United States Patent 11,866,727 (MATERIALS AND METHODS FOR TREATMENT OF GLYCOGEN STORAGE DISEASE TYPE 1A) - sequence listing, part 2

SEQ ID NO: 4665 - DNA, 22 bp, Artificial Sequence
  chemically synthesized
aaattgaaaatcaagataaaaa

SEQ ID NO: 4666 - DNA, 22 bp, Artificial Sequence
  chemically synthesized
aaaatcaagataaaaatgttca

SEQ ID NO: 4667 - DNA, 22 bp, Artificial Sequence
  chemically synthesized
acaattaagctccttcttttta

SEQ ID NO: 4668 - DNA, 22 bp, Artificial Sequence
  chemically synthesized
agctccttctttttattgttcc

SEQ ID NO: 4669 - DNA, 22 bp, Artificial Sequence
  chemically synthesized
cttctttttattgttcctctag

SEQ ID NO: 4670 - DNA, 22 bp, Artificial Sequence
  chemically synthesized
ctttttattgttcctctagtta

SEQ ID NO: 4671 - DNA, 22 bp, Artificial Sequence
  chemically synthesized
tttttattgttcctctagttat

SEQ ID NO: 4672 - DNA, 22 bp, Artificial Sequence
  chemically synthesized
tttattgttcctctagttattt

SEQ ID NO: 4673 - DNA, 22 bp, Artificial Sequence
  chemically synthesized
ttattgttcctctagttatttc

SEQ ID NO: 4674 - DNA, 22 bp, Artificial Sequence
  chemically synthesized
tattgttcctctagttatttcc

SEQ ID NO: 4675 - DNA, 22 bp, Artificial Sequence
  chemically synthesized
attgttcctctagttatttcct

SEQ ID NO: 4676 - DNA, 22 bp, Artificial Sequence
  chemically synthesized
ttgttcctctagttatttcctc

SEQ ID NO: 4677 - DNA, 22 bp, Artificial Sequence
  chemically synthesized
ttcctctagttatttcctccag

SEQ ID NO: 4678 - DNA, 22 bp, Artificial Sequence
  chemically synthesized
ctctagttatttcctccagaat

SEQ ID NO: 4679 - DNA, 22 bp, Artificial Sequence
  chemically synthesized
tagttatttcctccagaattga

SEQ ID NO: 4680 - DNA, 22 bp, Artificial Sequence
  chemically synthesized
gttatttcctccagaattgatc

SEQ ID NO: 4681 - DNA, 22 bp, Artificial Sequence
  chemically synthesized
tttcctccagaattgatcaaga

SEQ ID NO: 4682 - DNA, 22 bp, Artificial Sequence
  chemically synthesized
cctccagaattgatcaagacaa

SEQ ID NO: 4683 - DNA, 22 bp, Artificial Sequence
  chemically synthesized
ctccagaattgatcaagacaat

SEQ ID NO: 4684 - DNA, 22 bp, Artificial Sequence
  chemically synthesized
cagaattgatcaagacaattca

SEQ ID NO: 4685 - DNA, 22 bp, Artificial Sequence
  chemically synthesized
atcaagacaattcatcatttga

SEQ ID NO: 4686 - DNA, 22 bp, Artificial Sequence
  chemically synthesized
atcatttgattctctatctcca

SEQ ID NO: 4687 - DNA, 22 bp, Artificial Sequence
  chemically synthesized
gattctctatctccagagccaa

SEQ ID NO: 4688 - DNA, 22 bp, Artificial Sequence
  chemically synthesized
attctctatctccagagccaaa

SEQ ID NO: 4689 - DNA, 22 bp, Artificial Sequence
  chemically synthesized
tctatctccagagccaaaatca

SEQ ID NO: 4690 - DNA, 22 bp, Artificial Sequence
  chemically synthesized
tatctccagagccaaaatcaag

SEQ ID NO: 4691 - DNA, 22 bp, Artificial Sequence
  chemically synthesized
tctccagagccaaaatcaagat

SEQ ID NO: 4692 - DNA, 22 bp, Artificial Sequence
  chemically synthesized
cagagccaaaatcaagatttgc

SEQ ID NO: 4693 - DNA, 22 bp, Artificial Sequence
  chemically synthesized
gctatgttagacgatgtaaaaa

SEQ ID NO: 4694 - DNA, 22 bp, Artificial Sequence
  chemically synthesized
ctatgttagacgatgtaaaaat

SEQ ID NO: 4695 - DNA, 22 bp, Artificial Sequence
  chemically synthesized
tgttagacgatgtaaaaatttt

SEQ ID NO: 4696 - DNA, 22 bp, Artificial Sequence
  chemically synthesized
gacgatgtaaaaattttagcca

SEQ ID NO: 4697 - DNA, 22 bp, Artificial Sequence
  chemically synthesized
tagccaatggcctccttcagtt

SEQ ID NO: 4698 - DNA, 22 bp, Artificial Sequence
  chemically synthesized
agccaatggcctccttcagttg

SEQ ID NO: 4699 - DNA, 22 bp, Artificial Sequence
  chemically synthesized
gccaatggcctccttcagttgg

SEQ ID NO: 4700 - DNA, 22 bp, Artificial Sequence
  chemically synthesized
cttcagttgggacatggtctta

SEQ ID NO: 4701 - DNA, 22 bp, Artificial Sequence
  chemically synthesized
cagttgggacatggtcttaaag

SEQ ID NO: 4702 - DNA, 22 bp, Artificial Sequence
  chemically synthesized
agttgggacatggtcttaaaga

SEQ ID NO: 4703 - DNA, 22 bp, Artificial Sequence
  chemically synthesized
ggacatggtcttaaagactttg

SEQ ID NO: 4704 - DNA, 22 bp, Artificial Sequence
  chemically synthesized
aaagactttgtccataagacga

SEQ ID NO: 4705 - DNA, 22 bp, Artificial Sequence
  chemically synthesized
aagactttgtccataagacgaa

SEQ ID NO: 4706 - DNA, 22 bp, Artificial Sequence
  chemically synthesized
tgtccataagacgaagggccaa

SEQ ID NO: 4707 - DNA, 22 bp, Artificial Sequence
  chemically synthesized
gtccataagacgaagggccaaa

SEQ ID NO: 4708 - DNA, 22 bp, Artificial Sequence
  chemically synthesized
tccataagacgaagggccaaat

SEQ ID NO: 4709 - DNA, 22 bp, Artificial Sequence
  chemically synthesized
atgacatatttcaaaaactcaa

SEQ ID NO: 4710 - DNA, 22 bp, Artificial Sequence
  chemically synthesized
caaaaactcaacatatttgatc

SEQ ID NO: 4711 - DNA, 22 bp, Artificial Sequence
  chemically synthesized
aaaaactcaacatatttgatca

SEQ ID NO: 4712 - DNA, 22 bp, Artificial Sequence
  chemically synthesized
aacatatttgatcagtcttttt

SEQ ID NO: 4713 - DNA, 22 bp, Artificial Sequence
  chemically synthesized
gatcagtctttttatgatctat

SEQ ID NO: 4714 - DNA, 22 bp, Artificial Sequence
  chemically synthesized
atcagtctttttatgatctatc

SEQ ID NO: 4715 - DNA, 22 bp, Artificial Sequence
  chemically synthesized
tttatgatctatcgctgcaaac

SEQ ID NO: 4716 - DNA, 22 bp, Artificial Sequence
  chemically synthesized
ttatgatctatcgctgcaaacc

SEQ ID NO: 4717 - DNA, 22 bp, Artificial Sequence
  chemically synthesized
tatgatctatcgctgcaaacca

SEQ ID NO: 4718 - DNA, 22 bp, Artificial Sequence
  chemically synthesized
atgatctatcgctgcaaaccag

SEQ ID NO: 4719 - DNA, 22 bp, Artificial Sequence
  chemically synthesized
tgatctatcgctgcaaaccagt

SEQ ID NO: 4720 - DNA, 22 bp, Artificial Sequence
  chemically synthesized
tcgctgcaaaccagtgaaatca

SEQ ID NO: 4721 - DNA, 22 bp, Artificial Sequence
  chemically synthesized
caaaccagtgaaatcaaagaag

SEQ ID NO: 4722 - DNA, 22 bp, Artificial Sequence
  chemically synthesized
agaagaactacatataaactac

SEQ ID NO: 4723 - DNA, 22 bp, Artificial Sequence
  chemically synthesized
catataaactacaagtcaaaaa

SEQ ID NO: 4724 - DNA, 22 bp, Artificial Sequence
  chemically synthesized
caagtcaaaaatgaagaggtaa

SEQ ID NO: 4725 - DNA, 22 bp, Artificial Sequence
  chemically synthesized
gaactcaactcaaaacttgaaa

SEQ ID NO: 4726 - DNA, 22 bp, Artificial Sequence
  chemically synthesized
aactcaactcaaaacttgaaag

SEQ ID NO: 4727 - DNA, 22 bp, Artificial Sequence
  chemically synthesized
aactcaaaacttgaaagcctcc

SEQ ID NO: 4728 - DNA, 22 bp, Artificial Sequence
  chemically synthesized
aaaacttgaaagcctcctagaa

SEQ ID NO: 4729 - DNA, 22 bp, Artificial Sequence
  chemically synthesized
gaaagcctcctagaagaaaaaa

SEQ ID NO: 4730 - DNA, 22 bp, Artificial Sequence
  chemically synthesized
aaagcctcctagaagaaaaaat

SEQ ID NO: 4731 - DNA, 22 bp, Artificial Sequence
  chemically synthesized
ctagaagaaaaaattctacttc

SEQ ID NO: 4732 - DNA, 22 bp, Artificial Sequence
  chemically synthesized
gaagaaaaaattctacttcaac

SEQ ID NO: 4733 - DNA, 22 bp, Artificial Sequence
  chemically synthesized
tacttcaacaaaaagtgaaata

SEQ ID NO: 4734 - DNA, 22 bp, Artificial Sequence
  chemically synthesized
cttcaacaaaaagtgaaatatt

SEQ ID NO: 4735 - DNA, 22 bp, Artificial Sequence
  chemically synthesized
caacaaaaagtgaaatatttag

SEQ ID NO: 4736 - DNA, 22 bp, Artificial Sequence
  chemically synthesized
aacaaaaagtgaaatatttaga

SEQ ID NO: 4737 - DNA, 22 bp, Artificial Sequence
  chemically synthesized
agaagagcaactaactaactta

SEQ ID NO: 4738 - DNA, 22 bp, Artificial Sequence
  chemically synthesized
gaagagcaactaactaacttaa

SEQ ID NO: 4739 - DNA, 22 bp, Artificial Sequence
  chemically synthesized
actaacttaattcaaaatcaac

SEQ ID NO: 4740 - DNA, 22 bp, Artificial Sequence
  chemically synthesized
acttaattcaaaatcaacctga

SEQ ID NO: 4741 - DNA, 22 bp, Artificial Sequence
  chemically synthesized
aattcaaaatcaacctgaaact

SEQ ID NO: 4742 - DNA, 22 bp, Artificial Sequence
  chemically synthesized
attcaaaatcaacctgaaactc

SEQ ID NO: 4743 - DNA, 22 bp, Artificial Sequence
  chemically synthesized
aaaatcaacctgaaactccaga

SEQ ID NO: 4744 - DNA, 22 bp, Artificial Sequence
  chemically synthesized
aaactccagaacacccagaagt

SEQ ID NO: 4745 - DNA, 22 bp, Artificial Sequence
  chemically synthesized
cagaacacccagaagtaacttc

SEQ ID NO: 4746 - DNA, 22 bp, Artificial Sequence
  chemically synthesized
cacttaaagtaagtagaaaata

SEQ ID NO: 4747 - DNA, 22 bp, Artificial Sequence
  chemically synthesized
acttaaagtaagtagaaaataa

SEQ ID NO: 4748 - DNA, 22 bp, Artificial Sequence
  chemically synthesized
aaagtaagtagaaaataaagag

SEQ ID NO: 4749 - DNA, 22 bp, Artificial Sequence
  chemically synthesized
aagtaagtagaaaataaagagg

SEQ ID NO: 4750 - DNA, 22 bp, Artificial Sequence
  chemically synthesized
atgtttatgttttcaatgtgga

SEQ ID NO: 4751 - DNA, 22 bp, Artificial Sequence
  chemically synthesized
atgttttcaatgtggatctttt

SEQ ID NO: 4752 - DNA, 22 bp, Artificial Sequence
  chemically synthesized
tgttttcaatgtggatctttta

SEQ ID NO: 4753 - DNA, 22 bp, Artificial Sequence
  chemically synthesized
tcaatgtggatcttttaaaaaa

SEQ ID NO: 4754 - DNA, 22 bp, Artificial Sequence
  chemically synthesized
caatgtggatcttttaaaaaaa

SEQ ID NO: 4755 - DNA, 22 bp, Artificial Sequence
  chemically synthesized
aatgtggatcttttaaaaaaaa

SEQ ID NO: 4756 - DNA, 22 bp, Artificial Sequence
  chemically synthesized
ttaaaaaaaatatttctaaggc

SEQ ID NO: 4757 - DNA, 22 bp, Artificial Sequence
  chemically synthesized
taaaaaaaatatttctaaggca

SEQ ID NO: 4758 - DNA, 22 bp, Artificial Sequence
  chemically synthesized
aaaaaaaatatttctaaggcat

SEQ ID NO: 4759 - DNA, 22 bp, Artificial Sequence
  chemically synthesized
aaaaaaatatttctaaggcatg

SEQ ID NO: 4760 - DNA, 22 bp, Artificial Sequence
  chemically synthesized
ctaaggcatgccatttgaaata

SEQ ID NO: 4761 - DNA, 22 bp, Artificial Sequence
  chemically synthesized
taaggcatgccatttgaaatac

SEQ ID NO: 4762 - DNA, 22 bp, Artificial Sequence
  chemically synthesized
aggcatgccatttgaaatactt

SEQ ID NO: 4763 - DNA, 22 bp, Artificial Sequence
  chemically synthesized
gaaatactttgttgcattgttg

SEQ ID NO: 4764 - DNA, 22 bp, Artificial Sequence
  chemically synthesized
aaatactttgttgcattgttga

SEQ ID NO: 4765 - DNA, 22 bp, Artificial Sequence
  chemically synthesized
tgttgcattgttgaaatacttt

SEQ ID NO: 4766 - DNA, 22 bp, Artificial Sequence
  chemically synthesized
gttgcattgttgaaatactttt

SEQ ID NO: 4767 - DNA, 22 bp, Artificial Sequence
  chemically synthesized
ttgcattgttgaaatacttttt

SEQ ID NO: 4768 - DNA, 22 bp, Artificial Sequence
  chemically synthesized
cattgttgaaatactttttttt

SEQ ID NO: 4769 - DNA, 22 bp, Artificial Sequence
  chemically synthesized
ttgaaatacttttttttccaag

SEQ ID NO: 4770 - DNA, 22 bp, Artificial Sequence
  chemically synthesized
aaatacttttttttccaagaaa

SEQ ID NO: 4771 - DNA, 22 bp, Artificial Sequence
  chemically synthesized
ttttttccaagaaaaataatct

SEQ ID NO: 4772 - DNA, 22 bp, Artificial Sequence
  chemically synthesized
tttttccaagaaaaataatctc

SEQ ID NO: 4773 - DNA, 22 bp, Artificial Sequence
  chemically synthesized
ttttccaagaaaaataatctcc

SEQ ID NO: 4774 - DNA, 22 bp, Artificial Sequence
  chemically synthesized
tttccaagaaaaataatctcca

SEQ ID NO: 4775 - DNA, 22 bp, Artificial Sequence
  chemically synthesized
ttccaagaaaaataatctccag

SEQ ID NO: 4776 - DNA, 22 bp, Artificial Sequence
  chemically synthesized
tccaagaaaaataatctccaga

SEQ ID NO: 4777 - DNA, 22 bp, Artificial Sequence
  chemically synthesized
ccaagaaaaataatctccagaa

SEQ ID NO: 4778 - DNA, 22 bp, Artificial Sequence
  chemically synthesized
caagaaaaataatctccagaaa

SEQ ID NO: 4779 - DNA, 22 bp, Artificial Sequence
  chemically synthesized
cagaaaataaaatttcctatta

SEQ ID NO: 4780 - DNA, 22 bp, Artificial Sequence
  chemically synthesized
cctattataatttcaagttagt

SEQ ID NO: 4781 - DNA, 22 bp, Artificial Sequence
  chemically synthesized
ctattataatttcaagttagtt

SEQ ID NO: 4782 - DNA, 22 bp, Artificial Sequence
  chemically synthesized
ttataatttcaagttagttttt

SEQ ID NO: 4783 - DNA, 22 bp, Artificial Sequence
  chemically synthesized
taatttcaagttagttttttgt

SEQ ID NO: 4784 - DNA, 22 bp, Artificial Sequence
  chemically synthesized
caagttagttttttgtttccct

SEQ ID NO: 4785 - DNA, 22 bp, Artificial Sequence
  chemically synthesized
aagttagttttttgtttcccta

SEQ ID NO: 4786 - DNA, 22 bp, Artificial Sequence
  chemically synthesized
gttttttgtttccctaatgtta

SEQ ID NO: 4787 - DNA, 22 bp, Artificial Sequence
  chemically synthesized
tttgtttccctaatgttatata

SEQ ID NO: 4788 - DNA, 22 bp, Artificial Sequence
  chemically synthesized
ttgtttccctaatgttatatat

SEQ ID NO: 4789 - DNA, 22 bp, Artificial Sequence
  chemically synthesized
tgtttccctaatgttatatatg

SEQ ID NO: 4790 - DNA, 22 bp, Artificial Sequence
  chemically synthesized
gtttccctaatgttatatatga

SEQ ID NO: 4791 - DNA, 22 bp, Artificial Sequence
  chemically synthesized
tttccctaatgttatatatgaa

SEQ ID NO: 4792 - DNA, 22 bp, Artificial Sequence
  chemically synthesized
ccctaatgttatatatgaaaac

SEQ ID NO: 4793 - DNA, 22 bp, Artificial Sequence
  chemically synthesized
cctaatgttatatatgaaaaca

SEQ ID NO: 4794 - DNA, 22 bp, Artificial Sequence
  chemically synthesized
atgttatatatgaaaacactga

SEQ ID NO: 4795 - DNA, 22 bp, Artificial Sequence
  chemically synthesized
tatatgaaaacactgaaaattt

SEQ ID NO: 4796 - DNA, 22 bp, Artificial Sequence
  chemically synthesized
aaaatttgcattttatatgaaa

SEQ ID NO: 4797 - DNA, 22 bp, Artificial Sequence
  chemically synthesized
gcattttatatgaaaattacaa

SEQ ID NO: 4798 - DNA, 22 bp, Artificial Sequence
  chemically synthesized
cattttatatgaaaattacaaa

SEQ ID NO: 4799 - DNA, 22 bp, Artificial Sequence
  chemically synthesized
tatatgaaaattacaaatcggt

SEQ ID NO: 4800 - DNA, 22 bp, Artificial Sequence
  chemically synthesized
atatgaaaattacaaatcggtt

SEQ ID NO: 4801 - DNA, 22 bp, Artificial Sequence
  chemically synthesized
tatgaaaattacaaatcggtta

SEQ ID NO: 4802 - DNA, 22 bp, Artificial Sequence
  chemically synthesized
caaatcggttaaattatacaat

SEQ ID NO: 4803 - DNA, 22 bp, Artificial Sequence
  chemically synthesized
aattatacaatctagaacacta

SEQ ID NO: 4804 - DNA, 22 bp, Artificial Sequence
  chemically synthesized
tacaatctagaacactatgtca

SEQ ID NO: 4805 - DNA, 22 bp, Artificial Sequence
  chemically synthesized
gaacactatgtcattacactat

SEQ ID NO: 4806 - DNA, 22 bp, Artificial Sequence
  chemically synthesized
tgtcattacactattgtaaatt

SEQ ID NO: 4807 - DNA, 22 bp, Artificial Sequence
  chemically synthesized
cactattgtaaattactgaagg

SEQ ID NO: 4808 - DNA, 22 bp, Artificial Sequence
  chemically synthesized
ttgtaaattactgaaggtaagt

SEQ ID NO: 4809 - DNA, 22 bp, Artificial Sequence
  chemically synthesized
taaattactgaaggtaagtaaa

SEQ ID NO: 4810 - DNA, 22 bp, Artificial Sequence
  chemically synthesized
ctgaaggtaagtaaaaagttaa

SEQ ID NO: 4811 - DNA, 22 bp, Artificial Sequence
  chemically synthesized
aaggtaagtaaaaagttaaaaa

SEQ ID NO: 4812 - DNA, 22 bp, Artificial Sequence
  chemically synthesized
aaaaaaatttaaaactattctc

SEQ ID NO: 4813 - DNA, 22 bp, Artificial Sequence
  chemically synthesized
aaaactattctccagtgtttaa

SEQ ID NO: 4814 - DNA, 22 bp, Artificial Sequence
  chemically synthesized
aaactattctccagtgtttaaa

SEQ ID NO: 4815 - DNA, 22 bp, Artificial Sequence
  chemically synthesized
ttctccagtgtttaaaacagat

SEQ ID NO: 4816 - DNA, 22 bp, Artificial Sequence
  chemically synthesized
tccagtgtttaaaacagattaa

SEQ ID NO: 4817 - DNA, 22 bp, Artificial Sequence
  chemically synthesized
cagtgtttaaaacagattaaat

SEQ ID NO: 4818 - DNA, 22 bp, Artificial Sequence
  chemically synthesized
aaaacagattaaataatacagt

SEQ ID NO: 4819 - DNA, 22 bp, Artificial Sequence
  chemically synthesized
aaacagattaaataatacagta

SEQ ID NO: 4820 - DNA, 22 bp, Artificial Sequence
  chemically synthesized
aataatacagtaaatggaaaag

SEQ ID NO: 4821 - DNA, 22 bp, Artificial Sequence
  chemically synthesized
attcatatgaaaatatgctggg

SEQ ID NO: 4822 - DNA, 22 bp, Artificial Sequence
  chemically synthesized
ttcatatgaaaatatgctgggc

SEQ ID NO: 4823 - DNA, 22 bp, Artificial Sequence
  chemically synthesized
atatgaaaatatgctgggcttt

SEQ ID NO: 4824 - DNA, 22 bp, Artificial Sequence
  chemically synthesized
ggctttttcttttaattgaagt

SEQ ID NO: 4825 - DNA, 22 bp, Artificial Sequence
  chemically synthesized
tttcttttaattgaagttcaga

SEQ ID NO: 4826 - DNA, 22 bp, Artificial Sequence
  chemically synthesized
ttcttttaattgaagttcagaa

SEQ ID NO: 4827 - DNA, 22 bp, Artificial Sequence
  chemically synthesized
tcttttaattgaagttcagaaa

SEQ ID NO: 4828 - DNA, 22 bp, Artificial Sequence
  chemically synthesized
cttttaattgaagttcagaaaa

SEQ ID NO: 4829 - DNA, 22 bp, Artificial Sequence
  chemically synthesized
ttttaattgaagttcagaaaat

SEQ ID NO: 4830 - DNA, 22 bp, Artificial Sequence
  chemically synthesized
ttaattgaagttcagaaaatca

SEQ ID NO: 4831 - DNA, 22 bp, Artificial Sequence
  chemically synthesized
taattgaagttcagaaaatcaa

SEQ ID NO: 4832 - DNA, 22 bp, Artificial Sequence
  chemically synthesized
aattgaagttcagaaaatcaaa

SEQ ID NO: 4833 - DNA, 22 bp, Artificial Sequence
  chemically synthesized
attgaagttcagaaaatcaaat

SEQ ID NO: 4834 - DNA, 22 bp, Artificial Sequence
  chemically synthesized
aagttcagaaaatcaaatttta

SEQ ID NO: 4835 - DNA, 22 bp, Artificial Sequence
  chemically synthesized
agaaaatcaaattttagagata

SEQ ID NO: 4836 - DNA, 22 bp, Artificial Sequence
  chemically synthesized
tagagatagtacaatttaaata

SEQ ID NO: 4837 - DNA, 22 bp, Artificial Sequence
  chemically synthesized
agagatagtacaatttaaataa

SEQ ID NO: 4838 - DNA, 22 bp, Artificial Sequence
  chemically synthesized
gagatagtacaatttaaataaa

SEQ ID NO: 4839 - DNA, 22 bp, Artificial Sequence
  chemically synthesized
aaataaaatgttaaggacaaaa

SEQ ID NO: 4840 - DNA, 22 bp, Artificial Sequence
  chemically synthesized
aataaaatgttaaggacaaaaa

SEQ ID NO: 4841 - DNA, 22 bp, Artificial Sequence
  chemically synthesized
aggacaaaaatatgtgctattt

SEQ ID NO: 4842 - DNA, 22 bp, Artificial Sequence
  chemically synthesized
tttgaaagaagcatacaagggg

SEQ ID NO: 4843 - DNA, 22 bp, Artificial Sequence
  chemically synthesized
gaaagaagcatacaaggggaag

SEQ ID NO: 4844 - DNA, 22 bp, Artificial Sequence
  chemically synthesized
aaagaagcatacaaggggaagg

SEQ ID NO: 4845 - DNA, 22 bp, Artificial Sequence
  chemically synthesized
ccaatattcatttttcaaatcc

SEQ ID NO: 4846 - DNA, 22 bp, Artificial Sequence
  chemically synthesized
atttttcaaatccattattagt

SEQ ID NO: 4847 - DNA, 22 bp, Artificial Sequence
  chemically synthesized
ttcaaatccattattagtttaa

SEQ ID NO: 4848 - DNA, 22 bp, Artificial Sequence
  chemically synthesized
tcaaatccattattagtttaaa

SEQ ID NO: 4849 - DNA, 22 bp, Artificial Sequence
  chemically synthesized
caaatccattattagtttaaaa

SEQ ID NO: 4850 - DNA, 22 bp, Artificial Sequence
  chemically synthesized
aaatccattattagtttaaaaa

SEQ ID NO: 4851 - DNA, 22 bp, Artificial Sequence
  chemically synthesized
ttagtttaaaaatttagattat

SEQ ID NO: 4852 - DNA, 22 bp, Artificial Sequence
  chemically synthesized
gtttaaaaatttagattatgat

SEQ ID NO: 4853 - DNA, 22 bp, Artificial Sequence
  chemically synthesized
aaaaatttagattatgatagtg

SEQ ID NO: 4854 - DNA, 22 bp, Artificial Sequence
  chemically synthesized
aaaatttagattatgatagtgt

SEQ ID NO: 4855 - DNA, 22 bp, Artificial Sequence
  chemically synthesized
agattatgatagtgttacagga

SEQ ID NO: 4856 - DNA, 22 bp, Artificial Sequence
  chemically synthesized
gattatgatagtgttacaggaa

SEQ ID NO: 4857 - DNA, 22 bp, Artificial Sequence
  chemically synthesized
tgatagtgttacaggaaattaa

SEQ ID NO: 4858 - DNA, 22 bp, Artificial Sequence
  chemically synthesized
caggaaattaatagaaaagaaa

SEQ ID NO: 4859 - DNA, 22 bp, Artificial Sequence
  chemically synthesized
atagaaaagaaagaggaaagca

SEQ ID NO: 4860 - DNA, 22 bp, Artificial Sequence
  chemically synthesized
ataaccaacctactctctatat

SEQ ID NO: 4861 - DNA, 22 bp, Artificial Sequence
  chemically synthesized
taaccaacctactctctatatc

SEQ ID NO: 4862 - DNA, 22 bp, Artificial Sequence
  chemically synthesized
ctctctatatccagacttttgt

SEQ ID NO: 4863 - DNA, 22 bp, Artificial Sequence
  chemically synthesized
tctatatccagacttttgtaga

SEQ ID NO: 4864 - DNA, 22 bp, Artificial Sequence
  chemically synthesized
tatatccagacttttgtagaaa

SEQ ID NO: 4865 - DNA, 22 bp, Artificial Sequence
  chemically synthesized
tatccagacttttgtagaaaaa

SEQ ID NO: 4866 - DNA, 22 bp, Artificial Sequence
  chemically synthesized
ttgtagaaaaacaagataatag

SEQ ID NO: 4867 - DNA, 22 bp, Artificial Sequence
  chemically synthesized
tgtagaaaaacaagataatagc

SEQ ID NO: 4868 - DNA, 22 bp, Artificial Sequence
  chemically synthesized
gtagaaaaacaagataatagca

SEQ ID NO: 4869 - DNA, 22 bp, Artificial Sequence
  chemically synthesized
tagaaaaacaagataatagcat

SEQ ID NO: 4870 - DNA, 22 bp, Artificial Sequence
  chemically synthesized
ctccagaccgtggaagaccaat

SEQ ID NO: 4871 - DNA, 22 bp, Artificial Sequence
  chemically synthesized
tccagaccgtggaagaccaata

SEQ ID NO: 4872 - DNA, 22 bp, Artificial Sequence
  chemically synthesized
cagaccgtggaagaccaatata

SEQ ID NO: 4873 - DNA, 22 bp, Artificial Sequence
  chemically synthesized
aaccaacagcatagtcaaataa

SEQ ID NO: 4874 - DNA, 22 bp, Artificial Sequence
  chemically synthesized
taatggtatgtcccatctttca

SEQ ID NO: 4875 - DNA, 22 bp, Artificial Sequence
  chemically synthesized
aatggtatgtcccatctttcac

SEQ ID NO: 4876 - DNA, 22 bp, Artificial Sequence
  chemically synthesized
atggtatgtcccatctttcaca

SEQ ID NO: 4877 - DNA, 22 bp, Artificial Sequence
  chemically synthesized
tcacacaggtctgtaaaaacac

SEQ ID NO: 4878 - DNA, 22 bp, Artificial Sequence
  chemically synthesized
cacacaggtctgtaaaaacact

SEQ ID NO: 4879 - DNA, 22 bp, Artificial Sequence
  chemically synthesized
acacaggtctgtaaaaacactg

SEQ ID NO: 4880 - DNA, 22 bp, Artificial Sequence
  chemically synthesized
taaaaacactgaatcctaaaat

SEQ ID NO: 4881 - DNA, 22 bp, Artificial Sequence
  chemically synthesized
aatcctaaaattatttacaagc

SEQ ID NO: 4882 - DNA, 22 bp, Artificial Sequence
  chemically synthesized
aaattatttacaagctttaact

SEQ ID NO: 4883 - DNA, 22 bp, Artificial Sequence
  chemically synthesized
tttacaagctttaactggatca

SEQ ID NO: 4884 - DNA, 22 bp, Artificial Sequence
  chemically synthesized
acaagctttaactggatcatga

SEQ ID NO: 4885 - DNA, 22 bp, Artificial Sequence
  chemically synthesized
caagctttaactggatcatgag

SEQ ID NO: 4886 - DNA, 22 bp, Artificial Sequence
  chemically synthesized
taactggatcatgagtaaaatt

SEQ ID NO: 4887 - DNA, 22 bp, Artificial Sequence
  chemically synthesized
aactggatcatgagtaaaatta

SEQ ID NO: 4888 - DNA, 22 bp, Artificial Sequence
  chemically synthesized
actggatcatgagtaaaattat

SEQ ID NO: 4889 - DNA, 22 bp, Artificial Sequence
  chemically synthesized
gatcatgagtaaaattatcaca

SEQ ID NO: 4890 - DNA, 22 bp, Artificial Sequence
  chemically synthesized
tcacatcagcataactgttaaa

SEQ ID NO: 4891 - DNA, 22 bp, Artificial Sequence
  chemically synthesized
ttaaaattgcaggctctgaagc

SEQ ID NO: 4892 - DNA, 22 bp, Artificial Sequence
  chemically synthesized
aaattgcaggctctgaagctaa

SEQ ID NO: 4893 - DNA, 22 bp, Artificial Sequence
  chemically synthesized
caggctctgaagctaataaact

SEQ ID NO: 4894 - DNA, 22 bp, Artificial Sequence
  chemically synthesized
tgaagctaataaactacctgca

SEQ ID NO: 4895 - DNA, 22 bp, Artificial Sequence
  chemically synthesized
aagctaataaactacctgcatt

SEQ ID NO: 4896 - DNA, 22 bp, Artificial Sequence
  chemically synthesized
ataaactacctgcatttaaacc

SEQ ID NO: 4897 - DNA, 22 bp, Artificial Sequence
  chemically synthesized
cctgcatttaaaccatggctct

SEQ ID NO: 4898 - DNA, 22 bp, Artificial Sequence
  chemically synthesized
catttaaaccatggctctaaaa

SEQ ID NO: 4899 - DNA, 22 bp, Artificial Sequence
  chemically synthesized
aaaccatggctctaaaactttg

SEQ ID NO: 4900 - DNA, 22 bp, Artificial Sequence
  chemically synthesized
aaccatggctctaaaactttgt

SEQ ID NO: 4901 - DNA, 22 bp, Artificial Sequence
  chemically synthesized
taaaactttgtgtgaccttgaa

SEQ ID NO: 4902 - DNA, 22 bp, Artificial Sequence
  chemically synthesized
aaactttgtgtgaccttgaata

SEQ ID NO: 4903 - DNA, 22 bp, Artificial Sequence
  chemically synthesized
tgtgtgaccttgaataaattac

SEQ ID NO: 4904 - DNA, 22 bp, Artificial Sequence
  chemically synthesized
gtgtgaccttgaataaattact

SEQ ID NO: 4905 - DNA, 22 bp, Artificial Sequence
  chemically synthesized
tgtgaccttgaataaattactt

SEQ ID NO: 4906 - DNA, 22 bp, Artificial Sequence
  chemically synthesized
gaataaattacttcaccccttt

SEQ ID NO: 4907 - DNA, 22 bp, Artificial Sequence
  chemically synthesized
aataaattacttcaccccttta

SEQ ID NO: 4908 - DNA, 22 bp, Artificial Sequence
  chemically synthesized
cttcacccctttatctctcagt

SEQ ID NO: 4909 - DNA, 22 bp, Artificial Sequence
  chemically synthesized
cacccctttatctctcagtttc

SEQ ID NO: 4910 - DNA, 22 bp, Artificial Sequence
  chemically synthesized
acccctttatctctcagtttcc

SEQ ID NO: 4911 - DNA, 22 bp, Artificial Sequence
  chemically synthesized
tatctctcagtttcctcacata

SEQ ID NO: 4912 - DNA, 22 bp, Artificial Sequence
  chemically synthesized
atctctcagtttcctcacatat

SEQ ID NO: 4913 - DNA, 22 bp, Artificial Sequence
  chemically synthesized
tctctcagtttcctcacatata

SEQ ID NO: 4914 - DNA, 22 bp, Artificial Sequence
  chemically synthesized
tcagtttcctcacatatactac

SEQ ID NO: 4915 - DNA, 22 bp, Artificial Sequence
  chemically synthesized
agtttcctcacatatactacaa

SEQ ID NO: 4916 - DNA, 22 bp, Artificial Sequence
  chemically synthesized
cctcacatatactacaaagata

SEQ ID NO: 4917 - DNA, 22 bp, Artificial Sequence
  chemically synthesized
ctcacatatactacaaagataa

SEQ ID NO: 4918 - DNA, 22 bp, Artificial Sequence
  chemically synthesized
acatatactacaaagataataa

SEQ ID NO: 4919 - DNA, 22 bp, Artificial Sequence
  chemically synthesized
caaagataataacagaacttat

SEQ ID NO: 4920 - DNA, 22 bp, Artificial Sequence
  chemically synthesized
ataggattattgtaagaaaaaa

SEQ ID NO: 4921 - DNA, 22 bp, Artificial Sequence
  chemically synthesized
taggattattgtaagaaaaaaa

SEQ ID NO: 4922 - DNA, 22 bp, Artificial Sequence
  chemically synthesized
ttgtaagaaaaaaaattaattc

SEQ ID NO: 4923 - DNA, 22 bp, Artificial Sequence
  chemically synthesized
taagaaaaaaaattaattcata

SEQ ID NO: 4924 - DNA, 22 bp, Artificial Sequence
  chemically synthesized
attcatagcagccaatgtcatc

SEQ ID NO: 4925 - DNA, 22 bp, Artificial Sequence
  chemically synthesized
atagcagccaatgtcatcttac

SEQ ID NO: 4926 - DNA, 22 bp, Artificial Sequence
  chemically synthesized
actaaaattcaaattagatcat

SEQ ID NO: 4927 - DNA, 22 bp, Artificial Sequence
  chemically synthesized
ctaaaattcaaattagatcatg

SEQ ID NO: 4928 - DNA, 22 bp, Artificial Sequence
  chemically synthesized
aaattcaaattagatcatgttt

SEQ ID NO: 4929 - DNA, 22 bp, Artificial Sequence
  chemically synthesized
aaattagatcatgtttctcttt

SEQ ID NO: 4930 - DNA, 22 bp, Artificial Sequence
  chemically synthesized
gatcatgtttctctttgctcaa

SEQ ID NO: 4931 - DNA, 22 bp, Artificial Sequence
  chemically synthesized
ctctttgctcaaaaccacacaa

SEQ ID NO: 4932 - DNA, 22 bp, Artificial Sequence
  chemically synthesized
tctttgctcaaaaccacacaat

SEQ ID NO: 4933 - DNA, 22 bp, Artificial Sequence
  chemically synthesized
tttgctcaaaaccacacaatag

SEQ ID NO: 4934 - DNA, 22 bp, Artificial Sequence
  chemically synthesized
tgctcaaaaccacacaatagct

SEQ ID NO: 4935 - DNA, 22 bp, Artificial Sequence
  chemically synthesized
gctcaaaaccacacaatagctt

SEQ ID NO: 4936 - DNA, 22 bp, Artificial Sequence
  chemically synthesized
ctcaaaaccacacaatagcttt

SEQ ID NO: 4937 - DNA, 22 bp, Artificial Sequence
  chemically synthesized
aaaaccacacaatagctttcca

SEQ ID NO: 4938 - DNA, 22 bp, Artificial Sequence
  chemically synthesized
tccatttcactcatattggctc

SEQ ID NO: 4939 - DNA, 22 bp, Artificial Sequence
  chemically synthesized
ccatttcactcatattggctct

SEQ ID NO: 4940 - DNA, 22 bp, Artificial Sequence
  chemically synthesized
catttcactcatattggctctt

SEQ ID NO: 4941 - DNA, 22 bp, Artificial Sequence
  chemically synthesized
cactcatattggctctttagac

SEQ ID NO: 4942 - DNA, 22 bp, Artificial Sequence
  chemically synthesized
actcatattggctctttagacc

SEQ ID NO: 4943 - DNA, 22 bp, Artificial Sequence
  chemically synthesized
atattggctctttagaccaaga

SEQ ID NO: 4944 - DNA, 22 bp, Artificial Sequence
  chemically synthesized
gctctttagaccaagattaccc

SEQ ID NO: 4945 - DNA, 22 bp, Artificial Sequence
  chemically synthesized
ggtaatcttggtctaaagagcc

SEQ ID NO: 4946 - DNA, 22 bp, Artificial Sequence
  chemically synthesized
ggtctaaagagccaatatgagt

SEQ ID NO: 4947 - DNA, 22 bp, Artificial Sequence
  chemically synthesized
gtctaaagagccaatatgagtg

SEQ ID NO: 4948 - DNA, 22 bp, Artificial Sequence
  chemically synthesized
aagagccaatatgagtgaaatg

SEQ ID NO: 4949 - DNA, 22 bp, Artificial Sequence
  chemically synthesized
ttgtgtggttttgagcaaagag

SEQ ID NO: 4950 - DNA, 22 bp, Artificial Sequence
  chemically synthesized
tgtggttttgagcaaagagaaa

SEQ ID NO: 4951 - DNA, 22 bp, Artificial Sequence
  chemically synthesized
tgagcaaagagaaacatgatct

SEQ ID NO: 4952 - DNA, 22 bp, Artificial Sequence
  chemically synthesized
gagcaaagagaaacatgatcta

SEQ ID NO: 4953 - DNA, 22 bp, Artificial Sequence
  chemically synthesized
agcaaagagaaacatgatctaa

SEQ ID NO: 4954 - DNA, 22 bp, Artificial Sequence
  chemically synthesized
atttgaattttagtaagatgac

SEQ ID NO: 4955 - DNA, 22 bp, Artificial Sequence
  chemically synthesized
gaattttagtaagatgacattg

SEQ ID NO: 4956 - DNA, 22 bp, Artificial Sequence
  chemically synthesized
aattttagtaagatgacattgg

SEQ ID NO: 4957 - DNA, 22 bp, Artificial Sequence
  chemically synthesized
tagtaagatgacattggctgct

SEQ ID NO: 4958 - DNA, 22 bp, Artificial Sequence
  chemically synthesized
agtaagatgacattggctgcta

SEQ ID NO: 4959 - DNA, 22 bp, Artificial Sequence
  chemically synthesized
gtaagatgacattggctgctat

SEQ ID NO: 4960 - DNA, 22 bp, Artificial Sequence
  chemically synthesized
gctgctatgaattaattttttt

SEQ ID NO: 4961 - DNA, 22 bp, Artificial Sequence
  chemically synthesized
ctatgaattaattttttttctt

SEQ ID NO: 4962 - DNA, 22 bp, Artificial Sequence
  chemically synthesized
tgaattaattttttttcttaca

SEQ ID NO: 4963 - DNA, 22 bp, Artificial Sequence
  chemically synthesized
attttttttcttacaataatcc

SEQ ID NO: 4964 - DNA, 22 bp, Artificial Sequence
  chemically synthesized
tttttcttacaataatcctata

SEQ ID NO: 4965 - DNA, 22 bp, Artificial Sequence
  chemically synthesized
ttttcttacaataatcctataa

SEQ ID NO: 4966 - DNA, 22 bp, Artificial Sequence
  chemically synthesized
tttcttacaataatcctataag

SEQ ID NO: 4967 - DNA, 22 bp, Artificial Sequence
  chemically synthesized
ttcttacaataatcctataagt

SEQ ID NO: 4968 - DNA, 22 bp, Artificial Sequence
  chemically synthesized
tcttacaataatcctataagtt

SEQ ID NO: 4969 - DNA, 22 bp, Artificial Sequence
  chemically synthesized
cttacaataatcctataagttc

SEQ ID NO: 4970 - DNA, 22 bp, Artificial Sequence
  chemically synthesized
ttacaataatcctataagttct

SEQ ID NO: 4971 - DNA, 22 bp, Artificial Sequence
  chemically synthesized
acaataatcctataagttctgt

SEQ ID NO: 4972 - DNA, 22 bp, Artificial Sequence
  chemically synthesized
caataatcctataagttctgtt

SEQ ID NO: 4973 - DNA, 22 bp, Artificial Sequence
  chemically synthesized
taagttctgttattatctttgt

SEQ ID NO: 4974 - DNA, 22 bp, Artificial Sequence
  chemically synthesized
tgttattatctttgtagtatat

SEQ ID NO: 4975 - DNA, 22 bp, Artificial Sequence
  chemically synthesized
ttattatctttgtagtatatgt

SEQ ID NO: 4976 - DNA, 22 bp, Artificial Sequence
  chemically synthesized
ttatctttgtagtatatgtgag

SEQ ID NO: 4977 - DNA, 22 bp, Artificial Sequence
  chemically synthesized
tctttgtagtatatgtgaggaa

SEQ ID NO: 4978 - DNA, 22 bp, Artificial Sequence
  chemically synthesized
tgtagtatatgtgaggaaactg

SEQ ID NO: 4979 - DNA, 22 bp, Artificial Sequence
  chemically synthesized
gtagtatatgtgaggaaactga

SEQ ID NO: 4980 - DNA, 22 bp, Artificial Sequence
  chemically synthesized
tagtatatgtgaggaaactgag

SEQ ID NO: 4981 - DNA, 22 bp, Artificial Sequence
  chemically synthesized
agagataaaggggtgaagtaat

SEQ ID NO: 4982 - DNA, 22 bp, Artificial Sequence
  chemically synthesized
attcaaggtcacacaaagtttt

SEQ ID NO: 4983 - DNA, 22 bp, Artificial Sequence
  chemically synthesized
ttcaaggtcacacaaagtttta

SEQ ID NO: 4984 - DNA, 22 bp, Artificial Sequence
  chemically synthesized
aaggtcacacaaagttttagag

SEQ ID NO: 4985 - DNA, 22 bp, Artificial Sequence
  chemically synthesized
tagagccatggtttaaatgcag

SEQ ID NO: 4986 - DNA, 22 bp, Artificial Sequence
  chemically synthesized
agagccatggtttaaatgcagg

SEQ ID NO: 4987 - DNA, 22 bp, Artificial Sequence
  chemically synthesized
gagccatggtttaaatgcaggt

SEQ ID NO: 4988 - DNA, 22 bp, Artificial Sequence
  chemically synthesized
aaatgcaggtagtttattagct

SEQ ID NO: 4989 - DNA, 22 bp, Artificial Sequence
  chemically synthesized
aatgcaggtagtttattagctt

SEQ ID NO: 4990 - DNA, 22 bp, Artificial Sequence
  chemically synthesized
attagcttcagagcctgcaatt

SEQ ID NO: 4991 - DNA, 22 bp, Artificial Sequence
  chemically synthesized
ttagcttcagagcctgcaattt

SEQ ID NO: 4992 - DNA, 22 bp, Artificial Sequence
  chemically synthesized
gcttcagagcctgcaattttaa

SEQ ID NO: 4993 - DNA, 22 bp, Artificial Sequence
  chemically synthesized
cagagcctgcaattttaacagt

SEQ ID NO: 4994 - DNA, 22 bp, Artificial Sequence
  chemically synthesized
agagcctgcaattttaacagtt

SEQ ID NO: 4995 - DNA, 22 bp, Artificial Sequence
  chemically synthesized
caattttaacagttatgctgat

SEQ ID NO: 4996 - DNA, 22 bp, Artificial Sequence
  chemically synthesized
taacagttatgctgatgtgata

SEQ ID NO: 4997 - DNA, 22 bp, Artificial Sequence
  chemically synthesized
aacagttatgctgatgtgataa

SEQ ID NO: 4998 - DNA, 22 bp, Artificial Sequence
  chemically synthesized
acagttatgctgatgtgataat

SEQ ID NO: 4999 - DNA, 22 bp, Artificial Sequence
  chemically synthesized
tgctgatgtgataattttactc

SEQ ID NO: 5000 - DNA, 22 bp, Artificial Sequence
  chemically synthesized
atgtgataattttactcatgat

SEQ ID NO: 5001 - DNA, 22 bp, Artificial Sequence
  chemically synthesized
tactcatgatccagttaaagct

SEQ ID NO: 5002 - DNA, 22 bp, Artificial Sequence
  chemically synthesized
actcatgatccagttaaagctt

SEQ ID NO: 5003 - DNA, 22 bp, Artificial Sequence
  chemically synthesized
ctcatgatccagttaaagcttg

SEQ ID NO: 5004 - DNA, 22 bp, Artificial Sequence
  chemically synthesized
atgatccagttaaagcttgtaa

SEQ ID NO: 5005 - DNA, 22 bp, Artificial Sequence
  chemically synthesized
aagcttgtaaataattttagga

SEQ ID NO: 5006 - DNA, 22 bp, Artificial Sequence
  chemically synthesized
gtaaataattttaggattcagt

SEQ ID NO: 5007 - DNA, 22 bp, Artificial Sequence
  chemically synthesized
taaataattttaggattcagtg

SEQ ID NO: 5008 - DNA, 22 bp, Artificial Sequence
  chemically synthesized
taggattcagtgtttttacaga

SEQ ID NO: 5009 - DNA, 22 bp, Artificial Sequence
  chemically synthesized
aggattcagtgtttttacagac

SEQ ID NO: 5010 - DNA, 22 bp, Artificial Sequence
  chemically synthesized
ggattcagtgtttttacagacc

SEQ ID NO: 5011 - DNA, 22 bp, Artificial Sequence
  chemically synthesized
agtgtttttacagacctgtgtg

SEQ ID NO: 5012 - DNA, 22 bp, Artificial Sequence
  chemically synthesized
ttacagacctgtgtgaaagatg

SEQ ID NO: 5013 - DNA, 22 bp, Artificial Sequence
  chemically synthesized
tacagacctgtgtgaaagatgg

SEQ ID NO: 5014 - DNA, 22 bp, Artificial Sequence
  chemically synthesized
acagacctgtgtgaaagatggg

SEQ ID NO: 5015 - DNA, 22 bp, Artificial Sequence
  chemically synthesized
cagacctgtgtgaaagatggga

SEQ ID NO: 5016 - DNA, 22 bp, Artificial Sequence
  chemically synthesized
tgtgaaagatgggacataccat

SEQ ID NO: 5017 - DNA, 22 bp, Artificial Sequence
  chemically synthesized
aaatactgacttacctgatttt

SEQ ID NO: 5018 - DNA, 22 bp, Artificial Sequence
  chemically synthesized
acttacctgattttctatttct

SEQ ID NO: 5019 - DNA, 22 bp, Artificial Sequence
  chemically synthesized
acctgattttctatttctttta

SEQ ID NO: 5020 - DNA, 22 bp, Artificial Sequence
  chemically synthesized
cctgattttctatttcttttat

SEQ ID NO: 5021 - DNA, 22 bp, Artificial Sequence
  chemically synthesized
attttctatttcttttatttga

SEQ ID NO: 5022 - DNA, 22 bp, Artificial Sequence
  chemically synthesized
tctatttcttttatttgactat

SEQ ID NO: 5023 - DNA, 22 bp, Artificial Sequence
  chemically synthesized
ctatttcttttatttgactatg

SEQ ID NO: 5024 - DNA, 22 bp, Artificial Sequence
  chemically synthesized
tatttcttttatttgactatgc

SEQ ID NO: 5025 - DNA, 22 bp, Artificial Sequence
  chemically synthesized
tttcttttatttgactatgctg

SEQ ID NO: 5026 - DNA, 22 bp, Artificial Sequence
  chemically synthesized
cttttatttgactatgctgttg

SEQ ID NO: 5027 - DNA, 22 bp, Artificial Sequence
  chemically synthesized
ttttatttgactatgctgttgg

SEQ ID NO: 5028 - DNA, 22 bp, Artificial Sequence
  chemically synthesized
ttatttgactatgctgttggtt

SEQ ID NO: 5029 - DNA, 22 bp, Artificial Sequence
  chemically synthesized
tatttgactatgctgttggttt

SEQ ID NO: 5030 - DNA, 22 bp, Artificial Sequence
  chemically synthesized
atttgactatgctgttggttta

SEQ ID NO: 5031 - DNA, 22 bp, Artificial Sequence
  chemically synthesized
tttgactatgctgttggtttaa

SEQ ID NO: 5032 - DNA, 22 bp, Artificial Sequence
  chemically synthesized
gactatgctgttggtttaattg

SEQ ID NO: 5033 - DNA, 22 bp, Artificial Sequence
  chemically synthesized
actatgctgttggtttaattgt

SEQ ID NO: 5034 - DNA, 22 bp, Artificial Sequence
  chemically synthesized
tgctgttggtttaattgtttat

SEQ ID NO: 5035 - DNA, 22 bp, Artificial Sequence
  chemically synthesized
ttggtttaattgtttatattgg

SEQ ID NO: 5036 - DNA, 22 bp, Artificial Sequence
  chemically synthesized
gtttaattgtttatattggtct

SEQ ID NO: 5037 - DNA, 22 bp, Artificial Sequence
  chemically synthesized
aattgtttatattggtcttcca

SEQ ID NO: 5038 - DNA, 22 bp, Artificial Sequence
  chemically synthesized
attgtttatattggtcttccac

SEQ ID NO: 5039 - DNA, 22 bp, Artificial Sequence
  chemically synthesized
tttatattggtcttccacggtc

SEQ ID NO: 5040 - DNA, 22 bp, Artificial Sequence
  chemically synthesized
atattggtcttccacggtctgg

SEQ ID NO: 5041 - DNA, 22 bp, Artificial Sequence
  chemically synthesized
tattggtcttccacggtctgga

SEQ ID NO: 5042 - DNA, 22 bp, Artificial Sequence
  chemically synthesized
gtcttccacggtctggagaagg

SEQ ID NO: 5043 - DNA, 22 bp, Artificial Sequence
  chemically synthesized
ccacggtctggagaaggtcttt

SEQ ID NO: 5044 - DNA, 22 bp, Artificial Sequence
  chemically synthesized
cacggtctggagaaggtctttg

SEQ ID NO: 5045 - DNA, 22 bp, Artificial Sequence
  chemically synthesized
gagaaggtctttgatgctatta

SEQ ID NO: 5046 - DNA, 22 bp, Artificial Sequence
  chemically synthesized
tgatgctattatcttgtttttc

SEQ ID NO: 5047 - DNA, 22 bp, Artificial Sequence
  chemically synthesized
gatgctattatcttgtttttct

SEQ ID NO: 5048 - DNA, 22 bp, Artificial Sequence
  chemically synthesized
atgctattatcttgtttttcta

SEQ ID NO: 5049 - DNA, 22 bp, Artificial Sequence
  chemically synthesized
ttatcttgtttttctacaaaag

SEQ ID NO: 5050 - DNA, 22 bp, Artificial Sequence
  chemically synthesized
tcttgtttttctacaaaagtct

SEQ ID NO: 5051 - DNA, 22 bp, Artificial Sequence
  chemically synthesized
gtttttctacaaaagtctggat

SEQ ID NO: 5052 - DNA, 22 bp, Artificial Sequence
  chemically synthesized
tttttctacaaaagtctggata

SEQ ID NO: 5053 - DNA, 22 bp, Artificial Sequence
  chemically synthesized
ttctacaaaagtctggatatag

SEQ ID NO: 5054 - DNA, 22 bp, Artificial Sequence
  chemically synthesized
tctacaaaagtctggatataga

SEQ ID NO: 5055 - DNA, 22 bp, Artificial Sequence
  chemically synthesized
ctacaaaagtctggatatagag

SEQ ID NO: 5056 - DNA, 22 bp, Artificial Sequence
  chemically synthesized
tacaaaagtctggatatagaga

SEQ ID NO: 5057 - DNA, 22 bp, Artificial Sequence
  chemically synthesized
caaaagtctggatatagagagt

SEQ ID NO: 5058 - DNA, 22 bp, Artificial Sequence
  chemically synthesized
gatatagagagtaggttggtta

SEQ ID NO: 5059 - DNA, 22 bp, Artificial Sequence
  chemically synthesized
gttataagttgctttcctcttt

SEQ ID NO: 5060 - DNA, 22 bp, Artificial Sequence
  chemically synthesized
taagttgctttcctctttcttt

SEQ ID NO: 5061 - DNA, 22 bp, Artificial Sequence
  chemically synthesized
ctttcctctttcttttctatta

SEQ ID NO: 5062 - DNA, 22 bp, Artificial Sequence
  chemically synthesized
tcctctttcttttctattaatt

SEQ ID NO: 5063 - DNA, 22 bp, Artificial Sequence
  chemically synthesized
cctctttcttttctattaattt

SEQ ID NO: 5064 - DNA, 22 bp, Artificial Sequence
  chemically synthesized
ctctttcttttctattaatttc

SEQ ID NO: 5065 - DNA, 22 bp, Artificial Sequence
  chemically synthesized
tttcttttctattaatttcctg

SEQ ID NO: 5066 - DNA, 22 bp, Artificial Sequence
  chemically synthesized
tcttttctattaatttcctgta

SEQ ID NO: 5067 - DNA, 22 bp, Artificial Sequence
  chemically synthesized
cttttctattaatttcctgtaa

SEQ ID NO: 5068 - DNA, 22 bp, Artificial Sequence
  chemically synthesized
ttttctattaatttcctgtaac

SEQ ID NO: 5069 - DNA, 22 bp, Artificial Sequence
  chemically synthesized
ttctattaatttcctgtaacac

SEQ ID NO: 5070 - DNA, 22 bp, Artificial Sequence
  chemically synthesized
tctattaatttcctgtaacact

SEQ ID NO: 5071 - DNA, 22 bp, Artificial Sequence
  chemically synthesized
ctattaatttcctgtaacacta

SEQ ID NO: 5072 - DNA, 22 bp, Artificial Sequence
  chemically synthesized
tattaatttcctgtaacactat

SEQ ID NO: 5073 - DNA, 22 bp, Artificial Sequence
  chemically synthesized
ttaatttcctgtaacactatca

SEQ ID NO: 5074 - DNA, 22 bp, Artificial Sequence
  chemically synthesized
atttcctgtaacactatcataa

SEQ ID NO: 5075 - DNA, 22 bp, Artificial Sequence
  chemically synthesized
cctgtaacactatcataatcta

SEQ ID NO: 5076 - DNA, 22 bp, Artificial Sequence
  chemically synthesized
ctgtaacactatcataatctaa

SEQ ID NO: 5077 - DNA, 22 bp, Artificial Sequence
  chemically synthesized
taacactatcataatctaaatt

SEQ ID NO: 5078 - DNA, 22 bp, Artificial Sequence
  chemically synthesized
tcataatctaaatttttaaact

SEQ ID NO: 5079 - DNA, 22 bp, Artificial Sequence
  chemically synthesized
aatttttaaactaataatggat

SEQ ID NO: 5080 - DNA, 22 bp, Artificial Sequence
  chemically synthesized
ttaaactaataatggatttgaa

SEQ ID NO: 5081 - DNA, 22 bp, Artificial Sequence
  chemically synthesized
taaactaataatggatttgaaa

SEQ ID NO: 5082 - DNA, 22 bp, Artificial Sequence
  chemically synthesized
aaactaataatggatttgaaaa

SEQ ID NO: 5083 - DNA, 22 bp, Artificial Sequence
  chemically synthesized
aactaataatggatttgaaaaa

SEQ ID NO: 5084 - DNA, 22 bp, Artificial Sequence
  chemically synthesized
ataatggatttgaaaaatgaat

SEQ ID NO: 5085 - DNA, 22 bp, Artificial Sequence
  chemically synthesized
gaaaaatgaatattggcaattc

SEQ ID NO: 5086 - DNA, 22 bp, Artificial Sequence
  chemically synthesized
aaaaatgaatattggcaattcc

SEQ ID NO: 5087 - DNA, 22 bp, Artificial Sequence
  chemically synthesized
gcaattccttccccttgtatgc

SEQ ID NO: 5088 - DNA, 22 bp, Artificial Sequence
  chemically synthesized
cttccccttgtatgcttctttc

SEQ ID NO: 5089 - DNA, 22 bp, Artificial Sequence
  chemically synthesized
ccccttgtatgcttctttcaaa

SEQ ID NO: 5090 - DNA, 22 bp, Artificial Sequence
  chemically synthesized
cccttgtatgcttctttcaaat

SEQ ID NO: 5091 - DNA, 22 bp, Artificial Sequence
  chemically synthesized
gtatgcttctttcaaatagcac

SEQ ID NO: 5092 - DNA, 22 bp, Artificial Sequence
  chemically synthesized
tatgcttctttcaaatagcaca

SEQ ID NO: 5093 - DNA, 22 bp, Artificial Sequence
  chemically synthesized
ctttcaaatagcacatattttt

SEQ ID NO: 5094 - DNA, 22 bp, Artificial Sequence
  chemically synthesized
tttcaaatagcacatatttttg

SEQ ID NO: 5095 - DNA, 22 bp, Artificial Sequence
  chemically synthesized
tcaaatagcacatatttttgtc

SEQ ID NO: 5096 - DNA, 22 bp, Artificial Sequence
  chemically synthesized
caaatagcacatatttttgtcc

SEQ ID NO: 5097 - DNA, 22 bp, Artificial Sequence
  chemically synthesized
aaatagcacatatttttgtcct

SEQ ID NO: 5098 - DNA, 22 bp, Artificial Sequence
  chemically synthesized
ttgtccttaacattttatttaa

SEQ ID NO: 5099 - DNA, 22 bp, Artificial Sequence
  chemically synthesized
tgtccttaacattttatttaaa

SEQ ID NO: 5100 - DNA, 22 bp, Artificial Sequence
  chemically synthesized
gtccttaacattttatttaaat

SEQ ID NO: 5101 - DNA, 22 bp, Artificial Sequence
  chemically synthesized
tccttaacattttatttaaatt

SEQ ID NO: 5102 - DNA, 22 bp, Artificial Sequence
  chemically synthesized
aacattttatttaaattgtact

SEQ ID NO: 5103 - DNA, 22 bp, Artificial Sequence
  chemically synthesized
acattttatttaaattgtacta

SEQ ID NO: 5104 - DNA, 22 bp, Artificial Sequence
  chemically synthesized
tatttaaattgtactatctcta

SEQ ID NO: 5105 - DNA, 22 bp, Artificial Sequence
  chemically synthesized
atttaaattgtactatctctaa

SEQ ID NO: 5106 - DNA, 22 bp, Artificial Sequence
  chemically synthesized
tttaaattgtactatctctaaa

SEQ ID NO: 5107 - DNA, 22 bp, Artificial Sequence
  chemically synthesized
aaattgtactatctctaaaatt

SEQ ID NO: 5108 - DNA, 22 bp, Artificial Sequence
  chemically synthesized
aattgtactatctctaaaattt

SEQ ID NO: 5109 - DNA, 22 bp, Artificial Sequence
  chemically synthesized
tactatctctaaaatttgattt

SEQ ID NO: 5110 - DNA, 22 bp, Artificial Sequence
  chemically synthesized
tctctaaaatttgattttctga

SEQ ID NO: 5111 - DNA, 22 bp, Artificial Sequence
  chemically synthesized
taaaatttgattttctgaactt

SEQ ID NO: 5112 - DNA, 22 bp, Artificial Sequence
  chemically synthesized
aaatttgattttctgaacttca

SEQ ID NO: 5113 - DNA, 22 bp, Artificial Sequence
  chemically synthesized
gattttctgaacttcaattaaa

SEQ ID NO: 5114 - DNA, 22 bp, Artificial Sequence
  chemically synthesized
attttctgaacttcaattaaaa

SEQ ID NO: 5115 - DNA, 22 bp, Artificial Sequence
  chemically synthesized
tctgaacttcaattaaaagaaa

SEQ ID NO: 5116 - DNA, 22 bp, Artificial Sequence
  chemically synthesized
ctgaacttcaattaaaagaaaa

SEQ ID NO: 5117 - DNA, 22 bp, Artificial Sequence
  chemically synthesized
tgaacttcaattaaaagaaaaa

SEQ ID NO: 5118 - DNA, 22 bp, Artificial Sequence
  chemically synthesized
aacttcaattaaaagaaaaagc

SEQ ID NO: 5119 - DNA, 22 bp, Artificial Sequence
  chemically synthesized
caattaaaagaaaaagcccagc

SEQ ID NO: 5120 - DNA, 22 bp, Artificial Sequence
  chemically synthesized
aattaaaagaaaaagcccagca

SEQ ID NO: 5121 - DNA, 22 bp, Artificial Sequence
  chemically synthesized
aaagaaaaagcccagcatattt

SEQ ID NO: 5122 - DNA, 22 bp, Artificial Sequence
  chemically synthesized
tcatatgaataaatcttttcca

SEQ ID NO: 5123 - DNA, 22 bp, Artificial Sequence
  chemically synthesized
catatgaataaatcttttccat

SEQ ID NO: 5124 - DNA, 22 bp, Artificial Sequence
  chemically synthesized
atatgaataaatcttttccatt

SEQ ID NO: 5125 - DNA, 22 bp, Artificial Sequence
  chemically synthesized
ttccatttactgtattatttaa

SEQ ID NO: 5126 - DNA, 22 bp, Artificial Sequence
  chemically synthesized
tccatttactgtattatttaat

SEQ ID NO: 5127 - DNA, 22 bp, Artificial Sequence
  chemically synthesized
ccatttactgtattatttaatc

SEQ ID NO: 5128 - DNA, 22 bp, Artificial Sequence
  chemically synthesized
catttactgtattatttaatct

SEQ ID NO: 5129 - DNA, 22 bp, Artificial Sequence
  chemically synthesized
actgtattatttaatctgtttt

SEQ ID NO: 5130 - DNA, 22 bp, Artificial Sequence
  chemically synthesized
ctgtattatttaatctgtttta

SEQ ID NO: 5131 - DNA, 22 bp, Artificial Sequence
  chemically synthesized
tattatttaatctgttttaaac

SEQ ID NO: 5132 - DNA, 22 bp, Artificial Sequence
  chemically synthesized
tttaatctgttttaaacactgg

SEQ ID NO: 5133 - DNA, 22 bp, Artificial Sequence
  chemically synthesized
aatctgttttaaacactggaga

SEQ ID NO: 5134 - DNA, 22 bp, Artificial Sequence
  chemically synthesized
atctgttttaaacactggagaa

SEQ ID NO: 5135 - DNA, 22 bp, Artificial Sequence
  chemically synthesized
ttttaaacactggagaatagtt

SEQ ID NO: 5136 - DNA, 22 bp, Artificial Sequence
  chemically synthesized
taaacactggagaatagtttta

SEQ ID NO: 5137 - DNA, 22 bp, Artificial Sequence
  chemically synthesized
aaacactggagaatagttttaa

SEQ ID NO: 5138 - DNA, 22 bp, Artificial Sequence
  chemically synthesized
aacactggagaatagttttaaa

SEQ ID NO: 5139 - DNA, 22 bp, Artificial Sequence
  chemically synthesized
gagaatagttttaaattttttt

SEQ ID NO: 5140 - DNA, 22 bp, Artificial Sequence
  chemically synthesized
taaattttttttaactttttac

SEQ ID NO: 5141 - DNA, 22 bp, Artificial Sequence
  chemically synthesized
aaattttttttaactttttact

SEQ ID NO: 5142 - DNA, 22 bp, Artificial Sequence
  chemically synthesized
aattttttttaactttttactt

SEQ ID NO: 5143 - DNA, 22 bp, Artificial Sequence
  chemically synthesized
tttttaactttttacttacctt

SEQ ID NO: 5144 - DNA, 22 bp, Artificial Sequence
  chemically synthesized
ttttaactttttacttaccttc

SEQ ID NO: 5145 - DNA, 22 bp, Artificial Sequence
  chemically synthesized
tttaactttttacttaccttca

SEQ ID NO: 5146 - DNA, 22 bp, Artificial Sequence
  chemically synthesized
ttaactttttacttaccttcag

SEQ ID NO: 5147 - DNA, 22 bp, Artificial Sequence
  chemically synthesized
taactttttacttaccttcagt

SEQ ID NO: 5148 - DNA, 22 bp, Artificial Sequence
  chemically synthesized
aactttttacttaccttcagta

SEQ ID NO: 5149 - DNA, 22 bp, Artificial Sequence
  chemically synthesized
actttttacttaccttcagtaa

SEQ ID NO: 5150 - DNA, 22 bp, Artificial Sequence
  chemically synthesized
tttacttaccttcagtaattta

SEQ ID NO: 5151 - DNA, 22 bp, Artificial Sequence
  chemically synthesized
ttacttaccttcagtaatttac

SEQ ID NO: 5152 - DNA, 22 bp, Artificial Sequence
  chemically synthesized
tacttaccttcagtaatttaca

SEQ ID NO: 5153 - DNA, 22 bp, Artificial Sequence
  chemically synthesized
acttaccttcagtaatttacaa

SEQ ID NO: 5154 - DNA, 22 bp, Artificial Sequence
  chemically synthesized
cttaccttcagtaatttacaat

SEQ ID NO: 5155 - DNA, 22 bp, Artificial Sequence
  chemically synthesized
accttcagtaatttacaatagt

SEQ ID NO: 5156 - DNA, 22 bp, Artificial Sequence
  chemically synthesized
ccttcagtaatttacaatagtg

SEQ ID NO: 5157 - DNA, 22 bp, Artificial Sequence
  chemically synthesized
cagtaatttacaatagtgtaat

SEQ ID NO: 5158 - DNA, 22 bp, Artificial Sequence
  chemically synthesized
agtaatttacaatagtgtaatg

SEQ ID NO: 5159 - DNA, 22 bp, Artificial Sequence
  chemically synthesized
acaatagtgtaatgacatagtg

SEQ ID NO: 5160 - DNA, 22 bp, Artificial Sequence
  chemically synthesized
caatagtgtaatgacatagtgt

SEQ ID NO: 5161 - DNA, 22 bp, Artificial Sequence
  chemically synthesized
tagattgtataatttaaccgat

SEQ ID NO: 5162 - DNA, 22 bp, Artificial Sequence
  chemically synthesized
gattgtataatttaaccgattt

SEQ ID NO: 5163 - DNA, 22 bp, Artificial Sequence
  chemically synthesized
tataatttaaccgatttgtaat

SEQ ID NO: 5164 - DNA, 22 bp, Artificial Sequence
  chemically synthesized
aaccgatttgtaattttcatat

SEQ ID NO: 5165 - DNA, 22 bp, Artificial Sequence
  chemically synthesized
accgatttgtaattttcatata

SEQ ID NO: 5166 - DNA, 22 bp, Artificial Sequence
  chemically synthesized
gtaattttcatataaaatgcaa

SEQ ID NO: 5167 - DNA, 22 bp, Artificial Sequence
  chemically synthesized
taattttcatataaaatgcaaa

SEQ ID NO: 5168 - DNA, 22 bp, Artificial Sequence
  chemically synthesized
tcatataaaatgcaaattttca

SEQ ID NO: 5169 - DNA, 22 bp, Artificial Sequence
  chemically synthesized
catataaaatgcaaattttcag

SEQ ID NO: 5170 - DNA, 22 bp, Artificial Sequence
  chemically synthesized
atataaaatgcaaattttcagt

SEQ ID NO: 5171 - DNA, 22 bp, Artificial Sequence
  chemically synthesized
tcagtgttttcatatataacat

SEQ ID NO: 5172 - DNA, 22 bp, Artificial Sequence
  chemically synthesized
cagtgttttcatatataacatt

SEQ ID NO: 5173 - DNA, 22 bp, Artificial Sequence
  chemically synthesized
agtgttttcatatataacatta

SEQ ID NO: 5174 - DNA, 22 bp, Artificial Sequence
  chemically synthesized
tcatatataacattagggaaac

SEQ ID NO: 5175 - DNA, 22 bp, Artificial Sequence
  chemically synthesized
catatataacattagggaaaca

SEQ ID NO: 5176 - DNA, 22 bp, Artificial Sequence
  chemically synthesized
atatataacattagggaaacaa

SEQ ID NO: 5177 - DNA, 22 bp, Artificial Sequence
  chemically synthesized
gggaaacaaaaaactaacttga

SEQ ID NO: 5178 - DNA, 22 bp, Artificial Sequence
  chemically synthesized
acttgaaattataataggaaat

SEQ ID NO: 5179 - DNA, 22 bp, Artificial Sequence
  chemically synthesized
gaaattataataggaaatttta

SEQ ID NO: 5180 - DNA, 22 bp, Artificial Sequence
  chemically synthesized
aaattataataggaaattttat

SEQ ID NO: 5181 - DNA, 22 bp, Artificial Sequence
  chemically synthesized
taataggaaattttattttctg

SEQ ID NO: 5182 - DNA, 22 bp, Artificial Sequence
  chemically synthesized
tattttctggagattatttttc

SEQ ID NO: 5183 - DNA, 22 bp, Artificial Sequence
  chemically synthesized
attttctggagattatttttct

SEQ ID NO: 5184 - DNA, 22 bp, Artificial Sequence
  chemically synthesized
ttttctggagattatttttctt

SEQ ID NO: 5185 - DNA, 22 bp, Artificial Sequence
  chemically synthesized
tctggagattatttttcttgga

SEQ ID NO: 5186 - DNA, 22 bp, Artificial Sequence
  chemically synthesized
ctggagattatttttcttggaa

SEQ ID NO: 5187 - DNA, 22 bp, Artificial Sequence
  chemically synthesized
tggagattatttttcttggaaa

SEQ ID NO: 5188 - DNA, 22 bp, Artificial Sequence
  chemically synthesized
gagattatttttcttggaaaaa

SEQ ID NO: 5189 - DNA, 22 bp, Artificial Sequence
  chemically synthesized
tttttcttggaaaaaaaagtat

SEQ ID NO: 5190 - DNA, 22 bp, Artificial Sequence
  chemically synthesized
ttcttggaaaaaaaagtatttc

SEQ ID NO: 5191 - DNA, 22 bp, Artificial Sequence
  chemically synthesized
tcttggaaaaaaaagtatttca

SEQ ID NO: 5192 - DNA, 22 bp, Artificial Sequence
  chemically synthesized
cttggaaaaaaaagtatttcaa

SEQ ID NO: 5193 - DNA, 22 bp, Artificial Sequence
  chemically synthesized
ttggaaaaaaaagtatttcaac

SEQ ID NO: 5194 - DNA, 22 bp, Artificial Sequence
  chemically synthesized
ggaaaaaaaagtatttcaacaa

SEQ ID NO: 5195 - DNA, 22 bp, Artificial Sequence
  chemically synthesized
gaaaaaaaagtatttcaacaat

SEQ ID NO: 5196 - DNA, 22 bp, Artificial Sequence
  chemically synthesized
caacaatgcaacaaagtatttc

SEQ ID NO: 5197 - DNA, 22 bp, Artificial Sequence
  chemically synthesized
aacaatgcaacaaagtatttca

SEQ ID NO: 5198 - DNA, 22 bp, Artificial Sequence
  chemically synthesized
caaatggcatgccttagaaata

SEQ ID NO: 5199 - DNA, 22 bp, Artificial Sequence
  chemically synthesized
aaatggcatgccttagaaatat

SEQ ID NO: 5200 - DNA, 22 bp, Artificial Sequence
  chemically synthesized
agaaatattttttttaaaagat

SEQ ID NO: 5201 - DNA, 22 bp, Artificial Sequence
  chemically synthesized
gaaatattttttttaaaagatc

SEQ ID NO: 5202 - DNA, 22 bp, Artificial Sequence
  chemically synthesized
tttttaaaagatccacattgaa

SEQ ID NO: 5203 - DNA, 22 bp, Artificial Sequence
  chemically synthesized
ttttaaaagatccacattgaaa

SEQ ID NO: 5204 - DNA, 22 bp, Artificial Sequence
  chemically synthesized
tttaaaagatccacattgaaaa

SEQ ID NO: 5205 - DNA, 22 bp, Artificial Sequence
  chemically synthesized
ttaaaagatccacattgaaaac

SEQ ID NO: 5206 - DNA, 22 bp, Artificial Sequence
  chemically synthesized
taaaagatccacattgaaaaca

SEQ ID NO: 5207 - DNA, 22 bp, Artificial Sequence
  chemically synthesized
aaaagatccacattgaaaacat

SEQ ID NO: 5208 - DNA, 22 bp, Artificial Sequence
  chemically synthesized
aaagatccacattgaaaacata

SEQ ID NO: 5209 - DNA, 22 bp, Artificial Sequence
  chemically synthesized
aaaacataaacatgaaccctct

SEQ ID NO: 5210 - DNA, 22 bp, Artificial Sequence
  chemically synthesized
tttattttctacttactttaag

SEQ ID NO: 5211 - DNA, 22 bp, Artificial Sequence
  chemically synthesized
tattttctacttactttaagtg

SEQ ID NO: 5212 - DNA, 22 bp, Artificial Sequence
  chemically synthesized
attttctacttactttaagtga

SEQ ID NO: 5213 - DNA, 22 bp, Artificial Sequence
  chemically synthesized
ttttctacttactttaagtgaa

SEQ ID NO: 5214 - DNA, 22 bp, Artificial Sequence
  chemically synthesized
tctacttactttaagtgaagtt

SEQ ID NO: 5215 - DNA, 22 bp, Artificial Sequence
  chemically synthesized
ctacttactttaagtgaagtta

SEQ ID NO: 5216 - DNA, 22 bp, Artificial Sequence
  chemically synthesized
tacttactttaagtgaagttac

SEQ ID NO: 5217 - DNA, 22 bp, Artificial Sequence
  chemically synthesized
cttactttaagtgaagttactt

SEQ ID NO: 5218 - DNA, 22 bp, Artificial Sequence
  chemically synthesized
actttaagtgaagttacttctg

SEQ ID NO: 5219 - DNA, 22 bp, Artificial Sequence
  chemically synthesized
ctttaagtgaagttacttctgg

SEQ ID NO: 5220 - DNA, 22 bp, Artificial Sequence
  chemically synthesized
taagtgaagttacttctgggtg

SEQ ID NO: 5221 - DNA, 22 bp, Artificial Sequence
  chemically synthesized
aagtgaagttacttctgggtgt

SEQ ID NO: 5222 - DNA, 22 bp, Artificial Sequence
  chemically synthesized
agtgaagttacttctgggtgtt

SEQ ID NO: 5223 - DNA, 22 bp, Artificial Sequence
  chemically synthesized
cttctgggtgttctggagtttc

SEQ ID NO: 5224 - DNA, 22 bp, Artificial Sequence
  chemically synthesized
ctgggtgttctggagtttcagg

SEQ ID NO: 5225 - DNA, 22 bp, Artificial Sequence
  chemically synthesized
tgggtgttctggagtttcaggt

SEQ ID NO: 5226 - DNA, 22 bp, Artificial Sequence
  chemically synthesized
ggtgttctggagtttcaggttg

SEQ ID NO: 5227 - DNA, 22 bp, Artificial Sequence
  chemically synthesized
tggagtttcaggttgattttga

SEQ ID NO: 5228 - DNA, 22 bp, Artificial Sequence
  chemically synthesized
gagtttcaggttgattttgaat

SEQ ID NO: 5229 - DNA, 22 bp, Artificial Sequence
  chemically synthesized
caggttgattttgaattaagtt

SEQ ID NO: 5230 - DNA, 22 bp, Artificial Sequence
  chemically synthesized
aggttgattttgaattaagtta

SEQ ID NO: 5231 - DNA, 22 bp, Artificial Sequence
  chemically synthesized
attttgaattaagttagttagt

SEQ ID NO: 5232 - DNA, 22 bp, Artificial Sequence
  chemically synthesized
tgaattaagttagttagttgct

SEQ ID NO: 5233 - DNA, 22 bp, Artificial Sequence
  chemically synthesized
gaattaagttagttagttgctc

SEQ ID NO: 5234 - DNA, 22 bp, Artificial Sequence
  chemically synthesized
aattaagttagttagttgctct

SEQ ID NO: 5235 - DNA, 22 bp, Artificial Sequence
  chemically synthesized
agttagttagttgctcttctaa

SEQ ID NO: 5236 - DNA, 22 bp, Artificial Sequence
  chemically synthesized
gttagttgctcttctaaatatt

SEQ ID NO: 5237 - DNA, 22 bp, Artificial Sequence
  chemically synthesized
gttgctcttctaaatatttcac

SEQ ID NO: 5238 - DNA, 22 bp, Artificial Sequence
  chemically synthesized
ctcttctaaatatttcactttt

SEQ ID NO: 5239 - DNA, 22 bp, Artificial Sequence
  chemically synthesized
ttctaaatatttcactttttgt

SEQ ID NO: 5240 - DNA, 22 bp, Artificial Sequence
  chemically synthesized
ctaaatatttcactttttgttg

SEQ ID NO: 5241 - DNA, 22 bp, Artificial Sequence
  chemically synthesized
taaatatttcactttttgttga

SEQ ID NO: 5242 - DNA, 22 bp, Artificial Sequence
  chemically synthesized
aatatttcactttttgttgaag

SEQ ID NO: 5243 - DNA, 22 bp, Artificial Sequence
  chemically synthesized
cactttttgttgaagtagaatt

SEQ ID NO: 5244 - DNA, 22 bp, Artificial Sequence
  chemically synthesized
actttttgttgaagtagaattt

SEQ ID NO: 5245 - DNA, 22 bp, Artificial Sequence
  chemically synthesized
tttgttgaagtagaattttttc

SEQ ID NO: 5246 - DNA, 22 bp, Artificial Sequence
  chemically synthesized
ttgttgaagtagaattttttct

SEQ ID NO: 5247 - DNA, 22 bp, Artificial Sequence
  chemically synthesized
tgttgaagtagaattttttctt

SEQ ID NO: 5248 - DNA, 22 bp, Artificial Sequence
  chemically synthesized
gttgaagtagaattttttcttc

SEQ ID NO: 5249 - DNA, 22 bp, Artificial Sequence
  chemically synthesized
ttgaagtagaattttttcttct

SEQ ID NO: 5250 - DNA, 22 bp, Artificial Sequence
  chemically synthesized
aagtagaattttttcttctagg

SEQ ID NO: 5251 - DNA, 22 bp, Artificial Sequence
  chemically synthesized
tttcttctaggaggctttcaag

SEQ ID NO: 5252 - DNA, 22 bp, Artificial Sequence
  chemically synthesized
ttcttctaggaggctttcaagt

SEQ ID NO: 5253 - DNA, 22 bp, Artificial Sequence
  chemically synthesized
tcttctaggaggctttcaagtt

SEQ ID NO: 5254 - DNA, 22 bp, Artificial Sequence
  chemically synthesized
cttctaggaggctttcaagttt

SEQ ID NO: 5255 - DNA, 22 bp, Artificial Sequence
  chemically synthesized
ttctaggaggctttcaagtttt

SEQ ID NO: 5256 - DNA, 22 bp, Artificial Sequence
  chemically synthesized
ctaggaggctttcaagttttga

SEQ ID NO: 5257 - DNA, 22 bp, Artificial Sequence
  chemically synthesized
taggaggctttcaagttttgag

SEQ ID NO: 5258 - DNA, 22 bp, Artificial Sequence
  chemically synthesized
ggaggctttcaagttttgagtt

SEQ ID NO: 5259 - DNA, 22 bp, Artificial Sequence
  chemically synthesized
tcaagttttgagttgagttcaa

SEQ ID NO: 5260 - DNA, 22 bp, Artificial Sequence
  chemically synthesized
caagttttgagttgagttcaag

SEQ ID NO: 5261 - DNA, 22 bp, Artificial Sequence
  chemically synthesized
aagttttgagttgagttcaagt

SEQ ID NO: 5262 - DNA, 22 bp, Artificial Sequence
  chemically synthesized
tgagttgagttcaagtgacata

SEQ ID NO: 5263 - DNA, 22 bp, Artificial Sequence
  chemically synthesized
gagttgagttcaagtgacatat

SEQ ID NO: 5264 - DNA, 22 bp, Artificial Sequence
  chemically synthesized
agttgagttcaagtgacatatt

SEQ ID NO: 5265 - DNA, 22 bp, Artificial Sequence
  chemically synthesized
agttcaagtgacatattcttta

SEQ ID NO: 5266 - DNA, 22 bp, Artificial Sequence
  chemically synthesized
aagtgacatattctttacctct

SEQ ID NO: 5267 - DNA, 22 bp, Artificial Sequence
  chemically synthesized
tttacctcttcatttttgactt

SEQ ID NO: 5268 - DNA, 22 bp, Artificial Sequence
  chemically synthesized
tacctcttcatttttgacttgt

SEQ ID NO: 5269 - DNA, 22 bp, Artificial Sequence
  chemically synthesized
acctcttcatttttgacttgta

SEQ ID NO: 5270 - DNA, 22 bp, Artificial Sequence
  chemically synthesized
cctcttcatttttgacttgtag

SEQ ID NO: 5271 - DNA, 22 bp, Artificial Sequence
  chemically synthesized
ttcatttttgacttgtagttta

SEQ ID NO: 5272 - DNA, 22 bp, Artificial Sequence
  chemically synthesized
catttttgacttgtagtttata

SEQ ID NO: 5273 - DNA, 22 bp, Artificial Sequence
  chemically synthesized
atttttgacttgtagtttatat

SEQ ID NO: 5274 - DNA, 22 bp, Artificial Sequence
  chemically synthesized
ttgacttgtagtttatatgtag

SEQ ID NO: 5275 - DNA, 22 bp, Artificial Sequence
  chemically synthesized
tgacttgtagtttatatgtagt

SEQ ID NO: 5276 - DNA, 22 bp, Artificial Sequence
  chemically synthesized
gacttgtagtttatatgtagtt

SEQ ID NO: 5277 - DNA, 22 bp, Artificial Sequence
  chemically synthesized
acttgtagtttatatgtagttc

SEQ ID NO: 5278 - DNA, 22 bp, Artificial Sequence
  chemically synthesized
gtagtttatatgtagttcttct

SEQ ID NO: 5279 - DNA, 22 bp, Artificial Sequence
  chemically synthesized
tagtttatatgtagttcttctc

SEQ ID NO: 5280 - DNA, 22 bp, Artificial Sequence
  chemically synthesized
atatgtagttcttctcagttcc

SEQ ID NO: 5281 - DNA, 22 bp, Artificial Sequence
  chemically synthesized
tatgtagttcttctcagttcct

SEQ ID NO: 5282 - DNA, 22 bp, Artificial Sequence
  chemically synthesized
ttctcagttccttttcttcttc

SEQ ID NO: 5283 - DNA, 22 bp, Artificial Sequence
  chemically synthesized
ctcagttccttttcttcttctt

SEQ ID NO: 5284 - DNA, 22 bp, Artificial Sequence
  chemically synthesized
tcagttccttttcttcttcttt

SEQ ID NO: 5285 - DNA, 22 bp, Artificial Sequence
  chemically synthesized
agttccttttcttcttctttga

SEQ ID NO: 5286 - DNA, 22 bp, Artificial Sequence
  chemically synthesized
cttttcttcttctttgatttca

SEQ ID NO: 5287 - DNA, 22 bp, Artificial Sequence
  chemically synthesized
ttcttcttctttgatttcactg

SEQ ID NO: 5288 - DNA, 22 bp, Artificial Sequence
  chemically synthesized
tcttcttctttgatttcactgg

SEQ ID NO: 5289 - DNA, 22 bp, Artificial Sequence
  chemically synthesized
cttcttctttgatttcactggt

SEQ ID NO: 5290 - DNA, 22 bp, Artificial Sequence
  chemically synthesized
ttcttctttgatttcactggtt

SEQ ID NO: 5291 - DNA, 22 bp, Artificial Sequence
  chemically synthesized
cttctttgatttcactggtttg

SEQ ID NO: 5292 - DNA, 22 bp, Artificial Sequence
  chemically synthesized
ttctttgatttcactggtttgc

SEQ ID NO: 5293 - DNA, 22 bp, Artificial Sequence
  chemically synthesized
ctttgatttcactggtttgcag

SEQ ID NO: 5294 - DNA, 22 bp, Artificial Sequence
  chemically synthesized
tttgatttcactggtttgcagc

SEQ ID NO: 5295 - DNA, 22 bp, Artificial Sequence
  chemically synthesized
tgatttcactggtttgcagcga

SEQ ID NO: 5296 - DNA, 22 bp, Artificial Sequence
  chemically synthesized
gatttcactggtttgcagcgat

SEQ ID NO: 5297 - DNA, 22 bp, Artificial Sequence
  chemically synthesized
atttcactggtttgcagcgata

SEQ ID NO: 5298 - DNA, 22 bp, Artificial Sequence
  chemically synthesized
cactggtttgcagcgatagatc

SEQ ID NO: 5299 - DNA, 22 bp, Artificial Sequence
  chemically synthesized
actggtttgcagcgatagatca

SEQ ID NO: 5300 - DNA, 22 bp, Artificial Sequence
  chemically synthesized
gtttgcagcgatagatcataaa

SEQ ID NO: 5301 - DNA, 22 bp, Artificial Sequence
  chemically synthesized
gcagcgatagatcataaaaaga

SEQ ID NO: 5302 - DNA, 22 bp, Artificial Sequence
  chemically synthesized
cagcgatagatcataaaaagac

SEQ ID NO: 5303 - DNA, 22 bp, Artificial Sequence
  chemically synthesized
atcaaatatgttgagtttttga

SEQ ID NO: 5304 - DNA, 22 bp, Artificial Sequence
  chemically synthesized
agtttttgaaatatgtcattaa

SEQ ID NO: 5305 - DNA, 22 bp, Artificial Sequence
  chemically synthesized
ttgaaatatgtcattaatttgg

SEQ ID NO: 5306 - DNA, 22 bp, Artificial Sequence
  chemically synthesized
tgaaatatgtcattaatttggc

SEQ ID NO: 5307 - DNA, 22 bp, Artificial Sequence
  chemically synthesized
gaaatatgtcattaatttggcc

SEQ ID NO: 5308 - DNA, 22 bp, Artificial Sequence
  chemically synthesized
aaatatgtcattaatttggccc

SEQ ID NO: 5309 - DNA, 22 bp, Artificial Sequence
  chemically synthesized
atttggcccttcgtcttatgga

SEQ ID NO: 5310 - DNA, 22 bp, Artificial Sequence
  chemically synthesized
ggcccttcgtcttatggacaaa

SEQ ID NO: 5311 - DNA, 22 bp, Artificial Sequence
  chemically synthesized
gcccttcgtcttatggacaaag

SEQ ID NO: 5312 - DNA, 22 bp, Artificial Sequence
  chemically synthesized
cgtcttatggacaaagtcttta

SEQ ID NO: 5313 - DNA, 22 bp, Artificial Sequence
  chemically synthesized
gtcttatggacaaagtctttaa

SEQ ID NO: 5314 - DNA, 22 bp, Artificial Sequence
  chemically synthesized
atggacaaagtctttaagacca

SEQ ID NO: 5315 - DNA, 22 bp, Artificial Sequence
  chemically synthesized
tggacaaagtctttaagaccat

SEQ ID NO: 5316 - DNA, 22 bp, Artificial Sequence
  chemically synthesized
taagaccatgtcccaactgaag

SEQ ID NO: 5317 - DNA, 22 bp, Artificial Sequence
  chemically synthesized
aagaccatgtcccaactgaagg

SEQ ID NO: 5318 - DNA, 22 bp, Artificial Sequence
  chemically synthesized
agaccatgtcccaactgaagga

SEQ ID NO: 5319 - DNA, 22 bp, Artificial Sequence
  chemically synthesized
aaggaggccattggctaaaatt

SEQ ID NO: 5320 - DNA, 22 bp, Artificial Sequence
  chemically synthesized
gctaaaatttttacatcgtcta

SEQ ID NO: 5321 - DNA, 22 bp, Artificial Sequence
  chemically synthesized
aaatttttacatcgtctaacat

SEQ ID NO: 5322 - DNA, 22 bp, Artificial Sequence
  chemically synthesized
ttacatcgtctaacatagcaaa

SEQ ID NO: 5323 - DNA, 22 bp, Artificial Sequence
  chemically synthesized
tacatcgtctaacatagcaaat

SEQ ID NO: 5324 - DNA, 22 bp, Artificial Sequence
  chemically synthesized
acatcgtctaacatagcaaatc

SEQ ID NO: 5325 - DNA, 22 bp, Artificial Sequence
  chemically synthesized
catcgtctaacatagcaaatct

SEQ ID NO: 5326 - DNA, 22 bp, Artificial Sequence
  chemically synthesized
acatagcaaatcttgattttgg

SEQ ID NO: 5327 - DNA, 22 bp, Artificial Sequence
  chemically synthesized
gattttggctctggagatagag

SEQ ID NO: 5328 - DNA, 22 bp, Artificial Sequence
  chemically synthesized
attttggctctggagatagaga

SEQ ID NO: 5329 - DNA, 22 bp, Artificial Sequence
  chemically synthesized
tggctctggagatagagaatca

SEQ ID NO: 5330 - DNA, 22 bp, Artificial Sequence
  chemically synthesized
ggctctggagatagagaatcaa

SEQ ID NO: 5331 - DNA, 22 bp, Artificial Sequence
  chemically synthesized
gctctggagatagagaatcaaa

SEQ ID NO: 5332 - DNA, 22 bp, Artificial Sequence
  chemically synthesized
tggagatagagaatcaaatgat

SEQ ID NO: 5333 - DNA, 22 bp, Artificial Sequence
  chemically synthesized
gagatagagaatcaaatgatga

SEQ ID NO: 5334 - DNA, 22 bp, Artificial Sequence
  chemically synthesized
tcttgatcaattctggaggaaa

SEQ ID NO: 5335 - DNA, 22 bp, Artificial Sequence
  chemically synthesized
gatcaattctggaggaaataac

SEQ ID NO: 5336 - DNA, 22 bp, Artificial Sequence
  chemically synthesized
atcaattctggaggaaataact

SEQ ID NO: 5337 - DNA, 22 bp, Artificial Sequence
  chemically synthesized
tggaggaaataactagaggaac

SEQ ID NO: 5338 - DNA, 22 bp, Artificial Sequence
  chemically synthesized
gaggaaataactagaggaacaa

SEQ ID NO: 5339 - DNA, 22 bp, Artificial Sequence
  chemically synthesized
gaggaacaataaaaagaaggag

SEQ ID NO: 5340 - DNA, 22 bp, Artificial Sequence
  chemically synthesized
aattgtgaacatttttatcttg

SEQ ID NO: 5341 - DNA, 22 bp, Artificial Sequence
  chemically synthesized
attgtgaacatttttatcttga

SEQ ID NO: 5342 - DNA, 22 bp, Artificial Sequence
  chemically synthesized
tgaacatttttatcttgatttt

SEQ ID NO: 5343 - DNA, 22 bp, Artificial Sequence
  chemically synthesized
ttatcttgattttcaatttcaa

SEQ ID NO: 5344 - DNA, 22 bp, Artificial Sequence
  chemically synthesized
tatcttgattttcaatttcaag

SEQ ID NO: 5345 - DNA, 22 bp, Artificial Sequence
  chemically synthesized
atcttgattttcaatttcaagc

SEQ ID NO: 5346 - DNA, 22 bp, Artificial Sequence
  chemically synthesized
tcttgattttcaatttcaagca

SEQ ID NO: 5347 - DNA, 22 bp, Artificial Sequence
  chemically synthesized
gattttcaatttcaagcaacgt

SEQ ID NO: 5348 - DNA, 22 bp, Artificial Sequence
  chemically synthesized
attttcaatttcaagcaacgtg

SEQ ID NO: 5349 - DNA, 22 bp, Artificial Sequence
  chemically synthesized
tcaatttcaagcaacgtggaac

SEQ ID NO: 5350 - DNA, 22 bp, Artificial Sequence
  chemically synthesized
caatttcaagcaacgtggaact

SEQ ID NO: 5351 - DNA, 22 bp, Artificial Sequence
  chemically synthesized
aatttcaagcaacgtggaactg

SEQ ID NO: 5352 - DNA, 22 bp, Artificial Sequence
  chemically synthesized
caagcaacgtggaactgttttc

SEQ ID NO: 5353 - DNA, 22 bp, Artificial Sequence
  chemically synthesized
aagcaacgtggaactgttttct

SEQ ID NO: 5354 - DNA, 22 bp, Artificial Sequence
  chemically synthesized
ttttcttctggaagcagaccta

SEQ ID NO: 5355 - DNA, 22 bp, Artificial Sequence
  chemically synthesized
tcttctggaagcagacctagac

SEQ ID NO: 5356 - DNA, 22 bp, Artificial Sequence
  chemically synthesized
cttctggaagcagacctagact

SEQ ID NO: 5357 - DNA, 22 bp, Artificial Sequence
  chemically synthesized
ttctggaagcagacctagactt

SEQ ID NO: 5358 - DNA, 22 bp, Artificial Sequence
  chemically synthesized
ctggaagcagacctagacttct

SEQ ID NO: 5359 - DNA, 22 bp, Artificial Sequence
  chemically synthesized
tggaagcagacctagacttctt

SEQ ID NO: 5360 - DNA, 22 bp, Artificial Sequence
  chemically synthesized
gaagcagacctagacttcttaa

SEQ ID NO: 5361 - DNA, 22 bp, Artificial Sequence
  chemically synthesized
gacttcttaactctatatatac

SEQ ID NO: 5362 - DNA, 22 bp, Artificial Sequence
  chemically synthesized
cttaactctatatataccaata

SEQ ID NO: 5363 - DNA, 22 bp, Artificial Sequence
  chemically synthesized
ttaactctatatataccaatat

SEQ ID NO: 5364 - DNA, 22 bp, Artificial Sequence
  chemically synthesized
aactctatatataccaatattt

SEQ ID NO: 5365 - DNA, 22 bp, Artificial Sequence
  chemically synthesized
actctatatataccaatatttg

SEQ ID NO: 5366 - DNA, 22 bp, Artificial Sequence
  chemically synthesized
tatatataccaatatttgccca

SEQ ID NO: 5367 - DNA, 22 bp, Artificial Sequence
  chemically synthesized
tatataccaatatttgcccaga

SEQ ID NO: 5368 - DNA, 22 bp, Artificial Sequence
  chemically synthesized
gcccagaaaaggtaaggttggt

SEQ ID NO: 5369 - DNA, 22 bp, Artificial Sequence
  chemically synthesized
cccagaaaaggtaaggttggta

SEQ ID NO: 5370 - DNA, 22 bp, Artificial Sequence
  chemically synthesized
gtaggtgaacatagttaatcat

SEQ ID NO: 5371 - DNA, 22 bp, Artificial Sequence
  chemically synthesized
atcattaagccgtgttaacttg

SEQ ID NO: 5372 - DNA, 22 bp, Artificial Sequence
  chemically synthesized
agccgtgttaacttgcacgaat

SEQ ID NO: 5373 - DNA, 22 bp, Artificial Sequence
  chemically synthesized
acttgcacgaatgtaaccttct

SEQ ID NO: 5374 - DNA, 22 bp, Artificial Sequence
  chemically synthesized
gcacgaatgtaaccttcttcca

SEQ ID NO: 5375 - DNA, 22 bp, Artificial Sequence
  chemically synthesized
cacgaatgtaaccttcttccac

SEQ ID NO: 5376 - DNA, 22 bp, Artificial Sequence
  chemically synthesized
cttccacattgagttagatcaa

SEQ ID NO: 5377 - DNA, 22 bp, Artificial Sequence
  chemically synthesized
ttccacattgagttagatcaat

SEQ ID NO: 5378 - DNA, 22 bp, Artificial Sequence
  chemically synthesized
ccacattgagttagatcaatgc

SEQ ID NO: 5379 - DNA, 22 bp, Artificial Sequence
  chemically synthesized
cacattgagttagatcaatgct

SEQ ID NO: 5380 - DNA, 22 bp, Artificial Sequence
  chemically synthesized
agttagatcaatgctaaatgaa

SEQ ID NO: 5381 - DNA, 22 bp, Artificial Sequence
  chemically synthesized
gatcaatgctaaatgaaatcaa

SEQ ID NO: 5382 - DNA, 22 bp, Artificial Sequence
  chemically synthesized
aatgaaatcaaagaaatgagca

SEQ ID NO: 5383 - DNA, 22 bp, Artificial Sequence
  chemically synthesized
acttaataggtaatttgaaatt

SEQ ID NO: 5384 - DNA, 22 bp, Artificial Sequence
  chemically synthesized
aataggtaatttgaaattgtat

SEQ ID NO: 5385 - DNA, 22 bp, Artificial Sequence
  chemically synthesized
ataggtaatttgaaattgtatt

SEQ ID NO: 5386 - DNA, 22 bp, Artificial Sequence
  chemically synthesized
gaaattgtatttaactttgctg

SEQ ID NO: 5387 - DNA, 22 bp, Artificial Sequence
  chemically synthesized
aaattgtatttaactttgctgt

SEQ ID NO: 5388 - DNA, 22 bp, Artificial Sequence
  chemically synthesized
tatttaactttgctgtattata

SEQ ID NO: 5389 - DNA, 22 bp, Artificial Sequence
  chemically synthesized
aactttgctgtattataaacta

SEQ ID NO: 5390 - DNA, 22 bp, Artificial Sequence
  chemically synthesized
actttgctgtattataaactac

SEQ ID NO: 5391 - DNA, 22 bp, Artificial Sequence
  chemically synthesized
tgctgtattataaactacacat

SEQ ID NO: 5392 - DNA, 22 bp, Artificial Sequence
  chemically synthesized
gctgtattataaactacacatt

SEQ ID NO: 5393 - DNA, 22 bp, Artificial Sequence
  chemically synthesized
ctgtattataaactacacattc

SEQ ID NO: 5394 - DNA, 22 bp, Artificial Sequence
  chemically synthesized
tattataaactacacattcaat

SEQ ID NO: 5395 - DNA, 22 bp, Artificial Sequence
  chemically synthesized
taaactacacattcaatgctat

SEQ ID NO: 5396 - DNA, 22 bp, Artificial Sequence
  chemically synthesized
cacattcaatgctatggtgact

SEQ ID NO: 5397 - DNA, 22 bp, Artificial Sequence
  chemically synthesized
aatgctatggtgactacctgtt

SEQ ID NO: 5398 - DNA, 22 bp, Artificial Sequence
  chemically synthesized
tggtgactacctgtttttaaaa

SEQ ID NO: 5399 - DNA, 22 bp, Artificial Sequence
  chemically synthesized
cctgtttttaaaagctaatttt

SEQ ID NO: 5400 - DNA, 22 bp, Artificial Sequence
  chemically synthesized
tttttaaaagctaattttactt

SEQ ID NO: 5401 - DNA, 22 bp, Artificial Sequence
  chemically synthesized
ttaaaagctaattttacttttt

SEQ ID NO: 5402 - DNA, 22 bp, Artificial Sequence
  chemically synthesized
taaaagctaattttactttttt

SEQ ID NO: 5403 - DNA, 22 bp, Artificial Sequence
  chemically synthesized
aaaagctaattttactttttta

SEQ ID NO: 5404 - DNA, 22 bp, Artificial Sequence
  chemically synthesized
aaagctaattttacttttttat

SEQ ID NO: 5405 - DNA, 22 bp, Artificial Sequence
  chemically synthesized
attttacttttttatgatttta

SEQ ID NO: 5406 - DNA, 22 bp, Artificial Sequence
  chemically synthesized
tacttttttatgattttaagag

SEQ ID NO: 5407 - DNA, 22 bp, Artificial Sequence
  chemically synthesized
acttttttatgattttaagaga

SEQ ID NO: 5408 - DNA, 22 bp, Artificial Sequence
  chemically synthesized
cttttttatgattttaagagat

SEQ ID NO: 5409 - DNA, 22 bp, Artificial Sequence
  chemically synthesized
ttttatgattttaagagattta

SEQ ID NO: 5410 - DNA, 22 bp, Artificial Sequence
  chemically synthesized
tttatgattttaagagatttac

SEQ ID NO: 5411 - DNA, 22 bp, Artificial Sequence
  chemically synthesized
ttatgattttaagagatttaca

SEQ ID NO: 5412 - DNA, 22 bp, Artificial Sequence
  chemically synthesized
tatgattttaagagatttacaa

SEQ ID NO: 5413 - DNA, 22 bp, Artificial Sequence
  chemically synthesized
atgattttaagagatttacaag

SEQ ID NO: 5414 - DNA, 22 bp, Artificial Sequence
  chemically synthesized
tgattttaagagatttacaagt

SEQ ID NO: 5415 - DNA, 22 bp, Artificial Sequence
  chemically synthesized
taagagatttacaagtcaaaaa

SEQ ID NO: 5416 - DNA, 22 bp, Artificial Sequence
  chemically synthesized
aagagatttacaagtcaaaaat

SEQ ID NO: 5417 - DNA, 22 bp, Artificial Sequence
  chemically synthesized
agagatttacaagtcaaaaata

SEQ ID NO: 5418 - DNA, 22 bp, Artificial Sequence
  chemically synthesized
acaagtcaaaaataaacttttt

SEQ ID NO: 5419 - DNA, 22 bp, Artificial Sequence
  chemically synthesized
caagtcaaaaataaactttttt

SEQ ID NO: 5420 - DNA, 22 bp, Artificial Sequence
  chemically synthesized
ttttgttgggtaaatttattat

SEQ ID NO: 5421 - DNA, 22 bp, Artificial Sequence
  chemically synthesized
tttgttgggtaaatttattatt

SEQ ID NO: 5422 - DNA, 22 bp, Artificial Sequence
  chemically synthesized
ttgttgggtaaatttattatta

SEQ ID NO: 5423 - DNA, 22 bp, Artificial Sequence
  chemically synthesized
tgttgggtaaatttattattaa

SEQ ID NO: 5424 - DNA, 22 bp, Artificial Sequence
  chemically synthesized
gttgggtaaatttattattaaa

SEQ ID NO: 5425 - DNA, 22 bp, Artificial Sequence
  chemically synthesized
ttgggtaaatttattattaaag

SEQ ID NO: 5426 - DNA, 22 bp, Artificial Sequence
  chemically synthesized
ggtaaatttattattaaagttg

SEQ ID NO: 5427 - DNA, 22 bp, Artificial Sequence
  chemically synthesized
attattaaagttgaggggaaaa

SEQ ID NO: 5428 - DNA, 22 bp, Artificial Sequence
  chemically synthesized
ttattaaagttgaggggaaaaa

SEQ ID NO: 5429 - DNA, 22 bp, Artificial Sequence
  chemically synthesized
ttaaagttgaggggaaaaaagt

SEQ ID NO: 5430 - DNA, 22 bp, Artificial Sequence
  chemically synthesized
aagttgaggggaaaaaagtaat

SEQ ID NO: 5431 - DNA, 22 bp, Artificial Sequence
  chemically synthesized
aggggaaaaaagtaatgaatta

SEQ ID NO: 5432 - DNA, 20 bp, Artificial Sequence
  chemically synthesized
tcccgcccgcttgctgcatc

SEQ ID NO: 5433 - DNA, 20 bp, Artificial Sequence
  chemically synthesized
tgcatctggacaccctgcct

SEQ ID NO: 5434 - DNA, 20 bp, Artificial Sequence
  chemically synthesized
gcatctggacaccctgcctc

SEQ ID NO: 5435 - DNA, 20 bp, Artificial Sequence
  chemically synthesized
cctcaggccctcatctccac

SEQ ID NO: 5436 - DNA, 20 bp, Artificial Sequence
  chemically synthesized
aggccctcatctccactggt

SEQ ID NO: 5437 - DNA, 20 bp, Artificial Sequence
  chemically synthesized
ccctcatctccactggtcag

SEQ ID NO: 5438 - DNA, 20 bp, Artificial Sequence
  chemically synthesized
cctcatctccactggtcagc

SEQ ID NO: 5439 - DNA, 20 bp, Artificial Sequence
  chemically synthesized
gtcagcaggtgacctttgcc

SEQ ID NO: 5440 - DNA, 20 bp, Artificial Sequence
  chemically synthesized
gtgacctttgcccagcgccc

SEQ ID NO: 5441 - DNA, 20 bp, Artificial Sequence
  chemically synthesized
tgacctttgcccagcgccct

SEQ ID NO: 5442 - DNA, 20 bp, Artificial Sequence
  chemically synthesized
tgcccagcgccctgggtcct

SEQ ID NO: 5443 - DNA, 20 bp, Artificial Sequence
  chemically synthesized
gtcctcagtgcctgctgccc

SEQ ID NO: 5444 - DNA, 20 bp, Artificial Sequence
  chemically synthesized
cctcagtgcctgctgccctg

SEQ ID NO: 5445 - DNA, 20 bp, Artificial Sequence
  chemically synthesized
gccctggagatgatataaaa

SEQ ID NO: 5446 - DNA, 20 bp, Artificial Sequence
  chemically synthesized
ccctggagatgatataaaac

SEQ ID NO: 5447 - DNA, 20 bp, Artificial Sequence
  chemically synthesized
ggagatgatataaaacaggt

SEQ ID NO: 5448 - DNA, 20 bp, Artificial Sequence
  chemically synthesized
aaccctcctgcctgtctgct

SEQ ID NO: 5449 - DNA, 20 bp, Artificial Sequence
  chemically synthesized
ctgtctgctcagttcatccc

SEQ ID NO: 5450 - DNA, 20 bp, Artificial Sequence
  chemically synthesized
gtctgctcagttcatcccta

SEQ ID NO: 5451 - DNA, 20 bp, Artificial Sequence
  chemically synthesized
tctgctcagttcatccctag

SEQ ID NO: 5452 - DNA, 20 bp, Artificial Sequence
  chemically synthesized
gctcagttcatccctagagg

SEQ ID NO: 5453 - DNA, 20 bp, Artificial Sequence
  chemically synthesized
atccctagaggcagctgctc

SEQ ID NO: 5454 - DNA, 20 bp, Artificial Sequence
  chemically synthesized
tccctagaggcagctgctcc

SEQ ID NO: 5455 - DNA, 20 bp, Artificial Sequence
  chemically synthesized
ctgctccaggtaatgccctc

SEQ ID NO: 5456 - DNA, 20 bp, Artificial Sequence
  chemically synthesized
tgctccaggtaatgccctct

SEQ ID NO: 5457 - DNA, 20 bp, Artificial Sequence
  chemically synthesized
gctccaggtaatgccctctg

SEQ ID NO: 5458 - DNA, 20 bp, Artificial Sequence
  chemically synthesized
tccaggtaatgccctctggg

SEQ ID NO: 5459 - DNA, 20 bp, Artificial Sequence
  chemically synthesized
ccaggtaatgccctctgggg

SEQ ID NO: 5460 - DNA, 20 bp, Artificial Sequence
  chemically synthesized
caggtaatgccctctgggga

SEQ ID NO: 5461 - DNA, 20 bp, Artificial Sequence
  chemically synthesized
aggtaatgccctctggggag

SEQ ID NO: 5462 - DNA, 20 bp, Artificial Sequence
  chemically synthesized
aatgccctctggggagggga

SEQ ID NO: 5463 - DNA, 20 bp, Artificial Sequence
  chemically synthesized
tgccctctggggaggggaaa

SEQ ID NO: 5464 - DNA, 20 bp, Artificial Sequence
  chemically synthesized
gccctctggggaggggaaag

SEQ ID NO: 5465 - DNA, 20 bp, Artificial Sequence
  chemically synthesized
cctctggggaggggaaagag

SEQ ID NO: 5466 - DNA, 20 bp, Artificial Sequence
  chemically synthesized
ctctggggaggggaaagagg

SEQ ID NO: 5467 - DNA, 20 bp, Artificial Sequence
  chemically synthesized
tctggggaggggaaagagga

SEQ ID NO: 5468 - DNA, 20 bp, Artificial Sequence
  chemically synthesized
ctggggaggggaaagaggag

SEQ ID NO: 5469 - DNA, 20 bp, Artificial Sequence
  chemically synthesized
ggggaggggaaagaggaggg

SEQ ID NO: 5470 - DNA, 20 bp, Artificial Sequence
  chemically synthesized
gggaggggaaagaggagggg

SEQ ID NO: 5471 - DNA, 20 bp, Artificial Sequence
  chemically synthesized
gaggggaaagaggaggggag

SEQ ID NO: 5472 - DNA, 20 bp, Artificial Sequence
  chemically synthesized
aggggaaagaggaggggagg

SEQ ID NO: 5473 - DNA, 20 bp, Artificial Sequence
  chemically synthesized
aagaggaggggaggaggatg

SEQ ID NO: 5474 - DNA, 20 bp, Artificial Sequence
  chemically synthesized
gaggaggggaggaggatgaa

SEQ ID NO: 5475 - DNA, 20 bp, Artificial Sequence
  chemically synthesized
aggaggggaggaggatgaag

SEQ ID NO: 5476 - DNA, 20 bp, Artificial Sequence
  chemically synthesized
ggaggggaggaggatgaaga

SEQ ID NO: 5477 - DNA, 20 bp, Artificial Sequence
  chemically synthesized
gaggggaggaggatgaagag

SEQ ID NO: 5478 - DNA, 20 bp, Artificial Sequence
  chemically synthesized
ggaggaggatgaagaggggc

SEQ ID NO: 5479 - DNA, 20 bp, Artificial Sequence
  chemically synthesized
aggaggatgaagaggggcaa

SEQ ID NO: 5480 - DNA, 20 bp, Artificial Sequence
  chemically synthesized
ggaggatgaagaggggcaag

SEQ ID NO: 5481 - DNA, 20 bp, Artificial Sequence
  chemically synthesized
aggatgaagaggggcaagag

SEQ ID NO: 5482 - DNA, 20 bp, Artificial Sequence
  chemically synthesized
ggcaagaggagctccctgcc

SEQ ID NO: 5483 - DNA, 20 bp, Artificial Sequence
  chemically synthesized
gaggagctccctgcccagcc

SEQ ID NO: 5484 - DNA, 20 bp, Artificial Sequence
  chemically synthesized
agctccctgcccagcccagc

SEQ ID NO: 5485 - DNA, 20 bp, Artificial Sequence
  chemically synthesized
ccctgcccagcccagccagc

SEQ ID NO: 5486 - DNA, 20 bp, Artificial Sequence
  chemically synthesized
cccagcccagccagcaagcc

SEQ ID NO: 5487 - DNA, 20 bp, Artificial Sequence
  chemically synthesized
cagcccagccagcaagcctg

SEQ ID NO: 5488 - DNA, 20 bp, Artificial Sequence
  chemically synthesized
cccagccagcaagcctggag

SEQ ID NO: 5489 - DNA, 20 bp, Artificial Sequence
  chemically synthesized
aagcctggagaagcacttgc

SEQ ID NO: 5490 - DNA, 20 bp, Artificial Sequence
  chemically synthesized
gcctggagaagcacttgcta

SEQ ID NO: 5491 - DNA, 20 bp, Artificial Sequence
  chemically synthesized
gagaagcacttgctagagct

SEQ ID NO: 5492 - DNA, 20 bp, Artificial Sequence
  chemically synthesized
agaagcacttgctagagcta

SEQ ID NO: 5493 - DNA, 20 bp, Artificial Sequence
  chemically synthesized
agcacttgctagagctaagg

SEQ ID NO: 5494 - DNA, 20 bp, Artificial Sequence
  chemically synthesized
tgctagagctaaggaagcct

SEQ ID NO: 5495 - DNA, 20 bp, Artificial Sequence
  chemically synthesized
ctagagctaaggaagcctcg

SEQ ID NO: 5496 - DNA, 20 bp, Artificial Sequence
  chemically synthesized
agctaaggaagcctcggagc

SEQ ID NO: 5497 - DNA, 20 bp, Artificial Sequence
  chemically synthesized
aaggaagcctcggagctgga

SEQ ID NO: 5498 - DNA, 20 bp, Artificial Sequence
  chemically synthesized
aggaagcctcggagctggac

SEQ ID NO: 5499 - DNA, 20 bp, Artificial Sequence
  chemically synthesized
ccacccctcatcataacctg

SEQ ID NO: 5500 - DNA, 20 bp, Artificial Sequence
  chemically synthesized
tcatcataacctgaagaaca

SEQ ID NO: 5501 - DNA, 20 bp, Artificial Sequence
  chemically synthesized
atcataacctgaagaacatg

SEQ ID NO: 5502 - DNA, 20 bp, Artificial Sequence
  chemically synthesized
tcataacctgaagaacatgg

SEQ ID NO: 5503 - DNA, 20 bp, Artificial Sequence
  chemically synthesized
acctgaagaacatggaggcc

SEQ ID NO: 5504 - DNA, 20 bp, Artificial Sequence
  chemically synthesized
cctgaagaacatggaggccc

SEQ ID NO: 5505 - DNA, 20 bp, Artificial Sequence
  chemically synthesized
tgaagaacatggaggcccgg

SEQ ID NO: 5506 - DNA, 20 bp, Artificial Sequence
  chemically synthesized
gaagaacatggaggcccggg

SEQ ID NO: 5507 - DNA, 20 bp, Artificial Sequence
  chemically synthesized
aagaacatggaggcccggga

SEQ ID NO: 5508 - DNA, 20 bp, Artificial Sequence
  chemically synthesized
agaacatggaggcccgggag

SEQ ID NO: 5509 - DNA, 20 bp, Artificial Sequence
  chemically synthesized
ggaggggtgtcacttgccca

SEQ ID NO: 5510 - DNA, 20 bp, Artificial Sequence
  chemically synthesized
gtcacttgcccaaagctaca

SEQ ID NO: 5511 - DNA, 20 bp, Artificial Sequence
  chemically synthesized
tcacttgcccaaagctacac

SEQ ID NO: 5512 - DNA, 20 bp, Artificial Sequence
  chemically synthesized
cacttgcccaaagctacaca

SEQ ID NO: 5513 - DNA, 20 bp, Artificial Sequence
  chemically synthesized
acttgcccaaagctacacag

SEQ ID NO: 5514 - DNA, 20 bp, Artificial Sequence
  chemically synthesized
cttgcccaaagctacacagg

SEQ ID NO: 5515 - DNA, 20 bp, Artificial Sequence
  chemically synthesized
gcccaaagctacacaggggg

SEQ ID NO: 5516 - DNA, 20 bp, Artificial Sequence
  chemically synthesized
cccaaagctacacagggggt

SEQ ID NO: 5517 - DNA, 20 bp, Artificial Sequence
  chemically synthesized
ccaaagctacacagggggtg

SEQ ID NO: 5518 - DNA, 20 bp, Artificial Sequence
  chemically synthesized
agctacacagggggtggggc

SEQ ID NO: 5519 - DNA, 20 bp, Artificial Sequence
  chemically synthesized
tacacagggggtggggctgg

SEQ ID NO: 5520 - DNA, 20 bp, Artificial Sequence
  chemically synthesized
acagggggtggggctggaag

SEQ ID NO: 5521 - DNA, 20 bp, Artificial Sequence
  chemically synthesized
gtggggctggaagtggctcc

SEQ ID NO: 5522 - DNA, 20 bp, Artificial Sequence
  chemically synthesized
gctggaagtggctccaagtg

SEQ ID NO: 5523 - DNA, 20 bp, Artificial Sequence
  chemically synthesized
ctggaagtggctccaagtgc

SEQ ID NO: 5524 - DNA, 20 bp, Artificial Sequence
  chemically synthesized
caggttcccccctcattctt

SEQ ID NO: 5525 - DNA, 20 bp, Artificial Sequence
  chemically synthesized
aggttcccccctcattcttc

SEQ ID NO: 5526 - DNA, 20 bp, Artificial Sequence
  chemically synthesized
cccccctcattcttcaggct

SEQ ID NO: 5527 - DNA, 20 bp, Artificial Sequence
  chemically synthesized
ccccctcattcttcaggctt

SEQ ID NO: 5528 - DNA, 20 bp, Artificial Sequence
  chemically synthesized
cccctcattcttcaggctta

SEQ ID NO: 5529 - DNA, 20 bp, Artificial Sequence
  chemically synthesized
tcattcttcaggcttagggc

SEQ ID NO: 5530 - DNA, 20 bp, Artificial Sequence
  chemically synthesized
attcttcaggcttagggctg

SEQ ID NO: 5531 - DNA, 20 bp, Artificial Sequence
  chemically synthesized
ttcttcaggcttagggctgg

SEQ ID NO: 5532 - DNA, 20 bp, Artificial Sequence
  chemically synthesized
ttcaggcttagggctggagg

SEQ ID NO: 5533 - DNA, 20 bp, Artificial Sequence
  chemically synthesized
cttagggctggaggaagcct

SEQ ID NO: 5534 - DNA, 20 bp, Artificial Sequence
  chemically synthesized
gggctggaggaagccttaga

SEQ ID NO: 5535 - DNA, 20 bp, Artificial Sequence
  chemically synthesized
ggaggaagccttagacagcc

SEQ ID NO: 5536 - DNA, 20 bp, Artificial Sequence
  chemically synthesized
tagacagcccagtcctaccc

SEQ ID NO: 5537 - DNA, 20 bp, Artificial Sequence
  chemically synthesized
cagcccagtcctaccccaga

SEQ ID NO: 5538 - DNA, 20 bp, Artificial Sequence
  chemically synthesized
agcccagtcctaccccagac

SEQ ID NO: 5539 - DNA, 20 bp, Artificial Sequence
  chemically synthesized
gcccagtcctaccccagaca

SEQ ID NO: 5540 - DNA, 20 bp, Artificial Sequence
  chemically synthesized
ctaccccagacagggaaact

SEQ ID NO: 5541 - DNA, 20 bp, Artificial Sequence
  chemically synthesized
taccccagacagggaaactg

SEQ ID NO: 5542 - DNA, 20 bp, Artificial Sequence
  chemically synthesized
cagacagggaaactgaggcc

SEQ ID NO: 5543 - DNA, 20 bp, Artificial Sequence
  chemically synthesized
gacagggaaactgaggcctg

SEQ ID NO: 5544 - DNA, 20 bp, Artificial Sequence
  chemically synthesized
cagggaaactgaggcctgga

SEQ ID NO: 5545 - DNA, 20 bp, Artificial Sequence
  chemically synthesized
agggaaactgaggcctggag

SEQ ID NO: 5546 - DNA, 20 bp, Artificial Sequence
  chemically synthesized
gggaaactgaggcctggaga

SEQ ID NO: 5547 - DNA, 20 bp, Artificial Sequence
  chemically synthesized
aactgaggcctggagagggc

SEQ ID NO: 5548 - DNA, 20 bp, Artificial Sequence
  chemically synthesized
agagggccagaaatcaccca

SEQ ID NO: 5549 - DNA, 20 bp, Artificial Sequence
  chemically synthesized
agaaatcacccaaagacaca

SEQ ID NO: 5550 - DNA, 20 bp, Artificial Sequence
  chemically synthesized
cccaaagacacacagcatgt

SEQ ID NO: 5551 - DNA, 20 bp, Artificial Sequence
  chemically synthesized
aagacacacagcatgttggc

SEQ ID NO: 5552 - DNA, 20 bp, Artificial Sequence
  chemically synthesized
acacagcatgttggctggac

SEQ ID NO: 5553 - DNA, 20 bp, Artificial Sequence
  chemically synthesized
agcatgttggctggactgga

SEQ ID NO: 5554 - DNA, 20 bp, Artificial Sequence
  chemically synthesized
catgttggctggactggacg

SEQ ID NO: 5555 - DNA, 20 bp, Artificial Sequence
  chemically synthesized
tggctggactggacggagat

SEQ ID NO: 5556 - DNA, 20 bp, Artificial Sequence
  chemically synthesized
ggactggacggagatcagtc

SEQ ID NO: 5557 - DNA, 20 bp, Artificial Sequence
  chemically synthesized
acggagatcagtccagaccg

SEQ ID NO: 5558 - DNA, 20 bp, Artificial Sequence
  chemically synthesized
cggagatcagtccagaccgc

SEQ ID NO: 5559 - DNA, 20 bp, Artificial Sequence
  chemically synthesized
accgcaggtgccttgatgtt

SEQ ID NO: 5560 - DNA, 20 bp, Artificial Sequence
  chemically synthesized
aggtgccttgatgttcagtc

SEQ ID NO: 5561 - DNA, 20 bp, Artificial Sequence
  chemically synthesized
tgccttgatgttcagtctgg

SEQ ID NO: 5562 - DNA, 20 bp, Artificial Sequence
  chemically synthesized
gccttgatgttcagtctggt

SEQ ID NO: 5563 - DNA, 20 bp, Artificial Sequence
  chemically synthesized
ccatcccacccacctccctt

SEQ ID NO: 5564 - DNA, 20 bp, Artificial Sequence
  chemically synthesized
catcccacccacctcccttt

SEQ ID NO: 5565 - DNA, 20 bp, Artificial Sequence
  chemically synthesized
ctcgatccctcgcccctcac

SEQ ID NO: 5566 - DNA, 20 bp, Artificial Sequence
  chemically synthesized
ccctcaccagtcccccttct

SEQ ID NO: 5567 - DNA, 20 bp, Artificial Sequence
  chemically synthesized
ctcaccagtcccccttctga

SEQ ID NO: 5568 - DNA, 20 bp, Artificial Sequence
  chemically synthesized
ccccttctgagagcccgtat

SEQ ID NO: 5569 - DNA, 20 bp, Artificial Sequence
  chemically synthesized
cttctgagagcccgtattag

SEQ ID NO: 5570 - DNA, 20 bp, Artificial Sequence
  chemically synthesized
ttctgagagcccgtattagc

SEQ ID NO: 5571 - DNA, 20 bp, Artificial Sequence
  chemically synthesized
tctgagagcccgtattagca

SEQ ID NO: 5572 - DNA, 20 bp, Artificial Sequence
  chemically synthesized
tgagagcccgtattagcagg

SEQ ID NO: 5573 - DNA, 20 bp, Artificial Sequence
  chemically synthesized
agcccgtattagcagggagc

SEQ ID NO: 5574 - DNA, 20 bp, Artificial Sequence
  chemically synthesized
gagccggcccctactccttc

SEQ ID NO: 5575 - DNA, 20 bp, Artificial Sequence
  chemically synthesized
ccggcccctactccttctgg

SEQ ID NO: 5576 - DNA, 20 bp, Artificial Sequence
  chemically synthesized
cctactccttctggcagacc

SEQ ID NO: 5577 - DNA, 20 bp, Artificial Sequence
  chemically synthesized
tccttctggcagacccagct

SEQ ID NO: 5578 - DNA, 20 bp, Artificial Sequence
  chemically synthesized
ccttctggcagacccagcta

SEQ ID NO: 5579 - DNA, 20 bp, Artificial Sequence
  chemically synthesized
acccagctaaggttctacct

SEQ ID NO: 5580 - DNA, 20 bp, Artificial Sequence
  chemically synthesized
cccagctaaggttctacctt

SEQ ID NO: 5581 - DNA, 20 bp, Artificial Sequence
  chemically synthesized
ccagctaaggttctacctta

SEQ ID NO: 5582 - DNA, 20 bp, Artificial Sequence
  chemically synthesized
cagctaaggttctaccttag

SEQ ID NO: 5583 - DNA, 20 bp, Artificial Sequence
  chemically synthesized
taggggccacgccacctccc

SEQ ID NO: 5584 - DNA, 20 bp, Artificial Sequence
  chemically synthesized
aggggccacgccacctcccc

SEQ ID NO: 5585 - DNA, 20 bp, Artificial Sequence
  chemically synthesized
ggggccacgccacctcccca

SEQ ID NO: 5586 - DNA, 20 bp, Artificial Sequence
  chemically synthesized
ggccacgccacctccccagg

SEQ ID NO: 5587 - DNA, 20 bp, Artificial Sequence
  chemically synthesized
gccacgccacctccccaggg

SEQ ID NO: 5588 - DNA, 20 bp, Artificial Sequence
  chemically synthesized
ccacgccacctccccaggga

SEQ ID NO: 5589 - DNA, 20 bp, Artificial Sequence
  chemically synthesized
cacgccacctccccagggag

SEQ ID NO: 5590 - DNA, 20 bp, Artificial Sequence
  chemically synthesized
cacctccccagggaggggtc

SEQ ID NO: 5591 - DNA, 20 bp, Artificial Sequence
  chemically synthesized
cctccccagggaggggtcca

SEQ ID NO: 5592 - DNA, 20 bp, Artificial Sequence
  chemically synthesized
ctccccagggaggggtccag

SEQ ID NO: 5593 - DNA, 20 bp, Artificial Sequence
  chemically synthesized
cagggaggggtccagaggca

SEQ ID NO: 5594 - DNA, 20 bp, Artificial Sequence
  chemically synthesized
agggaggggtccagaggcat

SEQ ID NO: 5595 - DNA, 20 bp, Artificial Sequence
  chemically synthesized
gggaggggtccagaggcatg

SEQ ID NO: 5596 - DNA, 20 bp, Artificial Sequence
  chemically synthesized
ggtccagaggcatggggacc

SEQ ID NO: 5597 - DNA, 20 bp, Artificial Sequence
  chemically synthesized
gtccagaggcatggggacct

SEQ ID NO: 5598 - DNA, 20 bp, Artificial Sequence
  chemically synthesized
tccagaggcatggggacctg

SEQ ID NO: 5599 - DNA, 20 bp, Artificial Sequence
  chemically synthesized
gggacctggggtgcccctca

SEQ ID NO: 5600 - DNA, 20 bp, Artificial Sequence
  chemically synthesized
ggacctggggtgcccctcac

SEQ ID NO: 5601 - DNA, 20 bp, Artificial Sequence
  chemically synthesized
cctcacaggacacttccttg

SEQ ID NO: 5602 - DNA, 20 bp, Artificial Sequence
  chemically synthesized
ctcacaggacacttccttgc

SEQ ID NO: 5603 - DNA, 20 bp, Artificial Sequence
  chemically synthesized
aggacacttccttgcaggaa

SEQ ID NO: 5604 - DNA, 20 bp, Artificial Sequence
  chemically synthesized
gacacttccttgcaggaaca

SEQ ID NO: 5605 - DNA, 20 bp, Artificial Sequence
  chemically synthesized
acacttccttgcaggaacag

SEQ ID NO: 5606 - DNA, 20 bp, Artificial Sequence
  chemically synthesized
gcaggaacagaggtgccatg

SEQ ID NO: 5607 - DNA, 20 bp, Artificial Sequence
  chemically synthesized
acagaggtgccatgcagccc

SEQ ID NO: 5608 - DNA, 20 bp, Artificial Sequence
  chemically synthesized
cagaggtgccatgcagcccc

SEQ ID NO: 5609 - DNA, 20 bp, Artificial Sequence
  chemically synthesized
actccttgttgttgccctcc

SEQ ID NO: 5610 - DNA, 20 bp, Artificial Sequence
  chemically synthesized
tgttgccctcctggcgctcc

SEQ ID NO: 5611 - DNA, 20 bp, Artificial Sequence
  chemically synthesized
cgctcctggcctctgcccgt

SEQ ID NO: 5612 - DNA, 20 bp, Artificial Sequence
  chemically synthesized
ggcctctgcccgtaagcact

SEQ ID NO: 5613 - DNA, 20 bp, Artificial Sequence
  chemically synthesized
ctctgcccgtaagcacttgg

SEQ ID NO: 5614 - DNA, 20 bp, Artificial Sequence
  chemically synthesized
tctgcccgtaagcacttggt

SEQ ID NO: 5615 - DNA, 20 bp, Artificial Sequence
  chemically synthesized
ccgtaagcacttggtgggac

SEQ ID NO: 5616 - DNA, 20 bp, Artificial Sequence
  chemically synthesized
cgtaagcacttggtgggact

SEQ ID NO: 5617 - DNA, 20 bp, Artificial Sequence
  chemically synthesized
agcacttggtgggactgggc

SEQ ID NO: 5618 - DNA, 20 bp, Artificial Sequence
  chemically synthesized
gcacttggtgggactgggct

SEQ ID NO: 5619 - DNA, 20 bp, Artificial Sequence
  chemically synthesized
cacttggtgggactgggctg

SEQ ID NO: 5620 - DNA, 20 bp, Artificial Sequence
  chemically synthesized
acttggtgggactgggctgg

SEQ ID NO: 5621 - DNA, 20 bp, Artificial Sequence
  chemically synthesized
tggtgggactgggctggggg

SEQ ID NO: 5622 - DNA, 20 bp, Artificial Sequence
  chemically synthesized
ggtgggactgggctgggggc

SEQ ID NO: 5623 - DNA, 20 bp, Artificial Sequence
  chemically synthesized
gtgggactgggctgggggca

SEQ ID NO: 5624 - DNA, 20 bp, Artificial Sequence
  chemically synthesized
gcccccagcccagtcccacc

SEQ ID NO: 5625 - DNA, 20 bp, Artificial Sequence
  chemically synthesized
ccagtcccaccaagtgctta

SEQ ID NO: 5626 - DNA, 20 bp, Artificial Sequence
  chemically synthesized
cagtcccaccaagtgcttac

SEQ ID NO: 5627 - DNA, 20 bp, Artificial Sequence
  chemically synthesized
tcccaccaagtgcttacggg

SEQ ID NO: 5628 - DNA, 20 bp, Artificial Sequence
  chemically synthesized
ccaccaagtgcttacgggca

SEQ ID NO: 5629 - DNA, 20 bp, Artificial Sequence
  chemically synthesized
caccaagtgcttacgggcag

SEQ ID NO: 5630 - DNA, 20 bp, Artificial Sequence
  chemically synthesized
aagtgcttacgggcagaggc

SEQ ID NO: 5631 - DNA, 20 bp, Artificial Sequence
  chemically synthesized
agtgcttacgggcagaggcc

SEQ ID NO: 5632 - DNA, 20 bp, Artificial Sequence
  chemically synthesized
tgcttacgggcagaggccag

SEQ ID NO: 5633 - DNA, 20 bp, Artificial Sequence
  chemically synthesized
cgggcagaggccaggagcgc

SEQ ID NO: 5634 - DNA, 20 bp, Artificial Sequence
  chemically synthesized
gggcagaggccaggagcgcc

SEQ ID NO: 5635 - DNA, 20 bp, Artificial Sequence
  chemically synthesized
gcagaggccaggagcgccag

SEQ ID NO: 5636 - DNA, 20 bp, Artificial Sequence
  chemically synthesized
cagaggccaggagcgccagg

SEQ ID NO: 5637 - DNA, 20 bp, Artificial Sequence
  chemically synthesized
agaggccaggagcgccagga

SEQ ID NO: 5638 - DNA, 20 bp, Artificial Sequence
  chemically synthesized
agcgccaggagggcaacaac

SEQ ID NO: 5639 - DNA, 20 bp, Artificial Sequence
  chemically synthesized
gcgccaggagggcaacaaca

SEQ ID NO: 5640 - DNA, 20 bp, Artificial Sequence
  chemically synthesized
gccaggagggcaacaacaag

SEQ ID NO: 5641 - DNA, 20 bp, Artificial Sequence
  chemically synthesized
gggcaacaacaaggagtacc

SEQ ID NO: 5642 - DNA, 20 bp, Artificial Sequence
  chemically synthesized
ggcaacaacaaggagtaccc

SEQ ID NO: 5643 - DNA, 20 bp, Artificial Sequence
  chemically synthesized
gcaacaacaaggagtacccg

SEQ ID NO: 5644 - DNA, 20 bp, Artificial Sequence
  chemically synthesized
aaggagtacccggggctgca

SEQ ID NO: 5645 - DNA, 20 bp, Artificial Sequence
  chemically synthesized
catggcacctctgttcctgc

SEQ ID NO: 5646 - DNA, 20 bp, Artificial Sequence
  chemically synthesized
atggcacctctgttcctgca

SEQ ID NO: 5647 - DNA, 20 bp, Artificial Sequence
  chemically synthesized
gcacctctgttcctgcaagg

SEQ ID NO: 5648 - DNA, 20 bp, Artificial Sequence
  chemically synthesized
cctgcaaggaagtgtcctgt

SEQ ID NO: 5649 - DNA, 20 bp, Artificial Sequence
  chemically synthesized
ctgcaaggaagtgtcctgtg

SEQ ID NO: 5650 - DNA, 20 bp, Artificial Sequence
  chemically synthesized
tgcaaggaagtgtcctgtga

SEQ ID NO: 5651 - DNA, 20 bp, Artificial Sequence
  chemically synthesized
gcaaggaagtgtcctgtgag

SEQ ID NO: 5652 - DNA, 20 bp, Artificial Sequence
  chemically synthesized
gtgtcctgtgaggggcaccc

SEQ ID NO: 5653 - DNA, 20 bp, Artificial Sequence
  chemically synthesized
tgtcctgtgaggggcacccc

SEQ ID NO: 5654 - DNA, 20 bp, Artificial Sequence
  chemically synthesized
accccaggtccccatgcctc

SEQ ID NO: 5655 - DNA, 20 bp, Artificial Sequence
  chemically synthesized
catgcctctggacccctccc

SEQ ID NO: 5656 - DNA, 20 bp, Artificial Sequence
  chemically synthesized
atgcctctggacccctccct

SEQ ID NO: 5657 - DNA, 20 bp, Artificial Sequence
  chemically synthesized
tgcctctggacccctccctg

SEQ ID NO: 5658 - DNA, 20 bp, Artificial Sequence
  chemically synthesized
cctctggacccctccctggg

SEQ ID NO: 5659 - DNA, 20 bp, Artificial Sequence
  chemically synthesized
ctctggacccctccctgggg

SEQ ID NO: 5660 - DNA, 20 bp, Artificial Sequence
  chemically synthesized
tggacccctccctggggagg

SEQ ID NO: 5661 - DNA, 20 bp, Artificial Sequence
  chemically synthesized
ccctccctggggaggtggcg

SEQ ID NO: 5662 - DNA, 20 bp, Artificial Sequence
  chemically synthesized
ggggaggtggcgtggcccct

SEQ ID NO: 5663 - DNA, 20 bp, Artificial Sequence
  chemically synthesized
gggaggtggcgtggccccta

SEQ ID NO: 5664 - DNA, 20 bp, Artificial Sequence
  chemically synthesized
aggtggcgtggcccctaagg

SEQ ID NO: 5665 - DNA, 20 bp, Artificial Sequence
  chemically synthesized
tggcccctaaggtagaacct

SEQ ID NO: 5666 - DNA, 20 bp, Artificial Sequence
  chemically synthesized
ccctaaggtagaaccttagc

SEQ ID NO: 5667 - DNA, 20 bp, Artificial Sequence
  chemically synthesized
cctaaggtagaaccttagct

SEQ ID NO: 5668 - DNA, 20 bp, Artificial Sequence
  chemically synthesized
agaaccttagctgggtctgc

SEQ ID NO: 5669 - DNA, 20 bp, Artificial Sequence
  chemically synthesized
accttagctgggtctgccag

SEQ ID NO: 5670 - DNA, 20 bp, Artificial Sequence
  chemically synthesized
ccttagctgggtctgccaga

SEQ ID NO: 5671 - DNA, 20 bp, Artificial Sequence
  chemically synthesized
ttagctgggtctgccagaag

SEQ ID NO: 5672 - DNA, 20 bp, Artificial Sequence
  chemically synthesized
gctgggtctgccagaaggag

SEQ ID NO: 5673 - DNA, 20 bp, Artificial Sequence
  chemically synthesized
ctgggtctgccagaaggagt

SEQ ID NO: 5674 - DNA, 20 bp, Artificial Sequence
  chemically synthesized
tgggtctgccagaaggagta

SEQ ID NO: 5675 - DNA, 20 bp, Artificial Sequence
  chemically synthesized
gggtctgccagaaggagtag

SEQ ID NO: 5676 - DNA, 20 bp, Artificial Sequence
  chemically synthesized
ctgccagaaggagtaggggc

SEQ ID NO: 5677 - DNA, 20 bp, Artificial Sequence
  chemically synthesized
gggccggctccctgctaata

SEQ ID NO: 5678 - DNA, 20 bp, Artificial Sequence
  chemically synthesized
ggccggctccctgctaatac

SEQ ID NO: 5679 - DNA, 20 bp, Artificial Sequence
  chemically synthesized
tccctgctaatacgggctct

SEQ ID NO: 5680 - DNA, 20 bp, Artificial Sequence
  chemically synthesized
ctgctaatacgggctctcag

SEQ ID NO: 5681 - DNA, 20 bp, Artificial Sequence
  chemically synthesized
tgctaatacgggctctcaga

SEQ ID NO: 5682 - DNA, 20 bp, Artificial Sequence
  chemically synthesized
gctaatacgggctctcagaa

SEQ ID NO: 5683 - DNA, 20 bp, Artificial Sequence
  chemically synthesized
ctaatacgggctctcagaag

SEQ ID NO: 5684 - DNA, 20 bp, Artificial Sequence
  chemically synthesized
taatacgggctctcagaagg

SEQ ID NO: 5685 - DNA, 20 bp, Artificial Sequence
  chemically synthesized
cgggctctcagaagggggac

SEQ ID NO: 5686 - DNA, 20 bp, Artificial Sequence
  chemically synthesized
ctctcagaagggggactggt

SEQ ID NO: 5687 - DNA, 20 bp, Artificial Sequence
  chemically synthesized
tctcagaagggggactggtg

SEQ ID NO: 5688 - DNA, 20 bp, Artificial Sequence
  chemically synthesized
ctcagaagggggactggtga

SEQ ID NO: 5689 - DNA, 20 bp, Artificial Sequence
  chemically synthesized
tcagaagggggactggtgag

SEQ ID NO: 5690 - DNA, 20 bp, Artificial Sequence
  chemically synthesized
aagggggactggtgaggggc

SEQ ID NO: 5691 - DNA, 20 bp, Artificial Sequence
  chemically synthesized
agggggactggtgaggggcg

SEQ ID NO: 5692 - DNA, 20 bp, Artificial Sequence
  chemically synthesized
gggggactggtgaggggcga

SEQ ID NO: 5693 - DNA, 20 bp, Artificial Sequence
  chemically synthesized
ctggtgaggggcgagggatc

SEQ ID NO: 5694 - DNA, 20 bp, Artificial Sequence
  chemically synthesized
tggtgaggggcgagggatcg

SEQ ID NO: 5695 - DNA, 20 bp, Artificial Sequence
  chemically synthesized
gggcgagggatcgaggccca

SEQ ID NO: 5696 - DNA, 20 bp, Artificial Sequence
  chemically synthesized
ggcgagggatcgaggcccaa

SEQ ID NO: 5697 - DNA, 20 bp, Artificial Sequence
  chemically synthesized
gcgagggatcgaggcccaaa

SEQ ID NO: 5698 - DNA, 20 bp, Artificial Sequence
  chemically synthesized
gagggatcgaggcccaaagg

SEQ ID NO: 5699 - DNA, 20 bp, Artificial Sequence
  chemically synthesized
agggatcgaggcccaaaggg

SEQ ID NO: 5700 - DNA, 20 bp, Artificial Sequence
  chemically synthesized
gatcgaggcccaaagggagg

SEQ ID NO: 5701 - DNA, 20 bp, Artificial Sequence
  chemically synthesized
atcgaggcccaaagggaggt

SEQ ID NO: 5702 - DNA, 20 bp, Artificial Sequence
  chemically synthesized
gaggcccaaagggaggtggg

SEQ ID NO: 5703 - DNA, 20 bp, Artificial Sequence
  chemically synthesized
aggcccaaagggaggtgggt

SEQ ID NO: 5704 - DNA, 20 bp, Artificial Sequence
  chemically synthesized
ccaaagggaggtgggtggga

SEQ ID NO: 5705 - DNA, 20 bp, Artificial Sequence
  chemically synthesized
aaagggaggtgggtgggatg

SEQ ID NO: 5706 - DNA, 20 bp, Artificial Sequence
  chemically synthesized
gggaggtgggtgggatggag

SEQ ID NO: 5707 - DNA, 20 bp, Artificial Sequence
  chemically synthesized
ggatggagcagaaaacccac

SEQ ID NO: 5708 - DNA, 20 bp, Artificial Sequence
  chemically synthesized
aacccaccagactgaacatc

SEQ ID NO: 5709 - DNA, 20 bp, Artificial Sequence
  chemically synthesized
acccaccagactgaacatca

SEQ ID NO: 5710 - DNA, 20 bp, Artificial Sequence
  chemically synthesized
actgaacatcaaggcacctg

SEQ ID NO: 5711 - DNA, 20 bp, Artificial Sequence
  chemically synthesized
acatcaaggcacctgcggtc

SEQ ID NO: 5712 - DNA, 20 bp, Artificial Sequence
  chemically synthesized
ggtctggactgatctccgtc

SEQ ID NO: 5713 - DNA, 20 bp, Artificial Sequence
  chemically synthesized
ggactgatctccgtccagtc

SEQ ID NO: 5714 - DNA, 20 bp, Artificial Sequence
  chemically synthesized
gccaacatgctgtgtgtctt

SEQ ID NO: 5715 - DNA, 20 bp, Artificial Sequence
  chemically synthesized
ccaacatgctgtgtgtcttt

SEQ ID NO: 5716 - DNA, 20 bp, Artificial Sequence
  chemically synthesized
gtgtgtctttgggtgatttc

SEQ ID NO: 5717 - DNA, 20 bp, Artificial Sequence
  chemically synthesized
gggtgatttctggccctctc

SEQ ID NO: 5718 - DNA, 20 bp, Artificial Sequence
  chemically synthesized
ggtgatttctggccctctcc

SEQ ID NO: 5719 - DNA, 20 bp, Artificial Sequence
  chemically synthesized
ttctggccctctccaggcct

SEQ ID NO: 5720 - DNA, 20 bp, Artificial Sequence
  chemically synthesized
caggcctcagtttccctgtc

SEQ ID NO: 5721 - DNA, 20 bp, Artificial Sequence
  chemically synthesized
aggcctcagtttccctgtct

SEQ ID NO: 5722 - DNA, 20 bp, Artificial Sequence
  chemically synthesized
ggcctcagtttccctgtctg

SEQ ID NO: 5723 - DNA, 20 bp, Artificial Sequence
  chemically synthesized
ctcagtttccctgtctgggg

SEQ ID NO: 5724 - DNA, 20 bp, Artificial Sequence
  chemically synthesized
tcagtttccctgtctggggt

SEQ ID NO: 5725 - DNA, 20 bp, Artificial Sequence
  chemically synthesized
ttccctgtctggggtaggac

SEQ ID NO: 5726 - DNA, 20 bp, Artificial Sequence
  chemically synthesized
tccctgtctggggtaggact

SEQ ID NO: 5727 - DNA, 20 bp, Artificial Sequence
  chemically synthesized
ggggtaggactgggctgtct

SEQ ID NO: 5728 - DNA, 20 bp, Artificial Sequence
  chemically synthesized
gggtaggactgggctgtcta

SEQ ID NO: 5729 - DNA, 20 bp, Artificial Sequence
  chemically synthesized
gggctgtctaaggcttcctc

SEQ ID NO: 5730 - DNA, 20 bp, Artificial Sequence
  chemically synthesized
ctaaggcttcctccagccct

SEQ ID NO: 5731 - DNA, 20 bp, Artificial Sequence
  chemically synthesized
ttcctccagccctaagcctg

SEQ ID NO: 5732 - DNA, 20 bp, Artificial Sequence
  chemically synthesized
cagccctaagcctgaagaat

SEQ ID NO: 5733 - DNA, 20 bp, Artificial Sequence
  chemically synthesized
agccctaagcctgaagaatg

SEQ ID NO: 5734 - DNA, 20 bp, Artificial Sequence
  chemically synthesized
gccctaagcctgaagaatga

SEQ ID NO: 5735 - DNA, 20 bp, Artificial Sequence
  chemically synthesized
ccctaagcctgaagaatgag

SEQ ID NO: 5736 - DNA, 20 bp, Artificial Sequence
  chemically synthesized
cctaagcctgaagaatgagg

SEQ ID NO: 5737 - DNA, 20 bp, Artificial Sequence
  chemically synthesized
ctaagcctgaagaatgaggg

SEQ ID NO: 5738 - DNA, 20 bp, Artificial Sequence
  chemically synthesized
atgaggggggaacctgcact

SEQ ID NO: 5739 - DNA, 20 bp, Artificial Sequence
  chemically synthesized
gaggggggaacctgcacttg

SEQ ID NO: 5740 - DNA, 20 bp, Artificial Sequence
  chemically synthesized
cctgcacttggagccacttc

SEQ ID NO: 5741 - DNA, 20 bp, Artificial Sequence
  chemically synthesized
ttccagccccaccccctgtg

SEQ ID NO: 5742 - DNA, 20 bp, Artificial Sequence
  chemically synthesized
ccccaccccctgtgtagctt

SEQ ID NO: 5743 - DNA, 20 bp, Artificial Sequence
  chemically synthesized
cccaccccctgtgtagcttt

SEQ ID NO: 5744 - DNA, 20 bp, Artificial Sequence
  chemically synthesized
ccccctgtgtagctttgggc

SEQ ID NO: 5745 - DNA, 20 bp, Artificial Sequence
  chemically synthesized
tgggcaagtgacacccctcc

SEQ ID NO: 5746 - DNA, 20 bp, Artificial Sequence
  chemically synthesized
gggcaagtgacacccctccc

SEQ ID NO: 5747 - DNA, 20 bp, Artificial Sequence
  chemically synthesized
tcccgggcctccatgttctt

SEQ ID NO: 5748 - DNA, 20 bp, Artificial Sequence
  chemically synthesized
cccgggcctccatgttcttc

SEQ ID NO: 5749 - DNA, 20 bp, Artificial Sequence
  chemically synthesized
catgttcttcaggttatgat

SEQ ID NO: 5750 - DNA, 20 bp, Artificial Sequence
  chemically synthesized
atgttcttcaggttatgatg

SEQ ID NO: 5751 - DNA, 20 bp, Artificial Sequence
  chemically synthesized
tgttcttcaggttatgatga

SEQ ID NO: 5752 - DNA, 20 bp, Artificial Sequence
  chemically synthesized
gttcttcaggttatgatgag

SEQ ID NO: 5753 - DNA, 20 bp, Artificial Sequence
  chemically synthesized
cttcaggttatgatgagggg

SEQ ID NO: 5754 - DNA, 20 bp, Artificial Sequence
  chemically synthesized
ttcaggttatgatgaggggt

SEQ ID NO: 5755 - DNA, 20 bp, Artificial Sequence
  chemically synthesized
tcaggttatgatgaggggtg

SEQ ID NO: 5756 - DNA, 20 bp, Artificial Sequence
  chemically synthesized
caggttatgatgaggggtgg

SEQ ID NO: 5757 - DNA, 20 bp, Artificial Sequence
  chemically synthesized
aggttatgatgaggggtggg

SEQ ID NO: 5758 - DNA, 20 bp, Artificial Sequence
  chemically synthesized
aggggtggggggcacccgtc

SEQ ID NO: 5759 - DNA, 20 bp, Artificial Sequence
  chemically synthesized
gggggcacccgtccagctcc

SEQ ID NO: 5760 - DNA, 20 bp, Artificial Sequence
  chemically synthesized
ggggcacccgtccagctccg

SEQ ID NO: 5761 - DNA, 20 bp, Artificial Sequence
  chemically synthesized
gtccagctccgaggcttcct

SEQ ID NO: 5762 - DNA, 20 bp, Artificial Sequence
  chemically synthesized
ctccgaggcttccttagctc

SEQ ID NO: 5763 - DNA, 20 bp, Artificial Sequence
  chemically synthesized
gaggcttccttagctctagc

SEQ ID NO: 5764 - DNA, 20 bp, Artificial Sequence
  chemically synthesized
agctctagcaagtgcttctc

SEQ ID NO: 5765 - DNA, 20 bp, Artificial Sequence
  chemically synthesized
gctctagcaagtgcttctcc

SEQ ID NO: 5766 - DNA, 20 bp, Artificial Sequence
  chemically synthesized
aagtgcttctccaggcttgc

SEQ ID NO: 5767 - DNA, 20 bp, Artificial Sequence
  chemically synthesized
gcttctccaggcttgctggc

SEQ ID NO: 5768 - DNA, 20 bp, Artificial Sequence
  chemically synthesized
cttctccaggcttgctggct

SEQ ID NO: 5769 - DNA, 20 bp, Artificial Sequence
  chemically synthesized
tccaggcttgctggctgggc

SEQ ID NO: 5770 - DNA, 20 bp, Artificial Sequence
  chemically synthesized
ccaggcttgctggctgggct

SEQ ID NO: 5771 - DNA, 20 bp, Artificial Sequence
  chemically synthesized
ggcttgctggctgggctggg

SEQ ID NO: 5772 - DNA, 20 bp, Artificial Sequence
  chemically synthesized
gcttgctggctgggctgggc

SEQ ID NO: 5773 - DNA, 20 bp, Artificial Sequence
  chemically synthesized
cttgctggctgggctgggca

SEQ ID NO: 5774 - DNA, 20 bp, Artificial Sequence
  chemically synthesized
tgctggctgggctgggcagg

SEQ ID NO: 5775 - DNA, 20 bp, Artificial Sequence
  chemically synthesized
cccctcctctttcccctccc

SEQ ID NO: 5776 - DNA, 20 bp, Artificial Sequence
  chemically synthesized
cctcctctttcccctcccca

SEQ ID NO: 5777 - DNA, 20 bp, Artificial Sequence
  chemically synthesized
ctcctctttcccctccccag

SEQ ID NO: 5778 - DNA, 20 bp, Artificial Sequence
  chemically synthesized
tcctctttcccctccccaga

SEQ ID NO: 5779 - DNA, 20 bp, Artificial Sequence
  chemically synthesized
cctccccagagggcattacc

SEQ ID NO: 5780 - DNA, 20 bp, Artificial Sequence
  chemically synthesized
tccccagagggcattacctg

SEQ ID NO: 5781 - DNA, 20 bp, Artificial Sequence
  chemically synthesized
ccagagggcattacctggag

SEQ ID NO: 5782 - DNA, 20 bp, Artificial Sequence
  chemically synthesized
ttacctggagcagctgcctc

SEQ ID NO: 5783 - DNA, 20 bp, Artificial Sequence
  chemically synthesized
tacctggagcagctgcctct

SEQ ID NO: 5784 - DNA, 20 bp, Artificial Sequence
  chemically synthesized
acctggagcagctgcctcta

SEQ ID NO: 5785 - DNA, 20 bp, Artificial Sequence
  chemically synthesized
gctgcctctagggatgaact

SEQ ID NO: 5786 - DNA, 20 bp, Artificial Sequence
  chemically synthesized
gcctctagggatgaactgag

SEQ ID NO: 5787 - DNA, 20 bp, Artificial Sequence
  chemically synthesized
ctagggatgaactgagcaga

SEQ ID NO: 5788 - DNA, 20 bp, Artificial Sequence
  chemically synthesized
tagggatgaactgagcagac

SEQ ID NO: 5789 - DNA, 20 bp, Artificial Sequence
  chemically synthesized
ggatgaactgagcagacagg

SEQ ID NO: 5790 - DNA, 20 bp, Artificial Sequence
  chemically synthesized
gatgaactgagcagacaggc

SEQ ID NO: 5791 - DNA, 20 bp, Artificial Sequence
  chemically synthesized
tgaactgagcagacaggcag

SEQ ID NO: 5792 - DNA, 20 bp, Artificial Sequence
  chemically synthesized
gaactgagcagacaggcagg

SEQ ID NO: 5793 - DNA, 20 bp, Artificial Sequence
  chemically synthesized
aactgagcagacaggcagga

SEQ ID NO: 5794 - DNA, 20 bp, Artificial Sequence
  chemically synthesized
gacctgttttatatcatctc

SEQ ID NO: 5795 - DNA, 20 bp, Artificial Sequence
  chemically synthesized
acctgttttatatcatctcc

SEQ ID NO: 5796 - DNA, 20 bp, Artificial Sequence
  chemically synthesized
cctgttttatatcatctcca

SEQ ID NO: 5797 - DNA, 20 bp, Artificial Sequence
  chemically synthesized
gttttatatcatctccaggg

SEQ ID NO: 5798 - DNA, 20 bp, Artificial Sequence
  chemically synthesized
ttatatcatctccagggcag

SEQ ID NO: 5799 - DNA, 20 bp, Artificial Sequence
  chemically synthesized
tatatcatctccagggcagc

SEQ ID NO: 5800 - DNA, 20 bp, Artificial Sequence
  chemically synthesized
tctccagggcagcaggcact

SEQ ID NO: 5801 - DNA, 20 bp, Artificial Sequence
  chemically synthesized
ctccagggcagcaggcactg

SEQ ID NO: 5802 - DNA, 20 bp, Artificial Sequence
  chemically synthesized
ggcagcaggcactgaggacc

SEQ ID NO: 5803 - DNA, 20 bp, Artificial Sequence
  chemically synthesized
gcagcaggcactgaggaccc

SEQ ID NO: 5804 - DNA, 20 bp, Artificial Sequence
  chemically synthesized
cagcaggcactgaggaccca

SEQ ID NO: 5805 - DNA, 20 bp, Artificial Sequence
  chemically synthesized
gcactgaggacccagggcgc

SEQ ID NO: 5806 - DNA, 20 bp, Artificial Sequence
  chemically synthesized
cactgaggacccagggcgct

SEQ ID NO: 5807 - DNA, 20 bp, Artificial Sequence
  chemically synthesized
aggacccagggcgctgggca

SEQ ID NO: 5808 - DNA, 20 bp, Artificial Sequence
  chemically synthesized
ggacccagggcgctgggcaa

SEQ ID NO: 5809 - DNA, 20 bp, Artificial Sequence
  chemically synthesized
ggcaaaggtcacctgctgac

SEQ ID NO: 5810 - DNA, 20 bp, Artificial Sequence
  chemically synthesized
aaaggtcacctgctgaccag

SEQ ID NO: 5811 - DNA, 20 bp, Artificial Sequence
  chemically synthesized
aggtcacctgctgaccagtg

SEQ ID NO: 5812 - DNA, 20 bp, Artificial Sequence
  chemically synthesized
acctgctgaccagtggagat

SEQ ID NO: 5813 - DNA, 20 bp, Artificial Sequence
  chemically synthesized
cctgctgaccagtggagatg

SEQ ID NO: 5814 - DNA, 20 bp, Artificial Sequence
  chemically synthesized
ctgctgaccagtggagatga

SEQ ID NO: 5815 - DNA, 20 bp, Artificial Sequence
  chemically synthesized
accagtggagatgagggcct

SEQ ID NO: 5816 - DNA, 20 bp, Artificial Sequence
  chemically synthesized
ccagtggagatgagggcctg

SEQ ID NO: 5817 - DNA, 20 bp, Artificial Sequence
  chemically synthesized
gtggagatgagggcctgagg

SEQ ID NO: 5818 - DNA, 20 bp, Artificial Sequence
  chemically synthesized
tggagatgagggcctgaggc

SEQ ID NO: 5819 - DNA, 20 bp, Artificial Sequence
  chemically synthesized
ggagatgagggcctgaggca

SEQ ID NO: 5820 - DNA, 20 bp, Artificial Sequence
  chemically synthesized
agggcctgaggcagggtgtc

SEQ ID NO: 5821 - DNA, 20 bp, Artificial Sequence
  chemically synthesized
tgaggcagggtgtccagatg

SEQ ID NO: 5822 - DNA, 20 bp, Artificial Sequence
  chemically synthesized
gcagggtgtccagatgcagc

SEQ ID NO: 5823 - DNA, 20 bp, Artificial Sequence
  chemically synthesized
gggtgtccagatgcagcaag

SEQ ID NO: 5824 - DNA, 20 bp, Artificial Sequence
  chemically synthesized
ggtgtccagatgcagcaagc

SEQ ID NO: 5825 - DNA, 20 bp, Artificial Sequence
  chemically synthesized
gtccagatgcagcaagcggg

SEQ ID NO: 5826 - DNA, 20 bp, Artificial Sequence
  chemically synthesized
tccagatgcagcaagcgggc

SEQ ID NO: 5827 - DNA, 20 bp, Artificial Sequence
  chemically synthesized
cagatgcagcaagcgggcgg

SEQ ID NO: 5828 - DNA, 20 bp, Artificial Sequence
  chemically synthesized
gatgcagcaagcgggcggga

SEQ ID NO: 5829 - DNA, 20 bp, Artificial Sequence
  chemically synthesized
cagcaagcgggcgggagagt

SEQ ID NO: 5830 - DNA, 20 bp, Artificial Sequence
  chemically synthesized
agcaagcgggcgggagagtt

SEQ ID NO: 5831 - DNA, 20 bp, Artificial Sequence
  chemically synthesized
cgggagagttgggaaatccc

SEQ ID NO: 5832 - DNA, 20 bp, Artificial Sequence
  chemically synthesized
gggagagttgggaaatccct

SEQ ID NO: 5833 - DNA, 20 bp, Artificial Sequence
  chemically synthesized
gagagttgggaaatccctag

SEQ ID NO: 5834 - DNA, 20 bp, Artificial Sequence
  chemically synthesized
tgggaaatccctaggagact

SEQ ID NO: 5835 - DNA, 20 bp, Artificial Sequence
  chemically synthesized
ggtgacctttgcccagcgcc

SEQ ID NO: 5836 - DNA, 20 bp, Artificial Sequence
  chemically synthesized
gaggggaaagaggaggggag

SEQ ID NO: 5837 - DNA, 20 bp, Artificial Sequence
  chemically synthesized
taaggaagcctcggagctgg

SEQ ID NO: 5838 - DNA, 20 bp, Artificial Sequence
  chemically synthesized
gaagaacatggaggcccggg

SEQ ID NO: 5839 - DNA, 20 bp, Artificial Sequence
  chemically synthesized
cacttgcccaaagctacaca

SEQ ID NO: 5840 - DNA, 20 bp, Artificial Sequence
  chemically synthesized
gtgccttgatgttcagtctg

SEQ ID NO: 5841 - DNA, 20 bp, Artificial Sequence
  chemically synthesized
gccacgccacctccccaggg

SEQ ID NO: 5842 - DNA, 20 bp, Artificial Sequence
  chemically synthesized
ggtccagaggcatggggacc

SEQ ID NO: 5843 - DNA, 20 bp, Artificial Sequence
  chemically synthesized
aacagaggtgccatgcagcc

SEQ ID NO: 5844 - DNA, 20 bp, Artificial Sequence
  chemically synthesized
tggtgggactgggctggggg

SEQ ID NO: 5845 - DNA, 20 bp, Artificial Sequence
  chemically synthesized
gcgccaggagggcaacaaca

SEQ ID NO: 5846 - DNA, 20 bp, Artificial Sequence
  chemically synthesized
cccctaaggtagaaccttag

SEQ ID NO: 5847 - DNA, 20 bp, Artificial Sequence
  chemically synthesized
ccttagctgggtctgccaga

SEQ ID NO: 5848 - DNA, 20 bp, Artificial Sequence
  chemically synthesized
agggggactggtgaggggcg

SEQ ID NO: 5849 - DNA, 20 bp, Artificial Sequence
  chemically synthesized
ggatcgaggcccaaagggag

SEQ ID NO: 5850 - DNA, 20 bp, Artificial Sequence
  chemically synthesized
gaggcccaaagggaggtggg

SEQ ID NO: 5851 - DNA, 20 bp, Artificial Sequence
  chemically synthesized
agccaacatgctgtgtgtct

SEQ ID NO: 5852 - DNA, 20 bp, Artificial Sequence
  chemically synthesized
caggcctcagtttccctgtc

SEQ ID NO: 5853 - DNA, 20 bp, Artificial Sequence
  chemically synthesized
ttcctccagccctaagcctg

SEQ ID NO: 5854 - DNA, 20 bp, Artificial Sequence
  chemically synthesized
atgttcttcaggttatgatg

SEQ ID NO: 5855 - DNA, 20 bp, Artificial Sequence
  chemically synthesized
tacctggagcagctgcctct

SEQ ID NO: 5856 - DNA, 20 bp, Artificial Sequence
  chemically synthesized
tgaactgagcagacaggcag

SEQ ID NO: 5857 - DNA, 20 bp, Artificial Sequence
  chemically synthesized
gtggagatgagggcctgagg

SEQ ID NO: 5858 - DNA, 20 bp, Artificial Sequence
  chemically synthesized
cagatgcagcaagcgggcgg

SEQ ID NO: 5859 - DNA, 20 bp, Artificial Sequence
  chemically synthesized
gttgggaaatccctaggaga

SEQ ID NO: 5860 - DNA, 20 bp, Artificial Sequence
  chemically synthesized
aaactgaggcctggagaggg

SEQ ID NO: 5861 - DNA, 20 bp, Artificial Sequence
  chemically synthesized
agggaggtgggtgggatgga

SEQ ID NO: 5862 - DNA, 20 bp, Artificial Sequence
  chemically synthesized
cttcctccagccctaagcct

SEQ ID NO: 5863 - DNA, 20 bp, Artificial Sequence
  chemically synthesized
ctgctgccctggagatgata

SEQ ID NO: 5864 - DNA, 20 bp, Artificial Sequence
  chemically synthesized
gaggtgggtgggatggagca

SEQ ID NO: 5865 - DNA, 20 bp, Artificial Sequence
  chemically synthesized
agggatttcccaactctccc

SEQ ID NO: 5866 - DNA, 20 bp, Artificial Sequence
  chemically synthesized
gcaggttcccccctcattct

SEQ ID NO: 5867 - DNA, 20 bp, Artificial Sequence
  chemically synthesized
gtgccttgatgttcagtctg

SEQ ID NO: 5868 - DNA, 20 bp, Artificial Sequence
  chemically synthesized
gcccccagcccagtcccacc

SEQ ID NO: 5869 - DNA, 20 bp, Artificial Sequence
  chemically synthesized
ccaacatgctgtgtgtcttt

SEQ ID NO: 5870 - DNA, 20 bp, Artificial Sequence
  chemically synthesized
atttctggccctctccaggc

SEQ ID NO: 5871 - DNA, 20 bp, Artificial Sequence
  chemically synthesized
tggggtaggactgggctgtc

SEQ ID NO: 5872 - DNA, 20 bp, Artificial Sequence
  chemically synthesized
acttccagccccaccccctg

SEQ ID NO: 5873 - DNA, 20 bp, Artificial Sequence
  chemically synthesized
ggggggcacccgtccagctc

SEQ ID NO: 5874 - DNA, 20 bp, Artificial Sequence
  chemically synthesized
gaggcttccttagctctagc

SEQ ID NO: 5875 - DNA, 20 bp, Artificial Sequence
  chemically synthesized
tagctctagcaagtgcttct

SEQ ID NO: 5876 - DNA, 20 bp, Artificial Sequence
  chemically synthesized
agacaggcaggagggttctg

SEQ ID NO: 5877 - DNA, 22 bp, Artificial Sequence
  chemically synthesized
agtctcctagggatttcccaac

SEQ ID NO: 5878 - DNA, 22 bp, Artificial Sequence
  chemically synthesized
ctagggatttcccaactctccc

SEQ ID NO: 5879 - DNA, 22 bp, Artificial Sequence
  chemically synthesized
gggatttcccaactctcccgcc

SEQ ID NO: 5880 - DNA, 22 bp, Artificial Sequence
  chemically synthesized
cccaactctcccgcccgcttgc

SEQ ID NO: 5881 - DNA, 22 bp, Artificial Sequence
  chemically synthesized
ccaactctcccgcccgcttgct

SEQ ID NO: 5882 - DNA, 22 bp, Artificial Sequence
  chemically synthesized
tcccgcccgcttgctgcatctg

SEQ ID NO: 5883 - DNA, 22 bp, Artificial Sequence
  chemically synthesized
ccgcccgcttgctgcatctgga

SEQ ID NO: 5884 - DNA, 22 bp, Artificial Sequence
  chemically synthesized
gctgcatctggacaccctgcct

SEQ ID NO: 5885 - DNA, 22 bp, Artificial Sequence
  chemically synthesized
ctgcatctggacaccctgcctc

SEQ ID NO: 5886 - DNA, 22 bp, Artificial Sequence
  chemically synthesized
catctggacaccctgcctcagg

SEQ ID NO: 5887 - DNA, 22 bp, Artificial Sequence
  chemically synthesized
gacaccctgcctcaggccctca

SEQ ID NO: 5888 - DNA, 22 bp, Artificial Sequence
  chemically synthesized
cctcaggccctcatctccactg

SEQ ID NO: 5889 - DNA, 22 bp, Artificial Sequence
  chemically synthesized
aggccctcatctccactggtca

SEQ ID NO: 5890 - DNA, 22 bp, Artificial Sequence
  chemically synthesized
atctccactggtcagcaggtga

SEQ ID NO: 5891 - DNA, 22 bp, Artificial Sequence
  chemically synthesized
cactggtcagcaggtgaccttt

SEQ ID NO: 5892 - DNA, 22 bp, Artificial Sequence
  chemically synthesized
gtcagcaggtgacctttgccca

SEQ ID NO: 5893 - DNA, 22 bp, Artificial Sequence
  chemically synthesized
tgcccagcgccctgggtcctca

SEQ ID NO: 5894 - DNA, 22 bp, Artificial Sequence
  chemically synthesized
gcccagcgccctgggtcctcag

SEQ ID NO: 5895 - DNA, 22 bp, Artificial Sequence
  chemically synthesized
cccagcgccctgggtcctcagt

SEQ ID NO: 5896 - DNA, 22 bp, Artificial Sequence
  chemically synthesized
ggtcctcagtgcctgctgccct

SEQ ID NO: 5897 - DNA, 22 bp, Artificial Sequence
  chemically synthesized
agtgcctgctgccctggagatg

SEQ ID NO: 5898 - DNA, 22 bp, Artificial Sequence
  chemically synthesized
ctgccctggagatgatataaaa

SEQ ID NO: 5899 - DNA, 22 bp, Artificial Sequence
  chemically synthesized
ccctggagatgatataaaacag

SEQ ID NO: 5900 - DNA, 22 bp, Artificial Sequence
  chemically synthesized
gagatgatataaaacaggtcag

SEQ ID NO: 5901 - DNA, 22 bp, Artificial Sequence
  chemically synthesized
ctgcctgtctgctcagttcatc

SEQ ID NO: 5902 - DNA, 22 bp, Artificial Sequence
  chemically synthesized
cctgtctgctcagttcatccct

SEQ ID NO: 5903 - DNA, 22 bp, Artificial Sequence
  chemically synthesized
tctgctcagttcatccctagag

SEQ ID NO: 5904 - DNA, 22 bp, Artificial Sequence
  chemically synthesized
ctcagttcatccctagaggcag

SEQ ID NO: 5905 - DNA, 22 bp, Artificial Sequence
  chemically synthesized
agttcatccctagaggcagctg

SEQ ID NO: 5906 - DNA, 22 bp, Artificial Sequence
  chemically synthesized
atccctagaggcagctgctcca

SEQ ID NO: 5907 - DNA, 22 bp, Artificial Sequence
  chemically synthesized
gaggcagctgctccaggtaatg

SEQ ID NO: 5908 - DNA, 22 bp, Artificial Sequence
  chemically synthesized
ctccaggtaatgccctctgggg

SEQ ID NO: 5909 - DNA, 22 bp, Artificial Sequence
  chemically synthesized
caggtaatgccctctggggagg

SEQ ID NO: 5910 - DNA, 22 bp, Artificial Sequence
  chemically synthesized
tggggaggggaaagaggagggg

SEQ ID NO: 5911 - DNA, 22 bp, Artificial Sequence
  chemically synthesized
gggaggggaaagaggaggggag

SEQ ID NO: 5912 - DNA, 22 bp, Artificial Sequence
  chemically synthesized
cctgcccagcccagccagcaag

SEQ ID NO: 5913 - DNA, 22 bp, Artificial Sequence
  chemically synthesized
cccagcccagccagcaagcctg

SEQ ID NO: 5914 - DNA, 22 bp, Artificial Sequence
  chemically synthesized
gagaagcacttgctagagctaa

SEQ ID NO: 5915 - DNA, 22 bp, Artificial Sequence
  chemically synthesized
gctagagctaaggaagcctcgg

SEQ ID NO: 5916 - DNA, 22 bp, Artificial Sequence
  chemically synthesized
ctagagctaaggaagcctcgga

SEQ ID NO: 5917 - DNA, 22 bp, Artificial Sequence
  chemically synthesized
gagctaaggaagcctcggagct

SEQ ID NO: 5918 - DNA, 22 bp, Artificial Sequence
  chemically synthesized
aggaagcctcggagctggacgg

SEQ ID NO: 5919 - DNA, 22 bp, Artificial Sequence
  chemically synthesized
ggagctggacgggtgcccccca

SEQ ID NO: 5920 - DNA, 22 bp, Artificial Sequence
  chemically synthesized
gacgggtgccccccacccctca

SEQ ID NO: 5921 - DNA, 22 bp, Artificial Sequence
  chemically synthesized
atcataacctgaagaacatgga

SEQ ID NO: 5922 - DNA, 22 bp, Artificial Sequence
  chemically synthesized
aagaacatggaggcccgggagg

SEQ ID NO: 5923 - DNA, 22 bp, Artificial Sequence
  chemically synthesized
gcccaaagctacacagggggtg

SEQ ID NO: 5924 - DNA, 22 bp, Artificial Sequence
  chemically synthesized
cccaaagctacacagggggtgg

SEQ ID NO: 5925 - DNA, 22 bp, Artificial Sequence
  chemically synthesized
cacagggggtggggctggaagt

SEQ ID NO: 5926 - DNA, 22 bp, Artificial Sequence
  chemically synthesized
gaagtggctccaagtgcaggtt

SEQ ID NO: 5927 - DNA, 22 bp, Artificial Sequence
  chemically synthesized
caagtgcaggttcccccctcat

SEQ ID NO: 5928 - DNA, 22 bp, Artificial Sequence
  chemically synthesized
ccccctcattcttcaggcttag

SEQ ID NO: 5929 - DNA, 22 bp, Artificial Sequence
  chemically synthesized
attcttcaggcttagggctgga

SEQ ID NO: 5930 - DNA, 22 bp, Artificial Sequence
  chemically synthesized
ttcaggcttagggctggaggaa

SEQ ID NO: 5931 - DNA, 22 bp, Artificial Sequence
  chemically synthesized
caggcttagggctggaggaagc

SEQ ID NO: 5932 - DNA, 22 bp, Artificial Sequence
  chemically synthesized
aggcttagggctggaggaagcc

SEQ ID NO: 5933 - DNA, 22 bp, Artificial Sequence
  chemically synthesized
agggctggaggaagccttagac

SEQ ID NO: 5934 - DNA, 22 bp, Artificial Sequence
  chemically synthesized
gggctggaggaagccttagaca

SEQ ID NO: 5935 - DNA, 22 bp, Artificial Sequence
  chemically synthesized
gaggaagccttagacagcccag

SEQ ID NO: 5936 - DNA, 22 bp, Artificial Sequence
  chemically synthesized
agacagcccagtcctaccccag

SEQ ID NO: 5937 - DNA, 22 bp, Artificial Sequence
  chemically synthesized
gacagcccagtcctaccccaga

SEQ ID NO: 5938 - DNA, 22 bp, Artificial Sequence
  chemically synthesized
ccccagacagggaaactgaggc

SEQ ID NO: 5939 - DNA, 22 bp, Artificial Sequence
  chemically synthesized
aggcctggagagggccagaaat

SEQ ID NO: 5940 - DNA, 22 bp, Artificial Sequence
  chemically synthesized
gagagggccagaaatcacccaa

SEQ ID NO: 5941 - DNA, 22 bp, Artificial Sequence
  chemically synthesized
gctggactggacggagatcagt

SEQ ID NO: 5942 - DNA, 22 bp, Artificial Sequence
  chemically synthesized
gactggacggagatcagtccag

SEQ ID NO: 5943 - DNA, 22 bp, Artificial Sequence
  chemically synthesized
gacggagatcagtccagaccgc

SEQ ID NO: 5944 - DNA, 22 bp, Artificial Sequence
  chemically synthesized
gatgttcagtctggtgggtttt

SEQ ID NO: 5945 - DNA, 22 bp, Artificial Sequence
  chemically synthesized
atgttcagtctggtgggttttc

SEQ ID NO: 5946 - DNA, 22 bp, Artificial Sequence
  chemically synthesized
agtctggtgggttttctgctcc

SEQ ID NO: 5947 - DNA, 22 bp, Artificial Sequence
  chemically synthesized
gtgggttttctgctccatccca

SEQ ID NO: 5948 - DNA, 22 bp, Artificial Sequence
  chemically synthesized
tctgctccatcccacccacctc

SEQ ID NO: 5949 - DNA, 22 bp, Artificial Sequence
  chemically synthesized
ctgctccatcccacccacctcc

SEQ ID NO: 5950 - DNA, 22 bp, Artificial Sequence
  chemically synthesized
tgctccatcccacccacctccc

SEQ ID NO: 5951 - DNA, 22 bp, Artificial Sequence
  chemically synthesized
ctccatcccacccacctccctt

SEQ ID NO: 5952 - DNA, 22 bp, Artificial Sequence
  chemically synthesized
catcccacccacctccctttgg

SEQ ID NO: 5953 - DNA, 22 bp, Artificial Sequence
  chemically synthesized
cctttgggcctcgatccctcgc

SEQ ID NO: 5954 - DNA, 22 bp, Artificial Sequence
  chemically synthesized
tgggcctcgatccctcgcccct

SEQ ID NO: 5955 - DNA, 22 bp, Artificial Sequence
  chemically synthesized
gggcctcgatccctcgcccctc

SEQ ID NO: 5956 - DNA, 22 bp, Artificial Sequence
  chemically synthesized
ggcctcgatccctcgcccctca

SEQ ID NO: 5957 - DNA, 22 bp, Artificial Sequence
  chemically synthesized
gatccctcgcccctcaccagtc

SEQ ID NO: 5958 - DNA, 22 bp, Artificial Sequence
  chemically synthesized
gcccctcaccagtcccccttct

SEQ ID NO: 5959 - DNA, 22 bp, Artificial Sequence
  chemically synthesized
accagtcccccttctgagagcc

SEQ ID NO: 5960 - DNA, 22 bp, Artificial Sequence
  chemically synthesized
ctgagagcccgtattagcaggg

SEQ ID NO: 5961 - DNA, 22 bp, Artificial Sequence
  chemically synthesized
tgagagcccgtattagcaggga

SEQ ID NO: 5962 - DNA, 22 bp, Artificial Sequence
  chemically synthesized
agagcccgtattagcagggagc

SEQ ID NO: 5963 - DNA, 22 bp, Artificial Sequence
  chemically synthesized
gcagggagccggcccctactcc

SEQ ID NO: 5964 - DNA, 22 bp, Artificial Sequence
  chemically synthesized
ctccttctggcagacccagcta

SEQ ID NO: 5965 - DNA, 22 bp, Artificial Sequence
  chemically synthesized
cttctggcagacccagctaagg

SEQ ID NO: 5966 - DNA, 22 bp, Artificial Sequence
  chemically synthesized
ctggcagacccagctaaggttc

SEQ ID NO: 5967 - DNA, 22 bp, Artificial Sequence
  chemically synthesized
tggcagacccagctaaggttct

SEQ ID NO: 5968 - DNA, 22 bp, Artificial Sequence
  chemically synthesized
gcagacccagctaaggttctac

SEQ ID NO: 5969 - DNA, 22 bp, Artificial Sequence
  chemically synthesized
aggttctaccttaggggccacg

SEQ ID NO: 5970 - DNA, 22 bp, Artificial Sequence
  chemically synthesized
taccttaggggccacgccacct

SEQ ID NO: 5971 - DNA, 22 bp, Artificial Sequence
  chemically synthesized
ccttaggggccacgccacctcc

SEQ ID NO: 5972 - DNA, 22 bp, Artificial Sequence
  chemically synthesized
aggggccacgccacctccccag

SEQ ID NO: 5973 - DNA, 22 bp, Artificial Sequence
  chemically synthesized
ggggccacgccacctccccagg

SEQ ID NO: 5974 - DNA, 22 bp, Artificial Sequence
  chemically synthesized
cccagggaggggtccagaggca

SEQ ID NO: 5975 - DNA, 22 bp, Artificial Sequence
  chemically synthesized
gggtgcccctcacaggacactt

SEQ ID NO: 5976 - DNA, 22 bp, Artificial Sequence
  chemically synthesized
acaggacacttccttgcaggaa

SEQ ID NO: 5977 - DNA, 22 bp, Artificial Sequence
  chemically synthesized
ccttgcaggaacagaggtgcca

SEQ ID NO: 5978 - DNA, 22 bp, Artificial Sequence
  chemically synthesized
cttgcaggaacagaggtgccat

SEQ ID NO: 5979 - DNA, 22 bp, Artificial Sequence
  chemically synthesized
gcaggaacagaggtgccatgca

SEQ ID NO: 5980 - DNA, 22 bp, Artificial Sequence
  chemically synthesized
caggaacagaggtgccatgcag

SEQ ID NO: 5981 - DNA, 22 bp, Artificial Sequence
  chemically synthesized
cttgttgttgccctcctggcgc

SEQ ID NO: 5982 - DNA, 22 bp, Artificial Sequence
  chemically synthesized
gttgttgccctcctggcgctcc

SEQ ID NO: 5983 - DNA, 22 bp, Artificial Sequence
  chemically synthesized
ttgttgccctcctggcgctcct

SEQ ID NO: 5984 - DNA, 22 bp, Artificial Sequence
  chemically synthesized
ttgccctcctggcgctcctggc

SEQ ID NO: 5985 - DNA, 22 bp, Artificial Sequence
  chemically synthesized
ccctcctggcgctcctggcctc

SEQ ID NO: 5986 - DNA, 22 bp, Artificial Sequence
  chemically synthesized
ctggcgctcctggcctctgccc

SEQ ID NO: 5987 - DNA, 22 bp, Artificial Sequence
  chemically synthesized
gcgctcctggcctctgcccgta

SEQ ID NO: 5988 - DNA, 22 bp, Artificial Sequence
  chemically synthesized
ctggcctctgcccgtaagcact

SEQ ID NO: 5989 - DNA, 22 bp, Artificial Sequence
  chemically synthesized
gcctctgcccgtaagcacttgg

SEQ ID NO: 5990 - DNA, 22 bp, Artificial Sequence
  chemically synthesized
tgcccgtaagcacttggtggga

SEQ ID NO: 5991 - DNA, 22 bp, Artificial Sequence
  chemically synthesized
cccgtaagcacttggtgggact

SEQ ID NO: 5992 - DNA, 22 bp, Artificial Sequence
  chemically synthesized
ggtgggactgggctgggggcag

SEQ ID NO: 5993 - DNA, 22 bp, Artificial Sequence
  chemically synthesized
gtgggactgggctgggggcagg

SEQ ID NO: 5994 - DNA, 22 bp, Artificial Sequence
  chemically synthesized
cccccagcccagtcccaccaag

SEQ ID NO: 5995 - DNA, 22 bp, Artificial Sequence
  chemically synthesized
acgggcagaggccaggagcgcc

SEQ ID NO: 5996 - DNA, 22 bp, Artificial Sequence
  chemically synthesized
cgggcagaggccaggagcgcca

SEQ ID NO: 5997 - DNA, 22 bp, Artificial Sequence
  chemically synthesized
catggcacctctgttcctgcaa

SEQ ID NO: 5998 - DNA, 22 bp, Artificial Sequence
  chemically synthesized
tgttcctgcaaggaagtgtcct

SEQ ID NO: 5999 - DNA, 22 bp, Artificial Sequence
  chemically synthesized
ttcctgcaaggaagtgtcctgt

SEQ ID NO: 6000 - DNA, 22 bp, Artificial Sequence
  chemically synthesized
ctgcaaggaagtgtcctgtgag

SEQ ID NO: 6001 - DNA, 22 bp, Artificial Sequence
  chemically synthesized
caaggaagtgtcctgtgagggg

SEQ ID NO: 6002 - DNA, 22 bp, Artificial Sequence
  chemically synthesized
tgaggggcaccccaggtcccca

SEQ ID NO: 6003 - DNA, 22 bp, Artificial Sequence
  chemically synthesized
tggacccctccctggggaggtg

SEQ ID NO: 6004 - DNA, 22 bp, Artificial Sequence
  chemically synthesized
gacccctccctggggaggtggc

SEQ ID NO: 6005 - DNA, 22 bp, Artificial Sequence
  chemically synthesized
cctggggaggtggcgtggcccc

SEQ ID NO: 6006 - DNA, 22 bp, Artificial Sequence
  chemically synthesized
gggaggtggcgtggcccctaag

SEQ ID NO: 6007 - DNA, 22 bp, Artificial Sequence
  chemically synthesized
aggtagaaccttagctgggtct

SEQ ID NO: 6008 - DNA, 22 bp, Artificial Sequence
  chemically synthesized
agctgggtctgccagaaggagt

SEQ ID NO: 6009 - DNA, 22 bp, Artificial Sequence
  chemically synthesized
gctgggtctgccagaaggagta

SEQ ID NO: 6010 - DNA, 22 bp, Artificial Sequence
  chemically synthesized
ggtctgccagaaggagtagggg

SEQ ID NO: 6011 - DNA, 22 bp, Artificial Sequence
  chemically synthesized
ccagaaggagtaggggccggct

SEQ ID NO: 6012 - DNA, 22 bp, Artificial Sequence
  chemically synthesized
cctgctaatacgggctctcaga

SEQ ID NO: 6013 - DNA, 22 bp, Artificial Sequence
  chemically synthesized
ctaatacgggctctcagaaggg

SEQ ID NO: 6014 - DNA, 22 bp, Artificial Sequence
  chemically synthesized
atacgggctctcagaaggggga

SEQ ID NO: 6015 - DNA, 22 bp, Artificial Sequence
  chemically synthesized
tcagaagggggactggtgaggg

SEQ ID NO: 6016 - DNA, 22 bp, Artificial Sequence
  chemically synthesized
agaagggggactggtgaggggc

SEQ ID NO: 6017 - DNA, 22 bp, Artificial Sequence
  chemically synthesized
gtgaggggcgagggatcgaggc

SEQ ID NO: 6018 - DNA, 22 bp, Artificial Sequence
  chemically synthesized
aacatcaaggcacctgcggtct

SEQ ID NO: 6019 - DNA, 22 bp, Artificial Sequence
  chemically synthesized
cggtctggactgatctccgtcc

SEQ ID NO: 6020 - DNA, 22 bp, Artificial Sequence
  chemically synthesized
gactgatctccgtccagtccag

SEQ ID NO: 6021 - DNA, 22 bp, Artificial Sequence
  chemically synthesized
atctccgtccagtccagccaac

SEQ ID NO: 6022 - DNA, 22 bp, Artificial Sequence
  chemically synthesized
cgtccagtccagccaacatgct

SEQ ID NO: 6023 - DNA, 22 bp, Artificial Sequence
  chemically synthesized
tgtgtctttgggtgatttctgg

SEQ ID NO: 6024 - DNA, 22 bp, Artificial Sequence
  chemically synthesized
tgggtgatttctggccctctcc

SEQ ID NO: 6025 - DNA, 22 bp, Artificial Sequence
  chemically synthesized
gggtgatttctggccctctcca

SEQ ID NO: 6026 - DNA, 22 bp, Artificial Sequence
  chemically synthesized
ggtgatttctggccctctccag

SEQ ID NO: 6027 - DNA, 22 bp, Artificial Sequence
  chemically synthesized
ctggccctctccaggcctcagt

SEQ ID NO: 6028 - DNA, 22 bp, Artificial Sequence
  chemically synthesized
tggccctctccaggcctcagtt

SEQ ID NO: 6029 - DNA, 22 bp, Artificial Sequence
  chemically synthesized
gccctctccaggcctcagtttc

SEQ ID NO: 6030 - DNA, 22 bp, Artificial Sequence
  chemically synthesized
tccaggcctcagtttccctgtc

SEQ ID NO: 6031 - DNA, 22 bp, Artificial Sequence
  chemically synthesized
caggcctcagtttccctgtctg

SEQ ID NO: 6032 - DNA, 22 bp, Artificial Sequence
  chemically synthesized
agtttccctgtctggggtagga

SEQ ID NO: 6033 - DNA, 22 bp, Artificial Sequence
  chemically synthesized
ccctgtctggggtaggactggg

SEQ ID NO: 6034 - DNA, 22 bp, Artificial Sequence
  chemically synthesized
cctgtctggggtaggactgggc

SEQ ID NO: 6035 - DNA, 22 bp, Artificial Sequence
  chemically synthesized
tctggggtaggactgggctgtc

SEQ ID NO: 6036 - DNA, 22 bp, Artificial Sequence
  chemically synthesized
gggtaggactgggctgtctaag

SEQ ID NO: 6037 - DNA, 22 bp, Artificial Sequence
  chemically synthesized
ggctgtctaaggcttcctccag

SEQ ID NO: 6038 - DNA, 22 bp, Artificial Sequence
  chemically synthesized
tctaaggcttcctccagcccta

SEQ ID NO: 6039 - DNA, 22 bp, Artificial Sequence
  chemically synthesized
aggcttcctccagccctaagcc

SEQ ID NO: 6040 - DNA, 22 bp, Artificial Sequence
  chemically synthesized
cctccagccctaagcctgaaga

SEQ ID NO: 6041 - DNA, 22 bp, Artificial Sequence
  chemically synthesized
ctccagccctaagcctgaagaa

SEQ ID NO: 6042 - DNA, 22 bp, Artificial Sequence
  chemically synthesized
cagccctaagcctgaagaatga

SEQ ID NO: 6043 - DNA, 22 bp, Artificial Sequence
  chemically synthesized
agcctgaagaatgaggggggaa

SEQ ID NO: 6044 - DNA, 22 bp, Artificial Sequence
  chemically synthesized
aagaatgaggggggaacctgca

SEQ ID NO: 6045 - DNA, 22 bp, Artificial Sequence
  chemically synthesized
cacttggagccacttccagccc

SEQ ID NO: 6046 - DNA, 22 bp, Artificial Sequence
  chemically synthesized
ggagccacttccagccccaccc

SEQ ID NO: 6047 - DNA, 22 bp, Artificial Sequence
  chemically synthesized
gagccacttccagccccacccc

SEQ ID NO: 6048 - DNA, 22 bp, Artificial Sequence
  chemically synthesized
ccagccccaccccctgtgtagc

SEQ ID NO: 6049 - DNA, 22 bp, Artificial Sequence
  chemically synthesized
cagccccaccccctgtgtagct

SEQ ID NO: 6050 - DNA, 22 bp, Artificial Sequence
  chemically synthesized
tgtagctttgggcaagtgacac

SEQ ID NO: 6051 - DNA, 22 bp, Artificial Sequence
  chemically synthesized
tgggcaagtgacacccctcccg

SEQ ID NO: 6052 - DNA, 22 bp, Artificial Sequence
  chemically synthesized
gggcaagtgacacccctcccgg

SEQ ID NO: 6053 - DNA, 22 bp, Artificial Sequence
  chemically synthesized
ggcaagtgacacccctcccggg

SEQ ID NO: 6054 - DNA, 22 bp, Artificial Sequence
  chemically synthesized
ccgggcctccatgttcttcagg

SEQ ID NO: 6055 - DNA, 22 bp, Artificial Sequence
  chemically synthesized
catgttcttcaggttatgatga

SEQ ID NO: 6056 - DNA, 22 bp, Artificial Sequence
  chemically synthesized
ttcaggttatgatgaggggtgg

SEQ ID NO: 6057 - DNA, 22 bp, Artificial Sequence
  chemically synthesized
caggttatgatgaggggtgggg

SEQ ID NO: 6058 - DNA, 22 bp, Artificial Sequence
  chemically synthesized
aggttatgatgaggggtggggg

SEQ ID NO: 6059 - DNA, 22 bp, Artificial Sequence
  chemically synthesized
tgatgaggggtggggggcaccc

SEQ ID NO: 6060 - DNA, 22 bp, Artificial Sequence
  chemically synthesized
cgaggcttccttagctctagca

SEQ ID NO: 6061 - DNA, 22 bp, Artificial Sequence
  chemically synthesized
ccttagctctagcaagtgcttc

SEQ ID NO: 6062 - DNA, 22 bp, Artificial Sequence
  chemically synthesized
cttagctctagcaagtgcttct

SEQ ID NO: 6063 - DNA, 22 bp, Artificial Sequence
  chemically synthesized
agctctagcaagtgcttctcca

SEQ ID NO: 6064 - DNA, 22 bp, Artificial Sequence
  chemically synthesized
gctctagcaagtgcttctccag

SEQ ID NO: 6065 - DNA, 22 bp, Artificial Sequence
  chemically synthesized
tagcaagtgcttctccaggctt

SEQ ID NO: 6066 - DNA, 22 bp, Artificial Sequence
  chemically synthesized
gcaagtgcttctccaggcttgc

SEQ ID NO: 6067 - DNA, 22 bp, Artificial Sequence
  chemically synthesized
ctccaggcttgctggctgggct

SEQ ID NO: 6068 - DNA, 22 bp, Artificial Sequence
  chemically synthesized
tccaggcttgctggctgggctg

SEQ ID NO: 6069 - DNA, 22 bp, Artificial Sequence
  chemically synthesized
caggcttgctggctgggctggg

SEQ ID NO: 6070 - DNA, 22 bp, Artificial Sequence
  chemically synthesized
gctggctgggctgggcagggag

SEQ ID NO: 6071 - DNA, 22 bp, Artificial Sequence
  chemically synthesized
ctggctgggctgggcagggagc

SEQ ID NO: 6072 - DNA, 22 bp, Artificial Sequence
  chemically synthesized
gctgggctgggcagggagctcc

SEQ ID NO: 6073 - DNA, 22 bp, Artificial Sequence
  chemically synthesized
ggctgggcagggagctcctctt

SEQ ID NO: 6074 - DNA, 22 bp, Artificial Sequence
  chemically synthesized
ggcagggagctcctcttgcccc

SEQ ID NO: 6075 - DNA, 22 bp, Artificial Sequence
  chemically synthesized
ctcttgcccctcttcatcctcc

SEQ ID NO: 6076 - DNA, 22 bp, Artificial Sequence
  chemically synthesized
ttgcccctcttcatcctcctcc

SEQ ID NO: 6077 - DNA, 22 bp, Artificial Sequence
  chemically synthesized
gcccctcttcatcctcctcccc

SEQ ID NO: 6078 - DNA, 22 bp, Artificial Sequence
  chemically synthesized
cccctcttcatcctcctcccct

SEQ ID NO: 6079 - DNA, 22 bp, Artificial Sequence
  chemically synthesized
ttcatcctcctcccctcctctt

SEQ ID NO: 6080 - DNA, 22 bp, Artificial Sequence
  chemically synthesized
catcctcctcccctcctctttc

SEQ ID NO: 6081 - DNA, 22 bp, Artificial Sequence
  chemically synthesized
atcctcctcccctcctctttcc

SEQ ID NO: 6082 - DNA, 22 bp, Artificial Sequence
  chemically synthesized
ctcccctcctctttcccctccc

SEQ ID NO: 6083 - DNA, 22 bp, Artificial Sequence
  chemically synthesized
ccctcctctttcccctccccag

SEQ ID NO: 6084 - DNA, 22 bp, Artificial Sequence
  chemically synthesized
ctctttcccctccccagagggc

SEQ ID NO: 6085 - DNA, 22 bp, Artificial Sequence
  chemically synthesized
tttcccctccccagagggcatt

SEQ ID NO: 6086 - DNA, 22 bp, Artificial Sequence
  chemically synthesized
tcccctccccagagggcattac

SEQ ID NO: 6087 - DNA, 22 bp, Artificial Sequence
  chemically synthesized
cccctccccagagggcattacc

SEQ ID NO: 6088 - DNA, 22 bp, Artificial Sequence
  chemically synthesized
ccctccccagagggcattacct

SEQ ID NO: 6089 - DNA, 22 bp, Artificial Sequence
  chemically synthesized
cccagagggcattacctggagc

SEQ ID NO: 6090 - DNA, 22 bp, Artificial Sequence
  chemically synthesized
cctggagcagctgcctctaggg

SEQ ID NO: 6091 - DNA, 22 bp, Artificial Sequence
  chemically synthesized
gagcagctgcctctagggatga

SEQ ID NO: 6092 - DNA, 22 bp, Artificial Sequence
  chemically synthesized
cctctagggatgaactgagcag

SEQ ID NO: 6093 - DNA, 22 bp, Artificial Sequence
  chemically synthesized
tagggatgaactgagcagacag

SEQ ID NO: 6094 - DNA, 22 bp, Artificial Sequence
  chemically synthesized
gggatgaactgagcagacaggc

SEQ ID NO: 6095 - DNA, 22 bp, Artificial Sequence
  chemically synthesized
agcagacaggcaggagggttct

SEQ ID NO: 6096 - DNA, 22 bp, Artificial Sequence
  chemically synthesized
tgacctgttttatatcatctcc

SEQ ID NO: 6097 - DNA, 22 bp, Artificial Sequence
  chemically synthesized
acctgttttatatcatctccag

SEQ ID NO: 6098 - DNA, 22 bp, Artificial Sequence
  chemically synthesized
ttttatatcatctccagggcag

SEQ ID NO: 6099 - DNA, 22 bp, Artificial Sequence
  chemically synthesized
tatatcatctccagggcagcag

SEQ ID NO: 6100 - DNA, 22 bp, Artificial Sequence
  chemically synthesized
atatcatctccagggcagcagg

SEQ ID NO: 6101 - DNA, 22 bp, Artificial Sequence
  chemically synthesized
tatcatctccagggcagcaggc

SEQ ID NO: 6102 - DNA, 22 bp, Artificial Sequence
  chemically synthesized
cagggcagcaggcactgaggac

SEQ ID NO: 6103 - DNA, 22 bp, Artificial Sequence
  chemically synthesized
aggacccagggcgctgggcaaa

SEQ ID NO: 6104 - DNA, 22 bp, Artificial Sequence
  chemically synthesized
ggcaaaggtcacctgctgacca

SEQ ID NO: 6105 - DNA, 22 bp, Artificial Sequence
  chemically synthesized
ctgaccagtggagatgagggcc

SEQ ID NO: 6106 - DNA, 22 bp, Artificial Sequence
  chemically synthesized
accagtggagatgagggcctga

SEQ ID NO: 6107 - DNA, 22 bp, Artificial Sequence
  chemically synthesized
aggcagggtgtccagatgcagc

SEQ ID NO: 6108 - DNA, 22 bp, Artificial Sequence
  chemically synthesized
ggaaatccctaggagactgagt

SEQ ID NO: 6109 - DNA, 20 bp, Artificial Sequence
  chemically synthesized
taccccttgcccatccctgc

SEQ ID NO: 6110 - DNA, 20 bp, Artificial Sequence
  chemically synthesized
ggcccccgtgaccctcactt

SEQ ID NO: 6111 - DNA, 20 bp, Artificial Sequence
  chemically synthesized
gcccccgtgaccctcacttt

SEQ ID NO: 6112 - DNA, 20 bp, Artificial Sequence
  chemically synthesized
gtgaccctcactttgggacc

SEQ ID NO: 6113 - DNA, 20 bp, Artificial Sequence
  chemically synthesized
cactttgggacccagtcaca

SEQ ID NO: 6114 - DNA, 20 bp, Artificial Sequence
  chemically synthesized
ccagtcacacagatgaccac

SEQ ID NO: 6115 - DNA, 20 bp, Artificial Sequence
  chemically synthesized
gtcacacagatgaccaccag

SEQ ID NO: 6116 - DNA, 20 bp, Artificial Sequence
  chemically synthesized
acacagatgaccaccagcag

SEQ ID NO: 6117 - DNA, 20 bp, Artificial Sequence
  chemically synthesized
cacagatgaccaccagcagc

SEQ ID NO: 6118 - DNA, 20 bp, Artificial Sequence
  chemically synthesized
ccaccagcagcaggatgttg

SEQ ID NO: 6119 - DNA, 20 bp, Artificial Sequence
  chemically synthesized
agcagcaggatgttgaagct

SEQ ID NO: 6120 - DNA, 20 bp, Artificial Sequence
  chemically synthesized
gcagcaggatgttgaagctc

SEQ ID NO: 6121 - DNA, 20 bp, Artificial Sequence
  chemically synthesized
cagcaggatgttgaagctca

SEQ ID NO: 6122 - DNA, 20 bp, Artificial Sequence
  chemically synthesized
aggatgttgaagctcagggc

SEQ ID NO: 6123 - DNA, 20 bp, Artificial Sequence
  chemically synthesized
atgttgaagctcagggcaag

SEQ ID NO: 6124 - DNA, 20 bp, Artificial Sequence
  chemically synthesized
agctcagggcaagcagactg

SEQ ID NO: 6125 - DNA, 20 bp, Artificial Sequence
  chemically synthesized
tcagggcaagcagactgaag

SEQ ID NO: 6126 - DNA, 20 bp, Artificial Sequence
  chemically synthesized
aagcagactgaagcagacca

SEQ ID NO: 6127 - DNA, 20 bp, Artificial Sequence
  chemically synthesized
gcagactgaagcagaccatg

SEQ ID NO: 6128 - DNA, 20 bp, Artificial Sequence
  chemically synthesized
gactgaagcagaccatggag

SEQ ID NO: 6129 - DNA, 20 bp, Artificial Sequence
  chemically synthesized
ctgaagcagaccatggagca

SEQ ID NO: 6130 - DNA, 20 bp, Artificial Sequence
  chemically synthesized
atggagcagagacgctgtgc

SEQ ID NO: 6131 - DNA, 20 bp, Artificial Sequence
  chemically synthesized
tggagcagagacgctgtgcc

SEQ ID NO: 6132 - DNA, 20 bp, Artificial Sequence
  chemically synthesized
ggagcagagacgctgtgcca

SEQ ID NO: 6133 - DNA, 20 bp, Artificial Sequence
  chemically synthesized
gagcagagacgctgtgccag

SEQ ID NO: 6134 - DNA, 20 bp, Artificial Sequence
  chemically synthesized
agagacgctgtgccaggggc

SEQ ID NO: 6135 - DNA, 20 bp, Artificial Sequence
  chemically synthesized
gagacgctgtgccaggggct

SEQ ID NO: 6136 - DNA, 20 bp, Artificial Sequence
  chemically synthesized
acgctgtgccaggggctggg

SEQ ID NO: 6137 - DNA, 20 bp, Artificial Sequence
  chemically synthesized
cgctgtgccaggggctgggc

SEQ ID NO: 6138 - DNA, 20 bp, Artificial Sequence
  chemically synthesized
ctgtgccaggggctgggcag

SEQ ID NO: 6139 - DNA, 20 bp, Artificial Sequence
  chemically synthesized
tgtgccaggggctgggcagg

SEQ ID NO: 6140 - DNA, 20 bp, Artificial Sequence
  chemically synthesized
gccaggggctgggcaggagg

SEQ ID NO: 6141 - DNA, 20 bp, Artificial Sequence
  chemically synthesized
ctgggcaggaggtggccctg

SEQ ID NO: 6142 - DNA, 20 bp, Artificial Sequence
  chemically synthesized
tgggcaggaggtggccctgt

SEQ ID NO: 6143 - DNA, 20 bp, Artificial Sequence
  chemically synthesized
ggcaggaggtggccctgtgg

SEQ ID NO: 6144 - DNA, 20 bp, Artificial Sequence
  chemically synthesized
caggaggtggccctgtggga

SEQ ID NO: 6145 - DNA, 20 bp, Artificial Sequence
  chemically synthesized
aggaggtggccctgtgggag

SEQ ID NO: 6146 - DNA, 20 bp, Artificial Sequence
  chemically synthesized
ggaggtggccctgtgggaga

SEQ ID NO: 6147 - DNA, 20 bp, Artificial Sequence
  chemically synthesized
gaggtggccctgtgggagag

SEQ ID NO: 6148 - DNA, 20 bp, Artificial Sequence
  chemically synthesized
gccctgtgggagaggggcat

SEQ ID NO: 6149 - DNA, 20 bp, Artificial Sequence
  chemically synthesized
ccctgtgggagaggggcatc

SEQ ID NO: 6150 - DNA, 20 bp, Artificial Sequence
  chemically synthesized
ctgtgggagaggggcatcag

SEQ ID NO: 6151 - DNA, 20 bp, Artificial Sequence
  chemically synthesized
gggagaggggcatcaggagc

SEQ ID NO: 6152 - DNA, 20 bp, Artificial Sequence
  chemically synthesized
agaggggcatcaggagccgg

SEQ ID NO: 6153 - DNA, 20 bp, Artificial Sequence
  chemically synthesized
ggcatcaggagccggcagcc

SEQ ID NO: 6154 - DNA, 20 bp, Artificial Sequence
  chemically synthesized
gcatcaggagccggcagcct

SEQ ID NO: 6155 - DNA, 20 bp, Artificial Sequence
  chemically synthesized
aggagccggcagcctgggtg

SEQ ID NO: 6156 - DNA, 20 bp, Artificial Sequence
  chemically synthesized
ggagccggcagcctgggtgt

SEQ ID NO: 6157 - DNA, 20 bp, Artificial Sequence
  chemically synthesized
gagccggcagcctgggtgtg

SEQ ID NO: 6158 - DNA, 20 bp, Artificial Sequence
  chemically synthesized
gccggcagcctgggtgtggg

SEQ ID NO: 6159 - DNA, 20 bp, Artificial Sequence
  chemically synthesized
gcagcctgggtgtggggagc

SEQ ID NO: 6160 - DNA, 20 bp, Artificial Sequence
  chemically synthesized
agcctgggtgtggggagccg

SEQ ID NO: 6161 - DNA, 20 bp, Artificial Sequence
  chemically synthesized
gcctgggtgtggggagccgg

SEQ ID NO: 6162 - DNA, 20 bp, Artificial Sequence
  chemically synthesized
cctgggtgtggggagccgga

SEQ ID NO: 6163 - DNA, 20 bp, Artificial Sequence
  chemically synthesized
gtgtggggagccggagggta

SEQ ID NO: 6164 - DNA, 20 bp, Artificial Sequence
  chemically synthesized
ggggagccggagggtaaaga

SEQ ID NO: 6165 - DNA, 20 bp, Artificial Sequence
  chemically synthesized
gggagccggagggtaaagac

SEQ ID NO: 6166 - DNA, 20 bp, Artificial Sequence
  chemically synthesized
ggagccggagggtaaagaca

SEQ ID NO: 6167 - DNA, 20 bp, Artificial Sequence
  chemically synthesized
agggtaaagacagggcaccg

SEQ ID NO: 6168 - DNA, 20 bp, Artificial Sequence
  chemically synthesized
aagacagggcaccgaagcct

SEQ ID NO: 6169 - DNA, 20 bp, Artificial Sequence
  chemically synthesized
agacagggcaccgaagcctg

SEQ ID NO: 6170 - DNA, 20 bp, Artificial Sequence
  chemically synthesized
acagggcaccgaagcctgag

SEQ ID NO: 6171 - DNA, 20 bp, Artificial Sequence
  chemically synthesized
cagggcaccgaagcctgagg

SEQ ID NO: 6172 - DNA, 20 bp, Artificial Sequence
  chemically synthesized
aagcctgaggaggcataacc

SEQ ID NO: 6173 - DNA, 20 bp, Artificial Sequence
  chemically synthesized
agcctgaggaggcataacct

SEQ ID NO: 6174 - DNA, 20 bp, Artificial Sequence
  chemically synthesized
ctgaggaggcataacctggg

SEQ ID NO: 6175 - DNA, 20 bp, Artificial Sequence
  chemically synthesized
tgaggaggcataacctgggc

SEQ ID NO: 6176 - DNA, 20 bp, Artificial Sequence
  chemically synthesized
gaggaggcataacctgggcg

SEQ ID NO: 6177 - DNA, 20 bp, Artificial Sequence
  chemically synthesized
aggaggcataacctgggcgg

SEQ ID NO: 6178 - DNA, 20 bp, Artificial Sequence
  chemically synthesized
ggaggcataacctgggcggg

SEQ ID NO: 6179 - DNA, 20 bp, Artificial Sequence
  chemically synthesized
cataacctgggcggggggat

SEQ ID NO: 6180 - DNA, 20 bp, Artificial Sequence
  chemically synthesized
acctgggcggggggattggt

SEQ ID NO: 6181 - DNA, 20 bp, Artificial Sequence
  chemically synthesized
cctgggcggggggattggtt

SEQ ID NO: 6182 - DNA, 20 bp, Artificial Sequence
  chemically synthesized
ctgggcggggggattggttg

SEQ ID NO: 6183 - DNA, 20 bp, Artificial Sequence
  chemically synthesized
ggggggattggttggggcca

SEQ ID NO: 6184 - DNA, 20 bp, Artificial Sequence
  chemically synthesized
gggggattggttggggccat

SEQ ID NO: 6185 - DNA, 20 bp, Artificial Sequence
  chemically synthesized
ggggattggttggggccatg

SEQ ID NO: 6186 - DNA, 20 bp, Artificial Sequence
  chemically synthesized
gggattggttggggccatgg

SEQ ID NO: 6187 - DNA, 20 bp, Artificial Sequence
  chemically synthesized
ggattggttggggccatggg

SEQ ID NO: 6188 - DNA, 20 bp, Artificial Sequence
  chemically synthesized
gattggttggggccatgggg

SEQ ID NO: 6189 - DNA, 20 bp, Artificial Sequence
  chemically synthesized
attggttggggccatggggg

SEQ ID NO: 6190 - DNA, 20 bp, Artificial Sequence
  chemically synthesized
ttggttggggccatgggggg

SEQ ID NO: 6191 - DNA, 20 bp, Artificial Sequence
  chemically synthesized
gccatgggggggggtcatca

SEQ ID NO: 6192 - DNA, 20 bp, Artificial Sequence
  chemically synthesized
ccatgggggggggtcatcat

SEQ ID NO: 6193 - DNA, 20 bp, Artificial Sequence
  chemically synthesized
gtcatcataggctttgaccc

SEQ ID NO: 6194 - DNA, 20 bp, Artificial Sequence
  chemically synthesized
aggctttgaccccagcattt

SEQ ID NO: 6195 - DNA, 20 bp, Artificial Sequence
  chemically synthesized
catgtataaatatacacacg

SEQ ID NO: 6196 - DNA, 20 bp, Artificial Sequence
  chemically synthesized
atatacacacgcagctaatc

SEQ ID NO: 6197 - DNA, 20 bp, Artificial Sequence
  chemically synthesized
acacacccatgcacacgact

SEQ ID NO: 6198 - DNA, 20 bp, Artificial Sequence
  chemically synthesized
cacacccatgcacacgactc

SEQ ID NO: 6199 - DNA, 20 bp, Artificial Sequence
  chemically synthesized
acgactcaggatattcacat

SEQ ID NO: 6200 - DNA, 20 bp, Artificial Sequence
  chemically synthesized
attcacatcagctgtgtgca

SEQ ID NO: 6201 - DNA, 20 bp, Artificial Sequence
  chemically synthesized
catcagctgtgtgcaaagcc

SEQ ID NO: 6202 - DNA, 20 bp, Artificial Sequence
  chemically synthesized
tgtgtgcaaagcccggatcc

SEQ ID NO: 6203 - DNA, 20 bp, Artificial Sequence
  chemically synthesized
tgtgcaaagcccggatcctg

SEQ ID NO: 6204 - DNA, 20 bp, Artificial Sequence
  chemically synthesized
caaagcccggatcctggagc

SEQ ID NO: 6205 - DNA, 20 bp, Artificial Sequence
  chemically synthesized
aaagcccggatcctggagct

SEQ ID NO: 6206 - DNA, 20 bp, Artificial Sequence
  chemically synthesized
aagcccggatcctggagctg

SEQ ID NO: 6207 - DNA, 20 bp, Artificial Sequence
  chemically synthesized
agcccggatcctggagctgg

SEQ ID NO: 6208 - DNA, 20 bp, Artificial Sequence
  chemically synthesized
ggatcctggagctgggggac

SEQ ID NO: 6209 - DNA, 20 bp, Artificial Sequence
  chemically synthesized
gatcctggagctgggggact

SEQ ID NO: 6210 - DNA, 20 bp, Artificial Sequence
  chemically synthesized
tcctggagctgggggactgg

SEQ ID NO: 6211 - DNA, 20 bp, Artificial Sequence
  chemically synthesized
ctgggggactgggagacgca

SEQ ID NO: 6212 - DNA, 20 bp, Artificial Sequence
  chemically synthesized
tgggggactgggagacgcac

SEQ ID NO: 6213 - DNA, 20 bp, Artificial Sequence
  chemically synthesized
gggggactgggagacgcaca

SEQ ID NO: 6214 - DNA, 20 bp, Artificial Sequence
  chemically synthesized
ggggactgggagacgcacag

SEQ ID NO: 6215 - DNA, 20 bp, Artificial Sequence
  chemically synthesized
gggactgggagacgcacagg

SEQ ID NO: 6216 - DNA, 20 bp, Artificial Sequence
  chemically synthesized
actgggagacgcacaggggg

SEQ ID NO: 6217 - DNA, 20 bp, Artificial Sequence
  chemically synthesized
ctgggagacgcacagggggc

SEQ ID NO: 6218 - DNA, 20 bp, Artificial Sequence
  chemically synthesized
tgggagacgcacagggggcg

SEQ ID NO: 6219 - DNA, 20 bp, Artificial Sequence
  chemically synthesized
gggagacgcacagggggcgg

SEQ ID NO: 6220 - DNA, 20 bp, Artificial Sequence
  chemically synthesized
ggagacgcacagggggcggg

SEQ ID NO: 6221 - DNA, 20 bp, Artificial Sequence
  chemically synthesized
gagacgcacagggggcgggg

SEQ ID NO: 6222 - DNA, 20 bp, Artificial Sequence
  chemically synthesized
acgcacagggggcggggggg

SEQ ID NO: 6223 - DNA, 20 bp, Artificial Sequence
  chemically synthesized
agggggcgggggggcagacc

SEQ ID NO: 6224 - DNA, 20 bp, Artificial Sequence
  chemically synthesized
ggggcagacccggccctgcc

SEQ ID NO: 6225 - DNA, 20 bp, Artificial Sequence
  chemically synthesized
gggcagacccggccctgcct

SEQ ID NO: 6226 - DNA, 20 bp, Artificial Sequence
  chemically synthesized
cctgcctaggcacacatcct

SEQ ID NO: 6227 - DNA, 20 bp, Artificial Sequence
  chemically synthesized
gcctaggcacacatcctgag

SEQ ID NO: 6228 - DNA, 20 bp, Artificial Sequence
  chemically synthesized
cctaggcacacatcctgaga

SEQ ID NO: 6229 - DNA, 20 bp, Artificial Sequence
  chemically synthesized
ctaggcacacatcctgagaa

SEQ ID NO: 6230 - DNA, 20 bp, Artificial Sequence
  chemically synthesized
taggcacacatcctgagaag

SEQ ID NO: 6231 - DNA, 20 bp, Artificial Sequence
  chemically synthesized
aggcacacatcctgagaagg

SEQ ID NO: 6232 - DNA, 20 bp, Artificial Sequence
  chemically synthesized
tgagaagggggatctgtgaa

SEQ ID NO: 6233 - DNA, 20 bp, Artificial Sequence
  chemically synthesized
tgaatggttttcctcccatc

SEQ ID NO: 6234 - DNA, 20 bp, Artificial Sequence
  chemically synthesized
tggttttcctcccatccagc

SEQ ID NO: 6235 - DNA, 20 bp, Artificial Sequence
  chemically synthesized
ttttcctcccatccagccag

SEQ ID NO: 6236 - DNA, 20 bp, Artificial Sequence
  chemically synthesized
tcctcccatccagccagtgg

SEQ ID NO: 6237 - DNA, 20 bp, Artificial Sequence
  chemically synthesized
ctcccatccagccagtggca

SEQ ID NO: 6238 - DNA, 20 bp, Artificial Sequence
  chemically synthesized
tcccatccagccagtggcag

SEQ ID NO: 6239 - DNA, 20 bp, Artificial Sequence
  chemically synthesized
cagccagtggcagaggcctc

SEQ ID NO: 6240 - DNA, 20 bp, Artificial Sequence
  chemically synthesized
cagaggcctccagatcacct

SEQ ID NO: 6241 - DNA, 20 bp, Artificial Sequence
  chemically synthesized
agaggcctccagatcacctc

SEQ ID NO: 6242 - DNA, 20 bp, Artificial Sequence
  chemically synthesized
ctccagatcacctcgggcct

SEQ ID NO: 6243 - DNA, 20 bp, Artificial Sequence
  chemically synthesized
atcacctcgggccttagtct

SEQ ID NO: 6244 - DNA, 20 bp, Artificial Sequence
  chemically synthesized
gccttagtctcagctcttct

SEQ ID NO: 6245 - DNA, 20 bp, Artificial Sequence
  chemically synthesized
ccttagtctcagctcttcta

SEQ ID NO: 6246 - DNA, 20 bp, Artificial Sequence
  chemically synthesized
ttctaaggctcctgtcccct

SEQ ID NO: 6247 - DNA, 20 bp, Artificial Sequence
  chemically synthesized
aggctcctgtcccctcagat

SEQ ID NO: 6248 - DNA, 20 bp, Artificial Sequence
  chemically synthesized
gctcctgtcccctcagattg

SEQ ID NO: 6249 - DNA, 20 bp, Artificial Sequence
  chemically synthesized
tcccctcagattggagactc

SEQ ID NO: 6250 - DNA, 20 bp, Artificial Sequence
  chemically synthesized
cctcagattggagactccag

SEQ ID NO: 6251 - DNA, 20 bp, Artificial Sequence
  chemically synthesized
agattggagactccagaagc

SEQ ID NO: 6252 - DNA, 20 bp, Artificial Sequence
  chemically synthesized
gattggagactccagaagct

SEQ ID NO: 6253 - DNA, 20 bp, Artificial Sequence
  chemically synthesized
gttcttcctaaaatccatac

SEQ ID NO: 6254 - DNA, 20 bp, Artificial Sequence
  chemically synthesized
tcctaaaatccatactggaa

SEQ ID NO: 6255 - DNA, 20 bp, Artificial Sequence
  chemically synthesized
tcccctgccaaaattccatt

SEQ ID NO: 6256 - DNA, 20 bp, Artificial Sequence
  chemically synthesized
tccattgagatccttaaatc

SEQ ID NO: 6257 - DNA, 20 bp, Artificial Sequence
  chemically synthesized
ccattgagatccttaaatct

SEQ ID NO: 6258 - DNA, 20 bp, Artificial Sequence
  chemically synthesized
aaatctgggtcattccacca

SEQ ID NO: 6259 - DNA, 20 bp, Artificial Sequence
  chemically synthesized
tccaccatagcccactctcc

SEQ ID NO: 6260 - DNA, 20 bp, Artificial Sequence
  chemically synthesized
actctccaagcacaaccctc

SEQ ID NO: 6261 - DNA, 20 bp, Artificial Sequence
  chemically synthesized
ctctccaagcacaaccctcc

SEQ ID NO: 6262 - DNA, 20 bp, Artificial Sequence
  chemically synthesized
gtcctcatcccccaccacgc

SEQ ID NO: 6263 - DNA, 20 bp, Artificial Sequence
  chemically synthesized
tcctcatcccccaccacgca

SEQ ID NO: 6264 - DNA, 20 bp, Artificial Sequence
  chemically synthesized
accacgcaaggcctcctccc

SEQ ID NO: 6265 - DNA, 20 bp, Artificial Sequence
  chemically synthesized
gccctttgccctcgcttccc

SEQ ID NO: 6266 - DNA, 20 bp, Artificial Sequence
  chemically synthesized
cacactaaatttgctcccct

SEQ ID NO: 6267 - DNA, 20 bp, Artificial Sequence
  chemically synthesized
aaatttgctcccctcagccc

SEQ ID NO: 6268 - DNA, 20 bp, Artificial Sequence
  chemically synthesized
aatttgctcccctcagcccg

SEQ ID NO: 6269 - DNA, 20 bp, Artificial Sequence
  chemically synthesized
ctcagcccgaggtcatctca

SEQ ID NO: 6270 - DNA, 20 bp, Artificial Sequence
  chemically synthesized
tcagcccgaggtcatctcac

SEQ ID NO: 6271 - DNA, 20 bp, Artificial Sequence
  chemically synthesized
ttgatccatctgcaccctga

SEQ ID NO: 6272 - DNA, 20 bp, Artificial Sequence
  chemically synthesized
cacccacgtcttcctgcaca

SEQ ID NO: 6273 - DNA, 20 bp, Artificial Sequence
  chemically synthesized
cccacgtcttcctgcacaca

SEQ ID NO: 6274 - DNA, 20 bp, Artificial Sequence
  chemically synthesized
cgtcttcctgcacacagagc

SEQ ID NO: 6275 - DNA, 20 bp, Artificial Sequence
  chemically synthesized
gtcttcctgcacacagagct

SEQ ID NO: 6276 - DNA, 20 bp, Artificial Sequence
  chemically synthesized
ggctccctctctgctgcctc

SEQ ID NO: 6277 - DNA, 20 bp, Artificial Sequence
  chemically synthesized
ctctctgctgcctccagacc

SEQ ID NO: 6278 - DNA, 20 bp, Artificial Sequence
  chemically synthesized
ctctgctgcctccagaccca

SEQ ID NO: 6279 - DNA, 20 bp, Artificial Sequence
  chemically synthesized
tgctgcctccagacccagag

SEQ ID NO: 6280 - DNA, 20 bp, Artificial Sequence
  chemically synthesized
ctccagacccagagcagctc

SEQ ID NO: 6281 - DNA, 20 bp, Artificial Sequence
  chemically synthesized
cagagcagctccagttgtcc

SEQ ID NO: 6282 - DNA, 20 bp, Artificial Sequence
  chemically synthesized
gctccagttgtcccagccct

SEQ ID NO: 6283 - DNA, 20 bp, Artificial Sequence
  chemically synthesized
gccctgagctcctctctttg

SEQ ID NO: 6284 - DNA, 20 bp, Artificial Sequence
  chemically synthesized
ttgcagcatccacctgcaaa

SEQ ID NO: 6285 - DNA, 20 bp, Artificial Sequence
  chemically synthesized
cctgcaaacagaacaccttc

SEQ ID NO: 6286 - DNA, 20 bp, Artificial Sequence
  chemically synthesized
ctgcaaacagaacaccttct

SEQ ID NO: 6287 - DNA, 20 bp, Artificial Sequence
  chemically synthesized
acagaacaccttctaggcct

SEQ ID NO: 6288 - DNA, 20 bp, Artificial Sequence
  chemically synthesized
ggccttggaccctgactctg

SEQ ID NO: 6289 - DNA, 20 bp, Artificial Sequence
  chemically synthesized
attcctatcaccccccgacc

SEQ ID NO: 6290 - DNA, 20 bp, Artificial Sequence
  chemically synthesized
cctatcaccccccgacccag

SEQ ID NO: 6291 - DNA, 20 bp, Artificial Sequence
  chemically synthesized
ctatcaccccccgacccagc

SEQ ID NO: 6292 - DNA, 20 bp, Artificial Sequence
  chemically synthesized
gacccagcaggaccacatcc

SEQ ID NO: 6293 - DNA, 20 bp, Artificial Sequence
  chemically synthesized
acccagcaggaccacatcct

SEQ ID NO: 6294 - DNA, 20 bp, Artificial Sequence
  chemically synthesized
cccagcaggaccacatcctg

SEQ ID NO: 6295 - DNA, 20 bp, Artificial Sequence
  chemically synthesized
cagcaggaccacatcctggg

SEQ ID NO: 6296 - DNA, 20 bp, Artificial Sequence
  chemically synthesized
agcaggaccacatcctgggg

SEQ ID NO: 6297 - DNA, 20 bp, Artificial Sequence
  chemically synthesized
gaccacatcctggggaggct

SEQ ID NO: 6298 - DNA, 20 bp, Artificial Sequence
  chemically synthesized
acatcctggggaggctcagt

SEQ ID NO: 6299 - DNA, 20 bp, Artificial Sequence
  chemically synthesized
catcctggggaggctcagtc

SEQ ID NO: 6300 - DNA, 20 bp, Artificial Sequence
  chemically synthesized
atcctggggaggctcagtca

SEQ ID NO: 6301 - DNA, 20 bp, Artificial Sequence
  chemically synthesized
tcctggggaggctcagtcag

SEQ ID NO: 6302 - DNA, 20 bp, Artificial Sequence
  chemically synthesized
gggaggctcagtcaggggcc

SEQ ID NO: 6303 - DNA, 20 bp, Artificial Sequence
  chemically synthesized
gggcccagaatcttcctccc

SEQ ID NO: 6304 - DNA, 20 bp, Artificial Sequence
  chemically synthesized
ggcccagaatcttcctcccc

SEQ ID NO: 6305 - DNA, 20 bp, Artificial Sequence
  chemically synthesized
tcacttcctgccactgtcct

SEQ ID NO: 6306 - DNA, 20 bp, Artificial Sequence
  chemically synthesized
ttcctgccactgtcctgagt

SEQ ID NO: 6307 - DNA, 20 bp, Artificial Sequence
  chemically synthesized
gagtcagacactgcccctgt

SEQ ID NO: 6308 - DNA, 20 bp, Artificial Sequence
  chemically synthesized
actcttcatctttttcacac

SEQ ID NO: 6309 - DNA, 20 bp, Artificial Sequence
  chemically synthesized
gacttccaccttccccactg

SEQ ID NO: 6310 - DNA, 20 bp, Artificial Sequence
  chemically synthesized
ttccccactgcagccacact

SEQ ID NO: 6311 - DNA, 20 bp, Artificial Sequence
  chemically synthesized
tccccactgcagccacactc

SEQ ID NO: 6312 - DNA, 20 bp, Artificial Sequence
  chemically synthesized
actcaggaccccatttgacc

SEQ ID NO: 6313 - DNA, 20 bp, Artificial Sequence
  chemically synthesized
ctcaggaccccatttgaccc

SEQ ID NO: 6314 - DNA, 20 bp, Artificial Sequence
  chemically synthesized
tcaggaccccatttgaccca

SEQ ID NO: 6315 - DNA, 20 bp, Artificial Sequence
  chemically synthesized
aggaccccatttgacccagg

SEQ ID NO: 6316 - DNA, 20 bp, Artificial Sequence
  chemically synthesized
ggaccccatttgacccaggg

SEQ ID NO: 6317 - DNA, 20 bp, Artificial Sequence
  chemically synthesized
ccactgcccactcccgctct

SEQ ID NO: 6318 - DNA, 20 bp, Artificial Sequence
  chemically synthesized
gcccactcccgctctgagca

SEQ ID NO: 6319 - DNA, 20 bp, Artificial Sequence
  chemically synthesized
ctgcccccaccccttcctcc

SEQ ID NO: 6320 - DNA, 20 bp, Artificial Sequence
  chemically synthesized
tgcccccaccccttcctcca

SEQ ID NO: 6321 - DNA, 20 bp, Artificial Sequence
  chemically synthesized
cctttgcattcctctccatc

SEQ ID NO: 6322 - DNA, 20 bp, Artificial Sequence
  chemically synthesized
ttgcattcctctccatccag

SEQ ID NO: 6323 - DNA, 20 bp, Artificial Sequence
  chemically synthesized
ccagaagcgctccatgacca

SEQ ID NO: 6324 - DNA, 20 bp, Artificial Sequence
  chemically synthesized
tgaccacggtgttccccacc

SEQ ID NO: 6325 - DNA, 20 bp, Artificial Sequence
  chemically synthesized
cacggtgttccccaccaagc

SEQ ID NO: 6326 - DNA, 20 bp, Artificial Sequence
  chemically synthesized
cccaccaagctggccctcca

SEQ ID NO: 6327 - DNA, 20 bp, Artificial Sequence
  chemically synthesized
caagctggccctccatggct

SEQ ID NO: 6328 - DNA, 20 bp, Artificial Sequence
  chemically synthesized
gagtccctgactgctgtctt

SEQ ID NO: 6329 - DNA, 20 bp, Artificial Sequence
  chemically synthesized
tgtcttcagcaccctccact

SEQ ID NO: 6330 - DNA, 20 bp, Artificial Sequence
  chemically synthesized
tcttcagcaccctccactca

SEQ ID NO: 6331 - DNA, 20 bp, Artificial Sequence
  chemically synthesized
cttcagcaccctccactcag

SEQ ID NO: 6332 - DNA, 20 bp, Artificial Sequence
  chemically synthesized
ttcagcaccctccactcaga

SEQ ID NO: 6333 - DNA, 20 bp, Artificial Sequence
  chemically synthesized
gagggtcctgtcctgcttcc

SEQ ID NO: 6334 - DNA, 20 bp, Artificial Sequence
  chemically synthesized
gacttatcaactcccaatgc

SEQ ID NO: 6335 - DNA, 20 bp, Artificial Sequence
  chemically synthesized
acttatcaactcccaatgct

SEQ ID NO: 6336 - DNA, 20 bp, Artificial Sequence
  chemically synthesized
atcaactcccaatgctgggt

SEQ ID NO: 6337 - DNA, 20 bp, Artificial Sequence
  chemically synthesized
ctcccaatgctgggtcagcc

SEQ ID NO: 6338 - DNA, 20 bp, Artificial Sequence
  chemically synthesized
ctgtatatccaccctgaaac

SEQ ID NO: 6339 - DNA, 20 bp, Artificial Sequence
  chemically synthesized
ccctgaaaccagactgccca

SEQ ID NO: 6340 - DNA, 20 bp, Artificial Sequence
  chemically synthesized
cctgaaaccagactgcccac

SEQ ID NO: 6341 - DNA, 20 bp, Artificial Sequence
  chemically synthesized
ctgaaaccagactgcccaca

SEQ ID NO: 6342 - DNA, 20 bp, Artificial Sequence
  chemically synthesized
aaaccagactgcccacaggg

SEQ ID NO: 6343 - DNA, 20 bp, Artificial Sequence
  chemically synthesized
agactgcccacagggtagcc

SEQ ID NO: 6344 - DNA, 20 bp, Artificial Sequence
  chemically synthesized
gggtagcccagctgtgcctc

SEQ ID NO: 6345 - DNA, 20 bp, Artificial Sequence
  chemically synthesized
ggtagcccagctgtgcctcc

SEQ ID NO: 6346 - DNA, 20 bp, Artificial Sequence
  chemically synthesized
agcccagctgtgcctccagg

SEQ ID NO: 6347 - DNA, 20 bp, Artificial Sequence
  chemically synthesized
ctgtgcctccaggtagctct

SEQ ID NO: 6348 - DNA, 20 bp, Artificial Sequence
  chemically synthesized
gtagctctgagatcatgcac

SEQ ID NO: 6349 - DNA, 20 bp, Artificial Sequence
  chemically synthesized
ccattttctcgtgtgtaaaa

SEQ ID NO: 6350 - DNA, 20 bp, Artificial Sequence
  chemically synthesized
attttctcgtgtgtaaaatg

SEQ ID NO: 6351 - DNA, 20 bp, Artificial Sequence
  chemically synthesized
cgtgtgtaaaatggagatca

SEQ ID NO: 6352 - DNA, 20 bp, Artificial Sequence
  chemically synthesized
taaaatggagatcacagtcg

SEQ ID NO: 6353 - DNA, 20 bp, Artificial Sequence
  chemically synthesized
cacagtcgtagctacccgat

SEQ ID NO: 6354 - DNA, 20 bp, Artificial Sequence
  chemically synthesized
agctacccgattggattgct

SEQ ID NO: 6355 - DNA, 20 bp, Artificial Sequence
  chemically synthesized
gattggattgctcggataat

SEQ ID NO: 6356 - DNA, 20 bp, Artificial Sequence
  chemically synthesized
gattgctcggataattagat

SEQ ID NO: 6357 - DNA, 20 bp, Artificial Sequence
  chemically synthesized
aaaatatgtaatgtgcttct

SEQ ID NO: 6358 - DNA, 20 bp, Artificial Sequence
  chemically synthesized
aaatatgtaatgtgcttctt

SEQ ID NO: 6359 - DNA, 20 bp, Artificial Sequence
  chemically synthesized
gtaatgtgcttcttaggcaa

SEQ ID NO: 6360 - DNA, 20 bp, Artificial Sequence
  chemically synthesized
aggcaaaagtttgaacataa

SEQ ID NO: 6361 - DNA, 20 bp, Artificial Sequence
  chemically synthesized
aaaagtttgaacataaaaga

SEQ ID NO: 6362 - DNA, 20 bp, Artificial Sequence
  chemically synthesized
aaagtttgaacataaaagac

SEQ ID NO: 6363 - DNA, 20 bp, Artificial Sequence
  chemically synthesized
aagtttgaacataaaagaca

SEQ ID NO: 6364 - DNA, 20 bp, Artificial Sequence
  chemically synthesized
ataaaagacagggtctgccc

SEQ ID NO: 6365 - DNA, 20 bp, Artificial Sequence
  chemically synthesized
aagacagggtctgcccaaga

SEQ ID NO: 6366 - DNA, 20 bp, Artificial Sequence
  chemically synthesized
agacagggtctgcccaagat

SEQ ID NO: 6367 - DNA, 20 bp, Artificial Sequence
  chemically synthesized
cagggtctgcccaagatggg

SEQ ID NO: 6368 - DNA, 20 bp, Artificial Sequence
  chemically synthesized
gggtctgcccaagatgggaa

SEQ ID NO: 6369 - DNA, 20 bp, Artificial Sequence
  chemically synthesized
gggaagagttcttctctccc

SEQ ID NO: 6370 - DNA, 20 bp, Artificial Sequence
  chemically synthesized
agaaacaatcaaaacaaaaa

SEQ ID NO: 6371 - DNA, 20 bp, Artificial Sequence
  chemically synthesized
aaaacaaaaacagacaacta

SEQ ID NO: 6372 - DNA, 20 bp, Artificial Sequence
  chemically synthesized
aaacagacaactatagaaca

SEQ ID NO: 6373 - DNA, 20 bp, Artificial Sequence
  chemically synthesized
cagacaactatagaacatgg

SEQ ID NO: 6374 - DNA, 20 bp, Artificial Sequence
  chemically synthesized
tatagaacatggcagctttc

SEQ ID NO: 6375 - DNA, 20 bp, Artificial Sequence
  chemically synthesized
catggcagctttcaagactc

SEQ ID NO: 6376 - DNA, 20 bp, Artificial Sequence
  chemically synthesized
gctttcaagactctggacat

SEQ ID NO: 6377 - DNA, 20 bp, Artificial Sequence
  chemically synthesized
ctttcaagactctggacatc

SEQ ID NO: 6378 - DNA, 20 bp, Artificial Sequence
  chemically synthesized
caagactctggacatcaggc

SEQ ID NO: 6379 - DNA, 20 bp, Artificial Sequence
  chemically synthesized
aagactctggacatcaggca

SEQ ID NO: 6380 - DNA, 20 bp, Artificial Sequence
  chemically synthesized
gactctggacatcaggcaag

SEQ ID NO: 6381 - DNA, 20 bp, Artificial Sequence
  chemically synthesized
actctggacatcaggcaagg

SEQ ID NO: 6382 - DNA, 20 bp, Artificial Sequence
  chemically synthesized
tctggacatcaggcaaggag

SEQ ID NO: 6383 - DNA, 20 bp, Artificial Sequence
  chemically synthesized
acatcaggcaaggaggagta

SEQ ID NO: 6384 - DNA, 20 bp, Artificial Sequence
  chemically synthesized
aaggaggagtaaagatccct

SEQ ID NO: 6385 - DNA, 20 bp, Artificial Sequence
  chemically synthesized
aggaggagtaaagatccctg

SEQ ID NO: 6386 - DNA, 20 bp, Artificial Sequence
  chemically synthesized
ggaggagtaaagatccctga

SEQ ID NO: 6387 - DNA, 20 bp, Artificial Sequence
  chemically synthesized
agtaaagatccctgagggat

SEQ ID NO: 6388 - DNA, 20 bp, Artificial Sequence
  chemically synthesized
aaagatccctgagggataag

SEQ ID NO: 6389 - DNA, 20 bp, Artificial Sequence
  chemically synthesized
gagggataagaagcaaacaa

SEQ ID NO: 6390 - DNA, 20 bp, Artificial Sequence
  chemically synthesized
agggataagaagcaaacaac

SEQ ID NO: 6391 - DNA, 20 bp, Artificial Sequence
  chemically synthesized
caggaaccctccgatcaccc

SEQ ID NO: 6392 - DNA, 20 bp, Artificial Sequence
  chemically synthesized
gatcaccccagcttactgtt

SEQ ID NO: 6393 - DNA, 20 bp, Artificial Sequence
  chemically synthesized
tcaccccagcttactgtttg

SEQ ID NO: 6394 - DNA, 20 bp, Artificial Sequence
  chemically synthesized
accccagcttactgtttgga

SEQ ID NO: 6395 - DNA, 20 bp, Artificial Sequence
  chemically synthesized
cccagcttactgtttggaga

SEQ ID NO: 6396 - DNA, 20 bp, Artificial Sequence
  chemically synthesized
tactgtttggagagagtctg

SEQ ID NO: 6397 - DNA, 20 bp, Artificial Sequence
  chemically synthesized
actgtttggagagagtctgc

SEQ ID NO: 6398 - DNA, 20 bp, Artificial Sequence
  chemically synthesized
tggagagagtctgcaggtta

SEQ ID NO: 6399 - DNA, 20 bp, Artificial Sequence
  chemically synthesized
ggagagagtctgcaggttac

SEQ ID NO: 6400 - DNA, 20 bp, Artificial Sequence
  chemically synthesized
agagtctgcaggttacaggc

SEQ ID NO: 6401 - DNA, 20 bp, Artificial Sequence
  chemically synthesized
gagtctgcaggttacaggcc

SEQ ID NO: 6402 - DNA, 20 bp, Artificial Sequence
  chemically synthesized
ctgcaggttacaggccagga

SEQ ID NO: 6403 - DNA, 20 bp, Artificial Sequence
  chemically synthesized
tgcaggttacaggccaggaa

SEQ ID NO: 6404 - DNA, 20 bp, Artificial Sequence
  chemically synthesized
gcaggttacaggccaggaaa

SEQ ID NO: 6405 - DNA, 20 bp, Artificial Sequence
  chemically synthesized
ggttacaggccaggaaaggg

SEQ ID NO: 6406 - DNA, 20 bp, Artificial Sequence
  chemically synthesized
caggccaggaaagggaagtc

SEQ ID NO: 6407 - DNA, 20 bp, Artificial Sequence
  chemically synthesized
aggccaggaaagggaagtcc

SEQ ID NO: 6408 - DNA, 20 bp, Artificial Sequence
  chemically synthesized
ccaggaaagggaagtccagg

SEQ ID NO: 6409 - DNA, 20 bp, Artificial Sequence
  chemically synthesized
aggaaagggaagtccaggca

SEQ ID NO: 6410 - DNA, 20 bp, Artificial Sequence
  chemically synthesized
gggaagtccaggcagagccc

SEQ ID NO: 6411 - DNA, 20 bp, Artificial Sequence
  chemically synthesized
gaagtccaggcagagcccaa

SEQ ID NO: 6412 - DNA, 20 bp, Artificial Sequence
  chemically synthesized
cccaagagactccccacgtt

SEQ ID NO: 6413 - DNA, 20 bp, Artificial Sequence
  chemically synthesized
ccaagagactccccacgttg

SEQ ID NO: 6414 - DNA, 20 bp, Artificial Sequence
  chemically synthesized
aagagactccccacgttgag

SEQ ID NO: 6415 - DNA, 20 bp, Artificial Sequence
  chemically synthesized
gactccccacgttgaggaga

SEQ ID NO: 6416 - DNA, 20 bp, Artificial Sequence
  chemically synthesized
ctccccacgttgaggagatg

SEQ ID NO: 6417 - DNA, 20 bp, Artificial Sequence
  chemically synthesized
cacgttgaggagatggagct

SEQ ID NO: 6418 - DNA, 20 bp, Artificial Sequence
  chemically synthesized
cgttgaggagatggagctga

SEQ ID NO: 6419 - DNA, 20 bp, Artificial Sequence
  chemically synthesized
ggagatggagctgagagtcc

SEQ ID NO: 6420 - DNA, 20 bp, Artificial Sequence
  chemically synthesized
gagatggagctgagagtccg

SEQ ID NO: 6421 - DNA, 20 bp, Artificial Sequence
  chemically synthesized
gatggagctgagagtccgag

SEQ ID NO: 6422 - DNA, 20 bp, Artificial Sequence
  chemically synthesized
ccgaggagaccaaaacaatt

SEQ ID NO: 6423 - DNA, 20 bp, Artificial Sequence
  chemically synthesized
gaggagaccaaaacaattaa

SEQ ID NO: 6424 - DNA, 20 bp, Artificial Sequence
  chemically synthesized
caaacgatcaaactgactct

SEQ ID NO: 6425 - DNA, 20 bp, Artificial Sequence
  chemically synthesized
taagttgcttaactgcatcc

SEQ ID NO: 6426 - DNA, 20 bp, Artificial Sequence
  chemically synthesized
agttgcttaactgcatcccg

SEQ ID NO: 6427 - DNA, 20 bp, Artificial Sequence
  chemically synthesized
cttaactgcatcccggagca

SEQ ID NO: 6428 - DNA, 20 bp, Artificial Sequence
  chemically synthesized
tgcatcccggagcaaagctc

SEQ ID NO: 6429 - DNA, 20 bp, Artificial Sequence
  chemically synthesized
gagcaaagctcaagaacatt

SEQ ID NO: 6430 - DNA, 20 bp, Artificial Sequence
  chemically synthesized
gcaaagctcaagaacattta

SEQ ID NO: 6431 - DNA, 20 bp, Artificial Sequence
  chemically synthesized
caaagctcaagaacatttag

SEQ ID NO: 6432 - DNA, 20 bp, Artificial Sequence
  chemically synthesized
tagaggaatacaaaaatatc

SEQ ID NO: 6433 - DNA, 20 bp, Artificial Sequence
  chemically synthesized
aaaaatatccagcacccaac

SEQ ID NO: 6434 - DNA, 20 bp, Artificial Sequence
  chemically synthesized
aaaatatccagcacccaaca

SEQ ID NO: 6435 - DNA, 20 bp, Artificial Sequence
  chemically synthesized
aaggtgaaattgacaatgtc

SEQ ID NO: 6436 - DNA, 20 bp, Artificial Sequence
  chemically synthesized
gtgaaattgacaatgtctgg

SEQ ID NO: 6437 - DNA, 20 bp, Artificial Sequence
  chemically synthesized
caatgtctggcagccaatca

SEQ ID NO: 6438 - DNA, 20 bp, Artificial Sequence
  chemically synthesized
ggcagccaatcaaagattac

SEQ ID NO: 6439 - DNA, 20 bp, Artificial Sequence
  chemically synthesized
gcagccaatcaaagattaca

SEQ ID NO: 6440 - DNA, 20 bp, Artificial Sequence
  chemically synthesized
ttacaaggcatgcaatgaaa

SEQ ID NO: 6441 - DNA, 20 bp, Artificial Sequence
  chemically synthesized
tacaaggcatgcaatgaaac

SEQ ID NO: 6442 - DNA, 20 bp, Artificial Sequence
  chemically synthesized
gggaaaacacaatgcataac

SEQ ID NO: 6443 - DNA, 20 bp, Artificial Sequence
  chemically synthesized
ggaaaacacaatgcataacg

SEQ ID NO: 6444 - DNA, 20 bp, Artificial Sequence
  chemically synthesized
aaaacacaatgcataacgag

SEQ ID NO: 6445 - DNA, 20 bp, Artificial Sequence
  chemically synthesized
aaacacaatgcataacgagg

SEQ ID NO: 6446 - DNA, 20 bp, Artificial Sequence
  chemically synthesized
aggaggttcataaatatcaa

SEQ ID NO: 6447 - DNA, 20 bp, Artificial Sequence
  chemically synthesized
gaggttcataaatatcaaaa

SEQ ID NO: 6448 - DNA, 20 bp, Artificial Sequence
  chemically synthesized
cataaatatcaaaagagatc

SEQ ID NO: 6449 - DNA, 20 bp, Artificial Sequence
  chemically synthesized
aaagagatccagaactgaca

SEQ ID NO: 6450 - DNA, 20 bp, Artificial Sequence
  chemically synthesized
tccagaactgacacggatgc

SEQ ID NO: 6451 - DNA, 20 bp, Artificial Sequence
  chemically synthesized
actgacacggatgctagaat

SEQ ID NO: 6452 - DNA, 20 bp, Artificial Sequence
  chemically synthesized
gacacggatgctagaattag

SEQ ID NO: 6453 - DNA, 20 bp, Artificial Sequence
  chemically synthesized
acacggatgctagaattagc

SEQ ID NO: 6454 - DNA, 20 bp, Artificial Sequence
  chemically synthesized
ggatgctagaattagcaggc

SEQ ID NO: 6455 - DNA, 20 bp, Artificial Sequence
  chemically synthesized
gatgctagaattagcaggca

SEQ ID NO: 6456 - DNA, 20 bp, Artificial Sequence
  chemically synthesized
ctagaattagcaggcaagga

SEQ ID NO: 6457 - DNA, 20 bp, Artificial Sequence
  chemically synthesized
agcaggcaaggatggtaaaa

SEQ ID NO: 6458 - DNA, 20 bp, Artificial Sequence
  chemically synthesized
ggatggtaaaacagatatta

SEQ ID NO: 6459 - DNA, 20 bp, Artificial Sequence
  chemically synthesized
cccattatgttcaaaaaatt

SEQ ID NO: 6460 - DNA, 20 bp, Artificial Sequence
  chemically synthesized
attatgttcaaaaaattaag

SEQ ID NO: 6461 - DNA, 20 bp, Artificial Sequence
  chemically synthesized
caaaaaattaagtagaattg

SEQ ID NO: 6462 - DNA, 20 bp, Artificial Sequence
  chemically synthesized
aaaaattaagtagaattgtg

SEQ ID NO: 6463 - DNA, 20 bp, Artificial Sequence
  chemically synthesized
aaaattaagtagaattgtgg

SEQ ID NO: 6464 - DNA, 20 bp, Artificial Sequence
  chemically synthesized
tagaattgtggaggatattt

SEQ ID NO: 6465 - DNA, 20 bp, Artificial Sequence
  chemically synthesized
gaattgtggaggatatttaa

SEQ ID NO: 6466 - DNA, 20 bp, Artificial Sequence
  chemically synthesized
ggaggatatttaagagtccc

SEQ ID NO: 6467 - DNA, 20 bp, Artificial Sequence
  chemically synthesized
gaggatatttaagagtcccc

SEQ ID NO: 6468 - DNA, 20 bp, Artificial Sequence
  chemically synthesized
agagtccccaggtgaacttc

SEQ ID NO: 6469 - DNA, 20 bp, Artificial Sequence
  chemically synthesized
agtccccaggtgaacttcta

SEQ ID NO: 6470 - DNA, 20 bp, Artificial Sequence
  chemically synthesized
tctgaaatgaaaaaacacac

SEQ ID NO: 6471 - DNA, 20 bp, Artificial Sequence
  chemically synthesized
aaatgaaaaaacacactggc

SEQ ID NO: 6472 - DNA, 20 bp, Artificial Sequence
  chemically synthesized
aatgaaaaaacacactggcc

SEQ ID NO: 6473 - DNA, 20 bp, Artificial Sequence
  chemically synthesized
aacacactggccaggcgccg

SEQ ID NO: 6474 - DNA, 20 bp, Artificial Sequence
  chemically synthesized
caggcgccgtggctcacgcc

SEQ ID NO: 6475 - DNA, 20 bp, Artificial Sequence
  chemically synthesized
gtggctcacgcctggaatcc

SEQ ID NO: 6476 - DNA, 20 bp, Artificial Sequence
  chemically synthesized
cgcctggaatcccagcactg

SEQ ID NO: 6477 - DNA, 20 bp, Artificial Sequence
  chemically synthesized
gcctggaatcccagcactgt

SEQ ID NO: 6478 - DNA, 20 bp, Artificial Sequence
  chemically synthesized
ctggaatcccagcactgtgg

SEQ ID NO: 6479 - DNA, 20 bp, Artificial Sequence
  chemically synthesized
tggaatcccagcactgtggg

SEQ ID NO: 6480 - DNA, 20 bp, Artificial Sequence
  chemically synthesized
tcccagcactgtgggaggcc

SEQ ID NO: 6481 - DNA, 20 bp, Artificial Sequence
  chemically synthesized
cccagcactgtgggaggcca

SEQ ID NO: 6482 - DNA, 20 bp, Artificial Sequence
  chemically synthesized
agcactgtgggaggccaagg

SEQ ID NO: 6483 - DNA, 20 bp, Artificial Sequence
  chemically synthesized
gcactgtgggaggccaaggc

SEQ ID NO: 6484 - DNA, 20 bp, Artificial Sequence
  chemically synthesized
ctgtgggaggccaaggcggg

SEQ ID NO: 6485 - DNA, 20 bp, Artificial Sequence
  chemically synthesized
ggccaaggcgggcagatcat

SEQ ID NO: 6486 - DNA, 20 bp, Artificial Sequence
  chemically synthesized
gccaaggcgggcagatcatg

SEQ ID NO: 6487 - DNA, 20 bp, Artificial Sequence
  chemically synthesized
aggcgggcagatcatgaggt

SEQ ID NO: 6488 - DNA, 20 bp, Artificial Sequence
  chemically synthesized
ggcgggcagatcatgaggtc

SEQ ID NO: 6489 - DNA, 20 bp, Artificial Sequence
  chemically synthesized
cgggcagatcatgaggtcag

SEQ ID NO: 6490 - DNA, 20 bp, Artificial Sequence
  chemically synthesized
tcaggagatcgacaccatcc

SEQ ID NO: 6491 - DNA, 20 bp, Artificial Sequence
  chemically synthesized
cgacaccatcctggctaaca

SEQ ID NO: 6492 - DNA, 20 bp, Artificial Sequence
  chemically synthesized
ctactaaaaatacaaaaaat

SEQ ID NO: 6493 - DNA, 20 bp, Artificial Sequence
  chemically synthesized
taaaaatacaaaaaattagc

SEQ ID NO: 6494 - DNA, 20 bp, Artificial Sequence
  chemically synthesized
tacaaaaaattagccagacg

SEQ ID NO: 6495 - DNA, 20 bp, Artificial Sequence
  chemically synthesized
aaaaaattagccagacgtgg

SEQ ID NO: 6496 - DNA, 20 bp, Artificial Sequence
  chemically synthesized
aaattagccagacgtggtgg

SEQ ID NO: 6497 - DNA, 20 bp, Artificial Sequence
  chemically synthesized
aattagccagacgtggtggc

SEQ ID NO: 6498 - DNA, 20 bp, Artificial Sequence
  chemically synthesized
gacgtggtggcaggcgcctg

SEQ ID NO: 6499 - DNA, 20 bp, Artificial Sequence
  chemically synthesized
gtggcaggcgcctgtagtcc

SEQ ID NO: 6500 - DNA, 20 bp, Artificial Sequence
  chemically synthesized
cgcctgtagtcccagctact

SEQ ID NO: 6501 - DNA, 20 bp, Artificial Sequence
  chemically synthesized
gcctgtagtcccagctactc

SEQ ID NO: 6502 - DNA, 20 bp, Artificial Sequence
  chemically synthesized
ctgtagtcccagctactcgg

SEQ ID NO: 6503 - DNA, 20 bp, Artificial Sequence
  chemically synthesized
tgtagtcccagctactcggg

SEQ ID NO: 6504 - DNA, 20 bp, Artificial Sequence
  chemically synthesized
tcccagctactcgggaggct

SEQ ID NO: 6505 - DNA, 20 bp, Artificial Sequence
  chemically synthesized
cccagctactcgggaggctg

SEQ ID NO: 6506 - DNA, 20 bp, Artificial Sequence
  chemically synthesized
agctactcgggaggctgagg

SEQ ID NO: 6507 - DNA, 20 bp, Artificial Sequence
  chemically synthesized
gctactcgggaggctgaggc

SEQ ID NO: 6508 - DNA, 20 bp, Artificial Sequence
  chemically synthesized
tactcgggaggctgaggcag

SEQ ID NO: 6509 - DNA, 20 bp, Artificial Sequence
  chemically synthesized
gggaggctgaggcaggagaa

SEQ ID NO: 6510 - DNA, 20 bp, Artificial Sequence
  chemically synthesized
gcaggagaatggcatgaacc

SEQ ID NO: 6511 - DNA, 20 bp, Artificial Sequence
  chemically synthesized
caggagaatggcatgaaccc

SEQ ID NO: 6512 - DNA, 20 bp, Artificial Sequence
  chemically synthesized
ggagaatggcatgaacccgg

SEQ ID NO: 6513 - DNA, 20 bp, Artificial Sequence
  chemically synthesized
gagaatggcatgaacccggg

SEQ ID NO: 6514 - DNA, 20 bp, Artificial Sequence
  chemically synthesized
aatggcatgaacccgggagg

SEQ ID NO: 6515 - DNA, 20 bp, Artificial Sequence
  chemically synthesized
tggcatgaacccgggaggca

SEQ ID NO: 6516 - DNA, 20 bp, Artificial Sequence
  chemically synthesized
aacccgggaggcagagcttg

SEQ ID NO: 6517 - DNA, 20 bp, Artificial Sequence
  chemically synthesized
cgggaggcagagcttgcagt

SEQ ID NO: 6518 - DNA, 20 bp, Artificial Sequence
  chemically synthesized
ggcagagcttgcagtgagcc

SEQ ID NO: 6519 - DNA, 20 bp, Artificial Sequence
  chemically synthesized
aagatcgcgccactgcactc

SEQ ID NO: 6520 - DNA, 20 bp, Artificial Sequence
  chemically synthesized
cgcgccactgcactccggcc

SEQ ID NO: 6521 - DNA, 20 bp, Artificial Sequence
  chemically synthesized
gcgccactgcactccggcct

SEQ ID NO: 6522 - DNA, 20 bp, Artificial Sequence
  chemically synthesized
ctgcactccggcctgggcaa

SEQ ID NO: 6523 - DNA, 20 bp, Artificial Sequence
  chemically synthesized
gcactccggcctgggcaaca

SEQ ID NO: 6524 - DNA, 20 bp, Artificial Sequence
  chemically synthesized
tccggcctgggcaacagagc

SEQ ID NO: 6525 - DNA, 20 bp, Artificial Sequence
  chemically synthesized
ccgcctccaaaaaaaaaaaa

SEQ ID NO: 6526 - DNA, 20 bp, Artificial Sequence
  chemically synthesized
tccaaaaaaaaaaaaaagaa

SEQ ID NO: 6527 - DNA, 20 bp, Artificial Sequence
  chemically synthesized
aaaaaaaaaaaaagaaaaga

SEQ ID NO: 6528 - DNA, 20 bp, Artificial Sequence
  chemically synthesized
aaaaaaaagaaaagaaagaa

SEQ ID NO: 6529 - DNA, 20 bp, Artificial Sequence
  chemically synthesized
aaagaaaagaaaaaacacac

SEQ ID NO: 6530 - DNA, 20 bp, Artificial Sequence
  chemically synthesized
aaaagaaaaaacacactgga

SEQ ID NO: 6531 - DNA, 20 bp, Artificial Sequence
  chemically synthesized
aacacactggatggaaataa

SEQ ID NO: 6532 - DNA, 20 bp, Artificial Sequence
  chemically synthesized
acactggatggaaataatgg

SEQ ID NO: 6533 - DNA, 20 bp, Artificial Sequence
  chemically synthesized
ggatggaaataatggaagat

SEQ ID NO: 6534 - DNA, 20 bp, Artificial Sequence
  chemically synthesized
atggaagatgagaaatgcgt

SEQ ID NO: 6535 - DNA, 20 bp, Artificial Sequence
  chemically synthesized
agaaatgcgtaagaaaaatt

SEQ ID NO: 6536 - DNA, 20 bp, Artificial Sequence
  chemically synthesized
gaaatgcgtaagaaaaattt

SEQ ID NO: 6537 - DNA, 20 bp, Artificial Sequence
  chemically synthesized
aaatgcgtaagaaaaattta

SEQ ID NO: 6538 - DNA, 20 bp, Artificial Sequence
  chemically synthesized
gcgtaagaaaaatttagggc

SEQ ID NO: 6539 - DNA, 20 bp, Artificial Sequence
  chemically synthesized
cgtaagaaaaatttagggcc

SEQ ID NO: 6540 - DNA, 20 bp, Artificial Sequence
  chemically synthesized
aaatttagggccaggcactg

SEQ ID NO: 6541 - DNA, 20 bp, Artificial Sequence
  chemically synthesized
gtggatcacatctgtaatcc

SEQ ID NO: 6542 - DNA, 20 bp, Artificial Sequence
  chemically synthesized
catctgtaatcccagcactt

SEQ ID NO: 6543 - DNA, 20 bp, Artificial Sequence
  chemically synthesized
atctgtaatcccagcacttt

SEQ ID NO: 6544 - DNA, 20 bp, Artificial Sequence
  chemically synthesized
ctgtaatcccagcactttgg

SEQ ID NO: 6545 - DNA, 20 bp, Artificial Sequence
  chemically synthesized
tgtaatcccagcactttggg

SEQ ID NO: 6546 - DNA, 20 bp, Artificial Sequence
  chemically synthesized
agcactttgggaggtcgaca

SEQ ID NO: 6547 - DNA, 20 bp, Artificial Sequence
  chemically synthesized
gcactttgggaggtcgacac

SEQ ID NO: 6548 - DNA, 20 bp, Artificial Sequence
  chemically synthesized
cactttgggaggtcgacacg

SEQ ID NO: 6549 - DNA, 20 bp, Artificial Sequence
  chemically synthesized
actttgggaggtcgacacgg

SEQ ID NO: 6550 - DNA, 20 bp, Artificial Sequence
  chemically synthesized
ctttgggaggtcgacacggg

SEQ ID NO: 6551 - DNA, 20 bp, Artificial Sequence
  chemically synthesized
cgacacggggggaatcactt

SEQ ID NO: 6552 - DNA, 20 bp, Artificial Sequence
  chemically synthesized
cggggggaatcacttgagcc

SEQ ID NO: 6553 - DNA, 20 bp, Artificial Sequence
  chemically synthesized
ggggggaatcacttgagccc

SEQ ID NO: 6554 - DNA, 20 bp, Artificial Sequence
  chemically synthesized
ggggaatcacttgagcccag

SEQ ID NO: 6555 - DNA, 20 bp, Artificial Sequence
  chemically synthesized
tcacttgagcccaggagctc

SEQ ID NO: 6556 - DNA, 20 bp, Artificial Sequence
  chemically synthesized
tgagcccaggagctcaagac

SEQ ID NO: 6557 - DNA, 20 bp, Artificial Sequence
  chemically synthesized
ccaggagctcaagactagtc

SEQ ID NO: 6558 - DNA, 20 bp, Artificial Sequence
  chemically synthesized
caggagctcaagactagtct

SEQ ID NO: 6559 - DNA, 20 bp, Artificial Sequence
  chemically synthesized
gagctcaagactagtctggg

SEQ ID NO: 6560 - DNA, 20 bp, Artificial Sequence
  chemically synthesized
caagactagtctgggcagca

SEQ ID NO: 6561 - DNA, 20 bp, Artificial Sequence
  chemically synthesized
catggcaaaacccctctaca

SEQ ID NO: 6562 - DNA, 20 bp, Artificial Sequence
  chemically synthesized
tacaaaaaaaaatttttaat

SEQ ID NO: 6563 - DNA, 20 bp, Artificial Sequence
  chemically synthesized
aaaaaaaatttttaattagc

SEQ ID NO: 6564 - DNA, 20 bp, Artificial Sequence
  chemically synthesized
aaaaaaatttttaattagcc

SEQ ID NO: 6565 - DNA, 20 bp, Artificial Sequence
  chemically synthesized
aatttttaattagccaggtg

SEQ ID NO: 6566 - DNA, 20 bp, Artificial Sequence
  chemically synthesized
ggtgtggtgccacatgccta

SEQ ID NO: 6567 - DNA, 20 bp, Artificial Sequence
  chemically synthesized
gtgccacatgcctatagtcc

SEQ ID NO: 6568 - DNA, 20 bp, Artificial Sequence
  chemically synthesized
tgcctatagtcccagctacc

SEQ ID NO: 6569 - DNA, 20 bp, Artificial Sequence
  chemically synthesized
gcctatagtcccagctacct

SEQ ID NO: 6570 - DNA, 20 bp, Artificial Sequence
  chemically synthesized
ctatagtcccagctacctgg

SEQ ID NO: 6571 - DNA, 20 bp, Artificial Sequence
  chemically synthesized
tatagtcccagctacctggg

SEQ ID NO: 6572 - DNA, 20 bp, Artificial Sequence
  chemically synthesized
cccagctacctgggaggctg

SEQ ID NO: 6573 - DNA, 20 bp, Artificial Sequence
  chemically synthesized
agctacctgggaggctgaag

SEQ ID NO: 6574 - DNA, 20 bp, Artificial Sequence
  chemically synthesized
tacctgggaggctgaagtgg

SEQ ID NO: 6575 - DNA, 20 bp, Artificial Sequence
  chemically synthesized
acctgggaggctgaagtgga

SEQ ID NO: 6576 - DNA, 20 bp, Artificial Sequence
  chemically synthesized
ctgaagtggaaggatcgcct

SEQ ID NO: 6577 - DNA, 20 bp, Artificial Sequence
  chemically synthesized
gtggaaggatcgcctgagcc

SEQ ID NO: 6578 - DNA, 20 bp, Artificial Sequence
  chemically synthesized
tggaaggatcgcctgagccc

SEQ ID NO: 6579 - DNA, 20 bp, Artificial Sequence
  chemically synthesized
gaaggatcgcctgagcccag

SEQ ID NO: 6580 - DNA, 20 bp, Artificial Sequence
  chemically synthesized
aaggatcgcctgagcccagg

SEQ ID NO: 6581 - DNA, 20 bp, Artificial Sequence
  chemically synthesized
gatcgcctgagcccaggagg

SEQ ID NO: 6582 - DNA, 20 bp, Artificial Sequence
  chemically synthesized
tcgcctgagcccaggaggtg

SEQ ID NO: 6583 - DNA, 20 bp, Artificial Sequence
  chemically synthesized
cgcctgagcccaggaggtgg

SEQ ID NO: 6584 - DNA, 20 bp, Artificial Sequence
  chemically synthesized
agcccaggaggtggaggcca

SEQ ID NO: 6585 - DNA, 20 bp, Artificial Sequence
  chemically synthesized
caggaggtggaggccacagt

SEQ ID NO: 6586 - DNA, 20 bp, Artificial Sequence
  chemically synthesized
aggccacagtgagttgtgac

SEQ ID NO: 6587 - DNA, 20 bp, Artificial Sequence
  chemically synthesized
tgtgacaagctactgcattc

SEQ ID NO: 6588 - DNA, 20 bp, Artificial Sequence
  chemically synthesized
caagctactgcattccagcc

SEQ ID NO: 6589 - DNA, 20 bp, Artificial Sequence
  chemically synthesized
aagctactgcattccagcct

SEQ ID NO: 6590 - DNA, 20 bp, Artificial Sequence
  chemically synthesized
ctgcattccagcctgggcaa

SEQ ID NO: 6591 - DNA, 20 bp, Artificial Sequence
  chemically synthesized
gcattccagcctgggcaaca

SEQ ID NO: 6592 - DNA, 20 bp, Artificial Sequence
  chemically synthesized
tccagcctgggcaacagagt

SEQ ID NO: 6593 - DNA, 20 bp, Artificial Sequence
  chemically synthesized
cctgggcaacagagtgagat

SEQ ID NO: 6594 - DNA, 20 bp, Artificial Sequence
  chemically synthesized
tgggcaacagagtgagatga

SEQ ID NO: 6595 - DNA, 20 bp, Artificial Sequence
  chemically synthesized
ggcaacagagtgagatgaga

SEQ ID NO: 6596 - DNA, 20 bp, Artificial Sequence
  chemically synthesized
caacagagtgagatgagaga

SEQ ID NO: 6597 - DNA, 20 bp, Artificial Sequence
  chemically synthesized
acagagtgagatgagagaga

SEQ ID NO: 6598 - DNA, 20 bp, Artificial Sequence
  chemically synthesized
agagtgagatgagagagaga

SEQ ID NO: 6599 - DNA, 20 bp, Artificial Sequence
  chemically synthesized
gagtgagatgagagagagag

SEQ ID NO: 6600 - DNA, 20 bp, Artificial Sequence
  chemically synthesized
agtgagatgagagagagaga

SEQ ID NO: 6601 - DNA, 20 bp, Artificial Sequence
  chemically synthesized
gtgagatgagagagagagag

SEQ ID NO: 6602 - DNA, 20 bp, Artificial Sequence
  chemically synthesized
gagatgagagagagagaggg

SEQ ID NO: 6603 - DNA, 20 bp, Artificial Sequence
  chemically synthesized
agatgagagagagagagggg

SEQ ID NO: 6604 - DNA, 20 bp, Artificial Sequence
  chemically synthesized
gatgagagagagagagggga

SEQ ID NO: 6605 - DNA, 20 bp, Artificial Sequence
  chemically synthesized
atgagagagagagaggggag

SEQ ID NO: 6606 - DNA, 20 bp, Artificial Sequence
  chemically synthesized
agagagagagaggggagggg

SEQ ID NO: 6607 - DNA, 20 bp, Artificial Sequence
  chemically synthesized
agagagaggggaggggaagc

SEQ ID NO: 6608 - DNA, 20 bp, Artificial Sequence
  chemically synthesized
gagagaggggaggggaagcg

SEQ ID NO: 6609 - DNA, 20 bp, Artificial Sequence
  chemically synthesized
agagaggggaggggaagcga

SEQ ID NO: 6610 - DNA, 20 bp, Artificial Sequence
  chemically synthesized
gaggggaggggaagcgaggg

SEQ ID NO: 6611 - DNA, 20 bp, Artificial Sequence
  chemically synthesized
aggggaggggaagcgaggga

SEQ ID NO: 6612 - DNA, 20 bp, Artificial Sequence
  chemically synthesized
gaggggaagcgagggaagga

SEQ ID NO: 6613 - DNA, 20 bp, Artificial Sequence
  chemically synthesized
aggggaagcgagggaaggaa

SEQ ID NO: 6614 - DNA, 20 bp, Artificial Sequence
  chemically synthesized
gggaagcgagggaaggaaag

SEQ ID NO: 6615 - DNA, 20 bp, Artificial Sequence
  chemically synthesized
ggaagcgagggaaggaaagg

SEQ ID NO: 6616 - DNA, 20 bp, Artificial Sequence
  chemically synthesized
gaagcgagggaaggaaagga

SEQ ID NO: 6617 - DNA, 20 bp, Artificial Sequence
  chemically synthesized
aagcgagggaaggaaaggag

SEQ ID NO: 6618 - DNA, 20 bp, Artificial Sequence
  chemically synthesized
gcgagggaaggaaaggaggg

SEQ ID NO: 6619 - DNA, 20 bp, Artificial Sequence
  chemically synthesized
cgagggaaggaaaggagggg

SEQ ID NO: 6620 - DNA, 20 bp, Artificial Sequence
  chemically synthesized
gagggaaggaaaggagggga

SEQ ID NO: 6621 - DNA, 20 bp, Artificial Sequence
  chemically synthesized
agggaaggaaaggaggggag

SEQ ID NO: 6622 - DNA, 20 bp, Artificial Sequence
  chemically synthesized
ggaaggaaaggaggggaggg

SEQ ID NO: 6623 - DNA, 20 bp, Artificial Sequence
  chemically synthesized
gaaggaaaggaggggagggg

SEQ ID NO: 6624 - DNA, 20 bp, Artificial Sequence
  chemically synthesized
aaggaaaggaggggagggga

SEQ ID NO: 6625 - DNA, 20 bp, Artificial Sequence
  chemically synthesized
aggaaaggaggggaggggag

SEQ ID NO: 6626 - DNA, 20 bp, Artificial Sequence
  chemically synthesized
ggaaaggaggggaggggagg

SEQ ID NO: 6627 - DNA, 20 bp, Artificial Sequence
  chemically synthesized
aaaggaggggaggggagggg

SEQ ID NO: 6628 - DNA, 20 bp, Artificial Sequence
  chemically synthesized
aaggaggggaggggaggggg

SEQ ID NO: 6629 - DNA, 20 bp, Artificial Sequence
  chemically synthesized
aggaggggaggggaggggga

SEQ ID NO: 6630 - DNA, 20 bp, Artificial Sequence
  chemically synthesized
ggaggggaggggagggggag

SEQ ID NO: 6631 - DNA, 20 bp, Artificial Sequence
  chemically synthesized
ggggaggggagggggagggg

SEQ ID NO: 6632 - DNA, 20 bp, Artificial Sequence
  chemically synthesized
gggaggggagggggagggga

SEQ ID NO: 6633 - DNA, 20 bp, Artificial Sequence
  chemically synthesized
ggaggggagggggaggggaa

SEQ ID NO: 6634 - DNA, 20 bp, Artificial Sequence
  chemically synthesized
gaggggagggggaggggaag

SEQ ID NO: 6635 - DNA, 20 bp, Artificial Sequence
  chemically synthesized
ggaggggaaggggaaaattt

SEQ ID NO: 6636 - DNA, 20 bp, Artificial Sequence
  chemically synthesized
attttagttaacttaatgaa

SEQ ID NO: 6637 - DNA, 20 bp, Artificial Sequence
  chemically synthesized
aactctataaaatgaaacac

SEQ ID NO: 6638 - DNA, 20 bp, Artificial Sequence
  chemically synthesized
actctataaaatgaaacact

SEQ ID NO: 6639 - DNA, 20 bp, Artificial Sequence
  chemically synthesized
tctataaaatgaaacactgg

SEQ ID NO: 6640 - DNA, 20 bp, Artificial Sequence
  chemically synthesized
aatgaaacactgggagaaaa

SEQ ID NO: 6641 - DNA, 20 bp, Artificial Sequence
  chemically synthesized
gagaaaaaagaattaaaaaa

SEQ ID NO: 6642 - DNA, 20 bp, Artificial Sequence
  chemically synthesized
aaaaagaattaaaaaatgga

SEQ ID NO: 6643 - DNA, 20 bp, Artificial Sequence
  chemically synthesized
aaagaattaaaaaatggaaa

SEQ ID NO: 6644 - DNA, 20 bp, Artificial Sequence
  chemically synthesized
ttaaaaaatggaaagagaat

SEQ ID NO: 6645 - DNA, 20 bp, Artificial Sequence
  chemically synthesized
aaaatggaaagagaatgagt

SEQ ID NO: 6646 - DNA, 20 bp, Artificial Sequence
  chemically synthesized
gaaagagaatgagtgagctg

SEQ ID NO: 6647 - DNA, 20 bp, Artificial Sequence
  chemically synthesized
aaagagaatgagtgagctgt

SEQ ID NO: 6648 - DNA, 20 bp, Artificial Sequence
  chemically synthesized
tgcataattgaaatctttaa

SEQ ID NO: 6649 - DNA, 20 bp, Artificial Sequence
  chemically synthesized
attgaaatctttaaaagaaa

SEQ ID NO: 6650 - DNA, 20 bp, Artificial Sequence
  chemically synthesized
ttgaaatctttaaaagaaaa

SEQ ID NO: 6651 - DNA, 20 bp, Artificial Sequence
  chemically synthesized
tgaaatctttaaaagaaaaa

SEQ ID NO: 6652 - DNA, 20 bp, Artificial Sequence
  chemically synthesized
gaaatctttaaaagaaaaag

SEQ ID NO: 6653 - DNA, 20 bp, Artificial Sequence
  chemically synthesized
aaatctttaaaagaaaaagg

SEQ ID NO: 6654 - DNA, 20 bp, Artificial Sequence
  chemically synthesized
tctttaaaagaaaaaggggg

SEQ ID NO: 6655 - DNA, 20 bp, Artificial Sequence
  chemically synthesized
ttaaaagaaaaagggggtag

SEQ ID NO: 6656 - DNA, 20 bp, Artificial Sequence
  chemically synthesized
gggggtagcagaaaaaaatc

SEQ ID NO: 6657 - DNA, 20 bp, Artificial Sequence
  chemically synthesized
gcagaaaaaaatcaagtgct

SEQ ID NO: 6658 - DNA, 20 bp, Artificial Sequence
  chemically synthesized
aaaaaatcaagtgctgagac

SEQ ID NO: 6659 - DNA, 20 bp, Artificial Sequence
  chemically synthesized
aaatcaagtgctgagacaag

SEQ ID NO: 6660 - DNA, 20 bp, Artificial Sequence
  chemically synthesized
tcaagtgctgagacaagtgg

SEQ ID NO: 6661 - DNA, 20 bp, Artificial Sequence
  chemically synthesized
gtgctgagacaagtggaaga

SEQ ID NO: 6662 - DNA, 20 bp, Artificial Sequence
  chemically synthesized
tgctgagacaagtggaagat

SEQ ID NO: 6663 - DNA, 20 bp, Artificial Sequence
  chemically synthesized
gacaagtggaagatgggccc

SEQ ID NO: 6664 - DNA, 20 bp, Artificial Sequence
  chemically synthesized
agtggaagatgggccccggt

SEQ ID NO: 6665 - DNA, 20 bp, Artificial Sequence
  chemically synthesized
ggaagatgggccccggtgag

SEQ ID NO: 6666 - DNA, 20 bp, Artificial Sequence
  chemically synthesized
ggccccggtgagcagctgat

SEQ ID NO: 6667 - DNA, 20 bp, Artificial Sequence
  chemically synthesized
ggtgagcagctgatcagtgt

SEQ ID NO: 6668 - DNA, 20 bp, Artificial Sequence
  chemically synthesized
ctcccatgatgacgttcccc

SEQ ID NO: 6669 - DNA, 20 bp, Artificial Sequence
  chemically synthesized
ttcccccagcccccaccacc

SEQ ID NO: 6670 - DNA, 20 bp, Artificial Sequence
  chemically synthesized
tcccccagcccccaccaccc

SEQ ID NO: 6671 - DNA, 20 bp, Artificial Sequence
  chemically synthesized
gcccccaccacccgggctgc

SEQ ID NO: 6672 - DNA, 20 bp, Artificial Sequence
  chemically synthesized
ccccaccacccgggctgctg

SEQ ID NO: 6673 - DNA, 20 bp, Artificial Sequence
  chemically synthesized
cccaccacccgggctgctgg

SEQ ID NO: 6674 - DNA, 20 bp, Artificial Sequence
  chemically synthesized
ccaccacccgggctgctgga

SEQ ID NO: 6675 - DNA, 20 bp, Artificial Sequence
  chemically synthesized
cgggctgctggagggaaatg

SEQ ID NO: 6676 - DNA, 20 bp, Artificial Sequence
  chemically synthesized
gtgactttgctacatccctt

SEQ ID NO: 6677 - DNA, 20 bp, Artificial Sequence
  chemically synthesized
ctttgctacatcccttcaga

SEQ ID NO: 6678 - DNA, 20 bp, Artificial Sequence
  chemically synthesized
cccttcagacggtccctcac

SEQ ID NO: 6679 - DNA, 20 bp, Artificial Sequence
  chemically synthesized
ggtccctcactggtgtccct

SEQ ID NO: 6680 - DNA, 20 bp, Artificial Sequence
  chemically synthesized
gtccctcagcccattcgcgt

SEQ ID NO: 6681 - DNA, 20 bp, Artificial Sequence
  chemically synthesized
gctcactctcccattaattt

SEQ ID NO: 6682 - DNA, 20 bp, Artificial Sequence
  chemically synthesized
cccattaatttcagaaatcc

SEQ ID NO: 6683 - DNA, 20 bp, Artificial Sequence
  chemically synthesized
agaaatcctggcctctctcc

SEQ ID NO: 6684 - DNA, 20 bp, Artificial Sequence
  chemically synthesized
actctaaattctgtcaccct

SEQ ID NO: 6685 - DNA, 20 bp, Artificial Sequence
  chemically synthesized
ctaaattctgtcaccctcag

SEQ ID NO: 6686 - DNA, 20 bp, Artificial Sequence
  chemically synthesized
tctgtcaccctcagaagatt

SEQ ID NO: 6687 - DNA, 20 bp, Artificial Sequence
  chemically synthesized
gtcaccctcagaagattcag

SEQ ID NO: 6688 - DNA, 20 bp, Artificial Sequence
  chemically synthesized
cagcatcccgtattctctct

SEQ ID NO: 6689 - DNA, 20 bp, Artificial Sequence
  chemically synthesized
tctgagtgttcactatgtac

SEQ ID NO: 6690 - DNA, 20 bp, Artificial Sequence
  chemically synthesized
ctgagtgttcactatgtacc

SEQ ID NO: 6691 - DNA, 20 bp, Artificial Sequence
  chemically synthesized
actatgtaccgggtgccgtg

SEQ ID NO: 6692 - DNA, 20 bp, Artificial Sequence
  chemically synthesized
ctatgtaccgggtgccgtgt

SEQ ID NO: 6693 - DNA, 20 bp, Artificial Sequence
  chemically synthesized
accgggtgccgtgtgggcac

SEQ ID NO: 6694 - DNA, 20 bp, Artificial Sequence
  chemically synthesized
cgggtgccgtgtgggcactg

SEQ ID NO: 6695 - DNA, 20 bp, Artificial Sequence
  chemically synthesized
ccgtgtgggcactggagttg

SEQ ID NO: 6696 - DNA, 20 bp, Artificial Sequence
  chemically synthesized
gtgtgggcactggagttgca

SEQ ID NO: 6697 - DNA, 20 bp, Artificial Sequence
  chemically synthesized
tgtgggcactggagttgcag

SEQ ID NO: 6698 - DNA, 20 bp, Artificial Sequence
  chemically synthesized
tgggcactggagttgcagag

SEQ ID NO: 6699 - DNA, 20 bp, Artificial Sequence
  chemically synthesized
ggcactggagttgcagagga

SEQ ID NO: 6700 - DNA, 20 bp, Artificial Sequence
  chemically synthesized
ctggagttgcagaggagagt

SEQ ID NO: 6701 - DNA, 20 bp, Artificial Sequence
  chemically synthesized
tggagttgcagaggagagtg

SEQ ID NO: 6702 - DNA, 20 bp, Artificial Sequence
  chemically synthesized
agttgcagaggagagtgagg

SEQ ID NO: 6703 - DNA, 20 bp, Artificial Sequence
  chemically synthesized
gcagaggagagtgaggcgga

SEQ ID NO: 6704 - DNA, 20 bp, Artificial Sequence
  chemically synthesized
cagaggagagtgaggcggac

SEQ ID NO: 6705 - DNA, 20 bp, Artificial Sequence
  chemically synthesized
agaggagagtgaggcggaca

SEQ ID NO: 6706 - DNA, 20 bp, Artificial Sequence
  chemically synthesized
gcggacagggcctctgcctg

SEQ ID NO: 6707 - DNA, 20 bp, Artificial Sequence
  chemically synthesized
cggacagggcctctgcctgt

SEQ ID NO: 6708 - DNA, 20 bp, Artificial Sequence
  chemically synthesized
ggacagggcctctgcctgtg

SEQ ID NO: 6709 - DNA, 20 bp, Artificial Sequence
  chemically synthesized
ctgcctgtggggacaccgcc

SEQ ID NO: 6710 - DNA, 20 bp, Artificial Sequence
  chemically synthesized
cctgtggggacaccgcctgg

SEQ ID NO: 6711 - DNA, 20 bp, Artificial Sequence
  chemically synthesized
ctgtggggacaccgcctggt

SEQ ID NO: 6712 - DNA, 20 bp, Artificial Sequence
  chemically synthesized
tggggacaccgcctggtggg

SEQ ID NO: 6713 - DNA, 20 bp, Artificial Sequence
  chemically synthesized
acaccgcctggtgggaagtc

SEQ ID NO: 6714 - DNA, 20 bp, Artificial Sequence
  chemically synthesized
cgcctggtgggaagtccagc

SEQ ID NO: 6715 - DNA, 20 bp, Artificial Sequence
  chemically synthesized
gaagtccagccagcccccta

SEQ ID NO: 6716 - DNA, 20 bp, Artificial Sequence
  chemically synthesized
agtccagccagccccctaca

SEQ ID NO: 6717 - DNA, 20 bp, Artificial Sequence
  chemically synthesized
tccagccagccccctacaga

SEQ ID NO: 6718 - DNA, 20 bp, Artificial Sequence
  chemically synthesized
cagccagccccctacagaga

SEQ ID NO: 6719 - DNA, 20 bp, Artificial Sequence
  chemically synthesized
agccagccccctacagagag

SEQ ID NO: 6720 - DNA, 20 bp, Artificial Sequence
  chemically synthesized
ccagccccctacagagagag

SEQ ID NO: 6721 - DNA, 20 bp, Artificial Sequence
  chemically synthesized
acagagagaggagatgctac

SEQ ID NO: 6722 - DNA, 20 bp, Artificial Sequence
  chemically synthesized
gagatgctactggtgttcct

SEQ ID NO: 6723 - DNA, 20 bp, Artificial Sequence
  chemically synthesized
atgctactggtgttcctgag

SEQ ID NO: 6724 - DNA, 20 bp, Artificial Sequence
  chemically synthesized
tggtgttcctgagtggtcct

SEQ ID NO: 6725 - DNA, 20 bp, Artificial Sequence
  chemically synthesized
ggtgttcctgagtggtcctc

SEQ ID NO: 6726 - DNA, 20 bp, Artificial Sequence
  chemically synthesized
tgttcctgagtggtcctcgg

SEQ ID NO: 6727 - DNA, 20 bp, Artificial Sequence
  chemically synthesized
gttcctgagtggtcctcggg

SEQ ID NO: 6728 - DNA, 20 bp, Artificial Sequence
  chemically synthesized
ttcctgagtggtcctcggga

SEQ ID NO: 6729 - DNA, 20 bp, Artificial Sequence
  chemically synthesized
gtcccctgccctgccctgcc

SEQ ID NO: 6730 - DNA, 20 bp, Artificial Sequence
  chemically synthesized
tgccctgccctgcccagcac

SEQ ID NO: 6731 - DNA, 20 bp, Artificial Sequence
  chemically synthesized
gcccagcaccggccctccct

SEQ ID NO: 6732 - DNA, 20 bp, Artificial Sequence
  chemically synthesized
agcaccggccctccctcggt

SEQ ID NO: 6733 - DNA, 20 bp, Artificial Sequence
  chemically synthesized
ccggccctccctcggttggc

SEQ ID NO: 6734 - DNA, 20 bp, Artificial Sequence
  chemically synthesized
ctccctcggttggccagcct

SEQ ID NO: 6735 - DNA, 20 bp, Artificial Sequence
  chemically synthesized
tccctcggttggccagcctc

SEQ ID NO: 6736 - DNA, 20 bp, Artificial Sequence
  chemically synthesized
ggttggccagcctcaggaat

SEQ ID NO: 6737 - DNA, 20 bp, Artificial Sequence
  chemically synthesized
gttggccagcctcaggaatg

SEQ ID NO: 6738 - DNA, 20 bp, Artificial Sequence
  chemically synthesized
tggccagcctcaggaatgag

SEQ ID NO: 6739 - DNA, 20 bp, Artificial Sequence
  chemically synthesized
gaatgaggagtccctcattc

SEQ ID NO: 6740 - DNA, 20 bp, Artificial Sequence
  chemically synthesized
aggagtccctcattccagcc

SEQ ID NO: 6741 - DNA, 20 bp, Artificial Sequence
  chemically synthesized
agctaaccaatccccttcct

SEQ ID NO: 6742 - DNA, 20 bp, Artificial Sequence
  chemically synthesized
caatccccttcctaagctcc

SEQ ID NO: 6743 - DNA, 20 bp, Artificial Sequence
  chemically synthesized
ccctgctcctcctgcctcca

SEQ ID NO: 6744 - DNA, 20 bp, Artificial Sequence
  chemically synthesized
cctcctgcctccatggaacc

SEQ ID NO: 6745 - DNA, 20 bp, Artificial Sequence
  chemically synthesized
atggaacccggctccaccac

SEQ ID NO: 6746 - DNA, 20 bp, Artificial Sequence
  chemically synthesized
acctgacactcctccattcc

SEQ ID NO: 6747 - DNA, 20 bp, Artificial Sequence
  chemically synthesized
ctggctcttgcccttctgcc

SEQ ID NO: 6748 - DNA, 20 bp, Artificial Sequence
  chemically synthesized
cccttctgcctagcactgct

SEQ ID NO: 6749 - DNA, 20 bp, Artificial Sequence
  chemically synthesized
accttaaaatcttttcccac

SEQ ID NO: 6750 - DNA, 20 bp, Artificial Sequence
  chemically synthesized
aaaatcttttcccaccagcc

SEQ ID NO: 6751 - DNA, 20 bp, Artificial Sequence
  chemically synthesized
aaatcttttcccaccagcct

SEQ ID NO: 6752 - DNA, 20 bp, Artificial Sequence
  chemically synthesized
tcccaccagcctgggcaaca

SEQ ID NO: 6753 - DNA, 20 bp, Artificial Sequence
  chemically synthesized
accagcctgggcaacatagc

SEQ ID NO: 6754 - DNA, 20 bp, Artificial Sequence
  chemically synthesized
aaaaattttttttaatttgc

SEQ ID NO: 6755 - DNA, 20 bp, Artificial Sequence
  chemically synthesized
aaaattttttttaatttgcc

SEQ ID NO: 6756 - DNA, 20 bp, Artificial Sequence
  chemically synthesized
tttttttaatttgccaggca

SEQ ID NO: 6757 - DNA, 20 bp, Artificial Sequence
  chemically synthesized
ttttaatttgccaggcacag

SEQ ID NO: 6758 - DNA, 20 bp, Artificial Sequence
  chemically synthesized
gcacagtggtgcacacctgt

SEQ ID NO: 6759 - DNA, 20 bp, Artificial Sequence
  chemically synthesized
acctgtaagtcctaactact

SEQ ID NO: 6760 - DNA, 20 bp, Artificial Sequence
  chemically synthesized
cctgtaagtcctaactactt

SEQ ID NO: 6761 - DNA, 20 bp, Artificial Sequence
  chemically synthesized
tgtaagtcctaactacttgg

SEQ ID NO: 6762 - DNA, 20 bp, Artificial Sequence
  chemically synthesized
gtaagtcctaactacttggg

SEQ ID NO: 6763 - DNA, 20 bp, Artificial Sequence
  chemically synthesized
tcctaactacttgggaggct

SEQ ID NO: 6764 - DNA, 20 bp, Artificial Sequence
  chemically synthesized
cctaactacttgggaggctg

SEQ ID NO: 6765 - DNA, 20 bp, Artificial Sequence
  chemically synthesized
aactacttgggaggctgagg

SEQ ID NO: 6766 - DNA, 20 bp, Artificial Sequence
  chemically synthesized
actacttgggaggctgaggt

SEQ ID NO: 6767 - DNA, 20 bp, Artificial Sequence
  chemically synthesized
tacttgggaggctgaggtgg

SEQ ID NO: 6768 - DNA, 20 bp, Artificial Sequence
  chemically synthesized
acttgggaggctgaggtggg

SEQ ID NO: 6769 - DNA, 20 bp, Artificial Sequence
  chemically synthesized
gggaggctgaggtgggagga

SEQ ID NO: 6770 - DNA, 20 bp, Artificial Sequence
  chemically synthesized
ctgaggtgggaggatggctt

SEQ ID NO: 6771 - DNA, 20 bp, Artificial Sequence
  chemically synthesized
gtgggaggatggcttgagcc

SEQ ID NO: 6772 - DNA, 20 bp, Artificial Sequence
  chemically synthesized
tgggaggatggcttgagccc

SEQ ID NO: 6773 - DNA, 20 bp, Artificial Sequence
  chemically synthesized
ggaggatggcttgagcccag

SEQ ID NO: 6774 - DNA, 20 bp, Artificial Sequence
  chemically synthesized
tggcttgagcccaggagttc

SEQ ID NO: 6775 - DNA, 20 bp, Artificial Sequence
  chemically synthesized
ggcttgagcccaggagttcg

SEQ ID NO: 6776 - DNA, 20 bp, Artificial Sequence
  chemically synthesized
agcccaggagttcgaggttg

SEQ ID NO: 6777 - DNA, 20 bp, Artificial Sequence
  chemically synthesized
caggagttcgaggttgcagt

SEQ ID NO: 6778 - DNA, 20 bp, Artificial Sequence
  chemically synthesized
tctctaaaaaaaaaatgtcc

SEQ ID NO: 6779 - DNA, 20 bp, Artificial Sequence
  chemically synthesized
aaaaaaatgtccaagatact

SEQ ID NO: 6780 - DNA, 20 bp, Artificial Sequence
  chemically synthesized
aaaaaatgtccaagatactt

SEQ ID NO: 6781 - DNA, 20 bp, Artificial Sequence
  chemically synthesized
tccaagatacttaggtcctt

SEQ ID NO: 6782 - DNA, 20 bp, Artificial Sequence
  chemically synthesized
gatacttaggtccttcagtc

SEQ ID NO: 6783 - DNA, 20 bp, Artificial Sequence
  chemically synthesized
ccttcagtcaagatttatta

SEQ ID NO: 6784 - DNA, 20 bp, Artificial Sequence
  chemically synthesized
tcagtcaagatttattacag

SEQ ID NO: 6785 - DNA, 20 bp, Artificial Sequence
  chemically synthesized
cagtcaagatttattacaga

SEQ ID NO: 6786 - DNA, 20 bp, Artificial Sequence
  chemically synthesized
agatttattacagaaggatc

SEQ ID NO: 6787 - DNA, 20 bp, Artificial Sequence
  chemically synthesized
gatttattacagaaggatcc

SEQ ID NO: 6788 - DNA, 20 bp, Artificial Sequence
  chemically synthesized
atttattacagaaggatcca

SEQ ID NO: 6789 - DNA, 20 bp, Artificial Sequence
  chemically synthesized
tattacagaaggatccaggg

SEQ ID NO: 6790 - DNA, 20 bp, Artificial Sequence
  chemically synthesized
attacagaaggatccaggga

SEQ ID NO: 6791 - DNA, 20 bp, Artificial Sequence
  chemically synthesized
ttacagaaggatccagggaa

SEQ ID NO: 6792 - DNA, 20 bp, Artificial Sequence
  chemically synthesized
aaggatccagggaagggtct

SEQ ID NO: 6793 - DNA, 20 bp, Artificial Sequence
  chemically synthesized
aggatccagggaagggtctt

SEQ ID NO: 6794 - DNA, 20 bp, Artificial Sequence
  chemically synthesized
gatccagggaagggtcttgg

SEQ ID NO: 6795 - DNA, 20 bp, Artificial Sequence
  chemically synthesized
agggaagggtcttgggagat

SEQ ID NO: 6796 - DNA, 20 bp, Artificial Sequence
  chemically synthesized
ggaagggtcttgggagatga

SEQ ID NO: 6797 - DNA, 20 bp, Artificial Sequence
  chemically synthesized
gaagggtcttgggagatgag

SEQ ID NO: 6798 - DNA, 20 bp, Artificial Sequence
  chemically synthesized
agggtcttgggagatgagag

SEQ ID NO: 6799 - DNA, 20 bp, Artificial Sequence
  chemically synthesized
gtcttgggagatgagaggag

SEQ ID NO: 6800 - DNA, 20 bp, Artificial Sequence
  chemically synthesized
tcttgggagatgagaggagc

SEQ ID NO: 6801 - DNA, 20 bp, Artificial Sequence
  chemically synthesized
cttgggagatgagaggagca

SEQ ID NO: 6802 - DNA, 20 bp, Artificial Sequence
  chemically synthesized
tgagaggagcagggatcttc

SEQ ID NO: 6803 - DNA, 20 bp, Artificial Sequence
  chemically synthesized
gagaggagcagggatcttcc

SEQ ID NO: 6804 - DNA, 20 bp, Artificial Sequence
  chemically synthesized
cacaacatacacacatgcac

SEQ ID NO: 6805 - DNA, 20 bp, Artificial Sequence
  chemically synthesized
cacaacatacactcacacac

SEQ ID NO: 6806 - DNA, 20 bp, Artificial Sequence
  chemically synthesized
cattcactcacacacacaca

SEQ ID NO: 6807 - DNA, 20 bp, Artificial Sequence
  chemically synthesized
ttcactcacacacacacaca

SEQ ID NO: 6808 - DNA, 20 bp, Artificial Sequence
  chemically synthesized
cacacacacacacagagtcc

SEQ ID NO: 6809 - DNA, 20 bp, Artificial Sequence
  chemically synthesized
atacgtgcacacgcacatac

SEQ ID NO: 6810 - DNA, 20 bp, Artificial Sequence
  chemically synthesized
tacgtgcacacgcacatacg

SEQ ID NO: 6811 - DNA, 20 bp, Artificial Sequence
  chemically synthesized
atacgaggcacatgtgttct

SEQ ID NO: 6812 - DNA, 20 bp, Artificial Sequence
  chemically synthesized
tacgaggcacatgtgttctt

SEQ ID NO: 6813 - DNA, 20 bp, Artificial Sequence
  chemically synthesized
aggcacatgtgttcttgggt

SEQ ID NO: 6814 - DNA, 20 bp, Artificial Sequence
  chemically synthesized
ggcacatgtgttcttgggtt

SEQ ID NO: 6815 - DNA, 20 bp, Artificial Sequence
  chemically synthesized
cacatgtgttcttgggttgg

SEQ ID NO: 6816 - DNA, 20 bp, Artificial Sequence
  chemically synthesized
acatgtgttcttgggttggg

SEQ ID NO: 6817 - DNA, 20 bp, Artificial Sequence
  chemically synthesized
atgtgttcttgggttgggag

SEQ ID NO: 6818 - DNA, 20 bp, Artificial Sequence
  chemically synthesized
tgttcttgggttgggaggag

SEQ ID NO: 6819 - DNA, 20 bp, Artificial Sequence
  chemically synthesized
gttcttgggttgggaggaga

SEQ ID NO: 6820 - DNA, 20 bp, Artificial Sequence
  chemically synthesized
ttcttgggttgggaggagaa

SEQ ID NO: 6821 - DNA, 20 bp, Artificial Sequence
  chemically synthesized
ttgggttgggaggagaaggg

SEQ ID NO: 6822 - DNA, 20 bp, Artificial Sequence
  chemically synthesized
tgggttgggaggagaagggc

SEQ ID NO: 6823 - DNA, 20 bp, Artificial Sequence
  chemically synthesized
gttgggaggagaagggcagg

SEQ ID NO: 6824 - DNA, 20 bp, Artificial Sequence
  chemically synthesized
aagggcaggcagttatcttc

SEQ ID NO: 6825 - DNA, 20 bp, Artificial Sequence
  chemically synthesized
tccagatctccccacacctc

SEQ ID NO: 6826 - DNA, 20 bp, Artificial Sequence
  chemically synthesized
cctctggcacatgcctttcc

SEQ ID NO: 6827 - DNA, 20 bp, Artificial Sequence
  chemically synthesized
ctctggcacatgcctttcct

SEQ ID NO: 6828 - DNA, 20 bp, Artificial Sequence
  chemically synthesized
tctggcacatgcctttcctg

SEQ ID NO: 6829 - DNA, 20 bp, Artificial Sequence
  chemically synthesized
acatgcctttcctggggtcc

SEQ ID NO: 6830 - DNA, 20 bp, Artificial Sequence
  chemically synthesized
catgcctttcctggggtcct

SEQ ID NO: 6831 - DNA, 20 bp, Artificial Sequence
  chemically synthesized
atgcctttcctggggtcctg

SEQ ID NO: 6832 - DNA, 20 bp, Artificial Sequence
  chemically synthesized
cctttcctggggtcctgggg

SEQ ID NO: 6833 - DNA, 20 bp, Artificial Sequence
  chemically synthesized
tcctggggtcctggggtaga

SEQ ID NO: 6834 - DNA, 20 bp, Artificial Sequence
  chemically synthesized
cctggggtcctggggtagac

SEQ ID NO: 6835 - DNA, 20 bp, Artificial Sequence
  chemically synthesized
ggggtcctggggtagacagg

SEQ ID NO: 6836 - DNA, 20 bp, Artificial Sequence
  chemically synthesized
gggtcctggggtagacagga

SEQ ID NO: 6837 - DNA, 20 bp, Artificial Sequence
  chemically synthesized
cctggggtagacaggaaggt

SEQ ID NO: 6838 - DNA, 20 bp, Artificial Sequence
  chemically synthesized
ctggggtagacaggaaggtg

SEQ ID NO: 6839 - DNA, 20 bp, Artificial Sequence
  chemically synthesized
ggtagacaggaaggtgaggt

SEQ ID NO: 6840 - DNA, 20 bp, Artificial Sequence
  chemically synthesized
gtagacaggaaggtgaggtg

SEQ ID NO: 6841 - DNA, 20 bp, Artificial Sequence
  chemically synthesized
tagacaggaaggtgaggtga

SEQ ID NO: 6842 - DNA, 20 bp, Artificial Sequence
  chemically synthesized
ggaaggtgaggtgagggaac

SEQ ID NO: 6843 - DNA, 20 bp, Artificial Sequence
  chemically synthesized
aggtgaggtgagggaacaag

SEQ ID NO: 6844 - DNA, 20 bp, Artificial Sequence
  chemically synthesized
ggtgaggtgagggaacaagc

SEQ ID NO: 6845 - DNA, 20 bp, Artificial Sequence
  chemically synthesized
gtgaggtgagggaacaagcg

SEQ ID NO: 6846 - DNA, 20 bp, Artificial Sequence
  chemically synthesized
tgaggtgagggaacaagcgg

SEQ ID NO: 6847 - DNA, 20 bp, Artificial Sequence
  chemically synthesized
gagggaacaagcgggggtgt

SEQ ID NO: 6848 - DNA, 20 bp, Artificial Sequence
  chemically synthesized
agggaacaagcgggggtgtc

SEQ ID NO: 6849 - DNA, 20 bp, Artificial Sequence
  chemically synthesized
cgggggtgtcgggccctcct

SEQ ID NO: 6850 - DNA, 20 bp, Artificial Sequence
  chemically synthesized
ccctcctcagtccctgttca

SEQ ID NO: 6851 - DNA, 20 bp, Artificial Sequence
  chemically synthesized
ctcctcagtccctgttcaca

SEQ ID NO: 6852 - DNA, 20 bp, Artificial Sequence
  chemically synthesized
ctcagtccctgttcacagag

SEQ ID NO: 6853 - DNA, 20 bp, Artificial Sequence
  chemically synthesized
tcagtccctgttcacagagt

SEQ ID NO: 6854 - DNA, 20 bp, Artificial Sequence
  chemically synthesized
ccctgttcacagagtgggtg

SEQ ID NO: 6855 - DNA, 20 bp, Artificial Sequence
  chemically synthesized
tgttcacagagtgggtgcgg

SEQ ID NO: 6856 - DNA, 20 bp, Artificial Sequence
  chemically synthesized
ttcacagagtgggtgcggca

SEQ ID NO: 6857 - DNA, 20 bp, Artificial Sequence
  chemically synthesized
tgggtgcggcagagacctca

SEQ ID NO: 6858 - DNA, 20 bp, Artificial Sequence
  chemically synthesized
gggtgcggcagagacctcaa

SEQ ID NO: 6859 - DNA, 20 bp, Artificial Sequence
  chemically synthesized
ggtgcggcagagacctcaaa

SEQ ID NO: 6860 - DNA, 20 bp, Artificial Sequence
  chemically synthesized
cggcagagacctcaaaggga

SEQ ID NO: 6861 - DNA, 20 bp, Artificial Sequence
  chemically synthesized
gcagagacctcaaagggaca

SEQ ID NO: 6862 - DNA, 20 bp, Artificial Sequence
  chemically synthesized
caaagggacagagcaatcat

SEQ ID NO: 6863 - DNA, 20 bp, Artificial Sequence
  chemically synthesized
ggacagagcaatcatgagct

SEQ ID NO: 6864 - DNA, 20 bp, Artificial Sequence
  chemically synthesized
agagcaatcatgagctgaga

SEQ ID NO: 6865 - DNA, 20 bp, Artificial Sequence
  chemically synthesized
agcaatcatgagctgagaca

SEQ ID NO: 6866 - DNA, 20 bp, Artificial Sequence
  chemically synthesized
gcaatcatgagctgagacag

SEQ ID NO: 6867 - DNA, 20 bp, Artificial Sequence
  chemically synthesized
caatcatgagctgagacaga

SEQ ID NO: 6868 - DNA, 20 bp, Artificial Sequence
  chemically synthesized
aatcatgagctgagacagag

SEQ ID NO: 6869 - DNA, 20 bp, Artificial Sequence
  chemically synthesized
atcatgagctgagacagagg

SEQ ID NO: 6870 - DNA, 20 bp, Artificial Sequence
  chemically synthesized
catgagctgagacagagggg

SEQ ID NO: 6871 - DNA, 20 bp, Artificial Sequence
  chemically synthesized
gctgagacagagggggagca

SEQ ID NO: 6872 - DNA, 20 bp, Artificial Sequence
  chemically synthesized
acagagggggagcaaagccg

SEQ ID NO: 6873 - DNA, 20 bp, Artificial Sequence
  chemically synthesized
gcacacttgcctttcaaaaa

SEQ ID NO: 6874 - DNA, 20 bp, Artificial Sequence
  chemically synthesized
caaaaatggatttcctctcc

SEQ ID NO: 6875 - DNA, 20 bp, Artificial Sequence
  chemically synthesized
aaaaatggatttcctctcct

SEQ ID NO: 6876 - DNA, 20 bp, Artificial Sequence
  chemically synthesized
ggatttcctctcctgggatt

SEQ ID NO: 6877 - DNA, 20 bp, Artificial Sequence
  chemically synthesized
tctcctgggattcagcctgc

SEQ ID NO: 6878 - DNA, 20 bp, Artificial Sequence
  chemically synthesized
ggattcagcctgcgagtgcc

SEQ ID NO: 6879 - DNA, 20 bp, Artificial Sequence
  chemically synthesized
tgcctggcccctcaccttga

SEQ ID NO: 6880 - DNA, 20 bp, Artificial Sequence
  chemically synthesized
tggcccctcaccttgatgga

SEQ ID NO: 6881 - DNA, 20 bp, Artificial Sequence
  chemically synthesized
ggcccctcaccttgatggaa

SEQ ID NO: 6882 - DNA, 20 bp, Artificial Sequence
  chemically synthesized
cctcaccttgatggaaagga

SEQ ID NO: 6883 - DNA, 20 bp, Artificial Sequence
  chemically synthesized
aaggatggtcattttcctcc

SEQ ID NO: 6884 - DNA, 20 bp, Artificial Sequence
  chemically synthesized
tggtcattttcctccgagct

SEQ ID NO: 6885 - DNA, 20 bp, Artificial Sequence
  chemically synthesized
tttcctccgagctcagctgc

SEQ ID NO: 6886 - DNA, 20 bp, Artificial Sequence
  chemically synthesized
tcagctgctggatatcttga

SEQ ID NO: 6887 - DNA, 20 bp, Artificial Sequence
  chemically synthesized
ctggatatcttgaaagtcct

SEQ ID NO: 6888 - DNA, 20 bp, Artificial Sequence
  chemically synthesized
ttgaaagtccttggccatga

SEQ ID NO: 6889 - DNA, 20 bp, Artificial Sequence
  chemically synthesized
tgaaagtccttggccatgat

SEQ ID NO: 6890 - DNA, 20 bp, Artificial Sequence
  chemically synthesized
gaaagtccttggccatgatg

SEQ ID NO: 6891 - DNA, 20 bp, Artificial Sequence
  chemically synthesized
tccttggccatgatggggcc

SEQ ID NO: 6892 - DNA, 20 bp, Artificial Sequence
  chemically synthesized
ccttggccatgatggggccc

SEQ ID NO: 6893 - DNA, 20 bp, Artificial Sequence
  chemically synthesized
ggccatgatggggcccgggc

SEQ ID NO: 6894 - DNA, 20 bp, Artificial Sequence
  chemically synthesized
ccatgatggggcccgggctg

SEQ ID NO: 6895 - DNA, 20 bp, Artificial Sequence
  chemically synthesized
gatggggcccgggctggagc

SEQ ID NO: 6896 - DNA, 20 bp, Artificial Sequence
  chemically synthesized
tggggcccgggctggagctg

SEQ ID NO: 6897 - DNA, 20 bp, Artificial Sequence
  chemically synthesized
gcccgggctggagctggagc

SEQ ID NO: 6898 - DNA, 20 bp, Artificial Sequence
  chemically synthesized
ccgggctggagctggagctg

SEQ ID NO: 6899 - DNA, 20 bp, Artificial Sequence
  chemically synthesized
gctggagctggagctggagc

SEQ ID NO: 6900 - DNA, 20 bp, Artificial Sequence
  chemically synthesized
ctggagctggagctggagct

SEQ ID NO: 6901 - DNA, 20 bp, Artificial Sequence
  chemically synthesized
agctggagctggagctgggc

SEQ ID NO: 6902 - DNA, 20 bp, Artificial Sequence
  chemically synthesized
gctggagctggagctgggct

SEQ ID NO: 6903 - DNA, 20 bp, Artificial Sequence
  chemically synthesized
gagctggagctgggctgggc

SEQ ID NO: 6904 - DNA, 20 bp, Artificial Sequence
  chemically synthesized
agctggagctgggctgggct

SEQ ID NO: 6905 - DNA, 20 bp, Artificial Sequence
  chemically synthesized
gagctgggctgggctgggct

SEQ ID NO: 6906 - DNA, 20 bp, Artificial Sequence
  chemically synthesized
agctgggctgggctgggctg

SEQ ID NO: 6907 - DNA, 20 bp, Artificial Sequence
  chemically synthesized
ggctgggctgaggttgctct

SEQ ID NO: 6908 - DNA, 20 bp, Artificial Sequence
  chemically synthesized
gctgggctgaggttgctctg

SEQ ID NO: 6909 - DNA, 20 bp, Artificial Sequence
  chemically synthesized
ctgggctgaggttgctctga

SEQ ID NO: 6910 - DNA, 20 bp, Artificial Sequence
  chemically synthesized
gctgaggttgctctgagggc

SEQ ID NO: 6911 - DNA, 20 bp, Artificial Sequence
  chemically synthesized
ctgaggttgctctgagggct

SEQ ID NO: 6912 - DNA, 20 bp, Artificial Sequence
  chemically synthesized
tgaggttgctctgagggctg

SEQ ID NO: 6913 - DNA, 20 bp, Artificial Sequence
  chemically synthesized
gttgctctgagggctggggc

SEQ ID NO: 6914 - DNA, 20 bp, Artificial Sequence
  chemically synthesized
ttgctctgagggctggggct

SEQ ID NO: 6915 - DNA, 20 bp, Artificial Sequence
  chemically synthesized
tgctctgagggctggggctg

SEQ ID NO: 6916 - DNA, 20 bp, Artificial Sequence
  chemically synthesized
tctgagggctggggctgggg

SEQ ID NO: 6917 - DNA, 20 bp, Artificial Sequence
  chemically synthesized
tgagggctggggctggggca

SEQ ID NO: 6918 - DNA, 20 bp, Artificial Sequence
  chemically synthesized
gagggctggggctggggcag

SEQ ID NO: 6919 - DNA, 20 bp, Artificial Sequence
  chemically synthesized
ctggggctggggcagaggtg

SEQ ID NO: 6920 - DNA, 20 bp, Artificial Sequence
  chemically synthesized
ggcagaggtgcagattcacg

SEQ ID NO: 6921 - DNA, 20 bp, Artificial Sequence
  chemically synthesized
cagaggtgcagattcacgtg

SEQ ID NO: 6922 - DNA, 20 bp, Artificial Sequence
  chemically synthesized
agaggtgcagattcacgtgg

SEQ ID NO: 6923 - DNA, 20 bp, Artificial Sequence
  chemically synthesized
cagattcacgtggaggttga

SEQ ID NO: 6924 - DNA, 20 bp, Artificial Sequence
  chemically synthesized
attcacgtggaggttgatgg

SEQ ID NO: 6925 - DNA, 20 bp, Artificial Sequence
  chemically synthesized
ttcacgtggaggttgatggt

SEQ ID NO: 6926 - DNA, 20 bp, Artificial Sequence
  chemically synthesized
cgtggaggttgatggtggga

SEQ ID NO: 6927 - DNA, 20 bp, Artificial Sequence
  chemically synthesized
gttgatggtgggatggaacg

SEQ ID NO: 6928 - DNA, 20 bp, Artificial Sequence
  chemically synthesized
ttgatggtgggatggaacgc

SEQ ID NO: 6929 - DNA, 20 bp, Artificial Sequence
  chemically synthesized
tgatggtgggatggaacgca

SEQ ID NO: 6930 - DNA, 20 bp, Artificial Sequence
  chemically synthesized
ggtgggatggaacgcagggt

SEQ ID NO: 6931 - DNA, 20 bp, Artificial Sequence
  chemically synthesized
tgggatggaacgcagggtcg

SEQ ID NO: 6932 - DNA, 20 bp, Artificial Sequence
  chemically synthesized
gggatggaacgcagggtcgg

SEQ ID NO: 6933 - DNA, 20 bp, Artificial Sequence
  chemically synthesized
ggatggaacgcagggtcgga

SEQ ID NO: 6934 - DNA, 20 bp, Artificial Sequence
  chemically synthesized
gatggaacgcagggtcggag

SEQ ID NO: 6935 - DNA, 20 bp, Artificial Sequence
  chemically synthesized
aacgcagggtcggaggggtt

SEQ ID NO: 6936 - DNA, 20 bp, Artificial Sequence
  chemically synthesized
acgcagggtcggaggggttc

SEQ ID NO: 6937 - DNA, 20 bp, Artificial Sequence
  chemically synthesized
cgcagggtcggaggggttcg

SEQ ID NO: 6938 - DNA, 20 bp, Artificial Sequence
  chemically synthesized
agggtcggaggggttcgggg

SEQ ID NO: 6939 - DNA, 20 bp, Artificial Sequence
  chemically synthesized
gtcggaggggttcggggtgg

SEQ ID NO: 6940 - DNA, 20 bp, Artificial Sequence
  chemically synthesized
aggggttcggggtggtggcc

SEQ ID NO: 6941 - DNA, 20 bp, Artificial Sequence
  chemically synthesized
ggggttcggggtggtggcct

SEQ ID NO: 6942 - DNA, 20 bp, Artificial Sequence
  chemically synthesized
gttcggggtggtggcctggg

SEQ ID NO: 6943 - DNA, 20 bp, Artificial Sequence
  chemically synthesized
ttcggggtggtggcctgggt

SEQ ID NO: 6944 - DNA, 20 bp, Artificial Sequence
  chemically synthesized
tggtggcctgggtaggatct

SEQ ID NO: 6945 - DNA, 20 bp, Artificial Sequence
  chemically synthesized
ggtggcctgggtaggatctg

SEQ ID NO: 6946 - DNA, 20 bp, Artificial Sequence
  chemically synthesized
gcctgggtaggatctgaggt

SEQ ID NO: 6947 - DNA, 20 bp, Artificial Sequence
  chemically synthesized
tgccaacctcagatcctacc

SEQ ID NO: 6948 - DNA, 20 bp, Artificial Sequence
  chemically synthesized
gccaacctcagatcctaccc

SEQ ID NO: 6949 - DNA, 20 bp, Artificial Sequence
  chemically synthesized
gtgaatctgcacctctgccc

SEQ ID NO: 6950 - DNA, 20 bp, Artificial Sequence
  chemically synthesized
ctgcacctctgccccagccc

SEQ ID NO: 6951 - DNA, 20 bp, Artificial Sequence
  chemically synthesized
tctgccccagccccagccct

SEQ ID NO: 6952 - DNA, 20 bp, Artificial Sequence
  chemically synthesized
tgccccagccccagccctca

SEQ ID NO: 6953 - DNA, 20 bp, Artificial Sequence
  chemically synthesized
cccagccctcagagcaacct

SEQ ID NO: 6954 - DNA, 20 bp, Artificial Sequence
  chemically synthesized
ccctcagagcaacctcagcc

SEQ ID NO: 6955 - DNA, 20 bp, Artificial Sequence
  chemically synthesized
agagcaacctcagcccagcc

SEQ ID NO: 6956 - DNA, 20 bp, Artificial Sequence
  chemically synthesized
aacctcagcccagcccagcc

SEQ ID NO: 6957 - DNA, 20 bp, Artificial Sequence
  chemically synthesized
agcccagcccagcccagctc

SEQ ID NO: 6958 - DNA, 20 bp, Artificial Sequence
  chemically synthesized
gcccagcccagctccagctc

SEQ ID NO: 6959 - DNA, 20 bp, Artificial Sequence
  chemically synthesized
cccagctccagctccagctc

SEQ ID NO: 6960 - DNA, 20 bp, Artificial Sequence
  chemically synthesized
ctccagctccagctccagcc

SEQ ID NO: 6961 - DNA, 20 bp, Artificial Sequence
  chemically synthesized
tccagctccagctccagccc

SEQ ID NO: 6962 - DNA, 20 bp, Artificial Sequence
  chemically synthesized
ctccagcccgggccccatca

SEQ ID NO: 6963 - DNA, 20 bp, Artificial Sequence
  chemically synthesized
gcccgggccccatcatggcc

SEQ ID NO: 6964 - DNA, 20 bp, Artificial Sequence
  chemically synthesized
cccgggccccatcatggcca

SEQ ID NO: 6965 - DNA, 20 bp, Artificial Sequence
  chemically synthesized
catcatggccaaggactttc

SEQ ID NO: 6966 - DNA, 20 bp, Artificial Sequence
  chemically synthesized
ccaaggactttcaagatatc

SEQ ID NO: 6967 - DNA, 20 bp, Artificial Sequence
  chemically synthesized
aggactttcaagatatccag

SEQ ID NO: 6968 - DNA, 20 bp, Artificial Sequence
  chemically synthesized
tttcaagatatccagcagct

SEQ ID NO: 6969 - DNA, 20 bp, Artificial Sequence
  chemically synthesized
agatatccagcagctgagct

SEQ ID NO: 6970 - DNA, 20 bp, Artificial Sequence
  chemically synthesized
atatccagcagctgagctcg

SEQ ID NO: 6971 - DNA, 20 bp, Artificial Sequence
  chemically synthesized
tatccagcagctgagctcgg

SEQ ID NO: 6972 - DNA, 20 bp, Artificial Sequence
  chemically synthesized
aaatgaccatcctttccatc

SEQ ID NO: 6973 - DNA, 20 bp, Artificial Sequence
  chemically synthesized
aatgaccatcctttccatca

SEQ ID NO: 6974 - DNA, 20 bp, Artificial Sequence
  chemically synthesized
accatcctttccatcaaggt

SEQ ID NO: 6975 - DNA, 20 bp, Artificial Sequence
  chemically synthesized
ccatcctttccatcaaggtg

SEQ ID NO: 6976 - DNA, 20 bp, Artificial Sequence
  chemically synthesized
catcctttccatcaaggtga

SEQ ID NO: 6977 - DNA, 20 bp, Artificial Sequence
  chemically synthesized
atcctttccatcaaggtgag

SEQ ID NO: 6978 - DNA, 20 bp, Artificial Sequence
  chemically synthesized
tttccatcaaggtgaggggc

SEQ ID NO: 6979 - DNA, 20 bp, Artificial Sequence
  chemically synthesized
ttccatcaaggtgaggggcc

SEQ ID NO: 6980 - DNA, 20 bp, Artificial Sequence
  chemically synthesized
ggtgaggggccaggcactcg

SEQ ID NO: 6981 - DNA, 20 bp, Artificial Sequence
  chemically synthesized
gtgaggggccaggcactcgc

SEQ ID NO: 6982 - DNA, 20 bp, Artificial Sequence
  chemically synthesized
ggcactcgcaggctgaatcc

SEQ ID NO: 6983 - DNA, 20 bp, Artificial Sequence
  chemically synthesized
gcactcgcaggctgaatccc

SEQ ID NO: 6984 - DNA, 20 bp, Artificial Sequence
  chemically synthesized
actcgcaggctgaatcccag

SEQ ID NO: 6985 - DNA, 20 bp, Artificial Sequence
  chemically synthesized
tcgcaggctgaatcccagga

SEQ ID NO: 6986 - DNA, 20 bp, Artificial Sequence
  chemically synthesized
cgcaggctgaatcccaggag

SEQ ID NO: 6987 - DNA, 20 bp, Artificial Sequence
  chemically synthesized
gagaggaaatccatttttga

SEQ ID NO: 6988 - DNA, 20 bp, Artificial Sequence
  chemically synthesized
agaggaaatccatttttgaa

SEQ ID NO: 6989 - DNA, 20 bp, Artificial Sequence
  chemically synthesized
gaaatccatttttgaaaggc

SEQ ID NO: 6990 - DNA, 20 bp, Artificial Sequence
  chemically synthesized
atttttgaaaggcaagtgtg

SEQ ID NO: 6991 - DNA, 20 bp, Artificial Sequence
  chemically synthesized
aggcaagtgtgcagtttctg

SEQ ID NO: 6992 - DNA, 20 bp, Artificial Sequence
  chemically synthesized
gctttgctccccctctgtct

SEQ ID NO: 6993 - DNA, 20 bp, Artificial Sequence
  chemically synthesized
catgattgctctgtcccttt

SEQ ID NO: 6994 - DNA, 20 bp, Artificial Sequence
  chemically synthesized
atgattgctctgtccctttg

SEQ ID NO: 6995 - DNA, 20 bp, Artificial Sequence
  chemically synthesized
tgccgcacccactctgtgaa

SEQ ID NO: 6996 - DNA, 20 bp, Artificial Sequence
  chemically synthesized
gccgcacccactctgtgaac

SEQ ID NO: 6997 - DNA, 20 bp, Artificial Sequence
  chemically synthesized
ccgcacccactctgtgaaca

SEQ ID NO: 6998 - DNA, 20 bp, Artificial Sequence
  chemically synthesized
ccactctgtgaacagggact

SEQ ID NO: 6999 - DNA, 20 bp, Artificial Sequence
  chemically synthesized
cactctgtgaacagggactg

SEQ ID NO: 7000 - DNA, 20 bp, Artificial Sequence
  chemically synthesized
ctctgtgaacagggactgag

SEQ ID NO: 7001 - DNA, 20 bp, Artificial Sequence
  chemically synthesized
tctgtgaacagggactgagg

SEQ ID NO: 7002 - DNA, 20 bp, Artificial Sequence
  chemically synthesized
ctgtgaacagggactgagga

SEQ ID NO: 7003 - DNA, 20 bp, Artificial Sequence
  chemically synthesized
cctcaccttcctgtctaccc

SEQ ID NO: 7004 - DNA, 20 bp, Artificial Sequence
  chemically synthesized
ctcaccttcctgtctacccc

SEQ ID NO: 7005 - DNA, 20 bp, Artificial Sequence
  chemically synthesized
tcctgtctaccccaggaccc

SEQ ID NO: 7006 - DNA, 20 bp, Artificial Sequence
  chemically synthesized
cctgtctaccccaggacccc

SEQ ID NO: 7007 - DNA, 20 bp, Artificial Sequence
  chemically synthesized
tctaccccaggaccccagga

SEQ ID NO: 7008 - DNA, 20 bp, Artificial Sequence
  chemically synthesized
ctaccccaggaccccaggaa

SEQ ID NO: 7009 - DNA, 20 bp, Artificial Sequence
  chemically synthesized
accccaggaaaggcatgtgc

SEQ ID NO: 7010 - DNA, 20 bp, Artificial Sequence
  chemically synthesized
cccaggaaaggcatgtgcca

SEQ ID NO: 7011 - DNA, 20 bp, Artificial Sequence
  chemically synthesized
ccaggaaaggcatgtgccag

SEQ ID NO: 7012 - DNA, 20 bp, Artificial Sequence
  chemically synthesized
aaaggcatgtgccagaggtg

SEQ ID NO: 7013 - DNA, 20 bp, Artificial Sequence
  chemically synthesized
aaggcatgtgccagaggtgt

SEQ ID NO: 7014 - DNA, 20 bp, Artificial Sequence
  chemically synthesized
aggcatgtgccagaggtgtg

SEQ ID NO: 7015 - DNA, 20 bp, Artificial Sequence
  chemically synthesized
gcatgtgccagaggtgtggg

SEQ ID NO: 7016 - DNA, 20 bp, Artificial Sequence
  chemically synthesized
gccagaggtgtggggagatc

SEQ ID NO: 7017 - DNA, 20 bp, Artificial Sequence
  chemically synthesized
agaggtgtggggagatctgg

SEQ ID NO: 7018 - DNA, 20 bp, Artificial Sequence
  chemically synthesized
tgcccttctcctcccaaccc

SEQ ID NO: 7019 - DNA, 20 bp, Artificial Sequence
  chemically synthesized
gtgtgcacgtatgtgcatat

SEQ ID NO: 7020 - DNA, 20 bp, Artificial Sequence
  chemically synthesized
tgtgcacgtatgtgcatatg

SEQ ID NO: 7021 - DNA, 20 bp, Artificial Sequence
  chemically synthesized
gtatgtgcatatgaggaatg

SEQ ID NO: 7022 - DNA, 20 bp, Artificial Sequence
  chemically synthesized
gcatatgaggaatgcagatt

SEQ ID NO: 7023 - DNA, 20 bp, Artificial Sequence
  chemically synthesized
atgaggaatgcagattcagc

SEQ ID NO: 7024 - DNA, 20 bp, Artificial Sequence
  chemically synthesized
tgaggaatgcagattcagct

SEQ ID NO: 7025 - DNA, 20 bp, Artificial Sequence
  chemically synthesized
gggactctgtgtgtgtgtgt

SEQ ID NO: 7026 - DNA, 20 bp, Artificial Sequence
  chemically synthesized
gtgtgtgtgtatatgtgcgc

SEQ ID NO: 7027 - DNA, 20 bp, Artificial Sequence
  chemically synthesized
gtgtgtgtatatgtgcgcga

SEQ ID NO: 7028 - DNA, 20 bp, Artificial Sequence
  chemically synthesized
tgtgtgtatgtcgtgtatgt

SEQ ID NO: 7029 - DNA, 20 bp, Artificial Sequence
  chemically synthesized
tgtgtatgtcgtgtatgtga

SEQ ID NO: 7030 - DNA, 20 bp, Artificial Sequence
  chemically synthesized
gtgtatgtcgtgtatgtgag

SEQ ID NO: 7031 - DNA, 20 bp, Artificial Sequence
  chemically synthesized
tgtatgtcgtgtatgtgaga

SEQ ID NO: 7032 - DNA, 20 bp, Artificial Sequence
  chemically synthesized
tgagagggtatgttgtgtgt

SEQ ID NO: 7033 - DNA, 20 bp, Artificial Sequence
  chemically synthesized
agagggtatgttgtgtgtga

SEQ ID NO: 7034 - DNA, 20 bp, Artificial Sequence
  chemically synthesized
gttgtgtgtgtatgttgtgt

SEQ ID NO: 7035 - DNA, 20 bp, Artificial Sequence
  chemically synthesized
gttgtgtgtatcttgtgtgt

SEQ ID NO: 7036 - DNA, 20 bp, Artificial Sequence
  chemically synthesized
tgcatgtgtgtatgttgtgc

SEQ ID NO: 7037 - DNA, 20 bp, Artificial Sequence
  chemically synthesized
cgagtgtatgttgtgtatgt

SEQ ID NO: 7038 - DNA, 20 bp, Artificial Sequence
  chemically synthesized
tgtgtatgtatgttgtgtat

SEQ ID NO: 7039 - DNA, 20 bp, Artificial Sequence
  chemically synthesized
gttgtgtgtgtgtattgtgt

SEQ ID NO: 7040 - DNA, 20 bp, Artificial Sequence
  chemically synthesized
tgtatgtttgtgtgttgtgt

SEQ ID NO: 7041 - DNA, 20 bp, Artificial Sequence
  chemically synthesized
tgcgtgtgtgtatgttgtgc

SEQ ID NO: 7042 - DNA, 20 bp, Artificial Sequence
  chemically synthesized
gtgttgtgtgtgtatgttgt

SEQ ID NO: 7043 - DNA, 20 bp, Artificial Sequence
  chemically synthesized
gttatgtatgttgtgtgtgt

SEQ ID NO: 7044 - DNA, 20 bp, Artificial Sequence
  chemically synthesized
tgtgtgtgagtgtgttgcgt

SEQ ID NO: 7045 - DNA, 20 bp, Artificial Sequence
  chemically synthesized
tgttgcgtgagtgtgtgtgt

SEQ ID NO: 7046 - DNA, 20 bp, Artificial Sequence
  chemically synthesized
tgtgtgtgtgtgtgtgtgtg

SEQ ID NO: 7047 - DNA, 20 bp, Artificial Sequence
  chemically synthesized
tgtgtgtgtgtgtgtgtgta

SEQ ID NO: 7048 - DNA, 20 bp, Artificial Sequence
  chemically synthesized
gtgtgtgtgtgtgtgtgtag

SEQ ID NO: 7049 - DNA, 20 bp, Artificial Sequence
  chemically synthesized
tgtgtgtgtgtgtgtagagg

SEQ ID NO: 7050 - DNA, 20 bp, Artificial Sequence
  chemically synthesized
gtgtgtgtgtgtgtagaggt

SEQ ID NO: 7051 - DNA, 20 bp, Artificial Sequence
  chemically synthesized
tgtgtgtgtgtgtagaggtg

SEQ ID NO: 7052 - DNA, 20 bp, Artificial Sequence
  chemically synthesized
tgtgtgtgtagaggtggggt

SEQ ID NO: 7053 - DNA, 20 bp, Artificial Sequence
  chemically synthesized
tgtgtagaggtggggtgagt

SEQ ID NO: 7054 - DNA, 20 bp, Artificial Sequence
  chemically synthesized
gtgtagaggtggggtgagtt

SEQ ID NO: 7055 - DNA, 20 bp, Artificial Sequence
  chemically synthesized
agaggtggggtgagttggga

SEQ ID NO: 7056 - DNA, 20 bp, Artificial Sequence
  chemically synthesized
gaggtggggtgagttgggat

SEQ ID NO: 7057 - DNA, 20 bp, Artificial Sequence
  chemically synthesized
gtggggtgagttgggatggg

SEQ ID NO: 7058 - DNA, 20 bp, Artificial Sequence
  chemically synthesized
tggggtgagttgggatgggt

SEQ ID NO: 7059 - DNA, 20 bp, Artificial Sequence
  chemically synthesized
ggggtgagttgggatgggtg

SEQ ID NO: 7060 - DNA, 20 bp, Artificial Sequence
  chemically synthesized
gggtgagttgggatgggtgg

SEQ ID NO: 7061 - DNA, 20 bp, Artificial Sequence
  chemically synthesized
ttgggatgggtgggggacgt

SEQ ID NO: 7062 - DNA, 20 bp, Artificial Sequence
  chemically synthesized
atgggtgggggacgtgagca

SEQ ID NO: 7063 - DNA, 20 bp, Artificial Sequence
  chemically synthesized
gggtgggggacgtgagcaca

SEQ ID NO: 7064 - DNA, 20 bp, Artificial Sequence
  chemically synthesized
gtgggggacgtgagcacaga

SEQ ID NO: 7065 - DNA, 20 bp, Artificial Sequence
  chemically synthesized
acgtgagcacagagagatcc

SEQ ID NO: 7066 - DNA, 20 bp, Artificial Sequence
  chemically synthesized
tgagcacagagagatcctgg

SEQ ID NO: 7067 - DNA, 20 bp, Artificial Sequence
  chemically synthesized
ccctgctcctctcatctccc

SEQ ID NO: 7068 - DNA, 20 bp, Artificial Sequence
  chemically synthesized
catctcccaagacccttccc

SEQ ID NO: 7069 - DNA, 20 bp, Artificial Sequence
  chemically synthesized
tctgtaataaatcttgactg

SEQ ID NO: 7070 - DNA, 20 bp, Artificial Sequence
  chemically synthesized
ctgtaataaatcttgactga

SEQ ID NO: 7071 - DNA, 20 bp, Artificial Sequence
  chemically synthesized
aaatcttgactgaaggacct

SEQ ID NO: 7072 - DNA, 20 bp, Artificial Sequence
  chemically synthesized
actgaaggacctaagtatct

SEQ ID NO: 7073 - DNA, 20 bp, Artificial Sequence
  chemically synthesized
tatcttggacattttttttt

SEQ ID NO: 7074 - DNA, 20 bp, Artificial Sequence
  chemically synthesized
tcttggacatttttttttta

SEQ ID NO: 7075 - DNA, 20 bp, Artificial Sequence
  chemically synthesized
ggacattttttttttagaga

SEQ ID NO: 7076 - DNA, 20 bp, Artificial Sequence
  chemically synthesized
gacattttttttttagagac

SEQ ID NO: 7077 - DNA, 20 bp, Artificial Sequence
  chemically synthesized
cattttttttttagagacag

SEQ ID NO: 7078 - DNA, 20 bp, Artificial Sequence
  chemically synthesized
tttttttagagacaggagtg

SEQ ID NO: 7079 - DNA, 20 bp, Artificial Sequence
  chemically synthesized
ttttagagacaggagtgtag

SEQ ID NO: 7080 - DNA, 20 bp, Artificial Sequence
  chemically synthesized
tagagacaggagtgtagtgg

SEQ ID NO: 7081 - DNA, 20 bp, Artificial Sequence
  chemically synthesized
agagacaggagtgtagtggc

SEQ ID NO: 7082 - DNA, 20 bp, Artificial Sequence
  chemically synthesized
ggagtgtagtggcaggatca

SEQ ID NO: 7083 - DNA, 20 bp, Artificial Sequence
  chemically synthesized
tcactgcaacctcgaactcc

SEQ ID NO: 7084 - DNA, 20 bp, Artificial Sequence
  chemically synthesized
cactgcaacctcgaactcct

SEQ ID NO: 7085 - DNA, 20 bp, Artificial Sequence
  chemically synthesized
aacctcgaactcctgggctc

SEQ ID NO: 7086 - DNA, 20 bp, Artificial Sequence
  chemically synthesized
ctcaagccatcctcccacct

SEQ ID NO: 7087 - DNA, 20 bp, Artificial Sequence
  chemically synthesized
tcctcccacctcagcctccc

SEQ ID NO: 7088 - DNA, 20 bp, Artificial Sequence
  chemically synthesized
tcccacctcagcctcccaag

SEQ ID NO: 7089 - DNA, 20 bp, Artificial Sequence
  chemically synthesized
acctcagcctcccaagtagt

SEQ ID NO: 7090 - DNA, 20 bp, Artificial Sequence
  chemically synthesized
cctcagcctcccaagtagtt

SEQ ID NO: 7091 - DNA, 20 bp, Artificial Sequence
  chemically synthesized
tcccaagtagttaggactta

SEQ ID NO: 7092 - DNA, 20 bp, Artificial Sequence
  chemically synthesized
cccaagtagttaggacttac

SEQ ID NO: 7093 - DNA, 20 bp, Artificial Sequence
  chemically synthesized
caggtgtgcaccactgtgcc

SEQ ID NO: 7094 - DNA, 20 bp, Artificial Sequence
  chemically synthesized
gcaaattaaaaaaaattttt

SEQ ID NO: 7095 - DNA, 20 bp, Artificial Sequence
  chemically synthesized
aaattaaaaaaaatttttta

SEQ ID NO: 7096 - DNA, 20 bp, Artificial Sequence
  chemically synthesized
aaaaaaattttttagagaaa

SEQ ID NO: 7097 - DNA, 20 bp, Artificial Sequence
  chemically synthesized
aaaaaattttttagagaaat

SEQ ID NO: 7098 - DNA, 20 bp, Artificial Sequence
  chemically synthesized
aaaaattttttagagaaatg

SEQ ID NO: 7099 - DNA, 20 bp, Artificial Sequence
  chemically synthesized
tggggtcttgctatgttgcc

SEQ ID NO: 7100 - DNA, 20 bp, Artificial Sequence
  chemically synthesized
ggggtcttgctatgttgccc

SEQ ID NO: 7101 - DNA, 20 bp, Artificial Sequence
  chemically synthesized
tcttgctatgttgcccaggc

SEQ ID NO: 7102 - DNA, 20 bp, Artificial Sequence
  chemically synthesized
tgctatgttgcccaggctgg

SEQ ID NO: 7103 - DNA, 20 bp, Artificial Sequence
  chemically synthesized
gctatgttgcccaggctggt

SEQ ID NO: 7104 - DNA, 20 bp, Artificial Sequence
  chemically synthesized
gttgcccaggctggtgggaa

SEQ ID NO: 7105 - DNA, 20 bp, Artificial Sequence
  chemically synthesized
ggctggtgggaaaagatttt

SEQ ID NO: 7106 - DNA, 20 bp, Artificial Sequence
  chemically synthesized
gctggtgggaaaagatttta

SEQ ID NO: 7107 - DNA, 20 bp, Artificial Sequence
  chemically synthesized
gtgggaaaagattttaaggt

SEQ ID NO: 7108 - DNA, 20 bp, Artificial Sequence
  chemically synthesized
gggaaaagattttaaggtga

SEQ ID NO: 7109 - DNA, 20 bp, Artificial Sequence
  chemically synthesized
gaaaagattttaaggtgaga

SEQ ID NO: 7110 - DNA, 20 bp, Artificial Sequence
  chemically synthesized
ttttaaggtgagagagatct

SEQ ID NO: 7111 - DNA, 20 bp, Artificial Sequence
  chemically synthesized
taaggtgagagagatctgag

SEQ ID NO: 7112 - DNA, 20 bp, Artificial Sequence
  chemically synthesized
gagagagatctgagcagtgc

SEQ ID NO: 7113 - DNA, 20 bp, Artificial Sequence
  chemically synthesized
agagagatctgagcagtgct

SEQ ID NO: 7114 - DNA, 20 bp, Artificial Sequence
  chemically synthesized
gagatctgagcagtgctagg

SEQ ID NO: 7115 - DNA, 20 bp, Artificial Sequence
  chemically synthesized
atctgagcagtgctaggcag

SEQ ID NO: 7116 - DNA, 20 bp, Artificial Sequence
  chemically synthesized
tctgagcagtgctaggcaga

SEQ ID NO: 7117 - DNA, 20 bp, Artificial Sequence
  chemically synthesized
ctgagcagtgctaggcagaa

SEQ ID NO: 7118 - DNA, 20 bp, Artificial Sequence
  chemically synthesized
gcagtgctaggcagaagggc

SEQ ID NO: 7119 - DNA, 20 bp, Artificial Sequence
  chemically synthesized
agtgctaggcagaagggcaa

SEQ ID NO: 7120 - DNA, 20 bp, Artificial Sequence
  chemically synthesized
ctaggcagaagggcaagagc

SEQ ID NO: 7121 - DNA, 20 bp, Artificial Sequence
  chemically synthesized
taggcagaagggcaagagcc

SEQ ID NO: 7122 - DNA, 20 bp, Artificial Sequence
  chemically synthesized
agaagggcaagagccaggaa

SEQ ID NO: 7123 - DNA, 20 bp, Artificial Sequence
  chemically synthesized
aagggcaagagccaggaatg

SEQ ID NO: 7124 - DNA, 20 bp, Artificial Sequence
  chemically synthesized
agggcaagagccaggaatgg

SEQ ID NO: 7125 - DNA, 20 bp, Artificial Sequence
  chemically synthesized
ggcaagagccaggaatggag

SEQ ID NO: 7126 - DNA, 20 bp, Artificial Sequence
  chemically synthesized
agccaggaatggaggagtgt

SEQ ID NO: 7127 - DNA, 20 bp, Artificial Sequence
  chemically synthesized
gccaggaatggaggagtgtc

SEQ ID NO: 7128 - DNA, 20 bp, Artificial Sequence
  chemically synthesized
atggaggagtgtcaggtgtg

SEQ ID NO: 7129 - DNA, 20 bp, Artificial Sequence
  chemically synthesized
tggaggagtgtcaggtgtgt

SEQ ID NO: 7130 - DNA, 20 bp, Artificial Sequence
  chemically synthesized
agtgtcaggtgtgtgggtgc

SEQ ID NO: 7131 - DNA, 20 bp, Artificial Sequence
  chemically synthesized
gtcaggtgtgtgggtgctgg

SEQ ID NO: 7132 - DNA, 20 bp, Artificial Sequence
  chemically synthesized
aggtgtgtgggtgctggtgg

SEQ ID NO: 7133 - DNA, 20 bp, Artificial Sequence
  chemically synthesized
gtgtgtgggtgctggtggtg

SEQ ID NO: 7134 - DNA, 20 bp, Artificial Sequence
  chemically synthesized
gtgggtgctggtggtggagc

SEQ ID NO: 7135 - DNA, 20 bp, Artificial Sequence
  chemically synthesized
tgggtgctggtggtggagcc

SEQ ID NO: 7136 - DNA, 20 bp, Artificial Sequence
  chemically synthesized
ggtggtggagccgggttcca

SEQ ID NO: 7137 - DNA, 20 bp, Artificial Sequence
  chemically synthesized
tggtggagccgggttccatg

SEQ ID NO: 7138 - DNA, 20 bp, Artificial Sequence
  chemically synthesized
ggtggagccgggttccatgg

SEQ ID NO: 7139 - DNA, 20 bp, Artificial Sequence
  chemically synthesized
ggagccgggttccatggagg

SEQ ID NO: 7140 - DNA, 20 bp, Artificial Sequence
  chemically synthesized
gagccgggttccatggaggc

SEQ ID NO: 7141 - DNA, 20 bp, Artificial Sequence
  chemically synthesized
gccgggttccatggaggcag

SEQ ID NO: 7142 - DNA, 20 bp, Artificial Sequence
  chemically synthesized
ccgggttccatggaggcagg

SEQ ID NO: 7143 - DNA, 20 bp, Artificial Sequence
  chemically synthesized
gggttccatggaggcaggag

SEQ ID NO: 7144 - DNA, 20 bp, Artificial Sequence
  chemically synthesized
ttccatggaggcaggaggag

SEQ ID NO: 7145 - DNA, 20 bp, Artificial Sequence
  chemically synthesized
tccatggaggcaggaggagc

SEQ ID NO: 7146 - DNA, 20 bp, Artificial Sequence
  chemically synthesized
ccatggaggcaggaggagca

SEQ ID NO: 7147 - DNA, 20 bp, Artificial Sequence
  chemically synthesized
catggaggcaggaggagcag

SEQ ID NO: 7148 - DNA, 20 bp, Artificial Sequence
  chemically synthesized
aggcaggaggagcaggggct

SEQ ID NO: 7149 - DNA, 20 bp, Artificial Sequence
  chemically synthesized
gcaggaggagcaggggcttg

SEQ ID NO: 7150 - DNA, 20 bp, Artificial Sequence
  chemically synthesized
aggagcaggggcttggagct

SEQ ID NO: 7151 - DNA, 20 bp, Artificial Sequence
  chemically synthesized
ggagcaggggcttggagctt

SEQ ID NO: 7152 - DNA, 20 bp, Artificial Sequence
  chemically synthesized
gcaggggcttggagcttagg

SEQ ID NO: 7153 - DNA, 20 bp, Artificial Sequence
  chemically synthesized
caggggcttggagcttagga

SEQ ID NO: 7154 - DNA, 20 bp, Artificial Sequence
  chemically synthesized
aggggcttggagcttaggaa

SEQ ID NO: 7155 - DNA, 20 bp, Artificial Sequence
  chemically synthesized
ggggcttggagcttaggaag

SEQ ID NO: 7156 - DNA, 20 bp, Artificial Sequence
  chemically synthesized
ttggagcttaggaaggggat

SEQ ID NO: 7157 - DNA, 20 bp, Artificial Sequence
  chemically synthesized
agcttaggaaggggattggt

SEQ ID NO: 7158 - DNA, 20 bp, Artificial Sequence
  chemically synthesized
taggaaggggattggttagc

SEQ ID NO: 7159 - DNA, 20 bp, Artificial Sequence
  chemically synthesized
aggaaggggattggttagct

SEQ ID NO: 7160 - DNA, 20 bp, Artificial Sequence
  chemically synthesized
aggggattggttagctgggc

SEQ ID NO: 7161 - DNA, 20 bp, Artificial Sequence
  chemically synthesized
ttggttagctgggctggaat

SEQ ID NO: 7162 - DNA, 20 bp, Artificial Sequence
  chemically synthesized
tggttagctgggctggaatg

SEQ ID NO: 7163 - DNA, 20 bp, Artificial Sequence
  chemically synthesized
ggttagctgggctggaatga

SEQ ID NO: 7164 - DNA, 20 bp, Artificial Sequence
  chemically synthesized
atgagggactcctcattcct

SEQ ID NO: 7165 - DNA, 20 bp, Artificial Sequence
  chemically synthesized
tgagggactcctcattcctg

SEQ ID NO: 7166 - DNA, 20 bp, Artificial Sequence
  chemically synthesized
ggactcctcattcctgaggc

SEQ ID NO: 7167 - DNA, 20 bp, Artificial Sequence
  chemically synthesized
attcctgaggctggccaacc

SEQ ID NO: 7168 - DNA, 20 bp, Artificial Sequence
  chemically synthesized
ttcctgaggctggccaaccg

SEQ ID NO: 7169 - DNA, 20 bp, Artificial Sequence
  chemically synthesized
tcctgaggctggccaaccga

SEQ ID NO: 7170 - DNA, 20 bp, Artificial Sequence
  chemically synthesized
ctgaggctggccaaccgagg

SEQ ID NO: 7171 - DNA, 20 bp, Artificial Sequence
  chemically synthesized
tgaggctggccaaccgaggg

SEQ ID NO: 7172 - DNA, 20 bp, Artificial Sequence
  chemically synthesized
gaggctggccaaccgaggga

SEQ ID NO: 7173 - DNA, 20 bp, Artificial Sequence
  chemically synthesized
ctggccaaccgagggagggc

SEQ ID NO: 7174 - DNA, 20 bp, Artificial Sequence
  chemically synthesized
aaccgagggagggccggtgc

SEQ ID NO: 7175 - DNA, 20 bp, Artificial Sequence
  chemically synthesized
accgagggagggccggtgct

SEQ ID NO: 7176 - DNA, 20 bp, Artificial Sequence
  chemically synthesized
gagggagggccggtgctggg

SEQ ID NO: 7177 - DNA, 20 bp, Artificial Sequence
  chemically synthesized
agggagggccggtgctgggc

SEQ ID NO: 7178 - DNA, 20 bp, Artificial Sequence
  chemically synthesized
gggagggccggtgctgggca

SEQ ID NO: 7179 - DNA, 20 bp, Artificial Sequence
  chemically synthesized
agggccggtgctgggcaggg

SEQ ID NO: 7180 - DNA, 20 bp, Artificial Sequence
  chemically synthesized
gggccggtgctgggcagggc

SEQ ID NO: 7181 - DNA, 20 bp, Artificial Sequence
  chemically synthesized
ggccggtgctgggcagggca

SEQ ID NO: 7182 - DNA, 20 bp, Artificial Sequence
  chemically synthesized
cggtgctgggcagggcaggg

SEQ ID NO: 7183 - DNA, 20 bp, Artificial Sequence
  chemically synthesized
ggtgctgggcagggcagggc

SEQ ID NO: 7184 - DNA, 20 bp, Artificial Sequence
  chemically synthesized
gtgctgggcagggcagggca

SEQ ID NO: 7185 - DNA, 20 bp, Artificial Sequence
  chemically synthesized
tgctgggcagggcagggcag

SEQ ID NO: 7186 - DNA, 20 bp, Artificial Sequence
  chemically synthesized
gggcagggcagggcagggga

SEQ ID NO: 7187 - DNA, 20 bp, Artificial Sequence
  chemically synthesized
ggcagggcagggcaggggac

SEQ ID NO: 7188 - DNA, 20 bp, Artificial Sequence
  chemically synthesized
cagggcagggcaggggacag

SEQ ID NO: 7189 - DNA, 20 bp, Artificial Sequence
  chemically synthesized
agggcagggcaggggacagg

SEQ ID NO: 7190 - DNA, 20 bp, Artificial Sequence
  chemically synthesized
gggcagggcaggggacagga

SEQ ID NO: 7191 - DNA, 20 bp, Artificial Sequence
  chemically synthesized
agggcaggggacaggaggga

SEQ ID NO: 7192 - DNA, 20 bp, Artificial Sequence
  chemically synthesized
gggcaggggacaggagggat

SEQ ID NO: 7193 - DNA, 20 bp, Artificial Sequence
  chemically synthesized
gcaggggacaggagggatag

SEQ ID NO: 7194 - DNA, 20 bp, Artificial Sequence
  chemically synthesized
caggggacaggagggatagg

SEQ ID NO: 7195 - DNA, 20 bp, Artificial Sequence
  chemically synthesized
agggataggaggtccctccc

SEQ ID NO: 7196 - DNA, 20 bp, Artificial Sequence
  chemically synthesized
gggataggaggtccctcccg

SEQ ID NO: 7197 - DNA, 20 bp, Artificial Sequence
  chemically synthesized
ggtccctcccgaggaccact

SEQ ID NO: 7198 - DNA, 20 bp, Artificial Sequence
  chemically synthesized
gtccctcccgaggaccactc

SEQ ID NO: 7199 - DNA, 20 bp, Artificial Sequence
  chemically synthesized
cgaggaccactcaggaacac

SEQ ID NO: 7200 - DNA, 20 bp, Artificial Sequence
  chemically synthesized
ggaccactcaggaacaccag

SEQ ID NO: 7201 - DNA, 20 bp, Artificial Sequence
  chemically synthesized
agtagcatctcctctctctg

SEQ ID NO: 7202 - DNA, 20 bp, Artificial Sequence
  chemically synthesized
gtagcatctcctctctctgt

SEQ ID NO: 7203 - DNA, 20 bp, Artificial Sequence
  chemically synthesized
tagcatctcctctctctgta

SEQ ID NO: 7204 - DNA, 20 bp, Artificial Sequence
  chemically synthesized
agcatctcctctctctgtag

SEQ ID NO: 7205 - DNA, 20 bp, Artificial Sequence
  chemically synthesized
gcatctcctctctctgtagg

SEQ ID NO: 7206 - DNA, 20 bp, Artificial Sequence
  chemically synthesized
ctcctctctctgtagggggc

SEQ ID NO: 7207 - DNA, 20 bp, Artificial Sequence
  chemically synthesized
tctctctgtagggggctggc

SEQ ID NO: 7208 - DNA, 20 bp, Artificial Sequence
  chemically synthesized
gggctggctggacttcccac

SEQ ID NO: 7209 - DNA, 20 bp, Artificial Sequence
  chemically synthesized
ggctggctggacttcccacc

SEQ ID NO: 7210 - DNA, 20 bp, Artificial Sequence
  chemically synthesized
tggctggacttcccaccagg

SEQ ID NO: 7211 - DNA, 20 bp, Artificial Sequence
  chemically synthesized
cccaccaggcggtgtcccca

SEQ ID NO: 7212 - DNA, 20 bp, Artificial Sequence
  chemically synthesized
ccaccaggcggtgtccccac

SEQ ID NO: 7213 - DNA, 20 bp, Artificial Sequence
  chemically synthesized
ccaggcggtgtccccacagg

SEQ ID NO: 7214 - DNA, 20 bp, Artificial Sequence
  chemically synthesized
aggcggtgtccccacaggca

SEQ ID NO: 7215 - DNA, 20 bp, Artificial Sequence
  chemically synthesized
ggcggtgtccccacaggcag

SEQ ID NO: 7216 - DNA, 20 bp, Artificial Sequence
  chemically synthesized
ctcactctcctctgcaactc

SEQ ID NO: 7217 - DNA, 20 bp, Artificial Sequence
  chemically synthesized
ctgcaactccagtgcccaca

SEQ ID NO: 7218 - DNA, 20 bp, Artificial Sequence
  chemically synthesized
tccagtgcccacacggcacc

SEQ ID NO: 7219 - DNA, 20 bp, Artificial Sequence
  chemically synthesized
cccacacggcacccggtaca

SEQ ID NO: 7220 - DNA, 20 bp, Artificial Sequence
  chemically synthesized
cccggtacatagtgaacact

SEQ ID NO: 7221 - DNA, 20 bp, Artificial Sequence
  chemically synthesized
cggtacatagtgaacactca

SEQ ID NO: 7222 - DNA, 20 bp, Artificial Sequence
  chemically synthesized
gtacatagtgaacactcaga

SEQ ID NO: 7223 - DNA, 20 bp, Artificial Sequence
  chemically synthesized
gtgaacactcagagagaata

SEQ ID NO: 7224 - DNA, 20 bp, Artificial Sequence
  chemically synthesized
tgaacactcagagagaatac

SEQ ID NO: 7225 - DNA, 20 bp, Artificial Sequence
  chemically synthesized
gggatgctgctgaatcttct

SEQ ID NO: 7226 - DNA, 20 bp, Artificial Sequence
  chemically synthesized
ggatgctgctgaatcttctg

SEQ ID NO: 7227 - DNA, 20 bp, Artificial Sequence
  chemically synthesized
gatgctgctgaatcttctga

SEQ ID NO: 7228 - DNA, 20 bp, Artificial Sequence
  chemically synthesized
gctgaatcttctgagggtga

SEQ ID NO: 7229 - DNA, 20 bp, Artificial Sequence
  chemically synthesized
cttctgagggtgacagaatt

SEQ ID NO: 7230 - DNA, 20 bp, Artificial Sequence
  chemically synthesized
tctgagggtgacagaattta

SEQ ID NO: 7231 - DNA, 20 bp, Artificial Sequence
  chemically synthesized
ggtgacagaatttagagttt

SEQ ID NO: 7232 - DNA, 20 bp, Artificial Sequence
  chemically synthesized
gacagaatttagagtttgag

SEQ ID NO: 7233 - DNA, 20 bp, Artificial Sequence
  chemically synthesized
acagaatttagagtttgagc

SEQ ID NO: 7234 - DNA, 20 bp, Artificial Sequence
  chemically synthesized
agaatttagagtttgagcag

SEQ ID NO: 7235 - DNA, 20 bp, Artificial Sequence
  chemically synthesized
gaatttagagtttgagcagg

SEQ ID NO: 7236 - DNA, 20 bp, Artificial Sequence
  chemically synthesized
tagagtttgagcaggaggct

SEQ ID NO: 7237 - DNA, 20 bp, Artificial Sequence
  chemically synthesized
gagtttgagcaggaggcttg

SEQ ID NO: 7238 - DNA, 20 bp, Artificial Sequence
  chemically synthesized
gtttgagcaggaggcttgga

SEQ ID NO: 7239 - DNA, 20 bp, Artificial Sequence
  chemically synthesized
ttgagcaggaggcttggaga

SEQ ID NO: 7240 - DNA, 20 bp, Artificial Sequence
  chemically synthesized
tgagcaggaggcttggagag

SEQ ID NO: 7241 - DNA, 20 bp, Artificial Sequence
  chemically synthesized
caggaggcttggagagaggc

SEQ ID NO: 7242 - DNA, 20 bp, Artificial Sequence
  chemically synthesized
aggaggcttggagagaggcc

SEQ ID NO: 7243 - DNA, 20 bp, Artificial Sequence
  chemically synthesized
gccaggatttctgaaattaa

SEQ ID NO: 7244 - DNA, 20 bp, Artificial Sequence
  chemically synthesized
ccaggatttctgaaattaat

SEQ ID NO: 7245 - DNA, 20 bp, Artificial Sequence
  chemically synthesized
aggatttctgaaattaatgg

SEQ ID NO: 7246 - DNA, 20 bp, Artificial Sequence
  chemically synthesized
gatttctgaaattaatggga

SEQ ID NO: 7247 - DNA, 20 bp, Artificial Sequence
  chemically synthesized
tctgaaattaatgggagagt

SEQ ID NO: 7248 - DNA, 20 bp, Artificial Sequence
  chemically synthesized
ggagagtgagctcacgcgaa

SEQ ID NO: 7249 - DNA, 20 bp, Artificial Sequence
  chemically synthesized
gagagtgagctcacgcgaat

SEQ ID NO: 7250 - DNA, 20 bp, Artificial Sequence
  chemically synthesized
tgagctcacgcgaatgggct

SEQ ID NO: 7251 - DNA, 20 bp, Artificial Sequence
  chemically synthesized
gagctcacgcgaatgggctg

SEQ ID NO: 7252 - DNA, 20 bp, Artificial Sequence
  chemically synthesized
agctcacgcgaatgggctga

SEQ ID NO: 7253 - DNA, 20 bp, Artificial Sequence
  chemically synthesized
gcgaatgggctgagggacac

SEQ ID NO: 7254 - DNA, 20 bp, Artificial Sequence
  chemically synthesized
atgggctgagggacaccagt

SEQ ID NO: 7255 - DNA, 20 bp, Artificial Sequence
  chemically synthesized
tgggctgagggacaccagtg

SEQ ID NO: 7256 - DNA, 20 bp, Artificial Sequence
  chemically synthesized
gggctgagggacaccagtga

SEQ ID NO: 7257 - DNA, 20 bp, Artificial Sequence
  chemically synthesized
caccagtgagggaccgtctg

SEQ ID NO: 7258 - DNA, 20 bp, Artificial Sequence
  chemically synthesized
accagtgagggaccgtctga

SEQ ID NO: 7259 - DNA, 20 bp, Artificial Sequence
  chemically synthesized
ccagtgagggaccgtctgaa

SEQ ID NO: 7260 - DNA, 20 bp, Artificial Sequence
  chemically synthesized
agggaccgtctgaagggatg

SEQ ID NO: 7261 - DNA, 20 bp, Artificial Sequence
  chemically synthesized
ccgtctgaagggatgtagca

SEQ ID NO: 7262 - DNA, 20 bp, Artificial Sequence
  chemically synthesized
aaagtcaccgcatttccctc

SEQ ID NO: 7263 - DNA, 20 bp, Artificial Sequence
  chemically synthesized
gtcaccgcatttccctccag

SEQ ID NO: 7264 - DNA, 20 bp, Artificial Sequence
  chemically synthesized
cgcatttccctccagcagcc

SEQ ID NO: 7265 - DNA, 20 bp, Artificial Sequence
  chemically synthesized
gcatttccctccagcagccc

SEQ ID NO: 7266 - DNA, 20 bp, Artificial Sequence
  chemically synthesized
tttccctccagcagcccggg

SEQ ID NO: 7267 - DNA, 20 bp, Artificial Sequence
  chemically synthesized
ccctccagcagcccgggtgg

SEQ ID NO: 7268 - DNA, 20 bp, Artificial Sequence
  chemically synthesized
cctccagcagcccgggtggt

SEQ ID NO: 7269 - DNA, 20 bp, Artificial Sequence
  chemically synthesized
ctccagcagcccgggtggtg

SEQ ID NO: 7270 - DNA, 20 bp, Artificial Sequence
  chemically synthesized
tccagcagcccgggtggtgg

SEQ ID NO: 7271 - DNA, 20 bp, Artificial Sequence
  chemically synthesized
gcagcccgggtggtgggggc

SEQ ID NO: 7272 - DNA, 20 bp, Artificial Sequence
  chemically synthesized
cagcccgggtggtgggggct

SEQ ID NO: 7273 - DNA, 20 bp, Artificial Sequence
  chemically synthesized
agcccgggtggtgggggctg

SEQ ID NO: 7274 - DNA, 20 bp, Artificial Sequence
  chemically synthesized
gcccgggtggtgggggctgg

SEQ ID NO: 7275 - DNA, 20 bp, Artificial Sequence
  chemically synthesized
gggctgggggaacgtcatca

SEQ ID NO: 7276 - DNA, 20 bp, Artificial Sequence
  chemically synthesized
ggctgggggaacgtcatcat

SEQ ID NO: 7277 - DNA, 20 bp, Artificial Sequence
  chemically synthesized
ctgggggaacgtcatcatgg

SEQ ID NO: 7278 - DNA, 20 bp, Artificial Sequence
  chemically synthesized
tcatgggagctgacactgat

SEQ ID NO: 7279 - DNA, 20 bp, Artificial Sequence
  chemically synthesized
gacactgatcagctgctcac

SEQ ID NO: 7280 - DNA, 20 bp, Artificial Sequence
  chemically synthesized
acactgatcagctgctcacc

SEQ ID NO: 7281 - DNA, 20 bp, Artificial Sequence
  chemically synthesized
cactgatcagctgctcaccg

SEQ ID NO: 7282 - DNA, 20 bp, Artificial Sequence
  chemically synthesized
ggcccatcttccacttgtct

SEQ ID NO: 7283 - DNA, 20 bp, Artificial Sequence
  chemically synthesized
gctaccccctttttctttta

SEQ ID NO: 7284 - DNA, 20 bp, Artificial Sequence
  chemically synthesized
atttcaattatgcatgtatt

SEQ ID NO: 7285 - DNA, 20 bp, Artificial Sequence
  chemically synthesized
tttcaattatgcatgtatta

SEQ ID NO: 7286 - DNA, 20 bp, Artificial Sequence
  chemically synthesized
ttcaattatgcatgtattaa

SEQ ID NO: 7287 - DNA, 20 bp, Artificial Sequence
  chemically synthesized
tgcatgtattaagggtccca

SEQ ID NO: 7288 - DNA, 20 bp, Artificial Sequence
  chemically synthesized
tttttaattcttttttctcc

SEQ ID NO: 7289 - DNA, 20 bp, Artificial Sequence
  chemically synthesized
tctcccagtgtttcatttta

SEQ ID NO: 7290 - DNA, 20 bp, Artificial Sequence
  chemically synthesized
tcccagtgtttcattttata

SEQ ID NO: 7291 - DNA, 20 bp, Artificial Sequence
  chemically synthesized
tagagttattgctgttcatt

SEQ ID NO: 7292 - DNA, 20 bp, Artificial Sequence
  chemically synthesized
tctcatctcactctgttgcc

SEQ ID NO: 7293 - DNA, 20 bp, Artificial Sequence
  chemically synthesized
ctcatctcactctgttgccc

SEQ ID NO: 7294 - DNA, 20 bp, Artificial Sequence
  chemically synthesized
tctcactctgttgcccaggc

SEQ ID NO: 7295 - DNA, 20 bp, Artificial Sequence
  chemically synthesized
ctgttgcccaggctggaatg

SEQ ID NO: 7296 - DNA, 20 bp, Artificial Sequence
  chemically synthesized
ttgcccaggctggaatgcag

SEQ ID NO: 7297 - DNA, 20 bp, Artificial Sequence
  chemically synthesized
tagcttgtcacaactcactg

SEQ ID NO: 7298 - DNA, 20 bp, Artificial Sequence
  chemically synthesized
tcactgtggcctccacctcc

SEQ ID NO: 7299 - DNA, 20 bp, Artificial Sequence
  chemically synthesized
cactgtggcctccacctcct

SEQ ID NO: 7300 - DNA, 20 bp, Artificial Sequence
  chemically synthesized
tggcctccacctcctgggct

SEQ ID NO: 7301 - DNA, 20 bp, Artificial Sequence
  chemically synthesized
ggcctccacctcctgggctc

SEQ ID NO: 7302 - DNA, 20 bp, Artificial Sequence
  chemically synthesized
ctcaggcgatccttccactt

SEQ ID NO: 7303 - DNA, 20 bp, Artificial Sequence
  chemically synthesized
atccttccacttcagcctcc

SEQ ID NO: 7304 - DNA, 20 bp, Artificial Sequence
  chemically synthesized
tccttccacttcagcctccc

SEQ ID NO: 7305 - DNA, 20 bp, Artificial Sequence
  chemically synthesized
ttccacttcagcctcccagg

SEQ ID NO: 7306 - DNA, 20 bp, Artificial Sequence
  chemically synthesized
acttcagcctcccaggtagc

SEQ ID NO: 7307 - DNA, 20 bp, Artificial Sequence
  chemically synthesized
cttcagcctcccaggtagct

SEQ ID NO: 7308 - DNA, 20 bp, Artificial Sequence
  chemically synthesized
ctcccaggtagctgggacta

SEQ ID NO: 7309 - DNA, 20 bp, Artificial Sequence
  chemically synthesized
tcccaggtagctgggactat

SEQ ID NO: 7310 - DNA, 20 bp, Artificial Sequence
  chemically synthesized
tagctgggactataggcatg

SEQ ID NO: 7311 - DNA, 20 bp, Artificial Sequence
  chemically synthesized
taggcatgtggcaccacacc

SEQ ID NO: 7312 - DNA, 20 bp, Artificial Sequence
  chemically synthesized
taattaaaaatttttttttg

SEQ ID NO: 7313 - DNA, 20 bp, Artificial Sequence
  chemically synthesized
attaaaaatttttttttgta

SEQ ID NO: 7314 - DNA, 20 bp, Artificial Sequence
  chemically synthesized
aaaatttttttttgtagaga

SEQ ID NO: 7315 - DNA, 20 bp, Artificial Sequence
  chemically synthesized
gtagagacggttttgccatg

SEQ ID NO: 7316 - DNA, 20 bp, Artificial Sequence
  chemically synthesized
agagacggttttgccatgta

SEQ ID NO: 7317 - DNA, 20 bp, Artificial Sequence
  chemically synthesized
gagacggttttgccatgtag

SEQ ID NO: 7318 - DNA, 20 bp, Artificial Sequence
  chemically synthesized
agacggttttgccatgtaga

SEQ ID NO: 7319 - DNA, 20 bp, Artificial Sequence
  chemically synthesized
gacggttttgccatgtagag

SEQ ID NO: 7320 - DNA, 20 bp, Artificial Sequence
  chemically synthesized
aggggttttgccatgctgcc

SEQ ID NO: 7321 - DNA, 20 bp, Artificial Sequence
  chemically synthesized
ttttgccatgctgcccagac

SEQ ID NO: 7322 - DNA, 20 bp, Artificial Sequence
  chemically synthesized
atgctgcccagactagtctt

SEQ ID NO: 7323 - DNA, 20 bp, Artificial Sequence
  chemically synthesized
ccagactagtcttgagctcc

SEQ ID NO: 7324 - DNA, 20 bp, Artificial Sequence
  chemically synthesized
cagactagtcttgagctcct

SEQ ID NO: 7325 - DNA, 20 bp, Artificial Sequence
  chemically synthesized
agtcttgagctcctgggctc

SEQ ID NO: 7326 - DNA, 20 bp, Artificial Sequence
  chemically synthesized
ccccccgtgtcgacctccca

SEQ ID NO: 7327 - DNA, 20 bp, Artificial Sequence
  chemically synthesized
gtgtcgacctcccaaagtgc

SEQ ID NO: 7328 - DNA, 20 bp, Artificial Sequence
  chemically synthesized
tgtcgacctcccaaagtgct

SEQ ID NO: 7329 - DNA, 20 bp, Artificial Sequence
  chemically synthesized
ctcccaaagtgctgggatta

SEQ ID NO: 7330 - DNA, 20 bp, Artificial Sequence
  chemically synthesized
gggattacagatgtgatcca

SEQ ID NO: 7331 - DNA, 20 bp, Artificial Sequence
  chemically synthesized
cagatgtgatccacagtgcc

SEQ ID NO: 7332 - DNA, 20 bp, Artificial Sequence
  chemically synthesized
catcttccattatttccatc

SEQ ID NO: 7333 - DNA, 20 bp, Artificial Sequence
  chemically synthesized
tcttttcttttttttttttt

SEQ ID NO: 7334 - DNA, 20 bp, Artificial Sequence
  chemically synthesized
ttttcttttttttttttttg

SEQ ID NO: 7335 - DNA, 20 bp, Artificial Sequence
  chemically synthesized
tttcttttttttttttttgg

SEQ ID NO: 7336 - DNA, 20 bp, Artificial Sequence
  chemically synthesized
cttttttttttttttggagg

SEQ ID NO: 7337 - DNA, 20 bp, Artificial Sequence
  chemically synthesized
tttttttttttttggaggcg

SEQ ID NO: 7338 - DNA, 20 bp, Artificial Sequence
  chemically synthesized
cggagtctcgctctgttgcc

SEQ ID NO: 7339 - DNA, 20 bp, Artificial Sequence
  chemically synthesized
ggagtctcgctctgttgccc

SEQ ID NO: 7340 - DNA, 20 bp, Artificial Sequence
  chemically synthesized
tctcgctctgttgcccaggc

SEQ ID NO: 7341 - DNA, 20 bp, Artificial Sequence
  chemically synthesized
tcgctctgttgcccaggccg

SEQ ID NO: 7342 - DNA, 20 bp, Artificial Sequence
  chemically synthesized
ctgttgcccaggccggagtg

SEQ ID NO: 7343 - DNA, 20 bp, Artificial Sequence
  chemically synthesized
ttgcccaggccggagtgcag

SEQ ID NO: 7344 - DNA, 20 bp, Artificial Sequence
  chemically synthesized
ggagtgcagtggcgcgatct

SEQ ID NO: 7345 - DNA, 20 bp, Artificial Sequence
  chemically synthesized
gcgcgatcttggctcactgc

SEQ ID NO: 7346 - DNA, 20 bp, Artificial Sequence
  chemically synthesized
tcactgcaagctctgcctcc

SEQ ID NO: 7347 - DNA, 20 bp, Artificial Sequence
  chemically synthesized
cactgcaagctctgcctccc

SEQ ID NO: 7348 - DNA, 20 bp, Artificial Sequence
  chemically synthesized
ttcatgccattctcctgcct

SEQ ID NO: 7349 - DNA, 20 bp, Artificial Sequence
  chemically synthesized
ttctcctgcctcagcctccc

SEQ ID NO: 7350 - DNA, 20 bp, Artificial Sequence
  chemically synthesized
tcctgcctcagcctcccgag

SEQ ID NO: 7351 - DNA, 20 bp, Artificial Sequence
  chemically synthesized
gcctcagcctcccgagtagc

SEQ ID NO: 7352 - DNA, 20 bp, Artificial Sequence
  chemically synthesized
cctcagcctcccgagtagct

SEQ ID NO: 7353 - DNA, 20 bp, Artificial Sequence
  chemically synthesized
ctcccgagtagctgggacta

SEQ ID NO: 7354 - DNA, 20 bp, Artificial Sequence
  chemically synthesized
tcccgagtagctgggactac

SEQ ID NO: 7355 - DNA, 20 bp, Artificial Sequence
  chemically synthesized
caggcgcctgccaccacgtc

SEQ ID NO: 7356 - DNA, 20 bp, Artificial Sequence
  chemically synthesized
tggctaattttttgtatttt

SEQ ID NO: 7357 - DNA, 20 bp, Artificial Sequence
  chemically synthesized
ctaattttttgtatttttag

SEQ ID NO: 7358 - DNA, 20 bp, Artificial Sequence
  chemically synthesized
aattttttgtatttttagta

SEQ ID NO: 7359 - DNA, 20 bp, Artificial Sequence
  chemically synthesized
ttttgtatttttagtagaga

SEQ ID NO: 7360 - DNA, 20 bp, Artificial Sequence
  chemically synthesized
tttgtatttttagtagagat

SEQ ID NO: 7361 - DNA, 20 bp, Artificial Sequence
  chemically synthesized
ttgtatttttagtagagatg

SEQ ID NO: 7362 - DNA, 20 bp, Artificial Sequence
  chemically synthesized
gagatggggtttcaccatgt

SEQ ID NO: 7363 - DNA, 20 bp, Artificial Sequence
  chemically synthesized
tggggtttcaccatgttagc

SEQ ID NO: 7364 - DNA, 20 bp, Artificial Sequence
  chemically synthesized
ggggtttcaccatgttagcc

SEQ ID NO: 7365 - DNA, 20 bp, Artificial Sequence
  chemically synthesized
tttcaccatgttagccagga

SEQ ID NO: 7366 - DNA, 20 bp, Artificial Sequence
  chemically synthesized
acctcatgatctgcccgcct

SEQ ID NO: 7367 - DNA, 20 bp, Artificial Sequence
  chemically synthesized
ctgcccgccttggcctccca

SEQ ID NO: 7368 - DNA, 20 bp, Artificial Sequence
  chemically synthesized
gccttggcctcccacagtgc

SEQ ID NO: 7369 - DNA, 20 bp, Artificial Sequence
  chemically synthesized
ccttggcctcccacagtgct

SEQ ID NO: 7370 - DNA, 20 bp, Artificial Sequence
  chemically synthesized
ctcccacagtgctgggattc

SEQ ID NO: 7371 - DNA, 20 bp, Artificial Sequence
  chemically synthesized
tcccacagtgctgggattcc

SEQ ID NO: 7372 - DNA, 20 bp, Artificial Sequence
  chemically synthesized
agtgctgggattccaggcgt

SEQ ID NO: 7373 - DNA, 20 bp, Artificial Sequence
  chemically synthesized
gggattccaggcgtgagcca

SEQ ID NO: 7374 - DNA, 20 bp, Artificial Sequence
  chemically synthesized
caggcgtgagccacggcgcc

SEQ ID NO: 7375 - DNA, 20 bp, Artificial Sequence
  chemically synthesized
cgtgagccacggcgcctggc

SEQ ID NO: 7376 - DNA, 20 bp, Artificial Sequence
  chemically synthesized
gccagtgtgttttttcattt

SEQ ID NO: 7377 - DNA, 20 bp, Artificial Sequence
  chemically synthesized
ttttttcatttcagacattg

SEQ ID NO: 7378 - DNA, 20 bp, Artificial Sequence
  chemically synthesized
gacattgtagtttttatctc

SEQ ID NO: 7379 - DNA, 20 bp, Artificial Sequence
  chemically synthesized
attgtagtttttatctctag

SEQ ID NO: 7380 - DNA, 20 bp, Artificial Sequence
  chemically synthesized
tttatctctagaagttcacc

SEQ ID NO: 7381 - DNA, 20 bp, Artificial Sequence
  chemically synthesized
ttatctctagaagttcacct

SEQ ID NO: 7382 - DNA, 20 bp, Artificial Sequence
  chemically synthesized
tatctctagaagttcacctg

SEQ ID NO: 7383 - DNA, 20 bp, Artificial Sequence
  chemically synthesized
acttaattttttgaacataa

SEQ ID NO: 7384 - DNA, 20 bp, Artificial Sequence
  chemically synthesized
cttaattttttgaacataat

SEQ ID NO: 7385 - DNA, 20 bp, Artificial Sequence
  chemically synthesized
tttttgaacataatgggata

SEQ ID NO: 7386 - DNA, 20 bp, Artificial Sequence
  chemically synthesized
ccatccttgcctgctaattc

SEQ ID NO: 7387 - DNA, 20 bp, Artificial Sequence
  chemically synthesized
gctaattctagcatccgtgt

SEQ ID NO: 7388 - DNA, 20 bp, Artificial Sequence
  chemically synthesized
tctagcatccgtgtcagttc

SEQ ID NO: 7389 - DNA, 20 bp, Artificial Sequence
  chemically synthesized
catgccttgtaatctttgat

SEQ ID NO: 7390 - DNA, 20 bp, Artificial Sequence
  chemically synthesized
tgtaatctttgattggctgc

SEQ ID NO: 7391 - DNA, 20 bp, Artificial Sequence
  chemically synthesized
cattgtcaatttcaccttgt

SEQ ID NO: 7392 - DNA, 20 bp, Artificial Sequence
  chemically synthesized
attgtcaatttcaccttgtt

SEQ ID NO: 7393 - DNA, 20 bp, Artificial Sequence
  chemically synthesized
aatttcaccttgttgggtgc

SEQ ID NO: 7394 - DNA, 20 bp, Artificial Sequence
  chemically synthesized
gtattcctctaaatgttctt

SEQ ID NO: 7395 - DNA, 20 bp, Artificial Sequence
  chemically synthesized
aatgttcttgagctttgctc

SEQ ID NO: 7396 - DNA, 20 bp, Artificial Sequence
  chemically synthesized
atgttcttgagctttgctcc

SEQ ID NO: 7397 - DNA, 20 bp, Artificial Sequence
  chemically synthesized
ttgagctttgctccgggatg

SEQ ID NO: 7398 - DNA, 20 bp, Artificial Sequence
  chemically synthesized
ctttgctccgggatgcagtt

SEQ ID NO: 7399 - DNA, 20 bp, Artificial Sequence
  chemically synthesized
cgggatgcagttaagcaact

SEQ ID NO: 7400 - DNA, 20 bp, Artificial Sequence
  chemically synthesized
ggatgcagttaagcaactta

SEQ ID NO: 7401 - DNA, 20 bp, Artificial Sequence
  chemically synthesized
gcagttaagcaacttagagt

SEQ ID NO: 7402 - DNA, 20 bp, Artificial Sequence
  chemically synthesized
gtttgaactcttaattgttt

SEQ ID NO: 7403 - DNA, 20 bp, Artificial Sequence
  chemically synthesized
cttaattgttttggtctcct

SEQ ID NO: 7404 - DNA, 20 bp, Artificial Sequence
  chemically synthesized
ttttggtctcctcggactct

SEQ ID NO: 7405 - DNA, 20 bp, Artificial Sequence
  chemically synthesized
tcagctccatctcctcaacg

SEQ ID NO: 7406 - DNA, 20 bp, Artificial Sequence
  chemically synthesized
cagctccatctcctcaacgt

SEQ ID NO: 7407 - DNA, 20 bp, Artificial Sequence
  chemically synthesized
agctccatctcctcaacgtg

SEQ ID NO: 7408 - DNA, 20 bp, Artificial Sequence
  chemically synthesized
ctccatctcctcaacgtggg

SEQ ID NO: 7409 - DNA, 20 bp, Artificial Sequence
  chemically synthesized
cctcaacgtggggagtctct

SEQ ID NO: 7410 - DNA, 20 bp, Artificial Sequence
  chemically synthesized
ctcaacgtggggagtctctt

SEQ ID NO: 7411 - DNA, 20 bp, Artificial Sequence
  chemically synthesized
ggagtctcttgggctctgcc

SEQ ID NO: 7412 - DNA, 20 bp, Artificial Sequence
  chemically synthesized
ctgcctggacttccctttcc

SEQ ID NO: 7413 - DNA, 20 bp, Artificial Sequence
  chemically synthesized
ctttcctggcctgtaacctg

SEQ ID NO: 7414 - DNA, 20 bp, Artificial Sequence
  chemically synthesized
acctgcagactctctccaaa

SEQ ID NO: 7415 - DNA, 20 bp, Artificial Sequence
  chemically synthesized
gcagactctctccaaacagt

SEQ ID NO: 7416 - DNA, 20 bp, Artificial Sequence
  chemically synthesized
actctctccaaacagtaagc

SEQ ID NO: 7417 - DNA, 20 bp, Artificial Sequence
  chemically synthesized
ctctctccaaacagtaagct

SEQ ID NO: 7418 - DNA, 20 bp, Artificial Sequence
  chemically synthesized
tctctccaaacagtaagctg

SEQ ID NO: 7419 - DNA, 20 bp, Artificial Sequence
  chemically synthesized
aaacagtaagctggggtgat

SEQ ID NO: 7420 - DNA, 20 bp, Artificial Sequence
  chemically synthesized
acagtaagctggggtgatcg

SEQ ID NO: 7421 - DNA, 20 bp, Artificial Sequence
  chemically synthesized
cagtaagctggggtgatcgg

SEQ ID NO: 7422 - DNA, 20 bp, Artificial Sequence
  chemically synthesized
agtaagctggggtgatcgga

SEQ ID NO: 7423 - DNA, 20 bp, Artificial Sequence
  chemically synthesized
gttgtttgcttcttatccct

SEQ ID NO: 7424 - DNA, 20 bp, Artificial Sequence
  chemically synthesized
ttgtttgcttcttatccctc

SEQ ID NO: 7425 - DNA, 20 bp, Artificial Sequence
  chemically synthesized
tgtttgcttcttatccctca

SEQ ID NO: 7426 - DNA, 20 bp, Artificial Sequence
  chemically synthesized
actcctccttgcctgatgtc

SEQ ID NO: 7427 - DNA, 20 bp, Artificial Sequence
  chemically synthesized
tcctccttgcctgatgtcca

SEQ ID NO: 7428 - DNA, 20 bp, Artificial Sequence
  chemically synthesized
cctgatgtccagagtcttga

SEQ ID NO: 7429 - DNA, 20 bp, Artificial Sequence
  chemically synthesized
ttgaaagctgccatgttcta

SEQ ID NO: 7430 - DNA, 20 bp, Artificial Sequence
  chemically synthesized
gtttttgttttgattgtttc

SEQ ID NO: 7431 - DNA, 20 bp, Artificial Sequence
  chemically synthesized
tttttgttttgattgtttct

SEQ ID NO: 7432 - DNA, 20 bp, Artificial Sequence
  chemically synthesized
ttttgttttgattgtttctg

SEQ ID NO: 7433 - DNA, 20 bp, Artificial Sequence
  chemically synthesized
ttgttttgattgtttctggg

SEQ ID NO: 7434 - DNA, 20 bp, Artificial Sequence
  chemically synthesized
gttttgattgtttctgggga

SEQ ID NO: 7435 - DNA, 20 bp, Artificial Sequence
  chemically synthesized
ttgattgtttctggggagag

SEQ ID NO: 7436 - DNA, 20 bp, Artificial Sequence
  chemically synthesized
gagaagaactcttcccatct

SEQ ID NO: 7437 - DNA, 20 bp, Artificial Sequence
  chemically synthesized
agaagaactcttcccatctt

SEQ ID NO: 7438 - DNA, 20 bp, Artificial Sequence
  chemically synthesized
agaactcttcccatcttggg

SEQ ID NO: 7439 - DNA, 20 bp, Artificial Sequence
  chemically synthesized
ttatgttcaaacttttgcct

SEQ ID NO: 7440 - DNA, 20 bp, Artificial Sequence
  chemically synthesized
tgttcaaacttttgcctaag

SEQ ID NO: 7441 - DNA, 20 bp, Artificial Sequence
  chemically synthesized
tttaactcatctaattatcc

SEQ ID NO: 7442 - DNA, 20 bp, Artificial Sequence
  chemically synthesized
aattatccgagcaatccaat

SEQ ID NO: 7443 - DNA, 20 bp, Artificial Sequence
  chemically synthesized
attatccgagcaatccaatc

SEQ ID NO: 7444 - DNA, 20 bp, Artificial Sequence
  chemically synthesized
atccgagcaatccaatcggg

SEQ ID NO: 7445 - DNA, 20 bp, Artificial Sequence
  chemically synthesized
gtgatctccattttacacac

SEQ ID NO: 7446 - DNA, 20 bp, Artificial Sequence
  chemically synthesized
ccattttacacacgagaaaa

SEQ ID NO: 7447 - DNA, 20 bp, Artificial Sequence
  chemically synthesized
ttttacacacgagaaaatgg

SEQ ID NO: 7448 - DNA, 20 bp, Artificial Sequence
  chemically synthesized
cacacgagaaaatggaagca

SEQ ID NO: 7449 - DNA, 20 bp, Artificial Sequence
  chemically synthesized
cacgagaaaatggaagcatg

SEQ ID NO: 7450 - DNA, 20 bp, Artificial Sequence
  chemically synthesized
agcatggagaaattgaatgc

SEQ ID NO: 7451 - DNA, 20 bp, Artificial Sequence
  chemically synthesized
tgaatgctggtgcatgatct

SEQ ID NO: 7452 - DNA, 20 bp, Artificial Sequence
  chemically synthesized
aatgctggtgcatgatctca

SEQ ID NO: 7453 - DNA, 20 bp, Artificial Sequence
  chemically synthesized
tgcatgatctcagagctacc

SEQ ID NO: 7454 - DNA, 20 bp, Artificial Sequence
  chemically synthesized
catgatctcagagctacctg

SEQ ID NO: 7455 - DNA, 20 bp, Artificial Sequence
  chemically synthesized
atgatctcagagctacctgg

SEQ ID NO: 7456 - DNA, 20 bp, Artificial Sequence
  chemically synthesized
ctcagagctacctggaggca

SEQ ID NO: 7457 - DNA, 20 bp, Artificial Sequence
  chemically synthesized
gagctacctggaggcacagc

SEQ ID NO: 7458 - DNA, 20 bp, Artificial Sequence
  chemically synthesized
agctacctggaggcacagct

SEQ ID NO: 7459 - DNA, 20 bp, Artificial Sequence
  chemically synthesized
ggcacagctgggctaccctg

SEQ ID NO: 7460 - DNA, 20 bp, Artificial Sequence
  chemically synthesized
gcacagctgggctaccctgt

SEQ ID NO: 7461 - DNA, 20 bp, Artificial Sequence
  chemically synthesized
cagctgggctaccctgtggg

SEQ ID NO: 7462 - DNA, 20 bp, Artificial Sequence
  chemically synthesized
gggctaccctgtgggcagtc

SEQ ID NO: 7463 - DNA, 20 bp, Artificial Sequence
  chemically synthesized
ccctgtgggcagtctggttt

SEQ ID NO: 7464 - DNA, 20 bp, Artificial Sequence
  chemically synthesized
cctgtgggcagtctggtttc

SEQ ID NO: 7465 - DNA, 20 bp, Artificial Sequence
  chemically synthesized
ctgtgggcagtctggtttca

SEQ ID NO: 7466 - DNA, 20 bp, Artificial Sequence
  chemically synthesized
tgggcagtctggtttcaggg

SEQ ID NO: 7467 - DNA, 20 bp, Artificial Sequence
  chemically synthesized
ctggtttcagggtggatata

SEQ ID NO: 7468 - DNA, 20 bp, Artificial Sequence
  chemically synthesized
tggatatacagacacgttgc

SEQ ID NO: 7469 - DNA, 20 bp, Artificial Sequence
  chemically synthesized
ggatatacagacacgttgct

SEQ ID NO: 7470 - DNA, 20 bp, Artificial Sequence
  chemically synthesized
gacacgttgctgggctgacc

SEQ ID NO: 7471 - DNA, 20 bp, Artificial Sequence
  chemically synthesized
ttgctgggctgacccagcat

SEQ ID NO: 7472 - DNA, 20 bp, Artificial Sequence
  chemically synthesized
tgctgggctgacccagcatt

SEQ ID NO: 7473 - DNA, 20 bp, Artificial Sequence
  chemically synthesized
ctgggctgacccagcattgg

SEQ ID NO: 7474 - DNA, 20 bp, Artificial Sequence
  chemically synthesized
acccagcattgggagttgat

SEQ ID NO: 7475 - DNA, 20 bp, Artificial Sequence
  chemically synthesized
agcattgggagttgataagt

SEQ ID NO: 7476 - DNA, 20 bp, Artificial Sequence
  chemically synthesized
tgggagttgataagtcggac

SEQ ID NO: 7477 - DNA, 20 bp, Artificial Sequence
  chemically synthesized
gggagttgataagtcggact

SEQ ID NO: 7478 - DNA, 20 bp, Artificial Sequence
  chemically synthesized
agttgataagtcggactggg

SEQ ID NO: 7479 - DNA, 20 bp, Artificial Sequence
  chemically synthesized
tgataagtcggactgggaag

SEQ ID NO: 7480 - DNA, 20 bp, Artificial Sequence
  chemically synthesized
gataagtcggactgggaagc

SEQ ID NO: 7481 - DNA, 20 bp, Artificial Sequence
  chemically synthesized
agtcggactgggaagcagga

SEQ ID NO: 7482 - DNA, 20 bp, Artificial Sequence
  chemically synthesized
gtcggactgggaagcaggac

SEQ ID NO: 7483 - DNA, 20 bp, Artificial Sequence
  chemically synthesized
gaagcaggacaggaccctct

SEQ ID NO: 7484 - DNA, 20 bp, Artificial Sequence
  chemically synthesized
gcaggacaggaccctctgag

SEQ ID NO: 7485 - DNA, 20 bp, Artificial Sequence
  chemically synthesized
aggacaggaccctctgagtg

SEQ ID NO: 7486 - DNA, 20 bp, Artificial Sequence
  chemically synthesized
ggacaggaccctctgagtgg

SEQ ID NO: 7487 - DNA, 20 bp, Artificial Sequence
  chemically synthesized
gacaggaccctctgagtgga

SEQ ID NO: 7488 - DNA, 20 bp, Artificial Sequence
  chemically synthesized
cctctgagtggagggtgctg

SEQ ID NO: 7489 - DNA, 20 bp, Artificial Sequence
  chemically synthesized
tgagtggagggtgctgaaga

SEQ ID NO: 7490 - DNA, 20 bp, Artificial Sequence
  chemically synthesized
gtggagggtgctgaagacag

SEQ ID NO: 7491 - DNA, 20 bp, Artificial Sequence
  chemically synthesized
agggtgctgaagacagcagt

SEQ ID NO: 7492 - DNA, 20 bp, Artificial Sequence
  chemically synthesized
gggtgctgaagacagcagtc

SEQ ID NO: 7493 - DNA, 20 bp, Artificial Sequence
  chemically synthesized
ggtgctgaagacagcagtca

SEQ ID NO: 7494 - DNA, 20 bp, Artificial Sequence
  chemically synthesized
gaagacagcagtcagggact

SEQ ID NO: 7495 - DNA, 20 bp, Artificial Sequence
  chemically synthesized
agcagtcagggactcagcca

SEQ ID NO: 7496 - DNA, 20 bp, Artificial Sequence
  chemically synthesized
cagtcagggactcagccatg

SEQ ID NO: 7497 - DNA, 20 bp, Artificial Sequence
  chemically synthesized
agtcagggactcagccatgg

SEQ ID NO: 7498 - DNA, 20 bp, Artificial Sequence
  chemically synthesized
gtcagggactcagccatgga

SEQ ID NO: 7499 - DNA, 20 bp, Artificial Sequence
  chemically synthesized
gggactcagccatggagggc

SEQ ID NO: 7500 - DNA, 20 bp, Artificial Sequence
  chemically synthesized
tcagccatggagggccagct

SEQ ID NO: 7501 - DNA, 20 bp, Artificial Sequence
  chemically synthesized
gccatggagggccagcttgg

SEQ ID NO: 7502 - DNA, 20 bp, Artificial Sequence
  chemically synthesized
ccatggagggccagcttggt

SEQ ID NO: 7503 - DNA, 20 bp, Artificial Sequence
  chemically synthesized
catggagggccagcttggtg

SEQ ID NO: 7504 - DNA, 20 bp, Artificial Sequence
  chemically synthesized
cagcttggtggggaacaccg

SEQ ID NO: 7505 - DNA, 20 bp, Artificial Sequence
  chemically synthesized
ggtggggaacaccgtggtca

SEQ ID NO: 7506 - DNA, 20 bp, Artificial Sequence
  chemically synthesized
tggggaacaccgtggtcatg

SEQ ID NO: 7507 - DNA, 20 bp, Artificial Sequence
  chemically synthesized
ccgtggtcatggagcgcttc

SEQ ID NO: 7508 - DNA, 20 bp, Artificial Sequence
  chemically synthesized
ggtcatggagcgcttctgga

SEQ ID NO: 7509 - DNA, 20 bp, Artificial Sequence
  chemically synthesized
tcatggagcgcttctggatg

SEQ ID NO: 7510 - DNA, 20 bp, Artificial Sequence
  chemically synthesized
atggagcgcttctggatgga

SEQ ID NO: 7511 - DNA, 20 bp, Artificial Sequence
  chemically synthesized
tggagcgcttctggatggag

SEQ ID NO: 7512 - DNA, 20 bp, Artificial Sequence
  chemically synthesized
tctggatggagaggaatgca

SEQ ID NO: 7513 - DNA, 20 bp, Artificial Sequence
  chemically synthesized
ctggatggagaggaatgcaa

SEQ ID NO: 7514 - DNA, 20 bp, Artificial Sequence
  chemically synthesized
ggagaggaatgcaaaggcct

SEQ ID NO: 7515 - DNA, 20 bp, Artificial Sequence
  chemically synthesized
agaggaatgcaaaggccttg

SEQ ID NO: 7516 - DNA, 20 bp, Artificial Sequence
  chemically synthesized
gaggaatgcaaaggccttgg

SEQ ID NO: 7517 - DNA, 20 bp, Artificial Sequence
  chemically synthesized
gaatgcaaaggccttggagg

SEQ ID NO: 7518 - DNA, 20 bp, Artificial Sequence
  chemically synthesized
aatgcaaaggccttggagga

SEQ ID NO: 7519 - DNA, 20 bp, Artificial Sequence
  chemically synthesized
atgcaaaggccttggaggaa

SEQ ID NO: 7520 - DNA, 20 bp, Artificial Sequence
  chemically synthesized
tgcaaaggccttggaggaag

SEQ ID NO: 7521 - DNA, 20 bp, Artificial Sequence
  chemically synthesized
aaaggccttggaggaagggg

SEQ ID NO: 7522 - DNA, 20 bp, Artificial Sequence
  chemically synthesized
aaggccttggaggaaggggt

SEQ ID NO: 7523 - DNA, 20 bp, Artificial Sequence
  chemically synthesized
aggccttggaggaaggggtg

SEQ ID NO: 7524 - DNA, 20 bp, Artificial Sequence
  chemically synthesized
ggccttggaggaaggggtgg

SEQ ID NO: 7525 - DNA, 20 bp, Artificial Sequence
  chemically synthesized
cttggaggaaggggtggggg

SEQ ID NO: 7526 - DNA, 20 bp, Artificial Sequence
  chemically synthesized
gaggaaggggtgggggcagt

SEQ ID NO: 7527 - DNA, 20 bp, Artificial Sequence
  chemically synthesized
ggaaggggtgggggcagtga

SEQ ID NO: 7528 - DNA, 20 bp, Artificial Sequence
  chemically synthesized
gaaggggtgggggcagtgag

SEQ ID NO: 7529 - DNA, 20 bp, Artificial Sequence
  chemically synthesized
aaggggtgggggcagtgaga

SEQ ID NO: 7530 - DNA, 20 bp, Artificial Sequence
  chemically synthesized
ggggtgggggcagtgagagg

SEQ ID NO: 7531 - DNA, 20 bp, Artificial Sequence
  chemically synthesized
gggtgggggcagtgagaggg

SEQ ID NO: 7532 - DNA, 20 bp, Artificial Sequence
  chemically synthesized
ggtgggggcagtgagaggga

SEQ ID NO: 7533 - DNA, 20 bp, Artificial Sequence
  chemically synthesized
gggggcagtgagagggaggg

SEQ ID NO: 7534 - DNA, 20 bp, Artificial Sequence
  chemically synthesized
ggggcagtgagagggagggt

SEQ ID NO: 7535 - DNA, 20 bp, Artificial Sequence
  chemically synthesized
gggcagtgagagggagggtg

SEQ ID NO: 7536 - DNA, 20 bp, Artificial Sequence
  chemically synthesized
agggagggtggggctgtgct

SEQ ID NO: 7537 - DNA, 20 bp, Artificial Sequence
  chemically synthesized
ggagggtggggctgtgctca

SEQ ID NO: 7538 - DNA, 20 bp, Artificial Sequence
  chemically synthesized
gggtggggctgtgctcagag

SEQ ID NO: 7539 - DNA, 20 bp, Artificial Sequence
  chemically synthesized
ggtggggctgtgctcagagc

SEQ ID NO: 7540 - DNA, 20 bp, Artificial Sequence
  chemically synthesized
tggggctgtgctcagagcgg

SEQ ID NO: 7541 - DNA, 20 bp, Artificial Sequence
  chemically synthesized
ggctgtgctcagagcgggag

SEQ ID NO: 7542 - DNA, 20 bp, Artificial Sequence
  chemically synthesized
gctgtgctcagagcgggagt

SEQ ID NO: 7543 - DNA, 20 bp, Artificial Sequence
  chemically synthesized
gtgctcagagcgggagtggg

SEQ ID NO: 7544 - DNA, 20 bp, Artificial Sequence
  chemically synthesized
ctcagagcgggagtgggcag

SEQ ID NO: 7545 - DNA, 20 bp, Artificial Sequence
  chemically synthesized
cagagcgggagtgggcagtg

SEQ ID NO: 7546 - DNA, 20 bp, Artificial Sequence
  chemically synthesized
agagcgggagtgggcagtgg

SEQ ID NO: 7547 - DNA, 20 bp, Artificial Sequence
  chemically synthesized
ggagtgggcagtggaggtgt

SEQ ID NO: 7548 - DNA, 20 bp, Artificial Sequence
  chemically synthesized
agtgggcagtggaggtgtca

SEQ ID NO: 7549 - DNA, 20 bp, Artificial Sequence
  chemically synthesized
gtgggcagtggaggtgtcag

SEQ ID NO: 7550 - DNA, 20 bp, Artificial Sequence
  chemically synthesized
ggaggtgtcagaggcctccc

SEQ ID NO: 7551 - DNA, 20 bp, Artificial Sequence
  chemically synthesized
gaggtgtcagaggcctccct

SEQ ID NO: 7552 - DNA, 20 bp, Artificial Sequence
  chemically synthesized
agaggcctccctgggtcaaa

SEQ ID NO: 7553 - DNA, 20 bp, Artificial Sequence
  chemically synthesized
gaggcctccctgggtcaaat

SEQ ID NO: 7554 - DNA, 20 bp, Artificial Sequence
  chemically synthesized
aggcctccctgggtcaaatg

SEQ ID NO: 7555 - DNA, 20 bp, Artificial Sequence
  chemically synthesized
cctgggtcaaatggggtcct

SEQ ID NO: 7556 - DNA, 20 bp, Artificial Sequence
  chemically synthesized
gtcaaatggggtcctgagtg

SEQ ID NO: 7557 - DNA, 20 bp, Artificial Sequence
  chemically synthesized
tggggtcctgagtgtggctg

SEQ ID NO: 7558 - DNA, 20 bp, Artificial Sequence
  chemically synthesized
ggtcctgagtgtggctgcag

SEQ ID NO: 7559 - DNA, 20 bp, Artificial Sequence
  chemically synthesized
gtcctgagtgtggctgcagt

SEQ ID NO: 7560 - DNA, 20 bp, Artificial Sequence
  chemically synthesized
tcctgagtgtggctgcagtg

SEQ ID NO: 7561 - DNA, 20 bp, Artificial Sequence
  chemically synthesized
tgagtgtggctgcagtgggg

SEQ ID NO: 7562 - DNA, 20 bp, Artificial Sequence
  chemically synthesized
gagtgtggctgcagtgggga

SEQ ID NO: 7563 - DNA, 20 bp, Artificial Sequence
  chemically synthesized
tgtggctgcagtggggaagg

SEQ ID NO: 7564 - DNA, 20 bp, Artificial Sequence
  chemically synthesized
ggctgcagtggggaaggtgg

SEQ ID NO: 7565 - DNA, 20 bp, Artificial Sequence
  chemically synthesized
gtggggaaggtggaagtcac

SEQ ID NO: 7566 - DNA, 20 bp, Artificial Sequence
  chemically synthesized
tggaagtcactggtgtgaaa

SEQ ID NO: 7567 - DNA, 20 bp, Artificial Sequence
  chemically synthesized
tcactggtgtgaaaaagatg

SEQ ID NO: 7568 - DNA, 20 bp, Artificial Sequence
  chemically synthesized
actggtgtgaaaaagatgaa

SEQ ID NO: 7569 - DNA, 20 bp, Artificial Sequence
  chemically synthesized
gtgaaaaagatgaagagtta

SEQ ID NO: 7570 - DNA, 20 bp, Artificial Sequence
  chemically synthesized
aaaagatgaagagttatgga

SEQ ID NO: 7571 - DNA, 20 bp, Artificial Sequence
  chemically synthesized
gagttatggacagtcactta

SEQ ID NO: 7572 - DNA, 20 bp, Artificial Sequence
  chemically synthesized
agttatggacagtcacttac

SEQ ID NO: 7573 - DNA, 20 bp, Artificial Sequence
  chemically synthesized
gttatggacagtcacttaca

SEQ ID NO: 7574 - DNA, 20 bp, Artificial Sequence
  chemically synthesized
ttatggacagtcacttacag

SEQ ID NO: 7575 - DNA, 20 bp, Artificial Sequence
  chemically synthesized
tggacagtcacttacagggg

SEQ ID NO: 7576 - DNA, 20 bp, Artificial Sequence
  chemically synthesized
tacaggggcagtgtctgact

SEQ ID NO: 7577 - DNA, 20 bp, Artificial Sequence
  chemically synthesized
acaggggcagtgtctgactc

SEQ ID NO: 7578 - DNA, 20 bp, Artificial Sequence
  chemically synthesized
gggcagtgtctgactcagga

SEQ ID NO: 7579 - DNA, 20 bp, Artificial Sequence
  chemically synthesized
cagtgtctgactcaggacag

SEQ ID NO: 7580 - DNA, 20 bp, Artificial Sequence
  chemically synthesized
tgtctgactcaggacagtgg

SEQ ID NO: 7581 - DNA, 20 bp, Artificial Sequence
  chemically synthesized
gtctgactcaggacagtggc

SEQ ID NO: 7582 - DNA, 20 bp, Artificial Sequence
  chemically synthesized
tgactcaggacagtggcagg

SEQ ID NO: 7583 - DNA, 20 bp, Artificial Sequence
  chemically synthesized
gacagtggcaggaagtgacc

SEQ ID NO: 7584 - DNA, 20 bp, Artificial Sequence
  chemically synthesized
acagtggcaggaagtgacct

SEQ ID NO: 7585 - DNA, 20 bp, Artificial Sequence
  chemically synthesized
cagtggcaggaagtgacctg

SEQ ID NO: 7586 - DNA, 20 bp, Artificial Sequence
  chemically synthesized
gtggcaggaagtgacctggg

SEQ ID NO: 7587 - DNA, 20 bp, Artificial Sequence
  chemically synthesized
tggcaggaagtgacctgggg

SEQ ID NO: 7588 - DNA, 20 bp, Artificial Sequence
  chemically synthesized
caggaagtgacctggggagg

SEQ ID NO: 7589 - DNA, 20 bp, Artificial Sequence
  chemically synthesized
tgacctggggaggaagattc

SEQ ID NO: 7590 - DNA, 20 bp, Artificial Sequence
  chemically synthesized
gacctggggaggaagattct

SEQ ID NO: 7591 - DNA, 20 bp, Artificial Sequence
  chemically synthesized
aagattctgggcccctgact

SEQ ID NO: 7592 - DNA, 20 bp, Artificial Sequence
  chemically synthesized
ggcccctgactgagcctccc

SEQ ID NO: 7593 - DNA, 20 bp, Artificial Sequence
  chemically synthesized
gcccctgactgagcctcccc

SEQ ID NO: 7594 - DNA, 20 bp, Artificial Sequence
  chemically synthesized
gactgagcctccccaggatg

SEQ ID NO: 7595 - DNA, 20 bp, Artificial Sequence
  chemically synthesized
tccccaggatgtggtcctgc

SEQ ID NO: 7596 - DNA, 20 bp, Artificial Sequence
  chemically synthesized
ccccaggatgtggtcctgct

SEQ ID NO: 7597 - DNA, 20 bp, Artificial Sequence
  chemically synthesized
aggatgtggtcctgctgggt

SEQ ID NO: 7598 - DNA, 20 bp, Artificial Sequence
  chemically synthesized
ggatgtggtcctgctgggtc

SEQ ID NO: 7599 - DNA, 20 bp, Artificial Sequence
  chemically synthesized
gatgtggtcctgctgggtcg

SEQ ID NO: 7600 - DNA, 20 bp, Artificial Sequence
  chemically synthesized
atgtggtcctgctgggtcgg

SEQ ID NO: 7601 - DNA, 20 bp, Artificial Sequence
  chemically synthesized
tgtggtcctgctgggtcggg

SEQ ID NO: 7602 - DNA, 20 bp, Artificial Sequence
  chemically synthesized
cctgctgggtcggggggtga

SEQ ID NO: 7603 - DNA, 20 bp, Artificial Sequence
  chemically synthesized
ctgctgggtcggggggtgat

SEQ ID NO: 7604 - DNA, 20 bp, Artificial Sequence
  chemically synthesized
ggtcggggggtgataggaat

SEQ ID NO: 7605 - DNA, 20 bp, Artificial Sequence
  chemically synthesized
cggggggtgataggaatgag

SEQ ID NO: 7606 - DNA, 20 bp, Artificial Sequence
  chemically synthesized
ggtgataggaatgagaagac

SEQ ID NO: 7607 - DNA, 20 bp, Artificial Sequence
  chemically synthesized
gtgataggaatgagaagaca

SEQ ID NO: 7608 - DNA, 20 bp, Artificial Sequence
  chemically synthesized
ataggaatgagaagacaagg

SEQ ID NO: 7609 - DNA, 20 bp, Artificial Sequence
  chemically synthesized
tgagaagacaaggaagtcca

SEQ ID NO: 7610 - DNA, 20 bp, Artificial Sequence
  chemically synthesized
agaagacaaggaagtccaca

SEQ ID NO: 7611 - DNA, 20 bp, Artificial Sequence
  chemically synthesized
gacaaggaagtccacagagt

SEQ ID NO: 7612 - DNA, 20 bp, Artificial Sequence
  chemically synthesized
acaaggaagtccacagagtc

SEQ ID NO: 7613 - DNA, 20 bp, Artificial Sequence
  chemically synthesized
caaggaagtccacagagtca

SEQ ID NO: 7614 - DNA, 20 bp, Artificial Sequence
  chemically synthesized
agtccacagagtcagggtcc

SEQ ID NO: 7615 - DNA, 20 bp, Artificial Sequence
  chemically synthesized
gtccacagagtcagggtcca

SEQ ID NO: 7616 - DNA, 20 bp, Artificial Sequence
  chemically synthesized
cagagtcagggtccaaggcc

SEQ ID NO: 7617 - DNA, 20 bp, Artificial Sequence
  chemically synthesized
agtcagggtccaaggcctag

SEQ ID NO: 7618 - DNA, 20 bp, Artificial Sequence
  chemically synthesized
gtcagggtccaaggcctaga

SEQ ID NO: 7619 - DNA, 20 bp, Artificial Sequence
  chemically synthesized
cctagaaggtgttctgtttg

SEQ ID NO: 7620 - DNA, 20 bp, Artificial Sequence
  chemically synthesized
ctagaaggtgttctgtttgc

SEQ ID NO: 7621 - DNA, 20 bp, Artificial Sequence
  chemically synthesized
gaaggtgttctgtttgcagg

SEQ ID NO: 7622 - DNA, 20 bp, Artificial Sequence
  chemically synthesized
gtttgcaggtggatgctgca

SEQ ID NO: 7623 - DNA, 20 bp, Artificial Sequence
  chemically synthesized
ttgcaggtggatgctgcaaa

SEQ ID NO: 7624 - DNA, 20 bp, Artificial Sequence
  chemically synthesized
gcaggtggatgctgcaaaga

SEQ ID NO: 7625 - DNA, 20 bp, Artificial Sequence
  chemically synthesized
caggtggatgctgcaaagag

SEQ ID NO: 7626 - DNA, 20 bp, Artificial Sequence
  chemically synthesized
ggtggatgctgcaaagagag

SEQ ID NO: 7627 - DNA, 20 bp, Artificial Sequence
  chemically synthesized
atgctgcaaagagaggagct

SEQ ID NO: 7628 - DNA, 20 bp, Artificial Sequence
  chemically synthesized
tgctgcaaagagaggagctc

SEQ ID NO: 7629 - DNA, 20 bp, Artificial Sequence
  chemically synthesized
gctgcaaagagaggagctca

SEQ ID NO: 7630 - DNA, 20 bp, Artificial Sequence
  chemically synthesized
caaagagaggagctcagggc

SEQ ID NO: 7631 - DNA, 20 bp, Artificial Sequence
  chemically synthesized
aaagagaggagctcagggct

SEQ ID NO: 7632 - DNA, 20 bp, Artificial Sequence
  chemically synthesized
gagctcagggctgggacaac

SEQ ID NO: 7633 - DNA, 20 bp, Artificial Sequence
  chemically synthesized
gctcagggctgggacaactg

SEQ ID NO: 7634 - DNA, 20 bp, Artificial Sequence
  chemically synthesized
tgggacaactggagctgctc

SEQ ID NO: 7635 - DNA, 20 bp, Artificial Sequence
  chemically synthesized
gggacaactggagctgctct

SEQ ID NO: 7636 - DNA, 20 bp, Artificial Sequence
  chemically synthesized
aactggagctgctctgggtc

SEQ ID NO: 7637 - DNA, 20 bp, Artificial Sequence
  chemically synthesized
ctggagctgctctgggtctg

SEQ ID NO: 7638 - DNA, 20 bp, Artificial Sequence
  chemically synthesized
tggagctgctctgggtctgg

SEQ ID NO: 7639 - DNA, 20 bp, Artificial Sequence
  chemically synthesized
agctgctctgggtctggagg

SEQ ID NO: 7640 - DNA, 20 bp, Artificial Sequence
  chemically synthesized
tgctctgggtctggaggcag

SEQ ID NO: 7641 - DNA, 20 bp, Artificial Sequence
  chemically synthesized
ctctgggtctggaggcagca

SEQ ID NO: 7642 - DNA, 20 bp, Artificial Sequence
  chemically synthesized
ctgggtctggaggcagcaga

SEQ ID NO: 7643 - DNA, 20 bp, Artificial Sequence
  chemically synthesized
tgggtctggaggcagcagag

SEQ ID NO: 7644 - DNA, 20 bp, Artificial Sequence
  chemically synthesized
gggtctggaggcagcagaga

SEQ ID NO: 7645 - DNA, 20 bp, Artificial Sequence
  chemically synthesized
gtctggaggcagcagagagg

SEQ ID NO: 7646 - DNA, 20 bp, Artificial Sequence
  chemically synthesized
gaggcagcagagagggagcc

SEQ ID NO: 7647 - DNA, 20 bp, Artificial Sequence
  chemically synthesized
agggagcccagctctgtgtg

SEQ ID NO: 7648 - DNA, 20 bp, Artificial Sequence
  chemically synthesized
gggagcccagctctgtgtgc

SEQ ID NO: 7649 - DNA, 20 bp, Artificial Sequence
  chemically synthesized
agcccagctctgtgtgcagg

SEQ ID NO: 7650 - DNA, 20 bp, Artificial Sequence
  chemically synthesized
gctctgtgtgcaggaagacg

SEQ ID NO: 7651 - DNA, 20 bp, Artificial Sequence
  chemically synthesized
ctctgtgtgcaggaagacgt

SEQ ID NO: 7652 - DNA, 20 bp, Artificial Sequence
  chemically synthesized
gcaggaagacgtgggtgtgt

SEQ ID NO: 7653 - DNA, 20 bp, Artificial Sequence
  chemically synthesized
ggtgtgtgagtgtacgtgtg

SEQ ID NO: 7654 - DNA, 20 bp, Artificial Sequence
  chemically synthesized
gtgtgtgagtgtacgtgtgt

SEQ ID NO: 7655 - DNA, 20 bp, Artificial Sequence
  chemically synthesized
gtgtacgtgtgtgggtgtgt

SEQ ID NO: 7656 - DNA, 20 bp, Artificial Sequence
  chemically synthesized
tgtacgtgtgtgggtgtgtc

SEQ ID NO: 7657 - DNA, 20 bp, Artificial Sequence
  chemically synthesized
gtgtgtcaggtgtgtgtgtg

SEQ ID NO: 7658 - DNA, 20 bp, Artificial Sequence
  chemically synthesized
tgtgtcaggtgtgtgtgtgt

SEQ ID NO: 7659 - DNA, 20 bp, Artificial Sequence
  chemically synthesized
tgtcaggtgtgtgtgtgtgg

SEQ ID NO: 7660 - DNA, 20 bp, Artificial Sequence
  chemically synthesized
gtcaggtgtgtgtgtgtggg

SEQ ID NO: 7661 - DNA, 20 bp, Artificial Sequence
  chemically synthesized
tcaggtgtgtgtgtgtggga

SEQ ID NO: 7662 - DNA, 20 bp, Artificial Sequence
  chemically synthesized
aggtgtgtgtgtgtgggagg

SEQ ID NO: 7663 - DNA, 20 bp, Artificial Sequence
  chemically synthesized
gggagtatgaatgtgtgcat

SEQ ID NO: 7664 - DNA, 20 bp, Artificial Sequence
  chemically synthesized
tagcatgcatatgcacatgt

SEQ ID NO: 7665 - DNA, 20 bp, Artificial Sequence
  chemically synthesized
gcatgcatatgcacatgtga

SEQ ID NO: 7666 - DNA, 20 bp, Artificial Sequence
  chemically synthesized
tgcatatgcacatgtgagag

SEQ ID NO: 7667 - DNA, 20 bp, Artificial Sequence
  chemically synthesized
gcatatgcacatgtgagagt

SEQ ID NO: 7668 - DNA, 20 bp, Artificial Sequence
  chemically synthesized
tgcacatgtgagagtgggta

SEQ ID NO: 7669 - DNA, 20 bp, Artificial Sequence
  chemically synthesized
acatgtgagagtgggtacag

SEQ ID NO: 7670 - DNA, 20 bp, Artificial Sequence
  chemically synthesized
atgtgagagtgggtacagca

SEQ ID NO: 7671 - DNA, 20 bp, Artificial Sequence
  chemically synthesized
agagtgggtacagcagagcg

SEQ ID NO: 7672 - DNA, 20 bp, Artificial Sequence
  chemically synthesized
gtacagcagagcgtggtcat

SEQ ID NO: 7673 - DNA, 20 bp, Artificial Sequence
  chemically synthesized
gtgtgcaaatgtgtgttttt

SEQ ID NO: 7674 - DNA, 20 bp, Artificial Sequence
  chemically synthesized
caaatgtgtgtttttgagtg

SEQ ID NO: 7675 - DNA, 20 bp, Artificial Sequence
  chemically synthesized
tgtgtgtttttgagtgaagt

SEQ ID NO: 7676 - DNA, 20 bp, Artificial Sequence
  chemically synthesized
gagtgaagtgagcaatgtgt

SEQ ID NO: 7677 - DNA, 20 bp, Artificial Sequence
  chemically synthesized
tgagcaatgtgtgagtgtgt

SEQ ID NO: 7678 - DNA, 20 bp, Artificial Sequence
  chemically synthesized
gtgagtgtgtgagtgtgtgt

SEQ ID NO: 7679 - DNA, 20 bp, Artificial Sequence
  chemically synthesized
gtgagtgtgtgtgagtttgt

SEQ ID NO: 7680 - DNA, 20 bp, Artificial Sequence
  chemically synthesized
tgagtgtgtgtgagtttgtg

SEQ ID NO: 7681 - DNA, 20 bp, Artificial Sequence
  chemically synthesized
gagtgtgtgtgagtttgtga

SEQ ID NO: 7682 - DNA, 20 bp, Artificial Sequence
  chemically synthesized
gggcatgtgaatgtgtgtgt

SEQ ID NO: 7683 - DNA, 20 bp, Artificial Sequence
  chemically synthesized
aatgtgtgtgtcagtgctgt

SEQ ID NO: 7684 - DNA, 20 bp, Artificial Sequence
  chemically synthesized
atgtgtgtgtcagtgctgtc

SEQ ID NO: 7685 - DNA, 20 bp, Artificial Sequence
  chemically synthesized
tgtgtgtgtcagtgctgtca

SEQ ID NO: 7686 - DNA, 20 bp, Artificial Sequence
  chemically synthesized
gtgtcagtgctgtcagggtg

SEQ ID NO: 7687 - DNA, 20 bp, Artificial Sequence
  chemically synthesized
cagtgctgtcagggtgcaga

SEQ ID NO: 7688 - DNA, 20 bp, Artificial Sequence
  chemically synthesized
tgtcagggtgcagatggatc

SEQ ID NO: 7689 - DNA, 20 bp, Artificial Sequence
  chemically synthesized
gtcagggtgcagatggatca

SEQ ID NO: 7690 - DNA, 20 bp, Artificial Sequence
  chemically synthesized
tcagggtgcagatggatcaa

SEQ ID NO: 7691 - DNA, 20 bp, Artificial Sequence
  chemically synthesized
cagggtgcagatggatcaag

SEQ ID NO: 7692 - DNA, 20 bp, Artificial Sequence
  chemically synthesized
ggtgcagatggatcaagggg

SEQ ID NO: 7693 - DNA, 20 bp, Artificial Sequence
  chemically synthesized
gtgcagatggatcaaggggc

SEQ ID NO: 7694 - DNA, 20 bp, Artificial Sequence
  chemically synthesized
gcagatggatcaaggggcag

SEQ ID NO: 7695 - DNA, 20 bp, Artificial Sequence
  chemically synthesized
agatggatcaaggggcagga

SEQ ID NO: 7696 - DNA, 20 bp, Artificial Sequence
  chemically synthesized
gatggatcaaggggcaggag

SEQ ID NO: 7697 - DNA, 20 bp, Artificial Sequence
  chemically synthesized
ggggcaggagaggtacctgt

SEQ ID NO: 7698 - DNA, 20 bp, Artificial Sequence
  chemically synthesized
aggtacctgtgagatgacct

SEQ ID NO: 7699 - DNA, 20 bp, Artificial Sequence
  chemically synthesized
ggtacctgtgagatgacctc

SEQ ID NO: 7700 - DNA, 20 bp, Artificial Sequence
  chemically synthesized
ctgtgagatgacctcgggct

SEQ ID NO: 7701 - DNA, 20 bp, Artificial Sequence
  chemically synthesized
tgtgagatgacctcgggctg

SEQ ID NO: 7702 - DNA, 20 bp, Artificial Sequence
  chemically synthesized
gtgagatgacctcgggctga

SEQ ID NO: 7703 - DNA, 20 bp, Artificial Sequence
  chemically synthesized
tgagatgacctcgggctgag

SEQ ID NO: 7704 - DNA, 20 bp, Artificial Sequence
  chemically synthesized
agatgacctcgggctgaggg

SEQ ID NO: 7705 - DNA, 20 bp, Artificial Sequence
  chemically synthesized
cgggctgaggggagcaaatt

SEQ ID NO: 7706 - DNA, 20 bp, Artificial Sequence
  chemically synthesized
tgaggggagcaaatttagtg

SEQ ID NO: 7707 - DNA, 20 bp, Artificial Sequence
  chemically synthesized
gagcaaatttagtgtggaac

SEQ ID NO: 7708 - DNA, 20 bp, Artificial Sequence
  chemically synthesized
agcaaatttagtgtggaacg

SEQ ID NO: 7709 - DNA, 20 bp, Artificial Sequence
  chemically synthesized
ttagtgtggaacgaggtttc

SEQ ID NO: 7710 - DNA, 20 bp, Artificial Sequence
  chemically synthesized
tagtgtggaacgaggtttct

SEQ ID NO: 7711 - DNA, 20 bp, Artificial Sequence
  chemically synthesized
agtgtggaacgaggtttcta

SEQ ID NO: 7712 - DNA, 20 bp, Artificial Sequence
  chemically synthesized
gtggaacgaggtttctaggg

SEQ ID NO: 7713 - DNA, 20 bp, Artificial Sequence
  chemically synthesized
aacgaggtttctagggaagc

SEQ ID NO: 7714 - DNA, 20 bp, Artificial Sequence
  chemically synthesized
acgaggtttctagggaagcg

SEQ ID NO: 7715 - DNA, 20 bp, Artificial Sequence
  chemically synthesized
cgaggtttctagggaagcga

SEQ ID NO: 7716 - DNA, 20 bp, Artificial Sequence
  chemically synthesized
tttctagggaagcgagggca

SEQ ID NO: 7717 - DNA, 20 bp, Artificial Sequence
  chemically synthesized
ttctagggaagcgagggcaa

SEQ ID NO: 7718 - DNA, 20 bp, Artificial Sequence
  chemically synthesized
tctagggaagcgagggcaaa

SEQ ID NO: 7719 - DNA, 20 bp, Artificial Sequence
  chemically synthesized
gaagcgagggcaaagggcgc

SEQ ID NO: 7720 - DNA, 20 bp, Artificial Sequence
  chemically synthesized
aagcgagggcaaagggcgct

SEQ ID NO: 7721 - DNA, 20 bp, Artificial Sequence
  chemically synthesized
agcgagggcaaagggcgctg

SEQ ID NO: 7722 - DNA, 20 bp, Artificial Sequence
  chemically synthesized
cgagggcaaagggcgctggg

SEQ ID NO: 7723 - DNA, 20 bp, Artificial Sequence
  chemically synthesized
gagggcaaagggcgctgggg

SEQ ID NO: 7724 - DNA, 20 bp, Artificial Sequence
  chemically synthesized
gggcaaagggcgctggggag

SEQ ID NO: 7725 - DNA, 20 bp, Artificial Sequence
  chemically synthesized
ggcaaagggcgctggggagg

SEQ ID NO: 7726 - DNA, 20 bp, Artificial Sequence
  chemically synthesized
gctggggaggaggccttgcg

SEQ ID NO: 7727 - DNA, 20 bp, Artificial Sequence
  chemically synthesized
ggggaggaggccttgcgtgg

SEQ ID NO: 7728 - DNA, 20 bp, Artificial Sequence
  chemically synthesized
gggaggaggccttgcgtggt

SEQ ID NO: 7729 - DNA, 20 bp, Artificial Sequence
  chemically synthesized
ggaggaggccttgcgtggtg

SEQ ID NO: 7730 - DNA, 20 bp, Artificial Sequence
  chemically synthesized
gaggaggccttgcgtggtgg

SEQ ID NO: 7731 - DNA, 20 bp, Artificial Sequence
  chemically synthesized
ggccttgcgtggtgggggat

SEQ ID NO: 7732 - DNA, 20 bp, Artificial Sequence
  chemically synthesized
gccttgcgtggtgggggatg

SEQ ID NO: 7733 - DNA, 20 bp, Artificial Sequence
  chemically synthesized
gtggtgggggatgaggacaa

SEQ ID NO: 7734 - DNA, 20 bp, Artificial Sequence
  chemically synthesized
tggtgggggatgaggacaac

SEQ ID NO: 7735 - DNA, 20 bp, Artificial Sequence
  chemically synthesized
tgggggatgaggacaacagg

SEQ ID NO: 7736 - DNA, 20 bp, Artificial Sequence
  chemically synthesized
gggggatgaggacaacaggt

SEQ ID NO: 7737 - DNA, 20 bp, Artificial Sequence
  chemically synthesized
tgaggacaacaggtgggacc

SEQ ID NO: 7738 - DNA, 20 bp, Artificial Sequence
  chemically synthesized
aggacaacaggtgggacctg

SEQ ID NO: 7739 - DNA, 20 bp, Artificial Sequence
  chemically synthesized
ggacaacaggtgggacctgg

SEQ ID NO: 7740 - DNA, 20 bp, Artificial Sequence
  chemically synthesized
gacaacaggtgggacctgga

SEQ ID NO: 7741 - DNA, 20 bp, Artificial Sequence
  chemically synthesized
gggacctggagggttgtgct

SEQ ID NO: 7742 - DNA, 20 bp, Artificial Sequence
  chemically synthesized
gacctggagggttgtgcttg

SEQ ID NO: 7743 - DNA, 20 bp, Artificial Sequence
  chemically synthesized
cctggagggttgtgcttgga

SEQ ID NO: 7744 - DNA, 20 bp, Artificial Sequence
  chemically synthesized
ggagggttgtgcttggagag

SEQ ID NO: 7745 - DNA, 20 bp, Artificial Sequence
  chemically synthesized
gagggttgtgcttggagagt

SEQ ID NO: 7746 - DNA, 20 bp, Artificial Sequence
  chemically synthesized
tgtgcttggagagtgggcta

SEQ ID NO: 7747 - DNA, 20 bp, Artificial Sequence
  chemically synthesized
gcttggagagtgggctatgg

SEQ ID NO: 7748 - DNA, 20 bp, Artificial Sequence
  chemically synthesized
tgggctatggtggaatgacc

SEQ ID NO: 7749 - DNA, 20 bp, Artificial Sequence
  chemically synthesized
tggtggaatgacccagattt

SEQ ID NO: 7750 - DNA, 20 bp, Artificial Sequence
  chemically synthesized
ggtggaatgacccagattta

SEQ ID NO: 7751 - DNA, 20 bp, Artificial Sequence
  chemically synthesized
cccagatttaaggatctcaa

SEQ ID NO: 7752 - DNA, 20 bp, Artificial Sequence
  chemically synthesized
taaggatctcaatggaattt

SEQ ID NO: 7753 - DNA, 20 bp, Artificial Sequence
  chemically synthesized
ggatctcaatggaattttgg

SEQ ID NO: 7754 - DNA, 20 bp, Artificial Sequence
  chemically synthesized
gatctcaatggaattttggc

SEQ ID NO: 7755 - DNA, 20 bp, Artificial Sequence
  chemically synthesized
atctcaatggaattttggca

SEQ ID NO: 7756 - DNA, 20 bp, Artificial Sequence
  chemically synthesized
tctcaatggaattttggcag

SEQ ID NO: 7757 - DNA, 20 bp, Artificial Sequence
  chemically synthesized
tcaatggaattttggcaggg

SEQ ID NO: 7758 - DNA, 20 bp, Artificial Sequence
  chemically synthesized
caatggaattttggcagggg

SEQ ID NO: 7759 - DNA, 20 bp, Artificial Sequence
  chemically synthesized
aatggaattttggcagggga

SEQ ID NO: 7760 - DNA, 20 bp, Artificial Sequence
  chemically synthesized
tggcaggggagggactgttc

SEQ ID NO: 7761 - DNA, 20 bp, Artificial Sequence
  chemically synthesized
ggggagggactgttccagta

SEQ ID NO: 7762 - DNA, 20 bp, Artificial Sequence
  chemically synthesized
gactgttccagtatggattt

SEQ ID NO: 7763 - DNA, 20 bp, Artificial Sequence
  chemically synthesized
actgttccagtatggatttt

SEQ ID NO: 7764 - DNA, 20 bp, Artificial Sequence
  chemically synthesized
gttccagtatggattttagg

SEQ ID NO: 7765 - DNA, 20 bp, Artificial Sequence
  chemically synthesized
tatggattttaggaagaaca

SEQ ID NO: 7766 - DNA, 20 bp, Artificial Sequence
  chemically synthesized
atggattttaggaagaacac

SEQ ID NO: 7767 - DNA, 20 bp, Artificial Sequence
  chemically synthesized
tggattttaggaagaacaca

SEQ ID NO: 7768 - DNA, 20 bp, Artificial Sequence
  chemically synthesized
tttaggaagaacacagggcc

SEQ ID NO: 7769 - DNA, 20 bp, Artificial Sequence
  chemically synthesized
agaacacagggcccagcttc

SEQ ID NO: 7770 - DNA, 20 bp, Artificial Sequence
  chemically synthesized
aacacagggcccagcttctg

SEQ ID NO: 7771 - DNA, 20 bp, Artificial Sequence
  chemically synthesized
gcttctggagtctccaatct

SEQ ID NO: 7772 - DNA, 20 bp, Artificial Sequence
  chemically synthesized
cttctggagtctccaatctg

SEQ ID NO: 7773 - DNA, 20 bp, Artificial Sequence
  chemically synthesized
ttctggagtctccaatctga

SEQ ID NO: 7774 - DNA, 20 bp, Artificial Sequence
  chemically synthesized
tctggagtctccaatctgag

SEQ ID NO: 7775 - DNA, 20 bp, Artificial Sequence
  chemically synthesized
gagtctccaatctgagggga

SEQ ID NO: 7776 - DNA, 20 bp, Artificial Sequence
  chemically synthesized
agtctccaatctgaggggac

SEQ ID NO: 7777 - DNA, 20 bp, Artificial Sequence
  chemically synthesized
tctccaatctgaggggacag

SEQ ID NO: 7778 - DNA, 20 bp, Artificial Sequence
  chemically synthesized
atctgaggggacaggagcct

SEQ ID NO: 7779 - DNA, 20 bp, Artificial Sequence
  chemically synthesized
tgaggggacaggagccttag

SEQ ID NO: 7780 - DNA, 20 bp, Artificial Sequence
  chemically synthesized
aggggacaggagccttagaa

SEQ ID NO: 7781 - DNA, 20 bp, Artificial Sequence
  chemically synthesized
acaggagccttagaagagct

SEQ ID NO: 7782 - DNA, 20 bp, Artificial Sequence
  chemically synthesized
gccttagaagagctgagact

SEQ ID NO: 7783 - DNA, 20 bp, Artificial Sequence
  chemically synthesized
ccttagaagagctgagacta

SEQ ID NO: 7784 - DNA, 20 bp, Artificial Sequence
  chemically synthesized
aagagctgagactaaggccc

SEQ ID NO: 7785 - DNA, 20 bp, Artificial Sequence
  chemically synthesized
agagctgagactaaggcccg

SEQ ID NO: 7786 - DNA, 20 bp, Artificial Sequence
  chemically synthesized
gactaaggcccgaggtgatc

SEQ ID NO: 7787 - DNA, 20 bp, Artificial Sequence
  chemically synthesized
ctaaggcccgaggtgatctg

SEQ ID NO: 7788 - DNA, 20 bp, Artificial Sequence
  chemically synthesized
taaggcccgaggtgatctgg

SEQ ID NO: 7789 - DNA, 20 bp, Artificial Sequence
  chemically synthesized
gatctggaggcctctgccac

SEQ ID NO: 7790 - DNA, 20 bp, Artificial Sequence
  chemically synthesized
tggaggcctctgccactggc

SEQ ID NO: 7791 - DNA, 20 bp, Artificial Sequence
  chemically synthesized
ggcctctgccactggctgga

SEQ ID NO: 7792 - DNA, 20 bp, Artificial Sequence
  chemically synthesized
gcctctgccactggctggat

SEQ ID NO: 7793 - DNA, 20 bp, Artificial Sequence
  chemically synthesized
ctctgccactggctggatgg

SEQ ID NO: 7794 - DNA, 20 bp, Artificial Sequence
  chemically synthesized
tctgccactggctggatggg

SEQ ID NO: 7795 - DNA, 20 bp, Artificial Sequence
  chemically synthesized
gatgggaggaaaaccattca

SEQ ID NO: 7796 - DNA, 20 bp, Artificial Sequence
  chemically synthesized
cattcacagatcccccttct

SEQ ID NO: 7797 - DNA, 20 bp, Artificial Sequence
  chemically synthesized
attcacagatcccccttctc

SEQ ID NO: 7798 - DNA, 20 bp, Artificial Sequence
  chemically synthesized
cccttctcaggatgtgtgcc

SEQ ID NO: 7799 - DNA, 20 bp, Artificial Sequence
  chemically synthesized
ccttctcaggatgtgtgcct

SEQ ID NO: 7800 - DNA, 20 bp, Artificial Sequence
  chemically synthesized
tctcaggatgtgtgcctagg

SEQ ID NO: 7801 - DNA, 20 bp, Artificial Sequence
  chemically synthesized
ctcaggatgtgtgcctaggc

SEQ ID NO: 7802 - DNA, 20 bp, Artificial Sequence
  chemically synthesized
tcaggatgtgtgcctaggca

SEQ ID NO: 7803 - DNA, 20 bp, Artificial Sequence
  chemically synthesized
gatgtgtgcctaggcagggc

SEQ ID NO: 7804 - DNA, 20 bp, Artificial Sequence
  chemically synthesized
atgtgtgcctaggcagggcc

SEQ ID NO: 7805 - DNA, 20 bp, Artificial Sequence
  chemically synthesized
cccgccccctgtgcgtctcc

SEQ ID NO: 7806 - DNA, 20 bp, Artificial Sequence
  chemically synthesized
ctgtgcgtctcccagtcccc

SEQ ID NO: 7807 - DNA, 20 bp, Artificial Sequence
  chemically synthesized
gtctcccagtcccccagctc

SEQ ID NO: 7808 - DNA, 20 bp, Artificial Sequence
  chemically synthesized
tctcccagtcccccagctcc

SEQ ID NO: 7809 - DNA, 20 bp, Artificial Sequence
  chemically synthesized
agtcccccagctccaggatc

SEQ ID NO: 7810 - DNA, 20 bp, Artificial Sequence
  chemically synthesized
gtcccccagctccaggatcc

SEQ ID NO: 7811 - DNA, 20 bp, Artificial Sequence
  chemically synthesized
caggatccgggctttgcaca

SEQ ID NO: 7812 - DNA, 20 bp, Artificial Sequence
  chemically synthesized
acagctgatgtgaatatcct

SEQ ID NO: 7813 - DNA, 20 bp, Artificial Sequence
  chemically synthesized
aatatcctgagtcgtgtgca

SEQ ID NO: 7814 - DNA, 20 bp, Artificial Sequence
  chemically synthesized
atatcctgagtcgtgtgcat

SEQ ID NO: 7815 - DNA, 20 bp, Artificial Sequence
  chemically synthesized
gtgcatgggtgtgtgtgcac

SEQ ID NO: 7816 - DNA, 20 bp, Artificial Sequence
  chemically synthesized
tgggtgtgtgtgcaccagat

SEQ ID NO: 7817 - DNA, 20 bp, Artificial Sequence
  chemically synthesized
tgcgtgtgtatatttataca

SEQ ID NO: 7818 - DNA, 20 bp, Artificial Sequence
  chemically synthesized
tatatttatacatggtaata

SEQ ID NO: 7819 - DNA, 20 bp, Artificial Sequence
  chemically synthesized
atatttatacatggtaatat

SEQ ID NO: 7820 - DNA, 20 bp, Artificial Sequence
  chemically synthesized
atacatggtaatatgggtgc

SEQ ID NO: 7821 - DNA, 20 bp, Artificial Sequence
  chemically synthesized
taatatgggtgcgagtgtgt

SEQ ID NO: 7822 - DNA, 20 bp, Artificial Sequence
  chemically synthesized
atatgggtgcgagtgtgtaa

SEQ ID NO: 7823 - DNA, 20 bp, Artificial Sequence
  chemically synthesized
tgtgtgtaatgctcaaatgc

SEQ ID NO: 7824 - DNA, 20 bp, Artificial Sequence
  chemically synthesized
gtgtgtaatgctcaaatgct

SEQ ID NO: 7825 - DNA, 20 bp, Artificial Sequence
  chemically synthesized
tgtgtaatgctcaaatgctg

SEQ ID NO: 7826 - DNA, 20 bp, Artificial Sequence
  chemically synthesized
atgctcaaatgctggggtca

SEQ ID NO: 7827 - DNA, 20 bp, Artificial Sequence
  chemically synthesized
cctatgatgaccccccccca

SEQ ID NO: 7828 - DNA, 20 bp, Artificial Sequence
  chemically synthesized
ccccaaccaatccccccgcc

SEQ ID NO: 7829 - DNA, 20 bp, Artificial Sequence
  chemically synthesized
cccaaccaatccccccgccc

SEQ ID NO: 7830 - DNA, 20 bp, Artificial Sequence
  chemically synthesized
ccgcccaggttatgcctcct

SEQ ID NO: 7831 - DNA, 20 bp, Artificial Sequence
  chemically synthesized
cgcccaggttatgcctcctc

SEQ ID NO: 7832 - DNA, 20 bp, Artificial Sequence
  chemically synthesized
ggttatgcctcctcaggctt

SEQ ID NO: 7833 - DNA, 20 bp, Artificial Sequence
  chemically synthesized
ggtgccctgtctttaccctc

SEQ ID NO: 7834 - DNA, 20 bp, Artificial Sequence
  chemically synthesized
accctccggctccccacacc

SEQ ID NO: 7835 - DNA, 20 bp, Artificial Sequence
  chemically synthesized
ccctccggctccccacaccc

SEQ ID NO: 7836 - DNA, 20 bp, Artificial Sequence
  chemically synthesized
gctccccacacccaggctgc

SEQ ID NO: 7837 - DNA, 20 bp, Artificial Sequence
  chemically synthesized
ctcctgatgcccctctccca

SEQ ID NO: 7838 - DNA, 20 bp, Artificial Sequence
  chemically synthesized
tcctgatgcccctctcccac

SEQ ID NO: 7839 - DNA, 20 bp, Artificial Sequence
  chemically synthesized
cctgatgcccctctcccaca

SEQ ID NO: 7840 - DNA, 20 bp, Artificial Sequence
  chemically synthesized
ccacagggccacctcctgcc

SEQ ID NO: 7841 - DNA, 20 bp, Artificial Sequence
  chemically synthesized
gccacctcctgcccagcccc

SEQ ID NO: 7842 - DNA, 20 bp, Artificial Sequence
  chemically synthesized
ctcctgcccagcccctggca

SEQ ID NO: 7843 - DNA, 20 bp, Artificial Sequence
  chemically synthesized
ggcacagcgtctctgctcca

SEQ ID NO: 7844 - DNA, 20 bp, Artificial Sequence
  chemically synthesized
ctctgctccatggtctgctt

SEQ ID NO: 7845 - DNA, 20 bp, Artificial Sequence
  chemically synthesized
tgcttcagtctgcttgccct

SEQ ID NO: 7846 - DNA, 20 bp, Artificial Sequence
  chemically synthesized
gagcttcaacatcctgctgc

SEQ ID NO: 7847 - DNA, 20 bp, Artificial Sequence
  chemically synthesized
cttcaacatcctgctgctgg

SEQ ID NO: 7848 - DNA, 20 bp, Artificial Sequence
  chemically synthesized
ctggtggtcatctgtgtgac

SEQ ID NO: 7849 - DNA, 20 bp, Artificial Sequence
  chemically synthesized
tggtggtcatctgtgtgact

SEQ ID NO: 7850 - DNA, 20 bp, Artificial Sequence
  chemically synthesized
atctgtgtgactgggtccca

SEQ ID NO: 7851 - DNA, 20 bp, Artificial Sequence
  chemically synthesized
gtgtgactgggtcccaaagt

SEQ ID NO: 7852 - DNA, 20 bp, Artificial Sequence
  chemically synthesized
tgtgactgggtcccaaagtg

SEQ ID NO: 7853 - DNA, 20 bp, Artificial Sequence
  chemically synthesized
gtgactgggtcccaaagtga

SEQ ID NO: 7854 - DNA, 20 bp, Artificial Sequence
  chemically synthesized
gggtcccaaagtgagggtca

SEQ ID NO: 7855 - DNA, 20 bp, Artificial Sequence
  chemically synthesized
ggtcccaaagtgagggtcac

SEQ ID NO: 7856 - DNA, 20 bp, Artificial Sequence
  chemically synthesized
gtcccaaagtgagggtcacg

SEQ ID NO: 7857 - DNA, 20 bp, Artificial Sequence
  chemically synthesized
tcccaaagtgagggtcacgg

SEQ ID NO: 7858 - DNA, 20 bp, Artificial Sequence
  chemically synthesized
aaagtgagggtcacgggggc

SEQ ID NO: 7859 - DNA, 20 bp, Artificial Sequence
  chemically synthesized
gtgagggtcacgggggccag

SEQ ID NO: 7860 - DNA, 20 bp, Artificial Sequence
  chemically synthesized
tgagggtcacgggggccagc

SEQ ID NO: 7861 - DNA, 20 bp, Artificial Sequence
  chemically synthesized
gagggtcacgggggccagca

SEQ ID NO: 7862 - DNA, 20 bp, Artificial Sequence
  chemically synthesized
gtcacgggggccagcaggga

SEQ ID NO: 7863 - DNA, 20 bp, Artificial Sequence
  chemically synthesized
tcacgggggccagcagggat

SEQ ID NO: 7864 - DNA, 20 bp, Artificial Sequence
  chemically synthesized
gggggccagcagggatgggc

SEQ ID NO: 7865 - DNA, 20 bp, Artificial Sequence
  chemically synthesized
ggggccagcagggatgggca

SEQ ID NO: 7866 - DNA, 20 bp, Artificial Sequence
  chemically synthesized
gggccagcagggatgggcaa

SEQ ID NO: 7867 - DNA, 20 bp, Artificial Sequence
  chemically synthesized
ggccagcagggatgggcaag

SEQ ID NO: 7868 - DNA, 20 bp, Artificial Sequence
  chemically synthesized
cagcagggatgggcaagggg

SEQ ID NO: 7869 - DNA, 20 bp, Artificial Sequence
  chemically synthesized
agcagggatgggcaaggggt

SEQ ID NO: 7870 - DNA, 20 bp, Artificial Sequence
  chemically synthesized
gcagggatgggcaaggggta

SEQ ID NO: 7871 - DNA, 20 bp, Artificial Sequence
  chemically synthesized
ggatgggcaaggggtaggga

SEQ ID NO: 7872 - DNA, 20 bp, Artificial Sequence
  chemically synthesized
atgggcaaggggtagggaaa

SEQ ID NO: 7873 - DNA, 20 bp, Artificial Sequence
  chemically synthesized
aaggggtagggaaagagaca

SEQ ID NO: 7874 - DNA, 20 bp, Artificial Sequence
  chemically synthesized
aggggtagggaaagagacat

SEQ ID NO: 7875 - DNA, 20 bp, Artificial Sequence
  chemically synthesized
ggtagggaaagagacatggg

SEQ ID NO: 7876 - DNA, 20 bp, Artificial Sequence
  chemically synthesized
agggaaagagacatgggcag

SEQ ID NO: 7877 - DNA, 20 bp, Artificial Sequence
  chemically synthesized
acacagatgaccaccagcag

SEQ ID NO: 7878 - DNA, 20 bp, Artificial Sequence
  chemically synthesized
gggcatcaggagccggcagc

SEQ ID NO: 7879 - DNA, 20 bp, Artificial Sequence
  chemically synthesized
agcctgggtgtggggagccg

SEQ ID NO: 7880 - DNA, 20 bp, Artificial Sequence
  chemically synthesized
aggaggcataacctgggcgg

SEQ ID NO: 7881 - DNA, 20 bp, Artificial Sequence
  chemically synthesized
gattggttggggccatgggg

SEQ ID NO: 7882 - DNA, 20 bp, Artificial Sequence
  chemically synthesized
acacacccatgcacacgact

SEQ ID NO: 7883 - DNA, 20 bp, Artificial Sequence
  chemically synthesized
acatcagctgtgtgcaaagc

SEQ ID NO: 7884 - DNA, 20 bp, Artificial Sequence
  chemically synthesized
taggcacacatcctgagaag

SEQ ID NO: 7885 - DNA, 20 bp, Artificial Sequence
  chemically synthesized
catcctgagaagggggatct

SEQ ID NO: 7886 - DNA, 20 bp, Artificial Sequence
  chemically synthesized
ttccattgagatccttaaat

SEQ ID NO: 7887 - DNA, 20 bp, Artificial Sequence
  chemically synthesized
gggaggctcagtcaggggcc

SEQ ID NO: 7888 - DNA, 20 bp, Artificial Sequence
  chemically synthesized
ggtcacttcctgccactgtc

SEQ ID NO: 7889 - DNA, 20 bp, Artificial Sequence
  chemically synthesized
accaagctggccctccatgg

SEQ ID NO: 7890 - DNA, 20 bp, Artificial Sequence
  chemically synthesized
tcttcagcaccctccactca

SEQ ID NO: 7891 - DNA, 20 bp, Artificial Sequence
  chemically synthesized
cgacttatcaactcccaatg

SEQ ID NO: 7892 - DNA, 20 bp, Artificial Sequence
  chemically synthesized
ccctgaaaccagactgccca

SEQ ID NO: 7893 - DNA, 20 bp, Artificial Sequence
  chemically synthesized
tcacagtcgtagctacccga

SEQ ID NO: 7894 - DNA, 20 bp, Artificial Sequence
  chemically synthesized
tagctacccgattggattgc

SEQ ID NO: 7895 - DNA, 20 bp, Artificial Sequence
  chemically synthesized
tggattgctcggataattag

SEQ ID NO: 7896 - DNA, 20 bp, Artificial Sequence
  chemically synthesized
aaaagtttgaacataaaaga

SEQ ID NO: 7897 - DNA, 20 bp, Artificial Sequence
  chemically synthesized
cagggtctgcccaagatggg

SEQ ID NO: 7898 - DNA, 20 bp, Artificial Sequence
  chemically synthesized
actctggacatcaggcaagg

SEQ ID NO: 7899 - DNA, 20 bp, Artificial Sequence
  chemically synthesized
aggaggagtaaagatccctg

SEQ ID NO: 7900 - DNA, 20 bp, Artificial Sequence
  chemically synthesized
accccagcttactgtttgga

SEQ ID NO: 7901 - DNA, 20 bp, Artificial Sequence
  chemically synthesized
cacgttgaggagatggagct

SEQ ID NO: 7902 - DNA, 20 bp, Artificial Sequence
  chemically synthesized
ccgaggagaccaaaacaatt

SEQ ID NO: 7903 - DNA, 20 bp, Artificial Sequence
  chemically synthesized
caaagctcaagaacatttag

SEQ ID NO: 7904 - DNA, 20 bp, Artificial Sequence
  chemically synthesized
aaaagagatccagaactgac

SEQ ID NO: 7905 - DNA, 20 bp, Artificial Sequence
  chemically synthesized
tccagaactgacacggatgc

SEQ ID NO: 7906 - DNA, 20 bp, Artificial Sequence
  chemically synthesized
ggatgctagaattagcaggc

SEQ ID NO: 7907 - DNA, 20 bp, Artificial Sequence
  chemically synthesized
attatgttcaaaaaattaag

SEQ ID NO: 7908 - DNA, 20 bp, Artificial Sequence
  chemically synthesized
aaaaattaagtagaattgtg

SEQ ID NO: 7909 - DNA, 20 bp, Artificial Sequence
  chemically synthesized
tagaattgtggaggatattt

SEQ ID NO: 7910 - DNA, 20 bp, Artificial Sequence
  chemically synthesized
caggcgccgtggctcacgcc

SEQ ID NO: 7911 - DNA, 20 bp, Artificial Sequence
  chemically synthesized
tactcgggaggctgaggcag

SEQ ID NO: 7912 - DNA, 20 bp, Artificial Sequence
  chemically synthesized
gaaagaaaagaaaaaacaca

SEQ ID NO: 7913 - DNA, 20 bp, Artificial Sequence
  chemically synthesized
aaaatttagggccaggcact

SEQ ID NO: 7914 - DNA, 20 bp, Artificial Sequence
  chemically synthesized
ctttgggaggtcgacacggg

SEQ ID NO: 7915 - DNA, 20 bp, Artificial Sequence
  chemically synthesized
tacctgggaggctgaagtgg

SEQ ID NO: 7916 - DNA, 20 bp, Artificial Sequence
  chemically synthesized
cccaggaggtggaggccaca

SEQ ID NO: 7917 - DNA, 20 bp, Artificial Sequence
  chemically synthesized
ctgcattccagcctgggcaa

SEQ ID NO: 7918 - DNA, 20 bp, Artificial Sequence
  chemically synthesized
aatgaaacactgggagaaaa

SEQ ID NO: 7919 - DNA, 20 bp, Artificial Sequence
  chemically synthesized
aaagaattaaaaaatggaaa

SEQ ID NO: 7920 - DNA, 20 bp, Artificial Sequence
  chemically synthesized
aattaaaaaatggaaagaga

SEQ ID NO: 7921 - DNA, 20 bp, Artificial Sequence
  chemically synthesized
tgaaatctttaaaagaaaaa

SEQ ID NO: 7922 - DNA, 20 bp, Artificial Sequence
  chemically synthesized
agcagcatcccgtattctct

SEQ ID NO: 7923 - DNA, 20 bp, Artificial Sequence
  chemically synthesized
ctctgagtgttcactatgta

SEQ ID NO: 7924 - DNA, 20 bp, Artificial Sequence
  chemically synthesized
accgggtgccgtgtgggcac

SEQ ID NO: 7925 - DNA, 20 bp, Artificial Sequence
  chemically synthesized
tgggcactggagttgcagag

SEQ ID NO: 7926 - DNA, 20 bp, Artificial Sequence
  chemically synthesized
aggagatgctactggtgttc

SEQ ID NO: 7927 - DNA, 20 bp, Artificial Sequence
  chemically synthesized
tccctcggttggccagcctc

SEQ ID NO: 7928 - DNA, 20 bp, Artificial Sequence
  chemically synthesized
gttggccagcctcaggaatg

SEQ ID NO: 7929 - DNA, 20 bp, Artificial Sequence
  chemically synthesized
tacttgggaggctgaggtgg

SEQ ID NO: 7930 - DNA, 20 bp, Artificial Sequence
  chemically synthesized
tgggaggatggcttgagccc

SEQ ID NO: 7931 - DNA, 20 bp, Artificial Sequence
  chemically synthesized
tcagtcaagatttattacag

SEQ ID NO: 7932 - DNA, 20 bp, Artificial Sequence
  chemically synthesized
tattacagaaggatccaggg

SEQ ID NO: 7933 - DNA, 20 bp, Artificial Sequence
  chemically synthesized
tcttgggagatgagaggagc

SEQ ID NO: 7934 - DNA, 20 bp, Artificial Sequence
  chemically synthesized
tgagaggagcagggatcttc

SEQ ID NO: 7935 - DNA, 20 bp, Artificial Sequence
  chemically synthesized
cattcactcacacacacaca

SEQ ID NO: 7936 - DNA, 20 bp, Artificial Sequence
  chemically synthesized
acacacacacagagtcccag

SEQ ID NO: 7937 - DNA, 20 bp, Artificial Sequence
  chemically synthesized
catacgaggcacatgtgttc

SEQ ID NO: 7938 - DNA, 20 bp, Artificial Sequence
  chemically synthesized
cctctggcacatgcctttcc

SEQ ID NO: 7939 - DNA, 20 bp, Artificial Sequence
  chemically synthesized
acatgcctttcctggggtcc

SEQ ID NO: 7940 - DNA, 20 bp, Artificial Sequence
  chemically synthesized
ggtgaggtgagggaacaagc

SEQ ID NO: 7941 - DNA, 20 bp, Artificial Sequence
  chemically synthesized
ccctcctcagtccctgttca

SEQ ID NO: 7942 - DNA, 20 bp, Artificial Sequence
  chemically synthesized
cctcagtccctgttcacaga

SEQ ID NO: 7943 - DNA, 20 bp, Artificial Sequence
  chemically synthesized
tgcacacttgcctttcaaaa

SEQ ID NO: 7944 - DNA, 20 bp, Artificial Sequence
  chemically synthesized
caaaaatggatttcctctcc

SEQ ID NO: 7945 - DNA, 20 bp, Artificial Sequence
  chemically synthesized
cctctcctgggattcagcct

SEQ ID NO: 7946 - DNA, 20 bp, Artificial Sequence
  chemically synthesized
tggcccctcaccttgatgga

SEQ ID NO: 7947 - DNA, 20 bp, Artificial Sequence
  chemically synthesized
ttttcctccgagctcagctg

SEQ ID NO: 7948 - DNA, 20 bp, Artificial Sequence
  chemically synthesized
attcacgtggaggttgatgg

SEQ ID NO: 7949 - DNA, 20 bp, Artificial Sequence
  chemically synthesized
gttgatggtgggatggaacg

SEQ ID NO: 7950 - DNA, 20 bp, Artificial Sequence
  chemically synthesized
gggatggaacgcagggtcgg

SEQ ID NO: 7951 - DNA, 20 bp, Artificial Sequence
  chemically synthesized
aacgcagggtcggaggggtt

SEQ ID NO: 7952 - DNA, 20 bp, Artificial Sequence
  chemically synthesized
gaggggttcggggtggtggc

SEQ ID NO: 7953 - DNA, 20 bp, Artificial Sequence
  chemically synthesized
gttcggggtggtggcctggg

SEQ ID NO: 7954 - DNA, 20 bp, Artificial Sequence
  chemically synthesized
atcccaccatcaacctccac

SEQ ID NO: 7955 - DNA, 20 bp, Artificial Sequence
  chemically synthesized
aggggccaggcactcgcagg

SEQ ID NO: 7956 - DNA, 20 bp, Artificial Sequence
  chemically synthesized
tgtgcacgtatgtgcatatg

SEQ ID NO: 7957 - DNA, 20 bp, Artificial Sequence
  chemically synthesized
ctgggactctgtgtgtgtgt

SEQ ID NO: 7958 - DNA, 20 bp, Artificial Sequence
  chemically synthesized
gactctgtgtgtgtgtgtga

SEQ ID NO: 7959 - DNA, 20 bp, Artificial Sequence
  chemically synthesized
tgtgtatgtcgtgtatgtga

SEQ ID NO: 7960 - DNA, 20 bp, Artificial Sequence
  chemically synthesized
tgagagggtatgttgtgtgt

SEQ ID NO: 7961 - DNA, 20 bp, Artificial Sequence
  chemically synthesized
gtgttgtgtgtgtatgttgt

SEQ ID NO: 7962 - DNA, 20 bp, Artificial Sequence
  chemically synthesized
atgttgtgtgtatcttgtgt

SEQ ID NO: 7963 - DNA, 20 bp, Artificial Sequence
  chemically synthesized
tgtgcatgtgtgtatgttgt

SEQ ID NO: 7964 - DNA, 20 bp, Artificial Sequence
  chemically synthesized
tgcgagtgtatgttgtgtat

SEQ ID NO: 7965 - DNA, 20 bp, Artificial Sequence
  chemically synthesized
tgtgtgtatgtatgttgtgt

SEQ ID NO: 7966 - DNA, 20 bp, Artificial Sequence
  chemically synthesized
gtgttgtgtgtgtgtattgt

SEQ ID NO: 7967 - DNA, 20 bp, Artificial Sequence
  chemically synthesized
tatgtatgtttgtgtgttgt

SEQ ID NO: 7968 - DNA, 20 bp, Artificial Sequence
  chemically synthesized
tgtgcgtgtgtgtatgttgt

SEQ ID NO: 7969 - DNA, 20 bp, Artificial Sequence
  chemically synthesized
gtgtgttgtgtgtgtatgtt

SEQ ID NO: 7970 - DNA, 20 bp, Artificial Sequence
  chemically synthesized
gtgttatgtatgttgtgtgt

SEQ ID NO: 7971 - DNA, 20 bp, Artificial Sequence
  chemically synthesized
tgtgtgtgtgagtgtgttgc

SEQ ID NO: 7972 - DNA, 20 bp, Artificial Sequence
  chemically synthesized
tgtgtgtgtgtgtgtagagg

SEQ ID NO: 7973 - DNA, 20 bp, Artificial Sequence
  chemically synthesized
tgtgtgtgtgtagaggtggg

SEQ ID NO: 7974 - DNA, 20 bp, Artificial Sequence
  chemically synthesized
tgtgtagaggtggggtgagt

SEQ ID NO: 7975 - DNA, 20 bp, Artificial Sequence
  chemically synthesized
tagaggtggggtgagttggg

SEQ ID NO: 7976 - DNA, 20 bp, Artificial Sequence
  chemically synthesized
tcatctcccaagacccttcc

SEQ ID NO: 7977 - DNA, 20 bp, Artificial Sequence
  chemically synthesized
gacattttttttttagagac

SEQ ID NO: 7978 - DNA, 20 bp, Artificial Sequence
  chemically synthesized
tagagacaggagtgtagtgg

SEQ ID NO: 7979 - DNA, 20 bp, Artificial Sequence
  chemically synthesized
aaaaaaattttttagagaaa

SEQ ID NO: 7980 - DNA, 20 bp, Artificial Sequence
  chemically synthesized
taggcagaagggcaagagcc

SEQ ID NO: 7981 - DNA, 20 bp, Artificial Sequence
  chemically synthesized
agggcaagagccaggaatgg

SEQ ID NO: 7982 - DNA, 20 bp, Artificial Sequence
  chemically synthesized
aatggaggagtgtcaggtgt

SEQ ID NO: 7983 - DNA, 20 bp, Artificial Sequence
  chemically synthesized
tgtgggtgctggtggtggag

SEQ ID NO: 7984 - DNA, 20 bp, Artificial Sequence
  chemically synthesized
aggggcttggagcttaggaa

SEQ ID NO: 7985 - DNA, 20 bp, Artificial Sequence
  chemically synthesized
aggggattggttagctgggc

SEQ ID NO: 7986 - DNA, 20 bp, Artificial Sequence
  chemically synthesized
agggcagggcaggggacagg

SEQ ID NO: 7987 - DNA, 20 bp, Artificial Sequence
  chemically synthesized
gtacatagtgaacactcaga

SEQ ID NO: 7988 - DNA, 20 bp, Artificial Sequence
  chemically synthesized
gtgaacactcagagagaata

SEQ ID NO: 7989 - DNA, 20 bp, Artificial Sequence
  chemically synthesized
agagagaatacgggatgctg

SEQ ID NO: 7990 - DNA, 20 bp, Artificial Sequence
  chemically synthesized
gggatgctgctgaatcttct

SEQ ID NO: 7991 - DNA, 20 bp, Artificial Sequence
  chemically synthesized
gctgaatcttctgagggtga

SEQ ID NO: 7992 - DNA, 20 bp, Artificial Sequence
  chemically synthesized
cttctgagggtgacagaatt

SEQ ID NO: 7993 - DNA, 20 bp, Artificial Sequence
  chemically synthesized
caggaggcttggagagaggc

SEQ ID NO: 7994 - DNA, 20 bp, Artificial Sequence
  chemically synthesized
aggatttctgaaattaatgg

SEQ ID NO: 7995 - DNA, 20 bp, Artificial Sequence
  chemically synthesized
taatgggagagtgagctcac

SEQ ID NO: 7996 - DNA, 20 bp, Artificial Sequence
  chemically synthesized
accagtgagggaccgtctga

SEQ ID NO: 7997 - DNA, 20 bp, Artificial Sequence
  chemically synthesized
ccgcatttccctccagcagc

SEQ ID NO: 7998 - DNA, 20 bp, Artificial Sequence
  chemically synthesized
atttcaattatgcatgtatt

SEQ ID NO: 7999 - DNA, 20 bp, Artificial Sequence
  chemically synthesized
tctcccagtgtttcatttta

SEQ ID NO: 8000 - DNA, 20 bp, Artificial Sequence
  chemically synthesized
tctcactctgttgcccaggc

SEQ ID NO: 8001 - DNA, 20 bp, Artificial Sequence
  chemically synthesized
gagacggttttgccatgtag

SEQ ID NO: 8002 - DNA, 20 bp, Artificial Sequence
  chemically synthesized
gtgtcgacctcccaaagtgc

SEQ ID NO: 8003 - DNA, 20 bp, Artificial Sequence
  chemically synthesized
cttttttttttttttggagg

SEQ ID NO: 8004 - DNA, 20 bp, Artificial Sequence
  chemically synthesized
tctcgctctgttgcccaggc

SEQ ID NO: 8005 - DNA, 20 bp, Artificial Sequence
  chemically synthesized
ctcactgcaagctctgcctc

SEQ ID NO: 8006 - DNA, 20 bp, Artificial Sequence
  chemically synthesized
cattctcctgcctcagcctc

SEQ ID NO: 8007 - DNA, 20 bp, Artificial Sequence
  chemically synthesized
ttttgtatttttagtagaga

SEQ ID NO: 8008 - DNA, 20 bp, Artificial Sequence
  chemically synthesized
tggggtttcaccatgttagc

SEQ ID NO: 8009 - DNA, 20 bp, Artificial Sequence
  chemically synthesized
gccttggcctcccacagtgc

SEQ ID NO: 8010 - DNA, 20 bp, Artificial Sequence
  chemically synthesized
acttaattttttgaacataa

SEQ ID NO: 8011 - DNA, 20 bp, Artificial Sequence
  chemically synthesized
ttctagcatccgtgtcagtt

SEQ ID NO: 8012 - DNA, 20 bp, Artificial Sequence
  chemically synthesized
acattgtcaatttcaccttg

SEQ ID NO: 8013 - DNA, 20 bp, Artificial Sequence
  chemically synthesized
caatttcaccttgttgggtg

SEQ ID NO: 8014 - DNA, 20 bp, Artificial Sequence
  chemically synthesized
aatgttcttgagctttgctc

SEQ ID NO: 8015 - DNA, 20 bp, Artificial Sequence
  chemically synthesized
cgggatgcagttaagcaact

SEQ ID NO: 8016 - DNA, 20 bp, Artificial Sequence
  chemically synthesized
agctccatctcctcaacgtg

SEQ ID NO: 8017 - DNA, 20 bp, Artificial Sequence
  chemically synthesized
actctctccaaacagtaagc

SEQ ID NO: 8018 - DNA, 20 bp, Artificial Sequence
  chemically synthesized
acagtaagctggggtgatcg

SEQ ID NO: 8019 - DNA, 20 bp, Artificial Sequence
  chemically synthesized
ttgtttgcttcttatccctc

SEQ ID NO: 8020 - DNA, 20 bp, Artificial Sequence
  chemically synthesized
actcctccttgcctgatgtc

SEQ ID NO: 8021 - DNA, 20 bp, Artificial Sequence
  chemically synthesized
taattatccgagcaatccaa

SEQ ID NO: 8022 - DNA, 20 bp, Artificial Sequence
  chemically synthesized
aaaatggaagcatggagaaa

SEQ ID NO: 8023 - DNA, 20 bp, Artificial Sequence
  chemically synthesized
ccctgtgggcagtctggttt

SEQ ID NO: 8024 - DNA, 20 bp, Artificial Sequence
  chemically synthesized
gtgggcagtctggtttcagg

SEQ ID NO: 8025 - DNA, 20 bp, Artificial Sequence
  chemically synthesized
tgctgggctgacccagcatt

SEQ ID NO: 8026 - DNA, 20 bp, Artificial Sequence
  chemically synthesized
gggaagcaggacaggaccct

SEQ ID NO: 8027 - DNA, 20 bp, Artificial Sequence
  chemically synthesized
aggacaggaccctctgagtg

SEQ ID NO: 8028 - DNA, 20 bp, Artificial Sequence
  chemically synthesized
accgtggtcatggagcgctt

SEQ ID NO: 8029 - DNA, 20 bp, Artificial Sequence
  chemically synthesized
tggagcgcttctggatggag

SEQ ID NO: 8030 - DNA, 20 bp, Artificial Sequence
  chemically synthesized
aatgcaaaggccttggagga

SEQ ID NO: 8031 - DNA, 20 bp, Artificial Sequence
  chemically synthesized
ggggtgggggcagtgagagg

SEQ ID NO: 8032 - DNA, 20 bp, Artificial Sequence
  chemically synthesized
ggtggggctgtgctcagagc

SEQ ID NO: 8033 - DNA, 20 bp, Artificial Sequence
  chemically synthesized
tggaggtgtcagaggcctcc

SEQ ID NO: 8034 - DNA, 20 bp, Artificial Sequence
  chemically synthesized
agaggcctccctgggtcaaa

SEQ ID NO: 8035 - DNA, 20 bp, Artificial Sequence
  chemically synthesized
tccctgggtcaaatggggtc

SEQ ID NO: 8036 - DNA, 20 bp, Artificial Sequence
  chemically synthesized
tcactggtgtgaaaaagatg

SEQ ID NO: 8037 - DNA, 20 bp, Artificial Sequence
  chemically synthesized
ggcccctgactgagcctccc

SEQ ID NO: 8038 - DNA, 20 bp, Artificial Sequence
  chemically synthesized
ctccccaggatgtggtcctg

SEQ ID NO: 8039 - DNA, 20 bp, Artificial Sequence
  chemically synthesized
gatgtggtcctgctgggtcg

SEQ ID NO: 8040 - DNA, 20 bp, Artificial Sequence
  chemically synthesized
ctgctgggtcggggggtgat

SEQ ID NO: 8041 - DNA, 20 bp, Artificial Sequence
  chemically synthesized
tgagaagacaaggaagtcca

SEQ ID NO: 8042 - DNA, 20 bp, Artificial Sequence
  chemically synthesized
gacaaggaagtccacagagt

SEQ ID NO: 8043 - DNA, 20 bp, Artificial Sequence
  chemically synthesized
agaaggtgttctgtttgcag

SEQ ID NO: 8044 - DNA, 20 bp, Artificial Sequence
  chemically synthesized
ctgggacaactggagctgct

SEQ ID NO: 8045 - DNA, 20 bp, Artificial Sequence
  chemically synthesized
agctctgtgtgcaggaagac

SEQ ID NO: 8046 - DNA, 20 bp, Artificial Sequence
  chemically synthesized
gtgcaggaagacgtgggtgt

SEQ ID NO: 8047 - DNA, 20 bp, Artificial Sequence
  chemically synthesized
gggtgtgtgagtgtacgtgt

SEQ ID NO: 8048 - DNA, 20 bp, Artificial Sequence
  chemically synthesized
tcaggtgtgtgtgtgtggga

SEQ ID NO: 8049 - DNA, 20 bp, Artificial Sequence
  chemically synthesized
gtgtgtgtgtgggagggagt

SEQ ID NO: 8050 - DNA, 20 bp, Artificial Sequence
  chemically synthesized
tagcatgcatatgcacatgt

SEQ ID NO: 8051 - DNA, 20 bp, Artificial Sequence
  chemically synthesized
atgcatatgcacatgtgaga

SEQ ID NO: 8052 - DNA, 20 bp, Artificial Sequence
  chemically synthesized
gggtacagcagagcgtggtc

SEQ ID NO: 8053 - DNA, 20 bp, Artificial Sequence
  chemically synthesized
gtgtgtgcaaatgtgtgttt

SEQ ID NO: 8054 - DNA, 20 bp, Artificial Sequence
  chemically synthesized
ttgagtgaagtgagcaatgt

SEQ ID NO: 8055 - DNA, 20 bp, Artificial Sequence
  chemically synthesized
agtgagcaatgtgtgagtgt

SEQ ID NO: 8056 - DNA, 20 bp, Artificial Sequence
  chemically synthesized
gtgtgagtgtgtgagtgtgt

SEQ ID NO: 8057 - DNA, 20 bp, Artificial Sequence
  chemically synthesized
gtgtgagtttgtgagggcat

SEQ ID NO: 8058 - DNA, 20 bp, Artificial Sequence
  chemically synthesized
aatgtgtgtgtcagtgctgt

SEQ ID NO: 8059 - DNA, 20 bp, Artificial Sequence
  chemically synthesized
tcagtgctgtcagggtgcag

SEQ ID NO: 8060 - DNA, 20 bp, Artificial Sequence
  chemically synthesized
ggaggaggccttgcgtggtg

SEQ ID NO: 8061 - DNA, 20 bp, Artificial Sequence
  chemically synthesized
aggacaacaggtgggacctg

SEQ ID NO: 8062 - DNA, 20 bp, Artificial Sequence
  chemically synthesized
gacctggagggttgtgcttg

SEQ ID NO: 8063 - DNA, 20 bp, Artificial Sequence
  chemically synthesized
gcttggagagtgggctatgg

SEQ ID NO: 8064 - DNA, 20 bp, Artificial Sequence
  chemically synthesized
tggtggaatgacccagattt

SEQ ID NO: 8065 - DNA, 20 bp, Artificial Sequence
  chemically synthesized
cccagatttaaggatctcaa

SEQ ID NO: 8066 - DNA, 20 bp, Artificial Sequence
  chemically synthesized
aggggagggactgttccagt

SEQ ID NO: 8067 - DNA, 20 bp, Artificial Sequence
  chemically synthesized
agaacacagggcccagcttc

SEQ ID NO: 8068 - DNA, 20 bp, Artificial Sequence
  chemically synthesized
ctggaggcctctgccactgg

SEQ ID NO: 8069 - DNA, 20 bp, Artificial Sequence
  chemically synthesized
cattcacagatcccccttct

SEQ ID NO: 8070 - DNA, 20 bp, Artificial Sequence
  chemically synthesized
ggatgtgtgcctaggcaggg

SEQ ID NO: 8071 - DNA, 20 bp, Artificial Sequence
  chemically synthesized
gtctcccagtcccccagctc

SEQ ID NO: 8072 - DNA, 20 bp, Artificial Sequence
  chemically synthesized
gggctttgcacacagctgat

SEQ ID NO: 8073 - DNA, 20 bp, Artificial Sequence
  chemically synthesized
acacagctgatgtgaatatc

SEQ ID NO: 8074 - DNA, 20 bp, Artificial Sequence
  chemically synthesized
gaatatcctgagtcgtgtgc

SEQ ID NO: 8075 - DNA, 20 bp, Artificial Sequence
  chemically synthesized
gtatatttatacatggtaat

SEQ ID NO: 8076 - DNA, 20 bp, Artificial Sequence
  chemically synthesized
ttatacatggtaatatgggt

SEQ ID NO: 8077 - DNA, 20 bp, Artificial Sequence
  chemically synthesized
taatatgggtgcgagtgtgt

SEQ ID NO: 8078 - DNA, 20 bp, Artificial Sequence
  chemically synthesized
tgtgtgtaatgctcaaatgc

SEQ ID NO: 8079 - DNA, 20 bp, Artificial Sequence
  chemically synthesized
gctggtggtcatctgtgtga

SEQ ID NO: 8080 - DNA, 20 bp, Artificial Sequence
  chemically synthesized
gtgtgactgggtcccaaagt

SEQ ID NO: 8081 - DNA, 20 bp, Artificial Sequence
  chemically synthesized
tgagggtcacgggggccagc

SEQ ID NO: 8082 - DNA, 20 bp, Artificial Sequence
  chemically synthesized
ggggccagcagggatgggca

SEQ ID NO: 8083 - DNA, 20 bp, Artificial Sequence
  chemically synthesized
cgccctttgccctcgcttcc

SEQ ID NO: 8084 - DNA, 20 bp, Artificial Sequence
  chemically synthesized
ggggaggctcagtcaggggc

SEQ ID NO: 8085 - DNA, 20 bp, Artificial Sequence
  chemically synthesized
tgggaagagttcttctctcc

SEQ ID NO: 8086 - DNA, 20 bp, Artificial Sequence
  chemically synthesized
atccagaactgacacggatg

SEQ ID NO: 8087 - DNA, 20 bp, Artificial Sequence
  chemically synthesized
cattatgttcaaaaaattaa

SEQ ID NO: 8088 - DNA, 20 bp, Artificial Sequence
  chemically synthesized
ctactcgggaggctgaggca

SEQ ID NO: 8089 - DNA, 20 bp, Artificial Sequence
  chemically synthesized
tccgcctccaaaaaaaaaaa

SEQ ID NO: 8090 - DNA, 20 bp, Artificial Sequence
  chemically synthesized
ctccaaaaaaaaaaaaaaga

SEQ ID NO: 8091 - DNA, 20 bp, Artificial Sequence
  chemically synthesized
aaaaaaaaaaaaaagaaaag

SEQ ID NO: 8092 - DNA, 20 bp, Artificial Sequence
  chemically synthesized
aaaaaaaaagaaaagaaaga

SEQ ID NO: 8093 - DNA, 20 bp, Artificial Sequence
  chemically synthesized
tggatggaaataatggaaga

SEQ ID NO: 8094 - DNA, 20 bp, Artificial Sequence
  chemically synthesized
aatggaagatgagaaatgcg

SEQ ID NO: 8095 - DNA, 20 bp, Artificial Sequence
  chemically synthesized
ctctataaaatgaaacactg

SEQ ID NO: 8096 - DNA, 20 bp, Artificial Sequence
  chemically synthesized
aaatgaaacactgggagaaa

SEQ ID NO: 8097 - DNA, 20 bp, Artificial Sequence
  chemically synthesized
aaaagaattaaaaaatggaa

SEQ ID NO: 8098 - DNA, 20 bp, Artificial Sequence
  chemically synthesized
atgcataattgaaatcttta

SEQ ID NO: 8099 - DNA, 20 bp, Artificial Sequence
  chemically synthesized
tttaaaagaaaaagggggta

SEQ ID NO: 8100 - DNA, 20 bp, Artificial Sequence
  chemically synthesized
agctcactctcccattaatt

SEQ ID NO: 8101 - DNA, 20 bp, Artificial Sequence
  chemically synthesized
gacagagggggagcaaagcc

SEQ ID NO: 8102 - DNA, 20 bp, Artificial Sequence
  chemically synthesized
caaattaaaaaaaatttttt

SEQ ID NO: 8103 - DNA, 20 bp, Artificial Sequence
  chemically synthesized
ggtacatagtgaacactcag

SEQ ID NO: 8104 - DNA, 20 bp, Artificial Sequence
  chemically synthesized
tgctgaatcttctgagggtg

SEQ ID NO: 8105 - DNA, 20 bp, Artificial Sequence
  chemically synthesized
tgtgatctccattttacaca

SEQ ID NO: 8106 - DNA, 20 bp, Artificial Sequence
  chemically synthesized
acacgagaaaatggaagcat

SEQ ID NO: 8107 - DNA, 20 bp, Artificial Sequence
  chemically synthesized
acacattgctcacttcactc

SEQ ID NO: 8108 - DNA, 20 bp, Artificial Sequence
  chemically synthesized
cttctctccccagaaacaat

SEQ ID NO: 8109 - DNA, 20 bp, Artificial Sequence
  chemically synthesized
tccccagaaacaatcaaaac

SEQ ID NO: 8110 - DNA, 20 bp, Artificial Sequence
  chemically synthesized
agctgagagtccgaggagac

SEQ ID NO: 8111 - DNA, 20 bp, Artificial Sequence
  chemically synthesized
caaggcatgcaatgaaacgg

SEQ ID NO: 8112 - DNA, 20 bp, Artificial Sequence
  chemically synthesized
gaattagcaggcaaggatgg

SEQ ID NO: 8113 - DNA, 20 bp, Artificial Sequence
  chemically synthesized
ccaggtgaacttctagagat

SEQ ID NO: 8114 - DNA, 20 bp, Artificial Sequence
  chemically synthesized
aactacaatgtctgaaatga

SEQ ID NO: 8115 - DNA, 20 bp, Artificial Sequence
  chemically synthesized
aaaagaaaagaaagaaaaga

SEQ ID NO: 8116 - DNA, 20 bp, Artificial Sequence
  chemically synthesized
gactagtctgggcagcatgg

SEQ ID NO: 8117 - DNA, 20 bp, Artificial Sequence
  chemically synthesized
ggcaaaacccctctacatgg

SEQ ID NO: 8118 - DNA, 20 bp, Artificial Sequence
  chemically synthesized
tgccactggctggatgggag

SEQ ID NO: 8119 - DNA, 20 bp, Artificial Sequence
  chemically synthesized
gaggaggcataacctgggcg

SEQ ID NO: 8120 - DNA, 20 bp, Artificial Sequence
  chemically synthesized
ggccatgggggggggtcatc

SEQ ID NO: 8121 - DNA, 20 bp, Artificial Sequence
  chemically synthesized
cctgagaagggggatctgtg

SEQ ID NO: 8122 - DNA, 20 bp, Artificial Sequence
  chemically synthesized
tcttctaaggctcctgtccc

SEQ ID NO: 8123 - DNA, 20 bp, Artificial Sequence
  chemically synthesized
tcctccccagcgccctttgc

SEQ ID NO: 8124 - DNA, 20 bp, Artificial Sequence
  chemically synthesized
cctccactcagagggtcctg

SEQ ID NO: 8125 - DNA, 20 bp, Artificial Sequence
  chemically synthesized
tgcaccagcattcaatttct

SEQ ID NO: 8126 - DNA, 20 bp, Artificial Sequence
  chemically synthesized
tggagatcacagtcgtagct

SEQ ID NO: 8127 - DNA, 20 bp, Artificial Sequence
  chemically synthesized
atcacagtcgtagctacccg

SEQ ID NO: 8128 - DNA, 20 bp, Artificial Sequence
  chemically synthesized
tagatgagttaaaatatgta

SEQ ID NO: 8129 - DNA, 20 bp, Artificial Sequence
  chemically synthesized
atgtaatgtgcttcttaggc

SEQ ID NO: 8130 - DNA, 20 bp, Artificial Sequence
  chemically synthesized
aacagacaactatagaacat

SEQ ID NO: 8131 - DNA, 20 bp, Artificial Sequence
  chemically synthesized
aacaggaaccctccgatcac

SEQ ID NO: 8132 - DNA, 20 bp, Artificial Sequence
  chemically synthesized
accctccgatcaccccagct

SEQ ID NO: 8133 - DNA, 20 bp, Artificial Sequence
  chemically synthesized
aaacgatcaaactgactcta

SEQ ID NO: 8134 - DNA, 20 bp, Artificial Sequence
  chemically synthesized
gacaatgtctggcagccaat

SEQ ID NO: 8135 - DNA, 20 bp, Artificial Sequence
  chemically synthesized
aatggcatgaacccgggagg

SEQ ID NO: 8136 - DNA, 20 bp, Artificial Sequence
  chemically synthesized
ctctaaattctgtcaccctc

SEQ ID NO: 8137 - DNA, 20 bp, Artificial Sequence
  chemically synthesized
ttgggaggctgaggtgggag

SEQ ID NO: 8138 - DNA, 20 bp, Artificial Sequence
  chemically synthesized
aagatacttaggtccttcag

SEQ ID NO: 8139 - DNA, 20 bp, Artificial Sequence
  chemically synthesized
ctgcacacttgcctttcaaa

SEQ ID NO: 8140 - DNA, 20 bp, Artificial Sequence
  chemically synthesized
tcaaaaatggatttcctctc

SEQ ID NO: 8141 - DNA, 20 bp, Artificial Sequence
  chemically synthesized
ggctggggctggggcagagg

SEQ ID NO: 8142 - DNA, 20 bp, Artificial Sequence
  chemically synthesized
ccatttttgaaaggcaagtg

SEQ ID NO: 8143 - DNA, 20 bp, Artificial Sequence
  chemically synthesized
aaaggcaagtgtgcagtttc

SEQ ID NO: 8144 - DNA, 20 bp, Artificial Sequence
  chemically synthesized
tgctccccctctgtctcagc

SEQ ID NO: 8145 - DNA, 20 bp, Artificial Sequence
  chemically synthesized
gactgaggagggcccgacac

SEQ ID NO: 8146 - DNA, 20 bp, Artificial Sequence
  chemically synthesized
acgtatgtgcatatgaggaa

SEQ ID NO: 8147 - DNA, 20 bp, Artificial Sequence
  chemically synthesized
tgtgtattgtgtgagtgtat

SEQ ID NO: 8148 - DNA, 20 bp, Artificial Sequence
  chemically synthesized
gtgtgtgtgttagtgtgtgt

SEQ ID NO: 8149 - DNA, 20 bp, Artificial Sequence
  chemically synthesized
atgttgcccaggctggtggg

SEQ ID NO: 8150 - DNA, 20 bp, Artificial Sequence
  chemically synthesized
tccatggaggcaggaggagc

SEQ ID NO: 8151 - DNA, 20 bp, Artificial Sequence
  chemically synthesized
aggcaggaggagcaggggct

SEQ ID NO: 8152 - DNA, 20 bp, Artificial Sequence
  chemically synthesized
caggggcttggagcttagga

SEQ ID NO: 8153 - DNA, 20 bp, Artificial Sequence
  chemically synthesized
cttctgagggtgacagaatt

SEQ ID NO: 8154 - DNA, 20 bp, Artificial Sequence
  chemically synthesized
cagaatttagagtttgagca

SEQ ID NO: 8155 - DNA, 20 bp, Artificial Sequence
  chemically synthesized
gcaggaggcttggagagagg

SEQ ID NO: 8156 - DNA, 20 bp, Artificial Sequence
  chemically synthesized
catcttccacttgtctcagc

SEQ ID NO: 8157 - DNA, 20 bp, Artificial Sequence
  chemically synthesized
ctgctaccccctttttcttt

SEQ ID NO: 8158 - DNA, 20 bp, Artificial Sequence
  chemically synthesized
tttttaattcttttttctcc

SEQ ID NO: 8159 - DNA, 20 bp, Artificial Sequence
  chemically synthesized
cccctcccctcctttccttc

SEQ ID NO: 8160 - DNA, 20 bp, Artificial Sequence
  chemically synthesized
tgttgcccaggctggaatgc

SEQ ID NO: 8161 - DNA, 20 bp, Artificial Sequence
  chemically synthesized
taaaaatttttttttgtaga

SEQ ID NO: 8162 - DNA, 20 bp, Artificial Sequence
  chemically synthesized
gagacggttttgccatgtag

SEQ ID NO: 8163 - DNA, 20 bp, Artificial Sequence
  chemically synthesized
agtcttgagctcctgggctc

SEQ ID NO: 8164 - DNA, 20 bp, Artificial Sequence
  chemically synthesized
cgtgtcgacctcccaaagtg

SEQ ID NO: 8165 - DNA, 20 bp, Artificial Sequence
  chemically synthesized
tcttccattatttccatcca

SEQ ID NO: 8166 - DNA, 20 bp, Artificial Sequence
  chemically synthesized
ttttgtatttttagtagaga

SEQ ID NO: 8167 - DNA, 20 bp, Artificial Sequence
  chemically synthesized
cgccttggcctcccacagtg

SEQ ID NO: 8168 - DNA, 20 bp, Artificial Sequence
  chemically synthesized
tgagccacggcgcctggcca

SEQ ID NO: 8169 - DNA, 20 bp, Artificial Sequence
  chemically synthesized
tgttttttcatttcagacat

SEQ ID NO: 8170 - DNA, 20 bp, Artificial Sequence
  chemically synthesized
taatgggatatggctataat

SEQ ID NO: 8171 - DNA, 20 bp, Artificial Sequence
  chemically synthesized
atgaacctcctcgttatgca

SEQ ID NO: 8172 - DNA, 20 bp, Artificial Sequence
  chemically synthesized
cctcgttatgcattgtgttt

SEQ ID NO: 8173 - DNA, 20 bp, Artificial Sequence
  chemically synthesized
ttcattgcatgccttgtaat

SEQ ID NO: 8174 - DNA, 20 bp, Artificial Sequence
  chemically synthesized
ttgtattcctctaaatgttc

SEQ ID NO: 8175 - DNA, 20 bp, Artificial Sequence
  chemically synthesized
atgcagttaagcaacttaga

SEQ ID NO: 8176 - DNA, 20 bp, Artificial Sequence
  chemically synthesized
aagcaacttagagtcagttt

SEQ ID NO: 8177 - DNA, 20 bp, Artificial Sequence
  chemically synthesized
gtttgatcgtttgaactctt

SEQ ID NO: 8178 - DNA, 20 bp, Artificial Sequence
  chemically synthesized
tggggtgatcggagggttcc

SEQ ID NO: 8179 - DNA, 20 bp, Artificial Sequence
  chemically synthesized
gtgatcggagggttcctgtt

SEQ ID NO: 8180 - DNA, 20 bp, Artificial Sequence
  chemically synthesized
agctgccatgttctatagtt

SEQ ID NO: 8181 - DNA, 20 bp, Artificial Sequence
  chemically synthesized
catgttctatagttgtctgt

SEQ ID NO: 8182 - DNA, 20 bp, Artificial Sequence
  chemically synthesized
tctatagttgtctgtttttg

SEQ ID NO: 8183 - DNA, 20 bp, Artificial Sequence
  chemically synthesized
tagttgtctgtttttgtttt

SEQ ID NO: 8184 - DNA, 20 bp, Artificial Sequence
  chemically synthesized
ctgggctaccctgtgggcag

SEQ ID NO: 8185 - DNA, 20 bp, Artificial Sequence
  chemically synthesized
cagggactcagccatggagg

SEQ ID NO: 8186 - DNA, 20 bp, Artificial Sequence
  chemically synthesized
tggggaacaccgtggtcatg

SEQ ID NO: 8187 - DNA, 20 bp, Artificial Sequence
  chemically synthesized
ggcaggaagtgacctgggga

SEQ ID NO: 8188 - DNA, 20 bp, Artificial Sequence
  chemically synthesized
ggtccaaggcctagaaggtg

SEQ ID NO: 8189 - DNA, 20 bp, Artificial Sequence
  chemically synthesized
ggtcatgagtgtgtgcaaat

SEQ ID NO: 8190 - DNA, 20 bp, Artificial Sequence
  chemically synthesized
gtgtgagtgtgtgagtgtgt

SEQ ID NO: 8191 - DNA, 20 bp, Artificial Sequence
  chemically synthesized
ggagcaaatttagtgtggaa

SEQ ID NO: 8192 - DNA, 20 bp, Artificial Sequence
  chemically synthesized
aacaggtgggacctggaggg

SEQ ID NO: 8193 - DNA, 20 bp, Artificial Sequence
  chemically synthesized
agtgggctatggtggaatga

SEQ ID NO: 8194 - DNA, 20 bp, Artificial Sequence
  chemically synthesized
caggggagggactgttccag

SEQ ID NO: 8195 - DNA, 20 bp, Artificial Sequence
  chemically synthesized
attttaggaagaacacaggg

SEQ ID NO: 8196 - DNA, 20 bp, Artificial Sequence
  chemically synthesized
cagtcccccagctccaggat

SEQ ID NO: 8197 - DNA, 20 bp, Artificial Sequence
  chemically synthesized
gtgtgcatgggtgtgtgtgc

SEQ ID NO: 8198 - DNA, 20 bp, Artificial Sequence
  chemically synthesized
cccgcccaggttatgcctcc

SEQ ID NO: 8199 - DNA, 20 bp, Artificial Sequence
  chemically synthesized
cacagcgtctctgctccatg

SEQ ID NO: 8200 - DNA, 20 bp, Artificial Sequence
  chemically synthesized
ctgctccatggtctgcttca

SEQ ID NO: 8201 - DNA, 20 bp, Artificial Sequence
  chemically synthesized
tctgcttcagtctgcttgcc

SEQ ID NO: 8202 - DNA, 22 bp, Artificial Sequence
  chemically synthesized
cccatgtctctttccctacccc

SEQ ID NO: 8203 - DNA, 22 bp, Artificial Sequence
  chemically synthesized
tttccctaccccttgcccatcc

SEQ ID NO: 8204 - DNA, 22 bp, Artificial Sequence
  chemically synthesized
tccctaccccttgcccatccct

SEQ ID NO: 8205 - DNA, 22 bp, Artificial Sequence
  chemically synthesized
ccctaccccttgcccatccctg

SEQ ID NO: 8206 - DNA, 22 bp, Artificial Sequence
  chemically synthesized
cctaccccttgcccatccctgc

SEQ ID NO: 8207 - DNA, 22 bp, Artificial Sequence
  chemically synthesized
ccccttgcccatccctgctggc

SEQ ID NO: 8208 - DNA, 22 bp, Artificial Sequence
  chemically synthesized
gcccatccctgctggcccccgt

SEQ ID NO: 8209 - DNA, 22 bp, Artificial Sequence
  chemically synthesized
cccatccctgctggcccccgtg

SEQ ID NO: 8210 - DNA, 22 bp, Artificial Sequence
  chemically synthesized
ctggcccccgtgaccctcactt

SEQ ID NO: 8211 - DNA, 22 bp, Artificial Sequence
  chemically synthesized
gcccccgtgaccctcactttgg

SEQ ID NO: 8212 - DNA, 22 bp, Artificial Sequence
  chemically synthesized
actttgggacccagtcacacag

SEQ ID NO: 8213 - DNA, 22 bp, Artificial Sequence
  chemically synthesized
tgggacccagtcacacagatga

SEQ ID NO: 8214 - DNA, 22 bp, Artificial Sequence
  chemically synthesized
gggacccagtcacacagatgac

SEQ ID NO: 8215 - DNA, 22 bp, Artificial Sequence
  chemically synthesized
ggacccagtcacacagatgacc

SEQ ID NO: 8216 - DNA, 22 bp, Artificial Sequence
  chemically synthesized
aagctcagggcaagcagactga

SEQ ID NO: 8217 - DNA, 22 bp, Artificial Sequence
  chemically synthesized
agggcaagcagactgaagcaga

SEQ ID NO: 8218 - DNA, 22 bp, Artificial Sequence
  chemically synthesized
aagcagaccatggagcagagac

SEQ ID NO: 8219 - DNA, 22 bp, Artificial Sequence
  chemically synthesized
tgccaggggctgggcaggaggt

SEQ ID NO: 8220 - DNA, 22 bp, Artificial Sequence
  chemically synthesized
ggcaggaggtggccctgtggga

SEQ ID NO: 8221 - DNA, 22 bp, Artificial Sequence
  chemically synthesized
tgggagaggggcatcaggagcc

SEQ ID NO: 8222 - DNA, 22 bp, Artificial Sequence
  chemically synthesized
ggtgtggggagccggagggtaa

SEQ ID NO: 8223 - DNA, 22 bp, Artificial Sequence
  chemically synthesized
aggaggcataacctgggcgggg

SEQ ID NO: 8224 - DNA, 22 bp, Artificial Sequence
  chemically synthesized
ggcggggggattggttggggcc

SEQ ID NO: 8225 - DNA, 22 bp, Artificial Sequence
  chemically synthesized
gttggggccatgggggggggtc

SEQ ID NO: 8226 - DNA, 22 bp, Artificial Sequence
  chemically synthesized
gggccatgggggggggtcatca

SEQ ID NO: 8227 - DNA, 22 bp, Artificial Sequence
  chemically synthesized
tgaccccagcatttgagcatta

SEQ ID NO: 8228 - DNA, 22 bp, Artificial Sequence
  chemically synthesized
gaccccagcatttgagcattac

SEQ ID NO: 8229 - DNA, 22 bp, Artificial Sequence
  chemically synthesized
accccagcatttgagcattaca

SEQ ID NO: 8230 - DNA, 22 bp, Artificial Sequence
  chemically synthesized
gagcattacacacacactctta

SEQ ID NO: 8231 - DNA, 22 bp, Artificial Sequence
  chemically synthesized
agcattacacacacactcttac

SEQ ID NO: 8232 - DNA, 22 bp, Artificial Sequence
  chemically synthesized
cacacacactcttacacactcg

SEQ ID NO: 8233 - DNA, 22 bp, Artificial Sequence
  chemically synthesized
ttacacactcgcacccatatta

SEQ ID NO: 8234 - DNA, 22 bp, Artificial Sequence
  chemically synthesized
acacactcgcacccatattacc

SEQ ID NO: 8235 - DNA, 22 bp, Artificial Sequence
  chemically synthesized
cacactcgcacccatattacca

SEQ ID NO: 8236 - DNA, 22 bp, Artificial Sequence
  chemically synthesized
gcacccatattaccatgtataa

SEQ ID NO: 8237 - DNA, 22 bp, Artificial Sequence
  chemically synthesized
ccatgtataaatatacacacgc

SEQ ID NO: 8238 - DNA, 22 bp, Artificial Sequence
  chemically synthesized
atctggtgcacacacacccatg

SEQ ID NO: 8239 - DNA, 22 bp, Artificial Sequence
  chemically synthesized
gtgcacacacacccatgcacac

SEQ ID NO: 8240 - DNA, 22 bp, Artificial Sequence
  chemically synthesized
aggatattcacatcagctgtgt

SEQ ID NO: 8241 - DNA, 22 bp, Artificial Sequence
  chemically synthesized
acatcagctgtgtgcaaagccc

SEQ ID NO: 8242 - DNA, 22 bp, Artificial Sequence
  chemically synthesized
tgtgcaaagcccggatcctgga

SEQ ID NO: 8243 - DNA, 22 bp, Artificial Sequence
  chemically synthesized
gagctgggggactgggagacgc

SEQ ID NO: 8244 - DNA, 22 bp, Artificial Sequence
  chemically synthesized
ggggactgggagacgcacaggg

SEQ ID NO: 8245 - DNA, 22 bp, Artificial Sequence
  chemically synthesized
ggagacgcacagggggcggggg

SEQ ID NO: 8246 - DNA, 22 bp, Artificial Sequence
  chemically synthesized
cctaggcacacatcctgagaag

SEQ ID NO: 8247 - DNA, 22 bp, Artificial Sequence
  chemically synthesized
ggcacacatcctgagaaggggg

SEQ ID NO: 8248 - DNA, 22 bp, Artificial Sequence
  chemically synthesized
agaagggggatctgtgaatggt

SEQ ID NO: 8249 - DNA, 22 bp, Artificial Sequence
  chemically synthesized
tgaatggttttcctcccatcca

SEQ ID NO: 8250 - DNA, 22 bp, Artificial Sequence
  chemically synthesized
tcctcccatccagccagtggca

SEQ ID NO: 8251 - DNA, 22 bp, Artificial Sequence
  chemically synthesized
cctcccatccagccagtggcag

SEQ ID NO: 8252 - DNA, 22 bp, Artificial Sequence
  chemically synthesized
ctcccatccagccagtggcaga

SEQ ID NO: 8253 - DNA, 22 bp, Artificial Sequence
  chemically synthesized
ccatccagccagtggcagaggc

SEQ ID NO: 8254 - DNA, 22 bp, Artificial Sequence
  chemically synthesized
cagatcacctcgggccttagtc

SEQ ID NO: 8255 - DNA, 22 bp, Artificial Sequence
  chemically synthesized
gggccttagtctcagctcttct

SEQ ID NO: 8256 - DNA, 22 bp, Artificial Sequence
  chemically synthesized
agtctcagctcttctaaggctc

SEQ ID NO: 8257 - DNA, 22 bp, Artificial Sequence
  chemically synthesized
gtctcagctcttctaaggctcc

SEQ ID NO: 8258 - DNA, 22 bp, Artificial Sequence
  chemically synthesized
agctcttctaaggctcctgtcc

SEQ ID NO: 8259 - DNA, 22 bp, Artificial Sequence
  chemically synthesized
ttctaaggctcctgtcccctca

SEQ ID NO: 8260 - DNA, 22 bp, Artificial Sequence
  chemically synthesized
ctaaggctcctgtcccctcaga

SEQ ID NO: 8261 - DNA, 22 bp, Artificial Sequence
  chemically synthesized
taaggctcctgtcccctcagat

SEQ ID NO: 8262 - DNA, 22 bp, Artificial Sequence
  chemically synthesized
aggctcctgtcccctcagattg

SEQ ID NO: 8263 - DNA, 22 bp, Artificial Sequence
  chemically synthesized
ctgtcccctcagattggagact

SEQ ID NO: 8264 - DNA, 22 bp, Artificial Sequence
  chemically synthesized
tcccctcagattggagactcca

SEQ ID NO: 8265 - DNA, 22 bp, Artificial Sequence
  chemically synthesized
agattggagactccagaagctg

SEQ ID NO: 8266 - DNA, 22 bp, Artificial Sequence
  chemically synthesized
gagactccagaagctgggccct

SEQ ID NO: 8267 - DNA, 22 bp, Artificial Sequence
  chemically synthesized
cagaagctgggccctgtgttct

SEQ ID NO: 8268 - DNA, 22 bp, Artificial Sequence
  chemically synthesized
ggccctgtgttcttcctaaaat

SEQ ID NO: 8269 - DNA, 22 bp, Artificial Sequence
  chemically synthesized
tgttcttcctaaaatccatact

SEQ ID NO: 8270 - DNA, 22 bp, Artificial Sequence
  chemically synthesized
ttcctaaaatccatactggaac

SEQ ID NO: 8271 - DNA, 22 bp, Artificial Sequence
  chemically synthesized
cctaaaatccatactggaacag

SEQ ID NO: 8272 - DNA, 22 bp, Artificial Sequence
  chemically synthesized
ctaaaatccatactggaacagt

SEQ ID NO: 8273 - DNA, 22 bp, Artificial Sequence
  chemically synthesized
aaatccatactggaacagtccc

SEQ ID NO: 8274 - DNA, 22 bp, Artificial Sequence
  chemically synthesized
gaacagtccctcccctgccaaa

SEQ ID NO: 8275 - DNA, 22 bp, Artificial Sequence
  chemically synthesized
ccctgccaaaattccattgaga

SEQ ID NO: 8276 - DNA, 22 bp, Artificial Sequence
  chemically synthesized
ccaaaattccattgagatcctt

SEQ ID NO: 8277 - DNA, 22 bp, Artificial Sequence
  chemically synthesized
cattgagatccttaaatctggg

SEQ ID NO: 8278 - DNA, 22 bp, Artificial Sequence
  chemically synthesized
agatccttaaatctgggtcatt

SEQ ID NO: 8279 - DNA, 22 bp, Artificial Sequence
  chemically synthesized
aaatctgggtcattccaccata

SEQ ID NO: 8280 - DNA, 22 bp, Artificial Sequence
  chemically synthesized
aatctgggtcattccaccatag

SEQ ID NO: 8281 - DNA, 22 bp, Artificial Sequence
  chemically synthesized
ggtcattccaccatagcccact

SEQ ID NO: 8282 - DNA, 22 bp, Artificial Sequence
  chemically synthesized
caccatagcccactctccaagc

SEQ ID NO: 8283 - DNA, 22 bp, Artificial Sequence
  chemically synthesized
tccaagcacaaccctccaggtc

SEQ ID NO: 8284 - DNA, 22 bp, Artificial Sequence
  chemically synthesized
caagcacaaccctccaggtccc

SEQ ID NO: 8285 - DNA, 22 bp, Artificial Sequence
  chemically synthesized
caggtcccacctgttgtcctca

SEQ ID NO: 8286 - DNA, 22 bp, Artificial Sequence
  chemically synthesized
ttgtcctcatcccccaccacgc

SEQ ID NO: 8287 - DNA, 22 bp, Artificial Sequence
  chemically synthesized
tcctcatcccccaccacgcaag

SEQ ID NO: 8288 - DNA, 22 bp, Artificial Sequence
  chemically synthesized
atcccccaccacgcaaggcctc

SEQ ID NO: 8289 - DNA, 22 bp, Artificial Sequence
  chemically synthesized
ctccccagcgccctttgccctc

SEQ ID NO: 8290 - DNA, 22 bp, Artificial Sequence
  chemically synthesized
cccagcgccctttgccctcgct

SEQ ID NO: 8291 - DNA, 22 bp, Artificial Sequence
  chemically synthesized
tgccctcgcttccctagaaacc

SEQ ID NO: 8292 - DNA, 22 bp, Artificial Sequence
  chemically synthesized
gccctcgcttccctagaaacct

SEQ ID NO: 8293 - DNA, 22 bp, Artificial Sequence
  chemically synthesized
ccctcgcttccctagaaacctc

SEQ ID NO: 8294 - DNA, 22 bp, Artificial Sequence
  chemically synthesized
gcttccctagaaacctcgttcc

SEQ ID NO: 8295 - DNA, 22 bp, Artificial Sequence
  chemically synthesized
ccctagaaacctcgttccacac

SEQ ID NO: 8296 - DNA, 22 bp, Artificial Sequence
  chemically synthesized
cctagaaacctcgttccacact

SEQ ID NO: 8297 - DNA, 22 bp, Artificial Sequence
  chemically synthesized
gaaacctcgttccacactaaat

SEQ ID NO: 8298 - DNA, 22 bp, Artificial Sequence
  chemically synthesized
gttccacactaaatttgctccc

SEQ ID NO: 8299 - DNA, 22 bp, Artificial Sequence
  chemically synthesized
cacactaaatttgctcccctca

SEQ ID NO: 8300 - DNA, 22 bp, Artificial Sequence
  chemically synthesized
aatttgctcccctcagcccgag

SEQ ID NO: 8301 - DNA, 22 bp, Artificial Sequence
  chemically synthesized
gctcccctcagcccgaggtcat

SEQ ID NO: 8302 - DNA, 22 bp, Artificial Sequence
  chemically synthesized
ctcccctcagcccgaggtcatc

SEQ ID NO: 8303 - DNA, 22 bp, Artificial Sequence
  chemically synthesized
ccctcagcccgaggtcatctca

SEQ ID NO: 8304 - DNA, 22 bp, Artificial Sequence
  chemically synthesized
agcccgaggtcatctcacaggt

SEQ ID NO: 8305 - DNA, 22 bp, Artificial Sequence
  chemically synthesized
acaggtacctctcctgcccctt

SEQ ID NO: 8306 - DNA, 22 bp, Artificial Sequence
  chemically synthesized
tcctgccccttgatccatctgc

SEQ ID NO: 8307 - DNA, 22 bp, Artificial Sequence
  chemically synthesized
ctgccccttgatccatctgcac

SEQ ID NO: 8308 - DNA, 22 bp, Artificial Sequence
  chemically synthesized
ccccttgatccatctgcaccct

SEQ ID NO: 8309 - DNA, 22 bp, Artificial Sequence
  chemically synthesized
gatccatctgcaccctgacagc

SEQ ID NO: 8310 - DNA, 22 bp, Artificial Sequence
  chemically synthesized
atccatctgcaccctgacagca

SEQ ID NO: 8311 - DNA, 22 bp, Artificial Sequence
  chemically synthesized
caccctgacagcactgacacac

SEQ ID NO: 8312 - DNA, 22 bp, Artificial Sequence
  chemically synthesized
acagcactgacacacacattca

SEQ ID NO: 8313 - DNA, 22 bp, Artificial Sequence
  chemically synthesized
acacacacattcacatgccctc

SEQ ID NO: 8314 - DNA, 22 bp, Artificial Sequence
  chemically synthesized
acatgccctcacaaactcacac

SEQ ID NO: 8315 - DNA, 22 bp, Artificial Sequence
  chemically synthesized
acaaactcacacacactcacac

SEQ ID NO: 8316 - DNA, 22 bp, Artificial Sequence
  chemically synthesized
acacacactcacacactcacac

SEQ ID NO: 8317 - DNA, 22 bp, Artificial Sequence
  chemically synthesized
acacactcacacattgctcact

SEQ ID NO: 8318 - DNA, 22 bp, Artificial Sequence
  chemically synthesized
acacattgctcacttcactcaa

SEQ ID NO: 8319 - DNA, 22 bp, Artificial Sequence
  chemically synthesized
ctcacttcactcaaaaacacac

SEQ ID NO: 8320 - DNA, 22 bp, Artificial Sequence
  chemically synthesized
acttcactcaaaaacacacatt

SEQ ID NO: 8321 - DNA, 22 bp, Artificial Sequence
  chemically synthesized
cactcaaaaacacacatttgca

SEQ ID NO: 8322 - DNA, 22 bp, Artificial Sequence
  chemically synthesized
actcaaaaacacacatttgcac

SEQ ID NO: 8323 - DNA, 22 bp, Artificial Sequence
  chemically synthesized
aaaaacacacatttgcacacac

SEQ ID NO: 8324 - DNA, 22 bp, Artificial Sequence
  chemically synthesized
gcacacactcatgaccacgctc

SEQ ID NO: 8325 - DNA, 22 bp, Artificial Sequence
  chemically synthesized
cacacactcatgaccacgctct

SEQ ID NO: 8326 - DNA, 22 bp, Artificial Sequence
  chemically synthesized
atgaccacgctctgctgtaccc

SEQ ID NO: 8327 - DNA, 22 bp, Artificial Sequence
  chemically synthesized
tgctgtacccactctcacatgt

SEQ ID NO: 8328 - DNA, 22 bp, Artificial Sequence
  chemically synthesized
ctgtacccactctcacatgtgc

SEQ ID NO: 8329 - DNA, 22 bp, Artificial Sequence
  chemically synthesized
tacccactctcacatgtgcata

SEQ ID NO: 8330 - DNA, 22 bp, Artificial Sequence
  chemically synthesized
tcacatgtgcatatgcatgcta

SEQ ID NO: 8331 - DNA, 22 bp, Artificial Sequence
  chemically synthesized
acatgtgcatatgcatgctaat

SEQ ID NO: 8332 - DNA, 22 bp, Artificial Sequence
  chemically synthesized
atgcacacattcatactccctc

SEQ ID NO: 8333 - DNA, 22 bp, Artificial Sequence
  chemically synthesized
atactccctcccacacacacac

SEQ ID NO: 8334 - DNA, 22 bp, Artificial Sequence
  chemically synthesized
cctcccacacacacacacctga

SEQ ID NO: 8335 - DNA, 22 bp, Artificial Sequence
  chemically synthesized
ccacacacacacacctgacaca

SEQ ID NO: 8336 - DNA, 22 bp, Artificial Sequence
  chemically synthesized
acacacccacacacgtacactc

SEQ ID NO: 8337 - DNA, 22 bp, Artificial Sequence
  chemically synthesized
acacacccacgtcttcctgcac

SEQ ID NO: 8338 - DNA, 22 bp, Artificial Sequence
  chemically synthesized
cctgcacacagagctgggctcc

SEQ ID NO: 8339 - DNA, 22 bp, Artificial Sequence
  chemically synthesized
ctgcacacagagctgggctccc

SEQ ID NO: 8340 - DNA, 22 bp, Artificial Sequence
  chemically synthesized
cacacagagctgggctccctct

SEQ ID NO: 8341 - DNA, 22 bp, Artificial Sequence
  chemically synthesized
ggctccctctctgctgcctcca

SEQ ID NO: 8342 - DNA, 22 bp, Artificial Sequence
  chemically synthesized
cctctctgctgcctccagaccc

SEQ ID NO: 8343 - DNA, 22 bp, Artificial Sequence
  chemically synthesized
tctgctgcctccagacccagag

SEQ ID NO: 8344 - DNA, 22 bp, Artificial Sequence
  chemically synthesized
tgctgcctccagacccagagca

SEQ ID NO: 8345 - DNA, 22 bp, Artificial Sequence
  chemically synthesized
ctgcctccagacccagagcagc

SEQ ID NO: 8346 - DNA, 22 bp, Artificial Sequence
  chemically synthesized
cctccagacccagagcagctcc

SEQ ID NO: 8347 - DNA, 22 bp, Artificial Sequence
  chemically synthesized
cagacccagagcagctccagtt

SEQ ID NO: 8348 - DNA, 22 bp, Artificial Sequence
  chemically synthesized
cagttgtcccagccctgagctc

SEQ ID NO: 8349 - DNA, 22 bp, Artificial Sequence
  chemically synthesized
tcccagccctgagctcctctct

SEQ ID NO: 8350 - DNA, 22 bp, Artificial Sequence
  chemically synthesized
agctcctctctttgcagcatcc

SEQ ID NO: 8351 - DNA, 22 bp, Artificial Sequence
  chemically synthesized
ctctctttgcagcatccacctg

SEQ ID NO: 8352 - DNA, 22 bp, Artificial Sequence
  chemically synthesized
tctttgcagcatccacctgcaa

SEQ ID NO: 8353 - DNA, 22 bp, Artificial Sequence
  chemically synthesized
tttgcagcatccacctgcaaac

SEQ ID NO: 8354 - DNA, 22 bp, Artificial Sequence
  chemically synthesized
tgcagcatccacctgcaaacag

SEQ ID NO: 8355 - DNA, 22 bp, Artificial Sequence
  chemically synthesized
gcagcatccacctgcaaacaga

SEQ ID NO: 8356 - DNA, 22 bp, Artificial Sequence
  chemically synthesized
cagcatccacctgcaaacagaa

SEQ ID NO: 8357 - DNA, 22 bp, Artificial Sequence
  chemically synthesized
caaacagaacaccttctaggcc

SEQ ID NO: 8358 - DNA, 22 bp, Artificial Sequence
  chemically synthesized
ctaggccttggaccctgactct

SEQ ID NO: 8359 - DNA, 22 bp, Artificial Sequence
  chemically synthesized
taggccttggaccctgactctg

SEQ ID NO: 8360 - DNA, 22 bp, Artificial Sequence
  chemically synthesized
ggccttggaccctgactctgtg

SEQ ID NO: 8361 - DNA, 22 bp, Artificial Sequence
  chemically synthesized
ggaccctgactctgtggacttc

SEQ ID NO: 8362 - DNA, 22 bp, Artificial Sequence
  chemically synthesized
gaccctgactctgtggacttcc

SEQ ID NO: 8363 - DNA, 22 bp, Artificial Sequence
  chemically synthesized
actctgtggacttccttgtctt

SEQ ID NO: 8364 - DNA, 22 bp, Artificial Sequence
  chemically synthesized
tgtggacttccttgtcttctca

SEQ ID NO: 8365 - DNA, 22 bp, Artificial Sequence
  chemically synthesized
tggacttccttgtcttctcatt

SEQ ID NO: 8366 - DNA, 22 bp, Artificial Sequence
  chemically synthesized
ccttgtcttctcattcctatca

SEQ ID NO: 8367 - DNA, 22 bp, Artificial Sequence
  chemically synthesized
cttgtcttctcattcctatcac

SEQ ID NO: 8368 - DNA, 22 bp, Artificial Sequence
  chemically synthesized
gtcttctcattcctatcacccc

SEQ ID NO: 8369 - DNA, 22 bp, Artificial Sequence
  chemically synthesized
tcttctcattcctatcaccccc

SEQ ID NO: 8370 - DNA, 22 bp, Artificial Sequence
  chemically synthesized
ctcattcctatcaccccccgac

SEQ ID NO: 8371 - DNA, 22 bp, Artificial Sequence
  chemically synthesized
tcattcctatcaccccccgacc

SEQ ID NO: 8372 - DNA, 22 bp, Artificial Sequence
  chemically synthesized
attcctatcaccccccgaccca

SEQ ID NO: 8373 - DNA, 22 bp, Artificial Sequence
  chemically synthesized
ctatcaccccccgacccagcag

SEQ ID NO: 8374 - DNA, 22 bp, Artificial Sequence
  chemically synthesized
tcaccccccgacccagcaggac

SEQ ID NO: 8375 - DNA, 22 bp, Artificial Sequence
  chemically synthesized
gggaggctcagtcaggggccca

SEQ ID NO: 8376 - DNA, 22 bp, Artificial Sequence
  chemically synthesized
agtcaggggcccagaatcttcc

SEQ ID NO: 8377 - DNA, 22 bp, Artificial Sequence
  chemically synthesized
cctccccaggtcacttcctgcc

SEQ ID NO: 8378 - DNA, 22 bp, Artificial Sequence
  chemically synthesized
ctccccaggtcacttcctgcca

SEQ ID NO: 8379 - DNA, 22 bp, Artificial Sequence
  chemically synthesized
cccaggtcacttcctgccactg

SEQ ID NO: 8380 - DNA, 22 bp, Artificial Sequence
  chemically synthesized
cctgccactgtcctgagtcaga

SEQ ID NO: 8381 - DNA, 22 bp, Artificial Sequence
  chemically synthesized
ctgccactgtcctgagtcagac

SEQ ID NO: 8382 - DNA, 22 bp, Artificial Sequence
  chemically synthesized
ccactgtcctgagtcagacact

SEQ ID NO: 8383 - DNA, 22 bp, Artificial Sequence
  chemically synthesized
tcctgagtcagacactgcccct

SEQ ID NO: 8384 - DNA, 22 bp, Artificial Sequence
  chemically synthesized
agtcagacactgcccctgtaag

SEQ ID NO: 8385 - DNA, 22 bp, Artificial Sequence
  chemically synthesized
cccctgtaagtgactgtccata

SEQ ID NO: 8386 - DNA, 22 bp, Artificial Sequence
  chemically synthesized
taagtgactgtccataactctt

SEQ ID NO: 8387 - DNA, 22 bp, Artificial Sequence
  chemically synthesized
tccataactcttcatctttttc

SEQ ID NO: 8388 - DNA, 22 bp, Artificial Sequence
  chemically synthesized
ttcatctttttcacaccagtga

SEQ ID NO: 8389 - DNA, 22 bp, Artificial Sequence
  chemically synthesized
catctttttcacaccagtgact

SEQ ID NO: 8390 - DNA, 22 bp, Artificial Sequence
  chemically synthesized
atctttttcacaccagtgactt

SEQ ID NO: 8391 - DNA, 22 bp, Artificial Sequence
  chemically synthesized
tttcacaccagtgacttccacc

SEQ ID NO: 8392 - DNA, 22 bp, Artificial Sequence
  chemically synthesized
ttcacaccagtgacttccacct

SEQ ID NO: 8393 - DNA, 22 bp, Artificial Sequence
  chemically synthesized
tcacaccagtgacttccacctt

SEQ ID NO: 8394 - DNA, 22 bp, Artificial Sequence
  chemically synthesized
cacaccagtgacttccaccttc

SEQ ID NO: 8395 - DNA, 22 bp, Artificial Sequence
  chemically synthesized
acaccagtgacttccaccttcc

SEQ ID NO: 8396 - DNA, 22 bp, Artificial Sequence
  chemically synthesized
ccaccttccccactgcagccac

SEQ ID NO: 8397 - DNA, 22 bp, Artificial Sequence
  chemically synthesized
caccttccccactgcagccaca

SEQ ID NO: 8398 - DNA, 22 bp, Artificial Sequence
  chemically synthesized
ccccactgcagccacactcagg

SEQ ID NO: 8399 - DNA, 22 bp, Artificial Sequence
  chemically synthesized
cccactgcagccacactcagga

SEQ ID NO: 8400 - DNA, 22 bp, Artificial Sequence
  chemically synthesized
cagccacactcaggaccccatt

SEQ ID NO: 8401 - DNA, 22 bp, Artificial Sequence
  chemically synthesized
aggaccccatttgacccaggga

SEQ ID NO: 8402 - DNA, 22 bp, Artificial Sequence
  chemically synthesized
gacccagggaggcctctgacac

SEQ ID NO: 8403 - DNA, 22 bp, Artificial Sequence
  chemically synthesized
acccagggaggcctctgacacc

SEQ ID NO: 8404 - DNA, 22 bp, Artificial Sequence
  chemically synthesized
tgacacctccactgcccactcc

SEQ ID NO: 8405 - DNA, 22 bp, Artificial Sequence
  chemically synthesized
acacctccactgcccactcccg

SEQ ID NO: 8406 - DNA, 22 bp, Artificial Sequence
  chemically synthesized
cactgcccactcccgctctgag

SEQ ID NO: 8407 - DNA, 22 bp, Artificial Sequence
  chemically synthesized
cccactcccgctctgagcacag

SEQ ID NO: 8408 - DNA, 22 bp, Artificial Sequence
  chemically synthesized
ccgctctgagcacagccccacc

SEQ ID NO: 8409 - DNA, 22 bp, Artificial Sequence
  chemically synthesized
tgagcacagccccaccctccct

SEQ ID NO: 8410 - DNA, 22 bp, Artificial Sequence
  chemically synthesized
agcacagccccaccctccctct

SEQ ID NO: 8411 - DNA, 22 bp, Artificial Sequence
  chemically synthesized
cctctcactgcccccacccctt

SEQ ID NO: 8412 - DNA, 22 bp, Artificial Sequence
  chemically synthesized
tcactgcccccaccccttcctc

SEQ ID NO: 8413 - DNA, 22 bp, Artificial Sequence
  chemically synthesized
actgcccccaccccttcctcca

SEQ ID NO: 8414 - DNA, 22 bp, Artificial Sequence
  chemically synthesized
cccccaccccttcctccaaggc

SEQ ID NO: 8415 - DNA, 22 bp, Artificial Sequence
  chemically synthesized
cctccaaggcctttgcattcct

SEQ ID NO: 8416 - DNA, 22 bp, Artificial Sequence
  chemically synthesized
ctccaaggcctttgcattcctc

SEQ ID NO: 8417 - DNA, 22 bp, Artificial Sequence
  chemically synthesized
caaggcctttgcattcctctcc

SEQ ID NO: 8418 - DNA, 22 bp, Artificial Sequence
  chemically synthesized
tgcattcctctccatccagaag

SEQ ID NO: 8419 - DNA, 22 bp, Artificial Sequence
  chemically synthesized
gcattcctctccatccagaagc

SEQ ID NO: 8420 - DNA, 22 bp, Artificial Sequence
  chemically synthesized
cattcctctccatccagaagcg

SEQ ID NO: 8421 - DNA, 22 bp, Artificial Sequence
  chemically synthesized
ctctccatccagaagcgctcca

SEQ ID NO: 8422 - DNA, 22 bp, Artificial Sequence
  chemically synthesized
tccatccagaagcgctccatga

SEQ ID NO: 8423 - DNA, 22 bp, Artificial Sequence
  chemically synthesized
catccagaagcgctccatgacc

SEQ ID NO: 8424 - DNA, 22 bp, Artificial Sequence
  chemically synthesized
catgaccacggtgttccccacc

SEQ ID NO: 8425 - DNA, 22 bp, Artificial Sequence
  chemically synthesized
cccaccaagctggccctccatg

SEQ ID NO: 8426 - DNA, 22 bp, Artificial Sequence
  chemically synthesized
gccctccatggctgagtccctg

SEQ ID NO: 8427 - DNA, 22 bp, Artificial Sequence
  chemically synthesized
catggctgagtccctgactgct

SEQ ID NO: 8428 - DNA, 22 bp, Artificial Sequence
  chemically synthesized
agtccctgactgctgtcttcag

SEQ ID NO: 8429 - DNA, 22 bp, Artificial Sequence
  chemically synthesized
actgctgtcttcagcaccctcc

SEQ ID NO: 8430 - DNA, 22 bp, Artificial Sequence
  chemically synthesized
ctgtcttcagcaccctccactc

SEQ ID NO: 8431 - DNA, 22 bp, Artificial Sequence
  chemically synthesized
tcttcagcaccctccactcaga

SEQ ID NO: 8432 - DNA, 22 bp, Artificial Sequence
  chemically synthesized
cagcaccctccactcagagggt

SEQ ID NO: 8433 - DNA, 22 bp, Artificial Sequence
  chemically synthesized
agcaccctccactcagagggtc

SEQ ID NO: 8434 - DNA, 22 bp, Artificial Sequence
  chemically synthesized
cactcagagggtcctgtcctgc

SEQ ID NO: 8435 - DNA, 22 bp, Artificial Sequence
  chemically synthesized
agagggtcctgtcctgcttccc

SEQ ID NO: 8436 - DNA, 22 bp, Artificial Sequence
  chemically synthesized
tcctgcttcccagtccgactta

SEQ ID NO: 8437 - DNA, 22 bp, Artificial Sequence
  chemically synthesized
cttcccagtccgacttatcaac

SEQ ID NO: 8438 - DNA, 22 bp, Artificial Sequence
  chemically synthesized
cccagtccgacttatcaactcc

SEQ ID NO: 8439 - DNA, 22 bp, Artificial Sequence
  chemically synthesized
ccagtccgacttatcaactccc

SEQ ID NO: 8440 - DNA, 22 bp, Artificial Sequence
  chemically synthesized
atcaactcccaatgctgggtca

SEQ ID NO: 8441 - DNA, 22 bp, Artificial Sequence
  chemically synthesized
tcaactcccaatgctgggtcag

SEQ ID NO: 8442 - DNA, 22 bp, Artificial Sequence
  chemically synthesized
ccaatgctgggtcagcccagca

SEQ ID NO: 8443 - DNA, 22 bp, Artificial Sequence
  chemically synthesized
ggtcagcccagcaacgtgtctg

SEQ ID NO: 8444 - DNA, 22 bp, Artificial Sequence
  chemically synthesized
tatatccaccctgaaaccagac

SEQ ID NO: 8445 - DNA, 22 bp, Artificial Sequence
  chemically synthesized
aaaccagactgcccacagggta

SEQ ID NO: 8446 - DNA, 22 bp, Artificial Sequence
  chemically synthesized
cccacagggtagcccagctgtg

SEQ ID NO: 8447 - DNA, 22 bp, Artificial Sequence
  chemically synthesized
tgcctccaggtagctctgagat

SEQ ID NO: 8448 - DNA, 22 bp, Artificial Sequence
  chemically synthesized
caggtagctctgagatcatgca

SEQ ID NO: 8449 - DNA, 22 bp, Artificial Sequence
  chemically synthesized
tgagatcatgcaccagcattca

SEQ ID NO: 8450 - DNA, 22 bp, Artificial Sequence
  chemically synthesized
agatcatgcaccagcattcaat

SEQ ID NO: 8451 - DNA, 22 bp, Artificial Sequence
  chemically synthesized
aatttctccatgcttccatttt

SEQ ID NO: 8452 - DNA, 22 bp, Artificial Sequence
  chemically synthesized
ctccatgcttccattttctcgt

SEQ ID NO: 8453 - DNA, 22 bp, Artificial Sequence
  chemically synthesized
tccatgcttccattttctcgtg

SEQ ID NO: 8454 - DNA, 22 bp, Artificial Sequence
  chemically synthesized
catgcttccattttctcgtgtg

SEQ ID NO: 8455 - DNA, 22 bp, Artificial Sequence
  chemically synthesized
ccattttctcgtgtgtaaaatg

SEQ ID NO: 8456 - DNA, 22 bp, Artificial Sequence
  chemically synthesized
cattttctcgtgtgtaaaatgg

SEQ ID NO: 8457 - DNA, 22 bp, Artificial Sequence
  chemically synthesized
tctcgtgtgtaaaatggagatc

SEQ ID NO: 8458 - DNA, 22 bp, Artificial Sequence
  chemically synthesized
ctcgtgtgtaaaatggagatca

SEQ ID NO: 8459 - DNA, 22 bp, Artificial Sequence
  chemically synthesized
tcgtgtgtaaaatggagatcac

SEQ ID NO: 8460 - DNA, 22 bp, Artificial Sequence
  chemically synthesized
gtgtgtaaaatggagatcacag

SEQ ID NO: 8461 - DNA, 22 bp, Artificial Sequence
  chemically synthesized
cccgattggattgctcggataa

SEQ ID NO: 8462 - DNA, 22 bp, Artificial Sequence
  chemically synthesized
gattgctcggataattagatga

SEQ ID NO: 8463 - DNA, 22 bp, Artificial Sequence
  chemically synthesized
ctcggataattagatgagttaa

SEQ ID NO: 8464 - DNA, 22 bp, Artificial Sequence
  chemically synthesized
ggataattagatgagttaaaat

SEQ ID NO: 8465 - DNA, 22 bp, Artificial Sequence
  chemically synthesized
gatgagttaaaatatgtaatgt

SEQ ID NO: 8466 - DNA, 22 bp, Artificial Sequence
  chemically synthesized
aaatatgtaatgtgcttcttag

SEQ ID NO: 8467 - DNA, 22 bp, Artificial Sequence
  chemically synthesized
cttaggcaaaagtttgaacata

SEQ ID NO: 8468 - DNA, 22 bp, Artificial Sequence
  chemically synthesized
ttaggcaaaagtttgaacataa

SEQ ID NO: 8469 - DNA, 22 bp, Artificial Sequence
  chemically synthesized
aggcaaaagtttgaacataaaa

SEQ ID NO: 8470 - DNA, 22 bp, Artificial Sequence
  chemically synthesized
ggcaaaagtttgaacataaaag

SEQ ID NO: 8471 - DNA, 22 bp, Artificial Sequence
  chemically synthesized
gaacataaaagacagggtctgc

SEQ ID NO: 8472 - DNA, 22 bp, Artificial Sequence
  chemically synthesized
aacataaaagacagggtctgcc

SEQ ID NO: 8473 - DNA, 22 bp, Artificial Sequence
  chemically synthesized
cccaagatgggaagagttcttc

SEQ ID NO: 8474 - DNA, 22 bp, Artificial Sequence
  chemically synthesized
ttctctccccagaaacaatcaa

SEQ ID NO: 8475 - DNA, 22 bp, Artificial Sequence
  chemically synthesized
ctctccccagaaacaatcaaaa

SEQ ID NO: 8476 - DNA, 22 bp, Artificial Sequence
  chemically synthesized
tctccccagaaacaatcaaaac

SEQ ID NO: 8477 - DNA, 22 bp, Artificial Sequence
  chemically synthesized
tccccagaaacaatcaaaacaa

SEQ ID NO: 8478 - DNA, 22 bp, Artificial Sequence
  chemically synthesized
cccagaaacaatcaaaacaaaa

SEQ ID NO: 8479 - DNA, 22 bp, Artificial Sequence
  chemically synthesized
tagaacatggcagctttcaaga

SEQ ID NO: 8480 - DNA, 22 bp, Artificial Sequence
  chemically synthesized
tcaagactctggacatcaggca

SEQ ID NO: 8481 - DNA, 22 bp, Artificial Sequence
  chemically synthesized
caagactctggacatcaggcaa

SEQ ID NO: 8482 - DNA, 22 bp, Artificial Sequence
  chemically synthesized
aagactctggacatcaggcaag

SEQ ID NO: 8483 - DNA, 22 bp, Artificial Sequence
  chemically synthesized
tggacatcaggcaaggaggagt

SEQ ID NO: 8484 - DNA, 22 bp, Artificial Sequence
  chemically synthesized
gacatcaggcaaggaggagtaa

SEQ ID NO: 8485 - DNA, 22 bp, Artificial Sequence
  chemically synthesized
agggataagaagcaaacaacag

SEQ ID NO: 8486 - DNA, 22 bp, Artificial Sequence
  chemically synthesized
cgatcaccccagcttactgttt

SEQ ID NO: 8487 - DNA, 22 bp, Artificial Sequence
  chemically synthesized
actgtttggagagagtctgcag

SEQ ID NO: 8488 - DNA, 22 bp, Artificial Sequence
  chemically synthesized
ctgtttggagagagtctgcagg

SEQ ID NO: 8489 - DNA, 22 bp, Artificial Sequence
  chemically synthesized
tttggagagagtctgcaggtta

SEQ ID NO: 8490 - DNA, 22 bp, Artificial Sequence
  chemically synthesized
ggagagagtctgcaggttacag

SEQ ID NO: 8491 - DNA, 22 bp, Artificial Sequence
  chemically synthesized
gagagagtctgcaggttacagg

SEQ ID NO: 8492 - DNA, 22 bp, Artificial Sequence
  chemically synthesized
caggttacaggccaggaaaggg

SEQ ID NO: 8493 - DNA, 22 bp, Artificial Sequence
  chemically synthesized
caggccaggaaagggaagtcca

SEQ ID NO: 8494 - DNA, 22 bp, Artificial Sequence
  chemically synthesized
cccacgttgaggagatggagct

SEQ ID NO: 8495 - DNA, 22 bp, Artificial Sequence
  chemically synthesized
aggagatggagctgagagtccg

SEQ ID NO: 8496 - DNA, 22 bp, Artificial Sequence
  chemically synthesized
agagtccgaggagaccaaaaca

SEQ ID NO: 8497 - DNA, 22 bp, Artificial Sequence
  chemically synthesized
agagttcaaacgatcaaactga

SEQ ID NO: 8498 - DNA, 22 bp, Artificial Sequence
  chemically synthesized
aaacgatcaaactgactctaag

SEQ ID NO: 8499 - DNA, 22 bp, Artificial Sequence
  chemically synthesized
actctaagttgcttaactgcat

SEQ ID NO: 8500 - DNA, 22 bp, Artificial Sequence
  chemically synthesized
taagttgcttaactgcatcccg

SEQ ID NO: 8501 - DNA, 22 bp, Artificial Sequence
  chemically synthesized
agttgcttaactgcatcccgga

SEQ ID NO: 8502 - DNA, 22 bp, Artificial Sequence
  chemically synthesized
cttaactgcatcccggagcaaa

SEQ ID NO: 8503 - DNA, 22 bp, Artificial Sequence
  chemically synthesized
aactgcatcccggagcaaagct

SEQ ID NO: 8504 - DNA, 22 bp, Artificial Sequence
  chemically synthesized
actgcatcccggagcaaagctc

SEQ ID NO: 8505 - DNA, 22 bp, Artificial Sequence
  chemically synthesized
catcccggagcaaagctcaaga

SEQ ID NO: 8506 - DNA, 22 bp, Artificial Sequence
  chemically synthesized
aagaacatttagaggaatacaa

SEQ ID NO: 8507 - DNA, 22 bp, Artificial Sequence
  chemically synthesized
agaggaatacaaaaatatccag

SEQ ID NO: 8508 - DNA, 22 bp, Artificial Sequence
  chemically synthesized
gaggaatacaaaaatatccagc

SEQ ID NO: 8509 - DNA, 22 bp, Artificial Sequence
  chemically synthesized
acaatgtctggcagccaatcaa

SEQ ID NO: 8510 - DNA, 22 bp, Artificial Sequence
  chemically synthesized
gcagccaatcaaagattacaag

SEQ ID NO: 8511 - DNA, 22 bp, Artificial Sequence
  chemically synthesized
caaggcatgcaatgaaacggga

SEQ ID NO: 8512 - DNA, 22 bp, Artificial Sequence
  chemically synthesized
ataaatatcaaaagagatccag

SEQ ID NO: 8513 - DNA, 22 bp, Artificial Sequence
  chemically synthesized
acacggatgctagaattagcag

SEQ ID NO: 8514 - DNA, 22 bp, Artificial Sequence
  chemically synthesized
gaattagcaggcaaggatggta

SEQ ID NO: 8515 - DNA, 22 bp, Artificial Sequence
  chemically synthesized
gcaggcaaggatggtaaaacag

SEQ ID NO: 8516 - DNA, 22 bp, Artificial Sequence
  chemically synthesized
tagccatatcccattatgttca

SEQ ID NO: 8517 - DNA, 22 bp, Artificial Sequence
  chemically synthesized
tgttcaaaaaattaagtagaat

SEQ ID NO: 8518 - DNA, 22 bp, Artificial Sequence
  chemically synthesized
aaaaaattaagtagaattgtgg

SEQ ID NO: 8519 - DNA, 22 bp, Artificial Sequence
  chemically synthesized
agtagaattgtggaggatattt

SEQ ID NO: 8520 - DNA, 22 bp, Artificial Sequence
  chemically synthesized
tggaggatatttaagagtcccc

SEQ ID NO: 8521 - DNA, 22 bp, Artificial Sequence
  chemically synthesized
aagagtccccaggtgaacttct

SEQ ID NO: 8522 - DNA, 22 bp, Artificial Sequence
  chemically synthesized
agagtccccaggtgaacttcta

SEQ ID NO: 8523 - DNA, 22 bp, Artificial Sequence
  chemically synthesized
ctagagataaaaactacaatgt

SEQ ID NO: 8524 - DNA, 22 bp, Artificial Sequence
  chemically synthesized
tagagataaaaactacaatgtc

SEQ ID NO: 8525 - DNA, 22 bp, Artificial Sequence
  chemically synthesized
gagataaaaactacaatgtctg

SEQ ID NO: 8526 - DNA, 22 bp, Artificial Sequence
  chemically synthesized
caatgtctgaaatgaaaaaaca

SEQ ID NO: 8527 - DNA, 22 bp, Artificial Sequence
  chemically synthesized
aaatgaaaaaacacactggcca

SEQ ID NO: 8528 - DNA, 22 bp, Artificial Sequence
  chemically synthesized
gccaggcgccgtggctcacgcc

SEQ ID NO: 8529 - DNA, 22 bp, Artificial Sequence
  chemically synthesized
acgcctggaatcccagcactgt

SEQ ID NO: 8530 - DNA, 22 bp, Artificial Sequence
  chemically synthesized
gaatcccagcactgtgggaggc

SEQ ID NO: 8531 - DNA, 22 bp, Artificial Sequence
  chemically synthesized
tgggaggccaaggcgggcagat

SEQ ID NO: 8532 - DNA, 22 bp, Artificial Sequence
  chemically synthesized
gctaacatggtgaaaccccatc

SEQ ID NO: 8533 - DNA, 22 bp, Artificial Sequence
  chemically synthesized
acatggtgaaaccccatctcta

SEQ ID NO: 8534 - DNA, 22 bp, Artificial Sequence
  chemically synthesized
tactaaaaatacaaaaaattag

SEQ ID NO: 8535 - DNA, 22 bp, Artificial Sequence
  chemically synthesized
ctaaaaatacaaaaaattagcc

SEQ ID NO: 8536 - DNA, 22 bp, Artificial Sequence
  chemically synthesized
aaaatacaaaaaattagccaga

SEQ ID NO: 8537 - DNA, 22 bp, Artificial Sequence
  chemically synthesized
gccagacgtggtggcaggcgcc

SEQ ID NO: 8538 - DNA, 22 bp, Artificial Sequence
  chemically synthesized
tagtcccagctactcgggaggc

SEQ ID NO: 8539 - DNA, 22 bp, Artificial Sequence
  chemically synthesized
ctcgggaggctgaggcaggaga

SEQ ID NO: 8540 - DNA, 22 bp, Artificial Sequence
  chemically synthesized
gggaggctgaggcaggagaatg

SEQ ID NO: 8541 - DNA, 22 bp, Artificial Sequence
  chemically synthesized
aggcaggagaatggcatgaacc

SEQ ID NO: 8542 - DNA, 22 bp, Artificial Sequence
  chemically synthesized
gcagtgagccaagatcgcgcca

SEQ ID NO: 8543 - DNA, 22 bp, Artificial Sequence
  chemically synthesized
cagtgagccaagatcgcgccac

SEQ ID NO: 8544 - DNA, 22 bp, Artificial Sequence
  chemically synthesized
cactccggcctgggcaacagag

SEQ ID NO: 8545 - DNA, 22 bp, Artificial Sequence
  chemically synthesized
cggcctgggcaacagagcgaga

SEQ ID NO: 8546 - DNA, 22 bp, Artificial Sequence
  chemically synthesized
ggcaacagagcgagactccgcc

SEQ ID NO: 8547 - DNA, 22 bp, Artificial Sequence
  chemically synthesized
cgcctccaaaaaaaaaaaaaag

SEQ ID NO: 8548 - DNA, 22 bp, Artificial Sequence
  chemically synthesized
caaaaaaaaaaaaaagaaaaga

SEQ ID NO: 8549 - DNA, 22 bp, Artificial Sequence
  chemically synthesized
gatggaaataatggaagatgag

SEQ ID NO: 8550 - DNA, 22 bp, Artificial Sequence
  chemically synthesized
agggccaggcactgtggatcac

SEQ ID NO: 8551 - DNA, 22 bp, Artificial Sequence
  chemically synthesized
gggccaggcactgtggatcaca

SEQ ID NO: 8552 - DNA, 22 bp, Artificial Sequence
  chemically synthesized
tggatcacatctgtaatcccag

SEQ ID NO: 8553 - DNA, 22 bp, Artificial Sequence
  chemically synthesized
taatcccagcactttgggaggt

SEQ ID NO: 8554 - DNA, 22 bp, Artificial Sequence
  chemically synthesized
tgggaggtcgacacggggggaa

SEQ ID NO: 8555 - DNA, 22 bp, Artificial Sequence
  chemically synthesized
gggaggtcgacacggggggaat

SEQ ID NO: 8556 - DNA, 22 bp, Artificial Sequence
  chemically synthesized
ggaggtcgacacggggggaatc

SEQ ID NO: 8557 - DNA, 22 bp, Artificial Sequence
  chemically synthesized
gagcccaggagctcaagactag

SEQ ID NO: 8558 - DNA, 22 bp, Artificial Sequence
  chemically synthesized
agcccaggagctcaagactagt

SEQ ID NO: 8559 - DNA, 22 bp, Artificial Sequence
  chemically synthesized
aagactagtctgggcagcatgg

SEQ ID NO: 8560 - DNA, 22 bp, Artificial Sequence
  chemically synthesized
gtctgggcagcatggcaaaacc

SEQ ID NO: 8561 - DNA, 22 bp, Artificial Sequence
  chemically synthesized
ggcagcatggcaaaacccctct

SEQ ID NO: 8562 - DNA, 22 bp, Artificial Sequence
  chemically synthesized
tacatggcaaaaccgtctctac

SEQ ID NO: 8563 - DNA, 22 bp, Artificial Sequence
  chemically synthesized
catggcaaaaccgtctctacaa

SEQ ID NO: 8564 - DNA, 22 bp, Artificial Sequence
  chemically synthesized
tacaaaaaaaaatttttaatta

SEQ ID NO: 8565 - DNA, 22 bp, Artificial Sequence
  chemically synthesized
caaaaaaaaatttttaattagc

SEQ ID NO: 8566 - DNA, 22 bp, Artificial Sequence
  chemically synthesized
ttaattagccaggtgtggtgcc

SEQ ID NO: 8567 - DNA, 22 bp, Artificial Sequence
  chemically synthesized
taattagccaggtgtggtgcca

SEQ ID NO: 8568 - DNA, 22 bp, Artificial Sequence
  chemically synthesized
aattagccaggtgtggtgccac

SEQ ID NO: 8569 - DNA, 22 bp, Artificial Sequence
  chemically synthesized
attagccaggtgtggtgccaca

SEQ ID NO: 8570 - DNA, 22 bp, Artificial Sequence
  chemically synthesized
gccaggtgtggtgccacatgcc

SEQ ID NO: 8571 - DNA, 22 bp, Artificial Sequence
  chemically synthesized
tagtcccagctacctgggaggc

SEQ ID NO: 8572 - DNA, 22 bp, Artificial Sequence
  chemically synthesized
cctgggaggctgaagtggaagg

SEQ ID NO: 8573 - DNA, 22 bp, Artificial Sequence
  chemically synthesized
ggaggctgaagtggaaggatcg

SEQ ID NO: 8574 - DNA, 22 bp, Artificial Sequence
  chemically synthesized
aagtggaaggatcgcctgagcc

SEQ ID NO: 8575 - DNA, 22 bp, Artificial Sequence
  chemically synthesized
agcccaggaggtggaggccaca

SEQ ID NO: 8576 - DNA, 22 bp, Artificial Sequence
  chemically synthesized
tgacaagctactgcattccagc

SEQ ID NO: 8577 - DNA, 22 bp, Artificial Sequence
  chemically synthesized
ctgcattccagcctgggcaaca

SEQ ID NO: 8578 - DNA, 22 bp, Artificial Sequence
  chemically synthesized
cattccagcctgggcaacagag

SEQ ID NO: 8579 - DNA, 22 bp, Artificial Sequence
  chemically synthesized
cagcctgggcaacagagtgaga

SEQ ID NO: 8580 - DNA, 22 bp, Artificial Sequence
  chemically synthesized
ggcaacagagtgagatgagaga

SEQ ID NO: 8581 - DNA, 22 bp, Artificial Sequence
  chemically synthesized
tagttaacttaatgaacagcaa

SEQ ID NO: 8582 - DNA, 22 bp, Artificial Sequence
  chemically synthesized
agttaacttaatgaacagcaat

SEQ ID NO: 8583 - DNA, 22 bp, Artificial Sequence
  chemically synthesized
gttaacttaatgaacagcaata

SEQ ID NO: 8584 - DNA, 22 bp, Artificial Sequence
  chemically synthesized
acttaatgaacagcaataactc

SEQ ID NO: 8585 - DNA, 22 bp, Artificial Sequence
  chemically synthesized
aatgaacagcaataactctata

SEQ ID NO: 8586 - DNA, 22 bp, Artificial Sequence
  chemically synthesized
atgaacagcaataactctataa

SEQ ID NO: 8587 - DNA, 22 bp, Artificial Sequence
  chemically synthesized
tataaaatgaaacactgggaga

SEQ ID NO: 8588 - DNA, 22 bp, Artificial Sequence
  chemically synthesized
taaaatgaaacactgggagaaa

SEQ ID NO: 8589 - DNA, 22 bp, Artificial Sequence
  chemically synthesized
ggagaaaaaagaattaaaaaat

SEQ ID NO: 8590 - DNA, 22 bp, Artificial Sequence
  chemically synthesized
aaaaatggaaagagaatgagtg

SEQ ID NO: 8591 - DNA, 22 bp, Artificial Sequence
  chemically synthesized
tgggacccttaatacatgcata

SEQ ID NO: 8592 - DNA, 22 bp, Artificial Sequence
  chemically synthesized
aatacatgcataattgaaatct

SEQ ID NO: 8593 - DNA, 22 bp, Artificial Sequence
  chemically synthesized
atacatgcataattgaaatctt

SEQ ID NO: 8594 - DNA, 22 bp, Artificial Sequence
  chemically synthesized
aaatctttaaaagaaaaagggg

SEQ ID NO: 8595 - DNA, 22 bp, Artificial Sequence
  chemically synthesized
taaaagaaaaagggggtagcag

SEQ ID NO: 8596 - DNA, 22 bp, Artificial Sequence
  chemically synthesized
aaaagaaaaagggggtagcaga

SEQ ID NO: 8597 - DNA, 22 bp, Artificial Sequence
  chemically synthesized
aaagaaaaagggggtagcagaa

SEQ ID NO: 8598 - DNA, 22 bp, Artificial Sequence
  chemically synthesized
agacaagtggaagatgggcccc

SEQ ID NO: 8599 - DNA, 22 bp, Artificial Sequence
  chemically synthesized
atcagtgtcagctcccatgatg

SEQ ID NO: 8600 - DNA, 22 bp, Artificial Sequence
  chemically synthesized
ccatgatgacgttcccccagcc

SEQ ID NO: 8601 - DNA, 22 bp, Artificial Sequence
  chemically synthesized
ccccagcccccaccacccgggc

SEQ ID NO: 8602 - DNA, 22 bp, Artificial Sequence
  chemically synthesized
ctggagggaaatgcggtgactt

SEQ ID NO: 8603 - DNA, 22 bp, Artificial Sequence
  chemically synthesized
gagggaaatgcggtgactttgc

SEQ ID NO: 8604 - DNA, 22 bp, Artificial Sequence
  chemically synthesized
tgctacatcccttcagacggtc

SEQ ID NO: 8605 - DNA, 22 bp, Artificial Sequence
  chemically synthesized
gctacatcccttcagacggtcc

SEQ ID NO: 8606 - DNA, 22 bp, Artificial Sequence
  chemically synthesized
ctacatcccttcagacggtccc

SEQ ID NO: 8607 - DNA, 22 bp, Artificial Sequence
  chemically synthesized
catcccttcagacggtccctca

SEQ ID NO: 8608 - DNA, 22 bp, Artificial Sequence
  chemically synthesized
cagacggtccctcactggtgtc

SEQ ID NO: 8609 - DNA, 22 bp, Artificial Sequence
  chemically synthesized
agacggtccctcactggtgtcc

SEQ ID NO: 8610 - DNA, 22 bp, Artificial Sequence
  chemically synthesized
actggtgtccctcagcccattc

SEQ ID NO: 8611 - DNA, 22 bp, Artificial Sequence
  chemically synthesized
gtgtccctcagcccattcgcgt

SEQ ID NO: 8612 - DNA, 22 bp, Artificial Sequence
  chemically synthesized
agcccattcgcgtgagctcact

SEQ ID NO: 8613 - DNA, 22 bp, Artificial Sequence
  chemically synthesized
gcgtgagctcactctcccatta

SEQ ID NO: 8614 - DNA, 22 bp, Artificial Sequence
  chemically synthesized
actctcccattaatttcagaaa

SEQ ID NO: 8615 - DNA, 22 bp, Artificial Sequence
  chemically synthesized
tcccattaatttcagaaatcct

SEQ ID NO: 8616 - DNA, 22 bp, Artificial Sequence
  chemically synthesized
ccattaatttcagaaatcctgg

SEQ ID NO: 8617 - DNA, 22 bp, Artificial Sequence
  chemically synthesized
atttcagaaatcctggcctctc

SEQ ID NO: 8618 - DNA, 22 bp, Artificial Sequence
  chemically synthesized
cagaaatcctggcctctctcca

SEQ ID NO: 8619 - DNA, 22 bp, Artificial Sequence
  chemically synthesized
agaaatcctggcctctctccaa

SEQ ID NO: 8620 - DNA, 22 bp, Artificial Sequence
  chemically synthesized
gcctctctccaagcctcctgct

SEQ ID NO: 8621 - DNA, 22 bp, Artificial Sequence
  chemically synthesized
tctccaagcctcctgctcaaac

SEQ ID NO: 8622 - DNA, 22 bp, Artificial Sequence
  chemically synthesized
tccaagcctcctgctcaaactc

SEQ ID NO: 8623 - DNA, 22 bp, Artificial Sequence
  chemically synthesized
caagcctcctgctcaaactcta

SEQ ID NO: 8624 - DNA, 22 bp, Artificial Sequence
  chemically synthesized
ctgctcaaactctaaattctgt

SEQ ID NO: 8625 - DNA, 22 bp, Artificial Sequence
  chemically synthesized
ctcaaactctaaattctgtcac

SEQ ID NO: 8626 - DNA, 22 bp, Artificial Sequence
  chemically synthesized
aaactctaaattctgtcaccct

SEQ ID NO: 8627 - DNA, 22 bp, Artificial Sequence
  chemically synthesized
taaattctgtcaccctcagaag

SEQ ID NO: 8628 - DNA, 22 bp, Artificial Sequence
  chemically synthesized
aattctgtcaccctcagaagat

SEQ ID NO: 8629 - DNA, 22 bp, Artificial Sequence
  chemically synthesized
tgtcaccctcagaagattcagc

SEQ ID NO: 8630 - DNA, 22 bp, Artificial Sequence
  chemically synthesized
tcaccctcagaagattcagcag

SEQ ID NO: 8631 - DNA, 22 bp, Artificial Sequence
  chemically synthesized
agaagattcagcagcatcccgt

SEQ ID NO: 8632 - DNA, 22 bp, Artificial Sequence
  chemically synthesized
agcagcatcccgtattctctct

SEQ ID NO: 8633 - DNA, 22 bp, Artificial Sequence
  chemically synthesized
tctctgagtgttcactatgtac

SEQ ID NO: 8634 - DNA, 22 bp, Artificial Sequence
  chemically synthesized
tctgagtgttcactatgtaccg

SEQ ID NO: 8635 - DNA, 22 bp, Artificial Sequence
  chemically synthesized
tgagtgttcactatgtaccggg

SEQ ID NO: 8636 - DNA, 22 bp, Artificial Sequence
  chemically synthesized
agtgttcactatgtaccgggtg

SEQ ID NO: 8637 - DNA, 22 bp, Artificial Sequence
  chemically synthesized
actatgtaccgggtgccgtgtg

SEQ ID NO: 8638 - DNA, 22 bp, Artificial Sequence
  chemically synthesized
tgtaccgggtgccgtgtgggca

SEQ ID NO: 8639 - DNA, 22 bp, Artificial Sequence
  chemically synthesized
gagttgcagaggagagtgaggc

SEQ ID NO: 8640 - DNA, 22 bp, Artificial Sequence
  chemically synthesized
cagaggagagtgaggcggacag

SEQ ID NO: 8641 - DNA, 22 bp, Artificial Sequence
  chemically synthesized
tgcctgtggggacaccgcctgg

SEQ ID NO: 8642 - DNA, 22 bp, Artificial Sequence
  chemically synthesized
cctgtggggacaccgcctggtg

SEQ ID NO: 8643 - DNA, 22 bp, Artificial Sequence
  chemically synthesized
tggggacaccgcctggtgggaa

SEQ ID NO: 8644 - DNA, 22 bp, Artificial Sequence
  chemically synthesized
gtgggaagtccagccagccccc

SEQ ID NO: 8645 - DNA, 22 bp, Artificial Sequence
  chemically synthesized
cagagagaggagatgctactgg

SEQ ID NO: 8646 - DNA, 22 bp, Artificial Sequence
  chemically synthesized
ctggtgttcctgagtggtcctc

SEQ ID NO: 8647 - DNA, 22 bp, Artificial Sequence
  chemically synthesized
gtgttcctgagtggtcctcggg

SEQ ID NO: 8648 - DNA, 22 bp, Artificial Sequence
  chemically synthesized
ctgagtggtcctcgggagggac

SEQ ID NO: 8649 - DNA, 22 bp, Artificial Sequence
  chemically synthesized
agtggtcctcgggagggacctc

SEQ ID NO: 8650 - DNA, 22 bp, Artificial Sequence
  chemically synthesized
gggagggacctcctatccctcc

SEQ ID NO: 8651 - DNA, 22 bp, Artificial Sequence
  chemically synthesized
ctatccctcctgtcccctgccc

SEQ ID NO: 8652 - DNA, 22 bp, Artificial Sequence
  chemically synthesized
tccctcctgtcccctgccctgc

SEQ ID NO: 8653 - DNA, 22 bp, Artificial Sequence
  chemically synthesized
ctgtcccctgccctgccctgcc

SEQ ID NO: 8654 - DNA, 22 bp, Artificial Sequence
  chemically synthesized
tcccctgccctgccctgcccag

SEQ ID NO: 8655 - DNA, 22 bp, Artificial Sequence
  chemically synthesized
ccctgccctgcccagcaccggc

SEQ ID NO: 8656 - DNA, 22 bp, Artificial Sequence
  chemically synthesized
ccctgcccagcaccggccctcc

SEQ ID NO: 8657 - DNA, 22 bp, Artificial Sequence
  chemically synthesized
cccagcaccggccctccctcgg

SEQ ID NO: 8658 - DNA, 22 bp, Artificial Sequence
  chemically synthesized
cctcggttggccagcctcagga

SEQ ID NO: 8659 - DNA, 22 bp, Artificial Sequence
  chemically synthesized
ggttggccagcctcaggaatga

SEQ ID NO: 8660 - DNA, 22 bp, Artificial Sequence
  chemically synthesized
gccagcctcaggaatgaggagt

SEQ ID NO: 8661 - DNA, 22 bp, Artificial Sequence
  chemically synthesized
aggaatgaggagtccctcattc

SEQ ID NO: 8662 - DNA, 22 bp, Artificial Sequence
  chemically synthesized
attccagcccagctaaccaatc

SEQ ID NO: 8663 - DNA, 22 bp, Artificial Sequence
  chemically synthesized
cagcccagctaaccaatcccct

SEQ ID NO: 8664 - DNA, 22 bp, Artificial Sequence
  chemically synthesized
accaatccccttcctaagctcc

SEQ ID NO: 8665 - DNA, 22 bp, Artificial Sequence
  chemically synthesized
cctaagctccaagcccctgctc

SEQ ID NO: 8666 - DNA, 22 bp, Artificial Sequence
  chemically synthesized
ctaagctccaagcccctgctcc

SEQ ID NO: 8667 - DNA, 22 bp, Artificial Sequence
  chemically synthesized
agctccaagcccctgctcctcc

SEQ ID NO: 8668 - DNA, 22 bp, Artificial Sequence
  chemically synthesized
caagcccctgctcctcctgcct

SEQ ID NO: 8669 - DNA, 22 bp, Artificial Sequence
  chemically synthesized
ctcctcctgcctccatggaacc

SEQ ID NO: 8670 - DNA, 22 bp, Artificial Sequence
  chemically synthesized
ctcctgcctccatggaacccgg

SEQ ID NO: 8671 - DNA, 22 bp, Artificial Sequence
  chemically synthesized
ctgcctccatggaacccggctc

SEQ ID NO: 8672 - DNA, 22 bp, Artificial Sequence
  chemically synthesized
cctccatggaacccggctccac

SEQ ID NO: 8673 - DNA, 22 bp, Artificial Sequence
  chemically synthesized
catggaacccggctccaccacc

SEQ ID NO: 8674 - DNA, 22 bp, Artificial Sequence
  chemically synthesized
caccaccagcacccacacacct

SEQ ID NO: 8675 - DNA, 22 bp, Artificial Sequence
  chemically synthesized
acactcctccattcctggctct

SEQ ID NO: 8676 - DNA, 22 bp, Artificial Sequence
  chemically synthesized
ctccattcctggctcttgccct

SEQ ID NO: 8677 - DNA, 22 bp, Artificial Sequence
  chemically synthesized
cattcctggctcttgcccttct

SEQ ID NO: 8678 - DNA, 22 bp, Artificial Sequence
  chemically synthesized
ctggctcttgcccttctgccta

SEQ ID NO: 8679 - DNA, 22 bp, Artificial Sequence
  chemically synthesized
gctcttgcccttctgcctagca

SEQ ID NO: 8680 - DNA, 22 bp, Artificial Sequence
  chemically synthesized
ttgcccttctgcctagcactgc

SEQ ID NO: 8681 - DNA, 22 bp, Artificial Sequence
  chemically synthesized
gcccttctgcctagcactgctc

SEQ ID NO: 8682 - DNA, 22 bp, Artificial Sequence
  chemically synthesized
cccttctgcctagcactgctca

SEQ ID NO: 8683 - DNA, 22 bp, Artificial Sequence
  chemically synthesized
ctgcctagcactgctcagatct

SEQ ID NO: 8684 - DNA, 22 bp, Artificial Sequence
  chemically synthesized
tgcctagcactgctcagatctc

SEQ ID NO: 8685 - DNA, 22 bp, Artificial Sequence
  chemically synthesized
cctagcactgctcagatctctc

SEQ ID NO: 8686 - DNA, 22 bp, Artificial Sequence
  chemically synthesized
gcactgctcagatctctctcac

SEQ ID NO: 8687 - DNA, 22 bp, Artificial Sequence
  chemically synthesized
ctcagatctctctcaccttaaa

SEQ ID NO: 8688 - DNA, 22 bp, Artificial Sequence
  chemically synthesized
agatctctctcaccttaaaatc

SEQ ID NO: 8689 - DNA, 22 bp, Artificial Sequence
  chemically synthesized
tctcaccttaaaatcttttccc

SEQ ID NO: 8690 - DNA, 22 bp, Artificial Sequence
  chemically synthesized
tcaccttaaaatcttttcccac

SEQ ID NO: 8691 - DNA, 22 bp, Artificial Sequence
  chemically synthesized
accttaaaatcttttcccacca

SEQ ID NO: 8692 - DNA, 22 bp, Artificial Sequence
  chemically synthesized
aaaatcttttcccaccagcctg

SEQ ID NO: 8693 - DNA, 22 bp, Artificial Sequence
  chemically synthesized
aaatcttttcccaccagcctgg

SEQ ID NO: 8694 - DNA, 22 bp, Artificial Sequence
  chemically synthesized
ttcccaccagcctgggcaacat

SEQ ID NO: 8695 - DNA, 22 bp, Artificial Sequence
  chemically synthesized
tcccaccagcctgggcaacata

SEQ ID NO: 8696 - DNA, 22 bp, Artificial Sequence
  chemically synthesized
cccaccagcctgggcaacatag

SEQ ID NO: 8697 - DNA, 22 bp, Artificial Sequence
  chemically synthesized
ccaccagcctgggcaacatagc

SEQ ID NO: 8698 - DNA, 22 bp, Artificial Sequence
  chemically synthesized
ggcaacatagcaagaccccatt

SEQ ID NO: 8699 - DNA, 22 bp, Artificial Sequence
  chemically synthesized
ctctaaaaaattttttttaatt

SEQ ID NO: 8700 - DNA, 22 bp, Artificial Sequence
  chemically synthesized
tctaaaaaattttttttaattt

SEQ ID NO: 8701 - DNA, 22 bp, Artificial Sequence
  chemically synthesized
taaaaaattttttttaatttgc

SEQ ID NO: 8702 - DNA, 22 bp, Artificial Sequence
  chemically synthesized
aaaaattttttttaatttgcca

SEQ ID NO: 8703 - DNA, 22 bp, Artificial Sequence
  chemically synthesized
tttttaatttgccaggcacagt

SEQ ID NO: 8704 - DNA, 22 bp, Artificial Sequence
  chemically synthesized
ttttaatttgccaggcacagtg

SEQ ID NO: 8705 - DNA, 22 bp, Artificial Sequence
  chemically synthesized
tttaatttgccaggcacagtgg

SEQ ID NO: 8706 - DNA, 22 bp, Artificial Sequence
  chemically synthesized
ttaatttgccaggcacagtggt

SEQ ID NO: 8707 - DNA, 22 bp, Artificial Sequence
  chemically synthesized
taatttgccaggcacagtggtg

SEQ ID NO: 8708 - DNA, 22 bp, Artificial Sequence
  chemically synthesized
aatttgccaggcacagtggtgc

SEQ ID NO: 8709 - DNA, 22 bp, Artificial Sequence
  chemically synthesized
atttgccaggcacagtggtgca

SEQ ID NO: 8710 - DNA, 22 bp, Artificial Sequence
  chemically synthesized
gccaggcacagtggtgcacacc

SEQ ID NO: 8711 - DNA, 22 bp, Artificial Sequence
  chemically synthesized
ccaggcacagtggtgcacacct

SEQ ID NO: 8712 - DNA, 22 bp, Artificial Sequence
  chemically synthesized
taagtcctaactacttgggagg

SEQ ID NO: 8713 - DNA, 22 bp, Artificial Sequence
  chemically synthesized
actacttgggaggctgaggtgg

SEQ ID NO: 8714 - DNA, 22 bp, Artificial Sequence
  chemically synthesized
cttgggaggctgaggtgggagg

SEQ ID NO: 8715 - DNA, 22 bp, Artificial Sequence
  chemically synthesized
gggaggctgaggtgggaggatg

SEQ ID NO: 8716 - DNA, 22 bp, Artificial Sequence
  chemically synthesized
ggaggctgaggtgggaggatgg

SEQ ID NO: 8717 - DNA, 22 bp, Artificial Sequence
  chemically synthesized
aggtgggaggatggcttgagcc

SEQ ID NO: 8718 - DNA, 22 bp, Artificial Sequence
  chemically synthesized
gagcccaggagttcgaggttgc

SEQ ID NO: 8719 - DNA, 22 bp, Artificial Sequence
  chemically synthesized
agcccaggagttcgaggttgca

SEQ ID NO: 8720 - DNA, 22 bp, Artificial Sequence
  chemically synthesized
gaggttgcagtgagctatgatc

SEQ ID NO: 8721 - DNA, 22 bp, Artificial Sequence
  chemically synthesized
cagtgagctatgatcctgccac

SEQ ID NO: 8722 - DNA, 22 bp, Artificial Sequence
  chemically synthesized
tgatcctgccactacactcctg

SEQ ID NO: 8723 - DNA, 22 bp, Artificial Sequence
  chemically synthesized
ccactacactcctgtctctaaa

SEQ ID NO: 8724 - DNA, 22 bp, Artificial Sequence
  chemically synthesized
cactcctgtctctaaaaaaaaa

SEQ ID NO: 8725 - DNA, 22 bp, Artificial Sequence
  chemically synthesized
ctgtctctaaaaaaaaaatgtc

SEQ ID NO: 8726 - DNA, 22 bp, Artificial Sequence
  chemically synthesized
tctctaaaaaaaaaatgtccaa

SEQ ID NO: 8727 - DNA, 22 bp, Artificial Sequence
  chemically synthesized
taaaaaaaaaatgtccaagata

SEQ ID NO: 8728 - DNA, 22 bp, Artificial Sequence
  chemically synthesized
aaaaaaaaatgtccaagatact

SEQ ID NO: 8729 - DNA, 22 bp, Artificial Sequence
  chemically synthesized
aggtccttcagtcaagatttat

SEQ ID NO: 8730 - DNA, 22 bp, Artificial Sequence
  chemically synthesized
ggtccttcagtcaagatttatt

SEQ ID NO: 8731 - DNA, 22 bp, Artificial Sequence
  chemically synthesized
cagtcaagatttattacagaag

SEQ ID NO: 8732 - DNA, 22 bp, Artificial Sequence
  chemically synthesized
agtcaagatttattacagaagg

SEQ ID NO: 8733 - DNA, 22 bp, Artificial Sequence
  chemically synthesized
attacagaaggatccagggaag

SEQ ID NO: 8734 - DNA, 22 bp, Artificial Sequence
  chemically synthesized
ttacagaaggatccagggaagg

SEQ ID NO: 8735 - DNA, 22 bp, Artificial Sequence
  chemically synthesized
cagaaggatccagggaagggtc

SEQ ID NO: 8736 - DNA, 22 bp, Artificial Sequence
  chemically synthesized
gggagatgagaggagcagggat

SEQ ID NO: 8737 - DNA, 22 bp, Artificial Sequence
  chemically synthesized
ggagatgagaggagcagggatc

SEQ ID NO: 8738 - DNA, 22 bp, Artificial Sequence
  chemically synthesized
ccaggatctctctgtgctcacg

SEQ ID NO: 8739 - DNA, 22 bp, Artificial Sequence
  chemically synthesized
caggatctctctgtgctcacgt

SEQ ID NO: 8740 - DNA, 22 bp, Artificial Sequence
  chemically synthesized
tctgtgctcacgtcccccaccc

SEQ ID NO: 8741 - DNA, 22 bp, Artificial Sequence
  chemically synthesized
tgtgctcacgtcccccacccat

SEQ ID NO: 8742 - DNA, 22 bp, Artificial Sequence
  chemically synthesized
tgctcacgtcccccacccatcc

SEQ ID NO: 8743 - DNA, 22 bp, Artificial Sequence
  chemically synthesized
acgtcccccacccatcccaact

SEQ ID NO: 8744 - DNA, 22 bp, Artificial Sequence
  chemically synthesized
accccacctctacacacacaca

SEQ ID NO: 8745 - DNA, 22 bp, Artificial Sequence
  chemically synthesized
tacacacacacacacacacaca

SEQ ID NO: 8746 - DNA, 22 bp, Artificial Sequence
  chemically synthesized
cacacacacacacacacacata

SEQ ID NO: 8747 - DNA, 22 bp, Artificial Sequence
  chemically synthesized
acacacacactcacgcaacaca

SEQ ID NO: 8748 - DNA, 22 bp, Artificial Sequence
  chemically synthesized
acgcaacacactcacacacaca

SEQ ID NO: 8749 - DNA, 22 bp, Artificial Sequence
  chemically synthesized
acacacacaacatacataacac

SEQ ID NO: 8750 - DNA, 22 bp, Artificial Sequence
  chemically synthesized
acaacatacacacacaacacac

SEQ ID NO: 8751 - DNA, 22 bp, Artificial Sequence
  chemically synthesized
gcacaacatacacacacgcaca

SEQ ID NO: 8752 - DNA, 22 bp, Artificial Sequence
  chemically synthesized
acacaacacacaaacatacata

SEQ ID NO: 8753 - DNA, 22 bp, Artificial Sequence
  chemically synthesized
acacaatacacacacacaacac

SEQ ID NO: 8754 - DNA, 22 bp, Artificial Sequence
  chemically synthesized
atacacaacatacatacacaca

SEQ ID NO: 8755 - DNA, 22 bp, Artificial Sequence
  chemically synthesized
acatacacaacatacactcgca

SEQ ID NO: 8756 - DNA, 22 bp, Artificial Sequence
  chemically synthesized
gcacaacatacacacatgcaca

SEQ ID NO: 8757 - DNA, 22 bp, Artificial Sequence
  chemically synthesized
acacacaagatacacacaacat

SEQ ID NO: 8758 - DNA, 22 bp, Artificial Sequence
  chemically synthesized
acacaacatacacacacaacac

SEQ ID NO: 8759 - DNA, 22 bp, Artificial Sequence
  chemically synthesized
tcacacacaacataccctctca

SEQ ID NO: 8760 - DNA, 22 bp, Artificial Sequence
  chemically synthesized
acacacaacataccctctcaca

SEQ ID NO: 8761 - DNA, 22 bp, Artificial Sequence
  chemically synthesized
tcacatacacgacatacacaca

SEQ ID NO: 8762 - DNA, 22 bp, Artificial Sequence
  chemically synthesized
acatacacgacatacacacaca

SEQ ID NO: 8763 - DNA, 22 bp, Artificial Sequence
  chemically synthesized
tcgcgcacatatacacacacac

SEQ ID NO: 8764 - DNA, 22 bp, Artificial Sequence
  chemically synthesized
gcgcacatatacacacacacaa

SEQ ID NO: 8765 - DNA, 22 bp, Artificial Sequence
  chemically synthesized
actcacacacacacacagagtc

SEQ ID NO: 8766 - DNA, 22 bp, Artificial Sequence
  chemically synthesized
acacacacacacagagtcccag

SEQ ID NO: 8767 - DNA, 22 bp, Artificial Sequence
  chemically synthesized
aatctgcattcctcatatgcac

SEQ ID NO: 8768 - DNA, 22 bp, Artificial Sequence
  chemically synthesized
cattcctcatatgcacatacgt

SEQ ID NO: 8769 - DNA, 22 bp, Artificial Sequence
  chemically synthesized
ctcatatgcacatacgtgcaca

SEQ ID NO: 8770 - DNA, 22 bp, Artificial Sequence
  chemically synthesized
atatgcacatacgtgcacacgc

SEQ ID NO: 8771 - DNA, 22 bp, Artificial Sequence
  chemically synthesized
ttgggttgggaggagaagggca

SEQ ID NO: 8772 - DNA, 22 bp, Artificial Sequence
  chemically synthesized
gggttgggaggagaagggcagg

SEQ ID NO: 8773 - DNA, 22 bp, Artificial Sequence
  chemically synthesized
ggttgggaggagaagggcaggc

SEQ ID NO: 8774 - DNA, 22 bp, Artificial Sequence
  chemically synthesized
ggaggagaagggcaggcagtta

SEQ ID NO: 8775 - DNA, 22 bp, Artificial Sequence
  chemically synthesized
tcttccagatctccccacacct

SEQ ID NO: 8776 - DNA, 22 bp, Artificial Sequence
  chemically synthesized
ccagatctccccacacctctgg

SEQ ID NO: 8777 - DNA, 22 bp, Artificial Sequence
  chemically synthesized
cagatctccccacacctctggc

SEQ ID NO: 8778 - DNA, 22 bp, Artificial Sequence
  chemically synthesized
cccacacctctggcacatgcct

SEQ ID NO: 8779 - DNA, 22 bp, Artificial Sequence
  chemically synthesized
tggcacatgcctttcctggggt

SEQ ID NO: 8780 - DNA, 22 bp, Artificial Sequence
  chemically synthesized
gcacatgcctttcctggggtcc

SEQ ID NO: 8781 - DNA, 22 bp, Artificial Sequence
  chemically synthesized
tcctggggtcctggggtagaca

SEQ ID NO: 8782 - DNA, 22 bp, Artificial Sequence
  chemically synthesized
cctggggtcctggggtagacag

SEQ ID NO: 8783 - DNA, 22 bp, Artificial Sequence
  chemically synthesized
ctggggtcctggggtagacagg

SEQ ID NO: 8784 - DNA, 22 bp, Artificial Sequence
  chemically synthesized
gggtcctggggtagacaggaag

SEQ ID NO: 8785 - DNA, 22 bp, Artificial Sequence
  chemically synthesized
gggtagacaggaaggtgaggtg

SEQ ID NO: 8786 - DNA, 22 bp, Artificial Sequence
  chemically synthesized
ctcagtccctgttcacagagtg

SEQ ID NO: 8787 - DNA, 22 bp, Artificial Sequence
  chemically synthesized
agtccctgttcacagagtgggt

SEQ ID NO: 8788 - DNA, 22 bp, Artificial Sequence
  chemically synthesized
ttcacagagtgggtgcggcaga

SEQ ID NO: 8789 - DNA, 22 bp, Artificial Sequence
  chemically synthesized
acagagtgggtgcggcagagac

SEQ ID NO: 8790 - DNA, 22 bp, Artificial Sequence
  chemically synthesized
aaagggacagagcaatcatgag

SEQ ID NO: 8791 - DNA, 22 bp, Artificial Sequence
  chemically synthesized
agacagagggggagcaaagccg

SEQ ID NO: 8792 - DNA, 22 bp, Artificial Sequence
  chemically synthesized
cacacttgcctttcaaaaatgg

SEQ ID NO: 8793 - DNA, 22 bp, Artificial Sequence
  chemically synthesized
gcctttcaaaaatggatttcct

SEQ ID NO: 8794 - DNA, 22 bp, Artificial Sequence
  chemically synthesized
cctttcaaaaatggatttcctc

SEQ ID NO: 8795 - DNA, 22 bp, Artificial Sequence
  chemically synthesized
tcaaaaatggatttcctctcct

SEQ ID NO: 8796 - DNA, 22 bp, Artificial Sequence
  chemically synthesized
caaaaatggatttcctctcctg

SEQ ID NO: 8797 - DNA, 22 bp, Artificial Sequence
  chemically synthesized
aaaaatggatttcctctcctgg

SEQ ID NO: 8798 - DNA, 22 bp, Artificial Sequence
  chemically synthesized
cctctcctgggattcagcctgc

SEQ ID NO: 8799 - DNA, 22 bp, Artificial Sequence
  chemically synthesized
ctctcctgggattcagcctgcg

SEQ ID NO: 8800 - DNA, 22 bp, Artificial Sequence
  chemically synthesized
tcctgggattcagcctgcgagt

SEQ ID NO: 8801 - DNA, 22 bp, Artificial Sequence
  chemically synthesized
ctgggattcagcctgcgagtgc

SEQ ID NO: 8802 - DNA, 22 bp, Artificial Sequence
  chemically synthesized
ggattcagcctgcgagtgcctg

SEQ ID NO: 8803 - DNA, 22 bp, Artificial Sequence
  chemically synthesized
agcctgcgagtgcctggcccct

SEQ ID NO: 8804 - DNA, 22 bp, Artificial Sequence
  chemically synthesized
cgagtgcctggcccctcacctt

SEQ ID NO: 8805 - DNA, 22 bp, Artificial Sequence
  chemically synthesized
gcccctcaccttgatggaaagg

SEQ ID NO: 8806 - DNA, 22 bp, Artificial Sequence
  chemically synthesized
accttgatggaaaggatggtca

SEQ ID NO: 8807 - DNA, 22 bp, Artificial Sequence
  chemically synthesized
gatggaaaggatggtcattttc

SEQ ID NO: 8808 - DNA, 22 bp, Artificial Sequence
  chemically synthesized
atggaaaggatggtcattttcc

SEQ ID NO: 8809 - DNA, 22 bp, Artificial Sequence
  chemically synthesized
tcctccgagctcagctgctgga

SEQ ID NO: 8810 - DNA, 22 bp, Artificial Sequence
  chemically synthesized
cctccgagctcagctgctggat

SEQ ID NO: 8811 - DNA, 22 bp, Artificial Sequence
  chemically synthesized
ctccgagctcagctgctggata

SEQ ID NO: 8812 - DNA, 22 bp, Artificial Sequence
  chemically synthesized
cgagctcagctgctggatatct

SEQ ID NO: 8813 - DNA, 22 bp, Artificial Sequence
  chemically synthesized
agctgctggatatcttgaaagt

SEQ ID NO: 8814 - DNA, 22 bp, Artificial Sequence
  chemically synthesized
ctggatatcttgaaagtccttg

SEQ ID NO: 8815 - DNA, 22 bp, Artificial Sequence
  chemically synthesized
gatatcttgaaagtccttggcc

SEQ ID NO: 8816 - DNA, 22 bp, Artificial Sequence
  chemically synthesized
gaaagtccttggccatgatggg

SEQ ID NO: 8817 - DNA, 22 bp, Artificial Sequence
  chemically synthesized
aaagtccttggccatgatgggg

SEQ ID NO: 8818 - DNA, 22 bp, Artificial Sequence
  chemically synthesized
ggccatgatggggcccgggctg

SEQ ID NO: 8819 - DNA, 22 bp, Artificial Sequence
  chemically synthesized
gccatgatggggcccgggctgg

SEQ ID NO: 8820 - DNA, 22 bp, Artificial Sequence
  chemically synthesized
gagctggagctggagctgggct

SEQ ID NO: 8821 - DNA, 22 bp, Artificial Sequence
  chemically synthesized
gagctggagctgggctgggctg

SEQ ID NO: 8822 - DNA, 22 bp, Artificial Sequence
  chemically synthesized
gagctgggctgggctgggctga

SEQ ID NO: 8823 - DNA, 22 bp, Artificial Sequence
  chemically synthesized
ggctgggctgggctgaggttgc

SEQ ID NO: 8824 - DNA, 22 bp, Artificial Sequence
  chemically synthesized
ggctgggctgaggttgctctga

SEQ ID NO: 8825 - DNA, 22 bp, Artificial Sequence
  chemically synthesized
ggctgaggttgctctgagggct

SEQ ID NO: 8826 - DNA, 22 bp, Artificial Sequence
  chemically synthesized
aggttgctctgagggctggggc

SEQ ID NO: 8827 - DNA, 22 bp, Artificial Sequence
  chemically synthesized
ctctgagggctggggctggggc

SEQ ID NO: 8828 - DNA, 22 bp, Artificial Sequence
  chemically synthesized
tgagggctggggctggggcaga

SEQ ID NO: 8829 - DNA, 22 bp, Artificial Sequence
  chemically synthesized
agggctggggctggggcagagg

SEQ ID NO: 8830 - DNA, 22 bp, Artificial Sequence
  chemically synthesized
gggctggggcagaggtgcagat

SEQ ID NO: 8831 - DNA, 22 bp, Artificial Sequence
  chemically synthesized
gggcagaggtgcagattcacgt

SEQ ID NO: 8832 - DNA, 22 bp, Artificial Sequence
  chemically synthesized
acgtggaggttgatggtgggat

SEQ ID NO: 8833 - DNA, 22 bp, Artificial Sequence
  chemically synthesized
atggtgggatggaacgcagggt

SEQ ID NO: 8834 - DNA, 22 bp, Artificial Sequence
  chemically synthesized
ggggtggtggcctgggtaggat

SEQ ID NO: 8835 - DNA, 22 bp, Artificial Sequence
  chemically synthesized
agatcctacccaggccaccacc

SEQ ID NO: 8836 - DNA, 22 bp, Artificial Sequence
  chemically synthesized
cccaggccaccaccccgaaccc

SEQ ID NO: 8837 - DNA, 22 bp, Artificial Sequence
  chemically synthesized
cgaccctgcgttccatcccacc

SEQ ID NO: 8838 - DNA, 22 bp, Artificial Sequence
  chemically synthesized
cgttccatcccaccatcaacct

SEQ ID NO: 8839 - DNA, 22 bp, Artificial Sequence
  chemically synthesized
catcccaccatcaacctccacg

SEQ ID NO: 8840 - DNA, 22 bp, Artificial Sequence
  chemically synthesized
cacgtgaatctgcacctctgcc

SEQ ID NO: 8841 - DNA, 22 bp, Artificial Sequence
  chemically synthesized
cacctctgccccagccccagcc

SEQ ID NO: 8842 - DNA, 22 bp, Artificial Sequence
  chemically synthesized
tgccccagccccagccctcaga

SEQ ID NO: 8843 - DNA, 22 bp, Artificial Sequence
  chemically synthesized
ccccagccccagccctcagagc

SEQ ID NO: 8844 - DNA, 22 bp, Artificial Sequence
  chemically synthesized
agagcaacctcagcccagccca

SEQ ID NO: 8845 - DNA, 22 bp, Artificial Sequence
  chemically synthesized
agcccagcccagcccagctcca

SEQ ID NO: 8846 - DNA, 22 bp, Artificial Sequence
  chemically synthesized
cagctccagctccagcccgggc

SEQ ID NO: 8847 - DNA, 22 bp, Artificial Sequence
  chemically synthesized
cagctccagcccgggccccatc

SEQ ID NO: 8848 - DNA, 22 bp, Artificial Sequence
  chemically synthesized
cagcccgggccccatcatggcc

SEQ ID NO: 8849 - DNA, 22 bp, Artificial Sequence
  chemically synthesized
tcaagatatccagcagctgagc

SEQ ID NO: 8850 - DNA, 22 bp, Artificial Sequence
  chemically synthesized
caagatatccagcagctgagct

SEQ ID NO: 8851 - DNA, 22 bp, Artificial Sequence
  chemically synthesized
aagatatccagcagctgagctc

SEQ ID NO: 8852 - DNA, 22 bp, Artificial Sequence
  chemically synthesized
agctcggaggaaaatgaccatc

SEQ ID NO: 8853 - DNA, 22 bp, Artificial Sequence
  chemically synthesized
ggaggaaaatgaccatcctttc

SEQ ID NO: 8854 - DNA, 22 bp, Artificial Sequence
  chemically synthesized
tccatcaaggtgaggggccagg

SEQ ID NO: 8855 - DNA, 22 bp, Artificial Sequence
  chemically synthesized
ccatcaaggtgaggggccaggc

SEQ ID NO: 8856 - DNA, 22 bp, Artificial Sequence
  chemically synthesized
catcaaggtgaggggccaggca

SEQ ID NO: 8857 - DNA, 22 bp, Artificial Sequence
  chemically synthesized
gcaggctgaatcccaggagagg

SEQ ID NO: 8858 - DNA, 22 bp, Artificial Sequence
  chemically synthesized
aatcccaggagaggaaatccat

SEQ ID NO: 8859 - DNA, 22 bp, Artificial Sequence
  chemically synthesized
ttgaaaggcaagtgtgcagttt

SEQ ID NO: 8860 - DNA, 22 bp, Artificial Sequence
  chemically synthesized
tgaaaggcaagtgtgcagtttc

SEQ ID NO: 8861 - DNA, 22 bp, Artificial Sequence
  chemically synthesized
gaaaggcaagtgtgcagtttct

SEQ ID NO: 8862 - DNA, 22 bp, Artificial Sequence
  chemically synthesized
aaaggcaagtgtgcagtttctg

SEQ ID NO: 8863 - DNA, 22 bp, Artificial Sequence
  chemically synthesized
ctgcggctttgctccccctctg

SEQ ID NO: 8864 - DNA, 22 bp, Artificial Sequence
  chemically synthesized
tgcggctttgctccccctctgt

SEQ ID NO: 8865 - DNA, 22 bp, Artificial Sequence
  chemically synthesized
cggctttgctccccctctgtct

SEQ ID NO: 8866 - DNA, 22 bp, Artificial Sequence
  chemically synthesized
tgctccccctctgtctcagctc

SEQ ID NO: 8867 - DNA, 22 bp, Artificial Sequence
  chemically synthesized
gctccccctctgtctcagctca

SEQ ID NO: 8868 - DNA, 22 bp, Artificial Sequence
  chemically synthesized
ctccccctctgtctcagctcat

SEQ ID NO: 8869 - DNA, 22 bp, Artificial Sequence
  chemically synthesized
cccctctgtctcagctcatgat

SEQ ID NO: 8870 - DNA, 22 bp, Artificial Sequence
  chemically synthesized
tgtctcagctcatgattgctct

SEQ ID NO: 8871 - DNA, 22 bp, Artificial Sequence
  chemically synthesized
tctcagctcatgattgctctgt

SEQ ID NO: 8872 - DNA, 22 bp, Artificial Sequence
  chemically synthesized
agctcatgattgctctgtccct

SEQ ID NO: 8873 - DNA, 22 bp, Artificial Sequence
  chemically synthesized
atgattgctctgtccctttgag

SEQ ID NO: 8874 - DNA, 22 bp, Artificial Sequence
  chemically synthesized
ctctgtccctttgaggtctctg

SEQ ID NO: 8875 - DNA, 22 bp, Artificial Sequence
  chemically synthesized
tgtccctttgaggtctctgccg

SEQ ID NO: 8876 - DNA, 22 bp, Artificial Sequence
  chemically synthesized
tccctttgaggtctctgccgca

SEQ ID NO: 8877 - DNA, 22 bp, Artificial Sequence
  chemically synthesized
tgaggtctctgccgcacccact

SEQ ID NO: 8878 - DNA, 22 bp, Artificial Sequence
  chemically synthesized
gaggtctctgccgcacccactc

SEQ ID NO: 8879 - DNA, 22 bp, Artificial Sequence
  chemically synthesized
aggtctctgccgcacccactct

SEQ ID NO: 8880 - DNA, 22 bp, Artificial Sequence
  chemically synthesized
tgccgcacccactctgtgaaca

SEQ ID NO: 8881 - DNA, 22 bp, Artificial Sequence
  chemically synthesized
ccgcacccactctgtgaacagg

SEQ ID NO: 8882 - DNA, 22 bp, Artificial Sequence
  chemically synthesized
tgtgaacagggactgaggaggg

SEQ ID NO: 8883 - DNA, 22 bp, Artificial Sequence
  chemically synthesized
tgaacagggactgaggagggcc

SEQ ID NO: 8884 - DNA, 22 bp, Artificial Sequence
  chemically synthesized
aggagggcccgacacccccgct

SEQ ID NO: 8885 - DNA, 22 bp, Artificial Sequence
  chemically synthesized
gttccctcacctcaccttcctg

SEQ ID NO: 8886 - DNA, 22 bp, Artificial Sequence
  chemically synthesized
ttccctcacctcaccttcctgt

SEQ ID NO: 8887 - DNA, 22 bp, Artificial Sequence
  chemically synthesized
cctcacctcaccttcctgtcta

SEQ ID NO: 8888 - DNA, 22 bp, Artificial Sequence
  chemically synthesized
acctcaccttcctgtctacccc

SEQ ID NO: 8889 - DNA, 22 bp, Artificial Sequence
  chemically synthesized
accttcctgtctaccccaggac

SEQ ID NO: 8890 - DNA, 22 bp, Artificial Sequence
  chemically synthesized
cctgtctaccccaggaccccag

SEQ ID NO: 8891 - DNA, 22 bp, Artificial Sequence
  chemically synthesized
ctgtctaccccaggaccccagg

SEQ ID NO: 8892 - DNA, 22 bp, Artificial Sequence
  chemically synthesized
tctaccccaggaccccaggaaa

SEQ ID NO: 8893 - DNA, 22 bp, Artificial Sequence
  chemically synthesized
ccccaggaccccaggaaaggca

SEQ ID NO: 8894 - DNA, 22 bp, Artificial Sequence
  chemically synthesized
gaagataactgcctgcccttct

SEQ ID NO: 8895 - DNA, 22 bp, Artificial Sequence
  chemically synthesized
cctgcccttctcctcccaaccc

SEQ ID NO: 8896 - DNA, 22 bp, Artificial Sequence
  chemically synthesized
cccttctcctcccaacccaaga

SEQ ID NO: 8897 - DNA, 22 bp, Artificial Sequence
  chemically synthesized
ctcctcccaacccaagaacaca

SEQ ID NO: 8898 - DNA, 22 bp, Artificial Sequence
  chemically synthesized
tcctcccaacccaagaacacat

SEQ ID NO: 8899 - DNA, 22 bp, Artificial Sequence
  chemically synthesized
ctcccaacccaagaacacatgt

SEQ ID NO: 8900 - DNA, 22 bp, Artificial Sequence
  chemically synthesized
ccaacccaagaacacatgtgcc

SEQ ID NO: 8901 - DNA, 22 bp, Artificial Sequence
  chemically synthesized
gtatgtgcgtgtgcacgtatgt

SEQ ID NO: 8902 - DNA, 22 bp, Artificial Sequence
  chemically synthesized
agctgggactctgtgtgtgtgt

SEQ ID NO: 8903 - DNA, 22 bp, Artificial Sequence
  chemically synthesized
ggactctgtgtgtgtgtgtgag

SEQ ID NO: 8904 - DNA, 22 bp, Artificial Sequence
  chemically synthesized
tgtgtgtgtgtgtgagtgaatg

SEQ ID NO: 8905 - DNA, 22 bp, Artificial Sequence
  chemically synthesized
tgtgtgtgtgtgagtgaatgtt

SEQ ID NO: 8906 - DNA, 22 bp, Artificial Sequence
  chemically synthesized
tgtgtgtgtatatgtgcgcgag

SEQ ID NO: 8907 - DNA, 22 bp, Artificial Sequence
  chemically synthesized
tgtgtgtgtatgtcgtgtatgt

SEQ ID NO: 8908 - DNA, 22 bp, Artificial Sequence
  chemically synthesized
tgtgtgagagtgtgttgtgtgt

SEQ ID NO: 8909 - DNA, 22 bp, Artificial Sequence
  chemically synthesized
tgtgtgtatgttgtgtgagtat

SEQ ID NO: 8910 - DNA, 22 bp, Artificial Sequence
  chemically synthesized
tgtgagtatatgttgtgtgtat

SEQ ID NO: 8911 - DNA, 22 bp, Artificial Sequence
  chemically synthesized
tgtgtatcttgtgtgtgagtgt

SEQ ID NO: 8912 - DNA, 22 bp, Artificial Sequence
  chemically synthesized
gtgtgtgagtgtatgttgtgtg

SEQ ID NO: 8913 - DNA, 22 bp, Artificial Sequence
  chemically synthesized
tgtgtgagtgtatgttgtgtgt

SEQ ID NO: 8914 - DNA, 22 bp, Artificial Sequence
  chemically synthesized
tgtgttgtgtgtgtatcttgtg

SEQ ID NO: 8915 - DNA, 22 bp, Artificial Sequence
  chemically synthesized
tgtgtgtatcttgtgcatgtgt

SEQ ID NO: 8916 - DNA, 22 bp, Artificial Sequence
  chemically synthesized
gtgcatgtgtgtatgttgtgcg

SEQ ID NO: 8917 - DNA, 22 bp, Artificial Sequence
  chemically synthesized
tgcatgtgtgtatgttgtgcga

SEQ ID NO: 8918 - DNA, 22 bp, Artificial Sequence
  chemically synthesized
tgcgagtgtatgttgtgtatgt

SEQ ID NO: 8919 - DNA, 22 bp, Artificial Sequence
  chemically synthesized
tgtatgtgagtgtgtgtatgtt

SEQ ID NO: 8920 - DNA, 22 bp, Artificial Sequence
  chemically synthesized
tgtgtatgttgtgtgtatgtat

SEQ ID NO: 8921 - DNA, 22 bp, Artificial Sequence
  chemically synthesized
tgtgtatgtatgttgtgtatga

SEQ ID NO: 8922 - DNA, 22 bp, Artificial Sequence
  chemically synthesized
tgtatgagtgtgtgtatgttgt

SEQ ID NO: 8923 - DNA, 22 bp, Artificial Sequence
  chemically synthesized
tgtgtgtgtacgttgtgtatgt

SEQ ID NO: 8924 - DNA, 22 bp, Artificial Sequence
  chemically synthesized
tgtatgttgtgtgtgtgttgtg

SEQ ID NO: 8925 - DNA, 22 bp, Artificial Sequence
  chemically synthesized
tgtgtgtgttgtgtgtgtgtat

SEQ ID NO: 8926 - DNA, 22 bp, Artificial Sequence
  chemically synthesized
tgtgtgtgtattgtgtgagtgt

SEQ ID NO: 8927 - DNA, 22 bp, Artificial Sequence
  chemically synthesized
tgtgagtgtatgtatgtttgtg

SEQ ID NO: 8928 - DNA, 22 bp, Artificial Sequence
  chemically synthesized
gtgtgttgtgtgagtgttgtgt

SEQ ID NO: 8929 - DNA, 22 bp, Artificial Sequence
  chemically synthesized
tgtgttgtgtgagtgttgtgta

SEQ ID NO: 8930 - DNA, 22 bp, Artificial Sequence
  chemically synthesized
tgtgagtgttgtgtatgttgtg

SEQ ID NO: 8931 - DNA, 22 bp, Artificial Sequence
  chemically synthesized
tgtatgttgtgcgtgtgtgtat

SEQ ID NO: 8932 - DNA, 22 bp, Artificial Sequence
  chemically synthesized
tgcgtgtgtgtatgttgtgcga

SEQ ID NO: 8933 - DNA, 22 bp, Artificial Sequence
  chemically synthesized
tgcgagtgtgtgtgttgtgtgt

SEQ ID NO: 8934 - DNA, 22 bp, Artificial Sequence
  chemically synthesized
tgtgtgtatgttgtgagtgtgt

SEQ ID NO: 8935 - DNA, 22 bp, Artificial Sequence
  chemically synthesized
tgagtgtgttatgtatgttgtg

SEQ ID NO: 8936 - DNA, 22 bp, Artificial Sequence
  chemically synthesized
tgtatgttgtgtgtgtgagtgt

SEQ ID NO: 8937 - DNA, 22 bp, Artificial Sequence
  chemically synthesized
tgtgtgtgagtgtgttgcgtga

SEQ ID NO: 8938 - DNA, 22 bp, Artificial Sequence
  chemically synthesized
cgtgagtgtgtgtgttagtgtg

SEQ ID NO: 8939 - DNA, 22 bp, Artificial Sequence
  chemically synthesized
gtgtgtgtatgtgattgtatgt

SEQ ID NO: 8940 - DNA, 22 bp, Artificial Sequence
  chemically synthesized
tatgtgtgtgtgtgtgtgtgtg

SEQ ID NO: 8941 - DNA, 22 bp, Artificial Sequence
  chemically synthesized
ggatgggtgggggacgtgagca

SEQ ID NO: 8942 - DNA, 22 bp, Artificial Sequence
  chemically synthesized
gaagatccctgctcctctcatc

SEQ ID NO: 8943 - DNA, 22 bp, Artificial Sequence
  chemically synthesized
ctcctctcatctcccaagaccc

SEQ ID NO: 8944 - DNA, 22 bp, Artificial Sequence
  chemically synthesized
ctctcatctcccaagacccttc

SEQ ID NO: 8945 - DNA, 22 bp, Artificial Sequence
  chemically synthesized
tcatctcccaagacccttccct

SEQ ID NO: 8946 - DNA, 22 bp, Artificial Sequence
  chemically synthesized
atctcccaagacccttccctgg

SEQ ID NO: 8947 - DNA, 22 bp, Artificial Sequence
  chemically synthesized
ccaagacccttccctggatcct

SEQ ID NO: 8948 - DNA, 22 bp, Artificial Sequence
  chemically synthesized
ccctggatccttctgtaataaa

SEQ ID NO: 8949 - DNA, 22 bp, Artificial Sequence
  chemically synthesized
cctggatccttctgtaataaat

SEQ ID NO: 8950 - DNA, 22 bp, Artificial Sequence
  chemically synthesized
gatccttctgtaataaatcttg

SEQ ID NO: 8951 - DNA, 22 bp, Artificial Sequence
  chemically synthesized
ctgtaataaatcttgactgaag

SEQ ID NO: 8952 - DNA, 22 bp, Artificial Sequence
  chemically synthesized
tgtaataaatcttgactgaagg

SEQ ID NO: 8953 - DNA, 22 bp, Artificial Sequence
  chemically synthesized
taataaatcttgactgaaggac

SEQ ID NO: 8954 - DNA, 22 bp, Artificial Sequence
  chemically synthesized
gactgaaggacctaagtatctt

SEQ ID NO: 8955 - DNA, 22 bp, Artificial Sequence
  chemically synthesized
actgaaggacctaagtatcttg

SEQ ID NO: 8956 - DNA, 22 bp, Artificial Sequence
  chemically synthesized
aaggacctaagtatcttggaca

SEQ ID NO: 8957 - DNA, 22 bp, Artificial Sequence
  chemically synthesized
agtatcttggacattttttttt

SEQ ID NO: 8958 - DNA, 22 bp, Artificial Sequence
  chemically synthesized
ggacattttttttttagagaca

SEQ ID NO: 8959 - DNA, 22 bp, Artificial Sequence
  chemically synthesized
gacattttttttttagagacag

SEQ ID NO: 8960 - DNA, 22 bp, Artificial Sequence
  chemically synthesized
tttttttagagacaggagtgta

SEQ ID NO: 8961 - DNA, 22 bp, Artificial Sequence
  chemically synthesized
ttttttagagacaggagtgtag

SEQ ID NO: 8962 - DNA, 22 bp, Artificial Sequence
  chemically synthesized
tttttagagacaggagtgtagt

SEQ ID NO: 8963 - DNA, 22 bp, Artificial Sequence
  chemically synthesized
ttttagagacaggagtgtagtg

SEQ ID NO: 8964 - DNA, 22 bp, Artificial Sequence
  chemically synthesized
tttagagacaggagtgtagtgg

SEQ ID NO: 8965 - DNA, 22 bp, Artificial Sequence
  chemically synthesized
ttagagacaggagtgtagtggc

SEQ ID NO: 8966 - DNA, 22 bp, Artificial Sequence
  chemically synthesized
tagagacaggagtgtagtggca

SEQ ID NO: 8967 - DNA, 22 bp, Artificial Sequence
  chemically synthesized
agagacaggagtgtagtggcag

SEQ ID NO: 8968 - DNA, 22 bp, Artificial Sequence
  chemically synthesized
gagacaggagtgtagtggcagg

SEQ ID NO: 8969 - DNA, 22 bp, Artificial Sequence
  chemically synthesized
actgcaacctcgaactcctggg

SEQ ID NO: 8970 - DNA, 22 bp, Artificial Sequence
  chemically synthesized
caacctcgaactcctgggctca

SEQ ID NO: 8971 - DNA, 22 bp, Artificial Sequence
  chemically synthesized
gaactcctgggctcaagccatc

SEQ ID NO: 8972 - DNA, 22 bp, Artificial Sequence
  chemically synthesized
ctgggctcaagccatcctccca

SEQ ID NO: 8973 - DNA, 22 bp, Artificial Sequence
  chemically synthesized
ggctcaagccatcctcccacct

SEQ ID NO: 8974 - DNA, 22 bp, Artificial Sequence
  chemically synthesized
aagccatcctcccacctcagcc

SEQ ID NO: 8975 - DNA, 22 bp, Artificial Sequence
  chemically synthesized
ccacctcagcctcccaagtagt

SEQ ID NO: 8976 - DNA, 22 bp, Artificial Sequence
  chemically synthesized
agcctcccaagtagttaggact

SEQ ID NO: 8977 - DNA, 22 bp, Artificial Sequence
  chemically synthesized
ccaagtagttaggacttacagg

SEQ ID NO: 8978 - DNA, 22 bp, Artificial Sequence
  chemically synthesized
ggacttacaggtgtgcaccact

SEQ ID NO: 8979 - DNA, 22 bp, Artificial Sequence
  chemically synthesized
acaggtgtgcaccactgtgcct

SEQ ID NO: 8980 - DNA, 22 bp, Artificial Sequence
  chemically synthesized
caggtgtgcaccactgtgcctg

SEQ ID NO: 8981 - DNA, 22 bp, Artificial Sequence
  chemically synthesized
tgcctggcaaattaaaaaaaat

SEQ ID NO: 8982 - DNA, 22 bp, Artificial Sequence
  chemically synthesized
gcaaattaaaaaaaatttttta

SEQ ID NO: 8983 - DNA, 22 bp, Artificial Sequence
  chemically synthesized
aaaaaaattttttagagaaatg

SEQ ID NO: 8984 - DNA, 22 bp, Artificial Sequence
  chemically synthesized
tttagagaaatggggtcttgct

SEQ ID NO: 8985 - DNA, 22 bp, Artificial Sequence
  chemically synthesized
ttagagaaatggggtcttgcta

SEQ ID NO: 8986 - DNA, 22 bp, Artificial Sequence
  chemically synthesized
tagagaaatggggtcttgctat

SEQ ID NO: 8987 - DNA, 22 bp, Artificial Sequence
  chemically synthesized
agagaaatggggtcttgctatg

SEQ ID NO: 8988 - DNA, 22 bp, Artificial Sequence
  chemically synthesized
gagaaatggggtcttgctatgt

SEQ ID NO: 8989 - DNA, 22 bp, Artificial Sequence
  chemically synthesized
gctatgttgcccaggctggtgg

SEQ ID NO: 8990 - DNA, 22 bp, Artificial Sequence
  chemically synthesized
ctatgttgcccaggctggtggg

SEQ ID NO: 8991 - DNA, 22 bp, Artificial Sequence
  chemically synthesized
tgttgcccaggctggtgggaaa

SEQ ID NO: 8992 - DNA, 22 bp, Artificial Sequence
  chemically synthesized
cccaggctggtgggaaaagatt

SEQ ID NO: 8993 - DNA, 22 bp, Artificial Sequence
  chemically synthesized
gtgggaaaagattttaaggtga

SEQ ID NO: 8994 - DNA, 22 bp, Artificial Sequence
  chemically synthesized
taaggtgagagagatctgagca

SEQ ID NO: 8995 - DNA, 22 bp, Artificial Sequence
  chemically synthesized
aaggtgagagagatctgagcag

SEQ ID NO: 8996 - DNA, 22 bp, Artificial Sequence
  chemically synthesized
aggtgagagagatctgagcagt

SEQ ID NO: 8997 - DNA, 22 bp, Artificial Sequence
  chemically synthesized
agcagtgctaggcagaagggca

SEQ ID NO: 8998 - DNA, 22 bp, Artificial Sequence
  chemically synthesized
ggcagaagggcaagagccagga

SEQ ID NO: 8999 - DNA, 22 bp, Artificial Sequence
  chemically synthesized
gtggtggagccgggttccatgg

SEQ ID NO: 9000 - DNA, 22 bp, Artificial Sequence
  chemically synthesized
catggaggcaggaggagcaggg

SEQ ID NO: 9001 - DNA, 22 bp, Artificial Sequence
  chemically synthesized
ggagcttaggaaggggattggt

SEQ ID NO: 9002 - DNA, 22 bp, Artificial Sequence
  chemically synthesized
gagcttaggaaggggattggtt

SEQ ID NO: 9003 - DNA, 22 bp, Artificial Sequence
  chemically synthesized
aggaaggggattggttagctgg

SEQ ID NO: 9004 - DNA, 22 bp, Artificial Sequence
  chemically synthesized
ggaaggggattggttagctggg

SEQ ID NO: 9005 - DNA, 22 bp, Artificial Sequence
  chemically synthesized
gttagctgggctggaatgaggg

SEQ ID NO: 9006 - DNA, 22 bp, Artificial Sequence
  chemically synthesized
gctgggctggaatgagggactc

SEQ ID NO: 9007 - DNA, 22 bp, Artificial Sequence
  chemically synthesized
ggctggaatgagggactcctca

SEQ ID NO: 9008 - DNA, 22 bp, Artificial Sequence
  chemically synthesized
gaatgagggactcctcattcct

SEQ ID NO: 9009 - DNA, 22 bp, Artificial Sequence
  chemically synthesized
ctcattcctgaggctggccaac

SEQ ID NO: 9010 - DNA, 22 bp, Artificial Sequence
  chemically synthesized
attcctgaggctggccaaccga

SEQ ID NO: 9011 - DNA, 22 bp, Artificial Sequence
  chemically synthesized
ctgaggctggccaaccgaggga

SEQ ID NO: 9012 - DNA, 22 bp, Artificial Sequence
  chemically synthesized
aggctggccaaccgagggaggg

SEQ ID NO: 9013 - DNA, 22 bp, Artificial Sequence
  chemically synthesized
gccaaccgagggagggccggtg

SEQ ID NO: 9014 - DNA, 22 bp, Artificial Sequence
  chemically synthesized
ggcagggcagggcaggggacag

SEQ ID NO: 9015 - DNA, 22 bp, Artificial Sequence
  chemically synthesized
ccgaggaccactcaggaacacc

SEQ ID NO: 9016 - DNA, 22 bp, Artificial Sequence
  chemically synthesized
aggaacaccagtagcatctcct

SEQ ID NO: 9017 - DNA, 22 bp, Artificial Sequence
  chemically synthesized
ctctctctgtagggggctggct

SEQ ID NO: 9018 - DNA, 22 bp, Artificial Sequence
  chemically synthesized
tctctgtagggggctggctgga

SEQ ID NO: 9019 - DNA, 22 bp, Artificial Sequence
  chemically synthesized
tctgtagggggctggctggact

SEQ ID NO: 9020 - DNA, 22 bp, Artificial Sequence
  chemically synthesized
tgtagggggctggctggacttc

SEQ ID NO: 9021 - DNA, 22 bp, Artificial Sequence
  chemically synthesized
tagggggctggctggacttccc

SEQ ID NO: 9022 - DNA, 22 bp, Artificial Sequence
  chemically synthesized
gctggacttcccaccaggcggt

SEQ ID NO: 9023 - DNA, 22 bp, Artificial Sequence
  chemically synthesized
gacttcccaccaggcggtgtcc

SEQ ID NO: 9024 - DNA, 22 bp, Artificial Sequence
  chemically synthesized
cccaccaggcggtgtccccaca

SEQ ID NO: 9025 - DNA, 22 bp, Artificial Sequence
  chemically synthesized
ccaccaggcggtgtccccacag

SEQ ID NO: 9026 - DNA, 22 bp, Artificial Sequence
  chemically synthesized
tccgcctcactctcctctgcaa

SEQ ID NO: 9027 - DNA, 22 bp, Artificial Sequence
  chemically synthesized
actctcctctgcaactccagtg

SEQ ID NO: 9028 - DNA, 22 bp, Artificial Sequence
  chemically synthesized
tcctctgcaactccagtgccca

SEQ ID NO: 9029 - DNA, 22 bp, Artificial Sequence
  chemically synthesized
ctctgcaactccagtgcccaca

SEQ ID NO: 9030 - DNA, 22 bp, Artificial Sequence
  chemically synthesized
tgcaactccagtgcccacacgg

SEQ ID NO: 9031 - DNA, 22 bp, Artificial Sequence
  chemically synthesized
caactccagtgcccacacggca

SEQ ID NO: 9032 - DNA, 22 bp, Artificial Sequence
  chemically synthesized
cagtgcccacacggcacccggt

SEQ ID NO: 9033 - DNA, 22 bp, Artificial Sequence
  chemically synthesized
agagagaatacgggatgctgct

SEQ ID NO: 9034 - DNA, 22 bp, Artificial Sequence
  chemically synthesized
ctgaatcttctgagggtgacag

SEQ ID NO: 9035 - DNA, 22 bp, Artificial Sequence
  chemically synthesized
aatcttctgagggtgacagaat

SEQ ID NO: 9036 - DNA, 22 bp, Artificial Sequence
  chemically synthesized
ctgagggtgacagaatttagag

SEQ ID NO: 9037 - DNA, 22 bp, Artificial Sequence
  chemically synthesized
tgagggtgacagaatttagagt

SEQ ID NO: 9038 - DNA, 22 bp, Artificial Sequence
  chemically synthesized
agggtgacagaatttagagttt

SEQ ID NO: 9039 - DNA, 22 bp, Artificial Sequence
  chemically synthesized
agagtttgagcaggaggcttgg

SEQ ID NO: 9040 - DNA, 22 bp, Artificial Sequence
  chemically synthesized
gagtttgagcaggaggcttgga

SEQ ID NO: 9041 - DNA, 22 bp, Artificial Sequence
  chemically synthesized
gagcaggaggcttggagagagg

SEQ ID NO: 9042 - DNA, 22 bp, Artificial Sequence
  chemically synthesized
agcaggaggcttggagagaggc

SEQ ID NO: 9043 - DNA, 22 bp, Artificial Sequence
  chemically synthesized
ggagagaggccaggatttctga

SEQ ID NO: 9044 - DNA, 22 bp, Artificial Sequence
  chemically synthesized
gagagaggccaggatttctgaa

SEQ ID NO: 9045 - DNA, 22 bp, Artificial Sequence
  chemically synthesized
ctgaaattaatgggagagtgag

SEQ ID NO: 9046 - DNA, 22 bp, Artificial Sequence
  chemically synthesized
tgaaattaatgggagagtgagc

SEQ ID NO: 9047 - DNA, 22 bp, Artificial Sequence
  chemically synthesized
aaattaatgggagagtgagctc

SEQ ID NO: 9048 - DNA, 22 bp, Artificial Sequence
  chemically synthesized
atgggagagtgagctcacgcga

SEQ ID NO: 9049 - DNA, 22 bp, Artificial Sequence
  chemically synthesized
acgcgaatgggctgagggacac

SEQ ID NO: 9050 - DNA, 22 bp, Artificial Sequence
  chemically synthesized
agggacaccagtgagggaccgt

SEQ ID NO: 9051 - DNA, 22 bp, Artificial Sequence
  chemically synthesized
aagggatgtagcaaagtcaccg

SEQ ID NO: 9052 - DNA, 22 bp, Artificial Sequence
  chemically synthesized
ccctccagcagcccgggtggtg

SEQ ID NO: 9053 - DNA, 22 bp, Artificial Sequence
  chemically synthesized
cctccagcagcccgggtggtgg

SEQ ID NO: 9054 - DNA, 22 bp, Artificial Sequence
  chemically synthesized
cagcagcccgggtggtgggggc

SEQ ID NO: 9055 - DNA, 22 bp, Artificial Sequence
  chemically synthesized
ggggaacgtcatcatgggagct

SEQ ID NO: 9056 - DNA, 22 bp, Artificial Sequence
  chemically synthesized
acactgatcagctgctcaccgg

SEQ ID NO: 9057 - DNA, 22 bp, Artificial Sequence
  chemically synthesized
atcagctgctcaccggggccca

SEQ ID NO: 9058 - DNA, 22 bp, Artificial Sequence
  chemically synthesized
ctcaccggggcccatcttccac

SEQ ID NO: 9059 - DNA, 22 bp, Artificial Sequence
  chemically synthesized
accggggcccatcttccacttg

SEQ ID NO: 9060 - DNA, 22 bp, Artificial Sequence
  chemically synthesized
ccacttgtctcagcacttgatt

SEQ ID NO: 9061 - DNA, 22 bp, Artificial Sequence
  chemically synthesized
cacttgtctcagcacttgattt

SEQ ID NO: 9062 - DNA, 22 bp, Artificial Sequence
  chemically synthesized
gtctcagcacttgatttttttc

SEQ ID NO: 9063 - DNA, 22 bp, Artificial Sequence
  chemically synthesized
tctcagcacttgatttttttct

SEQ ID NO: 9064 - DNA, 22 bp, Artificial Sequence
  chemically synthesized
agcacttgatttttttctgcta

SEQ ID NO: 9065 - DNA, 22 bp, Artificial Sequence
  chemically synthesized
gatttttttctgctaccccctt

SEQ ID NO: 9066 - DNA, 22 bp, Artificial Sequence
  chemically synthesized
atttttttctgctacccccttt

SEQ ID NO: 9067 - DNA, 22 bp, Artificial Sequence
  chemically synthesized
ttttctgctaccccctttttct

SEQ ID NO: 9068 - DNA, 22 bp, Artificial Sequence
  chemically synthesized
tttctgctaccccctttttctt

SEQ ID NO: 9069 - DNA, 22 bp, Artificial Sequence
  chemically synthesized
ttctgctaccccctttttcttt

SEQ ID NO: 9070 - DNA, 22 bp, Artificial Sequence
  chemically synthesized
tctgctaccccctttttctttt

SEQ ID NO: 9071 - DNA, 22 bp, Artificial Sequence
  chemically synthesized
ctgctaccccctttttctttta

SEQ ID NO: 9072 - DNA, 22 bp, Artificial Sequence
  chemically synthesized
tgctaccccctttttcttttaa

SEQ ID NO: 9073 - DNA, 22 bp, Artificial Sequence
  chemically synthesized
ctaccccctttttcttttaaag

SEQ ID NO: 9074 - DNA, 22 bp, Artificial Sequence
  chemically synthesized
ccccctttttcttttaaagatt

SEQ ID NO: 9075 - DNA, 22 bp, Artificial Sequence
  chemically synthesized
tttcttttaaagatttcaatta

SEQ ID NO: 9076 - DNA, 22 bp, Artificial Sequence
  chemically synthesized
ttcttttaaagatttcaattat

SEQ ID NO: 9077 - DNA, 22 bp, Artificial Sequence
  chemically synthesized
tcttttaaagatttcaattatg

SEQ ID NO: 9078 - DNA, 22 bp, Artificial Sequence
  chemically synthesized
cttttaaagatttcaattatgc

SEQ ID NO: 9079 - DNA, 22 bp, Artificial Sequence
  chemically synthesized
ttttaaagatttcaattatgca

SEQ ID NO: 9080 - DNA, 22 bp, Artificial Sequence
  chemically synthesized
ttaaagatttcaattatgcatg

SEQ ID NO: 9081 - DNA, 22 bp, Artificial Sequence
  chemically synthesized
taaagatttcaattatgcatgt

SEQ ID NO: 9082 - DNA, 22 bp, Artificial Sequence
  chemically synthesized
aaagatttcaattatgcatgta

SEQ ID NO: 9083 - DNA, 22 bp, Artificial Sequence
  chemically synthesized
aagatttcaattatgcatgtat

SEQ ID NO: 9084 - DNA, 22 bp, Artificial Sequence
  chemically synthesized
caattatgcatgtattaagggt

SEQ ID NO: 9085 - DNA, 22 bp, Artificial Sequence
  chemically synthesized
aattatgcatgtattaagggtc

SEQ ID NO: 9086 - DNA, 22 bp, Artificial Sequence
  chemically synthesized
tgcatgtattaagggtcccaca

SEQ ID NO: 9087 - DNA, 22 bp, Artificial Sequence
  chemically synthesized
agggtcccacagctcactcatt

SEQ ID NO: 9088 - DNA, 22 bp, Artificial Sequence
  chemically synthesized
actcattctctttccatttttt

SEQ ID NO: 9089 - DNA, 22 bp, Artificial Sequence
  chemically synthesized
attctctttccattttttaatt

SEQ ID NO: 9090 - DNA, 22 bp, Artificial Sequence
  chemically synthesized
tctttccattttttaattcttt

SEQ ID NO: 9091 - DNA, 22 bp, Artificial Sequence
  chemically synthesized
tttccattttttaattcttttt

SEQ ID NO: 9092 - DNA, 22 bp, Artificial Sequence
  chemically synthesized
tccattttttaattcttttttc

SEQ ID NO: 9093 - DNA, 22 bp, Artificial Sequence
  chemically synthesized
ccattttttaattcttttttct

SEQ ID NO: 9094 - DNA, 22 bp, Artificial Sequence
  chemically synthesized
cattttttaattcttttttctc

SEQ ID NO: 9095 - DNA, 22 bp, Artificial Sequence
  chemically synthesized
tttaattcttttttctcccagt

SEQ ID NO: 9096 - DNA, 22 bp, Artificial Sequence
  chemically synthesized
ttaattcttttttctcccagtg

SEQ ID NO: 9097 - DNA, 22 bp, Artificial Sequence
  chemically synthesized
taattcttttttctcccagtgt

SEQ ID NO: 9098 - DNA, 22 bp, Artificial Sequence
  chemically synthesized
aattcttttttctcccagtgtt

SEQ ID NO: 9099 - DNA, 22 bp, Artificial Sequence
  chemically synthesized
attcttttttctcccagtgttt

SEQ ID NO: 9100 - DNA, 22 bp, Artificial Sequence
  chemically synthesized
ttttttctcccagtgtttcatt

SEQ ID NO: 9101 - DNA, 22 bp, Artificial Sequence
  chemically synthesized
ttttctcccagtgtttcatttt

SEQ ID NO: 9102 - DNA, 22 bp, Artificial Sequence
  chemically synthesized
tttctcccagtgtttcatttta

SEQ ID NO: 9103 - DNA, 22 bp, Artificial Sequence
  chemically synthesized
ttctcccagtgtttcattttat

SEQ ID NO: 9104 - DNA, 22 bp, Artificial Sequence
  chemically synthesized
tctcccagtgtttcattttata

SEQ ID NO: 9105 - DNA, 22 bp, Artificial Sequence
  chemically synthesized
ctcccagtgtttcattttatag

SEQ ID NO: 9106 - DNA, 22 bp, Artificial Sequence
  chemically synthesized
tcccagtgtttcattttataga

SEQ ID NO: 9107 - DNA, 22 bp, Artificial Sequence
  chemically synthesized
ccagtgtttcattttatagagt

SEQ ID NO: 9108 - DNA, 22 bp, Artificial Sequence
  chemically synthesized
cattttatagagttattgctgt

SEQ ID NO: 9109 - DNA, 22 bp, Artificial Sequence
  chemically synthesized
attttatagagttattgctgtt

SEQ ID NO: 9110 - DNA, 22 bp, Artificial Sequence
  chemically synthesized
tatagagttattgctgttcatt

SEQ ID NO: 9111 - DNA, 22 bp, Artificial Sequence
  chemically synthesized
atagagttattgctgttcatta

SEQ ID NO: 9112 - DNA, 22 bp, Artificial Sequence
  chemically synthesized
tagagttattgctgttcattaa

SEQ ID NO: 9113 - DNA, 22 bp, Artificial Sequence
  chemically synthesized
ttgctgttcattaagttaacta

SEQ ID NO: 9114 - DNA, 22 bp, Artificial Sequence
  chemically synthesized
ctgttcattaagttaactaaaa

SEQ ID NO: 9115 - DNA, 22 bp, Artificial Sequence
  chemically synthesized
ttcattaagttaactaaaattt

SEQ ID NO: 9116 - DNA, 22 bp, Artificial Sequence
  chemically synthesized
attaagttaactaaaattttcc

SEQ ID NO: 9117 - DNA, 22 bp, Artificial Sequence
  chemically synthesized
agttaactaaaattttcccctt

SEQ ID NO: 9118 - DNA, 22 bp, Artificial Sequence
  chemically synthesized
actaaaattttccccttcccct

SEQ ID NO: 9119 - DNA, 22 bp, Artificial Sequence
  chemically synthesized
aaattttccccttcccctcccc

SEQ ID NO: 9120 - DNA, 22 bp, Artificial Sequence
  chemically synthesized
tccccttcccctccccctcccc

SEQ ID NO: 9121 - DNA, 22 bp, Artificial Sequence
  chemically synthesized
ccccttcccctccccctcccct

SEQ ID NO: 9122 - DNA, 22 bp, Artificial Sequence
  chemically synthesized
cccttcccctccccctcccctc

SEQ ID NO: 9123 - DNA, 22 bp, Artificial Sequence
  chemically synthesized
cccctccccctcccctcccctc

SEQ ID NO: 9124 - DNA, 22 bp, Artificial Sequence
  chemically synthesized
ccctccccctcccctcccctcc

SEQ ID NO: 9125 - DNA, 22 bp, Artificial Sequence
  chemically synthesized
cccctcccctcccctcctttcc

SEQ ID NO: 9126 - DNA, 22 bp, Artificial Sequence
  chemically synthesized
ccctcccctcctttccttccct

SEQ ID NO: 9127 - DNA, 22 bp, Artificial Sequence
  chemically synthesized
ccctcctttccttccctcgctt

SEQ ID NO: 9128 - DNA, 22 bp, Artificial Sequence
  chemically synthesized
ctttccttccctcgcttcccct

SEQ ID NO: 9129 - DNA, 22 bp, Artificial Sequence
  chemically synthesized
tccttccctcgcttcccctccc

SEQ ID NO: 9130 - DNA, 22 bp, Artificial Sequence
  chemically synthesized
ccttccctcgcttcccctcccc

SEQ ID NO: 9131 - DNA, 22 bp, Artificial Sequence
  chemically synthesized
cttccctcgcttcccctcccct

SEQ ID NO: 9132 - DNA, 22 bp, Artificial Sequence
  chemically synthesized
ccctcgcttcccctcccctctc

SEQ ID NO: 9133 - DNA, 22 bp, Artificial Sequence
  chemically synthesized
cctcgcttcccctcccctctct

SEQ ID NO: 9134 - DNA, 22 bp, Artificial Sequence
  chemically synthesized
gcttcccctcccctctctctct

SEQ ID NO: 9135 - DNA, 22 bp, Artificial Sequence
  chemically synthesized
cccctcccctctctctctctca

SEQ ID NO: 9136 - DNA, 22 bp, Artificial Sequence
  chemically synthesized
ccctcccctctctctctctcat

SEQ ID NO: 9137 - DNA, 22 bp, Artificial Sequence
  chemically synthesized
ccctctctctctctcatctcac

SEQ ID NO: 9138 - DNA, 22 bp, Artificial Sequence
  chemically synthesized
tctctctctcatctcactctgt

SEQ ID NO: 9139 - DNA, 22 bp, Artificial Sequence
  chemically synthesized
tctctctcatctcactctgttg

SEQ ID NO: 9140 - DNA, 22 bp, Artificial Sequence
  chemically synthesized
tctctcatctcactctgttgcc

SEQ ID NO: 9141 - DNA, 22 bp, Artificial Sequence
  chemically synthesized
tctcatctcactctgttgccca

SEQ ID NO: 9142 - DNA, 22 bp, Artificial Sequence
  chemically synthesized
tcatctcactctgttgcccagg

SEQ ID NO: 9143 - DNA, 22 bp, Artificial Sequence
  chemically synthesized
atctcactctgttgcccaggct

SEQ ID NO: 9144 - DNA, 22 bp, Artificial Sequence
  chemically synthesized
actctgttgcccaggctggaat

SEQ ID NO: 9145 - DNA, 22 bp, Artificial Sequence
  chemically synthesized
tgttgcccaggctggaatgcag

SEQ ID NO: 9146 - DNA, 22 bp, Artificial Sequence
  chemically synthesized
ttgcccaggctggaatgcagta

SEQ ID NO: 9147 - DNA, 22 bp, Artificial Sequence
  chemically synthesized
cccaggctggaatgcagtagct

SEQ ID NO: 9148 - DNA, 22 bp, Artificial Sequence
  chemically synthesized
gaatgcagtagcttgtcacaac

SEQ ID NO: 9149 - DNA, 22 bp, Artificial Sequence
  chemically synthesized
gtcacaactcactgtggcctcc

SEQ ID NO: 9150 - DNA, 22 bp, Artificial Sequence
  chemically synthesized
tcacaactcactgtggcctcca

SEQ ID NO: 9151 - DNA, 22 bp, Artificial Sequence
  chemically synthesized
actgtggcctccacctcctggg

SEQ ID NO: 9152 - DNA, 22 bp, Artificial Sequence
  chemically synthesized
tggcctccacctcctgggctca

SEQ ID NO: 9153 - DNA, 22 bp, Artificial Sequence
  chemically synthesized
cacctcctgggctcaggcgatc

SEQ ID NO: 9154 - DNA, 22 bp, Artificial Sequence
  chemically synthesized
ctgggctcaggcgatccttcca

SEQ ID NO: 9155 - DNA, 22 bp, Artificial Sequence
  chemically synthesized
ggctcaggcgatccttccactt

SEQ ID NO: 9156 - DNA, 22 bp, Artificial Sequence
  chemically synthesized
aggcgatccttccacttcagcc

SEQ ID NO: 9157 - DNA, 22 bp, Artificial Sequence
  chemically synthesized
ccacttcagcctcccaggtagc

SEQ ID NO: 9158 - DNA, 22 bp, Artificial Sequence
  chemically synthesized
cacttcagcctcccaggtagct

SEQ ID NO: 9159 - DNA, 22 bp, Artificial Sequence
  chemically synthesized
cagcctcccaggtagctgggac

SEQ ID NO: 9160 - DNA, 22 bp, Artificial Sequence
  chemically synthesized
agcctcccaggtagctgggact

SEQ ID NO: 9161 - DNA, 22 bp, Artificial Sequence
  chemically synthesized
ccaggtagctgggactataggc

SEQ ID NO: 9162 - DNA, 22 bp, Artificial Sequence
  chemically synthesized
ggactataggcatgtggcacca

SEQ ID NO: 9163 - DNA, 22 bp, Artificial Sequence
  chemically synthesized
taggcatgtggcaccacacctg

SEQ ID NO: 9164 - DNA, 22 bp, Artificial Sequence
  chemically synthesized
gctaattaaaaatttttttttg

SEQ ID NO: 9165 - DNA, 22 bp, Artificial Sequence
  chemically synthesized
attaaaaatttttttttgtaga

SEQ ID NO: 9166 - DNA, 22 bp, Artificial Sequence
  chemically synthesized
aaaatttttttttgtagagacg

SEQ ID NO: 9167 - DNA, 22 bp, Artificial Sequence
  chemically synthesized
ttttttgtagagacggttttgc

SEQ ID NO: 9168 - DNA, 22 bp, Artificial Sequence
  chemically synthesized
tttttgtagagacggttttgcc

SEQ ID NO: 9169 - DNA, 22 bp, Artificial Sequence
  chemically synthesized
ttttgtagagacggttttgcca

SEQ ID NO: 9170 - DNA, 22 bp, Artificial Sequence
  chemically synthesized
tttgtagagacggttttgccat

SEQ ID NO: 9171 - DNA, 22 bp, Artificial Sequence
  chemically synthesized
ttgtagagacggttttgccatg

SEQ ID NO: 9172 - DNA, 22 bp, Artificial Sequence
  chemically synthesized
tgtagagacggttttgccatgt

SEQ ID NO: 9173 - DNA, 22 bp, Artificial Sequence
  chemically synthesized
gtagagacggttttgccatgta

SEQ ID NO: 9174 - DNA, 22 bp, Artificial Sequence
  chemically synthesized
tagagacggttttgccatgtag

SEQ ID NO: 9175 - DNA, 22 bp, Artificial Sequence
  chemically synthesized
tgccatgtagaggggttttgcc

SEQ ID NO: 9176 - DNA, 22 bp, Artificial Sequence
  chemically synthesized
gccatgtagaggggttttgcca

SEQ ID NO: 9177 - DNA, 22 bp, Artificial Sequence
  chemically synthesized
ccatgtagaggggttttgccat

SEQ ID NO: 9178 - DNA, 22 bp, Artificial Sequence
  chemically synthesized
tgccatgctgcccagactagtc

SEQ ID NO: 9179 - DNA, 22 bp, Artificial Sequence
  chemically synthesized
gccatgctgcccagactagtct

SEQ ID NO: 9180 - DNA, 22 bp, Artificial Sequence
  chemically synthesized
ccatgctgcccagactagtctt

SEQ ID NO: 9181 - DNA, 22 bp, Artificial Sequence
  chemically synthesized
cccagactagtcttgagctcct

SEQ ID NO: 9182 - DNA, 22 bp, Artificial Sequence
  chemically synthesized
gtcttgagctcctgggctcaag

SEQ ID NO: 9183 - DNA, 22 bp, Artificial Sequence
  chemically synthesized
gagctcctgggctcaagtgatt

SEQ ID NO: 9184 - DNA, 22 bp, Artificial Sequence
  chemically synthesized
agctcctgggctcaagtgattc

SEQ ID NO: 9185 - DNA, 22 bp, Artificial Sequence
  chemically synthesized
ctgggctcaagtgattcccccc

SEQ ID NO: 9186 - DNA, 22 bp, Artificial Sequence
  chemically synthesized
ggctcaagtgattccccccgtg

SEQ ID NO: 9187 - DNA, 22 bp, Artificial Sequence
  chemically synthesized
aagtgattccccccgtgtcgac

SEQ ID NO: 9188 - DNA, 22 bp, Artificial Sequence
  chemically synthesized
cccccgtgtcgacctcccaaag

SEQ ID NO: 9189 - DNA, 22 bp, Artificial Sequence
  chemically synthesized
ccaaagtgctgggattacagat

SEQ ID NO: 9190 - DNA, 22 bp, Artificial Sequence
  chemically synthesized
ggattacagatgtgatccacag

SEQ ID NO: 9191 - DNA, 22 bp, Artificial Sequence
  chemically synthesized
cagatgtgatccacagtgcctg

SEQ ID NO: 9192 - DNA, 22 bp, Artificial Sequence
  chemically synthesized
gccctaaatttttcttacgcat

SEQ ID NO: 9193 - DNA, 22 bp, Artificial Sequence
  chemically synthesized
aatttttcttacgcatttctca

SEQ ID NO: 9194 - DNA, 22 bp, Artificial Sequence
  chemically synthesized
ttcttacgcatttctcatcttc

SEQ ID NO: 9195 - DNA, 22 bp, Artificial Sequence
  chemically synthesized
tcttacgcatttctcatcttcc

SEQ ID NO: 9196 - DNA, 22 bp, Artificial Sequence
  chemically synthesized
cttacgcatttctcatcttcca

SEQ ID NO: 9197 - DNA, 22 bp, Artificial Sequence
  chemically synthesized
ttacgcatttctcatcttccat

SEQ ID NO: 9198 - DNA, 22 bp, Artificial Sequence
  chemically synthesized
acgcatttctcatcttccatta

SEQ ID NO: 9199 - DNA, 22 bp, Artificial Sequence
  chemically synthesized
cgcatttctcatcttccattat

SEQ ID NO: 9200 - DNA, 22 bp, Artificial Sequence
  chemically synthesized
ctcatcttccattatttccatc

SEQ ID NO: 9201 - DNA, 22 bp, Artificial Sequence
  chemically synthesized
tcatcttccattatttccatcc

SEQ ID NO: 9202 - DNA, 22 bp, Artificial Sequence
  chemically synthesized
atcttccattatttccatccag

SEQ ID NO: 9203 - DNA, 22 bp, Artificial Sequence
  chemically synthesized
ccattatttccatccagtgtgt

SEQ ID NO: 9204 - DNA, 22 bp, Artificial Sequence
  chemically synthesized
cattatttccatccagtgtgtt

SEQ ID NO: 9205 - DNA, 22 bp, Artificial Sequence
  chemically synthesized
tttccatccagtgtgttttttc

SEQ ID NO: 9206 - DNA, 22 bp, Artificial Sequence
  chemically synthesized
ccatccagtgtgttttttcttt

SEQ ID NO: 9207 - DNA, 22 bp, Artificial Sequence
  chemically synthesized
catccagtgtgttttttctttt

SEQ ID NO: 9208 - DNA, 22 bp, Artificial Sequence
  chemically synthesized
tttcttttctttcttttctttt

SEQ ID NO: 9209 - DNA, 22 bp, Artificial Sequence
  chemically synthesized
ttcttttctttcttttcttttt

SEQ ID NO: 9210 - DNA, 22 bp, Artificial Sequence
  chemically synthesized
tcttttctttcttttctttttt

SEQ ID NO: 9211 - DNA, 22 bp, Artificial Sequence
  chemically synthesized
cttttctttcttttcttttttt

SEQ ID NO: 9212 - DNA, 22 bp, Artificial Sequence
  chemically synthesized
ttttctttcttttctttttttt

SEQ ID NO: 9213 - DNA, 22 bp, Artificial Sequence
  chemically synthesized
ttctttcttttctttttttttt

SEQ ID NO: 9214 - DNA, 22 bp, Artificial Sequence
  chemically synthesized
tctttcttttcttttttttttt

SEQ ID NO: 9215 - DNA, 22 bp, Artificial Sequence
  chemically synthesized
ctttcttttctttttttttttt

SEQ ID NO: 9216 - DNA, 22 bp, Artificial Sequence
  chemically synthesized
tttcttttcttttttttttttt

SEQ ID NO: 9217 - DNA, 22 bp, Artificial Sequence
  chemically synthesized
tcttttcttttttttttttttg

SEQ ID NO: 9218 - DNA, 22 bp, Artificial Sequence
  chemically synthesized
cttttcttttttttttttttgg

SEQ ID NO: 9219 - DNA, 22 bp, Artificial Sequence
  chemically synthesized
ttttcttttttttttttttgga

SEQ ID NO: 9220 - DNA, 22 bp, Artificial Sequence
  chemically synthesized
ttcttttttttttttttggagg

SEQ ID NO: 9221 - DNA, 22 bp, Artificial Sequence
  chemically synthesized
tcttttttttttttttggaggc

SEQ ID NO: 9222 - DNA, 22 bp, Artificial Sequence
  chemically synthesized
cttttttttttttttggaggcg

SEQ ID NO: 9223 - DNA, 22 bp, Artificial Sequence
  chemically synthesized
ttttttttttttttggaggcgg

SEQ ID NO: 9224 - DNA, 22 bp, Artificial Sequence
  chemically synthesized
ttttttttttttggaggcggag

SEQ ID NO: 9225 - DNA, 22 bp, Artificial Sequence
  chemically synthesized
tttttttttttggaggcggagt

SEQ ID NO: 9226 - DNA, 22 bp, Artificial Sequence
  chemically synthesized
ttttttttttggaggcggagtc

SEQ ID NO: 9227 - DNA, 22 bp, Artificial Sequence
  chemically synthesized
tttttttttggaggcggagtct

SEQ ID NO: 9228 - DNA, 22 bp, Artificial Sequence
  chemically synthesized
ttttttttggaggcggagtctc

SEQ ID NO: 9229 - DNA, 22 bp, Artificial Sequence
  chemically synthesized
tttttttggaggcggagtctcg

SEQ ID NO: 9230 - DNA, 22 bp, Artificial Sequence
  chemically synthesized
ttttttggaggcggagtctcgc

SEQ ID NO: 9231 - DNA, 22 bp, Artificial Sequence
  chemically synthesized
tttttggaggcggagtctcgct

SEQ ID NO: 9232 - DNA, 22 bp, Artificial Sequence
  chemically synthesized
ttttggaggcggagtctcgctc

SEQ ID NO: 9233 - DNA, 22 bp, Artificial Sequence
  chemically synthesized
tttggaggcggagtctcgctct

SEQ ID NO: 9234 - DNA, 22 bp, Artificial Sequence
  chemically synthesized
ttggaggcggagtctcgctctg

SEQ ID NO: 9235 - DNA, 22 bp, Artificial Sequence
  chemically synthesized
tggaggcggagtctcgctctgt

SEQ ID NO: 9236 - DNA, 22 bp, Artificial Sequence
  chemically synthesized
ggaggcggagtctcgctctgtt

SEQ ID NO: 9237 - DNA, 22 bp, Artificial Sequence
  chemically synthesized
gaggcggagtctcgctctgttg

SEQ ID NO: 9238 - DNA, 22 bp, Artificial Sequence
  chemically synthesized
gctctgttgcccaggccggagt

SEQ ID NO: 9239 - DNA, 22 bp, Artificial Sequence
  chemically synthesized
tgttgcccaggccggagtgcag

SEQ ID NO: 9240 - DNA, 22 bp, Artificial Sequence
  chemically synthesized
ttgcccaggccggagtgcagtg

SEQ ID NO: 9241 - DNA, 22 bp, Artificial Sequence
  chemically synthesized
cccaggccggagtgcagtggcg

SEQ ID NO: 9242 - DNA, 22 bp, Artificial Sequence
  chemically synthesized
ggctcactgcaagctctgcctc

SEQ ID NO: 9243 - DNA, 22 bp, Artificial Sequence
  chemically synthesized
gctcactgcaagctctgcctcc

SEQ ID NO: 9244 - DNA, 22 bp, Artificial Sequence
  chemically synthesized
actgcaagctctgcctcccggg

SEQ ID NO: 9245 - DNA, 22 bp, Artificial Sequence
  chemically synthesized
caagctctgcctcccgggttca

SEQ ID NO: 9246 - DNA, 22 bp, Artificial Sequence
  chemically synthesized
tgcctcccgggttcatgccatt

SEQ ID NO: 9247 - DNA, 22 bp, Artificial Sequence
  chemically synthesized
cctcccgggttcatgccattct

SEQ ID NO: 9248 - DNA, 22 bp, Artificial Sequence
  chemically synthesized
ccgggttcatgccattctcctg

SEQ ID NO: 9249 - DNA, 22 bp, Artificial Sequence
  chemically synthesized
atgccattctcctgcctcagcc

SEQ ID NO: 9250 - DNA, 22 bp, Artificial Sequence
  chemically synthesized
tcctgcctcagcctcccgagta

SEQ ID NO: 9251 - DNA, 22 bp, Artificial Sequence
  chemically synthesized
ctgcctcagcctcccgagtagc

SEQ ID NO: 9252 - DNA, 22 bp, Artificial Sequence
  chemically synthesized
cctcagcctcccgagtagctgg

SEQ ID NO: 9253 - DNA, 22 bp, Artificial Sequence
  chemically synthesized
agcctcccgagtagctgggact

SEQ ID NO: 9254 - DNA, 22 bp, Artificial Sequence
  chemically synthesized
ccgagtagctgggactacaggc

SEQ ID NO: 9255 - DNA, 22 bp, Artificial Sequence
  chemically synthesized
ggactacaggcgcctgccacca

SEQ ID NO: 9256 - DNA, 22 bp, Artificial Sequence
  chemically synthesized
caggcgcctgccaccacgtctg

SEQ ID NO: 9257 - DNA, 22 bp, Artificial Sequence
  chemically synthesized
ccaccacgtctggctaattttt

SEQ ID NO: 9258 - DNA, 22 bp, Artificial Sequence
  chemically synthesized
gctaattttttgtatttttagt

SEQ ID NO: 9259 - DNA, 22 bp, Artificial Sequence
  chemically synthesized
attttttgtatttttagtagag

SEQ ID NO: 9260 - DNA, 22 bp, Artificial Sequence
  chemically synthesized
tttgtatttttagtagagatgg

SEQ ID NO: 9261 - DNA, 22 bp, Artificial Sequence
  chemically synthesized
ttgtatttttagtagagatggg

SEQ ID NO: 9262 - DNA, 22 bp, Artificial Sequence
  chemically synthesized
tgtatttttagtagagatgggg

SEQ ID NO: 9263 - DNA, 22 bp, Artificial Sequence
  chemically synthesized
gtatttttagtagagatggggt

SEQ ID NO: 9264 - DNA, 22 bp, Artificial Sequence
  chemically synthesized
tatttttagtagagatggggtt

SEQ ID NO: 9265 - DNA, 22 bp, Artificial Sequence
  chemically synthesized
ttagtagagatggggtttcacc

SEQ ID NO: 9266 - DNA, 22 bp, Artificial Sequence
  chemically synthesized
tagtagagatggggtttcacca

SEQ ID NO: 9267 - DNA, 22 bp, Artificial Sequence
  chemically synthesized
agtagagatggggtttcaccat

SEQ ID NO: 9268 - DNA, 22 bp, Artificial Sequence
  chemically synthesized
gtagagatggggtttcaccatg

SEQ ID NO: 9269 - DNA, 22 bp, Artificial Sequence
  chemically synthesized
caccatgttagccaggatggtg

SEQ ID NO: 9270 - DNA, 22 bp, Artificial Sequence
  chemically synthesized
accatgttagccaggatggtgt

SEQ ID NO: 9271 - DNA, 22 bp, Artificial Sequence
  chemically synthesized
gccaggatggtgtcgatctcct

SEQ ID NO: 9272 - DNA, 22 bp, Artificial Sequence
  chemically synthesized
ctgacctcatgatctgcccgcc

SEQ ID NO: 9273 - DNA, 22 bp, Artificial Sequence
  chemically synthesized
acctcatgatctgcccgccttg

SEQ ID NO: 9274 - DNA, 22 bp, Artificial Sequence
  chemically synthesized
atgatctgcccgccttggcctc

SEQ ID NO: 9275 - DNA, 22 bp, Artificial Sequence
  chemically synthesized
cccgccttggcctcccacagtg

SEQ ID NO: 9276 - DNA, 22 bp, Artificial Sequence
  chemically synthesized
ggcctcccacagtgctgggatt

SEQ ID NO: 9277 - DNA, 22 bp, Artificial Sequence
  chemically synthesized
gcctcccacagtgctgggattc

SEQ ID NO: 9278 - DNA, 22 bp, Artificial Sequence
  chemically synthesized
ccacagtgctgggattccaggc

SEQ ID NO: 9279 - DNA, 22 bp, Artificial Sequence
  chemically synthesized
ggattccaggcgtgagccacgg

SEQ ID NO: 9280 - DNA, 22 bp, Artificial Sequence
  chemically synthesized
caggcgtgagccacggcgcctg

SEQ ID NO: 9281 - DNA, 22 bp, Artificial Sequence
  chemically synthesized
gccagtgtgttttttcatttca

SEQ ID NO: 9282 - DNA, 22 bp, Artificial Sequence
  chemically synthesized
tttcatttcagacattgtagtt

SEQ ID NO: 9283 - DNA, 22 bp, Artificial Sequence
  chemically synthesized
ttcatttcagacattgtagttt

SEQ ID NO: 9284 - DNA, 22 bp, Artificial Sequence
  chemically synthesized
tcatttcagacattgtagtttt

SEQ ID NO: 9285 - DNA, 22 bp, Artificial Sequence
  chemically synthesized
catttcagacattgtagttttt

SEQ ID NO: 9286 - DNA, 22 bp, Artificial Sequence
  chemically synthesized
atttcagacattgtagttttta

SEQ ID NO: 9287 - DNA, 22 bp, Artificial Sequence
  chemically synthesized
cagacattgtagtttttatctc

SEQ ID NO: 9288 - DNA, 22 bp, Artificial Sequence
  chemically synthesized
agacattgtagtttttatctct

SEQ ID NO: 9289 - DNA, 22 bp, Artificial Sequence
  chemically synthesized
tagtttttatctctagaagttc

SEQ ID NO: 9290 - DNA, 22 bp, Artificial Sequence
  chemically synthesized
ttatctctagaagttcacctgg

SEQ ID NO: 9291 - DNA, 22 bp, Artificial Sequence
  chemically synthesized
tatctctagaagttcacctggg

SEQ ID NO: 9292 - DNA, 22 bp, Artificial Sequence
  chemically synthesized
atctctagaagttcacctgggg

SEQ ID NO: 9293 - DNA, 22 bp, Artificial Sequence
  chemically synthesized
tctctagaagttcacctgggga

SEQ ID NO: 9294 - DNA, 22 bp, Artificial Sequence
  chemically synthesized
tagaagttcacctggggactct

SEQ ID NO: 9295 - DNA, 22 bp, Artificial Sequence
  chemically synthesized
gaagttcacctggggactctta

SEQ ID NO: 9296 - DNA, 22 bp, Artificial Sequence
  chemically synthesized
acctggggactcttaaatatcc

SEQ ID NO: 9297 - DNA, 22 bp, Artificial Sequence
  chemically synthesized
gggactcttaaatatcctccac

SEQ ID NO: 9298 - DNA, 22 bp, Artificial Sequence
  chemically synthesized
ttaaatatcctccacaattcta

SEQ ID NO: 9299 - DNA, 22 bp, Artificial Sequence
  chemically synthesized
aaatatcctccacaattctact

SEQ ID NO: 9300 - DNA, 22 bp, Artificial Sequence
  chemically synthesized
aatatcctccacaattctactt

SEQ ID NO: 9301 - DNA, 22 bp, Artificial Sequence
  chemically synthesized
cacaattctacttaattttttg

SEQ ID NO: 9302 - DNA, 22 bp, Artificial Sequence
  chemically synthesized
tacttaattttttgaacataat

SEQ ID NO: 9303 - DNA, 22 bp, Artificial Sequence
  chemically synthesized
cttaattttttgaacataatgg

SEQ ID NO: 9304 - DNA, 22 bp, Artificial Sequence
  chemically synthesized
aattttttgaacataatgggat

SEQ ID NO: 9305 - DNA, 22 bp, Artificial Sequence
  chemically synthesized
attttttgaacataatgggata

SEQ ID NO: 9306 - DNA, 22 bp, Artificial Sequence
  chemically synthesized
tttgaacataatgggatatggc

SEQ ID NO: 9307 - DNA, 22 bp, Artificial Sequence
  chemically synthesized
ttgaacataatgggatatggct

SEQ ID NO: 9308 - DNA, 22 bp, Artificial Sequence
  chemically synthesized
tgaacataatgggatatggcta

SEQ ID NO: 9309 - DNA, 22 bp, Artificial Sequence
  chemically synthesized
gaacataatgggatatggctat

SEQ ID NO: 9310 - DNA, 22 bp, Artificial Sequence
  chemically synthesized
aacataatgggatatggctata

SEQ ID NO: 9311 - DNA, 22 bp, Artificial Sequence
  chemically synthesized
taatatctgttttaccatcctt

SEQ ID NO: 9312 - DNA, 22 bp, Artificial Sequence
  chemically synthesized
ttttaccatccttgcctgctaa

SEQ ID NO: 9313 - DNA, 22 bp, Artificial Sequence
  chemically synthesized
taccatccttgcctgctaattc

SEQ ID NO: 9314 - DNA, 22 bp, Artificial Sequence
  chemically synthesized
accatccttgcctgctaattct

SEQ ID NO: 9315 - DNA, 22 bp, Artificial Sequence
  chemically synthesized
ccatccttgcctgctaattcta

SEQ ID NO: 9316 - DNA, 22 bp, Artificial Sequence
  chemically synthesized
gcctgctaattctagcatccgt

SEQ ID NO: 9317 - DNA, 22 bp, Artificial Sequence
  chemically synthesized
cctgctaattctagcatccgtg

SEQ ID NO: 9318 - DNA, 22 bp, Artificial Sequence
  chemically synthesized
ctaattctagcatccgtgtcag

SEQ ID NO: 9319 - DNA, 22 bp, Artificial Sequence
  chemically synthesized
attctagcatccgtgtcagttc

SEQ ID NO: 9320 - DNA, 22 bp, Artificial Sequence
  chemically synthesized
tagcatccgtgtcagttctgga

SEQ ID NO: 9321 - DNA, 22 bp, Artificial Sequence
  chemically synthesized
gcatccgtgtcagttctggatc

SEQ ID NO: 9322 - DNA, 22 bp, Artificial Sequence
  chemically synthesized
tggatctcttttgatatttatg

SEQ ID NO: 9323 - DNA, 22 bp, Artificial Sequence
  chemically synthesized
gatctcttttgatatttatgaa

SEQ ID NO: 9324 - DNA, 22 bp, Artificial Sequence
  chemically synthesized
ttttgatatttatgaacctcct

SEQ ID NO: 9325 - DNA, 22 bp, Artificial Sequence
  chemically synthesized
ttgatatttatgaacctcctcg

SEQ ID NO: 9326 - DNA, 22 bp, Artificial Sequence
  chemically synthesized
tgatatttatgaacctcctcgt

SEQ ID NO: 9327 - DNA, 22 bp, Artificial Sequence
  chemically synthesized
gatatttatgaacctcctcgtt

SEQ ID NO: 9328 - DNA, 22 bp, Artificial Sequence
  chemically synthesized
atatttatgaacctcctcgtta

SEQ ID NO: 9329 - DNA, 22 bp, Artificial Sequence
  chemically synthesized
atgaacctcctcgttatgcatt

SEQ ID NO: 9330 - DNA, 22 bp, Artificial Sequence
  chemically synthesized
tgaacctcctcgttatgcattg

SEQ ID NO: 9331 - DNA, 22 bp, Artificial Sequence
  chemically synthesized
ctcgttatgcattgtgttttcc

SEQ ID NO: 9332 - DNA, 22 bp, Artificial Sequence
  chemically synthesized
gttatgcattgtgttttcccgt

SEQ ID NO: 9333 - DNA, 22 bp, Artificial Sequence
  chemically synthesized
tgcattgtgttttcccgtttca

SEQ ID NO: 9334 - DNA, 22 bp, Artificial Sequence
  chemically synthesized
tgttttcccgtttcattgcatg

SEQ ID NO: 9335 - DNA, 22 bp, Artificial Sequence
  chemically synthesized
tcccgtttcattgcatgccttg

SEQ ID NO: 9336 - DNA, 22 bp, Artificial Sequence
  chemically synthesized
cccgtttcattgcatgccttgt

SEQ ID NO: 9337 - DNA, 22 bp, Artificial Sequence
  chemically synthesized
ccgtttcattgcatgccttgta

SEQ ID NO: 9338 - DNA, 22 bp, Artificial Sequence
  chemically synthesized
cattgcatgccttgtaatcttt

SEQ ID NO: 9339 - DNA, 22 bp, Artificial Sequence
  chemically synthesized
attgcatgccttgtaatctttg

SEQ ID NO: 9340 - DNA, 22 bp, Artificial Sequence
  chemically synthesized
catgccttgtaatctttgattg

SEQ ID NO: 9341 - DNA, 22 bp, Artificial Sequence
  chemically synthesized
gtaatctttgattggctgccag

SEQ ID NO: 9342 - DNA, 22 bp, Artificial Sequence
  chemically synthesized
taatctttgattggctgccaga

SEQ ID NO: 9343 - DNA, 22 bp, Artificial Sequence
  chemically synthesized
tgattggctgccagacattgtc

SEQ ID NO: 9344 - DNA, 22 bp, Artificial Sequence
  chemically synthesized
gattggctgccagacattgtca

SEQ ID NO: 9345 - DNA, 22 bp, Artificial Sequence
  chemically synthesized
attggctgccagacattgtcaa

SEQ ID NO: 9346 - DNA, 22 bp, Artificial Sequence
  chemically synthesized
gctgccagacattgtcaatttc

SEQ ID NO: 9347 - DNA, 22 bp, Artificial Sequence
  chemically synthesized
ccagacattgtcaatttcacct

SEQ ID NO: 9348 - DNA, 22 bp, Artificial Sequence
  chemically synthesized
tcaatttcaccttgttgggtgc

SEQ ID NO: 9349 - DNA, 22 bp, Artificial Sequence
  chemically synthesized
caccttgttgggtgctggatat

SEQ ID NO: 9350 - DNA, 22 bp, Artificial Sequence
  chemically synthesized
accttgttgggtgctggatatt

SEQ ID NO: 9351 - DNA, 22 bp, Artificial Sequence
  chemically synthesized
gttgggtgctggatatttttgt

SEQ ID NO: 9352 - DNA, 22 bp, Artificial Sequence
  chemically synthesized
ttgggtgctggatatttttgta

SEQ ID NO: 9353 - DNA, 22 bp, Artificial Sequence
  chemically synthesized
ggtgctggatatttttgtattc

SEQ ID NO: 9354 - DNA, 22 bp, Artificial Sequence
  chemically synthesized
gatatttttgtattcctctaaa

SEQ ID NO: 9355 - DNA, 22 bp, Artificial Sequence
  chemically synthesized
ttgtattcctctaaatgttctt

SEQ ID NO: 9356 - DNA, 22 bp, Artificial Sequence
  chemically synthesized
tgtattcctctaaatgttcttg

SEQ ID NO: 9357 - DNA, 22 bp, Artificial Sequence
  chemically synthesized
gtattcctctaaatgttcttga

SEQ ID NO: 9358 - DNA, 22 bp, Artificial Sequence
  chemically synthesized
tattcctctaaatgttcttgag

SEQ ID NO: 9359 - DNA, 22 bp, Artificial Sequence
  chemically synthesized
ctctaaatgttcttgagctttg

SEQ ID NO: 9360 - DNA, 22 bp, Artificial Sequence
  chemically synthesized
taaatgttcttgagctttgctc

SEQ ID NO: 9361 - DNA, 22 bp, Artificial Sequence
  chemically synthesized
aatgttcttgagctttgctccg

SEQ ID NO: 9362 - DNA, 22 bp, Artificial Sequence
  chemically synthesized
ttgagctttgctccgggatgca

SEQ ID NO: 9363 - DNA, 22 bp, Artificial Sequence
  chemically synthesized
gagctttgctccgggatgcagt

SEQ ID NO: 9364 - DNA, 22 bp, Artificial Sequence
  chemically synthesized
agctttgctccgggatgcagtt

SEQ ID NO: 9365 - DNA, 22 bp, Artificial Sequence
  chemically synthesized
tgctccgggatgcagttaagca

SEQ ID NO: 9366 - DNA, 22 bp, Artificial Sequence
  chemically synthesized
gctccgggatgcagttaagcaa

SEQ ID NO: 9367 - DNA, 22 bp, Artificial Sequence
  chemically synthesized
ctccgggatgcagttaagcaac

SEQ ID NO: 9368 - DNA, 22 bp, Artificial Sequence
  chemically synthesized
cgggatgcagttaagcaactta

SEQ ID NO: 9369 - DNA, 22 bp, Artificial Sequence
  chemically synthesized
agcaacttagagtcagtttgat

SEQ ID NO: 9370 - DNA, 22 bp, Artificial Sequence
  chemically synthesized
agagtcagtttgatcgtttgaa

SEQ ID NO: 9371 - DNA, 22 bp, Artificial Sequence
  chemically synthesized
gagtcagtttgatcgtttgaac

SEQ ID NO: 9372 - DNA, 22 bp, Artificial Sequence
  chemically synthesized
gatcgtttgaactcttaattgt

SEQ ID NO: 9373 - DNA, 22 bp, Artificial Sequence
  chemically synthesized
atcgtttgaactcttaattgtt

SEQ ID NO: 9374 - DNA, 22 bp, Artificial Sequence
  chemically synthesized
gaactcttaattgttttggtct

SEQ ID NO: 9375 - DNA, 22 bp, Artificial Sequence
  chemically synthesized
aactcttaattgttttggtctc

SEQ ID NO: 9376 - DNA, 22 bp, Artificial Sequence
  chemically synthesized
ttaattgttttggtctcctcgg

SEQ ID NO: 9377 - DNA, 22 bp, Artificial Sequence
  chemically synthesized
aattgttttggtctcctcggac

SEQ ID NO: 9378 - DNA, 22 bp, Artificial Sequence
  chemically synthesized
attgttttggtctcctcggact

SEQ ID NO: 9379 - DNA, 22 bp, Artificial Sequence
  chemically synthesized
ttttggtctcctcggactctca

SEQ ID NO: 9380 - DNA, 22 bp, Artificial Sequence
  chemically synthesized
tggtctcctcggactctcagct

SEQ ID NO: 9381 - DNA, 22 bp, Artificial Sequence
  chemically synthesized
ggtctcctcggactctcagctc

SEQ ID NO: 9382 - DNA, 22 bp, Artificial Sequence
  chemically synthesized
gtctcctcggactctcagctcc

SEQ ID NO: 9383 - DNA, 22 bp, Artificial Sequence
  chemically synthesized
ctcggactctcagctccatctc

SEQ ID NO: 9384 - DNA, 22 bp, Artificial Sequence
  chemically synthesized
ggactctcagctccatctcctc

SEQ ID NO: 9385 - DNA, 22 bp, Artificial Sequence
  chemically synthesized
tcagctccatctcctcaacgtg

SEQ ID NO: 9386 - DNA, 22 bp, Artificial Sequence
  chemically synthesized
agctccatctcctcaacgtggg

SEQ ID NO: 9387 - DNA, 22 bp, Artificial Sequence
  chemically synthesized
catctcctcaacgtggggagtc

SEQ ID NO: 9388 - DNA, 22 bp, Artificial Sequence
  chemically synthesized
ctcaacgtggggagtctcttgg

SEQ ID NO: 9389 - DNA, 22 bp, Artificial Sequence
  chemically synthesized
aacgtggggagtctcttgggct

SEQ ID NO: 9390 - DNA, 22 bp, Artificial Sequence
  chemically synthesized
ttgggctctgcctggacttccc

SEQ ID NO: 9391 - DNA, 22 bp, Artificial Sequence
  chemically synthesized
gggctctgcctggacttccctt

SEQ ID NO: 9392 - DNA, 22 bp, Artificial Sequence
  chemically synthesized
ggctctgcctggacttcccttt

SEQ ID NO: 9393 - DNA, 22 bp, Artificial Sequence
  chemically synthesized
tgcctggacttccctttcctgg

SEQ ID NO: 9394 - DNA, 22 bp, Artificial Sequence
  chemically synthesized
cctggacttccctttcctggcc

SEQ ID NO: 9395 - DNA, 22 bp, Artificial Sequence
  chemically synthesized
gacttccctttcctggcctgta

SEQ ID NO: 9396 - DNA, 22 bp, Artificial Sequence
  chemically synthesized
ccctttcctggcctgtaacctg

SEQ ID NO: 9397 - DNA, 22 bp, Artificial Sequence
  chemically synthesized
cctttcctggcctgtaacctgc

SEQ ID NO: 9398 - DNA, 22 bp, Artificial Sequence
  chemically synthesized
tcctggcctgtaacctgcagac

SEQ ID NO: 9399 - DNA, 22 bp, Artificial Sequence
  chemically synthesized
cctggcctgtaacctgcagact

SEQ ID NO: 9400 - DNA, 22 bp, Artificial Sequence
  chemically synthesized
ctggcctgtaacctgcagactc

SEQ ID NO: 9401 - DNA, 22 bp, Artificial Sequence
  chemically synthesized
gcctgtaacctgcagactctct

SEQ ID NO: 9402 - DNA, 22 bp, Artificial Sequence
  chemically synthesized
taacctgcagactctctccaaa

SEQ ID NO: 9403 - DNA, 22 bp, Artificial Sequence
  chemically synthesized
cagactctctccaaacagtaag

SEQ ID NO: 9404 - DNA, 22 bp, Artificial Sequence
  chemically synthesized
tctccaaacagtaagctggggt

SEQ ID NO: 9405 - DNA, 22 bp, Artificial Sequence
  chemically synthesized
tccaaacagtaagctggggtga

SEQ ID NO: 9406 - DNA, 22 bp, Artificial Sequence
  chemically synthesized
caaacagtaagctggggtgatc

SEQ ID NO: 9407 - DNA, 22 bp, Artificial Sequence
  chemically synthesized
gggtgatcggagggttcctgtt

SEQ ID NO: 9408 - DNA, 22 bp, Artificial Sequence
  chemically synthesized
ctgttgtttgcttcttatccct

SEQ ID NO: 9409 - DNA, 22 bp, Artificial Sequence
  chemically synthesized
ttgtttgcttcttatccctcag

SEQ ID NO: 9410 - DNA, 22 bp, Artificial Sequence
  chemically synthesized
tttgcttcttatccctcaggga

SEQ ID NO: 9411 - DNA, 22 bp, Artificial Sequence
  chemically synthesized
gcttcttatccctcagggatct

SEQ ID NO: 9412 - DNA, 22 bp, Artificial Sequence
  chemically synthesized
cttcttatccctcagggatctt

SEQ ID NO: 9413 - DNA, 22 bp, Artificial Sequence
  chemically synthesized
cttatccctcagggatctttac

SEQ ID NO: 9414 - DNA, 22 bp, Artificial Sequence
  chemically synthesized
ttatccctcagggatctttact

SEQ ID NO: 9415 - DNA, 22 bp, Artificial Sequence
  chemically synthesized
atccctcagggatctttactcc

SEQ ID NO: 9416 - DNA, 22 bp, Artificial Sequence
  chemically synthesized
tccctcagggatctttactcct

SEQ ID NO: 9417 - DNA, 22 bp, Artificial Sequence
  chemically synthesized
agggatctttactcctccttgc

SEQ ID NO: 9418 - DNA, 22 bp, Artificial Sequence
  chemically synthesized
tactcctccttgcctgatgtcc

SEQ ID NO: 9419 - DNA, 22 bp, Artificial Sequence
  chemically synthesized
actcctccttgcctgatgtcca

SEQ ID NO: 9420 - DNA, 22 bp, Artificial Sequence
  chemically synthesized
ctcctccttgcctgatgtccag

SEQ ID NO: 9421 - DNA, 22 bp, Artificial Sequence
  chemically synthesized
ctccttgcctgatgtccagagt

SEQ ID NO: 9422 - DNA, 22 bp, Artificial Sequence
  chemically synthesized
cttgcctgatgtccagagtctt

SEQ ID NO: 9423 - DNA, 22 bp, Artificial Sequence
  chemically synthesized
gcctgatgtccagagtcttgaa

SEQ ID NO: 9424 - DNA, 22 bp, Artificial Sequence
  chemically synthesized
cctgatgtccagagtcttgaaa

SEQ ID NO: 9425 - DNA, 22 bp, Artificial Sequence
  chemically synthesized
atgtccagagtcttgaaagctg

SEQ ID NO: 9426 - DNA, 22 bp, Artificial Sequence
  chemically synthesized
gaaagctgccatgttctatagt

SEQ ID NO: 9427 - DNA, 22 bp, Artificial Sequence
  chemically synthesized
aaagctgccatgttctatagtt

SEQ ID NO: 9428 - DNA, 22 bp, Artificial Sequence
  chemically synthesized
ccatgttctatagttgtctgtt

SEQ ID NO: 9429 - DNA, 22 bp, Artificial Sequence
  chemically synthesized
tatagttgtctgtttttgtttt

SEQ ID NO: 9430 - DNA, 22 bp, Artificial Sequence
  chemically synthesized
tagttgtctgtttttgttttga

SEQ ID NO: 9431 - DNA, 22 bp, Artificial Sequence
  chemically synthesized
tctgtttttgttttgattgttt

SEQ ID NO: 9432 - DNA, 22 bp, Artificial Sequence
  chemically synthesized
tttttgttttgattgtttctgg

SEQ ID NO: 9433 - DNA, 22 bp, Artificial Sequence
  chemically synthesized
ttgttttgattgtttctgggga

SEQ ID NO: 9434 - DNA, 22 bp, Artificial Sequence
  chemically synthesized
tgttttgattgtttctggggag

SEQ ID NO: 9435 - DNA, 22 bp, Artificial Sequence
  chemically synthesized
gttttgattgtttctggggaga

SEQ ID NO: 9436 - DNA, 22 bp, Artificial Sequence
  chemically synthesized
ttttgattgtttctggggagag

SEQ ID NO: 9437 - DNA, 22 bp, Artificial Sequence
  chemically synthesized
tgattgtttctggggagagaag

SEQ ID NO: 9438 - DNA, 22 bp, Artificial Sequence
  chemically synthesized
gattgtttctggggagagaaga

SEQ ID NO: 9439 - DNA, 22 bp, Artificial Sequence
  chemically synthesized
attgtttctggggagagaagaa

SEQ ID NO: 9440 - DNA, 22 bp, Artificial Sequence
  chemically synthesized
tttctggggagagaagaactct

SEQ ID NO: 9441 - DNA, 22 bp, Artificial Sequence
  chemically synthesized
ctggggagagaagaactcttcc

SEQ ID NO: 9442 - DNA, 22 bp, Artificial Sequence
  chemically synthesized
tggggagagaagaactcttccc

SEQ ID NO: 9443 - DNA, 22 bp, Artificial Sequence
  chemically synthesized
gggagagaagaactcttcccat

SEQ ID NO: 9444 - DNA, 22 bp, Artificial Sequence
  chemically synthesized
ttcccatcttgggcagaccctg

SEQ ID NO: 9445 - DNA, 22 bp, Artificial Sequence
  chemically synthesized
cccatcttgggcagaccctgtc

SEQ ID NO: 9446 - DNA, 22 bp, Artificial Sequence
  chemically synthesized
ccatcttgggcagaccctgtct

SEQ ID NO: 9447 - DNA, 22 bp, Artificial Sequence
  chemically synthesized
gggcagaccctgtcttttatgt

SEQ ID NO: 9448 - DNA, 22 bp, Artificial Sequence
  chemically synthesized
ggcagaccctgtcttttatgtt

SEQ ID NO: 9449 - DNA, 22 bp, Artificial Sequence
  chemically synthesized
tcttttatgttcaaacttttgc

SEQ ID NO: 9450 - DNA, 22 bp, Artificial Sequence
  chemically synthesized
ttatgttcaaacttttgcctaa

SEQ ID NO: 9451 - DNA, 22 bp, Artificial Sequence
  chemically synthesized
tatgttcaaacttttgcctaag

SEQ ID NO: 9452 - DNA, 22 bp, Artificial Sequence
  chemically synthesized
atgttcaaacttttgcctaaga

SEQ ID NO: 9453 - DNA, 22 bp, Artificial Sequence
  chemically synthesized
tgttcaaacttttgcctaagaa

SEQ ID NO: 9454 - DNA, 22 bp, Artificial Sequence
  chemically synthesized
aaacttttgcctaagaagcaca

SEQ ID NO: 9455 - DNA, 22 bp, Artificial Sequence
  chemically synthesized
ttgcctaagaagcacattacat

SEQ ID NO: 9456 - DNA, 22 bp, Artificial Sequence
  chemically synthesized
tgcctaagaagcacattacata

SEQ ID NO: 9457 - DNA, 22 bp, Artificial Sequence
  chemically synthesized
gcctaagaagcacattacatat

SEQ ID NO: 9458 - DNA, 22 bp, Artificial Sequence
  chemically synthesized
cctaagaagcacattacatatt

SEQ ID NO: 9459 - DNA, 22 bp, Artificial Sequence
  chemically synthesized
agaagcacattacatattttaa

SEQ ID NO: 9460 - DNA, 22 bp, Artificial Sequence
  chemically synthesized
catattttaactcatctaatta

SEQ ID NO: 9461 - DNA, 22 bp, Artificial Sequence
  chemically synthesized
taactcatctaattatccgagc

SEQ ID NO: 9462 - DNA, 22 bp, Artificial Sequence
  chemically synthesized
aactcatctaattatccgagca

SEQ ID NO: 9463 - DNA, 22 bp, Artificial Sequence
  chemically synthesized
actcatctaattatccgagcaa

SEQ ID NO: 9464 - DNA, 22 bp, Artificial Sequence
  chemically synthesized
atctaattatccgagcaatcca

SEQ ID NO: 9465 - DNA, 22 bp, Artificial Sequence
  chemically synthesized
attatccgagcaatccaatcgg

SEQ ID NO: 9466 - DNA, 22 bp, Artificial Sequence
  chemically synthesized
tccgagcaatccaatcgggtag

SEQ ID NO: 9467 - DNA, 22 bp, Artificial Sequence
  chemically synthesized
cgactgtgatctccattttaca

SEQ ID NO: 9468 - DNA, 22 bp, Artificial Sequence
  chemically synthesized
tgatctccattttacacacgag

SEQ ID NO: 9469 - DNA, 22 bp, Artificial Sequence
  chemically synthesized
cattttacacacgagaaaatgg

SEQ ID NO: 9470 - DNA, 22 bp, Artificial Sequence
  chemically synthesized
tacacacgagaaaatggaagca

SEQ ID NO: 9471 - DNA, 22 bp, Artificial Sequence
  chemically synthesized
acacacgagaaaatggaagcat

SEQ ID NO: 9472 - DNA, 22 bp, Artificial Sequence
  chemically synthesized
cacacgagaaaatggaagcatg

SEQ ID NO: 9473 - DNA, 22 bp, Artificial Sequence
  chemically synthesized
aatgctggtgcatgatctcaga

SEQ ID NO: 9474 - DNA, 22 bp, Artificial Sequence
  chemically synthesized
gtgcatgatctcagagctacct

SEQ ID NO: 9475 - DNA, 22 bp, Artificial Sequence
  chemically synthesized
agagctacctggaggcacagct

SEQ ID NO: 9476 - DNA, 22 bp, Artificial Sequence
  chemically synthesized
cctggaggcacagctgggctac

SEQ ID NO: 9477 - DNA, 22 bp, Artificial Sequence
  chemically synthesized
gaggcacagctgggctaccctg

SEQ ID NO: 9478 - DNA, 22 bp, Artificial Sequence
  chemically synthesized
ggctaccctgtgggcagtctgg

SEQ ID NO: 9479 - DNA, 22 bp, Artificial Sequence
  chemically synthesized
ccctgtgggcagtctggtttca

SEQ ID NO: 9480 - DNA, 22 bp, Artificial Sequence
  chemically synthesized
tgggcagtctggtttcagggtg

SEQ ID NO: 9481 - DNA, 22 bp, Artificial Sequence
  chemically synthesized
gtttcagggtggatatacagac

SEQ ID NO: 9482 - DNA, 22 bp, Artificial Sequence
  chemically synthesized
cagggtggatatacagacacgt

SEQ ID NO: 9483 - DNA, 22 bp, Artificial Sequence
  chemically synthesized
agggtggatatacagacacgtt

SEQ ID NO: 9484 - DNA, 22 bp, Artificial Sequence
  chemically synthesized
ctgggctgacccagcattggga

SEQ ID NO: 9485 - DNA, 22 bp, Artificial Sequence
  chemically synthesized
ggctgacccagcattgggagtt

SEQ ID NO: 9486 - DNA, 22 bp, Artificial Sequence
  chemically synthesized
acccagcattgggagttgataa

SEQ ID NO: 9487 - DNA, 22 bp, Artificial Sequence
  chemically synthesized
ggagttgataagtcggactggg

SEQ ID NO: 9488 - DNA, 22 bp, Artificial Sequence
  chemically synthesized
ataagtcggactgggaagcagg

SEQ ID NO: 9489 - DNA, 22 bp, Artificial Sequence
  chemically synthesized
ggaagcaggacaggaccctctg

SEQ ID NO: 9490 - DNA, 22 bp, Artificial Sequence
  chemically synthesized
tgagtggagggtgctgaagaca

SEQ ID NO: 9491 - DNA, 22 bp, Artificial Sequence
  chemically synthesized
agtggagggtgctgaagacagc

SEQ ID NO: 9492 - DNA, 22 bp, Artificial Sequence
  chemically synthesized
aagacagcagtcagggactcag

SEQ ID NO: 9493 - DNA, 22 bp, Artificial Sequence
  chemically synthesized
agccatggagggccagcttggt

SEQ ID NO: 9494 - DNA, 22 bp, Artificial Sequence
  chemically synthesized
ggtggggaacaccgtggtcatg

SEQ ID NO: 9495 - DNA, 22 bp, Artificial Sequence
  chemically synthesized
gtggggaacaccgtggtcatgg

SEQ ID NO: 9496 - DNA, 22 bp, Artificial Sequence
  chemically synthesized
ctggatggagaggaatgcaaag

SEQ ID NO: 9497 - DNA, 22 bp, Artificial Sequence
  chemically synthesized
tggatggagaggaatgcaaagg

SEQ ID NO: 9498 - DNA, 22 bp, Artificial Sequence
  chemically synthesized
gatggagaggaatgcaaaggcc

SEQ ID NO: 9499 - DNA, 22 bp, Artificial Sequence
  chemically synthesized
ggaggaaggggtgggggcagtg

SEQ ID NO: 9500 - DNA, 22 bp, Artificial Sequence
  chemically synthesized
gaggaaggggtgggggcagtga

SEQ ID NO: 9501 - DNA, 22 bp, Artificial Sequence
  chemically synthesized
tgctcagagcgggagtgggcag

SEQ ID NO: 9502 - DNA, 22 bp, Artificial Sequence
  chemically synthesized
agagcgggagtgggcagtggag

SEQ ID NO: 9503 - DNA, 22 bp, Artificial Sequence
  chemically synthesized
cctgggtcaaatggggtcctga

SEQ ID NO: 9504 - DNA, 22 bp, Artificial Sequence
  chemically synthesized
ggtcaaatggggtcctgagtgt

SEQ ID NO: 9505 - DNA, 22 bp, Artificial Sequence
  chemically synthesized
agtgtggctgcagtggggaagg

SEQ ID NO: 9506 - DNA, 22 bp, Artificial Sequence
  chemically synthesized
cagtggggaaggtggaagtcac

SEQ ID NO: 9507 - DNA, 22 bp, Artificial Sequence
  chemically synthesized
gtgtgaaaaagatgaagagtta

SEQ ID NO: 9508 - DNA, 22 bp, Artificial Sequence
  chemically synthesized
tggacagtcacttacaggggca

SEQ ID NO: 9509 - DNA, 22 bp, Artificial Sequence
  chemically synthesized
acaggggcagtgtctgactcag

SEQ ID NO: 9510 - DNA, 22 bp, Artificial Sequence
  chemically synthesized
caggggcagtgtctgactcagg

SEQ ID NO: 9511 - DNA, 22 bp, Artificial Sequence
  chemically synthesized
actcaggacagtggcaggaagt

SEQ ID NO: 9512 - DNA, 22 bp, Artificial Sequence
  chemically synthesized
aggacagtggcaggaagtgacc

SEQ ID NO: 9513 - DNA, 22 bp, Artificial Sequence
  chemically synthesized
gggaggaagattctgggcccct

SEQ ID NO: 9514 - DNA, 22 bp, Artificial Sequence
  chemically synthesized
tgggcccctgactgagcctccc

SEQ ID NO: 9515 - DNA, 22 bp, Artificial Sequence
  chemically synthesized
ggcccctgactgagcctcccca

SEQ ID NO: 9516 - DNA, 22 bp, Artificial Sequence
  chemically synthesized
actgagcctccccaggatgtgg

SEQ ID NO: 9517 - DNA, 22 bp, Artificial Sequence
  chemically synthesized
agcctccccaggatgtggtcct

SEQ ID NO: 9518 - DNA, 22 bp, Artificial Sequence
  chemically synthesized
cccaggatgtggtcctgctggg

SEQ ID NO: 9519 - DNA, 22 bp, Artificial Sequence
  chemically synthesized
ctgggtcggggggtgataggaa

SEQ ID NO: 9520 - DNA, 22 bp, Artificial Sequence
  chemically synthesized
ggtcggggggtgataggaatga

SEQ ID NO: 9521 - DNA, 22 bp, Artificial Sequence
  chemically synthesized
gaaggtgttctgtttgcaggtg

SEQ ID NO: 9522 - DNA, 22 bp, Artificial Sequence
  chemically synthesized
tgtttgcaggtggatgctgcaa

SEQ ID NO: 9523 - DNA, 22 bp, Artificial Sequence
  chemically synthesized
tttgcaggtggatgctgcaaag

SEQ ID NO: 9524 - DNA, 22 bp, Artificial Sequence
  chemically synthesized
gcaggtggatgctgcaaagaga

SEQ ID NO: 9525 - DNA, 22 bp, Artificial Sequence
  chemically synthesized
caggtggatgctgcaaagagag

SEQ ID NO: 9526 - DNA, 22 bp, Artificial Sequence
  chemically synthesized
caaagagaggagctcagggctg

SEQ ID NO: 9527 - DNA, 22 bp, Artificial Sequence
  chemically synthesized
agggctgggacaactggagctg

SEQ ID NO: 9528 - DNA, 22 bp, Artificial Sequence
  chemically synthesized
ggacaactggagctgctctggg

SEQ ID NO: 9529 - DNA, 22 bp, Artificial Sequence
  chemically synthesized
gagctgctctgggtctggaggc

SEQ ID NO: 9530 - DNA, 22 bp, Artificial Sequence
  chemically synthesized
ctctgggtctggaggcagcaga

SEQ ID NO: 9531 - DNA, 22 bp, Artificial Sequence
  chemically synthesized
tgggtctggaggcagcagagag

SEQ ID NO: 9532 - DNA, 22 bp, Artificial Sequence
  chemically synthesized
ggtctggaggcagcagagaggg

SEQ ID NO: 9533 - DNA, 22 bp, Artificial Sequence
  chemically synthesized
gaggcagcagagagggagccca

SEQ ID NO: 9534 - DNA, 22 bp, Artificial Sequence
  chemically synthesized
tgtgtgcaggaagacgtgggtg

SEQ ID NO: 9535 - DNA, 22 bp, Artificial Sequence
  chemically synthesized
tgtgcaggaagacgtgggtgtg

SEQ ID NO: 9536 - DNA, 22 bp, Artificial Sequence
  chemically synthesized
gcatgcatatgcacatgtgaga

SEQ ID NO: 9537 - DNA, 22 bp, Artificial Sequence
  chemically synthesized
ttgagtgaagtgagcaatgtgt

SEQ ID NO: 9538 - DNA, 22 bp, Artificial Sequence
  chemically synthesized
tgagtgaagtgagcaatgtgtg

SEQ ID NO: 9539 - DNA, 22 bp, Artificial Sequence
  chemically synthesized
gagtgaagtgagcaatgtgtga

SEQ ID NO: 9540 - DNA, 22 bp, Artificial Sequence
  chemically synthesized
agtgaagtgagcaatgtgtgag

SEQ ID NO: 9541 - DNA, 22 bp, Artificial Sequence
  chemically synthesized
gtgagggcatgtgaatgtgtgt

SEQ ID NO: 9542 - DNA, 22 bp, Artificial Sequence
  chemically synthesized
tgagggcatgtgaatgtgtgtg

SEQ ID NO: 9543 - DNA, 22 bp, Artificial Sequence
  chemically synthesized
tcagggtgcagatggatcaagg

SEQ ID NO: 9544 - DNA, 22 bp, Artificial Sequence
  chemically synthesized
tgagatgacctcgggctgaggg

SEQ ID NO: 9545 - DNA, 22 bp, Artificial Sequence
  chemically synthesized
gggctgaggggagcaaatttag

SEQ ID NO: 9546 - DNA, 22 bp, Artificial Sequence
  chemically synthesized
aggggagcaaatttagtgtgga

SEQ ID NO: 9547 - DNA, 22 bp, Artificial Sequence
  chemically synthesized
agtgtggaacgaggtttctagg

SEQ ID NO: 9548 - DNA, 22 bp, Artificial Sequence
  chemically synthesized
gtgtggaacgaggtttctaggg

SEQ ID NO: 9549 - DNA, 22 bp, Artificial Sequence
  chemically synthesized
ctagggaagcgagggcaaaggg

SEQ ID NO: 9550 - DNA, 22 bp, Artificial Sequence
  chemically synthesized
tagggaagcgagggcaaagggc

SEQ ID NO: 9551 - DNA, 22 bp, Artificial Sequence
  chemically synthesized
gggaagcgagggcaaagggcgc

SEQ ID NO: 9552 - DNA, 22 bp, Artificial Sequence
  chemically synthesized
gggaggaggccttgcgtggtgg

SEQ ID NO: 9553 - DNA, 22 bp, Artificial Sequence
  chemically synthesized
gcgtggtgggggatgaggacaa

SEQ ID NO: 9554 - DNA, 22 bp, Artificial Sequence
  chemically synthesized
cgtggtgggggatgaggacaac

SEQ ID NO: 9555 - DNA, 22 bp, Artificial Sequence
  chemically synthesized
gagggttgtgcttggagagtgg

SEQ ID NO: 9556 - DNA, 22 bp, Artificial Sequence
  chemically synthesized
tgcttggagagtgggctatggt

SEQ ID NO: 9557 - DNA, 22 bp, Artificial Sequence
  chemically synthesized
ggagagtgggctatggtggaat

SEQ ID NO: 9558 - DNA, 22 bp, Artificial Sequence
  chemically synthesized
gagagtgggctatggtggaatg

SEQ ID NO: 9559 - DNA, 22 bp, Artificial Sequence
  chemically synthesized
tggtggaatgacccagatttaa

SEQ ID NO: 9560 - DNA, 22 bp, Artificial Sequence
  chemically synthesized
aaggatctcaatggaattttgg

SEQ ID NO: 9561 - DNA, 22 bp, Artificial Sequence
  chemically synthesized
aggatctcaatggaattttggc

SEQ ID NO: 9562 - DNA, 22 bp, Artificial Sequence
  chemically synthesized
aatggaattttggcaggggagg

SEQ ID NO: 9563 - DNA, 22 bp, Artificial Sequence
  chemically synthesized
tggcaggggagggactgttcca

SEQ ID NO: 9564 - DNA, 22 bp, Artificial Sequence
  chemically synthesized
ggcaggggagggactgttccag

SEQ ID NO: 9565 - DNA, 22 bp, Artificial Sequence
  chemically synthesized
gcaggggagggactgttccagt

SEQ ID NO: 9566 - DNA, 22 bp, Artificial Sequence
  chemically synthesized
ttccagtatggattttaggaag

SEQ ID NO: 9567 - DNA, 22 bp, Artificial Sequence
  chemically synthesized
cagtatggattttaggaagaac

SEQ ID NO: 9568 - DNA, 22 bp, Artificial Sequence
  chemically synthesized
taggaagaacacagggcccagc

SEQ ID NO: 9569 - DNA, 22 bp, Artificial Sequence
  chemically synthesized
aggaagaacacagggcccagct

SEQ ID NO: 9570 - DNA, 22 bp, Artificial Sequence
  chemically synthesized
ggaagaacacagggcccagctt

SEQ ID NO: 9571 - DNA, 22 bp, Artificial Sequence
  chemically synthesized
ctggagtctccaatctgagggg

SEQ ID NO: 9572 - DNA, 22 bp, Artificial Sequence
  chemically synthesized
tggagtctccaatctgagggga

SEQ ID NO: 9573 - DNA, 22 bp, Artificial Sequence
  chemically synthesized
gagtctccaatctgaggggaca

SEQ ID NO: 9574 - DNA, 22 bp, Artificial Sequence
  chemically synthesized
caatctgaggggacaggagcct

SEQ ID NO: 9575 - DNA, 22 bp, Artificial Sequence
  chemically synthesized
aggggacaggagccttagaaga

SEQ ID NO: 9576 - DNA, 22 bp, Artificial Sequence
  chemically synthesized
agaagagctgagactaaggccc

SEQ ID NO: 9577 - DNA, 22 bp, Artificial Sequence
  chemically synthesized
gaagagctgagactaaggcccg

SEQ ID NO: 9578 - DNA, 22 bp, Artificial Sequence
  chemically synthesized
agactaaggcccgaggtgatct

SEQ ID NO: 9579 - DNA, 22 bp, Artificial Sequence
  chemically synthesized
aggcccgaggtgatctggaggc

SEQ ID NO: 9580 - DNA, 22 bp, Artificial Sequence
  chemically synthesized
gaggcctctgccactggctgga

SEQ ID NO: 9581 - DNA, 22 bp, Artificial Sequence
  chemically synthesized
tgccactggctggatgggagga

SEQ ID NO: 9582 - DNA, 22 bp, Artificial Sequence
  chemically synthesized
ccactggctggatgggaggaaa

SEQ ID NO: 9583 - DNA, 22 bp, Artificial Sequence
  chemically synthesized
gctggatgggaggaaaaccatt

SEQ ID NO: 9584 - DNA, 22 bp, Artificial Sequence
  chemically synthesized
gatgggaggaaaaccattcaca

SEQ ID NO: 9585 - DNA, 22 bp, Artificial Sequence
  chemically synthesized
acagatcccccttctcaggatg

SEQ ID NO: 9586 - DNA, 22 bp, Artificial Sequence
  chemically synthesized
ctcaggatgtgtgcctaggcag

SEQ ID NO: 9587 - DNA, 22 bp, Artificial Sequence
  chemically synthesized
tcaggatgtgtgcctaggcagg

SEQ ID NO: 9588 - DNA, 22 bp, Artificial Sequence
  chemically synthesized
aggatgtgtgcctaggcagggc

SEQ ID NO: 9589 - DNA, 22 bp, Artificial Sequence
  chemically synthesized
ggcagggccgggtctgcccccc

SEQ ID NO: 9590 - DNA, 22 bp, Artificial Sequence
  chemically synthesized
cccccccgccccctgtgcgtct

SEQ ID NO: 9591 - DNA, 22 bp, Artificial Sequence
  chemically synthesized
tgcgtctcccagtcccccagct

SEQ ID NO: 9592 - DNA, 22 bp, Artificial Sequence
  chemically synthesized
ccagtcccccagctccaggatc

SEQ ID NO: 9593 - DNA, 22 bp, Artificial Sequence
  chemically synthesized
caggatccgggctttgcacaca

SEQ ID NO: 9594 - DNA, 22 bp, Artificial Sequence
  chemically synthesized
tgcacacagctgatgtgaatat

SEQ ID NO: 9595 - DNA, 22 bp, Artificial Sequence
  chemically synthesized
gcacacagctgatgtgaatatc

SEQ ID NO: 9596 - DNA, 22 bp, Artificial Sequence
  chemically synthesized
cacacagctgatgtgaatatcc

SEQ ID NO: 9597 - DNA, 22 bp, Artificial Sequence
  chemically synthesized
atgtgaatatcctgagtcgtgt

SEQ ID NO: 9598 - DNA, 22 bp, Artificial Sequence
  chemically synthesized
agtcgtgtgcatgggtgtgtgt

SEQ ID NO: 9599 - DNA, 22 bp, Artificial Sequence
  chemically synthesized
gctgcgtgtgtatatttataca

SEQ ID NO: 9600 - DNA, 22 bp, Artificial Sequence
  chemically synthesized
cgtgtgtatatttatacatggt

SEQ ID NO: 9601 - DNA, 22 bp, Artificial Sequence
  chemically synthesized
atacatggtaatatgggtgcga

SEQ ID NO: 9602 - DNA, 22 bp, Artificial Sequence
  chemically synthesized
tacatggtaatatgggtgcgag

SEQ ID NO: 9603 - DNA, 22 bp, Artificial Sequence
  chemically synthesized
aaatgctggggtcaaagcctat

SEQ ID NO: 9604 - DNA, 22 bp, Artificial Sequence
  chemically synthesized
gggtcaaagcctatgatgaccc

SEQ ID NO: 9605 - DNA, 22 bp, Artificial Sequence
  chemically synthesized
tgatgacccccccccatggccc

SEQ ID NO: 9606 - DNA, 22 bp, Artificial Sequence
  chemically synthesized
tgcctcctcaggcttcggtgcc

SEQ ID NO: 9607 - DNA, 22 bp, Artificial Sequence
  chemically synthesized
ctcaggcttcggtgccctgtct

SEQ ID NO: 9608 - DNA, 22 bp, Artificial Sequence
  chemically synthesized
aggcttcggtgccctgtcttta

SEQ ID NO: 9609 - DNA, 22 bp, Artificial Sequence
  chemically synthesized
cggtgccctgtctttaccctcc

SEQ ID NO: 9610 - DNA, 22 bp, Artificial Sequence
  chemically synthesized
ggtgccctgtctttaccctccg

SEQ ID NO: 9611 - DNA, 22 bp, Artificial Sequence
  chemically synthesized
tctttaccctccggctccccac

SEQ ID NO: 9612 - DNA, 22 bp, Artificial Sequence
  chemically synthesized
taccctccggctccccacaccc

SEQ ID NO: 9613 - DNA, 22 bp, Artificial Sequence
  chemically synthesized
accctccggctccccacaccca

SEQ ID NO: 9614 - DNA, 22 bp, Artificial Sequence
  chemically synthesized
ccctccggctccccacacccag

SEQ ID NO: 9615 - DNA, 22 bp, Artificial Sequence
  chemically synthesized
cggctccccacacccaggctgc

SEQ ID NO: 9616 - DNA, 22 bp, Artificial Sequence
  chemically synthesized
cccacacccaggctgccggctc

SEQ ID NO: 9617 - DNA, 22 bp, Artificial Sequence
  chemically synthesized
ccggctcctgatgcccctctcc

SEQ ID NO: 9618 - DNA, 22 bp, Artificial Sequence
  chemically synthesized
ctgatgcccctctcccacaggg

SEQ ID NO: 9619 - DNA, 22 bp, Artificial Sequence
  chemically synthesized
atgcccctctcccacagggcca

SEQ ID NO: 9620 - DNA, 22 bp, Artificial Sequence
  chemically synthesized
tcccacagggccacctcctgcc

SEQ ID NO: 9621 - DNA, 22 bp, Artificial Sequence
  chemically synthesized
ccacagggccacctcctgccca

SEQ ID NO: 9622 - DNA, 22 bp, Artificial Sequence
  chemically synthesized
ctgcccagcccctggcacagcg

SEQ ID NO: 9623 - DNA, 22 bp, Artificial Sequence
  chemically synthesized
cccagcccctggcacagcgtct

SEQ ID NO: 9624 - DNA, 22 bp, Artificial Sequence
  chemically synthesized
gcacagcgtctctgctccatgg

SEQ ID NO: 9625 - DNA, 22 bp, Artificial Sequence
  chemically synthesized
tgctccatggtctgcttcagtc

SEQ ID NO: 9626 - DNA, 22 bp, Artificial Sequence
  chemically synthesized
ctccatggtctgcttcagtctg

SEQ ID NO: 9627 - DNA, 22 bp, Artificial Sequence
  chemically synthesized
catggtctgcttcagtctgctt

SEQ ID NO: 9628 - DNA, 22 bp, Artificial Sequence
  chemically synthesized
cttcagtctgcttgccctgagc

SEQ ID NO: 9629 - DNA, 22 bp, Artificial Sequence
  chemically synthesized
cagtctgcttgccctgagcttc

SEQ ID NO: 9630 - DNA, 22 bp, Artificial Sequence
  chemically synthesized
agtctgcttgccctgagcttca

SEQ ID NO: 9631 - DNA, 22 bp, Artificial Sequence
  chemically synthesized
cttgccctgagcttcaacatcc

SEQ ID NO: 9632 - DNA, 22 bp, Artificial Sequence
  chemically synthesized
gccctgagcttcaacatcctgc

SEQ ID NO: 9633 - DNA, 22 bp, Artificial Sequence
  chemically synthesized
ccctgagcttcaacatcctgct

SEQ ID NO: 9634 - DNA, 22 bp, Artificial Sequence
  chemically synthesized
agcttcaacatcctgctgctgg

SEQ ID NO: 9635 - DNA, 22 bp, Artificial Sequence
  chemically synthesized
caacatcctgctgctggtggtc

SEQ ID NO: 9636 - DNA, 22 bp, Artificial Sequence
  chemically synthesized
aacatcctgctgctggtggtca

SEQ ID NO: 9637 - DNA, 22 bp, Artificial Sequence
  chemically synthesized
ctgctggtggtcatctgtgtga

SEQ ID NO: 9638 - DNA, 22 bp, Artificial Sequence
  chemically synthesized
ctggtggtcatctgtgtgactg

SEQ ID NO: 9639 - DNA, 22 bp, Artificial Sequence
  chemically synthesized
gtggtcatctgtgtgactgggt

SEQ ID NO: 9640 - DNA, 22 bp, Artificial Sequence
  chemically synthesized
tgtgactgggtcccaaagtgag

SEQ ID NO: 9641 - DNA, 22 bp, Artificial Sequence
  chemically synthesized
ggtcccaaagtgagggtcacgg

SEQ ID NO: 9642 - DNA, 20 bp, Artificial Sequence
  chemically synthesized
cttcagatagattatatctg

SEQ ID NO: 9643 - DNA, 20 bp, Artificial Sequence
  chemically synthesized
gatagattatatctggagtg

SEQ ID NO: 9644 - DNA, 20 bp, Artificial Sequence
  chemically synthesized
aatcctgccacctatgtatc

SEQ ID NO: 9645 - DNA, 20 bp, Artificial Sequence
  chemically synthesized
tgccacctatgtatctggca

SEQ ID NO: 9646 - DNA, 20 bp, Artificial Sequence
  chemically synthesized
ctatgtatctggcatagtgt

SEQ ID NO: 9647 - DNA, 20 bp, Artificial Sequence
  chemically synthesized
gagtcctcataaatgcttac

SEQ ID NO: 9648 - DNA, 20 bp, Artificial Sequence
  chemically synthesized
cataaatgcttactggtttg

SEQ ID NO: 9649 - DNA, 20 bp, Artificial Sequence
  chemically synthesized
ataaatgcttactggtttga

SEQ ID NO: 9650 - DNA, 20 bp, Artificial Sequence
  chemically synthesized
taaatgcttactggtttgaa

SEQ ID NO: 9651 - DNA, 20 bp, Artificial Sequence
  chemically synthesized
tggtttgaagggcaacaaaa

SEQ ID NO: 9652 - DNA, 20 bp, Artificial Sequence
  chemically synthesized
aagggcaacaaaatagtgaa

SEQ ID NO: 9653 - DNA, 20 bp, Artificial Sequence
  chemically synthesized
gggcaacaaaatagtgaaca

SEQ ID NO: 9654 - DNA, 20 bp, Artificial Sequence
  chemically synthesized
acagagtgaaaatccccact

SEQ ID NO: 9655 - DNA, 20 bp, Artificial Sequence
  chemically synthesized
gaaaatccccactaagatcc

SEQ ID NO: 9656 - DNA, 20 bp, Artificial Sequence
  chemically synthesized
aaaatccccactaagatcct

SEQ ID NO: 9657 - DNA, 20 bp, Artificial Sequence
  chemically synthesized
ccccactaagatcctgggtc

SEQ ID NO: 9658 - DNA, 20 bp, Artificial Sequence
  chemically synthesized
taagatcctgggtccagaaa

SEQ ID NO: 9659 - DNA, 20 bp, Artificial Sequence
  chemically synthesized
atcctgggtccagaaaaaga

SEQ ID NO: 9660 - DNA, 20 bp, Artificial Sequence
  chemically synthesized
tcctgggtccagaaaaagat

SEQ ID NO: 9661 - DNA, 20 bp, Artificial Sequence
  chemically synthesized
aaaaagatgggaaacctgtt

SEQ ID NO: 9662 - DNA, 20 bp, Artificial Sequence
  chemically synthesized
aacctgtttagctcacccgt

SEQ ID NO: 9663 - DNA, 20 bp, Artificial Sequence
  chemically synthesized
ttagctcacccgtgagccca

SEQ ID NO: 9664 - DNA, 20 bp, Artificial Sequence
  chemically synthesized
agcccatagttaaaactctt

SEQ ID NO: 9665 - DNA, 20 bp, Artificial Sequence
  chemically synthesized
agttaaaactctttagacaa

SEQ ID NO: 9666 - DNA, 20 bp, Artificial Sequence
  chemically synthesized
gttaaaactctttagacaac

SEQ ID NO: 9667 - DNA, 20 bp, Artificial Sequence
  chemically synthesized
caacaggttgtttccgttta

SEQ ID NO: 9668 - DNA, 20 bp, Artificial Sequence
  chemically synthesized
acaggttgtttccgtttaca

SEQ ID NO: 9669 - DNA, 20 bp, Artificial Sequence
  chemically synthesized
tttacagagaacaataatat

SEQ ID NO: 9670 - DNA, 20 bp, Artificial Sequence
  chemically synthesized
ttacagagaacaataatatt

SEQ ID NO: 9671 - DNA, 20 bp, Artificial Sequence
  chemically synthesized
cagagaacaataatattggg

SEQ ID NO: 9672 - DNA, 20 bp, Artificial Sequence
  chemically synthesized
gaacaataatattgggtggt

SEQ ID NO: 9673 - DNA, 20 bp, Artificial Sequence
  chemically synthesized
ttgggtggtgagcatctgtg

SEQ ID NO: 9674 - DNA, 20 bp, Artificial Sequence
  chemically synthesized
tgggtggtgagcatctgtgt

SEQ ID NO: 9675 - DNA, 20 bp, Artificial Sequence
  chemically synthesized
gggtggtgagcatctgtgtg

SEQ ID NO: 9676 - DNA, 20 bp, Artificial Sequence
  chemically synthesized
ggtggtgagcatctgtgtgg

SEQ ID NO: 9677 - DNA, 20 bp, Artificial Sequence
  chemically synthesized
gtgagcatctgtgtgggggt

SEQ ID NO: 9678 - DNA, 20 bp, Artificial Sequence
  chemically synthesized
tgagcatctgtgtgggggtt

SEQ ID NO: 9679 - DNA, 20 bp, Artificial Sequence
  chemically synthesized
gagcatctgtgtgggggttg

SEQ ID NO: 9680 - DNA, 20 bp, Artificial Sequence
  chemically synthesized
catctgtgtgggggttgggg

SEQ ID NO: 9681 - DNA, 20 bp, Artificial Sequence
  chemically synthesized
atctgtgtgggggttggggt

SEQ ID NO: 9682 - DNA, 20 bp, Artificial Sequence
  chemically synthesized
gtgtgggggttggggtggga

SEQ ID NO: 9683 - DNA, 20 bp, Artificial Sequence
  chemically synthesized
tgtgggggttggggtgggat

SEQ ID NO: 9684 - DNA, 20 bp, Artificial Sequence
  chemically synthesized
gtgggggttggggtgggata

SEQ ID NO: 9685 - DNA, 20 bp, Artificial Sequence
  chemically synthesized
tgggggttggggtgggatag

SEQ ID NO: 9686 - DNA, 20 bp, Artificial Sequence
  chemically synthesized
ttggggtgggataggggata

SEQ ID NO: 9687 - DNA, 20 bp, Artificial Sequence
  chemically synthesized
tggggtgggataggggatac

SEQ ID NO: 9688 - DNA, 20 bp, Artificial Sequence
  chemically synthesized
ggggtgggataggggatacg

SEQ ID NO: 9689 - DNA, 20 bp, Artificial Sequence
  chemically synthesized
ggtgggataggggatacggg

SEQ ID NO: 9690 - DNA, 20 bp, Artificial Sequence
  chemically synthesized
tgggataggggatacgggga

SEQ ID NO: 9691 - DNA, 20 bp, Artificial Sequence
  chemically synthesized
gataggggatacggggagag

SEQ ID NO: 9692 - DNA, 20 bp, Artificial Sequence
  chemically synthesized
taggggatacggggagagtg

SEQ ID NO: 9693 - DNA, 20 bp, Artificial Sequence
  chemically synthesized
atacggggagagtggagaaa

SEQ ID NO: 9694 - DNA, 20 bp, Artificial Sequence
  chemically synthesized
tacggggagagtggagaaaa

SEQ ID NO: 9695 - DNA, 20 bp, Artificial Sequence
  chemically synthesized
acggggagagtggagaaaaa

SEQ ID NO: 9696 - DNA, 20 bp, Artificial Sequence
  chemically synthesized
cggggagagtggagaaaaag

SEQ ID NO: 9697 - DNA, 20 bp, Artificial Sequence
  chemically synthesized
gagtggagaaaaaggggaca

SEQ ID NO: 9698 - DNA, 20 bp, Artificial Sequence
  chemically synthesized
agtggagaaaaaggggacac

SEQ ID NO: 9699 - DNA, 20 bp, Artificial Sequence
  chemically synthesized
gtggagaaaaaggggacaca

SEQ ID NO: 9700 - DNA, 20 bp, Artificial Sequence
  chemically synthesized
ggggacacagggttaatgtg

SEQ ID NO: 9701 - DNA, 20 bp, Artificial Sequence
  chemically synthesized
cacagggttaatgtgaagtc

SEQ ID NO: 9702 - DNA, 20 bp, Artificial Sequence
  chemically synthesized
acagggttaatgtgaagtcc

SEQ ID NO: 9703 - DNA, 20 bp, Artificial Sequence
  chemically synthesized
aggatccccctctacattta

SEQ ID NO: 9704 - DNA, 20 bp, Artificial Sequence
  chemically synthesized
tccccctctacatttaaagt

SEQ ID NO: 9705 - DNA, 20 bp, Artificial Sequence
  chemically synthesized
tctacatttaaagttggttt

SEQ ID NO: 9706 - DNA, 20 bp, Artificial Sequence
  chemically synthesized
catttaaagttggtttaagt

SEQ ID NO: 9707 - DNA, 20 bp, Artificial Sequence
  chemically synthesized
tttaagttggctttaattaa

SEQ ID NO: 9708 - DNA, 20 bp, Artificial Sequence
  chemically synthesized
tttaattaatagcaactctt

SEQ ID NO: 9709 - DNA, 20 bp, Artificial Sequence
  chemically synthesized
atagcaactcttaagataat

SEQ ID NO: 9710 - DNA, 20 bp, Artificial Sequence
  chemically synthesized
tcagaattttcttaaccttt

SEQ ID NO: 9711 - DNA, 20 bp, Artificial Sequence
  chemically synthesized
cttttagccttactgttgaa

SEQ ID NO: 9712 - DNA, 20 bp, Artificial Sequence
  chemically synthesized
tgtacaaatcatttgcttct

SEQ ID NO: 9713 - DNA, 20 bp, Artificial Sequence
  chemically synthesized
caaatcatttgcttcttgga

SEQ ID NO: 9714 - DNA, 20 bp, Artificial Sequence
  chemically synthesized
taatttcttttactaaaatg

SEQ ID NO: 9715 - DNA, 20 bp, Artificial Sequence
  chemically synthesized
aatttcttttactaaaatgt

SEQ ID NO: 9716 - DNA, 20 bp, Artificial Sequence
  chemically synthesized
ctaaaatgtgggcttttgac

SEQ ID NO: 9717 - DNA, 20 bp, Artificial Sequence
  chemically synthesized
gatgaatgtaaatgttcttc

SEQ ID NO: 9718 - DNA, 20 bp, Artificial Sequence
  chemically synthesized
ttattctttatattttctaa

SEQ ID NO: 9719 - DNA, 20 bp, Artificial Sequence
  chemically synthesized
attttctaacagattctgtg

SEQ ID NO: 9720 - DNA, 20 bp, Artificial Sequence
  chemically synthesized
ttctaacagattctgtgtag

SEQ ID NO: 9721 - DNA, 20 bp, Artificial Sequence
  chemically synthesized
tctaacagattctgtgtagt

SEQ ID NO: 9722 - DNA, 20 bp, Artificial Sequence
  chemically synthesized
cagattctgtgtagtgggat

SEQ ID NO: 9723 - DNA, 20 bp, Artificial Sequence
  chemically synthesized
attctgtgtagtgggatgag

SEQ ID NO: 9724 - DNA, 20 bp, Artificial Sequence
  chemically synthesized
tctgtgtagtgggatgagca

SEQ ID NO: 9725 - DNA, 20 bp, Artificial Sequence
  chemically synthesized
agaacaaaaacaaaataatc

SEQ ID NO: 9726 - DNA, 20 bp, Artificial Sequence
  chemically synthesized
caaaaacaaaataatccagt

SEQ ID NO: 9727 - DNA, 20 bp, Artificial Sequence
  chemically synthesized
acaaaataatccagtgagaa

SEQ ID NO: 9728 - DNA, 20 bp, Artificial Sequence
  chemically synthesized
aaagcccgtaaataaacctt

SEQ ID NO: 9729 - DNA, 20 bp, Artificial Sequence
  chemically synthesized
ccgtaaataaaccttcagac

SEQ ID NO: 9730 - DNA, 20 bp, Artificial Sequence
  chemically synthesized
gtaaataaaccttcagacca

SEQ ID NO: 9731 - DNA, 20 bp, Artificial Sequence
  chemically synthesized
cagaccagagatctattctc

SEQ ID NO: 9732 - DNA, 20 bp, Artificial Sequence
  chemically synthesized
tctattctctagcttatttt

SEQ ID NO: 9733 - DNA, 20 bp, Artificial Sequence
  chemically synthesized
tattttaagctcaacttaaa

SEQ ID NO: 9734 - DNA, 20 bp, Artificial Sequence
  chemically synthesized
tttaagctcaacttaaaaag

SEQ ID NO: 9735 - DNA, 20 bp, Artificial Sequence
  chemically synthesized
ttaactccaccctccttcaa

SEQ ID NO: 9736 - DNA, 20 bp, Artificial Sequence
  chemically synthesized
ccaccctccttcaaaagaaa

SEQ ID NO: 9737 - DNA, 20 bp, Artificial Sequence
  chemically synthesized
gtctatatgattgatttgca

SEQ ID NO: 9738 - DNA, 20 bp, Artificial Sequence
  chemically synthesized
attgatttgcacagctcatc

SEQ ID NO: 9739 - DNA, 20 bp, Artificial Sequence
  chemically synthesized
atttgcacagctcatctggc

SEQ ID NO: 9740 - DNA, 20 bp, Artificial Sequence
  chemically synthesized
tgcacagctcatctggccag

SEQ ID NO: 9741 - DNA, 20 bp, Artificial Sequence
  chemically synthesized
cacagctcatctggccagaa

SEQ ID NO: 9742 - DNA, 20 bp, Artificial Sequence
  chemically synthesized
ctcatctggccagaagagct

SEQ ID NO: 9743 - DNA, 20 bp, Artificial Sequence
  chemically synthesized
tgagacatccgttcccctac

SEQ ID NO: 9744 - DNA, 20 bp, Artificial Sequence
  chemically synthesized
gagagtttcttgtaggggaa

SEQ ID NO: 9745 - DNA, 20 bp, Artificial Sequence
  chemically synthesized
ttgtaggggaacggatgtct

SEQ ID NO: 9746 - DNA, 20 bp, Artificial Sequence
  chemically synthesized
aacggatgtctcagctcttc

SEQ ID NO: 9747 - DNA, 20 bp, Artificial Sequence
  chemically synthesized
gatgtctcagctcttctggc

SEQ ID NO: 9748 - DNA, 20 bp, Artificial Sequence
  chemically synthesized
ctcagctcttctggccagat

SEQ ID NO: 9749 - DNA, 20 bp, Artificial Sequence
  chemically synthesized
agctgtgcaaatcaatcata

SEQ ID NO: 9750 - DNA, 20 bp, Artificial Sequence
  chemically synthesized
gtgcaaatcaatcatataga

SEQ ID NO: 9751 - DNA, 20 bp, Artificial Sequence
  chemically synthesized
caatcatatagacagtataa

SEQ ID NO: 9752 - DNA, 20 bp, Artificial Sequence
  chemically synthesized
tcatatagacagtataaaag

SEQ ID NO: 9753 - DNA, 20 bp, Artificial Sequence
  chemically synthesized
catatagacagtataaaagt

SEQ ID NO: 9754 - DNA, 20 bp, Artificial Sequence
  chemically synthesized
aggaaatgctgtttcttttg

SEQ ID NO: 9755 - DNA, 20 bp, Artificial Sequence
  chemically synthesized
ggaaatgctgtttcttttga

SEQ ID NO: 9756 - DNA, 20 bp, Artificial Sequence
  chemically synthesized
aaatgctgtttcttttgaag

SEQ ID NO: 9757 - DNA, 20 bp, Artificial Sequence
  chemically synthesized
aatgctgtttcttttgaagg

SEQ ID NO: 9758 - DNA, 20 bp, Artificial Sequence
  chemically synthesized
atgctgtttcttttgaagga

SEQ ID NO: 9759 - DNA, 20 bp, Artificial Sequence
  chemically synthesized
ctgtttcttttgaaggaggg

SEQ ID NO: 9760 - DNA, 20 bp, Artificial Sequence
  chemically synthesized
gtttcttttgaaggagggtg

SEQ ID NO: 9761 - DNA, 20 bp, Artificial Sequence
  chemically synthesized
gagggtggagttaaatcatt

SEQ ID NO: 9762 - DNA, 20 bp, Artificial Sequence
  chemically synthesized
ttaaatcattaagtgtattg

SEQ ID NO: 9763 - DNA, 20 bp, Artificial Sequence
  chemically synthesized
taaatcattaagtgtattga

SEQ ID NO: 9764 - DNA, 20 bp, Artificial Sequence
  chemically synthesized
ttaagtgtattgaaggcgaa

SEQ ID NO: 9765 - DNA, 20 bp, Artificial Sequence
  chemically synthesized
gtattgaaggcgaaaagaat

SEQ ID NO: 9766 - DNA, 20 bp, Artificial Sequence
  chemically synthesized
attgaaggcgaaaagaatca

SEQ ID NO: 9767 - DNA, 20 bp, Artificial Sequence
  chemically synthesized
aggcgaaaagaatcagagaa

SEQ ID NO: 9768 - DNA, 20 bp, Artificial Sequence
  chemically synthesized
agagaacagttcttcttttt

SEQ ID NO: 9769 - DNA, 20 bp, Artificial Sequence
  chemically synthesized
acagttcttctttttaagtt

SEQ ID NO: 9770 - DNA, 20 bp, Artificial Sequence
  chemically synthesized
ttttaagttgagcttaaaat

SEQ ID NO: 9771 - DNA, 20 bp, Artificial Sequence
  chemically synthesized
aagttgagcttaaaataagc

SEQ ID NO: 9772 - DNA, 20 bp, Artificial Sequence
  chemically synthesized
gttgagcttaaaataagcta

SEQ ID NO: 9773 - DNA, 20 bp, Artificial Sequence
  chemically synthesized
gcttaaaataagctagagaa

SEQ ID NO: 9774 - DNA, 20 bp, Artificial Sequence
  chemically synthesized
taagctagagaatagatctc

SEQ ID NO: 9775 - DNA, 20 bp, Artificial Sequence
  chemically synthesized
gagaatagatctctggtctg

SEQ ID NO: 9776 - DNA, 20 bp, Artificial Sequence
  chemically synthesized
agaatagatctctggtctga

SEQ ID NO: 9777 - DNA, 20 bp, Artificial Sequence
  chemically synthesized
ctggtctgaaggtttattta

SEQ ID NO: 9778 - DNA, 20 bp, Artificial Sequence
  chemically synthesized
tggtctgaaggtttatttac

SEQ ID NO: 9779 - DNA, 20 bp, Artificial Sequence
  chemically synthesized
tatttacgggcttttctcac

SEQ ID NO: 9780 - DNA, 20 bp, Artificial Sequence
  chemically synthesized
tctctgctcatcccactaca

SEQ ID NO: 9781 - DNA, 20 bp, Artificial Sequence
  chemically synthesized
tcccactacacagaatctgt

SEQ ID NO: 9782 - DNA, 20 bp, Artificial Sequence
  chemically synthesized
agaatctgttagaaaatata

SEQ ID NO: 9783 - DNA, 20 bp, Artificial Sequence
  chemically synthesized
gttagaaaatataaagaata

SEQ ID NO: 9784 - DNA, 20 bp, Artificial Sequence
  chemically synthesized
ttagaaaatataaagaataa

SEQ ID NO: 9785 - DNA, 20 bp, Artificial Sequence
  chemically synthesized
atataaagaataaaggatat

SEQ ID NO: 9786 - DNA, 20 bp, Artificial Sequence
  chemically synthesized
ataaagaataaaggatatca

SEQ ID NO: 9787 - DNA, 20 bp, Artificial Sequence
  chemically synthesized
agaataaaggatatcagagc

SEQ ID NO: 9788 - DNA, 20 bp, Artificial Sequence
  chemically synthesized
ataaaggatatcagagctag

SEQ ID NO: 9789 - DNA, 20 bp, Artificial Sequence
  chemically synthesized
gaagaacatttacattcatc

SEQ ID NO: 9790 - DNA, 20 bp, Artificial Sequence
  chemically synthesized
atttacattcatctagtcaa

SEQ ID NO: 9791 - DNA, 20 bp, Artificial Sequence
  chemically synthesized
ctagtcaaaagcccacattt

SEQ ID NO: 9792 - DNA, 20 bp, Artificial Sequence
  chemically synthesized
aaaagcccacattttagtaa

SEQ ID NO: 9793 - DNA, 20 bp, Artificial Sequence
  chemically synthesized
agtaaaagaaattactatcc

SEQ ID NO: 9794 - DNA, 20 bp, Artificial Sequence
  chemically synthesized
aaaagaaattactatccaag

SEQ ID NO: 9795 - DNA, 20 bp, Artificial Sequence
  chemically synthesized
aagaagcaaatgatttgtac

SEQ ID NO: 9796 - DNA, 20 bp, Artificial Sequence
  chemically synthesized
aaatgatttgtacaagatca

SEQ ID NO: 9797 - DNA, 20 bp, Artificial Sequence
  chemically synthesized
aatgatttgtacaagatcac

SEQ ID NO: 9798 - DNA, 20 bp, Artificial Sequence
  chemically synthesized
atgatttgtacaagatcaca

SEQ ID NO: 9799 - DNA, 20 bp, Artificial Sequence
  chemically synthesized
aagatcacagggcttttcaa

SEQ ID NO: 9800 - DNA, 20 bp, Artificial Sequence
  chemically synthesized
tcacagggcttttcaacagt

SEQ ID NO: 9801 - DNA, 20 bp, Artificial Sequence
  chemically synthesized
cacagggcttttcaacagta

SEQ ID NO: 9802 - DNA, 20 bp, Artificial Sequence
  chemically synthesized
cttttcaacagtaaggctaa

SEQ ID NO: 9803 - DNA, 20 bp, Artificial Sequence
  chemically synthesized
ttttcaacagtaaggctaaa

SEQ ID NO: 9804 - DNA, 20 bp, Artificial Sequence
  chemically synthesized
aacagtaaggctaaaaggtt

SEQ ID NO: 9805 - DNA, 20 bp, Artificial Sequence
  chemically synthesized
aagaaaattctgattatctt

SEQ ID NO: 9806 - DNA, 20 bp, Artificial Sequence
  chemically synthesized
gaaaattctgattatcttaa

SEQ ID NO: 9807 - DNA, 20 bp, Artificial Sequence
  chemically synthesized
ttaagagttgctattaatta

SEQ ID NO: 9808 - DNA, 20 bp, Artificial Sequence
  chemically synthesized
acttaaaccaactttaaatg

SEQ ID NO: 9809 - DNA, 20 bp, Artificial Sequence
  chemically synthesized
ttaaaccaactttaaatgta

SEQ ID NO: 9810 - DNA, 20 bp, Artificial Sequence
  chemically synthesized
taaaccaactttaaatgtag

SEQ ID NO: 9811 - DNA, 20 bp, Artificial Sequence
  chemically synthesized
aaaccaactttaaatgtaga

SEQ ID NO: 9812 - DNA, 20 bp, Artificial Sequence
  chemically synthesized
aaccaactttaaatgtagag

SEQ ID NO: 9813 - DNA, 20 bp, Artificial Sequence
  chemically synthesized
accaactttaaatgtagagg

SEQ ID NO: 9814 - DNA, 20 bp, Artificial Sequence
  chemically synthesized
ttaaatgtagagggggatcc

SEQ ID NO: 9815 - DNA, 20 bp, Artificial Sequence
  chemically synthesized
atcccaccccaacccccaca

SEQ ID NO: 9816 - DNA, 20 bp, Artificial Sequence
  chemically synthesized
atattattgttctctgtaaa

SEQ ID NO: 9817 - DNA, 20 bp, Artificial Sequence
  chemically synthesized
cggaaacaacctgttgtcta

SEQ ID NO: 9818 - DNA, 20 bp, Artificial Sequence
  chemically synthesized
gaaacaacctgttgtctaaa

SEQ ID NO: 9819 - DNA, 20 bp, Artificial Sequence
  chemically synthesized
tgtctaaagagttttaacta

SEQ ID NO: 9820 - DNA, 20 bp, Artificial Sequence
  chemically synthesized
gtctaaagagttttaactat

SEQ ID NO: 9821 - DNA, 20 bp, Artificial Sequence
  chemically synthesized
gagttttaactatgggctca

SEQ ID NO: 9822 - DNA, 20 bp, Artificial Sequence
  chemically synthesized
agttttaactatgggctcac

SEQ ID NO: 9823 - DNA, 20 bp, Artificial Sequence
  chemically synthesized
ttaactatgggctcacgggt

SEQ ID NO: 9824 - DNA, 20 bp, Artificial Sequence
  chemically synthesized
gggctcacgggtgagctaaa

SEQ ID NO: 9825 - DNA, 20 bp, Artificial Sequence
  chemically synthesized
ggctcacgggtgagctaaac

SEQ ID NO: 9826 - DNA, 20 bp, Artificial Sequence
  chemically synthesized
acaggtttcccatctttttc

SEQ ID NO: 9827 - DNA, 20 bp, Artificial Sequence
  chemically synthesized
ttcccatctttttctggacc

SEQ ID NO: 9828 - DNA, 20 bp, Artificial Sequence
  chemically synthesized
tcccatctttttctggaccc

SEQ ID NO: 9829 - DNA, 20 bp, Artificial Sequence
  chemically synthesized
tttttctggacccaggatct

SEQ ID NO: 9830 - DNA, 20 bp, Artificial Sequence
  chemically synthesized
ttctggacccaggatcttag

SEQ ID NO: 9831 - DNA, 20 bp, Artificial Sequence
  chemically synthesized
tctggacccaggatcttagt

SEQ ID NO: 9832 - DNA, 20 bp, Artificial Sequence
  chemically synthesized
ctggacccaggatcttagtg

SEQ ID NO: 9833 - DNA, 20 bp, Artificial Sequence
  chemically synthesized
tattttgttgcccttcaaac

SEQ ID NO: 9834 - DNA, 20 bp, Artificial Sequence
  chemically synthesized
ttgttgcccttcaaaccagt

SEQ ID NO: 9835 - DNA, 20 bp, Artificial Sequence
  chemically synthesized
tcaaaccagtaagcatttat

SEQ ID NO: 9836 - DNA, 20 bp, Artificial Sequence
  chemically synthesized
caaaccagtaagcatttatg

SEQ ID NO: 9837 - DNA, 20 bp, Artificial Sequence
  chemically synthesized
tatgaggactcacactatgc

SEQ ID NO: 9838 - DNA, 20 bp, Artificial Sequence
  chemically synthesized
ctcacactatgccagataca

SEQ ID NO: 9839 - DNA, 20 bp, Artificial Sequence
  chemically synthesized
tcacactatgccagatacat

SEQ ID NO: 9840 - DNA, 20 bp, Artificial Sequence
  chemically synthesized
cactatgccagatacatagg

SEQ ID NO: 9841 - DNA, 20 bp, Artificial Sequence
  chemically synthesized
tatgccagatacataggtgg

SEQ ID NO: 9842 - DNA, 20 bp, Artificial Sequence
  chemically synthesized
atgccagatacataggtggc

SEQ ID NO: 9843 - DNA, 20 bp, Artificial Sequence
  chemically synthesized
ggtggcaggattcttcactc

SEQ ID NO: 9844 - DNA, 20 bp, Artificial Sequence
  chemically synthesized
ctccagatataatctatctg

SEQ ID NO: 9845 - DNA, 20 bp, Artificial Sequence
  chemically synthesized
gatagattatatctggagtg

SEQ ID NO: 9846 - DNA, 20 bp, Artificial Sequence
  chemically synthesized
acctatgtatctggcatagt

SEQ ID NO: 9847 - DNA, 20 bp, Artificial Sequence
  chemically synthesized
aagggcaacaaaatagtgaa

SEQ ID NO: 9848 - DNA, 20 bp, Artificial Sequence
  chemically synthesized
tgaaaatccccactaagatc

SEQ ID NO: 9849 - DNA, 20 bp, Artificial Sequence
  chemically synthesized
gtttacagagaacaataata

SEQ ID NO: 9850 - DNA, 20 bp, Artificial Sequence
  chemically synthesized
tgggtggtgagcatctgtgt

SEQ ID NO: 9851 - DNA, 20 bp, Artificial Sequence
  chemically synthesized
gtgagcatctgtgtgggggt

SEQ ID NO: 9852 - DNA, 20 bp, Artificial Sequence
  chemically synthesized
catctgtgtgggggttgggg

SEQ ID NO: 9853 - DNA, 20 bp, Artificial Sequence
  chemically synthesized
gtgggggttggggtgggata

SEQ ID NO: 9854 - DNA, 20 bp, Artificial Sequence
  chemically synthesized
ggtgggataggggatacggg

SEQ ID NO: 9855 - DNA, 20 bp, Artificial Sequence
  chemically synthesized
gagtggagaaaaaggggaca

SEQ ID NO: 9856 - DNA, 20 bp, Artificial Sequence
  chemically synthesized
cacagggttaatgtgaagtc

SEQ ID NO: 9857 - DNA, 20 bp, Artificial Sequence
  chemically synthesized
atagcaactcttaagataat

SEQ ID NO: 9858 - DNA, 20 bp, Artificial Sequence
  chemically synthesized
ttgtacaaatcatttgcttc

SEQ ID NO: 9859 - DNA, 20 bp, Artificial Sequence
  chemically synthesized
aaatgtgggcttttgactag

SEQ ID NO: 9860 - DNA, 20 bp, Artificial Sequence
  chemically synthesized
ttctaacagattctgtgtag

SEQ ID NO: 9861 - DNA, 20 bp, Artificial Sequence
  chemically synthesized
ggagagtttcttgtagggga

SEQ ID NO: 9862 - DNA, 20 bp, Artificial Sequence
  chemically synthesized
aaatgctgtttcttttgaag

SEQ ID NO: 9863 - DNA, 20 bp, Artificial Sequence
  chemically synthesized
ctgtttcttttgaaggaggg

SEQ ID NO: 9864 - DNA, 20 bp, Artificial Sequence
  chemically synthesized
ttaagtgtattgaaggcgaa

SEQ ID NO: 9865 - DNA, 20 bp, Artificial Sequence
  chemically synthesized
gttgagcttaaaataagcta

SEQ ID NO: 9866 - DNA, 20 bp, Artificial Sequence
  chemically synthesized
ttatttacgggcttttctca

SEQ ID NO: 9867 - DNA, 20 bp, Artificial Sequence
  chemically synthesized
tctctgctcatcccactaca

SEQ ID NO: 9868 - DNA, 20 bp, Artificial Sequence
  chemically synthesized
agaatctgttagaaaatata

SEQ ID NO: 9869 - DNA, 20 bp, Artificial Sequence
  chemically synthesized
gttagaaaatataaagaata

SEQ ID NO: 9870 - DNA, 20 bp, Artificial Sequence
  chemically synthesized
aagaaaattctgattatctt

SEQ ID NO: 9871 - DNA, 20 bp, Artificial Sequence
  chemically synthesized
aaccaactttaaatgtagag

SEQ ID NO: 9872 - DNA, 20 bp, Artificial Sequence
  chemically synthesized
cggaaacaacctgttgtcta

SEQ ID NO: 9873 - DNA, 20 bp, Artificial Sequence
  chemically synthesized
agagttttaactatgggctc

SEQ ID NO: 9874 - DNA, 20 bp, Artificial Sequence
  chemically synthesized
ttcccatctttttctggacc

SEQ ID NO: 9875 - DNA, 20 bp, Artificial Sequence
  chemically synthesized
tctggacccaggatcttagt

SEQ ID NO: 9876 - DNA, 20 bp, Artificial Sequence
  chemically synthesized
tatgccagatacataggtgg

SEQ ID NO: 9877 - DNA, 20 bp, Artificial Sequence
  chemically synthesized
agatagattatatctggagt

SEQ ID NO: 9878 - DNA, 20 bp, Artificial Sequence
  chemically synthesized
tccccactaagatcctgggt

SEQ ID NO: 9879 - DNA, 20 bp, Artificial Sequence
  chemically synthesized
ataggggatacggggagagt

SEQ ID NO: 9880 - DNA, 20 bp, Artificial Sequence
  chemically synthesized
aatagcaactcttaagataa

SEQ ID NO: 9881 - DNA, 20 bp, Artificial Sequence
  chemically synthesized
acaaaaacaaaataatccag

SEQ ID NO: 9882 - DNA, 20 bp, Artificial Sequence
  chemically synthesized
tttaactccaccctccttca

SEQ ID NO: 9883 - DNA, 20 bp, Artificial Sequence
  chemically synthesized
ctgagacatccgttccccta

SEQ ID NO: 9884 - DNA, 20 bp, Artificial Sequence
  chemically synthesized
attaagtgtattgaaggcga

SEQ ID NO: 9885 - DNA, 20 bp, Artificial Sequence
  chemically synthesized
agttgagcttaaaataagct

SEQ ID NO: 9886 - DNA, 20 bp, Artificial Sequence
  chemically synthesized
ttctctgctcatcccactac

SEQ ID NO: 9887 - DNA, 20 bp, Artificial Sequence
  chemically synthesized
atcccactacacagaatctg

SEQ ID NO: 9888 - DNA, 20 bp, Artificial Sequence
  chemically synthesized
cagaatctgttagaaaatat

SEQ ID NO: 9889 - DNA, 20 bp, Artificial Sequence
  chemically synthesized
caaaagcccacattttagta

SEQ ID NO: 9890 - DNA, 20 bp, Artificial Sequence
  chemically synthesized
caacagtaaggctaaaaggt

SEQ ID NO: 9891 - DNA, 20 bp, Artificial Sequence
  chemically synthesized
ctcacccgtgagcccatagt

SEQ ID NO: 9892 - DNA, 20 bp, Artificial Sequence
  chemically synthesized
tagtgggatgagcagagaac

SEQ ID NO: 9893 - DNA, 20 bp, Artificial Sequence
  chemically synthesized
ggcatagtgtgagtcctcat

SEQ ID NO: 9894 - DNA, 20 bp, Artificial Sequence
  chemically synthesized
gtgagtcctcataaatgctt

SEQ ID NO: 9895 - DNA, 20 bp, Artificial Sequence
  chemically synthesized
ggtccagaaaaagatgggaa

SEQ ID NO: 9896 - DNA, 20 bp, Artificial Sequence
  chemically synthesized
ttaaaactctttagacaaca

SEQ ID NO: 9897 - DNA, 20 bp, Artificial Sequence
  chemically synthesized
ctctttagacaacaggttgt

SEQ ID NO: 9898 - DNA, 20 bp, Artificial Sequence
  chemically synthesized
gatccccctctacatttaaa

SEQ ID NO: 9899 - DNA, 20 bp, Artificial Sequence
  chemically synthesized
tacatttaaagttggtttaa

SEQ ID NO: 9900 - DNA, 20 bp, Artificial Sequence
  chemically synthesized
cctgtgatcttgtacaaatc

SEQ ID NO: 9901 - DNA, 20 bp, Artificial Sequence
  chemically synthesized
gtaatttcttttactaaaat

SEQ ID NO: 9902 - DNA, 20 bp, Artificial Sequence
  chemically synthesized
ctttattctttatattttct

SEQ ID NO: 9903 - DNA, 20 bp, Artificial Sequence
  chemically synthesized
ttcagaccagagatctattc

SEQ ID NO: 9904 - DNA, 20 bp, Artificial Sequence
  chemically synthesized
acttaaaaagaagaactgtt

SEQ ID NO: 9905 - DNA, 20 bp, Artificial Sequence
  chemically synthesized
cttttcgccttcaatacact

SEQ ID NO: 9906 - DNA, 20 bp, Artificial Sequence
  chemically synthesized
ttcctacttttatactgtct

SEQ ID NO: 9907 - DNA, 20 bp, Artificial Sequence
  chemically synthesized
tacttttatactgtctatat

SEQ ID NO: 9908 - DNA, 20 bp, Artificial Sequence
  chemically synthesized
gacagtataaaagtaggaaa

SEQ ID NO: 9909 - DNA, 20 bp, Artificial Sequence
  chemically synthesized
gaacagttcttctttttaag

SEQ ID NO: 9910 - DNA, 20 bp, Artificial Sequence
  chemically synthesized
agagaatagatctctggtct

SEQ ID NO: 9911 - DNA, 20 bp, Artificial Sequence
  chemically synthesized
tctggtctgaaggtttattt

SEQ ID NO: 9912 - DNA, 20 bp, Artificial Sequence
  chemically synthesized
tttatttacgggcttttctc

SEQ ID NO: 9913 - DNA, 20 bp, Artificial Sequence
  chemically synthesized
gggcttttctcactggatta

SEQ ID NO: 9914 - DNA, 20 bp, Artificial Sequence
  chemically synthesized
gaaattactatccaagaagc

SEQ ID NO: 9915 - DNA, 20 bp, Artificial Sequence
  chemically synthesized
aaatgatttgtacaagatca

SEQ ID NO: 9916 - DNA, 20 bp, Artificial Sequence
  chemically synthesized
aggctaaaaggttaagaaaa

SEQ ID NO: 9917 - DNA, 20 bp, Artificial Sequence
  chemically synthesized
cggaaacaacctgttgtcta

SEQ ID NO: 9918 - DNA, 20 bp, Artificial Sequence
  chemically synthesized
tgggctcacgggtgagctaa

SEQ ID NO: 9919 - DNA, 20 bp, Artificial Sequence
  chemically synthesized
ttctggacccaggatcttag

SEQ ID NO: 9920 - DNA, 20 bp, Artificial Sequence
  chemically synthesized
ctatgccagatacataggtg

SEQ ID NO: 9921 - DNA, 22 bp, Artificial Sequence
  chemically synthesized
cagatagattatatctggagtg

SEQ ID NO: 9922 - DNA, 22 bp, Artificial Sequence
  chemically synthesized
agatagattatatctggagtga

SEQ ID NO: 9923 - DNA, 22 bp, Artificial Sequence
  chemically synthesized
tatctggagtgaagaatcctgc

SEQ ID NO: 9924 - DNA, 22 bp, Artificial Sequence
  chemically synthesized
gagtgaagaatcctgccaccta

SEQ ID NO: 9925 - DNA, 22 bp, Artificial Sequence
  chemically synthesized
ccacctatgtatctggcatagt

SEQ ID NO: 9926 - DNA, 22 bp, Artificial Sequence
  chemically synthesized
tgtatctggcatagtgtgagtc

SEQ ID NO: 9927 - DNA, 22 bp, Artificial Sequence
  chemically synthesized
gcatagtgtgagtcctcataaa

SEQ ID NO: 9928 - DNA, 22 bp, Artificial Sequence
  chemically synthesized
ataaatgcttactggtttgaag

SEQ ID NO: 9929 - DNA, 22 bp, Artificial Sequence
  chemically synthesized
actggtttgaagggcaacaaaa

SEQ ID NO: 9930 - DNA, 22 bp, Artificial Sequence
  chemically synthesized
ctggtttgaagggcaacaaaat

SEQ ID NO: 9931 - DNA, 22 bp, Artificial Sequence
  chemically synthesized
gtttgaagggcaacaaaatagt

SEQ ID NO: 9932 - DNA, 22 bp, Artificial Sequence
  chemically synthesized
gaagggcaacaaaatagtgaac

SEQ ID NO: 9933 - DNA, 22 bp, Artificial Sequence
  chemically synthesized
aagggcaacaaaatagtgaaca

SEQ ID NO: 9934 - DNA, 22 bp, Artificial Sequence
  chemically synthesized
agatcctgggtccagaaaaaga

SEQ ID NO: 9935 - DNA, 22 bp, Artificial Sequence
  chemically synthesized
ggtccagaaaaagatgggaaac

SEQ ID NO: 9936 - DNA, 22 bp, Artificial Sequence
  chemically synthesized
tttagctcacccgtgagcccat

SEQ ID NO: 9937 - DNA, 22 bp, Artificial Sequence
  chemically synthesized
agctcacccgtgagcccatagt

SEQ ID NO: 9938 - DNA, 22 bp, Artificial Sequence
  chemically synthesized
gctcacccgtgagcccatagtt

SEQ ID NO: 9939 - DNA, 22 bp, Artificial Sequence
  chemically synthesized
acccgtgagcccatagttaaaa

SEQ ID NO: 9940 - DNA, 22 bp, Artificial Sequence
  chemically synthesized
aaactctttagacaacaggttg

SEQ ID NO: 9941 - DNA, 22 bp, Artificial Sequence
  chemically synthesized
tttagacaacaggttgtttccg

SEQ ID NO: 9942 - DNA, 22 bp, Artificial Sequence
  chemically synthesized
tagacaacaggttgtttccgtt

SEQ ID NO: 9943 - DNA, 22 bp, Artificial Sequence
  chemically synthesized
agacaacaggttgtttccgttt

SEQ ID NO: 9944 - DNA, 22 bp, Artificial Sequence
  chemically synthesized
gacaacaggttgtttccgttta

SEQ ID NO: 9945 - DNA, 22 bp, Artificial Sequence
  chemically synthesized
tttccgtttacagagaacaata

SEQ ID NO: 9946 - DNA, 22 bp, Artificial Sequence
  chemically synthesized
ccgtttacagagaacaataata

SEQ ID NO: 9947 - DNA, 22 bp, Artificial Sequence
  chemically synthesized
cgtttacagagaacaataatat

SEQ ID NO: 9948 - DNA, 22 bp, Artificial Sequence
  chemically synthesized
acagagaacaataatattgggt

SEQ ID NO: 9949 - DNA, 22 bp, Artificial Sequence
  chemically synthesized
cagagaacaataatattgggtg

SEQ ID NO: 9950 - DNA, 22 bp, Artificial Sequence
  chemically synthesized
ggtggtgagcatctgtgtgggg

SEQ ID NO: 9951 - DNA, 22 bp, Artificial Sequence
  chemically synthesized
tgtgggggttggggtgggatag

SEQ ID NO: 9952 - DNA, 22 bp, Artificial Sequence
  chemically synthesized
gggtgggataggggatacgggg

SEQ ID NO: 9953 - DNA, 22 bp, Artificial Sequence
  chemically synthesized
atgtgaagtccaggatccccct

SEQ ID NO: 9954 - DNA, 22 bp, Artificial Sequence
  chemically synthesized
tacatttaaagttggtttaagt

SEQ ID NO: 9955 - DNA, 22 bp, Artificial Sequence
  chemically synthesized
catttaaagttggtttaagttg

SEQ ID NO: 9956 - DNA, 22 bp, Artificial Sequence
  chemically synthesized
aaagttggtttaagttggcttt

SEQ ID NO: 9957 - DNA, 22 bp, Artificial Sequence
  chemically synthesized
aagttggtttaagttggcttta

SEQ ID NO: 9958 - DNA, 22 bp, Artificial Sequence
  chemically synthesized
gtttaagttggctttaattaat

SEQ ID NO: 9959 - DNA, 22 bp, Artificial Sequence
  chemically synthesized
aagttggctttaattaatagca

SEQ ID NO: 9960 - DNA, 22 bp, Artificial Sequence
  chemically synthesized
agttggctttaattaatagcaa

SEQ ID NO: 9961 - DNA, 22 bp, Artificial Sequence
  chemically synthesized
gctttaattaatagcaactctt

SEQ ID NO: 9962 - DNA, 22 bp, Artificial Sequence
  chemically synthesized
taattaatagcaactcttaaga

SEQ ID NO: 9963 - DNA, 22 bp, Artificial Sequence
  chemically synthesized
aattaatagcaactcttaagat

SEQ ID NO: 9964 - DNA, 22 bp, Artificial Sequence
  chemically synthesized
attaatagcaactcttaagata

SEQ ID NO: 9965 - DNA, 22 bp, Artificial Sequence
  chemically synthesized
atagcaactcttaagataatca

SEQ ID NO: 9966 - DNA, 22 bp, Artificial Sequence
  chemically synthesized
ttaagataatcagaattttctt

SEQ ID NO: 9967 - DNA, 22 bp, Artificial Sequence
  chemically synthesized
aagataatcagaattttcttaa

SEQ ID NO: 9968 - DNA, 22 bp, Artificial Sequence
  chemically synthesized
agataatcagaattttcttaac

SEQ ID NO: 9969 - DNA, 22 bp, Artificial Sequence
  chemically synthesized
tcttaaccttttagccttactg

SEQ ID NO: 9970 - DNA, 22 bp, Artificial Sequence
  chemically synthesized
cttaaccttttagccttactgt

SEQ ID NO: 9971 - DNA, 22 bp, Artificial Sequence
  chemically synthesized
ttaaccttttagccttactgtt

SEQ ID NO: 9972 - DNA, 22 bp, Artificial Sequence
  chemically synthesized
aaccttttagccttactgttga

SEQ ID NO: 9973 - DNA, 22 bp, Artificial Sequence
  chemically synthesized
accttttagccttactgttgaa

SEQ ID NO: 9974 - DNA, 22 bp, Artificial Sequence
  chemically synthesized
ttagccttactgttgaaaagcc

SEQ ID NO: 9975 - DNA, 22 bp, Artificial Sequence
  chemically synthesized
tagccttactgttgaaaagccc

SEQ ID NO: 9976 - DNA, 22 bp, Artificial Sequence
  chemically synthesized
agccttactgttgaaaagccct

SEQ ID NO: 9977 - DNA, 22 bp, Artificial Sequence
  chemically synthesized
gccttactgttgaaaagccctg

SEQ ID NO: 9978 - DNA, 22 bp, Artificial Sequence
  chemically synthesized
actgttgaaaagccctgtgatc

SEQ ID NO: 9979 - DNA, 22 bp, Artificial Sequence
  chemically synthesized
ctgttgaaaagccctgtgatct

SEQ ID NO: 9980 - DNA, 22 bp, Artificial Sequence
  chemically synthesized
ttgaaaagccctgtgatcttgt

SEQ ID NO: 9981 - DNA, 22 bp, Artificial Sequence
  chemically synthesized
aaaagccctgtgatcttgtaca

SEQ ID NO: 9982 - DNA, 22 bp, Artificial Sequence
  chemically synthesized
tgatcttgtacaaatcatttgc

SEQ ID NO: 9983 - DNA, 22 bp, Artificial Sequence
  chemically synthesized
gtacaaatcatttgcttcttgg

SEQ ID NO: 9984 - DNA, 22 bp, Artificial Sequence
  chemically synthesized
tacaaatcatttgcttcttgga

SEQ ID NO: 9985 - DNA, 22 bp, Artificial Sequence
  chemically synthesized
gcttcttggatagtaatttctt

SEQ ID NO: 9986 - DNA, 22 bp, Artificial Sequence
  chemically synthesized
cttcttggatagtaatttcttt

SEQ ID NO: 9987 - DNA, 22 bp, Artificial Sequence
  chemically synthesized
cttggatagtaatttcttttac

SEQ ID NO: 9988 - DNA, 22 bp, Artificial Sequence
  chemically synthesized
ttggatagtaatttcttttact

SEQ ID NO: 9989 - DNA, 22 bp, Artificial Sequence
  chemically synthesized
ggatagtaatttcttttactaa

SEQ ID NO: 9990 - DNA, 22 bp, Artificial Sequence
  chemically synthesized
gatagtaatttcttttactaaa

SEQ ID NO: 9991 - DNA, 22 bp, Artificial Sequence
  chemically synthesized
cttttactaaaatgtgggcttt

SEQ ID NO: 9992 - DNA, 22 bp, Artificial Sequence
  chemically synthesized
ttttactaaaatgtgggctttt

SEQ ID NO: 9993 - DNA, 22 bp, Artificial Sequence
  chemically synthesized
ttactaaaatgtgggcttttga

SEQ ID NO: 9994 - DNA, 22 bp, Artificial Sequence
  chemically synthesized
tactaaaatgtgggcttttgac

SEQ ID NO: 9995 - DNA, 22 bp, Artificial Sequence
  chemically synthesized
actaaaatgtgggcttttgact

SEQ ID NO: 9996 - DNA, 22 bp, Artificial Sequence
  chemically synthesized
ctaaaatgtgggcttttgacta

SEQ ID NO: 9997 - DNA, 22 bp, Artificial Sequence
  chemically synthesized
aaatgtgggcttttgactagat

SEQ ID NO: 9998 - DNA, 22 bp, Artificial Sequence
  chemically synthesized
ttgactagatgaatgtaaatgt

SEQ ID NO: 9999 - DNA, 22 bp, Artificial Sequence
  chemically synthesized
tgactagatgaatgtaaatgtt

SEQ ID NO: 10000 - DNA, 22 bp, Artificial Sequence
  chemically synthesized
gactagatgaatgtaaatgttc

SEQ ID NO: 10001 - DNA, 22 bp, Artificial Sequence
  chemically synthesized
actagatgaatgtaaatgttct

SEQ ID NO: 10002 - DNA, 22 bp, Artificial Sequence
  chemically synthesized
gatgaatgtaaatgttcttcta

SEQ ID NO: 10003 - DNA, 22 bp, Artificial Sequence
  chemically synthesized
ttctagctctgatatcctttat

SEQ ID NO: 10004 - DNA, 22 bp, Artificial Sequence
  chemically synthesized
ctagctctgatatcctttattc

SEQ ID NO: 10005 - DNA, 22 bp, Artificial Sequence
  chemically synthesized
tagctctgatatcctttattct

SEQ ID NO: 10006 - DNA, 22 bp, Artificial Sequence
  chemically synthesized
gctctgatatcctttattcttt

SEQ ID NO: 10007 - DNA, 22 bp, Artificial Sequence
  chemically synthesized
tgatatcctttattctttatat

SEQ ID NO: 10008 - DNA, 22 bp, Artificial Sequence
  chemically synthesized
atatcctttattctttatattt

SEQ ID NO: 10009 - DNA, 22 bp, Artificial Sequence
  chemically synthesized
tattctttatattttctaacag

SEQ ID NO: 10010 - DNA, 22 bp, Artificial Sequence
  chemically synthesized
attctttatattttctaacaga

SEQ ID NO: 10011 - DNA, 22 bp, Artificial Sequence
  chemically synthesized
ttctttatattttctaacagat

SEQ ID NO: 10012 - DNA, 22 bp, Artificial Sequence
  chemically synthesized
tttatattttctaacagattct

SEQ ID NO: 10013 - DNA, 22 bp, Artificial Sequence
  chemically synthesized
tatattttctaacagattctgt

SEQ ID NO: 10014 - DNA, 22 bp, Artificial Sequence
  chemically synthesized
atattttctaacagattctgtg

SEQ ID NO: 10015 - DNA, 22 bp, Artificial Sequence
  chemically synthesized
tattttctaacagattctgtgt

SEQ ID NO: 10016 - DNA, 22 bp, Artificial Sequence
  chemically synthesized
tctaacagattctgtgtagtgg

SEQ ID NO: 10017 - DNA, 22 bp, Artificial Sequence
  chemically synthesized
ctaacagattctgtgtagtggg

SEQ ID NO: 10018 - DNA, 22 bp, Artificial Sequence
  chemically synthesized
taacagattctgtgtagtggga

SEQ ID NO: 10019 - DNA, 22 bp, Artificial Sequence
  chemically synthesized
acagattctgtgtagtgggatg

SEQ ID NO: 10020 - DNA, 22 bp, Artificial Sequence
  chemically synthesized
tgtgtagtgggatgagcagaga

SEQ ID NO: 10021 - DNA, 22 bp, Artificial Sequence
  chemically synthesized
tgtagtgggatgagcagagaac

SEQ ID NO: 10022 - DNA, 22 bp, Artificial Sequence
  chemically synthesized
cagaccagagatctattctcta

SEQ ID NO: 10023 - DNA, 22 bp, Artificial Sequence
  chemically synthesized
agaccagagatctattctctag

SEQ ID NO: 10024 - DNA, 22 bp, Artificial Sequence
  chemically synthesized
ttctctagcttattttaagctc

SEQ ID NO: 10025 - DNA, 22 bp, Artificial Sequence
  chemically synthesized
tctagcttattttaagctcaac

SEQ ID NO: 10026 - DNA, 22 bp, Artificial Sequence
  chemically synthesized
tagcttattttaagctcaactt

SEQ ID NO: 10027 - DNA, 22 bp, Artificial Sequence
  chemically synthesized
gcttattttaagctcaacttaa

SEQ ID NO: 10028 - DNA, 22 bp, Artificial Sequence
  chemically synthesized
attttaagctcaacttaaaaag

SEQ ID NO: 10029 - DNA, 22 bp, Artificial Sequence
  chemically synthesized
ttttaagctcaacttaaaaaga

SEQ ID NO: 10030 - DNA, 22 bp, Artificial Sequence
  chemically synthesized
taagctcaacttaaaaagaaga

SEQ ID NO: 10031 - DNA, 22 bp, Artificial Sequence
  chemically synthesized
aagctcaacttaaaaagaagaa

SEQ ID NO: 10032 - DNA, 22 bp, Artificial Sequence
  chemically synthesized
agctcaacttaaaaagaagaac

SEQ ID NO: 10033 - DNA, 22 bp, Artificial Sequence
  chemically synthesized
aacttaaaaagaagaactgttc

SEQ ID NO: 10034 - DNA, 22 bp, Artificial Sequence
  chemically synthesized
aaaaagaagaactgttctctga

SEQ ID NO: 10035 - DNA, 22 bp, Artificial Sequence
  chemically synthesized
aaaagaagaactgttctctgat

SEQ ID NO: 10036 - DNA, 22 bp, Artificial Sequence
  chemically synthesized
ttctctgattcttttcgccttc

SEQ ID NO: 10037 - DNA, 22 bp, Artificial Sequence
  chemically synthesized
tctgattcttttcgccttcaat

SEQ ID NO: 10038 - DNA, 22 bp, Artificial Sequence
  chemically synthesized
tgattcttttcgccttcaatac

SEQ ID NO: 10039 - DNA, 22 bp, Artificial Sequence
  chemically synthesized
attcttttcgccttcaatacac

SEQ ID NO: 10040 - DNA, 22 bp, Artificial Sequence
  chemically synthesized
ttttcgccttcaatacacttaa

SEQ ID NO: 10041 - DNA, 22 bp, Artificial Sequence
  chemically synthesized
ttcgccttcaatacacttaatg

SEQ ID NO: 10042 - DNA, 22 bp, Artificial Sequence
  chemically synthesized
tcgccttcaatacacttaatga

SEQ ID NO: 10043 - DNA, 22 bp, Artificial Sequence
  chemically synthesized
cgccttcaatacacttaatgat

SEQ ID NO: 10044 - DNA, 22 bp, Artificial Sequence
  chemically synthesized
gccttcaatacacttaatgatt

SEQ ID NO: 10045 - DNA, 22 bp, Artificial Sequence
  chemically synthesized
caatacacttaatgatttaact

SEQ ID NO: 10046 - DNA, 22 bp, Artificial Sequence
  chemically synthesized
aatacacttaatgatttaactc

SEQ ID NO: 10047 - DNA, 22 bp, Artificial Sequence
  chemically synthesized
aatgatttaactccaccctcct

SEQ ID NO: 10048 - DNA, 22 bp, Artificial Sequence
  chemically synthesized
atgatttaactccaccctcctt

SEQ ID NO: 10049 - DNA, 22 bp, Artificial Sequence
  chemically synthesized
aactccaccctccttcaaaaga

SEQ ID NO: 10050 - DNA, 22 bp, Artificial Sequence
  chemically synthesized
actccaccctccttcaaaagaa

SEQ ID NO: 10051 - DNA, 22 bp, Artificial Sequence
  chemically synthesized
caccctccttcaaaagaaacag

SEQ ID NO: 10052 - DNA, 22 bp, Artificial Sequence
  chemically synthesized
cttcaaaagaaacagcatttcc

SEQ ID NO: 10053 - DNA, 22 bp, Artificial Sequence
  chemically synthesized
caaaagaaacagcatttcctac

SEQ ID NO: 10054 - DNA, 22 bp, Artificial Sequence
  chemically synthesized
aaaagaaacagcatttcctact

SEQ ID NO: 10055 - DNA, 22 bp, Artificial Sequence
  chemically synthesized
cctacttttatactgtctatat

SEQ ID NO: 10056 - DNA, 22 bp, Artificial Sequence
  chemically synthesized
ctacttttatactgtctatatg

SEQ ID NO: 10057 - DNA, 22 bp, Artificial Sequence
  chemically synthesized
cttttatactgtctatatgatt

SEQ ID NO: 10058 - DNA, 22 bp, Artificial Sequence
  chemically synthesized
ttatactgtctatatgattgat

SEQ ID NO: 10059 - DNA, 22 bp, Artificial Sequence
  chemically synthesized
tatactgtctatatgattgatt

SEQ ID NO: 10060 - DNA, 22 bp, Artificial Sequence
  chemically synthesized
atactgtctatatgattgattt

SEQ ID NO: 10061 - DNA, 22 bp, Artificial Sequence
  chemically synthesized
tactgtctatatgattgatttg

SEQ ID NO: 10062 - DNA, 22 bp, Artificial Sequence
  chemically synthesized
tctatatgattgatttgcacag

SEQ ID NO: 10063 - DNA, 22 bp, Artificial Sequence
  chemically synthesized
tatgattgatttgcacagctca

SEQ ID NO: 10064 - DNA, 22 bp, Artificial Sequence
  chemically synthesized
atttgcacagctcatctggcca

SEQ ID NO: 10065 - DNA, 22 bp, Artificial Sequence
  chemically synthesized
gcacagctcatctggccagaag

SEQ ID NO: 10066 - DNA, 22 bp, Artificial Sequence
  chemically synthesized
cacagctcatctggccagaaga

SEQ ID NO: 10067 - DNA, 22 bp, Artificial Sequence
  chemically synthesized
atctggccagaagagctgagac

SEQ ID NO: 10068 - DNA, 22 bp, Artificial Sequence
  chemically synthesized
gccagaagagctgagacatccg

SEQ ID NO: 10069 - DNA, 22 bp, Artificial Sequence
  chemically synthesized
agacatccgttcccctacaaga

SEQ ID NO: 10070 - DNA, 22 bp, Artificial Sequence
  chemically synthesized
cttgtaggggaacggatgtctc

SEQ ID NO: 10071 - DNA, 22 bp, Artificial Sequence
  chemically synthesized
ttgtaggggaacggatgtctca

SEQ ID NO: 10072 - DNA, 22 bp, Artificial Sequence
  chemically synthesized
gtaggggaacggatgtctcagc

SEQ ID NO: 10073 - DNA, 22 bp, Artificial Sequence
  chemically synthesized
taggggaacggatgtctcagct

SEQ ID NO: 10074 - DNA, 22 bp, Artificial Sequence
  chemically synthesized
agctcttctggccagatgagct

SEQ ID NO: 10075 - DNA, 22 bp, Artificial Sequence
  chemically synthesized
ttctggccagatgagctgtgca

SEQ ID NO: 10076 - DNA, 22 bp, Artificial Sequence
  chemically synthesized
ctggccagatgagctgtgcaaa

SEQ ID NO: 10077 - DNA, 22 bp, Artificial Sequence
  chemically synthesized
tggccagatgagctgtgcaaat

SEQ ID NO: 10078 - DNA, 22 bp, Artificial Sequence
  chemically synthesized
gccagatgagctgtgcaaatca

SEQ ID NO: 10079 - DNA, 22 bp, Artificial Sequence
  chemically synthesized
tgcaaatcaatcatatagacag

SEQ ID NO: 10080 - DNA, 22 bp, Artificial Sequence
  chemically synthesized
tttcttttgaaggagggtggag

SEQ ID NO: 10081 - DNA, 22 bp, Artificial Sequence
  chemically synthesized
cttttgaaggagggtggagtta

SEQ ID NO: 10082 - DNA, 22 bp, Artificial Sequence
  chemically synthesized
ttttgaaggagggtggagttaa

SEQ ID NO: 10083 - DNA, 22 bp, Artificial Sequence
  chemically synthesized
ttgaaggagggtggagttaaat

SEQ ID NO: 10084 - DNA, 22 bp, Artificial Sequence
  chemically synthesized
tgaaggagggtggagttaaatc

SEQ ID NO: 10085 - DNA, 22 bp, Artificial Sequence
  chemically synthesized
gaaggagggtggagttaaatca

SEQ ID NO: 10086 - DNA, 22 bp, Artificial Sequence
  chemically synthesized
aaggagggtggagttaaatcat

SEQ ID NO: 10087 - DNA, 22 bp, Artificial Sequence
  chemically synthesized
aatcattaagtgtattgaaggc

SEQ ID NO: 10088 - DNA, 22 bp, Artificial Sequence
  chemically synthesized
agtgtattgaaggcgaaaagaa

SEQ ID NO: 10089 - DNA, 22 bp, Artificial Sequence
  chemically synthesized
aaggcgaaaagaatcagagaac

SEQ ID NO: 10090 - DNA, 22 bp, Artificial Sequence
  chemically synthesized
ttctttttaagttgagcttaaa

SEQ ID NO: 10091 - DNA, 22 bp, Artificial Sequence
  chemically synthesized
ctttttaagttgagcttaaaat

SEQ ID NO: 10092 - DNA, 22 bp, Artificial Sequence
  chemically synthesized
tttttaagttgagcttaaaata

SEQ ID NO: 10093 - DNA, 22 bp, Artificial Sequence
  chemically synthesized
tttaagttgagcttaaaataag

SEQ ID NO: 10094 - DNA, 22 bp, Artificial Sequence
  chemically synthesized
ttaagttgagcttaaaataagc

SEQ ID NO: 10095 - DNA, 22 bp, Artificial Sequence
  chemically synthesized
taagttgagcttaaaataagct

SEQ ID NO: 10096 - DNA, 22 bp, Artificial Sequence
  chemically synthesized
aagttgagcttaaaataagcta

SEQ ID NO: 10097 - DNA, 22 bp, Artificial Sequence
  chemically synthesized
agttgagcttaaaataagctag

SEQ ID NO: 10098 - DNA, 22 bp, Artificial Sequence
  chemically synthesized
agcttaaaataagctagagaat

SEQ ID NO: 10099 - DNA, 22 bp, Artificial Sequence
  chemically synthesized
aaaataagctagagaatagatc

SEQ ID NO: 10100 - DNA, 22 bp, Artificial Sequence
  chemically synthesized
aaataagctagagaatagatct

SEQ ID NO: 10101 - DNA, 22 bp, Artificial Sequence
  chemically synthesized
gagaatagatctctggtctgaa

SEQ ID NO: 10102 - DNA, 22 bp, Artificial Sequence
  chemically synthesized
tggtctgaaggtttatttacgg

SEQ ID NO: 10103 - DNA, 22 bp, Artificial Sequence
  chemically synthesized
gtctgaaggtttatttacgggc

SEQ ID NO: 10104 - DNA, 22 bp, Artificial Sequence
  chemically synthesized
aaggtttatttacgggcttttc

SEQ ID NO: 10105 - DNA, 22 bp, Artificial Sequence
  chemically synthesized
atttacgggcttttctcactgg

SEQ ID NO: 10106 - DNA, 22 bp, Artificial Sequence
  chemically synthesized
tttacgggcttttctcactgga

SEQ ID NO: 10107 - DNA, 22 bp, Artificial Sequence
  chemically synthesized
acgggcttttctcactggatta

SEQ ID NO: 10108 - DNA, 22 bp, Artificial Sequence
  chemically synthesized
cgggcttttctcactggattat

SEQ ID NO: 10109 - DNA, 22 bp, Artificial Sequence
  chemically synthesized
ttctcactggattattttgttt

SEQ ID NO: 10110 - DNA, 22 bp, Artificial Sequence
  chemically synthesized
tctcactggattattttgtttt

SEQ ID NO: 10111 - DNA, 22 bp, Artificial Sequence
  chemically synthesized
ctcactggattattttgttttt

SEQ ID NO: 10112 - DNA, 22 bp, Artificial Sequence
  chemically synthesized
tcactggattattttgtttttg

SEQ ID NO: 10113 - DNA, 22 bp, Artificial Sequence
  chemically synthesized
actggattattttgtttttgtt

SEQ ID NO: 10114 - DNA, 22 bp, Artificial Sequence
  chemically synthesized
gattattttgtttttgttctct

SEQ ID NO: 10115 - DNA, 22 bp, Artificial Sequence
  chemically synthesized
ttttgtttttgttctctgctca

SEQ ID NO: 10116 - DNA, 22 bp, Artificial Sequence
  chemically synthesized
tgtttttgttctctgctcatcc

SEQ ID NO: 10117 - DNA, 22 bp, Artificial Sequence
  chemically synthesized
gtttttgttctctgctcatccc

SEQ ID NO: 10118 - DNA, 22 bp, Artificial Sequence
  chemically synthesized
tttttgttctctgctcatccca

SEQ ID NO: 10119 - DNA, 22 bp, Artificial Sequence
  chemically synthesized
ttgttctctgctcatcccacta

SEQ ID NO: 10120 - DNA, 22 bp, Artificial Sequence
  chemically synthesized
tgttctctgctcatcccactac

SEQ ID NO: 10121 - DNA, 22 bp, Artificial Sequence
  chemically synthesized
gttctctgctcatcccactaca

SEQ ID NO: 10122 - DNA, 22 bp, Artificial Sequence
  chemically synthesized
ttctctgctcatcccactacac

SEQ ID NO: 10123 - DNA, 22 bp, Artificial Sequence
  chemically synthesized
tctgctcatcccactacacaga

SEQ ID NO: 10124 - DNA, 22 bp, Artificial Sequence
  chemically synthesized
tgctcatcccactacacagaat

SEQ ID NO: 10125 - DNA, 22 bp, Artificial Sequence
  chemically synthesized
ctcatcccactacacagaatct

SEQ ID NO: 10126 - DNA, 22 bp, Artificial Sequence
  chemically synthesized
atcccactacacagaatctgtt

SEQ ID NO: 10127 - DNA, 22 bp, Artificial Sequence
  chemically synthesized
cacagaatctgttagaaaatat

SEQ ID NO: 10128 - DNA, 22 bp, Artificial Sequence
  chemically synthesized
ttagaaaatataaagaataaag

SEQ ID NO: 10129 - DNA, 22 bp, Artificial Sequence
  chemically synthesized
gaaaatataaagaataaaggat

SEQ ID NO: 10130 - DNA, 22 bp, Artificial Sequence
  chemically synthesized
gaagaacatttacattcatcta

SEQ ID NO: 10131 - DNA, 22 bp, Artificial Sequence
  chemically synthesized
acattcatctagtcaaaagccc

SEQ ID NO: 10132 - DNA, 22 bp, Artificial Sequence
  chemically synthesized
cattcatctagtcaaaagccca

SEQ ID NO: 10133 - DNA, 22 bp, Artificial Sequence
  chemically synthesized
atctagtcaaaagcccacattt

SEQ ID NO: 10134 - DNA, 22 bp, Artificial Sequence
  chemically synthesized
gtcaaaagcccacattttagta

SEQ ID NO: 10135 - DNA, 22 bp, Artificial Sequence
  chemically synthesized
tagtaaaagaaattactatcca

SEQ ID NO: 10136 - DNA, 22 bp, Artificial Sequence
  chemically synthesized
agtaaaagaaattactatccaa

SEQ ID NO: 10137 - DNA, 22 bp, Artificial Sequence
  chemically synthesized
gtaaaagaaattactatccaag

SEQ ID NO: 10138 - DNA, 22 bp, Artificial Sequence
  chemically synthesized
ctatccaagaagcaaatgattt

SEQ ID NO: 10139 - DNA, 22 bp, Artificial Sequence
  chemically synthesized
tccaagaagcaaatgatttgta

SEQ ID NO: 10140 - DNA, 22 bp, Artificial Sequence
  chemically synthesized
gtacaagatcacagggcttttc

SEQ ID NO: 10141 - DNA, 22 bp, Artificial Sequence
  chemically synthesized
tacaagatcacagggcttttca

SEQ ID NO: 10142 - DNA, 22 bp, Artificial Sequence
  chemically synthesized
ttcaacagtaaggctaaaaggt

SEQ ID NO: 10143 - DNA, 22 bp, Artificial Sequence
  chemically synthesized
tcaacagtaaggctaaaaggtt

SEQ ID NO: 10144 - DNA, 22 bp, Artificial Sequence
  chemically synthesized
caacagtaaggctaaaaggtta

SEQ ID NO: 10145 - DNA, 22 bp, Artificial Sequence
  chemically synthesized
aacagtaaggctaaaaggttaa

SEQ ID NO: 10146 - DNA, 22 bp, Artificial Sequence
  chemically synthesized
aaaggttaagaaaattctgatt

SEQ ID NO: 10147 - DNA, 22 bp, Artificial Sequence
  chemically synthesized
agaaaattctgattatcttaag

SEQ ID NO: 10148 - DNA, 22 bp, Artificial Sequence
  chemically synthesized
tgattatcttaagagttgctat

SEQ ID NO: 10149 - DNA, 22 bp, Artificial Sequence
  chemically synthesized
attatcttaagagttgctatta

SEQ ID NO: 10150 - DNA, 22 bp, Artificial Sequence
  chemically synthesized
tcttaagagttgctattaatta

SEQ ID NO: 10151 - DNA, 22 bp, Artificial Sequence
  chemically synthesized
aagagttgctattaattaaagc

SEQ ID NO: 10152 - DNA, 22 bp, Artificial Sequence
  chemically synthesized
agagttgctattaattaaagcc

SEQ ID NO: 10153 - DNA, 22 bp, Artificial Sequence
  chemically synthesized
ctattaattaaagccaacttaa

SEQ ID NO: 10154 - DNA, 22 bp, Artificial Sequence
  chemically synthesized
ttaattaaagccaacttaaacc

SEQ ID NO: 10155 - DNA, 22 bp, Artificial Sequence
  chemically synthesized
attaaagccaacttaaaccaac

SEQ ID NO: 10156 - DNA, 22 bp, Artificial Sequence
  chemically synthesized
aagccaacttaaaccaacttta

SEQ ID NO: 10157 - DNA, 22 bp, Artificial Sequence
  chemically synthesized
aaaccaactttaaatgtagagg

SEQ ID NO: 10158 - DNA, 22 bp, Artificial Sequence
  chemically synthesized
aaccaactttaaatgtagaggg

SEQ ID NO: 10159 - DNA, 22 bp, Artificial Sequence
  chemically synthesized
taaatgtagagggggatcctgg

SEQ ID NO: 10160 - DNA, 22 bp, Artificial Sequence
  chemically synthesized
aaatgtagagggggatcctgga

SEQ ID NO: 10161 - DNA, 22 bp, Artificial Sequence
  chemically synthesized
aatgtagagggggatcctggac

SEQ ID NO: 10162 - DNA, 22 bp, Artificial Sequence
  chemically synthesized
gacttcacattaaccctgtgtc

SEQ ID NO: 10163 - DNA, 22 bp, Artificial Sequence
  chemically synthesized
cacattaaccctgtgtcccctt

SEQ ID NO: 10164 - DNA, 22 bp, Artificial Sequence
  chemically synthesized
acattaaccctgtgtccccttt

SEQ ID NO: 10165 - DNA, 22 bp, Artificial Sequence
  chemically synthesized
accctgtgtcccctttttctcc

SEQ ID NO: 10166 - DNA, 22 bp, Artificial Sequence
  chemically synthesized
tgtcccctttttctccactctc

SEQ ID NO: 10167 - DNA, 22 bp, Artificial Sequence
  chemically synthesized
tttctccactctccccgtatcc

SEQ ID NO: 10168 - DNA, 22 bp, Artificial Sequence
  chemically synthesized
ttctccactctccccgtatccc

SEQ ID NO: 10169 - DNA, 22 bp, Artificial Sequence
  chemically synthesized
tctccactctccccgtatcccc

SEQ ID NO: 10170 - DNA, 22 bp, Artificial Sequence
  chemically synthesized
ctccactctccccgtatcccct

SEQ ID NO: 10171 - DNA, 22 bp, Artificial Sequence
  chemically synthesized
tccactctccccgtatccccta

SEQ ID NO: 10172 - DNA, 22 bp, Artificial Sequence
  chemically synthesized
cactctccccgtatcccctatc

SEQ ID NO: 10173 - DNA, 22 bp, Artificial Sequence
  chemically synthesized
tccccgtatcccctatcccacc

SEQ ID NO: 10174 - DNA, 22 bp, Artificial Sequence
  chemically synthesized
cccgtatcccctatcccacccc

SEQ ID NO: 10175 - DNA, 22 bp, Artificial Sequence
  chemically synthesized
tcccaccccaacccccacacag

SEQ ID NO: 10176 - DNA, 22 bp, Artificial Sequence
  chemically synthesized
accacccaatattattgttctc

SEQ ID NO: 10177 - DNA, 22 bp, Artificial Sequence
  chemically synthesized
ttgttctctgtaaacggaaaca

SEQ ID NO: 10178 - DNA, 22 bp, Artificial Sequence
  chemically synthesized
ttctctgtaaacggaaacaacc

SEQ ID NO: 10179 - DNA, 22 bp, Artificial Sequence
  chemically synthesized
tctgtaaacggaaacaacctgt

SEQ ID NO: 10180 - DNA, 22 bp, Artificial Sequence
  chemically synthesized
tgtaaacggaaacaacctgttg

SEQ ID NO: 10181 - DNA, 22 bp, Artificial Sequence
  chemically synthesized
taaacggaaacaacctgttgtc

SEQ ID NO: 10182 - DNA, 22 bp, Artificial Sequence
  chemically synthesized
ttgtctaaagagttttaactat

SEQ ID NO: 10183 - DNA, 22 bp, Artificial Sequence
  chemically synthesized
tctaaagagttttaactatggg

SEQ ID NO: 10184 - DNA, 22 bp, Artificial Sequence
  chemically synthesized
aagagttttaactatgggctca

SEQ ID NO: 10185 - DNA, 22 bp, Artificial Sequence
  chemically synthesized
taactatgggctcacgggtgag

SEQ ID NO: 10186 - DNA, 22 bp, Artificial Sequence
  chemically synthesized
aactatgggctcacgggtgagc

SEQ ID NO: 10187 - DNA, 22 bp, Artificial Sequence
  chemically synthesized
actatgggctcacgggtgagct

SEQ ID NO: 10188 - DNA, 22 bp, Artificial Sequence
  chemically synthesized
tgggctcacgggtgagctaaac

SEQ ID NO: 10189 - DNA, 22 bp, Artificial Sequence
  chemically synthesized
acgggtgagctaaacaggtttc

SEQ ID NO: 10190 - DNA, 22 bp, Artificial Sequence
  chemically synthesized
aacaggtttcccatctttttct

SEQ ID NO: 10191 - DNA, 22 bp, Artificial Sequence
  chemically synthesized
cccatctttttctggacccagg

SEQ ID NO: 10192 - DNA, 22 bp, Artificial Sequence
  chemically synthesized
ccatctttttctggacccagga

SEQ ID NO: 10193 - DNA, 22 bp, Artificial Sequence
  chemically synthesized
tttctggacccaggatcttagt

SEQ ID NO: 10194 - DNA, 22 bp, Artificial Sequence
  chemically synthesized
ttctggacccaggatcttagtg

SEQ ID NO: 10195 - DNA, 22 bp, Artificial Sequence
  chemically synthesized
tctggacccaggatcttagtgg

SEQ ID NO: 10196 - DNA, 22 bp, Artificial Sequence
  chemically synthesized
ctggacccaggatcttagtggg

SEQ ID NO: 10197 - DNA, 22 bp, Artificial Sequence
  chemically synthesized
tggacccaggatcttagtgggg

SEQ ID NO: 10198 - DNA, 22 bp, Artificial Sequence
  chemically synthesized
gacccaggatcttagtggggat

SEQ ID NO: 10199 - DNA, 22 bp, Artificial Sequence
  chemically synthesized
agtggggattttcactctgttc

SEQ ID NO: 10200 - DNA, 22 bp, Artificial Sequence
  chemically synthesized
gtggggattttcactctgttca

SEQ ID NO: 10201 - DNA, 22 bp, Artificial Sequence
  chemically synthesized
tcactctgttcactattttgtt

SEQ ID NO: 10202 - DNA, 22 bp, Artificial Sequence
  chemically synthesized
cactctgttcactattttgttg

SEQ ID NO: 10203 - DNA, 22 bp, Artificial Sequence
  chemically synthesized
actctgttcactattttgttgc

SEQ ID NO: 10204 - DNA, 22 bp, Artificial Sequence
  chemically synthesized
tgttcactattttgttgccctt

SEQ ID NO: 10205 - DNA, 22 bp, Artificial Sequence
  chemically synthesized
ttcactattttgttgcccttca

SEQ ID NO: 10206 - DNA, 22 bp, Artificial Sequence
  chemically synthesized
actattttgttgcccttcaaac

SEQ ID NO: 10207 - DNA, 22 bp, Artificial Sequence
  chemically synthesized
ttttgttgcccttcaaaccagt

SEQ ID NO: 10208 - DNA, 22 bp, Artificial Sequence
  chemically synthesized
tgttgcccttcaaaccagtaag

SEQ ID NO: 10209 - DNA, 22 bp, Artificial Sequence
  chemically synthesized
gttgcccttcaaaccagtaagc

SEQ ID NO: 10210 - DNA, 22 bp, Artificial Sequence
  chemically synthesized
ttgcccttcaaaccagtaagca

SEQ ID NO: 10211 - DNA, 22 bp, Artificial Sequence
  chemically synthesized
cccttcaaaccagtaagcattt

SEQ ID NO: 10212 - DNA, 22 bp, Artificial Sequence
  chemically synthesized
caaaccagtaagcatttatgag

SEQ ID NO: 10213 - DNA, 22 bp, Artificial Sequence
  chemically synthesized
aaaccagtaagcatttatgagg

SEQ ID NO: 10214 - DNA, 22 bp, Artificial Sequence
  chemically synthesized
atgaggactcacactatgccag

SEQ ID NO: 10215 - DNA, 22 bp, Artificial Sequence
  chemically synthesized
tgaggactcacactatgccaga

SEQ ID NO: 10216 - DNA, 22 bp, Artificial Sequence
  chemically synthesized
acactatgccagatacataggt

SEQ ID NO: 10217 - DNA, 22 bp, Artificial Sequence
  chemically synthesized
tgccagatacataggtggcagg

SEQ ID NO: 10218 - DNA, 22 bp, Artificial Sequence
  chemically synthesized
ttcactccagatataatctatc

SEQ ID NO: 10219 - DNA, 22 bp, Artificial Sequence
  chemically synthesized
cactccagatataatctatctg

SEQ ID NO: 10220 - DNA, 22 bp, Artificial Sequence
  chemically synthesized
actccagatataatctatctga

SEQ ID NO: 10221 - DNA, 20 bp, Artificial Sequence
  chemically synthesized
actttcacaatctgctagca

SEQ ID NO: 10222 - DNA, 20 bp, Artificial Sequence
  chemically synthesized
ctttcacaatctgctagcaa

SEQ ID NO: 10223 - DNA, 20 bp, Artificial Sequence
  chemically synthesized
atctgctagcaaaggttatg

SEQ ID NO: 10224 - DNA, 20 bp, Artificial Sequence
  chemically synthesized
gcagcgcgtgaacatgatca

SEQ ID NO: 10225 - DNA, 20 bp, Artificial Sequence
  chemically synthesized
gcgcgtgaacatgatcatgg

SEQ ID NO: 10226 - DNA, 20 bp, Artificial Sequence
  chemically synthesized
catgatcatggcagaatcac

SEQ ID NO: 10227 - DNA, 20 bp, Artificial Sequence
  chemically synthesized
atgatcatggcagaatcacc

SEQ ID NO: 10228 - DNA, 20 bp, Artificial Sequence
  chemically synthesized
cctcatcaccatctgccttt

SEQ ID NO: 10229 - DNA, 20 bp, Artificial Sequence
  chemically synthesized
ctcatcaccatctgcctttt

SEQ ID NO: 10230 - DNA, 20 bp, Artificial Sequence
  chemically synthesized
tgccttttaggatatctact

SEQ ID NO: 10231 - DNA, 20 bp, Artificial Sequence
  chemically synthesized
tctactcagtgctgaatgta

SEQ ID NO: 10232 - DNA, 20 bp, Artificial Sequence
  chemically synthesized
ctactcagtgctgaatgtac

SEQ ID NO: 10233 - DNA, 20 bp, Artificial Sequence
  chemically synthesized
ttccttttttaaaatacatt

SEQ ID NO: 10234 - DNA, 20 bp, Artificial Sequence
  chemically synthesized
cattgagtatgcttgccttt

SEQ ID NO: 10235 - DNA, 20 bp, Artificial Sequence
  chemically synthesized
gtatgcttgccttttagata

SEQ ID NO: 10236 - DNA, 20 bp, Artificial Sequence
  chemically synthesized
attttgattacatgatttga

SEQ ID NO: 10237 - DNA, 20 bp, Artificial Sequence
  chemically synthesized
atgatttgacagcaatattg

SEQ ID NO: 10238 - DNA, 20 bp, Artificial Sequence
  chemically synthesized
gatttgacagcaatattgaa

SEQ ID NO: 10239 - DNA, 20 bp, Artificial Sequence
  chemically synthesized
agcaatattgaagagtctaa

SEQ ID NO: 10240 - DNA, 20 bp, Artificial Sequence
  chemically synthesized
atattgaagagtctaacagc

SEQ ID NO: 10241 - DNA, 20 bp, Artificial Sequence
  chemically synthesized
agagtctaacagccagcacg

SEQ ID NO: 10242 - DNA, 20 bp, Artificial Sequence
  chemically synthesized
gagtctaacagccagcacgc

SEQ ID NO: 10243 - DNA, 20 bp, Artificial Sequence
  chemically synthesized
ctaacagccagcacgcaggt

SEQ ID NO: 10244 - DNA, 20 bp, Artificial Sequence
  chemically synthesized
cagccagcacgcaggttggt

SEQ ID NO: 10245 - DNA, 20 bp, Artificial Sequence
  chemically synthesized
gcacgcaggttggtaagtac

SEQ ID NO: 10246 - DNA, 20 bp, Artificial Sequence
  chemically synthesized
ggtaagtactggttctttgt

SEQ ID NO: 10247 - DNA, 20 bp, Artificial Sequence
  chemically synthesized
agtactggttctttgttagc

SEQ ID NO: 10248 - DNA, 20 bp, Artificial Sequence
  chemically synthesized
gtactggttctttgttagct

SEQ ID NO: 10249 - DNA, 20 bp, Artificial Sequence
  chemically synthesized
tcttcatttttaaaactaaa

SEQ ID NO: 10250 - DNA, 20 bp, Artificial Sequence
  chemically synthesized
tatgtttaataaacactgtt

SEQ ID NO: 10251 - DNA, 20 bp, Artificial Sequence
  chemically synthesized
acactgttcagttcatgatt

SEQ ID NO: 10252 - DNA, 20 bp, Artificial Sequence
  chemically synthesized
tttggtcatgtaattcctgt

SEQ ID NO: 10253 - DNA, 20 bp, Artificial Sequence
  chemically synthesized
ttagaaaacattcatctcct

SEQ ID NO: 10254 - DNA, 20 bp, Artificial Sequence
  chemically synthesized
ccttggtttaaaaaaattaa

SEQ ID NO: 10255 - DNA, 20 bp, Artificial Sequence
  chemically synthesized
tggtttaaaaaaattaaaag

SEQ ID NO: 10256 - DNA, 20 bp, Artificial Sequence
  chemically synthesized
ggtttaaaaaaattaaaagt

SEQ ID NO: 10257 - DNA, 20 bp, Artificial Sequence
  chemically synthesized
aaattaaaagtgggaaaaca

SEQ ID NO: 10258 - DNA, 20 bp, Artificial Sequence
  chemically synthesized
aaagtgggaaaacaaagaaa

SEQ ID NO: 10259 - DNA, 20 bp, Artificial Sequence
  chemically synthesized
gtgggaaaacaaagaaatag

SEQ ID NO: 10260 - DNA, 20 bp, Artificial Sequence
  chemically synthesized
aacaaagaaatagcagaata

SEQ ID NO: 10261 - DNA, 20 bp, Artificial Sequence
  chemically synthesized
ataaccacattatttttgtt

SEQ ID NO: 10262 - DNA, 20 bp, Artificial Sequence
  chemically synthesized
ttaccactttgaaatcaaaa

SEQ ID NO: 10263 - DNA, 20 bp, Artificial Sequence
  chemically synthesized
taccactttgaaatcaaaat

SEQ ID NO: 10264 - DNA, 20 bp, Artificial Sequence
  chemically synthesized
gaaatcaaaatgggaaacaa

SEQ ID NO: 10265 - DNA, 20 bp, Artificial Sequence
  chemically synthesized
ggaaacaaaagcacaaacaa

SEQ ID NO: 10266 - DNA, 20 bp, Artificial Sequence
  chemically synthesized
aatggccttatttacacaaa

SEQ ID NO: 10267 - DNA, 20 bp, Artificial Sequence
  chemically synthesized
tacacaaaaagtctgatttt

SEQ ID NO: 10268 - DNA, 20 bp, Artificial Sequence
  chemically synthesized
tttaagatatatgacatttc

SEQ ID NO: 10269 - DNA, 20 bp, Artificial Sequence
  chemically synthesized
ttaagatatatgacatttca

SEQ ID NO: 10270 - DNA, 20 bp, Artificial Sequence
  chemically synthesized
tatatgacatttcaaggttt

SEQ ID NO: 10271 - DNA, 20 bp, Artificial Sequence
  chemically synthesized
atgacatttcaaggtttcag

SEQ ID NO: 10272 - DNA, 20 bp, Artificial Sequence
  chemically synthesized
aggtttcagaagtatgtaat

SEQ ID NO: 10273 - DNA, 20 bp, Artificial Sequence
  chemically synthesized
ggtttcagaagtatgtaatg

SEQ ID NO: 10274 - DNA, 20 bp, Artificial Sequence
  chemically synthesized
aattatatatcttcaattta

SEQ ID NO: 10275 - DNA, 20 bp, Artificial Sequence
  chemically synthesized
atatcttcaatttaaagttt

SEQ ID NO: 10276 - DNA, 20 bp, Artificial Sequence
  chemically synthesized
aaagttttagttaaaacata

SEQ ID NO: 10277 - DNA, 20 bp, Artificial Sequence
  chemically synthesized
cataaagattaacctttcat

SEQ ID NO: 10278 - DNA, 20 bp, Artificial Sequence
  chemically synthesized
aagattaacctttcattagc

SEQ ID NO: 10279 - DNA, 20 bp, Artificial Sequence
  chemically synthesized
acctttcattagcaagctgt

SEQ ID NO: 10280 - DNA, 20 bp, Artificial Sequence
  chemically synthesized
caagctgttagttatcacca

SEQ ID NO: 10281 - DNA, 20 bp, Artificial Sequence
  chemically synthesized
gttatcaccaaagcttttca

SEQ ID NO: 10282 - DNA, 20 bp, Artificial Sequence
  chemically synthesized
caccaaagcttttcatggat

SEQ ID NO: 10283 - DNA, 20 bp, Artificial Sequence
  chemically synthesized
accaaagcttttcatggatt

SEQ ID NO: 10284 - DNA, 20 bp, Artificial Sequence
  chemically synthesized
tgtctctatgtcaaacatct

SEQ ID NO: 10285 - DNA, 20 bp, Artificial Sequence
  chemically synthesized
tctctatgtcaaacatcttg

SEQ ID NO: 10286 - DNA, 20 bp, Artificial Sequence
  chemically synthesized
aacatcttggagttgatatt

SEQ ID NO: 10287 - DNA, 20 bp, Artificial Sequence
  chemically synthesized
acatcttggagttgatattt

SEQ ID NO: 10288 - DNA, 20 bp, Artificial Sequence
  chemically synthesized
catcttggagttgatatttg

SEQ ID NO: 10289 - DNA, 20 bp, Artificial Sequence
  chemically synthesized
atttggggaaacacaatact

SEQ ID NO: 10290 - DNA, 20 bp, Artificial Sequence
  chemically synthesized
gggaaacacaatactcagtt

SEQ ID NO: 10291 - DNA, 20 bp, Artificial Sequence
  chemically synthesized
caatactcagttgagttccc

SEQ ID NO: 10292 - DNA, 20 bp, Artificial Sequence
  chemically synthesized
aatactcagttgagttccct

SEQ ID NO: 10293 - DNA, 20 bp, Artificial Sequence
  chemically synthesized
atactcagttgagttcccta

SEQ ID NO: 10294 - DNA, 20 bp, Artificial Sequence
  chemically synthesized
tactcagttgagttccctag

SEQ ID NO: 10295 - DNA, 20 bp, Artificial Sequence
  chemically synthesized
ctcagttgagttccctaggg

SEQ ID NO: 10296 - DNA, 20 bp, Artificial Sequence
  chemically synthesized
ttgagttccctaggggagaa

SEQ ID NO: 10297 - DNA, 20 bp, Artificial Sequence
  chemically synthesized
gttccctaggggagaaaagc

SEQ ID NO: 10298 - DNA, 20 bp, Artificial Sequence
  chemically synthesized
taggggagaaaagcaagctt

SEQ ID NO: 10299 - DNA, 20 bp, Artificial Sequence
  chemically synthesized
caagcttaagaattgacata

SEQ ID NO: 10300 - DNA, 20 bp, Artificial Sequence
  chemically synthesized
agcttaagaattgacataaa

SEQ ID NO: 10301 - DNA, 20 bp, Artificial Sequence
  chemically synthesized
ttaagaattgacataaagag

SEQ ID NO: 10302 - DNA, 20 bp, Artificial Sequence
  chemically synthesized
taagaattgacataaagagt

SEQ ID NO: 10303 - DNA, 20 bp, Artificial Sequence
  chemically synthesized
gaattgacataaagagtagg

SEQ ID NO: 10304 - DNA, 20 bp, Artificial Sequence
  chemically synthesized
tgacataaagagtaggaagt

SEQ ID NO: 10305 - DNA, 20 bp, Artificial Sequence
  chemically synthesized
actttgttttttcacaacta

SEQ ID NO: 10306 - DNA, 20 bp, Artificial Sequence
  chemically synthesized
cagtgactttatgtatttcc

SEQ ID NO: 10307 - DNA, 20 bp, Artificial Sequence
  chemically synthesized
gtgactttatgtatttccca

SEQ ID NO: 10308 - DNA, 20 bp, Artificial Sequence
  chemically synthesized
tgactttatgtatttcccag

SEQ ID NO: 10309 - DNA, 20 bp, Artificial Sequence
  chemically synthesized
ctttatgtatttcccagagg

SEQ ID NO: 10310 - DNA, 20 bp, Artificial Sequence
  chemically synthesized
tttatgtatttcccagagga

SEQ ID NO: 10311 - DNA, 20 bp, Artificial Sequence
  chemically synthesized
atttcccagaggaaggcata

SEQ ID NO: 10312 - DNA, 20 bp, Artificial Sequence
  chemically synthesized
tttcccagaggaaggcatac

SEQ ID NO: 10313 - DNA, 20 bp, Artificial Sequence
  chemically synthesized
ttcccagaggaaggcataca

SEQ ID NO: 10314 - DNA, 20 bp, Artificial Sequence
  chemically synthesized
ccagaggaaggcatacaggg

SEQ ID NO: 10315 - DNA, 20 bp, Artificial Sequence
  chemically synthesized
agggaagaaattatcccatt

SEQ ID NO: 10316 - DNA, 20 bp, Artificial Sequence
  chemically synthesized
aattatcccatttggacaaa

SEQ ID NO: 10317 - DNA, 20 bp, Artificial Sequence
  chemically synthesized
ggacaaacagcatgttctca

SEQ ID NO: 10318 - DNA, 20 bp, Artificial Sequence
  chemically synthesized
gacaaacagcatgttctcac

SEQ ID NO: 10319 - DNA, 20 bp, Artificial Sequence
  chemically synthesized
aaacagcatgttctcacagg

SEQ ID NO: 10320 - DNA, 20 bp, Artificial Sequence
  chemically synthesized
acacttacttgtcaactttc

SEQ ID NO: 10321 - DNA, 20 bp, Artificial Sequence
  chemically synthesized
caactttctagaatcaaatc

SEQ ID NO: 10322 - DNA, 20 bp, Artificial Sequence
  chemically synthesized
ctttctagaatcaaatctag

SEQ ID NO: 10323 - DNA, 20 bp, Artificial Sequence
  chemically synthesized
gaatcaaatctagtagctga

SEQ ID NO: 10324 - DNA, 20 bp, Artificial Sequence
  chemically synthesized
aatctagtagctgacagtac

SEQ ID NO: 10325 - DNA, 20 bp, Artificial Sequence
  chemically synthesized
atctagtagctgacagtacc

SEQ ID NO: 10326 - DNA, 20 bp, Artificial Sequence
  chemically synthesized
gtagctgacagtaccaggat

SEQ ID NO: 10327 - DNA, 20 bp, Artificial Sequence
  chemically synthesized
tagctgacagtaccaggatc

SEQ ID NO: 10328 - DNA, 20 bp, Artificial Sequence
  chemically synthesized
agctgacagtaccaggatca

SEQ ID NO: 10329 - DNA, 20 bp, Artificial Sequence
  chemically synthesized
gctgacagtaccaggatcag

SEQ ID NO: 10330 - DNA, 20 bp, Artificial Sequence
  chemically synthesized
ggatcaggggtgccaaccct

SEQ ID NO: 10331 - DNA, 20 bp, Artificial Sequence
  chemically synthesized
gtgccaaccctaagcacccc

SEQ ID NO: 10332 - DNA, 20 bp, Artificial Sequence
  chemically synthesized
caaccctaagcacccccaga

SEQ ID NO: 10333 - DNA, 20 bp, Artificial Sequence
  chemically synthesized
agcacccccagaaagctgac

SEQ ID NO: 10334 - DNA, 20 bp, Artificial Sequence
  chemically synthesized
cagaaagctgactggccctg

SEQ ID NO: 10335 - DNA, 20 bp, Artificial Sequence
  chemically synthesized
tggccctgtggttcccactc

SEQ ID NO: 10336 - DNA, 20 bp, Artificial Sequence
  chemically synthesized
tcccactccagacatgatgt

SEQ ID NO: 10337 - DNA, 20 bp, Artificial Sequence
  chemically synthesized
catgatgtcagctgtgaaat

SEQ ID NO: 10338 - DNA, 20 bp, Artificial Sequence
  chemically synthesized
aataacgataaaaaaaaata

SEQ ID NO: 10339 - DNA, 20 bp, Artificial Sequence
  chemically synthesized
taacgataaaaaaaaataca

SEQ ID NO: 10340 - DNA, 20 bp, Artificial Sequence
  chemically synthesized
aacgataaaaaaaaatacag

SEQ ID NO: 10341 - DNA, 20 bp, Artificial Sequence
  chemically synthesized
aaaaaatacagaggttaaac

SEQ ID NO: 10342 - DNA, 20 bp, Artificial Sequence
  chemically synthesized
atacagaggttaaactagca

SEQ ID NO: 10343 - DNA, 20 bp, Artificial Sequence
  chemically synthesized
agaggttaaactagcaaagt

SEQ ID NO: 10344 - DNA, 20 bp, Artificial Sequence
  chemically synthesized
ttaaactagcaaagtgagta

SEQ ID NO: 10345 - DNA, 20 bp, Artificial Sequence
  chemically synthesized
ctagcaaagtgagtaaagtc

SEQ ID NO: 10346 - DNA, 20 bp, Artificial Sequence
  chemically synthesized
tagcaaagtgagtaaagtca

SEQ ID NO: 10347 - DNA, 20 bp, Artificial Sequence
  chemically synthesized
agcaaagtgagtaaagtcaa

SEQ ID NO: 10348 - DNA, 20 bp, Artificial Sequence
  chemically synthesized
gtgagtaaagtcaagggata

SEQ ID NO: 10349 - DNA, 20 bp, Artificial Sequence
  chemically synthesized
aagggataaagaaaatttgt

SEQ ID NO: 10350 - DNA, 20 bp, Artificial Sequence
  chemically synthesized
aatttgttggaaaactcaca

SEQ ID NO: 10351 - DNA, 20 bp, Artificial Sequence
  chemically synthesized
ttgttggaaaactcacaaag

SEQ ID NO: 10352 - DNA, 20 bp, Artificial Sequence
  chemically synthesized
tgttggaaaactcacaaagc

SEQ ID NO: 10353 - DNA, 20 bp, Artificial Sequence
  chemically synthesized
aactcacaaagcaggacata

SEQ ID NO: 10354 - DNA, 20 bp, Artificial Sequence
  chemically synthesized
cacaaagcaggacataaagc

SEQ ID NO: 10355 - DNA, 20 bp, Artificial Sequence
  chemically synthesized
acaaagcaggacataaagca

SEQ ID NO: 10356 - DNA, 20 bp, Artificial Sequence
  chemically synthesized
aggacataaagcaaggccat

SEQ ID NO: 10357 - DNA, 20 bp, Artificial Sequence
  chemically synthesized
ggccattagatatatctcat

SEQ ID NO: 10358 - DNA, 20 bp, Artificial Sequence
  chemically synthesized
tatctcattagtgtgacatc

SEQ ID NO: 10359 - DNA, 20 bp, Artificial Sequence
  chemically synthesized
atctcattagtgtgacatct

SEQ ID NO: 10360 - DNA, 20 bp, Artificial Sequence
  chemically synthesized
ctcattagtgtgacatctgg

SEQ ID NO: 10361 - DNA, 20 bp, Artificial Sequence
  chemically synthesized
tcattagtgtgacatctggg

SEQ ID NO: 10362 - DNA, 20 bp, Artificial Sequence
  chemically synthesized
gtgtgacatctgggaggaca

SEQ ID NO: 10363 - DNA, 20 bp, Artificial Sequence
  chemically synthesized
ccaaaccctttcttctatat

SEQ ID NO: 10364 - DNA, 20 bp, Artificial Sequence
  chemically synthesized
aaccctttcttctatataag

SEQ ID NO: 10365 - DNA, 20 bp, Artificial Sequence
  chemically synthesized
ctttcttctatataagtggt

SEQ ID NO: 10366 - DNA, 20 bp, Artificial Sequence
  chemically synthesized
atataagtggtgagatgatg

SEQ ID NO: 10367 - DNA, 20 bp, Artificial Sequence
  chemically synthesized
tataagtggtgagatgatga

SEQ ID NO: 10368 - DNA, 20 bp, Artificial Sequence
  chemically synthesized
ggtgagatgatgaaggttgt

SEQ ID NO: 10369 - DNA, 20 bp, Artificial Sequence
  chemically synthesized
tgagatgatgaaggttgtaa

SEQ ID NO: 10370 - DNA, 20 bp, Artificial Sequence
  chemically synthesized
gagatgatgaaggttgtaag

SEQ ID NO: 10371 - DNA, 20 bp, Artificial Sequence
  chemically synthesized
agatgatgaaggttgtaaga

SEQ ID NO: 10372 - DNA, 20 bp, Artificial Sequence
  chemically synthesized
agagggcttctgcccccttg

SEQ ID NO: 10373 - DNA, 20 bp, Artificial Sequence
  chemically synthesized
ttctgcccccttgaagactt

SEQ ID NO: 10374 - DNA, 20 bp, Artificial Sequence
  chemically synthesized
cccttgaagacttcagatgc

SEQ ID NO: 10375 - DNA, 20 bp, Artificial Sequence
  chemically synthesized
ccttgaagacttcagatgct

SEQ ID NO: 10376 - DNA, 20 bp, Artificial Sequence
  chemically synthesized
cttgaagacttcagatgctg

SEQ ID NO: 10377 - DNA, 20 bp, Artificial Sequence
  chemically synthesized
aagacttcagatgctgggga

SEQ ID NO: 10378 - DNA, 20 bp, Artificial Sequence
  chemically synthesized
agacttcagatgctggggaa

SEQ ID NO: 10379 - DNA, 20 bp, Artificial Sequence
  chemically synthesized
ttcagatgctggggaaagga

SEQ ID NO: 10380 - DNA, 20 bp, Artificial Sequence
  chemically synthesized
atgctggggaaaggatagat

SEQ ID NO: 10381 - DNA, 20 bp, Artificial Sequence
  chemically synthesized
gggaaaggatagataagaat

SEQ ID NO: 10382 - DNA, 20 bp, Artificial Sequence
  chemically synthesized
ggaaaggatagataagaata

SEQ ID NO: 10383 - DNA, 20 bp, Artificial Sequence
  chemically synthesized
agataagaataaggatgaac

SEQ ID NO: 10384 - DNA, 20 bp, Artificial Sequence
  chemically synthesized
gataagaataaggatgaacc

SEQ ID NO: 10385 - DNA, 20 bp, Artificial Sequence
  chemically synthesized
ataaggatgaaccaggcttt

SEQ ID NO: 10386 - DNA, 20 bp, Artificial Sequence
  chemically synthesized
aaggatgaaccaggcttttg

SEQ ID NO: 10387 - DNA, 20 bp, Artificial Sequence
  chemically synthesized
tgaaccaggcttttggagcc

SEQ ID NO: 10388 - DNA, 20 bp, Artificial Sequence
  chemically synthesized
gaaccaggcttttggagcct

SEQ ID NO: 10389 - DNA, 20 bp, Artificial Sequence
  chemically synthesized
ggagcctgggaaataatgac

SEQ ID NO: 10390 - DNA, 20 bp, Artificial Sequence
  chemically synthesized
aatgactagcgataaacctg

SEQ ID NO: 10391 - DNA, 20 bp, Artificial Sequence
  chemically synthesized
atgactagcgataaacctga

SEQ ID NO: 10392 - DNA, 20 bp, Artificial Sequence
  chemically synthesized
tgactagcgataaacctgaa

SEQ ID NO: 10393 - DNA, 20 bp, Artificial Sequence
  chemically synthesized
ctagcgataaacctgaaggg

SEQ ID NO: 10394 - DNA, 20 bp, Artificial Sequence
  chemically synthesized
gataaacctgaagggaagtt

SEQ ID NO: 10395 - DNA, 20 bp, Artificial Sequence
  chemically synthesized
gaagttaagtatacgatccc

SEQ ID NO: 10396 - DNA, 20 bp, Artificial Sequence
  chemically synthesized
tacgatccccagataatact

SEQ ID NO: 10397 - DNA, 20 bp, Artificial Sequence
  chemically synthesized
acgatccccagataatacta

SEQ ID NO: 10398 - DNA, 20 bp, Artificial Sequence
  chemically synthesized
gatccccagataatactaag

SEQ ID NO: 10399 - DNA, 20 bp, Artificial Sequence
  chemically synthesized
cccagataatactaaggaga

SEQ ID NO: 10400 - DNA, 20 bp, Artificial Sequence
  chemically synthesized
ccagataatactaaggagaa

SEQ ID NO: 10401 - DNA, 20 bp, Artificial Sequence
  chemically synthesized
agaaaggcaatgtgattctg

SEQ ID NO: 10402 - DNA, 20 bp, Artificial Sequence
  chemically synthesized
atgtgattctgcagccattg

SEQ ID NO: 10403 - DNA, 20 bp, Artificial Sequence
  chemically synthesized
gattctgcagccattgtagc

SEQ ID NO: 10404 - DNA, 20 bp, Artificial Sequence
  chemically synthesized
ttctgcagccattgtagcca

SEQ ID NO: 10405 - DNA, 20 bp, Artificial Sequence
  chemically synthesized
ccattgtagccagagataat

SEQ ID NO: 10406 - DNA, 20 bp, Artificial Sequence
  chemically synthesized
gccagagataataagccctt

SEQ ID NO: 10407 - DNA, 20 bp, Artificial Sequence
  chemically synthesized
ccagagataataagcccttg

SEQ ID NO: 10408 - DNA, 20 bp, Artificial Sequence
  chemically synthesized
gagataataagcccttgagg

SEQ ID NO: 10409 - DNA, 20 bp, Artificial Sequence
  chemically synthesized
agataataagcccttgagga

SEQ ID NO: 10410 - DNA, 20 bp, Artificial Sequence
  chemically synthesized
gataataagcccttgaggaa

SEQ ID NO: 10411 - DNA, 20 bp, Artificial Sequence
  chemically synthesized
ataataagcccttgaggaag

SEQ ID NO: 10412 - DNA, 20 bp, Artificial Sequence
  chemically synthesized
taagcccttgaggaaggggc

SEQ ID NO: 10413 - DNA, 20 bp, Artificial Sequence
  chemically synthesized
aagcccttgaggaaggggcc

SEQ ID NO: 10414 - DNA, 20 bp, Artificial Sequence
  chemically synthesized
agcccttgaggaaggggcca

SEQ ID NO: 10415 - DNA, 20 bp, Artificial Sequence
  chemically synthesized
gcccttgaggaaggggccag

SEQ ID NO: 10416 - DNA, 20 bp, Artificial Sequence
  chemically synthesized
ggggccaggggaatttttct

SEQ ID NO: 10417 - DNA, 20 bp, Artificial Sequence
  chemically synthesized
gggccaggggaatttttcta

SEQ ID NO: 10418 - DNA, 20 bp, Artificial Sequence
  chemically synthesized
caggggaatttttctaagga

SEQ ID NO: 10419 - DNA, 20 bp, Artificial Sequence
  chemically synthesized
ggaatttttctaaggataga

SEQ ID NO: 10420 - DNA, 20 bp, Artificial Sequence
  chemically synthesized
aaggatagacagtattaatg

SEQ ID NO: 10421 - DNA, 20 bp, Artificial Sequence
  chemically synthesized
ttctgctattaaactctcat

SEQ ID NO: 10422 - DNA, 20 bp, Artificial Sequence
  chemically synthesized
aaactctcattggcttctaa

SEQ ID NO: 10423 - DNA, 20 bp, Artificial Sequence
  chemically synthesized
aactctcattggcttctaaa

SEQ ID NO: 10424 - DNA, 20 bp, Artificial Sequence
  chemically synthesized
ctctcattggcttctaaaag

SEQ ID NO: 10425 - DNA, 20 bp, Artificial Sequence
  chemically synthesized
ttggcttctaaaaggagttt

SEQ ID NO: 10426 - DNA, 20 bp, Artificial Sequence
  chemically synthesized
cttctaaaaggagtttcggt

SEQ ID NO: 10427 - DNA, 20 bp, Artificial Sequence
  chemically synthesized
gtttcggtgagtgatttgct

SEQ ID NO: 10428 - DNA, 20 bp, Artificial Sequence
  chemically synthesized
gctgagatgttgcattttca

SEQ ID NO: 10429 - DNA, 20 bp, Artificial Sequence
  chemically synthesized
attttcatggctgctgcctt

SEQ ID NO: 10430 - DNA, 20 bp, Artificial Sequence
  chemically synthesized
ttttcatggctgctgccttt

SEQ ID NO: 10431 - DNA, 20 bp, Artificial Sequence
  chemically synthesized
gcctttaggtattattgcaa

SEQ ID NO: 10432 - DNA, 20 bp, Artificial Sequence
  chemically synthesized
taggtattattgcaacagtt

SEQ ID NO: 10433 - DNA, 20 bp, Artificial Sequence
  chemically synthesized
ttggaattttgaaattaaaa

SEQ ID NO: 10434 - DNA, 20 bp, Artificial Sequence
  chemically synthesized
ttaaaacagttctgtaaaac

SEQ ID NO: 10435 - DNA, 20 bp, Artificial Sequence
  chemically synthesized
acagttctgtaaaaccagtt

SEQ ID NO: 10436 - DNA, 20 bp, Artificial Sequence
  chemically synthesized
aaaaccagtttagttttgta

SEQ ID NO: 10437 - DNA, 20 bp, Artificial Sequence
  chemically synthesized
tttgtaaagtgtatgcatca

SEQ ID NO: 10438 - DNA, 20 bp, Artificial Sequence
  chemically synthesized
catcaaagatgtccttcatt

SEQ ID NO: 10439 - DNA, 20 bp, Artificial Sequence
  chemically synthesized
tccttcattcagacattact

SEQ ID NO: 10440 - DNA, 20 bp, Artificial Sequence
  chemically synthesized
acattactgagttacaacta

SEQ ID NO: 10441 - DNA, 20 bp, Artificial Sequence
  chemically synthesized
ctgagttacaactatggtgc

SEQ ID NO: 10442 - DNA, 20 bp, Artificial Sequence
  chemically synthesized
tgagttacaactatggtgcc

SEQ ID NO: 10443 - DNA, 20 bp, Artificial Sequence
  chemically synthesized
tatggtgccaggtactgtgt

SEQ ID NO: 10444 - DNA, 20 bp, Artificial Sequence
  chemically synthesized
atggtgccaggtactgtgtc

SEQ ID NO: 10445 - DNA, 20 bp, Artificial Sequence
  chemically synthesized
tggtgccaggtactgtgtca

SEQ ID NO: 10446 - DNA, 20 bp, Artificial Sequence
  chemically synthesized
caggtactgtgtcagggtac

SEQ ID NO: 10447 - DNA, 20 bp, Artificial Sequence
  chemically synthesized
aggtactgtgtcagggtact

SEQ ID NO: 10448 - DNA, 20 bp, Artificial Sequence
  chemically synthesized
ggtactgtgtcagggtacta

SEQ ID NO: 10449 - DNA, 20 bp, Artificial Sequence
  chemically synthesized
gtactgtgtcagggtactag

SEQ ID NO: 10450 - DNA, 20 bp, Artificial Sequence
  chemically synthesized
gtgtcagggtactaggggta

SEQ ID NO: 10451 - DNA, 20 bp, Artificial Sequence
  chemically synthesized
tgtcagggtactaggggtat

SEQ ID NO: 10452 - DNA, 20 bp, Artificial Sequence
  chemically synthesized
gtcagggtactaggggtatg

SEQ ID NO: 10453 - DNA, 20 bp, Artificial Sequence
  chemically synthesized
ctaggggtatggggataaac

SEQ ID NO: 10454 - DNA, 20 bp, Artificial Sequence
  chemically synthesized
cagactccctctttgatcta

SEQ ID NO: 10455 - DNA, 20 bp, Artificial Sequence
  chemically synthesized
actccctctttgatctaaag

SEQ ID NO: 10456 - DNA, 20 bp, Artificial Sequence
  chemically synthesized
tctttgatctaaagcagcat

SEQ ID NO: 10457 - DNA, 20 bp, Artificial Sequence
  chemically synthesized
ctttgatctaaagcagcatg

SEQ ID NO: 10458 - DNA, 20 bp, Artificial Sequence
  chemically synthesized
gatctaaagcagcatgaggc

SEQ ID NO: 10459 - DNA, 20 bp, Artificial Sequence
  chemically synthesized
atctaaagcagcatgaggcc

SEQ ID NO: 10460 - DNA, 20 bp, Artificial Sequence
  chemically synthesized
aaagcagcatgaggccaggt

SEQ ID NO: 10461 - DNA, 20 bp, Artificial Sequence
  chemically synthesized
agcagcatgaggccaggtga

SEQ ID NO: 10462 - DNA, 20 bp, Artificial Sequence
  chemically synthesized
gcagcatgaggccaggtgag

SEQ ID NO: 10463 - DNA, 20 bp, Artificial Sequence
  chemically synthesized
taatgtgataaaatgtgcac

SEQ ID NO: 10464 - DNA, 20 bp, Artificial Sequence
  chemically synthesized
aatgtgataaaatgtgcact

SEQ ID NO: 10465 - DNA, 20 bp, Artificial Sequence
  chemically synthesized
taaaatgtgcactaggtact

SEQ ID NO: 10466 - DNA, 20 bp, Artificial Sequence
  chemically synthesized
aaaatgtgcactaggtacta

SEQ ID NO: 10467 - DNA, 20 bp, Artificial Sequence
  chemically synthesized
aaatgtgcactaggtactaa

SEQ ID NO: 10468 - DNA, 20 bp, Artificial Sequence
  chemically synthesized
cactaggtactaagggatca

SEQ ID NO: 10469 - DNA, 20 bp, Artificial Sequence
  chemically synthesized
ctaggtactaagggatcata

SEQ ID NO: 10470 - DNA, 20 bp, Artificial Sequence
  chemically synthesized
gtactaagggatcatagaga

SEQ ID NO: 10471 - DNA, 20 bp, Artificial Sequence
  chemically synthesized
tactaagggatcatagagaa

SEQ ID NO: 10472 - DNA, 20 bp, Artificial Sequence
  chemically synthesized
agagaaaggaacacattaaa

SEQ ID NO: 10473 - DNA, 20 bp, Artificial Sequence
  chemically synthesized
gagaaaggaacacattaaat

SEQ ID NO: 10474 - DNA, 20 bp, Artificial Sequence
  chemically synthesized
agaaaggaacacattaaatg

SEQ ID NO: 10475 - DNA, 20 bp, Artificial Sequence
  chemically synthesized
ttaaatggggaaacaattga

SEQ ID NO: 10476 - DNA, 20 bp, Artificial Sequence
  chemically synthesized
aaatggggaaacaattgata

SEQ ID NO: 10477 - DNA, 20 bp, Artificial Sequence
  chemically synthesized
atggggaaacaattgataga

SEQ ID NO: 10478 - DNA, 20 bp, Artificial Sequence
  chemically synthesized
ggggaaacaattgatagaga

SEQ ID NO: 10479 - DNA, 20 bp, Artificial Sequence
  chemically synthesized
agagagagaatattttcatc

SEQ ID NO: 10480 - DNA, 20 bp, Artificial Sequence
  chemically synthesized
gagagagaatattttcatct

SEQ ID NO: 10481 - DNA, 20 bp, Artificial Sequence
  chemically synthesized
tattttcatctgggtcttaa

SEQ ID NO: 10482 - DNA, 20 bp, Artificial Sequence
  chemically synthesized
tcatctgggtcttaaaagat

SEQ ID NO: 10483 - DNA, 20 bp, Artificial Sequence
  chemically synthesized
tctgggtcttaaaagatgag

SEQ ID NO: 10484 - DNA, 20 bp, Artificial Sequence
  chemically synthesized
ctgggtcttaaaagatgagt

SEQ ID NO: 10485 - DNA, 20 bp, Artificial Sequence
  chemically synthesized
tctctttaaatgtctgatat

SEQ ID NO: 10486 - DNA, 20 bp, Artificial Sequence
  chemically synthesized
ctctttaaatgtctgatata

SEQ ID NO: 10487 - DNA, 20 bp, Artificial Sequence
  chemically synthesized
tctttaaatgtctgatataa

SEQ ID NO: 10488 - DNA, 20 bp, Artificial Sequence
  chemically synthesized
atataagggcattttatgca

SEQ ID NO: 10489 - DNA, 20 bp, Artificial Sequence
  chemically synthesized
ataagggcattttatgcaaa

SEQ ID NO: 10490 - DNA, 20 bp, Artificial Sequence
  chemically synthesized
taagggcattttatgcaaag

SEQ ID NO: 10491 - DNA, 20 bp, Artificial Sequence
  chemically synthesized
caaagaggatcactcgtgca

SEQ ID NO: 10492 - DNA, 20 bp, Artificial Sequence
  chemically synthesized
ggatcactcgtgcaaagact

SEQ ID NO: 10493 - DNA, 20 bp, Artificial Sequence
  chemically synthesized
gtgcaaagactcagatttgc

SEQ ID NO: 10494 - DNA, 20 bp, Artificial Sequence
  chemically synthesized
actcagatttgcaagaacgt

SEQ ID NO: 10495 - DNA, 20 bp, Artificial Sequence
  chemically synthesized
ctcagatttgcaagaacgtg

SEQ ID NO: 10496 - DNA, 20 bp, Artificial Sequence
  chemically synthesized
tgcaagaacgtgaggtattt

SEQ ID NO: 10497 - DNA, 20 bp, Artificial Sequence
  chemically synthesized
gcaagaacgtgaggtatttc

SEQ ID NO: 10498 - DNA, 20 bp, Artificial Sequence
  chemically synthesized
aagaacgtgaggtatttcag

SEQ ID NO: 10499 - DNA, 20 bp, Artificial Sequence
  chemically synthesized
ggtatttcaggagttttgta

SEQ ID NO: 10500 - DNA, 20 bp, Artificial Sequence
  chemically synthesized
gagttttgtatggttccata

SEQ ID NO: 10501 - DNA, 20 bp, Artificial Sequence
  chemically synthesized
ggttccatatggactatgac

SEQ ID NO: 10502 - DNA, 20 bp, Artificial Sequence
  chemically synthesized
ccatatggactatgacaagt

SEQ ID NO: 10503 - DNA, 20 bp, Artificial Sequence
  chemically synthesized
atggactatgacaagtgaga

SEQ ID NO: 10504 - DNA, 20 bp, Artificial Sequence
  chemically synthesized
tggactatgacaagtgagac

SEQ ID NO: 10505 - DNA, 20 bp, Artificial Sequence
  chemically synthesized
gacaagtgagacaggtaaac

SEQ ID NO: 10506 - DNA, 20 bp, Artificial Sequence
  chemically synthesized
acaagtgagacaggtaaact

SEQ ID NO: 10507 - DNA, 20 bp, Artificial Sequence
  chemically synthesized
agtgagacaggtaaactagg

SEQ ID NO: 10508 - DNA, 20 bp, Artificial Sequence
  chemically synthesized
tgagacaggtaaactaggca

SEQ ID NO: 10509 - DNA, 20 bp, Artificial Sequence
  chemically synthesized
acaggtaaactaggcagagc

SEQ ID NO: 10510 - DNA, 20 bp, Artificial Sequence
  chemically synthesized
aactaggcagagctggtcat

SEQ ID NO: 10511 - DNA, 20 bp, Artificial Sequence
  chemically synthesized
gagctggtcatcagataatg

SEQ ID NO: 10512 - DNA, 20 bp, Artificial Sequence
  chemically synthesized
gataatgaagtcattaacct

SEQ ID NO: 10513 - DNA, 20 bp, Artificial Sequence
  chemically synthesized
ataatgaagtcattaaccta

SEQ ID NO: 10514 - DNA, 20 bp, Artificial Sequence
  chemically synthesized
aatgaagtcattaacctaag

SEQ ID NO: 10515 - DNA, 20 bp, Artificial Sequence
  chemically synthesized
agtcattaacctaaggagat

SEQ ID NO: 10516 - DNA, 20 bp, Artificial Sequence
  chemically synthesized
ttggacaataaaatgcaata

SEQ ID NO: 10517 - DNA, 20 bp, Artificial Sequence
  chemically synthesized
ggacaataaaatgcaatatg

SEQ ID NO: 10518 - DNA, 20 bp, Artificial Sequence
  chemically synthesized
gacaataaaatgcaatatgg

SEQ ID NO: 10519 - DNA, 20 bp, Artificial Sequence
  chemically synthesized
aatgcaatatggaggtatcg

SEQ ID NO: 10520 - DNA, 20 bp, Artificial Sequence
  chemically synthesized
aggtatcgaagtataaacat

SEQ ID NO: 10521 - DNA, 20 bp, Artificial Sequence
  chemically synthesized
ggtatcgaagtataaacata

SEQ ID NO: 10522 - DNA, 20 bp, Artificial Sequence
  chemically synthesized
tatcgaagtataaacataag

SEQ ID NO: 10523 - DNA, 20 bp, Artificial Sequence
  chemically synthesized
aacataaggagtaccactga

SEQ ID NO: 10524 - DNA, 20 bp, Artificial Sequence
  chemically synthesized
agtaccactgatggctgatt

SEQ ID NO: 10525 - DNA, 20 bp, Artificial Sequence
  chemically synthesized
gtaccactgatggctgattt

SEQ ID NO: 10526 - DNA, 20 bp, Artificial Sequence
  chemically synthesized
gatggctgatttaggatgcc

SEQ ID NO: 10527 - DNA, 20 bp, Artificial Sequence
  chemically synthesized
ctgatttaggatgcccagtc

SEQ ID NO: 10528 - DNA, 20 bp, Artificial Sequence
  chemically synthesized
gcaacacgctaatgaaatga

SEQ ID NO: 10529 - DNA, 20 bp, Artificial Sequence
  chemically synthesized
acacgctaatgaaatgatag

SEQ ID NO: 10530 - DNA, 20 bp, Artificial Sequence
  chemically synthesized
cacgctaatgaaatgatagt

SEQ ID NO: 10531 - DNA, 20 bp, Artificial Sequence
  chemically synthesized
acgctaatgaaatgatagtg

SEQ ID NO: 10532 - DNA, 20 bp, Artificial Sequence
  chemically synthesized
cgctaatgaaatgatagtgg

SEQ ID NO: 10533 - DNA, 20 bp, Artificial Sequence
  chemically synthesized
ctaatgaaatgatagtgggg

SEQ ID NO: 10534 - DNA, 20 bp, Artificial Sequence
  chemically synthesized
taatgaaatgatagtggggg

SEQ ID NO: 10535 - DNA, 20 bp, Artificial Sequence
  chemically synthesized
aatgaaatgatagtggggga

SEQ ID NO: 10536 - DNA, 20 bp, Artificial Sequence
  chemically synthesized
atgaaatgatagtgggggag

SEQ ID NO: 10537 - DNA, 20 bp, Artificial Sequence
  chemically synthesized
tgaaatgatagtgggggagg

SEQ ID NO: 10538 - DNA, 20 bp, Artificial Sequence
  chemically synthesized
gtgggggagggggccgtacc

SEQ ID NO: 10539 - DNA, 20 bp, Artificial Sequence
  chemically synthesized
ggagggggccgtaccaagac

SEQ ID NO: 10540 - DNA, 20 bp, Artificial Sequence
  chemically synthesized
gagggggccgtaccaagact

SEQ ID NO: 10541 - DNA, 20 bp, Artificial Sequence
  chemically synthesized
gggggccgtaccaagactag

SEQ ID NO: 10542 - DNA, 20 bp, Artificial Sequence
  chemically synthesized
gggccgtaccaagactagga

SEQ ID NO: 10543 - DNA, 20 bp, Artificial Sequence
  chemically synthesized
gccgtaccaagactaggaga

SEQ ID NO: 10544 - DNA, 20 bp, Artificial Sequence
  chemically synthesized
gtaccaagactaggagagag

SEQ ID NO: 10545 - DNA, 20 bp, Artificial Sequence
  chemically synthesized
gactaggagagagcagtcct

SEQ ID NO: 10546 - DNA, 20 bp, Artificial Sequence
  chemically synthesized
gagactattgcaattatctg

SEQ ID NO: 10547 - DNA, 20 bp, Artificial Sequence
  chemically synthesized
agactattgcaattatctgc

SEQ ID NO: 10548 - DNA, 20 bp, Artificial Sequence
  chemically synthesized
actattgcaattatctgcgg

SEQ ID NO: 10549 - DNA, 20 bp, Artificial Sequence
  chemically synthesized
aattatctgcgggagacata

SEQ ID NO: 10550 - DNA, 20 bp, Artificial Sequence
  chemically synthesized
attatctgcgggagacataa

SEQ ID NO: 10551 - DNA, 20 bp, Artificial Sequence
  chemically synthesized
tctgcgggagacataaaggc

SEQ ID NO: 10552 - DNA, 20 bp, Artificial Sequence
  chemically synthesized
cataaaggctagaacctgaa

SEQ ID NO: 10553 - DNA, 20 bp, Artificial Sequence
  chemically synthesized
aaaggctagaacctgaacag

SEQ ID NO: 10554 - DNA, 20 bp, Artificial Sequence
  chemically synthesized
ggctagaacctgaacagtag

SEQ ID NO: 10555 - DNA, 20 bp, Artificial Sequence
  chemically synthesized
gaacagtagcagtacaaaaa

SEQ ID NO: 10556 - DNA, 20 bp, Artificial Sequence
  chemically synthesized
acagtagcagtacaaaaaaa

SEQ ID NO: 10557 - DNA, 20 bp, Artificial Sequence
  chemically synthesized
cagtagcagtacaaaaaaag

SEQ ID NO: 10558 - DNA, 20 bp, Artificial Sequence
  chemically synthesized
agtagcagtacaaaaaaaga

SEQ ID NO: 10559 - DNA, 20 bp, Artificial Sequence
  chemically synthesized
gtagcagtacaaaaaaagag

SEQ ID NO: 10560 - DNA, 20 bp, Artificial Sequence
  chemically synthesized
agcagtacaaaaaaagaggg

SEQ ID NO: 10561 - DNA, 20 bp, Artificial Sequence
  chemically synthesized
aggggagttcaaatgatatt

SEQ ID NO: 10562 - DNA, 20 bp, Artificial Sequence
  chemically synthesized
ggggagttcaaatgatatta

SEQ ID NO: 10563 - DNA, 20 bp, Artificial Sequence
  chemically synthesized
gagttcaaatgatattaagg

SEQ ID NO: 10564 - DNA, 20 bp, Artificial Sequence
  chemically synthesized
ttcaaatgatattaaggaag

SEQ ID NO: 10565 - DNA, 20 bp, Artificial Sequence
  chemically synthesized
aaatgatattaaggaagtag

SEQ ID NO: 10566 - DNA, 20 bp, Artificial Sequence
  chemically synthesized
tgatattaaggaagtagaag

SEQ ID NO: 10567 - DNA, 20 bp, Artificial Sequence
  chemically synthesized
agtggtatgacttaaccatc

SEQ ID NO: 10568 - DNA, 20 bp, Artificial Sequence
  chemically synthesized
gtggtatgacttaaccatct

SEQ ID NO: 10569 - DNA, 20 bp, Artificial Sequence
  chemically synthesized
atgacttaaccatctgggta

SEQ ID NO: 10570 - DNA, 20 bp, Artificial Sequence
  chemically synthesized
acttaaccatctgggtatgg

SEQ ID NO: 10571 - DNA, 20 bp, Artificial Sequence
  chemically synthesized
cttaaccatctgggtatgga

SEQ ID NO: 10572 - DNA, 20 bp, Artificial Sequence
  chemically synthesized
ttaaccatctgggtatggaa

SEQ ID NO: 10573 - DNA, 20 bp, Artificial Sequence
  chemically synthesized
taaccatctgggtatggaag

SEQ ID NO: 10574 - DNA, 20 bp, Artificial Sequence
  chemically synthesized
tctgggtatggaaggggaaa

SEQ ID NO: 10575 - DNA, 20 bp, Artificial Sequence
  chemically synthesized
ggtatggaaggggaaatggc

SEQ ID NO: 10576 - DNA, 20 bp, Artificial Sequence
  chemically synthesized
tatggaaggggaaatggcta

SEQ ID NO: 10577 - DNA, 20 bp, Artificial Sequence
  chemically synthesized
aggggaaatggctagagtct

SEQ ID NO: 10578 - DNA, 20 bp, Artificial Sequence
  chemically synthesized
ggggaaatggctagagtctt

SEQ ID NO: 10579 - DNA, 20 bp, Artificial Sequence
  chemically synthesized
gggaaatggctagagtcttg

SEQ ID NO: 10580 - DNA, 20 bp, Artificial Sequence
  chemically synthesized
ctttgtgtttgatgtgatta

SEQ ID NO: 10581 - DNA, 20 bp, Artificial Sequence
  chemically synthesized
tttgatgtgattatggacca

SEQ ID NO: 10582 - DNA, 20 bp, Artificial Sequence
  chemically synthesized
tggaccacagaataatgtct

SEQ ID NO: 10583 - DNA, 20 bp, Artificial Sequence
  chemically synthesized
gaccacagaataatgtctaa

SEQ ID NO: 10584 - DNA, 20 bp, Artificial Sequence
  chemically synthesized
agaataatgtctaagagaac

SEQ ID NO: 10585 - DNA, 20 bp, Artificial Sequence
  chemically synthesized
gtctaagagaactggctctt

SEQ ID NO: 10586 - DNA, 20 bp, Artificial Sequence
  chemically synthesized
tggctctttagtctgactgc

SEQ ID NO: 10587 - DNA, 20 bp, Artificial Sequence
  chemically synthesized
gctctttagtctgactgcca

SEQ ID NO: 10588 - DNA, 20 bp, Artificial Sequence
  chemically synthesized
agtctgaatcctgaatgttt

SEQ ID NO: 10589 - DNA, 20 bp, Artificial Sequence
  chemically synthesized
aatgttttagtatgttacct

SEQ ID NO: 10590 - DNA, 20 bp, Artificial Sequence
  chemically synthesized
atgttttagtatgttacctt

SEQ ID NO: 10591 - DNA, 20 bp, Artificial Sequence
  chemically synthesized
ttagtatgttaccttgggca

SEQ ID NO: 10592 - DNA, 20 bp, Artificial Sequence
  chemically synthesized
gttaccttgggcaaagccct

SEQ ID NO: 10593 - DNA, 20 bp, Artificial Sequence
  chemically synthesized
tcttcctcattcataaaaat

SEQ ID NO: 10594 - DNA, 20 bp, Artificial Sequence
  chemically synthesized
cattcataaaaataagatga

SEQ ID NO: 10595 - DNA, 20 bp, Artificial Sequence
  chemically synthesized
agatgacagtgcctatctcg

SEQ ID NO: 10596 - DNA, 20 bp, Artificial Sequence
  chemically synthesized
gatgacagtgcctatctcgt

SEQ ID NO: 10597 - DNA, 20 bp, Artificial Sequence
  chemically synthesized
ctatctcgtgggacttttgt

SEQ ID NO: 10598 - DNA, 20 bp, Artificial Sequence
  chemically synthesized
tatctcgtgggacttttgtg

SEQ ID NO: 10599 - DNA, 20 bp, Artificial Sequence
  chemically synthesized
gtgggacttttgtgaggatg

SEQ ID NO: 10600 - DNA, 20 bp, Artificial Sequence
  chemically synthesized
gacttttgtgaggatgaagt

SEQ ID NO: 10601 - DNA, 20 bp, Artificial Sequence
  chemically synthesized
gtgaggatgaagtgagataa

SEQ ID NO: 10602 - DNA, 20 bp, Artificial Sequence
  chemically synthesized
gaagtgagataatggatgca

SEQ ID NO: 10603 - DNA, 20 bp, Artificial Sequence
  chemically synthesized
ataatggatgcaaagttact

SEQ ID NO: 10604 - DNA, 20 bp, Artificial Sequence
  chemically synthesized
ggatgcaaagttactgagca

SEQ ID NO: 10605 - DNA, 20 bp, Artificial Sequence
  chemically synthesized
actgagcacagtgtccaaca

SEQ ID NO: 10606 - DNA, 20 bp, Artificial Sequence
  chemically synthesized
gagcacagtgtccaacacag

SEQ ID NO: 10607 - DNA, 20 bp, Artificial Sequence
  chemically synthesized
cacagtgtccaacacagcag

SEQ ID NO: 10608 - DNA, 20 bp, Artificial Sequence
  chemically synthesized
cagaagcattacatatacat

SEQ ID NO: 10609 - DNA, 20 bp, Artificial Sequence
  chemically synthesized
acatatacattagctattac

SEQ ID NO: 10610 - DNA, 20 bp, Artificial Sequence
  chemically synthesized
actggctacattatgatata

SEQ ID NO: 10611 - DNA, 20 bp, Artificial Sequence
  chemically synthesized
gctacattatgatatacagt

SEQ ID NO: 10612 - DNA, 20 bp, Artificial Sequence
  chemically synthesized
ctacattatgatatacagtt

SEQ ID NO: 10613 - DNA, 20 bp, Artificial Sequence
  chemically synthesized
tacattatgatatacagtta

SEQ ID NO: 10614 - DNA, 20 bp, Artificial Sequence
  chemically synthesized
cattatgatatacagttagg

SEQ ID NO: 10615 - DNA, 20 bp, Artificial Sequence
  chemically synthesized
atgatatacagttagggagt

SEQ ID NO: 10616 - DNA, 20 bp, Artificial Sequence
  chemically synthesized
tatacagttagggagttgga

SEQ ID NO: 10617 - DNA, 20 bp, Artificial Sequence
  chemically synthesized
tggaaagataatctgaaatt

SEQ ID NO: 10618 - DNA, 20 bp, Artificial Sequence
  chemically synthesized
ggaaagataatctgaaattc

SEQ ID NO: 10619 - DNA, 20 bp, Artificial Sequence
  chemically synthesized
aaagataatctgaaattcag

SEQ ID NO: 10620 - DNA, 20 bp, Artificial Sequence
  chemically synthesized
tcaggagacgtatctgacta

SEQ ID NO: 10621 - DNA, 20 bp, Artificial Sequence
  chemically synthesized
caggagacgtatctgactat

SEQ ID NO: 10622 - DNA, 20 bp, Artificial Sequence
  chemically synthesized
agacgtatctgactataggt

SEQ ID NO: 10623 - DNA, 20 bp, Artificial Sequence
  chemically synthesized
tctgactataggtgagtatt

SEQ ID NO: 10624 - DNA, 20 bp, Artificial Sequence
  chemically synthesized
ggaactcattgttctgtaaa

SEQ ID NO: 10625 - DNA, 20 bp, Artificial Sequence
  chemically synthesized
actcattgttctgtaaacag

SEQ ID NO: 10626 - DNA, 20 bp, Artificial Sequence
  chemically synthesized
tgttctgtaaacagtagtta

SEQ ID NO: 10627 - DNA, 20 bp, Artificial Sequence
  chemically synthesized
agtagttacagccacgtgtg

SEQ ID NO: 10628 - DNA, 20 bp, Artificial Sequence
  chemically synthesized
gtagttacagccacgtgtgt

SEQ ID NO: 10629 - DNA, 20 bp, Artificial Sequence
  chemically synthesized
cagccacgtgtgtgggcatc

SEQ ID NO: 10630 - DNA, 20 bp, Artificial Sequence
  chemically synthesized
gccacgtgtgtgggcatctg

SEQ ID NO: 10631 - DNA, 20 bp, Artificial Sequence
  chemically synthesized
cacgtgtgtgggcatctgga

SEQ ID NO: 10632 - DNA, 20 bp, Artificial Sequence
  chemically synthesized
tgtgtgggcatctggagagt

SEQ ID NO: 10633 - DNA, 20 bp, Artificial Sequence
  chemically synthesized
gggcatctggagagtgagca

SEQ ID NO: 10634 - DNA, 20 bp, Artificial Sequence
  chemically synthesized
agcatggatattgtgatacc

SEQ ID NO: 10635 - DNA, 20 bp, Artificial Sequence
  chemically synthesized
ggatattgtgatacctagta

SEQ ID NO: 10636 - DNA, 20 bp, Artificial Sequence
  chemically synthesized
gtgatacctagtacagtgcc

SEQ ID NO: 10637 - DNA, 20 bp, Artificial Sequence
  chemically synthesized
atacctagtacagtgcctgg

SEQ ID NO: 10638 - DNA, 20 bp, Artificial Sequence
  chemically synthesized
cctagtacagtgcctggcag

SEQ ID NO: 10639 - DNA, 20 bp, Artificial Sequence
  chemically synthesized
agtacagtgcctggcagtag

SEQ ID NO: 10640 - DNA, 20 bp, Artificial Sequence
  chemically synthesized
ggcagtagtggttgtatgct

SEQ ID NO: 10641 - DNA, 20 bp, Artificial Sequence
  chemically synthesized
tgctcagtaaattttgttga

SEQ ID NO: 10642 - DNA, 20 bp, Artificial Sequence
  chemically synthesized
gctcagtaaattttgttgac

SEQ ID NO: 10643 - DNA, 20 bp, Artificial Sequence
  chemically synthesized
ctcagtaaattttgttgaca

SEQ ID NO: 10644 - DNA, 20 bp, Artificial Sequence
  chemically synthesized
gtaaattttgttgacagggt

SEQ ID NO: 10645 - DNA, 20 bp, Artificial Sequence
  chemically synthesized
taaattttgttgacagggtc

SEQ ID NO: 10646 - DNA, 20 bp, Artificial Sequence
  chemically synthesized
aaattttgttgacagggtca

SEQ ID NO: 10647 - DNA, 20 bp, Artificial Sequence
  chemically synthesized
tttgttgacagggtcagggc

SEQ ID NO: 10648 - DNA, 20 bp, Artificial Sequence
  chemically synthesized
tgacagggtcagggccggac

SEQ ID NO: 10649 - DNA, 20 bp, Artificial Sequence
  chemically synthesized
gtcagggccggactagactg

SEQ ID NO: 10650 - DNA, 20 bp, Artificial Sequence
  chemically synthesized
gggccggactagactgtggt

SEQ ID NO: 10651 - DNA, 20 bp, Artificial Sequence
  chemically synthesized
cggactagactgtggtaagc

SEQ ID NO: 10652 - DNA, 20 bp, Artificial Sequence
  chemically synthesized
ggactagactgtggtaagca

SEQ ID NO: 10653 - DNA, 20 bp, Artificial Sequence
  chemically synthesized
actgtggtaagcaaggcctg

SEQ ID NO: 10654 - DNA, 20 bp, Artificial Sequence
  chemically synthesized
ctgtggtaagcaaggcctgt

SEQ ID NO: 10655 - DNA, 20 bp, Artificial Sequence
  chemically synthesized
tgtggtaagcaaggcctgta

SEQ ID NO: 10656 - DNA, 20 bp, Artificial Sequence
  chemically synthesized
taaatatacttgtatgcccc

SEQ ID NO: 10657 - DNA, 20 bp, Artificial Sequence
  chemically synthesized
atatacttgtatgccccgag

SEQ ID NO: 10658 - DNA, 20 bp, Artificial Sequence
  chemically synthesized
acttgtatgccccgagaagt

SEQ ID NO: 10659 - DNA, 20 bp, Artificial Sequence
  chemically synthesized
cttgtatgccccgagaagtg

SEQ ID NO: 10660 - DNA, 20 bp, Artificial Sequence
  chemically synthesized
tgtgccctacatgccttgtt

SEQ ID NO: 10661 - DNA, 20 bp, Artificial Sequence
  chemically synthesized
tgtttggttcactcttgtcc

SEQ ID NO: 10662 - DNA, 20 bp, Artificial Sequence
  chemically synthesized
gttcactcttgtcccagccc

SEQ ID NO: 10663 - DNA, 20 bp, Artificial Sequence
  chemically synthesized
actcttgtcccagccctagc

SEQ ID NO: 10664 - DNA, 20 bp, Artificial Sequence
  chemically synthesized
cagccctagcaagtatatat

SEQ ID NO: 10665 - DNA, 20 bp, Artificial Sequence
  chemically synthesized
agccctagcaagtatatata

SEQ ID NO: 10666 - DNA, 20 bp, Artificial Sequence
  chemically synthesized
caagtatatataaggtgaaa

SEQ ID NO: 10667 - DNA, 20 bp, Artificial Sequence
  chemically synthesized
aagtatatataaggtgaaaa

SEQ ID NO: 10668 - DNA, 20 bp, Artificial Sequence
  chemically synthesized
atataaggtgaaaaaggaaa

SEQ ID NO: 10669 - DNA, 20 bp, Artificial Sequence
  chemically synthesized
aggtgaaaaaggaaaaagct

SEQ ID NO: 10670 - DNA, 20 bp, Artificial Sequence
  chemically synthesized
ggtgaaaaaggaaaaagctg

SEQ ID NO: 10671 - DNA, 20 bp, Artificial Sequence
  chemically synthesized
aaaaaggaaaaagctgaggc

SEQ ID NO: 10672 - DNA, 20 bp, Artificial Sequence
  chemically synthesized
aaaggaaaaagctgaggctg

SEQ ID NO: 10673 - DNA, 20 bp, Artificial Sequence
  chemically synthesized
aaaaagctgaggctggagcc

SEQ ID NO: 10674 - DNA, 20 bp, Artificial Sequence
  chemically synthesized
aaaagctgaggctggagcct

SEQ ID NO: 10675 - DNA, 20 bp, Artificial Sequence
  chemically synthesized
aagctgaggctggagcctgg

SEQ ID NO: 10676 - DNA, 20 bp, Artificial Sequence
  chemically synthesized
gctggagcctgggagaaccc

SEQ ID NO: 10677 - DNA, 20 bp, Artificial Sequence
  chemically synthesized
tgggagaaccctggacattt

SEQ ID NO: 10678 - DNA, 20 bp, Artificial Sequence
  chemically synthesized
gggagaaccctggacattta

SEQ ID NO: 10679 - DNA, 20 bp, Artificial Sequence
  chemically synthesized
ggagaaccctggacatttaa

SEQ ID NO: 10680 - DNA, 20 bp, Artificial Sequence
  chemically synthesized
ccctggacatttaagggcca

SEQ ID NO: 10681 - DNA, 20 bp, Artificial Sequence
  chemically synthesized
ctggacatttaagggccatg

SEQ ID NO: 10682 - DNA, 20 bp, Artificial Sequence
  chemically synthesized
ggacatttaagggccatgga

SEQ ID NO: 10683 - DNA, 20 bp, Artificial Sequence
  chemically synthesized
gacatttaagggccatggag

SEQ ID NO: 10684 - DNA, 20 bp, Artificial Sequence
  chemically synthesized
ttaagggccatggagaggaa

SEQ ID NO: 10685 - DNA, 20 bp, Artificial Sequence
  chemically synthesized
taagggccatggagaggaac

SEQ ID NO: 10686 - DNA, 20 bp, Artificial Sequence
  chemically synthesized
agggccatggagaggaacag

SEQ ID NO: 10687 - DNA, 20 bp, Artificial Sequence
  chemically synthesized
gaacaggagttaatcaattc

SEQ ID NO: 10688 - DNA, 20 bp, Artificial Sequence
  chemically synthesized
gagttaatcaattcaagtgc

SEQ ID NO: 10689 - DNA, 20 bp, Artificial Sequence
  chemically synthesized
taatcaattcaagtgctgga

SEQ ID NO: 10690 - DNA, 20 bp, Artificial Sequence
  chemically synthesized
ttcaagtgctggatggataa

SEQ ID NO: 10691 - DNA, 20 bp, Artificial Sequence
  chemically synthesized
tcaagtgctggatggataac

SEQ ID NO: 10692 - DNA, 20 bp, Artificial Sequence
  chemically synthesized
aagtgctggatggataacag

SEQ ID NO: 10693 - DNA, 20 bp, Artificial Sequence
  chemically synthesized
gctggatggataacaggagt

SEQ ID NO: 10694 - DNA, 20 bp, Artificial Sequence
  chemically synthesized
tggatggataacaggagtta

SEQ ID NO: 10695 - DNA, 20 bp, Artificial Sequence
  chemically synthesized
ggataacaggagttagagca

SEQ ID NO: 10696 - DNA, 20 bp, Artificial Sequence
  chemically synthesized
taacaggagttagagcaaag

SEQ ID NO: 10697 - DNA, 20 bp, Artificial Sequence
  chemically synthesized
aacaggagttagagcaaagc

SEQ ID NO: 10698 - DNA, 20 bp, Artificial Sequence
  chemically synthesized
acaggagttagagcaaagcg

SEQ ID NO: 10699 - DNA, 20 bp, Artificial Sequence
  chemically synthesized
gttagagcaaagcggggaac

SEQ ID NO: 10700 - DNA, 20 bp, Artificial Sequence
  chemically synthesized
agcaaagcggggaaccagaa

SEQ ID NO: 10701 - DNA, 20 bp, Artificial Sequence
  chemically synthesized
caaagcggggaaccagaata

SEQ ID NO: 10702 - DNA, 20 bp, Artificial Sequence
  chemically synthesized
aatagagtgattattataaa

SEQ ID NO: 10703 - DNA, 20 bp, Artificial Sequence
  chemically synthesized
tagagtgattattataaaaa

SEQ ID NO: 10704 - DNA, 20 bp, Artificial Sequence
  chemically synthesized
tataaaaagagtttcctaaa

SEQ ID NO: 10705 - DNA, 20 bp, Artificial Sequence
  chemically synthesized
ataaaaagagtttcctaaaa

SEQ ID NO: 10706 - DNA, 20 bp, Artificial Sequence
  chemically synthesized
taaaaagagtttcctaaaaa

SEQ ID NO: 10707 - DNA, 20 bp, Artificial Sequence
  chemically synthesized
aaaagagtttcctaaaaagg

SEQ ID NO: 10708 - DNA, 20 bp, Artificial Sequence
  chemically synthesized
aagagtttcctaaaaaggga

SEQ ID NO: 10709 - DNA, 20 bp, Artificial Sequence
  chemically synthesized
aaaagggagagatcaacaat

SEQ ID NO: 10710 - DNA, 20 bp, Artificial Sequence
  chemically synthesized
atcaacaattagaaattatt

SEQ ID NO: 10711 - DNA, 20 bp, Artificial Sequence
  chemically synthesized
caacaattagaaattattta

SEQ ID NO: 10712 - DNA, 20 bp, Artificial Sequence
  chemically synthesized
caattagaaattatttagag

SEQ ID NO: 10713 - DNA, 20 bp, Artificial Sequence
  chemically synthesized
tagaaattatttagagcagc

SEQ ID NO: 10714 - DNA, 20 bp, Artificial Sequence
  chemically synthesized
ataaactcaaaattattctt

SEQ ID NO: 10715 - DNA, 20 bp, Artificial Sequence
  chemically synthesized
taaactcaaaattattcttt

SEQ ID NO: 10716 - DNA, 20 bp, Artificial Sequence
  chemically synthesized
gtcattcctgattgtgacaa

SEQ ID NO: 10717 - DNA, 20 bp, Artificial Sequence
  chemically synthesized
ttcattatataaatgtgatt

SEQ ID NO: 10718 - DNA, 20 bp, Artificial Sequence
  chemically synthesized
tcattatataaatgtgatta

SEQ ID NO: 10719 - DNA, 20 bp, Artificial Sequence
  chemically synthesized
ttatataaatgtgattaagg

SEQ ID NO: 10720 - DNA, 20 bp, Artificial Sequence
  chemically synthesized
tatataaatgtgattaagga

SEQ ID NO: 10721 - DNA, 20 bp, Artificial Sequence
  chemically synthesized
aaatgtgattaaggaaggaa

SEQ ID NO: 10722 - DNA, 20 bp, Artificial Sequence
  chemically synthesized
atgtgattaaggaaggaaaa

SEQ ID NO: 10723 - DNA, 20 bp, Artificial Sequence
  chemically synthesized
aaggaaggaaaagagctaca

SEQ ID NO: 10724 - DNA, 20 bp, Artificial Sequence
  chemically synthesized
gaaggaaaagagctacacag

SEQ ID NO: 10725 - DNA, 20 bp, Artificial Sequence
  chemically synthesized
gagctacacagaagttatta

SEQ ID NO: 10726 - DNA, 20 bp, Artificial Sequence
  chemically synthesized
gctacacagaagttattaaa

SEQ ID NO: 10727 - DNA, 20 bp, Artificial Sequence
  chemically synthesized
cagaagttattaaagagcta

SEQ ID NO: 10728 - DNA, 20 bp, Artificial Sequence
  chemically synthesized
gaagttattaaagagctaaa

SEQ ID NO: 10729 - DNA, 20 bp, Artificial Sequence
  chemically synthesized
ttaaagagctaaagagaatt

SEQ ID NO: 10730 - DNA, 20 bp, Artificial Sequence
  chemically synthesized
gagaattgagaaatttaaaa

SEQ ID NO: 10731 - DNA, 20 bp, Artificial Sequence
  chemically synthesized
aattgagaaatttaaaacag

SEQ ID NO: 10732 - DNA, 20 bp, Artificial Sequence
  chemically synthesized
gagaaatttaaaacagaaga

SEQ ID NO: 10733 - DNA, 20 bp, Artificial Sequence
  chemically synthesized
aaatttaaaacagaagaaag

SEQ ID NO: 10734 - DNA, 20 bp, Artificial Sequence
  chemically synthesized
aatttaaaacagaagaaagt

SEQ ID NO: 10735 - DNA, 20 bp, Artificial Sequence
  chemically synthesized
atttaaaacagaagaaagta

SEQ ID NO: 10736 - DNA, 20 bp, Artificial Sequence
  chemically synthesized
agaaagtagggccaacatga

SEQ ID NO: 10737 - DNA, 20 bp, Artificial Sequence
  chemically synthesized
gaaagtagggccaacatgaa

SEQ ID NO: 10738 - DNA, 20 bp, Artificial Sequence
  chemically synthesized
aagtagggccaacatgaaag

SEQ ID NO: 10739 - DNA, 20 bp, Artificial Sequence
  chemically synthesized
tagggccaacatgaaaggag

SEQ ID NO: 10740 - DNA, 20 bp, Artificial Sequence
  chemically synthesized
agggccaacatgaaaggagt

SEQ ID NO: 10741 - DNA, 20 bp, Artificial Sequence
  chemically synthesized
gggccaacatgaaaggagta

SEQ ID NO: 10742 - DNA, 20 bp, Artificial Sequence
  chemically synthesized
gccaacatgaaaggagtagg

SEQ ID NO: 10743 - DNA, 20 bp, Artificial Sequence
  chemically synthesized
atgaaaggagtagggagaaa

SEQ ID NO: 10744 - DNA, 20 bp, Artificial Sequence
  chemically synthesized
gaaaggagtagggagaaaaa

SEQ ID NO: 10745 - DNA, 20 bp, Artificial Sequence
  chemically synthesized
tagggagaaaaagagataac

SEQ ID NO: 10746 - DNA, 20 bp, Artificial Sequence
  chemically synthesized
ctgatcctgccaacacctgt

SEQ ID NO: 10747 - DNA, 20 bp, Artificial Sequence
  chemically synthesized
tcctgccaacacctgtgaga

SEQ ID NO: 10748 - DNA, 20 bp, Artificial Sequence
  chemically synthesized
aacctaatttacatttgaca

SEQ ID NO: 10749 - DNA, 20 bp, Artificial Sequence
  chemically synthesized
aatttacatttgacaaagtt

SEQ ID NO: 10750 - DNA, 20 bp, Artificial Sequence
  chemically synthesized
atttacatttgacaaagtta

SEQ ID NO: 10751 - DNA, 20 bp, Artificial Sequence
  chemically synthesized
catttgacaaagttaaggtt

SEQ ID NO: 10752 - DNA, 20 bp, Artificial Sequence
  chemically synthesized
tttgacaaagttaaggttca

SEQ ID NO: 10753 - DNA, 20 bp, Artificial Sequence
  chemically synthesized
agagcttgtgtgacttgtcc

SEQ ID NO: 10754 - DNA, 20 bp, Artificial Sequence
  chemically synthesized
gagcttgtgtgacttgtcca

SEQ ID NO: 10755 - DNA, 20 bp, Artificial Sequence
  chemically synthesized
gtgtgacttgtccaaggtca

SEQ ID NO: 10756 - DNA, 20 bp, Artificial Sequence
  chemically synthesized
tgtgacttgtccaaggtcac

SEQ ID NO: 10757 - DNA, 20 bp, Artificial Sequence
  chemically synthesized
cttgtccaaggtcacaggtc

SEQ ID NO: 10758 - DNA, 20 bp, Artificial Sequence
  chemically synthesized
tgtccaaggtcacaggtcta

SEQ ID NO: 10759 - DNA, 20 bp, Artificial Sequence
  chemically synthesized
gtccaaggtcacaggtctag

SEQ ID NO: 10760 - DNA, 20 bp, Artificial Sequence
  chemically synthesized
ccaaggtcacaggtctagag

SEQ ID NO: 10761 - DNA, 20 bp, Artificial Sequence
  chemically synthesized
caaggtcacaggtctagagg

SEQ ID NO: 10762 - DNA, 20 bp, Artificial Sequence
  chemically synthesized
ggtcacaggtctagaggagg

SEQ ID NO: 10763 - DNA, 20 bp, Artificial Sequence
  chemically synthesized
ttctgtctgatctgattcta

SEQ ID NO: 10764 - DNA, 20 bp, Artificial Sequence
  chemically synthesized
tttcactcaaccacactgta

SEQ ID NO: 10765 - DNA, 20 bp, Artificial Sequence
  chemically synthesized
actcaaccacactgtacagt

SEQ ID NO: 10766 - DNA, 20 bp, Artificial Sequence
  chemically synthesized
gtacagtcagctctccttgt

SEQ ID NO: 10767 - DNA, 20 bp, Artificial Sequence
  chemically synthesized
agctctccttgtgagttcca

SEQ ID NO: 10768 - DNA, 20 bp, Artificial Sequence
  chemically synthesized
ccttgtgagttccacagcca

SEQ ID NO: 10769 - DNA, 20 bp, Artificial Sequence
  chemically synthesized
gccacagattcaattaactg

SEQ ID NO: 10770 - DNA, 20 bp, Artificial Sequence
  chemically synthesized
actgcagatcaaaaatattc

SEQ ID NO: 10771 - DNA, 20 bp, Artificial Sequence
  chemically synthesized
aaaaatattcaagaaaaaaa

SEQ ID NO: 10772 - DNA, 20 bp, Artificial Sequence
  chemically synthesized
atattcaagaaaaaaatgga

SEQ ID NO: 10773 - DNA, 20 bp, Artificial Sequence
  chemically synthesized
gcatctctactgaacatgta

SEQ ID NO: 10774 - DNA, 20 bp, Artificial Sequence
  chemically synthesized
tcattattccctaaacaata

SEQ ID NO: 10775 - DNA, 20 bp, Artificial Sequence
  chemically synthesized
cagcataacaactatttaca

SEQ ID NO: 10776 - DNA, 20 bp, Artificial Sequence
  chemically synthesized
acatagcatttacattgtat

SEQ ID NO: 10777 - DNA, 20 bp, Artificial Sequence
  chemically synthesized
tttacattgtattagctatt

SEQ ID NO: 10778 - DNA, 20 bp, Artificial Sequence
  chemically synthesized
tacattgtattagctattaa

SEQ ID NO: 10779 - DNA, 20 bp, Artificial Sequence
  chemically synthesized
attagctattaagagaaacc

SEQ ID NO: 10780 - DNA, 20 bp, Artificial Sequence
  chemically synthesized
tagctattaagagaaaccta

SEQ ID NO: 10781 - DNA, 20 bp, Artificial Sequence
  chemically synthesized
agaaacctagagatgattta

SEQ ID NO: 10782 - DNA, 20 bp, Artificial Sequence
  chemically synthesized
tagagatgatttaaagtaca

SEQ ID NO: 10783 - DNA, 20 bp, Artificial Sequence
  chemically synthesized
agagatgatttaaagtacaa

SEQ ID NO: 10784 - DNA, 20 bp, Artificial Sequence
  chemically synthesized
agatgatttaaagtacaaag

SEQ ID NO: 10785 - DNA, 20 bp, Artificial Sequence
  chemically synthesized
gatgatttaaagtacaaagg

SEQ ID NO: 10786 - DNA, 20 bp, Artificial Sequence
  chemically synthesized
agtacaaaggaggatgtgtt

SEQ ID NO: 10787 - DNA, 20 bp, Artificial Sequence
  chemically synthesized
gtacaaaggaggatgtgttt

SEQ ID NO: 10788 - DNA, 20 bp, Artificial Sequence
  chemically synthesized
gtgtttaggttatatgcaaa

SEQ ID NO: 10789 - DNA, 20 bp, Artificial Sequence
  chemically synthesized
ttaggttatatgcaaatagt

SEQ ID NO: 10790 - DNA, 20 bp, Artificial Sequence
  chemically synthesized
atagtaagccatttttatat

SEQ ID NO: 10791 - DNA, 20 bp, Artificial Sequence
  chemically synthesized
agtaagccatttttatatcg

SEQ ID NO: 10792 - DNA, 20 bp, Artificial Sequence
  chemically synthesized
catttttatatcggagactt

SEQ ID NO: 10793 - DNA, 20 bp, Artificial Sequence
  chemically synthesized
atcggagacttgagcatcca

SEQ ID NO: 10794 - DNA, 20 bp, Artificial Sequence
  chemically synthesized
tccacagatcttgatatttg

SEQ ID NO: 10795 - DNA, 20 bp, Artificial Sequence
  chemically synthesized
ccacagatcttgatatttgc

SEQ ID NO: 10796 - DNA, 20 bp, Artificial Sequence
  chemically synthesized
cacagatcttgatatttgca

SEQ ID NO: 10797 - DNA, 20 bp, Artificial Sequence
  chemically synthesized
acagatcttgatatttgcag

SEQ ID NO: 10798 - DNA, 20 bp, Artificial Sequence
  chemically synthesized
cagatcttgatatttgcagg

SEQ ID NO: 10799 - DNA, 20 bp, Artificial Sequence
  chemically synthesized
gtcttgccaccaattttcca

SEQ ID NO: 10800 - DNA, 20 bp, Artificial Sequence
  chemically synthesized
accaattttccatggatact

SEQ ID NO: 10801 - DNA, 20 bp, Artificial Sequence
  chemically synthesized
ccaattttccatggatactg

SEQ ID NO: 10802 - DNA, 20 bp, Artificial Sequence
  chemically synthesized
tactgaggaacgactgtaaa

SEQ ID NO: 10803 - DNA, 20 bp, Artificial Sequence
  chemically synthesized
ggaacgactgtaaatggatg

SEQ ID NO: 10804 - DNA, 20 bp, Artificial Sequence
  chemically synthesized
gaacgactgtaaatggatgc

SEQ ID NO: 10805 - DNA, 20 bp, Artificial Sequence
  chemically synthesized
actgtaaatggatgcaggca

SEQ ID NO: 10806 - DNA, 20 bp, Artificial Sequence
  chemically synthesized
atgcaggcatggatgctatt

SEQ ID NO: 10807 - DNA, 20 bp, Artificial Sequence
  chemically synthesized
tgcaggcatggatgctattt

SEQ ID NO: 10808 - DNA, 20 bp, Artificial Sequence
  chemically synthesized
caggcatggatgctatttag

SEQ ID NO: 10809 - DNA, 20 bp, Artificial Sequence
  chemically synthesized
ggatgctatttaggagtgtc

SEQ ID NO: 10810 - DNA, 20 bp, Artificial Sequence
  chemically synthesized
gatgctatttaggagtgtcc

SEQ ID NO: 10811 - DNA, 20 bp, Artificial Sequence
  chemically synthesized
atgctatttaggagtgtcca

SEQ ID NO: 10812 - DNA, 20 bp, Artificial Sequence
  chemically synthesized
atttaggagtgtccagggcc

SEQ ID NO: 10813 - DNA, 20 bp, Artificial Sequence
  chemically synthesized
gtgtccagggccaagtaaat

SEQ ID NO: 10814 - DNA, 20 bp, Artificial Sequence
  chemically synthesized
ggccaagtaaatgagttgct

SEQ ID NO: 10815 - DNA, 20 bp, Artificial Sequence
  chemically synthesized
caagtaaatgagttgctgag

SEQ ID NO: 10816 - DNA, 20 bp, Artificial Sequence
  chemically synthesized
agtaaatgagttgctgagca

SEQ ID NO: 10817 - DNA, 20 bp, Artificial Sequence
  chemically synthesized
taaatgagttgctgagcaga

SEQ ID NO: 10818 - DNA, 20 bp, Artificial Sequence
  chemically synthesized
aaatgagttgctgagcagag

SEQ ID NO: 10819 - DNA, 20 bp, Artificial Sequence
  chemically synthesized
tgagttgctgagcagagagg

SEQ ID NO: 10820 - DNA, 20 bp, Artificial Sequence
  chemically synthesized
gagttgctgagcagagaggt

SEQ ID NO: 10821 - DNA, 20 bp, Artificial Sequence
  chemically synthesized
ttgctgagcagagaggtggg

SEQ ID NO: 10822 - DNA, 20 bp, Artificial Sequence
  chemically synthesized
gctgagcagagaggtgggtg

SEQ ID NO: 10823 - DNA, 20 bp, Artificial Sequence
  chemically synthesized
ctgagcagagaggtgggtgg

SEQ ID NO: 10824 - DNA, 20 bp, Artificial Sequence
  chemically synthesized
gagaggtgggtggaggctgt

SEQ ID NO: 10825 - DNA, 20 bp, Artificial Sequence
  chemically synthesized
agaggtgggtggaggctgtg

SEQ ID NO: 10826 - DNA, 20 bp, Artificial Sequence
  chemically synthesized
ggctgtgaggcatcaatatg

SEQ ID NO: 10827 - DNA, 20 bp, Artificial Sequence
  chemically synthesized
tgtgaggcatcaatatgtgg

SEQ ID NO: 10828 - DNA, 20 bp, Artificial Sequence
  chemically synthesized
ggtggcatccatctgcattt

SEQ ID NO: 10829 - DNA, 20 bp, Artificial Sequence
  chemically synthesized
ttggtgatttttttccttca

SEQ ID NO: 10830 - DNA, 20 bp, Artificial Sequence
  chemically synthesized
tttttttccttcacagtcct

SEQ ID NO: 10831 - DNA, 20 bp, Artificial Sequence
  chemically synthesized
cttcacagtcctcggctgtc

SEQ ID NO: 10832 - DNA, 20 bp, Artificial Sequence
  chemically synthesized
ttcacagtcctcggctgtct

SEQ ID NO: 10833 - DNA, 20 bp, Artificial Sequence
  chemically synthesized
acagtcctcggctgtctggg

SEQ ID NO: 10834 - DNA, 20 bp, Artificial Sequence
  chemically synthesized
agtcctcggctgtctgggaa

SEQ ID NO: 10835 - DNA, 20 bp, Artificial Sequence
  chemically synthesized
cctcggctgtctgggaagag

SEQ ID NO: 10836 - DNA, 20 bp, Artificial Sequence
  chemically synthesized
ctcggctgtctgggaagaga

SEQ ID NO: 10837 - DNA, 20 bp, Artificial Sequence
  chemically synthesized
tgtctgggaagagaaggatg

SEQ ID NO: 10838 - DNA, 20 bp, Artificial Sequence
  chemically synthesized
gtctgggaagagaaggatga

SEQ ID NO: 10839 - DNA, 20 bp, Artificial Sequence
  chemically synthesized
tgggaagagaaggatgaagg

SEQ ID NO: 10840 - DNA, 20 bp, Artificial Sequence
  chemically synthesized
aagagaaggatgaaggcaga

SEQ ID NO: 10841 - DNA, 20 bp, Artificial Sequence
  chemically synthesized
ggcagatggctgctccaatt

SEQ ID NO: 10842 - DNA, 20 bp, Artificial Sequence
  chemically synthesized
gcagatggctgctccaattt

SEQ ID NO: 10843 - DNA, 20 bp, Artificial Sequence
  chemically synthesized
cagatggctgctccaattta

SEQ ID NO: 10844 - DNA, 20 bp, Artificial Sequence
  chemically synthesized
agatggctgctccaatttag

SEQ ID NO: 10845 - DNA, 20 bp, Artificial Sequence
  chemically synthesized
ggctgctccaatttaggggc

SEQ ID NO: 10846 - DNA, 20 bp, Artificial Sequence
  chemically synthesized
gctgctccaatttaggggct

SEQ ID NO: 10847 - DNA, 20 bp, Artificial Sequence
  chemically synthesized
caatttaggggctaggattg

SEQ ID NO: 10848 - DNA, 20 bp, Artificial Sequence
  chemically synthesized
aatttaggggctaggattgc

SEQ ID NO: 10849 - DNA, 20 bp, Artificial Sequence
  chemically synthesized
atttaggggctaggattgca

SEQ ID NO: 10850 - DNA, 20 bp, Artificial Sequence
  chemically synthesized
taggggctaggattgcaggg

SEQ ID NO: 10851 - DNA, 20 bp, Artificial Sequence
  chemically synthesized
aggggctaggattgcagggt

SEQ ID NO: 10852 - DNA, 20 bp, Artificial Sequence
  chemically synthesized
ctaggattgcagggtgggca

SEQ ID NO: 10853 - DNA, 20 bp, Artificial Sequence
  chemically synthesized
gtgggcacagcattgcaaac

SEQ ID NO: 10854 - DNA, 20 bp, Artificial Sequence
  chemically synthesized
cacagcattgcaaacgagtg

SEQ ID NO: 10855 - DNA, 20 bp, Artificial Sequence
  chemically synthesized
acagcattgcaaacgagtga

SEQ ID NO: 10856 - DNA, 20 bp, Artificial Sequence
  chemically synthesized
gcaaacgagtgaaggaaatt

SEQ ID NO: 10857 - DNA, 20 bp, Artificial Sequence
  chemically synthesized
gtgaaggaaattgagaaata

SEQ ID NO: 10858 - DNA, 20 bp, Artificial Sequence
  chemically synthesized
attgagaaatatggccaatg

SEQ ID NO: 10859 - DNA, 20 bp, Artificial Sequence
  chemically synthesized
tgagaaatatggccaatgaa

SEQ ID NO: 10860 - DNA, 20 bp, Artificial Sequence
  chemically synthesized
atatggccaatgaagagttg

SEQ ID NO: 10861 - DNA, 20 bp, Artificial Sequence
  chemically synthesized
atggccaatgaagagttgaa

SEQ ID NO: 10862 - DNA, 20 bp, Artificial Sequence
  chemically synthesized
ggccaatgaagagttgaaga

SEQ ID NO: 10863 - DNA, 20 bp, Artificial Sequence
  chemically synthesized
gccaatgaagagttgaagag

SEQ ID NO: 10864 - DNA, 20 bp, Artificial Sequence
  chemically synthesized
tgaagagttgaagagaggcc

SEQ ID NO: 10865 - DNA, 20 bp, Artificial Sequence
  chemically synthesized
agttgaagagaggcctggca

SEQ ID NO: 10866 - DNA, 20 bp, Artificial Sequence
  chemically synthesized
tgaagagaggcctggcatgg

SEQ ID NO: 10867 - DNA, 20 bp, Artificial Sequence
  chemically synthesized
gtggctcacacctataatcc

SEQ ID NO: 10868 - DNA, 20 bp, Artificial Sequence
  chemically synthesized
acctataatcccagcacttt

SEQ ID NO: 10869 - DNA, 20 bp, Artificial Sequence
  chemically synthesized
ctataatcccagcactttca

SEQ ID NO: 10870 - DNA, 20 bp, Artificial Sequence
  chemically synthesized
tataatcccagcactttcag

SEQ ID NO: 10871 - DNA, 20 bp, Artificial Sequence
  chemically synthesized
tcccagcactttcagaggcc

SEQ ID NO: 10872 - DNA, 20 bp, Artificial Sequence
  chemically synthesized
cccagcactttcagaggccc

SEQ ID NO: 10873 - DNA, 20 bp, Artificial Sequence
  chemically synthesized
agcactttcagaggcccagg

SEQ ID NO: 10874 - DNA, 20 bp, Artificial Sequence
  chemically synthesized
gcactttcagaggcccaggc

SEQ ID NO: 10875 - DNA, 20 bp, Artificial Sequence
  chemically synthesized
ctttcagaggcccaggcagg

SEQ ID NO: 10876 - DNA, 20 bp, Artificial Sequence
  chemically synthesized
cccaggcaggcagatcactt

SEQ ID NO: 10877 - DNA, 20 bp, Artificial Sequence
  chemically synthesized
ccaggcaggcagatcacttg

SEQ ID NO: 10878 - DNA, 20 bp, Artificial Sequence
  chemically synthesized
gcaggcagatcacttgaggt

SEQ ID NO: 10879 - DNA, 20 bp, Artificial Sequence
  chemically synthesized
caggcagatcacttgaggtc

SEQ ID NO: 10880 - DNA, 20 bp, Artificial Sequence
  chemically synthesized
ggcagatcacttgaggtcag

SEQ ID NO: 10881 - DNA, 20 bp, Artificial Sequence
  chemically synthesized
tgaggtcaggagttcgacac

SEQ ID NO: 10882 - DNA, 20 bp, Artificial Sequence
  chemically synthesized
tcaggagttcgacaccagcc

SEQ ID NO: 10883 - DNA, 20 bp, Artificial Sequence
  chemically synthesized
tcgacaccagcctggccaac

SEQ ID NO: 10884 - DNA, 20 bp, Artificial Sequence
  chemically synthesized
cgacaccagcctggccaaca

SEQ ID NO: 10885 - DNA, 20 bp, Artificial Sequence
  chemically synthesized
gcctggccaacaaggtgaaa

SEQ ID NO: 10886 - DNA, 20 bp, Artificial Sequence
  chemically synthesized
aaggtgaaatggtgaaaccc

SEQ ID NO: 10887 - DNA, 20 bp, Artificial Sequence
  chemically synthesized
tttactaaaaatacaaaaat

SEQ ID NO: 10888 - DNA, 20 bp, Artificial Sequence
  chemically synthesized
ctaaaaatacaaaaattagc

SEQ ID NO: 10889 - DNA, 20 bp, Artificial Sequence
  chemically synthesized
taaaaatacaaaaattagct

SEQ ID NO: 10890 - DNA, 20 bp, Artificial Sequence
  chemically synthesized
atacaaaaattagctgggca

SEQ ID NO: 10891 - DNA, 20 bp, Artificial Sequence
  chemically synthesized
caaaaattagctgggcatgg

SEQ ID NO: 10892 - DNA, 20 bp, Artificial Sequence
  chemically synthesized
aaattagctgggcatggtgg

SEQ ID NO: 10893 - DNA, 20 bp, Artificial Sequence
  chemically synthesized
aattagctgggcatggtggc

SEQ ID NO: 10894 - DNA, 20 bp, Artificial Sequence
  chemically synthesized
gtggcgggtgcctgtaatcc

SEQ ID NO: 10895 - DNA, 20 bp, Artificial Sequence
  chemically synthesized
tgcctgtaatcccagctact

SEQ ID NO: 10896 - DNA, 20 bp, Artificial Sequence
  chemically synthesized
gcctgtaatcccagctactt

SEQ ID NO: 10897 - DNA, 20 bp, Artificial Sequence
  chemically synthesized
ctgtaatcccagctacttgg

SEQ ID NO: 10898 - DNA, 20 bp, Artificial Sequence
  chemically synthesized
tgtaatcccagctacttggg

SEQ ID NO: 10899 - DNA, 20 bp, Artificial Sequence
  chemically synthesized
tcccagctacttgggaggct

SEQ ID NO: 10900 - DNA, 20 bp, Artificial Sequence
  chemically synthesized
cccagctacttgggaggctg

SEQ ID NO: 10901 - DNA, 20 bp, Artificial Sequence
  chemically synthesized
agctacttgggaggctgagg

SEQ ID NO: 10902 - DNA, 20 bp, Artificial Sequence
  chemically synthesized
gctacttgggaggctgaggc

SEQ ID NO: 10903 - DNA, 20 bp, Artificial Sequence
  chemically synthesized
tacttgggaggctgaggcag

SEQ ID NO: 10904 - DNA, 20 bp, Artificial Sequence
  chemically synthesized
gggaggctgaggcaggagaa

SEQ ID NO: 10905 - DNA, 20 bp, Artificial Sequence
  chemically synthesized
gcaggagaatagcttgaacc

SEQ ID NO: 10906 - DNA, 20 bp, Artificial Sequence
  chemically synthesized
caggagaatagcttgaacct

SEQ ID NO: 10907 - DNA, 20 bp, Artificial Sequence
  chemically synthesized
ggagaatagcttgaacctgg

SEQ ID NO: 10908 - DNA, 20 bp, Artificial Sequence
  chemically synthesized
aatagcttgaacctgggaga

SEQ ID NO: 10909 - DNA, 20 bp, Artificial Sequence
  chemically synthesized
tagcttgaacctgggagatg

SEQ ID NO: 10910 - DNA, 20 bp, Artificial Sequence
  chemically synthesized
agcttgaacctgggagatgg

SEQ ID NO: 10911 - DNA, 20 bp, Artificial Sequence
  chemically synthesized
aacctgggagatggaggttg

SEQ ID NO: 10912 - DNA, 20 bp, Artificial Sequence
  chemically synthesized
tgggagatggaggttgcagt

SEQ ID NO: 10913 - DNA, 20 bp, Artificial Sequence
  chemically synthesized
gatggaggttgcagtgagct

SEQ ID NO: 10914 - DNA, 20 bp, Artificial Sequence
  chemically synthesized
gagatcgcaccactgcactc

SEQ ID NO: 10915 - DNA, 20 bp, Artificial Sequence
  chemically synthesized
cgcaccactgcactccagcc

SEQ ID NO: 10916 - DNA, 20 bp, Artificial Sequence
  chemically synthesized
gcaccactgcactccagcct

SEQ ID NO: 10917 - DNA, 20 bp, Artificial Sequence
  chemically synthesized
ctgcactccagcctgggcga

SEQ ID NO: 10918 - DNA, 20 bp, Artificial Sequence
  chemically synthesized
gcactccagcctgggcgaca

SEQ ID NO: 10919 - DNA, 20 bp, Artificial Sequence
  chemically synthesized
tccagcctgggcgacagagc

SEQ ID NO: 10920 - DNA, 20 bp, Artificial Sequence
  chemically synthesized
caagactctgtcaaaaaaaa

SEQ ID NO: 10921 - DNA, 20 bp, Artificial Sequence
  chemically synthesized
agactctgtcaaaaaaaaaa

SEQ ID NO: 10922 - DNA, 20 bp, Artificial Sequence
  chemically synthesized
tgtcaaaaaaaaaagagttg

SEQ ID NO: 10923 - DNA, 20 bp, Artificial Sequence
  chemically synthesized
tcaaaaaaaaaagagttgaa

SEQ ID NO: 10924 - DNA, 20 bp, Artificial Sequence
  chemically synthesized
aaaaaagagttgaagagaaa

SEQ ID NO: 10925 - DNA, 20 bp, Artificial Sequence
  chemically synthesized
agagttgaagagaaaaagtc

SEQ ID NO: 10926 - DNA, 20 bp, Artificial Sequence
  chemically synthesized
gagttgaagagaaaaagtct

SEQ ID NO: 10927 - DNA, 20 bp, Artificial Sequence
  chemically synthesized
aaaagtctaggctaaattca

SEQ ID NO: 10928 - DNA, 20 bp, Artificial Sequence
  chemically synthesized
aggctaaattcaaagaaaaa

SEQ ID NO: 10929 - DNA, 20 bp, Artificial Sequence
  chemically synthesized
taaattcaaagaaaaaaagt

SEQ ID NO: 10930 - DNA, 20 bp, Artificial Sequence
  chemically synthesized
aagaaaaaaagtgagcccaa

SEQ ID NO: 10931 - DNA, 20 bp, Artificial Sequence
  chemically synthesized
agaaaaaaagtgagcccaaa

SEQ ID NO: 10932 - DNA, 20 bp, Artificial Sequence
  chemically synthesized
gtgagcccaaaaggaacttg

SEQ ID NO: 10933 - DNA, 20 bp, Artificial Sequence
  chemically synthesized
gagcccaaaaggaacttgca

SEQ ID NO: 10934 - DNA, 20 bp, Artificial Sequence
  chemically synthesized
ccaaaaggaacttgcagagc

SEQ ID NO: 10935 - DNA, 20 bp, Artificial Sequence
  chemically synthesized
caaaaggaacttgcagagca

SEQ ID NO: 10936 - DNA, 20 bp, Artificial Sequence
  chemically synthesized
aaaaggaacttgcagagcaa

SEQ ID NO: 10937 - DNA, 20 bp, Artificial Sequence
  chemically synthesized
gaacttgcagagcaagggaa

SEQ ID NO: 10938 - DNA, 20 bp, Artificial Sequence
  chemically synthesized
cttgcagagcaagggaaaag

SEQ ID NO: 10939 - DNA, 20 bp, Artificial Sequence
  chemically synthesized
ttgcagagcaagggaaaagc

SEQ ID NO: 10940 - DNA, 20 bp, Artificial Sequence
  chemically synthesized
tgcagagcaagggaaaagca

SEQ ID NO: 10941 - DNA, 20 bp, Artificial Sequence
  chemically synthesized
aagggaaaagcagggatgtc

SEQ ID NO: 10942 - DNA, 20 bp, Artificial Sequence
  chemically synthesized
agggaaaagcagggatgtca

SEQ ID NO: 10943 - DNA, 20 bp, Artificial Sequence
  chemically synthesized
gggaaaagcagggatgtcaa

SEQ ID NO: 10944 - DNA, 20 bp, Artificial Sequence
  chemically synthesized
aagcagggatgtcaagggac

SEQ ID NO: 10945 - DNA, 20 bp, Artificial Sequence
  chemically synthesized
agggactagaacactccata

SEQ ID NO: 10946 - DNA, 20 bp, Artificial Sequence
  chemically synthesized
agaacactccataaagtgaa

SEQ ID NO: 10947 - DNA, 20 bp, Artificial Sequence
  chemically synthesized
tgaacagctgcaatgaaaat

SEQ ID NO: 10948 - DNA, 20 bp, Artificial Sequence
  chemically synthesized
gaacagctgcaatgaaaata

SEQ ID NO: 10949 - DNA, 20 bp, Artificial Sequence
  chemically synthesized
aacagctgcaatgaaaataa

SEQ ID NO: 10950 - DNA, 20 bp, Artificial Sequence
  chemically synthesized
agctgcaatgaaaataaggg

SEQ ID NO: 10951 - DNA, 20 bp, Artificial Sequence
  chemically synthesized
gcaatgaaaataagggaaga

SEQ ID NO: 10952 - DNA, 20 bp, Artificial Sequence
  chemically synthesized
gaaaataagggaagaaagtt

SEQ ID NO: 10953 - DNA, 20 bp, Artificial Sequence
  chemically synthesized
ctttcctttctcttcctttt

SEQ ID NO: 10954 - DNA, 20 bp, Artificial Sequence
  chemically synthesized
ttcctttctcttcctttttg

SEQ ID NO: 10955 - DNA, 20 bp, Artificial Sequence
  chemically synthesized
tcttcctttttggagttaat

SEQ ID NO: 10956 - DNA, 20 bp, Artificial Sequence
  chemically synthesized
cttcctttttggagttaatc

SEQ ID NO: 10957 - DNA, 20 bp, Artificial Sequence
  chemically synthesized
cctttttggagttaatcagg

SEQ ID NO: 10958 - DNA, 20 bp, Artificial Sequence
  chemically synthesized
ttttggagttaatcaggaag

SEQ ID NO: 10959 - DNA, 20 bp, Artificial Sequence
  chemically synthesized
ggaagtagtcccaaataccc

SEQ ID NO: 10960 - DNA, 20 bp, Artificial Sequence
  chemically synthesized
gtagtcccaaataccccaga

SEQ ID NO: 10961 - DNA, 20 bp, Artificial Sequence
  chemically synthesized
ccccagaaagttcatcttat

SEQ ID NO: 10962 - DNA, 20 bp, Artificial Sequence
  chemically synthesized
aagttcatcttataagccct

SEQ ID NO: 10963 - DNA, 20 bp, Artificial Sequence
  chemically synthesized
tataagcccttggtcctctt

SEQ ID NO: 10964 - DNA, 20 bp, Artificial Sequence
  chemically synthesized
agcccttggtcctcttgaga

SEQ ID NO: 10965 - DNA, 20 bp, Artificial Sequence
  chemically synthesized
tggtcctcttgagatggtat

SEQ ID NO: 10966 - DNA, 20 bp, Artificial Sequence
  chemically synthesized
gatggtatcagatatattgc

SEQ ID NO: 10967 - DNA, 20 bp, Artificial Sequence
  chemically synthesized
gatatattgctagacccttg

SEQ ID NO: 10968 - DNA, 20 bp, Artificial Sequence
  chemically synthesized
tattgctagacccttgaaga

SEQ ID NO: 10969 - DNA, 20 bp, Artificial Sequence
  chemically synthesized
attgctagacccttgaagaa

SEQ ID NO: 10970 - DNA, 20 bp, Artificial Sequence
  chemically synthesized
cttgaagaaaggaacaactc

SEQ ID NO: 10971 - DNA, 20 bp, Artificial Sequence
  chemically synthesized
ttgaagaaaggaacaactcc

SEQ ID NO: 10972 - DNA, 20 bp, Artificial Sequence
  chemically synthesized
acaactccaggcaacttctt

SEQ ID NO: 10973 - DNA, 20 bp, Artificial Sequence
  chemically synthesized
caaacacatgtgtgtgtata

SEQ ID NO: 10974 - DNA, 20 bp, Artificial Sequence
  chemically synthesized
agccatgcattccttaacaa

SEQ ID NO: 10975 - DNA, 20 bp, Artificial Sequence
  chemically synthesized
gccatgcattccttaacaat

SEQ ID NO: 10976 - DNA, 20 bp, Artificial Sequence
  chemically synthesized
ccatgcattccttaacaatg

SEQ ID NO: 10977 - DNA, 20 bp, Artificial Sequence
  chemically synthesized
taacaatggggatatattct

SEQ ID NO: 10978 - DNA, 20 bp, Artificial Sequence
  chemically synthesized
attctgagaaatgtgtcatt

SEQ ID NO: 10979 - DNA, 20 bp, Artificial Sequence
  chemically synthesized
tcatcattgtgcgaacataa

SEQ ID NO: 10980 - DNA, 20 bp, Artificial Sequence
  chemically synthesized
atcattgtgcgaacataata

SEQ ID NO: 10981 - DNA, 20 bp, Artificial Sequence
  chemically synthesized
tgtacttacctaaacctaaa

SEQ ID NO: 10982 - DNA, 20 bp, Artificial Sequence
  chemically synthesized
ttacctaaacctaaatggta

SEQ ID NO: 10983 - DNA, 20 bp, Artificial Sequence
  chemically synthesized
ggtatagcttactacatacc

SEQ ID NO: 10984 - DNA, 20 bp, Artificial Sequence
  chemically synthesized
gtatagcttactacatacct

SEQ ID NO: 10985 - DNA, 20 bp, Artificial Sequence
  chemically synthesized
atacctaggttgtattgatg

SEQ ID NO: 10986 - DNA, 20 bp, Artificial Sequence
  chemically synthesized
ttgatgtggcctattgctcc

SEQ ID NO: 10987 - DNA, 20 bp, Artificial Sequence
  chemically synthesized
tgatgtggcctattgctcct

SEQ ID NO: 10988 - DNA, 20 bp, Artificial Sequence
  chemically synthesized
gcctattgctcctaggctcc

SEQ ID NO: 10989 - DNA, 20 bp, Artificial Sequence
  chemically synthesized
cctattgctcctaggctcct

SEQ ID NO: 10990 - DNA, 20 bp, Artificial Sequence
  chemically synthesized
tcctgggctgcaaacctgta

SEQ ID NO: 10991 - DNA, 20 bp, Artificial Sequence
  chemically synthesized
tgtgactgtactgaacactg

SEQ ID NO: 10992 - DNA, 20 bp, Artificial Sequence
  chemically synthesized
gtgactgtactgaacactgt

SEQ ID NO: 10993 - DNA, 20 bp, Artificial Sequence
  chemically synthesized
gtactgaacactgtaggcaa

SEQ ID NO: 10994 - DNA, 20 bp, Artificial Sequence
  chemically synthesized
aacactgtaggcaatggtaa

SEQ ID NO: 10995 - DNA, 20 bp, Artificial Sequence
  chemically synthesized
actgtaggcaatggtaacag

SEQ ID NO: 10996 - DNA, 20 bp, Artificial Sequence
  chemically synthesized
ggtatttgtgtatctaaaca

SEQ ID NO: 10997 - DNA, 20 bp, Artificial Sequence
  chemically synthesized
ttgtgtatctaaacatagaa

SEQ ID NO: 10998 - DNA, 20 bp, Artificial Sequence
  chemically synthesized
tgtgtatctaaacatagaaa

SEQ ID NO: 10999 - DNA, 20 bp, Artificial Sequence
  chemically synthesized
atctaaacatagaaaaggta

SEQ ID NO: 11000 - DNA, 20 bp, Artificial Sequence
  chemically synthesized
gaaaaggtacagtgaaaata

SEQ ID NO: 11001 - DNA, 20 bp, Artificial Sequence
  chemically synthesized
aatacagtattataacctta

SEQ ID NO: 11002 - DNA, 20 bp, Artificial Sequence
  chemically synthesized
atacagtattataaccttat

SEQ ID NO: 11003 - DNA, 20 bp, Artificial Sequence
  chemically synthesized
gggaccactgtcgtataatg

SEQ ID NO: 11004 - DNA, 20 bp, Artificial Sequence
  chemically synthesized
ttgaccaaaatgtcattgtg

SEQ ID NO: 11005 - DNA, 20 bp, Artificial Sequence
  chemically synthesized
tatatgtacacacacacaca

SEQ ID NO: 11006 - DNA, 20 bp, Artificial Sequence
  chemically synthesized
tatgtacacacacacacata

SEQ ID NO: 11007 - DNA, 20 bp, Artificial Sequence
  chemically synthesized
tgtacacacacacacataga

SEQ ID NO: 11008 - DNA, 20 bp, Artificial Sequence
  chemically synthesized
tacacacacacacatagaga

SEQ ID NO: 11009 - DNA, 20 bp, Artificial Sequence
  chemically synthesized
cacacacacacatagagaga

SEQ ID NO: 11010 - DNA, 20 bp, Artificial Sequence
  chemically synthesized
cacacacacatagagagaga

SEQ ID NO: 11011 - DNA, 20 bp, Artificial Sequence
  chemically synthesized
cacacacatagagagagaga

SEQ ID NO: 11012 - DNA, 20 bp, Artificial Sequence
  chemically synthesized
cacacatagagagagagaga

SEQ ID NO: 11013 - DNA, 20 bp, Artificial Sequence
  chemically synthesized
acacatagagagagagagag

SEQ ID NO: 11014 - DNA, 20 bp, Artificial Sequence
  chemically synthesized
acatagagagagagagagag

SEQ ID NO: 11015 - DNA, 20 bp, Artificial Sequence
  chemically synthesized
atagagagagagagagagga

SEQ ID NO: 11016 - DNA, 20 bp, Artificial Sequence
  chemically synthesized
tagagagagagagagaggag

SEQ ID NO: 11017 - DNA, 20 bp, Artificial Sequence
  chemically synthesized
gagagagagagagaggagag

SEQ ID NO: 11018 - DNA, 20 bp, Artificial Sequence
  chemically synthesized
gagagagagagaggagagga

SEQ ID NO: 11019 - DNA, 20 bp, Artificial Sequence
  chemically synthesized
agagagagagaggagaggag

SEQ ID NO: 11020 - DNA, 20 bp, Artificial Sequence
  chemically synthesized
gagagagaggagaggagagg

SEQ ID NO: 11021 - DNA, 20 bp, Artificial Sequence
  chemically synthesized
agagagaggagaggagagga

SEQ ID NO: 11022 - DNA, 20 bp, Artificial Sequence
  chemically synthesized
agagaggagaggagaggaag

SEQ ID NO: 11023 - DNA, 20 bp, Artificial Sequence
  chemically synthesized
gagaggagaggagaggaagg

SEQ ID NO: 11024 - DNA, 20 bp, Artificial Sequence
  chemically synthesized
agaggagaggagaggaagga

SEQ ID NO: 11025 - DNA, 20 bp, Artificial Sequence
  chemically synthesized
aggagaggagaggaaggagg

SEQ ID NO: 11026 - DNA, 20 bp, Artificial Sequence
  chemically synthesized
ggagaggagaggaaggaggg

SEQ ID NO: 11027 - DNA, 20 bp, Artificial Sequence
  chemically synthesized
gagaggagaggaaggaggga

SEQ ID NO: 11028 - DNA, 20 bp, Artificial Sequence
  chemically synthesized
aggagaggaaggagggaggg

SEQ ID NO: 11029 - DNA, 20 bp, Artificial Sequence
  chemically synthesized
ggagaggaaggagggaggga

SEQ ID NO: 11030 - DNA, 20 bp, Artificial Sequence
  chemically synthesized
agaggaaggagggagggaag

SEQ ID NO: 11031 - DNA, 20 bp, Artificial Sequence
  chemically synthesized
agggaaggagaaatatgatt

SEQ ID NO: 11032 - DNA, 20 bp, Artificial Sequence
  chemically synthesized
aaggagaaatatgattcaga

SEQ ID NO: 11033 - DNA, 20 bp, Artificial Sequence
  chemically synthesized
ggagaaatatgattcagata

SEQ ID NO: 11034 - DNA, 20 bp, Artificial Sequence
  chemically synthesized
agatagagacatctatcctc

SEQ ID NO: 11035 - DNA, 20 bp, Artificial Sequence
  chemically synthesized
atagagacatctatcctcca

SEQ ID NO: 11036 - DNA, 20 bp, Artificial Sequence
  chemically synthesized
gacatctatcctccagagtt

SEQ ID NO: 11037 - DNA, 20 bp, Artificial Sequence
  chemically synthesized
acatctatcctccagagttc

SEQ ID NO: 11038 - DNA, 20 bp, Artificial Sequence
  chemically synthesized
atctatcctccagagttcag

SEQ ID NO: 11039 - DNA, 20 bp, Artificial Sequence
  chemically synthesized
agagttcaggagtgtctctt

SEQ ID NO: 11040 - DNA, 20 bp, Artificial Sequence
  chemically synthesized
tcaggagtgtctcttcagac

SEQ ID NO: 11041 - DNA, 20 bp, Artificial Sequence
  chemically synthesized
caggagtgtctcttcagact

SEQ ID NO: 11042 - DNA, 20 bp, Artificial Sequence
  chemically synthesized
gagtgtctcttcagactagg

SEQ ID NO: 11043 - DNA, 20 bp, Artificial Sequence
  chemically synthesized
ctcttcagactaggtagatg

SEQ ID NO: 11044 - DNA, 20 bp, Artificial Sequence
  chemically synthesized
aaaaaacatatcctgaattc

SEQ ID NO: 11045 - DNA, 20 bp, Artificial Sequence
  chemically synthesized
aaaacatatcctgaattcta

SEQ ID NO: 11046 - DNA, 20 bp, Artificial Sequence
  chemically synthesized
aacatatcctgaattctaga

SEQ ID NO: 11047 - DNA, 20 bp, Artificial Sequence
  chemically synthesized
cctataacacttgccaacca

SEQ ID NO: 11048 - DNA, 20 bp, Artificial Sequence
  chemically synthesized
ctataacacttgccaaccaa

SEQ ID NO: 11049 - DNA, 20 bp, Artificial Sequence
  chemically synthesized
attgcttttttaaattaatg

SEQ ID NO: 11050 - DNA, 20 bp, Artificial Sequence
  chemically synthesized
agtgatttttctttaacatc

SEQ ID NO: 11051 - DNA, 20 bp, Artificial Sequence
  chemically synthesized
ttttctttaacatctagtga

SEQ ID NO: 11052 - DNA, 20 bp, Artificial Sequence
  chemically synthesized
taacatctagtgacagacac

SEQ ID NO: 11053 - DNA, 20 bp, Artificial Sequence
  chemically synthesized
aacatctagtgacagacact

SEQ ID NO: 11054 - DNA, 20 bp, Artificial Sequence
  chemically synthesized
acatctagtgacagacactg

SEQ ID NO: 11055 - DNA, 20 bp, Artificial Sequence
  chemically synthesized
agacactggggtcacatttg

SEQ ID NO: 11056 - DNA, 20 bp, Artificial Sequence
  chemically synthesized
actggggtcacatttgcagc

SEQ ID NO: 11057 - DNA, 20 bp, Artificial Sequence
  chemically synthesized
atttgcagctggaccataat

SEQ ID NO: 11058 - DNA, 20 bp, Artificial Sequence
  chemically synthesized
tttgcagctggaccataatt

SEQ ID NO: 11059 - DNA, 20 bp, Artificial Sequence
  chemically synthesized
ataattaggcttctgttctt

SEQ ID NO: 11060 - DNA, 20 bp, Artificial Sequence
  chemically synthesized
taattaggcttctgttcttc

SEQ ID NO: 11061 - DNA, 20 bp, Artificial Sequence
  chemically synthesized
attaggcttctgttcttcag

SEQ ID NO: 11062 - DNA, 20 bp, Artificial Sequence
  chemically synthesized
cttcaggagacatttgttca

SEQ ID NO: 11063 - DNA, 20 bp, Artificial Sequence
  chemically synthesized
gacatttgttcaaagtcatt

SEQ ID NO: 11064 - DNA, 20 bp, Artificial Sequence
  chemically synthesized
acatttgttcaaagtcattt

SEQ ID NO: 11065 - DNA, 20 bp, Artificial Sequence
  chemically synthesized
gggcaaccatattctgaaaa

SEQ ID NO: 11066 - DNA, 20 bp, Artificial Sequence
  chemically synthesized
accatattctgaaaacagcc

SEQ ID NO: 11067 - DNA, 20 bp, Artificial Sequence
  chemically synthesized
tattctgaaaacagcccagc

SEQ ID NO: 11068 - DNA, 20 bp, Artificial Sequence
  chemically synthesized
attctgaaaacagcccagcc

SEQ ID NO: 11069 - DNA, 20 bp, Artificial Sequence
  chemically synthesized
ttctgaaaacagcccagcca

SEQ ID NO: 11070 - DNA, 20 bp, Artificial Sequence
  chemically synthesized
aaacagcccagccagggtga

SEQ ID NO: 11071 - DNA, 20 bp, Artificial Sequence
  chemically synthesized
gggtgatggatcactttgca

SEQ ID NO: 11072 - DNA, 20 bp, Artificial Sequence
  chemically synthesized
actttgcaaagatcctcaat

SEQ ID NO: 11073 - DNA, 20 bp, Artificial Sequence
  chemically synthesized
atcctcaatgagctattttc

SEQ ID NO: 11074 - DNA, 20 bp, Artificial Sequence
  chemically synthesized
gctattttcaagtgatgaca

SEQ ID NO: 11075 - DNA, 20 bp, Artificial Sequence
  chemically synthesized
tcaagtgatgacaaagtgtg

SEQ ID NO: 11076 - DNA, 20 bp, Artificial Sequence
  chemically synthesized
gtgaagttaaccgctcattt

SEQ ID NO: 11077 - DNA, 20 bp, Artificial Sequence
  chemically synthesized
agaactttctttttcatcca

SEQ ID NO: 11078 - DNA, 20 bp, Artificial Sequence
  chemically synthesized
aaagtaaattcaaatatgat

SEQ ID NO: 11079 - DNA, 20 bp, Artificial Sequence
  chemically synthesized
gaaatctgaccttttattac

SEQ ID NO: 11080 - DNA, 20 bp, Artificial Sequence
  chemically synthesized
actggaattctcttgactaa

SEQ ID NO: 11081 - DNA, 20 bp, Artificial Sequence
  chemically synthesized
cctaaatctccatgtgtata

SEQ ID NO: 11082 - DNA, 20 bp, Artificial Sequence
  chemically synthesized
tccatgtgtatacagtactg

SEQ ID NO: 11083 - DNA, 20 bp, Artificial Sequence
  chemically synthesized
ccatgtgtatacagtactgt

SEQ ID NO: 11084 - DNA, 20 bp, Artificial Sequence
  chemically synthesized
acagtactgtgggaacatca

SEQ ID NO: 11085 - DNA, 20 bp, Artificial Sequence
  chemically synthesized
tgtgggaacatcacagattt

SEQ ID NO: 11086 - DNA, 20 bp, Artificial Sequence
  chemically synthesized
gattttggctccatgcccta

SEQ ID NO: 11087 - DNA, 20 bp, Artificial Sequence
  chemically synthesized
ttttggctccatgccctaaa

SEQ ID NO: 11088 - DNA, 20 bp, Artificial Sequence
  chemically synthesized
tccatgccctaaagagaaat

SEQ ID NO: 11089 - DNA, 20 bp, Artificial Sequence
  chemically synthesized
cctaaagagaaattggcttt

SEQ ID NO: 11090 - DNA, 20 bp, Artificial Sequence
  chemically synthesized
aaattggctttcagattatt

SEQ ID NO: 11091 - DNA, 20 bp, Artificial Sequence
  chemically synthesized
gattatttggattaaaaaca

SEQ ID NO: 11092 - DNA, 20 bp, Artificial Sequence
  chemically synthesized
ttaaaaacaaagactttctt

SEQ ID NO: 11093 - DNA, 20 bp, Artificial Sequence
  chemically synthesized
aaaaacaaagactttcttaa

SEQ ID NO: 11094 - DNA, 20 bp, Artificial Sequence
  chemically synthesized
tttcttttttgctaaaacta

SEQ ID NO: 11095 - DNA, 20 bp, Artificial Sequence
  chemically synthesized
agaattattcttttacattt

SEQ ID NO: 11096 - DNA, 20 bp, Artificial Sequence
  chemically synthesized
acgccaacaaaattctgaat

SEQ ID NO: 11097 - DNA, 20 bp, Artificial Sequence
  chemically synthesized
acaaaattctgaatcggcca

SEQ ID NO: 11098 - DNA, 20 bp, Artificial Sequence
  chemically synthesized
aaaattctgaatcggccaaa

SEQ ID NO: 11099 - DNA, 20 bp, Artificial Sequence
  chemically synthesized
aaattctgaatcggccaaag

SEQ ID NO: 11100 - DNA, 20 bp, Artificial Sequence
  chemically synthesized
tcggccaaagaggtataatt

SEQ ID NO: 11101 - DNA, 20 bp, Artificial Sequence
  chemically synthesized
cggccaaagaggtataattc

SEQ ID NO: 11102 - DNA, 20 bp, Artificial Sequence
  chemically synthesized
gaggtataattcaggtaaat

SEQ ID NO: 11103 - DNA, 20 bp, Artificial Sequence
  chemically synthesized
gtataattcaggtaaattgg

SEQ ID NO: 11104 - DNA, 20 bp, Artificial Sequence
  chemically synthesized
ataattcaggtaaattggaa

SEQ ID NO: 11105 - DNA, 20 bp, Artificial Sequence
  chemically synthesized
taaattggaagagtttgttc

SEQ ID NO: 11106 - DNA, 20 bp, Artificial Sequence
  chemically synthesized
aaattggaagagtttgttca

SEQ ID NO: 11107 - DNA, 20 bp, Artificial Sequence
  chemically synthesized
aattggaagagtttgttcaa

SEQ ID NO: 11108 - DNA, 20 bp, Artificial Sequence
  chemically synthesized
agtttgttcaagggaacctt

SEQ ID NO: 11109 - DNA, 20 bp, Artificial Sequence
  chemically synthesized
tttgttcaagggaaccttga

SEQ ID NO: 11110 - DNA, 20 bp, Artificial Sequence
  chemically synthesized
tgttcaagggaaccttgaga

SEQ ID NO: 11111 - DNA, 20 bp, Artificial Sequence
  chemically synthesized
gaaccttgagagagaatgta

SEQ ID NO: 11112 - DNA, 20 bp, Artificial Sequence
  chemically synthesized
ccttgagagagaatgtatgg

SEQ ID NO: 11113 - DNA, 20 bp, Artificial Sequence
  chemically synthesized
agagagaatgtatggaagaa

SEQ ID NO: 11114 - DNA, 20 bp, Artificial Sequence
  chemically synthesized
gaatgtatggaagaaaagtg

SEQ ID NO: 11115 - DNA, 20 bp, Artificial Sequence
  chemically synthesized
ggaagaaaagtgtagttttg

SEQ ID NO: 11116 - DNA, 20 bp, Artificial Sequence
  chemically synthesized
agaaaagtgtagttttgaag

SEQ ID NO: 11117 - DNA, 20 bp, Artificial Sequence
  chemically synthesized
gtgtagttttgaagaagcac

SEQ ID NO: 11118 - DNA, 20 bp, Artificial Sequence
  chemically synthesized
tagttttgaagaagcacgag

SEQ ID NO: 11119 - DNA, 20 bp, Artificial Sequence
  chemically synthesized
gaagtttttgaaaacactga

SEQ ID NO: 11120 - DNA, 20 bp, Artificial Sequence
  chemically synthesized
tcttccatacattctctctc

SEQ ID NO: 11121 - DNA, 20 bp, Artificial Sequence
  chemically synthesized
cttccatacattctctctca

SEQ ID NO: 11122 - DNA, 20 bp, Artificial Sequence
  chemically synthesized
ttacctgaattatacctctt

SEQ ID NO: 11123 - DNA, 20 bp, Artificial Sequence
  chemically synthesized
ttatacctctttggccgatt

SEQ ID NO: 11124 - DNA, 20 bp, Artificial Sequence
  chemically synthesized
tggccgattcagaattttgt

SEQ ID NO: 11125 - DNA, 20 bp, Artificial Sequence
  chemically synthesized
ttgttggcgttttcatgatc

SEQ ID NO: 11126 - DNA, 20 bp, Artificial Sequence
  chemically synthesized
caagaaaaactgaaatgtaa

SEQ ID NO: 11127 - DNA, 20 bp, Artificial Sequence
  chemically synthesized
aatgtaaaagaataattctt

SEQ ID NO: 11128 - DNA, 20 bp, Artificial Sequence
  chemically synthesized
aaagaataattctttagttt

SEQ ID NO: 11129 - DNA, 20 bp, Artificial Sequence
  chemically synthesized
attctttagttttagcaaaa

SEQ ID NO: 11130 - DNA, 20 bp, Artificial Sequence
  chemically synthesized
atgaaaattttacatctctt

SEQ ID NO: 11131 - DNA, 20 bp, Artificial Sequence
  chemically synthesized
aaattttacatctcttaaga

SEQ ID NO: 11132 - DNA, 20 bp, Artificial Sequence
  chemically synthesized
ttttaatccaaataatctga

SEQ ID NO: 11133 - DNA, 20 bp, Artificial Sequence
  chemically synthesized
tctgaaagccaatttctctt

SEQ ID NO: 11134 - DNA, 20 bp, Artificial Sequence
  chemically synthesized
ctgaaagccaatttctcttt

SEQ ID NO: 11135 - DNA, 20 bp, Artificial Sequence
  chemically synthesized
tgaaagccaatttctcttta

SEQ ID NO: 11136 - DNA, 20 bp, Artificial Sequence
  chemically synthesized
gccaatttctctttagggca

SEQ ID NO: 11137 - DNA, 20 bp, Artificial Sequence
  chemically synthesized
caatttctctttagggcatg

SEQ ID NO: 11138 - DNA, 20 bp, Artificial Sequence
  chemically synthesized
caaaatctgtgatgttccca

SEQ ID NO: 11139 - DNA, 20 bp, Artificial Sequence
  chemically synthesized
cccacagtactgtatacaca

SEQ ID NO: 11140 - DNA, 20 bp, Artificial Sequence
  chemically synthesized
cacagtactgtatacacatg

SEQ ID NO: 11141 - DNA, 20 bp, Artificial Sequence
  chemically synthesized
actgtatacacatggagatt

SEQ ID NO: 11142 - DNA, 20 bp, Artificial Sequence
  chemically synthesized
ctgtatacacatggagattt

SEQ ID NO: 11143 - DNA, 20 bp, Artificial Sequence
  chemically synthesized
ttaaaattcaattttacttt

SEQ ID NO: 11144 - DNA, 20 bp, Artificial Sequence
  chemically synthesized
attcaattttacttttagtc

SEQ ID NO: 11145 - DNA, 20 bp, Artificial Sequence
  chemically synthesized
tcaattttacttttagtcaa

SEQ ID NO: 11146 - DNA, 20 bp, Artificial Sequence
  chemically synthesized
acttttagtcaagagaattc

SEQ ID NO: 11147 - DNA, 20 bp, Artificial Sequence
  chemically synthesized
caagagaattccagtaataa

SEQ ID NO: 11148 - DNA, 20 bp, Artificial Sequence
  chemically synthesized
aagagaattccagtaataaa

SEQ ID NO: 11149 - DNA, 20 bp, Artificial Sequence
  chemically synthesized
gaattccagtaataaaaggt

SEQ ID NO: 11150 - DNA, 20 bp, Artificial Sequence
  chemically synthesized
aatcatatttgaatttactt

SEQ ID NO: 11151 - DNA, 20 bp, Artificial Sequence
  chemically synthesized
tgaatttactttggatgaaa

SEQ ID NO: 11152 - DNA, 20 bp, Artificial Sequence
  chemically synthesized
tttactttggatgaaaaaga

SEQ ID NO: 11153 - DNA, 20 bp, Artificial Sequence
  chemically synthesized
gaaaaagaaagttctcaaat

SEQ ID NO: 11154 - DNA, 20 bp, Artificial Sequence
  chemically synthesized
aaagaaagttctcaaatgag

SEQ ID NO: 11155 - DNA, 20 bp, Artificial Sequence
  chemically synthesized
actttgtcatcacttgaaaa

SEQ ID NO: 11156 - DNA, 20 bp, Artificial Sequence
  chemically synthesized
tcacttgaaaatagctcatt

SEQ ID NO: 11157 - DNA, 20 bp, Artificial Sequence
  chemically synthesized
cacttgaaaatagctcattg

SEQ ID NO: 11158 - DNA, 20 bp, Artificial Sequence
  chemically synthesized
gctcattgaggatctttgca

SEQ ID NO: 11159 - DNA, 20 bp, Artificial Sequence
  chemically synthesized
tgcaaagtgatccatcaccc

SEQ ID NO: 11160 - DNA, 20 bp, Artificial Sequence
  chemically synthesized
aagtgatccatcaccctggc

SEQ ID NO: 11161 - DNA, 20 bp, Artificial Sequence
  chemically synthesized
agtgatccatcaccctggct

SEQ ID NO: 11162 - DNA, 20 bp, Artificial Sequence
  chemically synthesized
caccctggctgggctgtttt

SEQ ID NO: 11163 - DNA, 20 bp, Artificial Sequence
  chemically synthesized
gctgggctgttttcagaata

SEQ ID NO: 11164 - DNA, 20 bp, Artificial Sequence
  chemically synthesized
ctttgaacaaatgtctcctg

SEQ ID NO: 11165 - DNA, 20 bp, Artificial Sequence
  chemically synthesized
aacaaatgtctcctgaagaa

SEQ ID NO: 11166 - DNA, 20 bp, Artificial Sequence
  chemically synthesized
aaatgtctcctgaagaacag

SEQ ID NO: 11167 - DNA, 20 bp, Artificial Sequence
  chemically synthesized
gaagaacagaagcctaatta

SEQ ID NO: 11168 - DNA, 20 bp, Artificial Sequence
  chemically synthesized
acagaagcctaattatggtc

SEQ ID NO: 11169 - DNA, 20 bp, Artificial Sequence
  chemically synthesized
tccagctgcaaatgtgaccc

SEQ ID NO: 11170 - DNA, 20 bp, Artificial Sequence
  chemically synthesized
gtgaccccagtgtctgtcac

SEQ ID NO: 11171 - DNA, 20 bp, Artificial Sequence
  chemically synthesized
gtgtctgtcactagatgtta

SEQ ID NO: 11172 - DNA, 20 bp, Artificial Sequence
  chemically synthesized
atcactgcattaatttaaaa

SEQ ID NO: 11173 - DNA, 20 bp, Artificial Sequence
  chemically synthesized
ttaatttaaaaaagcaattt

SEQ ID NO: 11174 - DNA, 20 bp, Artificial Sequence
  chemically synthesized
aaaaagcaatttcagatcaa

SEQ ID NO: 11175 - DNA, 20 bp, Artificial Sequence
  chemically synthesized
tttcagatcaacagcacctt

SEQ ID NO: 11176 - DNA, 20 bp, Artificial Sequence
  chemically synthesized
agatcaacagcacctttggt

SEQ ID NO: 11177 - DNA, 20 bp, Artificial Sequence
  chemically synthesized
caacagcacctttggttggc

SEQ ID NO: 11178 - DNA, 20 bp, Artificial Sequence
  chemically synthesized
cctttggttggcaagtgtta

SEQ ID NO: 11179 - DNA, 20 bp, Artificial Sequence
  chemically synthesized
ctttggttggcaagtgttat

SEQ ID NO: 11180 - DNA, 20 bp, Artificial Sequence
  chemically synthesized
ggcaagtgttataggaattg

SEQ ID NO: 11181 - DNA, 20 bp, Artificial Sequence
  chemically synthesized
tataggaattgcagtgattt

SEQ ID NO: 11182 - DNA, 20 bp, Artificial Sequence
  chemically synthesized
cagtgatttaagcatctctc

SEQ ID NO: 11183 - DNA, 20 bp, Artificial Sequence
  chemically synthesized
ttaagcatctctctagaatt

SEQ ID NO: 11184 - DNA, 20 bp, Artificial Sequence
  chemically synthesized
taagcatctctctagaattc

SEQ ID NO: 11185 - DNA, 20 bp, Artificial Sequence
  chemically synthesized
attcaggatatgtttttttt

SEQ ID NO: 11186 - DNA, 20 bp, Artificial Sequence
  chemically synthesized
ttttttaagctacatctacc

SEQ ID NO: 11187 - DNA, 20 bp, Artificial Sequence
  chemically synthesized
agctacatctacctagtctg

SEQ ID NO: 11188 - DNA, 20 bp, Artificial Sequence
  chemically synthesized
ctacatctacctagtctgaa

SEQ ID NO: 11189 - DNA, 20 bp, Artificial Sequence
  chemically synthesized
gaagagacactcctgaactc

SEQ ID NO: 11190 - DNA, 20 bp, Artificial Sequence
  chemically synthesized
agagacactcctgaactctg

SEQ ID NO: 11191 - DNA, 20 bp, Artificial Sequence
  chemically synthesized
gagacactcctgaactctgg

SEQ ID NO: 11192 - DNA, 20 bp, Artificial Sequence
  chemically synthesized
cactcctgaactctggagga

SEQ ID NO: 11193 - DNA, 20 bp, Artificial Sequence
  chemically synthesized
tatcatatatatatatatat

SEQ ID NO: 11194 - DNA, 20 bp, Artificial Sequence
  chemically synthesized
tttgctgcacaatgacattt

SEQ ID NO: 11195 - DNA, 20 bp, Artificial Sequence
  chemically synthesized
aatgacattttggtcaatga

SEQ ID NO: 11196 - DNA, 20 bp, Artificial Sequence
  chemically synthesized
tgatggaccacattatacga

SEQ ID NO: 11197 - DNA, 20 bp, Artificial Sequence
  chemically synthesized
tggaccacattatacgacag

SEQ ID NO: 11198 - DNA, 20 bp, Artificial Sequence
  chemically synthesized
ttatacgacagtggtcccat

SEQ ID NO: 11199 - DNA, 20 bp, Artificial Sequence
  chemically synthesized
tatacgacagtggtcccata

SEQ ID NO: 11200 - DNA, 20 bp, Artificial Sequence
  chemically synthesized
cactgtaccttttctatgtt

SEQ ID NO: 11201 - DNA, 20 bp, Artificial Sequence
  chemically synthesized
accactgttaccattgccta

SEQ ID NO: 11202 - DNA, 20 bp, Artificial Sequence
  chemically synthesized
ttaccattgcctacagtgtt

SEQ ID NO: 11203 - DNA, 20 bp, Artificial Sequence
  chemically synthesized
attgcctacagtgttcagta

SEQ ID NO: 11204 - DNA, 20 bp, Artificial Sequence
  chemically synthesized
cagtacagtcacatgctgta

SEQ ID NO: 11205 - DNA, 20 bp, Artificial Sequence
  chemically synthesized
agtacagtcacatgctgtac

SEQ ID NO: 11206 - DNA, 20 bp, Artificial Sequence
  chemically synthesized
tcacatgctgtacaggtttg

SEQ ID NO: 11207 - DNA, 20 bp, Artificial Sequence
  chemically synthesized
tgctgtacaggtttgcagcc

SEQ ID NO: 11208 - DNA, 20 bp, Artificial Sequence
  chemically synthesized
gctgtacaggtttgcagccc

SEQ ID NO: 11209 - DNA, 20 bp, Artificial Sequence
  chemically synthesized
tgtacaggtttgcagcccag

SEQ ID NO: 11210 - DNA, 20 bp, Artificial Sequence
  chemically synthesized
aggtttgcagcccaggagcc

SEQ ID NO: 11211 - DNA, 20 bp, Artificial Sequence
  chemically synthesized
ggtttgcagcccaggagcct

SEQ ID NO: 11212 - DNA, 20 bp, Artificial Sequence
  chemically synthesized
tttgcagcccaggagcctag

SEQ ID NO: 11213 - DNA, 20 bp, Artificial Sequence
  chemically synthesized
gcccaggagcctaggagcaa

SEQ ID NO: 11214 - DNA, 20 bp, Artificial Sequence
  chemically synthesized
cccaggagcctaggagcaat

SEQ ID NO: 11215 - DNA, 20 bp, Artificial Sequence
  chemically synthesized
taggccacatcaatacaacc

SEQ ID NO: 11216 - DNA, 20 bp, Artificial Sequence
  chemically synthesized
aggccacatcaatacaacct

SEQ ID NO: 11217 - DNA, 20 bp, Artificial Sequence
  chemically synthesized
atcaatacaacctaggtatg

SEQ ID NO: 11218 - DNA, 20 bp, Artificial Sequence
  chemically synthesized
atacaacctaggtatgtagt

SEQ ID NO: 11219 - DNA, 20 bp, Artificial Sequence
  chemically synthesized
atgtagtaagctataccatt

SEQ ID NO: 11220 - DNA, 20 bp, Artificial Sequence
  chemically synthesized
tgtagtaagctataccattt

SEQ ID NO: 11221 - DNA, 20 bp, Artificial Sequence
  chemically synthesized
taagctataccatttaggtt

SEQ ID NO: 11222 - DNA, 20 bp, Artificial Sequence
  chemically synthesized
aagctataccatttaggttt

SEQ ID NO: 11223 - DNA, 20 bp, Artificial Sequence
  chemically synthesized
tataccatttaggtttaggt

SEQ ID NO: 11224 - DNA, 20 bp, Artificial Sequence
  chemically synthesized
ttgcttaatgacacatttct

SEQ ID NO: 11225 - DNA, 20 bp, Artificial Sequence
  chemically synthesized
cagaatatatccccattgtt

SEQ ID NO: 11226 - DNA, 20 bp, Artificial Sequence
  chemically synthesized
agaatatatccccattgtta

SEQ ID NO: 11227 - DNA, 20 bp, Artificial Sequence
  chemically synthesized
ccccattgttaaggaatgca

SEQ ID NO: 11228 - DNA, 20 bp, Artificial Sequence
  chemically synthesized
tgtatgtataaaattaataa

SEQ ID NO: 11229 - DNA, 20 bp, Artificial Sequence
  chemically synthesized
gtatgtataaaattaataac

SEQ ID NO: 11230 - DNA, 20 bp, Artificial Sequence
  chemically synthesized
tatgtataaaattaataaca

SEQ ID NO: 11231 - DNA, 20 bp, Artificial Sequence
  chemically synthesized
aaaattaataacagggactc

SEQ ID NO: 11232 - DNA, 20 bp, Artificial Sequence
  chemically synthesized
attaataacagggactcaag

SEQ ID NO: 11233 - DNA, 20 bp, Artificial Sequence
  chemically synthesized
cagggactcaagaagttgcc

SEQ ID NO: 11234 - DNA, 20 bp, Artificial Sequence
  chemically synthesized
gggactcaagaagttgcctg

SEQ ID NO: 11235 - DNA, 20 bp, Artificial Sequence
  chemically synthesized
ctggagttgttcctttcttc

SEQ ID NO: 11236 - DNA, 20 bp, Artificial Sequence
  chemically synthesized
tggagttgttcctttcttca

SEQ ID NO: 11237 - DNA, 20 bp, Artificial Sequence
  chemically synthesized
ggagttgttcctttcttcaa

SEQ ID NO: 11238 - DNA, 20 bp, Artificial Sequence
  chemically synthesized
tgttcctttcttcaagggtc

SEQ ID NO: 11239 - DNA, 20 bp, Artificial Sequence
  chemically synthesized
aatatatctgataccatctc

SEQ ID NO: 11240 - DNA, 20 bp, Artificial Sequence
  chemically synthesized
tatatctgataccatctcaa

SEQ ID NO: 11241 - DNA, 20 bp, Artificial Sequence
  chemically synthesized
atatctgataccatctcaag

SEQ ID NO: 11242 - DNA, 20 bp, Artificial Sequence
  chemically synthesized
gataccatctcaagaggacc

SEQ ID NO: 11243 - DNA, 20 bp, Artificial Sequence
  chemically synthesized
ataccatctcaagaggacca

SEQ ID NO: 11244 - DNA, 20 bp, Artificial Sequence
  chemically synthesized
taccatctcaagaggaccaa

SEQ ID NO: 11245 - DNA, 20 bp, Artificial Sequence
  chemically synthesized
caagaggaccaagggcttat

SEQ ID NO: 11246 - DNA, 20 bp, Artificial Sequence
  chemically synthesized
ggcttataagatgaactttc

SEQ ID NO: 11247 - DNA, 20 bp, Artificial Sequence
  chemically synthesized
gcttataagatgaactttct

SEQ ID NO: 11248 - DNA, 20 bp, Artificial Sequence
  chemically synthesized
cttataagatgaactttctg

SEQ ID NO: 11249 - DNA, 20 bp, Artificial Sequence
  chemically synthesized
gatgaactttctggggtatt

SEQ ID NO: 11250 - DNA, 20 bp, Artificial Sequence
  chemically synthesized
atgaactttctggggtattt

SEQ ID NO: 11251 - DNA, 20 bp, Artificial Sequence
  chemically synthesized
acttcctgattaactccaaa

SEQ ID NO: 11252 - DNA, 20 bp, Artificial Sequence
  chemically synthesized
cttcctgattaactccaaaa

SEQ ID NO: 11253 - DNA, 20 bp, Artificial Sequence
  chemically synthesized
cctgattaactccaaaaagg

SEQ ID NO: 11254 - DNA, 20 bp, Artificial Sequence
  chemically synthesized
tgattaactccaaaaaggaa

SEQ ID NO: 11255 - DNA, 20 bp, Artificial Sequence
  chemically synthesized
taactccaaaaaggaagaga

SEQ ID NO: 11256 - DNA, 20 bp, Artificial Sequence
  chemically synthesized
aactccaaaaaggaagagaa

SEQ ID NO: 11257 - DNA, 20 bp, Artificial Sequence
  chemically synthesized
ccaaaaaggaagagaaagga

SEQ ID NO: 11258 - DNA, 20 bp, Artificial Sequence
  chemically synthesized
ggaagagaaaggaaagtaaa

SEQ ID NO: 11259 - DNA, 20 bp, Artificial Sequence
  chemically synthesized
gaagagaaaggaaagtaaaa

SEQ ID NO: 11260 - DNA, 20 bp, Artificial Sequence
  chemically synthesized
agaaaggaaagtaaaaagga

SEQ ID NO: 11261 - DNA, 20 bp, Artificial Sequence
  chemically synthesized
gaaaggaaagtaaaaaggaa

SEQ ID NO: 11262 - DNA, 20 bp, Artificial Sequence
  chemically synthesized
ggaaagtaaaaaggaaagga

SEQ ID NO: 11263 - DNA, 20 bp, Artificial Sequence
  chemically synthesized
taaaaaggaaaggaaagaaa

SEQ ID NO: 11264 - DNA, 20 bp, Artificial Sequence
  chemically synthesized
aaaaggaaaggaaagaaacg

SEQ ID NO: 11265 - DNA, 20 bp, Artificial Sequence
  chemically synthesized
ttcttcccttattttcattg

SEQ ID NO: 11266 - DNA, 20 bp, Artificial Sequence
  chemically synthesized
cattgcagctgttcacttta

SEQ ID NO: 11267 - DNA, 20 bp, Artificial Sequence
  chemically synthesized
ttgcagctgttcactttatg

SEQ ID NO: 11268 - DNA, 20 bp, Artificial Sequence
  chemically synthesized
gttcactttatggagtgttc

SEQ ID NO: 11269 - DNA, 20 bp, Artificial Sequence
  chemically synthesized
ctgcttttcccttgctctgc

SEQ ID NO: 11270 - DNA, 20 bp, Artificial Sequence
  chemically synthesized
cttgctctgcaagttccttt

SEQ ID NO: 11271 - DNA, 20 bp, Artificial Sequence
  chemically synthesized
ttgctctgcaagttcctttt

SEQ ID NO: 11272 - DNA, 20 bp, Artificial Sequence
  chemically synthesized
tcactttttttctttgaatt

SEQ ID NO: 11273 - DNA, 20 bp, Artificial Sequence
  chemically synthesized
ttttttctttgaatttagcc

SEQ ID NO: 11274 - DNA, 20 bp, Artificial Sequence
  chemically synthesized
ttcaactcttttttttttga

SEQ ID NO: 11275 - DNA, 20 bp, Artificial Sequence
  chemically synthesized
caactcttttttttttgaca

SEQ ID NO: 11276 - DNA, 20 bp, Artificial Sequence
  chemically synthesized
cagagtcttgctctgtcgcc

SEQ ID NO: 11277 - DNA, 20 bp, Artificial Sequence
  chemically synthesized
agagtcttgctctgtcgccc

SEQ ID NO: 11278 - DNA, 20 bp, Artificial Sequence
  chemically synthesized
tcttgctctgtcgcccaggc

SEQ ID NO: 11279 - DNA, 20 bp, Artificial Sequence
  chemically synthesized
ttgctctgtcgcccaggctg

SEQ ID NO: 11280 - DNA, 20 bp, Artificial Sequence
  chemically synthesized
ctgtcgcccaggctggagtg

SEQ ID NO: 11281 - DNA, 20 bp, Artificial Sequence
  chemically synthesized
tcgcccaggctggagtgcag

SEQ ID NO: 11282 - DNA, 20 bp, Artificial Sequence
  chemically synthesized
ggagtgcagtggtgcgatct

SEQ ID NO: 11283 - DNA, 20 bp, Artificial Sequence
  chemically synthesized
tcactgcaacctccatctcc

SEQ ID NO: 11284 - DNA, 20 bp, Artificial Sequence
  chemically synthesized
cactgcaacctccatctccc

SEQ ID NO: 11285 - DNA, 20 bp, Artificial Sequence
  chemically synthesized
aacctccatctcccaggttc

SEQ ID NO: 11286 - DNA, 20 bp, Artificial Sequence
  chemically synthesized
ttcaagctattctcctgcct

SEQ ID NO: 11287 - DNA, 20 bp, Artificial Sequence
  chemically synthesized
ttctcctgcctcagcctccc

SEQ ID NO: 11288 - DNA, 20 bp, Artificial Sequence
  chemically synthesized
tcctgcctcagcctcccaag

SEQ ID NO: 11289 - DNA, 20 bp, Artificial Sequence
  chemically synthesized
gcctcagcctcccaagtagc

SEQ ID NO: 11290 - DNA, 20 bp, Artificial Sequence
  chemically synthesized
cctcagcctcccaagtagct

SEQ ID NO: 11291 - DNA, 20 bp, Artificial Sequence
  chemically synthesized
ctcccaagtagctgggatta

SEQ ID NO: 11292 - DNA, 20 bp, Artificial Sequence
  chemically synthesized
tcccaagtagctgggattac

SEQ ID NO: 11293 - DNA, 20 bp, Artificial Sequence
  chemically synthesized
caggcacccgccaccatgcc

SEQ ID NO: 11294 - DNA, 20 bp, Artificial Sequence
  chemically synthesized
ccagctaatttttgtatttt

SEQ ID NO: 11295 - DNA, 20 bp, Artificial Sequence
  chemically synthesized
taatttttgtatttttagta

SEQ ID NO: 11296 - DNA, 20 bp, Artificial Sequence
  chemically synthesized
ttttgtatttttagtaaagc

SEQ ID NO: 11297 - DNA, 20 bp, Artificial Sequence
  chemically synthesized
tttgtatttttagtaaagcc

SEQ ID NO: 11298 - DNA, 20 bp, Artificial Sequence
  chemically synthesized
ttgtatttttagtaaagccg

SEQ ID NO: 11299 - DNA, 20 bp, Artificial Sequence
  chemically synthesized
gtttcaccatttcaccttgt

SEQ ID NO: 11300 - DNA, 20 bp, Artificial Sequence
  chemically synthesized
caccatttcaccttgttggc

SEQ ID NO: 11301 - DNA, 20 bp, Artificial Sequence
  chemically synthesized
accatttcaccttgttggcc

SEQ ID NO: 11302 - DNA, 20 bp, Artificial Sequence
  chemically synthesized
tttcaccttgttggccaggc

SEQ ID NO: 11303 - DNA, 20 bp, Artificial Sequence
  chemically synthesized
ggtgtcgaactcctgacctc

SEQ ID NO: 11304 - DNA, 20 bp, Artificial Sequence
  chemically synthesized
cctcaagtgatctgcctgcc

SEQ ID NO: 11305 - DNA, 20 bp, Artificial Sequence
  chemically synthesized
ctcaagtgatctgcctgcct

SEQ ID NO: 11306 - DNA, 20 bp, Artificial Sequence
  chemically synthesized
ctgcctgcctgggcctctga

SEQ ID NO: 11307 - DNA, 20 bp, Artificial Sequence
  chemically synthesized
gcctgggcctctgaaagtgc

SEQ ID NO: 11308 - DNA, 20 bp, Artificial Sequence
  chemically synthesized
cctgggcctctgaaagtgct

SEQ ID NO: 11309 - DNA, 20 bp, Artificial Sequence
  chemically synthesized
ctctgaaagtgctgggatta

SEQ ID NO: 11310 - DNA, 20 bp, Artificial Sequence
  chemically synthesized
tctgaaagtgctgggattat

SEQ ID NO: 11311 - DNA, 20 bp, Artificial Sequence
  chemically synthesized
agtgctgggattataggtgt

SEQ ID NO: 11312 - DNA, 20 bp, Artificial Sequence
  chemically synthesized
ataggtgtgagccaccatgc

SEQ ID NO: 11313 - DNA, 20 bp, Artificial Sequence
  chemically synthesized
taggtgtgagccaccatgcc

SEQ ID NO: 11314 - DNA, 20 bp, Artificial Sequence
  chemically synthesized
gcctctcttcaactcttcat

SEQ ID NO: 11315 - DNA, 20 bp, Artificial Sequence
  chemically synthesized
ctgtgcccaccctgcaatcc

SEQ ID NO: 11316 - DNA, 20 bp, Artificial Sequence
  chemically synthesized
tgcaatcctagcccctaaat

SEQ ID NO: 11317 - DNA, 20 bp, Artificial Sequence
  chemically synthesized
caatcctagcccctaaattg

SEQ ID NO: 11318 - DNA, 20 bp, Artificial Sequence
  chemically synthesized
tcctagcccctaaattggag

SEQ ID NO: 11319 - DNA, 20 bp, Artificial Sequence
  chemically synthesized
tgccttcatccttctcttcc

SEQ ID NO: 11320 - DNA, 20 bp, Artificial Sequence
  chemically synthesized
ttcatccttctcttcccaga

SEQ ID NO: 11321 - DNA, 20 bp, Artificial Sequence
  chemically synthesized
ccttctcttcccagacagcc

SEQ ID NO: 11322 - DNA, 20 bp, Artificial Sequence
  chemically synthesized
cttctcttcccagacagccg

SEQ ID NO: 11323 - DNA, 20 bp, Artificial Sequence
  chemically synthesized
ccagacagccgaggactgtg

SEQ ID NO: 11324 - DNA, 20 bp, Artificial Sequence
  chemically synthesized
cagacagccgaggactgtga

SEQ ID NO: 11325 - DNA, 20 bp, Artificial Sequence
  chemically synthesized
ggaaaaaaatcaccaaaatg

SEQ ID NO: 11326 - DNA, 20 bp, Artificial Sequence
  chemically synthesized
aaaaatcaccaaaatgcaga

SEQ ID NO: 11327 - DNA, 20 bp, Artificial Sequence
  chemically synthesized
caccacatattgatgcctca

SEQ ID NO: 11328 - DNA, 20 bp, Artificial Sequence
  chemically synthesized
cctccacccacctctctgct

SEQ ID NO: 11329 - DNA, 20 bp, Artificial Sequence
  chemically synthesized
tgctcagcaactcatttact

SEQ ID NO: 11330 - DNA, 20 bp, Artificial Sequence
  chemically synthesized
gcaactcatttacttggccc

SEQ ID NO: 11331 - DNA, 20 bp, Artificial Sequence
  chemically synthesized
tggccctggacactcctaaa

SEQ ID NO: 11332 - DNA, 20 bp, Artificial Sequence
  chemically synthesized
tccatgcctgcatccattta

SEQ ID NO: 11333 - DNA, 20 bp, Artificial Sequence
  chemically synthesized
atccatttacagtcgttcct

SEQ ID NO: 11334 - DNA, 20 bp, Artificial Sequence
  chemically synthesized
cagtcgttcctcagtatcca

SEQ ID NO: 11335 - DNA, 20 bp, Artificial Sequence
  chemically synthesized
cctcagtatccatggaaaat

SEQ ID NO: 11336 - DNA, 20 bp, Artificial Sequence
  chemically synthesized
cagtatccatggaaaattgg

SEQ ID NO: 11337 - DNA, 20 bp, Artificial Sequence
  chemically synthesized
atccatggaaaattggtggc

SEQ ID NO: 11338 - DNA, 20 bp, Artificial Sequence
  chemically synthesized
caagaccccctgcaaatatc

SEQ ID NO: 11339 - DNA, 20 bp, Artificial Sequence
  chemically synthesized
cctgcaaatatcaagatctg

SEQ ID NO: 11340 - DNA, 20 bp, Artificial Sequence
  chemically synthesized
atcaagatctgtggatgctc

SEQ ID NO: 11341 - DNA, 20 bp, Artificial Sequence
  chemically synthesized
tcaagtctccgatataaaaa

SEQ ID NO: 11342 - DNA, 20 bp, Artificial Sequence
  chemically synthesized
tttgtactttaaatcatctc

SEQ ID NO: 11343 - DNA, 20 bp, Artificial Sequence
  chemically synthesized
ttgtactttaaatcatctct

SEQ ID NO: 11344 - DNA, 20 bp, Artificial Sequence
  chemically synthesized
catctctaggtttctcttaa

SEQ ID NO: 11345 - DNA, 20 bp, Artificial Sequence
  chemically synthesized
caatgtaaatgctatgtaaa

SEQ ID NO: 11346 - DNA, 20 bp, Artificial Sequence
  chemically synthesized
agttgttatgctgtattgtt

SEQ ID NO: 11347 - DNA, 20 bp, Artificial Sequence
  chemically synthesized
gttgttatgctgtattgttt

SEQ ID NO: 11348 - DNA, 20 bp, Artificial Sequence
  chemically synthesized
ttgttatgctgtattgttta

SEQ ID NO: 11349 - DNA, 20 bp, Artificial Sequence
  chemically synthesized
tattgtttagggaataatga

SEQ ID NO: 11350 - DNA, 20 bp, Artificial Sequence
  chemically synthesized
tagggaataatgaaagataa

SEQ ID NO: 11351 - DNA, 20 bp, Artificial Sequence
  chemically synthesized
gggaataatgaaagataaaa

SEQ ID NO: 11352 - DNA, 20 bp, Artificial Sequence
  chemically synthesized
taaaagagtctgtacatgtt

SEQ ID NO: 11353 - DNA, 20 bp, Artificial Sequence
  chemically synthesized
aagagtctgtacatgttcag

SEQ ID NO: 11354 - DNA, 20 bp, Artificial Sequence
  chemically synthesized
gagtctgtacatgttcagta

SEQ ID NO: 11355 - DNA, 20 bp, Artificial Sequence
  chemically synthesized
tcttgaatatttttgatctg

SEQ ID NO: 11356 - DNA, 20 bp, Artificial Sequence
  chemically synthesized
tctgcagttaattgaatctg

SEQ ID NO: 11357 - DNA, 20 bp, Artificial Sequence
  chemically synthesized
gttaattgaatctgtggctg

SEQ ID NO: 11358 - DNA, 20 bp, Artificial Sequence
  chemically synthesized
tctgtggctgtggaactcac

SEQ ID NO: 11359 - DNA, 20 bp, Artificial Sequence
  chemically synthesized
ctgtggctgtggaactcaca

SEQ ID NO: 11360 - DNA, 20 bp, Artificial Sequence
  chemically synthesized
gtggctgtggaactcacaag

SEQ ID NO: 11361 - DNA, 20 bp, Artificial Sequence
  chemically synthesized
ggctgtggaactcacaagga

SEQ ID NO: 11362 - DNA, 20 bp, Artificial Sequence
  chemically synthesized
cacaaggagagctgactgta

SEQ ID NO: 11363 - DNA, 20 bp, Artificial Sequence
  chemically synthesized
ggagagctgactgtacagtg

SEQ ID NO: 11364 - DNA, 20 bp, Artificial Sequence
  chemically synthesized
gctgactgtacagtgtggtt

SEQ ID NO: 11365 - DNA, 20 bp, Artificial Sequence
  chemically synthesized
agtgtggttgagtgaaaaaa

SEQ ID NO: 11366 - DNA, 20 bp, Artificial Sequence
  chemically synthesized
ttgagtgaaaaaacagactt

SEQ ID NO: 11367 - DNA, 20 bp, Artificial Sequence
  chemically synthesized
gaaaaaacagactttagaat

SEQ ID NO: 11368 - DNA, 20 bp, Artificial Sequence
  chemically synthesized
aacagactttagaatcagat

SEQ ID NO: 11369 - DNA, 20 bp, Artificial Sequence
  chemically synthesized
gactttagaatcagatcaga

SEQ ID NO: 11370 - DNA, 20 bp, Artificial Sequence
  chemically synthesized
agaatcagatcagacagaaa

SEQ ID NO: 11371 - DNA, 20 bp, Artificial Sequence
  chemically synthesized
gaatcagatcagacagaaat

SEQ ID NO: 11372 - DNA, 20 bp, Artificial Sequence
  chemically synthesized
gacagaaataggtttgaatc

SEQ ID NO: 11373 - DNA, 20 bp, Artificial Sequence
  chemically synthesized
aatcaagtatctgcctcctc

SEQ ID NO: 11374 - DNA, 20 bp, Artificial Sequence
  chemically synthesized
ctcctctagacctgtgacct

SEQ ID NO: 11375 - DNA, 20 bp, Artificial Sequence
  chemically synthesized
ctagacctgtgaccttggac

SEQ ID NO: 11376 - DNA, 20 bp, Artificial Sequence
  chemically synthesized
tgaccttggacaagtcacac

SEQ ID NO: 11377 - DNA, 20 bp, Artificial Sequence
  chemically synthesized
taactttgtcaaatgtaaat

SEQ ID NO: 11378 - DNA, 20 bp, Artificial Sequence
  chemically synthesized
aactttgtcaaatgtaaatt

SEQ ID NO: 11379 - DNA, 20 bp, Artificial Sequence
  chemically synthesized
caaatgtaaattaggtttaa

SEQ ID NO: 11380 - DNA, 20 bp, Artificial Sequence
  chemically synthesized
atgtaaattaggtttaacag

SEQ ID NO: 11381 - DNA, 20 bp, Artificial Sequence
  chemically synthesized
aggtttaacagtagtataat

SEQ ID NO: 11382 - DNA, 20 bp, Artificial Sequence
  chemically synthesized
taataagaatatctatctca

SEQ ID NO: 11383 - DNA, 20 bp, Artificial Sequence
  chemically synthesized
aataagaatatctatctcac

SEQ ID NO: 11384 - DNA, 20 bp, Artificial Sequence
  chemically synthesized
aatatctatctcacaggtgt

SEQ ID NO: 11385 - DNA, 20 bp, Artificial Sequence
  chemically synthesized
atctatctcacaggtgttgg

SEQ ID NO: 11386 - DNA, 20 bp, Artificial Sequence
  chemically synthesized
tctatctcacaggtgttggc

SEQ ID NO: 11387 - DNA, 20 bp, Artificial Sequence
  chemically synthesized
ctcacaggtgttggcaggat

SEQ ID NO: 11388 - DNA, 20 bp, Artificial Sequence
  chemically synthesized
caggtgttggcaggatcagt

SEQ ID NO: 11389 - DNA, 20 bp, Artificial Sequence
  chemically synthesized
ggatcagtgagacaatatgc

SEQ ID NO: 11390 - DNA, 20 bp, Artificial Sequence
  chemically synthesized
tctccctactcctttcatgt

SEQ ID NO: 11391 - DNA, 20 bp, Artificial Sequence
  chemically synthesized
ttaaatttctcaattctctt

SEQ ID NO: 11392 - DNA, 20 bp, Artificial Sequence
  chemically synthesized
gctctttaataacttctgtg

SEQ ID NO: 11393 - DNA, 20 bp, Artificial Sequence
  chemically synthesized
gaaatgactattgtcacaat

SEQ ID NO: 11394 - DNA, 20 bp, Artificial Sequence
  chemically synthesized
aaatgactattgtcacaatc

SEQ ID NO: 11395 - DNA, 20 bp, Artificial Sequence
  chemically synthesized
tcacaatcaggaatgaccta

SEQ ID NO: 11396 - DNA, 20 bp, Artificial Sequence
  chemically synthesized
atgacctaaagaataatttt

SEQ ID NO: 11397 - DNA, 20 bp, Artificial Sequence
  chemically synthesized
ttttgagtttatgtatttac

SEQ ID NO: 11398 - DNA, 20 bp, Artificial Sequence
  chemically synthesized
attgttgatctctccctttt

SEQ ID NO: 11399 - DNA, 20 bp, Artificial Sequence
  chemically synthesized
ttgttgatctctcccttttt

SEQ ID NO: 11400 - DNA, 20 bp, Artificial Sequence
  chemically synthesized
ttataataatcactctattc

SEQ ID NO: 11401 - DNA, 20 bp, Artificial Sequence
  chemically synthesized
tctaactcctgttatccatc

SEQ ID NO: 11402 - DNA, 20 bp, Artificial Sequence
  chemically synthesized
ttaactcctgttcctctcca

SEQ ID NO: 11403 - DNA, 20 bp, Artificial Sequence
  chemically synthesized
ctccatggcccttaaatgtc

SEQ ID NO: 11404 - DNA, 20 bp, Artificial Sequence
  chemically synthesized
tccatggcccttaaatgtcc

SEQ ID NO: 11405 - DNA, 20 bp, Artificial Sequence
  chemically synthesized
ccatggcccttaaatgtcca

SEQ ID NO: 11406 - DNA, 20 bp, Artificial Sequence
  chemically synthesized
ttaaatgtccagggttctcc

SEQ ID NO: 11407 - DNA, 20 bp, Artificial Sequence
  chemically synthesized
taaatgtccagggttctccc

SEQ ID NO: 11408 - DNA, 20 bp, Artificial Sequence
  chemically synthesized
tccagggttctcccaggctc

SEQ ID NO: 11409 - DNA, 20 bp, Artificial Sequence
  chemically synthesized
gttctcccaggctccagcct

SEQ ID NO: 11410 - DNA, 20 bp, Artificial Sequence
  chemically synthesized
ttcaccttatatatacttgc

SEQ ID NO: 11411 - DNA, 20 bp, Artificial Sequence
  chemically synthesized
tcaccttatatatacttgct

SEQ ID NO: 11412 - DNA, 20 bp, Artificial Sequence
  chemically synthesized
caccttatatatacttgcta

SEQ ID NO: 11413 - DNA, 20 bp, Artificial Sequence
  chemically synthesized
ttatatatacttgctagggc

SEQ ID NO: 11414 - DNA, 20 bp, Artificial Sequence
  chemically synthesized
tatatatacttgctagggct

SEQ ID NO: 11415 - DNA, 20 bp, Artificial Sequence
  chemically synthesized
atacttgctagggctgggac

SEQ ID NO: 11416 - DNA, 20 bp, Artificial Sequence
  chemically synthesized
acttgctagggctgggacaa

SEQ ID NO: 11417 - DNA, 20 bp, Artificial Sequence
  chemically synthesized
gggacaagagtgaaccaaac

SEQ ID NO: 11418 - DNA, 20 bp, Artificial Sequence
  chemically synthesized
ggacaagagtgaaccaaaca

SEQ ID NO: 11419 - DNA, 20 bp, Artificial Sequence
  chemically synthesized
agtgaaccaaacaaggcatg

SEQ ID NO: 11420 - DNA, 20 bp, Artificial Sequence
  chemically synthesized
gtgaaccaaacaaggcatgt

SEQ ID NO: 11421 - DNA, 20 bp, Artificial Sequence
  chemically synthesized
tgaaccaaacaaggcatgta

SEQ ID NO: 11422 - DNA, 20 bp, Artificial Sequence
  chemically synthesized
gcatgtagggcacaatattt

SEQ ID NO: 11423 - DNA, 20 bp, Artificial Sequence
  chemically synthesized
atgtagggcacaatatttaa

SEQ ID NO: 11424 - DNA, 20 bp, Artificial Sequence
  chemically synthesized
tgtagggcacaatatttaag

SEQ ID NO: 11425 - DNA, 20 bp, Artificial Sequence
  chemically synthesized
tttaagaggtcctcacttct

SEQ ID NO: 11426 - DNA, 20 bp, Artificial Sequence
  chemically synthesized
ttaagaggtcctcacttctc

SEQ ID NO: 11427 - DNA, 20 bp, Artificial Sequence
  chemically synthesized
taagaggtcctcacttctcg

SEQ ID NO: 11428 - DNA, 20 bp, Artificial Sequence
  chemically synthesized
cctcacttctcggggcatac

SEQ ID NO: 11429 - DNA, 20 bp, Artificial Sequence
  chemically synthesized
acaagtatatttatgcccta

SEQ ID NO: 11430 - DNA, 20 bp, Artificial Sequence
  chemically synthesized
caagtatatttatgccctac

SEQ ID NO: 11431 - DNA, 20 bp, Artificial Sequence
  chemically synthesized
cctacaggccttgcttacca

SEQ ID NO: 11432 - DNA, 20 bp, Artificial Sequence
  chemically synthesized
aggccttgcttaccacagtc

SEQ ID NO: 11433 - DNA, 20 bp, Artificial Sequence
  chemically synthesized
ttgcttaccacagtctagtc

SEQ ID NO: 11434 - DNA, 20 bp, Artificial Sequence
  chemically synthesized
ccctgtcaacaaaatttact

SEQ ID NO: 11435 - DNA, 20 bp, Artificial Sequence
  chemically synthesized
gagcatacaaccactactgc

SEQ ID NO: 11436 - DNA, 20 bp, Artificial Sequence
  chemically synthesized
agcatacaaccactactgcc

SEQ ID NO: 11437 - DNA, 20 bp, Artificial Sequence
  chemically synthesized
actactgccaggcactgtac

SEQ ID NO: 11438 - DNA, 20 bp, Artificial Sequence
  chemically synthesized
ctactgccaggcactgtact

SEQ ID NO: 11439 - DNA, 20 bp, Artificial Sequence
  chemically synthesized
caatatccatgctcactctc

SEQ ID NO: 11440 - DNA, 20 bp, Artificial Sequence
  chemically synthesized
tctccagatgcccacacacg

SEQ ID NO: 11441 - DNA, 20 bp, Artificial Sequence
  chemically synthesized
gtggctgtaactactgttta

SEQ ID NO: 11442 - DNA, 20 bp, Artificial Sequence
  chemically synthesized
actactgtttacagaacaat

SEQ ID NO: 11443 - DNA, 20 bp, Artificial Sequence
  chemically synthesized
gagttccaaatactcaccta

SEQ ID NO: 11444 - DNA, 20 bp, Artificial Sequence
  chemically synthesized
tccaaatactcacctatagt

SEQ ID NO: 11445 - DNA, 20 bp, Artificial Sequence
  chemically synthesized
cagatacgtctcctgaattt

SEQ ID NO: 11446 - DNA, 20 bp, Artificial Sequence
  chemically synthesized
cctaactgtatatcataatg

SEQ ID NO: 11447 - DNA, 20 bp, Artificial Sequence
  chemically synthesized
actgtatatcataatgtagc

SEQ ID NO: 11448 - DNA, 20 bp, Artificial Sequence
  chemically synthesized
tatcataatgtagccagtaa

SEQ ID NO: 11449 - DNA, 20 bp, Artificial Sequence
  chemically synthesized
atgtaatgcttctgctgtgt

SEQ ID NO: 11450 - DNA, 20 bp, Artificial Sequence
  chemically synthesized
gctgtgttggacactgtgct

SEQ ID NO: 11451 - DNA, 20 bp, Artificial Sequence
  chemically synthesized
atctcacttcatcctcacaa

SEQ ID NO: 11452 - DNA, 20 bp, Artificial Sequence
  chemically synthesized
catcctcacaaaagtcccac

SEQ ID NO: 11453 - DNA, 20 bp, Artificial Sequence
  chemically synthesized
ctcacaaaagtcccacgaga

SEQ ID NO: 11454 - DNA, 20 bp, Artificial Sequence
  chemically synthesized
tcacaaaagtcccacgagat

SEQ ID NO: 11455 - DNA, 20 bp, Artificial Sequence
  chemically synthesized
gtcatcttatttttatgaat

SEQ ID NO: 11456 - DNA, 20 bp, Artificial Sequence
  chemically synthesized
tcatcttatttttatgaatg

SEQ ID NO: 11457 - DNA, 20 bp, Artificial Sequence
  chemically synthesized
tcttatttttatgaatgagg

SEQ ID NO: 11458 - DNA, 20 bp, Artificial Sequence
  chemically synthesized
atttttatgaatgaggaaga

SEQ ID NO: 11459 - DNA, 20 bp, Artificial Sequence
  chemically synthesized
gaatgaggaagatagattca

SEQ ID NO: 11460 - DNA, 20 bp, Artificial Sequence
  chemically synthesized
atgaggaagatagattcata

SEQ ID NO: 11461 - DNA, 20 bp, Artificial Sequence
  chemically synthesized
tgaggaagatagattcatag

SEQ ID NO: 11462 - DNA, 20 bp, Artificial Sequence
  chemically synthesized
aagatagattcatagaggct

SEQ ID NO: 11463 - DNA, 20 bp, Artificial Sequence
  chemically synthesized
agatagattcatagaggcta

SEQ ID NO: 11464 - DNA, 20 bp, Artificial Sequence
  chemically synthesized
gatagattcatagaggctaa

SEQ ID NO: 11465 - DNA, 20 bp, Artificial Sequence
  chemically synthesized
agaggctaagggctttgccc

SEQ ID NO: 11466 - DNA, 20 bp, Artificial Sequence
  chemically synthesized
gaggctaagggctttgccca

SEQ ID NO: 11467 - DNA, 20 bp, Artificial Sequence
  chemically synthesized
aggtaacatactaaaacatt

SEQ ID NO: 11468 - DNA, 20 bp, Artificial Sequence
  chemically synthesized
ggtaacatactaaaacattc

SEQ ID NO: 11469 - DNA, 20 bp, Artificial Sequence
  chemically synthesized
atactaaaacattcaggatt

SEQ ID NO: 11470 - DNA, 20 bp, Artificial Sequence
  chemically synthesized
aacattcaggattcagactc

SEQ ID NO: 11471 - DNA, 20 bp, Artificial Sequence
  chemically synthesized
attcaggattcagactctgg

SEQ ID NO: 11472 - DNA, 20 bp, Artificial Sequence
  chemically synthesized
aggattcagactctggcagt

SEQ ID NO: 11473 - DNA, 20 bp, Artificial Sequence
  chemically synthesized
agactctggcagtcagacta

SEQ ID NO: 11474 - DNA, 20 bp, Artificial Sequence
  chemically synthesized
actctggcagtcagactaaa

SEQ ID NO: 11475 - DNA, 20 bp, Artificial Sequence
  chemically synthesized
tggcagtcagactaaagagc

SEQ ID NO: 11476 - DNA, 20 bp, Artificial Sequence
  chemically synthesized
gactaaagagccagttctct

SEQ ID NO: 11477 - DNA, 20 bp, Artificial Sequence
  chemically synthesized
ttctcttagacattattctg

SEQ ID NO: 11478 - DNA, 20 bp, Artificial Sequence
  chemically synthesized
ccataatcacatcaaacaca

SEQ ID NO: 11479 - DNA, 20 bp, Artificial Sequence
  chemically synthesized
acatcaaacacaaagtcccc

SEQ ID NO: 11480 - DNA, 20 bp, Artificial Sequence
  chemically synthesized
acacaaagtccccaagactc

SEQ ID NO: 11481 - DNA, 20 bp, Artificial Sequence
  chemically synthesized
gccatttccccttccatacc

SEQ ID NO: 11482 - DNA, 20 bp, Artificial Sequence
  chemically synthesized
tttccccttccatacccaga

SEQ ID NO: 11483 - DNA, 20 bp, Artificial Sequence
  chemically synthesized
ccttccatacccagatggtt

SEQ ID NO: 11484 - DNA, 20 bp, Artificial Sequence
  chemically synthesized
ttttttgtactgctactgtt

SEQ ID NO: 11485 - DNA, 20 bp, Artificial Sequence
  chemically synthesized
tttttgtactgctactgttc

SEQ ID NO: 11486 - DNA, 20 bp, Artificial Sequence
  chemically synthesized
tactgctactgttcaggttc

SEQ ID NO: 11487 - DNA, 20 bp, Artificial Sequence
  chemically synthesized
tctagcctttatgtctcccg

SEQ ID NO: 11488 - DNA, 20 bp, Artificial Sequence
  chemically synthesized
tctcccgcagataattgcaa

SEQ ID NO: 11489 - DNA, 20 bp, Artificial Sequence
  chemically synthesized
gcagataattgcaatagtct

SEQ ID NO: 11490 - DNA, 20 bp, Artificial Sequence
  chemically synthesized
cagataattgcaatagtctc

SEQ ID NO: 11491 - DNA, 20 bp, Artificial Sequence
  chemically synthesized
gtctcaggactgctctctcc

SEQ ID NO: 11492 - DNA, 20 bp, Artificial Sequence
  chemically synthesized
ggactgctctctcctagtct

SEQ ID NO: 11493 - DNA, 20 bp, Artificial Sequence
  chemically synthesized
gctctctcctagtcttggta

SEQ ID NO: 11494 - DNA, 20 bp, Artificial Sequence
  chemically synthesized
ctcccccactatcatttcat

SEQ ID NO: 11495 - DNA, 20 bp, Artificial Sequence
  chemically synthesized
tcatttcattagcgtgttgc

SEQ ID NO: 11496 - DNA, 20 bp, Artificial Sequence
  chemically synthesized
tcattagcgtgttgccagac

SEQ ID NO: 11497 - DNA, 20 bp, Artificial Sequence
  chemically synthesized
cattagcgtgttgccagact

SEQ ID NO: 11498 - DNA, 20 bp, Artificial Sequence
  chemically synthesized
ccagactgggcatcctaaat

SEQ ID NO: 11499 - DNA, 20 bp, Artificial Sequence
  chemically synthesized
gggcatcctaaatcagccat

SEQ ID NO: 11500 - DNA, 20 bp, Artificial Sequence
  chemically synthesized
catcctaaatcagccatcag

SEQ ID NO: 11501 - DNA, 20 bp, Artificial Sequence
  chemically synthesized
attttattgtccaatctcct

SEQ ID NO: 11502 - DNA, 20 bp, Artificial Sequence
  chemically synthesized
ttttattgtccaatctcctt

SEQ ID NO: 11503 - DNA, 20 bp, Artificial Sequence
  chemically synthesized
tgacttcattatctgatgac

SEQ ID NO: 11504 - DNA, 20 bp, Artificial Sequence
  chemically synthesized
atctgatgaccagctctgcc

SEQ ID NO: 11505 - DNA, 20 bp, Artificial Sequence
  chemically synthesized
tttacctgtctcacttgtca

SEQ ID NO: 11506 - DNA, 20 bp, Artificial Sequence
  chemically synthesized
ctcacttgtcatagtccata

SEQ ID NO: 11507 - DNA, 20 bp, Artificial Sequence
  chemically synthesized
cctcacgttcttgcaaatct

SEQ ID NO: 11508 - DNA, 20 bp, Artificial Sequence
  chemically synthesized
gcaaatctgagtctttgcac

SEQ ID NO: 11509 - DNA, 20 bp, Artificial Sequence
  chemically synthesized
tgcataaaatgcccttatat

SEQ ID NO: 11510 - DNA, 20 bp, Artificial Sequence
  chemically synthesized
gcccttatatcagacattta

SEQ ID NO: 11511 - DNA, 20 bp, Artificial Sequence
  chemically synthesized
ccttatatcagacatttaaa

SEQ ID NO: 11512 - DNA, 20 bp, Artificial Sequence
  chemically synthesized
ttatatcagacatttaaaga

SEQ ID NO: 11513 - DNA, 20 bp, Artificial Sequence
  chemically synthesized
atatcagacatttaaagaga

SEQ ID NO: 11514 - DNA, 20 bp, Artificial Sequence
  chemically synthesized
agaacgcctactcatctttt

SEQ ID NO: 11515 - DNA, 20 bp, Artificial Sequence
  chemically synthesized
cctactcatcttttaagacc

SEQ ID NO: 11516 - DNA, 20 bp, Artificial Sequence
  chemically synthesized
ttcctttctctatgatccct

SEQ ID NO: 11517 - DNA, 20 bp, Artificial Sequence
  chemically synthesized
ctctatgatcccttagtacc

SEQ ID NO: 11518 - DNA, 20 bp, Artificial Sequence
  chemically synthesized
ttatattgaaacctctcacc

SEQ ID NO: 11519 - DNA, 20 bp, Artificial Sequence
  chemically synthesized
cacctggcctcatgctgctt

SEQ ID NO: 11520 - DNA, 20 bp, Artificial Sequence
  chemically synthesized
cctcatgctgctttagatca

SEQ ID NO: 11521 - DNA, 20 bp, Artificial Sequence
  chemically synthesized
tcatgctgctttagatcaaa

SEQ ID NO: 11522 - DNA, 20 bp, Artificial Sequence
  chemically synthesized
catgctgctttagatcaaag

SEQ ID NO: 11523 - DNA, 20 bp, Artificial Sequence
  chemically synthesized
atgctgctttagatcaaaga

SEQ ID NO: 11524 - DNA, 20 bp, Artificial Sequence
  chemically synthesized
gctgctttagatcaaagagg

SEQ ID NO: 11525 - DNA, 20 bp, Artificial Sequence
  chemically synthesized
tttagatcaaagagggagtc

SEQ ID NO: 11526 - DNA, 20 bp, Artificial Sequence
  chemically synthesized
ctggtttatccccatacccc

SEQ ID NO: 11527 - DNA, 20 bp, Artificial Sequence
  chemically synthesized
atacccctagtaccctgaca

SEQ ID NO: 11528 - DNA, 20 bp, Artificial Sequence
  chemically synthesized
tagtaccctgacacagtacc

SEQ ID NO: 11529 - DNA, 20 bp, Artificial Sequence
  chemically synthesized
tgacacagtacctggcacca

SEQ ID NO: 11530 - DNA, 20 bp, Artificial Sequence
  chemically synthesized
ctggcaccatagttgtaact

SEQ ID NO: 11531 - DNA, 20 bp, Artificial Sequence
  chemically synthesized
aactcagtaatgtctgaatg

SEQ ID NO: 11532 - DNA, 20 bp, Artificial Sequence
  chemically synthesized
actcagtaatgtctgaatga

SEQ ID NO: 11533 - DNA, 20 bp, Artificial Sequence
  chemically synthesized
tacactttacaaaactaaac

SEQ ID NO: 11534 - DNA, 20 bp, Artificial Sequence
  chemically synthesized
acaaaactaaactggtttta

SEQ ID NO: 11535 - DNA, 20 bp, Artificial Sequence
  chemically synthesized
aactgttgcaataataccta

SEQ ID NO: 11536 - DNA, 20 bp, Artificial Sequence
  chemically synthesized
actgttgcaataatacctaa

SEQ ID NO: 11537 - DNA, 20 bp, Artificial Sequence
  chemically synthesized
gttgcaataatacctaaagg

SEQ ID NO: 11538 - DNA, 20 bp, Artificial Sequence
  chemically synthesized
gcaataatacctaaaggcag

SEQ ID NO: 11539 - DNA, 20 bp, Artificial Sequence
  chemically synthesized
gccatgaaaatgcaacatct

SEQ ID NO: 11540 - DNA, 20 bp, Artificial Sequence
  chemically synthesized
tcactcaccgaaactccttt

SEQ ID NO: 11541 - DNA, 20 bp, Artificial Sequence
  chemically synthesized
ctcaccgaaactccttttag

SEQ ID NO: 11542 - DNA, 20 bp, Artificial Sequence
  chemically synthesized
aactccttttagaagccaat

SEQ ID NO: 11543 - DNA, 20 bp, Artificial Sequence
  chemically synthesized
ctccttttagaagccaatga

SEQ ID NO: 11544 - DNA, 20 bp, Artificial Sequence
  chemically synthesized
agaagccaatgagagtttaa

SEQ ID NO: 11545 - DNA, 20 bp, Artificial Sequence
  chemically synthesized
agccaatgagagtttaatag

SEQ ID NO: 11546 - DNA, 20 bp, Artificial Sequence
  chemically synthesized
caatgagagtttaatagcag

SEQ ID NO: 11547 - DNA, 20 bp, Artificial Sequence
  chemically synthesized
atgagagtttaatagcagaa

SEQ ID NO: 11548 - DNA, 20 bp, Artificial Sequence
  chemically synthesized
gagagtttaatagcagaaga

SEQ ID NO: 11549 - DNA, 20 bp, Artificial Sequence
  chemically synthesized
gcattaatactgtctatcct

SEQ ID NO: 11550 - DNA, 20 bp, Artificial Sequence
  chemically synthesized
tatccttagaaaaattcccc

SEQ ID NO: 11551 - DNA, 20 bp, Artificial Sequence
  chemically synthesized
attcccctggccccttcctc

SEQ ID NO: 11552 - DNA, 20 bp, Artificial Sequence
  chemically synthesized
ttcccctggccccttcctca

SEQ ID NO: 11553 - DNA, 20 bp, Artificial Sequence
  chemically synthesized
tcccctggccccttcctcaa

SEQ ID NO: 11554 - DNA, 20 bp, Artificial Sequence
  chemically synthesized
cctcaagggcttattatctc

SEQ ID NO: 11555 - DNA, 20 bp, Artificial Sequence
  chemically synthesized
cttattatctctggctacaa

SEQ ID NO: 11556 - DNA, 20 bp, Artificial Sequence
  chemically synthesized
atctctggctacaatggctg

SEQ ID NO: 11557 - DNA, 20 bp, Artificial Sequence
  chemically synthesized
aatcacattgcctttctcct

SEQ ID NO: 11558 - DNA, 20 bp, Artificial Sequence
  chemically synthesized
cctttctccttagtattatc

SEQ ID NO: 11559 - DNA, 20 bp, Artificial Sequence
  chemically synthesized
ctttctccttagtattatct

SEQ ID NO: 11560 - DNA, 20 bp, Artificial Sequence
  chemically synthesized
tttctccttagtattatctg

SEQ ID NO: 11561 - DNA, 20 bp, Artificial Sequence
  chemically synthesized
tcgtatacttaacttccctt

SEQ ID NO: 11562 - DNA, 20 bp, Artificial Sequence
  chemically synthesized
cgtatacttaacttcccttc

SEQ ID NO: 11563 - DNA, 20 bp, Artificial Sequence
  chemically synthesized
cttcccttcaggtttatcgc

SEQ ID NO: 11564 - DNA, 20 bp, Artificial Sequence
  chemically synthesized
tatcgctagtcattatttcc

SEQ ID NO: 11565 - DNA, 20 bp, Artificial Sequence
  chemically synthesized
atcgctagtcattatttccc

SEQ ID NO: 11566 - DNA, 20 bp, Artificial Sequence
  chemically synthesized
cattatttcccaggctccaa

SEQ ID NO: 11567 - DNA, 20 bp, Artificial Sequence
  chemically synthesized
tttcccaggctccaaaagcc

SEQ ID NO: 11568 - DNA, 20 bp, Artificial Sequence
  chemically synthesized
attcttatctatcctttccc

SEQ ID NO: 11569 - DNA, 20 bp, Artificial Sequence
  chemically synthesized
tatcctttccccagcatctg

SEQ ID NO: 11570 - DNA, 20 bp, Artificial Sequence
  chemically synthesized
ccccagcatctgaagtcttc

SEQ ID NO: 11571 - DNA, 20 bp, Artificial Sequence
  chemically synthesized
cccagcatctgaagtcttca

SEQ ID NO: 11572 - DNA, 20 bp, Artificial Sequence
  chemically synthesized
ccagcatctgaagtcttcaa

SEQ ID NO: 11573 - DNA, 20 bp, Artificial Sequence
  chemically synthesized
cagcatctgaagtcttcaag

SEQ ID NO: 11574 - DNA, 20 bp, Artificial Sequence
  chemically synthesized
agcatctgaagtcttcaagg

SEQ ID NO: 11575 - DNA, 20 bp, Artificial Sequence
  chemically synthesized
atctgaagtcttcaaggggg

SEQ ID NO: 11576 - DNA, 20 bp, Artificial Sequence
  chemically synthesized
tgaagtcttcaagggggcag

SEQ ID NO: 11577 - DNA, 20 bp, Artificial Sequence
  chemically synthesized
tcatcatctcaccacttata

SEQ ID NO: 11578 - DNA, 20 bp, Artificial Sequence
  chemically synthesized
tcatctcaccacttatatag

SEQ ID NO: 11579 - DNA, 20 bp, Artificial Sequence
  chemically synthesized
ctcaccacttatatagaaga

SEQ ID NO: 11580 - DNA, 20 bp, Artificial Sequence
  chemically synthesized
tcaccacttatatagaagaa

SEQ ID NO: 11581 - DNA, 20 bp, Artificial Sequence
  chemically synthesized
caccacttatatagaagaaa

SEQ ID NO: 11582 - DNA, 20 bp, Artificial Sequence
  chemically synthesized
cttatatagaagaaagggtt

SEQ ID NO: 11583 - DNA, 20 bp, Artificial Sequence
  chemically synthesized
gtttggatgctttgtcctcc

SEQ ID NO: 11584 - DNA, 20 bp, Artificial Sequence
  chemically synthesized
ctcccagatgtcacactaat

SEQ ID NO: 11585 - DNA, 20 bp, Artificial Sequence
  chemically synthesized
cactaatgagatatatctaa

SEQ ID NO: 11586 - DNA, 20 bp, Artificial Sequence
  chemically synthesized
tgctttatgtcctgctttgt

SEQ ID NO: 11587 - DNA, 20 bp, Artificial Sequence
  chemically synthesized
cttgactttactcactttgc

SEQ ID NO: 11588 - DNA, 20 bp, Artificial Sequence
  chemically synthesized
atttttttttatcgttattt

SEQ ID NO: 11589 - DNA, 20 bp, Artificial Sequence
  chemically synthesized
ttatcgttatttcagcattt

SEQ ID NO: 11590 - DNA, 20 bp, Artificial Sequence
  chemically synthesized
agcatttcagtctgatttca

SEQ ID NO: 11591 - DNA, 20 bp, Artificial Sequence
  chemically synthesized
ttcacagctgacatcatgtc

SEQ ID NO: 11592 - DNA, 20 bp, Artificial Sequence
  chemically synthesized
cacagctgacatcatgtctg

SEQ ID NO: 11593 - DNA, 20 bp, Artificial Sequence
  chemically synthesized
agctgacatcatgtctggag

SEQ ID NO: 11594 - DNA, 20 bp, Artificial Sequence
  chemically synthesized
gctgacatcatgtctggagt

SEQ ID NO: 11595 - DNA, 20 bp, Artificial Sequence
  chemically synthesized
catgtctggagtgggaacca

SEQ ID NO: 11596 - DNA, 20 bp, Artificial Sequence
  chemically synthesized
atgtctggagtgggaaccac

SEQ ID NO: 11597 - DNA, 20 bp, Artificial Sequence
  chemically synthesized
tgtctggagtgggaaccaca

SEQ ID NO: 11598 - DNA, 20 bp, Artificial Sequence
  chemically synthesized
tggagtgggaaccacagggc

SEQ ID NO: 11599 - DNA, 20 bp, Artificial Sequence
  chemically synthesized
gtgggaaccacagggccagt

SEQ ID NO: 11600 - DNA, 20 bp, Artificial Sequence
  chemically synthesized
cacagggccagtcagctttc

SEQ ID NO: 11601 - DNA, 20 bp, Artificial Sequence
  chemically synthesized
acagggccagtcagctttct

SEQ ID NO: 11602 - DNA, 20 bp, Artificial Sequence
  chemically synthesized
cagggccagtcagctttctg

SEQ ID NO: 11603 - DNA, 20 bp, Artificial Sequence
  chemically synthesized
agggccagtcagctttctgg

SEQ ID NO: 11604 - DNA, 20 bp, Artificial Sequence
  chemically synthesized
gtcagctttctgggggtgct

SEQ ID NO: 11605 - DNA, 20 bp, Artificial Sequence
  chemically synthesized
tcagctttctgggggtgctt

SEQ ID NO: 11606 - DNA, 20 bp, Artificial Sequence
  chemically synthesized
cagctttctgggggtgctta

SEQ ID NO: 11607 - DNA, 20 bp, Artificial Sequence
  chemically synthesized
tttctgggggtgcttagggt

SEQ ID NO: 11608 - DNA, 20 bp, Artificial Sequence
  chemically synthesized
agggttggcacccctgatcc

SEQ ID NO: 11609 - DNA, 20 bp, Artificial Sequence
  chemically synthesized
acccctgatcctggtactgt

SEQ ID NO: 11610 - DNA, 20 bp, Artificial Sequence
  chemically synthesized
atcctggtactgtcagctac

SEQ ID NO: 11611 - DNA, 20 bp, Artificial Sequence
  chemically synthesized
tcagctactagatttgattc

SEQ ID NO: 11612 - DNA, 20 bp, Artificial Sequence
  chemically synthesized
ctactagatttgattctaga

SEQ ID NO: 11613 - DNA, 20 bp, Artificial Sequence
  chemically synthesized
tttgattctagaaagttgac

SEQ ID NO: 11614 - DNA, 20 bp, Artificial Sequence
  chemically synthesized
attctagaaagttgacaagt

SEQ ID NO: 11615 - DNA, 20 bp, Artificial Sequence
  chemically synthesized
gtgtgataaatgcttcctgt

SEQ ID NO: 11616 - DNA, 20 bp, Artificial Sequence
  chemically synthesized
gaacatgctgtttgtccaaa

SEQ ID NO: 11617 - DNA, 20 bp, Artificial Sequence
  chemically synthesized
aacatgctgtttgtccaaat

SEQ ID NO: 11618 - DNA, 20 bp, Artificial Sequence
  chemically synthesized
cttccctgtatgccttcctc

SEQ ID NO: 11619 - DNA, 20 bp, Artificial Sequence
  chemically synthesized
ttccctgtatgccttcctct

SEQ ID NO: 11620 - DNA, 20 bp, Artificial Sequence
  chemically synthesized
cttcctctgggaaatacata

SEQ ID NO: 11621 - DNA, 20 bp, Artificial Sequence
  chemically synthesized
ggaaatacataaagtcactg

SEQ ID NO: 11622 - DNA, 20 bp, Artificial Sequence
  chemically synthesized
actgtagttgtgaaaaaaca

SEQ ID NO: 11623 - DNA, 20 bp, Artificial Sequence
  chemically synthesized
caaagtgatatatgttgcat

SEQ ID NO: 11624 - DNA, 20 bp, Artificial Sequence
  chemically synthesized
tactctttatgtcaattctt

SEQ ID NO: 11625 - DNA, 20 bp, Artificial Sequence
  chemically synthesized
ttaagcttgcttttctcccc

SEQ ID NO: 11626 - DNA, 20 bp, Artificial Sequence
  chemically synthesized
taagcttgcttttctcccct

SEQ ID NO: 11627 - DNA, 20 bp, Artificial Sequence
  chemically synthesized
aagcttgcttttctccccta

SEQ ID NO: 11628 - DNA, 20 bp, Artificial Sequence
  chemically synthesized
ctcccctagggaactcaact

SEQ ID NO: 11629 - DNA, 20 bp, Artificial Sequence
  chemically synthesized
tttccccaaatatcaactcc

SEQ ID NO: 11630 - DNA, 20 bp, Artificial Sequence
  chemically synthesized
caactccaagatgtttgaca

SEQ ID NO: 11631 - DNA, 20 bp, Artificial Sequence
  chemically synthesized
actccaagatgtttgacata

SEQ ID NO: 11632 - DNA, 20 bp, Artificial Sequence
  chemically synthesized
attttttcctaatccatgaa

SEQ ID NO: 11633 - DNA, 20 bp, Artificial Sequence
  chemically synthesized
tcctaatccatgaaaagctt

SEQ ID NO: 11634 - DNA, 20 bp, Artificial Sequence
  chemically synthesized
aaagctttggtgataactaa

SEQ ID NO: 11635 - DNA, 20 bp, Artificial Sequence
  chemically synthesized
aactaacagcttgctaatga

SEQ ID NO: 11636 - DNA, 20 bp, Artificial Sequence
  chemically synthesized
actaacagcttgctaatgaa

SEQ ID NO: 11637 - DNA, 20 bp, Artificial Sequence
  chemically synthesized
ttaactaaaactttaaattg

SEQ ID NO: 11638 - DNA, 20 bp, Artificial Sequence
  chemically synthesized
agatatataatttaaaaaat

SEQ ID NO: 11639 - DNA, 20 bp, Artificial Sequence
  chemically synthesized
atatataatttaaaaaatta

SEQ ID NO: 11640 - DNA, 20 bp, Artificial Sequence
  chemically synthesized
aatgtcatatatcttaaaat

SEQ ID NO: 11641 - DNA, 20 bp, Artificial Sequence
  chemically synthesized
atcagactttttgtgtaaat

SEQ ID NO: 11642 - DNA, 20 bp, Artificial Sequence
  chemically synthesized
tcagactttttgtgtaaata

SEQ ID NO: 11643 - DNA, 20 bp, Artificial Sequence
  chemically synthesized
tgtttcccattttgatttca

SEQ ID NO: 11644 - DNA, 20 bp, Artificial Sequence
  chemically synthesized
ttcccattttgatttcaaag

SEQ ID NO: 11645 - DNA, 20 bp, Artificial Sequence
  chemically synthesized
cattttgatttcaaagtggt

SEQ ID NO: 11646 - DNA, 20 bp, Artificial Sequence
  chemically synthesized
aagtccaaacaaaaataatg

SEQ ID NO: 11647 - DNA, 20 bp, Artificial Sequence
  chemically synthesized
acttttaatttttttaaacc

SEQ ID NO: 11648 - DNA, 20 bp, Artificial Sequence
  chemically synthesized
cttttaatttttttaaacca

SEQ ID NO: 11649 - DNA, 20 bp, Artificial Sequence
  chemically synthesized
tttaatttttttaaaccaag

SEQ ID NO: 11650 - DNA, 20 bp, Artificial Sequence
  chemically synthesized
aggagatgaatgttttctaa

SEQ ID NO: 11651 - DNA, 20 bp, Artificial Sequence
  chemically synthesized
ggagatgaatgttttctaac

SEQ ID NO: 11652 - DNA, 20 bp, Artificial Sequence
  chemically synthesized
tgaccaaatcatgaactgaa

SEQ ID NO: 11653 - DNA, 20 bp, Artificial Sequence
  chemically synthesized
attaaacataaatgcatcat

SEQ ID NO: 11654 - DNA, 20 bp, Artificial Sequence
  chemically synthesized
ataagcattgtcgatctatt

SEQ ID NO: 11655 - DNA, 20 bp, Artificial Sequence
  chemically synthesized
tctatttagttttaaaaatg

SEQ ID NO: 11656 - DNA, 20 bp, Artificial Sequence
  chemically synthesized
atttagttttaaaaatgaag

SEQ ID NO: 11657 - DNA, 20 bp, Artificial Sequence
  chemically synthesized
tagttttaaaaatgaagaag

SEQ ID NO: 11658 - DNA, 20 bp, Artificial Sequence
  chemically synthesized
aaatgaagaagaagaaaacc

SEQ ID NO: 11659 - DNA, 20 bp, Artificial Sequence
  chemically synthesized
agaagaaaacctagctaaca

SEQ ID NO: 11660 - DNA, 20 bp, Artificial Sequence
  chemically synthesized
aaacctagctaacaaagaac

SEQ ID NO: 11661 - DNA, 20 bp, Artificial Sequence
  chemically synthesized
gtacttaccaacctgcgtgc

SEQ ID NO: 11662 - DNA, 20 bp, Artificial Sequence
  chemically synthesized
ccaacctgcgtgctggctgt

SEQ ID NO: 11663 - DNA, 20 bp, Artificial Sequence
  chemically synthesized
caaatcatgtaatcaaaatt

SEQ ID NO: 11664 - DNA, 20 bp, Artificial Sequence
  chemically synthesized
catgtaatcaaaatttagtg

SEQ ID NO: 11665 - DNA, 20 bp, Artificial Sequence
  chemically synthesized
gtaatcaaaatttagtgaag

SEQ ID NO: 11666 - DNA, 20 bp, Artificial Sequence
  chemically synthesized
tcaaaatttagtgaagaaga

SEQ ID NO: 11667 - DNA, 20 bp, Artificial Sequence
  chemically synthesized
tttagtgaagaagacagcat

SEQ ID NO: 11668 - DNA, 20 bp, Artificial Sequence
  chemically synthesized
tcagatatttctatatctaa

SEQ ID NO: 11669 - DNA, 20 bp, Artificial Sequence
  chemically synthesized
cagatatttctatatctaaa

SEQ ID NO: 11670 - DNA, 20 bp, Artificial Sequence
  chemically synthesized
tatttctatatctaaaaggc

SEQ ID NO: 11671 - DNA, 20 bp, Artificial Sequence
  chemically synthesized
atactcaatgtattttaaaa

SEQ ID NO: 11672 - DNA, 20 bp, Artificial Sequence
  chemically synthesized
tactcaatgtattttaaaaa

SEQ ID NO: 11673 - DNA, 20 bp, Artificial Sequence
  chemically synthesized
aggaaacaaacctgtacatt

SEQ ID NO: 11674 - DNA, 20 bp, Artificial Sequence
  chemically synthesized
aaacctgtacattcagcact

SEQ ID NO: 11675 - DNA, 20 bp, Artificial Sequence
  chemically synthesized
cctgtacattcagcactgag

SEQ ID NO: 11676 - DNA, 20 bp, Artificial Sequence
  chemically synthesized
gcactgagtagatatcctaa

SEQ ID NO: 11677 - DNA, 20 bp, Artificial Sequence
  chemically synthesized
cactgagtagatatcctaaa

SEQ ID NO: 11678 - DNA, 20 bp, Artificial Sequence
  chemically synthesized
tgagtagatatcctaaaagg

SEQ ID NO: 11679 - DNA, 20 bp, Artificial Sequence
  chemically synthesized
tagatatcctaaaaggcaga

SEQ ID NO: 11680 - DNA, 20 bp, Artificial Sequence
  chemically synthesized
cctaaaaggcagatggtgat

SEQ ID NO: 11681 - DNA, 20 bp, Artificial Sequence
  chemically synthesized
ctaaaaggcagatggtgatg

SEQ ID NO: 11682 - DNA, 20 bp, Artificial Sequence
  chemically synthesized
aggcagatggtgatgaggcc

SEQ ID NO: 11683 - DNA, 20 bp, Artificial Sequence
  chemically synthesized
acgcgctgcataacctttgc

SEQ ID NO: 11684 - DNA, 20 bp, Artificial Sequence
  chemically synthesized
cgctgcataacctttgctag

SEQ ID NO: 11685 - DNA, 20 bp, Artificial Sequence
  chemically synthesized
cctttgctagcagattgtga

SEQ ID NO: 11686 - DNA, 20 bp, Artificial Sequence
  chemically synthesized
ttgctagcagattgtgaaag

SEQ ID NO: 11687 - DNA, 20 bp, Artificial Sequence
  chemically synthesized
gcgcgtgaacatgatcatgg

SEQ ID NO: 11688 - DNA, 20 bp, Artificial Sequence
  chemically synthesized
cctcatcaccatctgccttt

SEQ ID NO: 11689 - DNA, 20 bp, Artificial Sequence
  chemically synthesized
tttaggatatctactcagtg

SEQ ID NO: 11690 - DNA, 20 bp, Artificial Sequence
  chemically synthesized
gtttccttttttaaaataca

SEQ ID NO: 11691 - DNA, 20 bp, Artificial Sequence
  chemically synthesized
atgatttgacagcaatattg

SEQ ID NO: 11692 - DNA, 20 bp, Artificial Sequence
  chemically synthesized
gtgggaaaacaaagaaatag

SEQ ID NO: 11693 - DNA, 20 bp, Artificial Sequence
  chemically synthesized
agttatcaccaaagcttttc

SEQ ID NO: 11694 - DNA, 20 bp, Artificial Sequence
  chemically synthesized
tgtctctatgtcaaacatct

SEQ ID NO: 11695 - DNA, 20 bp, Artificial Sequence
  chemically synthesized
tggggaaacacaatactcag

SEQ ID NO: 11696 - DNA, 20 bp, Artificial Sequence
  chemically synthesized
taggggagaaaagcaagctt

SEQ ID NO: 11697 - DNA, 20 bp, Artificial Sequence
  chemically synthesized
caagcttaagaattgacata

SEQ ID NO: 11698 - DNA, 20 bp, Artificial Sequence
  chemically synthesized
acacttacttgtcaactttc

SEQ ID NO: 11699 - DNA, 20 bp, Artificial Sequence
  chemically synthesized
aatctagtagctgacagtac

SEQ ID NO: 11700 - DNA, 20 bp, Artificial Sequence
  chemically synthesized
tagctgacagtaccaggatc

SEQ ID NO: 11701 - DNA, 20 bp, Artificial Sequence
  chemically synthesized
acagaggttaaactagcaaa

SEQ ID NO: 11702 - DNA, 20 bp, Artificial Sequence
  chemically synthesized
tagcaaagtgagtaaagtca

SEQ ID NO: 11703 - DNA, 20 bp, Artificial Sequence
  chemically synthesized
aagacttcagatgctgggga

SEQ ID NO: 11704 - DNA, 20 bp, Artificial Sequence
  chemically synthesized
atgctggggaaaggatagat

SEQ ID NO: 11705 - DNA, 20 bp, Artificial Sequence
  chemically synthesized
gggaaaggatagataagaat

SEQ ID NO: 11706 - DNA, 20 bp, Artificial Sequence
  chemically synthesized
gcccttgaggaaggggccag

SEQ ID NO: 11707 - DNA, 20 bp, Artificial Sequence
  chemically synthesized
ggggccaggggaatttttct

SEQ ID NO: 11708 - DNA, 20 bp, Artificial Sequence
  chemically synthesized
aactctcattggcttctaaa

SEQ ID NO: 11709 - DNA, 20 bp, Artificial Sequence
  chemically synthesized
ggcttctaaaaggagtttcg

SEQ ID NO: 11710 - DNA, 20 bp, Artificial Sequence
  chemically synthesized
taggtattattgcaacagtt

SEQ ID NO: 11711 - DNA, 20 bp, Artificial Sequence
  chemically synthesized
tgtccttcattcagacatta

SEQ ID NO: 11712 - DNA, 20 bp, Artificial Sequence
  chemically synthesized
tatggtgccaggtactgtgt

SEQ ID NO: 11713 - DNA, 20 bp, Artificial Sequence
  chemically synthesized
aggtactgtgtcagggtact

SEQ ID NO: 11714 - DNA, 20 bp, Artificial Sequence
  chemically synthesized
tgtcagggtactaggggtat

SEQ ID NO: 11715 - DNA, 20 bp, Artificial Sequence
  chemically synthesized
aaaatgtgcactaggtacta

SEQ ID NO: 11716 - DNA, 20 bp, Artificial Sequence
  chemically synthesized
ggggaaacaattgatagaga

SEQ ID NO: 11717 - DNA, 20 bp, Artificial Sequence
  chemically synthesized
tagagagagaatattttcat

SEQ ID NO: 11718 - DNA, 20 bp, Artificial Sequence
  chemically synthesized
tttcatctgggtcttaaaag

SEQ ID NO: 11719 - DNA, 20 bp, Artificial Sequence
  chemically synthesized
ataagggcattttatgcaaa

SEQ ID NO: 11720 - DNA, 20 bp, Artificial Sequence
  chemically synthesized
gcaagaacgtgaggtatttc

SEQ ID NO: 11721 - DNA, 20 bp, Artificial Sequence
  chemically synthesized
ggtatcgaagtataaacata

SEQ ID NO: 11722 - DNA, 20 bp, Artificial Sequence
  chemically synthesized
agtaccactgatggctgatt

SEQ ID NO: 11723 - DNA, 20 bp, Artificial Sequence
  chemically synthesized
gtagcagtacaaaaaaagag

SEQ ID NO: 11724 - DNA, 20 bp, Artificial Sequence
  chemically synthesized
aagtggtatgacttaaccat

SEQ ID NO: 11725 - DNA, 20 bp, Artificial Sequence
  chemically synthesized
ggtatggaaggggaaatggc

SEQ ID NO: 11726 - DNA, 20 bp, Artificial Sequence
  chemically synthesized
tttgatgtgattatggacca

SEQ ID NO: 11727 - DNA, 20 bp, Artificial Sequence
  chemically synthesized
tggctctttagtctgactgc

SEQ ID NO: 11728 - DNA, 20 bp, Artificial Sequence
  chemically synthesized
tttagtctgactgccagagt

SEQ ID NO: 11729 - DNA, 20 bp, Artificial Sequence
  chemically synthesized
tgactgccagagtctgaatc

SEQ ID NO: 11730 - DNA, 20 bp, Artificial Sequence
  chemically synthesized
gggcaaagcccttagcctct

SEQ ID NO: 11731 - DNA, 20 bp, Artificial Sequence
  chemically synthesized
ctatctcgtgggacttttgt

SEQ ID NO: 11732 - DNA, 20 bp, Artificial Sequence
  chemically synthesized
tgtgaggatgaagtgagata

SEQ ID NO: 11733 - DNA, 20 bp, Artificial Sequence
  chemically synthesized
tacattatgatatacagtta

SEQ ID NO: 11734 - DNA, 20 bp, Artificial Sequence
  chemically synthesized
ggagacgtatctgactatag

SEQ ID NO: 11735 - DNA, 20 bp, Artificial Sequence
  chemically synthesized
gccacgtgtgtgggcatctg

SEQ ID NO: 11736 - DNA, 20 bp, Artificial Sequence
  chemically synthesized
tgggcatctggagagtgagc

SEQ ID NO: 11737 - DNA, 20 bp, Artificial Sequence
  chemically synthesized
tgctcagtaaattttgttga

SEQ ID NO: 11738 - DNA, 20 bp, Artificial Sequence
  chemically synthesized
taagggccatggagaggaac

SEQ ID NO: 11739 - DNA, 20 bp, Artificial Sequence
  chemically synthesized
ggagttaatcaattcaagtg

SEQ ID NO: 11740 - DNA, 20 bp, Artificial Sequence
  chemically synthesized
ttaatcaattcaagtgctgg

SEQ ID NO: 11741 - DNA, 20 bp, Artificial Sequence
  chemically synthesized
tcaagtgctggatggataac

SEQ ID NO: 11742 - DNA, 20 bp, Artificial Sequence
  chemically synthesized
gttagagcaaagcggggaac

SEQ ID NO: 11743 - DNA, 20 bp, Artificial Sequence
  chemically synthesized
agcaaagcggggaaccagaa

SEQ ID NO: 11744 - DNA, 20 bp, Artificial Sequence
  chemically synthesized
aatagagtgattattataaa

SEQ ID NO: 11745 - DNA, 20 bp, Artificial Sequence
  chemically synthesized
gaagttattaaagagctaaa

SEQ ID NO: 11746 - DNA, 20 bp, Artificial Sequence
  chemically synthesized
gaaagtagggccaacatgaa

SEQ ID NO: 11747 - DNA, 20 bp, Artificial Sequence
  chemically synthesized
ctgtacagtcagctctcctt

SEQ ID NO: 11748 - DNA, 20 bp, Artificial Sequence
  chemically synthesized
caaaaatattcaagaaaaaa

SEQ ID NO: 11749 - DNA, 20 bp, Artificial Sequence
  chemically synthesized
agatgatttaaagtacaaag

SEQ ID NO: 11750 - DNA, 20 bp, Artificial Sequence
  chemically synthesized
cacagatcttgatatttgca

SEQ ID NO: 11751 - DNA, 20 bp, Artificial Sequence
  chemically synthesized
ggtcttgccaccaattttcc

SEQ ID NO: 11752 - DNA, 20 bp, Artificial Sequence
  chemically synthesized
atactgaggaacgactgtaa

SEQ ID NO: 11753 - DNA, 20 bp, Artificial Sequence
  chemically synthesized
gactgtaaatggatgcaggc

SEQ ID NO: 11754 - DNA, 20 bp, Artificial Sequence
  chemically synthesized
tgcaggcatggatgctattt

SEQ ID NO: 11755 - DNA, 20 bp, Artificial Sequence
  chemically synthesized
gagtgtccagggccaagtaa

SEQ ID NO: 11756 - DNA, 20 bp, Artificial Sequence
  chemically synthesized
atgagttgctgagcagagag

SEQ ID NO: 11757 - DNA, 20 bp, Artificial Sequence
  chemically synthesized
cctcggctgtctgggaagag

SEQ ID NO: 11758 - DNA, 20 bp, Artificial Sequence
  chemically synthesized
ggctgctccaatttaggggc

SEQ ID NO: 11759 - DNA, 20 bp, Artificial Sequence
  chemically synthesized
caatttaggggctaggattg

SEQ ID NO: 11760 - DNA, 20 bp, Artificial Sequence
  chemically synthesized
gggtgggcacagcattgcaa

SEQ ID NO: 11761 - DNA, 20 bp, Artificial Sequence
  chemically synthesized
attgagaaatatggccaatg

SEQ ID NO: 11762 - DNA, 20 bp, Artificial Sequence
  chemically synthesized
caggcagatcacttgaggtc

SEQ ID NO: 11763 - DNA, 20 bp, Artificial Sequence
  chemically synthesized
aaaattagctgggcatggtg

SEQ ID NO: 11764 - DNA, 20 bp, Artificial Sequence
  chemically synthesized
tacttgggaggctgaggcag

SEQ ID NO: 11765 - DNA, 20 bp, Artificial Sequence
  chemically synthesized
caagactctgtcaaaaaaaa

SEQ ID NO: 11766 - DNA, 20 bp, Artificial Sequence
  chemically synthesized
ttgcagagcaagggaaaagc

SEQ ID NO: 11767 - DNA, 20 bp, Artificial Sequence
  chemically synthesized
ctttcctttctcttcctttt

SEQ ID NO: 11768 - DNA, 20 bp, Artificial Sequence
  chemically synthesized
gaacaactccaggcaacttc

SEQ ID NO: 11769 - DNA, 20 bp, Artificial Sequence
  chemically synthesized
gccatgcattccttaacaat

SEQ ID NO: 11770 - DNA, 20 bp, Artificial Sequence
  chemically synthesized
tcatcattgtgcgaacataa

SEQ ID NO: 11771 - DNA, 20 bp, Artificial Sequence
  chemically synthesized
agatagagacatctatcctc

SEQ ID NO: 11772 - DNA, 20 bp, Artificial Sequence
  chemically synthesized
acatctatcctccagagttc

SEQ ID NO: 11773 - DNA, 20 bp, Artificial Sequence
  chemically synthesized
tagcttaaaaaaaacatatc

SEQ ID NO: 11774 - DNA, 20 bp, Artificial Sequence
  chemically synthesized
taacatctagtgacagacac

SEQ ID NO: 11775 - DNA, 20 bp, Artificial Sequence
  chemically synthesized
tattctgaaaacagcccagc

SEQ ID NO: 11776 - DNA, 20 bp, Artificial Sequence
  chemically synthesized
aaaacagcccagccagggtg

SEQ ID NO: 11777 - DNA, 20 bp, Artificial Sequence
  chemically synthesized
gaaatctgaccttttattac

SEQ ID NO: 11778 - DNA, 20 bp, Artificial Sequence
  chemically synthesized
tctcttgactaaaagtaaaa

SEQ ID NO: 11779 - DNA, 20 bp, Artificial Sequence
  chemically synthesized
gaaattggctttcagattat

SEQ ID NO: 11780 - DNA, 20 bp, Artificial Sequence
  chemically synthesized
tttcttttttgctaaaacta

SEQ ID NO: 11781 - DNA, 20 bp, Artificial Sequence
  chemically synthesized
atgaaaacgccaacaaaatt

SEQ ID NO: 11782 - DNA, 20 bp, Artificial Sequence
  chemically synthesized
gtataattcaggtaaattgg

SEQ ID NO: 11783 - DNA, 20 bp, Artificial Sequence
  chemically synthesized
tgttcaagggaaccttgaga

SEQ ID NO: 11784 - DNA, 20 bp, Artificial Sequence
  chemically synthesized
aacaaactcttccaatttac

SEQ ID NO: 11785 - DNA, 20 bp, Artificial Sequence
  chemically synthesized
ttatacctctttggccgatt

SEQ ID NO: 11786 - DNA, 20 bp, Artificial Sequence
  chemically synthesized
caagaaaaactgaaatgtaa

SEQ ID NO: 11787 - DNA, 20 bp, Artificial Sequence
  chemically synthesized
ctgtatacacatggagattt

SEQ ID NO: 11788 - DNA, 20 bp, Artificial Sequence
  chemically synthesized
tcaattttacttttagtcaa

SEQ ID NO: 11789 - DNA, 20 bp, Artificial Sequence
  chemically synthesized
ggtcagatttctaatcatat

SEQ ID NO: 11790 - DNA, 20 bp, Artificial Sequence
  chemically synthesized
taatcatatttgaatttact

SEQ ID NO: 11791 - DNA, 20 bp, Artificial Sequence
  chemically synthesized
tcacttgaaaatagctcatt

SEQ ID NO: 11792 - DNA, 20 bp, Artificial Sequence
  chemically synthesized
caccctggctgggctgtttt

SEQ ID NO: 11793 - DNA, 20 bp, Artificial Sequence
  chemically synthesized
ctttggttggcaagtgttat

SEQ ID NO: 11794 - DNA, 20 bp, Artificial Sequence
  chemically synthesized
cagtgatttaagcatctctc

SEQ ID NO: 11795 - DNA, 20 bp, Artificial Sequence
  chemically synthesized
ttaagcatctctctagaatt

SEQ ID NO: 11796 - DNA, 20 bp, Artificial Sequence
  chemically synthesized
agagacactcctgaactctg

SEQ ID NO: 11797 - DNA, 20 bp, Artificial Sequence
  chemically synthesized
tggaggatagatgtctctat

SEQ ID NO: 11798 - DNA, 20 bp, Artificial Sequence
  chemically synthesized
ttgcttaatgacacatttct

SEQ ID NO: 11799 - DNA, 20 bp, Artificial Sequence
  chemically synthesized
agaatatatccccattgtta

SEQ ID NO: 11800 - DNA, 20 bp, Artificial Sequence
  chemically synthesized
cagggactcaagaagttgcc

SEQ ID NO: 11801 - DNA, 20 bp, Artificial Sequence
  chemically synthesized
ctggagttgttcctttcttc

SEQ ID NO: 11802 - DNA, 20 bp, Artificial Sequence
  chemically synthesized
ggcttataagatgaactttc

SEQ ID NO: 11803 - DNA, 20 bp, Artificial Sequence
  chemically synthesized
cattgcagctgttcacttta

SEQ ID NO: 11804 - DNA, 20 bp, Artificial Sequence
  chemically synthesized
tttgggctcactttttttct

SEQ ID NO: 11805 - DNA, 20 bp, Artificial Sequence
  chemically synthesized
ttcaactcttttttttttga

SEQ ID NO: 11806 - DNA, 20 bp, Artificial Sequence
  chemically synthesized
tcttgctctgtcgcccaggc

SEQ ID NO: 11807 - DNA, 20 bp, Artificial Sequence
  chemically synthesized
gcctcagcctcccaagtagc

SEQ ID NO: 11808 - DNA, 20 bp, Artificial Sequence
  chemically synthesized
ttttgtatttttagtaaagc

SEQ ID NO: 11809 - DNA, 20 bp, Artificial Sequence
  chemically synthesized
gcctgggcctctgaaagtgc

SEQ ID NO: 11810 - DNA, 20 bp, Artificial Sequence
  chemically synthesized
aaaaaatcaccaaaatgcag

SEQ ID NO: 11811 - DNA, 20 bp, Artificial Sequence
  chemically synthesized
ccctgcaaatatcaagatct

SEQ ID NO: 11812 - DNA, 20 bp, Artificial Sequence
  chemically synthesized
ttgttatgctgtattgttta

SEQ ID NO: 11813 - DNA, 20 bp, Artificial Sequence
  chemically synthesized
tagggaataatgaaagataa

SEQ ID NO: 11814 - DNA, 20 bp, Artificial Sequence
  chemically synthesized
tgcaaccatccatttttttc

SEQ ID NO: 11815 - DNA, 20 bp, Artificial Sequence
  chemically synthesized
tatttttgatctgcagttaa

SEQ ID NO: 11816 - DNA, 20 bp, Artificial Sequence
  chemically synthesized
gagctgactgtacagtgtgg

SEQ ID NO: 11817 - DNA, 20 bp, Artificial Sequence
  chemically synthesized
ttgagtgaaaaaacagactt

SEQ ID NO: 11818 - DNA, 20 bp, Artificial Sequence
  chemically synthesized
cagatcagacagaaataggt

SEQ ID NO: 11819 - DNA, 20 bp, Artificial Sequence
  chemically synthesized
aggtttaacagtagtataat

SEQ ID NO: 11820 - DNA, 20 bp, Artificial Sequence
  chemically synthesized
atctatctcacaggtgttgg

SEQ ID NO: 11821 - DNA, 20 bp, Artificial Sequence
  chemically synthesized
aaatgactattgtcacaatc

SEQ ID NO: 11822 - DNA, 20 bp, Artificial Sequence
  chemically synthesized
tcacaatcaggaatgaccta

SEQ ID NO: 11823 - DNA, 20 bp, Artificial Sequence
  chemically synthesized
gaatgacctaaagaataatt

SEQ ID NO: 11824 - DNA, 20 bp, Artificial Sequence
  chemically synthesized
tcctgttatccatccagcac

SEQ ID NO: 11825 - DNA, 20 bp, Artificial Sequence
  chemically synthesized
ctccatggcccttaaatgtc

SEQ ID NO: 11826 - DNA, 20 bp, Artificial Sequence
  chemically synthesized
atacttgctagggctgggac

SEQ ID NO: 11827 - DNA, 20 bp, Artificial Sequence
  chemically synthesized
taactactgtttacagaaca

SEQ ID NO: 11828 - DNA, 20 bp, Artificial Sequence
  chemically synthesized
cctatagtcagatacgtctc

SEQ ID NO: 11829 - DNA, 20 bp, Artificial Sequence
  chemically synthesized
ggcactgtcatcttattttt

SEQ ID NO: 11830 - DNA, 20 bp, Artificial Sequence
  chemically synthesized
aggtaacatactaaaacatt

SEQ ID NO: 11831 - DNA, 20 bp, Artificial Sequence
  chemically synthesized
tacctcacgttcttgcaaat

SEQ ID NO: 11832 - DNA, 20 bp, Artificial Sequence
  chemically synthesized
ttgcaaatctgagtctttgc

SEQ ID NO: 11833 - DNA, 20 bp, Artificial Sequence
  chemically synthesized
atgctgctttagatcaaaga

SEQ ID NO: 11834 - DNA, 20 bp, Artificial Sequence
  chemically synthesized
tagttgtaactcagtaatgt

SEQ ID NO: 11835 - DNA, 20 bp, Artificial Sequence
  chemically synthesized
aactccttttagaagccaat

SEQ ID NO: 11836 - DNA, 20 bp, Artificial Sequence
  chemically synthesized
atgagagtttaatagcagaa

SEQ ID NO: 11837 - DNA, 20 bp, Artificial Sequence
  chemically synthesized
atctctggctacaatggctg

SEQ ID NO: 11838 - DNA, 20 bp, Artificial Sequence
  chemically synthesized
ctttctccttagtattatct

SEQ ID NO: 11839 - DNA, 20 bp, Artificial Sequence
  chemically synthesized
ctcaccacttatatagaaga

SEQ ID NO: 11840 - DNA, 20 bp, Artificial Sequence
  chemically synthesized
acttatatagaagaaagggt

SEQ ID NO: 11841 - DNA, 20 bp, Artificial Sequence
  chemically synthesized
cttgctttatgtcctgcttt

SEQ ID NO: 11842 - DNA, 20 bp, Artificial Sequence
  chemically synthesized
ttcacagctgacatcatgtc

SEQ ID NO: 11843 - DNA, 20 bp, Artificial Sequence
  chemically synthesized
acagggccagtcagctttct

SEQ ID NO: 11844 - DNA, 20 bp, Artificial Sequence
  chemically synthesized
gtcagctttctgggggtgct

SEQ ID NO: 11845 - DNA, 20 bp, Artificial Sequence
  chemically synthesized
gaacatgctgtttgtccaaa

SEQ ID NO: 11846 - DNA, 20 bp, Artificial Sequence
  chemically synthesized
ttctcccctagggaactcaa

SEQ ID NO: 11847 - DNA, 20 bp, Artificial Sequence
  chemically synthesized
aatttttttaaaccaaggag

SEQ ID NO: 11848 - DNA, 20 bp, Artificial Sequence
  chemically synthesized
ggagatgaatgttttctaac

SEQ ID NO: 11849 - DNA, 20 bp, Artificial Sequence
  chemically synthesized
acaaacctgtacattcagca

SEQ ID NO: 11850 - DNA, 20 bp, Artificial Sequence
  chemically synthesized
agcgcgtgaacatgatcatg

SEQ ID NO: 11851 - DNA, 20 bp, Artificial Sequence
  chemically synthesized
agtatgcttgccttttagat

SEQ ID NO: 11852 - DNA, 20 bp, Artificial Sequence
  chemically synthesized
atttggtcatgtaattcctg

SEQ ID NO: 11853 - DNA, 20 bp, Artificial Sequence
  chemically synthesized
aaaattaaaagtgggaaaac

SEQ ID NO: 11854 - DNA, 20 bp, Artificial Sequence
  chemically synthesized
agtgggaaaacaaagaaata

SEQ ID NO: 11855 - DNA, 20 bp, Artificial Sequence
  chemically synthesized
actcagttgagttccctagg

SEQ ID NO: 11856 - DNA, 20 bp, Artificial Sequence
  chemically synthesized
ctaggggagaaaagcaagct

SEQ ID NO: 11857 - DNA, 20 bp, Artificial Sequence
  chemically synthesized
cccagaggaaggcatacagg

SEQ ID NO: 11858 - DNA, 20 bp, Artificial Sequence
  chemically synthesized
cacacttacttgtcaacttt

SEQ ID NO: 11859 - DNA, 20 bp, Artificial Sequence
  chemically synthesized
ggtgccaaccctaagcaccc

SEQ ID NO: 11860 - DNA, 20 bp, Artificial Sequence
  chemically synthesized
agtgagtaaagtcaagggat

SEQ ID NO: 11861 - DNA, 20 bp, Artificial Sequence
  chemically synthesized
gatgctggggaaaggataga

SEQ ID NO: 11862 - DNA, 20 bp, Artificial Sequence
  chemically synthesized
cgatccccagataatactaa

SEQ ID NO: 11863 - DNA, 20 bp, Artificial Sequence
  chemically synthesized
actaggtactaagggatcat

SEQ ID NO: 11864 - DNA, 20 bp, Artificial Sequence
  chemically synthesized
tggggaaacaattgatagag

SEQ ID NO: 11865 - DNA, 20 bp, Artificial Sequence
  chemically synthesized
gtttgatgtgattatggacc

SEQ ID NO: 11866 - DNA, 20 bp, Artificial Sequence
  chemically synthesized
agttagagcaaagcggggaa

SEQ ID NO: 11867 - DNA, 20 bp, Artificial Sequence
  chemically synthesized
aaaaagggagagatcaacaa

SEQ ID NO: 11868 - DNA, 20 bp, Artificial Sequence
  chemically synthesized
agaagttattaaagagctaa

SEQ ID NO: 11869 - DNA, 20 bp, Artificial Sequence
  chemically synthesized
attaaagagctaaagagaat

SEQ ID NO: 11870 - DNA, 20 bp, Artificial Sequence
  chemically synthesized
gaattgagaaatttaaaaca

SEQ ID NO: 11871 - DNA, 20 bp, Artificial Sequence
  chemically synthesized
ggccaacatgaaaggagtag

SEQ ID NO: 11872 - DNA, 20 bp, Artificial Sequence
  chemically synthesized
aactgcagatcaaaaatatt

SEQ ID NO: 11873 - DNA, 20 bp, Artificial Sequence
  chemically synthesized
ttacattgtattagctatta

SEQ ID NO: 11874 - DNA, 20 bp, Artificial Sequence
  chemically synthesized
tgcaaacgagtgaaggaaat

SEQ ID NO: 11875 - DNA, 20 bp, Artificial Sequence
  chemically synthesized
ctacttgggaggctgaggca

SEQ ID NO: 11876 - DNA, 20 bp, Artificial Sequence
  chemically synthesized
gtcaaaaaaaaaagagttga

SEQ ID NO: 11877 - DNA, 20 bp, Artificial Sequence
  chemically synthesized
aaaaagtctaggctaaattc

SEQ ID NO: 11878 - DNA, 20 bp, Artificial Sequence
  chemically synthesized
cagctgcaatgaaaataagg

SEQ ID NO: 11879 - DNA, 20 bp, Artificial Sequence
  chemically synthesized
aggaagtagtcccaaatacc

SEQ ID NO: 11880 - DNA, 20 bp, Artificial Sequence
  chemically synthesized
agatatattgctagaccctt

SEQ ID NO: 11881 - DNA, 20 bp, Artificial Sequence
  chemically synthesized
ttaacaatggggatatattc

SEQ ID NO: 11882 - DNA, 20 bp, Artificial Sequence
  chemically synthesized
tggtatttgtgtatctaaac

SEQ ID NO: 11883 - DNA, 20 bp, Artificial Sequence
  chemically synthesized
gagaggaaggagggagggaa

SEQ ID NO: 11884 - DNA, 20 bp, Artificial Sequence
  chemically synthesized
caaagtaaattcaaatatga

SEQ ID NO: 11885 - DNA, 20 bp, Artificial Sequence
  chemically synthesized
attttggctccatgccctaa

SEQ ID NO: 11886 - DNA, 20 bp, Artificial Sequence
  chemically synthesized
ttttcttttttgctaaaact

SEQ ID NO: 11887 - DNA, 20 bp, Artificial Sequence
  chemically synthesized
ttgttcaagggaaccttgag

SEQ ID NO: 11888 - DNA, 20 bp, Artificial Sequence
  chemically synthesized
accttgagagagaatgtatg

SEQ ID NO: 11889 - DNA, 20 bp, Artificial Sequence
  chemically synthesized
attatacctctttggccgat

SEQ ID NO: 11890 - DNA, 20 bp, Artificial Sequence
  chemically synthesized
tttgttggcgttttcatgat

SEQ ID NO: 11891 - DNA, 20 bp, Artificial Sequence
  chemically synthesized
tcaagaaaaactgaaatgta

SEQ ID NO: 11892 - DNA, 20 bp, Artificial Sequence
  chemically synthesized
aattctttagttttagcaaa

SEQ ID NO: 11893 - DNA, 20 bp, Artificial Sequence
  chemically synthesized
catgaaaattttacatctct

SEQ ID NO: 11894 - DNA, 20 bp, Artificial Sequence
  chemically synthesized
ttcaattttacttttagtca

SEQ ID NO: 11895 - DNA, 20 bp, Artificial Sequence
  chemically synthesized
ttgaatttactttggatgaa

SEQ ID NO: 11896 - DNA, 20 bp, Artificial Sequence
  chemically synthesized
tcaccctggctgggctgttt

SEQ ID NO: 11897 - DNA, 20 bp, Artificial Sequence
  chemically synthesized
agtgtctgtcactagatgtt

SEQ ID NO: 11898 - DNA, 20 bp, Artificial Sequence
  chemically synthesized
gcagtgatttaagcatctct

SEQ ID NO: 11899 - DNA, 20 bp, Artificial Sequence
  chemically synthesized
attgcttaatgacacatttc

SEQ ID NO: 11900 - DNA, 20 bp, Artificial Sequence
  chemically synthesized
ctgattaactccaaaaagga

SEQ ID NO: 11901 - DNA, 20 bp, Artificial Sequence
  chemically synthesized
aggaaagtaaaaaggaaagg

SEQ ID NO: 11902 - DNA, 20 bp, Artificial Sequence
  chemically synthesized
gttgagtgaaaaaacagact

SEQ ID NO: 11903 - DNA, 20 bp, Artificial Sequence
  chemically synthesized
agactttagaatcagatcag

SEQ ID NO: 11904 - DNA, 20 bp, Artificial Sequence
  chemically synthesized
taggtttaacagtagtataa

SEQ ID NO: 11905 - DNA, 20 bp, Artificial Sequence
  chemically synthesized
gtcacaatcaggaatgacct

SEQ ID NO: 11906 - DNA, 20 bp, Artificial Sequence
  chemically synthesized
tgcattaatactgtctatcc

SEQ ID NO: 11907 - DNA, 20 bp, Artificial Sequence
  chemically synthesized
tatctctggctacaatggct

SEQ ID NO: 11908 - DNA, 20 bp, Artificial Sequence
  chemically synthesized
atcatctcaccacttatata

SEQ ID NO: 11909 - DNA, 20 bp, Artificial Sequence
  chemically synthesized
gtcagctactagatttgatt

SEQ ID NO: 11910 - DNA, 20 bp, Artificial Sequence
  chemically synthesized
ttagttttaaaaatgaagaa

SEQ ID NO: 11911 - DNA, 20 bp, Artificial Sequence
  chemically synthesized
gttttcttcttcttcatttt

SEQ ID NO: 11912 - DNA, 20 bp, Artificial Sequence
  chemically synthesized
tggtcatgtaattcctgtta

SEQ ID NO: 11913 - DNA, 20 bp, Artificial Sequence
  chemically synthesized
tttaaaaaaattaaaagtgg

SEQ ID NO: 11914 - DNA, 20 bp, Artificial Sequence
  chemically synthesized
cttcaatttaaagttttagt

SEQ ID NO: 11915 - DNA, 20 bp, Artificial Sequence
  chemically synthesized
gggataaagaaaatttgttg

SEQ ID NO: 11916 - DNA, 20 bp, Artificial Sequence
  chemically synthesized
acagtttggaattttgaaat

SEQ ID NO: 11917 - DNA, 20 bp, Artificial Sequence
  chemically synthesized
ttgaaattaaaacagttctg

SEQ ID NO: 11918 - DNA, 20 bp, Artificial Sequence
  chemically synthesized
ctaaagagaattgagaaatt

SEQ ID NO: 11919 - DNA, 20 bp, Artificial Sequence
  chemically synthesized
acacatatatgtatatacat

SEQ ID NO: 11920 - DNA, 20 bp, Artificial Sequence
  chemically synthesized
ctaggtagatgtagcttaaa

SEQ ID NO: 11921 - DNA, 20 bp, Artificial Sequence
  chemically synthesized
catttgggcaaccatattct

SEQ ID NO: 11922 - DNA, 20 bp, Artificial Sequence
  chemically synthesized
gctttcagattatttggatt

SEQ ID NO: 11923 - DNA, 20 bp, Artificial Sequence
  chemically synthesized
catgatgttttcttttttgc

SEQ ID NO: 11924 - DNA, 20 bp, Artificial Sequence
  chemically synthesized
tttcagtttttcttgatcat

SEQ ID NO: 11925 - DNA, 20 bp, Artificial Sequence
  chemically synthesized
aagaagcacgagaagttttt

SEQ ID NO: 11926 - DNA, 20 bp, Artificial Sequence
  chemically synthesized
aaaaacttctcgtgcttctt

SEQ ID NO: 11927 - DNA, 20 bp, Artificial Sequence
  chemically synthesized
ttggcgttttcatgatcaag

SEQ ID NO: 11928 - DNA, 20 bp, Artificial Sequence
  chemically synthesized
tctttagttttagcaaaaaa

SEQ ID NO: 11929 - DNA, 20 bp, Artificial Sequence
  chemically synthesized
tgtacagtgtggttgagtga

SEQ ID NO: 11930 - DNA, 20 bp, Artificial Sequence
  chemically synthesized
ctttgcccaaggtaacatac

SEQ ID NO: 11931 - DNA, 20 bp, Artificial Sequence
  chemically synthesized
atagtccatatggaaccata

SEQ ID NO: 11932 - DNA, 20 bp, Artificial Sequence
  chemically synthesized
tctttgatgcatacacttta

SEQ ID NO: 11933 - DNA, 20 bp, Artificial Sequence
  chemically synthesized
taaagtcactgtagttgtga

SEQ ID NO: 11934 - DNA, 20 bp, Artificial Sequence
  chemically synthesized
gttaatctttatgttttaac

SEQ ID NO: 11935 - DNA, 20 bp, Artificial Sequence
  chemically synthesized
gttttaaaaatgaagaagaa

SEQ ID NO: 11936 - DNA, 20 bp, Artificial Sequence
  chemically synthesized
atctactcagtgctgaatgt

SEQ ID NO: 11937 - DNA, 20 bp, Artificial Sequence
  chemically synthesized
actcagtgctgaatgtacag

SEQ ID NO: 11938 - DNA, 20 bp, Artificial Sequence
  chemically synthesized
ccttttttaaaatacattga

SEQ ID NO: 11939 - DNA, 20 bp, Artificial Sequence
  chemically synthesized
atgctgtcttcttcactaaa

SEQ ID NO: 11940 - DNA, 20 bp, Artificial Sequence
  chemically synthesized
ttcttcactaaattttgatt

SEQ ID NO: 11941 - DNA, 20 bp, Artificial Sequence
  chemically synthesized
aagtactggttctttgttag

SEQ ID NO: 11942 - DNA, 20 bp, Artificial Sequence
  chemically synthesized
tttaaaactaaatagatcga

SEQ ID NO: 11943 - DNA, 20 bp, Artificial Sequence
  chemically synthesized
cgacaatgcttatgatgcat

SEQ ID NO: 11944 - DNA, 20 bp, Artificial Sequence
  chemically synthesized
tttaataaacactgttcagt

SEQ ID NO: 11945 - DNA, 20 bp, Artificial Sequence
  chemically synthesized
tgttagaaaacattcatctc

SEQ ID NO: 11946 - DNA, 20 bp, Artificial Sequence
  chemically synthesized
aaaaaaaataaccacattat

SEQ ID NO: 11947 - DNA, 20 bp, Artificial Sequence
  chemically synthesized
tggccttatttacacaaaaa

SEQ ID NO: 11948 - DNA, 20 bp, Artificial Sequence
  chemically synthesized
ttttaagatatatgacattt

SEQ ID NO: 11949 - DNA, 20 bp, Artificial Sequence
  chemically synthesized
taaattatatatcttcaatt

SEQ ID NO: 11950 - DNA, 20 bp, Artificial Sequence
  chemically synthesized
ttaaagttttagttaaaaca

SEQ ID NO: 11951 - DNA, 20 bp, Artificial Sequence
  chemically synthesized
agcaagctgttagttatcac

SEQ ID NO: 11952 - DNA, 20 bp, Artificial Sequence
  chemically synthesized
tagttatcaccaaagctttt

SEQ ID NO: 11953 - DNA, 20 bp, Artificial Sequence
  chemically synthesized
gagttccctaggggagaaaa

SEQ ID NO: 11954 - DNA, 20 bp, Artificial Sequence
  chemically synthesized
agctaatgcaacatatatca

SEQ ID NO: 11955 - DNA, 20 bp, Artificial Sequence
  chemically synthesized
tgagatgatgaaggttgtaa

SEQ ID NO: 11956 - DNA, 20 bp, Artificial Sequence
  chemically synthesized
tagataagaataaggatgaa

SEQ ID NO: 11957 - DNA, 20 bp, Artificial Sequence
  chemically synthesized
taatactaaggagaaaggca

SEQ ID NO: 11958 - DNA, 20 bp, Artificial Sequence
  chemically synthesized
tcttctgctattaaactctc

SEQ ID NO: 11959 - DNA, 20 bp, Artificial Sequence
  chemically synthesized
aactctcattggcttctaaa

SEQ ID NO: 11960 - DNA, 20 bp, Artificial Sequence
  chemically synthesized
cttctaaaaggagtttcggt

SEQ ID NO: 11961 - DNA, 20 bp, Artificial Sequence
  chemically synthesized
ctgcctttaggtattattgc

SEQ ID NO: 11962 - DNA, 20 bp, Artificial Sequence
  chemically synthesized
aattaaaacagttctgtaaa

SEQ ID NO: 11963 - DNA, 20 bp, Artificial Sequence
  chemically synthesized
aaacagttctgtaaaaccag

SEQ ID NO: 11964 - DNA, 20 bp, Artificial Sequence
  chemically synthesized
aagcagcatgaggccaggtg

SEQ ID NO: 11965 - DNA, 20 bp, Artificial Sequence
  chemically synthesized
gaggatcactcgtgcaaaga

SEQ ID NO: 11966 - DNA, 20 bp, Artificial Sequence
  chemically synthesized
gcaagaacgtgaggtatttc

SEQ ID NO: 11967 - DNA, 20 bp, Artificial Sequence
  chemically synthesized
ataatgaagtcattaaccta

SEQ ID NO: 11968 - DNA, 20 bp, Artificial Sequence
  chemically synthesized
acataaggagtaccactgat

SEQ ID NO: 11969 - DNA, 20 bp, Artificial Sequence
  chemically synthesized
tggctagagtcttggggact

SEQ ID NO: 11970 - DNA, 20 bp, Artificial Sequence
  chemically synthesized
tcttggggactttgtgtttg

SEQ ID NO: 11971 - DNA, 20 bp, Artificial Sequence
  chemically synthesized
actgccagagtctgaatcct

SEQ ID NO: 11972 - DNA, 20 bp, Artificial Sequence
  chemically synthesized
taaatattgtgccctacatg

SEQ ID NO: 11973 - DNA, 20 bp, Artificial Sequence
  chemically synthesized
caaagcggggaaccagaata

SEQ ID NO: 11974 - DNA, 20 bp, Artificial Sequence
  chemically synthesized
aatagagtgattattataaa

SEQ ID NO: 11975 - DNA, 20 bp, Artificial Sequence
  chemically synthesized
aaaattattctttaggtcat

SEQ ID NO: 11976 - DNA, 20 bp, Artificial Sequence
  chemically synthesized
atagtcatttcattatataa

SEQ ID NO: 11977 - DNA, 20 bp, Artificial Sequence
  chemically synthesized
catttgacaaagttaaggtt

SEQ ID NO: 11978 - DNA, 20 bp, Artificial Sequence
  chemically synthesized
caggtctagaggaggcagat

SEQ ID NO: 11979 - DNA, 20 bp, Artificial Sequence
  chemically synthesized
ttcaaacctatttctgtctg

SEQ ID NO: 11980 - DNA, 20 bp, Artificial Sequence
  chemically synthesized
ctgtctgatctgattctaaa

SEQ ID NO: 11981 - DNA, 20 bp, Artificial Sequence
  chemically synthesized
ctccttgtgagttccacagc

SEQ ID NO: 11982 - DNA, 20 bp, Artificial Sequence
  chemically synthesized
agctattaagagaaacctag

SEQ ID NO: 11983 - DNA, 20 bp, Artificial Sequence
  chemically synthesized
gatttaaagtacaaaggagg

SEQ ID NO: 11984 - DNA, 20 bp, Artificial Sequence
  chemically synthesized
ggtggcatccatctgcattt

SEQ ID NO: 11985 - DNA, 20 bp, Artificial Sequence
  chemically synthesized
tggctgctccaatttagggg

SEQ ID NO: 11986 - DNA, 20 bp, Artificial Sequence
  chemically synthesized
acaaggtgaaatggtgaaac

SEQ ID NO: 11987 - DNA, 20 bp, Artificial Sequence
  chemically synthesized
ttgggaggctgaggcaggag

SEQ ID NO: 11988 - DNA, 20 bp, Artificial Sequence
  chemically synthesized
ctgcaatgaaaataagggaa

SEQ ID NO: 11989 - DNA, 20 bp, Artificial Sequence
  chemically synthesized
gggaagaaagtttagttcat

SEQ ID NO: 11990 - DNA, 20 bp, Artificial Sequence
  chemically synthesized
acttacctaaacctaaatgg

SEQ ID NO: 11991 - DNA, 20 bp, Artificial Sequence
  chemically synthesized
ccaaaatgtcattgtgcagc

SEQ ID NO: 11992 - DNA, 20 bp, Artificial Sequence
  chemically synthesized
aaggagggagggaaggagaa

SEQ ID NO: 11993 - DNA, 20 bp, Artificial Sequence
  chemically synthesized
gtctcttcagactaggtaga

SEQ ID NO: 11994 - DNA, 20 bp, Artificial Sequence
  chemically synthesized
acatatcctgaattctagag

SEQ ID NO: 11995 - DNA, 20 bp, Artificial Sequence
  chemically synthesized
caaaggtgctgttgatctga

SEQ ID NO: 11996 - DNA, 20 bp, Artificial Sequence
  chemically synthesized
attgcttttttaaattaatg

SEQ ID NO: 11997 - DNA, 20 bp, Artificial Sequence
  chemically synthesized
catttgcagctggaccataa

SEQ ID NO: 11998 - DNA, 20 bp, Artificial Sequence
  chemically synthesized
ttcatccaaagtaaattcaa

SEQ ID NO: 11999 - DNA, 20 bp, Artificial Sequence
  chemically synthesized
atacagtactgtgggaacat

SEQ ID NO: 12000 - DNA, 20 bp, Artificial Sequence
  chemically synthesized
gctccatgccctaaagagaa

SEQ ID NO: 12001 - DNA, 20 bp, Artificial Sequence
  chemically synthesized
gccctaaagagaaattggct

SEQ ID NO: 12002 - DNA, 20 bp, Artificial Sequence
  chemically synthesized
agaaattggctttcagatta

SEQ ID NO: 12003 - DNA, 20 bp, Artificial Sequence
  chemically synthesized
taagagatgtaaaattttca

SEQ ID NO: 12004 - DNA, 20 bp, Artificial Sequence
  chemically synthesized
aaagaattattcttttacat

SEQ ID NO: 12005 - DNA, 20 bp, Artificial Sequence
  chemically synthesized
gtataattcaggtaaattgg

SEQ ID NO: 12006 - DNA, 20 bp, Artificial Sequence
  chemically synthesized
gagaatgtatggaagaaaag

SEQ ID NO: 12007 - DNA, 20 bp, Artificial Sequence
  chemically synthesized
tgtagttttgaagaagcacg

SEQ ID NO: 12008 - DNA, 20 bp, Artificial Sequence
  chemically synthesized
tcagtgttttcaaaaacttc

SEQ ID NO: 12009 - DNA, 20 bp, Artificial Sequence
  chemically synthesized
tacctgaattatacctcttt

SEQ ID NO: 12010 - DNA, 20 bp, Artificial Sequence
  chemically synthesized
tggccgattcagaattttgt

SEQ ID NO: 12011 - DNA, 20 bp, Artificial Sequence
  chemically synthesized
gaaatgtaaaagaataattc

SEQ ID NO: 12012 - DNA, 20 bp, Artificial Sequence
  chemically synthesized
tttacatctcttaagaaagt

SEQ ID NO: 12013 - DNA, 20 bp, Artificial Sequence
  chemically synthesized
cccacagtactgtatacaca

SEQ ID NO: 12014 - DNA, 20 bp, Artificial Sequence
  chemically synthesized
gagaattccagtaataaaag

SEQ ID NO: 12015 - DNA, 20 bp, Artificial Sequence
  chemically synthesized
gtgatccatcaccctggctg

SEQ ID NO: 12016 - DNA, 20 bp, Artificial Sequence
  chemically synthesized
ggcaagtgttataggaattg

SEQ ID NO: 12017 - DNA, 20 bp, Artificial Sequence
  chemically synthesized
gcatctctctagaattcagg

SEQ ID NO: 12018 - DNA, 20 bp, Artificial Sequence
  chemically synthesized
gtattttcactgtacctttt

SEQ ID NO: 12019 - DNA, 20 bp, Artificial Sequence
  chemically synthesized
tcagtacagtcacatgctgt

SEQ ID NO: 12020 - DNA, 20 bp, Artificial Sequence
  chemically synthesized
tatgtagtaagctataccat

SEQ ID NO: 12021 - DNA, 20 bp, Artificial Sequence
  chemically synthesized
ttatgttcgcacaatgatga

SEQ ID NO: 12022 - DNA, 20 bp, Artificial Sequence
  chemically synthesized
gcatggctgtatacacacac

SEQ ID NO: 12023 - DNA, 20 bp, Artificial Sequence
  chemically synthesized
gtatacacacacatgtgttt

SEQ ID NO: 12024 - DNA, 20 bp, Artificial Sequence
  chemically synthesized
gataccatctcaagaggacc

SEQ ID NO: 12025 - DNA, 20 bp, Artificial Sequence
  chemically synthesized
ctggggtatttgggactact

SEQ ID NO: 12026 - DNA, 20 bp, Artificial Sequence
  chemically synthesized
gtgttctagtcccttgacat

SEQ ID NO: 12027 - DNA, 20 bp, Artificial Sequence
  chemically synthesized
tgcctcagcctcccaagtag

SEQ ID NO: 12028 - DNA, 20 bp, Artificial Sequence
  chemically synthesized
ttttgtatttttagtaaagc

SEQ ID NO: 12029 - DNA, 20 bp, Artificial Sequence
  chemically synthesized
tgcctgggcctctgaaagtg

SEQ ID NO: 12030 - DNA, 20 bp, Artificial Sequence
  chemically synthesized
catatttctcaatttccttc

SEQ ID NO: 12031 - DNA, 20 bp, Artificial Sequence
  chemically synthesized
gctcaagtctccgatataaa

SEQ ID NO: 12032 - DNA, 20 bp, Artificial Sequence
  chemically synthesized
ctttgtactttaaatcatct

SEQ ID NO: 12033 - DNA, 20 bp, Artificial Sequence
  chemically synthesized
tgtaaatagttgttatgctg

SEQ ID NO: 12034 - DNA, 20 bp, Artificial Sequence
  chemically synthesized
tagaatcagatcagacagaa

SEQ ID NO: 12035 - DNA, 20 bp, Artificial Sequence
  chemically synthesized
ttaactttgtcaaatgtaaa

SEQ ID NO: 12036 - DNA, 20 bp, Artificial Sequence
  chemically synthesized
ttcatgttggccctactttc

SEQ ID NO: 12037 - DNA, 20 bp, Artificial Sequence
  chemically synthesized
gaatgacctaaagaataatt

SEQ ID NO: 12038 - DNA, 20 bp, Artificial Sequence
  chemically synthesized
ataatcactctattctggtt

SEQ ID NO: 12039 - DNA, 20 bp, Artificial Sequence
  chemically synthesized
tgttatccatccagcacttg

SEQ ID NO: 12040 - DNA, 20 bp, Artificial Sequence
  chemically synthesized
gggttctcccaggctccagc

SEQ ID NO: 12041 - DNA, 20 bp, Artificial Sequence
  chemically synthesized
gtatatttatgccctacagg

SEQ ID NO: 12042 - DNA, 20 bp, Artificial Sequence
  chemically synthesized
cccacacacgtggctgtaac

SEQ ID NO: 12043 - DNA, 20 bp, Artificial Sequence
  chemically synthesized
gtcagatacgtctcctgaat

SEQ ID NO: 12044 - DNA, 20 bp, Artificial Sequence
  chemically synthesized
agtaatagctaatgtatatg

SEQ ID NO: 12045 - DNA, 20 bp, Artificial Sequence
  chemically synthesized
ttatttttatgaatgaggaa

SEQ ID NO: 12046 - DNA, 20 bp, Artificial Sequence
  chemically synthesized
aagatagattcatagaggct

SEQ ID NO: 12047 - DNA, 20 bp, Artificial Sequence
  chemically synthesized
aaggtaacatactaaaacat

SEQ ID NO: 12048 - DNA, 20 bp, Artificial Sequence
  chemically synthesized
tcagccatcagtggtactcc

SEQ ID NO: 12049 - DNA, 20 bp, Artificial Sequence
  chemically synthesized
ttatctgatgaccagctctg

SEQ ID NO: 12050 - DNA, 20 bp, Artificial Sequence
  chemically synthesized
gaaaatattctctctctatc

SEQ ID NO: 12051 - DNA, 20 bp, Artificial Sequence
  chemically synthesized
aaacctctcacctggcctca

SEQ ID NO: 12052 - DNA, 20 bp, Artificial Sequence
  chemically synthesized
gctttagatcaaagagggag

SEQ ID NO: 12053 - DNA, 20 bp, Artificial Sequence
  chemically synthesized
catacactttacaaaactaa

SEQ ID NO: 12054 - DNA, 20 bp, Artificial Sequence
  chemically synthesized
aaactaaactggttttacag

SEQ ID NO: 12055 - DNA, 20 bp, Artificial Sequence
  chemically synthesized
aactccttttagaagccaat

SEQ ID NO: 12056 - DNA, 20 bp, Artificial Sequence
  chemically synthesized
attcccctggccccttcctc

SEQ ID NO: 12057 - DNA, 20 bp, Artificial Sequence
  chemically synthesized
atcgtatacttaacttccct

SEQ ID NO: 12058 - DNA, 20 bp, Artificial Sequence
  chemically synthesized
ctcaccacttatatagaaga

SEQ ID NO: 12059 - DNA, 20 bp, Artificial Sequence
  chemically synthesized
ttatatagaagaaagggttt

SEQ ID NO: 12060 - DNA, 20 bp, Artificial Sequence
  chemically synthesized
taatgagatatatctaatgg

SEQ ID NO: 12061 - DNA, 20 bp, Artificial Sequence
  chemically synthesized
tctaatggccttgctttatg

SEQ ID NO: 12062 - DNA, 20 bp, Artificial Sequence
  chemically synthesized
cttgctttatgtcctgcttt

SEQ ID NO: 12063 - DNA, 20 bp, Artificial Sequence
  chemically synthesized
cccttgactttactcacttt

SEQ ID NO: 12064 - DNA, 20 bp, Artificial Sequence
  chemically synthesized
atcgttatttcagcatttca

SEQ ID NO: 12065 - DNA, 20 bp, Artificial Sequence
  chemically synthesized
gagtgggaaccacagggcca

SEQ ID NO: 12066 - DNA, 20 bp, Artificial Sequence
  chemically synthesized
agggccagtcagctttctgg

SEQ ID NO: 12067 - DNA, 20 bp, Artificial Sequence
  chemically synthesized
tgatcctggtactgtcagct

SEQ ID NO: 12068 - DNA, 20 bp, Artificial Sequence
  chemically synthesized
ctggtactgtcagctactag

SEQ ID NO: 12069 - DNA, 20 bp, Artificial Sequence
  chemically synthesized
agttgacaagtaagtgtgat

SEQ ID NO: 12070 - DNA, 20 bp, Artificial Sequence
  chemically synthesized
aaatgcttcctgtgagaaca

SEQ ID NO: 12071 - DNA, 20 bp, Artificial Sequence
  chemically synthesized
cctactctttatgtcaattc

SEQ ID NO: 12072 - DNA, 20 bp, Artificial Sequence
  chemically synthesized
ctctttatgtcaattcttaa

SEQ ID NO: 12073 - DNA, 20 bp, Artificial Sequence
  chemically synthesized
ctagggaactcaactgagta

SEQ ID NO: 12074 - DNA, 20 bp, Artificial Sequence
  chemically synthesized
ttccccaaatatcaactcca

SEQ ID NO: 12075 - DNA, 20 bp, Artificial Sequence
  chemically synthesized
agatgtttgacatagagaca

SEQ ID NO: 12076 - DNA, 20 bp, Artificial Sequence
  chemically synthesized
tgattttttcctaatccatg

SEQ ID NO: 12077 - DNA, 20 bp, Artificial Sequence
  chemically synthesized
gaaaagctttggtgataact

SEQ ID NO: 12078 - DNA, 20 bp, Artificial Sequence
  chemically synthesized
tgctaatgaaaggttaatct

SEQ ID NO: 12079 - DNA, 20 bp, Artificial Sequence
  chemically synthesized
actttttgtgtaaataaggc

SEQ ID NO: 12080 - DNA, 20 bp, Artificial Sequence
  chemically synthesized
tgtgtaaataaggccattgt

SEQ ID NO: 12081 - DNA, 20 bp, Artificial Sequence
  chemically synthesized
aataaggccattgtttgtgc

SEQ ID NO: 12082 - DNA, 20 bp, Artificial Sequence
  chemically synthesized
gtttgtgcttttgtttccca

SEQ ID NO: 12083 - DNA, 20 bp, Artificial Sequence
  chemically synthesized
ttcactatattctgctattt

SEQ ID NO: 12084 - DNA, 20 bp, Artificial Sequence
  chemically synthesized
tttttttaaaccaaggagat

SEQ ID NO: 12085 - DNA, 20 bp, Artificial Sequence
  chemically synthesized
tgaccaaatcatgaactgaa

SEQ ID NO: 12086 - DNA, 20 bp, Artificial Sequence
  chemically synthesized
tcataagcattgtcgatcta

SEQ ID NO: 12087 - DNA, 20 bp, Artificial Sequence
  chemically synthesized
aggcagatggtgatgaggcc

SEQ ID NO: 12088 - DNA, 20 bp, Artificial Sequence
  chemically synthesized
cgcgctgcataacctttgct

SEQ ID NO: 12089 - DNA, 22 bp, Artificial Sequence
  chemically synthesized
tcacaatctgctagcaaaggtt

SEQ ID NO: 12090 - DNA, 22 bp, Artificial Sequence
  chemically synthesized
cacaatctgctagcaaaggtta

SEQ ID NO: 12091 - DNA, 22 bp, Artificial Sequence
  chemically synthesized
acaatctgctagcaaaggttat

SEQ ID NO: 12092 - DNA, 22 bp, Artificial Sequence
  chemically synthesized
ctagcaaaggttatgcagcgcg

SEQ ID NO: 12093 - DNA, 22 bp, Artificial Sequence
  chemically synthesized
gcaaaggttatgcagcgcgtga

SEQ ID NO: 12094 - DNA, 22 bp, Artificial Sequence
  chemically synthesized
tgcagcgcgtgaacatgatcat

SEQ ID NO: 12095 - DNA, 22 bp, Artificial Sequence
  chemically synthesized
atcaccatctgccttttaggat

SEQ ID NO: 12096 - DNA, 22 bp, Artificial Sequence
  chemically synthesized
ccttttaggatatctactcagt

SEQ ID NO: 12097 - DNA, 22 bp, Artificial Sequence
  chemically synthesized
ttaggatatctactcagtgctg

SEQ ID NO: 12098 - DNA, 22 bp, Artificial Sequence
  chemically synthesized
taggatatctactcagtgctga

SEQ ID NO: 12099 - DNA, 22 bp, Artificial Sequence
  chemically synthesized
aggatatctactcagtgctgaa

SEQ ID NO: 12100 - DNA, 22 bp, Artificial Sequence
  chemically synthesized
ggatatctactcagtgctgaat

SEQ ID NO: 12101 - DNA, 22 bp, Artificial Sequence
  chemically synthesized
ctcagtgctgaatgtacaggtt

SEQ ID NO: 12102 - DNA, 22 bp, Artificial Sequence
  chemically synthesized
agtgctgaatgtacaggtttgt

SEQ ID NO: 12103 - DNA, 22 bp, Artificial Sequence
  chemically synthesized
aatgtacaggtttgtttccttt

SEQ ID NO: 12104 - DNA, 22 bp, Artificial Sequence
  chemically synthesized
gtttccttttttaaaatacatt

SEQ ID NO: 12105 - DNA, 22 bp, Artificial Sequence
  chemically synthesized
tttccttttttaaaatacattg

SEQ ID NO: 12106 - DNA, 22 bp, Artificial Sequence
  chemically synthesized
ccttttttaaaatacattgagt

SEQ ID NO: 12107 - DNA, 22 bp, Artificial Sequence
  chemically synthesized
cttttttaaaatacattgagta

SEQ ID NO: 12108 - DNA, 22 bp, Artificial Sequence
  chemically synthesized
ttttaaaatacattgagtatgc

SEQ ID NO: 12109 - DNA, 22 bp, Artificial Sequence
  chemically synthesized
tttaaaatacattgagtatgct

SEQ ID NO: 12110 - DNA, 22 bp, Artificial Sequence
  chemically synthesized
ttaaaatacattgagtatgctt

SEQ ID NO: 12111 - DNA, 22 bp, Artificial Sequence
  chemically synthesized
taaaatacattgagtatgcttg

SEQ ID NO: 12112 - DNA, 22 bp, Artificial Sequence
  chemically synthesized
aaaatacattgagtatgcttgc

SEQ ID NO: 12113 - DNA, 22 bp, Artificial Sequence
  chemically synthesized
aaatacattgagtatgcttgcc

SEQ ID NO: 12114 - DNA, 22 bp, Artificial Sequence
  chemically synthesized
agtatgcttgccttttagatat

SEQ ID NO: 12115 - DNA, 22 bp, Artificial Sequence
  chemically synthesized
gccttttagatatagaaatatc

SEQ ID NO: 12116 - DNA, 22 bp, Artificial Sequence
  chemically synthesized
ccttttagatatagaaatatct

SEQ ID NO: 12117 - DNA, 22 bp, Artificial Sequence
  chemically synthesized
ttagatatagaaatatctgatg

SEQ ID NO: 12118 - DNA, 22 bp, Artificial Sequence
  chemically synthesized
tagatatagaaatatctgatgc

SEQ ID NO: 12119 - DNA, 22 bp, Artificial Sequence
  chemically synthesized
agatatagaaatatctgatgct

SEQ ID NO: 12120 - DNA, 22 bp, Artificial Sequence
  chemically synthesized
gatatagaaatatctgatgctg

SEQ ID NO: 12121 - DNA, 22 bp, Artificial Sequence
  chemically synthesized
atgctgtcttcttcactaaatt

SEQ ID NO: 12122 - DNA, 22 bp, Artificial Sequence
  chemically synthesized
tcttcttcactaaattttgatt

SEQ ID NO: 12123 - DNA, 22 bp, Artificial Sequence
  chemically synthesized
cttcactaaattttgattacat

SEQ ID NO: 12124 - DNA, 22 bp, Artificial Sequence
  chemically synthesized
ttcactaaattttgattacatg

SEQ ID NO: 12125 - DNA, 22 bp, Artificial Sequence
  chemically synthesized
cactaaattttgattacatgat

SEQ ID NO: 12126 - DNA, 22 bp, Artificial Sequence
  chemically synthesized
actaaattttgattacatgatt

SEQ ID NO: 12127 - DNA, 22 bp, Artificial Sequence
  chemically synthesized
aattttgattacatgatttgac

SEQ ID NO: 12128 - DNA, 22 bp, Artificial Sequence
  chemically synthesized
tgattacatgatttgacagcaa

SEQ ID NO: 12129 - DNA, 22 bp, Artificial Sequence
  chemically synthesized
gattacatgatttgacagcaat

SEQ ID NO: 12130 - DNA, 22 bp, Artificial Sequence
  chemically synthesized
attacatgatttgacagcaata

SEQ ID NO: 12131 - DNA, 22 bp, Artificial Sequence
  chemically synthesized
catgatttgacagcaatattga

SEQ ID NO: 12132 - DNA, 22 bp, Artificial Sequence
  chemically synthesized
gacagcaatattgaagagtcta

SEQ ID NO: 12133 - DNA, 22 bp, Artificial Sequence
  chemically synthesized
acagcaatattgaagagtctaa

SEQ ID NO: 12134 - DNA, 22 bp, Artificial Sequence
  chemically synthesized
aagagtctaacagccagcacgc

SEQ ID NO: 12135 - DNA, 22 bp, Artificial Sequence
  chemically synthesized
acagccagcacgcaggttggta

SEQ ID NO: 12136 - DNA, 22 bp, Artificial Sequence
  chemically synthesized
gtaagtactggttctttgttag

SEQ ID NO: 12137 - DNA, 22 bp, Artificial Sequence
  chemically synthesized
gttctttgttagctaggttttc

SEQ ID NO: 12138 - DNA, 22 bp, Artificial Sequence
  chemically synthesized
tttgttagctaggttttcttct

SEQ ID NO: 12139 - DNA, 22 bp, Artificial Sequence
  chemically synthesized
tgttagctaggttttcttcttc

SEQ ID NO: 12140 - DNA, 22 bp, Artificial Sequence
  chemically synthesized
gttagctaggttttcttcttct

SEQ ID NO: 12141 - DNA, 22 bp, Artificial Sequence
  chemically synthesized
ttagctaggttttcttcttctt

SEQ ID NO: 12142 - DNA, 22 bp, Artificial Sequence
  chemically synthesized
gctaggttttcttcttcttcat

SEQ ID NO: 12143 - DNA, 22 bp, Artificial Sequence
  chemically synthesized
ggttttcttcttcttcattttt

SEQ ID NO: 12144 - DNA, 22 bp, Artificial Sequence
  chemically synthesized
tcttcttcttcatttttaaaac

SEQ ID NO: 12145 - DNA, 22 bp, Artificial Sequence
  chemically synthesized
cttcttcttcatttttaaaact

SEQ ID NO: 12146 - DNA, 22 bp, Artificial Sequence
  chemically synthesized
ttcttcttcatttttaaaacta

SEQ ID NO: 12147 - DNA, 22 bp, Artificial Sequence
  chemically synthesized
cttcttcatttttaaaactaaa

SEQ ID NO: 12148 - DNA, 22 bp, Artificial Sequence
  chemically synthesized
ttcttcatttttaaaactaaat

SEQ ID NO: 12149 - DNA, 22 bp, Artificial Sequence
  chemically synthesized
cttcatttttaaaactaaatag

SEQ ID NO: 12150 - DNA, 22 bp, Artificial Sequence
  chemically synthesized
ttcatttttaaaactaaataga

SEQ ID NO: 12151 - DNA, 22 bp, Artificial Sequence
  chemically synthesized
catttttaaaactaaatagatc

SEQ ID NO: 12152 - DNA, 22 bp, Artificial Sequence
  chemically synthesized
atttttaaaactaaatagatcg

SEQ ID NO: 12153 - DNA, 22 bp, Artificial Sequence
  chemically synthesized
ttaaaactaaatagatcgacaa

SEQ ID NO: 12154 - DNA, 22 bp, Artificial Sequence
  chemically synthesized
taaaactaaatagatcgacaat

SEQ ID NO: 12155 - DNA, 22 bp, Artificial Sequence
  chemically synthesized
aaaactaaatagatcgacaatg

SEQ ID NO: 12156 - DNA, 22 bp, Artificial Sequence
  chemically synthesized
aaactaaatagatcgacaatgc

SEQ ID NO: 12157 - DNA, 22 bp, Artificial Sequence
  chemically synthesized
aatagatcgacaatgcttatga

SEQ ID NO: 12158 - DNA, 22 bp, Artificial Sequence
  chemically synthesized
atgatgcatttatgtttaataa

SEQ ID NO: 12159 - DNA, 22 bp, Artificial Sequence
  chemically synthesized
tgatgcatttatgtttaataaa

SEQ ID NO: 12160 - DNA, 22 bp, Artificial Sequence
  chemically synthesized
atgtttaataaacactgttcag

SEQ ID NO: 12161 - DNA, 22 bp, Artificial Sequence
  chemically synthesized
tgtttaataaacactgttcagt

SEQ ID NO: 12162 - DNA, 22 bp, Artificial Sequence
  chemically synthesized
aataaacactgttcagttcatg

SEQ ID NO: 12163 - DNA, 22 bp, Artificial Sequence
  chemically synthesized
ataaacactgttcagttcatga

SEQ ID NO: 12164 - DNA, 22 bp, Artificial Sequence
  chemically synthesized
ttcagttcatgatttggtcatg

SEQ ID NO: 12165 - DNA, 22 bp, Artificial Sequence
  chemically synthesized
agttcatgatttggtcatgtaa

SEQ ID NO: 12166 - DNA, 22 bp, Artificial Sequence
  chemically synthesized
atgatttggtcatgtaattcct

SEQ ID NO: 12167 - DNA, 22 bp, Artificial Sequence
  chemically synthesized
ggtcatgtaattcctgttagaa

SEQ ID NO: 12168 - DNA, 22 bp, Artificial Sequence
  chemically synthesized
gtcatgtaattcctgttagaaa

SEQ ID NO: 12169 - DNA, 22 bp, Artificial Sequence
  chemically synthesized
ctgttagaaaacattcatctcc

SEQ ID NO: 12170 - DNA, 22 bp, Artificial Sequence
  chemically synthesized
ttagaaaacattcatctccttg

SEQ ID NO: 12171 - DNA, 22 bp, Artificial Sequence
  chemically synthesized
gaaaacattcatctccttggtt

SEQ ID NO: 12172 - DNA, 22 bp, Artificial Sequence
  chemically synthesized
atctccttggtttaaaaaaatt

SEQ ID NO: 12173 - DNA, 22 bp, Artificial Sequence
  chemically synthesized
cttggtttaaaaaaattaaaag

SEQ ID NO: 12174 - DNA, 22 bp, Artificial Sequence
  chemically synthesized
ggtttaaaaaaattaaaagtgg

SEQ ID NO: 12175 - DNA, 22 bp, Artificial Sequence
  chemically synthesized
gtttaaaaaaattaaaagtggg

SEQ ID NO: 12176 - DNA, 22 bp, Artificial Sequence
  chemically synthesized
aaaaaaattaaaagtgggaaaa

SEQ ID NO: 12177 - DNA, 22 bp, Artificial Sequence
  chemically synthesized
aaaaaattaaaagtgggaaaac

SEQ ID NO: 12178 - DNA, 22 bp, Artificial Sequence
  chemically synthesized
aaagtgggaaaacaaagaaata

SEQ ID NO: 12179 - DNA, 22 bp, Artificial Sequence
  chemically synthesized
tttttgtttggacttaccactt

SEQ ID NO: 12180 - DNA, 22 bp, Artificial Sequence
  chemically synthesized
ttgtttggacttaccactttga

SEQ ID NO: 12181 - DNA, 22 bp, Artificial Sequence
  chemically synthesized
tgtttggacttaccactttgaa

SEQ ID NO: 12182 - DNA, 22 bp, Artificial Sequence
  chemically synthesized
gtttggacttaccactttgaaa

SEQ ID NO: 12183 - DNA, 22 bp, Artificial Sequence
  chemically synthesized
tttggacttaccactttgaaat

SEQ ID NO: 12184 - DNA, 22 bp, Artificial Sequence
  chemically synthesized
ggacttaccactttgaaatcaa

SEQ ID NO: 12185 - DNA, 22 bp, Artificial Sequence
  chemically synthesized
gacttaccactttgaaatcaaa

SEQ ID NO: 12186 - DNA, 22 bp, Artificial Sequence
  chemically synthesized
accactttgaaatcaaaatggg

SEQ ID NO: 12187 - DNA, 22 bp, Artificial Sequence
  chemically synthesized
ccactttgaaatcaaaatggga

SEQ ID NO: 12188 - DNA, 22 bp, Artificial Sequence
  chemically synthesized
tgaaatcaaaatgggaaacaaa

SEQ ID NO: 12189 - DNA, 22 bp, Artificial Sequence
  chemically synthesized
gaaatcaaaatgggaaacaaaa

SEQ ID NO: 12190 - DNA, 22 bp, Artificial Sequence
  chemically synthesized
aaatcaaaatgggaaacaaaag

SEQ ID NO: 12191 - DNA, 22 bp, Artificial Sequence
  chemically synthesized
atttacacaaaaagtctgattt

SEQ ID NO: 12192 - DNA, 22 bp, Artificial Sequence
  chemically synthesized
tttacacaaaaagtctgatttt

SEQ ID NO: 12193 - DNA, 22 bp, Artificial Sequence
  chemically synthesized
acacaaaaagtctgattttaag

SEQ ID NO: 12194 - DNA, 22 bp, Artificial Sequence
  chemically synthesized
cacaaaaagtctgattttaaga

SEQ ID NO: 12195 - DNA, 22 bp, Artificial Sequence
  chemically synthesized
attttaagatatatgacatttc

SEQ ID NO: 12196 - DNA, 22 bp, Artificial Sequence
  chemically synthesized
taagatatatgacatttcaagg

SEQ ID NO: 12197 - DNA, 22 bp, Artificial Sequence
  chemically synthesized
aagatatatgacatttcaaggt

SEQ ID NO: 12198 - DNA, 22 bp, Artificial Sequence
  chemically synthesized
agatatatgacatttcaaggtt

SEQ ID NO: 12199 - DNA, 22 bp, Artificial Sequence
  chemically synthesized
caaggtttcagaagtatgtaat

SEQ ID NO: 12200 - DNA, 22 bp, Artificial Sequence
  chemically synthesized
aaggtttcagaagtatgtaatg

SEQ ID NO: 12201 - DNA, 22 bp, Artificial Sequence
  chemically synthesized
cagaagtatgtaatgaggtgtg

SEQ ID NO: 12202 - DNA, 22 bp, Artificial Sequence
  chemically synthesized
agaagtatgtaatgaggtgtgt

SEQ ID NO: 12203 - DNA, 22 bp, Artificial Sequence
  chemically synthesized
taattttttaaattatatatct

SEQ ID NO: 12204 - DNA, 22 bp, Artificial Sequence
  chemically synthesized
attttttaaattatatatcttc

SEQ ID NO: 12205 - DNA, 22 bp, Artificial Sequence
  chemically synthesized
tttaaattatatatcttcaatt

SEQ ID NO: 12206 - DNA, 22 bp, Artificial Sequence
  chemically synthesized
ttaaattatatatcttcaattt

SEQ ID NO: 12207 - DNA, 22 bp, Artificial Sequence
  chemically synthesized
taaattatatatcttcaattta

SEQ ID NO: 12208 - DNA, 22 bp, Artificial Sequence
  chemically synthesized
aaattatatatcttcaatttaa

SEQ ID NO: 12209 - DNA, 22 bp, Artificial Sequence
  chemically synthesized
aattatatatcttcaatttaaa

SEQ ID NO: 12210 - DNA, 22 bp, Artificial Sequence
  chemically synthesized
tatatcttcaatttaaagtttt

SEQ ID NO: 12211 - DNA, 22 bp, Artificial Sequence
  chemically synthesized
caatttaaagttttagttaaaa

SEQ ID NO: 12212 - DNA, 22 bp, Artificial Sequence
  chemically synthesized
aatttaaagttttagttaaaac

SEQ ID NO: 12213 - DNA, 22 bp, Artificial Sequence
  chemically synthesized
aaagttttagttaaaacataaa

SEQ ID NO: 12214 - DNA, 22 bp, Artificial Sequence
  chemically synthesized
aagttttagttaaaacataaag

SEQ ID NO: 12215 - DNA, 22 bp, Artificial Sequence
  chemically synthesized
tagttaaaacataaagattaac

SEQ ID NO: 12216 - DNA, 22 bp, Artificial Sequence
  chemically synthesized
agttaaaacataaagattaacc

SEQ ID NO: 12217 - DNA, 22 bp, Artificial Sequence
  chemically synthesized
gttaaaacataaagattaacct

SEQ ID NO: 12218 - DNA, 22 bp, Artificial Sequence
  chemically synthesized
aaacataaagattaacctttca

SEQ ID NO: 12219 - DNA, 22 bp, Artificial Sequence
  chemically synthesized
acctttcattagcaagctgtta

SEQ ID NO: 12220 - DNA, 22 bp, Artificial Sequence
  chemically synthesized
tcattagcaagctgttagttat

SEQ ID NO: 12221 - DNA, 22 bp, Artificial Sequence
  chemically synthesized
cattagcaagctgttagttatc

SEQ ID NO: 12222 - DNA, 22 bp, Artificial Sequence
  chemically synthesized
attagcaagctgttagttatca

SEQ ID NO: 12223 - DNA, 22 bp, Artificial Sequence
  chemically synthesized
gcaagctgttagttatcaccaa

SEQ ID NO: 12224 - DNA, 22 bp, Artificial Sequence
  chemically synthesized
ttagttatcaccaaagcttttc

SEQ ID NO: 12225 - DNA, 22 bp, Artificial Sequence
  chemically synthesized
gttatcaccaaagcttttcatg

SEQ ID NO: 12226 - DNA, 22 bp, Artificial Sequence
  chemically synthesized
tcaccaaagcttttcatggatt

SEQ ID NO: 12227 - DNA, 22 bp, Artificial Sequence
  chemically synthesized
ttcatggattaggaaaaaatca

SEQ ID NO: 12228 - DNA, 22 bp, Artificial Sequence
  chemically synthesized
tcatggattaggaaaaaatcat

SEQ ID NO: 12229 - DNA, 22 bp, Artificial Sequence
  chemically synthesized
catggattaggaaaaaatcatt

SEQ ID NO: 12230 - DNA, 22 bp, Artificial Sequence
  chemically synthesized
atggattaggaaaaaatcattt

SEQ ID NO: 12231 - DNA, 22 bp, Artificial Sequence
  chemically synthesized
ggaaaaaatcattttgtctcta

SEQ ID NO: 12232 - DNA, 22 bp, Artificial Sequence
  chemically synthesized
tgtctctatgtcaaacatcttg

SEQ ID NO: 12233 - DNA, 22 bp, Artificial Sequence
  chemically synthesized
gtctctatgtcaaacatcttgg

SEQ ID NO: 12234 - DNA, 22 bp, Artificial Sequence
  chemically synthesized
tctctatgtcaaacatcttgga

SEQ ID NO: 12235 - DNA, 22 bp, Artificial Sequence
  chemically synthesized
tatgtcaaacatcttggagttg

SEQ ID NO: 12236 - DNA, 22 bp, Artificial Sequence
  chemically synthesized
tgtcaaacatcttggagttgat

SEQ ID NO: 12237 - DNA, 22 bp, Artificial Sequence
  chemically synthesized
ggagttgatatttggggaaaca

SEQ ID NO: 12238 - DNA, 22 bp, Artificial Sequence
  chemically synthesized
gagttgatatttggggaaacac

SEQ ID NO: 12239 - DNA, 22 bp, Artificial Sequence
  chemically synthesized
atatttggggaaacacaatact

SEQ ID NO: 12240 - DNA, 22 bp, Artificial Sequence
  chemically synthesized
ggggaaacacaatactcagttg

SEQ ID NO: 12241 - DNA, 22 bp, Artificial Sequence
  chemically synthesized
gggaaacacaatactcagttga

SEQ ID NO: 12242 - DNA, 22 bp, Artificial Sequence
  chemically synthesized
agttgagttccctaggggagaa

SEQ ID NO: 12243 - DNA, 22 bp, Artificial Sequence
  chemically synthesized
agttccctaggggagaaaagca

SEQ ID NO: 12244 - DNA, 22 bp, Artificial Sequence
  chemically synthesized
cctaggggagaaaagcaagctt

SEQ ID NO: 12245 - DNA, 22 bp, Artificial Sequence
  chemically synthesized
ggggagaaaagcaagcttaaga

SEQ ID NO: 12246 - DNA, 22 bp, Artificial Sequence
  chemically synthesized
aagaattgacataaagagtagg

SEQ ID NO: 12247 - DNA, 22 bp, Artificial Sequence
  chemically synthesized
agaattgacataaagagtagga

SEQ ID NO: 12248 - DNA, 22 bp, Artificial Sequence
  chemically synthesized
acataaagagtaggaagttagc

SEQ ID NO: 12249 - DNA, 22 bp, Artificial Sequence
  chemically synthesized
gctaatgcaacatatatcactt

SEQ ID NO: 12250 - DNA, 22 bp, Artificial Sequence
  chemically synthesized
atgcaacatatatcactttgtt

SEQ ID NO: 12251 - DNA, 22 bp, Artificial Sequence
  chemically synthesized
tgttttttcacaactacagtga

SEQ ID NO: 12252 - DNA, 22 bp, Artificial Sequence
  chemically synthesized
gttttttcacaactacagtgac

SEQ ID NO: 12253 - DNA, 22 bp, Artificial Sequence
  chemically synthesized
ttttttcacaactacagtgact

SEQ ID NO: 12254 - DNA, 22 bp, Artificial Sequence
  chemically synthesized
tttcacaactacagtgacttta

SEQ ID NO: 12255 - DNA, 22 bp, Artificial Sequence
  chemically synthesized
ttcacaactacagtgactttat

SEQ ID NO: 12256 - DNA, 22 bp, Artificial Sequence
  chemically synthesized
tcacaactacagtgactttatg

SEQ ID NO: 12257 - DNA, 22 bp, Artificial Sequence
  chemically synthesized
cacaactacagtgactttatgt

SEQ ID NO: 12258 - DNA, 22 bp, Artificial Sequence
  chemically synthesized
acaactacagtgactttatgta

SEQ ID NO: 12259 - DNA, 22 bp, Artificial Sequence
  chemically synthesized
cagtgactttatgtatttccca

SEQ ID NO: 12260 - DNA, 22 bp, Artificial Sequence
  chemically synthesized
tatgtatttcccagaggaaggc

SEQ ID NO: 12261 - DNA, 22 bp, Artificial Sequence
  chemically synthesized
atgtatttcccagaggaaggca

SEQ ID NO: 12262 - DNA, 22 bp, Artificial Sequence
  chemically synthesized
tgtatttcccagaggaaggcat

SEQ ID NO: 12263 - DNA, 22 bp, Artificial Sequence
  chemically synthesized
cccagaggaaggcatacaggga

SEQ ID NO: 12264 - DNA, 22 bp, Artificial Sequence
  chemically synthesized
ccagaggaaggcatacagggaa

SEQ ID NO: 12265 - DNA, 22 bp, Artificial Sequence
  chemically synthesized
tcccatttggacaaacagcatg

SEQ ID NO: 12266 - DNA, 22 bp, Artificial Sequence
  chemically synthesized
ggacaaacagcatgttctcaca

SEQ ID NO: 12267 - DNA, 22 bp, Artificial Sequence
  chemically synthesized
gacaaacagcatgttctcacag

SEQ ID NO: 12268 - DNA, 22 bp, Artificial Sequence
  chemically synthesized
tcacaggaagcatttatcacac

SEQ ID NO: 12269 - DNA, 22 bp, Artificial Sequence
  chemically synthesized
acaggaagcatttatcacactt

SEQ ID NO: 12270 - DNA, 22 bp, Artificial Sequence
  chemically synthesized
atcacacttacttgtcaacttt

SEQ ID NO: 12271 - DNA, 22 bp, Artificial Sequence
  chemically synthesized
tcacacttacttgtcaactttc

SEQ ID NO: 12272 - DNA, 22 bp, Artificial Sequence
  chemically synthesized
acttgtcaactttctagaatca

SEQ ID NO: 12273 - DNA, 22 bp, Artificial Sequence
  chemically synthesized
cttgtcaactttctagaatcaa

SEQ ID NO: 12274 - DNA, 22 bp, Artificial Sequence
  chemically synthesized
gtcaactttctagaatcaaatc

SEQ ID NO: 12275 - DNA, 22 bp, Artificial Sequence
  chemically synthesized
tcaactttctagaatcaaatct

SEQ ID NO: 12276 - DNA, 22 bp, Artificial Sequence
  chemically synthesized
tctagaatcaaatctagtagct

SEQ ID NO: 12277 - DNA, 22 bp, Artificial Sequence
  chemically synthesized
ctagaatcaaatctagtagctg

SEQ ID NO: 12278 - DNA, 22 bp, Artificial Sequence
  chemically synthesized
tagaatcaaatctagtagctga

SEQ ID NO: 12279 - DNA, 22 bp, Artificial Sequence
  chemically synthesized
gaatcaaatctagtagctgaca

SEQ ID NO: 12280 - DNA, 22 bp, Artificial Sequence
  chemically synthesized
gtagctgacagtaccaggatca

SEQ ID NO: 12281 - DNA, 22 bp, Artificial Sequence
  chemically synthesized
acagtaccaggatcaggggtgc

SEQ ID NO: 12282 - DNA, 22 bp, Artificial Sequence
  chemically synthesized
agcacccccagaaagctgactg

SEQ ID NO: 12283 - DNA, 22 bp, Artificial Sequence
  chemically synthesized
actggccctgtggttcccactc

SEQ ID NO: 12284 - DNA, 22 bp, Artificial Sequence
  chemically synthesized
gccctgtggttcccactccaga

SEQ ID NO: 12285 - DNA, 22 bp, Artificial Sequence
  chemically synthesized
tggttcccactccagacatgat

SEQ ID NO: 12286 - DNA, 22 bp, Artificial Sequence
  chemically synthesized
ccactccagacatgatgtcagc

SEQ ID NO: 12287 - DNA, 22 bp, Artificial Sequence
  chemically synthesized
cagacatgatgtcagctgtgaa

SEQ ID NO: 12288 - DNA, 22 bp, Artificial Sequence
  chemically synthesized
tgaaatcagactgaaatgctga

SEQ ID NO: 12289 - DNA, 22 bp, Artificial Sequence
  chemically synthesized
aaatgctgaaataacgataaaa

SEQ ID NO: 12290 - DNA, 22 bp, Artificial Sequence
  chemically synthesized
aaataacgataaaaaaaaatac

SEQ ID NO: 12291 - DNA, 22 bp, Artificial Sequence
  chemically synthesized
aactagcaaagtgagtaaagtc

SEQ ID NO: 12292 - DNA, 22 bp, Artificial Sequence
  chemically synthesized
gcaaagtgagtaaagtcaaggg

SEQ ID NO: 12293 - DNA, 22 bp, Artificial Sequence
  chemically synthesized
gttggaaaactcacaaagcagg

SEQ ID NO: 12294 - DNA, 22 bp, Artificial Sequence
  chemically synthesized
ttggaaaactcacaaagcagga

SEQ ID NO: 12295 - DNA, 22 bp, Artificial Sequence
  chemically synthesized
gaaaactcacaaagcaggacat

SEQ ID NO: 12296 - DNA, 22 bp, Artificial Sequence
  chemically synthesized
acaaagcaggacataaagcaag

SEQ ID NO: 12297 - DNA, 22 bp, Artificial Sequence
  chemically synthesized
gatatatctcattagtgtgaca

SEQ ID NO: 12298 - DNA, 22 bp, Artificial Sequence
  chemically synthesized
attagtgtgacatctgggagga

SEQ ID NO: 12299 - DNA, 22 bp, Artificial Sequence
  chemically synthesized
gtgtgacatctgggaggacaaa

SEQ ID NO: 12300 - DNA, 22 bp, Artificial Sequence
  chemically synthesized
ggaggacaaagcatccaaaccc

SEQ ID NO: 12301 - DNA, 22 bp, Artificial Sequence
  chemically synthesized
tcttctatataagtggtgagat

SEQ ID NO: 12302 - DNA, 22 bp, Artificial Sequence
  chemically synthesized
cttctatataagtggtgagatg

SEQ ID NO: 12303 - DNA, 22 bp, Artificial Sequence
  chemically synthesized
ttctatataagtggtgagatga

SEQ ID NO: 12304 - DNA, 22 bp, Artificial Sequence
  chemically synthesized
ctatataagtggtgagatgatg

SEQ ID NO: 12305 - DNA, 22 bp, Artificial Sequence
  chemically synthesized
tatataagtggtgagatgatga

SEQ ID NO: 12306 - DNA, 22 bp, Artificial Sequence
  chemically synthesized
tataagtggtgagatgatgaag

SEQ ID NO: 12307 - DNA, 22 bp, Artificial Sequence
  chemically synthesized
taagagggcttctgcccccttg

SEQ ID NO: 12308 - DNA, 22 bp, Artificial Sequence
  chemically synthesized
ctgcccccttgaagacttcaga

SEQ ID NO: 12309 - DNA, 22 bp, Artificial Sequence
  chemically synthesized
tgcccccttgaagacttcagat

SEQ ID NO: 12310 - DNA, 22 bp, Artificial Sequence
  chemically synthesized
cccccttgaagacttcagatgc

SEQ ID NO: 12311 - DNA, 22 bp, Artificial Sequence
  chemically synthesized
gaagacttcagatgctggggaa

SEQ ID NO: 12312 - DNA, 22 bp, Artificial Sequence
  chemically synthesized
aagacttcagatgctggggaaa

SEQ ID NO: 12313 - DNA, 22 bp, Artificial Sequence
  chemically synthesized
cagatgctggggaaaggataga

SEQ ID NO: 12314 - DNA, 22 bp, Artificial Sequence
  chemically synthesized
agatgctggggaaaggatagat

SEQ ID NO: 12315 - DNA, 22 bp, Artificial Sequence
  chemically synthesized
gggaaaggatagataagaataa

SEQ ID NO: 12316 - DNA, 22 bp, Artificial Sequence
  chemically synthesized
ttggagcctgggaaataatgac

SEQ ID NO: 12317 - DNA, 22 bp, Artificial Sequence
  chemically synthesized
tggagcctgggaaataatgact

SEQ ID NO: 12318 - DNA, 22 bp, Artificial Sequence
  chemically synthesized
ggagcctgggaaataatgacta

SEQ ID NO: 12319 - DNA, 22 bp, Artificial Sequence
  chemically synthesized
gagcctgggaaataatgactag

SEQ ID NO: 12320 - DNA, 22 bp, Artificial Sequence
  chemically synthesized
ggaaataatgactagcgataaa

SEQ ID NO: 12321 - DNA, 22 bp, Artificial Sequence
  chemically synthesized
gcgataaacctgaagggaagtt

SEQ ID NO: 12322 - DNA, 22 bp, Artificial Sequence
  chemically synthesized
aagggaagttaagtatacgatc

SEQ ID NO: 12323 - DNA, 22 bp, Artificial Sequence
  chemically synthesized
agtatacgatccccagataata

SEQ ID NO: 12324 - DNA, 22 bp, Artificial Sequence
  chemically synthesized
aggagaaaggcaatgtgattct

SEQ ID NO: 12325 - DNA, 22 bp, Artificial Sequence
  chemically synthesized
tgcagccattgtagccagagat

SEQ ID NO: 12326 - DNA, 22 bp, Artificial Sequence
  chemically synthesized
cagccattgtagccagagataa

SEQ ID NO: 12327 - DNA, 22 bp, Artificial Sequence
  chemically synthesized
tagccagagataataagccctt

SEQ ID NO: 12328 - DNA, 22 bp, Artificial Sequence
  chemically synthesized
gaggaaggggccaggggaattt

SEQ ID NO: 12329 - DNA, 22 bp, Artificial Sequence
  chemically synthesized
aggaaggggccaggggaatttt

SEQ ID NO: 12330 - DNA, 22 bp, Artificial Sequence
  chemically synthesized
ttctaaggatagacagtattaa

SEQ ID NO: 12331 - DNA, 22 bp, Artificial Sequence
  chemically synthesized
tctaaggatagacagtattaat

SEQ ID NO: 12332 - DNA, 22 bp, Artificial Sequence
  chemically synthesized
ctaaggatagacagtattaatg

SEQ ID NO: 12333 - DNA, 22 bp, Artificial Sequence
  chemically synthesized
taaggatagacagtattaatgc

SEQ ID NO: 12334 - DNA, 22 bp, Artificial Sequence
  chemically synthesized
aggatagacagtattaatgcag

SEQ ID NO: 12335 - DNA, 22 bp, Artificial Sequence
  chemically synthesized
atgcagcactctcttctgctat

SEQ ID NO: 12336 - DNA, 22 bp, Artificial Sequence
  chemically synthesized
tcttctgctattaaactctcat

SEQ ID NO: 12337 - DNA, 22 bp, Artificial Sequence
  chemically synthesized
ttctgctattaaactctcattg

SEQ ID NO: 12338 - DNA, 22 bp, Artificial Sequence
  chemically synthesized
ctgctattaaactctcattggc

SEQ ID NO: 12339 - DNA, 22 bp, Artificial Sequence
  chemically synthesized
tgctattaaactctcattggct

SEQ ID NO: 12340 - DNA, 22 bp, Artificial Sequence
  chemically synthesized
ctattaaactctcattggcttc

SEQ ID NO: 12341 - DNA, 22 bp, Artificial Sequence
  chemically synthesized
ttaaactctcattggcttctaa

SEQ ID NO: 12342 - DNA, 22 bp, Artificial Sequence
  chemically synthesized
aactctcattggcttctaaaag

SEQ ID NO: 12343 - DNA, 22 bp, Artificial Sequence
  chemically synthesized
tcattggcttctaaaaggagtt

SEQ ID NO: 12344 - DNA, 22 bp, Artificial Sequence
  chemically synthesized
attggcttctaaaaggagtttc

SEQ ID NO: 12345 - DNA, 22 bp, Artificial Sequence
  chemically synthesized
gcttctaaaaggagtttcggtg

SEQ ID NO: 12346 - DNA, 22 bp, Artificial Sequence
  chemically synthesized
ctaaaaggagtttcggtgagtg

SEQ ID NO: 12347 - DNA, 22 bp, Artificial Sequence
  chemically synthesized
taaaaggagtttcggtgagtga

SEQ ID NO: 12348 - DNA, 22 bp, Artificial Sequence
  chemically synthesized
aaaggagtttcggtgagtgatt

SEQ ID NO: 12349 - DNA, 22 bp, Artificial Sequence
  chemically synthesized
cggtgagtgatttgctgagatg

SEQ ID NO: 12350 - DNA, 22 bp, Artificial Sequence
  chemically synthesized
ggtgagtgatttgctgagatgt

SEQ ID NO: 12351 - DNA, 22 bp, Artificial Sequence
  chemically synthesized
gctgagatgttgcattttcatg

SEQ ID NO: 12352 - DNA, 22 bp, Artificial Sequence
  chemically synthesized
ctgagatgttgcattttcatgg

SEQ ID NO: 12353 - DNA, 22 bp, Artificial Sequence
  chemically synthesized
agatgttgcattttcatggctg

SEQ ID NO: 12354 - DNA, 22 bp, Artificial Sequence
  chemically synthesized
cattttcatggctgctgccttt

SEQ ID NO: 12355 - DNA, 22 bp, Artificial Sequence
  chemically synthesized
tcatggctgctgcctttaggta

SEQ ID NO: 12356 - DNA, 22 bp, Artificial Sequence
  chemically synthesized
catggctgctgcctttaggtat

SEQ ID NO: 12357 - DNA, 22 bp, Artificial Sequence
  chemically synthesized
atggctgctgcctttaggtatt

SEQ ID NO: 12358 - DNA, 22 bp, Artificial Sequence
  chemically synthesized
ctgcctttaggtattattgcaa

SEQ ID NO: 12359 - DNA, 22 bp, Artificial Sequence
  chemically synthesized
cctttaggtattattgcaacag

SEQ ID NO: 12360 - DNA, 22 bp, Artificial Sequence
  chemically synthesized
taggtattattgcaacagtttg

SEQ ID NO: 12361 - DNA, 22 bp, Artificial Sequence
  chemically synthesized
aggtattattgcaacagtttgg

SEQ ID NO: 12362 - DNA, 22 bp, Artificial Sequence
  chemically synthesized
ggtattattgcaacagtttgga

SEQ ID NO: 12363 - DNA, 22 bp, Artificial Sequence
  chemically synthesized
ttgcaacagtttggaattttga

SEQ ID NO: 12364 - DNA, 22 bp, Artificial Sequence
  chemically synthesized
caacagtttggaattttgaaat

SEQ ID NO: 12365 - DNA, 22 bp, Artificial Sequence
  chemically synthesized
ggaattttgaaattaaaacagt

SEQ ID NO: 12366 - DNA, 22 bp, Artificial Sequence
  chemically synthesized
gaattttgaaattaaaacagtt

SEQ ID NO: 12367 - DNA, 22 bp, Artificial Sequence
  chemically synthesized
tgaaattaaaacagttctgtaa

SEQ ID NO: 12368 - DNA, 22 bp, Artificial Sequence
  chemically synthesized
gaaattaaaacagttctgtaaa

SEQ ID NO: 12369 - DNA, 22 bp, Artificial Sequence
  chemically synthesized
aaattaaaacagttctgtaaaa

SEQ ID NO: 12370 - DNA, 22 bp, Artificial Sequence
  chemically synthesized
aaacagttctgtaaaaccagtt

SEQ ID NO: 12371 - DNA, 22 bp, Artificial Sequence
  chemically synthesized
tgtaaaaccagtttagttttgt

SEQ ID NO: 12372 - DNA, 22 bp, Artificial Sequence
  chemically synthesized
taaaaccagtttagttttgtaa

SEQ ID NO: 12373 - DNA, 22 bp, Artificial Sequence
  chemically synthesized
agttttgtaaagtgtatgcatc

SEQ ID NO: 12374 - DNA, 22 bp, Artificial Sequence
  chemically synthesized
gttttgtaaagtgtatgcatca

SEQ ID NO: 12375 - DNA, 22 bp, Artificial Sequence
  chemically synthesized
tgtaaagtgtatgcatcaaaga

SEQ ID NO: 12376 - DNA, 22 bp, Artificial Sequence
  chemically synthesized
gtaaagtgtatgcatcaaagat

SEQ ID NO: 12377 - DNA, 22 bp, Artificial Sequence
  chemically synthesized
taaagtgtatgcatcaaagatg

SEQ ID NO: 12378 - DNA, 22 bp, Artificial Sequence
  chemically synthesized
cattcagacattactgagttac

SEQ ID NO: 12379 - DNA, 22 bp, Artificial Sequence
  chemically synthesized
attcagacattactgagttaca

SEQ ID NO: 12380 - DNA, 22 bp, Artificial Sequence
  chemically synthesized
agacattactgagttacaacta

SEQ ID NO: 12381 - DNA, 22 bp, Artificial Sequence
  chemically synthesized
ctgagttacaactatggtgcca

SEQ ID NO: 12382 - DNA, 22 bp, Artificial Sequence
  chemically synthesized
agttacaactatggtgccaggt

SEQ ID NO: 12383 - DNA, 22 bp, Artificial Sequence
  chemically synthesized
caactatggtgccaggtactgt

SEQ ID NO: 12384 - DNA, 22 bp, Artificial Sequence
  chemically synthesized
tggtgccaggtactgtgtcagg

SEQ ID NO: 12385 - DNA, 22 bp, Artificial Sequence
  chemically synthesized
tgtcagggtactaggggtatgg

SEQ ID NO: 12386 - DNA, 22 bp, Artificial Sequence
  chemically synthesized
ggggtatggggataaaccagac

SEQ ID NO: 12387 - DNA, 22 bp, Artificial Sequence
  chemically synthesized
cctctttgatctaaagcagcat

SEQ ID NO: 12388 - DNA, 22 bp, Artificial Sequence
  chemically synthesized
tttgatctaaagcagcatgagg

SEQ ID NO: 12389 - DNA, 22 bp, Artificial Sequence
  chemically synthesized
tgatctaaagcagcatgaggcc

SEQ ID NO: 12390 - DNA, 22 bp, Artificial Sequence
  chemically synthesized
gatctaaagcagcatgaggcca

SEQ ID NO: 12391 - DNA, 22 bp, Artificial Sequence
  chemically synthesized
atctaaagcagcatgaggccag

SEQ ID NO: 12392 - DNA, 22 bp, Artificial Sequence
  chemically synthesized
aagcagcatgaggccaggtgag

SEQ ID NO: 12393 - DNA, 22 bp, Artificial Sequence
  chemically synthesized
caatataatgtgataaaatgtg

SEQ ID NO: 12394 - DNA, 22 bp, Artificial Sequence
  chemically synthesized
aatataatgtgataaaatgtgc

SEQ ID NO: 12395 - DNA, 22 bp, Artificial Sequence
  chemically synthesized
ggtactaagggatcatagagaa

SEQ ID NO: 12396 - DNA, 22 bp, Artificial Sequence
  chemically synthesized
agggatcatagagaaaggaaca

SEQ ID NO: 12397 - DNA, 22 bp, Artificial Sequence
  chemically synthesized
aatggggaaacaattgatagag

SEQ ID NO: 12398 - DNA, 22 bp, Artificial Sequence
  chemically synthesized
atagagagagaatattttcatc

SEQ ID NO: 12399 - DNA, 22 bp, Artificial Sequence
  chemically synthesized
tcatctgggtcttaaaagatga

SEQ ID NO: 12400 - DNA, 22 bp, Artificial Sequence
  chemically synthesized
catctgggtcttaaaagatgag

SEQ ID NO: 12401 - DNA, 22 bp, Artificial Sequence
  chemically synthesized
atctgggtcttaaaagatgagt

SEQ ID NO: 12402 - DNA, 22 bp, Artificial Sequence
  chemically synthesized
ggtcttaaaagatgagtaggcg

SEQ ID NO: 12403 - DNA, 22 bp, Artificial Sequence
  chemically synthesized
aaaagatgagtaggcgttctct

SEQ ID NO: 12404 - DNA, 22 bp, Artificial Sequence
  chemically synthesized
aaagatgagtaggcgttctctc

SEQ ID NO: 12405 - DNA, 22 bp, Artificial Sequence
  chemically synthesized
tctctctttaaatgtctgatat

SEQ ID NO: 12406 - DNA, 22 bp, Artificial Sequence
  chemically synthesized
tctctttaaatgtctgatataa

SEQ ID NO: 12407 - DNA, 22 bp, Artificial Sequence
  chemically synthesized
tctttaaatgtctgatataagg

SEQ ID NO: 12408 - DNA, 22 bp, Artificial Sequence
  chemically synthesized
tttaaatgtctgatataagggc

SEQ ID NO: 12409 - DNA, 22 bp, Artificial Sequence
  chemically synthesized
taaatgtctgatataagggcat

SEQ ID NO: 12410 - DNA, 22 bp, Artificial Sequence
  chemically synthesized
aaatgtctgatataagggcatt

SEQ ID NO: 12411 - DNA, 22 bp, Artificial Sequence
  chemically synthesized
aatgtctgatataagggcattt

SEQ ID NO: 12412 - DNA, 22 bp, Artificial Sequence
  chemically synthesized
atataagggcattttatgcaaa

SEQ ID NO: 12413 - DNA, 22 bp, Artificial Sequence
  chemically synthesized
tatgcaaagaggatcactcgtg

SEQ ID NO: 12414 - DNA, 22 bp, Artificial Sequence
  chemically synthesized
atgcaaagaggatcactcgtgc

SEQ ID NO: 12415 - DNA, 22 bp, Artificial Sequence
  chemically synthesized
tgcaaagaggatcactcgtgca

SEQ ID NO: 12416 - DNA, 22 bp, Artificial Sequence
  chemically synthesized
gtgcaaagactcagatttgcaa

SEQ ID NO: 12417 - DNA, 22 bp, Artificial Sequence
  chemically synthesized
agatttgcaagaacgtgaggta

SEQ ID NO: 12418 - DNA, 22 bp, Artificial Sequence
  chemically synthesized
gcaagaacgtgaggtatttcag

SEQ ID NO: 12419 - DNA, 22 bp, Artificial Sequence
  chemically synthesized
caagaacgtgaggtatttcagg

SEQ ID NO: 12420 - DNA, 22 bp, Artificial Sequence
  chemically synthesized
caggagttttgtatggttccat

SEQ ID NO: 12421 - DNA, 22 bp, Artificial Sequence
  chemically synthesized
aggagttttgtatggttccata

SEQ ID NO: 12422 - DNA, 22 bp, Artificial Sequence
  chemically synthesized
tgtatggttccatatggactat

SEQ ID NO: 12423 - DNA, 22 bp, Artificial Sequence
  chemically synthesized
gtatggttccatatggactatg

SEQ ID NO: 12424 - DNA, 22 bp, Artificial Sequence
  chemically synthesized
tatggttccatatggactatga

SEQ ID NO: 12425 - DNA, 22 bp, Artificial Sequence
  chemically synthesized
catatggactatgacaagtgag

SEQ ID NO: 12426 - DNA, 22 bp, Artificial Sequence
  chemically synthesized
tgacaagtgagacaggtaaact

SEQ ID NO: 12427 - DNA, 22 bp, Artificial Sequence
  chemically synthesized
ggcagagctggtcatcagataa

SEQ ID NO: 12428 - DNA, 22 bp, Artificial Sequence
  chemically synthesized
gtcatcagataatgaagtcatt

SEQ ID NO: 12429 - DNA, 22 bp, Artificial Sequence
  chemically synthesized
acctaaggagattggacaataa

SEQ ID NO: 12430 - DNA, 22 bp, Artificial Sequence
  chemically synthesized
aggagattggacaataaaatgc

SEQ ID NO: 12431 - DNA, 22 bp, Artificial Sequence
  chemically synthesized
gacaataaaatgcaatatggag

SEQ ID NO: 12432 - DNA, 22 bp, Artificial Sequence
  chemically synthesized
atggctgatttaggatgcccag

SEQ ID NO: 12433 - DNA, 22 bp, Artificial Sequence
  chemically synthesized
atttaggatgcccagtctggca

SEQ ID NO: 12434 - DNA, 22 bp, Artificial Sequence
  chemically synthesized
aggatgcccagtctggcaacac

SEQ ID NO: 12435 - DNA, 22 bp, Artificial Sequence
  chemically synthesized
ggatgcccagtctggcaacacg

SEQ ID NO: 12436 - DNA, 22 bp, Artificial Sequence
  chemically synthesized
gcaacacgctaatgaaatgata

SEQ ID NO: 12437 - DNA, 22 bp, Artificial Sequence
  chemically synthesized
atgaaatgatagtgggggaggg

SEQ ID NO: 12438 - DNA, 22 bp, Artificial Sequence
  chemically synthesized
ggagagagcagtcctgagacta

SEQ ID NO: 12439 - DNA, 22 bp, Artificial Sequence
  chemically synthesized
agactattgcaattatctgcgg

SEQ ID NO: 12440 - DNA, 22 bp, Artificial Sequence
  chemically synthesized
ttgcaattatctgcgggagaca

SEQ ID NO: 12441 - DNA, 22 bp, Artificial Sequence
  chemically synthesized
caattatctgcgggagacataa

SEQ ID NO: 12442 - DNA, 22 bp, Artificial Sequence
  chemically synthesized
tctgcgggagacataaaggcta

SEQ ID NO: 12443 - DNA, 22 bp, Artificial Sequence
  chemically synthesized
cgggagacataaaggctagaac

SEQ ID NO: 12444 - DNA, 22 bp, Artificial Sequence
  chemically synthesized
gaacctgaacagtagcagtaca

SEQ ID NO: 12445 - DNA, 22 bp, Artificial Sequence
  chemically synthesized
aacagtagcagtacaaaaaaag

SEQ ID NO: 12446 - DNA, 22 bp, Artificial Sequence
  chemically synthesized
aaatgatattaaggaagtagaa

SEQ ID NO: 12447 - DNA, 22 bp, Artificial Sequence
  chemically synthesized
aggaagtagaagtggtatgact

SEQ ID NO: 12448 - DNA, 22 bp, Artificial Sequence
  chemically synthesized
aaccatctgggtatggaagggg

SEQ ID NO: 12449 - DNA, 22 bp, Artificial Sequence
  chemically synthesized
accatctgggtatggaagggga

SEQ ID NO: 12450 - DNA, 22 bp, Artificial Sequence
  chemically synthesized
ggtatggaaggggaaatggcta

SEQ ID NO: 12451 - DNA, 22 bp, Artificial Sequence
  chemically synthesized
gagtcttggggactttgtgttt

SEQ ID NO: 12452 - DNA, 22 bp, Artificial Sequence
  chemically synthesized
ggggactttgtgtttgatgtga

SEQ ID NO: 12453 - DNA, 22 bp, Artificial Sequence
  chemically synthesized
gggactttgtgtttgatgtgat

SEQ ID NO: 12454 - DNA, 22 bp, Artificial Sequence
  chemically synthesized
tgtgtttgatgtgattatggac

SEQ ID NO: 12455 - DNA, 22 bp, Artificial Sequence
  chemically synthesized
gtgtttgatgtgattatggacc

SEQ ID NO: 12456 - DNA, 22 bp, Artificial Sequence
  chemically synthesized
tgtttgatgtgattatggacca

SEQ ID NO: 12457 - DNA, 22 bp, Artificial Sequence
  chemically synthesized
gatgtgattatggaccacagaa

SEQ ID NO: 12458 - DNA, 22 bp, Artificial Sequence
  chemically synthesized
atgtgattatggaccacagaat

SEQ ID NO: 12459 - DNA, 22 bp, Artificial Sequence
  chemically synthesized
tggaccacagaataatgtctaa

SEQ ID NO: 12460 - DNA, 22 bp, Artificial Sequence
  chemically synthesized
agagaactggctctttagtctg

SEQ ID NO: 12461 - DNA, 22 bp, Artificial Sequence
  chemically synthesized
gctctttagtctgactgccaga

SEQ ID NO: 12462 - DNA, 22 bp, Artificial Sequence
  chemically synthesized
tttagtctgactgccagagtct

SEQ ID NO: 12463 - DNA, 22 bp, Artificial Sequence
  chemically synthesized
tagtctgactgccagagtctga

SEQ ID NO: 12464 - DNA, 22 bp, Artificial Sequence
  chemically synthesized
agtctgactgccagagtctgaa

SEQ ID NO: 12465 - DNA, 22 bp, Artificial Sequence
  chemically synthesized
gtctgactgccagagtctgaat

SEQ ID NO: 12466 - DNA, 22 bp, Artificial Sequence
  chemically synthesized
actgccagagtctgaatcctga

SEQ ID NO: 12467 - DNA, 22 bp, Artificial Sequence
  chemically synthesized
ccagagtctgaatcctgaatgt

SEQ ID NO: 12468 - DNA, 22 bp, Artificial Sequence
  chemically synthesized
aatcctgaatgttttagtatgt

SEQ ID NO: 12469 - DNA, 22 bp, Artificial Sequence
  chemically synthesized
aatgttttagtatgttaccttg

SEQ ID NO: 12470 - DNA, 22 bp, Artificial Sequence
  chemically synthesized
tagtatgttaccttgggcaaag

SEQ ID NO: 12471 - DNA, 22 bp, Artificial Sequence
  chemically synthesized
agtatgttaccttgggcaaagc

SEQ ID NO: 12472 - DNA, 22 bp, Artificial Sequence
  chemically synthesized
gtatgttaccttgggcaaagcc

SEQ ID NO: 12473 - DNA, 22 bp, Artificial Sequence
  chemically synthesized
ccttgggcaaagcccttagcct

SEQ ID NO: 12474 - DNA, 22 bp, Artificial Sequence
  chemically synthesized
gggcaaagcccttagcctctat

SEQ ID NO: 12475 - DNA, 22 bp, Artificial Sequence
  chemically synthesized
ggcaaagcccttagcctctatg

SEQ ID NO: 12476 - DNA, 22 bp, Artificial Sequence
  chemically synthesized
agcctctatgaatctatcttcc

SEQ ID NO: 12477 - DNA, 22 bp, Artificial Sequence
  chemically synthesized
gcctctatgaatctatcttcct

SEQ ID NO: 12478 - DNA, 22 bp, Artificial Sequence
  chemically synthesized
tatgaatctatcttcctcattc

SEQ ID NO: 12479 - DNA, 22 bp, Artificial Sequence
  chemically synthesized
tgaatctatcttcctcattcat

SEQ ID NO: 12480 - DNA, 22 bp, Artificial Sequence
  chemically synthesized
tcttcctcattcataaaaataa

SEQ ID NO: 12481 - DNA, 22 bp, Artificial Sequence
  chemically synthesized
cctcattcataaaaataagatg

SEQ ID NO: 12482 - DNA, 22 bp, Artificial Sequence
  chemically synthesized
ctcattcataaaaataagatga

SEQ ID NO: 12483 - DNA, 22 bp, Artificial Sequence
  chemically synthesized
attcataaaaataagatgacag

SEQ ID NO: 12484 - DNA, 22 bp, Artificial Sequence
  chemically synthesized
ataaaaataagatgacagtgcc

SEQ ID NO: 12485 - DNA, 22 bp, Artificial Sequence
  chemically synthesized
tctcgtgggacttttgtgagga

SEQ ID NO: 12486 - DNA, 22 bp, Artificial Sequence
  chemically synthesized
gtgggacttttgtgaggatgaa

SEQ ID NO: 12487 - DNA, 22 bp, Artificial Sequence
  chemically synthesized
ttgtgaggatgaagtgagataa

SEQ ID NO: 12488 - DNA, 22 bp, Artificial Sequence
  chemically synthesized
tgtgaggatgaagtgagataat

SEQ ID NO: 12489 - DNA, 22 bp, Artificial Sequence
  chemically synthesized
gtgaggatgaagtgagataatg

SEQ ID NO: 12490 - DNA, 22 bp, Artificial Sequence
  chemically synthesized
tgaggatgaagtgagataatgg

SEQ ID NO: 12491 - DNA, 22 bp, Artificial Sequence
  chemically synthesized
ctgagcacagtgtccaacacag

SEQ ID NO: 12492 - DNA, 22 bp, Artificial Sequence
  chemically synthesized
agcacagtgtccaacacagcag

SEQ ID NO: 12493 - DNA, 22 bp, Artificial Sequence
  chemically synthesized
catatacattagctattactgg

SEQ ID NO: 12494 - DNA, 22 bp, Artificial Sequence
  chemically synthesized
gctattactggctacattatga

SEQ ID NO: 12495 - DNA, 22 bp, Artificial Sequence
  chemically synthesized
ttactggctacattatgatata

SEQ ID NO: 12496 - DNA, 22 bp, Artificial Sequence
  chemically synthesized
ctggctacattatgatatacag

SEQ ID NO: 12497 - DNA, 22 bp, Artificial Sequence
  chemically synthesized
gctacattatgatatacagtta

SEQ ID NO: 12498 - DNA, 22 bp, Artificial Sequence
  chemically synthesized
cattatgatatacagttaggga

SEQ ID NO: 12499 - DNA, 22 bp, Artificial Sequence
  chemically synthesized
tgatatacagttagggagttgg

SEQ ID NO: 12500 - DNA, 22 bp, Artificial Sequence
  chemically synthesized
gggagttggaaagataatctga

SEQ ID NO: 12501 - DNA, 22 bp, Artificial Sequence
  chemically synthesized
gaaagataatctgaaattcagg

SEQ ID NO: 12502 - DNA, 22 bp, Artificial Sequence
  chemically synthesized
aaattcaggagacgtatctgac

SEQ ID NO: 12503 - DNA, 22 bp, Artificial Sequence
  chemically synthesized
aggagacgtatctgactatagg

SEQ ID NO: 12504 - DNA, 22 bp, Artificial Sequence
  chemically synthesized
actataggtgagtatttggaac

SEQ ID NO: 12505 - DNA, 22 bp, Artificial Sequence
  chemically synthesized
taggtgagtatttggaactcat

SEQ ID NO: 12506 - DNA, 22 bp, Artificial Sequence
  chemically synthesized
ggaactcattgttctgtaaaca

SEQ ID NO: 12507 - DNA, 22 bp, Artificial Sequence
  chemically synthesized
gaactcattgttctgtaaacag

SEQ ID NO: 12508 - DNA, 22 bp, Artificial Sequence
  chemically synthesized
attgttctgtaaacagtagtta

SEQ ID NO: 12509 - DNA, 22 bp, Artificial Sequence
  chemically synthesized
ttctgtaaacagtagttacagc

SEQ ID NO: 12510 - DNA, 22 bp, Artificial Sequence
  chemically synthesized
tgtaaacagtagttacagccac

SEQ ID NO: 12511 - DNA, 22 bp, Artificial Sequence
  chemically synthesized
taaacagtagttacagccacgt

SEQ ID NO: 12512 - DNA, 22 bp, Artificial Sequence
  chemically synthesized
cagccacgtgtgtgggcatctg

SEQ ID NO: 12513 - DNA, 22 bp, Artificial Sequence
  chemically synthesized
gagagtgagcatggatattgtg

SEQ ID NO: 12514 - DNA, 22 bp, Artificial Sequence
  chemically synthesized
tgatacctagtacagtgcctgg

SEQ ID NO: 12515 - DNA, 22 bp, Artificial Sequence
  chemically synthesized
gtacagtgcctggcagtagtgg

SEQ ID NO: 12516 - DNA, 22 bp, Artificial Sequence
  chemically synthesized
gcagtagtggttgtatgctcag

SEQ ID NO: 12517 - DNA, 22 bp, Artificial Sequence
  chemically synthesized
tatgctcagtaaattttgttga

SEQ ID NO: 12518 - DNA, 22 bp, Artificial Sequence
  chemically synthesized
agtaaattttgttgacagggtc

SEQ ID NO: 12519 - DNA, 22 bp, Artificial Sequence
  chemically synthesized
tgttgacagggtcagggccgga

SEQ ID NO: 12520 - DNA, 22 bp, Artificial Sequence
  chemically synthesized
gttgacagggtcagggccggac

SEQ ID NO: 12521 - DNA, 22 bp, Artificial Sequence
  chemically synthesized
ttgacagggtcagggccggact

SEQ ID NO: 12522 - DNA, 22 bp, Artificial Sequence
  chemically synthesized
acagggtcagggccggactaga

SEQ ID NO: 12523 - DNA, 22 bp, Artificial Sequence
  chemically synthesized
gactgtggtaagcaaggcctgt

SEQ ID NO: 12524 - DNA, 22 bp, Artificial Sequence
  chemically synthesized
tggtaagcaaggcctgtagggc

SEQ ID NO: 12525 - DNA, 22 bp, Artificial Sequence
  chemically synthesized
tagggcataaatatacttgtat

SEQ ID NO: 12526 - DNA, 22 bp, Artificial Sequence
  chemically synthesized
gtatgccccgagaagtgaggac

SEQ ID NO: 12527 - DNA, 22 bp, Artificial Sequence
  chemically synthesized
tatgccccgagaagtgaggacc

SEQ ID NO: 12528 - DNA, 22 bp, Artificial Sequence
  chemically synthesized
ttaaatattgtgccctacatgc

SEQ ID NO: 12529 - DNA, 22 bp, Artificial Sequence
  chemically synthesized
aaatattgtgccctacatgcct

SEQ ID NO: 12530 - DNA, 22 bp, Artificial Sequence
  chemically synthesized
aatattgtgccctacatgcctt

SEQ ID NO: 12531 - DNA, 22 bp, Artificial Sequence
  chemically synthesized
tgccctacatgccttgtttggt

SEQ ID NO: 12532 - DNA, 22 bp, Artificial Sequence
  chemically synthesized
catgccttgtttggttcactct

SEQ ID NO: 12533 - DNA, 22 bp, Artificial Sequence
  chemically synthesized
gtttggttcactcttgtcccag

SEQ ID NO: 12534 - DNA, 22 bp, Artificial Sequence
  chemically synthesized
tttggttcactcttgtcccagc

SEQ ID NO: 12535 - DNA, 22 bp, Artificial Sequence
  chemically synthesized
ggttcactcttgtcccagccct

SEQ ID NO: 12536 - DNA, 22 bp, Artificial Sequence
  chemically synthesized
gttcactcttgtcccagcccta

SEQ ID NO: 12537 - DNA, 22 bp, Artificial Sequence
  chemically synthesized
actcttgtcccagccctagcaa

SEQ ID NO: 12538 - DNA, 22 bp, Artificial Sequence
  chemically synthesized
ttgtcccagccctagcaagtat

SEQ ID NO: 12539 - DNA, 22 bp, Artificial Sequence
  chemically synthesized
gtcccagccctagcaagtatat

SEQ ID NO: 12540 - DNA, 22 bp, Artificial Sequence
  chemically synthesized
tcccagccctagcaagtatata

SEQ ID NO: 12541 - DNA, 22 bp, Artificial Sequence
  chemically synthesized
gcaagtatatataaggtgaaaa

SEQ ID NO: 12542 - DNA, 22 bp, Artificial Sequence
  chemically synthesized
aggctggagcctgggagaaccc

SEQ ID NO: 12543 - DNA, 22 bp, Artificial Sequence
  chemically synthesized
gagcctgggagaaccctggaca

SEQ ID NO: 12544 - DNA, 22 bp, Artificial Sequence
  chemically synthesized
ggagaaccctggacatttaagg

SEQ ID NO: 12545 - DNA, 22 bp, Artificial Sequence
  chemically synthesized
gacatttaagggccatggagag

SEQ ID NO: 12546 - DNA, 22 bp, Artificial Sequence
  chemically synthesized
aagggccatggagaggaacagg

SEQ ID NO: 12547 - DNA, 22 bp, Artificial Sequence
  chemically synthesized
agggccatggagaggaacagga

SEQ ID NO: 12548 - DNA, 22 bp, Artificial Sequence
  chemically synthesized
atcaattcaagtgctggatgga

SEQ ID NO: 12549 - DNA, 22 bp, Artificial Sequence
  chemically synthesized
aagtgctggatggataacagga

SEQ ID NO: 12550 - DNA, 22 bp, Artificial Sequence
  chemically synthesized
gatggataacaggagttagagc

SEQ ID NO: 12551 - DNA, 22 bp, Artificial Sequence
  chemically synthesized
gagcaaagcggggaaccagaat

SEQ ID NO: 12552 - DNA, 22 bp, Artificial Sequence
  chemically synthesized
ttataaaaagagtttcctaaaa

SEQ ID NO: 12553 - DNA, 22 bp, Artificial Sequence
  chemically synthesized
taaaaagagtttcctaaaaagg

SEQ ID NO: 12554 - DNA, 22 bp, Artificial Sequence
  chemically synthesized
cctaaaaagggagagatcaaca

SEQ ID NO: 12555 - DNA, 22 bp, Artificial Sequence
  chemically synthesized
ctaaaaagggagagatcaacaa

SEQ ID NO: 12556 - DNA, 22 bp, Artificial Sequence
  chemically synthesized
aaaagggagagatcaacaatta

SEQ ID NO: 12557 - DNA, 22 bp, Artificial Sequence
  chemically synthesized
gaaattatttagagcagccagt

SEQ ID NO: 12558 - DNA, 22 bp, Artificial Sequence
  chemically synthesized
tttagagcagccagtaaataca

SEQ ID NO: 12559 - DNA, 22 bp, Artificial Sequence
  chemically synthesized
agagcagccagtaaatacataa

SEQ ID NO: 12560 - DNA, 22 bp, Artificial Sequence
  chemically synthesized
gagcagccagtaaatacataaa

SEQ ID NO: 12561 - DNA, 22 bp, Artificial Sequence
  chemically synthesized
aaaattattctttaggtcattc

SEQ ID NO: 12562 - DNA, 22 bp, Artificial Sequence
  chemically synthesized
ttctttaggtcattcctgattg

SEQ ID NO: 12563 - DNA, 22 bp, Artificial Sequence
  chemically synthesized
tttaggtcattcctgattgtga

SEQ ID NO: 12564 - DNA, 22 bp, Artificial Sequence
  chemically synthesized
taggtcattcctgattgtgaca

SEQ ID NO: 12565 - DNA, 22 bp, Artificial Sequence
  chemically synthesized
aggtcattcctgattgtgacaa

SEQ ID NO: 12566 - DNA, 22 bp, Artificial Sequence
  chemically synthesized
ggtcattcctgattgtgacaat

SEQ ID NO: 12567 - DNA, 22 bp, Artificial Sequence
  chemically synthesized
ctgattgtgacaatagtcattt

SEQ ID NO: 12568 - DNA, 22 bp, Artificial Sequence
  chemically synthesized
attgtgacaatagtcatttcat

SEQ ID NO: 12569 - DNA, 22 bp, Artificial Sequence
  chemically synthesized
tgacaatagtcatttcattata

SEQ ID NO: 12570 - DNA, 22 bp, Artificial Sequence
  chemically synthesized
cattatataaatgtgattaagg

SEQ ID NO: 12571 - DNA, 22 bp, Artificial Sequence
  chemically synthesized
attatataaatgtgattaagga

SEQ ID NO: 12572 - DNA, 22 bp, Artificial Sequence
  chemically synthesized
tataaatgtgattaaggaagga

SEQ ID NO: 12573 - DNA, 22 bp, Artificial Sequence
  chemically synthesized
aggaaggaaaagagctacacag

SEQ ID NO: 12574 - DNA, 22 bp, Artificial Sequence
  chemically synthesized
cacagaagttattaaagagcta

SEQ ID NO: 12575 - DNA, 22 bp, Artificial Sequence
  chemically synthesized
ttaaagagctaaagagaattga

SEQ ID NO: 12576 - DNA, 22 bp, Artificial Sequence
  chemically synthesized
aagagctaaagagaattgagaa

SEQ ID NO: 12577 - DNA, 22 bp, Artificial Sequence
  chemically synthesized
aagagaattgagaaatttaaaa

SEQ ID NO: 12578 - DNA, 22 bp, Artificial Sequence
  chemically synthesized
agaaatttaaaacagaagaaag

SEQ ID NO: 12579 - DNA, 22 bp, Artificial Sequence
  chemically synthesized
aaaacagaagaaagtagggcca

SEQ ID NO: 12580 - DNA, 22 bp, Artificial Sequence
  chemically synthesized
aaacagaagaaagtagggccaa

SEQ ID NO: 12581 - DNA, 22 bp, Artificial Sequence
  chemically synthesized
tctcactgatcctgccaacacc

SEQ ID NO: 12582 - DNA, 22 bp, Artificial Sequence
  chemically synthesized
actgatcctgccaacacctgtg

SEQ ID NO: 12583 - DNA, 22 bp, Artificial Sequence
  chemically synthesized
atcctgccaacacctgtgagat

SEQ ID NO: 12584 - DNA, 22 bp, Artificial Sequence
  chemically synthesized
ccaacacctgtgagatagatat

SEQ ID NO: 12585 - DNA, 22 bp, Artificial Sequence
  chemically synthesized
tgagatagatattcttattata

SEQ ID NO: 12586 - DNA, 22 bp, Artificial Sequence
  chemically synthesized
ttattatactactgttaaacct

SEQ ID NO: 12587 - DNA, 22 bp, Artificial Sequence
  chemically synthesized
attatactactgttaaacctaa

SEQ ID NO: 12588 - DNA, 22 bp, Artificial Sequence
  chemically synthesized
ttatactactgttaaacctaat

SEQ ID NO: 12589 - DNA, 22 bp, Artificial Sequence
  chemically synthesized
tactactgttaaacctaattta

SEQ ID NO: 12590 - DNA, 22 bp, Artificial Sequence
  chemically synthesized
ctgttaaacctaatttacattt

SEQ ID NO: 12591 - DNA, 22 bp, Artificial Sequence
  chemically synthesized
ttaaacctaatttacatttgac

SEQ ID NO: 12592 - DNA, 22 bp, Artificial Sequence
  chemically synthesized
aacctaatttacatttgacaaa

SEQ ID NO: 12593 - DNA, 22 bp, Artificial Sequence
  chemically synthesized
atttacatttgacaaagttaag

SEQ ID NO: 12594 - DNA, 22 bp, Artificial Sequence
  chemically synthesized
acatttgacaaagttaaggttc

SEQ ID NO: 12595 - DNA, 22 bp, Artificial Sequence
  chemically synthesized
catttgacaaagttaaggttca

SEQ ID NO: 12596 - DNA, 22 bp, Artificial Sequence
  chemically synthesized
gacaaagttaaggttcagagct

SEQ ID NO: 12597 - DNA, 22 bp, Artificial Sequence
  chemically synthesized
acaaagttaaggttcagagctt

SEQ ID NO: 12598 - DNA, 22 bp, Artificial Sequence
  chemically synthesized
aggttcagagcttgtgtgactt

SEQ ID NO: 12599 - DNA, 22 bp, Artificial Sequence
  chemically synthesized
agagcttgtgtgacttgtccaa

SEQ ID NO: 12600 - DNA, 22 bp, Artificial Sequence
  chemically synthesized
gtgtgacttgtccaaggtcaca

SEQ ID NO: 12601 - DNA, 22 bp, Artificial Sequence
  chemically synthesized
tgtgacttgtccaaggtcacag

SEQ ID NO: 12602 - DNA, 22 bp, Artificial Sequence
  chemically synthesized
gtccaaggtcacaggtctagag

SEQ ID NO: 12603 - DNA, 22 bp, Artificial Sequence
  chemically synthesized
tccaaggtcacaggtctagagg

SEQ ID NO: 12604 - DNA, 22 bp, Artificial Sequence
  chemically synthesized
gaggaggcagatacttgattca

SEQ ID NO: 12605 - DNA, 22 bp, Artificial Sequence
  chemically synthesized
gattcaaacctatttctgtctg

SEQ ID NO: 12606 - DNA, 22 bp, Artificial Sequence
  chemically synthesized
attcaaacctatttctgtctga

SEQ ID NO: 12607 - DNA, 22 bp, Artificial Sequence
  chemically synthesized
aaacctatttctgtctgatctg

SEQ ID NO: 12608 - DNA, 22 bp, Artificial Sequence
  chemically synthesized
tttctgtctgatctgattctaa

SEQ ID NO: 12609 - DNA, 22 bp, Artificial Sequence
  chemically synthesized
ctgtctgatctgattctaaagt

SEQ ID NO: 12610 - DNA, 22 bp, Artificial Sequence
  chemically synthesized
tgtctgatctgattctaaagtc

SEQ ID NO: 12611 - DNA, 22 bp, Artificial Sequence
  chemically synthesized
tctgatctgattctaaagtctg

SEQ ID NO: 12612 - DNA, 22 bp, Artificial Sequence
  chemically synthesized
atctgattctaaagtctgtttt

SEQ ID NO: 12613 - DNA, 22 bp, Artificial Sequence
  chemically synthesized
attctaaagtctgttttttcac

SEQ ID NO: 12614 - DNA, 22 bp, Artificial Sequence
  chemically synthesized
taaagtctgttttttcactcaa

SEQ ID NO: 12615 - DNA, 22 bp, Artificial Sequence
  chemically synthesized
aagtctgttttttcactcaacc

SEQ ID NO: 12616 - DNA, 22 bp, Artificial Sequence
  chemically synthesized
ttttttcactcaaccacactgt

SEQ ID NO: 12617 - DNA, 22 bp, Artificial Sequence
  chemically synthesized
tttcactcaaccacactgtaca

SEQ ID NO: 12618 - DNA, 22 bp, Artificial Sequence
  chemically synthesized
ttcactcaaccacactgtacag

SEQ ID NO: 12619 - DNA, 22 bp, Artificial Sequence
  chemically synthesized
tcactcaaccacactgtacagt

SEQ ID NO: 12620 - DNA, 22 bp, Artificial Sequence
  chemically synthesized
cactcaaccacactgtacagtc

SEQ ID NO: 12621 - DNA, 22 bp, Artificial Sequence
  chemically synthesized
actcaaccacactgtacagtca

SEQ ID NO: 12622 - DNA, 22 bp, Artificial Sequence
  chemically synthesized
aaccacactgtacagtcagctc

SEQ ID NO: 12623 - DNA, 22 bp, Artificial Sequence
  chemically synthesized
tacagtcagctctccttgtgag

SEQ ID NO: 12624 - DNA, 22 bp, Artificial Sequence
  chemically synthesized
tccttgtgagttccacagccac

SEQ ID NO: 12625 - DNA, 22 bp, Artificial Sequence
  chemically synthesized
cttgtgagttccacagccacag

SEQ ID NO: 12626 - DNA, 22 bp, Artificial Sequence
  chemically synthesized
gtgagttccacagccacagatt

SEQ ID NO: 12627 - DNA, 22 bp, Artificial Sequence
  chemically synthesized
tgagttccacagccacagattc

SEQ ID NO: 12628 - DNA, 22 bp, Artificial Sequence
  chemically synthesized
cacagccacagattcaattaac

SEQ ID NO: 12629 - DNA, 22 bp, Artificial Sequence
  chemically synthesized
aattaactgcagatcaaaaata

SEQ ID NO: 12630 - DNA, 22 bp, Artificial Sequence
  chemically synthesized
actgcagatcaaaaatattcaa

SEQ ID NO: 12631 - DNA, 22 bp, Artificial Sequence
  chemically synthesized
cagatcaaaaatattcaagaaa

SEQ ID NO: 12632 - DNA, 22 bp, Artificial Sequence
  chemically synthesized
aagaaaaaaatggatggttgca

SEQ ID NO: 12633 - DNA, 22 bp, Artificial Sequence
  chemically synthesized
catctctactgaacatgtacag

SEQ ID NO: 12634 - DNA, 22 bp, Artificial Sequence
  chemically synthesized
tactgaacatgtacagactctt

SEQ ID NO: 12635 - DNA, 22 bp, Artificial Sequence
  chemically synthesized
ctgaacatgtacagactctttt

SEQ ID NO: 12636 - DNA, 22 bp, Artificial Sequence
  chemically synthesized
aacatgtacagactcttttatc

SEQ ID NO: 12637 - DNA, 22 bp, Artificial Sequence
  chemically synthesized
ttttatctttcattattcccta

SEQ ID NO: 12638 - DNA, 22 bp, Artificial Sequence
  chemically synthesized
ttatctttcattattccctaaa

SEQ ID NO: 12639 - DNA, 22 bp, Artificial Sequence
  chemically synthesized
tatctttcattattccctaaac

SEQ ID NO: 12640 - DNA, 22 bp, Artificial Sequence
  chemically synthesized
atctttcattattccctaaaca

SEQ ID NO: 12641 - DNA, 22 bp, Artificial Sequence
  chemically synthesized
tctttcattattccctaaacaa

SEQ ID NO: 12642 - DNA, 22 bp, Artificial Sequence
  chemically synthesized
tcattattccctaaacaataca

SEQ ID NO: 12643 - DNA, 22 bp, Artificial Sequence
  chemically synthesized
cattattccctaaacaatacag

SEQ ID NO: 12644 - DNA, 22 bp, Artificial Sequence
  chemically synthesized
attattccctaaacaatacagc

SEQ ID NO: 12645 - DNA, 22 bp, Artificial Sequence
  chemically synthesized
ttccctaaacaatacagcataa

SEQ ID NO: 12646 - DNA, 22 bp, Artificial Sequence
  chemically synthesized
cctaaacaatacagcataacaa

SEQ ID NO: 12647 - DNA, 22 bp, Artificial Sequence
  chemically synthesized
aacaatacagcataacaactat

SEQ ID NO: 12648 - DNA, 22 bp, Artificial Sequence
  chemically synthesized
tttacatagcatttacattgta

SEQ ID NO: 12649 - DNA, 22 bp, Artificial Sequence
  chemically synthesized
acatagcatttacattgtatta

SEQ ID NO: 12650 - DNA, 22 bp, Artificial Sequence
  chemically synthesized
catagcatttacattgtattag

SEQ ID NO: 12651 - DNA, 22 bp, Artificial Sequence
  chemically synthesized
acattgtattagctattaagag

SEQ ID NO: 12652 - DNA, 22 bp, Artificial Sequence
  chemically synthesized
cattgtattagctattaagaga

SEQ ID NO: 12653 - DNA, 22 bp, Artificial Sequence
  chemically synthesized
tattagctattaagagaaacct

SEQ ID NO: 12654 - DNA, 22 bp, Artificial Sequence
  chemically synthesized
gctattaagagaaacctagaga

SEQ ID NO: 12655 - DNA, 22 bp, Artificial Sequence
  chemically synthesized
ttaagagaaacctagagatgat

SEQ ID NO: 12656 - DNA, 22 bp, Artificial Sequence
  chemically synthesized
agagaaacctagagatgattta

SEQ ID NO: 12657 - DNA, 22 bp, Artificial Sequence
  chemically synthesized
gagatgatttaaagtacaaagg

SEQ ID NO: 12658 - DNA, 22 bp, Artificial Sequence
  chemically synthesized
aaagtacaaaggaggatgtgtt

SEQ ID NO: 12659 - DNA, 22 bp, Artificial Sequence
  chemically synthesized
aagtacaaaggaggatgtgttt

SEQ ID NO: 12660 - DNA, 22 bp, Artificial Sequence
  chemically synthesized
aggttatatgcaaatagtaagc

SEQ ID NO: 12661 - DNA, 22 bp, Artificial Sequence
  chemically synthesized
ggttatatgcaaatagtaagcc

SEQ ID NO: 12662 - DNA, 22 bp, Artificial Sequence
  chemically synthesized
tatgcaaatagtaagccatttt

SEQ ID NO: 12663 - DNA, 22 bp, Artificial Sequence
  chemically synthesized
ttatatcggagacttgagcatc

SEQ ID NO: 12664 - DNA, 22 bp, Artificial Sequence
  chemically synthesized
tatatcggagacttgagcatcc

SEQ ID NO: 12665 - DNA, 22 bp, Artificial Sequence
  chemically synthesized
atatcggagacttgagcatcca

SEQ ID NO: 12666 - DNA, 22 bp, Artificial Sequence
  chemically synthesized
tatcggagacttgagcatccac

SEQ ID NO: 12667 - DNA, 22 bp, Artificial Sequence
  chemically synthesized
gagcatccacagatcttgatat

SEQ ID NO: 12668 - DNA, 22 bp, Artificial Sequence
  chemically synthesized
agcatccacagatcttgatatt

SEQ ID NO: 12669 - DNA, 22 bp, Artificial Sequence
  chemically synthesized
gatatttgcagggggtcttgcc

SEQ ID NO: 12670 - DNA, 22 bp, Artificial Sequence
  chemically synthesized
atatttgcagggggtcttgcca

SEQ ID NO: 12671 - DNA, 22 bp, Artificial Sequence
  chemically synthesized
gcagggggtcttgccaccaatt

SEQ ID NO: 12672 - DNA, 22 bp, Artificial Sequence
  chemically synthesized
cagggggtcttgccaccaattt

SEQ ID NO: 12673 - DNA, 22 bp, Artificial Sequence
  chemically synthesized
gccaccaattttccatggatac

SEQ ID NO: 12674 - DNA, 22 bp, Artificial Sequence
  chemically synthesized
ccaccaattttccatggatact

SEQ ID NO: 12675 - DNA, 22 bp, Artificial Sequence
  chemically synthesized
tccatggatactgaggaacgac

SEQ ID NO: 12676 - DNA, 22 bp, Artificial Sequence
  chemically synthesized
ccatggatactgaggaacgact

SEQ ID NO: 12677 - DNA, 22 bp, Artificial Sequence
  chemically synthesized
catggatactgaggaacgactg

SEQ ID NO: 12678 - DNA, 22 bp, Artificial Sequence
  chemically synthesized
aggaacgactgtaaatggatgc

SEQ ID NO: 12679 - DNA, 22 bp, Artificial Sequence
  chemically synthesized
taaatggatgcaggcatggatg

SEQ ID NO: 12680 - DNA, 22 bp, Artificial Sequence
  chemically synthesized
tttaggagtgtccagggccaag

SEQ ID NO: 12681 - DNA, 22 bp, Artificial Sequence
  chemically synthesized
aggagtgtccagggccaagtaa

SEQ ID NO: 12682 - DNA, 22 bp, Artificial Sequence
  chemically synthesized
ggagtgtccagggccaagtaaa

SEQ ID NO: 12683 - DNA, 22 bp, Artificial Sequence
  chemically synthesized
ctgagcagagaggtgggtggag

SEQ ID NO: 12684 - DNA, 22 bp, Artificial Sequence
  chemically synthesized
agcagagaggtgggtggaggct

SEQ ID NO: 12685 - DNA, 22 bp, Artificial Sequence
  chemically synthesized
tgaggcatcaatatgtggtggc

SEQ ID NO: 12686 - DNA, 22 bp, Artificial Sequence
  chemically synthesized
cattttggtgatttttttcctt

SEQ ID NO: 12687 - DNA, 22 bp, Artificial Sequence
  chemically synthesized
tggtgatttttttccttcacag

SEQ ID NO: 12688 - DNA, 22 bp, Artificial Sequence
  chemically synthesized
ggtgatttttttccttcacagt

SEQ ID NO: 12689 - DNA, 22 bp, Artificial Sequence
  chemically synthesized
gtgatttttttccttcacagtc

SEQ ID NO: 12690 - DNA, 22 bp, Artificial Sequence
  chemically synthesized
ttttccttcacagtcctcggct

SEQ ID NO: 12691 - DNA, 22 bp, Artificial Sequence
  chemically synthesized
tttccttcacagtcctcggctg

SEQ ID NO: 12692 - DNA, 22 bp, Artificial Sequence
  chemically synthesized
ttccttcacagtcctcggctgt

SEQ ID NO: 12693 - DNA, 22 bp, Artificial Sequence
  chemically synthesized
tccttcacagtcctcggctgtc

SEQ ID NO: 12694 - DNA, 22 bp, Artificial Sequence
  chemically synthesized
ccttcacagtcctcggctgtct

SEQ ID NO: 12695 - DNA, 22 bp, Artificial Sequence
  chemically synthesized
cttcacagtcctcggctgtctg

SEQ ID NO: 12696 - DNA, 22 bp, Artificial Sequence
  chemically synthesized
cacagtcctcggctgtctggga

SEQ ID NO: 12697 - DNA, 22 bp, Artificial Sequence
  chemically synthesized
acagtcctcggctgtctgggaa

SEQ ID NO: 12698 - DNA, 22 bp, Artificial Sequence
  chemically synthesized
ggctgtctgggaagagaaggat

SEQ ID NO: 12699 - DNA, 22 bp, Artificial Sequence
  chemically synthesized
tctgggaagagaaggatgaagg

SEQ ID NO: 12700 - DNA, 22 bp, Artificial Sequence
  chemically synthesized
ggaagagaaggatgaaggcaga

SEQ ID NO: 12701 - DNA, 22 bp, Artificial Sequence
  chemically synthesized
ctccaatttaggggctaggatt

SEQ ID NO: 12702 - DNA, 22 bp, Artificial Sequence
  chemically synthesized
caatttaggggctaggattgca

SEQ ID NO: 12703 - DNA, 22 bp, Artificial Sequence
  chemically synthesized
aggggctaggattgcagggtgg

SEQ ID NO: 12704 - DNA, 22 bp, Artificial Sequence
  chemically synthesized
ggggctaggattgcagggtggg

SEQ ID NO: 12705 - DNA, 22 bp, Artificial Sequence
  chemically synthesized
ggattgcagggtgggcacagca

SEQ ID NO: 12706 - DNA, 22 bp, Artificial Sequence
  chemically synthesized
cagggtgggcacagcattgcaa

SEQ ID NO: 12707 - DNA, 22 bp, Artificial Sequence
  chemically synthesized
caaacgagtgaaggaaattgag

SEQ ID NO: 12708 - DNA, 22 bp, Artificial Sequence
  chemically synthesized
agaaatatggccaatgaagagt

SEQ ID NO: 12709 - DNA, 22 bp, Artificial Sequence
  chemically synthesized
aagagaggcctggcatggtggc

SEQ ID NO: 12710 - DNA, 22 bp, Artificial Sequence
  chemically synthesized
gcatggtggctcacacctataa

SEQ ID NO: 12711 - DNA, 22 bp, Artificial Sequence
  chemically synthesized
acacctataatcccagcacttt

SEQ ID NO: 12712 - DNA, 22 bp, Artificial Sequence
  chemically synthesized
taatcccagcactttcagaggc

SEQ ID NO: 12713 - DNA, 22 bp, Artificial Sequence
  chemically synthesized
tcagaggcccaggcaggcagat

SEQ ID NO: 12714 - DNA, 22 bp, Artificial Sequence
  chemically synthesized
cagaggcccaggcaggcagatc

SEQ ID NO: 12715 - DNA, 22 bp, Artificial Sequence
  chemically synthesized
agaggcccaggcaggcagatca

SEQ ID NO: 12716 - DNA, 22 bp, Artificial Sequence
  chemically synthesized
gaggtcaggagttcgacaccag

SEQ ID NO: 12717 - DNA, 22 bp, Artificial Sequence
  chemically synthesized
aggtcaggagttcgacaccagc

SEQ ID NO: 12718 - DNA, 22 bp, Artificial Sequence
  chemically synthesized
gacaccagcctggccaacaagg

SEQ ID NO: 12719 - DNA, 22 bp, Artificial Sequence
  chemically synthesized
gccaacaaggtgaaatggtgaa

SEQ ID NO: 12720 - DNA, 22 bp, Artificial Sequence
  chemically synthesized
tactaaaaatacaaaaattagc

SEQ ID NO: 12721 - DNA, 22 bp, Artificial Sequence
  chemically synthesized
actaaaaatacaaaaattagct

SEQ ID NO: 12722 - DNA, 22 bp, Artificial Sequence
  chemically synthesized
ctaaaaatacaaaaattagctg

SEQ ID NO: 12723 - DNA, 22 bp, Artificial Sequence
  chemically synthesized
aaaatacaaaaattagctgggc

SEQ ID NO: 12724 - DNA, 22 bp, Artificial Sequence
  chemically synthesized
gctgggcatggtggcgggtgcc

SEQ ID NO: 12725 - DNA, 22 bp, Artificial Sequence
  chemically synthesized
ggcatggtggcgggtgcctgta

SEQ ID NO: 12726 - DNA, 22 bp, Artificial Sequence
  chemically synthesized
taatcccagctacttgggaggc

SEQ ID NO: 12727 - DNA, 22 bp, Artificial Sequence
  chemically synthesized
cttgggaggctgaggcaggaga

SEQ ID NO: 12728 - DNA, 22 bp, Artificial Sequence
  chemically synthesized
gggaggctgaggcaggagaata

SEQ ID NO: 12729 - DNA, 22 bp, Artificial Sequence
  chemically synthesized
ggaggctgaggcaggagaatag

SEQ ID NO: 12730 - DNA, 22 bp, Artificial Sequence
  chemically synthesized
aggcaggagaatagcttgaacc

SEQ ID NO: 12731 - DNA, 22 bp, Artificial Sequence
  chemically synthesized
gaacctgggagatggaggttgc

SEQ ID NO: 12732 - DNA, 22 bp, Artificial Sequence
  chemically synthesized
aacctgggagatggaggttgca

SEQ ID NO: 12733 - DNA, 22 bp, Artificial Sequence
  chemically synthesized
ggagatggaggttgcagtgagc

SEQ ID NO: 12734 - DNA, 22 bp, Artificial Sequence
  chemically synthesized
cagtgagctgagatcgcaccac

SEQ ID NO: 12735 - DNA, 22 bp, Artificial Sequence
  chemically synthesized
agatcgcaccactgcactccag

SEQ ID NO: 12736 - DNA, 22 bp, Artificial Sequence
  chemically synthesized
cactccagcctgggcgacagag

SEQ ID NO: 12737 - DNA, 22 bp, Artificial Sequence
  chemically synthesized
cagcctgggcgacagagcaaga

SEQ ID NO: 12738 - DNA, 22 bp, Artificial Sequence
  chemically synthesized
ggcgacagagcaagactctgtc

SEQ ID NO: 12739 - DNA, 22 bp, Artificial Sequence
  chemically synthesized
tgtcaaaaaaaaaagagttgaa

SEQ ID NO: 12740 - DNA, 22 bp, Artificial Sequence
  chemically synthesized
tcaaaaaaaaaagagttgaaga

SEQ ID NO: 12741 - DNA, 22 bp, Artificial Sequence
  chemically synthesized
aagagaaaaagtctaggctaaa

SEQ ID NO: 12742 - DNA, 22 bp, Artificial Sequence
  chemically synthesized
ggctaaattcaaagaaaaaaag

SEQ ID NO: 12743 - DNA, 22 bp, Artificial Sequence
  chemically synthesized
aattcaaagaaaaaaagtgagc

SEQ ID NO: 12744 - DNA, 22 bp, Artificial Sequence
  chemically synthesized
aaagaaaaaaagtgagcccaaa

SEQ ID NO: 12745 - DNA, 22 bp, Artificial Sequence
  chemically synthesized
gcagagcaagggaaaagcaggg

SEQ ID NO: 12746 - DNA, 22 bp, Artificial Sequence
  chemically synthesized
cagagcaagggaaaagcaggga

SEQ ID NO: 12747 - DNA, 22 bp, Artificial Sequence
  chemically synthesized
gaacactccataaagtgaacag

SEQ ID NO: 12748 - DNA, 22 bp, Artificial Sequence
  chemically synthesized
cataaagtgaacagctgcaatg

SEQ ID NO: 12749 - DNA, 22 bp, Artificial Sequence
  chemically synthesized
caatgaaaataagggaagaaag

SEQ ID NO: 12750 - DNA, 22 bp, Artificial Sequence
  chemically synthesized
agttcatctccgtttctttcct

SEQ ID NO: 12751 - DNA, 22 bp, Artificial Sequence
  chemically synthesized
gttcatctccgtttctttcctt

SEQ ID NO: 12752 - DNA, 22 bp, Artificial Sequence
  chemically synthesized
atctccgtttctttcctttcct

SEQ ID NO: 12753 - DNA, 22 bp, Artificial Sequence
  chemically synthesized
cgtttctttcctttccttttta

SEQ ID NO: 12754 - DNA, 22 bp, Artificial Sequence
  chemically synthesized
ctttcctttcctttttactttc

SEQ ID NO: 12755 - DNA, 22 bp, Artificial Sequence
  chemically synthesized
tttcctttcctttttactttcc

SEQ ID NO: 12756 - DNA, 22 bp, Artificial Sequence
  chemically synthesized
tcctttcctttttactttcctt

SEQ ID NO: 12757 - DNA, 22 bp, Artificial Sequence
  chemically synthesized
cctttcctttttactttccttt

SEQ ID NO: 12758 - DNA, 22 bp, Artificial Sequence
  chemically synthesized
ctttcctttttactttcctttc

SEQ ID NO: 12759 - DNA, 22 bp, Artificial Sequence
  chemically synthesized
tcctttttactttcctttctct

SEQ ID NO: 12760 - DNA, 22 bp, Artificial Sequence
  chemically synthesized
cctttttactttcctttctctt

SEQ ID NO: 12761 - DNA, 22 bp, Artificial Sequence
  chemically synthesized
ctttttactttcctttctcttc

SEQ ID NO: 12762 - DNA, 22 bp, Artificial Sequence
  chemically synthesized
tttactttcctttctcttcctt

SEQ ID NO: 12763 - DNA, 22 bp, Artificial Sequence
  chemically synthesized
ttactttcctttctcttccttt

SEQ ID NO: 12764 - DNA, 22 bp, Artificial Sequence
  chemically synthesized
tactttcctttctcttcctttt

SEQ ID NO: 12765 - DNA, 22 bp, Artificial Sequence
  chemically synthesized
actttcctttctcttccttttt

SEQ ID NO: 12766 - DNA, 22 bp, Artificial Sequence
  chemically synthesized
ctttcctttctcttcctttttg

SEQ ID NO: 12767 - DNA, 22 bp, Artificial Sequence
  chemically synthesized
tcctttctcttcctttttggag

SEQ ID NO: 12768 - DNA, 22 bp, Artificial Sequence
  chemically synthesized
cctttctcttcctttttggagt

SEQ ID NO: 12769 - DNA, 22 bp, Artificial Sequence
  chemically synthesized
ctttctcttcctttttggagtt

SEQ ID NO: 12770 - DNA, 22 bp, Artificial Sequence
  chemically synthesized
tctcttcctttttggagttaat

SEQ ID NO: 12771 - DNA, 22 bp, Artificial Sequence
  chemically synthesized
ctcttcctttttggagttaatc

SEQ ID NO: 12772 - DNA, 22 bp, Artificial Sequence
  chemically synthesized
tcttcctttttggagttaatca

SEQ ID NO: 12773 - DNA, 22 bp, Artificial Sequence
  chemically synthesized
ttcctttttggagttaatcagg

SEQ ID NO: 12774 - DNA, 22 bp, Artificial Sequence
  chemically synthesized
cctttttggagttaatcaggaa

SEQ ID NO: 12775 - DNA, 22 bp, Artificial Sequence
  chemically synthesized
ctttttggagttaatcaggaag

SEQ ID NO: 12776 - DNA, 22 bp, Artificial Sequence
  chemically synthesized
tttggagttaatcaggaagtag

SEQ ID NO: 12777 - DNA, 22 bp, Artificial Sequence
  chemically synthesized
ttggagttaatcaggaagtagt

SEQ ID NO: 12778 - DNA, 22 bp, Artificial Sequence
  chemically synthesized
tggagttaatcaggaagtagtc

SEQ ID NO: 12779 - DNA, 22 bp, Artificial Sequence
  chemically synthesized
ggagttaatcaggaagtagtcc

SEQ ID NO: 12780 - DNA, 22 bp, Artificial Sequence
  chemically synthesized
gagttaatcaggaagtagtccc

SEQ ID NO: 12781 - DNA, 22 bp, Artificial Sequence
  chemically synthesized
atcaggaagtagtcccaaatac

SEQ ID NO: 12782 - DNA, 22 bp, Artificial Sequence
  chemically synthesized
atcttataagcccttggtcctc

SEQ ID NO: 12783 - DNA, 22 bp, Artificial Sequence
  chemically synthesized
ataagcccttggtcctcttgag

SEQ ID NO: 12784 - DNA, 22 bp, Artificial Sequence
  chemically synthesized
taagcccttggtcctcttgaga

SEQ ID NO: 12785 - DNA, 22 bp, Artificial Sequence
  chemically synthesized
ggtcctcttgagatggtatcag

SEQ ID NO: 12786 - DNA, 22 bp, Artificial Sequence
  chemically synthesized
gtcctcttgagatggtatcaga

SEQ ID NO: 12787 - DNA, 22 bp, Artificial Sequence
  chemically synthesized
ttgagatggtatcagatatatt

SEQ ID NO: 12788 - DNA, 22 bp, Artificial Sequence
  chemically synthesized
gagatggtatcagatatattgc

SEQ ID NO: 12789 - DNA, 22 bp, Artificial Sequence
  chemically synthesized
agatggtatcagatatattgct

SEQ ID NO: 12790 - DNA, 22 bp, Artificial Sequence
  chemically synthesized
ctagacccttgaagaaaggaac

SEQ ID NO: 12791 - DNA, 22 bp, Artificial Sequence
  chemically synthesized
gacccttgaagaaaggaacaac

SEQ ID NO: 12792 - DNA, 22 bp, Artificial Sequence
  chemically synthesized
gaagaaaggaacaactccaggc

SEQ ID NO: 12793 - DNA, 22 bp, Artificial Sequence
  chemically synthesized
aagaaaggaacaactccaggca

SEQ ID NO: 12794 - DNA, 22 bp, Artificial Sequence
  chemically synthesized
caggcaacttcttgagtccctg

SEQ ID NO: 12795 - DNA, 22 bp, Artificial Sequence
  chemically synthesized
cttgagtccctgttattaattt

SEQ ID NO: 12796 - DNA, 22 bp, Artificial Sequence
  chemically synthesized
ttgagtccctgttattaatttt

SEQ ID NO: 12797 - DNA, 22 bp, Artificial Sequence
  chemically synthesized
gagtccctgttattaattttat

SEQ ID NO: 12798 - DNA, 22 bp, Artificial Sequence
  chemically synthesized
agtccctgttattaattttata

SEQ ID NO: 12799 - DNA, 22 bp, Artificial Sequence
  chemically synthesized
ttattaattttatacatacaca

SEQ ID NO: 12800 - DNA, 22 bp, Artificial Sequence
  chemically synthesized
ttaattttatacatacacacac

SEQ ID NO: 12801 - DNA, 22 bp, Artificial Sequence
  chemically synthesized
attttatacatacacacacata

SEQ ID NO: 12802 - DNA, 22 bp, Artificial Sequence
  chemically synthesized
tatacatacacacacatatatg

SEQ ID NO: 12803 - DNA, 22 bp, Artificial Sequence
  chemically synthesized
atacatacacacacatatatgt

SEQ ID NO: 12804 - DNA, 22 bp, Artificial Sequence
  chemically synthesized
tacatacacacacatatatgta

SEQ ID NO: 12805 - DNA, 22 bp, Artificial Sequence
  chemically synthesized
cttaacaatggggatatattct

SEQ ID NO: 12806 - DNA, 22 bp, Artificial Sequence
  chemically synthesized
aacaatggggatatattctgag

SEQ ID NO: 12807 - DNA, 22 bp, Artificial Sequence
  chemically synthesized
acaatggggatatattctgaga

SEQ ID NO: 12808 - DNA, 22 bp, Artificial Sequence
  chemically synthesized
tgagaaatgtgtcattaagcaa

SEQ ID NO: 12809 - DNA, 22 bp, Artificial Sequence
  chemically synthesized
agaaatgtgtcattaagcaatt

SEQ ID NO: 12810 - DNA, 22 bp, Artificial Sequence
  chemically synthesized
agcaatttcatcattgtgcgaa

SEQ ID NO: 12811 - DNA, 22 bp, Artificial Sequence
  chemically synthesized
catcattgtgcgaacataatag

SEQ ID NO: 12812 - DNA, 22 bp, Artificial Sequence
  chemically synthesized
atcattgtgcgaacataataga

SEQ ID NO: 12813 - DNA, 22 bp, Artificial Sequence
  chemically synthesized
tgcgaacataatagagtgtact

SEQ ID NO: 12814 - DNA, 22 bp, Artificial Sequence
  chemically synthesized
acctaaacctaaatggtatagc

SEQ ID NO: 12815 - DNA, 22 bp, Artificial Sequence
  chemically synthesized
cctaaacctaaatggtatagct

SEQ ID NO: 12816 - DNA, 22 bp, Artificial Sequence
  chemically synthesized
aacctaaatggtatagcttact

SEQ ID NO: 12817 - DNA, 22 bp, Artificial Sequence
  chemically synthesized
aatggtatagcttactacatac

SEQ ID NO: 12818 - DNA, 22 bp, Artificial Sequence
  chemically synthesized
actacatacctaggttgtattg

SEQ ID NO: 12819 - DNA, 22 bp, Artificial Sequence
  chemically synthesized
ctacatacctaggttgtattga

SEQ ID NO: 12820 - DNA, 22 bp, Artificial Sequence
  chemically synthesized
catacctaggttgtattgatgt

SEQ ID NO: 12821 - DNA, 22 bp, Artificial Sequence
  chemically synthesized
ggttgtattgatgtggcctatt

SEQ ID NO: 12822 - DNA, 22 bp, Artificial Sequence
  chemically synthesized
tattgatgtggcctattgctcc

SEQ ID NO: 12823 - DNA, 22 bp, Artificial Sequence
  chemically synthesized
atgtggcctattgctcctaggc

SEQ ID NO: 12824 - DNA, 22 bp, Artificial Sequence
  chemically synthesized
ttgctcctaggctcctgggctg

SEQ ID NO: 12825 - DNA, 22 bp, Artificial Sequence
  chemically synthesized
ctcctaggctcctgggctgcaa

SEQ ID NO: 12826 - DNA, 22 bp, Artificial Sequence
  chemically synthesized
ctaggctcctgggctgcaaacc

SEQ ID NO: 12827 - DNA, 22 bp, Artificial Sequence
  chemically synthesized
ggctcctgggctgcaaacctgt

SEQ ID NO: 12828 - DNA, 22 bp, Artificial Sequence
  chemically synthesized
ctgggctgcaaacctgtacagc

SEQ ID NO: 12829 - DNA, 22 bp, Artificial Sequence
  chemically synthesized
ggctgcaaacctgtacagcatg

SEQ ID NO: 12830 - DNA, 22 bp, Artificial Sequence
  chemically synthesized
caaacctgtacagcatgtgact

SEQ ID NO: 12831 - DNA, 22 bp, Artificial Sequence
  chemically synthesized
tacagcatgtgactgtactgaa

SEQ ID NO: 12832 - DNA, 22 bp, Artificial Sequence
  chemically synthesized
tactgaacactgtaggcaatgg

SEQ ID NO: 12833 - DNA, 22 bp, Artificial Sequence
  chemically synthesized
aacactgtaggcaatggtaaca

SEQ ID NO: 12834 - DNA, 22 bp, Artificial Sequence
  chemically synthesized
taggcaatggtaacagtggtat

SEQ ID NO: 12835 - DNA, 22 bp, Artificial Sequence
  chemically synthesized
gtgtatctaaacatagaaaagg

SEQ ID NO: 12836 - DNA, 22 bp, Artificial Sequence
  chemically synthesized
tgtatctaaacatagaaaaggt

SEQ ID NO: 12837 - DNA, 22 bp, Artificial Sequence
  chemically synthesized
aacatagaaaaggtacagtgaa

SEQ ID NO: 12838 - DNA, 22 bp, Artificial Sequence
  chemically synthesized
taaccttatgggaccactgtcg

SEQ ID NO: 12839 - DNA, 22 bp, Artificial Sequence
  chemically synthesized
atgggaccactgtcgtataatg

SEQ ID NO: 12840 - DNA, 22 bp, Artificial Sequence
  chemically synthesized
tgggaccactgtcgtataatgt

SEQ ID NO: 12841 - DNA, 22 bp, Artificial Sequence
  chemically synthesized
tcgtataatgtggtccatcatt

SEQ ID NO: 12842 - DNA, 22 bp, Artificial Sequence
  chemically synthesized
accaaaatgtcattgtgcagca

SEQ ID NO: 12843 - DNA, 22 bp, Artificial Sequence
  chemically synthesized
tgcagcaaatgattatctcata

SEQ ID NO: 12844 - DNA, 22 bp, Artificial Sequence
  chemically synthesized
tctcatatatatatatatatga

SEQ ID NO: 12845 - DNA, 22 bp, Artificial Sequence
  chemically synthesized
atatatatatatatatgatatg

SEQ ID NO: 12846 - DNA, 22 bp, Artificial Sequence
  chemically synthesized
agatagagacatctatcctcca

SEQ ID NO: 12847 - DNA, 22 bp, Artificial Sequence
  chemically synthesized
tcctccagagttcaggagtgtc

SEQ ID NO: 12848 - DNA, 22 bp, Artificial Sequence
  chemically synthesized
cagagttcaggagtgtctcttc

SEQ ID NO: 12849 - DNA, 22 bp, Artificial Sequence
  chemically synthesized
aggagtgtctcttcagactagg

SEQ ID NO: 12850 - DNA, 22 bp, Artificial Sequence
  chemically synthesized
ttcagactaggtagatgtagct

SEQ ID NO: 12851 - DNA, 22 bp, Artificial Sequence
  chemically synthesized
cagactaggtagatgtagctta

SEQ ID NO: 12852 - DNA, 22 bp, Artificial Sequence
  chemically synthesized
agactaggtagatgtagcttaa

SEQ ID NO: 12853 - DNA, 22 bp, Artificial Sequence
  chemically synthesized
ggtagatgtagcttaaaaaaaa

SEQ ID NO: 12854 - DNA, 22 bp, Artificial Sequence
  chemically synthesized
aaaaaaaacatatcctgaattc

SEQ ID NO: 12855 - DNA, 22 bp, Artificial Sequence
  chemically synthesized
aaaaaaacatatcctgaattct

SEQ ID NO: 12856 - DNA, 22 bp, Artificial Sequence
  chemically synthesized
aattctagagagatgcttaaat

SEQ ID NO: 12857 - DNA, 22 bp, Artificial Sequence
  chemically synthesized
tagagagatgcttaaatcactg

SEQ ID NO: 12858 - DNA, 22 bp, Artificial Sequence
  chemically synthesized
gagagatgcttaaatcactgca

SEQ ID NO: 12859 - DNA, 22 bp, Artificial Sequence
  chemically synthesized
aaatcactgcaattcctataac

SEQ ID NO: 12860 - DNA, 22 bp, Artificial Sequence
  chemically synthesized
aatcactgcaattcctataaca

SEQ ID NO: 12861 - DNA, 22 bp, Artificial Sequence
  chemically synthesized
caattcctataacacttgccaa

SEQ ID NO: 12862 - DNA, 22 bp, Artificial Sequence
  chemically synthesized
ctataacacttgccaaccaaag

SEQ ID NO: 12863 - DNA, 22 bp, Artificial Sequence
  chemically synthesized
taacacttgccaaccaaaggtg

SEQ ID NO: 12864 - DNA, 22 bp, Artificial Sequence
  chemically synthesized
gccaaccaaaggtgctgttgat

SEQ ID NO: 12865 - DNA, 22 bp, Artificial Sequence
  chemically synthesized
ccaaccaaaggtgctgttgatc

SEQ ID NO: 12866 - DNA, 22 bp, Artificial Sequence
  chemically synthesized
ttgatctgaaattgctttttta

SEQ ID NO: 12867 - DNA, 22 bp, Artificial Sequence
  chemically synthesized
atctgaaattgcttttttaaat

SEQ ID NO: 12868 - DNA, 22 bp, Artificial Sequence
  chemically synthesized
aaattgcttttttaaattaatg

SEQ ID NO: 12869 - DNA, 22 bp, Artificial Sequence
  chemically synthesized
cttttttaaattaatgcagtga

SEQ ID NO: 12870 - DNA, 22 bp, Artificial Sequence
  chemically synthesized
ttttaaattaatgcagtgattt

SEQ ID NO: 12871 - DNA, 22 bp, Artificial Sequence
  chemically synthesized
tttaaattaatgcagtgatttt

SEQ ID NO: 12872 - DNA, 22 bp, Artificial Sequence
  chemically synthesized
ttaaattaatgcagtgattttt

SEQ ID NO: 12873 - DNA, 22 bp, Artificial Sequence
  chemically synthesized
taaattaatgcagtgatttttc

SEQ ID NO: 12874 - DNA, 22 bp, Artificial Sequence
  chemically synthesized
aaattaatgcagtgatttttct

SEQ ID NO: 12875 - DNA, 22 bp, Artificial Sequence
  chemically synthesized
aattaatgcagtgatttttctt

SEQ ID NO: 12876 - DNA, 22 bp, Artificial Sequence
  chemically synthesized
atgcagtgatttttctttaaca

SEQ ID NO: 12877 - DNA, 22 bp, Artificial Sequence
  chemically synthesized
ttctttaacatctagtgacaga

SEQ ID NO: 12878 - DNA, 22 bp, Artificial Sequence
  chemically synthesized
tctttaacatctagtgacagac

SEQ ID NO: 12879 - DNA, 22 bp, Artificial Sequence
  chemically synthesized
ctttaacatctagtgacagaca

SEQ ID NO: 12880 - DNA, 22 bp, Artificial Sequence
  chemically synthesized
tttaacatctagtgacagacac

SEQ ID NO: 12881 - DNA, 22 bp, Artificial Sequence
  chemically synthesized
taacatctagtgacagacactg

SEQ ID NO: 12882 - DNA, 22 bp, Artificial Sequence
  chemically synthesized
aacatctagtgacagacactgg

SEQ ID NO: 12883 - DNA, 22 bp, Artificial Sequence
  chemically synthesized
acatctagtgacagacactggg

SEQ ID NO: 12884 - DNA, 22 bp, Artificial Sequence
  chemically synthesized
gtgacagacactggggtcacat

SEQ ID NO: 12885 - DNA, 22 bp, Artificial Sequence
  chemically synthesized
gggtcacatttgcagctggacc

SEQ ID NO: 12886 - DNA, 22 bp, Artificial Sequence
  chemically synthesized
gcagctggaccataattaggct

SEQ ID NO: 12887 - DNA, 22 bp, Artificial Sequence
  chemically synthesized
cagctggaccataattaggctt

SEQ ID NO: 12888 - DNA, 22 bp, Artificial Sequence
  chemically synthesized
gaccataattaggcttctgttc

SEQ ID NO: 12889 - DNA, 22 bp, Artificial Sequence
  chemically synthesized
ggcttctgttcttcaggagaca

SEQ ID NO: 12890 - DNA, 22 bp, Artificial Sequence
  chemically synthesized
ctgttcttcaggagacatttgt

SEQ ID NO: 12891 - DNA, 22 bp, Artificial Sequence
  chemically synthesized
tgttcttcaggagacatttgtt

SEQ ID NO: 12892 - DNA, 22 bp, Artificial Sequence
  chemically synthesized
ttcttcaggagacatttgttca

SEQ ID NO: 12893 - DNA, 22 bp, Artificial Sequence
  chemically synthesized
ttcaggagacatttgttcaaag

SEQ ID NO: 12894 - DNA, 22 bp, Artificial Sequence
  chemically synthesized
caggagacatttgttcaaagtc

SEQ ID NO: 12895 - DNA, 22 bp, Artificial Sequence
  chemically synthesized
aggagacatttgttcaaagtca

SEQ ID NO: 12896 - DNA, 22 bp, Artificial Sequence
  chemically synthesized
gttcaaagtcatttgggcaacc

SEQ ID NO: 12897 - DNA, 22 bp, Artificial Sequence
  chemically synthesized
ttcaaagtcatttgggcaacca

SEQ ID NO: 12898 - DNA, 22 bp, Artificial Sequence
  chemically synthesized
aaagtcatttgggcaaccatat

SEQ ID NO: 12899 - DNA, 22 bp, Artificial Sequence
  chemically synthesized
gggcaaccatattctgaaaaca

SEQ ID NO: 12900 - DNA, 22 bp, Artificial Sequence
  chemically synthesized
ggcaaccatattctgaaaacag

SEQ ID NO: 12901 - DNA, 22 bp, Artificial Sequence
  chemically synthesized
tgaaaacagcccagccagggtg

SEQ ID NO: 12902 - DNA, 22 bp, Artificial Sequence
  chemically synthesized
aaaacagcccagccagggtgat

SEQ ID NO: 12903 - DNA, 22 bp, Artificial Sequence
  chemically synthesized
tgcaaagatcctcaatgagcta

SEQ ID NO: 12904 - DNA, 22 bp, Artificial Sequence
  chemically synthesized
gcaaagatcctcaatgagctat

SEQ ID NO: 12905 - DNA, 22 bp, Artificial Sequence
  chemically synthesized
caaagatcctcaatgagctatt

SEQ ID NO: 12906 - DNA, 22 bp, Artificial Sequence
  chemically synthesized
aatgagctattttcaagtgatg

SEQ ID NO: 12907 - DNA, 22 bp, Artificial Sequence
  chemically synthesized
ttttcaagtgatgacaaagtgt

SEQ ID NO: 12908 - DNA, 22 bp, Artificial Sequence
  chemically synthesized
tcaagtgatgacaaagtgtgaa

SEQ ID NO: 12909 - DNA, 22 bp, Artificial Sequence
  chemically synthesized
caagtgatgacaaagtgtgaag

SEQ ID NO: 12910 - DNA, 22 bp, Artificial Sequence
  chemically synthesized
aagtgatgacaaagtgtgaagt

SEQ ID NO: 12911 - DNA, 22 bp, Artificial Sequence
  chemically synthesized
accgctcatttgagaactttct

SEQ ID NO: 12912 - DNA, 22 bp, Artificial Sequence
  chemically synthesized
atttgagaactttctttttcat

SEQ ID NO: 12913 - DNA, 22 bp, Artificial Sequence
  chemically synthesized
gagaactttctttttcatccaa

SEQ ID NO: 12914 - DNA, 22 bp, Artificial Sequence
  chemically synthesized
agaactttctttttcatccaaa

SEQ ID NO: 12915 - DNA, 22 bp, Artificial Sequence
  chemically synthesized
tctttttcatccaaagtaaatt

SEQ ID NO: 12916 - DNA, 22 bp, Artificial Sequence
  chemically synthesized
ctttttcatccaaagtaaattc

SEQ ID NO: 12917 - DNA, 22 bp, Artificial Sequence
  chemically synthesized
tttttcatccaaagtaaattca

SEQ ID NO: 12918 - DNA, 22 bp, Artificial Sequence
  chemically synthesized
tttcatccaaagtaaattcaaa

SEQ ID NO: 12919 - DNA, 22 bp, Artificial Sequence
  chemically synthesized
ttcatccaaagtaaattcaaat

SEQ ID NO: 12920 - DNA, 22 bp, Artificial Sequence
  chemically synthesized
tcatccaaagtaaattcaaata

SEQ ID NO: 12921 - DNA, 22 bp, Artificial Sequence
  chemically synthesized
catccaaagtaaattcaaatat

SEQ ID NO: 12922 - DNA, 22 bp, Artificial Sequence
  chemically synthesized
atccaaagtaaattcaaatatg

SEQ ID NO: 12923 - DNA, 22 bp, Artificial Sequence
  chemically synthesized
aaatatgattagaaatctgacc

SEQ ID NO: 12924 - DNA, 22 bp, Artificial Sequence
  chemically synthesized
gaaatctgaccttttattactg

SEQ ID NO: 12925 - DNA, 22 bp, Artificial Sequence
  chemically synthesized
accttttattactggaattctc

SEQ ID NO: 12926 - DNA, 22 bp, Artificial Sequence
  chemically synthesized
ttattactggaattctcttgac

SEQ ID NO: 12927 - DNA, 22 bp, Artificial Sequence
  chemically synthesized
tattactggaattctcttgact

SEQ ID NO: 12928 - DNA, 22 bp, Artificial Sequence
  chemically synthesized
attactggaattctcttgacta

SEQ ID NO: 12929 - DNA, 22 bp, Artificial Sequence
  chemically synthesized
ttactggaattctcttgactaa

SEQ ID NO: 12930 - DNA, 22 bp, Artificial Sequence
  chemically synthesized
ctggaattctcttgactaaaag

SEQ ID NO: 12931 - DNA, 22 bp, Artificial Sequence
  chemically synthesized
gaattctcttgactaaaagtaa

SEQ ID NO: 12932 - DNA, 22 bp, Artificial Sequence
  chemically synthesized
tcttgactaaaagtaaaattga

SEQ ID NO: 12933 - DNA, 22 bp, Artificial Sequence
  chemically synthesized
ttgactaaaagtaaaattgaat

SEQ ID NO: 12934 - DNA, 22 bp, Artificial Sequence
  chemically synthesized
gactaaaagtaaaattgaattt

SEQ ID NO: 12935 - DNA, 22 bp, Artificial Sequence
  chemically synthesized
actaaaagtaaaattgaatttt

SEQ ID NO: 12936 - DNA, 22 bp, Artificial Sequence
  chemically synthesized
aaagtaaaattgaattttaatt

SEQ ID NO: 12937 - DNA, 22 bp, Artificial Sequence
  chemically synthesized
aattttaattcctaaatctcca

SEQ ID NO: 12938 - DNA, 22 bp, Artificial Sequence
  chemically synthesized
taattcctaaatctccatgtgt

SEQ ID NO: 12939 - DNA, 22 bp, Artificial Sequence
  chemically synthesized
aattcctaaatctccatgtgta

SEQ ID NO: 12940 - DNA, 22 bp, Artificial Sequence
  chemically synthesized
attcctaaatctccatgtgtat

SEQ ID NO: 12941 - DNA, 22 bp, Artificial Sequence
  chemically synthesized
ctaaatctccatgtgtatacag

SEQ ID NO: 12942 - DNA, 22 bp, Artificial Sequence
  chemically synthesized
aatctccatgtgtatacagtac

SEQ ID NO: 12943 - DNA, 22 bp, Artificial Sequence
  chemically synthesized
catgtgtatacagtactgtggg

SEQ ID NO: 12944 - DNA, 22 bp, Artificial Sequence
  chemically synthesized
tgggaacatcacagattttggc

SEQ ID NO: 12945 - DNA, 22 bp, Artificial Sequence
  chemically synthesized
tggctccatgccctaaagagaa

SEQ ID NO: 12946 - DNA, 22 bp, Artificial Sequence
  chemically synthesized
ggctccatgccctaaagagaaa

SEQ ID NO: 12947 - DNA, 22 bp, Artificial Sequence
  chemically synthesized
gctccatgccctaaagagaaat

SEQ ID NO: 12948 - DNA, 22 bp, Artificial Sequence
  chemically synthesized
catgccctaaagagaaattggc

SEQ ID NO: 12949 - DNA, 22 bp, Artificial Sequence
  chemically synthesized
aagagaaattggctttcagatt

SEQ ID NO: 12950 - DNA, 22 bp, Artificial Sequence
  chemically synthesized
gctttcagattatttggattaa

SEQ ID NO: 12951 - DNA, 22 bp, Artificial Sequence
  chemically synthesized
tcagattatttggattaaaaac

SEQ ID NO: 12952 - DNA, 22 bp, Artificial Sequence
  chemically synthesized
cagattatttggattaaaaaca

SEQ ID NO: 12953 - DNA, 22 bp, Artificial Sequence
  chemically synthesized
agattatttggattaaaaacaa

SEQ ID NO: 12954 - DNA, 22 bp, Artificial Sequence
  chemically synthesized
tttggattaaaaacaaagactt

SEQ ID NO: 12955 - DNA, 22 bp, Artificial Sequence
  chemically synthesized
ggattaaaaacaaagactttct

SEQ ID NO: 12956 - DNA, 22 bp, Artificial Sequence
  chemically synthesized
gattaaaaacaaagactttctt

SEQ ID NO: 12957 - DNA, 22 bp, Artificial Sequence
  chemically synthesized
aaaacaaagactttcttaagag

SEQ ID NO: 12958 - DNA, 22 bp, Artificial Sequence
  chemically synthesized
tcttaagagatgtaaaattttc

SEQ ID NO: 12959 - DNA, 22 bp, Artificial Sequence
  chemically synthesized
cttaagagatgtaaaattttca

SEQ ID NO: 12960 - DNA, 22 bp, Artificial Sequence
  chemically synthesized
ttaagagatgtaaaattttcat

SEQ ID NO: 12961 - DNA, 22 bp, Artificial Sequence
  chemically synthesized
aagagatgtaaaattttcatga

SEQ ID NO: 12962 - DNA, 22 bp, Artificial Sequence
  chemically synthesized
agagatgtaaaattttcatgat

SEQ ID NO: 12963 - DNA, 22 bp, Artificial Sequence
  chemically synthesized
tcatgatgttttcttttttgct

SEQ ID NO: 12964 - DNA, 22 bp, Artificial Sequence
  chemically synthesized
catgatgttttcttttttgcta

SEQ ID NO: 12965 - DNA, 22 bp, Artificial Sequence
  chemically synthesized
atgatgttttcttttttgctaa

SEQ ID NO: 12966 - DNA, 22 bp, Artificial Sequence
  chemically synthesized
tcttttttgctaaaactaaaga

SEQ ID NO: 12967 - DNA, 22 bp, Artificial Sequence
  chemically synthesized
cttttttgctaaaactaaagaa

SEQ ID NO: 12968 - DNA, 22 bp, Artificial Sequence
  chemically synthesized
ttttttgctaaaactaaagaat

SEQ ID NO: 12969 - DNA, 22 bp, Artificial Sequence
  chemically synthesized
ttttgctaaaactaaagaatta

SEQ ID NO: 12970 - DNA, 22 bp, Artificial Sequence
  chemically synthesized
tttgctaaaactaaagaattat

SEQ ID NO: 12971 - DNA, 22 bp, Artificial Sequence
  chemically synthesized
ttgctaaaactaaagaattatt

SEQ ID NO: 12972 - DNA, 22 bp, Artificial Sequence
  chemically synthesized
tgctaaaactaaagaattattc

SEQ ID NO: 12973 - DNA, 22 bp, Artificial Sequence
  chemically synthesized
gctaaaactaaagaattattct

SEQ ID NO: 12974 - DNA, 22 bp, Artificial Sequence
  chemically synthesized
ctaaaactaaagaattattctt

SEQ ID NO: 12975 - DNA, 22 bp, Artificial Sequence
  chemically synthesized
aaactaaagaattattctttta

SEQ ID NO: 12976 - DNA, 22 bp, Artificial Sequence
  chemically synthesized
aagaattattcttttacatttc

SEQ ID NO: 12977 - DNA, 22 bp, Artificial Sequence
  chemically synthesized
ttcttttacatttcagtttttc

SEQ ID NO: 12978 - DNA, 22 bp, Artificial Sequence
  chemically synthesized
ttttacatttcagtttttcttg

SEQ ID NO: 12979 - DNA, 22 bp, Artificial Sequence
  chemically synthesized
ttacatttcagtttttcttgat

SEQ ID NO: 12980 - DNA, 22 bp, Artificial Sequence
  chemically synthesized
tacatttcagtttttcttgatc

SEQ ID NO: 12981 - DNA, 22 bp, Artificial Sequence
  chemically synthesized
acatttcagtttttcttgatca

SEQ ID NO: 12982 - DNA, 22 bp, Artificial Sequence
  chemically synthesized
catttcagtttttcttgatcat

SEQ ID NO: 12983 - DNA, 22 bp, Artificial Sequence
  chemically synthesized
cagtttttcttgatcatgaaaa

SEQ ID NO: 12984 - DNA, 22 bp, Artificial Sequence
  chemically synthesized
agtttttcttgatcatgaaaac

SEQ ID NO: 12985 - DNA, 22 bp, Artificial Sequence
  chemically synthesized
ttcttgatcatgaaaacgccaa

SEQ ID NO: 12986 - DNA, 22 bp, Artificial Sequence
  chemically synthesized
tcttgatcatgaaaacgccaac

SEQ ID NO: 12987 - DNA, 22 bp, Artificial Sequence
  chemically synthesized
cttgatcatgaaaacgccaaca

SEQ ID NO: 12988 - DNA, 22 bp, Artificial Sequence
  chemically synthesized
ttgatcatgaaaacgccaacaa

SEQ ID NO: 12989 - DNA, 22 bp, Artificial Sequence
  chemically synthesized
gatcatgaaaacgccaacaaaa

SEQ ID NO: 12990 - DNA, 22 bp, Artificial Sequence
  chemically synthesized
atcatgaaaacgccaacaaaat

SEQ ID NO: 12991 - DNA, 22 bp, Artificial Sequence
  chemically synthesized
tgaatcggccaaagaggtataa

SEQ ID NO: 12992 - DNA, 22 bp, Artificial Sequence
  chemically synthesized
aatcggccaaagaggtataatt

SEQ ID NO: 12993 - DNA, 22 bp, Artificial Sequence
  chemically synthesized
aggtaaattggaagagtttgtt

SEQ ID NO: 12994 - DNA, 22 bp, Artificial Sequence
  chemically synthesized
gaagagtttgttcaagggaacc

SEQ ID NO: 12995 - DNA, 22 bp, Artificial Sequence
  chemically synthesized
gttcaagggaaccttgagagag

SEQ ID NO: 12996 - DNA, 22 bp, Artificial Sequence
  chemically synthesized
ttcaagggaaccttgagagaga

SEQ ID NO: 12997 - DNA, 22 bp, Artificial Sequence
  chemically synthesized
aagggaaccttgagagagaatg

SEQ ID NO: 12998 - DNA, 22 bp, Artificial Sequence
  chemically synthesized
gagagagaatgtatggaagaaa

SEQ ID NO: 12999 - DNA, 22 bp, Artificial Sequence
  chemically synthesized
agagagaatgtatggaagaaaa

SEQ ID NO: 13000 - DNA, 22 bp, Artificial Sequence
  chemically synthesized
tgaagaagcacgagaagttttt

SEQ ID NO: 13001 - DNA, 22 bp, Artificial Sequence
  chemically synthesized
gaagaagcacgagaagtttttg

SEQ ID NO: 13002 - DNA, 22 bp, Artificial Sequence
  chemically synthesized
aagaagcacgagaagtttttga

SEQ ID NO: 13003 - DNA, 22 bp, Artificial Sequence
  chemically synthesized
tttcagtgttttcaaaaacttc

SEQ ID NO: 13004 - DNA, 22 bp, Artificial Sequence
  chemically synthesized
tcagtgttttcaaaaacttctc

SEQ ID NO: 13005 - DNA, 22 bp, Artificial Sequence
  chemically synthesized
cagtgttttcaaaaacttctcg

SEQ ID NO: 13006 - DNA, 22 bp, Artificial Sequence
  chemically synthesized
agtgttttcaaaaacttctcgt

SEQ ID NO: 13007 - DNA, 22 bp, Artificial Sequence
  chemically synthesized
tcaaaaacttctcgtgcttctt

SEQ ID NO: 13008 - DNA, 22 bp, Artificial Sequence
  chemically synthesized
caaaaacttctcgtgcttcttc

SEQ ID NO: 13009 - DNA, 22 bp, Artificial Sequence
  chemically synthesized
aaaaacttctcgtgcttcttca

SEQ ID NO: 13010 - DNA, 22 bp, Artificial Sequence
  chemically synthesized
ctcgtgcttcttcaaaactaca

SEQ ID NO: 13011 - DNA, 22 bp, Artificial Sequence
  chemically synthesized
tcgtgcttcttcaaaactacac

SEQ ID NO: 13012 - DNA, 22 bp, Artificial Sequence
  chemically synthesized
gtgcttcttcaaaactacactt

SEQ ID NO: 13013 - DNA, 22 bp, Artificial Sequence
  chemically synthesized
cttcaaaactacacttttcttc

SEQ ID NO: 13014 - DNA, 22 bp, Artificial Sequence
  chemically synthesized
ttcaaaactacacttttcttcc

SEQ ID NO: 13015 - DNA, 22 bp, Artificial Sequence
  chemically synthesized
caaaactacacttttcttccat

SEQ ID NO: 13016 - DNA, 22 bp, Artificial Sequence
  chemically synthesized
aaaactacacttttcttccata

SEQ ID NO: 13017 - DNA, 22 bp, Artificial Sequence
  chemically synthesized
cacttttcttccatacattctc

SEQ ID NO: 13018 - DNA, 22 bp, Artificial Sequence
  chemically synthesized
ttcttccatacattctctctca

SEQ ID NO: 13019 - DNA, 22 bp, Artificial Sequence
  chemically synthesized
tcttccatacattctctctcaa

SEQ ID NO: 13020 - DNA, 22 bp, Artificial Sequence
  chemically synthesized
cttccatacattctctctcaag

SEQ ID NO: 13021 - DNA, 22 bp, Artificial Sequence
  chemically synthesized
ttccatacattctctctcaagg

SEQ ID NO: 13022 - DNA, 22 bp, Artificial Sequence
  chemically synthesized
ccatacattctctctcaaggtt

SEQ ID NO: 13023 - DNA, 22 bp, Artificial Sequence
  chemically synthesized
catacattctctctcaaggttc

SEQ ID NO: 13024 - DNA, 22 bp, Artificial Sequence
  chemically synthesized
tctctcaaggttcccttgaaca

SEQ ID NO: 13025 - DNA, 22 bp, Artificial Sequence
  chemically synthesized
tctcaaggttcccttgaacaaa

SEQ ID NO: 13026 - DNA, 22 bp, Artificial Sequence
  chemically synthesized
tcaaggttcccttgaacaaact

SEQ ID NO: 13027 - DNA, 22 bp, Artificial Sequence
  chemically synthesized
aaggttcccttgaacaaactct

SEQ ID NO: 13028 - DNA, 22 bp, Artificial Sequence
  chemically synthesized
ccttgaacaaactcttccaatt

SEQ ID NO: 13029 - DNA, 22 bp, Artificial Sequence
  chemically synthesized
gaacaaactcttccaatttacc

SEQ ID NO: 13030 - DNA, 22 bp, Artificial Sequence
  chemically synthesized
aacaaactcttccaatttacct

SEQ ID NO: 13031 - DNA, 22 bp, Artificial Sequence
  chemically synthesized
ttccaatttacctgaattatac

SEQ ID NO: 13032 - DNA, 22 bp, Artificial Sequence
  chemically synthesized
ccaatttacctgaattatacct

SEQ ID NO: 13033 - DNA, 22 bp, Artificial Sequence
  chemically synthesized
caatttacctgaattatacctc

SEQ ID NO: 13034 - DNA, 22 bp, Artificial Sequence
  chemically synthesized
acctgaattatacctctttggc

SEQ ID NO: 13035 - DNA, 22 bp, Artificial Sequence
  chemically synthesized
cctgaattatacctctttggcc

SEQ ID NO: 13036 - DNA, 22 bp, Artificial Sequence
  chemically synthesized
aattatacctctttggccgatt

SEQ ID NO: 13037 - DNA, 22 bp, Artificial Sequence
  chemically synthesized
tacctctttggccgattcagaa

SEQ ID NO: 13038 - DNA, 22 bp, Artificial Sequence
  chemically synthesized
tttggccgattcagaattttgt

SEQ ID NO: 13039 - DNA, 22 bp, Artificial Sequence
  chemically synthesized
tggccgattcagaattttgttg

SEQ ID NO: 13040 - DNA, 22 bp, Artificial Sequence
  chemically synthesized
ggccgattcagaattttgttgg

SEQ ID NO: 13041 - DNA, 22 bp, Artificial Sequence
  chemically synthesized
gccgattcagaattttgttggc

SEQ ID NO: 13042 - DNA, 22 bp, Artificial Sequence
  chemically synthesized
agaattttgttggcgttttcat

SEQ ID NO: 13043 - DNA, 22 bp, Artificial Sequence
  chemically synthesized
tgttggcgttttcatgatcaag

SEQ ID NO: 13044 - DNA, 22 bp, Artificial Sequence
  chemically synthesized
gttggcgttttcatgatcaaga

SEQ ID NO: 13045 - DNA, 22 bp, Artificial Sequence
  chemically synthesized
ttggcgttttcatgatcaagaa

SEQ ID NO: 13046 - DNA, 22 bp, Artificial Sequence
  chemically synthesized
gcgttttcatgatcaagaaaaa

SEQ ID NO: 13047 - DNA, 22 bp, Artificial Sequence
  chemically synthesized
tcatgatcaagaaaaactgaaa

SEQ ID NO: 13048 - DNA, 22 bp, Artificial Sequence
  chemically synthesized
catgatcaagaaaaactgaaat

SEQ ID NO: 13049 - DNA, 22 bp, Artificial Sequence
  chemically synthesized
atgatcaagaaaaactgaaatg

SEQ ID NO: 13050 - DNA, 22 bp, Artificial Sequence
  chemically synthesized
aaatgtaaaagaataattcttt

SEQ ID NO: 13051 - DNA, 22 bp, Artificial Sequence
  chemically synthesized
tttagttttagcaaaaaagaaa

SEQ ID NO: 13052 - DNA, 22 bp, Artificial Sequence
  chemically synthesized
tagttttagcaaaaaagaaaac

SEQ ID NO: 13053 - DNA, 22 bp, Artificial Sequence
  chemically synthesized
agttttagcaaaaaagaaaaca

SEQ ID NO: 13054 - DNA, 22 bp, Artificial Sequence
  chemically synthesized
gttttagcaaaaaagaaaacat

SEQ ID NO: 13055 - DNA, 22 bp, Artificial Sequence
  chemically synthesized
tagcaaaaaagaaaacatcatg

SEQ ID NO: 13056 - DNA, 22 bp, Artificial Sequence
  chemically synthesized
agcaaaaaagaaaacatcatga

SEQ ID NO: 13057 - DNA, 22 bp, Artificial Sequence
  chemically synthesized
gcaaaaaagaaaacatcatgaa

SEQ ID NO: 13058 - DNA, 22 bp, Artificial Sequence
  chemically synthesized
tacatctcttaagaaagtcttt

SEQ ID NO: 13059 - DNA, 22 bp, Artificial Sequence
  chemically synthesized
acatctcttaagaaagtctttg

SEQ ID NO: 13060 - DNA, 22 bp, Artificial Sequence
  chemically synthesized
catctcttaagaaagtctttgt

SEQ ID NO: 13061 - DNA, 22 bp, Artificial Sequence
  chemically synthesized
ttaagaaagtctttgtttttaa

SEQ ID NO: 13062 - DNA, 22 bp, Artificial Sequence
  chemically synthesized
aagaaagtctttgtttttaatc

SEQ ID NO: 13063 - DNA, 22 bp, Artificial Sequence
  chemically synthesized
agaaagtctttgtttttaatcc

SEQ ID NO: 13064 - DNA, 22 bp, Artificial Sequence
  chemically synthesized
tgtttttaatccaaataatctg

SEQ ID NO: 13065 - DNA, 22 bp, Artificial Sequence
  chemically synthesized
gtttttaatccaaataatctga

SEQ ID NO: 13066 - DNA, 22 bp, Artificial Sequence
  chemically synthesized
tttttaatccaaataatctgaa

SEQ ID NO: 13067 - DNA, 22 bp, Artificial Sequence
  chemically synthesized
ttaatccaaataatctgaaagc

SEQ ID NO: 13068 - DNA, 22 bp, Artificial Sequence
  chemically synthesized
taatccaaataatctgaaagcc

SEQ ID NO: 13069 - DNA, 22 bp, Artificial Sequence
  chemically synthesized
aatccaaataatctgaaagcca

SEQ ID NO: 13070 - DNA, 22 bp, Artificial Sequence
  chemically synthesized
atccaaataatctgaaagccaa

SEQ ID NO: 13071 - DNA, 22 bp, Artificial Sequence
  chemically synthesized
aaagccaatttctctttagggc

SEQ ID NO: 13072 - DNA, 22 bp, Artificial Sequence
  chemically synthesized
ctctttagggcatggagccaaa

SEQ ID NO: 13073 - DNA, 22 bp, Artificial Sequence
  chemically synthesized
tctttagggcatggagccaaaa

SEQ ID NO: 13074 - DNA, 22 bp, Artificial Sequence
  chemically synthesized
tttagggcatggagccaaaatc

SEQ ID NO: 13075 - DNA, 22 bp, Artificial Sequence
  chemically synthesized
tagggcatggagccaaaatctg

SEQ ID NO: 13076 - DNA, 22 bp, Artificial Sequence
  chemically synthesized
agggcatggagccaaaatctgt

SEQ ID NO: 13077 - DNA, 22 bp, Artificial Sequence
  chemically synthesized
gggcatggagccaaaatctgtg

SEQ ID NO: 13078 - DNA, 22 bp, Artificial Sequence
  chemically synthesized
tgatgttcccacagtactgtat

SEQ ID NO: 13079 - DNA, 22 bp, Artificial Sequence
  chemically synthesized
ccacagtactgtatacacatgg

SEQ ID NO: 13080 - DNA, 22 bp, Artificial Sequence
  chemically synthesized
tatacacatggagatttaggaa

SEQ ID NO: 13081 - DNA, 22 bp, Artificial Sequence
  chemically synthesized
aggaattaaaattcaattttac

SEQ ID NO: 13082 - DNA, 22 bp, Artificial Sequence
  chemically synthesized
ggaattaaaattcaattttact

SEQ ID NO: 13083 - DNA, 22 bp, Artificial Sequence
  chemically synthesized
aaattcaattttacttttagtc

SEQ ID NO: 13084 - DNA, 22 bp, Artificial Sequence
  chemically synthesized
aattttacttttagtcaagaga

SEQ ID NO: 13085 - DNA, 22 bp, Artificial Sequence
  chemically synthesized
tacttttagtcaagagaattcc

SEQ ID NO: 13086 - DNA, 22 bp, Artificial Sequence
  chemically synthesized
acttttagtcaagagaattcca

SEQ ID NO: 13087 - DNA, 22 bp, Artificial Sequence
  chemically synthesized
cttttagtcaagagaattccag

SEQ ID NO: 13088 - DNA, 22 bp, Artificial Sequence
  chemically synthesized
ttagtcaagagaattccagtaa

SEQ ID NO: 13089 - DNA, 22 bp, Artificial Sequence
  chemically synthesized
tagtcaagagaattccagtaat

SEQ ID NO: 13090 - DNA, 22 bp, Artificial Sequence
  chemically synthesized
agtcaagagaattccagtaata

SEQ ID NO: 13091 - DNA, 22 bp, Artificial Sequence
  chemically synthesized
gtcaagagaattccagtaataa

SEQ ID NO: 13092 - DNA, 22 bp, Artificial Sequence
  chemically synthesized
cagtaataaaaggtcagatttc

SEQ ID NO: 13093 - DNA, 22 bp, Artificial Sequence
  chemically synthesized
ctaatcatatttgaatttactt

SEQ ID NO: 13094 - DNA, 22 bp, Artificial Sequence
  chemically synthesized
taatcatatttgaatttacttt

SEQ ID NO: 13095 - DNA, 22 bp, Artificial Sequence
  chemically synthesized
atcatatttgaatttactttgg

SEQ ID NO: 13096 - DNA, 22 bp, Artificial Sequence
  chemically synthesized
gaatttactttggatgaaaaag

SEQ ID NO: 13097 - DNA, 22 bp, Artificial Sequence
  chemically synthesized
aatttactttggatgaaaaaga

SEQ ID NO: 13098 - DNA, 22 bp, Artificial Sequence
  chemically synthesized
actttggatgaaaaagaaagtt

SEQ ID NO: 13099 - DNA, 22 bp, Artificial Sequence
  chemically synthesized
ctttggatgaaaaagaaagttc

SEQ ID NO: 13100 - DNA, 22 bp, Artificial Sequence
  chemically synthesized
tggatgaaaaagaaagttctca

SEQ ID NO: 13101 - DNA, 22 bp, Artificial Sequence
  chemically synthesized
ggatgaaaaagaaagttctcaa

SEQ ID NO: 13102 - DNA, 22 bp, Artificial Sequence
  chemically synthesized
gatgaaaaagaaagttctcaaa

SEQ ID NO: 13103 - DNA, 22 bp, Artificial Sequence
  chemically synthesized
tcaaatgagcggttaacttcac

SEQ ID NO: 13104 - DNA, 22 bp, Artificial Sequence
  chemically synthesized
aaatgagcggttaacttcacac

SEQ ID NO: 13105 - DNA, 22 bp, Artificial Sequence
  chemically synthesized
acttcacactttgtcatcactt

SEQ ID NO: 13106 - DNA, 22 bp, Artificial Sequence
  chemically synthesized
cacactttgtcatcacttgaaa

SEQ ID NO: 13107 - DNA, 22 bp, Artificial Sequence
  chemically synthesized
acactttgtcatcacttgaaaa

SEQ ID NO: 13108 - DNA, 22 bp, Artificial Sequence
  chemically synthesized
tgtcatcacttgaaaatagctc

SEQ ID NO: 13109 - DNA, 22 bp, Artificial Sequence
  chemically synthesized
gtcatcacttgaaaatagctca

SEQ ID NO: 13110 - DNA, 22 bp, Artificial Sequence
  chemically synthesized
tcatcacttgaaaatagctcat

SEQ ID NO: 13111 - DNA, 22 bp, Artificial Sequence
  chemically synthesized
gaaaatagctcattgaggatct

SEQ ID NO: 13112 - DNA, 22 bp, Artificial Sequence
  chemically synthesized
aaaatagctcattgaggatctt

SEQ ID NO: 13113 - DNA, 22 bp, Artificial Sequence
  chemically synthesized
attgaggatctttgcaaagtga

SEQ ID NO: 13114 - DNA, 22 bp, Artificial Sequence
  chemically synthesized
aggatctttgcaaagtgatcca

SEQ ID NO: 13115 - DNA, 22 bp, Artificial Sequence
  chemically synthesized
tgcaaagtgatccatcaccctg

SEQ ID NO: 13116 - DNA, 22 bp, Artificial Sequence
  chemically synthesized
gcaaagtgatccatcaccctgg

SEQ ID NO: 13117 - DNA, 22 bp, Artificial Sequence
  chemically synthesized
caaagtgatccatcaccctggc

SEQ ID NO: 13118 - DNA, 22 bp, Artificial Sequence
  chemically synthesized
gctgggctgttttcagaatatg

SEQ ID NO: 13119 - DNA, 22 bp, Artificial Sequence
  chemically synthesized
ggctgttttcagaatatggttg

SEQ ID NO: 13120 - DNA, 22 bp, Artificial Sequence
  chemically synthesized
ttttcagaatatggttgcccaa

SEQ ID NO: 13121 - DNA, 22 bp, Artificial Sequence
  chemically synthesized
tcagaatatggttgcccaaatg

SEQ ID NO: 13122 - DNA, 22 bp, Artificial Sequence
  chemically synthesized
cagaatatggttgcccaaatga

SEQ ID NO: 13123 - DNA, 22 bp, Artificial Sequence
  chemically synthesized
agaatatggttgcccaaatgac

SEQ ID NO: 13124 - DNA, 22 bp, Artificial Sequence
  chemically synthesized
cccaaatgactttgaacaaatg

SEQ ID NO: 13125 - DNA, 22 bp, Artificial Sequence
  chemically synthesized
tgaacaaatgtctcctgaagaa

SEQ ID NO: 13126 - DNA, 22 bp, Artificial Sequence
  chemically synthesized
gaacaaatgtctcctgaagaac

SEQ ID NO: 13127 - DNA, 22 bp, Artificial Sequence
  chemically synthesized
aacaaatgtctcctgaagaaca

SEQ ID NO: 13128 - DNA, 22 bp, Artificial Sequence
  chemically synthesized
ctgaagaacagaagcctaatta

SEQ ID NO: 13129 - DNA, 22 bp, Artificial Sequence
  chemically synthesized
aagaacagaagcctaattatgg

SEQ ID NO: 13130 - DNA, 22 bp, Artificial Sequence
  chemically synthesized
attatggtccagctgcaaatgt

SEQ ID NO: 13131 - DNA, 22 bp, Artificial Sequence
  chemically synthesized
tggtccagctgcaaatgtgacc

SEQ ID NO: 13132 - DNA, 22 bp, Artificial Sequence
  chemically synthesized
caaatgtgaccccagtgtctgt

SEQ ID NO: 13133 - DNA, 22 bp, Artificial Sequence
  chemically synthesized
tcactagatgttaaagaaaaat

SEQ ID NO: 13134 - DNA, 22 bp, Artificial Sequence
  chemically synthesized
gatgttaaagaaaaatcactgc

SEQ ID NO: 13135 - DNA, 22 bp, Artificial Sequence
  chemically synthesized
aagaaaaatcactgcattaatt

SEQ ID NO: 13136 - DNA, 22 bp, Artificial Sequence
  chemically synthesized
cattaatttaaaaaagcaattt

SEQ ID NO: 13137 - DNA, 22 bp, Artificial Sequence
  chemically synthesized
atttaaaaaagcaatttcagat

SEQ ID NO: 13138 - DNA, 22 bp, Artificial Sequence
  chemically synthesized
aaaaaagcaatttcagatcaac

SEQ ID NO: 13139 - DNA, 22 bp, Artificial Sequence
  chemically synthesized
aaaaagcaatttcagatcaaca

SEQ ID NO: 13140 - DNA, 22 bp, Artificial Sequence
  chemically synthesized
cagatcaacagcacctttggtt

SEQ ID NO: 13141 - DNA, 22 bp, Artificial Sequence
  chemically synthesized
agatcaacagcacctttggttg

SEQ ID NO: 13142 - DNA, 22 bp, Artificial Sequence
  chemically synthesized
tggttggcaagtgttataggaa

SEQ ID NO: 13143 - DNA, 22 bp, Artificial Sequence
  chemically synthesized
ggttggcaagtgttataggaat

SEQ ID NO: 13144 - DNA, 22 bp, Artificial Sequence
  chemically synthesized
gttggcaagtgttataggaatt

SEQ ID NO: 13145 - DNA, 22 bp, Artificial Sequence
  chemically synthesized
gcaagtgttataggaattgcag

SEQ ID NO: 13146 - DNA, 22 bp, Artificial Sequence
  chemically synthesized
taggaattgcagtgatttaagc

SEQ ID NO: 13147 - DNA, 22 bp, Artificial Sequence
  chemically synthesized
cagtgatttaagcatctctcta

SEQ ID NO: 13148 - DNA, 22 bp, Artificial Sequence
  chemically synthesized
aagcatctctctagaattcagg

SEQ ID NO: 13149 - DNA, 22 bp, Artificial Sequence
  chemically synthesized
agcatctctctagaattcagga

SEQ ID NO: 13150 - DNA, 22 bp, Artificial Sequence
  chemically synthesized
tctagaattcaggatatgtttt

SEQ ID NO: 13151 - DNA, 22 bp, Artificial Sequence
  chemically synthesized
tagaattcaggatatgtttttt

SEQ ID NO: 13152 - DNA, 22 bp, Artificial Sequence
  chemically synthesized
gaattcaggatatgtttttttt

SEQ ID NO: 13153 - DNA, 22 bp, Artificial Sequence
  chemically synthesized
aggatatgttttttttaagcta

SEQ ID NO: 13154 - DNA, 22 bp, Artificial Sequence
  chemically synthesized
tttttaagctacatctacctag

SEQ ID NO: 13155 - DNA, 22 bp, Artificial Sequence
  chemically synthesized
ttttaagctacatctacctagt

SEQ ID NO: 13156 - DNA, 22 bp, Artificial Sequence
  chemically synthesized
tttaagctacatctacctagtc

SEQ ID NO: 13157 - DNA, 22 bp, Artificial Sequence
  chemically synthesized
ttaagctacatctacctagtct

SEQ ID NO: 13158 - DNA, 22 bp, Artificial Sequence
  chemically synthesized
taagctacatctacctagtctg

SEQ ID NO: 13159 - DNA, 22 bp, Artificial Sequence
  chemically synthesized
aagctacatctacctagtctga

SEQ ID NO: 13160 - DNA, 22 bp, Artificial Sequence
  chemically synthesized
agctacatctacctagtctgaa

SEQ ID NO: 13161 - DNA, 22 bp, Artificial Sequence
  chemically synthesized
catctacctagtctgaagagac

SEQ ID NO: 13162 - DNA, 22 bp, Artificial Sequence
  chemically synthesized
cctagtctgaagagacactcct

SEQ ID NO: 13163 - DNA, 22 bp, Artificial Sequence
  chemically synthesized
gtctgaagagacactcctgaac

SEQ ID NO: 13164 - DNA, 22 bp, Artificial Sequence
  chemically synthesized
aagagacactcctgaactctgg

SEQ ID NO: 13165 - DNA, 22 bp, Artificial Sequence
  chemically synthesized
ctgaactctggaggatagatgt

SEQ ID NO: 13166 - DNA, 22 bp, Artificial Sequence
  chemically synthesized
aactctggaggatagatgtctc

SEQ ID NO: 13167 - DNA, 22 bp, Artificial Sequence
  chemically synthesized
tggaggatagatgtctctatct

SEQ ID NO: 13168 - DNA, 22 bp, Artificial Sequence
  chemically synthesized
gaggatagatgtctctatctga

SEQ ID NO: 13169 - DNA, 22 bp, Artificial Sequence
  chemically synthesized
tatctgaatcatatttctcctt

SEQ ID NO: 13170 - DNA, 22 bp, Artificial Sequence
  chemically synthesized
tctgaatcatatttctccttcc

SEQ ID NO: 13171 - DNA, 22 bp, Artificial Sequence
  chemically synthesized
aatcatatttctccttccctcc

SEQ ID NO: 13172 - DNA, 22 bp, Artificial Sequence
  chemically synthesized
ctccttccctccctccttcctc

SEQ ID NO: 13173 - DNA, 22 bp, Artificial Sequence
  chemically synthesized
tccttccctccctccttcctct

SEQ ID NO: 13174 - DNA, 22 bp, Artificial Sequence
  chemically synthesized
cttccctccctccttcctctcc

SEQ ID NO: 13175 - DNA, 22 bp, Artificial Sequence
  chemically synthesized
ccctccctccttcctctcctct

SEQ ID NO: 13176 - DNA, 22 bp, Artificial Sequence
  chemically synthesized
cctccctccttcctctcctctc

SEQ ID NO: 13177 - DNA, 22 bp, Artificial Sequence
  chemically synthesized
cctccttcctctcctctcctct

SEQ ID NO: 13178 - DNA, 22 bp, Artificial Sequence
  chemically synthesized
cttcctctcctctcctctctct

SEQ ID NO: 13179 - DNA, 22 bp, Artificial Sequence
  chemically synthesized
cctctcctctcctctctctctc

SEQ ID NO: 13180 - DNA, 22 bp, Artificial Sequence
  chemically synthesized
ctctcctctcctctctctctct

SEQ ID NO: 13181 - DNA, 22 bp, Artificial Sequence
  chemically synthesized
tcctctcctctctctctctctc

SEQ ID NO: 13182 - DNA, 22 bp, Artificial Sequence
  chemically synthesized
ctctcctctctctctctctcta

SEQ ID NO: 13183 - DNA, 22 bp, Artificial Sequence
  chemically synthesized
tcctctctctctctctctatgt

SEQ ID NO: 13184 - DNA, 22 bp, Artificial Sequence
  chemically synthesized
ctctctctctctctctatgtgt

SEQ ID NO: 13185 - DNA, 22 bp, Artificial Sequence
  chemically synthesized
tctctctctctctatgtgtgtg

SEQ ID NO: 13186 - DNA, 22 bp, Artificial Sequence
  chemically synthesized
tctctctctctatgtgtgtgtg

SEQ ID NO: 13187 - DNA, 22 bp, Artificial Sequence
  chemically synthesized
tctctctctatgtgtgtgtgtg

SEQ ID NO: 13188 - DNA, 22 bp, Artificial Sequence
  chemically synthesized
tctctctatgtgtgtgtgtgta

SEQ ID NO: 13189 - DNA, 22 bp, Artificial Sequence
  chemically synthesized
tctctatgtgtgtgtgtgtaca

SEQ ID NO: 13190 - DNA, 22 bp, Artificial Sequence
  chemically synthesized
tctatgtgtgtgtgtgtacata

SEQ ID NO: 13191 - DNA, 22 bp, Artificial Sequence
  chemically synthesized
tatgtgtgtgtgtgtacatata

SEQ ID NO: 13192 - DNA, 22 bp, Artificial Sequence
  chemically synthesized
tgtgtgtgtgtgtacatatata

SEQ ID NO: 13193 - DNA, 22 bp, Artificial Sequence
  chemically synthesized
gctgcacaatgacattttggtc

SEQ ID NO: 13194 - DNA, 22 bp, Artificial Sequence
  chemically synthesized
ctgcacaatgacattttggtca

SEQ ID NO: 13195 - DNA, 22 bp, Artificial Sequence
  chemically synthesized
cacaatgacattttggtcaatg

SEQ ID NO: 13196 - DNA, 22 bp, Artificial Sequence
  chemically synthesized
tggtcaatgatggaccacatta

SEQ ID NO: 13197 - DNA, 22 bp, Artificial Sequence
  chemically synthesized
ggtcaatgatggaccacattat

SEQ ID NO: 13198 - DNA, 22 bp, Artificial Sequence
  chemically synthesized
gtcaatgatggaccacattata

SEQ ID NO: 13199 - DNA, 22 bp, Artificial Sequence
  chemically synthesized
tacgacagtggtcccataaggt

SEQ ID NO: 13200 - DNA, 22 bp, Artificial Sequence
  chemically synthesized
taatactgtattttcactgtac

SEQ ID NO: 13201 - DNA, 22 bp, Artificial Sequence
  chemically synthesized
tattttcactgtaccttttcta

SEQ ID NO: 13202 - DNA, 22 bp, Artificial Sequence
  chemically synthesized
tcactgtaccttttctatgttt

SEQ ID NO: 13203 - DNA, 22 bp, Artificial Sequence
  chemically synthesized
cactgtaccttttctatgttta

SEQ ID NO: 13204 - DNA, 22 bp, Artificial Sequence
  chemically synthesized
actgtaccttttctatgtttag

SEQ ID NO: 13205 - DNA, 22 bp, Artificial Sequence
  chemically synthesized
taccttttctatgtttagatac

SEQ ID NO: 13206 - DNA, 22 bp, Artificial Sequence
  chemically synthesized
ttctatgtttagatacacaaat

SEQ ID NO: 13207 - DNA, 22 bp, Artificial Sequence
  chemically synthesized
tctatgtttagatacacaaata

SEQ ID NO: 13208 - DNA, 22 bp, Artificial Sequence
  chemically synthesized
ctatgtttagatacacaaatac

SEQ ID NO: 13209 - DNA, 22 bp, Artificial Sequence
  chemically synthesized
tatgtttagatacacaaatacc

SEQ ID NO: 13210 - DNA, 22 bp, Artificial Sequence
  chemically synthesized
tgtttagatacacaaataccac

SEQ ID NO: 13211 - DNA, 22 bp, Artificial Sequence
  chemically synthesized
agatacacaaataccactgtta

SEQ ID NO: 13212 - DNA, 22 bp, Artificial Sequence
  chemically synthesized
gatacacaaataccactgttac

SEQ ID NO: 13213 - DNA, 22 bp, Artificial Sequence
  chemically synthesized
ttaccattgcctacagtgttca

SEQ ID NO: 13214 - DNA, 22 bp, Artificial Sequence
  chemically synthesized
ccattgcctacagtgttcagta

SEQ ID NO: 13215 - DNA, 22 bp, Artificial Sequence
  chemically synthesized
cctacagtgttcagtacagtca

SEQ ID NO: 13216 - DNA, 22 bp, Artificial Sequence
  chemically synthesized
cagtgttcagtacagtcacatg

SEQ ID NO: 13217 - DNA, 22 bp, Artificial Sequence
  chemically synthesized
agtacagtcacatgctgtacag

SEQ ID NO: 13218 - DNA, 22 bp, Artificial Sequence
  chemically synthesized
tacaggtttgcagcccaggagc

SEQ ID NO: 13219 - DNA, 22 bp, Artificial Sequence
  chemically synthesized
gcagcccaggagcctaggagca

SEQ ID NO: 13220 - DNA, 22 bp, Artificial Sequence
  chemically synthesized
cagcccaggagcctaggagcaa

SEQ ID NO: 13221 - DNA, 22 bp, Artificial Sequence
  chemically synthesized
ggagcaataggccacatcaata

SEQ ID NO: 13222 - DNA, 22 bp, Artificial Sequence
  chemically synthesized
ggtatgtagtaagctataccat

SEQ ID NO: 13223 - DNA, 22 bp, Artificial Sequence
  chemically synthesized
taccatttaggtttaggtaagt

SEQ ID NO: 13224 - DNA, 22 bp, Artificial Sequence
  chemically synthesized
aggtttaggtaagtacactcta

SEQ ID NO: 13225 - DNA, 22 bp, Artificial Sequence
  chemically synthesized
ggtttaggtaagtacactctat

SEQ ID NO: 13226 - DNA, 22 bp, Artificial Sequence
  chemically synthesized
aggtaagtacactctattatgt

SEQ ID NO: 13227 - DNA, 22 bp, Artificial Sequence
  chemically synthesized
ggtaagtacactctattatgtt

SEQ ID NO: 13228 - DNA, 22 bp, Artificial Sequence
  chemically synthesized
tattatgttcgcacaatgatga

SEQ ID NO: 13229 - DNA, 22 bp, Artificial Sequence
  chemically synthesized
ttatgttcgcacaatgatgaaa

SEQ ID NO: 13230 - DNA, 22 bp, Artificial Sequence
  chemically synthesized
tgttcgcacaatgatgaaattg

SEQ ID NO: 13231 - DNA, 22 bp, Artificial Sequence
  chemically synthesized
gcacaatgatgaaattgcttaa

SEQ ID NO: 13232 - DNA, 22 bp, Artificial Sequence
  chemically synthesized
cttaatgacacatttctcagaa

SEQ ID NO: 13233 - DNA, 22 bp, Artificial Sequence
  chemically synthesized
aatgacacatttctcagaatat

SEQ ID NO: 13234 - DNA, 22 bp, Artificial Sequence
  chemically synthesized
atgacacatttctcagaatata

SEQ ID NO: 13235 - DNA, 22 bp, Artificial Sequence
  chemically synthesized
ctcagaatatatccccattgtt

SEQ ID NO: 13236 - DNA, 22 bp, Artificial Sequence
  chemically synthesized
tcagaatatatccccattgtta

SEQ ID NO: 13237 - DNA, 22 bp, Artificial Sequence
  chemically synthesized
agaatatatccccattgttaag

SEQ ID NO: 13238 - DNA, 22 bp, Artificial Sequence
  chemically synthesized
ttaaggaatgcatggctgtata

SEQ ID NO: 13239 - DNA, 22 bp, Artificial Sequence
  chemically synthesized
aggaatgcatggctgtatacac

SEQ ID NO: 13240 - DNA, 22 bp, Artificial Sequence
  chemically synthesized
tatacacacacatgtgtttgtg

SEQ ID NO: 13241 - DNA, 22 bp, Artificial Sequence
  chemically synthesized
gtgtgttttcatgtatatacat

SEQ ID NO: 13242 - DNA, 22 bp, Artificial Sequence
  chemically synthesized
tgtgttttcatgtatatacata

SEQ ID NO: 13243 - DNA, 22 bp, Artificial Sequence
  chemically synthesized
tcatgtatatacatatatgtgt

SEQ ID NO: 13244 - DNA, 22 bp, Artificial Sequence
  chemically synthesized
catgtatatacatatatgtgtg

SEQ ID NO: 13245 - DNA, 22 bp, Artificial Sequence
  chemically synthesized
atgtatatacatatatgtgtgt

SEQ ID NO: 13246 - DNA, 22 bp, Artificial Sequence
  chemically synthesized
ataacagggactcaagaagttg

SEQ ID NO: 13247 - DNA, 22 bp, Artificial Sequence
  chemically synthesized
aagaagttgcctggagttgttc

SEQ ID NO: 13248 - DNA, 22 bp, Artificial Sequence
  chemically synthesized
cctggagttgttcctttcttca

SEQ ID NO: 13249 - DNA, 22 bp, Artificial Sequence
  chemically synthesized
gagttgttcctttcttcaaggg

SEQ ID NO: 13250 - DNA, 22 bp, Artificial Sequence
  chemically synthesized
ttcctttcttcaagggtctagc

SEQ ID NO: 13251 - DNA, 22 bp, Artificial Sequence
  chemically synthesized
ctttcttcaagggtctagcaat

SEQ ID NO: 13252 - DNA, 22 bp, Artificial Sequence
  chemically synthesized
tcttcaagggtctagcaatata

SEQ ID NO: 13253 - DNA, 22 bp, Artificial Sequence
  chemically synthesized
cttcaagggtctagcaatatat

SEQ ID NO: 13254 - DNA, 22 bp, Artificial Sequence
  chemically synthesized
ttcaagggtctagcaatatatc

SEQ ID NO: 13255 - DNA, 22 bp, Artificial Sequence
  chemically synthesized
caagggtctagcaatatatctg

SEQ ID NO: 13256 - DNA, 22 bp, Artificial Sequence
  chemically synthesized
aagggtctagcaatatatctga

SEQ ID NO: 13257 - DNA, 22 bp, Artificial Sequence
  chemically synthesized
gcaatatatctgataccatctc

SEQ ID NO: 13258 - DNA, 22 bp, Artificial Sequence
  chemically synthesized
ataccatctcaagaggaccaag

SEQ ID NO: 13259 - DNA, 22 bp, Artificial Sequence
  chemically synthesized
aagaggaccaagggcttataag

SEQ ID NO: 13260 - DNA, 22 bp, Artificial Sequence
  chemically synthesized
ataagatgaactttctggggta

SEQ ID NO: 13261 - DNA, 22 bp, Artificial Sequence
  chemically synthesized
taagatgaactttctggggtat

SEQ ID NO: 13262 - DNA, 22 bp, Artificial Sequence
  chemically synthesized
tctggggtatttgggactactt

SEQ ID NO: 13263 - DNA, 22 bp, Artificial Sequence
  chemically synthesized
ctggggtatttgggactacttc

SEQ ID NO: 13264 - DNA, 22 bp, Artificial Sequence
  chemically synthesized
tggggtatttgggactacttcc

SEQ ID NO: 13265 - DNA, 22 bp, Artificial Sequence
  chemically synthesized
gggtatttgggactacttcctg

SEQ ID NO: 13266 - DNA, 22 bp, Artificial Sequence
  chemically synthesized
gggactacttcctgattaactc

SEQ ID NO: 13267 - DNA, 22 bp, Artificial Sequence
  chemically synthesized
ggactacttcctgattaactcc

SEQ ID NO: 13268 - DNA, 22 bp, Artificial Sequence
  chemically synthesized
cttcctgattaactccaaaaag

SEQ ID NO: 13269 - DNA, 22 bp, Artificial Sequence
  chemically synthesized
cctgattaactccaaaaaggaa

SEQ ID NO: 13270 - DNA, 22 bp, Artificial Sequence
  chemically synthesized
ctgattaactccaaaaaggaag

SEQ ID NO: 13271 - DNA, 22 bp, Artificial Sequence
  chemically synthesized
attaactccaaaaaggaagaga

SEQ ID NO: 13272 - DNA, 22 bp, Artificial Sequence
  chemically synthesized
actccaaaaaggaagagaaagg

SEQ ID NO: 13273 - DNA, 22 bp, Artificial Sequence
  chemically synthesized
caaaaaggaagagaaaggaaag

SEQ ID NO: 13274 - DNA, 22 bp, Artificial Sequence
  chemically synthesized
aactttcttcccttattttcat

SEQ ID NO: 13275 - DNA, 22 bp, Artificial Sequence
  chemically synthesized
tcttcccttattttcattgcag

SEQ ID NO: 13276 - DNA, 22 bp, Artificial Sequence
  chemically synthesized
cttcccttattttcattgcagc

SEQ ID NO: 13277 - DNA, 22 bp, Artificial Sequence
  chemically synthesized
ttcccttattttcattgcagct

SEQ ID NO: 13278 - DNA, 22 bp, Artificial Sequence
  chemically synthesized
cccttattttcattgcagctgt

SEQ ID NO: 13279 - DNA, 22 bp, Artificial Sequence
  chemically synthesized
ccttattttcattgcagctgtt

SEQ ID NO: 13280 - DNA, 22 bp, Artificial Sequence
  chemically synthesized
attttcattgcagctgttcact

SEQ ID NO: 13281 - DNA, 22 bp, Artificial Sequence
  chemically synthesized
ttttcattgcagctgttcactt

SEQ ID NO: 13282 - DNA, 22 bp, Artificial Sequence
  chemically synthesized
tcattgcagctgttcactttat

SEQ ID NO: 13283 - DNA, 22 bp, Artificial Sequence
  chemically synthesized
cattgcagctgttcactttatg

SEQ ID NO: 13284 - DNA, 22 bp, Artificial Sequence
  chemically synthesized
attgcagctgttcactttatgg

SEQ ID NO: 13285 - DNA, 22 bp, Artificial Sequence
  chemically synthesized
cagctgttcactttatggagtg

SEQ ID NO: 13286 - DNA, 22 bp, Artificial Sequence
  chemically synthesized
ttcactttatggagtgttctag

SEQ ID NO: 13287 - DNA, 22 bp, Artificial Sequence
  chemically synthesized
actttatggagtgttctagtcc

SEQ ID NO: 13288 - DNA, 22 bp, Artificial Sequence
  chemically synthesized
tatggagtgttctagtcccttg

SEQ ID NO: 13289 - DNA, 22 bp, Artificial Sequence
  chemically synthesized
atggagtgttctagtcccttga

SEQ ID NO: 13290 - DNA, 22 bp, Artificial Sequence
  chemically synthesized
tggagtgttctagtcccttgac

SEQ ID NO: 13291 - DNA, 22 bp, Artificial Sequence
  chemically synthesized
tagtcccttgacatccctgctt

SEQ ID NO: 13292 - DNA, 22 bp, Artificial Sequence
  chemically synthesized
gtcccttgacatccctgctttt

SEQ ID NO: 13293 - DNA, 22 bp, Artificial Sequence
  chemically synthesized
gacatccctgcttttcccttgc

SEQ ID NO: 13294 - DNA, 22 bp, Artificial Sequence
  chemically synthesized
acatccctgcttttcccttgct

SEQ ID NO: 13295 - DNA, 22 bp, Artificial Sequence
  chemically synthesized
cttttcccttgctctgcaagtt

SEQ ID NO: 13296 - DNA, 22 bp, Artificial Sequence
  chemically synthesized
ttcccttgctctgcaagttcct

SEQ ID NO: 13297 - DNA, 22 bp, Artificial Sequence
  chemically synthesized
tcccttgctctgcaagttcctt

SEQ ID NO: 13298 - DNA, 22 bp, Artificial Sequence
  chemically synthesized
cccttgctctgcaagttccttt

SEQ ID NO: 13299 - DNA, 22 bp, Artificial Sequence
  chemically synthesized
ccttgctctgcaagttcctttt

SEQ ID NO: 13300 - DNA, 22 bp, Artificial Sequence
  chemically synthesized
gctctgcaagttccttttgggc

SEQ ID NO: 13301 - DNA, 22 bp, Artificial Sequence
  chemically synthesized
ctctgcaagttccttttgggct

SEQ ID NO: 13302 - DNA, 22 bp, Artificial Sequence
  chemically synthesized
tgcaagttccttttgggctcac

SEQ ID NO: 13303 - DNA, 22 bp, Artificial Sequence
  chemically synthesized
caagttccttttgggctcactt

SEQ ID NO: 13304 - DNA, 22 bp, Artificial Sequence
  chemically synthesized
cttttgggctcactttttttct

SEQ ID NO: 13305 - DNA, 22 bp, Artificial Sequence
  chemically synthesized
ttgggctcactttttttctttg

SEQ ID NO: 13306 - DNA, 22 bp, Artificial Sequence
  chemically synthesized
tgggctcactttttttctttga

SEQ ID NO: 13307 - DNA, 22 bp, Artificial Sequence
  chemically synthesized
gggctcactttttttctttgaa

SEQ ID NO: 13308 - DNA, 22 bp, Artificial Sequence
  chemically synthesized
ggctcactttttttctttgaat

SEQ ID NO: 13309 - DNA, 22 bp, Artificial Sequence
  chemically synthesized
actttttttctttgaatttagc

SEQ ID NO: 13310 - DNA, 22 bp, Artificial Sequence
  chemically synthesized
tttttctttgaatttagcctag

SEQ ID NO: 13311 - DNA, 22 bp, Artificial Sequence
  chemically synthesized
ttttctttgaatttagcctaga

SEQ ID NO: 13312 - DNA, 22 bp, Artificial Sequence
  chemically synthesized
tttctttgaatttagcctagac

SEQ ID NO: 13313 - DNA, 22 bp, Artificial Sequence
  chemically synthesized
ttctttgaatttagcctagact

SEQ ID NO: 13314 - DNA, 22 bp, Artificial Sequence
  chemically synthesized
tctttgaatttagcctagactt

SEQ ID NO: 13315 - DNA, 22 bp, Artificial Sequence
  chemically synthesized
ctttgaatttagcctagacttt

SEQ ID NO: 13316 - DNA, 22 bp, Artificial Sequence
  chemically synthesized
tttgaatttagcctagactttt

SEQ ID NO: 13317 - DNA, 22 bp, Artificial Sequence
  chemically synthesized
tgaatttagcctagactttttc

SEQ ID NO: 13318 - DNA, 22 bp, Artificial Sequence
  chemically synthesized
gaatttagcctagactttttct

SEQ ID NO: 13319 - DNA, 22 bp, Artificial Sequence
  chemically synthesized
aatttagcctagactttttctc

SEQ ID NO: 13320 - DNA, 22 bp, Artificial Sequence
  chemically synthesized
agcctagactttttctcttcaa

SEQ ID NO: 13321 - DNA, 22 bp, Artificial Sequence
  chemically synthesized
gcctagactttttctcttcaac

SEQ ID NO: 13322 - DNA, 22 bp, Artificial Sequence
  chemically synthesized
gactttttctcttcaactcttt

SEQ ID NO: 13323 - DNA, 22 bp, Artificial Sequence
  chemically synthesized
tttctcttcaactctttttttt

SEQ ID NO: 13324 - DNA, 22 bp, Artificial Sequence
  chemically synthesized
ttctcttcaactcttttttttt

SEQ ID NO: 13325 - DNA, 22 bp, Artificial Sequence
  chemically synthesized
tctcttcaactctttttttttt

SEQ ID NO: 13326 - DNA, 22 bp, Artificial Sequence
  chemically synthesized
ctcttcaactcttttttttttg

SEQ ID NO: 13327 - DNA, 22 bp, Artificial Sequence
  chemically synthesized
tcttcaactcttttttttttga

SEQ ID NO: 13328 - DNA, 22 bp, Artificial Sequence
  chemically synthesized
ttcaactcttttttttttgaca

SEQ ID NO: 13329 - DNA, 22 bp, Artificial Sequence
  chemically synthesized
caactcttttttttttgacaga

SEQ ID NO: 13330 - DNA, 22 bp, Artificial Sequence
  chemically synthesized
aactcttttttttttgacagag

SEQ ID NO: 13331 - DNA, 22 bp, Artificial Sequence
  chemically synthesized
ttttttttttgacagagtcttg

SEQ ID NO: 13332 - DNA, 22 bp, Artificial Sequence
  chemically synthesized
ttttttttgacagagtcttgct

SEQ ID NO: 13333 - DNA, 22 bp, Artificial Sequence
  chemically synthesized
tttttttgacagagtcttgctc

SEQ ID NO: 13334 - DNA, 22 bp, Artificial Sequence
  chemically synthesized
ttttttgacagagtcttgctct

SEQ ID NO: 13335 - DNA, 22 bp, Artificial Sequence
  chemically synthesized
tttttgacagagtcttgctctg

SEQ ID NO: 13336 - DNA, 22 bp, Artificial Sequence
  chemically synthesized
ttttgacagagtcttgctctgt

SEQ ID NO: 13337 - DNA, 22 bp, Artificial Sequence
  chemically synthesized
tttgacagagtcttgctctgtc

SEQ ID NO: 13338 - DNA, 22 bp, Artificial Sequence
  chemically synthesized
ttgacagagtcttgctctgtcg

SEQ ID NO: 13339 - DNA, 22 bp, Artificial Sequence
  chemically synthesized
tgacagagtcttgctctgtcgc

SEQ ID NO: 13340 - DNA, 22 bp, Artificial Sequence
  chemically synthesized
gacagagtcttgctctgtcgcc

SEQ ID NO: 13341 - DNA, 22 bp, Artificial Sequence
  chemically synthesized
acagagtcttgctctgtcgccc

SEQ ID NO: 13342 - DNA, 22 bp, Artificial Sequence
  chemically synthesized
gctctgtcgcccaggctggagt

SEQ ID NO: 13343 - DNA, 22 bp, Artificial Sequence
  chemically synthesized
ctctgtcgcccaggctggagtg

SEQ ID NO: 13344 - DNA, 22 bp, Artificial Sequence
  chemically synthesized
tgtcgcccaggctggagtgcag

SEQ ID NO: 13345 - DNA, 22 bp, Artificial Sequence
  chemically synthesized
tcgcccaggctggagtgcagtg

SEQ ID NO: 13346 - DNA, 22 bp, Artificial Sequence
  chemically synthesized
gagtgcagtggtgcgatctcag

SEQ ID NO: 13347 - DNA, 22 bp, Artificial Sequence
  chemically synthesized
agctcactgcaacctccatctc

SEQ ID NO: 13348 - DNA, 22 bp, Artificial Sequence
  chemically synthesized
actgcaacctccatctcccagg

SEQ ID NO: 13349 - DNA, 22 bp, Artificial Sequence
  chemically synthesized
caacctccatctcccaggttca

SEQ ID NO: 13350 - DNA, 22 bp, Artificial Sequence
  chemically synthesized
catctcccaggttcaagctatt

SEQ ID NO: 13351 - DNA, 22 bp, Artificial Sequence
  chemically synthesized
ccaggttcaagctattctcctg

SEQ ID NO: 13352 - DNA, 22 bp, Artificial Sequence
  chemically synthesized
aagctattctcctgcctcagcc

SEQ ID NO: 13353 - DNA, 22 bp, Artificial Sequence
  chemically synthesized
ttctcctgcctcagcctcccaa

SEQ ID NO: 13354 - DNA, 22 bp, Artificial Sequence
  chemically synthesized
tcctgcctcagcctcccaagta

SEQ ID NO: 13355 - DNA, 22 bp, Artificial Sequence
  chemically synthesized
ctgcctcagcctcccaagtagc

SEQ ID NO: 13356 - DNA, 22 bp, Artificial Sequence
  chemically synthesized
cctcagcctcccaagtagctgg

SEQ ID NO: 13357 - DNA, 22 bp, Artificial Sequence
  chemically synthesized
agcctcccaagtagctgggatt

SEQ ID NO: 13358 - DNA, 22 bp, Artificial Sequence
  chemically synthesized
ccaagtagctgggattacaggc

SEQ ID NO: 13359 - DNA, 22 bp, Artificial Sequence
  chemically synthesized
ggattacaggcacccgccacca

SEQ ID NO: 13360 - DNA, 22 bp, Artificial Sequence
  chemically synthesized
caggcacccgccaccatgccca

SEQ ID NO: 13361 - DNA, 22 bp, Artificial Sequence
  chemically synthesized
atttttgtatttttagtaaagc

SEQ ID NO: 13362 - DNA, 22 bp, Artificial Sequence
  chemically synthesized
ttgtatttttagtaaagccggg

SEQ ID NO: 13363 - DNA, 22 bp, Artificial Sequence
  chemically synthesized
tgtatttttagtaaagccgggg

SEQ ID NO: 13364 - DNA, 22 bp, Artificial Sequence
  chemically synthesized
gtatttttagtaaagccggggt

SEQ ID NO: 13365 - DNA, 22 bp, Artificial Sequence
  chemically synthesized
tatttttagtaaagccggggtt

SEQ ID NO: 13366 - DNA, 22 bp, Artificial Sequence
  chemically synthesized
ttagtaaagccggggtttcacc

SEQ ID NO: 13367 - DNA, 22 bp, Artificial Sequence
  chemically synthesized
tagtaaagccggggtttcacca

SEQ ID NO: 13368 - DNA, 22 bp, Artificial Sequence
  chemically synthesized
agtaaagccggggtttcaccat

SEQ ID NO: 13369 - DNA, 22 bp, Artificial Sequence
  chemically synthesized
gtaaagccggggtttcaccatt

SEQ ID NO: 13370 - DNA, 22 bp, Artificial Sequence
  chemically synthesized
caccatttcaccttgttggcca

SEQ ID NO: 13371 - DNA, 22 bp, Artificial Sequence
  chemically synthesized
accatttcaccttgttggccag

SEQ ID NO: 13372 - DNA, 22 bp, Artificial Sequence
  chemically synthesized
caccttgttggccaggctggtg

SEQ ID NO: 13373 - DNA, 22 bp, Artificial Sequence
  chemically synthesized
accttgttggccaggctggtgt

SEQ ID NO: 13374 - DNA, 22 bp, Artificial Sequence
  chemically synthesized
gttggccaggctggtgtcgaac

SEQ ID NO: 13375 - DNA, 22 bp, Artificial Sequence
  chemically synthesized
ttggccaggctggtgtcgaact

SEQ ID NO: 13376 - DNA, 22 bp, Artificial Sequence
  chemically synthesized
gccaggctggtgtcgaactcct

SEQ ID NO: 13377 - DNA, 22 bp, Artificial Sequence
  chemically synthesized
gtgtcgaactcctgacctcaag

SEQ ID NO: 13378 - DNA, 22 bp, Artificial Sequence
  chemically synthesized
ctgacctcaagtgatctgcctg

SEQ ID NO: 13379 - DNA, 22 bp, Artificial Sequence
  chemically synthesized
acctcaagtgatctgcctgcct

SEQ ID NO: 13380 - DNA, 22 bp, Artificial Sequence
  chemically synthesized
aagtgatctgcctgcctgggcc

SEQ ID NO: 13381 - DNA, 22 bp, Artificial Sequence
  chemically synthesized
cctgcctgggcctctgaaagtg

SEQ ID NO: 13382 - DNA, 22 bp, Artificial Sequence
  chemically synthesized
cctgggcctctgaaagtgctgg

SEQ ID NO: 13383 - DNA, 22 bp, Artificial Sequence
  chemically synthesized
ggcctctgaaagtgctgggatt

SEQ ID NO: 13384 - DNA, 22 bp, Artificial Sequence
  chemically synthesized
tgaaagtgctgggattataggt

SEQ ID NO: 13385 - DNA, 22 bp, Artificial Sequence
  chemically synthesized
aaagtgctgggattataggtgt

SEQ ID NO: 13386 - DNA, 22 bp, Artificial Sequence
  chemically synthesized
ggattataggtgtgagccacca

SEQ ID NO: 13387 - DNA, 22 bp, Artificial Sequence
  chemically synthesized
taggtgtgagccaccatgccag

SEQ ID NO: 13388 - DNA, 22 bp, Artificial Sequence
  chemically synthesized
tcttcaactcttcattggccat

SEQ ID NO: 13389 - DNA, 22 bp, Artificial Sequence
  chemically synthesized
ttcaactcttcattggccatat

SEQ ID NO: 13390 - DNA, 22 bp, Artificial Sequence
  chemically synthesized
caactcttcattggccatattt

SEQ ID NO: 13391 - DNA, 22 bp, Artificial Sequence
  chemically synthesized
aactcttcattggccatatttc

SEQ ID NO: 13392 - DNA, 22 bp, Artificial Sequence
  chemically synthesized
ttcattggccatatttctcaat

SEQ ID NO: 13393 - DNA, 22 bp, Artificial Sequence
  chemically synthesized
cattggccatatttctcaattt

SEQ ID NO: 13394 - DNA, 22 bp, Artificial Sequence
  chemically synthesized
attggccatatttctcaatttc

SEQ ID NO: 13395 - DNA, 22 bp, Artificial Sequence
  chemically synthesized
gccatatttctcaatttccttc

SEQ ID NO: 13396 - DNA, 22 bp, Artificial Sequence
  chemically synthesized
ctcaatttccttcactcgtttg

SEQ ID NO: 13397 - DNA, 22 bp, Artificial Sequence
  chemically synthesized
tcaatttccttcactcgtttgc

SEQ ID NO: 13398 - DNA, 22 bp, Artificial Sequence
  chemically synthesized
aatttccttcactcgtttgcaa

SEQ ID NO: 13399 - DNA, 22 bp, Artificial Sequence
  chemically synthesized
ccttcactcgtttgcaatgctg

SEQ ID NO: 13400 - DNA, 22 bp, Artificial Sequence
  chemically synthesized
cttcactcgtttgcaatgctgt

SEQ ID NO: 13401 - DNA, 22 bp, Artificial Sequence
  chemically synthesized
cactcgtttgcaatgctgtgcc

SEQ ID NO: 13402 - DNA, 22 bp, Artificial Sequence
  chemically synthesized
actcgtttgcaatgctgtgccc

SEQ ID NO: 13403 - DNA, 22 bp, Artificial Sequence
  chemically synthesized
gtttgcaatgctgtgcccaccc

SEQ ID NO: 13404 - DNA, 22 bp, Artificial Sequence
  chemically synthesized
gcaatgctgtgcccaccctgca

SEQ ID NO: 13405 - DNA, 22 bp, Artificial Sequence
  chemically synthesized
caatgctgtgcccaccctgcaa

SEQ ID NO: 13406 - DNA, 22 bp, Artificial Sequence
  chemically synthesized
tgcccaccctgcaatcctagcc

SEQ ID NO: 13407 - DNA, 22 bp, Artificial Sequence
  chemically synthesized
caatcctagcccctaaattgga

SEQ ID NO: 13408 - DNA, 22 bp, Artificial Sequence
  chemically synthesized
gcccctaaattggagcagccat

SEQ ID NO: 13409 - DNA, 22 bp, Artificial Sequence
  chemically synthesized
aattggagcagccatctgcctt

SEQ ID NO: 13410 - DNA, 22 bp, Artificial Sequence
  chemically synthesized
gagcagccatctgccttcatcc

SEQ ID NO: 13411 - DNA, 22 bp, Artificial Sequence
  chemically synthesized
ccttcatccttctcttcccaga

SEQ ID NO: 13412 - DNA, 22 bp, Artificial Sequence
  chemically synthesized
catccttctcttcccagacagc

SEQ ID NO: 13413 - DNA, 22 bp, Artificial Sequence
  chemically synthesized
atccttctcttcccagacagcc

SEQ ID NO: 13414 - DNA, 22 bp, Artificial Sequence
  chemically synthesized
ctcttcccagacagccgaggac

SEQ ID NO: 13415 - DNA, 22 bp, Artificial Sequence
  chemically synthesized
tcttcccagacagccgaggact

SEQ ID NO: 13416 - DNA, 22 bp, Artificial Sequence
  chemically synthesized
ttcccagacagccgaggactgt

SEQ ID NO: 13417 - DNA, 22 bp, Artificial Sequence
  chemically synthesized
cccagacagccgaggactgtga

SEQ ID NO: 13418 - DNA, 22 bp, Artificial Sequence
  chemically synthesized
ccagacagccgaggactgtgaa

SEQ ID NO: 13419 - DNA, 22 bp, Artificial Sequence
  chemically synthesized
tgaaggaaaaaaatcaccaaaa

SEQ ID NO: 13420 - DNA, 22 bp, Artificial Sequence
  chemically synthesized
atgcctcacagcctccacccac

SEQ ID NO: 13421 - DNA, 22 bp, Artificial Sequence
  chemically synthesized
acagcctccacccacctctctg

SEQ ID NO: 13422 - DNA, 22 bp, Artificial Sequence
  chemically synthesized
cacccacctctctgctcagcaa

SEQ ID NO: 13423 - DNA, 22 bp, Artificial Sequence
  chemically synthesized
tctgctcagcaactcatttact

SEQ ID NO: 13424 - DNA, 22 bp, Artificial Sequence
  chemically synthesized
tgctcagcaactcatttacttg

SEQ ID NO: 13425 - DNA, 22 bp, Artificial Sequence
  chemically synthesized
ctcagcaactcatttacttggc

SEQ ID NO: 13426 - DNA, 22 bp, Artificial Sequence
  chemically synthesized
agcaactcatttacttggccct

SEQ ID NO: 13427 - DNA, 22 bp, Artificial Sequence
  chemically synthesized
atttacttggccctggacactc

SEQ ID NO: 13428 - DNA, 22 bp, Artificial Sequence
  chemically synthesized
acttggccctggacactcctaa

SEQ ID NO: 13429 - DNA, 22 bp, Artificial Sequence
  chemically synthesized
cttggccctggacactcctaaa

SEQ ID NO: 13430 - DNA, 22 bp, Artificial Sequence
  chemically synthesized
ggccctggacactcctaaatag

SEQ ID NO: 13431 - DNA, 22 bp, Artificial Sequence
  chemically synthesized
gccctggacactcctaaatagc

SEQ ID NO: 13432 - DNA, 22 bp, Artificial Sequence
  chemically synthesized
gacactcctaaatagcatccat

SEQ ID NO: 13433 - DNA, 22 bp, Artificial Sequence
  chemically synthesized
ctaaatagcatccatgcctgca

SEQ ID NO: 13434 - DNA, 22 bp, Artificial Sequence
  chemically synthesized
aatagcatccatgcctgcatcc

SEQ ID NO: 13435 - DNA, 22 bp, Artificial Sequence
  chemically synthesized
catccatttacagtcgttcctc

SEQ ID NO: 13436 - DNA, 22 bp, Artificial Sequence
  chemically synthesized
acagtcgttcctcagtatccat

SEQ ID NO: 13437 - DNA, 22 bp, Artificial Sequence
  chemically synthesized
cagtcgttcctcagtatccatg

SEQ ID NO: 13438 - DNA, 22 bp, Artificial Sequence
  chemically synthesized
ctcagtatccatggaaaattgg

SEQ ID NO: 13439 - DNA, 22 bp, Artificial Sequence
  chemically synthesized
agtatccatggaaaattggtgg

SEQ ID NO: 13440 - DNA, 22 bp, Artificial Sequence
  chemically synthesized
gtggcaagaccccctgcaaata

SEQ ID NO: 13441 - DNA, 22 bp, Artificial Sequence
  chemically synthesized
caaatatcaagatctgtggatg

SEQ ID NO: 13442 - DNA, 22 bp, Artificial Sequence
  chemically synthesized
tggatgctcaagtctccgatat

SEQ ID NO: 13443 - DNA, 22 bp, Artificial Sequence
  chemically synthesized
aagtctccgatataaaaatggc

SEQ ID NO: 13444 - DNA, 22 bp, Artificial Sequence
  chemically synthesized
cgatataaaaatggcttactat

SEQ ID NO: 13445 - DNA, 22 bp, Artificial Sequence
  chemically synthesized
actatttgcatataacctaaac

SEQ ID NO: 13446 - DNA, 22 bp, Artificial Sequence
  chemically synthesized
ctatttgcatataacctaaaca

SEQ ID NO: 13447 - DNA, 22 bp, Artificial Sequence
  chemically synthesized
tttgcatataacctaaacacat

SEQ ID NO: 13448 - DNA, 22 bp, Artificial Sequence
  chemically synthesized
gcatataacctaaacacatcct

SEQ ID NO: 13449 - DNA, 22 bp, Artificial Sequence
  chemically synthesized
catataacctaaacacatcctc

SEQ ID NO: 13450 - DNA, 22 bp, Artificial Sequence
  chemically synthesized
aacacatcctcctttgtacttt

SEQ ID NO: 13451 - DNA, 22 bp, Artificial Sequence
  chemically synthesized
ctttgtactttaaatcatctct

SEQ ID NO: 13452 - DNA, 22 bp, Artificial Sequence
  chemically synthesized
tgtactttaaatcatctctagg

SEQ ID NO: 13453 - DNA, 22 bp, Artificial Sequence
  chemically synthesized
gtactttaaatcatctctaggt

SEQ ID NO: 13454 - DNA, 22 bp, Artificial Sequence
  chemically synthesized
tactttaaatcatctctaggtt

SEQ ID NO: 13455 - DNA, 22 bp, Artificial Sequence
  chemically synthesized
taaatcatctctaggtttctct

SEQ ID NO: 13456 - DNA, 22 bp, Artificial Sequence
  chemically synthesized
aaatcatctctaggtttctctt

SEQ ID NO: 13457 - DNA, 22 bp, Artificial Sequence
  chemically synthesized
aatcatctctaggtttctctta

SEQ ID NO: 13458 - DNA, 22 bp, Artificial Sequence
  chemically synthesized
taggtttctcttaatagctaat

SEQ ID NO: 13459 - DNA, 22 bp, Artificial Sequence
  chemically synthesized
ggtttctcttaatagctaatac

SEQ ID NO: 13460 - DNA, 22 bp, Artificial Sequence
  chemically synthesized
ctcttaatagctaatacaatgt

SEQ ID NO: 13461 - DNA, 22 bp, Artificial Sequence
  chemically synthesized
tcttaatagctaatacaatgta

SEQ ID NO: 13462 - DNA, 22 bp, Artificial Sequence
  chemically synthesized
ttaatagctaatacaatgtaaa

SEQ ID NO: 13463 - DNA, 22 bp, Artificial Sequence
  chemically synthesized
aatagctaatacaatgtaaatg

SEQ ID NO: 13464 - DNA, 22 bp, Artificial Sequence
  chemically synthesized
atagctaatacaatgtaaatgc

SEQ ID NO: 13465 - DNA, 22 bp, Artificial Sequence
  chemically synthesized
atacaatgtaaatgctatgtaa

SEQ ID NO: 13466 - DNA, 22 bp, Artificial Sequence
  chemically synthesized
tgtaaatagttgttatgctgta

SEQ ID NO: 13467 - DNA, 22 bp, Artificial Sequence
  chemically synthesized
ttatgctgtattgtttagggaa

SEQ ID NO: 13468 - DNA, 22 bp, Artificial Sequence
  chemically synthesized
tgctgtattgtttagggaataa

SEQ ID NO: 13469 - DNA, 22 bp, Artificial Sequence
  chemically synthesized
tattgtttagggaataatgaaa

SEQ ID NO: 13470 - DNA, 22 bp, Artificial Sequence
  chemically synthesized
tttagggaataatgaaagataa

SEQ ID NO: 13471 - DNA, 22 bp, Artificial Sequence
  chemically synthesized
agggaataatgaaagataaaag

SEQ ID NO: 13472 - DNA, 22 bp, Artificial Sequence
  chemically synthesized
gggaataatgaaagataaaaga

SEQ ID NO: 13473 - DNA, 22 bp, Artificial Sequence
  chemically synthesized
tacatgttcagtagagatgcaa

SEQ ID NO: 13474 - DNA, 22 bp, Artificial Sequence
  chemically synthesized
agtagagatgcaaccatccatt

SEQ ID NO: 13475 - DNA, 22 bp, Artificial Sequence
  chemically synthesized
ttttcttgaatatttttgatct

SEQ ID NO: 13476 - DNA, 22 bp, Artificial Sequence
  chemically synthesized
tttcttgaatatttttgatctg

SEQ ID NO: 13477 - DNA, 22 bp, Artificial Sequence
  chemically synthesized
ttcttgaatatttttgatctgc

SEQ ID NO: 13478 - DNA, 22 bp, Artificial Sequence
  chemically synthesized
tcttgaatatttttgatctgca

SEQ ID NO: 13479 - DNA, 22 bp, Artificial Sequence
  chemically synthesized
cttgaatatttttgatctgcag

SEQ ID NO: 13480 - DNA, 22 bp, Artificial Sequence
  chemically synthesized
ttgaatatttttgatctgcagt

SEQ ID NO: 13481 - DNA, 22 bp, Artificial Sequence
  chemically synthesized
gaatatttttgatctgcagtta

SEQ ID NO: 13482 - DNA, 22 bp, Artificial Sequence
  chemically synthesized
aatatttttgatctgcagttaa

SEQ ID NO: 13483 - DNA, 22 bp, Artificial Sequence
  chemically synthesized
ttgatctgcagttaattgaatc

SEQ ID NO: 13484 - DNA, 22 bp, Artificial Sequence
  chemically synthesized
tgatctgcagttaattgaatct

SEQ ID NO: 13485 - DNA, 22 bp, Artificial Sequence
  chemically synthesized
gatctgcagttaattgaatctg

SEQ ID NO: 13486 - DNA, 22 bp, Artificial Sequence
  chemically synthesized
atctgcagttaattgaatctgt

SEQ ID NO: 13487 - DNA, 22 bp, Artificial Sequence
  chemically synthesized
cagttaattgaatctgtggctg

SEQ ID NO: 13488 - DNA, 22 bp, Artificial Sequence
  chemically synthesized
attgaatctgtggctgtggaac

SEQ ID NO: 13489 - DNA, 22 bp, Artificial Sequence
  chemically synthesized
aatctgtggctgtggaactcac

SEQ ID NO: 13490 - DNA, 22 bp, Artificial Sequence
  chemically synthesized
tggctgtggaactcacaaggag

SEQ ID NO: 13491 - DNA, 22 bp, Artificial Sequence
  chemically synthesized
tggaactcacaaggagagctga

SEQ ID NO: 13492 - DNA, 22 bp, Artificial Sequence
  chemically synthesized
acaaggagagctgactgtacag

SEQ ID NO: 13493 - DNA, 22 bp, Artificial Sequence
  chemically synthesized
actgtacagtgtggttgagtga

SEQ ID NO: 13494 - DNA, 22 bp, Artificial Sequence
  chemically synthesized
tacagtgtggttgagtgaaaaa

SEQ ID NO: 13495 - DNA, 22 bp, Artificial Sequence
  chemically synthesized
agtgaaaaaacagactttagaa

SEQ ID NO: 13496 - DNA, 22 bp, Artificial Sequence
  chemically synthesized
tagaatcagatcagacagaaat

SEQ ID NO: 13497 - DNA, 22 bp, Artificial Sequence
  chemically synthesized
agaatcagatcagacagaaata

SEQ ID NO: 13498 - DNA, 22 bp, Artificial Sequence
  chemically synthesized
gaatcagatcagacagaaatag

SEQ ID NO: 13499 - DNA, 22 bp, Artificial Sequence
  chemically synthesized
gaatcaagtatctgcctcctct

SEQ ID NO: 13500 - DNA, 22 bp, Artificial Sequence
  chemically synthesized
aatcaagtatctgcctcctcta

SEQ ID NO: 13501 - DNA, 22 bp, Artificial Sequence
  chemically synthesized
cctcctctagacctgtgacctt

SEQ ID NO: 13502 - DNA, 22 bp, Artificial Sequence
  chemically synthesized
ctctagacctgtgaccttggac

SEQ ID NO: 13503 - DNA, 22 bp, Artificial Sequence
  chemically synthesized
tagacctgtgaccttggacaag

SEQ ID NO: 13504 - DNA, 22 bp, Artificial Sequence
  chemically synthesized
gacctgtgaccttggacaagtc

SEQ ID NO: 13505 - DNA, 22 bp, Artificial Sequence
  chemically synthesized
tgaccttggacaagtcacacaa

SEQ ID NO: 13506 - DNA, 22 bp, Artificial Sequence
  chemically synthesized
ggacaagtcacacaagctctga

SEQ ID NO: 13507 - DNA, 22 bp, Artificial Sequence
  chemically synthesized
gacaagtcacacaagctctgaa

SEQ ID NO: 13508 - DNA, 22 bp, Artificial Sequence
  chemically synthesized
tgaaccttaactttgtcaaatg

SEQ ID NO: 13509 - DNA, 22 bp, Artificial Sequence
  chemically synthesized
aaccttaactttgtcaaatgta

SEQ ID NO: 13510 - DNA, 22 bp, Artificial Sequence
  chemically synthesized
aactttgtcaaatgtaaattag

SEQ ID NO: 13511 - DNA, 22 bp, Artificial Sequence
  chemically synthesized
actttgtcaaatgtaaattagg

SEQ ID NO: 13512 - DNA, 22 bp, Artificial Sequence
  chemically synthesized
tgtcaaatgtaaattaggttta

SEQ ID NO: 13513 - DNA, 22 bp, Artificial Sequence
  chemically synthesized
gtcaaatgtaaattaggtttaa

SEQ ID NO: 13514 - DNA, 22 bp, Artificial Sequence
  chemically synthesized
tcaaatgtaaattaggtttaac

SEQ ID NO: 13515 - DNA, 22 bp, Artificial Sequence
  chemically synthesized
ggtttaacagtagtataataag

SEQ ID NO: 13516 - DNA, 22 bp, Artificial Sequence
  chemically synthesized
aacagtagtataataagaatat

SEQ ID NO: 13517 - DNA, 22 bp, Artificial Sequence
  chemically synthesized
acagtagtataataagaatatc

SEQ ID NO: 13518 - DNA, 22 bp, Artificial Sequence
  chemically synthesized
tctcacaggtgttggcaggatc

SEQ ID NO: 13519 - DNA, 22 bp, Artificial Sequence
  chemically synthesized
acaggtgttggcaggatcagtg

SEQ ID NO: 13520 - DNA, 22 bp, Artificial Sequence
  chemically synthesized
gcaggatcagtgagacaatatg

SEQ ID NO: 13521 - DNA, 22 bp, Artificial Sequence
  chemically synthesized
gttatctctttttctccctact

SEQ ID NO: 13522 - DNA, 22 bp, Artificial Sequence
  chemically synthesized
tctctttttctccctactcctt

SEQ ID NO: 13523 - DNA, 22 bp, Artificial Sequence
  chemically synthesized
tttttctccctactcctttcat

SEQ ID NO: 13524 - DNA, 22 bp, Artificial Sequence
  chemically synthesized
tttctccctactcctttcatgt

SEQ ID NO: 13525 - DNA, 22 bp, Artificial Sequence
  chemically synthesized
ttctccctactcctttcatgtt

SEQ ID NO: 13526 - DNA, 22 bp, Artificial Sequence
  chemically synthesized
tctccctactcctttcatgttg

SEQ ID NO: 13527 - DNA, 22 bp, Artificial Sequence
  chemically synthesized
ctccctactcctttcatgttgg

SEQ ID NO: 13528 - DNA, 22 bp, Artificial Sequence
  chemically synthesized
tccctactcctttcatgttggc

SEQ ID NO: 13529 - DNA, 22 bp, Artificial Sequence
  chemically synthesized
cctactcctttcatgttggccc

SEQ ID NO: 13530 - DNA, 22 bp, Artificial Sequence
  chemically synthesized
ctcctttcatgttggccctact

SEQ ID NO: 13531 - DNA, 22 bp, Artificial Sequence
  chemically synthesized
ctttcatgttggccctactttc

SEQ ID NO: 13532 - DNA, 22 bp, Artificial Sequence
  chemically synthesized
tcatgttggccctactttcttc

SEQ ID NO: 13533 - DNA, 22 bp, Artificial Sequence
  chemically synthesized
catgttggccctactttcttct

SEQ ID NO: 13534 - DNA, 22 bp, Artificial Sequence
  chemically synthesized
atgttggccctactttcttctg

SEQ ID NO: 13535 - DNA, 22 bp, Artificial Sequence
  chemically synthesized
gccctactttcttctgttttaa

SEQ ID NO: 13536 - DNA, 22 bp, Artificial Sequence
  chemically synthesized
ctttcttctgttttaaatttct

SEQ ID NO: 13537 - DNA, 22 bp, Artificial Sequence
  chemically synthesized
tcttctgttttaaatttctcaa

SEQ ID NO: 13538 - DNA, 22 bp, Artificial Sequence
  chemically synthesized
cttctgttttaaatttctcaat

SEQ ID NO: 13539 - DNA, 22 bp, Artificial Sequence
  chemically synthesized
ttctgttttaaatttctcaatt

SEQ ID NO: 13540 - DNA, 22 bp, Artificial Sequence
  chemically synthesized
ctgttttaaatttctcaattct

SEQ ID NO: 13541 - DNA, 22 bp, Artificial Sequence
  chemically synthesized
tgttttaaatttctcaattctc

SEQ ID NO: 13542 - DNA, 22 bp, Artificial Sequence
  chemically synthesized
ttttaaatttctcaattctctt

SEQ ID NO: 13543 - DNA, 22 bp, Artificial Sequence
  chemically synthesized
taaatttctcaattctctttag

SEQ ID NO: 13544 - DNA, 22 bp, Artificial Sequence
  chemically synthesized
aaatttctcaattctctttagc

SEQ ID NO: 13545 - DNA, 22 bp, Artificial Sequence
  chemically synthesized
aatttctcaattctctttagct

SEQ ID NO: 13546 - DNA, 22 bp, Artificial Sequence
  chemically synthesized
ctcaattctctttagctcttta

SEQ ID NO: 13547 - DNA, 22 bp, Artificial Sequence
  chemically synthesized
tcaattctctttagctctttaa

SEQ ID NO: 13548 - DNA, 22 bp, Artificial Sequence
  chemically synthesized
aattctctttagctctttaata

SEQ ID NO: 13549 - DNA, 22 bp, Artificial Sequence
  chemically synthesized
tctttagctctttaataacttc

SEQ ID NO: 13550 - DNA, 22 bp, Artificial Sequence
  chemically synthesized
tttagctctttaataacttctg

SEQ ID NO: 13551 - DNA, 22 bp, Artificial Sequence
  chemically synthesized
tagctctttaataacttctgtg

SEQ ID NO: 13552 - DNA, 22 bp, Artificial Sequence
  chemically synthesized
agctctttaataacttctgtgt

SEQ ID NO: 13553 - DNA, 22 bp, Artificial Sequence
  chemically synthesized
gctctttaataacttctgtgta

SEQ ID NO: 13554 - DNA, 22 bp, Artificial Sequence
  chemically synthesized
tttaataacttctgtgtagctc

SEQ ID NO: 13555 - DNA, 22 bp, Artificial Sequence
  chemically synthesized
taataacttctgtgtagctctt

SEQ ID NO: 13556 - DNA, 22 bp, Artificial Sequence
  chemically synthesized
aataacttctgtgtagctcttt

SEQ ID NO: 13557 - DNA, 22 bp, Artificial Sequence
  chemically synthesized
ataacttctgtgtagctctttt

SEQ ID NO: 13558 - DNA, 22 bp, Artificial Sequence
  chemically synthesized
ctgtgtagctcttttccttcct

SEQ ID NO: 13559 - DNA, 22 bp, Artificial Sequence
  chemically synthesized
tgtgtagctcttttccttcctt

SEQ ID NO: 13560 - DNA, 22 bp, Artificial Sequence
  chemically synthesized
tgtagctcttttccttccttaa

SEQ ID NO: 13561 - DNA, 22 bp, Artificial Sequence
  chemically synthesized
ttttccttccttaatcacattt

SEQ ID NO: 13562 - DNA, 22 bp, Artificial Sequence
  chemically synthesized
ttccttccttaatcacatttat

SEQ ID NO: 13563 - DNA, 22 bp, Artificial Sequence
  chemically synthesized
tccttccttaatcacatttata

SEQ ID NO: 13564 - DNA, 22 bp, Artificial Sequence
  chemically synthesized
ccttccttaatcacatttatat

SEQ ID NO: 13565 - DNA, 22 bp, Artificial Sequence
  chemically synthesized
cttccttaatcacatttatata

SEQ ID NO: 13566 - DNA, 22 bp, Artificial Sequence
  chemically synthesized
ccttaatcacatttatataatg

SEQ ID NO: 13567 - DNA, 22 bp, Artificial Sequence
  chemically synthesized
cttaatcacatttatataatga

SEQ ID NO: 13568 - DNA, 22 bp, Artificial Sequence
  chemically synthesized
aatcacatttatataatgaaat

SEQ ID NO: 13569 - DNA, 22 bp, Artificial Sequence
  chemically synthesized
atcacatttatataatgaaatg

SEQ ID NO: 13570 - DNA, 22 bp, Artificial Sequence
  chemically synthesized
atataatgaaatgactattgtc

SEQ ID NO: 13571 - DNA, 22 bp, Artificial Sequence
  chemically synthesized
tataatgaaatgactattgtca

SEQ ID NO: 13572 - DNA, 22 bp, Artificial Sequence
  chemically synthesized
ttgtcacaatcaggaatgacct

SEQ ID NO: 13573 - DNA, 22 bp, Artificial Sequence
  chemically synthesized
tcacaatcaggaatgacctaaa

SEQ ID NO: 13574 - DNA, 22 bp, Artificial Sequence
  chemically synthesized
aagaataattttgagtttatgt

SEQ ID NO: 13575 - DNA, 22 bp, Artificial Sequence
  chemically synthesized
tgagtttatgtatttactggct

SEQ ID NO: 13576 - DNA, 22 bp, Artificial Sequence
  chemically synthesized
gagtttatgtatttactggctg

SEQ ID NO: 13577 - DNA, 22 bp, Artificial Sequence
  chemically synthesized
agtttatgtatttactggctgc

SEQ ID NO: 13578 - DNA, 22 bp, Artificial Sequence
  chemically synthesized
atgtatttactggctgctctaa

SEQ ID NO: 13579 - DNA, 22 bp, Artificial Sequence
  chemically synthesized
tgtatttactggctgctctaaa

SEQ ID NO: 13580 - DNA, 22 bp, Artificial Sequence
  chemically synthesized
actggctgctctaaataatttc

SEQ ID NO: 13581 - DNA, 22 bp, Artificial Sequence
  chemically synthesized
ctggctgctctaaataatttct

SEQ ID NO: 13582 - DNA, 22 bp, Artificial Sequence
  chemically synthesized
gctgctctaaataatttctaat

SEQ ID NO: 13583 - DNA, 22 bp, Artificial Sequence
  chemically synthesized
ctctaaataatttctaattgtt

SEQ ID NO: 13584 - DNA, 22 bp, Artificial Sequence
  chemically synthesized
taaataatttctaattgttgat

SEQ ID NO: 13585 - DNA, 22 bp, Artificial Sequence
  chemically synthesized
aataatttctaattgttgatct

SEQ ID NO: 13586 - DNA, 22 bp, Artificial Sequence
  chemically synthesized
ctaattgttgatctctcccttt

SEQ ID NO: 13587 - DNA, 22 bp, Artificial Sequence
  chemically synthesized
taattgttgatctctccctttt

SEQ ID NO: 13588 - DNA, 22 bp, Artificial Sequence
  chemically synthesized
attgttgatctctcccttttta

SEQ ID NO: 13589 - DNA, 22 bp, Artificial Sequence
  chemically synthesized
ttgatctctccctttttaggaa

SEQ ID NO: 13590 - DNA, 22 bp, Artificial Sequence
  chemically synthesized
atctctccctttttaggaaact

SEQ ID NO: 13591 - DNA, 22 bp, Artificial Sequence
  chemically synthesized
tccctttttaggaaactctttt

SEQ ID NO: 13592 - DNA, 22 bp, Artificial Sequence
  chemically synthesized
cctttttaggaaactcttttta

SEQ ID NO: 13593 - DNA, 22 bp, Artificial Sequence
  chemically synthesized
tttaggaaactctttttataat

SEQ ID NO: 13594 - DNA, 22 bp, Artificial Sequence
  chemically synthesized
ttaggaaactctttttataata

SEQ ID NO: 13595 - DNA, 22 bp, Artificial Sequence
  chemically synthesized
taggaaactctttttataataa

SEQ ID NO: 13596 - DNA, 22 bp, Artificial Sequence
  chemically synthesized
aggaaactctttttataataat

SEQ ID NO: 13597 - DNA, 22 bp, Artificial Sequence
  chemically synthesized
ggaaactctttttataataatc

SEQ ID NO: 13598 - DNA, 22 bp, Artificial Sequence
  chemically synthesized
tttttataataatcactctatt

SEQ ID NO: 13599 - DNA, 22 bp, Artificial Sequence
  chemically synthesized
tttataataatcactctattct

SEQ ID NO: 13600 - DNA, 22 bp, Artificial Sequence
  chemically synthesized
ttataataatcactctattctg

SEQ ID NO: 13601 - DNA, 22 bp, Artificial Sequence
  chemically synthesized
tataataatcactctattctgg

SEQ ID NO: 13602 - DNA, 22 bp, Artificial Sequence
  chemically synthesized
ataataatcactctattctggt

SEQ ID NO: 13603 - DNA, 22 bp, Artificial Sequence
  chemically synthesized
taataatcactctattctggtt

SEQ ID NO: 13604 - DNA, 22 bp, Artificial Sequence
  chemically synthesized
tattctggttccccgctttgct

SEQ ID NO: 13605 - DNA, 22 bp, Artificial Sequence
  chemically synthesized
ttctggttccccgctttgctct

SEQ ID NO: 13606 - DNA, 22 bp, Artificial Sequence
  chemically synthesized
tggttccccgctttgctctaac

SEQ ID NO: 13607 - DNA, 22 bp, Artificial Sequence
  chemically synthesized
gttccccgctttgctctaactc

SEQ ID NO: 13608 - DNA, 22 bp, Artificial Sequence
  chemically synthesized
cccgctttgctctaactcctgt

SEQ ID NO: 13609 - DNA, 22 bp, Artificial Sequence
  chemically synthesized
tgctctaactcctgttatccat

SEQ ID NO: 13610 - DNA, 22 bp, Artificial Sequence
  chemically synthesized
gctctaactcctgttatccatc

SEQ ID NO: 13611 - DNA, 22 bp, Artificial Sequence
  chemically synthesized
ctctaactcctgttatccatcc

SEQ ID NO: 13612 - DNA, 22 bp, Artificial Sequence
  chemically synthesized
taactcctgttatccatccagc

SEQ ID NO: 13613 - DNA, 22 bp, Artificial Sequence
  chemically synthesized
actcctgttatccatccagcac

SEQ ID NO: 13614 - DNA, 22 bp, Artificial Sequence
  chemically synthesized
ctgttatccatccagcacttga

SEQ ID NO: 13615 - DNA, 22 bp, Artificial Sequence
  chemically synthesized
ttatccatccagcacttgaatt

SEQ ID NO: 13616 - DNA, 22 bp, Artificial Sequence
  chemically synthesized
tccatccagcacttgaattgat

SEQ ID NO: 13617 - DNA, 22 bp, Artificial Sequence
  chemically synthesized
gaattgattaactcctgttcct

SEQ ID NO: 13618 - DNA, 22 bp, Artificial Sequence
  chemically synthesized
aattgattaactcctgttcctc

SEQ ID NO: 13619 - DNA, 22 bp, Artificial Sequence
  chemically synthesized
attaactcctgttcctctccat

SEQ ID NO: 13620 - DNA, 22 bp, Artificial Sequence
  chemically synthesized
actcctgttcctctccatggcc

SEQ ID NO: 13621 - DNA, 22 bp, Artificial Sequence
  chemically synthesized
ctgttcctctccatggccctta

SEQ ID NO: 13622 - DNA, 22 bp, Artificial Sequence
  chemically synthesized
ttcctctccatggcccttaaat

SEQ ID NO: 13623 - DNA, 22 bp, Artificial Sequence
  chemically synthesized
ctctccatggcccttaaatgtc

SEQ ID NO: 13624 - DNA, 22 bp, Artificial Sequence
  chemically synthesized
tccatggcccttaaatgtccag

SEQ ID NO: 13625 - DNA, 22 bp, Artificial Sequence
  chemically synthesized
catggcccttaaatgtccaggg

SEQ ID NO: 13626 - DNA, 22 bp, Artificial Sequence
  chemically synthesized
aaatgtccagggttctcccagg

SEQ ID NO: 13627 - DNA, 22 bp, Artificial Sequence
  chemically synthesized
aatgtccagggttctcccaggc

SEQ ID NO: 13628 - DNA, 22 bp, Artificial Sequence
  chemically synthesized
tcccaggctccagcctcagctt

SEQ ID NO: 13629 - DNA, 22 bp, Artificial Sequence
  chemically synthesized
ccaggctccagcctcagctttt

SEQ ID NO: 13630 - DNA, 22 bp, Artificial Sequence
  chemically synthesized
cagcctcagctttttccttttt

SEQ ID NO: 13631 - DNA, 22 bp, Artificial Sequence
  chemically synthesized
agctttttcctttttcacctta

SEQ ID NO: 13632 - DNA, 22 bp, Artificial Sequence
  chemically synthesized
tttcctttttcaccttatatat

SEQ ID NO: 13633 - DNA, 22 bp, Artificial Sequence
  chemically synthesized
ttcctttttcaccttatatata

SEQ ID NO: 13634 - DNA, 22 bp, Artificial Sequence
  chemically synthesized
tcctttttcaccttatatatac

SEQ ID NO: 13635 - DNA, 22 bp, Artificial Sequence
  chemically synthesized
cctttttcaccttatatatact

SEQ ID NO: 13636 - DNA, 22 bp, Artificial Sequence
  chemically synthesized
ctttttcaccttatatatactt

SEQ ID NO: 13637 - DNA, 22 bp, Artificial Sequence
  chemically synthesized
tttcaccttatatatacttgct

SEQ ID NO: 13638 - DNA, 22 bp, Artificial Sequence
  chemically synthesized
ttcaccttatatatacttgcta

SEQ ID NO: 13639 - DNA, 22 bp, Artificial Sequence
  chemically synthesized
tcaccttatatatacttgctag

SEQ ID NO: 13640 - DNA, 22 bp, Artificial Sequence
  chemically synthesized
caccttatatatacttgctagg

SEQ ID NO: 13641 - DNA, 22 bp, Artificial Sequence
  chemically synthesized
accttatatatacttgctaggg

SEQ ID NO: 13642 - DNA, 22 bp, Artificial Sequence
  chemically synthesized
atatatacttgctagggctggg

SEQ ID NO: 13643 - DNA, 22 bp, Artificial Sequence
  chemically synthesized
tatatacttgctagggctggga

SEQ ID NO: 13644 - DNA, 22 bp, Artificial Sequence
  chemically synthesized
gctagggctgggacaagagtga

SEQ ID NO: 13645 - DNA, 22 bp, Artificial Sequence
  chemically synthesized
ctagggctgggacaagagtgaa

SEQ ID NO: 13646 - DNA, 22 bp, Artificial Sequence
  chemically synthesized
gggctgggacaagagtgaacca

SEQ ID NO: 13647 - DNA, 22 bp, Artificial Sequence
  chemically synthesized
ggacaagagtgaaccaaacaag

SEQ ID NO: 13648 - DNA, 22 bp, Artificial Sequence
  chemically synthesized
aagaggtcctcacttctcgggg

SEQ ID NO: 13649 - DNA, 22 bp, Artificial Sequence
  chemically synthesized
agaggtcctcacttctcggggc

SEQ ID NO: 13650 - DNA, 22 bp, Artificial Sequence
  chemically synthesized
acttctcggggcatacaagtat

SEQ ID NO: 13651 - DNA, 22 bp, Artificial Sequence
  chemically synthesized
ctcggggcatacaagtatattt

SEQ ID NO: 13652 - DNA, 22 bp, Artificial Sequence
  chemically synthesized
tcggggcatacaagtatattta

SEQ ID NO: 13653 - DNA, 22 bp, Artificial Sequence
  chemically synthesized
ggggcatacaagtatatttatg

SEQ ID NO: 13654 - DNA, 22 bp, Artificial Sequence
  chemically synthesized
atgccctacaggccttgcttac

SEQ ID NO: 13655 - DNA, 22 bp, Artificial Sequence
  chemically synthesized
tgccctacaggccttgcttacc

SEQ ID NO: 13656 - DNA, 22 bp, Artificial Sequence
  chemically synthesized
caggccttgcttaccacagtct

SEQ ID NO: 13657 - DNA, 22 bp, Artificial Sequence
  chemically synthesized
gcttaccacagtctagtccggc

SEQ ID NO: 13658 - DNA, 22 bp, Artificial Sequence
  chemically synthesized
cttaccacagtctagtccggcc

SEQ ID NO: 13659 - DNA, 22 bp, Artificial Sequence
  chemically synthesized
accacagtctagtccggccctg

SEQ ID NO: 13660 - DNA, 22 bp, Artificial Sequence
  chemically synthesized
ccacagtctagtccggccctga

SEQ ID NO: 13661 - DNA, 22 bp, Artificial Sequence
  chemically synthesized
gtccggccctgaccctgtcaac

SEQ ID NO: 13662 - DNA, 22 bp, Artificial Sequence
  chemically synthesized
accctgtcaacaaaatttactg

SEQ ID NO: 13663 - DNA, 22 bp, Artificial Sequence
  chemically synthesized
tcaacaaaatttactgagcata

SEQ ID NO: 13664 - DNA, 22 bp, Artificial Sequence
  chemically synthesized
actgagcatacaaccactactg

SEQ ID NO: 13665 - DNA, 22 bp, Artificial Sequence
  chemically synthesized
ctgagcatacaaccactactgc

SEQ ID NO: 13666 - DNA, 22 bp, Artificial Sequence
  chemically synthesized
agcatacaaccactactgccag

SEQ ID NO: 13667 - DNA, 22 bp, Artificial Sequence
  chemically synthesized
ctgccaggcactgtactaggta

SEQ ID NO: 13668 - DNA, 22 bp, Artificial Sequence
  chemically synthesized
ccaggcactgtactaggtatca

SEQ ID NO: 13669 - DNA, 22 bp, Artificial Sequence
  chemically synthesized
tactaggtatcacaatatccat

SEQ ID NO: 13670 - DNA, 22 bp, Artificial Sequence
  chemically synthesized
ggtatcacaatatccatgctca

SEQ ID NO: 13671 - DNA, 22 bp, Artificial Sequence
  chemically synthesized
actctccagatgcccacacacg

SEQ ID NO: 13672 - DNA, 22 bp, Artificial Sequence
  chemically synthesized
tccagatgcccacacacgtggc

SEQ ID NO: 13673 - DNA, 22 bp, Artificial Sequence
  chemically synthesized
cagatgcccacacacgtggctg

SEQ ID NO: 13674 - DNA, 22 bp, Artificial Sequence
  chemically synthesized
taactactgtttacagaacaat

SEQ ID NO: 13675 - DNA, 22 bp, Artificial Sequence
  chemically synthesized
ctgtttacagaacaatgagttc

SEQ ID NO: 13676 - DNA, 22 bp, Artificial Sequence
  chemically synthesized
tttacagaacaatgagttccaa

SEQ ID NO: 13677 - DNA, 22 bp, Artificial Sequence
  chemically synthesized
acagaacaatgagttccaaata

SEQ ID NO: 13678 - DNA, 22 bp, Artificial Sequence
  chemically synthesized
cagaacaatgagttccaaatac

SEQ ID NO: 13679 - DNA, 22 bp, Artificial Sequence
  chemically synthesized
caaatactcacctatagtcaga

SEQ ID NO: 13680 - DNA, 22 bp, Artificial Sequence
  chemically synthesized
acctatagtcagatacgtctcc

SEQ ID NO: 13681 - DNA, 22 bp, Artificial Sequence
  chemically synthesized
tagtcagatacgtctcctgaat

SEQ ID NO: 13682 - DNA, 22 bp, Artificial Sequence
  chemically synthesized
ctgaatttcagattatctttcc

SEQ ID NO: 13683 - DNA, 22 bp, Artificial Sequence
  chemically synthesized
aatttcagattatctttccaac

SEQ ID NO: 13684 - DNA, 22 bp, Artificial Sequence
  chemically synthesized
cagattatctttccaactccct

SEQ ID NO: 13685 - DNA, 22 bp, Artificial Sequence
  chemically synthesized
agattatctttccaactcccta

SEQ ID NO: 13686 - DNA, 22 bp, Artificial Sequence
  chemically synthesized
tctttccaactccctaactgta

SEQ ID NO: 13687 - DNA, 22 bp, Artificial Sequence
  chemically synthesized
tccaactccctaactgtatatc

SEQ ID NO: 13688 - DNA, 22 bp, Artificial Sequence
  chemically synthesized
ccaactccctaactgtatatca

SEQ ID NO: 13689 - DNA, 22 bp, Artificial Sequence
  chemically synthesized
caactccctaactgtatatcat

SEQ ID NO: 13690 - DNA, 22 bp, Artificial Sequence
  chemically synthesized
cctaactgtatatcataatgta

SEQ ID NO: 13691 - DNA, 22 bp, Artificial Sequence
  chemically synthesized
actgtatatcataatgtagcca

SEQ ID NO: 13692 - DNA, 22 bp, Artificial Sequence
  chemically synthesized
tatatcataatgtagccagtaa

SEQ ID NO: 13693 - DNA, 22 bp, Artificial Sequence
  chemically synthesized
atgtatatgtaatgcttctgct

SEQ ID NO: 13694 - DNA, 22 bp, Artificial Sequence
  chemically synthesized
ctgctgtgttggacactgtgct

SEQ ID NO: 13695 - DNA, 22 bp, Artificial Sequence
  chemically synthesized
tgctgtgttggacactgtgctc

SEQ ID NO: 13696 - DNA, 22 bp, Artificial Sequence
  chemically synthesized
ctgtgttggacactgtgctcag

SEQ ID NO: 13697 - DNA, 22 bp, Artificial Sequence
  chemically synthesized
tgttggacactgtgctcagtaa

SEQ ID NO: 13698 - DNA, 22 bp, Artificial Sequence
  chemically synthesized
gacactgtgctcagtaactttg

SEQ ID NO: 13699 - DNA, 22 bp, Artificial Sequence
  chemically synthesized
tgctcagtaactttgcatccat

SEQ ID NO: 13700 - DNA, 22 bp, Artificial Sequence
  chemically synthesized
agtaactttgcatccattatct

SEQ ID NO: 13701 - DNA, 22 bp, Artificial Sequence
  chemically synthesized
tgcatccattatctcacttcat

SEQ ID NO: 13702 - DNA, 22 bp, Artificial Sequence
  chemically synthesized
gcatccattatctcacttcatc

SEQ ID NO: 13703 - DNA, 22 bp, Artificial Sequence
  chemically synthesized
catccattatctcacttcatcc

SEQ ID NO: 13704 - DNA, 22 bp, Artificial Sequence
  chemically synthesized
tctcacttcatcctcacaaaag

SEQ ID NO: 13705 - DNA, 22 bp, Artificial Sequence
  chemically synthesized
acttcatcctcacaaaagtccc

SEQ ID NO: 13706 - DNA, 22 bp, Artificial Sequence
  chemically synthesized
catcctcacaaaagtcccacga

SEQ ID NO: 13707 - DNA, 22 bp, Artificial Sequence
  chemically synthesized
atcctcacaaaagtcccacgag

SEQ ID NO: 13708 - DNA, 22 bp, Artificial Sequence
  chemically synthesized
acaaaagtcccacgagataggc

SEQ ID NO: 13709 - DNA, 22 bp, Artificial Sequence
  chemically synthesized
tcatcttatttttatgaatgag

SEQ ID NO: 13710 - DNA, 22 bp, Artificial Sequence
  chemically synthesized
atttttatgaatgaggaagata

SEQ ID NO: 13711 - DNA, 22 bp, Artificial Sequence
  chemically synthesized
tttttatgaatgaggaagatag

SEQ ID NO: 13712 - DNA, 22 bp, Artificial Sequence
  chemically synthesized
ttatgaatgaggaagatagatt

SEQ ID NO: 13713 - DNA, 22 bp, Artificial Sequence
  chemically synthesized
tatgaatgaggaagatagattc

SEQ ID NO: 13714 - DNA, 22 bp, Artificial Sequence
  chemically synthesized
atgaatgaggaagatagattca

SEQ ID NO: 13715 - DNA, 22 bp, Artificial Sequence
  chemically synthesized
tgaatgaggaagatagattcat

SEQ ID NO: 13716 - DNA, 22 bp, Artificial Sequence
  chemically synthesized
atagaggctaagggctttgccc

SEQ ID NO: 13717 - DNA, 22 bp, Artificial Sequence
  chemically synthesized
agggctttgcccaaggtaacat

SEQ ID NO: 13718 - DNA, 22 bp, Artificial Sequence
  chemically synthesized
tgcccaaggtaacatactaaaa

SEQ ID NO: 13719 - DNA, 22 bp, Artificial Sequence
  chemically synthesized
gcccaaggtaacatactaaaac

SEQ ID NO: 13720 - DNA, 22 bp, Artificial Sequence
  chemically synthesized
cccaaggtaacatactaaaaca

SEQ ID NO: 13721 - DNA, 22 bp, Artificial Sequence
  chemically synthesized
aaacattcaggattcagactct

SEQ ID NO: 13722 - DNA, 22 bp, Artificial Sequence
  chemically synthesized
aggattcagactctggcagtca

SEQ ID NO: 13723 - DNA, 22 bp, Artificial Sequence
  chemically synthesized
agactctggcagtcagactaaa

SEQ ID NO: 13724 - DNA, 22 bp, Artificial Sequence
  chemically synthesized
tggcagtcagactaaagagcca

SEQ ID NO: 13725 - DNA, 22 bp, Artificial Sequence
  chemically synthesized
gcagtcagactaaagagccagt

SEQ ID NO: 13726 - DNA, 22 bp, Artificial Sequence
  chemically synthesized
aagagccagttctcttagacat

SEQ ID NO: 13727 - DNA, 22 bp, Artificial Sequence
  chemically synthesized
tcttagacattattctgtggtc

SEQ ID NO: 13728 - DNA, 22 bp, Artificial Sequence
  chemically synthesized
ttagacattattctgtggtcca

SEQ ID NO: 13729 - DNA, 22 bp, Artificial Sequence
  chemically synthesized
agacattattctgtggtccata

SEQ ID NO: 13730 - DNA, 22 bp, Artificial Sequence
  chemically synthesized
gacattattctgtggtccataa

SEQ ID NO: 13731 - DNA, 22 bp, Artificial Sequence
  chemically synthesized
ttctgtggtccataatcacatc

SEQ ID NO: 13732 - DNA, 22 bp, Artificial Sequence
  chemically synthesized
tgtggtccataatcacatcaaa

SEQ ID NO: 13733 - DNA, 22 bp, Artificial Sequence
  chemically synthesized
tggtccataatcacatcaaaca

SEQ ID NO: 13734 - DNA, 22 bp, Artificial Sequence
  chemically synthesized
tagccatttccccttccatacc

SEQ ID NO: 13735 - DNA, 22 bp, Artificial Sequence
  chemically synthesized
gccatttccccttccataccca

SEQ ID NO: 13736 - DNA, 22 bp, Artificial Sequence
  chemically synthesized
ccccttccatacccagatggtt

SEQ ID NO: 13737 - DNA, 22 bp, Artificial Sequence
  chemically synthesized
cccttccatacccagatggtta

SEQ ID NO: 13738 - DNA, 22 bp, Artificial Sequence
  chemically synthesized
ccatacccagatggttaagtca

SEQ ID NO: 13739 - DNA, 22 bp, Artificial Sequence
  chemically synthesized
catacccagatggttaagtcat

SEQ ID NO: 13740 - DNA, 22 bp, Artificial Sequence
  chemically synthesized
agtcataccacttctacttcct

SEQ ID NO: 13741 - DNA, 22 bp, Artificial Sequence
  chemically synthesized
ctacttccttaatatcatttga

SEQ ID NO: 13742 - DNA, 22 bp, Artificial Sequence
  chemically synthesized
tacttccttaatatcatttgaa

SEQ ID NO: 13743 - DNA, 22 bp, Artificial Sequence
  chemically synthesized
cttccttaatatcatttgaact

SEQ ID NO: 13744 - DNA, 22 bp, Artificial Sequence
  chemically synthesized
ccttaatatcatttgaactccc

SEQ ID NO: 13745 - DNA, 22 bp, Artificial Sequence
  chemically synthesized
cttaatatcatttgaactcccc

SEQ ID NO: 13746 - DNA, 22 bp, Artificial Sequence
  chemically synthesized
aatatcatttgaactcccctct

SEQ ID NO: 13747 - DNA, 22 bp, Artificial Sequence
  chemically synthesized
atatcatttgaactcccctctt

SEQ ID NO: 13748 - DNA, 22 bp, Artificial Sequence
  chemically synthesized
gaactcccctctttttttgtac

SEQ ID NO: 13749 - DNA, 22 bp, Artificial Sequence
  chemically synthesized
aactcccctctttttttgtact

SEQ ID NO: 13750 - DNA, 22 bp, Artificial Sequence
  chemically synthesized
ccctctttttttgtactgctac

SEQ ID NO: 13751 - DNA, 22 bp, Artificial Sequence
  chemically synthesized
tttttttgtactgctactgttc

SEQ ID NO: 13752 - DNA, 22 bp, Artificial Sequence
  chemically synthesized
tttttgtactgctactgttcag

SEQ ID NO: 13753 - DNA, 22 bp, Artificial Sequence
  chemically synthesized
ttttgtactgctactgttcagg

SEQ ID NO: 13754 - DNA, 22 bp, Artificial Sequence
  chemically synthesized
tttgtactgctactgttcaggt

SEQ ID NO: 13755 - DNA, 22 bp, Artificial Sequence
  chemically synthesized
ttgtactgctactgttcaggtt

SEQ ID NO: 13756 - DNA, 22 bp, Artificial Sequence
  chemically synthesized
tgtactgctactgttcaggttc

SEQ ID NO: 13757 - DNA, 22 bp, Artificial Sequence
  chemically synthesized
gtactgctactgttcaggttct

SEQ ID NO: 13758 - DNA, 22 bp, Artificial Sequence
  chemically synthesized
tactgctactgttcaggttcta

SEQ ID NO: 13759 - DNA, 22 bp, Artificial Sequence
  chemically synthesized
ctactgttcaggttctagcctt

SEQ ID NO: 13760 - DNA, 22 bp, Artificial Sequence
  chemically synthesized
ctgttcaggttctagcctttat

SEQ ID NO: 13761 - DNA, 22 bp, Artificial Sequence
  chemically synthesized
ttcaggttctagcctttatgtc

SEQ ID NO: 13762 - DNA, 22 bp, Artificial Sequence
  chemically synthesized
aggttctagcctttatgtctcc

SEQ ID NO: 13763 - DNA, 22 bp, Artificial Sequence
  chemically synthesized
tagcctttatgtctcccgcaga

SEQ ID NO: 13764 - DNA, 22 bp, Artificial Sequence
  chemically synthesized
gcctttatgtctcccgcagata

SEQ ID NO: 13765 - DNA, 22 bp, Artificial Sequence
  chemically synthesized
tatgtctcccgcagataattgc

SEQ ID NO: 13766 - DNA, 22 bp, Artificial Sequence
  chemically synthesized
atgtctcccgcagataattgca

SEQ ID NO: 13767 - DNA, 22 bp, Artificial Sequence
  chemically synthesized
tgtctcccgcagataattgcaa

SEQ ID NO: 13768 - DNA, 22 bp, Artificial Sequence
  chemically synthesized
ccgcagataattgcaatagtct

SEQ ID NO: 13769 - DNA, 22 bp, Artificial Sequence
  chemically synthesized
caatagtctcaggactgctctc

SEQ ID NO: 13770 - DNA, 22 bp, Artificial Sequence
  chemically synthesized
aggactgctctctcctagtctt

SEQ ID NO: 13771 - DNA, 22 bp, Artificial Sequence
  chemically synthesized
ctctctcctagtcttggtacgg

SEQ ID NO: 13772 - DNA, 22 bp, Artificial Sequence
  chemically synthesized
tctcctagtcttggtacggccc

SEQ ID NO: 13773 - DNA, 22 bp, Artificial Sequence
  chemically synthesized
tcctagtcttggtacggccccc

SEQ ID NO: 13774 - DNA, 22 bp, Artificial Sequence
  chemically synthesized
ctagtcttggtacggccccctc

SEQ ID NO: 13775 - DNA, 22 bp, Artificial Sequence
  chemically synthesized
gtcttggtacggccccctcccc

SEQ ID NO: 13776 - DNA, 22 bp, Artificial Sequence
  chemically synthesized
ggtacggccccctcccccacta

SEQ ID NO: 13777 - DNA, 22 bp, Artificial Sequence
  chemically synthesized
gtacggccccctcccccactat

SEQ ID NO: 13778 - DNA, 22 bp, Artificial Sequence
  chemically synthesized
ccccactatcatttcattagcg

SEQ ID NO: 13779 - DNA, 22 bp, Artificial Sequence
  chemically synthesized
tcatttcattagcgtgttgcca

SEQ ID NO: 13780 - DNA, 22 bp, Artificial Sequence
  chemically synthesized
cattagcgtgttgccagactgg

SEQ ID NO: 13781 - DNA, 22 bp, Artificial Sequence
  chemically synthesized
attagcgtgttgccagactggg

SEQ ID NO: 13782 - DNA, 22 bp, Artificial Sequence
  chemically synthesized
gcgtgttgccagactgggcatc

SEQ ID NO: 13783 - DNA, 22 bp, Artificial Sequence
  chemically synthesized
ccagactgggcatcctaaatca

SEQ ID NO: 13784 - DNA, 22 bp, Artificial Sequence
  chemically synthesized
ggcatcctaaatcagccatcag

SEQ ID NO: 13785 - DNA, 22 bp, Artificial Sequence
  chemically synthesized
aatcagccatcagtggtactcc

SEQ ID NO: 13786 - DNA, 22 bp, Artificial Sequence
  chemically synthesized
cttatgtttatacttcgatacc

SEQ ID NO: 13787 - DNA, 22 bp, Artificial Sequence
  chemically synthesized
atgtttatacttcgatacctcc

SEQ ID NO: 13788 - DNA, 22 bp, Artificial Sequence
  chemically synthesized
tgtttatacttcgatacctcca

SEQ ID NO: 13789 - DNA, 22 bp, Artificial Sequence
  chemically synthesized
atacttcgatacctccatattg

SEQ ID NO: 13790 - DNA, 22 bp, Artificial Sequence
  chemically synthesized
tacttcgatacctccatattgc

SEQ ID NO: 13791 - DNA, 22 bp, Artificial Sequence
  chemically synthesized
cgatacctccatattgcatttt

SEQ ID NO: 13792 - DNA, 22 bp, Artificial Sequence
  chemically synthesized
gatacctccatattgcatttta

SEQ ID NO: 13793 - DNA, 22 bp, Artificial Sequence
  chemically synthesized
catattgcattttattgtccaa

SEQ ID NO: 13794 - DNA, 22 bp, Artificial Sequence
  chemically synthesized
cattttattgtccaatctcctt

SEQ ID NO: 13795 - DNA, 22 bp, Artificial Sequence
  chemically synthesized
tattgtccaatctccttaggtt

SEQ ID NO: 13796 - DNA, 22 bp, Artificial Sequence
  chemically synthesized
attgtccaatctccttaggtta

SEQ ID NO: 13797 - DNA, 22 bp, Artificial Sequence
  chemically synthesized
ttgtccaatctccttaggttaa

SEQ ID NO: 13798 - DNA, 22 bp, Artificial Sequence
  chemically synthesized
tccaatctccttaggttaatga

SEQ ID NO: 13799 - DNA, 22 bp, Artificial Sequence
  chemically synthesized
cttaggttaatgacttcattat

SEQ ID NO: 13800 - DNA, 22 bp, Artificial Sequence
  chemically synthesized
aggttaatgacttcattatctg

SEQ ID NO: 13801 - DNA, 22 bp, Artificial Sequence
  chemically synthesized
ggttaatgacttcattatctga

SEQ ID NO: 13802 - DNA, 22 bp, Artificial Sequence
  chemically synthesized
atgacttcattatctgatgacc

SEQ ID NO: 13803 - DNA, 22 bp, Artificial Sequence
  chemically synthesized
cattatctgatgaccagctctg

SEQ ID NO: 13804 - DNA, 22 bp, Artificial Sequence
  chemically synthesized
attatctgatgaccagctctgc

SEQ ID NO: 13805 - DNA, 22 bp, Artificial Sequence
  chemically synthesized
tctgatgaccagctctgcctag

SEQ ID NO: 13806 - DNA, 22 bp, Artificial Sequence
  chemically synthesized
atgaccagctctgcctagttta

SEQ ID NO: 13807 - DNA, 22 bp, Artificial Sequence
  chemically synthesized
tgcctagtttacctgtctcact

SEQ ID NO: 13808 - DNA, 22 bp, Artificial Sequence
  chemically synthesized
cctagtttacctgtctcacttg

SEQ ID NO: 13809 - DNA, 22 bp, Artificial Sequence
  chemically synthesized
gtttacctgtctcacttgtcat

SEQ ID NO: 13810 - DNA, 22 bp, Artificial Sequence
  chemically synthesized
acctgtctcacttgtcatagtc

SEQ ID NO: 13811 - DNA, 22 bp, Artificial Sequence
  chemically synthesized
cctgtctcacttgtcatagtcc

SEQ ID NO: 13812 - DNA, 22 bp, Artificial Sequence
  chemically synthesized
tctcacttgtcatagtccatat

SEQ ID NO: 13813 - DNA, 22 bp, Artificial Sequence
  chemically synthesized
acttgtcatagtccatatggaa

SEQ ID NO: 13814 - DNA, 22 bp, Artificial Sequence
  chemically synthesized
gtcatagtccatatggaaccat

SEQ ID NO: 13815 - DNA, 22 bp, Artificial Sequence
  chemically synthesized
tcatagtccatatggaaccata

SEQ ID NO: 13816 - DNA, 22 bp, Artificial Sequence
  chemically synthesized
ctgaaatacctcacgttcttgc

SEQ ID NO: 13817 - DNA, 22 bp, Artificial Sequence
  chemically synthesized
aaatacctcacgttcttgcaaa

SEQ ID NO: 13818 - DNA, 22 bp, Artificial Sequence
  chemically synthesized
acgttcttgcaaatctgagtct

SEQ ID NO: 13819 - DNA, 22 bp, Artificial Sequence
  chemically synthesized
ttgcaaatctgagtctttgcac

SEQ ID NO: 13820 - DNA, 22 bp, Artificial Sequence
  chemically synthesized
gcaaatctgagtctttgcacga

SEQ ID NO: 13821 - DNA, 22 bp, Artificial Sequence
  chemically synthesized
caaatctgagtctttgcacgag

SEQ ID NO: 13822 - DNA, 22 bp, Artificial Sequence
  chemically synthesized
agtctttgcacgagtgatcctc

SEQ ID NO: 13823 - DNA, 22 bp, Artificial Sequence
  chemically synthesized
tgcacgagtgatcctctttgca

SEQ ID NO: 13824 - DNA, 22 bp, Artificial Sequence
  chemically synthesized
gcacgagtgatcctctttgcat

SEQ ID NO: 13825 - DNA, 22 bp, Artificial Sequence
  chemically synthesized
cacgagtgatcctctttgcata

SEQ ID NO: 13826 - DNA, 22 bp, Artificial Sequence
  chemically synthesized
tttgcataaaatgcccttatat

SEQ ID NO: 13827 - DNA, 22 bp, Artificial Sequence
  chemically synthesized
tgcataaaatgcccttatatca

SEQ ID NO: 13828 - DNA, 22 bp, Artificial Sequence
  chemically synthesized
gcataaaatgcccttatatcag

SEQ ID NO: 13829 - DNA, 22 bp, Artificial Sequence
  chemically synthesized
cataaaatgcccttatatcaga

SEQ ID NO: 13830 - DNA, 22 bp, Artificial Sequence
  chemically synthesized
atatcagacatttaaagagaga

SEQ ID NO: 13831 - DNA, 22 bp, Artificial Sequence
  chemically synthesized
tatcagacatttaaagagagag

SEQ ID NO: 13832 - DNA, 22 bp, Artificial Sequence
  chemically synthesized
aaagagagagaacgcctactca

SEQ ID NO: 13833 - DNA, 22 bp, Artificial Sequence
  chemically synthesized
aagagagagaacgcctactcat

SEQ ID NO: 13834 - DNA, 22 bp, Artificial Sequence
  chemically synthesized
ctcatcttttaagacccagatg

SEQ ID NO: 13835 - DNA, 22 bp, Artificial Sequence
  chemically synthesized
atcttttaagacccagatgaaa

SEQ ID NO: 13836 - DNA, 22 bp, Artificial Sequence
  chemically synthesized
ttaagacccagatgaaaatatt

SEQ ID NO: 13837 - DNA, 22 bp, Artificial Sequence
  chemically synthesized
taagacccagatgaaaatattc

SEQ ID NO: 13838 - DNA, 22 bp, Artificial Sequence
  chemically synthesized
aagacccagatgaaaatattct

SEQ ID NO: 13839 - DNA, 22 bp, Artificial Sequence
  chemically synthesized
agacccagatgaaaatattctc

SEQ ID NO: 13840 - DNA, 22 bp, Artificial Sequence
  chemically synthesized
tctctctatcaattgtttcccc

SEQ ID NO: 13841 - DNA, 22 bp, Artificial Sequence
  chemically synthesized
tctctatcaattgtttccccat

SEQ ID NO: 13842 - DNA, 22 bp, Artificial Sequence
  chemically synthesized
tctatcaattgtttccccattt

SEQ ID NO: 13843 - DNA, 22 bp, Artificial Sequence
  chemically synthesized
tatcaattgtttccccatttaa

SEQ ID NO: 13844 - DNA, 22 bp, Artificial Sequence
  chemically synthesized
tcaattgtttccccatttaatg

SEQ ID NO: 13845 - DNA, 22 bp, Artificial Sequence
  chemically synthesized
tttccccatttaatgtgttcct

SEQ ID NO: 13846 - DNA, 22 bp, Artificial Sequence
  chemically synthesized
ccccatttaatgtgttcctttc

SEQ ID NO: 13847 - DNA, 22 bp, Artificial Sequence
  chemically synthesized
cccatttaatgtgttcctttct

SEQ ID NO: 13848 - DNA, 22 bp, Artificial Sequence
  chemically synthesized
aatgtgttcctttctctatgat

SEQ ID NO: 13849 - DNA, 22 bp, Artificial Sequence
  chemically synthesized
atgtgttcctttctctatgatc

SEQ ID NO: 13850 - DNA, 22 bp, Artificial Sequence
  chemically synthesized
ctttctctatgatcccttagta

SEQ ID NO: 13851 - DNA, 22 bp, Artificial Sequence
  chemically synthesized
tctctatgatcccttagtacct

SEQ ID NO: 13852 - DNA, 22 bp, Artificial Sequence
  chemically synthesized
ctctatgatcccttagtaccta

SEQ ID NO: 13853 - DNA, 22 bp, Artificial Sequence
  chemically synthesized
tctatgatcccttagtacctag

SEQ ID NO: 13854 - DNA, 22 bp, Artificial Sequence
  chemically synthesized
tatgatcccttagtacctagtg

SEQ ID NO: 13855 - DNA, 22 bp, Artificial Sequence
  chemically synthesized
tgatcccttagtacctagtgca

SEQ ID NO: 13856 - DNA, 22 bp, Artificial Sequence
  chemically synthesized
agtacctagtgcacattttatc

SEQ ID NO: 13857 - DNA, 22 bp, Artificial Sequence
  chemically synthesized
gtacctagtgcacattttatca

SEQ ID NO: 13858 - DNA, 22 bp, Artificial Sequence
  chemically synthesized
gtgcacattttatcacattata

SEQ ID NO: 13859 - DNA, 22 bp, Artificial Sequence
  chemically synthesized
tatcacattatattgaaacctc

SEQ ID NO: 13860 - DNA, 22 bp, Artificial Sequence
  chemically synthesized
atcacattatattgaaacctct

SEQ ID NO: 13861 - DNA, 22 bp, Artificial Sequence
  chemically synthesized
tcacattatattgaaacctctc

SEQ ID NO: 13862 - DNA, 22 bp, Artificial Sequence
  chemically synthesized
tattgaaacctctcacctggcc

SEQ ID NO: 13863 - DNA, 22 bp, Artificial Sequence
  chemically synthesized
aaacctctcacctggcctcatg

SEQ ID NO: 13864 - DNA, 22 bp, Artificial Sequence
  chemically synthesized
tcacctggcctcatgctgcttt

SEQ ID NO: 13865 - DNA, 22 bp, Artificial Sequence
  chemically synthesized
acctggcctcatgctgctttag

SEQ ID NO: 13866 - DNA, 22 bp, Artificial Sequence
  chemically synthesized
gcctcatgctgctttagatcaa

SEQ ID NO: 13867 - DNA, 22 bp, Artificial Sequence
  chemically synthesized
atgctgctttagatcaaagagg

SEQ ID NO: 13868 - DNA, 22 bp, Artificial Sequence
  chemically synthesized
ctttagatcaaagagggagtct

SEQ ID NO: 13869 - DNA, 22 bp, Artificial Sequence
  chemically synthesized
tagatcaaagagggagtctggt

SEQ ID NO: 13870 - DNA, 22 bp, Artificial Sequence
  chemically synthesized
agatcaaagagggagtctggtt

SEQ ID NO: 13871 - DNA, 22 bp, Artificial Sequence
  chemically synthesized
gatcaaagagggagtctggttt

SEQ ID NO: 13872 - DNA, 22 bp, Artificial Sequence
  chemically synthesized
gtttatccccatacccctagta

SEQ ID NO: 13873 - DNA, 22 bp, Artificial Sequence
  chemically synthesized
atccccatacccctagtaccct

SEQ ID NO: 13874 - DNA, 22 bp, Artificial Sequence
  chemically synthesized
tccccatacccctagtaccctg

SEQ ID NO: 13875 - DNA, 22 bp, Artificial Sequence
  chemically synthesized
gtaccctgacacagtacctggc

SEQ ID NO: 13876 - DNA, 22 bp, Artificial Sequence
  chemically synthesized
acacagtacctggcaccatagt

SEQ ID NO: 13877 - DNA, 22 bp, Artificial Sequence
  chemically synthesized
gcaccatagttgtaactcagta

SEQ ID NO: 13878 - DNA, 22 bp, Artificial Sequence
  chemically synthesized
taactcagtaatgtctgaatga

SEQ ID NO: 13879 - DNA, 22 bp, Artificial Sequence
  chemically synthesized
agtaatgtctgaatgaaggaca

SEQ ID NO: 13880 - DNA, 22 bp, Artificial Sequence
  chemically synthesized
aatgaaggacatctttgatgca

SEQ ID NO: 13881 - DNA, 22 bp, Artificial Sequence
  chemically synthesized
tgatgcatacactttacaaaac

SEQ ID NO: 13882 - DNA, 22 bp, Artificial Sequence
  chemically synthesized
gatgcatacactttacaaaact

SEQ ID NO: 13883 - DNA, 22 bp, Artificial Sequence
  chemically synthesized
atgcatacactttacaaaacta

SEQ ID NO: 13884 - DNA, 22 bp, Artificial Sequence
  chemically synthesized
tacaaaactaaactggttttac

SEQ ID NO: 13885 - DNA, 22 bp, Artificial Sequence
  chemically synthesized
acaaaactaaactggttttaca

SEQ ID NO: 13886 - DNA, 22 bp, Artificial Sequence
  chemically synthesized
caaaactaaactggttttacag

SEQ ID NO: 13887 - DNA, 22 bp, Artificial Sequence
  chemically synthesized
aactggttttacagaactgttt

SEQ ID NO: 13888 - DNA, 22 bp, Artificial Sequence
  chemically synthesized
gttttacagaactgttttaatt

SEQ ID NO: 13889 - DNA, 22 bp, Artificial Sequence
  chemically synthesized
tacagaactgttttaatttcaa

SEQ ID NO: 13890 - DNA, 22 bp, Artificial Sequence
  chemically synthesized
acagaactgttttaatttcaaa

SEQ ID NO: 13891 - DNA, 22 bp, Artificial Sequence
  chemically synthesized
cagaactgttttaatttcaaaa

SEQ ID NO: 13892 - DNA, 22 bp, Artificial Sequence
  chemically synthesized
ttttaatttcaaaattccaaac

SEQ ID NO: 13893 - DNA, 22 bp, Artificial Sequence
  chemically synthesized
taatttcaaaattccaaactgt

SEQ ID NO: 13894 - DNA, 22 bp, Artificial Sequence
  chemically synthesized
aatttcaaaattccaaactgtt

SEQ ID NO: 13895 - DNA, 22 bp, Artificial Sequence
  chemically synthesized
atttcaaaattccaaactgttg

SEQ ID NO: 13896 - DNA, 22 bp, Artificial Sequence
  chemically synthesized
caaaattccaaactgttgcaat

SEQ ID NO: 13897 - DNA, 22 bp, Artificial Sequence
  chemically synthesized
aaaattccaaactgttgcaata

SEQ ID NO: 13898 - DNA, 22 bp, Artificial Sequence
  chemically synthesized
caaactgttgcaataataccta

SEQ ID NO: 13899 - DNA, 22 bp, Artificial Sequence
  chemically synthesized
ttgcaataatacctaaaggcag

SEQ ID NO: 13900 - DNA, 22 bp, Artificial Sequence
  chemically synthesized
caataatacctaaaggcagcag

SEQ ID NO: 13901 - DNA, 22 bp, Artificial Sequence
  chemically synthesized
aaggcagcagccatgaaaatgc

SEQ ID NO: 13902 - DNA, 22 bp, Artificial Sequence
  chemically synthesized
agcaaatcactcaccgaaactc

SEQ ID NO: 13903 - DNA, 22 bp, Artificial Sequence
  chemically synthesized
accgaaactccttttagaagcc

SEQ ID NO: 13904 - DNA, 22 bp, Artificial Sequence
  chemically synthesized
cttttagaagccaatgagagtt

SEQ ID NO: 13905 - DNA, 22 bp, Artificial Sequence
  chemically synthesized
ttagaagccaatgagagtttaa

SEQ ID NO: 13906 - DNA, 22 bp, Artificial Sequence
  chemically synthesized
tagaagccaatgagagtttaat

SEQ ID NO: 13907 - DNA, 22 bp, Artificial Sequence
  chemically synthesized
agaagccaatgagagtttaata

SEQ ID NO: 13908 - DNA, 22 bp, Artificial Sequence
  chemically synthesized
gaagccaatgagagtttaatag

SEQ ID NO: 13909 - DNA, 22 bp, Artificial Sequence
  chemically synthesized
aatagcagaagagagtgctgca

SEQ ID NO: 13910 - DNA, 22 bp, Artificial Sequence
  chemically synthesized
atagcagaagagagtgctgcat

SEQ ID NO: 13911 - DNA, 22 bp, Artificial Sequence
  chemically synthesized
cattaatactgtctatccttag

SEQ ID NO: 13912 - DNA, 22 bp, Artificial Sequence
  chemically synthesized
atactgtctatccttagaaaaa

SEQ ID NO: 13913 - DNA, 22 bp, Artificial Sequence
  chemically synthesized
tctatccttagaaaaattcccc

SEQ ID NO: 13914 - DNA, 22 bp, Artificial Sequence
  chemically synthesized
tccttagaaaaattcccctggc

SEQ ID NO: 13915 - DNA, 22 bp, Artificial Sequence
  chemically synthesized
agaaaaattcccctggcccctt

SEQ ID NO: 13916 - DNA, 22 bp, Artificial Sequence
  chemically synthesized
gaaaaattcccctggccccttc

SEQ ID NO: 13917 - DNA, 22 bp, Artificial Sequence
  chemically synthesized
ccctggccccttcctcaagggc

SEQ ID NO: 13918 - DNA, 22 bp, Artificial Sequence
  chemically synthesized
gccccttcctcaagggcttatt

SEQ ID NO: 13919 - DNA, 22 bp, Artificial Sequence
  chemically synthesized
cctcaagggcttattatctctg

SEQ ID NO: 13920 - DNA, 22 bp, Artificial Sequence
  chemically synthesized
ctcaagggcttattatctctgg

SEQ ID NO: 13921 - DNA, 22 bp, Artificial Sequence
  chemically synthesized
aagggcttattatctctggcta

SEQ ID NO: 13922 - DNA, 22 bp, Artificial Sequence
  chemically synthesized
attatctctggctacaatggct

SEQ ID NO: 13923 - DNA, 22 bp, Artificial Sequence
  chemically synthesized
ttatctctggctacaatggctg

SEQ ID NO: 13924 - DNA, 22 bp, Artificial Sequence
  chemically synthesized
tctctggctacaatggctgcag

SEQ ID NO: 13925 - DNA, 22 bp, Artificial Sequence
  chemically synthesized
tggctacaatggctgcagaatc

SEQ ID NO: 13926 - DNA, 22 bp, Artificial Sequence
  chemically synthesized
gctacaatggctgcagaatcac

SEQ ID NO: 13927 - DNA, 22 bp, Artificial Sequence
  chemically synthesized
caatggctgcagaatcacattg

SEQ ID NO: 13928 - DNA, 22 bp, Artificial Sequence
  chemically synthesized
cagaatcacattgcctttctcc

SEQ ID NO: 13929 - DNA, 22 bp, Artificial Sequence
  chemically synthesized
cctttctccttagtattatctg

SEQ ID NO: 13930 - DNA, 22 bp, Artificial Sequence
  chemically synthesized
tctccttagtattatctgggga

SEQ ID NO: 13931 - DNA, 22 bp, Artificial Sequence
  chemically synthesized
ctccttagtattatctggggat

SEQ ID NO: 13932 - DNA, 22 bp, Artificial Sequence
  chemically synthesized
tccttagtattatctggggatc

SEQ ID NO: 13933 - DNA, 22 bp, Artificial Sequence
  chemically synthesized
cttagtattatctggggatcgt

SEQ ID NO: 13934 - DNA, 22 bp, Artificial Sequence
  chemically synthesized
agtattatctggggatcgtata

SEQ ID NO: 13935 - DNA, 22 bp, Artificial Sequence
  chemically synthesized
gtattatctggggatcgtatac

SEQ ID NO: 13936 - DNA, 22 bp, Artificial Sequence
  chemically synthesized
tctggggatcgtatacttaact

SEQ ID NO: 13937 - DNA, 22 bp, Artificial Sequence
  chemically synthesized
gggatcgtatacttaacttccc

SEQ ID NO: 13938 - DNA, 22 bp, Artificial Sequence
  chemically synthesized
aacttcccttcaggtttatcgc

SEQ ID NO: 13939 - DNA, 22 bp, Artificial Sequence
  chemically synthesized
acttcccttcaggtttatcgct

SEQ ID NO: 13940 - DNA, 22 bp, Artificial Sequence
  chemically synthesized
cccttcaggtttatcgctagtc

SEQ ID NO: 13941 - DNA, 22 bp, Artificial Sequence
  chemically synthesized
ccttcaggtttatcgctagtca

SEQ ID NO: 13942 - DNA, 22 bp, Artificial Sequence
  chemically synthesized
caggtttatcgctagtcattat

SEQ ID NO: 13943 - DNA, 22 bp, Artificial Sequence
  chemically synthesized
aggtttatcgctagtcattatt

SEQ ID NO: 13944 - DNA, 22 bp, Artificial Sequence
  chemically synthesized
atcgctagtcattatttcccag

SEQ ID NO: 13945 - DNA, 22 bp, Artificial Sequence
  chemically synthesized
tcgctagtcattatttcccagg

SEQ ID NO: 13946 - DNA, 22 bp, Artificial Sequence
  chemically synthesized
gtcattatttcccaggctccaa

SEQ ID NO: 13947 - DNA, 22 bp, Artificial Sequence
  chemically synthesized
tttcccaggctccaaaagcctg

SEQ ID NO: 13948 - DNA, 22 bp, Artificial Sequence
  chemically synthesized
cccaggctccaaaagcctggtt

SEQ ID NO: 13949 - DNA, 22 bp, Artificial Sequence
  chemically synthesized
ccaggctccaaaagcctggttc

SEQ ID NO: 13950 - DNA, 22 bp, Artificial Sequence
  chemically synthesized
caaaagcctggttcatccttat

SEQ ID NO: 13951 - DNA, 22 bp, Artificial Sequence
  chemically synthesized
gttcatccttattcttatctat

SEQ ID NO: 13952 - DNA, 22 bp, Artificial Sequence
  chemically synthesized
atccttattcttatctatcctt

SEQ ID NO: 13953 - DNA, 22 bp, Artificial Sequence
  chemically synthesized
attcttatctatcctttcccca

SEQ ID NO: 13954 - DNA, 22 bp, Artificial Sequence
  chemically synthesized
ttcttatctatcctttccccag

SEQ ID NO: 13955 - DNA, 22 bp, Artificial Sequence
  chemically synthesized
ttatctatcctttccccagcat

SEQ ID NO: 13956 - DNA, 22 bp, Artificial Sequence
  chemically synthesized
atctatcctttccccagcatct

SEQ ID NO: 13957 - DNA, 22 bp, Artificial Sequence
  chemically synthesized
tctatcctttccccagcatctg

SEQ ID NO: 13958 - DNA, 22 bp, Artificial Sequence
  chemically synthesized
tcctttccccagcatctgaagt

SEQ ID NO: 13959 - DNA, 22 bp, Artificial Sequence
  chemically synthesized
tccccagcatctgaagtcttca

SEQ ID NO: 13960 - DNA, 22 bp, Artificial Sequence
  chemically synthesized
ccccagcatctgaagtcttcaa

SEQ ID NO: 13961 - DNA, 22 bp, Artificial Sequence
  chemically synthesized
cccagcatctgaagtcttcaag

SEQ ID NO: 13962 - DNA, 22 bp, Artificial Sequence
  chemically synthesized
aagtcttcaagggggcagaagc

SEQ ID NO: 13963 - DNA, 22 bp, Artificial Sequence
  chemically synthesized
caagggggcagaagccctctta

SEQ ID NO: 13964 - DNA, 22 bp, Artificial Sequence
  chemically synthesized
aagggggcagaagccctcttac

SEQ ID NO: 13965 - DNA, 22 bp, Artificial Sequence
  chemically synthesized
ttacaaccttcatcatctcacc

SEQ ID NO: 13966 - DNA, 22 bp, Artificial Sequence
  chemically synthesized
acaaccttcatcatctcaccac

SEQ ID NO: 13967 - DNA, 22 bp, Artificial Sequence
  chemically synthesized
caaccttcatcatctcaccact

SEQ ID NO: 13968 - DNA, 22 bp, Artificial Sequence
  chemically synthesized
catcatctcaccacttatatag

SEQ ID NO: 13969 - DNA, 22 bp, Artificial Sequence
  chemically synthesized
atcatctcaccacttatataga

SEQ ID NO: 13970 - DNA, 22 bp, Artificial Sequence
  chemically synthesized
accacttatatagaagaaaggg

SEQ ID NO: 13971 - DNA, 22 bp, Artificial Sequence
  chemically synthesized
atatagaagaaagggtttggat

SEQ ID NO: 13972 - DNA, 22 bp, Artificial Sequence
  chemically synthesized
tatagaagaaagggtttggatg

SEQ ID NO: 13973 - DNA, 22 bp, Artificial Sequence
  chemically synthesized
ggatgctttgtcctcccagatg

SEQ ID NO: 13974 - DNA, 22 bp, Artificial Sequence
  chemically synthesized
gatgctttgtcctcccagatgt

SEQ ID NO: 13975 - DNA, 22 bp, Artificial Sequence
  chemically synthesized
tgtcctcccagatgtcacacta

SEQ ID NO: 13976 - DNA, 22 bp, Artificial Sequence
  chemically synthesized
gtcctcccagatgtcacactaa

SEQ ID NO: 13977 - DNA, 22 bp, Artificial Sequence
  chemically synthesized
tcctcccagatgtcacactaat

SEQ ID NO: 13978 - DNA, 22 bp, Artificial Sequence
  chemically synthesized
ccagatgtcacactaatgagat

SEQ ID NO: 13979 - DNA, 22 bp, Artificial Sequence
  chemically synthesized
atgagatatatctaatggcctt

SEQ ID NO: 13980 - DNA, 22 bp, Artificial Sequence
  chemically synthesized
atggccttgctttatgtcctgc

SEQ ID NO: 13981 - DNA, 22 bp, Artificial Sequence
  chemically synthesized
gctttatgtcctgctttgtgag

SEQ ID NO: 13982 - DNA, 22 bp, Artificial Sequence
  chemically synthesized
ctttatgtcctgctttgtgagt

SEQ ID NO: 13983 - DNA, 22 bp, Artificial Sequence
  chemically synthesized
tatgtcctgctttgtgagtttt

SEQ ID NO: 13984 - DNA, 22 bp, Artificial Sequence
  chemically synthesized
atgtcctgctttgtgagttttc

SEQ ID NO: 13985 - DNA, 22 bp, Artificial Sequence
  chemically synthesized
tgtcctgctttgtgagttttcc

SEQ ID NO: 13986 - DNA, 22 bp, Artificial Sequence
  chemically synthesized
ctttgtgagttttccaacaaat

SEQ ID NO: 13987 - DNA, 22 bp, Artificial Sequence
  chemically synthesized
tgtgagttttccaacaaatttt

SEQ ID NO: 13988 - DNA, 22 bp, Artificial Sequence
  chemically synthesized
gtgagttttccaacaaattttc

SEQ ID NO: 13989 - DNA, 22 bp, Artificial Sequence
  chemically synthesized
tgagttttccaacaaattttct

SEQ ID NO: 13990 - DNA, 22 bp, Artificial Sequence
  chemically synthesized
tccaacaaattttctttatccc

SEQ ID NO: 13991 - DNA, 22 bp, Artificial Sequence
  chemically synthesized
ccaacaaattttctttatccct

SEQ ID NO: 13992 - DNA, 22 bp, Artificial Sequence
  chemically synthesized
caacaaattttctttatccctt

SEQ ID NO: 13993 - DNA, 22 bp, Artificial Sequence
  chemically synthesized
tctttatcccttgactttactc

SEQ ID NO: 13994 - DNA, 22 bp, Artificial Sequence
  chemically synthesized
ctttatcccttgactttactca

SEQ ID NO: 13995 - DNA, 22 bp, Artificial Sequence
  chemically synthesized
tttatcccttgactttactcac

SEQ ID NO: 13996 - DNA, 22 bp, Artificial Sequence
  chemically synthesized
tatcccttgactttactcactt

SEQ ID NO: 13997 - DNA, 22 bp, Artificial Sequence
  chemically synthesized
atcccttgactttactcacttt

SEQ ID NO: 13998 - DNA, 22 bp, Artificial Sequence
  chemically synthesized
tcccttgactttactcactttg

SEQ ID NO: 13999 - DNA, 22 bp, Artificial Sequence
  chemically synthesized
gactttactcactttgctagtt

SEQ ID NO: 14000 - DNA, 22 bp, Artificial Sequence
  chemically synthesized
actttactcactttgctagttt

SEQ ID NO: 14001 - DNA, 22 bp, Artificial Sequence
  chemically synthesized
tactcactttgctagtttaacc

SEQ ID NO: 14002 - DNA, 22 bp, Artificial Sequence
  chemically synthesized
actcactttgctagtttaacct

SEQ ID NO: 14003 - DNA, 22 bp, Artificial Sequence
  chemically synthesized
ctcactttgctagtttaacctc

SEQ ID NO: 14004 - DNA, 22 bp, Artificial Sequence
  chemically synthesized
actttgctagtttaacctctgt

SEQ ID NO: 14005 - DNA, 22 bp, Artificial Sequence
  chemically synthesized
tgctagtttaacctctgtattt

SEQ ID NO: 14006 - DNA, 22 bp, Artificial Sequence
  chemically synthesized
gctagtttaacctctgtatttt

SEQ ID NO: 14007 - DNA, 22 bp, Artificial Sequence
  chemically synthesized
ctagtttaacctctgtattttt

SEQ ID NO: 14008 - DNA, 22 bp, Artificial Sequence
  chemically synthesized
gtttaacctctgtatttttttt

SEQ ID NO: 14009 - DNA, 22 bp, Artificial Sequence
  chemically synthesized
aacctctgtatttttttttatc

SEQ ID NO: 14010 - DNA, 22 bp, Artificial Sequence
  chemically synthesized
acctctgtatttttttttatcg

SEQ ID NO: 14011 - DNA, 22 bp, Artificial Sequence
  chemically synthesized
tgtatttttttttatcgttatt

SEQ ID NO: 14012 - DNA, 22 bp, Artificial Sequence
  chemically synthesized
tatttttttttatcgttatttc

SEQ ID NO: 14013 - DNA, 22 bp, Artificial Sequence
  chemically synthesized
ttttttatcgttatttcagcat

SEQ ID NO: 14014 - DNA, 22 bp, Artificial Sequence
  chemically synthesized
tttttatcgttatttcagcatt

SEQ ID NO: 14015 - DNA, 22 bp, Artificial Sequence
  chemically synthesized
ttttatcgttatttcagcattt

SEQ ID NO: 14016 - DNA, 22 bp, Artificial Sequence
  chemically synthesized
tttatcgttatttcagcatttc

SEQ ID NO: 14017 - DNA, 22 bp, Artificial Sequence
  chemically synthesized
ttatcgttatttcagcatttca

SEQ ID NO: 14018 - DNA, 22 bp, Artificial Sequence
  chemically synthesized
tatcgttatttcagcatttcag

SEQ ID NO: 14019 - DNA, 22 bp, Artificial Sequence
  chemically synthesized
atcgttatttcagcatttcagt

SEQ ID NO: 14020 - DNA, 22 bp, Artificial Sequence
  chemically synthesized
tcgttatttcagcatttcagtc

SEQ ID NO: 14021 - DNA, 22 bp, Artificial Sequence
  chemically synthesized
tttcagcatttcagtctgattt

SEQ ID NO: 14022 - DNA, 22 bp, Artificial Sequence
  chemically synthesized
cagcatttcagtctgatttcac

SEQ ID NO: 14023 - DNA, 22 bp, Artificial Sequence
  chemically synthesized
agcatttcagtctgatttcaca

SEQ ID NO: 14024 - DNA, 22 bp, Artificial Sequence
  chemically synthesized
cagtctgatttcacagctgaca

SEQ ID NO: 14025 - DNA, 22 bp, Artificial Sequence
  chemically synthesized
agtctgatttcacagctgacat

SEQ ID NO: 14026 - DNA, 22 bp, Artificial Sequence
  chemically synthesized
atttcacagctgacatcatgtc

SEQ ID NO: 14027 - DNA, 22 bp, Artificial Sequence
  chemically synthesized
cacagctgacatcatgtctgga

SEQ ID NO: 14028 - DNA, 22 bp, Artificial Sequence
  chemically synthesized
acagctgacatcatgtctggag

SEQ ID NO: 14029 - DNA, 22 bp, Artificial Sequence
  chemically synthesized
acatcatgtctggagtgggaac

SEQ ID NO: 14030 - DNA, 22 bp, Artificial Sequence
  chemically synthesized
gagtgggaaccacagggccagt

SEQ ID NO: 14031 - DNA, 22 bp, Artificial Sequence
  chemically synthesized
tctgggggtgcttagggttggc

SEQ ID NO: 14032 - DNA, 22 bp, Artificial Sequence
  chemically synthesized
ctgggggtgcttagggttggca

SEQ ID NO: 14033 - DNA, 22 bp, Artificial Sequence
  chemically synthesized
tgggggtgcttagggttggcac

SEQ ID NO: 14034 - DNA, 22 bp, Artificial Sequence
  chemically synthesized
ggggtgcttagggttggcaccc

SEQ ID NO: 14035 - DNA, 22 bp, Artificial Sequence
  chemically synthesized
agggttggcacccctgatcctg

SEQ ID NO: 14036 - DNA, 22 bp, Artificial Sequence
  chemically synthesized
gggttggcacccctgatcctgg

SEQ ID NO: 14037 - DNA, 22 bp, Artificial Sequence
  chemically synthesized
gcacccctgatcctggtactgt

SEQ ID NO: 14038 - DNA, 22 bp, Artificial Sequence
  chemically synthesized
atcctggtactgtcagctacta

SEQ ID NO: 14039 - DNA, 22 bp, Artificial Sequence
  chemically synthesized
gtactgtcagctactagatttg

SEQ ID NO: 14040 - DNA, 22 bp, Artificial Sequence
  chemically synthesized
tcagctactagatttgattcta

SEQ ID NO: 14041 - DNA, 22 bp, Artificial Sequence
  chemically synthesized
ctagatttgattctagaaagtt

SEQ ID NO: 14042 - DNA, 22 bp, Artificial Sequence
  chemically synthesized
gatttgattctagaaagttgac

SEQ ID NO: 14043 - DNA, 22 bp, Artificial Sequence
  chemically synthesized
gattctagaaagttgacaagta

SEQ ID NO: 14044 - DNA, 22 bp, Artificial Sequence
  chemically synthesized
attctagaaagttgacaagtaa

SEQ ID NO: 14045 - DNA, 22 bp, Artificial Sequence
  chemically synthesized
tagaaagttgacaagtaagtgt

SEQ ID NO: 14046 - DNA, 22 bp, Artificial Sequence
  chemically synthesized
gaaagttgacaagtaagtgtga

SEQ ID NO: 14047 - DNA, 22 bp, Artificial Sequence
  chemically synthesized
acaagtaagtgtgataaatgct

SEQ ID NO: 14048 - DNA, 22 bp, Artificial Sequence
  chemically synthesized
cctgtgagaacatgctgtttgt

SEQ ID NO: 14049 - DNA, 22 bp, Artificial Sequence
  chemically synthesized
ctgtgagaacatgctgtttgtc

SEQ ID NO: 14050 - DNA, 22 bp, Artificial Sequence
  chemically synthesized
tgagaacatgctgtttgtccaa

SEQ ID NO: 14051 - DNA, 22 bp, Artificial Sequence
  chemically synthesized
tttgtccaaatgggataatttc

SEQ ID NO: 14052 - DNA, 22 bp, Artificial Sequence
  chemically synthesized
gtccaaatgggataatttcttc

SEQ ID NO: 14053 - DNA, 22 bp, Artificial Sequence
  chemically synthesized
tccaaatgggataatttcttcc

SEQ ID NO: 14054 - DNA, 22 bp, Artificial Sequence
  chemically synthesized
cttccctgtatgccttcctctg

SEQ ID NO: 14055 - DNA, 22 bp, Artificial Sequence
  chemically synthesized
ttccctgtatgccttcctctgg

SEQ ID NO: 14056 - DNA, 22 bp, Artificial Sequence
  chemically synthesized
ccctgtatgccttcctctggga

SEQ ID NO: 14057 - DNA, 22 bp, Artificial Sequence
  chemically synthesized
cctgtatgccttcctctgggaa

SEQ ID NO: 14058 - DNA, 22 bp, Artificial Sequence
  chemically synthesized
tatgccttcctctgggaaatac

SEQ ID NO: 14059 - DNA, 22 bp, Artificial Sequence
  chemically synthesized
cctctgggaaatacataaagtc

SEQ ID NO: 14060 - DNA, 22 bp, Artificial Sequence
  chemically synthesized
ctctgggaaatacataaagtca

SEQ ID NO: 14061 - DNA, 22 bp, Artificial Sequence
  chemically synthesized
tgggaaatacataaagtcactg

SEQ ID NO: 14062 - DNA, 22 bp, Artificial Sequence
  chemically synthesized
ggaaatacataaagtcactgta

SEQ ID NO: 14063 - DNA, 22 bp, Artificial Sequence
  chemically synthesized
tagttgtgaaaaaacaaagtga

SEQ ID NO: 14064 - DNA, 22 bp, Artificial Sequence
  chemically synthesized
tgaaaaaacaaagtgatatatg

SEQ ID NO: 14065 - DNA, 22 bp, Artificial Sequence
  chemically synthesized
cattagctaacttcctactctt

SEQ ID NO: 14066 - DNA, 22 bp, Artificial Sequence
  chemically synthesized
gctaacttcctactctttatgt

SEQ ID NO: 14067 - DNA, 22 bp, Artificial Sequence
  chemically synthesized
acttcctactctttatgtcaat

SEQ ID NO: 14068 - DNA, 22 bp, Artificial Sequence
  chemically synthesized
cctactctttatgtcaattctt

SEQ ID NO: 14069 - DNA, 22 bp, Artificial Sequence
  chemically synthesized
ctactctttatgtcaattctta

SEQ ID NO: 14070 - DNA, 22 bp, Artificial Sequence
  chemically synthesized
ctctttatgtcaattcttaagc

SEQ ID NO: 14071 - DNA, 22 bp, Artificial Sequence
  chemically synthesized
tttatgtcaattcttaagcttg

SEQ ID NO: 14072 - DNA, 22 bp, Artificial Sequence
  chemically synthesized
tatgtcaattcttaagcttgct

SEQ ID NO: 14073 - DNA, 22 bp, Artificial Sequence
  chemically synthesized
atgtcaattcttaagcttgctt

SEQ ID NO: 14074 - DNA, 22 bp, Artificial Sequence
  chemically synthesized
tgtcaattcttaagcttgcttt

SEQ ID NO: 14075 - DNA, 22 bp, Artificial Sequence
  chemically synthesized
ttaagcttgcttttctccccta

SEQ ID NO: 14076 - DNA, 22 bp, Artificial Sequence
  chemically synthesized
aagcttgcttttctcccctagg

SEQ ID NO: 14077 - DNA, 22 bp, Artificial Sequence
  chemically synthesized
agcttgcttttctcccctaggg

SEQ ID NO: 14078 - DNA, 22 bp, Artificial Sequence
  chemically synthesized
gcttttctcccctagggaactc

SEQ ID NO: 14079 - DNA, 22 bp, Artificial Sequence
  chemically synthesized
cttttctcccctagggaactca

SEQ ID NO: 14080 - DNA, 22 bp, Artificial Sequence
  chemically synthesized
ttctcccctagggaactcaact

SEQ ID NO: 14081 - DNA, 22 bp, Artificial Sequence
  chemically synthesized
tctcccctagggaactcaactg

SEQ ID NO: 14082 - DNA, 22 bp, Artificial Sequence
  chemically synthesized
ctcccctagggaactcaactga

SEQ ID NO: 14083 - DNA, 22 bp, Artificial Sequence
  chemically synthesized
tcccctagggaactcaactgag

SEQ ID NO: 14084 - DNA, 22 bp, Artificial Sequence
  chemically synthesized
ccctagggaactcaactgagta

SEQ ID NO: 14085 - DNA, 22 bp, Artificial Sequence
  chemically synthesized
gggaactcaactgagtattgtg

SEQ ID NO: 14086 - DNA, 22 bp, Artificial Sequence
  chemically synthesized
aactgagtattgtgtttcccca

SEQ ID NO: 14087 - DNA, 22 bp, Artificial Sequence
  chemically synthesized
agtattgtgtttccccaaatat

SEQ ID NO: 14088 - DNA, 22 bp, Artificial Sequence
  chemically synthesized
tgtttccccaaatatcaactcc

SEQ ID NO: 14089 - DNA, 22 bp, Artificial Sequence
  chemically synthesized
ccccaaatatcaactccaagat

SEQ ID NO: 14090 - DNA, 22 bp, Artificial Sequence
  chemically synthesized
cccaaatatcaactccaagatg

SEQ ID NO: 14091 - DNA, 22 bp, Artificial Sequence
  chemically synthesized
caagatgtttgacatagagaca

SEQ ID NO: 14092 - DNA, 22 bp, Artificial Sequence
  chemically synthesized
gacatagagacaaaatgatttt

SEQ ID NO: 14093 - DNA, 22 bp, Artificial Sequence
  chemically synthesized
acatagagacaaaatgattttt

SEQ ID NO: 14094 - DNA, 22 bp, Artificial Sequence
  chemically synthesized
tttcctaatccatgaaaagctt

SEQ ID NO: 14095 - DNA, 22 bp, Artificial Sequence
  chemically synthesized
ttcctaatccatgaaaagcttt

SEQ ID NO: 14096 - DNA, 22 bp, Artificial Sequence
  chemically synthesized
tcctaatccatgaaaagctttg

SEQ ID NO: 14097 - DNA, 22 bp, Artificial Sequence
  chemically synthesized
cctaatccatgaaaagctttgg

SEQ ID NO: 14098 - DNA, 22 bp, Artificial Sequence
  chemically synthesized
ctaatccatgaaaagctttggt

SEQ ID NO: 14099 - DNA, 22 bp, Artificial Sequence
  chemically synthesized
atccatgaaaagctttggtgat

SEQ ID NO: 14100 - DNA, 22 bp, Artificial Sequence
  chemically synthesized
tggtgataactaacagcttgct

SEQ ID NO: 14101 - DNA, 22 bp, Artificial Sequence
  chemically synthesized
ggtgataactaacagcttgcta

SEQ ID NO: 14102 - DNA, 22 bp, Artificial Sequence
  chemically synthesized
gtgataactaacagcttgctaa

SEQ ID NO: 14103 - DNA, 22 bp, Artificial Sequence
  chemically synthesized
acagcttgctaatgaaaggtta

SEQ ID NO: 14104 - DNA, 22 bp, Artificial Sequence
  chemically synthesized
gctaatgaaaggttaatcttta

SEQ ID NO: 14105 - DNA, 22 bp, Artificial Sequence
  chemically synthesized
ctaatgaaaggttaatctttat

SEQ ID NO: 14106 - DNA, 22 bp, Artificial Sequence
  chemically synthesized
atgaaaggttaatctttatgtt

SEQ ID NO: 14107 - DNA, 22 bp, Artificial Sequence
  chemically synthesized
atctttatgttttaactaaaac

SEQ ID NO: 14108 - DNA, 22 bp, Artificial Sequence
  chemically synthesized
tatgttttaactaaaactttaa

SEQ ID NO: 14109 - DNA, 22 bp, Artificial Sequence
  chemically synthesized
atgttttaactaaaactttaaa

SEQ ID NO: 14110 - DNA, 22 bp, Artificial Sequence
  chemically synthesized
tgttttaactaaaactttaaat

SEQ ID NO: 14111 - DNA, 22 bp, Artificial Sequence
  chemically synthesized
taactaaaactttaaattgaag

SEQ ID NO: 14112 - DNA, 22 bp, Artificial Sequence
  chemically synthesized
aactaaaactttaaattgaaga

SEQ ID NO: 14113 - DNA, 22 bp, Artificial Sequence
  chemically synthesized
actaaaactttaaattgaagat

SEQ ID NO: 14114 - DNA, 22 bp, Artificial Sequence
  chemically synthesized
aaactttaaattgaagatatat

SEQ ID NO: 14115 - DNA, 22 bp, Artificial Sequence
  chemically synthesized
taaattgaagatatataattta

SEQ ID NO: 14116 - DNA, 22 bp, Artificial Sequence
  chemically synthesized
aaattgaagatatataatttaa

SEQ ID NO: 14117 - DNA, 22 bp, Artificial Sequence
  chemically synthesized
aattgaagatatataatttaaa

SEQ ID NO: 14118 - DNA, 22 bp, Artificial Sequence
  chemically synthesized
aagatatataatttaaaaaatt

SEQ ID NO: 14119 - DNA, 22 bp, Artificial Sequence
  chemically synthesized
aaaaaattagagacacacctca

SEQ ID NO: 14120 - DNA, 22 bp, Artificial Sequence
  chemically synthesized
aaaaattagagacacacctcat

SEQ ID NO: 14121 - DNA, 22 bp, Artificial Sequence
  chemically synthesized
gagacacacctcattacatact

SEQ ID NO: 14122 - DNA, 22 bp, Artificial Sequence
  chemically synthesized
attacatacttctgaaaccttg

SEQ ID NO: 14123 - DNA, 22 bp, Artificial Sequence
  chemically synthesized
catacttctgaaaccttgaaat

SEQ ID NO: 14124 - DNA, 22 bp, Artificial Sequence
  chemically synthesized
ctgaaaccttgaaatgtcatat

SEQ ID NO: 14125 - DNA, 22 bp, Artificial Sequence
  chemically synthesized
tgaaaccttgaaatgtcatata

SEQ ID NO: 14126 - DNA, 22 bp, Artificial Sequence
  chemically synthesized
aaaccttgaaatgtcatatatc

SEQ ID NO: 14127 - DNA, 22 bp, Artificial Sequence
  chemically synthesized
gaaatgtcatatatcttaaaat

SEQ ID NO: 14128 - DNA, 22 bp, Artificial Sequence
  chemically synthesized
aaatgtcatatatcttaaaatc

SEQ ID NO: 14129 - DNA, 22 bp, Artificial Sequence
  chemically synthesized
aaaatcagactttttgtgtaaa

SEQ ID NO: 14130 - DNA, 22 bp, Artificial Sequence
  chemically synthesized
aaatcagactttttgtgtaaat

SEQ ID NO: 14131 - DNA, 22 bp, Artificial Sequence
  chemically synthesized
tttgtgtaaataaggccattgt

SEQ ID NO: 14132 - DNA, 22 bp, Artificial Sequence
  chemically synthesized
ttgtgtaaataaggccattgtt

SEQ ID NO: 14133 - DNA, 22 bp, Artificial Sequence
  chemically synthesized
tgtgtaaataaggccattgttt

SEQ ID NO: 14134 - DNA, 22 bp, Artificial Sequence
  chemically synthesized
gtgtaaataaggccattgtttg

SEQ ID NO: 14135 - DNA, 22 bp, Artificial Sequence
  chemically synthesized
tgtaaataaggccattgtttgt

SEQ ID NO: 14136 - DNA, 22 bp, Artificial Sequence
  chemically synthesized
tttgtgcttttgtttcccattt

SEQ ID NO: 14137 - DNA, 22 bp, Artificial Sequence
  chemically synthesized
gtgcttttgtttcccattttga

SEQ ID NO: 14138 - DNA, 22 bp, Artificial Sequence
  chemically synthesized
tgcttttgtttcccattttgat

SEQ ID NO: 14139 - DNA, 22 bp, Artificial Sequence
  chemically synthesized
ttgtttcccattttgatttcaa

SEQ ID NO: 14140 - DNA, 22 bp, Artificial Sequence
  chemically synthesized
tgtttcccattttgatttcaaa

SEQ ID NO: 14141 - DNA, 22 bp, Artificial Sequence
  chemically synthesized
gtttcccattttgatttcaaag

SEQ ID NO: 14142 - DNA, 22 bp, Artificial Sequence
  chemically synthesized
tttcccattttgatttcaaagt

SEQ ID NO: 14143 - DNA, 22 bp, Artificial Sequence
  chemically synthesized
cccattttgatttcaaagtggt

SEQ ID NO: 14144 - DNA, 22 bp, Artificial Sequence
  chemically synthesized
ccattttgatttcaaagtggta

SEQ ID NO: 14145 - DNA, 22 bp, Artificial Sequence
  chemically synthesized
tgatttcaaagtggtaagtcca

SEQ ID NO: 14146 - DNA, 22 bp, Artificial Sequence
  chemically synthesized
gatttcaaagtggtaagtccaa

SEQ ID NO: 14147 - DNA, 22 bp, Artificial Sequence
  chemically synthesized
atttcaaagtggtaagtccaaa

SEQ ID NO: 14148 - DNA, 22 bp, Artificial Sequence
  chemically synthesized
caaagtggtaagtccaaacaaa

SEQ ID NO: 14149 - DNA, 22 bp, Artificial Sequence
  chemically synthesized
aaagtggtaagtccaaacaaaa

SEQ ID NO: 14150 - DNA, 22 bp, Artificial Sequence
  chemically synthesized
ttttttttcactatattctgct

SEQ ID NO: 14151 - DNA, 22 bp, Artificial Sequence
  chemically synthesized
tttttcactatattctgctatt

SEQ ID NO: 14152 - DNA, 22 bp, Artificial Sequence
  chemically synthesized
ttttcactatattctgctattt

SEQ ID NO: 14153 - DNA, 22 bp, Artificial Sequence
  chemically synthesized
tttcactatattctgctatttc

SEQ ID NO: 14154 - DNA, 22 bp, Artificial Sequence
  chemically synthesized
ttcactatattctgctatttct

SEQ ID NO: 14155 - DNA, 22 bp, Artificial Sequence
  chemically synthesized
tcactatattctgctatttctt

SEQ ID NO: 14156 - DNA, 22 bp, Artificial Sequence
  chemically synthesized
cactatattctgctatttcttt

SEQ ID NO: 14157 - DNA, 22 bp, Artificial Sequence
  chemically synthesized
actatattctgctatttctttg

SEQ ID NO: 14158 - DNA, 22 bp, Artificial Sequence
  chemically synthesized
tattctgctatttctttgtttt

SEQ ID NO: 14159 - DNA, 22 bp, Artificial Sequence
  chemically synthesized
tgctatttctttgttttcccac

SEQ ID NO: 14160 - DNA, 22 bp, Artificial Sequence
  chemically synthesized
ctatttctttgttttcccactt

SEQ ID NO: 14161 - DNA, 22 bp, Artificial Sequence
  chemically synthesized
tttctttgttttcccactttta

SEQ ID NO: 14162 - DNA, 22 bp, Artificial Sequence
  chemically synthesized
ctttgttttcccacttttaatt

SEQ ID NO: 14163 - DNA, 22 bp, Artificial Sequence
  chemically synthesized
tttgttttcccacttttaattt

SEQ ID NO: 14164 - DNA, 22 bp, Artificial Sequence
  chemically synthesized
tgttttcccacttttaattttt

SEQ ID NO: 14165 - DNA, 22 bp, Artificial Sequence
  chemically synthesized
gttttcccacttttaatttttt

SEQ ID NO: 14166 - DNA, 22 bp, Artificial Sequence
  chemically synthesized
ttttcccacttttaattttttt

SEQ ID NO: 14167 - DNA, 22 bp, Artificial Sequence
  chemically synthesized
tcccacttttaatttttttaaa

SEQ ID NO: 14168 - DNA, 22 bp, Artificial Sequence
  chemically synthesized
cccacttttaatttttttaaac

SEQ ID NO: 14169 - DNA, 22 bp, Artificial Sequence
  chemically synthesized
ccacttttaatttttttaaacc

SEQ ID NO: 14170 - DNA, 22 bp, Artificial Sequence
  chemically synthesized
ttaatttttttaaaccaaggag

SEQ ID NO: 14171 - DNA, 22 bp, Artificial Sequence
  chemically synthesized
taatttttttaaaccaaggaga

SEQ ID NO: 14172 - DNA, 22 bp, Artificial Sequence
  chemically synthesized
aatttttttaaaccaaggagat

SEQ ID NO: 14173 - DNA, 22 bp, Artificial Sequence
  chemically synthesized
atttttttaaaccaaggagatg

SEQ ID NO: 14174 - DNA, 22 bp, Artificial Sequence
  chemically synthesized
ttttaaaccaaggagatgaatg

SEQ ID NO: 14175 - DNA, 22 bp, Artificial Sequence
  chemically synthesized
tttaaaccaaggagatgaatgt

SEQ ID NO: 14176 - DNA, 22 bp, Artificial Sequence
  chemically synthesized
ttaaaccaaggagatgaatgtt

SEQ ID NO: 14177 - DNA, 22 bp, Artificial Sequence
  chemically synthesized
taaaccaaggagatgaatgttt

SEQ ID NO: 14178 - DNA, 22 bp, Artificial Sequence
  chemically synthesized
aaaccaaggagatgaatgtttt

SEQ ID NO: 14179 - DNA, 22 bp, Artificial Sequence
  chemically synthesized
aaccaaggagatgaatgttttc

SEQ ID NO: 14180 - DNA, 22 bp, Artificial Sequence
  chemically synthesized
tctaacaggaattacatgacca

SEQ ID NO: 14181 - DNA, 22 bp, Artificial Sequence
  chemically synthesized
ctaacaggaattacatgaccaa

SEQ ID NO: 14182 - DNA, 22 bp, Artificial Sequence
  chemically synthesized
taacaggaattacatgaccaaa

SEQ ID NO: 14183 - DNA, 22 bp, Artificial Sequence
  chemically synthesized
acaggaattacatgaccaaatc

SEQ ID NO: 14184 - DNA, 22 bp, Artificial Sequence
  chemically synthesized
catgaccaaatcatgaactgaa

SEQ ID NO: 14185 - DNA, 22 bp, Artificial Sequence
  chemically synthesized
aacagtgtttattaaacataaa

SEQ ID NO: 14186 - DNA, 22 bp, Artificial Sequence
  chemically synthesized
attaaacataaatgcatcataa

SEQ ID NO: 14187 - DNA, 22 bp, Artificial Sequence
  chemically synthesized
ttaaacataaatgcatcataag

SEQ ID NO: 14188 - DNA, 22 bp, Artificial Sequence
  chemically synthesized
aacataaatgcatcataagcat

SEQ ID NO: 14189 - DNA, 22 bp, Artificial Sequence
  chemically synthesized
tcgatctatttagttttaaaaa

SEQ ID NO: 14190 - DNA, 22 bp, Artificial Sequence
  chemically synthesized
tttagttttaaaaatgaagaag

SEQ ID NO: 14191 - DNA, 22 bp, Artificial Sequence
  chemically synthesized
agttttaaaaatgaagaagaag

SEQ ID NO: 14192 - DNA, 22 bp, Artificial Sequence
  chemically synthesized
gttttaaaaatgaagaagaaga

SEQ ID NO: 14193 - DNA, 22 bp, Artificial Sequence
  chemically synthesized
taaaaatgaagaagaagaaaac

SEQ ID NO: 14194 - DNA, 22 bp, Artificial Sequence
  chemically synthesized
aaaaatgaagaagaagaaaacc

SEQ ID NO: 14195 - DNA, 22 bp, Artificial Sequence
  chemically synthesized
aaaatgaagaagaagaaaacct

SEQ ID NO: 14196 - DNA, 22 bp, Artificial Sequence
  chemically synthesized
gctaacaaagaaccagtactta

SEQ ID NO: 14197 - DNA, 22 bp, Artificial Sequence
  chemically synthesized
acaaagaaccagtacttaccaa

SEQ ID NO: 14198 - DNA, 22 bp, Artificial Sequence
  chemically synthesized
accaacctgcgtgctggctgtt

SEQ ID NO: 14199 - DNA, 22 bp, Artificial Sequence
  chemically synthesized
ccaacctgcgtgctggctgtta

SEQ ID NO: 14200 - DNA, 22 bp, Artificial Sequence
  chemically synthesized
cgtgctggctgttagactcttc

SEQ ID NO: 14201 - DNA, 22 bp, Artificial Sequence
  chemically synthesized
gctgttagactcttcaatattg

SEQ ID NO: 14202 - DNA, 22 bp, Artificial Sequence
  chemically synthesized
ttagactcttcaatattgctgt

SEQ ID NO: 14203 - DNA, 22 bp, Artificial Sequence
  chemically synthesized
gactcttcaatattgctgtcaa

SEQ ID NO: 14204 - DNA, 22 bp, Artificial Sequence
  chemically synthesized
ttcaatattgctgtcaaatcat

SEQ ID NO: 14205 - DNA, 22 bp, Artificial Sequence
  chemically synthesized
caatattgctgtcaaatcatgt

SEQ ID NO: 14206 - DNA, 22 bp, Artificial Sequence
  chemically synthesized
aatattgctgtcaaatcatgta

SEQ ID NO: 14207 - DNA, 22 bp, Artificial Sequence
  chemically synthesized
ctgtcaaatcatgtaatcaaaa

SEQ ID NO: 14208 - DNA, 22 bp, Artificial Sequence
  chemically synthesized
tcaaatcatgtaatcaaaattt

SEQ ID NO: 14209 - DNA, 22 bp, Artificial Sequence
  chemically synthesized
agtgaagaagacagcatcagat

SEQ ID NO: 14210 - DNA, 22 bp, Artificial Sequence
  chemically synthesized
gtgaagaagacagcatcagata

SEQ ID NO: 14211 - DNA, 22 bp, Artificial Sequence
  chemically synthesized
ctatatctaaaaggcaagcata

SEQ ID NO: 14212 - DNA, 22 bp, Artificial Sequence
  chemically synthesized
tatatctaaaaggcaagcatac

SEQ ID NO: 14213 - DNA, 22 bp, Artificial Sequence
  chemically synthesized
tatctaaaaggcaagcatactc

SEQ ID NO: 14214 - DNA, 22 bp, Artificial Sequence
  chemically synthesized
aaaggcaagcatactcaatgta

SEQ ID NO: 14215 - DNA, 22 bp, Artificial Sequence
  chemically synthesized
aatgtattttaaaaaaggaaac

SEQ ID NO: 14216 - DNA, 22 bp, Artificial Sequence
  chemically synthesized
taaaaaaggaaacaaacctgta

SEQ ID NO: 14217 - DNA, 22 bp, Artificial Sequence
  chemically synthesized
aaaaaaggaaacaaacctgtac

SEQ ID NO: 14218 - DNA, 22 bp, Artificial Sequence
  chemically synthesized
aaaaaggaaacaaacctgtaca

SEQ ID NO: 14219 - DNA, 22 bp, Artificial Sequence
  chemically synthesized
tacattcagcactgagtagata

SEQ ID NO: 14220 - DNA, 22 bp, Artificial Sequence
  chemically synthesized
agcactgagtagatatcctaaa

SEQ ID NO: 14221 - DNA, 22 bp, Artificial Sequence
  chemically synthesized
agtagatatcctaaaaggcaga

SEQ ID NO: 14222 - DNA, 22 bp, Artificial Sequence
  chemically synthesized
aaaggcagatggtgatgaggcc

SEQ ID NO: 14223 - DNA, 22 bp, Artificial Sequence
  chemically synthesized
gtgattctgccatgatcatgtt

SEQ ID NO: 14224 - DNA, 22 bp, Artificial Sequence
  chemically synthesized
tgccatgatcatgttcacgcgc

SEQ ID NO: 14225 - DNA, 22 bp, Artificial Sequence
  chemically synthesized
ccatgatcatgttcacgcgctg

SEQ ID NO: 14226 - DNA, 22 bp, Artificial Sequence
  chemically synthesized
acgcgctgcataacctttgcta

SEQ ID NO: 14227 - DNA, 22 bp, Artificial Sequence
  chemically synthesized
cataacctttgctagcagattg

SEQ ID NO: 14228 - DNA, 22 bp, Artificial Sequence
  chemically synthesized
tgctagcagattgtgaaagtgg

SEQ ID NO: 14229 - DNA, 22 bp, Artificial Sequence
  chemically synthesized
gctagcagattgtgaaagtggt

SEQ ID NO: 14230 - DNA, 20 bp, Artificial Sequence
  chemically synthesized
tgcgtccactgctcttctga

SEQ ID NO: 14231 - DNA, 20 bp, Artificial Sequence
  chemically synthesized
tcttctgacagcatcattta

SEQ ID NO: 14232 - DNA, 20 bp, Artificial Sequence
  chemically synthesized
cttctgacagcatcatttac

SEQ ID NO: 14233 - DNA, 20 bp, Artificial Sequence
  chemically synthesized
aggttcacactgttccacct

SEQ ID NO: 14234 - DNA, 20 bp, Artificial Sequence
  chemically synthesized
ttcatattatgctcaaaata

SEQ ID NO: 14235 - DNA, 20 bp, Artificial Sequence
  chemically synthesized
tgctcaaaatatggacctat

SEQ ID NO: 14236 - DNA, 20 bp, Artificial Sequence
  chemically synthesized
aatatggacctatcagaaaa

SEQ ID NO: 14237 - DNA, 20 bp, Artificial Sequence
  chemically synthesized
ccattcatctgctgttgttt

SEQ ID NO: 14238 - DNA, 20 bp, Artificial Sequence
  chemically synthesized
tttggcctttgtctgaatca

SEQ ID NO: 14239 - DNA, 20 bp, Artificial Sequence
  chemically synthesized
cctttgtctgaatcacagta

SEQ ID NO: 14240 - DNA, 20 bp, Artificial Sequence
  chemically synthesized
tagatgcctccaactgttaa

SEQ ID NO: 14241 - DNA, 20 bp, Artificial Sequence
  chemically synthesized
agatgcctccaactgttaaa

SEQ ID NO: 14242 - DNA, 20 bp, Artificial Sequence
  chemically synthesized
tccaactgttaaaaggaaaa

SEQ ID NO: 14243 - DNA, 20 bp, Artificial Sequence
  chemically synthesized
aaaaagtttctattatcatt

SEQ ID NO: 14244 - DNA, 20 bp, Artificial Sequence
  chemically synthesized
aaaagtttctattatcattc

SEQ ID NO: 14245 - DNA, 20 bp, Artificial Sequence
  chemically synthesized
gtttctattatcattcaggt

SEQ ID NO: 14246 - DNA, 20 bp, Artificial Sequence
  chemically synthesized
tcaggttagcaatttgttta

SEQ ID NO: 14247 - DNA, 20 bp, Artificial Sequence
  chemically synthesized
agcaatttgtttaaagtaat

SEQ ID NO: 14248 - DNA, 20 bp, Artificial Sequence
  chemically synthesized
gcaatttgtttaaagtaata

SEQ ID NO: 14249 - DNA, 20 bp, Artificial Sequence
  chemically synthesized
caatttgtttaaagtaataa

SEQ ID NO: 14250 - DNA, 20 bp, Artificial Sequence
  chemically synthesized
ttgtttaaagtaataaggga

SEQ ID NO: 14251 - DNA, 20 bp, Artificial Sequence
  chemically synthesized
aagtaataagggatggaaat

SEQ ID NO: 14252 - DNA, 20 bp, Artificial Sequence
  chemically synthesized
ataagggatggaaatgagtt

SEQ ID NO: 14253 - DNA, 20 bp, Artificial Sequence
  chemically synthesized
atgagttcagatttttaaat

SEQ ID NO: 14254 - DNA, 20 bp, Artificial Sequence
  chemically synthesized
cagatttttaaattagcatt

SEQ ID NO: 14255 - DNA, 20 bp, Artificial Sequence
  chemically synthesized
agatttttaaattagcattt

SEQ ID NO: 14256 - DNA, 20 bp, Artificial Sequence
  chemically synthesized
attagcatttaggatccact

SEQ ID NO: 14257 - DNA, 20 bp, Artificial Sequence
  chemically synthesized
atttaggatccactaagccc

SEQ ID NO: 14258 - DNA, 20 bp, Artificial Sequence
  chemically synthesized
tttaggatccactaagccca

SEQ ID NO: 14259 - DNA, 20 bp, Artificial Sequence
  chemically synthesized
tatttacctttcaaaaataa

SEQ ID NO: 14260 - DNA, 20 bp, Artificial Sequence
  chemically synthesized
atagtatttgacatattgtt

SEQ ID NO: 14261 - DNA, 20 bp, Artificial Sequence
  chemically synthesized
tagtatttgacatattgtta

SEQ ID NO: 14262 - DNA, 20 bp, Artificial Sequence
  chemically synthesized
agtatttgacatattgttaa

SEQ ID NO: 14263 - DNA, 20 bp, Artificial Sequence
  chemically synthesized
tgttaagggacaccaacgaa

SEQ ID NO: 14264 - DNA, 20 bp, Artificial Sequence
  chemically synthesized
tcaattctgtgcatgtttta

SEQ ID NO: 14265 - DNA, 20 bp, Artificial Sequence
  chemically synthesized
gcatgttttaaagtcccttc

SEQ ID NO: 14266 - DNA, 20 bp, Artificial Sequence
  chemically synthesized
catgttttaaagtcccttct

SEQ ID NO: 14267 - DNA, 20 bp, Artificial Sequence
  chemically synthesized
ccttctaggtgcatgtgaaa

SEQ ID NO: 14268 - DNA, 20 bp, Artificial Sequence
  chemically synthesized
tctaggtgcatgtgaaatag

SEQ ID NO: 14269 - DNA, 20 bp, Artificial Sequence
  chemically synthesized
aggtgcatgtgaaatagcag

SEQ ID NO: 14270 - DNA, 20 bp, Artificial Sequence
  chemically synthesized
ggtgcatgtgaaatagcagc

SEQ ID NO: 14271 - DNA, 20 bp, Artificial Sequence
  chemically synthesized
agcagcaggctgatgccgca

SEQ ID NO: 14272 - DNA, 20 bp, Artificial Sequence
  chemically synthesized
cagcaggctgatgccgcaaa

SEQ ID NO: 14273 - DNA, 20 bp, Artificial Sequence
  chemically synthesized
agcaggctgatgccgcaaag

SEQ ID NO: 14274 - DNA, 20 bp, Artificial Sequence
  chemically synthesized
aagaggtcaaatacctcaaa

SEQ ID NO: 14275 - DNA, 20 bp, Artificial Sequence
  chemically synthesized
ggtcaaatacctcaaaaaga

SEQ ID NO: 14276 - DNA, 20 bp, Artificial Sequence
  chemically synthesized
tcaaatacctcaaaaagaaa

SEQ ID NO: 14277 - DNA, 20 bp, Artificial Sequence
  chemically synthesized
tcaaaaagaaagagtctgaa

SEQ ID NO: 14278 - DNA, 20 bp, Artificial Sequence
  chemically synthesized
aaagagtctgaaaagacaat

SEQ ID NO: 14279 - DNA, 20 bp, Artificial Sequence
  chemically synthesized
agagtctgaaaagacaattg

SEQ ID NO: 14280 - DNA, 20 bp, Artificial Sequence
  chemically synthesized
ttggagtaactacttgccta

SEQ ID NO: 14281 - DNA, 20 bp, Artificial Sequence
  chemically synthesized
taactacttgcctaaagctc

SEQ ID NO: 14282 - DNA, 20 bp, Artificial Sequence
  chemically synthesized
ctaaagctccagtcactttg

SEQ ID NO: 14283 - DNA, 20 bp, Artificial Sequence
  chemically synthesized
ccagtcactttgtagtgtca

SEQ ID NO: 14284 - DNA, 20 bp, Artificial Sequence
  chemically synthesized
tcactttgtagtgtcaaagt

SEQ ID NO: 14285 - DNA, 20 bp, Artificial Sequence
  chemically synthesized
cactttgtagtgtcaaagtt

SEQ ID NO: 14286 - DNA, 20 bp, Artificial Sequence
  chemically synthesized
attgtcatcatacatgccct

SEQ ID NO: 14287 - DNA, 20 bp, Artificial Sequence
  chemically synthesized
gtcatcatacatgccctcag

SEQ ID NO: 14288 - DNA, 20 bp, Artificial Sequence
  chemically synthesized
atcatacatgccctcagcag

SEQ ID NO: 14289 - DNA, 20 bp, Artificial Sequence
  chemically synthesized
ctctcttcctccttctccta

SEQ ID NO: 14290 - DNA, 20 bp, Artificial Sequence
  chemically synthesized
tcttcctccttctcctacag

SEQ ID NO: 14291 - DNA, 20 bp, Artificial Sequence
  chemically synthesized
ctccttctcctacagtggtc

SEQ ID NO: 14292 - DNA, 20 bp, Artificial Sequence
  chemically synthesized
cttctcctacagtggtccag

SEQ ID NO: 14293 - DNA, 20 bp, Artificial Sequence
  chemically synthesized
ttctcctacagtggtccaga

SEQ ID NO: 14294 - DNA, 20 bp, Artificial Sequence
  chemically synthesized
tctcctacagtggtccagaa

SEQ ID NO: 14295 - DNA, 20 bp, Artificial Sequence
  chemically synthesized
ctcctacagtggtccagaag

SEQ ID NO: 14296 - DNA, 20 bp, Artificial Sequence
  chemically synthesized
acagtggtccagaaggggct

SEQ ID NO: 14297 - DNA, 20 bp, Artificial Sequence
  chemically synthesized
cagtggtccagaaggggctc

SEQ ID NO: 14298 - DNA, 20 bp, Artificial Sequence
  chemically synthesized
gctcaggtatgttcaaataa

SEQ ID NO: 14299 - DNA, 20 bp, Artificial Sequence
  chemically synthesized
tgttcaaataacagctgctg

SEQ ID NO: 14300 - DNA, 20 bp, Artificial Sequence
  chemically synthesized
tgctgtggttttcaattatg

SEQ ID NO: 14301 - DNA, 20 bp, Artificial Sequence
  chemically synthesized
caattatgaagaaatctcct

SEQ ID NO: 14302 - DNA, 20 bp, Artificial Sequence
  chemically synthesized
aagaaatctcctaagctaca

SEQ ID NO: 14303 - DNA, 20 bp, Artificial Sequence
  chemically synthesized
acatagtcatttatctttta

SEQ ID NO: 14304 - DNA, 20 bp, Artificial Sequence
  chemically synthesized
catttatcttttaaagcacc

SEQ ID NO: 14305 - DNA, 20 bp, Artificial Sequence
  chemically synthesized
atcttttaaagcaccaagca

SEQ ID NO: 14306 - DNA, 20 bp, Artificial Sequence
  chemically synthesized
caagcaaagtaccttttgat

SEQ ID NO: 14307 - DNA, 20 bp, Artificial Sequence
  chemically synthesized
aagcaaagtaccttttgata

SEQ ID NO: 14308 - DNA, 20 bp, Artificial Sequence
  chemically synthesized
gcaaagtaccttttgataag

SEQ ID NO: 14309 - DNA, 20 bp, Artificial Sequence
  chemically synthesized
tgataaggagaacgtgctta

SEQ ID NO: 14310 - DNA, 20 bp, Artificial Sequence
  chemically synthesized
aacgtgcttatagatgttca

SEQ ID NO: 14311 - DNA, 20 bp, Artificial Sequence
  chemically synthesized
gtgcttatagatgttcatag

SEQ ID NO: 14312 - DNA, 20 bp, Artificial Sequence
  chemically synthesized
agatgttcatagaagatgct

SEQ ID NO: 14313 - DNA, 20 bp, Artificial Sequence
  chemically synthesized
atacgtatttcattctcaca

SEQ ID NO: 14314 - DNA, 20 bp, Artificial Sequence
  chemically synthesized
acatggtatttctctcttcc

SEQ ID NO: 14315 - DNA, 20 bp, Artificial Sequence
  chemically synthesized
ggtatttctctcttcctagt

SEQ ID NO: 14316 - DNA, 20 bp, Artificial Sequence
  chemically synthesized
gtatttctctcttcctagta

SEQ ID NO: 14317 - DNA, 20 bp, Artificial Sequence
  chemically synthesized
tatttctctcttcctagtaa

SEQ ID NO: 14318 - DNA, 20 bp, Artificial Sequence
  chemically synthesized
tttctctcttcctagtaagg

SEQ ID NO: 14319 - DNA, 20 bp, Artificial Sequence
  chemically synthesized
ttctctcttcctagtaaggg

SEQ ID NO: 14320 - DNA, 20 bp, Artificial Sequence
  chemically synthesized
ctctcttcctagtaagggag

SEQ ID NO: 14321 - DNA, 20 bp, Artificial Sequence
  chemically synthesized
atgcccaatttctgcctcca

SEQ ID NO: 14322 - DNA, 20 bp, Artificial Sequence
  chemically synthesized
ccaatttctgcctccaaaga

SEQ ID NO: 14323 - DNA, 20 bp, Artificial Sequence
  chemically synthesized
atttctgcctccaaagaaag

SEQ ID NO: 14324 - DNA, 20 bp, Artificial Sequence
  chemically synthesized
tctgcctccaaagaaagaag

SEQ ID NO: 14325 - DNA, 20 bp, Artificial Sequence
  chemically synthesized
aaagaagaagtaaaaactaa

SEQ ID NO: 14326 - DNA, 20 bp, Artificial Sequence
  chemically synthesized
aagaagaagtaaaaactaaa

SEQ ID NO: 14327 - DNA, 20 bp, Artificial Sequence
  chemically synthesized
aagaagtaaaaactaaaagg

SEQ ID NO: 14328 - DNA, 20 bp, Artificial Sequence
  chemically synthesized
aaaggcagaaatgaaatcca

SEQ ID NO: 14329 - DNA, 20 bp, Artificial Sequence
  chemically synthesized
aaggcagaaatgaaatccac

SEQ ID NO: 14330 - DNA, 20 bp, Artificial Sequence
  chemically synthesized
aaatgaaatccacaggcaaa

SEQ ID NO: 14331 - DNA, 20 bp, Artificial Sequence
  chemically synthesized
aatccacaggcaaacagcct

SEQ ID NO: 14332 - DNA, 20 bp, Artificial Sequence
  chemically synthesized
aacagcctgagaccacatcc

SEQ ID NO: 14333 - DNA, 20 bp, Artificial Sequence
  chemically synthesized
acagcctgagaccacatcct

SEQ ID NO: 14334 - DNA, 20 bp, Artificial Sequence
  chemically synthesized
ctgagaccacatcctgggcc

SEQ ID NO: 14335 - DNA, 20 bp, Artificial Sequence
  chemically synthesized
ccacatcctgggcctggtta

SEQ ID NO: 14336 - DNA, 20 bp, Artificial Sequence
  chemically synthesized
atcctgggcctggttaaaga

SEQ ID NO: 14337 - DNA, 20 bp, Artificial Sequence
  chemically synthesized
ttaaagatagacccctgacc

SEQ ID NO: 14338 - DNA, 20 bp, Artificial Sequence
  chemically synthesized
agatagacccctgacctggc

SEQ ID NO: 14339 - DNA, 20 bp, Artificial Sequence
  chemically synthesized
ctggccagttatgttatcta

SEQ ID NO: 14340 - DNA, 20 bp, Artificial Sequence
  chemically synthesized
gttatgttatctatagattc

SEQ ID NO: 14341 - DNA, 20 bp, Artificial Sequence
  chemically synthesized
tatagattccagacactgta

SEQ ID NO: 14342 - DNA, 20 bp, Artificial Sequence
  chemically synthesized
attccagacactgtatggaa

SEQ ID NO: 14343 - DNA, 20 bp, Artificial Sequence
  chemically synthesized
ccagacactgtatggaaaag

SEQ ID NO: 14344 - DNA, 20 bp, Artificial Sequence
  chemically synthesized
ttctgttccattctgatgac

SEQ ID NO: 14345 - DNA, 20 bp, Artificial Sequence
  chemically synthesized
attctgatgaccagtgcatg

SEQ ID NO: 14346 - DNA, 20 bp, Artificial Sequence
  chemically synthesized
tgaccagtgcatgcagcccc

SEQ ID NO: 14347 - DNA, 20 bp, Artificial Sequence
  chemically synthesized
cccccagtcatgtaccccct

SEQ ID NO: 14348 - DNA, 20 bp, Artificial Sequence
  chemically synthesized
cccagtcatgtaccccctta

SEQ ID NO: 14349 - DNA, 20 bp, Artificial Sequence
  chemically synthesized
atgtacccccttagagttgt

SEQ ID NO: 14350 - DNA, 20 bp, Artificial Sequence
  chemically synthesized
ttagagttgtaagcccttaa

SEQ ID NO: 14351 - DNA, 20 bp, Artificial Sequence
  chemically synthesized
tagagttgtaagcccttaaa

SEQ ID NO: 14352 - DNA, 20 bp, Artificial Sequence
  chemically synthesized
agagttgtaagcccttaaaa

SEQ ID NO: 14353 - DNA, 20 bp, Artificial Sequence
  chemically synthesized
ttgtaagcccttaaaaggga

SEQ ID NO: 14354 - DNA, 20 bp, Artificial Sequence
  chemically synthesized
tgtaagcccttaaaagggac

SEQ ID NO: 14355 - DNA, 20 bp, Artificial Sequence
  chemically synthesized
ggacaggaattgctcactct

SEQ ID NO: 14356 - DNA, 20 bp, Artificial Sequence
  chemically synthesized
acaggaattgctcactctga

SEQ ID NO: 14357 - DNA, 20 bp, Artificial Sequence
  chemically synthesized
aattgctcactctgagagct

SEQ ID NO: 14358 - DNA, 20 bp, Artificial Sequence
  chemically synthesized
cactctgagagcttggttgt

SEQ ID NO: 14359 - DNA, 20 bp, Artificial Sequence
  chemically synthesized
ctctgagagcttggttgttg

SEQ ID NO: 14360 - DNA, 20 bp, Artificial Sequence
  chemically synthesized
agcttggttgttggagatgt

SEQ ID NO: 14361 - DNA, 20 bp, Artificial Sequence
  chemically synthesized
tggagatgtgagtcttgccc

SEQ ID NO: 14362 - DNA, 20 bp, Artificial Sequence
  chemically synthesized
gtgagtcttgcccaagctcc

SEQ ID NO: 14363 - DNA, 20 bp, Artificial Sequence
  chemically synthesized
cccaagctcccagccgaata

SEQ ID NO: 14364 - DNA, 20 bp, Artificial Sequence
  chemically synthesized
aagcccttccttctttaact

SEQ ID NO: 14365 - DNA, 20 bp, Artificial Sequence
  chemically synthesized
ccttctttaactcggtgtct

SEQ ID NO: 14366 - DNA, 20 bp, Artificial Sequence
  chemically synthesized
cttctttaactcggtgtctg

SEQ ID NO: 14367 - DNA, 20 bp, Artificial Sequence
  chemically synthesized
ttctttaactcggtgtctga

SEQ ID NO: 14368 - DNA, 20 bp, Artificial Sequence
  chemically synthesized
tctttaactcggtgtctgag

SEQ ID NO: 14369 - DNA, 20 bp, Artificial Sequence
  chemically synthesized
tgtctgaggggttttgtatg

SEQ ID NO: 14370 - DNA, 20 bp, Artificial Sequence
  chemically synthesized
tgcagcttgtcctgctacac

SEQ ID NO: 14371 - DNA, 20 bp, Artificial Sequence
  chemically synthesized
gctacctctattaaaacaca

SEQ ID NO: 14372 - DNA, 20 bp, Artificial Sequence
  chemically synthesized
aaacacaaagccacaatata

SEQ ID NO: 14373 - DNA, 20 bp, Artificial Sequence
  chemically synthesized
ccacaatatatggatacatt

SEQ ID NO: 14374 - DNA, 20 bp, Artificial Sequence
  chemically synthesized
tttggaaaatatgcacactt

SEQ ID NO: 14375 - DNA, 20 bp, Artificial Sequence
  chemically synthesized
aaatatgcacactttggatc

SEQ ID NO: 14376 - DNA, 20 bp, Artificial Sequence
  chemically synthesized
atgcacactttggatccagc

SEQ ID NO: 14377 - DNA, 20 bp, Artificial Sequence
  chemically synthesized
ggatccagcaagtccacatc

SEQ ID NO: 14378 - DNA, 20 bp, Artificial Sequence
  chemically synthesized
ccacatctagaaaaccatcc

SEQ ID NO: 14379 - DNA, 20 bp, Artificial Sequence
  chemically synthesized
cacatctagaaaaccatcct

SEQ ID NO: 14380 - DNA, 20 bp, Artificial Sequence
  chemically synthesized
acatctagaaaaccatcctg

SEQ ID NO: 14381 - DNA, 20 bp, Artificial Sequence
  chemically synthesized
catctagaaaaccatcctgg

SEQ ID NO: 14382 - DNA, 20 bp, Artificial Sequence
  chemically synthesized
aaccatcctgggggaaaatt

SEQ ID NO: 14383 - DNA, 20 bp, Artificial Sequence
  chemically synthesized
accatcctgggggaaaatta

SEQ ID NO: 14384 - DNA, 20 bp, Artificial Sequence
  chemically synthesized
catcctgggggaaaattaag

SEQ ID NO: 14385 - DNA, 20 bp, Artificial Sequence
  chemically synthesized
tcctgggggaaaattaagga

SEQ ID NO: 14386 - DNA, 20 bp, Artificial Sequence
  chemically synthesized
aaaattaaggagagtatgaa

SEQ ID NO: 14387 - DNA, 20 bp, Artificial Sequence
  chemically synthesized
aaattaaggagagtatgaaa

SEQ ID NO: 14388 - DNA, 20 bp, Artificial Sequence
  chemically synthesized
tatgaaaaggatgtttacta

SEQ ID NO: 14389 - DNA, 20 bp, Artificial Sequence
  chemically synthesized
tgtttactaaagcattatga

SEQ ID NO: 14390 - DNA, 20 bp, Artificial Sequence
  chemically synthesized
gcattatgatggcaaaaaat

SEQ ID NO: 14391 - DNA, 20 bp, Artificial Sequence
  chemically synthesized
agaaacaacttacactgaac

SEQ ID NO: 14392 - DNA, 20 bp, Artificial Sequence
  chemically synthesized
gaactagtcaacttacttaa

SEQ ID NO: 14393 - DNA, 20 bp, Artificial Sequence
  chemically synthesized
tagtcaacttacttaacaga

SEQ ID NO: 14394 - DNA, 20 bp, Artificial Sequence
  chemically synthesized
tcaacttacttaacagacag

SEQ ID NO: 14395 - DNA, 20 bp, Artificial Sequence
  chemically synthesized
caacttacttaacagacaga

SEQ ID NO: 14396 - DNA, 20 bp, Artificial Sequence
  chemically synthesized
taacagacagaaggctcaat

SEQ ID NO: 14397 - DNA, 20 bp, Artificial Sequence
  chemically synthesized
caattagctcatgtgtcaaa

SEQ ID NO: 14398 - DNA, 20 bp, Artificial Sequence
  chemically synthesized
aattagctcatgtgtcaaat

SEQ ID NO: 14399 - DNA, 20 bp, Artificial Sequence
  chemically synthesized
attagctcatgtgtcaaatg

SEQ ID NO: 14400 - DNA, 20 bp, Artificial Sequence
  chemically synthesized
ttagctcatgtgtcaaatgg

SEQ ID NO: 14401 - DNA, 20 bp, Artificial Sequence
  chemically synthesized
aatgggggtaaaataatatt

SEQ ID NO: 14402 - DNA, 20 bp, Artificial Sequence
  chemically synthesized
gggtaaaataatatttagtt

SEQ ID NO: 14403 - DNA, 20 bp, Artificial Sequence
  chemically synthesized
gtaaaataatatttagtttg

SEQ ID NO: 14404 - DNA, 20 bp, Artificial Sequence
  chemically synthesized
taaaataatatttagtttgg

SEQ ID NO: 14405 - DNA, 20 bp, Artificial Sequence
  chemically synthesized
aaaataatatttagtttgga

SEQ ID NO: 14406 - DNA, 20 bp, Artificial Sequence
  chemically synthesized
taatatttagtttggaggga

SEQ ID NO: 14407 - DNA, 20 bp, Artificial Sequence
  chemically synthesized
atttagtttggagggaaaga

SEQ ID NO: 14408 - DNA, 20 bp, Artificial Sequence
  chemically synthesized
tttagtttggagggaaagac

SEQ ID NO: 14409 - DNA, 20 bp, Artificial Sequence
  chemically synthesized
gagggaaagacaggctctaa

SEQ ID NO: 14410 - DNA, 20 bp, Artificial Sequence
  chemically synthesized
gggaaagacaggctctaaaa

SEQ ID NO: 14411 - DNA, 20 bp, Artificial Sequence
  chemically synthesized
ggaaagacaggctctaaaag

SEQ ID NO: 14412 - DNA, 20 bp, Artificial Sequence
  chemically synthesized
tctaaaagaggattaaaaat

SEQ ID NO: 14413 - DNA, 20 bp, Artificial Sequence
  chemically synthesized
agaggattaaaaattagatg

SEQ ID NO: 14414 - DNA, 20 bp, Artificial Sequence
  chemically synthesized
attaaaaattagatgtggcc

SEQ ID NO: 14415 - DNA, 20 bp, Artificial Sequence
  chemically synthesized
ttaaaaattagatgtggcct

SEQ ID NO: 14416 - DNA, 20 bp, Artificial Sequence
  chemically synthesized
aattagatgtggcctaggca

SEQ ID NO: 14417 - DNA, 20 bp, Artificial Sequence
  chemically synthesized
taggcaaagaatttatgacc

SEQ ID NO: 14418 - DNA, 20 bp, Artificial Sequence
  chemically synthesized
aaacacaacaaaaacaaaaa

SEQ ID NO: 14419 - DNA, 20 bp, Artificial Sequence
  chemically synthesized
caaaaacaaaaacagacaaa

SEQ ID NO: 14420 - DNA, 20 bp, Artificial Sequence
  chemically synthesized
aaaaacaaaaacagacaaat

SEQ ID NO: 14421 - DNA, 20 bp, Artificial Sequence
  chemically synthesized
aaaatgcttctgcaccgcaa

SEQ ID NO: 14422 - DNA, 20 bp, Artificial Sequence
  chemically synthesized
accgcaaaagaccgaatcaa

SEQ ID NO: 14423 - DNA, 20 bp, Artificial Sequence
  chemically synthesized
cgcaaaagaccgaatcaaca

SEQ ID NO: 14424 - DNA, 20 bp, Artificial Sequence
  chemically synthesized
gaccgaatcaacagagtaaa

SEQ ID NO: 14425 - DNA, 20 bp, Artificial Sequence
  chemically synthesized
cagagtaaacggataaccta

SEQ ID NO: 14426 - DNA, 20 bp, Artificial Sequence
  chemically synthesized
aaacggataacctacagaat

SEQ ID NO: 14427 - DNA, 20 bp, Artificial Sequence
  chemically synthesized
gcaaactatgaatgcaacaa

SEQ ID NO: 14428 - DNA, 20 bp, Artificial Sequence
  chemically synthesized
caaactatgaatgcaacaaa

SEQ ID NO: 14429 - DNA, 20 bp, Artificial Sequence
  chemically synthesized
tgcaacaaaaggctaatata

SEQ ID NO: 14430 - DNA, 20 bp, Artificial Sequence
  chemically synthesized
ggctaatatacagaatctac

SEQ ID NO: 14431 - DNA, 20 bp, Artificial Sequence
  chemically synthesized
gctaatatacagaatctaca

SEQ ID NO: 14432 - DNA, 20 bp, Artificial Sequence
  chemically synthesized
aacaaaaaaaccaacctcat

SEQ ID NO: 14433 - DNA, 20 bp, Artificial Sequence
  chemically synthesized
aaaaaaccaacctcattaga

SEQ ID NO: 14434 - DNA, 20 bp, Artificial Sequence
  chemically synthesized
tcattagaaagtgactgtga

SEQ ID NO: 14435 - DNA, 20 bp, Artificial Sequence
  chemically synthesized
tgactgtgatggttaatact

SEQ ID NO: 14436 - DNA, 20 bp, Artificial Sequence
  chemically synthesized
atactgagtgtcaacttgat

SEQ ID NO: 14437 - DNA, 20 bp, Artificial Sequence
  chemically synthesized
gtgtcaacttgattggactg

SEQ ID NO: 14438 - DNA, 20 bp, Artificial Sequence
  chemically synthesized
tgtcaacttgattggactga

SEQ ID NO: 14439 - DNA, 20 bp, Artificial Sequence
  chemically synthesized
tgattggactgaaggatgca

SEQ ID NO: 14440 - DNA, 20 bp, Artificial Sequence
  chemically synthesized
aggatgcaaagtaatgatct

SEQ ID NO: 14441 - DNA, 20 bp, Artificial Sequence
  chemically synthesized
ggatgcaaagtaatgatctt

SEQ ID NO: 14442 - DNA, 20 bp, Artificial Sequence
  chemically synthesized
atgatcttgggtgtgtctgt

SEQ ID NO: 14443 - DNA, 20 bp, Artificial Sequence
  chemically synthesized
tgatcttgggtgtgtctgtg

SEQ ID NO: 14444 - DNA, 20 bp, Artificial Sequence
  chemically synthesized
gatcttgggtgtgtctgtga

SEQ ID NO: 14445 - DNA, 20 bp, Artificial Sequence
  chemically synthesized
tgtctgtgagggtgttacca

SEQ ID NO: 14446 - DNA, 20 bp, Artificial Sequence
  chemically synthesized
gtctgtgagggtgttaccaa

SEQ ID NO: 14447 - DNA, 20 bp, Artificial Sequence
  chemically synthesized
ctgtgagggtgttaccaaag

SEQ ID NO: 14448 - DNA, 20 bp, Artificial Sequence
  chemically synthesized
accaaaggagattaatattt

SEQ ID NO: 14449 - DNA, 20 bp, Artificial Sequence
  chemically synthesized
aaggagattaatatttcagt

SEQ ID NO: 14450 - DNA, 20 bp, Artificial Sequence
  chemically synthesized
gagattaatatttcagtcag

SEQ ID NO: 14451 - DNA, 20 bp, Artificial Sequence
  chemically synthesized
agattaatatttcagtcagt

SEQ ID NO: 14452 - DNA, 20 bp, Artificial Sequence
  chemically synthesized
taatatttcagtcagtgggc

SEQ ID NO: 14453 - DNA, 20 bp, Artificial Sequence
  chemically synthesized
aatatttcagtcagtgggct

SEQ ID NO: 14454 - DNA, 20 bp, Artificial Sequence
  chemically synthesized
atatttcagtcagtgggctg

SEQ ID NO: 14455 - DNA, 20 bp, Artificial Sequence
  chemically synthesized
tttcagtcagtgggctgggg

SEQ ID NO: 14456 - DNA, 20 bp, Artificial Sequence
  chemically synthesized
ttcagtcagtgggctgggga

SEQ ID NO: 14457 - DNA, 20 bp, Artificial Sequence
  chemically synthesized
agtcagtgggctggggaagg

SEQ ID NO: 14458 - DNA, 20 bp, Artificial Sequence
  chemically synthesized
aggcagacccacccttaatc

SEQ ID NO: 14459 - DNA, 20 bp, Artificial Sequence
  chemically synthesized
ggcagacccacccttaatct

SEQ ID NO: 14460 - DNA, 20 bp, Artificial Sequence
  chemically synthesized
agacccacccttaatctggg

SEQ ID NO: 14461 - DNA, 20 bp, Artificial Sequence
  chemically synthesized
gacccacccttaatctgggt

SEQ ID NO: 14462 - DNA, 20 bp, Artificial Sequence
  chemically synthesized
ctgggtgggcaccatctaat

SEQ ID NO: 14463 - DNA, 20 bp, Artificial Sequence
  chemically synthesized
ggcaccatctaatcagttgc

SEQ ID NO: 14464 - DNA, 20 bp, Artificial Sequence
  chemically synthesized
catctaatcagttgccagca

SEQ ID NO: 14465 - DNA, 20 bp, Artificial Sequence
  chemically synthesized
taatcagttgccagcacagc

SEQ ID NO: 14466 - DNA, 20 bp, Artificial Sequence
  chemically synthesized
aatcagttgccagcacagcc

SEQ ID NO: 14467 - DNA, 20 bp, Artificial Sequence
  chemically synthesized
gccagcacagccaggatata

SEQ ID NO: 14468 - DNA, 20 bp, Artificial Sequence
  chemically synthesized
agcacagccaggatataaag

SEQ ID NO: 14469 - DNA, 20 bp, Artificial Sequence
  chemically synthesized
gcacagccaggatataaagc

SEQ ID NO: 14470 - DNA, 20 bp, Artificial Sequence
  chemically synthesized
cagccaggatataaagcagg

SEQ ID NO: 14471 - DNA, 20 bp, Artificial Sequence
  chemically synthesized
agcaggcagaaaaatgtgaa

SEQ ID NO: 14472 - DNA, 20 bp, Artificial Sequence
  chemically synthesized
gcaggcagaaaaatgtgaaa

SEQ ID NO: 14473 - DNA, 20 bp, Artificial Sequence
  chemically synthesized
gcagaaaaatgtgaaaaggc

SEQ ID NO: 14474 - DNA, 20 bp, Artificial Sequence
  chemically synthesized
aaaatgtgaaaaggctagat

SEQ ID NO: 14475 - DNA, 20 bp, Artificial Sequence
  chemically synthesized
gtgaaaaggctagattggct

SEQ ID NO: 14476 - DNA, 20 bp, Artificial Sequence
  chemically synthesized
gctagattggcttggcatcc

SEQ ID NO: 14477 - DNA, 20 bp, Artificial Sequence
  chemically synthesized
cctacatttttctcccatgc

SEQ ID NO: 14478 - DNA, 20 bp, Artificial Sequence
  chemically synthesized
atgctggattcttcctgccc

SEQ ID NO: 14479 - DNA, 20 bp, Artificial Sequence
  chemically synthesized
tgccctggaacattgaactc

SEQ ID NO: 14480 - DNA, 20 bp, Artificial Sequence
  chemically synthesized
gccctggaacattgaactcc

SEQ ID NO: 14481 - DNA, 20 bp, Artificial Sequence
  chemically synthesized
acattgaactccaggttctt

SEQ ID NO: 14482 - DNA, 20 bp, Artificial Sequence
  chemically synthesized
aactccaggttcttcagctt

SEQ ID NO: 14483 - DNA, 20 bp, Artificial Sequence
  chemically synthesized
actccaggttcttcagcttt

SEQ ID NO: 14484 - DNA, 20 bp, Artificial Sequence
  chemically synthesized
ttcagctttgggactccgac

SEQ ID NO: 14485 - DNA, 20 bp, Artificial Sequence
  chemically synthesized
cgactagcttccttgttcct

SEQ ID NO: 14486 - DNA, 20 bp, Artificial Sequence
  chemically synthesized
tagcttccttgttcctcagc

SEQ ID NO: 14487 - DNA, 20 bp, Artificial Sequence
  chemically synthesized
cttccttgttcctcagctgg

SEQ ID NO: 14488 - DNA, 20 bp, Artificial Sequence
  chemically synthesized
cttgttcctcagctggcaga

SEQ ID NO: 14489 - DNA, 20 bp, Artificial Sequence
  chemically synthesized
agctggcagatggcctgttt

SEQ ID NO: 14490 - DNA, 20 bp, Artificial Sequence
  chemically synthesized
gctggcagatggcctgtttt

SEQ ID NO: 14491 - DNA, 20 bp, Artificial Sequence
  chemically synthesized
ttgggaccttgtgaacatgt

SEQ ID NO: 14492 - DNA, 20 bp, Artificial Sequence
  chemically synthesized
ctacataataaactctcata

SEQ ID NO: 14493 - DNA, 20 bp, Artificial Sequence
  chemically synthesized
aataaactctcatatagata

SEQ ID NO: 14494 - DNA, 20 bp, Artificial Sequence
  chemically synthesized
ctctcatatagatatagata

SEQ ID NO: 14495 - DNA, 20 bp, Artificial Sequence
  chemically synthesized
ctcatatagatatagatata

SEQ ID NO: 14496 - DNA, 20 bp, Artificial Sequence
  chemically synthesized
tatagatatagatatagaga

SEQ ID NO: 14497 - DNA, 20 bp, Artificial Sequence
  chemically synthesized
tatagatatagagatagata

SEQ ID NO: 14498 - DNA, 20 bp, Artificial Sequence
  chemically synthesized
tagatatagagatagatata

SEQ ID NO: 14499 - DNA, 20 bp, Artificial Sequence
  chemically synthesized
tatagagatagatatagaga

SEQ ID NO: 14500 - DNA, 20 bp, Artificial Sequence
  chemically synthesized
gatagatatagagatagata

SEQ ID NO: 14501 - DNA, 20 bp, Artificial Sequence
  chemically synthesized
tatagagatagatatagata

SEQ ID NO: 14502 - DNA, 20 bp, Artificial Sequence
  chemically synthesized
gatagatatagatatagata

SEQ ID NO: 14503 - DNA, 20 bp, Artificial Sequence
  chemically synthesized
tatagatatagatatagata

SEQ ID NO: 14504 - DNA, 20 bp, Artificial Sequence
  chemically synthesized
tatagatatagatatagata

SEQ ID NO: 14505 - DNA, 20 bp, Artificial Sequence
  chemically synthesized
tatagatatagatatagata

SEQ ID NO: 14506 - DNA, 20 bp, Artificial Sequence
  chemically synthesized
ctattaattctgtttctctg

SEQ ID NO: 14507 - DNA, 20 bp, Artificial Sequence
  chemically synthesized
ttctctgtagaaccctaata

SEQ ID NO: 14508 - DNA, 20 bp, Artificial Sequence
  chemically synthesized
tagaaccctaatacagattt

SEQ ID NO: 14509 - DNA, 20 bp, Artificial Sequence
  chemically synthesized
cctaatacagattttggtac

SEQ ID NO: 14510 - DNA, 20 bp, Artificial Sequence
  chemically synthesized
ctaatacagattttggtacc

SEQ ID NO: 14511 - DNA, 20 bp, Artificial Sequence
  chemically synthesized
aatacagattttggtaccag

SEQ ID NO: 14512 - DNA, 20 bp, Artificial Sequence
  chemically synthesized
acagattttggtaccaggag

SEQ ID NO: 14513 - DNA, 20 bp, Artificial Sequence
  chemically synthesized
tttggtaccaggagtggttc

SEQ ID NO: 14514 - DNA, 20 bp, Artificial Sequence
  chemically synthesized
tggtaccaggagtggttcta

SEQ ID NO: 14515 - DNA, 20 bp, Artificial Sequence
  chemically synthesized
ggtaccaggagtggttctag

SEQ ID NO: 14516 - DNA, 20 bp, Artificial Sequence
  chemically synthesized
caggagtggttctagaggaa

SEQ ID NO: 14517 - DNA, 20 bp, Artificial Sequence
  chemically synthesized
ttctagaggaacagaatatt

SEQ ID NO: 14518 - DNA, 20 bp, Artificial Sequence
  chemically synthesized
tctagaggaacagaatatta

SEQ ID NO: 14519 - DNA, 20 bp, Artificial Sequence
  chemically synthesized
gaggaacagaatattaagga

SEQ ID NO: 14520 - DNA, 20 bp, Artificial Sequence
  chemically synthesized
ggaacagaatattaaggatg

SEQ ID NO: 14521 - DNA, 20 bp, Artificial Sequence
  chemically synthesized
taaggatggagttctttcat

SEQ ID NO: 14522 - DNA, 20 bp, Artificial Sequence
  chemically synthesized
tggagttctttcattggttt

SEQ ID NO: 14523 - DNA, 20 bp, Artificial Sequence
  chemically synthesized
ggagttctttcattggtttt

SEQ ID NO: 14524 - DNA, 20 bp, Artificial Sequence
  chemically synthesized
gagttctttcattggttttg

SEQ ID NO: 14525 - DNA, 20 bp, Artificial Sequence
  chemically synthesized
ttcattggttttggggtttc

SEQ ID NO: 14526 - DNA, 20 bp, Artificial Sequence
  chemically synthesized
cattggttttggggtttctg

SEQ ID NO: 14527 - DNA, 20 bp, Artificial Sequence
  chemically synthesized
ggttttggggtttctggagt

SEQ ID NO: 14528 - DNA, 20 bp, Artificial Sequence
  chemically synthesized
agttggctgcttaatatgat

SEQ ID NO: 14529 - DNA, 20 bp, Artificial Sequence
  chemically synthesized
tgattagacccaaatatgct

SEQ ID NO: 14530 - DNA, 20 bp, Artificial Sequence
  chemically synthesized
gattagacccaaatatgcta

SEQ ID NO: 14531 - DNA, 20 bp, Artificial Sequence
  chemically synthesized
gctaaggactcttcttctaa

SEQ ID NO: 14532 - DNA, 20 bp, Artificial Sequence
  chemically synthesized
ggactcttcttctaatggta

SEQ ID NO: 14533 - DNA, 20 bp, Artificial Sequence
  chemically synthesized
actcttcttctaatggtatg

SEQ ID NO: 14534 - DNA, 20 bp, Artificial Sequence
  chemically synthesized
tggagaacactgataatcct

SEQ ID NO: 14535 - DNA, 20 bp, Artificial Sequence
  chemically synthesized
aatccttggcatcaattgtt

SEQ ID NO: 14536 - DNA, 20 bp, Artificial Sequence
  chemically synthesized
tccttggcatcaattgttta

SEQ ID NO: 14537 - DNA, 20 bp, Artificial Sequence
  chemically synthesized
cttggcatcaattgtttaga

SEQ ID NO: 14538 - DNA, 20 bp, Artificial Sequence
  chemically synthesized
actcttgattcaacgcttgt

SEQ ID NO: 14539 - DNA, 20 bp, Artificial Sequence
  chemically synthesized
tcttgattcaacgcttgtga

SEQ ID NO: 14540 - DNA, 20 bp, Artificial Sequence
  chemically synthesized
cttgattcaacgcttgtgag

SEQ ID NO: 14541 - DNA, 20 bp, Artificial Sequence
  chemically synthesized
attcaacgcttgtgagaggc

SEQ ID NO: 14542 - DNA, 20 bp, Artificial Sequence
  chemically synthesized
ttcaacgcttgtgagaggca

SEQ ID NO: 14543 - DNA, 20 bp, Artificial Sequence
  chemically synthesized
cttgtgagaggcaaggaatt

SEQ ID NO: 14544 - DNA, 20 bp, Artificial Sequence
  chemically synthesized
ataatacttttgactatatg

SEQ ID NO: 14545 - DNA, 20 bp, Artificial Sequence
  chemically synthesized
aatacttttgactatatgtg

SEQ ID NO: 14546 - DNA, 20 bp, Artificial Sequence
  chemically synthesized
ttgactatatgtggagaatc

SEQ ID NO: 14547 - DNA, 20 bp, Artificial Sequence
  chemically synthesized
tgactatatgtggagaatca

SEQ ID NO: 14548 - DNA, 20 bp, Artificial Sequence
  chemically synthesized
atgtggagaatcaaggaaca

SEQ ID NO: 14549 - DNA, 20 bp, Artificial Sequence
  chemically synthesized
gagaatcaaggaacatagtg

SEQ ID NO: 14550 - DNA, 20 bp, Artificial Sequence
  chemically synthesized
atcaaggaacatagtgaagt

SEQ ID NO: 14551 - DNA, 20 bp, Artificial Sequence
  chemically synthesized
aggaacatagtgaagttggt

SEQ ID NO: 14552 - DNA, 20 bp, Artificial Sequence
  chemically synthesized
gaagttggttggttgcttgt

SEQ ID NO: 14553 - DNA, 20 bp, Artificial Sequence
  chemically synthesized
ttggttgcttgtaagttcgc

SEQ ID NO: 14554 - DNA, 20 bp, Artificial Sequence
  chemically synthesized
gcttgtaagttcgctggaca

SEQ ID NO: 14555 - DNA, 20 bp, Artificial Sequence
  chemically synthesized
ttcgctggacaaagtgatga

SEQ ID NO: 14556 - DNA, 20 bp, Artificial Sequence
  chemically synthesized
atgaaagaaaatgatgaact

SEQ ID NO: 14557 - DNA, 20 bp, Artificial Sequence
  chemically synthesized
tgaaagaaaatgatgaactc

SEQ ID NO: 14558 - DNA, 20 bp, Artificial Sequence
  chemically synthesized
aaagaaaatgatgaactcag

SEQ ID NO: 14559 - DNA, 20 bp, Artificial Sequence
  chemically synthesized
tcaggagtatatcaactctc

SEQ ID NO: 14560 - DNA, 20 bp, Artificial Sequence
  chemically synthesized
ctttgtgccataatcttatt

SEQ ID NO: 14561 - DNA, 20 bp, Artificial Sequence
  chemically synthesized
ttgtgccataatcttatttg

SEQ ID NO: 14562 - DNA, 20 bp, Artificial Sequence
  chemically synthesized
gtgccataatcttatttgga

SEQ ID NO: 14563 - DNA, 20 bp, Artificial Sequence
  chemically synthesized
tgctcacctttcacttccac

SEQ ID NO: 14564 - DNA, 20 bp, Artificial Sequence
  chemically synthesized
ttcacttccacaagatatca

SEQ ID NO: 14565 - DNA, 20 bp, Artificial Sequence
  chemically synthesized
acttccacaagatatcacag

SEQ ID NO: 14566 - DNA, 20 bp, Artificial Sequence
  chemically synthesized
tacattgatgacatgctgac

SEQ ID NO: 14567 - DNA, 20 bp, Artificial Sequence
  chemically synthesized
gatgacatgctgactggaac

SEQ ID NO: 14568 - DNA, 20 bp, Artificial Sequence
  chemically synthesized
acatgctgactggaactagt

SEQ ID NO: 14569 - DNA, 20 bp, Artificial Sequence
  chemically synthesized
gctgactggaactagtgagc

SEQ ID NO: 14570 - DNA, 20 bp, Artificial Sequence
  chemically synthesized
gactggaactagtgagcaag

SEQ ID NO: 14571 - DNA, 20 bp, Artificial Sequence
  chemically synthesized
tggaactagtgagcaagaag

SEQ ID NO: 14572 - DNA, 20 bp, Artificial Sequence
  chemically synthesized
gcaagaagtagcaaacacac

SEQ ID NO: 14573 - DNA, 20 bp, Artificial Sequence
  chemically synthesized
aacacactggatttattgat

SEQ ID NO: 14574 - DNA, 20 bp, Artificial Sequence
  chemically synthesized
atttattgatgagacatttg

SEQ ID NO: 14575 - DNA, 20 bp, Artificial Sequence
  chemically synthesized
tttattgatgagacatttgt

SEQ ID NO: 14576 - DNA, 20 bp, Artificial Sequence
  chemically synthesized
ttgatgagacatttgtggga

SEQ ID NO: 14577 - DNA, 20 bp, Artificial Sequence
  chemically synthesized
gatgagacatttgtgggaca

SEQ ID NO: 14578 - DNA, 20 bp, Artificial Sequence
  chemically synthesized
atgagacatttgtgggacag

SEQ ID NO: 14579 - DNA, 20 bp, Artificial Sequence
  chemically synthesized
gacatttgtgggacagagga

SEQ ID NO: 14580 - DNA, 20 bp, Artificial Sequence
  chemically synthesized
acatttgtgggacagaggat

SEQ ID NO: 14581 - DNA, 20 bp, Artificial Sequence
  chemically synthesized
gaaataaatctgattaaatt

SEQ ID NO: 14582 - DNA, 20 bp, Artificial Sequence
  chemically synthesized
aaataaatctgattaaattc

SEQ ID NO: 14583 - DNA, 20 bp, Artificial Sequence
  chemically synthesized
aataaatctgattaaattca

SEQ ID NO: 14584 - DNA, 20 bp, Artificial Sequence
  chemically synthesized
aattcagggaccttctacct

SEQ ID NO: 14585 - DNA, 20 bp, Artificial Sequence
  chemically synthesized
ttctacctcagtaaaattta

SEQ ID NO: 14586 - DNA, 20 bp, Artificial Sequence
  chemically synthesized
tctacctcagtaaaatttat

SEQ ID NO: 14587 - DNA, 20 bp, Artificial Sequence
  chemically synthesized
ctacctcagtaaaatttata

SEQ ID NO: 14588 - DNA, 20 bp, Artificial Sequence
  chemically synthesized
tacctcagtaaaatttatag

SEQ ID NO: 14589 - DNA, 20 bp, Artificial Sequence
  chemically synthesized
taaaatttataggggtccaa

SEQ ID NO: 14590 - DNA, 20 bp, Artificial Sequence
  chemically synthesized
tttataggggtccaatggtt

SEQ ID NO: 14591 - DNA, 20 bp, Artificial Sequence
  chemically synthesized
ttataggggtccaatggttt

SEQ ID NO: 14592 - DNA, 20 bp, Artificial Sequence
  chemically synthesized
tataggggtccaatggtttg

SEQ ID NO: 14593 - DNA, 20 bp, Artificial Sequence
  chemically synthesized
ccaatggtttggggctcttt

SEQ ID NO: 14594 - DNA, 20 bp, Artificial Sequence
  chemically synthesized
tctttgagatattccttcta

SEQ ID NO: 14595 - DNA, 20 bp, Artificial Sequence
  chemically synthesized
gagatattccttctaaagtg

SEQ ID NO: 14596 - DNA, 20 bp, Artificial Sequence
  chemically synthesized
agatattccttctaaagtga

SEQ ID NO: 14597 - DNA, 20 bp, Artificial Sequence
  chemically synthesized
gaaggataatttgctgcatt

SEQ ID NO: 14598 - DNA, 20 bp, Artificial Sequence
  chemically synthesized
atttggccactcttacaacc

SEQ ID NO: 14599 - DNA, 20 bp, Artificial Sequence
  chemically synthesized
ccactcttacaaccaagaaa

SEQ ID NO: 14600 - DNA, 20 bp, Artificial Sequence
  chemically synthesized
cactcttacaaccaagaaat

SEQ ID NO: 14601 - DNA, 20 bp, Artificial Sequence
  chemically synthesized
caagaaataggcacaacgcc

SEQ ID NO: 14602 - DNA, 20 bp, Artificial Sequence
  chemically synthesized
gaaataggcacaacgcctag

SEQ ID NO: 14603 - DNA, 20 bp, Artificial Sequence
  chemically synthesized
aaataggcacaacgcctagt

SEQ ID NO: 14604 - DNA, 20 bp, Artificial Sequence
  chemically synthesized
caacgcctagtgggcctatt

SEQ ID NO: 14605 - DNA, 20 bp, Artificial Sequence
  chemically synthesized
tagtgggcctatttggattt

SEQ ID NO: 14606 - DNA, 20 bp, Artificial Sequence
  chemically synthesized
gtgggcctatttggattttg

SEQ ID NO: 14607 - DNA, 20 bp, Artificial Sequence
  chemically synthesized
tgggcctatttggattttgg

SEQ ID NO: 14608 - DNA, 20 bp, Artificial Sequence
  chemically synthesized
gaggcaacatattcctgatt

SEQ ID NO: 14609 - DNA, 20 bp, Artificial Sequence
  chemically synthesized
aggcaacatattcctgattt

SEQ ID NO: 14610 - DNA, 20 bp, Artificial Sequence
  chemically synthesized
ctgatttgggtgtgttactc

SEQ ID NO: 14611 - DNA, 20 bp, Artificial Sequence
  chemically synthesized
gttactctggcccatttatc

SEQ ID NO: 14612 - DNA, 20 bp, Artificial Sequence
  chemically synthesized
ccatttatcgagtgatccaa

SEQ ID NO: 14613 - DNA, 20 bp, Artificial Sequence
  chemically synthesized
catttatcgagtgatccaaa

SEQ ID NO: 14614 - DNA, 20 bp, Artificial Sequence
  chemically synthesized
cgagtgatccaaaaggctgc

SEQ ID NO: 14615 - DNA, 20 bp, Artificial Sequence
  chemically synthesized
tccaaaaggctgccagtttt

SEQ ID NO: 14616 - DNA, 20 bp, Artificial Sequence
  chemically synthesized
aaaaggctgccagttttgag

SEQ ID NO: 14617 - DNA, 20 bp, Artificial Sequence
  chemically synthesized
aaggctgccagttttgagtg

SEQ ID NO: 14618 - DNA, 20 bp, Artificial Sequence
  chemically synthesized
tgccagttttgagtggagtc

SEQ ID NO: 14619 - DNA, 20 bp, Artificial Sequence
  chemically synthesized
gttttgagtggagtccagaa

SEQ ID NO: 14620 - DNA, 20 bp, Artificial Sequence
  chemically synthesized
ttgagtggagtccagaacag

SEQ ID NO: 14621 - DNA, 20 bp, Artificial Sequence
  chemically synthesized
tgagtggagtccagaacaga

SEQ ID NO: 14622 - DNA, 20 bp, Artificial Sequence
  chemically synthesized
cagaacagaaggctctgcca

SEQ ID NO: 14623 - DNA, 20 bp, Artificial Sequence
  chemically synthesized
agaacagaaggctctgccac

SEQ ID NO: 14624 - DNA, 20 bp, Artificial Sequence
  chemically synthesized
agaaggctctgccacaggtc

SEQ ID NO: 14625 - DNA, 20 bp, Artificial Sequence
  chemically synthesized
gaaggctctgccacaggtcc

SEQ ID NO: 14626 - DNA, 20 bp, Artificial Sequence
  chemically synthesized
acaggtccaggctgctgtgc

SEQ ID NO: 14627 - DNA, 20 bp, Artificial Sequence
  chemically synthesized
gtgcaagctgctatgccact

SEQ ID NO: 14628 - DNA, 20 bp, Artificial Sequence
  chemically synthesized
tgcaagctgctatgccactt

SEQ ID NO: 14629 - DNA, 20 bp, Artificial Sequence
  chemically synthesized
gccacttgggccatatgacc

SEQ ID NO: 14630 - DNA, 20 bp, Artificial Sequence
  chemically synthesized
acttgggccatatgacctag

SEQ ID NO: 14631 - DNA, 20 bp, Artificial Sequence
  chemically synthesized
tagcagatccaatgatgctt

SEQ ID NO: 14632 - DNA, 20 bp, Artificial Sequence
  chemically synthesized
agcagatccaatgatgcttg

SEQ ID NO: 14633 - DNA, 20 bp, Artificial Sequence
  chemically synthesized
tccaatgatgcttgaggtgt

SEQ ID NO: 14634 - DNA, 20 bp, Artificial Sequence
  chemically synthesized
gatgcttgaggtgtcagtgc

SEQ ID NO: 14635 - DNA, 20 bp, Artificial Sequence
  chemically synthesized
cttgaggtgtcagtgccaga

SEQ ID NO: 14636 - DNA, 20 bp, Artificial Sequence
  chemically synthesized
ttgaggtgtcagtgccagat

SEQ ID NO: 14637 - DNA, 20 bp, Artificial Sequence
  chemically synthesized
tgaggtgtcagtgccagata

SEQ ID NO: 14638 - DNA, 20 bp, Artificial Sequence
  chemically synthesized
tgccagatagggatgctgtt

SEQ ID NO: 14639 - DNA, 20 bp, Artificial Sequence
  chemically synthesized
ccagatagggatgctgtttg

SEQ ID NO: 14640 - DNA, 20 bp, Artificial Sequence
  chemically synthesized
gggatgctgtttggagcatt

SEQ ID NO: 14641 - DNA, 20 bp, Artificial Sequence
  chemically synthesized
atgctgtttggagcatttgg

SEQ ID NO: 14642 - DNA, 20 bp, Artificial Sequence
  chemically synthesized
tgctgtttggagcatttggc

SEQ ID NO: 14643 - DNA, 20 bp, Artificial Sequence
  chemically synthesized
gcatttggcaggctgaatca

SEQ ID NO: 14644 - DNA, 20 bp, Artificial Sequence
  chemically synthesized
tttggcaggctgaatcacag

SEQ ID NO: 14645 - DNA, 20 bp, Artificial Sequence
  chemically synthesized
tggcaggctgaatcacagcg

SEQ ID NO: 14646 - DNA, 20 bp, Artificial Sequence
  chemically synthesized
ggcaggctgaatcacagcgg

SEQ ID NO: 14647 - DNA, 20 bp, Artificial Sequence
  chemically synthesized
tgaatcacagcggaggcctc

SEQ ID NO: 14648 - DNA, 20 bp, Artificial Sequence
  chemically synthesized
gaatcacagcggaggcctct

SEQ ID NO: 14649 - DNA, 20 bp, Artificial Sequence
  chemically synthesized
agcggaggcctctaggattt

SEQ ID NO: 14650 - DNA, 20 bp, Artificial Sequence
  chemically synthesized
cggaggcctctaggattttg

SEQ ID NO: 14651 - DNA, 20 bp, Artificial Sequence
  chemically synthesized
ggcctctaggattttggagc

SEQ ID NO: 14652 - DNA, 20 bp, Artificial Sequence
  chemically synthesized
gcctctaggattttggagca

SEQ ID NO: 14653 - DNA, 20 bp, Artificial Sequence
  chemically synthesized
caaggccctgccatcttctg

SEQ ID NO: 14654 - DNA, 20 bp, Artificial Sequence
  chemically synthesized
tgcagataactactctcttt

SEQ ID NO: 14655 - DNA, 20 bp, Artificial Sequence
  chemically synthesized
gcagataactactctctttt

SEQ ID NO: 14656 - DNA, 20 bp, Artificial Sequence
  chemically synthesized
cagataactactctctttta

SEQ ID NO: 14657 - DNA, 20 bp, Artificial Sequence
  chemically synthesized
gataactactctcttttagg

SEQ ID NO: 14658 - DNA, 20 bp, Artificial Sequence
  chemically synthesized
actactctcttttagggaga

SEQ ID NO: 14659 - DNA, 20 bp, Artificial Sequence
  chemically synthesized
tcttttagggagaaagctct

SEQ ID NO: 14660 - DNA, 20 bp, Artificial Sequence
  chemically synthesized
gaaagctcttggcctgttac

SEQ ID NO: 14661 - DNA, 20 bp, Artificial Sequence
  chemically synthesized
aaagctcttggcctgttact

SEQ ID NO: 14662 - DNA, 20 bp, Artificial Sequence
  chemically synthesized
cttggcctgttactgggctt

SEQ ID NO: 14663 - DNA, 20 bp, Artificial Sequence
  chemically synthesized
ggcctgttactgggctttgg

SEQ ID NO: 14664 - DNA, 20 bp, Artificial Sequence
  chemically synthesized
gaaacgaaatatttgactat

SEQ ID NO: 14665 - DNA, 20 bp, Artificial Sequence
  chemically synthesized
atatttgactatgagtcatc

SEQ ID NO: 14666 - DNA, 20 bp, Artificial Sequence
  chemically synthesized
ctgaactgcctatcatgaac

SEQ ID NO: 14667 - DNA, 20 bp, Artificial Sequence
  chemically synthesized
tgaactgcctatcatgaact

SEQ ID NO: 14668 - DNA, 20 bp, Artificial Sequence
  chemically synthesized
tgggtgctttctgatccatc

SEQ ID NO: 14669 - DNA, 20 bp, Artificial Sequence
  chemically synthesized
ttctgatccatctagccata

SEQ ID NO: 14670 - DNA, 20 bp, Artificial Sequence
  chemically synthesized
tgatccatctagccataaag

SEQ ID NO: 14671 - DNA, 20 bp, Artificial Sequence
  chemically synthesized
gatccatctagccataaagt

SEQ ID NO: 14672 - DNA, 20 bp, Artificial Sequence
  chemically synthesized
gccataaagtgggctgtgca

SEQ ID NO: 14673 - DNA, 20 bp, Artificial Sequence
  chemically synthesized
ataaagtgggctgtgcacag

SEQ ID NO: 14674 - DNA, 20 bp, Artificial Sequence
  chemically synthesized
tgtgcacagcagcattgcat

SEQ ID NO: 14675 - DNA, 20 bp, Artificial Sequence
  chemically synthesized
agcagcattgcatcagcaaa

SEQ ID NO: 14676 - DNA, 20 bp, Artificial Sequence
  chemically synthesized
agcattgcatcagcaaatgg

SEQ ID NO: 14677 - DNA, 20 bp, Artificial Sequence
  chemically synthesized
attgcatcagcaaatggaag

SEQ ID NO: 14678 - DNA, 20 bp, Artificial Sequence
  chemically synthesized
ggaagtggtatatatgcgat

SEQ ID NO: 14679 - DNA, 20 bp, Artificial Sequence
  chemically synthesized
gaagtggtatatatgcgatt

SEQ ID NO: 14680 - DNA, 20 bp, Artificial Sequence
  chemically synthesized
gtatatatgcgattgggctt

SEQ ID NO: 14681 - DNA, 20 bp, Artificial Sequence
  chemically synthesized
tatatgcgattgggcttgag

SEQ ID NO: 14682 - DNA, 20 bp, Artificial Sequence
  chemically synthesized
ttgggcttgagcagatcctg

SEQ ID NO: 14683 - DNA, 20 bp, Artificial Sequence
  chemically synthesized
tgggcttgagcagatcctga

SEQ ID NO: 14684 - DNA, 20 bp, Artificial Sequence
  chemically synthesized
tgagcagatcctgaaggcac

SEQ ID NO: 14685 - DNA, 20 bp, Artificial Sequence
  chemically synthesized
cagatcctgaaggcactagt

SEQ ID NO: 14686 - DNA, 20 bp, Artificial Sequence
  chemically synthesized
aaggcactagtaagttacat

SEQ ID NO: 14687 - DNA, 20 bp, Artificial Sequence
  chemically synthesized
cactagtaagttacatgaga

SEQ ID NO: 14688 - DNA, 20 bp, Artificial Sequence
  chemically synthesized
actagtaagttacatgagaa

SEQ ID NO: 14689 - DNA, 20 bp, Artificial Sequence
  chemically synthesized
ctagtaagttacatgagaaa

SEQ ID NO: 14690 - DNA, 20 bp, Artificial Sequence
  chemically synthesized
tagtaagttacatgagaaag

SEQ ID NO: 14691 - DNA, 20 bp, Artificial Sequence
  chemically synthesized
gaaaggggctcaaatgccca

SEQ ID NO: 14692 - DNA, 20 bp, Artificial Sequence
  chemically synthesized
acacactgctttctctccct

SEQ ID NO: 14693 - DNA, 20 bp, Artificial Sequence
  chemically synthesized
tctccctgagactgcaccga

SEQ ID NO: 14694 - DNA, 20 bp, Artificial Sequence
  chemically synthesized
agactgcaccgatggtctca

SEQ ID NO: 14695 - DNA, 20 bp, Artificial Sequence
  chemically synthesized
gactgcaccgatggtctcat

SEQ ID NO: 14696 - DNA, 20 bp, Artificial Sequence
  chemically synthesized
actgcaccgatggtctcatg

SEQ ID NO: 14697 - DNA, 20 bp, Artificial Sequence
  chemically synthesized
tgcaccgatggtctcatggg

SEQ ID NO: 14698 - DNA, 20 bp, Artificial Sequence
  chemically synthesized
catggggagttccctatgat

SEQ ID NO: 14699 - DNA, 20 bp, Artificial Sequence
  chemically synthesized
agttccctatgatcagctga

SEQ ID NO: 14700 - DNA, 20 bp, Artificial Sequence
  chemically synthesized
ttccctatgatcagctgaca

SEQ ID NO: 14701 - DNA, 20 bp, Artificial Sequence
  chemically synthesized
tccctatgatcagctgacag

SEQ ID NO: 14702 - DNA, 20 bp, Artificial Sequence
  chemically synthesized
ctatgatcagctgacagagg

SEQ ID NO: 14703 - DNA, 20 bp, Artificial Sequence
  chemically synthesized
atgatcagctgacagaggaa

SEQ ID NO: 14704 - DNA, 20 bp, Artificial Sequence
  chemically synthesized
atcagctgacagaggaagag

SEQ ID NO: 14705 - DNA, 20 bp, Artificial Sequence
  chemically synthesized
ctgacagaggaagagaagac

SEQ ID NO: 14706 - DNA, 20 bp, Artificial Sequence
  chemically synthesized
tgacagaggaagagaagact

SEQ ID NO: 14707 - DNA, 20 bp, Artificial Sequence
  chemically synthesized
aggaagagaagactaggtcc

SEQ ID NO: 14708 - DNA, 20 bp, Artificial Sequence
  chemically synthesized
gaagactaggtcctggttca

SEQ ID NO: 14709 - DNA, 20 bp, Artificial Sequence
  chemically synthesized
actaggtcctggttcacaga

SEQ ID NO: 14710 - DNA, 20 bp, Artificial Sequence
  chemically synthesized
agatagttctgcacgatatg

SEQ ID NO: 14711 - DNA, 20 bp, Artificial Sequence
  chemically synthesized
gatagttctgcacgatatgc

SEQ ID NO: 14712 - DNA, 20 bp, Artificial Sequence
  chemically synthesized
gatatgcaggcaccacccaa

SEQ ID NO: 14713 - DNA, 20 bp, Artificial Sequence
  chemically synthesized
atgcaggcaccacccaaaag

SEQ ID NO: 14714 - DNA, 20 bp, Artificial Sequence
  chemically synthesized
aggcaccacccaaaagtgga

SEQ ID NO: 14715 - DNA, 20 bp, Artificial Sequence
  chemically synthesized
cacccaaaagtggacagccg

SEQ ID NO: 14716 - DNA, 20 bp, Artificial Sequence
  chemically synthesized
agtggacagccgcagcacta

SEQ ID NO: 14717 - DNA, 20 bp, Artificial Sequence
  chemically synthesized
gcagcactacagcccctttc

SEQ ID NO: 14718 - DNA, 20 bp, Artificial Sequence
  chemically synthesized
cagcactacagcccctttct

SEQ ID NO: 14719 - DNA, 20 bp, Artificial Sequence
  chemically synthesized
ccctttctaggacatccctg

SEQ ID NO: 14720 - DNA, 20 bp, Artificial Sequence
  chemically synthesized
cctttctaggacatccctga

SEQ ID NO: 14721 - DNA, 20 bp, Artificial Sequence
  chemically synthesized
aggacatccctgaaggacaa

SEQ ID NO: 14722 - DNA, 20 bp, Artificial Sequence
  chemically synthesized
atccctgaaggacaacggtg

SEQ ID NO: 14723 - DNA, 20 bp, Artificial Sequence
  chemically synthesized
tccctgaaggacaacggtga

SEQ ID NO: 14724 - DNA, 20 bp, Artificial Sequence
  chemically synthesized
ccctgaaggacaacggtgaa

SEQ ID NO: 14725 - DNA, 20 bp, Artificial Sequence
  chemically synthesized
acggtgaagggaaatcttcc

SEQ ID NO: 14726 - DNA, 20 bp, Artificial Sequence
  chemically synthesized
tgaagggaaatcttcctagt

SEQ ID NO: 14727 - DNA, 20 bp, Artificial Sequence
  chemically synthesized
agggaaatcttcctagttgg

SEQ ID NO: 14728 - DNA, 20 bp, Artificial Sequence
  chemically synthesized
ttcctagttggcagaacttt

SEQ ID NO: 14729 - DNA, 20 bp, Artificial Sequence
  chemically synthesized
ctagttggcagaactttgag

SEQ ID NO: 14730 - DNA, 20 bp, Artificial Sequence
  chemically synthesized
agaactttgagcagtgtgcc

SEQ ID NO: 14731 - DNA, 20 bp, Artificial Sequence
  chemically synthesized
gcctggttgtgcactttgca

SEQ ID NO: 14732 - DNA, 20 bp, Artificial Sequence
  chemically synthesized
tggttgtgcactttgcacag

SEQ ID NO: 14733 - DNA, 20 bp, Artificial Sequence
  chemically synthesized
ggttgtgcactttgcacaga

SEQ ID NO: 14734 - DNA, 20 bp, Artificial Sequence
  chemically synthesized
ttgtgcactttgcacagaag

SEQ ID NO: 14735 - DNA, 20 bp, Artificial Sequence
  chemically synthesized
actttgcacagaaggagaaa

SEQ ID NO: 14736 - DNA, 20 bp, Artificial Sequence
  chemically synthesized
tgcacagaaggagaaatggc

SEQ ID NO: 14737 - DNA, 20 bp, Artificial Sequence
  chemically synthesized
tgcgattatatacttattca

SEQ ID NO: 14738 - DNA, 20 bp, Artificial Sequence
  chemically synthesized
gcgattatatacttattcat

SEQ ID NO: 14739 - DNA, 20 bp, Artificial Sequence
  chemically synthesized
atatacttattcatgggctg

SEQ ID NO: 14740 - DNA, 20 bp, Artificial Sequence
  chemically synthesized
ttattcatgggctgtagcca

SEQ ID NO: 14741 - DNA, 20 bp, Artificial Sequence
  chemically synthesized
tattcatgggctgtagccaa

SEQ ID NO: 14742 - DNA, 20 bp, Artificial Sequence
  chemically synthesized
atgggctgtagccaaaggtt

SEQ ID NO: 14743 - DNA, 20 bp, Artificial Sequence
  chemically synthesized
gctgtagccaaaggtttggc

SEQ ID NO: 14744 - DNA, 20 bp, Artificial Sequence
  chemically synthesized
tagccaaaggtttggctaga

SEQ ID NO: 14745 - DNA, 20 bp, Artificial Sequence
  chemically synthesized
caaaggtttggctagatggt

SEQ ID NO: 14746 - DNA, 20 bp, Artificial Sequence
  chemically synthesized
aaaggtttggctagatggtc

SEQ ID NO: 14747 - DNA, 20 bp, Artificial Sequence
  chemically synthesized
aaggtttggctagatggtca

SEQ ID NO: 14748 - DNA, 20 bp, Artificial Sequence
  chemically synthesized
tggctagatggtcagggact

SEQ ID NO: 14749 - DNA, 20 bp, Artificial Sequence
  chemically synthesized
gatggtcagggacttggaaa

SEQ ID NO: 14750 - DNA, 20 bp, Artificial Sequence
  chemically synthesized
ggacttggaaaaagcatgac

SEQ ID NO: 14751 - DNA, 20 bp, Artificial Sequence
  chemically synthesized
tgactggaaaattgatgaca

SEQ ID NO: 14752 - DNA, 20 bp, Artificial Sequence
  chemically synthesized
aaattgatgacaaagaaatt

SEQ ID NO: 14753 - DNA, 20 bp, Artificial Sequence
  chemically synthesized
aattgatgacaaagaaattt

SEQ ID NO: 14754 - DNA, 20 bp, Artificial Sequence
  chemically synthesized
attgatgacaaagaaatttg

SEQ ID NO: 14755 - DNA, 20 bp, Artificial Sequence
  chemically synthesized
gatgacaaagaaatttgggg

SEQ ID NO: 14756 - DNA, 20 bp, Artificial Sequence
  chemically synthesized
tgacaaagaaatttggggaa

SEQ ID NO: 14757 - DNA, 20 bp, Artificial Sequence
  chemically synthesized
gacaaagaaatttggggaag

SEQ ID NO: 14758 - DNA, 20 bp, Artificial Sequence
  chemically synthesized
aaatttggggaagaggtatg

SEQ ID NO: 14759 - DNA, 20 bp, Artificial Sequence
  chemically synthesized
ttggggaagaggtatgtgga

SEQ ID NO: 14760 - DNA, 20 bp, Artificial Sequence
  chemically synthesized
tgtggatggacctctatgat

SEQ ID NO: 14761 - DNA, 20 bp, Artificial Sequence
  chemically synthesized
atgattagtcaaaaactaca

SEQ ID NO: 14762 - DNA, 20 bp, Artificial Sequence
  chemically synthesized
aagatattttcatcccatgt

SEQ ID NO: 14763 - DNA, 20 bp, Artificial Sequence
  chemically synthesized
cccatgtgagtgctcaccaa

SEQ ID NO: 14764 - DNA, 20 bp, Artificial Sequence
  chemically synthesized
ccatgtgagtgctcaccaat

SEQ ID NO: 14765 - DNA, 20 bp, Artificial Sequence
  chemically synthesized
tgctcaccaatgggtgacct

SEQ ID NO: 14766 - DNA, 20 bp, Artificial Sequence
  chemically synthesized
tcaccaatgggtgacctcag

SEQ ID NO: 14767 - DNA, 20 bp, Artificial Sequence
  chemically synthesized
ccaatgggtgacctcagcag

SEQ ID NO: 14768 - DNA, 20 bp, Artificial Sequence
  chemically synthesized
aatgggtgacctcagcagaa

SEQ ID NO: 14769 - DNA, 20 bp, Artificial Sequence
  chemically synthesized
atgggtgacctcagcagaag

SEQ ID NO: 14770 - DNA, 20 bp, Artificial Sequence
  chemically synthesized
agaagaggattttaataatc

SEQ ID NO: 14771 - DNA, 20 bp, Artificial Sequence
  chemically synthesized
agaggattttaataatcaag

SEQ ID NO: 14772 - DNA, 20 bp, Artificial Sequence
  chemically synthesized
gattttaataatcaagtgga

SEQ ID NO: 14773 - DNA, 20 bp, Artificial Sequence
  chemically synthesized
attttaataatcaagtggat

SEQ ID NO: 14774 - DNA, 20 bp, Artificial Sequence
  chemically synthesized
ggataggatgatcaattctg

SEQ ID NO: 14775 - DNA, 20 bp, Artificial Sequence
  chemically synthesized
tcaattctgtggacaccact

SEQ ID NO: 14776 - DNA, 20 bp, Artificial Sequence
  chemically synthesized
gacaccactcagccttttcc

SEQ ID NO: 14777 - DNA, 20 bp, Artificial Sequence
  chemically synthesized
acaccactcagccttttccc

SEQ ID NO: 14778 - DNA, 20 bp, Artificial Sequence
  chemically synthesized
ccactcatgtcatcgtccaa

SEQ ID NO: 14779 - DNA, 20 bp, Artificial Sequence
  chemically synthesized
gtccaatggacccatgaaca

SEQ ID NO: 14780 - DNA, 20 bp, Artificial Sequence
  chemically synthesized
caatggacccatgaacaaag

SEQ ID NO: 14781 - DNA, 20 bp, Artificial Sequence
  chemically synthesized
acccatgaacaaagtggcca

SEQ ID NO: 14782 - DNA, 20 bp, Artificial Sequence
  chemically synthesized
gaacaaagtggccacagttg

SEQ ID NO: 14783 - DNA, 20 bp, Artificial Sequence
  chemically synthesized
aacaaagtggccacagttgc

SEQ ID NO: 14784 - DNA, 20 bp, Artificial Sequence
  chemically synthesized
acaaagtggccacagttgca

SEQ ID NO: 14785 - DNA, 20 bp, Artificial Sequence
  chemically synthesized
agtggccacagttgcaggga

SEQ ID NO: 14786 - DNA, 20 bp, Artificial Sequence
  chemically synthesized
ggccacagttgcagggatgg

SEQ ID NO: 14787 - DNA, 20 bp, Artificial Sequence
  chemically synthesized
gcagggatggaagttatgct

SEQ ID NO: 14788 - DNA, 20 bp, Artificial Sequence
  chemically synthesized
cagggatggaagttatgctt

SEQ ID NO: 14789 - DNA, 20 bp, Artificial Sequence
  chemically synthesized
atggaagttatgcttgggct

SEQ ID NO: 14790 - DNA, 20 bp, Artificial Sequence
  chemically synthesized
tatgcttgggctcagcaaca

SEQ ID NO: 14791 - DNA, 20 bp, Artificial Sequence
  chemically synthesized
acatggacttccactcacca

SEQ ID NO: 14792 - DNA, 20 bp, Artificial Sequence
  chemically synthesized
tccactcaccaaagctgacc

SEQ ID NO: 14793 - DNA, 20 bp, Artificial Sequence
  chemically synthesized
caccaaagctgacctggcca

SEQ ID NO: 14794 - DNA, 20 bp, Artificial Sequence
  chemically synthesized
tggccacagccactgcttgc

SEQ ID NO: 14795 - DNA, 20 bp, Artificial Sequence
  chemically synthesized
cagccactgcttgccagcat

SEQ ID NO: 14796 - DNA, 20 bp, Artificial Sequence
  chemically synthesized
gccactgcttgccagcatca

SEQ ID NO: 14797 - DNA, 20 bp, Artificial Sequence
  chemically synthesized
cagcatcagagaccaacact

SEQ ID NO: 14798 - DNA, 20 bp, Artificial Sequence
  chemically synthesized
ccaacactaagcccttgata

SEQ ID NO: 14799 - DNA, 20 bp, Artificial Sequence
  chemically synthesized
cttgatatggcaccattcct

SEQ ID NO: 14800 - DNA, 20 bp, Artificial Sequence
  chemically synthesized
ttgatatggcaccattcctc

SEQ ID NO: 14801 - DNA, 20 bp, Artificial Sequence
  chemically synthesized
tgatatggcaccattcctcg

SEQ ID NO: 14802 - DNA, 20 bp, Artificial Sequence
  chemically synthesized
gcaccattcctcggggtgat

SEQ ID NO: 14803 - DNA, 20 bp, Artificial Sequence
  chemically synthesized
cattcctcggggtgatcagc

SEQ ID NO: 14804 - DNA, 20 bp, Artificial Sequence
  chemically synthesized
ggggtgatcagccagctacc

SEQ ID NO: 14805 - DNA, 20 bp, Artificial Sequence
  chemically synthesized
gtgatcagccagctacctgg

SEQ ID NO: 14806 - DNA, 20 bp, Artificial Sequence
  chemically synthesized
atcagccagctacctggtgg

SEQ ID NO: 14807 - DNA, 20 bp, Artificial Sequence
  chemically synthesized
tcagccagctacctggtggc

SEQ ID NO: 14808 - DNA, 20 bp, Artificial Sequence
  chemically synthesized
tggtggcaggttgattatat

SEQ ID NO: 14809 - DNA, 20 bp, Artificial Sequence
  chemically synthesized
atattggacctcttccatca

SEQ ID NO: 14810 - DNA, 20 bp, Artificial Sequence
  chemically synthesized
tggacctcttccatcatgga

SEQ ID NO: 14811 - DNA, 20 bp, Artificial Sequence
  chemically synthesized
ggacctcttccatcatggaa

SEQ ID NO: 14812 - DNA, 20 bp, Artificial Sequence
  chemically synthesized
gacctcttccatcatggaaa

SEQ ID NO: 14813 - DNA, 20 bp, Artificial Sequence
  chemically synthesized
ctcttccatcatggaaaggg

SEQ ID NO: 14814 - DNA, 20 bp, Artificial Sequence
  chemically synthesized
cttccatcatggaaagggca

SEQ ID NO: 14815 - DNA, 20 bp, Artificial Sequence
  chemically synthesized
ttccatcatggaaagggcag

SEQ ID NO: 14816 - DNA, 20 bp, Artificial Sequence
  chemically synthesized
gggcagaggcttgtcctcac

SEQ ID NO: 14817 - DNA, 20 bp, Artificial Sequence
  chemically synthesized
gaggcttgtcctcactggaa

SEQ ID NO: 14818 - DNA, 20 bp, Artificial Sequence
  chemically synthesized
actggaatagacacttactc

SEQ ID NO: 14819 - DNA, 20 bp, Artificial Sequence
  chemically synthesized
atagacacttactctggata

SEQ ID NO: 14820 - DNA, 20 bp, Artificial Sequence
  chemically synthesized
tagacacttactctggatat

SEQ ID NO: 14821 - DNA, 20 bp, Artificial Sequence
  chemically synthesized
ctgaactcaatgcttatgcc

SEQ ID NO: 14822 - DNA, 20 bp, Artificial Sequence
  chemically synthesized
tatgccaagactaccatcca

SEQ ID NO: 14823 - DNA, 20 bp, Artificial Sequence
  chemically synthesized
gactaccatccatggaatca

SEQ ID NO: 14824 - DNA, 20 bp, Artificial Sequence
  chemically synthesized
gaatgccgtatccactgtca

SEQ ID NO: 14825 - DNA, 20 bp, Artificial Sequence
  chemically synthesized
cactgtcatggtattccaca

SEQ ID NO: 14826 - DNA, 20 bp, Artificial Sequence
  chemically synthesized
acacagcattgcttctgacc

SEQ ID NO: 14827 - DNA, 20 bp, Artificial Sequence
  chemically synthesized
tgaccaagccactcacttta

SEQ ID NO: 14828 - DNA, 20 bp, Artificial Sequence
  chemically synthesized
agccactcactttatggcta

SEQ ID NO: 14829 - DNA, 20 bp, Artificial Sequence
  chemically synthesized
cactcactttatggctaaag

SEQ ID NO: 14830 - DNA, 20 bp, Artificial Sequence
  chemically synthesized
ttatggctaaagaagtgtga

SEQ ID NO: 14831 - DNA, 20 bp, Artificial Sequence
  chemically synthesized
tggctaaagaagtgtgacag

SEQ ID NO: 14832 - DNA, 20 bp, Artificial Sequence
  chemically synthesized
ggctaaagaagtgtgacagt

SEQ ID NO: 14833 - DNA, 20 bp, Artificial Sequence
  chemically synthesized
tgacagtgggctcatgctca

SEQ ID NO: 14834 - DNA, 20 bp, Artificial Sequence
  chemically synthesized
ctcatgctcatggaatttac

SEQ ID NO: 14835 - DNA, 20 bp, Artificial Sequence
  chemically synthesized
ccatgatccctatcatcctg

SEQ ID NO: 14836 - DNA, 20 bp, Artificial Sequence
  chemically synthesized
tgatccctatcatcctgaag

SEQ ID NO: 14837 - DNA, 20 bp, Artificial Sequence
  chemically synthesized
atcctgaagcagcttttgaa

SEQ ID NO: 14838 - DNA, 20 bp, Artificial Sequence
  chemically synthesized
agcttttgaatggccttttg

SEQ ID NO: 14839 - DNA, 20 bp, Artificial Sequence
  chemically synthesized
gtcacgattacaatgccaac

SEQ ID NO: 14840 - DNA, 20 bp, Artificial Sequence
  chemically synthesized
tcacgattacaatgccaact

SEQ ID NO: 14841 - DNA, 20 bp, Artificial Sequence
  chemically synthesized
aactaggtgacaatactttg

SEQ ID NO: 14842 - DNA, 20 bp, Artificial Sequence
  chemically synthesized
actaggtgacaatactttgc

SEQ ID NO: 14843 - DNA, 20 bp, Artificial Sequence
  chemically synthesized
gtgacaatactttgcaggcc

SEQ ID NO: 14844 - DNA, 20 bp, Artificial Sequence
  chemically synthesized
tgacaatactttgcaggcct

SEQ ID NO: 14845 - DNA, 20 bp, Artificial Sequence
  chemically synthesized
gacaatactttgcaggcctg

SEQ ID NO: 14846 - DNA, 20 bp, Artificial Sequence
  chemically synthesized
tactttgcaggcctggggca

SEQ ID NO: 14847 - DNA, 20 bp, Artificial Sequence
  chemically synthesized
aggcctggggcaaagttctc

SEQ ID NO: 14848 - DNA, 20 bp, Artificial Sequence
  chemically synthesized
cctggggcaaagttctccag

SEQ ID NO: 14849 - DNA, 20 bp, Artificial Sequence
  chemically synthesized
ctggggcaaagttctccaga

SEQ ID NO: 14850 - DNA, 20 bp, Artificial Sequence
  chemically synthesized
aggctgtgtatgctctgaat

SEQ ID NO: 14851 - DNA, 20 bp, Artificial Sequence
  chemically synthesized
ctgaatcagtgtccaatata

SEQ ID NO: 14852 - DNA, 20 bp, Artificial Sequence
  chemically synthesized
atatggtactgtttctccca

SEQ ID NO: 14853 - DNA, 20 bp, Artificial Sequence
  chemically synthesized
ggtactgtttctcccataga

SEQ ID NO: 14854 - DNA, 20 bp, Artificial Sequence
  chemically synthesized
gtactgtttctcccatagac

SEQ ID NO: 14855 - DNA, 20 bp, Artificial Sequence
  chemically synthesized
tctcccatagacaggattca

SEQ ID NO: 14856 - DNA, 20 bp, Artificial Sequence
  chemically synthesized
ctcccatagacaggattcac

SEQ ID NO: 14857 - DNA, 20 bp, Artificial Sequence
  chemically synthesized
atagacaggattcacgggtc

SEQ ID NO: 14858 - DNA, 20 bp, Artificial Sequence
  chemically synthesized
tagacaggattcacgggtcc

SEQ ID NO: 14859 - DNA, 20 bp, Artificial Sequence
  chemically synthesized
attcacgggtccaggaatca

SEQ ID NO: 14860 - DNA, 20 bp, Artificial Sequence
  chemically synthesized
ttcacgggtccaggaatcaa

SEQ ID NO: 14861 - DNA, 20 bp, Artificial Sequence
  chemically synthesized
tcacgggtccaggaatcaaa

SEQ ID NO: 14862 - DNA, 20 bp, Artificial Sequence
  chemically synthesized
cgggtccaggaatcaaaggg

SEQ ID NO: 14863 - DNA, 20 bp, Artificial Sequence
  chemically synthesized
gtccaggaatcaaagggtgg

SEQ ID NO: 14864 - DNA, 20 bp, Artificial Sequence
  chemically synthesized
caggaatcaaagggtggaag

SEQ ID NO: 14865 - DNA, 20 bp, Artificial Sequence
  chemically synthesized
gaatcaaagggtggaagtgg

SEQ ID NO: 14866 - DNA, 20 bp, Artificial Sequence
  chemically synthesized
tcaaagggtggaagtggaag

SEQ ID NO: 14867 - DNA, 20 bp, Artificial Sequence
  chemically synthesized
aagggtggaagtggaagtgg

SEQ ID NO: 14868 - DNA, 20 bp, Artificial Sequence
  chemically synthesized
ggtggaagtggaagtggaag

SEQ ID NO: 14869 - DNA, 20 bp, Artificial Sequence
  chemically synthesized
gcaccactcaccatcacccc

SEQ ID NO: 14870 - DNA, 20 bp, Artificial Sequence
  chemically synthesized
catcacccctagtgttccac

SEQ ID NO: 14871 - DNA, 20 bp, Artificial Sequence
  chemically synthesized
atttttgcttcctgttccca

SEQ ID NO: 14872 - DNA, 20 bp, Artificial Sequence
  chemically synthesized
cccatggcattatgttctgc

SEQ ID NO: 14873 - DNA, 20 bp, Artificial Sequence
  chemically synthesized
ggcattatgttctgctggct

SEQ ID NO: 14874 - DNA, 20 bp, Artificial Sequence
  chemically synthesized
cattatgttctgctggctta

SEQ ID NO: 14875 - DNA, 20 bp, Artificial Sequence
  chemically synthesized
attatgttctgctggcttag

SEQ ID NO: 14876 - DNA, 20 bp, Artificial Sequence
  chemically synthesized
ttctgctggcttagaggtct

SEQ ID NO: 14877 - DNA, 20 bp, Artificial Sequence
  chemically synthesized
tggcttagaggtcttagttc

SEQ ID NO: 14878 - DNA, 20 bp, Artificial Sequence
  chemically synthesized
gcttagaggtcttagttcca

SEQ ID NO: 14879 - DNA, 20 bp, Artificial Sequence
  chemically synthesized
cttagaggtcttagttccag

SEQ ID NO: 14880 - DNA, 20 bp, Artificial Sequence
  chemically synthesized
ttagaggtcttagttccaga

SEQ ID NO: 14881 - DNA, 20 bp, Artificial Sequence
  chemically synthesized
agaggtcttagttccagagg

SEQ ID NO: 14882 - DNA, 20 bp, Artificial Sequence
  chemically synthesized
gaggtcttagttccagaggg

SEQ ID NO: 14883 - DNA, 20 bp, Artificial Sequence
  chemically synthesized
agagggaggaacactgccgc

SEQ ID NO: 14884 - DNA, 20 bp, Artificial Sequence
  chemically synthesized
gagggaggaacactgccgcc

SEQ ID NO: 14885 - DNA, 20 bp, Artificial Sequence
  chemically synthesized
attccattaaactgcaaatt

SEQ ID NO: 14886 - DNA, 20 bp, Artificial Sequence
  chemically synthesized
tgcaaattaagattgccacc

SEQ ID NO: 14887 - DNA, 20 bp, Artificial Sequence
  chemically synthesized
agattgccacctggacactt

SEQ ID NO: 14888 - DNA, 20 bp, Artificial Sequence
  chemically synthesized
gattgccacctggacacttt

SEQ ID NO: 14889 - DNA, 20 bp, Artificial Sequence
  chemically synthesized
tttgggctcctcccaccttt

SEQ ID NO: 14890 - DNA, 20 bp, Artificial Sequence
  chemically synthesized
tcctcccacctttaagtcaa

SEQ ID NO: 14891 - DNA, 20 bp, Artificial Sequence
  chemically synthesized
cctcccacctttaagtcaac

SEQ ID NO: 14892 - DNA, 20 bp, Artificial Sequence
  chemically synthesized
cacctttaagtcaacaggct

SEQ ID NO: 14893 - DNA, 20 bp, Artificial Sequence
  chemically synthesized
ctttaagtcaacaggctaag

SEQ ID NO: 14894 - DNA, 20 bp, Artificial Sequence
  chemically synthesized
ttaagtcaacaggctaagaa

SEQ ID NO: 14895 - DNA, 20 bp, Artificial Sequence
  chemically synthesized
aagtcaacaggctaagaaga

SEQ ID NO: 14896 - DNA, 20 bp, Artificial Sequence
  chemically synthesized
acaggctaagaagagagtta

SEQ ID NO: 14897 - DNA, 20 bp, Artificial Sequence
  chemically synthesized
taagaagagagttacagtgt

SEQ ID NO: 14898 - DNA, 20 bp, Artificial Sequence
  chemically synthesized
gagagttacagtgttggctg

SEQ ID NO: 14899 - DNA, 20 bp, Artificial Sequence
  chemically synthesized
gttggctgcggtgattaacc

SEQ ID NO: 14900 - DNA, 20 bp, Artificial Sequence
  chemically synthesized
ggtgattaacccagactatc

SEQ ID NO: 14901 - DNA, 20 bp, Artificial Sequence
  chemically synthesized
ccagactatcaagatgaaat

SEQ ID NO: 14902 - DNA, 20 bp, Artificial Sequence
  chemically synthesized
atcagtctacaactccacaa

SEQ ID NO: 14903 - DNA, 20 bp, Artificial Sequence
  chemically synthesized
cagtctacaactccacaatg

SEQ ID NO: 14904 - DNA, 20 bp, Artificial Sequence
  chemically synthesized
agtctacaactccacaatgg

SEQ ID NO: 14905 - DNA, 20 bp, Artificial Sequence
  chemically synthesized
tacaactccacaatggaggt

SEQ ID NO: 14906 - DNA, 20 bp, Artificial Sequence
  chemically synthesized
acaactccacaatggaggta

SEQ ID NO: 14907 - DNA, 20 bp, Artificial Sequence
  chemically synthesized
actccacaatggaggtaagg

SEQ ID NO: 14908 - DNA, 20 bp, Artificial Sequence
  chemically synthesized
gaggtaaggaagcgtatgca

SEQ ID NO: 14909 - DNA, 20 bp, Artificial Sequence
  chemically synthesized
ggaagcgtatgcatggaata

SEQ ID NO: 14910 - DNA, 20 bp, Artificial Sequence
  chemically synthesized
gaagcgtatgcatggaatat

SEQ ID NO: 14911 - DNA, 20 bp, Artificial Sequence
  chemically synthesized
agcgtatgcatggaatatag

SEQ ID NO: 14912 - DNA, 20 bp, Artificial Sequence
  chemically synthesized
atggaatataggagatccat

SEQ ID NO: 14913 - DNA, 20 bp, Artificial Sequence
  chemically synthesized
tggaatataggagatccatt

SEQ ID NO: 14914 - DNA, 20 bp, Artificial Sequence
  chemically synthesized
ggaatataggagatccatta

SEQ ID NO: 14915 - DNA, 20 bp, Artificial Sequence
  chemically synthesized
agatccattagggtgtctct

SEQ ID NO: 14916 - DNA, 20 bp, Artificial Sequence
  chemically synthesized
ctcttagttttaccatgtcc

SEQ ID NO: 14917 - DNA, 20 bp, Artificial Sequence
  chemically synthesized
ttttaccatgtcctggaatt

SEQ ID NO: 14918 - DNA, 20 bp, Artificial Sequence
  chemically synthesized
tttaccatgtcctggaatta

SEQ ID NO: 14919 - DNA, 20 bp, Artificial Sequence
  chemically synthesized
ccatgtcctggaattaaggt

SEQ ID NO: 14920 - DNA, 20 bp, Artificial Sequence
  chemically synthesized
tgtcctggaattaaggtcag

SEQ ID NO: 14921 - DNA, 20 bp, Artificial Sequence
  chemically synthesized
gtcctggaattaaggtcagt

SEQ ID NO: 14922 - DNA, 20 bp, Artificial Sequence
  chemically synthesized
aggtcagtgggaaactacta

SEQ ID NO: 14923 - DNA, 20 bp, Artificial Sequence
  chemically synthesized
ggtcagtgggaaactactac

SEQ ID NO: 14924 - DNA, 20 bp, Artificial Sequence
  chemically synthesized
gaaactactacaggccattc

SEQ ID NO: 14925 - DNA, 20 bp, Artificial Sequence
  chemically synthesized
aaactactacaggccattcc

SEQ ID NO: 14926 - DNA, 20 bp, Artificial Sequence
  chemically synthesized
ctactacaggccattccagg

SEQ ID NO: 14927 - DNA, 20 bp, Artificial Sequence
  chemically synthesized
tactacaggccattccaggc

SEQ ID NO: 14928 - DNA, 20 bp, Artificial Sequence
  chemically synthesized
tccaggcaggactacaaata

SEQ ID NO: 14929 - DNA, 20 bp, Artificial Sequence
  chemically synthesized
ccaggcaggactacaaataa

SEQ ID NO: 14930 - DNA, 20 bp, Artificial Sequence
  chemically synthesized
caggactacaaataaaggtt

SEQ ID NO: 14931 - DNA, 20 bp, Artificial Sequence
  chemically synthesized
aggactacaaataaaggttt

SEQ ID NO: 14932 - DNA, 20 bp, Artificial Sequence
  chemically synthesized
aaaggtttgggtcactccac

SEQ ID NO: 14933 - DNA, 20 bp, Artificial Sequence
  chemically synthesized
aaggtttgggtcactccacc

SEQ ID NO: 14934 - DNA, 20 bp, Artificial Sequence
  chemically synthesized
caggaaaaaaaaaaaaaaaa

SEQ ID NO: 14935 - DNA, 20 bp, Artificial Sequence
  chemically synthesized
aaaaaaaaaaaaaaaaagac

SEQ ID NO: 14936 - DNA, 20 bp, Artificial Sequence
  chemically synthesized
aaaaaaagacaagacctgct

SEQ ID NO: 14937 - DNA, 20 bp, Artificial Sequence
  chemically synthesized
aaaaaagacaagacctgctg

SEQ ID NO: 14938 - DNA, 20 bp, Artificial Sequence
  chemically synthesized
gacctgctgaggtgcttgct

SEQ ID NO: 14939 - DNA, 20 bp, Artificial Sequence
  chemically synthesized
acctgctgaggtgcttgctg

SEQ ID NO: 14940 - DNA, 20 bp, Artificial Sequence
  chemically synthesized
cctgctgaggtgcttgctga

SEQ ID NO: 14941 - DNA, 20 bp, Artificial Sequence
  chemically synthesized
tgaggtgcttgctgagggca

SEQ ID NO: 14942 - DNA, 20 bp, Artificial Sequence
  chemically synthesized
gaggtgcttgctgagggcaa

SEQ ID NO: 14943 - DNA, 20 bp, Artificial Sequence
  chemically synthesized
aggtgcttgctgagggcaaa

SEQ ID NO: 14944 - DNA, 20 bp, Artificial Sequence
  chemically synthesized
tgctgagggcaaagggaata

SEQ ID NO: 14945 - DNA, 20 bp, Artificial Sequence
  chemically synthesized
caaagggaatacagaatatg

SEQ ID NO: 14946 - DNA, 20 bp, Artificial Sequence
  chemically synthesized
agggaatacagaatatgtag

SEQ ID NO: 14947 - DNA, 20 bp, Artificial Sequence
  chemically synthesized
gaatacagaatatgtagcag

SEQ ID NO: 14948 - DNA, 20 bp, Artificial Sequence
  chemically synthesized
tacagaatatgtagcagaag

SEQ ID NO: 14949 - DNA, 20 bp, Artificial Sequence
  chemically synthesized
acagaatatgtagcagaaga

SEQ ID NO: 14950 - DNA, 20 bp, Artificial Sequence
  chemically synthesized
gaatatgtagcagaagaagg

SEQ ID NO: 14951 - DNA, 20 bp, Artificial Sequence
  chemically synthesized
aagaaggtagtcatcaatac

SEQ ID NO: 14952 - DNA, 20 bp, Artificial Sequence
  chemically synthesized
tacgatcacgtgaccaattg

SEQ ID NO: 14953 - DNA, 20 bp, Artificial Sequence
  chemically synthesized
acgtgaccaattgcagatac

SEQ ID NO: 14954 - DNA, 20 bp, Artificial Sequence
  chemically synthesized
cgtgaccaattgcagataca

SEQ ID NO: 14955 - DNA, 20 bp, Artificial Sequence
  chemically synthesized
acaaggactgtaattgtcat

SEQ ID NO: 14956 - DNA, 20 bp, Artificial Sequence
  chemically synthesized
tgtctgtatacacttgtact

SEQ ID NO: 14957 - DNA, 20 bp, Artificial Sequence
  chemically synthesized
tttcctttatcatgtgacat

SEQ ID NO: 14958 - DNA, 20 bp, Artificial Sequence
  chemically synthesized
aagatttattgacttcatat

SEQ ID NO: 14959 - DNA, 20 bp, Artificial Sequence
  chemically synthesized
ttgacttcatatcagcattt

SEQ ID NO: 14960 - DNA, 20 bp, Artificial Sequence
  chemically synthesized
atcagcatttaagtattgtt

SEQ ID NO: 14961 - DNA, 20 bp, Artificial Sequence
  chemically synthesized
gtattgttaagtttatgtaa

SEQ ID NO: 14962 - DNA, 20 bp, Artificial Sequence
  chemically synthesized
ttatgtaatagcatttgcaa

SEQ ID NO: 14963 - DNA, 20 bp, Artificial Sequence
  chemically synthesized
tatgtaatagcatttgcaat

SEQ ID NO: 14964 - DNA, 20 bp, Artificial Sequence
  chemically synthesized
atgtaatagcatttgcaatg

SEQ ID NO: 14965 - DNA, 20 bp, Artificial Sequence
  chemically synthesized
atagcatttgcaatggggat

SEQ ID NO: 14966 - DNA, 20 bp, Artificial Sequence
  chemically synthesized
ggtgcattttcaattgcacg

SEQ ID NO: 14967 - DNA, 20 bp, Artificial Sequence
  chemically synthesized
gtgcattttcaattgcacga

SEQ ID NO: 14968 - DNA, 20 bp, Artificial Sequence
  chemically synthesized
attttcaattgcacgaagga

SEQ ID NO: 14969 - DNA, 20 bp, Artificial Sequence
  chemically synthesized
aattgcacgaaggatagttt

SEQ ID NO: 14970 - DNA, 20 bp, Artificial Sequence
  chemically synthesized
gaaggatagttttagtatgt

SEQ ID NO: 14971 - DNA, 20 bp, Artificial Sequence
  chemically synthesized
aaggatagttttagtatgtt

SEQ ID NO: 14972 - DNA, 20 bp, Artificial Sequence
  chemically synthesized
cttattgttgtctttatttg

SEQ ID NO: 14973 - DNA, 20 bp, Artificial Sequence
  chemically synthesized
ttgaagataatgtatgacct

SEQ ID NO: 14974 - DNA, 20 bp, Artificial Sequence
  chemically synthesized
tgaagataatgtatgacctc

SEQ ID NO: 14975 - DNA, 20 bp, Artificial Sequence
  chemically synthesized
gaagataatgtatgacctca

SEQ ID NO: 14976 - DNA, 20 bp, Artificial Sequence
  chemically synthesized
aagataatgtatgacctcag

SEQ ID NO: 14977 - DNA, 20 bp, Artificial Sequence
  chemically synthesized
atgacctcaggggatgtgta

SEQ ID NO: 14978 - DNA, 20 bp, Artificial Sequence
  chemically synthesized
tgacctcaggggatgtgtat

SEQ ID NO: 14979 - DNA, 20 bp, Artificial Sequence
  chemically synthesized
caggggatgtgtataggctc

SEQ ID NO: 14980 - DNA, 20 bp, Artificial Sequence
  chemically synthesized
gtgtataggctcaagttgac

SEQ ID NO: 14981 - DNA, 20 bp, Artificial Sequence
  chemically synthesized
aggctcaagttgacaagcga

SEQ ID NO: 14982 - DNA, 20 bp, Artificial Sequence
  chemically synthesized
gacaagcgatggacttgtga

SEQ ID NO: 14983 - DNA, 20 bp, Artificial Sequence
  chemically synthesized
gacttgtgatggttaatact

SEQ ID NO: 14984 - DNA, 20 bp, Artificial Sequence
  chemically synthesized
atactgagtgtcaacttgat

SEQ ID NO: 14985 - DNA, 20 bp, Artificial Sequence
  chemically synthesized
gtgtcaacttgattggattg

SEQ ID NO: 14986 - DNA, 20 bp, Artificial Sequence
  chemically synthesized
tgattggattgaagtgtgca

SEQ ID NO: 14987 - DNA, 20 bp, Artificial Sequence
  chemically synthesized
gtgtgcaaagtattgatcct

SEQ ID NO: 14988 - DNA, 20 bp, Artificial Sequence
  chemically synthesized
ttgatcctgagtgtgtctgt

SEQ ID NO: 14989 - DNA, 20 bp, Artificial Sequence
  chemically synthesized
tgatcctgagtgtgtctgtg

SEQ ID NO: 14990 - DNA, 20 bp, Artificial Sequence
  chemically synthesized
gatcctgagtgtgtctgtga

SEQ ID NO: 14991 - DNA, 20 bp, Artificial Sequence
  chemically synthesized
tgtctgtgagggtattgcca

SEQ ID NO: 14992 - DNA, 20 bp, Artificial Sequence
  chemically synthesized
gtctgtgagggtattgccaa

SEQ ID NO: 14993 - DNA, 20 bp, Artificial Sequence
  chemically synthesized
ctgtgagggtattgccaaag

SEQ ID NO: 14994 - DNA, 20 bp, Artificial Sequence
  chemically synthesized
gccaaaggagattaacattt

SEQ ID NO: 14995 - DNA, 20 bp, Artificial Sequence
  chemically synthesized
aaggagattaacattttagt

SEQ ID NO: 14996 - DNA, 20 bp, Artificial Sequence
  chemically synthesized
gagattaacattttagtcag

SEQ ID NO: 14997 - DNA, 20 bp, Artificial Sequence
  chemically synthesized
agattaacattttagtcagt

SEQ ID NO: 14998 - DNA, 20 bp, Artificial Sequence
  chemically synthesized
taacattttagtcagtgggc

SEQ ID NO: 14999 - DNA, 20 bp, Artificial Sequence
  chemically synthesized
aacattttagtcagtgggct

SEQ ID NO: 15000 - DNA, 20 bp, Artificial Sequence
  chemically synthesized
ttttagtcagtgggctggga

SEQ ID NO: 15001 - DNA, 20 bp, Artificial Sequence
  chemically synthesized
tttagtcagtgggctgggaa

SEQ ID NO: 15002 - DNA, 20 bp, Artificial Sequence
  chemically synthesized
agtcagtgggctgggaaagg

SEQ ID NO: 15003 - DNA, 20 bp, Artificial Sequence
  chemically synthesized
aggcagacccacccttaatc

SEQ ID NO: 15004 - DNA, 20 bp, Artificial Sequence
  chemically synthesized
ggcagacccacccttaatct

SEQ ID NO: 15005 - DNA, 20 bp, Artificial Sequence
  chemically synthesized
agacccacccttaatctggg

SEQ ID NO: 15006 - DNA, 20 bp, Artificial Sequence
  chemically synthesized
gacccacccttaatctgggt

SEQ ID NO: 15007 - DNA, 20 bp, Artificial Sequence
  chemically synthesized
ctgggtgggcaccatctaat

SEQ ID NO: 15008 - DNA, 20 bp, Artificial Sequence
  chemically synthesized
ggcaccatctaatcagttgc

SEQ ID NO: 15009 - DNA, 20 bp, Artificial Sequence
  chemically synthesized
catctaatcagttgccagtg

SEQ ID NO: 15010 - DNA, 20 bp, Artificial Sequence
  chemically synthesized
taatcagttgccagtgtggc

SEQ ID NO: 15011 - DNA, 20 bp, Artificial Sequence
  chemically synthesized
aatcagttgccagtgtggcc

SEQ ID NO: 15012 - DNA, 20 bp, Artificial Sequence
  chemically synthesized
gccagtgtggccaggatata

SEQ ID NO: 15013 - DNA, 20 bp, Artificial Sequence
  chemically synthesized
agtgtggccaggatataaag

SEQ ID NO: 15014 - DNA, 20 bp, Artificial Sequence
  chemically synthesized
gtgtggccaggatataaagc

SEQ ID NO: 15015 - DNA, 20 bp, Artificial Sequence
  chemically synthesized
tggccaggatataaagcagg

SEQ ID NO: 15016 - DNA, 20 bp, Artificial Sequence
  chemically synthesized
aaaaaaacatgtgaaaatcc

SEQ ID NO: 15017 - DNA, 20 bp, Artificial Sequence
  chemically synthesized
aacatgtgaaaatcctggac

SEQ ID NO: 15018 - DNA, 20 bp, Artificial Sequence
  chemically synthesized
gtgaaaatcctggactggct

SEQ ID NO: 15019 - DNA, 20 bp, Artificial Sequence
  chemically synthesized
cctggactggcttagcctcc

SEQ ID NO: 15020 - DNA, 20 bp, Artificial Sequence
  chemically synthesized
cctacatctttctcccatgc

SEQ ID NO: 15021 - DNA, 20 bp, Artificial Sequence
  chemically synthesized
tgcttcctgccctcaaacat

SEQ ID NO: 15022 - DNA, 20 bp, Artificial Sequence
  chemically synthesized
gccctcaaacattggactcc

SEQ ID NO: 15023 - DNA, 20 bp, Artificial Sequence
  chemically synthesized
acattggactccaagtcctt

SEQ ID NO: 15024 - DNA, 20 bp, Artificial Sequence
  chemically synthesized
gactccaagtccttcagctt

SEQ ID NO: 15025 - DNA, 20 bp, Artificial Sequence
  chemically synthesized
actccaagtccttcagcttt

SEQ ID NO: 15026 - DNA, 20 bp, Artificial Sequence
  chemically synthesized
agtccttcagctttgggact

SEQ ID NO: 15027 - DNA, 20 bp, Artificial Sequence
  chemically synthesized
ttcagctttgggacttggac

SEQ ID NO: 15028 - DNA, 20 bp, Artificial Sequence
  chemically synthesized
cttccttgctcctctgcttg

SEQ ID NO: 15029 - DNA, 20 bp, Artificial Sequence
  chemically synthesized
cttgctcctctgcttgcaga

SEQ ID NO: 15030 - DNA, 20 bp, Artificial Sequence
  chemically synthesized
tgcttgcagatggcctattg

SEQ ID NO: 15031 - DNA, 20 bp, Artificial Sequence
  chemically synthesized
gcttgcagatggcctattgt

SEQ ID NO: 15032 - DNA, 20 bp, Artificial Sequence
  chemically synthesized
gtgggaccttgtgattgtgt

SEQ ID NO: 15033 - DNA, 20 bp, Artificial Sequence
  chemically synthesized
tctatctatctatctcctat

SEQ ID NO: 15034 - DNA, 20 bp, Artificial Sequence
  chemically synthesized
tcctattagttctgtctctc

SEQ ID NO: 15035 - DNA, 20 bp, Artificial Sequence
  chemically synthesized
cctattagttctgtctctct

SEQ ID NO: 15036 - DNA, 20 bp, Artificial Sequence
  chemically synthesized
ctattagttctgtctctcta

SEQ ID NO: 15037 - DNA, 20 bp, Artificial Sequence
  chemically synthesized
ctagggaaccctgacaaata

SEQ ID NO: 15038 - DNA, 20 bp, Artificial Sequence
  chemically synthesized
ggaaccctgacaaatacagt

SEQ ID NO: 15039 - DNA, 20 bp, Artificial Sequence
  chemically synthesized
cctgacaaatacagtgagct

SEQ ID NO: 15040 - DNA, 20 bp, Artificial Sequence
  chemically synthesized
ctgacaaatacagtgagctc

SEQ ID NO: 15041 - DNA, 20 bp, Artificial Sequence
  chemically synthesized
atacagtgagctcaggtcct

SEQ ID NO: 15042 - DNA, 20 bp, Artificial Sequence
  chemically synthesized
cagtgagctcaggtcctgag

SEQ ID NO: 15043 - DNA, 20 bp, Artificial Sequence
  chemically synthesized
cctgagcagacattttccaa

SEQ ID NO: 15044 - DNA, 20 bp, Artificial Sequence
  chemically synthesized
gagcagacattttccaaaag

SEQ ID NO: 15045 - DNA, 20 bp, Artificial Sequence
  chemically synthesized
ttttccaaaagaagacatac

SEQ ID NO: 15046 - DNA, 20 bp, Artificial Sequence
  chemically synthesized
tccaaaagaagacatacaag

SEQ ID NO: 15047 - DNA, 20 bp, Artificial Sequence
  chemically synthesized
ggccaataaacgtcaaaaaa

SEQ ID NO: 15048 - DNA, 20 bp, Artificial Sequence
  chemically synthesized
agttcaacatcactaataat

SEQ ID NO: 15049 - DNA, 20 bp, Artificial Sequence
  chemically synthesized
ttcaacatcactaataatca

SEQ ID NO: 15050 - DNA, 20 bp, Artificial Sequence
  chemically synthesized
catatgatacctccttatgc

SEQ ID NO: 15051 - DNA, 20 bp, Artificial Sequence
  chemically synthesized
tgatacctccttatgccagt

SEQ ID NO: 15052 - DNA, 20 bp, Artificial Sequence
  chemically synthesized
cctccttatgccagtcagaa

SEQ ID NO: 15053 - DNA, 20 bp, Artificial Sequence
  chemically synthesized
tcagaatggctatcattata

SEQ ID NO: 15054 - DNA, 20 bp, Artificial Sequence
  chemically synthesized
atcattataaagttcaaaaa

SEQ ID NO: 15055 - DNA, 20 bp, Artificial Sequence
  chemically synthesized
attataaagttcaaaaacag

SEQ ID NO: 15056 - DNA, 20 bp, Artificial Sequence
  chemically synthesized
agttcaaaaacagcagatgt

SEQ ID NO: 15057 - DNA, 20 bp, Artificial Sequence
  chemically synthesized
caaaaacagcagatgttggt

SEQ ID NO: 15058 - DNA, 20 bp, Artificial Sequence
  chemically synthesized
aaaaacagcagatgttggtg

SEQ ID NO: 15059 - DNA, 20 bp, Artificial Sequence
  chemically synthesized
agcagatgttggtgaggatg

SEQ ID NO: 15060 - DNA, 20 bp, Artificial Sequence
  chemically synthesized
cagatgttggtgaggatgtg

SEQ ID NO: 15061 - DNA, 20 bp, Artificial Sequence
  chemically synthesized
gttggtgaggatgtggagac

SEQ ID NO: 15062 - DNA, 20 bp, Artificial Sequence
  chemically synthesized
agaaaatgcttatacactgt

SEQ ID NO: 15063 - DNA, 20 bp, Artificial Sequence
  chemically synthesized
aatgcttatacactgttggt

SEQ ID NO: 15064 - DNA, 20 bp, Artificial Sequence
  chemically synthesized
ctgttggtaagaatgtaaat

SEQ ID NO: 15065 - DNA, 20 bp, Artificial Sequence
  chemically synthesized
gtaaattagtacaaacttta

SEQ ID NO: 15066 - DNA, 20 bp, Artificial Sequence
  chemically synthesized
aattagtacaaactttatgg

SEQ ID NO: 15067 - DNA, 20 bp, Artificial Sequence
  chemically synthesized
agtacaaactttatggaaga

SEQ ID NO: 15068 - DNA, 20 bp, Artificial Sequence
  chemically synthesized
actttatggaagacagcatg

SEQ ID NO: 15069 - DNA, 20 bp, Artificial Sequence
  chemically synthesized
gacagcatgaagatttctta

SEQ ID NO: 15070 - DNA, 20 bp, Artificial Sequence
  chemically synthesized
atgaagatttcttaaagaac

SEQ ID NO: 15071 - DNA, 20 bp, Artificial Sequence
  chemically synthesized
atttcttaaagaactagaaa

SEQ ID NO: 15072 - DNA, 20 bp, Artificial Sequence
  chemically synthesized
caatcctgcaatcccactac

SEQ ID NO: 15073 - DNA, 20 bp, Artificial Sequence
  chemically synthesized
aatcctgcaatcccactact

SEQ ID NO: 15074 - DNA, 20 bp, Artificial Sequence
  chemically synthesized
tgcaatcccactactgggta

SEQ ID NO: 15075 - DNA, 20 bp, Artificial Sequence
  chemically synthesized
cactactgggtatggaccca

SEQ ID NO: 15076 - DNA, 20 bp, Artificial Sequence
  chemically synthesized
tgggtatggacccaaagtga

SEQ ID NO: 15077 - DNA, 20 bp, Artificial Sequence
  chemically synthesized
ggtatggacccaaagtgaaa

SEQ ID NO: 15078 - DNA, 20 bp, Artificial Sequence
  chemically synthesized
tgaaagagatcatattaaaa

SEQ ID NO: 15079 - DNA, 20 bp, Artificial Sequence
  chemically synthesized
attaaaaaagatatctgcat

SEQ ID NO: 15080 - DNA, 20 bp, Artificial Sequence
  chemically synthesized
tatctgcattagtatgttca

SEQ ID NO: 15081 - DNA, 20 bp, Artificial Sequence
  chemically synthesized
ctgcattagtatgttcaaag

SEQ ID NO: 15082 - DNA, 20 bp, Artificial Sequence
  chemically synthesized
caaagtagcactgttcccaa

SEQ ID NO: 15083 - DNA, 20 bp, Artificial Sequence
  chemically synthesized
tagcactgttcccaatagca

SEQ ID NO: 15084 - DNA, 20 bp, Artificial Sequence
  chemically synthesized
tgttcccaatagcaaagata

SEQ ID NO: 15085 - DNA, 20 bp, Artificial Sequence
  chemically synthesized
tcaacctaaatgtctaccaa

SEQ ID NO: 15086 - DNA, 20 bp, Artificial Sequence
  chemically synthesized
aatgtctaccaatggacgat

SEQ ID NO: 15087 - DNA, 20 bp, Artificial Sequence
  chemically synthesized
taccaatggacgattggata

SEQ ID NO: 15088 - DNA, 20 bp, Artificial Sequence
  chemically synthesized
acgattggataaagaaaatg

SEQ ID NO: 15089 - DNA, 20 bp, Artificial Sequence
  chemically synthesized
ttatatacatatatattact

SEQ ID NO: 15090 - DNA, 20 bp, Artificial Sequence
  chemically synthesized
tatattactcagccataaaa

SEQ ID NO: 15091 - DNA, 20 bp, Artificial Sequence
  chemically synthesized
gaatgaaatcatgtcttctc

SEQ ID NO: 15092 - DNA, 20 bp, Artificial Sequence
  chemically synthesized
tcatgtcttctctagaaaca

SEQ ID NO: 15093 - DNA, 20 bp, Artificial Sequence
  chemically synthesized
gtcttctctagaaacatggt

SEQ ID NO: 15094 - DNA, 20 bp, Artificial Sequence
  chemically synthesized
tctagaaacatggttagaac

SEQ ID NO: 15095 - DNA, 20 bp, Artificial Sequence
  chemically synthesized
tagaaacatggttagaactg

SEQ ID NO: 15096 - DNA, 20 bp, Artificial Sequence
  chemically synthesized
agaaacatggttagaactgg

SEQ ID NO: 15097 - DNA, 20 bp, Artificial Sequence
  chemically synthesized
gaactggaggacattatcct

SEQ ID NO: 15098 - DNA, 20 bp, Artificial Sequence
  chemically synthesized
ttatcctcagtgaaataact

SEQ ID NO: 15099 - DNA, 20 bp, Artificial Sequence
  chemically synthesized
tcagtgaaataactcagaaa

SEQ ID NO: 15100 - DNA, 20 bp, Artificial Sequence
  chemically synthesized
tgaaataactcagaaacaga

SEQ ID NO: 15101 - DNA, 20 bp, Artificial Sequence
  chemically synthesized
cagaaacagaaagtcaaaca

SEQ ID NO: 15102 - DNA, 20 bp, Artificial Sequence
  chemically synthesized
aaacacagtatgttctcatt

SEQ ID NO: 15103 - DNA, 20 bp, Artificial Sequence
  chemically synthesized
acagtatgttctcatttagt

SEQ ID NO: 15104 - DNA, 20 bp, Artificial Sequence
  chemically synthesized
agtatgttctcatttagtga

SEQ ID NO: 15105 - DNA, 20 bp, Artificial Sequence
  chemically synthesized
gttctcatttagtgagagcc

SEQ ID NO: 15106 - DNA, 20 bp, Artificial Sequence
  chemically synthesized
ctcatttagtgagagccaag

SEQ ID NO: 15107 - DNA, 20 bp, Artificial Sequence
  chemically synthesized
tcatttagtgagagccaagt

SEQ ID NO: 15108 - DNA, 20 bp, Artificial Sequence
  chemically synthesized
atttagtgagagccaagtgg

SEQ ID NO: 15109 - DNA, 20 bp, Artificial Sequence
  chemically synthesized
ccaagtgggagctaaacgat

SEQ ID NO: 15110 - DNA, 20 bp, Artificial Sequence
  chemically synthesized
gtgggagctaaacgatgagt

SEQ ID NO: 15111 - DNA, 20 bp, Artificial Sequence
  chemically synthesized
agctaaacgatgagtaagca

SEQ ID NO: 15112 - DNA, 20 bp, Artificial Sequence
  chemically synthesized
gatgagtaagcatagacata

SEQ ID NO: 15113 - DNA, 20 bp, Artificial Sequence
  chemically synthesized
agacatatagaatgaaataa

SEQ ID NO: 15114 - DNA, 20 bp, Artificial Sequence
  chemically synthesized
gaatgaaataatagacactt

SEQ ID NO: 15115 - DNA, 20 bp, Artificial Sequence
  chemically synthesized
aaataatagacacttgagac

SEQ ID NO: 15116 - DNA, 20 bp, Artificial Sequence
  chemically synthesized
ataatagacacttgagacta

SEQ ID NO: 15117 - DNA, 20 bp, Artificial Sequence
  chemically synthesized
tagacacttgagactagaga

SEQ ID NO: 15118 - DNA, 20 bp, Artificial Sequence
  chemically synthesized
agacacttgagactagagaa

SEQ ID NO: 15119 - DNA, 20 bp, Artificial Sequence
  chemically synthesized
cacttgagactagagaaagg

SEQ ID NO: 15120 - DNA, 20 bp, Artificial Sequence
  chemically synthesized
acttgagactagagaaaggt

SEQ ID NO: 15121 - DNA, 20 bp, Artificial Sequence
  chemically synthesized
ttgagactagagaaaggtgg

SEQ ID NO: 15122 - DNA, 20 bp, Artificial Sequence
  chemically synthesized
tgagactagagaaaggtggg

SEQ ID NO: 15123 - DNA, 20 bp, Artificial Sequence
  chemically synthesized
actagagaaaggtgggagga

SEQ ID NO: 15124 - DNA, 20 bp, Artificial Sequence
  chemically synthesized
ctagagaaaggtgggaggat

SEQ ID NO: 15125 - DNA, 20 bp, Artificial Sequence
  chemically synthesized
agagaaaggtgggaggatag

SEQ ID NO: 15126 - DNA, 20 bp, Artificial Sequence
  chemically synthesized
aaggtgggaggataggagta

SEQ ID NO: 15127 - DNA, 20 bp, Artificial Sequence
  chemically synthesized
tgggaggataggagtatggt

SEQ ID NO: 15128 - DNA, 20 bp, Artificial Sequence
  chemically synthesized
gggaggataggagtatggtg

SEQ ID NO: 15129 - DNA, 20 bp, Artificial Sequence
  chemically synthesized
tggtgaggactgaaaaacta

SEQ ID NO: 15130 - DNA, 20 bp, Artificial Sequence
  chemically synthesized
aggactgaaaaactacggat

SEQ ID NO: 15131 - DNA, 20 bp, Artificial Sequence
  chemically synthesized
tggatacaacattcactttt

SEQ ID NO: 15132 - DNA, 20 bp, Artificial Sequence
  chemically synthesized
ggatacaacattcacttttc

SEQ ID NO: 15133 - DNA, 20 bp, Artificial Sequence
  chemically synthesized
aacattcacttttcaggtga

SEQ ID NO: 15134 - DNA, 20 bp, Artificial Sequence
  chemically synthesized
ttcaggtgatggtccactaa

SEQ ID NO: 15135 - DNA, 20 bp, Artificial Sequence
  chemically synthesized
gtgatggtccactaaaagct

SEQ ID NO: 15136 - DNA, 20 bp, Artificial Sequence
  chemically synthesized
actatgcaacatacatatgt

SEQ ID NO: 15137 - DNA, 20 bp, Artificial Sequence
  chemically synthesized
ctatgcaacatacatatgta

SEQ ID NO: 15138 - DNA, 20 bp, Artificial Sequence
  chemically synthesized
catacatatgtaaggaaccc

SEQ ID NO: 15139 - DNA, 20 bp, Artificial Sequence
  chemically synthesized
cccgagcttgtaccctgata

SEQ ID NO: 15140 - DNA, 20 bp, Artificial Sequence
  chemically synthesized
ccaaatctcatcttgaattg

SEQ ID NO: 15141 - DNA, 20 bp, Artificial Sequence
  chemically synthesized
cccataatcctcacgtgttg

SEQ ID NO: 15142 - DNA, 20 bp, Artificial Sequence
  chemically synthesized
ccataatcctcacgtgttgt

SEQ ID NO: 15143 - DNA, 20 bp, Artificial Sequence
  chemically synthesized
ataatcctcacgtgttgtgg

SEQ ID NO: 15144 - DNA, 20 bp, Artificial Sequence
  chemically synthesized
taatcctcacgtgttgtggg

SEQ ID NO: 15145 - DNA, 20 bp, Artificial Sequence
  chemically synthesized
aatcctcacgtgttgtggga

SEQ ID NO: 15146 - DNA, 20 bp, Artificial Sequence
  chemically synthesized
cacgtgttgtgggagggatt

SEQ ID NO: 15147 - DNA, 20 bp, Artificial Sequence
  chemically synthesized
cgtgttgtgggagggatttg

SEQ ID NO: 15148 - DNA, 20 bp, Artificial Sequence
  chemically synthesized
gtgttgtgggagggatttgg

SEQ ID NO: 15149 - DNA, 20 bp, Artificial Sequence
  chemically synthesized
tgttgtgggagggatttgga

SEQ ID NO: 15150 - DNA, 20 bp, Artificial Sequence
  chemically synthesized
ttgtgggagggatttggagg

SEQ ID NO: 15151 - DNA, 20 bp, Artificial Sequence
  chemically synthesized
tgtgggagggatttggaggg

SEQ ID NO: 15152 - DNA, 20 bp, Artificial Sequence
  chemically synthesized
ggagggaggtaattgaatca

SEQ ID NO: 15153 - DNA, 20 bp, Artificial Sequence
  chemically synthesized
agggaggtaattgaatcata

SEQ ID NO: 15154 - DNA, 20 bp, Artificial Sequence
  chemically synthesized
gggaggtaattgaatcatag

SEQ ID NO: 15155 - DNA, 20 bp, Artificial Sequence
  chemically synthesized
gaggtaattgaatcatagag

SEQ ID NO: 15156 - DNA, 20 bp, Artificial Sequence
  chemically synthesized
aggtaattgaatcatagagg

SEQ ID NO: 15157 - DNA, 20 bp, Artificial Sequence
  chemically synthesized
ctctcatgctcttctcgtga

SEQ ID NO: 15158 - DNA, 20 bp, Artificial Sequence
  chemically synthesized
catgctcttctcgtgatagt

SEQ ID NO: 15159 - DNA, 20 bp, Artificial Sequence
  chemically synthesized
tcgtgatagtgagttcttac

SEQ ID NO: 15160 - DNA, 20 bp, Artificial Sequence
  chemically synthesized
tgagttcttacaagatctga

SEQ ID NO: 15161 - DNA, 20 bp, Artificial Sequence
  chemically synthesized
acaagatctgatggttttat

SEQ ID NO: 15162 - DNA, 20 bp, Artificial Sequence
  chemically synthesized
agatctgatggttttataag

SEQ ID NO: 15163 - DNA, 20 bp, Artificial Sequence
  chemically synthesized
cggcttttcccccttttgct

SEQ ID NO: 15164 - DNA, 20 bp, Artificial Sequence
  chemically synthesized
ctacttgctgctgccatgtg

SEQ ID NO: 15165 - DNA, 20 bp, Artificial Sequence
  chemically synthesized
cttgctgctgccatgtgaag

SEQ ID NO: 15166 - DNA, 20 bp, Artificial Sequence
  chemically synthesized
ttgctgctgccatgtgaaga

SEQ ID NO: 15167 - DNA, 20 bp, Artificial Sequence
  chemically synthesized
tcttcttctgccatgattgt

SEQ ID NO: 15168 - DNA, 20 bp, Artificial Sequence
  chemically synthesized
gccatgattgtaagtttccc

SEQ ID NO: 15169 - DNA, 20 bp, Artificial Sequence
  chemically synthesized
ccatgattgtaagtttcccg

SEQ ID NO: 15170 - DNA, 20 bp, Artificial Sequence
  chemically synthesized
taagtttcccgaggcctccc

SEQ ID NO: 15171 - DNA, 20 bp, Artificial Sequence
  chemically synthesized
ccgaggcctccccagccctg

SEQ ID NO: 15172 - DNA, 20 bp, Artificial Sequence
  chemically synthesized
ccccagccctgtggaactgt

SEQ ID NO: 15173 - DNA, 20 bp, Artificial Sequence
  chemically synthesized
ttttttccttataaattacc

SEQ ID NO: 15174 - DNA, 20 bp, Artificial Sequence
  chemically synthesized
ccttataaattacccagtct

SEQ ID NO: 15175 - DNA, 20 bp, Artificial Sequence
  chemically synthesized
cttataaattacccagtctc

SEQ ID NO: 15176 - DNA, 20 bp, Artificial Sequence
  chemically synthesized
agtctcaggtatgtctttat

SEQ ID NO: 15177 - DNA, 20 bp, Artificial Sequence
  chemically synthesized
ctcaggtatgtctttataag

SEQ ID NO: 15178 - DNA, 20 bp, Artificial Sequence
  chemically synthesized
taagcagcatgataacgaac

SEQ ID NO: 15179 - DNA, 20 bp, Artificial Sequence
  chemically synthesized
tttaaaaatataaaataaat

SEQ ID NO: 15180 - DNA, 20 bp, Artificial Sequence
  chemically synthesized
ataaattagatctgattgaa

SEQ ID NO: 15181 - DNA, 20 bp, Artificial Sequence
  chemically synthesized
taaattagatctgattgaaa

SEQ ID NO: 15182 - DNA, 20 bp, Artificial Sequence
  chemically synthesized
tgattgaaaaggcaaaaatt

SEQ ID NO: 15183 - DNA, 20 bp, Artificial Sequence
  chemically synthesized
tgaaaaggcaaaaattgagc

SEQ ID NO: 15184 - DNA, 20 bp, Artificial Sequence
  chemically synthesized
gcaagcaaaatatcacttaa

SEQ ID NO: 15185 - DNA, 20 bp, Artificial Sequence
  chemically synthesized
caagcaaaatatcacttaat

SEQ ID NO: 15186 - DNA, 20 bp, Artificial Sequence
  chemically synthesized
aagcaaaatatcacttaatg

SEQ ID NO: 15187 - DNA, 20 bp, Artificial Sequence
  chemically synthesized
tcacttaatggggtaattaa

SEQ ID NO: 15188 - DNA, 20 bp, Artificial Sequence
  chemically synthesized
cacttaatggggtaattaaa

SEQ ID NO: 15189 - DNA, 20 bp, Artificial Sequence
  chemically synthesized
acttaatggggtaattaaaa

SEQ ID NO: 15190 - DNA, 20 bp, Artificial Sequence
  chemically synthesized
atggggtaattaaaagggtg

SEQ ID NO: 15191 - DNA, 20 bp, Artificial Sequence
  chemically synthesized
aattaaaagggtgaagaaat

SEQ ID NO: 15192 - DNA, 20 bp, Artificial Sequence
  chemically synthesized
attaaaagggtgaagaaatt

SEQ ID NO: 15193 - DNA, 20 bp, Artificial Sequence
  chemically synthesized
gggtgaagaaattgggcaaa

SEQ ID NO: 15194 - DNA, 20 bp, Artificial Sequence
  chemically synthesized
attgggcaaatggatgtcat

SEQ ID NO: 15195 - DNA, 20 bp, Artificial Sequence
  chemically synthesized
ttgggcaaatggatgtcatg

SEQ ID NO: 15196 - DNA, 20 bp, Artificial Sequence
  chemically synthesized
gggcaaatggatgtcatgag

SEQ ID NO: 15197 - DNA, 20 bp, Artificial Sequence
  chemically synthesized
ggcaaatggatgtcatgagg

SEQ ID NO: 15198 - DNA, 20 bp, Artificial Sequence
  chemically synthesized
atgtcatgaggaggaatttt

SEQ ID NO: 15199 - DNA, 20 bp, Artificial Sequence
  chemically synthesized
tgtcatgaggaggaattttt

SEQ ID NO: 15200 - DNA, 20 bp, Artificial Sequence
  chemically synthesized
catgaggaggaatttttagg

SEQ ID NO: 15201 - DNA, 20 bp, Artificial Sequence
  chemically synthesized
tgaggaggaatttttaggca

SEQ ID NO: 15202 - DNA, 20 bp, Artificial Sequence
  chemically synthesized
gaggaggaatttttaggcag

SEQ ID NO: 15203 - DNA, 20 bp, Artificial Sequence
  chemically synthesized
gaatttttaggcagaggtaa

SEQ ID NO: 15204 - DNA, 20 bp, Artificial Sequence
  chemically synthesized
ttttaggcagaggtaatggt

SEQ ID NO: 15205 - DNA, 20 bp, Artificial Sequence
  chemically synthesized
ttaggcagaggtaatggtca

SEQ ID NO: 15206 - DNA, 20 bp, Artificial Sequence
  chemically synthesized
cagaggtaatggtcagagcc

SEQ ID NO: 15207 - DNA, 20 bp, Artificial Sequence
  chemically synthesized
agaggtaatggtcagagccc

SEQ ID NO: 15208 - DNA, 20 bp, Artificial Sequence
  chemically synthesized
atggtcagagcccaggccct

SEQ ID NO: 15209 - DNA, 20 bp, Artificial Sequence
  chemically synthesized
tcagagcccaggccctaagc

SEQ ID NO: 15210 - DNA, 20 bp, Artificial Sequence
  chemically synthesized
agagcccaggccctaagctg

SEQ ID NO: 15211 - DNA, 20 bp, Artificial Sequence
  chemically synthesized
gcccaggccctaagctggag

SEQ ID NO: 15212 - DNA, 20 bp, Artificial Sequence
  chemically synthesized
ccaggccctaagctggagta

SEQ ID NO: 15213 - DNA, 20 bp, Artificial Sequence
  chemically synthesized
taagctggagtagagtgtgc

SEQ ID NO: 15214 - DNA, 20 bp, Artificial Sequence
  chemically synthesized
aagctggagtagagtgtgca

SEQ ID NO: 15215 - DNA, 20 bp, Artificial Sequence
  chemically synthesized
tggagtagagtgtgcaagga

SEQ ID NO: 15216 - DNA, 20 bp, Artificial Sequence
  chemically synthesized
gagtagagtgtgcaaggaaa

SEQ ID NO: 15217 - DNA, 20 bp, Artificial Sequence
  chemically synthesized
agtgtgcaaggaaagagtaa

SEQ ID NO: 15218 - DNA, 20 bp, Artificial Sequence
  chemically synthesized
gtgtgcaaggaaagagtaat

SEQ ID NO: 15219 - DNA, 20 bp, Artificial Sequence
  chemically synthesized
gaaagagtaataggattgaa

SEQ ID NO: 15220 - DNA, 20 bp, Artificial Sequence
  chemically synthesized
aaagagtaataggattgaaa

SEQ ID NO: 15221 - DNA, 20 bp, Artificial Sequence
  chemically synthesized
ataggattgaaaaggataac

SEQ ID NO: 15222 - DNA, 20 bp, Artificial Sequence
  chemically synthesized
taggattgaaaaggataacc

SEQ ID NO: 15223 - DNA, 20 bp, Artificial Sequence
  chemically synthesized
gattgaaaaggataaccagg

SEQ ID NO: 15224 - DNA, 20 bp, Artificial Sequence
  chemically synthesized
attgaaaaggataaccaggt

SEQ ID NO: 15225 - DNA, 20 bp, Artificial Sequence
  chemically synthesized
tgaaaaggataaccaggtag

SEQ ID NO: 15226 - DNA, 20 bp, Artificial Sequence
  chemically synthesized
gaaaaggataaccaggtagg

SEQ ID NO: 15227 - DNA, 20 bp, Artificial Sequence
  chemically synthesized
gataaccaggtaggaggaca

SEQ ID NO: 15228 - DNA, 20 bp, Artificial Sequence
  chemically synthesized
ataaccaggtaggaggacat

SEQ ID NO: 15229 - DNA, 20 bp, Artificial Sequence
  chemically synthesized
taaccaggtaggaggacata

SEQ ID NO: 15230 - DNA, 20 bp, Artificial Sequence
  chemically synthesized
accaggtaggaggacatagg

SEQ ID NO: 15231 - DNA, 20 bp, Artificial Sequence
  chemically synthesized
ccaggtaggaggacataggg

SEQ ID NO: 15232 - DNA, 20 bp, Artificial Sequence
  chemically synthesized
caggtaggaggacataggga

SEQ ID NO: 15233 - DNA, 20 bp, Artificial Sequence
  chemically synthesized
aggtaggaggacatagggag

SEQ ID NO: 15234 - DNA, 20 bp, Artificial Sequence
  chemically synthesized
aggaggacatagggaggggt

SEQ ID NO: 15235 - DNA, 20 bp, Artificial Sequence
  chemically synthesized
ggaggacatagggaggggta

SEQ ID NO: 15236 - DNA, 20 bp, Artificial Sequence
  chemically synthesized
gaggacatagggaggggtaa

SEQ ID NO: 15237 - DNA, 20 bp, Artificial Sequence
  chemically synthesized
aggacatagggaggggtaag

SEQ ID NO: 15238 - DNA, 20 bp, Artificial Sequence
  chemically synthesized
gacatagggaggggtaaggg

SEQ ID NO: 15239 - DNA, 20 bp, Artificial Sequence
  chemically synthesized
acatagggaggggtaagggg

SEQ ID NO: 15240 - DNA, 20 bp, Artificial Sequence
  chemically synthesized
tagggaggggtaaggggagg

SEQ ID NO: 15241 - DNA, 20 bp, Artificial Sequence
  chemically synthesized
ggtaaggggaggaagacctc

SEQ ID NO: 15242 - DNA, 20 bp, Artificial Sequence
  chemically synthesized
aggaagacctccagtaaact

SEQ ID NO: 15243 - DNA, 20 bp, Artificial Sequence
  chemically synthesized
ggaagacctccagtaaactt

SEQ ID NO: 15244 - DNA, 20 bp, Artificial Sequence
  chemically synthesized
agacctccagtaaacttagg

SEQ ID NO: 15245 - DNA, 20 bp, Artificial Sequence
  chemically synthesized
gacctccagtaaacttaggc

SEQ ID NO: 15246 - DNA, 20 bp, Artificial Sequence
  chemically synthesized
aggcaggatatttcccgtga

SEQ ID NO: 15247 - DNA, 20 bp, Artificial Sequence
  chemically synthesized
actaaataataatcacatgt

SEQ ID NO: 15248 - DNA, 20 bp, Artificial Sequence
  chemically synthesized
aaataatctgtcgattactt

SEQ ID NO: 15249 - DNA, 20 bp, Artificial Sequence
  chemically synthesized
ttgagcaatactttgttcat

SEQ ID NO: 15250 - DNA, 20 bp, Artificial Sequence
  chemically synthesized
gcaatactttgttcatgagc

SEQ ID NO: 15251 - DNA, 20 bp, Artificial Sequence
  chemically synthesized
aatactttgttcatgagcta

SEQ ID NO: 15252 - DNA, 20 bp, Artificial Sequence
  chemically synthesized
ctttgttcatgagctagagc

SEQ ID NO: 15253 - DNA, 20 bp, Artificial Sequence
  chemically synthesized
tttgttcatgagctagagca

SEQ ID NO: 15254 - DNA, 20 bp, Artificial Sequence
  chemically synthesized
ttgttcatgagctagagcaa

SEQ ID NO: 15255 - DNA, 20 bp, Artificial Sequence
  chemically synthesized
tgttcatgagctagagcaag

SEQ ID NO: 15256 - DNA, 20 bp, Artificial Sequence
  chemically synthesized
ctagagcaaggggatgactc

SEQ ID NO: 15257 - DNA, 20 bp, Artificial Sequence
  chemically synthesized
agaaatcctttgtgaaatcc

SEQ ID NO: 15258 - DNA, 20 bp, Artificial Sequence
  chemically synthesized
aaatcctttgtgaaatcctg

SEQ ID NO: 15259 - DNA, 20 bp, Artificial Sequence
  chemically synthesized
aatcctttgtgaaatcctgg

SEQ ID NO: 15260 - DNA, 20 bp, Artificial Sequence
  chemically synthesized
tgtgaaatcctggaggtaat

SEQ ID NO: 15261 - DNA, 20 bp, Artificial Sequence
  chemically synthesized
tcctggaggtaataagatcc

SEQ ID NO: 15262 - DNA, 20 bp, Artificial Sequence
  chemically synthesized
atcttcaactcaattgcaaa

SEQ ID NO: 15263 - DNA, 20 bp, Artificial Sequence
  chemically synthesized
caaaacatattccatttcat

SEQ ID NO: 15264 - DNA, 20 bp, Artificial Sequence
  chemically synthesized
tattccatttcatcagacta

SEQ ID NO: 15265 - DNA, 20 bp, Artificial Sequence
  chemically synthesized
attccatttcatcagactac

SEQ ID NO: 15266 - DNA, 20 bp, Artificial Sequence
  chemically synthesized
catcagactacaggttttaa

SEQ ID NO: 15267 - DNA, 20 bp, Artificial Sequence
  chemically synthesized
atttcttaaatgtattattc

SEQ ID NO: 15268 - DNA, 20 bp, Artificial Sequence
  chemically synthesized
ccagtaacttatactttaca

SEQ ID NO: 15269 - DNA, 20 bp, Artificial Sequence
  chemically synthesized
tacatagtaaatcttatcaa

SEQ ID NO: 15270 - DNA, 20 bp, Artificial Sequence
  chemically synthesized
ttatcaatagtcacaatcaa

SEQ ID NO: 15271 - DNA, 20 bp, Artificial Sequence
  chemically synthesized
agtcacaatcaatggtcaca

SEQ ID NO: 15272 - DNA, 20 bp, Artificial Sequence
  chemically synthesized
cacaatcaatggtcacaaag

SEQ ID NO: 15273 - DNA, 20 bp, Artificial Sequence
  chemically synthesized
tcacaaagtagaacttcatc

SEQ ID NO: 15274 - DNA, 20 bp, Artificial Sequence
  chemically synthesized
acaaagtagaacttcatctg

SEQ ID NO: 15275 - DNA, 20 bp, Artificial Sequence
  chemically synthesized
tcatctggagacattacttt

SEQ ID NO: 15276 - DNA, 20 bp, Artificial Sequence
  chemically synthesized
ggagacattacttttagcct

SEQ ID NO: 15277 - DNA, 20 bp, Artificial Sequence
  chemically synthesized
gccatgcaaaatatactttt

SEQ ID NO: 15278 - DNA, 20 bp, Artificial Sequence
  chemically synthesized
tttggaaaattgccctttga

SEQ ID NO: 15279 - DNA, 20 bp, Artificial Sequence
  chemically synthesized
ttggaaaattgccctttgaa

SEQ ID NO: 15280 - DNA, 20 bp, Artificial Sequence
  chemically synthesized
aaaattgccctttgaaaggc

SEQ ID NO: 15281 - DNA, 20 bp, Artificial Sequence
  chemically synthesized
ctttgaaaggcgagacacaa

SEQ ID NO: 15282 - DNA, 20 bp, Artificial Sequence
  chemically synthesized
tttgaaaggcgagacacaaa

SEQ ID NO: 15283 - DNA, 20 bp, Artificial Sequence
  chemically synthesized
caaatgttgatgctattata

SEQ ID NO: 15284 - DNA, 20 bp, Artificial Sequence
  chemically synthesized
atgctattatatggtaccaa

SEQ ID NO: 15285 - DNA, 20 bp, Artificial Sequence
  chemically synthesized
tgctattatatggtaccaat

SEQ ID NO: 15286 - DNA, 20 bp, Artificial Sequence
  chemically synthesized
ataggattcattaatttata

SEQ ID NO: 15287 - DNA, 20 bp, Artificial Sequence
  chemically synthesized
taggattcattaatttataa

SEQ ID NO: 15288 - DNA, 20 bp, Artificial Sequence
  chemically synthesized
ggattcattaatttataaag

SEQ ID NO: 15289 - DNA, 20 bp, Artificial Sequence
  chemically synthesized
ttcattaatttataaaggag

SEQ ID NO: 15290 - DNA, 20 bp, Artificial Sequence
  chemically synthesized
cattaatttataaaggagaa

SEQ ID NO: 15291 - DNA, 20 bp, Artificial Sequence
  chemically synthesized
ctaatgtaactccaaaatgc

SEQ ID NO: 15292 - DNA, 20 bp, Artificial Sequence
  chemically synthesized
aatgcaagcaattttcatat

SEQ ID NO: 15293 - DNA, 20 bp, Artificial Sequence
  chemically synthesized
attttcatatgagtctacac

SEQ ID NO: 15294 - DNA, 20 bp, Artificial Sequence
  chemically synthesized
tacacaagctaattgtcctt

SEQ ID NO: 15295 - DNA, 20 bp, Artificial Sequence
  chemically synthesized
tccttaagaatttcatcttt

SEQ ID NO: 15296 - DNA, 20 bp, Artificial Sequence
  chemically synthesized
ccttaagaatttcatcttta

SEQ ID NO: 15297 - DNA, 20 bp, Artificial Sequence
  chemically synthesized
agaatttcatctttaaggaa

SEQ ID NO: 15298 - DNA, 20 bp, Artificial Sequence
  chemically synthesized
aagttttttactgtatcaaa

SEQ ID NO: 15299 - DNA, 20 bp, Artificial Sequence
  chemically synthesized
ttttttactgtatcaaaaag

SEQ ID NO: 15300 - DNA, 20 bp, Artificial Sequence
  chemically synthesized
aagaagtttaaactgtcatt

SEQ ID NO: 15301 - DNA, 20 bp, Artificial Sequence
  chemically synthesized
aagtttaaactgtcattgag

SEQ ID NO: 15302 - DNA, 20 bp, Artificial Sequence
  chemically synthesized
gtttaaactgtcattgagca

SEQ ID NO: 15303 - DNA, 20 bp, Artificial Sequence
  chemically synthesized
attgagcagagtctgataat

SEQ ID NO: 15304 - DNA, 20 bp, Artificial Sequence
  chemically synthesized
ttgagcagagtctgataata

SEQ ID NO: 15305 - DNA, 20 bp, Artificial Sequence
  chemically synthesized
ataaggacactgtcaaatca

SEQ ID NO: 15306 - DNA, 20 bp, Artificial Sequence
  chemically synthesized
gacactgtcaaatcacagtt

SEQ ID NO: 15307 - DNA, 20 bp, Artificial Sequence
  chemically synthesized
cagttcagatgttatgtgat

SEQ ID NO: 15308 - DNA, 20 bp, Artificial Sequence
  chemically synthesized
agttcagatgttatgtgatg

SEQ ID NO: 15309 - DNA, 20 bp, Artificial Sequence
  chemically synthesized
cagatgttatgtgatgagga

SEQ ID NO: 15310 - DNA, 20 bp, Artificial Sequence
  chemically synthesized
gttatgtgatgaggacagaa

SEQ ID NO: 15311 - DNA, 20 bp, Artificial Sequence
  chemically synthesized
gaggacagaatagaacacat

SEQ ID NO: 15312 - DNA, 20 bp, Artificial Sequence
  chemically synthesized
aggacagaatagaacacatg

SEQ ID NO: 15313 - DNA, 20 bp, Artificial Sequence
  chemically synthesized
gacagaatagaacacatgag

SEQ ID NO: 15314 - DNA, 20 bp, Artificial Sequence
  chemically synthesized
acagaatagaacacatgagg

SEQ ID NO: 15315 - DNA, 20 bp, Artificial Sequence
  chemically synthesized
gaatagaacacatgaggagg

SEQ ID NO: 15316 - DNA, 20 bp, Artificial Sequence
  chemically synthesized
tagaacacatgaggaggaag

SEQ ID NO: 15317 - DNA, 20 bp, Artificial Sequence
  chemically synthesized
gaggaggaagcagaaacttc

SEQ ID NO: 15318 - DNA, 20 bp, Artificial Sequence
  chemically synthesized
ggaagcagaaacttctagac

SEQ ID NO: 15319 - DNA, 20 bp, Artificial Sequence
  chemically synthesized
cagaaacttctagactggac

SEQ ID NO: 15320 - DNA, 20 bp, Artificial Sequence
  chemically synthesized
acttctagactggacaagaa

SEQ ID NO: 15321 - DNA, 20 bp, Artificial Sequence
  chemically synthesized
aaccatccaacaataaatct

SEQ ID NO: 15322 - DNA, 20 bp, Artificial Sequence
  chemically synthesized
tgatgtcatctactacatct

SEQ ID NO: 15323 - DNA, 20 bp, Artificial Sequence
  chemically synthesized
ctaagtatttcctcaaattc

SEQ ID NO: 15324 - DNA, 20 bp, Artificial Sequence
  chemically synthesized
cctcaaattctggacaattt

SEQ ID NO: 15325 - DNA, 20 bp, Artificial Sequence
  chemically synthesized
aaccatcaaaattatttgtt

SEQ ID NO: 15326 - DNA, 20 bp, Artificial Sequence
  chemically synthesized
accatcaaaattatttgttg

SEQ ID NO: 15327 - DNA, 20 bp, Artificial Sequence
  chemically synthesized
ttgttgaggaaaaataaact

SEQ ID NO: 15328 - DNA, 20 bp, Artificial Sequence
  chemically synthesized
aataaacttagccaatttgc

SEQ ID NO: 15329 - DNA, 20 bp, Artificial Sequence
  chemically synthesized
ataaacttagccaatttgca

SEQ ID NO: 15330 - DNA, 20 bp, Artificial Sequence
  chemically synthesized
taaacttagccaatttgcaa

SEQ ID NO: 15331 - DNA, 20 bp, Artificial Sequence
  chemically synthesized
ttgcaagggcaactaaaatg

SEQ ID NO: 15332 - DNA, 20 bp, Artificial Sequence
  chemically synthesized
aaatgaagaacttttcttta

SEQ ID NO: 15333 - DNA, 20 bp, Artificial Sequence
  chemically synthesized
aagaacttttctttaaagtg

SEQ ID NO: 15334 - DNA, 20 bp, Artificial Sequence
  chemically synthesized
agaacttttctttaaagtgt

SEQ ID NO: 15335 - DNA, 20 bp, Artificial Sequence
  chemically synthesized
aacttttctttaaagtgtgg

SEQ ID NO: 15336 - DNA, 20 bp, Artificial Sequence
  chemically synthesized
aaagtgtgggagtcacatct

SEQ ID NO: 15337 - DNA, 20 bp, Artificial Sequence
  chemically synthesized
caacatatttaaatatatct

SEQ ID NO: 15338 - DNA, 20 bp, Artificial Sequence
  chemically synthesized
acaaaaatgcaaaatttcca

SEQ ID NO: 15339 - DNA, 20 bp, Artificial Sequence
  chemically synthesized
aaagaatttctcctcttctg

SEQ ID NO: 15340 - DNA, 20 bp, Artificial Sequence
  chemically synthesized
ttcttcatcttcatcttttc

SEQ ID NO: 15341 - DNA, 20 bp, Artificial Sequence
  chemically synthesized
tcttcatcttcatcttttcc

SEQ ID NO: 15342 - DNA, 20 bp, Artificial Sequence
  chemically synthesized
ttcatcttcatcttttccag

SEQ ID NO: 15343 - DNA, 20 bp, Artificial Sequence
  chemically synthesized
tttccaggagaatataccat

SEQ ID NO: 15344 - DNA, 20 bp, Artificial Sequence
  chemically synthesized
aatataccataagtttctga

SEQ ID NO: 15345 - DNA, 20 bp, Artificial Sequence
  chemically synthesized
ttctgatggtacacatttat

SEQ ID NO: 15346 - DNA, 20 bp, Artificial Sequence
  chemically synthesized
ttgcaactatgcatcttact

SEQ ID NO: 15347 - DNA, 20 bp, Artificial Sequence
  chemically synthesized
gcaactatgcatcttactca

SEQ ID NO: 15348 - DNA, 20 bp, Artificial Sequence
  chemically synthesized
cttaaaacatccttgtttgt

SEQ ID NO: 15349 - DNA, 20 bp, Artificial Sequence
  chemically synthesized
tttcaaattcatatacactt

SEQ ID NO: 15350 - DNA, 20 bp, Artificial Sequence
  chemically synthesized
caaattcatatacactttgg

SEQ ID NO: 15351 - DNA, 20 bp, Artificial Sequence
  chemically synthesized
gcaaacatttttatttgctg

SEQ ID NO: 15352 - DNA, 20 bp, Artificial Sequence
  chemically synthesized
ttttatttgctgaagaacat

SEQ ID NO: 15353 - DNA, 20 bp, Artificial Sequence
  chemically synthesized
tttatttgctgaagaacata

SEQ ID NO: 15354 - DNA, 20 bp, Artificial Sequence
  chemically synthesized
ttatttgctgaagaacataa

SEQ ID NO: 15355 - DNA, 20 bp, Artificial Sequence
  chemically synthesized
tatttgctgaagaacataag

SEQ ID NO: 15356 - DNA, 20 bp, Artificial Sequence
  chemically synthesized
atttgctgaagaacataagg

SEQ ID NO: 15357 - DNA, 20 bp, Artificial Sequence
  chemically synthesized
tgaagaacataagggggaaa

SEQ ID NO: 15358 - DNA, 20 bp, Artificial Sequence
  chemically synthesized
aagaacataagggggaaata

SEQ ID NO: 15359 - DNA, 20 bp, Artificial Sequence
  chemically synthesized
aaatagagattctttatttg

SEQ ID NO: 15360 - DNA, 20 bp, Artificial Sequence
  chemically synthesized
aagaaacaaatgatttgatt

SEQ ID NO: 15361 - DNA, 20 bp, Artificial Sequence
  chemically synthesized
agaaacaaatgatttgattt

SEQ ID NO: 15362 - DNA, 20 bp, Artificial Sequence
  chemically synthesized
gatttgggaaatgaaatgaa

SEQ ID NO: 15363 - DNA, 20 bp, Artificial Sequence
  chemically synthesized
atgaaatgaaaagaaaaaca

SEQ ID NO: 15364 - DNA, 20 bp, Artificial Sequence
  chemically synthesized
gctacttcttttactcatct

SEQ ID NO: 15365 - DNA, 20 bp, Artificial Sequence
  chemically synthesized
ctacttcttttactcatctg

SEQ ID NO: 15366 - DNA, 20 bp, Artificial Sequence
  chemically synthesized
ttttactcatctgaggcctt

SEQ ID NO: 15367 - DNA, 20 bp, Artificial Sequence
  chemically synthesized
actcatctgaggccttcaga

SEQ ID NO: 15368 - DNA, 20 bp, Artificial Sequence
  chemically synthesized
ccttcagatagtcccccata

SEQ ID NO: 15369 - DNA, 20 bp, Artificial Sequence
  chemically synthesized
gatagtcccccatatagcct

SEQ ID NO: 15370 - DNA, 20 bp, Artificial Sequence
  chemically synthesized
tagtcccccatatagcctta

SEQ ID NO: 15371 - DNA, 20 bp, Artificial Sequence
  chemically synthesized
aaaatatgattatgctcttt

SEQ ID NO: 15372 - DNA, 20 bp, Artificial Sequence
  chemically synthesized
attatgctctttcagtctat

SEQ ID NO: 15373 - DNA, 20 bp, Artificial Sequence
  chemically synthesized
ctattagaaataaaaacata

SEQ ID NO: 15374 - DNA, 20 bp, Artificial Sequence
  chemically synthesized
cataaagcttaaaaaatttc

SEQ ID NO: 15375 - DNA, 20 bp, Artificial Sequence
  chemically synthesized
ataaagcttaaaaaatttca

SEQ ID NO: 15376 - DNA, 20 bp, Artificial Sequence
  chemically synthesized
taaagcttaaaaaatttcaa

SEQ ID NO: 15377 - DNA, 20 bp, Artificial Sequence
  chemically synthesized
agcttaaaaaatttcaaggg

SEQ ID NO: 15378 - DNA, 20 bp, Artificial Sequence
  chemically synthesized
gcttaaaaaatttcaaggga

SEQ ID NO: 15379 - DNA, 20 bp, Artificial Sequence
  chemically synthesized
cttaaaaaatttcaagggaa

SEQ ID NO: 15380 - DNA, 20 bp, Artificial Sequence
  chemically synthesized
ttaaaaaatttcaagggaag

SEQ ID NO: 15381 - DNA, 20 bp, Artificial Sequence
  chemically synthesized
atttcaagggaaggggcttg

SEQ ID NO: 15382 - DNA, 20 bp, Artificial Sequence
  chemically synthesized
gggcttgaagattactgact

SEQ ID NO: 15383 - DNA, 20 bp, Artificial Sequence
  chemically synthesized
ggcttgaagattactgacta

SEQ ID NO: 15384 - DNA, 20 bp, Artificial Sequence
  chemically synthesized
gcttgaagattactgactaa

SEQ ID NO: 15385 - DNA, 20 bp, Artificial Sequence
  chemically synthesized
tgaagattactgactaaggg

SEQ ID NO: 15386 - DNA, 20 bp, Artificial Sequence
  chemically synthesized
tgacactcacctcctccaca

SEQ ID NO: 15387 - DNA, 20 bp, Artificial Sequence
  chemically synthesized
tcctccacaaagaaccaaaa

SEQ ID NO: 15388 - DNA, 20 bp, Artificial Sequence
  chemically synthesized
ccacaaagaaccaaaatagt

SEQ ID NO: 15389 - DNA, 20 bp, Artificial Sequence
  chemically synthesized
caaagaaccaaaatagtaag

SEQ ID NO: 15390 - DNA, 20 bp, Artificial Sequence
  chemically synthesized
gtaagtagaaaatcccacat

SEQ ID NO: 15391 - DNA, 20 bp, Artificial Sequence
  chemically synthesized
aagtagaaaatcccacataa

SEQ ID NO: 15392 - DNA, 20 bp, Artificial Sequence
  chemically synthesized
gtagaaaatcccacataaga

SEQ ID NO: 15393 - DNA, 20 bp, Artificial Sequence
  chemically synthesized
tcccacataagagagaattc

SEQ ID NO: 15394 - DNA, 20 bp, Artificial Sequence
  chemically synthesized
gagagaattctggaattcaa

SEQ ID NO: 15395 - DNA, 20 bp, Artificial Sequence
  chemically synthesized
gagaattctggaattcaaca

SEQ ID NO: 15396 - DNA, 20 bp, Artificial Sequence
  chemically synthesized
aattctggaattcaacagag

SEQ ID NO: 15397 - DNA, 20 bp, Artificial Sequence
  chemically synthesized
ggaattcaacagagaagtga

SEQ ID NO: 15398 - DNA, 20 bp, Artificial Sequence
  chemically synthesized
gaattcaacagagaagtgac

SEQ ID NO: 15399 - DNA, 20 bp, Artificial Sequence
  chemically synthesized
ttcaacagagaagtgacagg

SEQ ID NO: 15400 - DNA, 20 bp, Artificial Sequence
  chemically synthesized
agaagtgacaggaagcatct

SEQ ID NO: 15401 - DNA, 20 bp, Artificial Sequence
  chemically synthesized
gaagtgacaggaagcatcta

SEQ ID NO: 15402 - DNA, 20 bp, Artificial Sequence
  chemically synthesized
aggaagcatctaaggcaatg

SEQ ID NO: 15403 - DNA, 20 bp, Artificial Sequence
  chemically synthesized
ggaagcatctaaggcaatga

SEQ ID NO: 15404 - DNA, 20 bp, Artificial Sequence
  chemically synthesized
gaagcatctaaggcaatgaa

SEQ ID NO: 15405 - DNA, 20 bp, Artificial Sequence
  chemically synthesized
aagcatctaaggcaatgaag

SEQ ID NO: 15406 - DNA, 20 bp, Artificial Sequence
  chemically synthesized
gcatctaaggcaatgaaggg

SEQ ID NO: 15407 - DNA, 20 bp, Artificial Sequence
  chemically synthesized
catctaaggcaatgaagggg

SEQ ID NO: 15408 - DNA, 20 bp, Artificial Sequence
  chemically synthesized
atctaaggcaatgaagggga

SEQ ID NO: 15409 - DNA, 20 bp, Artificial Sequence
  chemically synthesized
taaggcaatgaaggggaggg

SEQ ID NO: 15410 - DNA, 20 bp, Artificial Sequence
  chemically synthesized
gcaatgaaggggagggaagc

SEQ ID NO: 15411 - DNA, 20 bp, Artificial Sequence
  chemically synthesized
caatgaaggggagggaagca

SEQ ID NO: 15412 - DNA, 20 bp, Artificial Sequence
  chemically synthesized
tgaaggggagggaagcaagg

SEQ ID NO: 15413 - DNA, 20 bp, Artificial Sequence
  chemically synthesized
gggaagcaaggaagcctacc

SEQ ID NO: 15414 - DNA, 20 bp, Artificial Sequence
  chemically synthesized
aagcaaggaagcctacccag

SEQ ID NO: 15415 - DNA, 20 bp, Artificial Sequence
  chemically synthesized
agcaaggaagcctacccagt

SEQ ID NO: 15416 - DNA, 20 bp, Artificial Sequence
  chemically synthesized
gcaaggaagcctacccagta

SEQ ID NO: 15417 - DNA, 20 bp, Artificial Sequence
  chemically synthesized
acccagtagggatcctctgt

SEQ ID NO: 15418 - DNA, 20 bp, Artificial Sequence
  chemically synthesized
cccagtagggatcctctgtg

SEQ ID NO: 15419 - DNA, 20 bp, Artificial Sequence
  chemically synthesized
gtagggatcctctgtgaggc

SEQ ID NO: 15420 - DNA, 20 bp, Artificial Sequence
  chemically synthesized
agggatcctctgtgaggcca

SEQ ID NO: 15421 - DNA, 20 bp, Artificial Sequence
  chemically synthesized
ggatcctctgtgaggccaga

SEQ ID NO: 15422 - DNA, 20 bp, Artificial Sequence
  chemically synthesized
gatcctctgtgaggccagag

SEQ ID NO: 15423 - DNA, 20 bp, Artificial Sequence
  chemically synthesized
gtgaggccagagaggctccc

SEQ ID NO: 15424 - DNA, 20 bp, Artificial Sequence
  chemically synthesized
gaggctccccagtgcatcga

SEQ ID NO: 15425 - DNA, 20 bp, Artificial Sequence
  chemically synthesized
tccccagtgcatcgaaagtt

SEQ ID NO: 15426 - DNA, 20 bp, Artificial Sequence
  chemically synthesized
aaagttaagtgactgactcc

SEQ ID NO: 15427 - DNA, 20 bp, Artificial Sequence
  chemically synthesized
gttaagtgactgactcccag

SEQ ID NO: 15428 - DNA, 20 bp, Artificial Sequence
  chemically synthesized
agtggtccacatctgcatta

SEQ ID NO: 15429 - DNA, 20 bp, Artificial Sequence
  chemically synthesized
cacatctgcattatggactc

SEQ ID NO: 15430 - DNA, 20 bp, Artificial Sequence
  chemically synthesized
acatctgcattatggactcc

SEQ ID NO: 15431 - DNA, 20 bp, Artificial Sequence
  chemically synthesized
attatggactccaggaatcc

SEQ ID NO: 15432 - DNA, 20 bp, Artificial Sequence
  chemically synthesized
gactccaggaatcctagcca

SEQ ID NO: 15433 - DNA, 20 bp, Artificial Sequence
  chemically synthesized
actccaggaatcctagccac

SEQ ID NO: 15434 - DNA, 20 bp, Artificial Sequence
  chemically synthesized
tccaggaatcctagccacag

SEQ ID NO: 15435 - DNA, 20 bp, Artificial Sequence
  chemically synthesized
caggaatcctagccacagga

SEQ ID NO: 15436 - DNA, 20 bp, Artificial Sequence
  chemically synthesized
aggagagtcccttgaccatg

SEQ ID NO: 15437 - DNA, 20 bp, Artificial Sequence
  chemically synthesized
ggagagtcccttgaccatgc

SEQ ID NO: 15438 - DNA, 20 bp, Artificial Sequence
  chemically synthesized
cccttgaccatgcaggcctt

SEQ ID NO: 15439 - DNA, 20 bp, Artificial Sequence
  chemically synthesized
gcaggccttgagactatcat

SEQ ID NO: 15440 - DNA, 20 bp, Artificial Sequence
  chemically synthesized
caggccttgagactatcata

SEQ ID NO: 15441 - DNA, 20 bp, Artificial Sequence
  chemically synthesized
gactatcataaggaactgcc

SEQ ID NO: 15442 - DNA, 20 bp, Artificial Sequence
  chemically synthesized
aactgcccagcaatcgcaca

SEQ ID NO: 15443 - DNA, 20 bp, Artificial Sequence
  chemically synthesized
actgcccagcaatcgcacaa

SEQ ID NO: 15444 - DNA, 20 bp, Artificial Sequence
  chemically synthesized
atcgcacaaaggcattgctc

SEQ ID NO: 15445 - DNA, 20 bp, Artificial Sequence
  chemically synthesized
cgcacaaaggcattgctcca

SEQ ID NO: 15446 - DNA, 20 bp, Artificial Sequence
  chemically synthesized
acaaaggcattgctccagag

SEQ ID NO: 15447 - DNA, 20 bp, Artificial Sequence
  chemically synthesized
caaaggcattgctccagaga

SEQ ID NO: 15448 - DNA, 20 bp, Artificial Sequence
  chemically synthesized
aaggcattgctccagagaag

SEQ ID NO: 15449 - DNA, 20 bp, Artificial Sequence
  chemically synthesized
tccagagaaggagctctcac

SEQ ID NO: 15450 - DNA, 20 bp, Artificial Sequence
  chemically synthesized
ccagagaaggagctctcact

SEQ ID NO: 15451 - DNA, 20 bp, Artificial Sequence
  chemically synthesized
cccctgccatccccattact

SEQ ID NO: 15452 - DNA, 20 bp, Artificial Sequence
  chemically synthesized
ctgccatccccattactgag

SEQ ID NO: 15453 - DNA, 20 bp, Artificial Sequence
  chemically synthesized
catccccattactgagcagc

SEQ ID NO: 15454 - DNA, 20 bp, Artificial Sequence
  chemically synthesized
atccccattactgagcagca

SEQ ID NO: 15455 - DNA, 20 bp, Artificial Sequence
  chemically synthesized
gagcagcaaggtgccatttt

SEQ ID NO: 15456 - DNA, 20 bp, Artificial Sequence
  chemically synthesized
gcagcaaggtgccattttga

SEQ ID NO: 15457 - DNA, 20 bp, Artificial Sequence
  chemically synthesized
tttgagagcccaacacccac

SEQ ID NO: 15458 - DNA, 20 bp, Artificial Sequence
  chemically synthesized
caccagatgacatcgttcct

SEQ ID NO: 15459 - DNA, 20 bp, Artificial Sequence
  chemically synthesized
tctgcatctctacatccctg

SEQ ID NO: 15460 - DNA, 20 bp, Artificial Sequence
  chemically synthesized
ctgctgacatcccccaccca

SEQ ID NO: 15461 - DNA, 20 bp, Artificial Sequence
  chemically synthesized
gacatcccccacccacagct

SEQ ID NO: 15462 - DNA, 20 bp, Artificial Sequence
  chemically synthesized
ccacagctgagtgctactgc

SEQ ID NO: 15463 - DNA, 20 bp, Artificial Sequence
  chemically synthesized
ctactgctggctgctgtcac

SEQ ID NO: 15464 - DNA, 20 bp, Artificial Sequence
  chemically synthesized
tactgctggctgctgtcacc

SEQ ID NO: 15465 - DNA, 20 bp, Artificial Sequence
  chemically synthesized
actgctggctgctgtcacca

SEQ ID NO: 15466 - DNA, 20 bp, Artificial Sequence
  chemically synthesized
ggctgctgtcaccagggata

SEQ ID NO: 15467 - DNA, 20 bp, Artificial Sequence
  chemically synthesized
ccagggataaagtgtgtcat

SEQ ID NO: 15468 - DNA, 20 bp, Artificial Sequence
  chemically synthesized
gggataaagtgtgtcattag

SEQ ID NO: 15469 - DNA, 20 bp, Artificial Sequence
  chemically synthesized
ataaagtgtgtcattagaag

SEQ ID NO: 15470 - DNA, 20 bp, Artificial Sequence
  chemically synthesized
gaagtggactcccccacccc

SEQ ID NO: 15471 - DNA, 20 bp, Artificial Sequence
  chemically synthesized
gtggactcccccacccccag

SEQ ID NO: 15472 - DNA, 20 bp, Artificial Sequence
  chemically synthesized
gactcccccacccccagtag

SEQ ID NO: 15473 - DNA, 20 bp, Artificial Sequence
  chemically synthesized
actcccccacccccagtagc

SEQ ID NO: 15474 - DNA, 20 bp, Artificial Sequence
  chemically synthesized
ctcccccacccccagtagca

SEQ ID NO: 15475 - DNA, 20 bp, Artificial Sequence
  chemically synthesized
cagggctgctacacatttat

SEQ ID NO: 15476 - DNA, 20 bp, Artificial Sequence
  chemically synthesized
tacacatttataagctccct

SEQ ID NO: 15477 - DNA, 20 bp, Artificial Sequence
  chemically synthesized
agaaaatgctaccccacttg

SEQ ID NO: 15478 - DNA, 20 bp, Artificial Sequence
  chemically synthesized
ccccacttgcagccaccatc

SEQ ID NO: 15479 - DNA, 20 bp, Artificial Sequence
  chemically synthesized
cccacttgcagccaccatct

SEQ ID NO: 15480 - DNA, 20 bp, Artificial Sequence
  chemically synthesized
ccacttgcagccaccatctg

SEQ ID NO: 15481 - DNA, 20 bp, Artificial Sequence
  chemically synthesized
gggctgaaacacatgcccac

SEQ ID NO: 15482 - DNA, 20 bp, Artificial Sequence
  chemically synthesized
gcccaccagcaacccattta

SEQ ID NO: 15483 - DNA, 20 bp, Artificial Sequence
  chemically synthesized
tttatagctgctgccactga

SEQ ID NO: 15484 - DNA, 20 bp, Artificial Sequence
  chemically synthesized
aacacaccccgcaccccttc

SEQ ID NO: 15485 - DNA, 20 bp, Artificial Sequence
  chemically synthesized
cacaccccgcaccccttcaa

SEQ ID NO: 15486 - DNA, 20 bp, Artificial Sequence
  chemically synthesized
accccgcaccccttcaagag

SEQ ID NO: 15487 - DNA, 20 bp, Artificial Sequence
  chemically synthesized
ccccgcaccccttcaagagc

SEQ ID NO: 15488 - DNA, 20 bp, Artificial Sequence
  chemically synthesized
cccgcaccccttcaagagca

SEQ ID NO: 15489 - DNA, 20 bp, Artificial Sequence
  chemically synthesized
tcaagagcagggcaacaatg

SEQ ID NO: 15490 - DNA, 20 bp, Artificial Sequence
  chemically synthesized
agagcagggcaacaatgcag

SEQ ID NO: 15491 - DNA, 20 bp, Artificial Sequence
  chemically synthesized
gcagtagctgctaattcact

SEQ ID NO: 15492 - DNA, 20 bp, Artificial Sequence
  chemically synthesized
cagtagctgctaattcactc

SEQ ID NO: 15493 - DNA, 20 bp, Artificial Sequence
  chemically synthesized
aattcactcaggcattctgc

SEQ ID NO: 15494 - DNA, 20 bp, Artificial Sequence
  chemically synthesized
attcactcaggcattctgct

SEQ ID NO: 15495 - DNA, 20 bp, Artificial Sequence
  chemically synthesized
ttcactcaggcattctgctg

SEQ ID NO: 15496 - DNA, 20 bp, Artificial Sequence
  chemically synthesized
tcactcaggcattctgctgg

SEQ ID NO: 15497 - DNA, 20 bp, Artificial Sequence
  chemically synthesized
aggcattctgctgggggcct

SEQ ID NO: 15498 - DNA, 20 bp, Artificial Sequence
  chemically synthesized
ggcattctgctgggggcctg

SEQ ID NO: 15499 - DNA, 20 bp, Artificial Sequence
  chemically synthesized
gcctgaggatcactccactc

SEQ ID NO: 15500 - DNA, 20 bp, Artificial Sequence
  chemically synthesized
cactccactccagcctatga

SEQ ID NO: 15501 - DNA, 20 bp, Artificial Sequence
  chemically synthesized
ccactccagcctatgatagc

SEQ ID NO: 15502 - DNA, 20 bp, Artificial Sequence
  chemically synthesized
cggtgtccacacacaccact

SEQ ID NO: 15503 - DNA, 20 bp, Artificial Sequence
  chemically synthesized
tgtccacacacaccactgag

SEQ ID NO: 15504 - DNA, 20 bp, Artificial Sequence
  chemically synthesized
cacacaccactgagtggcct

SEQ ID NO: 15505 - DNA, 20 bp, Artificial Sequence
  chemically synthesized
acacaccactgagtggcctg

SEQ ID NO: 15506 - DNA, 20 bp, Artificial Sequence
  chemically synthesized
accactgagtggcctgaggt

SEQ ID NO: 15507 - DNA, 20 bp, Artificial Sequence
  chemically synthesized
ccactgagtggcctgaggtc

SEQ ID NO: 15508 - DNA, 20 bp, Artificial Sequence
  chemically synthesized
ggcctgaggtcaggaacacc

SEQ ID NO: 15509 - DNA, 20 bp, Artificial Sequence
  chemically synthesized
gaggtcaggaacacccagcc

SEQ ID NO: 15510 - DNA, 20 bp, Artificial Sequence
  chemically synthesized
ctttgccttcctcaatgcct

SEQ ID NO: 15511 - DNA, 20 bp, Artificial Sequence
  chemically synthesized
gccttcctcaatgcctaagc

SEQ ID NO: 15512 - DNA, 20 bp, Artificial Sequence
  chemically synthesized
caatgcctaagcaagttgtc

SEQ ID NO: 15513 - DNA, 20 bp, Artificial Sequence
  chemically synthesized
aatgcctaagcaagttgtct

SEQ ID NO: 15514 - DNA, 20 bp, Artificial Sequence
  chemically synthesized
aagcaagttgtctgggaacc

SEQ ID NO: 15515 - DNA, 20 bp, Artificial Sequence
  chemically synthesized
gcaagttgtctgggaaccca

SEQ ID NO: 15516 - DNA, 20 bp, Artificial Sequence
  chemically synthesized
gttgtctgggaacccagaga

SEQ ID NO: 15517 - DNA, 20 bp, Artificial Sequence
  chemically synthesized
cttgtgccatccaccatgac

SEQ ID NO: 15518 - DNA, 20 bp, Artificial Sequence
  chemically synthesized
atccaccatgactggtacct

SEQ ID NO: 15519 - DNA, 20 bp, Artificial Sequence
  chemically synthesized
tggtacctaagcaaccctcc

SEQ ID NO: 15520 - DNA, 20 bp, Artificial Sequence
  chemically synthesized
tacctaagcaaccctcccag

SEQ ID NO: 15521 - DNA, 20 bp, Artificial Sequence
  chemically synthesized
ccctcccagaagcctgatga

SEQ ID NO: 15522 - DNA, 20 bp, Artificial Sequence
  chemically synthesized
cctcccagaagcctgatgat

SEQ ID NO: 15523 - DNA, 20 bp, Artificial Sequence
  chemically synthesized
tctgccactgccatcacaac

SEQ ID NO: 15524 - DNA, 20 bp, Artificial Sequence
  chemically synthesized
cctcctgcatgtgccacctg

SEQ ID NO: 15525 - DNA, 20 bp, Artificial Sequence
  chemically synthesized
ctcctgcatgtgccacctgt

SEQ ID NO: 15526 - DNA, 20 bp, Artificial Sequence
  chemically synthesized
atgtgccacctgtgggtctg

SEQ ID NO: 15527 - DNA, 20 bp, Artificial Sequence
  chemically synthesized
ccacctgtgggtctgaagac

SEQ ID NO: 15528 - DNA, 20 bp, Artificial Sequence
  chemically synthesized
ggtctgaagactggctcatt

SEQ ID NO: 15529 - DNA, 20 bp, Artificial Sequence
  chemically synthesized
actggctcattcagcccttg

SEQ ID NO: 15530 - DNA, 20 bp, Artificial Sequence
  chemically synthesized
cttgcagccaccaccaacac

SEQ ID NO: 15531 - DNA, 20 bp, Artificial Sequence
  chemically synthesized
agccaccaccaacaccagtg

SEQ ID NO: 15532 - DNA, 20 bp, Artificial Sequence
  chemically synthesized
caacaccagtgcagactgct

SEQ ID NO: 15533 - DNA, 20 bp, Artificial Sequence
  chemically synthesized
aacaccagtgcagactgctt

SEQ ID NO: 15534 - DNA, 20 bp, Artificial Sequence
  chemically synthesized
caccagtgcagactgcttgg

SEQ ID NO: 15535 - DNA, 20 bp, Artificial Sequence
  chemically synthesized
agtgcagactgcttgggagc

SEQ ID NO: 15536 - DNA, 20 bp, Artificial Sequence
  chemically synthesized
tgcagactgcttgggagcca

SEQ ID NO: 15537 - DNA, 20 bp, Artificial Sequence
  chemically synthesized
gcagactgcttgggagccag

SEQ ID NO: 15538 - DNA, 20 bp, Artificial Sequence
  chemically synthesized
cagactgcttgggagccaga

SEQ ID NO: 15539 - DNA, 20 bp, Artificial Sequence
  chemically synthesized
ggagccagagggttgtcctg

SEQ ID NO: 15540 - DNA, 20 bp, Artificial Sequence
  chemically synthesized
gggttgtcctgcagttgcta

SEQ ID NO: 15541 - DNA, 20 bp, Artificial Sequence
  chemically synthesized
cccacaccacacccactgtc

SEQ ID NO: 15542 - DNA, 20 bp, Artificial Sequence
  chemically synthesized
acaccacacccactgtccag

SEQ ID NO: 15543 - DNA, 20 bp, Artificial Sequence
  chemically synthesized
cacccactgtccagaagcct

SEQ ID NO: 15544 - DNA, 20 bp, Artificial Sequence
  chemically synthesized
acccactgtccagaagcctg

SEQ ID NO: 15545 - DNA, 20 bp, Artificial Sequence
  chemically synthesized
aagcctgaggacccacacac

SEQ ID NO: 15546 - DNA, 20 bp, Artificial Sequence
  chemically synthesized
tgaggacccacacaccagcc

SEQ ID NO: 15547 - DNA, 20 bp, Artificial Sequence
  chemically synthesized
cacaccagcccagtctacta

SEQ ID NO: 15548 - DNA, 20 bp, Artificial Sequence
  chemically synthesized
tatggccactactgacaccc

SEQ ID NO: 15549 - DNA, 20 bp, Artificial Sequence
  chemically synthesized
acacccaagcaaactgcctg

SEQ ID NO: 15550 - DNA, 20 bp, Artificial Sequence
  chemically synthesized
cacccaagcaaactgcctga

SEQ ID NO: 15551 - DNA, 20 bp, Artificial Sequence
  chemically synthesized
agcaaactgcctgaaggcca

SEQ ID NO: 15552 - DNA, 20 bp, Artificial Sequence
  chemically synthesized
ggccaaagaatcaacccaac

SEQ ID NO: 15553 - DNA, 20 bp, Artificial Sequence
  chemically synthesized
ccaactagactcattaccat

SEQ ID NO: 15554 - DNA, 20 bp, Artificial Sequence
  chemically synthesized
accatcagtgccaatgtaca

SEQ ID NO: 15555 - DNA, 20 bp, Artificial Sequence
  chemically synthesized
agtgccaatgtacacagcca

SEQ ID NO: 15556 - DNA, 20 bp, Artificial Sequence
  chemically synthesized
gtgccaatgtacacagccat

SEQ ID NO: 15557 - DNA, 20 bp, Artificial Sequence
  chemically synthesized
tgccaatgtacacagccatg

SEQ ID NO: 15558 - DNA, 20 bp, Artificial Sequence
  chemically synthesized
tgtacacagccatggggccc

SEQ ID NO: 15559 - DNA, 20 bp, Artificial Sequence
  chemically synthesized
gtacacagccatggggccca

SEQ ID NO: 15560 - DNA, 20 bp, Artificial Sequence
  chemically synthesized
acagccatggggcccaagga

SEQ ID NO: 15561 - DNA, 20 bp, Artificial Sequence
  chemically synthesized
cagccatggggcccaaggac

SEQ ID NO: 15562 - DNA, 20 bp, Artificial Sequence
  chemically synthesized
gggcccaaggacaggaatgc

SEQ ID NO: 15563 - DNA, 20 bp, Artificial Sequence
  chemically synthesized
ggcccaaggacaggaatgct

SEQ ID NO: 15564 - DNA, 20 bp, Artificial Sequence
  chemically synthesized
gctaggcccaccaccaccac

SEQ ID NO: 15565 - DNA, 20 bp, Artificial Sequence
  chemically synthesized
ctaggcccaccaccaccact

SEQ ID NO: 15566 - DNA, 20 bp, Artificial Sequence
  chemically synthesized
taggcccaccaccaccactg

SEQ ID NO: 15567 - DNA, 20 bp, Artificial Sequence
  chemically synthesized
ccaccaccaccactggggcc

SEQ ID NO: 15568 - DNA, 20 bp, Artificial Sequence
  chemically synthesized
caccaccaccactggggcca

SEQ ID NO: 15569 - DNA, 20 bp, Artificial Sequence
  chemically synthesized
ccaccactggggccaaggac

SEQ ID NO: 15570 - DNA, 20 bp, Artificial Sequence
  chemically synthesized
ccacttgatattcttgtctc

SEQ ID NO: 15571 - DNA, 20 bp, Artificial Sequence
  chemically synthesized
ttcactaacaaatgcaccct

SEQ ID NO: 15572 - DNA, 20 bp, Artificial Sequence
  chemically synthesized
ctaagccactgaaaaaatca

SEQ ID NO: 15573 - DNA, 20 bp, Artificial Sequence
  chemically synthesized
acagacactgatgatactgt

SEQ ID NO: 15574 - DNA, 20 bp, Artificial Sequence
  chemically synthesized
gacactgatgatactgttgg

SEQ ID NO: 15575 - DNA, 20 bp, Artificial Sequence
  chemically synthesized
agctgaaaaaaaataatatg

SEQ ID NO: 15576 - DNA, 20 bp, Artificial Sequence
  chemically synthesized
actatgctgctgtatgcacc

SEQ ID NO: 15577 - DNA, 20 bp, Artificial Sequence
  chemically synthesized
gcacctagaaatcaaaatca

SEQ ID NO: 15578 - DNA, 20 bp, Artificial Sequence
  chemically synthesized
tgccctactcaatcaacacc

SEQ ID NO: 15579 - DNA, 20 bp, Artificial Sequence
  chemically synthesized
tcaacaccaagatacatctt

SEQ ID NO: 15580 - DNA, 20 bp, Artificial Sequence
  chemically synthesized
caagatacatcttcagaaaa

SEQ ID NO: 15581 - DNA, 20 bp, Artificial Sequence
  chemically synthesized
caaaaacaaatttacaaaac

SEQ ID NO: 15582 - DNA, 20 bp, Artificial Sequence
  chemically synthesized
aaacaaatttacaaaactgg

SEQ ID NO: 15583 - DNA, 20 bp, Artificial Sequence
  chemically synthesized
caaatttacaaaactggaag

SEQ ID NO: 15584 - DNA, 20 bp, Artificial Sequence
  chemically synthesized
ggaagcagcaatcattacac

SEQ ID NO: 15585 - DNA, 20 bp, Artificial Sequence
  chemically synthesized
agcaatcattacaccagatg

SEQ ID NO: 15586 - DNA, 20 bp, Artificial Sequence
  chemically synthesized
caatcattacaccagatgca

SEQ ID NO: 15587 - DNA, 20 bp, Artificial Sequence
  chemically synthesized
agatgcagagatatcaatgc

SEQ ID NO: 15588 - DNA, 20 bp, Artificial Sequence
  chemically synthesized
aagaacaaaataaacataaa

SEQ ID NO: 15589 - DNA, 20 bp, Artificial Sequence
  chemically synthesized
agaacaaaataaacataaaa

SEQ ID NO: 15590 - DNA, 20 bp, Artificial Sequence
  chemically synthesized
aaaataaacataaaaaggtg

SEQ ID NO: 15591 - DNA, 20 bp, Artificial Sequence
  chemically synthesized
gaagaaatatgacacttcca

SEQ ID NO: 15592 - DNA, 20 bp, Artificial Sequence
  chemically synthesized
aagaaatatgacacttccaa

SEQ ID NO: 15593 - DNA, 20 bp, Artificial Sequence
  chemically synthesized
aaaggaatttaataattctt

SEQ ID NO: 15594 - DNA, 20 bp, Artificial Sequence
  chemically synthesized
taataattcttcagcaacat

SEQ ID NO: 15595 - DNA, 20 bp, Artificial Sequence
  chemically synthesized
aattcttcagcaacataagc

SEQ ID NO: 15596 - DNA, 20 bp, Artificial Sequence
  chemically synthesized
tcttcagcaacataagccag

SEQ ID NO: 15597 - DNA, 20 bp, Artificial Sequence
  chemically synthesized
acataagccagtggaaaaaa

SEQ ID NO: 15598 - DNA, 20 bp, Artificial Sequence
  chemically synthesized
aaaagacatttataaaattc

SEQ ID NO: 15599 - DNA, 20 bp, Artificial Sequence
  chemically synthesized
atttataaaattctggaaaa

SEQ ID NO: 15600 - DNA, 20 bp, Artificial Sequence
  chemically synthesized
gaatccaaaatgttgatatt

SEQ ID NO: 15601 - DNA, 20 bp, Artificial Sequence
  chemically synthesized
aatccaaaatgttgatatta

SEQ ID NO: 15602 - DNA, 20 bp, Artificial Sequence
  chemically synthesized
ccaaaatgttgatattaagg

SEQ ID NO: 15603 - DNA, 20 bp, Artificial Sequence
  chemically synthesized
atgttgatattaaggaagct

SEQ ID NO: 15604 - DNA, 20 bp, Artificial Sequence
  chemically synthesized
tgatattaaggaagctcagt

SEQ ID NO: 15605 - DNA, 20 bp, Artificial Sequence
  chemically synthesized
aaggaagctcagtgagacac

SEQ ID NO: 15606 - DNA, 20 bp, Artificial Sequence
  chemically synthesized
ggaagctcagtgagacacaa

SEQ ID NO: 15607 - DNA, 20 bp, Artificial Sequence
  chemically synthesized
cagtgagacacaagagaact

SEQ ID NO: 15608 - DNA, 20 bp, Artificial Sequence
  chemically synthesized
gaactcagataaacaataaa

SEQ ID NO: 15609 - DNA, 20 bp, Artificial Sequence
  chemically synthesized
gataaacaataaaaagaaat

SEQ ID NO: 15610 - DNA, 20 bp, Artificial Sequence
  chemically synthesized
aagaaatcagaaaaacaatt

SEQ ID NO: 15611 - DNA, 20 bp, Artificial Sequence
  chemically synthesized
agaaatcagaaaaacaattc

SEQ ID NO: 15612 - DNA, 20 bp, Artificial Sequence
  chemically synthesized
aaacaattcaggatatgaat

SEQ ID NO: 15613 - DNA, 20 bp, Artificial Sequence
  chemically synthesized
tatgaatgagaaatttaccc

SEQ ID NO: 15614 - DNA, 20 bp, Artificial Sequence
  chemically synthesized
tgaatgagaaatttacccaa

SEQ ID NO: 15615 - DNA, 20 bp, Artificial Sequence
  chemically synthesized
tgagaaatttacccaagaga

SEQ ID NO: 15616 - DNA, 20 bp, Artificial Sequence
  chemically synthesized
acccaagagatagatacaac

SEQ ID NO: 15617 - DNA, 20 bp, Artificial Sequence
  chemically synthesized
tacaacaagaatgaaccaaa

SEQ ID NO: 15618 - DNA, 20 bp, Artificial Sequence
  chemically synthesized
aaacagaaattctgtaactg

SEQ ID NO: 15619 - DNA, 20 bp, Artificial Sequence
  chemically synthesized
acagaaattctgtaactgaa

SEQ ID NO: 15620 - DNA, 20 bp, Artificial Sequence
  chemically synthesized
gtaactgaagagtttattga

SEQ ID NO: 15621 - DNA, 20 bp, Artificial Sequence
  chemically synthesized
acattcaaaaacttcaacaa

SEQ ID NO: 15622 - DNA, 20 bp, Artificial Sequence
  chemically synthesized
caaaaacttcaacaatagat

SEQ ID NO: 15623 - DNA, 20 bp, Artificial Sequence
  chemically synthesized
cttcaacaatagatcagatc

SEQ ID NO: 15624 - DNA, 20 bp, Artificial Sequence
  chemically synthesized
caacaatagatcagatcaag

SEQ ID NO: 15625 - DNA, 20 bp, Artificial Sequence
  chemically synthesized
caatagatcagatcaagcag

SEQ ID NO: 15626 - DNA, 20 bp, Artificial Sequence
  chemically synthesized
atcaagcagaagaaaaattt

SEQ ID NO: 15627 - DNA, 20 bp, Artificial Sequence
  chemically synthesized
aagaaaaatttcagaacttg

SEQ ID NO: 15628 - DNA, 20 bp, Artificial Sequence
  chemically synthesized
aaaatttcagaacttgaaga

SEQ ID NO: 15629 - DNA, 20 bp, Artificial Sequence
  chemically synthesized
aaatttcagaacttgaagac

SEQ ID NO: 15630 - DNA, 20 bp, Artificial Sequence
  chemically synthesized
gaagacaggtcttttaaaat

SEQ ID NO: 15631 - DNA, 20 bp, Artificial Sequence
  chemically synthesized
acaggtcttttaaaattagc

SEQ ID NO: 15632 - DNA, 20 bp, Artificial Sequence
  chemically synthesized
aaaattagctggtcaaatga

SEQ ID NO: 15633 - DNA, 20 bp, Artificial Sequence
  chemically synthesized
ttagctggtcaaatgataga

SEQ ID NO: 15634 - DNA, 20 bp, Artificial Sequence
  chemically synthesized
tagctggtcaaatgatagaa

SEQ ID NO: 15635 - DNA, 20 bp, Artificial Sequence
  chemically synthesized
aatgatagaaaggaaaaaaa

SEQ ID NO: 15636 - DNA, 20 bp, Artificial Sequence
  chemically synthesized
ggaaaaaaaaagaatgaaca

SEQ ID NO: 15637 - DNA, 20 bp, Artificial Sequence
  chemically synthesized
acaaagtgtatgtgacatat

SEQ ID NO: 15638 - DNA, 20 bp, Artificial Sequence
  chemically synthesized
caaagtgtatgtgacatatg

SEQ ID NO: 15639 - DNA, 20 bp, Artificial Sequence
  chemically synthesized
gtgacatatgaggcactata

SEQ ID NO: 15640 - DNA, 20 bp, Artificial Sequence
  chemically synthesized
tgaacaaatattcaaatttg

SEQ ID NO: 15641 - DNA, 20 bp, Artificial Sequence
  chemically synthesized
tattcaaatttgcagtttcc

SEQ ID NO: 15642 - DNA, 20 bp, Artificial Sequence
  chemically synthesized
tcaaatttgcagtttcccag

SEQ ID NO: 15643 - DNA, 20 bp, Artificial Sequence
  chemically synthesized
caaatttgcagtttcccaga

SEQ ID NO: 15644 - DNA, 20 bp, Artificial Sequence
  chemically synthesized
ttgcagtttcccagaaggta

SEQ ID NO: 15645 - DNA, 20 bp, Artificial Sequence
  chemically synthesized
gcagtttcccagaaggtaaa

SEQ ID NO: 15646 - DNA, 20 bp, Artificial Sequence
  chemically synthesized
agaaggtaaagagaacatga

SEQ ID NO: 15647 - DNA, 20 bp, Artificial Sequence
  chemically synthesized
gaaggtaaagagaacatgaa

SEQ ID NO: 15648 - DNA, 20 bp, Artificial Sequence
  chemically synthesized
taaagagaacatgaaaggtg

SEQ ID NO: 15649 - DNA, 20 bp, Artificial Sequence
  chemically synthesized
aaagagaacatgaaaggtgt

SEQ ID NO: 15650 - DNA, 20 bp, Artificial Sequence
  chemically synthesized
aaacctacgtaacaacacaa

SEQ ID NO: 15651 - DNA, 20 bp, Artificial Sequence
  chemically synthesized
acaatagctgaaaacttgtc

SEQ ID NO: 15652 - DNA, 20 bp, Artificial Sequence
  chemically synthesized
agctgaaaacttgtcaagtc

SEQ ID NO: 15653 - DNA, 20 bp, Artificial Sequence
  chemically synthesized
gaaaacttgtcaagtctagc

SEQ ID NO: 15654 - DNA, 20 bp, Artificial Sequence
  chemically synthesized
gtcaagtctagcaagaaatg

SEQ ID NO: 15655 - DNA, 20 bp, Artificial Sequence
  chemically synthesized
tagcaagaaatgtagacatc

SEQ ID NO: 15656 - DNA, 20 bp, Artificial Sequence
  chemically synthesized
acatccagacaaatgaaaat

SEQ ID NO: 15657 - DNA, 20 bp, Artificial Sequence
  chemically synthesized
cccaaataatataatgcaaa

SEQ ID NO: 15658 - DNA, 20 bp, Artificial Sequence
  chemically synthesized
atgcaaaaagctcttctcca

SEQ ID NO: 15659 - DNA, 20 bp, Artificial Sequence
  chemically synthesized
ctcttctccacagcacatta

SEQ ID NO: 15660 - DNA, 20 bp, Artificial Sequence
  chemically synthesized
cattatagtcaaactgtcaa

SEQ ID NO: 15661 - DNA, 20 bp, Artificial Sequence
  chemically synthesized
agtcaaactgtcaaaagcca

SEQ ID NO: 15662 - DNA, 20 bp, Artificial Sequence
  chemically synthesized
tcaaactgtcaaaagccaaa

SEQ ID NO: 15663 - DNA, 20 bp, Artificial Sequence
  chemically synthesized
actgtcaaaagccaaagagt

SEQ ID NO: 15664 - DNA, 20 bp, Artificial Sequence
  chemically synthesized
aaagagtaagaactctaaaa

SEQ ID NO: 15665 - DNA, 20 bp, Artificial Sequence
  chemically synthesized
agtaagaactctaaaacagc

SEQ ID NO: 15666 - DNA, 20 bp, Artificial Sequence
  chemically synthesized
aaaacagcaagcaaaatgtc

SEQ ID NO: 15667 - DNA, 20 bp, Artificial Sequence
  chemically synthesized
caaaatgtctagtcacttat

SEQ ID NO: 15668 - DNA, 20 bp, Artificial Sequence
  chemically synthesized
aaaatgtctagtcacttata

SEQ ID NO: 15669 - DNA, 20 bp, Artificial Sequence
  chemically synthesized
aaatgtctagtcacttataa

SEQ ID NO: 15670 - DNA, 20 bp, Artificial Sequence
  chemically synthesized
acttataagggaacttccac

SEQ ID NO: 15671 - DNA, 20 bp, Artificial Sequence
  chemically synthesized
gggaacttccacaagattaa

SEQ ID NO: 15672 - DNA, 20 bp, Artificial Sequence
  chemically synthesized
ccacaagattaacagattaa

SEQ ID NO: 15673 - DNA, 20 bp, Artificial Sequence
  chemically synthesized
caagattaacagattaacag

SEQ ID NO: 15674 - DNA, 20 bp, Artificial Sequence
  chemically synthesized
cagattaacagcagatttct

SEQ ID NO: 15675 - DNA, 20 bp, Artificial Sequence
  chemically synthesized
attaacagcagatttctcag

SEQ ID NO: 15676 - DNA, 20 bp, Artificial Sequence
  chemically synthesized
atttctcagcagaaacctca

SEQ ID NO: 15677 - DNA, 20 bp, Artificial Sequence
  chemically synthesized
tttctcagcagaaacctcac

SEQ ID NO: 15678 - DNA, 20 bp, Artificial Sequence
  chemically synthesized
tcagcagaaacctcacaggc

SEQ ID NO: 15679 - DNA, 20 bp, Artificial Sequence
  chemically synthesized
cagcagaaacctcacaggcc

SEQ ID NO: 15680 - DNA, 20 bp, Artificial Sequence
  chemically synthesized
gcagaaacctcacaggccag

SEQ ID NO: 15681 - DNA, 20 bp, Artificial Sequence
  chemically synthesized
gaaacctcacaggccaggag

SEQ ID NO: 15682 - DNA, 20 bp, Artificial Sequence
  chemically synthesized
cctcacaggccaggagaaga

SEQ ID NO: 15683 - DNA, 20 bp, Artificial Sequence
  chemically synthesized
ctcacaggccaggagaagat

SEQ ID NO: 15684 - DNA, 20 bp, Artificial Sequence
  chemically synthesized
atgggatgatatattcaaaa

SEQ ID NO: 15685 - DNA, 20 bp, Artificial Sequence
  chemically synthesized
tgatatattcaaaatagtga

SEQ ID NO: 15686 - DNA, 20 bp, Artificial Sequence
  chemically synthesized
tgaaagaaaaaaatgacacc

SEQ ID NO: 15687 - DNA, 20 bp, Artificial Sequence
  chemically synthesized
gaaagaaaaaaatgacacca

SEQ ID NO: 15688 - DNA, 20 bp, Artificial Sequence
  chemically synthesized
gacaccaaggatgttatacc

SEQ ID NO: 15689 - DNA, 20 bp, Artificial Sequence
  chemically synthesized
aacattgttcttcaaaaatg

SEQ ID NO: 15690 - DNA, 20 bp, Artificial Sequence
  chemically synthesized
acattgttcttcaaaaatga

SEQ ID NO: 15691 - DNA, 20 bp, Artificial Sequence
  chemically synthesized
aggataaataaaatcttttc

SEQ ID NO: 15692 - DNA, 20 bp, Artificial Sequence
  chemically synthesized
ggataaataaaatcttttct

SEQ ID NO: 15693 - DNA, 20 bp, Artificial Sequence
  chemically synthesized
aaataaaatcttttctgggc

SEQ ID NO: 15694 - DNA, 20 bp, Artificial Sequence
  chemically synthesized
ttctgggcaagaaaaatttg

SEQ ID NO: 15695 - DNA, 20 bp, Artificial Sequence
  chemically synthesized
tctgggcaagaaaaatttga

SEQ ID NO: 15696 - DNA, 20 bp, Artificial Sequence
  chemically synthesized
ttgaaggaattcactatcac

SEQ ID NO: 15697 - DNA, 20 bp, Artificial Sequence
  chemically synthesized
ggaattcactatcactagac

SEQ ID NO: 15698 - DNA, 20 bp, Artificial Sequence
  chemically synthesized
tatcactagactggctttac

SEQ ID NO: 15699 - DNA, 20 bp, Artificial Sequence
  chemically synthesized
tggctttacaagaaatattt

SEQ ID NO: 15700 - DNA, 20 bp, Artificial Sequence
  chemically synthesized
ggctttacaagaaatattta

SEQ ID NO: 15701 - DNA, 20 bp, Artificial Sequence
  chemically synthesized
gctttacaagaaatatttaa

SEQ ID NO: 15702 - DNA, 20 bp, Artificial Sequence
  chemically synthesized
tttacaagaaatatttaagg

SEQ ID NO: 15703 - DNA, 20 bp, Artificial Sequence
  chemically synthesized
taagggagtcctacacatga

SEQ ID NO: 15704 - DNA, 20 bp, Artificial Sequence
  chemically synthesized
agtcctacacatgaaagtga

SEQ ID NO: 15705 - DNA, 20 bp, Artificial Sequence
  chemically synthesized
gtcctacacatgaaagtgac

SEQ ID NO: 15706 - DNA, 20 bp, Artificial Sequence
  chemically synthesized
gacaggacactgccattatg

SEQ ID NO: 15707 - DNA, 20 bp, Artificial Sequence
  chemically synthesized
tgccattatgaagacacaca

SEQ ID NO: 15708 - DNA, 20 bp, Artificial Sequence
  chemically synthesized
gccattatgaagacacacaa

SEQ ID NO: 15709 - DNA, 20 bp, Artificial Sequence
  chemically synthesized
cacaaaggtatacaactaac

SEQ ID NO: 15710 - DNA, 20 bp, Artificial Sequence
  chemically synthesized
aaaggtatacaactaactgg

SEQ ID NO: 15711 - DNA, 20 bp, Artificial Sequence
  chemically synthesized
aggtatacaactaactggta

SEQ ID NO: 15712 - DNA, 20 bp, Artificial Sequence
  chemically synthesized
ggtagagcaaaacacaaata

SEQ ID NO: 15713 - DNA, 20 bp, Artificial Sequence
  chemically synthesized
agagcaaaacacaaataaag

SEQ ID NO: 15714 - DNA, 20 bp, Artificial Sequence
  chemically synthesized
agcaaaacacaaataaagaa

SEQ ID NO: 15715 - DNA, 20 bp, Artificial Sequence
  chemically synthesized
aaacacaaataaagaagaga

SEQ ID NO: 15716 - DNA, 20 bp, Artificial Sequence
  chemically synthesized
gaactcaaacgttaccacta

SEQ ID NO: 15717 - DNA, 20 bp, Artificial Sequence
  chemically synthesized
aaaccacaatcataaataat

SEQ ID NO: 15718 - DNA, 20 bp, Artificial Sequence
  chemically synthesized
cacaatcataaataataaga

SEQ ID NO: 15719 - DNA, 20 bp, Artificial Sequence
  chemically synthesized
atcataaataataagaaaga

SEQ ID NO: 15720 - DNA, 20 bp, Artificial Sequence
  chemically synthesized
taaataataagaaagaaaga

SEQ ID NO: 15721 - DNA, 20 bp, Artificial Sequence
  chemically synthesized
taataagaaagaaagaaaga

SEQ ID NO: 15722 - DNA, 20 bp, Artificial Sequence
  chemically synthesized
aagaaagaaagaaagaaaga

SEQ ID NO: 15723 - DNA, 20 bp, Artificial Sequence
  chemically synthesized
gaaagaaagaaagaaagaaa

SEQ ID NO: 15724 - DNA, 20 bp, Artificial Sequence
  chemically synthesized
aagaaagaaagaaagaaaga

SEQ ID NO: 15725 - DNA, 20 bp, Artificial Sequence
  chemically synthesized
gaaagaaagaaagaaagaga

SEQ ID NO: 15726 - DNA, 20 bp, Artificial Sequence
  chemically synthesized
aagaaagaaagaaagagaga

SEQ ID NO: 15727 - DNA, 20 bp, Artificial Sequence
  chemically synthesized
gaaagaaagaaagagagaga

SEQ ID NO: 15728 - DNA, 20 bp, Artificial Sequence
  chemically synthesized
aagaaagaaagagagagaga

SEQ ID NO: 15729 - DNA, 20 bp, Artificial Sequence
  chemically synthesized
gaaagaaagagagagagaga

SEQ ID NO: 15730 - DNA, 20 bp, Artificial Sequence
  chemically synthesized
gagagagagagagagaatga

SEQ ID NO: 15731 - DNA, 20 bp, Artificial Sequence
  chemically synthesized
gagagagagagaatgaaaga

SEQ ID NO: 15732 - DNA, 20 bp, Artificial Sequence
  chemically synthesized
agagagaatgaaagaaagaa

SEQ ID NO: 15733 - DNA, 20 bp, Artificial Sequence
  chemically synthesized
gagagaatgaaagaaagaaa

SEQ ID NO: 15734 - DNA, 20 bp, Artificial Sequence
  chemically synthesized
agaatgaaagaaagaaaagg

SEQ ID NO: 15735 - DNA, 20 bp, Artificial Sequence
  chemically synthesized
gaatgaaagaaagaaaagga

SEQ ID NO: 15736 - DNA, 20 bp, Artificial Sequence
  chemically synthesized
tgaaagaaagaaaaggaagg

SEQ ID NO: 15737 - DNA, 20 bp, Artificial Sequence
  chemically synthesized
gaaagaaagaaaaggaagga

SEQ ID NO: 15738 - DNA, 20 bp, Artificial Sequence
  chemically synthesized
agaaagaaaaggaaggaagg

SEQ ID NO: 15739 - DNA, 20 bp, Artificial Sequence
  chemically synthesized
taaaaaaaaaacaaaacaac

SEQ ID NO: 15740 - DNA, 20 bp, Artificial Sequence
  chemically synthesized
aaaaaaaaaacaaaacaacc

SEQ ID NO: 15741 - DNA, 20 bp, Artificial Sequence
  chemically synthesized
ccaggaatcaattaacaaaa

SEQ ID NO: 15742 - DNA, 20 bp, Artificial Sequence
  chemically synthesized
ggaatcaattaacaaaatgg

SEQ ID NO: 15743 - DNA, 20 bp, Artificial Sequence
  chemically synthesized
gaatcaattaacaaaatggc

SEQ ID NO: 15744 - DNA, 20 bp, Artificial Sequence
  chemically synthesized
attaacaaaatggcaggaat

SEQ ID NO: 15745 - DNA, 20 bp, Artificial Sequence
  chemically synthesized
aagctctcacatgtcaataa

SEQ ID NO: 15746 - DNA, 20 bp, Artificial Sequence
  chemically synthesized
ataatagccttgcatgtaaa

SEQ ID NO: 15747 - DNA, 20 bp, Artificial Sequence
  chemically synthesized
tggattaaattgttacttga

SEQ ID NO: 15748 - DNA, 20 bp, Artificial Sequence
  chemically synthesized
aaattgttacttgaaagata

SEQ ID NO: 15749 - DNA, 20 bp, Artificial Sequence
  chemically synthesized
gttacttgaaagatatagac

SEQ ID NO: 15750 - DNA, 20 bp, Artificial Sequence
  chemically synthesized
aaagatatagactggctaaa

SEQ ID NO: 15751 - DNA, 20 bp, Artificial Sequence
  chemically synthesized
tttaaaacaaaaatatgacc

SEQ ID NO: 15752 - DNA, 20 bp, Artificial Sequence
  chemically synthesized
caaaaatatgacccagttgt

SEQ ID NO: 15753 - DNA, 20 bp, Artificial Sequence
  chemically synthesized
cccagttgtaagctgcctat

SEQ ID NO: 15754 - DNA, 20 bp, Artificial Sequence
  chemically synthesized
agaaacttatctcacttgta

SEQ ID NO: 15755 - DNA, 20 bp, Artificial Sequence
  chemically synthesized
ctcacttgtaaagataaata

SEQ ID NO: 15756 - DNA, 20 bp, Artificial Sequence
  chemically synthesized
taaagataaatatagactga

SEQ ID NO: 15757 - DNA, 20 bp, Artificial Sequence
  chemically synthesized
aaatatagactgaaagtaaa

SEQ ID NO: 15758 - DNA, 20 bp, Artificial Sequence
  chemically synthesized
gactgaaagtaaaaagatga

SEQ ID NO: 15759 - DNA, 20 bp, Artificial Sequence
  chemically synthesized
gatgaaagatcttccataca

SEQ ID NO: 15760 - DNA, 20 bp, Artificial Sequence
  chemically synthesized
tgaaagatcttccatacaaa

SEQ ID NO: 15761 - DNA, 20 bp, Artificial Sequence
  chemically synthesized
tacaaagagaaaccaaaaat

SEQ ID NO: 15762 - DNA, 20 bp, Artificial Sequence
  chemically synthesized
gagaaaccaaaaatgagcaa

SEQ ID NO: 15763 - DNA, 20 bp, Artificial Sequence
  chemically synthesized
aaaccaaaaatgagcaaaag

SEQ ID NO: 15764 - DNA, 20 bp, Artificial Sequence
  chemically synthesized
aaaagtagttatacctataa

SEQ ID NO: 15765 - DNA, 20 bp, Artificial Sequence
  chemically synthesized
gactttaaataaaaaacact

SEQ ID NO: 15766 - DNA, 20 bp, Artificial Sequence
  chemically synthesized
ctttaaataaaaaacactaa

SEQ ID NO: 15767 - DNA, 20 bp, Artificial Sequence
  chemically synthesized
taaaaaacactaagagacaa

SEQ ID NO: 15768 - DNA, 20 bp, Artificial Sequence
  chemically synthesized
aagtcattacataatgataa

SEQ ID NO: 15769 - DNA, 20 bp, Artificial Sequence
  chemically synthesized
agtcattacataatgataaa

SEQ ID NO: 15770 - DNA, 20 bp, Artificial Sequence
  chemically synthesized
taatgataaaaggaacaatt

SEQ ID NO: 15771 - DNA, 20 bp, Artificial Sequence
  chemically synthesized
gataaaaggaacaattcagc

SEQ ID NO: 15772 - DNA, 20 bp, Artificial Sequence
  chemically synthesized
taaaaggaacaattcagcaa

SEQ ID NO: 15773 - DNA, 20 bp, Artificial Sequence
  chemically synthesized
taaacattcacactcaacac

SEQ ID NO: 15774 - DNA, 20 bp, Artificial Sequence
  chemically synthesized
aacattcacactcaacacca

SEQ ID NO: 15775 - DNA, 20 bp, Artificial Sequence
  chemically synthesized
acactcaacaccagagcatc

SEQ ID NO: 15776 - DNA, 20 bp, Artificial Sequence
  chemically synthesized
ccagagcatccagatatgta

SEQ ID NO: 15777 - DNA, 20 bp, Artificial Sequence
  chemically synthesized
atatgtaaagcaaatgttat

SEQ ID NO: 15778 - DNA, 20 bp, Artificial Sequence
  chemically synthesized
agcaaatgttattagatata

SEQ ID NO: 15779 - DNA, 20 bp, Artificial Sequence
  chemically synthesized
gcaaatgttattagatataa

SEQ ID NO: 15780 - DNA, 20 bp, Artificial Sequence
  chemically synthesized
caaatgttattagatataaa

SEQ ID NO: 15781 - DNA, 20 bp, Artificial Sequence
  chemically synthesized
attagatataaagggtgaaa

SEQ ID NO: 15782 - DNA, 20 bp, Artificial Sequence
  chemically synthesized
aatagaatccaatacaataa

SEQ ID NO: 15783 - DNA, 20 bp, Artificial Sequence
  chemically synthesized
gaatccaatacaataatagt

SEQ ID NO: 15784 - DNA, 20 bp, Artificial Sequence
  chemically synthesized
aatccaatacaataatagtt

SEQ ID NO: 15785 - DNA, 20 bp, Artificial Sequence
  chemically synthesized
atccaatacaataatagttg

SEQ ID NO: 15786 - DNA, 20 bp, Artificial Sequence
  chemically synthesized
ggatttcaacattctaatct

SEQ ID NO: 15787 - DNA, 20 bp, Artificial Sequence
  chemically synthesized
caacattctaatctcagcat

SEQ ID NO: 15788 - DNA, 20 bp, Artificial Sequence
  chemically synthesized
attctaatctcagcatcaga

SEQ ID NO: 15789 - DNA, 20 bp, Artificial Sequence
  chemically synthesized
tcagcatcagatagatcatc

SEQ ID NO: 15790 - DNA, 20 bp, Artificial Sequence
  chemically synthesized
catcagatagatcatctaga

SEQ ID NO: 15791 - DNA, 20 bp, Artificial Sequence
  chemically synthesized
atctagacagaaaattaaca

SEQ ID NO: 15792 - DNA, 20 bp, Artificial Sequence
  chemically synthesized
gaaaattaacaaagaaacat

SEQ ID NO: 15793 - DNA, 20 bp, Artificial Sequence
  chemically synthesized
attggatttaaacttgactt

SEQ ID NO: 15794 - DNA, 20 bp, Artificial Sequence
  chemically synthesized
aaacttgactttagaccaaa

SEQ ID NO: 15795 - DNA, 20 bp, Artificial Sequence
  chemically synthesized
ttacacaatatttcatccaa

SEQ ID NO: 15796 - DNA, 20 bp, Artificial Sequence
  chemically synthesized
aatatttcatccaacagcta

SEQ ID NO: 15797 - DNA, 20 bp, Artificial Sequence
  chemically synthesized
acagaatatatttatctcat

SEQ ID NO: 15798 - DNA, 20 bp, Artificial Sequence
  chemically synthesized
tcagcacatgacgcattccc

SEQ ID NO: 15799 - DNA, 20 bp, Artificial Sequence
  chemically synthesized
cagcacatgacgcattcccc

SEQ ID NO: 15800 - DNA, 20 bp, Artificial Sequence
  chemically synthesized
ccccaggatacaccatatgt

SEQ ID NO: 15801 - DNA, 20 bp, Artificial Sequence
  chemically synthesized
caccatatgttagaacacaa

SEQ ID NO: 15802 - DNA, 20 bp, Artificial Sequence
  chemically synthesized
catatgttagaacacaaaag

SEQ ID NO: 15803 - DNA, 20 bp, Artificial Sequence
  chemically synthesized
gaaatatttgaaatcatatt

SEQ ID NO: 15804 - DNA, 20 bp, Artificial Sequence
  chemically synthesized
aatcatattaagcatcttct

SEQ ID NO: 15805 - DNA, 20 bp, Artificial Sequence
  chemically synthesized
agcatcttctcagaccacaa

SEQ ID NO: 15806 - DNA, 20 bp, Artificial Sequence
  chemically synthesized
agaccacaatggaataaaac

SEQ ID NO: 15807 - DNA, 20 bp, Artificial Sequence
  chemically synthesized
taaaactagaaatcaataac

SEQ ID NO: 15808 - DNA, 20 bp, Artificial Sequence
  chemically synthesized
ttaaaacctatacaaataca

SEQ ID NO: 15809 - DNA, 20 bp, Artificial Sequence
  chemically synthesized
tcctgaatgaacgttatgtc

SEQ ID NO: 15810 - DNA, 20 bp, Artificial Sequence
  chemically synthesized
tgaatgaacgttatgtcaag

SEQ ID NO: 15811 - DNA, 20 bp, Artificial Sequence
  chemically synthesized
gttatgtcaagaagaaaatt

SEQ ID NO: 15812 - DNA, 20 bp, Artificial Sequence
  chemically synthesized
atgtcaagaagaaaattaag

SEQ ID NO: 15813 - DNA, 20 bp, Artificial Sequence
  chemically synthesized
tgtcaagaagaaaattaaga

SEQ ID NO: 15814 - DNA, 20 bp, Artificial Sequence
  chemically synthesized
atgaaaattgaaatacaaca

SEQ ID NO: 15815 - DNA, 20 bp, Artificial Sequence
  chemically synthesized
tgaaaattgaaatacaacat

SEQ ID NO: 15816 - DNA, 20 bp, Artificial Sequence
  chemically synthesized
attgaaatacaacataggaa

SEQ ID NO: 15817 - DNA, 20 bp, Artificial Sequence
  chemically synthesized
atacaacataggaaaagcca

SEQ ID NO: 15818 - DNA, 20 bp, Artificial Sequence
  chemically synthesized
tacaacataggaaaagccat

SEQ ID NO: 15819 - DNA, 20 bp, Artificial Sequence
  chemically synthesized
ataggaaaagccatgggata

SEQ ID NO: 15820 - DNA, 20 bp, Artificial Sequence
  chemically synthesized
aaagccatgggatacagcaa

SEQ ID NO: 15821 - DNA, 20 bp, Artificial Sequence
  chemically synthesized
gccatgggatacagcaaaag

SEQ ID NO: 15822 - DNA, 20 bp, Artificial Sequence
  chemically synthesized
gatacagcaaaagcagtgct

SEQ ID NO: 15823 - DNA, 20 bp, Artificial Sequence
  chemically synthesized
tacagcaaaagcagtgctaa

SEQ ID NO: 15824 - DNA, 20 bp, Artificial Sequence
  chemically synthesized
cagcaaaagcagtgctaaga

SEQ ID NO: 15825 - DNA, 20 bp, Artificial Sequence
  chemically synthesized
caaaagcagtgctaagagag

SEQ ID NO: 15826 - DNA, 20 bp, Artificial Sequence
  chemically synthesized
aaacacttaaattaaaaaca

SEQ ID NO: 15827 - DNA, 20 bp, Artificial Sequence
  chemically synthesized
acttaaattaaaaacataga

SEQ ID NO: 15828 - DNA, 20 bp, Artificial Sequence
  chemically synthesized
atctaatcatgtacctcaac

SEQ ID NO: 15829 - DNA, 20 bp, Artificial Sequence
  chemically synthesized
aatcatgtacctcaacaagc

SEQ ID NO: 15830 - DNA, 20 bp, Artificial Sequence
  chemically synthesized
tgtacctcaacaagctagaa

SEQ ID NO: 15831 - DNA, 20 bp, Artificial Sequence
  chemically synthesized
cctcaacaagctagaaaagc

SEQ ID NO: 15832 - DNA, 20 bp, Artificial Sequence
  chemically synthesized
gcaagaacaaaacccaaaac

SEQ ID NO: 15833 - DNA, 20 bp, Artificial Sequence
  chemically synthesized
agaacaaaacccaaaactag

SEQ ID NO: 15834 - DNA, 20 bp, Artificial Sequence
  chemically synthesized
acaaaacccaaaactagcag

SEQ ID NO: 15835 - DNA, 20 bp, Artificial Sequence
  chemically synthesized
caaaacccaaaactagcaga

SEQ ID NO: 15836 - DNA, 20 bp, Artificial Sequence
  chemically synthesized
acccaaaactagcagaagga

SEQ ID NO: 15837 - DNA, 20 bp, Artificial Sequence
  chemically synthesized
gcagaaggaaagaaaaaatg

SEQ ID NO: 15838 - DNA, 20 bp, Artificial Sequence
  chemically synthesized
aggaaagaaaaaatgaagaa

SEQ ID NO: 15839 - DNA, 20 bp, Artificial Sequence
  chemically synthesized
aaagaaaaaatgaagaacag

SEQ ID NO: 15840 - DNA, 20 bp, Artificial Sequence
  chemically synthesized
aacagaagaacttaatgaaa

SEQ ID NO: 15841 - DNA, 20 bp, Artificial Sequence
  chemically synthesized
cagaagaacttaatgaaata

SEQ ID NO: 15842 - DNA, 20 bp, Artificial Sequence
  chemically synthesized
aaatagagaaaaacaacaac

SEQ ID NO: 15843 - DNA, 20 bp, Artificial Sequence
  chemically synthesized
aatagagaaaaacaacaaca

SEQ ID NO: 15844 - DNA, 20 bp, Artificial Sequence
  chemically synthesized
atagagaaaaacaacaacaa

SEQ ID NO: 15845 - DNA, 20 bp, Artificial Sequence
  chemically synthesized
gaaaaacaacaacaagggat

SEQ ID NO: 15846 - DNA, 20 bp, Artificial Sequence
  chemically synthesized
caagggattagcaaaatgaa

SEQ ID NO: 15847 - DNA, 20 bp, Artificial Sequence
  chemically synthesized
tgaaaagttgttatttaaaa

SEQ ID NO: 15848 - DNA, 20 bp, Artificial Sequence
  chemically synthesized
gttatttaaaaaagataaaa

SEQ ID NO: 15849 - DNA, 20 bp, Artificial Sequence
  chemically synthesized
taaaaaagataaaatggata

SEQ ID NO: 15850 - DNA, 20 bp, Artificial Sequence
  chemically synthesized
agataaaatggatatagctc

SEQ ID NO: 15851 - DNA, 20 bp, Artificial Sequence
  chemically synthesized
aaaatggatatagctctagc

SEQ ID NO: 15852 - DNA, 20 bp, Artificial Sequence
  chemically synthesized
tagctctagctagactaacc

SEQ ID NO: 15853 - DNA, 20 bp, Artificial Sequence
  chemically synthesized
tagctagactaaccaagaaa

SEQ ID NO: 15854 - DNA, 20 bp, Artificial Sequence
  chemically synthesized
gctagactaaccaagaaaaa

SEQ ID NO: 15855 - DNA, 20 bp, Artificial Sequence
  chemically synthesized
agactaaccaagaaaaagag

SEQ ID NO: 15856 - DNA, 20 bp, Artificial Sequence
  chemically synthesized
actaaccaagaaaaagagaa

SEQ ID NO: 15857 - DNA, 20 bp, Artificial Sequence
  chemically synthesized
aaagagaagagactgaaata

SEQ ID NO: 15858 - DNA, 20 bp, Artificial Sequence
  chemically synthesized
gagactgaaataaagaaaat

SEQ ID NO: 15859 - DNA, 20 bp, Artificial Sequence
  chemically synthesized
aaagaaaatcagaaataaaa

SEQ ID NO: 15860 - DNA, 20 bp, Artificial Sequence
  chemically synthesized
atatattacaaccgatacca

SEQ ID NO: 15861 - DNA, 20 bp, Artificial Sequence
  chemically synthesized
tacaaccgataccacagaaa

SEQ ID NO: 15862 - DNA, 20 bp, Artificial Sequence
  chemically synthesized
ccgataccacagaaatagaa

SEQ ID NO: 15863 - DNA, 20 bp, Artificial Sequence
  chemically synthesized
acagaaatagaaaagattat

SEQ ID NO: 15864 - DNA, 20 bp, Artificial Sequence
  chemically synthesized
agaaatagaaaagattatca

SEQ ID NO: 15865 - DNA, 20 bp, Artificial Sequence
  chemically synthesized
cactaaaaaactgaaaaatc

SEQ ID NO: 15866 - DNA, 20 bp, Artificial Sequence
  chemically synthesized
ctaaaaaactgaaaaatcta

SEQ ID NO: 15867 - DNA, 20 bp, Artificial Sequence
  chemically synthesized
taaaaaactgaaaaatctag

SEQ ID NO: 15868 - DNA, 20 bp, Artificial Sequence
  chemically synthesized
agaggaaattaataaatttc

SEQ ID NO: 15869 - DNA, 20 bp, Artificial Sequence
  chemically synthesized
ctggacacataccacctacc

SEQ ID NO: 15870 - DNA, 20 bp, Artificial Sequence
  chemically synthesized
ccacctaccaagattgaatt

SEQ ID NO: 15871 - DNA, 20 bp, Artificial Sequence
  chemically synthesized
ctaccaagattgaattaaga

SEQ ID NO: 15872 - DNA, 20 bp, Artificial Sequence
  chemically synthesized
aagattgaattaagaaagaa

SEQ ID NO: 15873 - DNA, 20 bp, Artificial Sequence
  chemically synthesized
gaaagaatagaaaacctgaa

SEQ ID NO: 15874 - DNA, 20 bp, Artificial Sequence
  chemically synthesized
aatagaaaacctgaacagac

SEQ ID NO: 15875 - DNA, 20 bp, Artificial Sequence
  chemically synthesized
aatgaataatgaaattgaat

SEQ ID NO: 15876 - DNA, 20 bp, Artificial Sequence
  chemically synthesized
gaataatgaaattgaatcag

SEQ ID NO: 15877 - DNA, 20 bp, Artificial Sequence
  chemically synthesized
gaaattgaatcagtagtaaa

SEQ ID NO: 15878 - DNA, 20 bp, Artificial Sequence
  chemically synthesized
tagtaaaaagtctcccaaaa

SEQ ID NO: 15879 - DNA, 20 bp, Artificial Sequence
  chemically synthesized
ctcccaaaaaagaaaatttc

SEQ ID NO: 15880 - DNA, 20 bp, Artificial Sequence
  chemically synthesized
aaaaaagaaaatttcaagac

SEQ ID NO: 15881 - DNA, 20 bp, Artificial Sequence
  chemically synthesized
aagaaaatttcaagaccaga

SEQ ID NO: 15882 - DNA, 20 bp, Artificial Sequence
  chemically synthesized
caaattttaccaaactttca

SEQ ID NO: 15883 - DNA, 20 bp, Artificial Sequence
  chemically synthesized
aactttcaaagaaaactaac

SEQ ID NO: 15884 - DNA, 20 bp, Artificial Sequence
  chemically synthesized
aaattcttttaaaaattaaa

SEQ ID NO: 15885 - DNA, 20 bp, Artificial Sequence
  chemically synthesized
aattcttttaaaaattaaac

SEQ ID NO: 15886 - DNA, 20 bp, Artificial Sequence
  chemically synthesized
tcttttaaaaattaaacagg

SEQ ID NO: 15887 - DNA, 20 bp, Artificial Sequence
  chemically synthesized
cttttaaaaattaaacagga

SEQ ID NO: 15888 - DNA, 20 bp, Artificial Sequence
  chemically synthesized
ttctccctaactcattctct

SEQ ID NO: 15889 - DNA, 20 bp, Artificial Sequence
  chemically synthesized
tctccctaactcattctctg

SEQ ID NO: 15890 - DNA, 20 bp, Artificial Sequence
  chemically synthesized
cctaactcattctctgaggc

SEQ ID NO: 15891 - DNA, 20 bp, Artificial Sequence
  chemically synthesized
tattatcctgattccataac

SEQ ID NO: 15892 - DNA, 20 bp, Artificial Sequence
  chemically synthesized
tcctgattccataaccagac

SEQ ID NO: 15893 - DNA, 20 bp, Artificial Sequence
  chemically synthesized
cctgattccataaccagaca

SEQ ID NO: 15894 - DNA, 20 bp, Artificial Sequence
  chemically synthesized
ccataaccagacaaggatgc

SEQ ID NO: 15895 - DNA, 20 bp, Artificial Sequence
  chemically synthesized
tgcaagtaaaaataaaactg

SEQ ID NO: 15896 - DNA, 20 bp, Artificial Sequence
  chemically synthesized
gcaagtaaaaataaaactgc

SEQ ID NO: 15897 - DNA, 20 bp, Artificial Sequence
  chemically synthesized
ctgcaggtcaatatccctga

SEQ ID NO: 15898 - DNA, 20 bp, Artificial Sequence
  chemically synthesized
tcaatatccctgatggaaca

SEQ ID NO: 15899 - DNA, 20 bp, Artificial Sequence
  chemically synthesized
caatatccctgatggaacat

SEQ ID NO: 15900 - DNA, 20 bp, Artificial Sequence
  chemically synthesized
gaaaatcctcaacaaaatac

SEQ ID NO: 15901 - DNA, 20 bp, Artificial Sequence
  chemically synthesized
tactagcaaactgaatccaa

SEQ ID NO: 15902 - DNA, 20 bp, Artificial Sequence
  chemically synthesized
gaatccaacagtacatccaa

SEQ ID NO: 15903 - DNA, 20 bp, Artificial Sequence
  chemically synthesized
aaagataatacaccatgatc

SEQ ID NO: 15904 - DNA, 20 bp, Artificial Sequence
  chemically synthesized
gataatacaccatgatcaag

SEQ ID NO: 15905 - DNA, 20 bp, Artificial Sequence
  chemically synthesized
ataatacaccatgatcaagt

SEQ ID NO: 15906 - DNA, 20 bp, Artificial Sequence
  chemically synthesized
tgatcaagtgggatttatac

SEQ ID NO: 15907 - DNA, 20 bp, Artificial Sequence
  chemically synthesized
gatcaagtgggatttatact

SEQ ID NO: 15908 - DNA, 20 bp, Artificial Sequence
  chemically synthesized
atcaagtgggatttatacta

SEQ ID NO: 15909 - DNA, 20 bp, Artificial Sequence
  chemically synthesized
gggatttatactagggttgc

SEQ ID NO: 15910 - DNA, 20 bp, Artificial Sequence
  chemically synthesized
ttatactagggttgcaagaa

SEQ ID NO: 15911 - DNA, 20 bp, Artificial Sequence
  chemically synthesized
tgatacatcacatcaacaaa

SEQ ID NO: 15912 - DNA, 20 bp, Artificial Sequence
  chemically synthesized
aaaccatatgatcatctcaa

SEQ ID NO: 15913 - DNA, 20 bp, Artificial Sequence
  chemically synthesized
tatgatcatctcaatagata

SEQ ID NO: 15914 - DNA, 20 bp, Artificial Sequence
  chemically synthesized
catctcaatagatacagaaa

SEQ ID NO: 15915 - DNA, 20 bp, Artificial Sequence
  chemically synthesized
ttcatgataaaaactatctg

SEQ ID NO: 15916 - DNA, 20 bp, Artificial Sequence
  chemically synthesized
aaactatctgcagccaatca

SEQ ID NO: 15917 - DNA, 20 bp, Artificial Sequence
  chemically synthesized
ctatctgcagccaatcatag

SEQ ID NO: 15918 - DNA, 20 bp, Artificial Sequence
  chemically synthesized
tatctgcagccaatcataga

SEQ ID NO: 15919 - DNA, 20 bp, Artificial Sequence
  chemically synthesized
aacatatctcaatataataa

SEQ ID NO: 15920 - DNA, 20 bp, Artificial Sequence
  chemically synthesized
agtcatatatgacaaaccca

SEQ ID NO: 15921 - DNA, 20 bp, Artificial Sequence
  chemically synthesized
cagctaacatcatactgaat

SEQ ID NO: 15922 - DNA, 20 bp, Artificial Sequence
  chemically synthesized
agctaacatcatactgaatt

SEQ ID NO: 15923 - DNA, 20 bp, Artificial Sequence
  chemically synthesized
acatcatactgaattgggaa

SEQ ID NO: 15924 - DNA, 20 bp, Artificial Sequence
  chemically synthesized
catactgaattgggaaaagc

SEQ ID NO: 15925 - DNA, 20 bp, Artificial Sequence
  chemically synthesized
actgaattgggaaaagctgg

SEQ ID NO: 15926 - DNA, 20 bp, Artificial Sequence
  chemically synthesized
aagctggaagcctttcctct

SEQ ID NO: 15927 - DNA, 20 bp, Artificial Sequence
  chemically synthesized
tctaagaactgaaacaaaat

SEQ ID NO: 15928 - DNA, 20 bp, Artificial Sequence
  chemically synthesized
ctaagaactgaaacaaaata

SEQ ID NO: 15929 - DNA, 20 bp, Artificial Sequence
  chemically synthesized
actcctattcaatataatac

SEQ ID NO: 15930 - DNA, 20 bp, Artificial Sequence
  chemically synthesized
cctattcaatataatactgg

SEQ ID NO: 15931 - DNA, 20 bp, Artificial Sequence
  chemically synthesized
caatataatactggaagtcc

SEQ ID NO: 15932 - DNA, 20 bp, Artificial Sequence
  chemically synthesized
aatactggaagtcctagcca

SEQ ID NO: 15933 - DNA, 20 bp, Artificial Sequence
  chemically synthesized
gaagtcctagccacagcttt

SEQ ID NO: 15934 - DNA, 20 bp, Artificial Sequence
  chemically synthesized
aagtcctagccacagctttc

SEQ ID NO: 15935 - DNA, 20 bp, Artificial Sequence
  chemically synthesized
cctagccacagctttcaggt

SEQ ID NO: 15936 - DNA, 20 bp, Artificial Sequence
  chemically synthesized
tagccacagctttcaggtca

SEQ ID NO: 15937 - DNA, 20 bp, Artificial Sequence
  chemically synthesized
cacagctttcaggtcagaga

SEQ ID NO: 15938 - DNA, 20 bp, Artificial Sequence
  chemically synthesized
gctttcaggtcagagaaaga

SEQ ID NO: 15939 - DNA, 20 bp, Artificial Sequence
  chemically synthesized
tcaggtcagagaaagaaaga

SEQ ID NO: 15940 - DNA, 20 bp, Artificial Sequence
  chemically synthesized
tcagagaaagaaagaaagaa

SEQ ID NO: 15941 - DNA, 20 bp, Artificial Sequence
  chemically synthesized
cagagaaagaaagaaagaaa

SEQ ID NO: 15942 - DNA, 20 bp, Artificial Sequence
  chemically synthesized
agaaagaaaaggcatgcaaa

SEQ ID NO: 15943 - DNA, 20 bp, Artificial Sequence
  chemically synthesized
gaaagaaaaggcatgcaaat

SEQ ID NO: 15944 - DNA, 20 bp, Artificial Sequence
  chemically synthesized
aaaaggcatgcaaataggaa

SEQ ID NO: 15945 - DNA, 20 bp, Artificial Sequence
  chemically synthesized
catgcaaataggaaaagatg

SEQ ID NO: 15946 - DNA, 20 bp, Artificial Sequence
  chemically synthesized
agtcaaactgtccatctttc

SEQ ID NO: 15947 - DNA, 20 bp, Artificial Sequence
  chemically synthesized
agatgacatgattttatacc

SEQ ID NO: 15948 - DNA, 20 bp, Artificial Sequence
  chemically synthesized
attttatacctagaaaaacc

SEQ ID NO: 15949 - DNA, 20 bp, Artificial Sequence
  chemically synthesized
gaaaaaccaagactccacca

SEQ ID NO: 15950 - DNA, 20 bp, Artificial Sequence
  chemically synthesized
agactccaccaaagcactct

SEQ ID NO: 15951 - DNA, 20 bp, Artificial Sequence
  chemically synthesized
ttagcgctgaaaaataaatt

SEQ ID NO: 15952 - DNA, 20 bp, Artificial Sequence
  chemically synthesized
gctgaaaaataaattcagta

SEQ ID NO: 15953 - DNA, 20 bp, Artificial Sequence
  chemically synthesized
aaataaattcagtaaagtta

SEQ ID NO: 15954 - DNA, 20 bp, Artificial Sequence
  chemically synthesized
aataaattcagtaaagttac

SEQ ID NO: 15955 - DNA, 20 bp, Artificial Sequence
  chemically synthesized
taaattcagtaaagttacag

SEQ ID NO: 15956 - DNA, 20 bp, Artificial Sequence
  chemically synthesized
aaagttacaggagacaaaat

SEQ ID NO: 15957 - DNA, 20 bp, Artificial Sequence
  chemically synthesized
acaaaatcagcatatgaaac

SEQ ID NO: 15958 - DNA, 20 bp, Artificial Sequence
  chemically synthesized
tctacacaccaataataaac

SEQ ID NO: 15959 - DNA, 20 bp, Artificial Sequence
  chemically synthesized
acaccaataataaactagct

SEQ ID NO: 15960 - DNA, 20 bp, Artificial Sequence
  chemically synthesized
ccaataataaactagctgag

SEQ ID NO: 15961 - DNA, 20 bp, Artificial Sequence
  chemically synthesized
caataataaactagctgaga

SEQ ID NO: 15962 - DNA, 20 bp, Artificial Sequence
  chemically synthesized
aactagctgagaaggaaatt

SEQ ID NO: 15963 - DNA, 20 bp, Artificial Sequence
  chemically synthesized
tagctgagaaggaaattaag

SEQ ID NO: 15964 - DNA, 20 bp, Artificial Sequence
  chemically synthesized
agctgagaaggaaattaaga

SEQ ID NO: 15965 - DNA, 20 bp, Artificial Sequence
  chemically synthesized
gaaggcaatcccatttacaa

SEQ ID NO: 15966 - DNA, 20 bp, Artificial Sequence
  chemically synthesized
tagctaaaaaataaaatatt

SEQ ID NO: 15967 - DNA, 20 bp, Artificial Sequence
  chemically synthesized
agctaaaaaataaaatattt

SEQ ID NO: 15968 - DNA, 20 bp, Artificial Sequence
  chemically synthesized
gctaaaaaataaaatattta

SEQ ID NO: 15969 - DNA, 20 bp, Artificial Sequence
  chemically synthesized
atttagggataaatttaacc

SEQ ID NO: 15970 - DNA, 20 bp, Artificial Sequence
  chemically synthesized
tttagggataaatttaacca

SEQ ID NO: 15971 - DNA, 20 bp, Artificial Sequence
  chemically synthesized
ggaaccgaaaaacctctatt

SEQ ID NO: 15972 - DNA, 20 bp, Artificial Sequence
  chemically synthesized
aaactacaaaacactgataa

SEQ ID NO: 15973 - DNA, 20 bp, Artificial Sequence
  chemically synthesized
acactgataaaagaattgaa

SEQ ID NO: 15974 - DNA, 20 bp, Artificial Sequence
  chemically synthesized
cactgataaaagaattgaaa

SEQ ID NO: 15975 - DNA, 20 bp, Artificial Sequence
  chemically synthesized
gataaaagaattgaaaagga

SEQ ID NO: 15976 - DNA, 20 bp, Artificial Sequence
  chemically synthesized
ttgaaaaggacagaaacaaa

SEQ ID NO: 15977 - DNA, 20 bp, Artificial Sequence
  chemically synthesized
gaaaaggacagaaacaaatg

SEQ ID NO: 15978 - DNA, 20 bp, Artificial Sequence
  chemically synthesized
aaaggacagaaacaaatgga

SEQ ID NO: 15979 - DNA, 20 bp, Artificial Sequence
  chemically synthesized
ggagagatatcctatgttca

SEQ ID NO: 15980 - DNA, 20 bp, Artificial Sequence
  chemically synthesized
gatatcctatgttcatggat

SEQ ID NO: 15981 - DNA, 20 bp, Artificial Sequence
  chemically synthesized
aaaaattaatattgttaaaa

SEQ ID NO: 15982 - DNA, 20 bp, Artificial Sequence
  chemically synthesized
taaaatggccatactaccca

SEQ ID NO: 15983 - DNA, 20 bp, Artificial Sequence
  chemically synthesized
atactacccaaagcaatcta

SEQ ID NO: 15984 - DNA, 20 bp, Artificial Sequence
  chemically synthesized
ctatatgaccgctatcaaaa

SEQ ID NO: 15985 - DNA, 20 bp, Artificial Sequence
  chemically synthesized
aatagcaatgtcatttttca

SEQ ID NO: 15986 - DNA, 20 bp, Artificial Sequence
  chemically synthesized
aatgtcatttttcacagaaa

SEQ ID NO: 15987 - DNA, 20 bp, Artificial Sequence
  chemically synthesized
atttgtatgaaattaaaaaa

SEQ ID NO: 15988 - DNA, 20 bp, Artificial Sequence
  chemically synthesized
atgaaattaaaaaatagctc

SEQ ID NO: 15989 - DNA, 20 bp, Artificial Sequence
  chemically synthesized
aaattaaaaaatagctccag

SEQ ID NO: 15990 - DNA, 20 bp, Artificial Sequence
  chemically synthesized
aaaaatagctccagtagcca

SEQ ID NO: 15991 - DNA, 20 bp, Artificial Sequence
  chemically synthesized
ccaaagtcatcctgtgaaaa

SEQ ID NO: 15992 - DNA, 20 bp, Artificial Sequence
  chemically synthesized
ctgtgaaaaaagaacaatgc

SEQ ID NO: 15993 - DNA, 20 bp, Artificial Sequence
  chemically synthesized
gtgaaaaaagaacaatgcta

SEQ ID NO: 15994 - DNA, 20 bp, Artificial Sequence
  chemically synthesized
tgaaaaaagaacaatgctag

SEQ ID NO: 15995 - DNA, 20 bp, Artificial Sequence
  chemically synthesized
tatcatactacctgatttca

SEQ ID NO: 15996 - DNA, 20 bp, Artificial Sequence
  chemically synthesized
gatttcaaagtatattacaa

SEQ ID NO: 15997 - DNA, 20 bp, Artificial Sequence
  chemically synthesized
caaagtatattacaaaagta

SEQ ID NO: 15998 - DNA, 20 bp, Artificial Sequence
  chemically synthesized
aaagtatattacaaaagtat

SEQ ID NO: 15999 - DNA, 20 bp, Artificial Sequence
  chemically synthesized
caaaagtataggaacctaaa

SEQ ID NO: 16000 - DNA, 20 bp, Artificial Sequence
  chemically synthesized
aaacagcatgatactgacat

SEQ ID NO: 16001 - DNA, 20 bp, Artificial Sequence
  chemically synthesized
gcatgatactgacattagaa

SEQ ID NO: 16002 - DNA, 20 bp, Artificial Sequence
  chemically synthesized
ctgacattagaacagacact

SEQ ID NO: 16003 - DNA, 20 bp, Artificial Sequence
  chemically synthesized
agaacagacacttagaccaa

SEQ ID NO: 16004 - DNA, 20 bp, Artificial Sequence
  chemically synthesized
acagacacttagaccaatgg

SEQ ID NO: 16005 - DNA, 20 bp, Artificial Sequence
  chemically synthesized
agacacttagaccaatggaa

SEQ ID NO: 16006 - DNA, 20 bp, Artificial Sequence
  chemically synthesized
cttagaccaatggaagagaa

SEQ ID NO: 16007 - DNA, 20 bp, Artificial Sequence
  chemically synthesized
tagaccaatggaagagaata

SEQ ID NO: 16008 - DNA, 20 bp, Artificial Sequence
  chemically synthesized
atggaagagaatagagaacc

SEQ ID NO: 16009 - DNA, 20 bp, Artificial Sequence
  chemically synthesized
gaaatgcatccacatattta

SEQ ID NO: 16010 - DNA, 20 bp, Artificial Sequence
  chemically synthesized
atccacatatttatagccaa

SEQ ID NO: 16011 - DNA, 20 bp, Artificial Sequence
  chemically synthesized
tagccaacagattttcaaca

SEQ ID NO: 16012 - DNA, 20 bp, Artificial Sequence
  chemically synthesized
agccaacagattttcaacaa

SEQ ID NO: 16013 - DNA, 20 bp, Artificial Sequence
  chemically synthesized
agattttcaacaaaggtgac

SEQ ID NO: 16014 - DNA, 20 bp, Artificial Sequence
  chemically synthesized
aggtgacaagaatatacatt

SEQ ID NO: 16015 - DNA, 20 bp, Artificial Sequence
  chemically synthesized
ggtgacaagaatatacattg

SEQ ID NO: 16016 - DNA, 20 bp, Artificial Sequence
  chemically synthesized
acaagaatatacattgagga

SEQ ID NO: 16017 - DNA, 20 bp, Artificial Sequence
  chemically synthesized
caagaatatacattgaggaa

SEQ ID NO: 16018 - DNA, 20 bp, Artificial Sequence
  chemically synthesized
tatacattgaggaaaggaca

SEQ ID NO: 16019 - DNA, 20 bp, Artificial Sequence
  chemically synthesized
gaggaaaggacacagtgttc

SEQ ID NO: 16020 - DNA, 20 bp, Artificial Sequence
  chemically synthesized
aggacacagtgttcaagaaa

SEQ ID NO: 16021 - DNA, 20 bp, Artificial Sequence
  chemically synthesized
agaaatggtgctgaaaaaat

SEQ ID NO: 16022 - DNA, 20 bp, Artificial Sequence
  chemically synthesized
tgaaaaaattggatatccat

SEQ ID NO: 16023 - DNA, 20 bp, Artificial Sequence
  chemically synthesized
cattggatatccatgtgcaa

SEQ ID NO: 16024 - DNA, 20 bp, Artificial Sequence
  chemically synthesized
catgtgcaaaagaataaaac

SEQ ID NO: 16025 - DNA, 20 bp, Artificial Sequence
  chemically synthesized
ataaaactggactgctgata

SEQ ID NO: 16026 - DNA, 20 bp, Artificial Sequence
  chemically synthesized
actggactgctgatatggtt

SEQ ID NO: 16027 - DNA, 20 bp, Artificial Sequence
  chemically synthesized
aaatataatccccaacttct

SEQ ID NO: 16028 - DNA, 20 bp, Artificial Sequence
  chemically synthesized
aatataatccccaacttctc

SEQ ID NO: 16029 - DNA, 20 bp, Artificial Sequence
  chemically synthesized
tccccaacttctcaggatct

SEQ ID NO: 16030 - DNA, 20 bp, Artificial Sequence
  chemically synthesized
ccaacttctcaggatcttgg

SEQ ID NO: 16031 - DNA, 20 bp, Artificial Sequence
  chemically synthesized
cttctcaggatcttggcgga

SEQ ID NO: 16032 - DNA, 20 bp, Artificial Sequence
  chemically synthesized
ttctcaggatcttggcggat

SEQ ID NO: 16033 - DNA, 20 bp, Artificial Sequence
  chemically synthesized
ctcaggatcttggcggatgg

SEQ ID NO: 16034 - DNA, 20 bp, Artificial Sequence
  chemically synthesized
tcaggatcttggcggatggg

SEQ ID NO: 16035 - DNA, 20 bp, Artificial Sequence
  chemically synthesized
ggatcttggcggatgggagg

SEQ ID NO: 16036 - DNA, 20 bp, Artificial Sequence
  chemically synthesized
gatcttggcggatgggaggt

SEQ ID NO: 16037 - DNA, 20 bp, Artificial Sequence
  chemically synthesized
tggcggatgggaggtaggcc

SEQ ID NO: 16038 - DNA, 20 bp, Artificial Sequence
  chemically synthesized
tgggaggtaggcctagattg

SEQ ID NO: 16039 - DNA, 20 bp, Artificial Sequence
  chemically synthesized
cctagattgcagctccaact

SEQ ID NO: 16040 - DNA, 20 bp, Artificial Sequence
  chemically synthesized
gattgcagctccaactcaga

SEQ ID NO: 16041 - DNA, 20 bp, Artificial Sequence
  chemically synthesized
gcagctccaactcagatgga

SEQ ID NO: 16042 - DNA, 20 bp, Artificial Sequence
  chemically synthesized
agctccaactcagatggaca

SEQ ID NO: 16043 - DNA, 20 bp, Artificial Sequence
  chemically synthesized
tccaactcagatggacagag

SEQ ID NO: 16044 - DNA, 20 bp, Artificial Sequence
  chemically synthesized
cagatggacagagcagcatg

SEQ ID NO: 16045 - DNA, 20 bp, Artificial Sequence
  chemically synthesized
gatggacagagcagcatgtg

SEQ ID NO: 16046 - DNA, 20 bp, Artificial Sequence
  chemically synthesized
atggacagagcagcatgtgg

SEQ ID NO: 16047 - DNA, 20 bp, Artificial Sequence
  chemically synthesized
gaggctcgcattgtgaattt

SEQ ID NO: 16048 - DNA, 20 bp, Artificial Sequence
  chemically synthesized
cgcattgtgaattttagctg

SEQ ID NO: 16049 - DNA, 20 bp, Artificial Sequence
  chemically synthesized
ttgtgaattttagctgcaga

SEQ ID NO: 16050 - DNA, 20 bp, Artificial Sequence
  chemically synthesized
tttagctgcagatagactgc

SEQ ID NO: 16051 - DNA, 20 bp, Artificial Sequence
  chemically synthesized
gatagactgcaagaacaaac

SEQ ID NO: 16052 - DNA, 20 bp, Artificial Sequence
  chemically synthesized
aagaacaaaccagcaatcct

SEQ ID NO: 16053 - DNA, 20 bp, Artificial Sequence
  chemically synthesized
gaacaaaccagcaatcctga

SEQ ID NO: 16054 - DNA, 20 bp, Artificial Sequence
  chemically synthesized
aacaaaccagcaatcctgag

SEQ ID NO: 16055 - DNA, 20 bp, Artificial Sequence
  chemically synthesized
agcaatcctgagaggaccca

SEQ ID NO: 16056 - DNA, 20 bp, Artificial Sequence
  chemically synthesized
gaggacccacagaccctctg

SEQ ID NO: 16057 - DNA, 20 bp, Artificial Sequence
  chemically synthesized
aggacccacagaccctctga

SEQ ID NO: 16058 - DNA, 20 bp, Artificial Sequence
  chemically synthesized
acccacagaccctctgaagg

SEQ ID NO: 16059 - DNA, 20 bp, Artificial Sequence
  chemically synthesized
cacagaccctctgaaggaag

SEQ ID NO: 16060 - DNA, 20 bp, Artificial Sequence
  chemically synthesized
aaggaagtagattgctcctg

SEQ ID NO: 16061 - DNA, 20 bp, Artificial Sequence
  chemically synthesized
aggaagtagattgctcctgc

SEQ ID NO: 16062 - DNA, 20 bp, Artificial Sequence
  chemically synthesized
tagattgctcctgcaggacc

SEQ ID NO: 16063 - DNA, 20 bp, Artificial Sequence
  chemically synthesized
agattgctcctgcaggaccc

SEQ ID NO: 16064 - DNA, 20 bp, Artificial Sequence
  chemically synthesized
attgctcctgcaggacccag

SEQ ID NO: 16065 - DNA, 20 bp, Artificial Sequence
  chemically synthesized
ggagacaccccaaatactgt

SEQ ID NO: 16066 - DNA, 20 bp, Artificial Sequence
  chemically synthesized
tactgtgagtgccccaactg

SEQ ID NO: 16067 - DNA, 20 bp, Artificial Sequence
  chemically synthesized
tgtgagtgccccaactgcgg

SEQ ID NO: 16068 - DNA, 20 bp, Artificial Sequence
  chemically synthesized
gagtgccccaactgcggaag

SEQ ID NO: 16069 - DNA, 20 bp, Artificial Sequence
  chemically synthesized
agtgccccaactgcggaagt

SEQ ID NO: 16070 - DNA, 20 bp, Artificial Sequence
  chemically synthesized
ccccaactgcggaagtggga

SEQ ID NO: 16071 - DNA, 20 bp, Artificial Sequence
  chemically synthesized
cccaactgcggaagtgggaa

SEQ ID NO: 16072 - DNA, 20 bp, Artificial Sequence
  chemically synthesized
ccaactgcggaagtgggaaa

SEQ ID NO: 16073 - DNA, 20 bp, Artificial Sequence
  chemically synthesized
aactgcggaagtgggaaagg

SEQ ID NO: 16074 - DNA, 20 bp, Artificial Sequence
  chemically synthesized
tcctaaacacacactcccac

SEQ ID NO: 16075 - DNA, 20 bp, Artificial Sequence
  chemically synthesized
ctaaacacacactcccactg

SEQ ID NO: 16076 - DNA, 20 bp, Artificial Sequence
  chemically synthesized
cactcccactggagaaactg

SEQ ID NO: 16077 - DNA, 20 bp, Artificial Sequence
  chemically synthesized
actcccactggagaaactga

SEQ ID NO: 16078 - DNA, 20 bp, Artificial Sequence
  chemically synthesized
agaaactgaaggtctgtttg

SEQ ID NO: 16079 - DNA, 20 bp, Artificial Sequence
  chemically synthesized
gaaactgaaggtctgtttgt

SEQ ID NO: 16080 - DNA, 20 bp, Artificial Sequence
  chemically synthesized
aactgaaggtctgtttgtgg

SEQ ID NO: 16081 - DNA, 20 bp, Artificial Sequence
  chemically synthesized
tgaaggtctgtttgtgggag

SEQ ID NO: 16082 - DNA, 20 bp, Artificial Sequence
  chemically synthesized
gagaagtttctgaccttacc

SEQ ID NO: 16083 - DNA, 20 bp, Artificial Sequence
  chemically synthesized
gaagtttctgaccttacctg

SEQ ID NO: 16084 - DNA, 20 bp, Artificial Sequence
  chemically synthesized
ttctgaccttacctggagtt

SEQ ID NO: 16085 - DNA, 20 bp, Artificial Sequence
  chemically synthesized
tacctggagttgagttaact

SEQ ID NO: 16086 - DNA, 20 bp, Artificial Sequence
  chemically synthesized
cctggagttgagttaactta

SEQ ID NO: 16087 - DNA, 20 bp, Artificial Sequence
  chemically synthesized
tggagttgagttaacttaga

SEQ ID NO: 16088 - DNA, 20 bp, Artificial Sequence
  chemically synthesized
ttgagttaacttagagagct

SEQ ID NO: 16089 - DNA, 20 bp, Artificial Sequence
  chemically synthesized
ttagagagctgagcaaaata

SEQ ID NO: 16090 - DNA, 20 bp, Artificial Sequence
  chemically synthesized
tagagagctgagcaaaatac

SEQ ID NO: 16091 - DNA, 20 bp, Artificial Sequence
  chemically synthesized
agctgagcaaaatacaggtg

SEQ ID NO: 16092 - DNA, 20 bp, Artificial Sequence
  chemically synthesized
ctgagcaaaatacaggtgta

SEQ ID NO: 16093 - DNA, 20 bp, Artificial Sequence
  chemically synthesized
tgagcaaaatacaggtgtag

SEQ ID NO: 16094 - DNA, 20 bp, Artificial Sequence
  chemically synthesized
gcaaaatacaggtgtagagg

SEQ ID NO: 16095 - DNA, 20 bp, Artificial Sequence
  chemically synthesized
aaatacaggtgtagaggaag

SEQ ID NO: 16096 - DNA, 20 bp, Artificial Sequence
  chemically synthesized
acaggtgtagaggaagcagt

SEQ ID NO: 16097 - DNA, 20 bp, Artificial Sequence
  chemically synthesized
gtgtagaggaagcagtgaga

SEQ ID NO: 16098 - DNA, 20 bp, Artificial Sequence
  chemically synthesized
tgtagaggaagcagtgagaa

SEQ ID NO: 16099 - DNA, 20 bp, Artificial Sequence
  chemically synthesized
ggaagcagtgagaaaggccc

SEQ ID NO: 16100 - DNA, 20 bp, Artificial Sequence
  chemically synthesized
gaagcagtgagaaaggccct

SEQ ID NO: 16101 - DNA, 20 bp, Artificial Sequence
  chemically synthesized
agcagtgagaaaggccctgg

SEQ ID NO: 16102 - DNA, 20 bp, Artificial Sequence
  chemically synthesized
gaaaggccctgggagctcac

SEQ ID NO: 16103 - DNA, 20 bp, Artificial Sequence
  chemically synthesized
aaaggccctgggagctcact

SEQ ID NO: 16104 - DNA, 20 bp, Artificial Sequence
  chemically synthesized
tgggagctcactgggtccct

SEQ ID NO: 16105 - DNA, 20 bp, Artificial Sequence
  chemically synthesized
gagctcactgggtccctgag

SEQ ID NO: 16106 - DNA, 20 bp, Artificial Sequence
  chemically synthesized
agctcactgggtccctgagc

SEQ ID NO: 16107 - DNA, 20 bp, Artificial Sequence
  chemically synthesized
ctgagcaggccattcctgcc

SEQ ID NO: 16108 - DNA, 20 bp, Artificial Sequence
  chemically synthesized
caggccattcctgcctggca

SEQ ID NO: 16109 - DNA, 20 bp, Artificial Sequence
  chemically synthesized
ccattcctgcctggcatagc

SEQ ID NO: 16110 - DNA, 20 bp, Artificial Sequence
  chemically synthesized
cattcctgcctggcatagcc

SEQ ID NO: 16111 - DNA, 20 bp, Artificial Sequence
  chemically synthesized
ttactaacattgaatgtaaa

SEQ ID NO: 16112 - DNA, 20 bp, Artificial Sequence
  chemically synthesized
ggcctaaatgctccacttaa

SEQ ID NO: 16113 - DNA, 20 bp, Artificial Sequence
  chemically synthesized
gcctaaatgctccacttaaa

SEQ ID NO: 16114 - DNA, 20 bp, Artificial Sequence
  chemically synthesized
cctaaatgctccacttaaaa

SEQ ID NO: 16115 - DNA, 20 bp, Artificial Sequence
  chemically synthesized
ctccacttaaaagggtgaaa

SEQ ID NO: 16116 - DNA, 20 bp, Artificial Sequence
  chemically synthesized
tccacttaaaagggtgaaaa

SEQ ID NO: 16117 - DNA, 20 bp, Artificial Sequence
  chemically synthesized
aaaaaggtatttcatgcaaa

SEQ ID NO: 16118 - DNA, 20 bp, Artificial Sequence
  chemically synthesized
ttcatgcaaatggccaccaa

SEQ ID NO: 16119 - DNA, 20 bp, Artificial Sequence
  chemically synthesized
tgcaaatggccaccaaaagt

SEQ ID NO: 16120 - DNA, 20 bp, Artificial Sequence
  chemically synthesized
aaatggccaccaaaagtgag

SEQ ID NO: 16121 - DNA, 20 bp, Artificial Sequence
  chemically synthesized
aatggccaccaaaagtgagt

SEQ ID NO: 16122 - DNA, 20 bp, Artificial Sequence
  chemically synthesized
agtaggcaaaacaaacttta

SEQ ID NO: 16123 - DNA, 20 bp, Artificial Sequence
  chemically synthesized
caaaacaaactttaaagcaa

SEQ ID NO: 16124 - DNA, 20 bp, Artificial Sequence
  chemically synthesized
aacaaactttaaagcaacag

SEQ ID NO: 16125 - DNA, 20 bp, Artificial Sequence
  chemically synthesized
tttaaagcaacagcagttaa

SEQ ID NO: 16126 - DNA, 20 bp, Artificial Sequence
  chemically synthesized
taaagcaacagcagttaaaa

SEQ ID NO: 16127 - DNA, 20 bp, Artificial Sequence
  chemically synthesized
aacagcagttaaaagagaca

SEQ ID NO: 16128 - DNA, 20 bp, Artificial Sequence
  chemically synthesized
cagcagttaaaagagacaaa

SEQ ID NO: 16129 - DNA, 20 bp, Artificial Sequence
  chemically synthesized
agcagttaaaagagacaaag

SEQ ID NO: 16130 - DNA, 20 bp, Artificial Sequence
  chemically synthesized
gcagttaaaagagacaaaga

SEQ ID NO: 16131 - DNA, 20 bp, Artificial Sequence
  chemically synthesized
caaagagggacattatataa

SEQ ID NO: 16132 - DNA, 20 bp, Artificial Sequence
  chemically synthesized
gggacattatataatggtaa

SEQ ID NO: 16133 - DNA, 20 bp, Artificial Sequence
  chemically synthesized
ggacattatataatggtaaa

SEQ ID NO: 16134 - DNA, 20 bp, Artificial Sequence
  chemically synthesized
tggtaaaaggccttgtccaa

SEQ ID NO: 16135 - DNA, 20 bp, Artificial Sequence
  chemically synthesized
ggtaaaaggccttgtccaac

SEQ ID NO: 16136 - DNA, 20 bp, Artificial Sequence
  chemically synthesized
aacatatatgcacctaacac

SEQ ID NO: 16137 - DNA, 20 bp, Artificial Sequence
  chemically synthesized
catatatgcacctaacactg

SEQ ID NO: 16138 - DNA, 20 bp, Artificial Sequence
  chemically synthesized
cactggagctcccaaattta

SEQ ID NO: 16139 - DNA, 20 bp, Artificial Sequence
  chemically synthesized
atttatagaacaattactaa

SEQ ID NO: 16140 - DNA, 20 bp, Artificial Sequence
  chemically synthesized
gaacaattactaatagacct

SEQ ID NO: 16141 - DNA, 20 bp, Artificial Sequence
  chemically synthesized
tactaatagacctaagaaat

SEQ ID NO: 16142 - DNA, 20 bp, Artificial Sequence
  chemically synthesized
aatagacctaagaaatgaga

SEQ ID NO: 16143 - DNA, 20 bp, Artificial Sequence
  chemically synthesized
gacctaagaaatgagataga

SEQ ID NO: 16144 - DNA, 20 bp, Artificial Sequence
  chemically synthesized
gatagacagcaacacaataa

SEQ ID NO: 16145 - DNA, 20 bp, Artificial Sequence
  chemically synthesized
agacagcaacacaataatag

SEQ ID NO: 16146 - DNA, 20 bp, Artificial Sequence
  chemically synthesized
gacagcaacacaataatagt

SEQ ID NO: 16147 - DNA, 20 bp, Artificial Sequence
  chemically synthesized
acagcaacacaataatagtg

SEQ ID NO: 16148 - DNA, 20 bp, Artificial Sequence
  chemically synthesized
cagcaacacaataatagtgg

SEQ ID NO: 16149 - DNA, 20 bp, Artificial Sequence
  chemically synthesized
ggacttcaatacttcattga

SEQ ID NO: 16150 - DNA, 20 bp, Artificial Sequence
  chemically synthesized
caatacttcattgacagcac

SEQ ID NO: 16151 - DNA, 20 bp, Artificial Sequence
  chemically synthesized
acttcattgacagcactaga

SEQ ID NO: 16152 - DNA, 20 bp, Artificial Sequence
  chemically synthesized
acagcactagacagttcatc

SEQ ID NO: 16153 - DNA, 20 bp, Artificial Sequence
  chemically synthesized
cactagacagttcatcaaga

SEQ ID NO: 16154 - DNA, 20 bp, Artificial Sequence
  chemically synthesized
agacagttcatcaagacaga

SEQ ID NO: 16155 - DNA, 20 bp, Artificial Sequence
  chemically synthesized
gaaagtcaacaaaaaaataa

SEQ ID NO: 16156 - DNA, 20 bp, Artificial Sequence
  chemically synthesized
aatggatttaaattatacct

SEQ ID NO: 16157 - DNA, 20 bp, Artificial Sequence
  chemically synthesized
aaattataccttagaacaaa

SEQ ID NO: 16158 - DNA, 20 bp, Artificial Sequence
  chemically synthesized
cttagaacaaatggacttaa

SEQ ID NO: 16159 - DNA, 20 bp, Artificial Sequence
  chemically synthesized
atggacttaacagttatata

SEQ ID NO: 16160 - DNA, 20 bp, Artificial Sequence
  chemically synthesized
aacatttcatccaataacca

SEQ ID NO: 16161 - DNA, 20 bp, Artificial Sequence
  chemically synthesized
agaacacacattctattcaa

SEQ ID NO: 16162 - DNA, 20 bp, Artificial Sequence
  chemically synthesized
acattctattcaacagcgcg

SEQ ID NO: 16163 - DNA, 20 bp, Artificial Sequence
  chemically synthesized
cagcgcgtggaaatttctcc

SEQ ID NO: 16164 - DNA, 20 bp, Artificial Sequence
  chemically synthesized
agcgcgtggaaatttctcca

SEQ ID NO: 16165 - DNA, 20 bp, Artificial Sequence
  chemically synthesized
gcgtggaaatttctccaagg

SEQ ID NO: 16166 - DNA, 20 bp, Artificial Sequence
  chemically synthesized
ctccaaggtagaccatatga

SEQ ID NO: 16167 - DNA, 20 bp, Artificial Sequence
  chemically synthesized
tccaaggtagaccatatgat

SEQ ID NO: 16168 - DNA, 20 bp, Artificial Sequence
  chemically synthesized
catatgataggccatgaaat

SEQ ID NO: 16169 - DNA, 20 bp, Artificial Sequence
  chemically synthesized
agcctcaataaatttactaa

SEQ ID NO: 16170 - DNA, 20 bp, Artificial Sequence
  chemically synthesized
tttactaacagaccaataac

SEQ ID NO: 16171 - DNA, 20 bp, Artificial Sequence
  chemically synthesized
actaacagaccaataacaag

SEQ ID NO: 16172 - DNA, 20 bp, Artificial Sequence
  chemically synthesized
acagaccaataacaagcagt

SEQ ID NO: 16173 - DNA, 20 bp, Artificial Sequence
  chemically synthesized
aacaagcagtgagatttaat

SEQ ID NO: 16174 - DNA, 20 bp, Artificial Sequence
  chemically synthesized
aaaaattaccaaccaaaaaa

SEQ ID NO: 16175 - DNA, 20 bp, Artificial Sequence
  chemically synthesized
ttaccaaccaaaaaaaagtt

SEQ ID NO: 16176 - DNA, 20 bp, Artificial Sequence
  chemically synthesized
taccaaccaaaaaaaagttc

SEQ ID NO: 16177 - DNA, 20 bp, Artificial Sequence
  chemically synthesized
accaaaaaaaagttcaggac

SEQ ID NO: 16178 - DNA, 20 bp, Artificial Sequence
  chemically synthesized
aaaaaaagttcaggaccaga

SEQ ID NO: 16179 - DNA, 20 bp, Artificial Sequence
  chemically synthesized
aggaccagatggattcacaa

SEQ ID NO: 16180 - DNA, 20 bp, Artificial Sequence
  chemically synthesized
gattcacaacagaattctac

SEQ ID NO: 16181 - DNA, 20 bp, Artificial Sequence
  chemically synthesized
agaattctactagacattca

SEQ ID NO: 16182 - DNA, 20 bp, Artificial Sequence
  chemically synthesized
aattctactagacattcaaa

SEQ ID NO: 16183 - DNA, 20 bp, Artificial Sequence
  chemically synthesized
attctactagacattcaaag

SEQ ID NO: 16184 - DNA, 20 bp, Artificial Sequence
  chemically synthesized
ctagacattcaaagaggaat

SEQ ID NO: 16185 - DNA, 20 bp, Artificial Sequence
  chemically synthesized
tctttttgacactattctac

SEQ ID NO: 16186 - DNA, 20 bp, Artificial Sequence
  chemically synthesized
tttgacactattctacaaga

SEQ ID NO: 16187 - DNA, 20 bp, Artificial Sequence
  chemically synthesized
actattctacaagacagata

SEQ ID NO: 16188 - DNA, 20 bp, Artificial Sequence
  chemically synthesized
attctacaagacagataaag

SEQ ID NO: 16189 - DNA, 20 bp, Artificial Sequence
  chemically synthesized
ttctacaagacagataaaga

SEQ ID NO: 16190 - DNA, 20 bp, Artificial Sequence
  chemically synthesized
ctgccctaattcattctatg

SEQ ID NO: 16191 - DNA, 20 bp, Artificial Sequence
  chemically synthesized
cctaattcattctatgaagc

SEQ ID NO: 16192 - DNA, 20 bp, Artificial Sequence
  chemically synthesized
agccagcatcacaccaaaac

SEQ ID NO: 16193 - DNA, 20 bp, Artificial Sequence
  chemically synthesized
gccagcatcacaccaaaacc

SEQ ID NO: 16194 - DNA, 20 bp, Artificial Sequence
  chemically synthesized
ccagcatcacaccaaaacca

SEQ ID NO: 16195 - DNA, 20 bp, Artificial Sequence
  chemically synthesized
gcatcacaccaaaaccaggg

SEQ ID NO: 16196 - DNA, 20 bp, Artificial Sequence
  chemically synthesized
catcacaccaaaaccaggga

SEQ ID NO: 16197 - DNA, 20 bp, Artificial Sequence
  chemically synthesized
agggaaggacataaccaaaa

SEQ ID NO: 16198 - DNA, 20 bp, Artificial Sequence
  chemically synthesized
ataaccaaaaaagaaaacta

SEQ ID NO: 16199 - DNA, 20 bp, Artificial Sequence
  chemically synthesized
aaaagaaaactacagactga

SEQ ID NO: 16200 - DNA, 20 bp, Artificial Sequence
  chemically synthesized
actgatagccttgatgaaca

SEQ ID NO: 16201 - DNA, 20 bp, Artificial Sequence
  chemically synthesized
taaaatccttaacaaaatac

SEQ ID NO: 16202 - DNA, 20 bp, Artificial Sequence
  chemically synthesized
aaattcaacaacataacaaa

SEQ ID NO: 16203 - DNA, 20 bp, Artificial Sequence
  chemically synthesized
aaagataatccaccatgatc

SEQ ID NO: 16204 - DNA, 20 bp, Artificial Sequence
  chemically synthesized
gataatccaccatgatcaag

SEQ ID NO: 16205 - DNA, 20 bp, Artificial Sequence
  chemically synthesized
ataatccaccatgatcaagc

SEQ ID NO: 16206 - DNA, 20 bp, Artificial Sequence
  chemically synthesized
tgatcaagcaggttccatgc

SEQ ID NO: 16207 - DNA, 20 bp, Artificial Sequence
  chemically synthesized
gatcaagcaggttccatgcc

SEQ ID NO: 16208 - DNA, 20 bp, Artificial Sequence
  chemically synthesized
atcaagcaggttccatgcca

SEQ ID NO: 16209 - DNA, 20 bp, Artificial Sequence
  chemically synthesized
caggttccatgccagggatg

SEQ ID NO: 16210 - DNA, 20 bp, Artificial Sequence
  chemically synthesized
aggttccatgccagggatgc

SEQ ID NO: 16211 - DNA, 20 bp, Artificial Sequence
  chemically synthesized
ggttccatgccagggatgca

SEQ ID NO: 16212 - DNA, 20 bp, Artificial Sequence
  chemically synthesized
ccatgccagggatgcagggt

SEQ ID NO: 16213 - DNA, 20 bp, Artificial Sequence
  chemically synthesized
agggttggtttgacatctgc

SEQ ID NO: 16214 - DNA, 20 bp, Artificial Sequence
  chemically synthesized
tttgacatctgcaagtcaat

SEQ ID NO: 16215 - DNA, 20 bp, Artificial Sequence
  chemically synthesized
agtgtgatacaccacataaa

SEQ ID NO: 16216 - DNA, 20 bp, Artificial Sequence
  chemically synthesized
aaattacatgatcatctcaa

SEQ ID NO: 16217 - DNA, 20 bp, Artificial Sequence
  chemically synthesized
catgatcatctcaatagatg

SEQ ID NO: 16218 - DNA, 20 bp, Artificial Sequence
  chemically synthesized
catctcaatagatgcagaaa

SEQ ID NO: 16219 - DNA, 20 bp, Artificial Sequence
  chemically synthesized
aaaaagcattcaacaaaatc

SEQ ID NO: 16220 - DNA, 20 bp, Artificial Sequence
  chemically synthesized
acatttatgattaaaatgct

SEQ ID NO: 16221 - DNA, 20 bp, Artificial Sequence
  chemically synthesized
attaaaatgctcagcaaaat

SEQ ID NO: 16222 - DNA, 20 bp, Artificial Sequence
  chemically synthesized
gctcagcaaaatcagcatac

SEQ ID NO: 16223 - DNA, 20 bp, Artificial Sequence
  chemically synthesized
tcagcaaaatcagcatacaa

SEQ ID NO: 16224 - DNA, 20 bp, Artificial Sequence
  chemically synthesized
agcatacaagagacatacct

SEQ ID NO: 16225 - DNA, 20 bp, Artificial Sequence
  chemically synthesized
gacatacctcagtgtaataa

SEQ ID NO: 16226 - DNA, 20 bp, Artificial Sequence
  chemically synthesized
agccatctgtgacaaaccca

SEQ ID NO: 16227 - DNA, 20 bp, Artificial Sequence
  chemically synthesized
acagccaacataatattgaa

SEQ ID NO: 16228 - DNA, 20 bp, Artificial Sequence
  chemically synthesized
cagccaacataatattgaat

SEQ ID NO: 16229 - DNA, 20 bp, Artificial Sequence
  chemically synthesized
agccaacataatattgaatg

SEQ ID NO: 16230 - DNA, 20 bp, Artificial Sequence
  chemically synthesized
acataatattgaatggggaa

SEQ ID NO: 16231 - DNA, 20 bp, Artificial Sequence
  chemically synthesized
attgaatggggaaaagttga

SEQ ID NO: 16232 - DNA, 20 bp, Artificial Sequence
  chemically synthesized
aagttgaaagcattccctct

SEQ ID NO: 16233 - DNA, 20 bp, Artificial Sequence
  chemically synthesized
aaagcattccctctgagaac

SEQ ID NO: 16234 - DNA, 20 bp, Artificial Sequence
  chemically synthesized
ttccctctgagaactggaac

SEQ ID NO: 16235 - DNA, 20 bp, Artificial Sequence
  chemically synthesized
tctgagaactggaacaagac

SEQ ID NO: 16236 - DNA, 20 bp, Artificial Sequence
  chemically synthesized
ctgagaactggaacaagaca

SEQ ID NO: 16237 - DNA, 20 bp, Artificial Sequence
  chemically synthesized
ctcaccactcctcttcaaca

SEQ ID NO: 16238 - DNA, 20 bp, Artificial Sequence
  chemically synthesized
actcctcttcaacatagtac

SEQ ID NO: 16239 - DNA, 20 bp, Artificial Sequence
  chemically synthesized
cctcttcaacatagtactgg

SEQ ID NO: 16240 - DNA, 20 bp, Artificial Sequence
  chemically synthesized
caacatagtactggaagtcc

SEQ ID NO: 16241 - DNA, 20 bp, Artificial Sequence
  chemically synthesized
atagtactggaagtcctagc

SEQ ID NO: 16242 - DNA, 20 bp, Artificial Sequence
  chemically synthesized
tagtactggaagtcctagcc

SEQ ID NO: 16243 - DNA, 20 bp, Artificial Sequence
  chemically synthesized
agtactggaagtcctagcca

SEQ ID NO: 16244 - DNA, 20 bp, Artificial Sequence
  chemically synthesized
gaagtcctagccagggcaat

SEQ ID NO: 16245 - DNA, 20 bp, Artificial Sequence
  chemically synthesized
cagggcaatcagacaaaaca

SEQ ID NO: 16246 - DNA, 20 bp, Artificial Sequence
  chemically synthesized
tcagacaaaacaaagaaata

SEQ ID NO: 16247 - DNA, 20 bp, Artificial Sequence
  chemically synthesized
cagacaaaacaaagaaataa

SEQ ID NO: 16248 - DNA, 20 bp, Artificial Sequence
  chemically synthesized
agacaaaacaaagaaataaa

SEQ ID NO: 16249 - DNA, 20 bp, Artificial Sequence
  chemically synthesized
gaaataaagggcattcaaat

SEQ ID NO: 16250 - DNA, 20 bp, Artificial Sequence
  chemically synthesized
aaagggcattcaaatcagta

SEQ ID NO: 16251 - DNA, 20 bp, Artificial Sequence
  chemically synthesized
agggcattcaaatcagtaaa

SEQ ID NO: 16252 - DNA, 20 bp, Artificial Sequence
  chemically synthesized
gggcattcaaatcagtaaag

SEQ ID NO: 16253 - DNA, 20 bp, Artificial Sequence
  chemically synthesized
cattcaaatcagtaaagagg

SEQ ID NO: 16254 - DNA, 20 bp, Artificial Sequence
  chemically synthesized
catttacctttaaaacccta

SEQ ID NO: 16255 - DNA, 20 bp, Artificial Sequence
  chemically synthesized
taaaaccctaaagactcctc

SEQ ID NO: 16256 - DNA, 20 bp, Artificial Sequence
  chemically synthesized
accctaaagactcctccaga

SEQ ID NO: 16257 - DNA, 20 bp, Artificial Sequence
  chemically synthesized
agactcctccagaaagctcc

SEQ ID NO: 16258 - DNA, 20 bp, Artificial Sequence
  chemically synthesized
ctagaactgataaaataatt

SEQ ID NO: 16259 - DNA, 20 bp, Artificial Sequence
  chemically synthesized
actgataaaataattcagca

SEQ ID NO: 16260 - DNA, 20 bp, Artificial Sequence
  chemically synthesized
aaataattcagcaaagtttc

SEQ ID NO: 16261 - DNA, 20 bp, Artificial Sequence
  chemically synthesized
tcagcaaagtttccagatac

SEQ ID NO: 16262 - DNA, 20 bp, Artificial Sequence
  chemically synthesized
caagatgaatgcacacaaat

SEQ ID NO: 16263 - DNA, 20 bp, Artificial Sequence
  chemically synthesized
gtaactcttctatacaccaa

SEQ ID NO: 16264 - DNA, 20 bp, Artificial Sequence
  chemically synthesized
atacaccaacagcaaccaaa

SEQ ID NO: 16265 - DNA, 20 bp, Artificial Sequence
  chemically synthesized
acaccaacagcaaccaaatg

SEQ ID NO: 16266 - DNA, 20 bp, Artificial Sequence
  chemically synthesized
accaaatggagaatcaaatc

SEQ ID NO: 16267 - DNA, 20 bp, Artificial Sequence
  chemically synthesized
gaactcaaccccttgtacaa

SEQ ID NO: 16268 - DNA, 20 bp, Artificial Sequence
  chemically synthesized
ttgtacaatagatgcaaaaa

SEQ ID NO: 16269 - DNA, 20 bp, Artificial Sequence
  chemically synthesized
gccatataaaacgtactctc

SEQ ID NO: 16270 - DNA, 20 bp, Artificial Sequence
  chemically synthesized
tataaaacgtactctcaaga

SEQ ID NO: 16271 - DNA, 20 bp, Artificial Sequence
  chemically synthesized
cgtactctcaagatggatta

SEQ ID NO: 16272 - DNA, 20 bp, Artificial Sequence
  chemically synthesized
taaaactataaaactactaa

SEQ ID NO: 16273 - DNA, 20 bp, Artificial Sequence
  chemically synthesized
aaactactaaaagaaaacat

SEQ ID NO: 16274 - DNA, 20 bp, Artificial Sequence
  chemically synthesized
aactactaaaagaaaacata

SEQ ID NO: 16275 - DNA, 20 bp, Artificial Sequence
  chemically synthesized
actactaaaagaaaacataa

SEQ ID NO: 16276 - DNA, 20 bp, Artificial Sequence
  chemically synthesized
tactaaaagaaaacataagg

SEQ ID NO: 16277 - DNA, 20 bp, Artificial Sequence
  chemically synthesized
aaacataagggagacacttc

SEQ ID NO: 16278 - DNA, 20 bp, Artificial Sequence
  chemically synthesized
aagggagacacttcaagaca

SEQ ID NO: 16279 - DNA, 20 bp, Artificial Sequence
  chemically synthesized
gacacttcaagacatggctt

SEQ ID NO: 16280 - DNA, 20 bp, Artificial Sequence
  chemically synthesized
acacttcaagacatggcttt

SEQ ID NO: 16281 - DNA, 20 bp, Artificial Sequence
  chemically synthesized
tcaagacatggctttgggca

SEQ ID NO: 16282 - DNA, 20 bp, Artificial Sequence
  chemically synthesized
ggctttgggcaaagatttta

SEQ ID NO: 16283 - DNA, 20 bp, Artificial Sequence
  chemically synthesized
tgggcaaagattttatggcc

SEQ ID NO: 16284 - DNA, 20 bp, Artificial Sequence
  chemically synthesized
ttttatggccaagacctcaa

SEQ ID NO: 16285 - DNA, 20 bp, Artificial Sequence
  chemically synthesized
tggccaagacctcaaaagca

SEQ ID NO: 16286 - DNA, 20 bp, Artificial Sequence
  chemically synthesized
ggccaagacctcaaaagcac

SEQ ID NO: 16287 - DNA, 20 bp, Artificial Sequence
  chemically synthesized
ctcaaaagcacaggcaacaa

SEQ ID NO: 16288 - DNA, 20 bp, Artificial Sequence
  chemically synthesized
acaggcaacaaaagcaaaaa

SEQ ID NO: 16289 - DNA, 20 bp, Artificial Sequence
  chemically synthesized
caaaagcaaaaatagacaaa

SEQ ID NO: 16290 - DNA, 20 bp, Artificial Sequence
  chemically synthesized
aaaagcaaaaatagacaaat

SEQ ID NO: 16291 - DNA, 20 bp, Artificial Sequence
  chemically synthesized
tagacaaatgggactatatt

SEQ ID NO: 16292 - DNA, 20 bp, Artificial Sequence
  chemically synthesized
taagctaaaatacatctgca

SEQ ID NO: 16293 - DNA, 20 bp, Artificial Sequence
  chemically synthesized
taaaatacatctgcacagta

SEQ ID NO: 16294 - DNA, 20 bp, Artificial Sequence
  chemically synthesized
aaaatacatctgcacagtaa

SEQ ID NO: 16295 - DNA, 20 bp, Artificial Sequence
  chemically synthesized
agtaaaggaaacaatcaaca

SEQ ID NO: 16296 - DNA, 20 bp, Artificial Sequence
  chemically synthesized
aggaaacaatcaacacagtg

SEQ ID NO: 16297 - DNA, 20 bp, Artificial Sequence
  chemically synthesized
gaaacaatcaacacagtgaa

SEQ ID NO: 16298 - DNA, 20 bp, Artificial Sequence
  chemically synthesized
aatcaacacagtgaagagac

SEQ ID NO: 16299 - DNA, 20 bp, Artificial Sequence
  chemically synthesized
agagacaagctgttgaatgc

SEQ ID NO: 16300 - DNA, 20 bp, Artificial Sequence
  chemically synthesized
aatatttgcatacatttgac

SEQ ID NO: 16301 - DNA, 20 bp, Artificial Sequence
  chemically synthesized
atatttgcatacatttgaca

SEQ ID NO: 16302 - DNA, 20 bp, Artificial Sequence
  chemically synthesized
tttgacaaggaattaatctc

SEQ ID NO: 16303 - DNA, 20 bp, Artificial Sequence
  chemically synthesized
aattaatctccagaatatat

SEQ ID NO: 16304 - DNA, 20 bp, Artificial Sequence
  chemically synthesized
aagaaactcaaacaactcaa

SEQ ID NO: 16305 - DNA, 20 bp, Artificial Sequence
  chemically synthesized
aaactcaaacaactcaacag

SEQ ID NO: 16306 - DNA, 20 bp, Artificial Sequence
  chemically synthesized
aaataatctcattaaaaaat

SEQ ID NO: 16307 - DNA, 20 bp, Artificial Sequence
  chemically synthesized
atctcattaaaaaattggca

SEQ ID NO: 16308 - DNA, 20 bp, Artificial Sequence
  chemically synthesized
tctcattaaaaaattggcaa

SEQ ID NO: 16309 - DNA, 20 bp, Artificial Sequence
  chemically synthesized
tggcaaaggatatttttcaa

SEQ ID NO: 16310 - DNA, 20 bp, Artificial Sequence
  chemically synthesized
caaaggatatttttcaaaag

SEQ ID NO: 16311 - DNA, 20 bp, Artificial Sequence
  chemically synthesized
gaagacatacaaatgcacaa

SEQ ID NO: 16312 - DNA, 20 bp, Artificial Sequence
  chemically synthesized
aagacatacaaatgcacaat

SEQ ID NO: 16313 - DNA, 20 bp, Artificial Sequence
  chemically synthesized
atacaaatgcacaatgggta

SEQ ID NO: 16314 - DNA, 20 bp, Artificial Sequence
  chemically synthesized
tacaaatgcacaatgggtat

SEQ ID NO: 16315 - DNA, 20 bp, Artificial Sequence
  chemically synthesized
acaaatgcacaatgggtatg

SEQ ID NO: 16316 - DNA, 20 bp, Artificial Sequence
  chemically synthesized
tgctcaacattactaatcat

SEQ ID NO: 16317 - DNA, 20 bp, Artificial Sequence
  chemically synthesized
ctcaacattactaatcatca

SEQ ID NO: 16318 - DNA, 20 bp, Artificial Sequence
  chemically synthesized
atgcaaatcaaaaccacaat

SEQ ID NO: 16319 - DNA, 20 bp, Artificial Sequence
  chemically synthesized
aatgagatatcatcttatgc

SEQ ID NO: 16320 - DNA, 20 bp, Artificial Sequence
  chemically synthesized
agatatcatcttatgccagt

SEQ ID NO: 16321 - DNA, 20 bp, Artificial Sequence
  chemically synthesized
aataaataaataacacatgc

SEQ ID NO: 16322 - DNA, 20 bp, Artificial Sequence
  chemically synthesized
aataaataacacatgctggc

SEQ ID NO: 16323 - DNA, 20 bp, Artificial Sequence
  chemically synthesized
ataaataacacatgctggca

SEQ ID NO: 16324 - DNA, 20 bp, Artificial Sequence
  chemically synthesized
cacatgctggcaaggatgtg

SEQ ID NO: 16325 - DNA, 20 bp, Artificial Sequence
  chemically synthesized
acatgctggcaaggatgtga

SEQ ID NO: 16326 - DNA, 20 bp, Artificial Sequence
  chemically synthesized
ctggcaaggatgtgaaggaa

SEQ ID NO: 16327 - DNA, 20 bp, Artificial Sequence
  chemically synthesized
tggcaaggatgtgaaggaaa

SEQ ID NO: 16328 - DNA, 20 bp, Artificial Sequence
  chemically synthesized
tgtgaaggaaaaggcactcg

SEQ ID NO: 16329 - DNA, 20 bp, Artificial Sequence
  chemically synthesized
gtgaaggaaaaggcactcgt

SEQ ID NO: 16330 - DNA, 20 bp, Artificial Sequence
  chemically synthesized
aaggcactcgtaggcactat

SEQ ID NO: 16331 - DNA, 20 bp, Artificial Sequence
  chemically synthesized
cactcgtaggcactattggt

SEQ ID NO: 16332 - DNA, 20 bp, Artificial Sequence
  chemically synthesized
ctattggtaagcatgcaaat

SEQ ID NO: 16333 - DNA, 20 bp, Artificial Sequence
  chemically synthesized
ggtaagcatgcaaattagta

SEQ ID NO: 16334 - DNA, 20 bp, Artificial Sequence
  chemically synthesized
gcaaattagtatagccacta

SEQ ID NO: 16335 - DNA, 20 bp, Artificial Sequence
  chemically synthesized
ccactatggaaaacaatatg

SEQ ID NO: 16336 - DNA, 20 bp, Artificial Sequence
  chemically synthesized
caatatgtagatttaccaaa

SEQ ID NO: 16337 - DNA, 20 bp, Artificial Sequence
  chemically synthesized
gctaaaaattgaactatcat

SEQ ID NO: 16338 - DNA, 20 bp, Artificial Sequence
  chemically synthesized
aattgaactatcataagatc

SEQ ID NO: 16339 - DNA, 20 bp, Artificial Sequence
  chemically synthesized
agatccagcaatcttattac

SEQ ID NO: 16340 - DNA, 20 bp, Artificial Sequence
  chemically synthesized
gatccagcaatcttattact

SEQ ID NO: 16341 - DNA, 20 bp, Artificial Sequence
  chemically synthesized
tattactgggtatttatcca

SEQ ID NO: 16342 - DNA, 20 bp, Artificial Sequence
  chemically synthesized
attactgggtatttatccaa

SEQ ID NO: 16343 - DNA, 20 bp, Artificial Sequence
  chemically synthesized
tgggtatttatccaaaggaa

SEQ ID NO: 16344 - DNA, 20 bp, Artificial Sequence
  chemically synthesized
ttatccaaaggaaaagaatt

SEQ ID NO: 16345 - DNA, 20 bp, Artificial Sequence
  chemically synthesized
aaagaattcagaataataaa

SEQ ID NO: 16346 - DNA, 20 bp, Artificial Sequence
  chemically synthesized
tcagaataataaacagatac

SEQ ID NO: 16347 - DNA, 20 bp, Artificial Sequence
  chemically synthesized
tggtaccacactgtttattg

SEQ ID NO: 16348 - DNA, 20 bp, Artificial Sequence
  chemically synthesized
tattgcagcacgattcacat

SEQ ID NO: 16349 - DNA, 20 bp, Artificial Sequence
  chemically synthesized
cagcacgattcacattagca

SEQ ID NO: 16350 - DNA, 20 bp, Artificial Sequence
  chemically synthesized
gattcacattagcaaagata

SEQ ID NO: 16351 - DNA, 20 bp, Artificial Sequence
  chemically synthesized
caaagatatggaatcaacct

SEQ ID NO: 16352 - DNA, 20 bp, Artificial Sequence
  chemically synthesized
tcaacctaagtgtccatcaa

SEQ ID NO: 16353 - DNA, 20 bp, Artificial Sequence
  chemically synthesized
tgtccatcaatggatgaatg

SEQ ID NO: 16354 - DNA, 20 bp, Artificial Sequence
  chemically synthesized
atggatgaatgaagaaaatg

SEQ ID NO: 16355 - DNA, 20 bp, Artificial Sequence
  chemically synthesized
atataaaatcatttcatttg

SEQ ID NO: 16356 - DNA, 20 bp, Artificial Sequence
  chemically synthesized
tcatttcatttgcagcaaca

SEQ ID NO: 16357 - DNA, 20 bp, Artificial Sequence
  chemically synthesized
tgcagcaacatggatgaaac

SEQ ID NO: 16358 - DNA, 20 bp, Artificial Sequence
  chemically synthesized
agcaacatggatgaaactgg

SEQ ID NO: 16359 - DNA, 20 bp, Artificial Sequence
  chemically synthesized
gtcattatgttaaacgaaat

SEQ ID NO: 16360 - DNA, 20 bp, Artificial Sequence
  chemically synthesized
ttatgttaaacgaaataagc

SEQ ID NO: 16361 - DNA, 20 bp, Artificial Sequence
  chemically synthesized
tatgttaaacgaaataagcc

SEQ ID NO: 16362 - DNA, 20 bp, Artificial Sequence
  chemically synthesized
taaacgaaataagccaggca

SEQ ID NO: 16363 - DNA, 20 bp, Artificial Sequence
  chemically synthesized
cgaaataagccaggcataga

SEQ ID NO: 16364 - DNA, 20 bp, Artificial Sequence
  chemically synthesized
tgcatgttctcactgatatg

SEQ ID NO: 16365 - DNA, 20 bp, Artificial Sequence
  chemically synthesized
gcatgttctcactgatatgt

SEQ ID NO: 16366 - DNA, 20 bp, Artificial Sequence
  chemically synthesized
atgttctcactgatatgtgg

SEQ ID NO: 16367 - DNA, 20 bp, Artificial Sequence
  chemically synthesized
ctgatatgtgggagctaaaa

SEQ ID NO: 16368 - DNA, 20 bp, Artificial Sequence
  chemically synthesized
ctaaaaaagttaatatcatg

SEQ ID NO: 16369 - DNA, 20 bp, Artificial Sequence
  chemically synthesized
taaaaaagttaatatcatgt

SEQ ID NO: 16370 - DNA, 20 bp, Artificial Sequence
  chemically synthesized
aaaagttaatatcatgtagg

SEQ ID NO: 16371 - DNA, 20 bp, Artificial Sequence
  chemically synthesized
aagttaatatcatgtaggta

SEQ ID NO: 16372 - DNA, 20 bp, Artificial Sequence
  chemically synthesized
gttaatatcatgtaggtaga

SEQ ID NO: 16373 - DNA, 20 bp, Artificial Sequence
  chemically synthesized
aatatcatgtaggtagagag

SEQ ID NO: 16374 - DNA, 20 bp, Artificial Sequence
  chemically synthesized
gtaggtagagagtagaatga

SEQ ID NO: 16375 - DNA, 20 bp, Artificial Sequence
  chemically synthesized
gagagtagaatgacagaaac

SEQ ID NO: 16376 - DNA, 20 bp, Artificial Sequence
  chemically synthesized
gagtagaatgacagaaacca

SEQ ID NO: 16377 - DNA, 20 bp, Artificial Sequence
  chemically synthesized
agtagaatgacagaaaccag

SEQ ID NO: 16378 - DNA, 20 bp, Artificial Sequence
  chemically synthesized
agaatgacagaaaccagagg

SEQ ID NO: 16379 - DNA, 20 bp, Artificial Sequence
  chemically synthesized
aatgacagaaaccagaggta

SEQ ID NO: 16380 - DNA, 20 bp, Artificial Sequence
  chemically synthesized
acagaaaccagaggtagaga

SEQ ID NO: 16381 - DNA, 20 bp, Artificial Sequence
  chemically synthesized
cagaaaccagaggtagagaa

SEQ ID NO: 16382 - DNA, 20 bp, Artificial Sequence
  chemically synthesized
agagaaaggtgtgtacgtta

SEQ ID NO: 16383 - DNA, 20 bp, Artificial Sequence
  chemically synthesized
gagaaaggtgtgtacgttat

SEQ ID NO: 16384 - DNA, 20 bp, Artificial Sequence
  chemically synthesized
gaaaggtgtgtacgttatgg

SEQ ID NO: 16385 - DNA, 20 bp, Artificial Sequence
  chemically synthesized
aaaggtgtgtacgttatggg

SEQ ID NO: 16386 - DNA, 20 bp, Artificial Sequence
  chemically synthesized
ggtgtgtacgttatgggagg

SEQ ID NO: 16387 - DNA, 20 bp, Artificial Sequence
  chemically synthesized
gtgtgtacgttatgggagga

SEQ ID NO: 16388 - DNA, 20 bp, Artificial Sequence
  chemically synthesized
tgtgtacgttatgggaggaa

SEQ ID NO: 16389 - DNA, 20 bp, Artificial Sequence
  chemically synthesized
tgtacgttatgggaggaagg

SEQ ID NO: 16390 - DNA, 20 bp, Artificial Sequence
  chemically synthesized
ttatgggaggaagggagacg

SEQ ID NO: 16391 - DNA, 20 bp, Artificial Sequence
  chemically synthesized
atgggaggaagggagacgaa

SEQ ID NO: 16392 - DNA, 20 bp, Artificial Sequence
  chemically synthesized
ggaggaagggagacgaagag

SEQ ID NO: 16393 - DNA, 20 bp, Artificial Sequence
  chemically synthesized
gaagggagacgaagagaagt

SEQ ID NO: 16394 - DNA, 20 bp, Artificial Sequence
  chemically synthesized
gacgaagagaagttggttaa

SEQ ID NO: 16395 - DNA, 20 bp, Artificial Sequence
  chemically synthesized
gagaagttggttaatggaaa

SEQ ID NO: 16396 - DNA, 20 bp, Artificial Sequence
  chemically synthesized
agaagttggttaatggaaac

SEQ ID NO: 16397 - DNA, 20 bp, Artificial Sequence
  chemically synthesized
agttggttaatggaaacagg

SEQ ID NO: 16398 - DNA, 20 bp, Artificial Sequence
  chemically synthesized
ggttaatggaaacaggcagt

SEQ ID NO: 16399 - DNA, 20 bp, Artificial Sequence
  chemically synthesized
aatggaaacaggcagttaga

SEQ ID NO: 16400 - DNA, 20 bp, Artificial Sequence
  chemically synthesized
ggaaacaggcagttagatag

SEQ ID NO: 16401 - DNA, 20 bp, Artificial Sequence
  chemically synthesized
gaaacaggcagttagataga

SEQ ID NO: 16402 - DNA, 20 bp, Artificial Sequence
  chemically synthesized
gaatatgttctgatgttcaa

SEQ ID NO: 16403 - DNA, 20 bp, Artificial Sequence
  chemically synthesized
tgttctgatgttcaatagca

SEQ ID NO: 16404 - DNA, 20 bp, Artificial Sequence
  chemically synthesized
tctgatgttcaatagcaaag

SEQ ID NO: 16405 - DNA, 20 bp, Artificial Sequence
  chemically synthesized
ctgatgttcaatagcaaagt

SEQ ID NO: 16406 - DNA, 20 bp, Artificial Sequence
  chemically synthesized
tgatgttcaatagcaaagta

SEQ ID NO: 16407 - DNA, 20 bp, Artificial Sequence
  chemically synthesized
atagcaaagtagggtgatta

SEQ ID NO: 16408 - DNA, 20 bp, Artificial Sequence
  chemically synthesized
atatattgtatatttcaaaa

SEQ ID NO: 16409 - DNA, 20 bp, Artificial Sequence
  chemically synthesized
tattgtatatttcaaaatag

SEQ ID NO: 16410 - DNA, 20 bp, Artificial Sequence
  chemically synthesized
tgtatatttcaaaatagtag

SEQ ID NO: 16411 - DNA, 20 bp, Artificial Sequence
  chemically synthesized
tatttcaaaatagtagaaga

SEQ ID NO: 16412 - DNA, 20 bp, Artificial Sequence
  chemically synthesized
atttcaaaatagtagaagaa

SEQ ID NO: 16413 - DNA, 20 bp, Artificial Sequence
  chemically synthesized
cttgaaatgttcctaacaca

SEQ ID NO: 16414 - DNA, 20 bp, Artificial Sequence
  chemically synthesized
catagaaacgataaatactt

SEQ ID NO: 16415 - DNA, 20 bp, Artificial Sequence
  chemically synthesized
atagaaacgataaatacttg

SEQ ID NO: 16416 - DNA, 20 bp, Artificial Sequence
  chemically synthesized
aacacgtcatatatcaataa

SEQ ID NO: 16417 - DNA, 20 bp, Artificial Sequence
  chemically synthesized
cgtcatatatcaataaaaga

SEQ ID NO: 16418 - DNA, 20 bp, Artificial Sequence
  chemically synthesized
aaagaaagtcgatctcatat

SEQ ID NO: 16419 - DNA, 20 bp, Artificial Sequence
  chemically synthesized
aagtcgatctcatattggtt

SEQ ID NO: 16420 - DNA, 20 bp, Artificial Sequence
  chemically synthesized
agtcgatctcatattggttg

SEQ ID NO: 16421 - DNA, 20 bp, Artificial Sequence
  chemically synthesized
attggttgaggcctgattgt

SEQ ID NO: 16422 - DNA, 20 bp, Artificial Sequence
  chemically synthesized
taagtaaatctttgtccctc

SEQ ID NO: 16423 - DNA, 20 bp, Artificial Sequence
  chemically synthesized
tccctgtactgtcttgctgt

SEQ ID NO: 16424 - DNA, 20 bp, Artificial Sequence
  chemically synthesized
ccctgtactgtcttgctgtg

SEQ ID NO: 16425 - DNA, 20 bp, Artificial Sequence
  chemically synthesized
ctgtactgtcttgctgtgag

SEQ ID NO: 16426 - DNA, 20 bp, Artificial Sequence
  chemically synthesized
cttatattccaacaccattt

SEQ ID NO: 16427 - DNA, 20 bp, Artificial Sequence
  chemically synthesized
tcctccccatatttttacct

SEQ ID NO: 16428 - DNA, 20 bp, Artificial Sequence
  chemically synthesized
ctcggtttttactgtttata

SEQ ID NO: 16429 - DNA, 20 bp, Artificial Sequence
  chemically synthesized
atatagcacactttgtgcta

SEQ ID NO: 16430 - DNA, 20 bp, Artificial Sequence
  chemically synthesized
ctttgtgctatagtttacct

SEQ ID NO: 16431 - DNA, 20 bp, Artificial Sequence
  chemically synthesized
ctcagtttttactatttata

SEQ ID NO: 16432 - DNA, 20 bp, Artificial Sequence
  chemically synthesized
ccccaaacttctctcttaac

SEQ ID NO: 16433 - DNA, 20 bp, Artificial Sequence
  chemically synthesized
aaacttctctcttaacaagc

SEQ ID NO: 16434 - DNA, 20 bp, Artificial Sequence
  chemically synthesized
ctcttaacaagctagaatat

SEQ ID NO: 16435 - DNA, 20 bp, Artificial Sequence
  chemically synthesized
gctagaatataagtgaatgc

SEQ ID NO: 16436 - DNA, 20 bp, Artificial Sequence
  chemically synthesized
tagaatataagtgaatgcaa

SEQ ID NO: 16437 - DNA, 20 bp, Artificial Sequence
  chemically synthesized
tataagtgaatgcaagagca

SEQ ID NO: 16438 - DNA, 20 bp, Artificial Sequence
  chemically synthesized
taagtgaatgcaagagcata

SEQ ID NO: 16439 - DNA, 20 bp, Artificial Sequence
  chemically synthesized
tgaatgcaagagcatagaga

SEQ ID NO: 16440 - DNA, 20 bp, Artificial Sequence
  chemically synthesized
gaatgcaagagcatagagac

SEQ ID NO: 16441 - DNA, 20 bp, Artificial Sequence
  chemically synthesized
aatgcaagagcatagagaca

SEQ ID NO: 16442 - DNA, 20 bp, Artificial Sequence
  chemically synthesized
tcattcctattttcatattt

SEQ ID NO: 16443 - DNA, 20 bp, Artificial Sequence
  chemically synthesized
cattcctattttcatatttg

SEQ ID NO: 16444 - DNA, 20 bp, Artificial Sequence
  chemically synthesized
tcatatttgaggtataaacc

SEQ ID NO: 16445 - DNA, 20 bp, Artificial Sequence
  chemically synthesized
catatttgaggtataaacca

SEQ ID NO: 16446 - DNA, 20 bp, Artificial Sequence
  chemically synthesized
tatttgaggtataaaccaag

SEQ ID NO: 16447 - DNA, 20 bp, Artificial Sequence
  chemically synthesized
tttttaaatctgcaaataaa

SEQ ID NO: 16448 - DNA, 20 bp, Artificial Sequence
  chemically synthesized
gttttattctgacattaaaa

SEQ ID NO: 16449 - DNA, 20 bp, Artificial Sequence
  chemically synthesized
aatgaatgatcgttttacca

SEQ ID NO: 16450 - DNA, 20 bp, Artificial Sequence
  chemically synthesized
atgatcgttttaccacagcg

SEQ ID NO: 16451 - DNA, 20 bp, Artificial Sequence
  chemically synthesized
tgatcgttttaccacagcgt

SEQ ID NO: 16452 - DNA, 20 bp, Artificial Sequence
  chemically synthesized
cttaaccttcactttcaaac

SEQ ID NO: 16453 - DNA, 20 bp, Artificial Sequence
  chemically synthesized
tttattgatctctattttcc

SEQ ID NO: 16454 - DNA, 20 bp, Artificial Sequence
  chemically synthesized
tctattttcctggaacaaca

SEQ ID NO: 16455 - DNA, 20 bp, Artificial Sequence
  chemically synthesized
ctattttcctggaacaacat

SEQ ID NO: 16456 - DNA, 20 bp, Artificial Sequence
  chemically synthesized
tattttcctggaacaacatg

SEQ ID NO: 16457 - DNA, 20 bp, Artificial Sequence
  chemically synthesized
attttcctggaacaacatgg

SEQ ID NO: 16458 - DNA, 20 bp, Artificial Sequence
  chemically synthesized
aacaacatgggggctatgtt

SEQ ID NO: 16459 - DNA, 20 bp, Artificial Sequence
  chemically synthesized
atgggggctatgtttagcgt

SEQ ID NO: 16460 - DNA, 20 bp, Artificial Sequence
  chemically synthesized
tgggggctatgtttagcgtg

SEQ ID NO: 16461 - DNA, 20 bp, Artificial Sequence
  chemically synthesized
ctatgtttagcgtgaggaca

SEQ ID NO: 16462 - DNA, 20 bp, Artificial Sequence
  chemically synthesized
gtatcacaactttcacctga

SEQ ID NO: 16463 - DNA, 20 bp, Artificial Sequence
  chemically synthesized
acaactttcacctgaaagaa

SEQ ID NO: 16464 - DNA, 20 bp, Artificial Sequence
  chemically synthesized
tttcacctgaaagaaaagat

SEQ ID NO: 16465 - DNA, 20 bp, Artificial Sequence
  chemically synthesized
aaagaaaagatgagctacca

SEQ ID NO: 16466 - DNA, 20 bp, Artificial Sequence
  chemically synthesized
accatggtacatataacaat

SEQ ID NO: 16467 - DNA, 20 bp, Artificial Sequence
  chemically synthesized
ccatggtacatataacaatg

SEQ ID NO: 16468 - DNA, 20 bp, Artificial Sequence
  chemically synthesized
tggtacatataacaatgagg

SEQ ID NO: 16469 - DNA, 20 bp, Artificial Sequence
  chemically synthesized
aatgaggtggttaaaactct

SEQ ID NO: 16470 - DNA, 20 bp, Artificial Sequence
  chemically synthesized
taaaactctaagtcgtcatc

SEQ ID NO: 16471 - DNA, 20 bp, Artificial Sequence
  chemically synthesized
tactaaaaatcactatttca

SEQ ID NO: 16472 - DNA, 20 bp, Artificial Sequence
  chemically synthesized
taaaaatcactatttcaaag

SEQ ID NO: 16473 - DNA, 20 bp, Artificial Sequence
  chemically synthesized
atcactatttcaaagaagta

SEQ ID NO: 16474 - DNA, 20 bp, Artificial Sequence
  chemically synthesized
tatttcaaagaagtatagaa

SEQ ID NO: 16475 - DNA, 20 bp, Artificial Sequence
  chemically synthesized
aagaagtatagaatagatat

SEQ ID NO: 16476 - DNA, 20 bp, Artificial Sequence
  chemically synthesized
gaatagatatcagccaaaat

SEQ ID NO: 16477 - DNA, 20 bp, Artificial Sequence
  chemically synthesized
aatagatatcagccaaaata

SEQ ID NO: 16478 - DNA, 20 bp, Artificial Sequence
  chemically synthesized
atatacatattatacacata

SEQ ID NO: 16479 - DNA, 20 bp, Artificial Sequence
  chemically synthesized
atacatattatacacatatg

SEQ ID NO: 16480 - DNA, 20 bp, Artificial Sequence
  chemically synthesized
ttgtatatgcttaaaaatta

SEQ ID NO: 16481 - DNA, 20 bp, Artificial Sequence
  chemically synthesized
tgcttaaaaattacagactt

SEQ ID NO: 16482 - DNA, 20 bp, Artificial Sequence
  chemically synthesized
ttaaaaattacagactttgg

SEQ ID NO: 16483 - DNA, 20 bp, Artificial Sequence
  chemically synthesized
tggaagtcatatgactattt

SEQ ID NO: 16484 - DNA, 20 bp, Artificial Sequence
  chemically synthesized
tatgactatttcagtgtgtg

SEQ ID NO: 16485 - DNA, 20 bp, Artificial Sequence
  chemically synthesized
caccctcctgttccaaaaca

SEQ ID NO: 16486 - DNA, 20 bp, Artificial Sequence
  chemically synthesized
cctgttccaaaacacagttg

SEQ ID NO: 16487 - DNA, 20 bp, Artificial Sequence
  chemically synthesized
gttccaaaacacagttgcag

SEQ ID NO: 16488 - DNA, 20 bp, Artificial Sequence
  chemically synthesized
ccaaaacacagttgcagaag

SEQ ID NO: 16489 - DNA, 20 bp, Artificial Sequence
  chemically synthesized
aaaacacagttgcagaagca

SEQ ID NO: 16490 - DNA, 20 bp, Artificial Sequence
  chemically synthesized
aaacacagttgcagaagcag

SEQ ID NO: 16491 - DNA, 20 bp, Artificial Sequence
  chemically synthesized
cacagttgcagaagcagagg

SEQ ID NO: 16492 - DNA, 20 bp, Artificial Sequence
  chemically synthesized
agaggaagtcattatacact

SEQ ID NO: 16493 - DNA, 20 bp, Artificial Sequence
  chemically synthesized
cacttagaacatcattttat

SEQ ID NO: 16494 - DNA, 20 bp, Artificial Sequence
  chemically synthesized
acttagaacatcattttata

SEQ ID NO: 16495 - DNA, 20 bp, Artificial Sequence
  chemically synthesized
tagaacatcattttataagg

SEQ ID NO: 16496 - DNA, 20 bp, Artificial Sequence
  chemically synthesized
aacatcattttataaggcag

SEQ ID NO: 16497 - DNA, 20 bp, Artificial Sequence
  chemically synthesized
acatcattttataaggcagc

SEQ ID NO: 16498 - DNA, 20 bp, Artificial Sequence
  chemically synthesized
attttataaggcagcaggtc

SEQ ID NO: 16499 - DNA, 20 bp, Artificial Sequence
  chemically synthesized
ttataaggcagcaggtctgg

SEQ ID NO: 16500 - DNA, 20 bp, Artificial Sequence
  chemically synthesized
tataaggcagcaggtctggt

SEQ ID NO: 16501 - DNA, 20 bp, Artificial Sequence
  chemically synthesized
aaggcagcaggtctggtagg

SEQ ID NO: 16502 - DNA, 20 bp, Artificial Sequence
  chemically synthesized
aggcagcaggtctggtagga

SEQ ID NO: 16503 - DNA, 20 bp, Artificial Sequence
  chemically synthesized
gcagcaggtctggtaggaag

SEQ ID NO: 16504 - DNA, 20 bp, Artificial Sequence
  chemically synthesized
aggtctggtaggaaggagat

SEQ ID NO: 16505 - DNA, 20 bp, Artificial Sequence
  chemically synthesized
ggtctggtaggaaggagatt

SEQ ID NO: 16506 - DNA, 20 bp, Artificial Sequence
  chemically synthesized
attaggtgctacttgtgaca

SEQ ID NO: 16507 - DNA, 20 bp, Artificial Sequence
  chemically synthesized
ttaggtgctacttgtgacaa

SEQ ID NO: 16508 - DNA, 20 bp, Artificial Sequence
  chemically synthesized
gtgctacttgtgacaaaggt

SEQ ID NO: 16509 - DNA, 20 bp, Artificial Sequence
  chemically synthesized
tcagcaaatatttgtgttcc

SEQ ID NO: 16510 - DNA, 20 bp, Artificial Sequence
  chemically synthesized
ttgtgttcccagcacttttc

SEQ ID NO: 16511 - DNA, 20 bp, Artificial Sequence
  chemically synthesized
ccagcacttttctagatcct

SEQ ID NO: 16512 - DNA, 20 bp, Artificial Sequence
  chemically synthesized
tagatcctcagttaaaatca

SEQ ID NO: 16513 - DNA, 20 bp, Artificial Sequence
  chemically synthesized
atcctcagttaaaatcaaag

SEQ ID NO: 16514 - DNA, 20 bp, Artificial Sequence
  chemically synthesized
agttaaaatcaaagcagctg

SEQ ID NO: 16515 - DNA, 20 bp, Artificial Sequence
  chemically synthesized
aatcaaagcagctgcagtct

SEQ ID NO: 16516 - DNA, 20 bp, Artificial Sequence
  chemically synthesized
caaagcagctgcagtcttgg

SEQ ID NO: 16517 - DNA, 20 bp, Artificial Sequence
  chemically synthesized
agcagctgcagtcttggcag

SEQ ID NO: 16518 - DNA, 20 bp, Artificial Sequence
  chemically synthesized
gcagctgcagtcttggcagt

SEQ ID NO: 16519 - DNA, 20 bp, Artificial Sequence
  chemically synthesized
agctgcagtcttggcagtgg

SEQ ID NO: 16520 - DNA, 20 bp, Artificial Sequence
  chemically synthesized
gctgcagtcttggcagtggg

SEQ ID NO: 16521 - DNA, 20 bp, Artificial Sequence
  chemically synthesized
gtgatactcacactttgaac

SEQ ID NO: 16522 - DNA, 20 bp, Artificial Sequence
  chemically synthesized
accacctgcactacctacaa

SEQ ID NO: 16523 - DNA, 20 bp, Artificial Sequence
  chemically synthesized
acctgcactacctacaatgg

SEQ ID NO: 16524 - DNA, 20 bp, Artificial Sequence
  chemically synthesized
gctccaaatattttatatga

SEQ ID NO: 16525 - DNA, 20 bp, Artificial Sequence
  chemically synthesized
ctccaaatattttatatgaa

SEQ ID NO: 16526 - DNA, 20 bp, Artificial Sequence
  chemically synthesized
tccaaatattttatatgaaa

SEQ ID NO: 16527 - DNA, 20 bp, Artificial Sequence
  chemically synthesized
ccaaatattttatatgaaag

SEQ ID NO: 16528 - DNA, 20 bp, Artificial Sequence
  chemically synthesized
tattttatatgaaaggggcc

SEQ ID NO: 16529 - DNA, 20 bp, Artificial Sequence
  chemically synthesized
atatgaaaggggcctagaca

SEQ ID NO: 16530 - DNA, 20 bp, Artificial Sequence
  chemically synthesized
gacatagcatgctgaatgaa

SEQ ID NO: 16531 - DNA, 20 bp, Artificial Sequence
  chemically synthesized
acatagcatgctgaatgaaa

SEQ ID NO: 16532 - DNA, 20 bp, Artificial Sequence
  chemically synthesized
tagcatgctgaatgaaaagg

SEQ ID NO: 16533 - DNA, 20 bp, Artificial Sequence
  chemically synthesized
atgctgaatgaaaaggaagt

SEQ ID NO: 16534 - DNA, 20 bp, Artificial Sequence
  chemically synthesized
ctgaatgaaaaggaagtgag

SEQ ID NO: 16535 - DNA, 20 bp, Artificial Sequence
  chemically synthesized
tgaaaaggaagtgagtagac

SEQ ID NO: 16536 - DNA, 20 bp, Artificial Sequence
  chemically synthesized
gtagactagtgctttccttg

SEQ ID NO: 16537 - DNA, 20 bp, Artificial Sequence
  chemically synthesized
ttccttgaagctgtgcaacc

SEQ ID NO: 16538 - DNA, 20 bp, Artificial Sequence
  chemically synthesized
tgaagctgtgcaaccaagca

SEQ ID NO: 16539 - DNA, 20 bp, Artificial Sequence
  chemically synthesized
aaccaagcatagtttttaca

SEQ ID NO: 16540 - DNA, 20 bp, Artificial Sequence
  chemically synthesized
catagatcgtgtgtttcaca

SEQ ID NO: 16541 - DNA, 20 bp, Artificial Sequence
  chemically synthesized
tgtttcacatggtgtgataa

SEQ ID NO: 16542 - DNA, 20 bp, Artificial Sequence
  chemically synthesized
acatggtgtgataacagctt

SEQ ID NO: 16543 - DNA, 20 bp, Artificial Sequence
  chemically synthesized
agcttgagatgccattgaca

SEQ ID NO: 16544 - DNA, 20 bp, Artificial Sequence
  chemically synthesized
atgccattgacatggcccac

SEQ ID NO: 16545 - DNA, 20 bp, Artificial Sequence
  chemically synthesized
gcccaccggcttatccacat

SEQ ID NO: 16546 - DNA, 20 bp, Artificial Sequence
  chemically synthesized
ggcttatccacatcagtaat

SEQ ID NO: 16547 - DNA, 20 bp, Artificial Sequence
  chemically synthesized
gcttatccacatcagtaatt

SEQ ID NO: 16548 - DNA, 20 bp, Artificial Sequence
  chemically synthesized
cttatccacatcagtaatta

SEQ ID NO: 16549 - DNA, 20 bp, Artificial Sequence
  chemically synthesized
ccacatcagtaattagggca

SEQ ID NO: 16550 - DNA, 20 bp, Artificial Sequence
  chemically synthesized
tactatgcatcccgtgattg

SEQ ID NO: 16551 - DNA, 20 bp, Artificial Sequence
  chemically synthesized
tgtgtttaaaaatgcaatta

SEQ ID NO: 16552 - DNA, 20 bp, Artificial Sequence
  chemically synthesized
tgcaattatggactcattca

SEQ ID NO: 16553 - DNA, 20 bp, Artificial Sequence
  chemically synthesized
tatggactcattcaaagtga

SEQ ID NO: 16554 - DNA, 20 bp, Artificial Sequence
  chemically synthesized
gactcattcaaagtgaaagc

SEQ ID NO: 16555 - DNA, 20 bp, Artificial Sequence
  chemically synthesized
aagctggtatgacaatacat

SEQ ID NO: 16556 - DNA, 20 bp, Artificial Sequence
  chemically synthesized
ttttatgaataaattttata

SEQ ID NO: 16557 - DNA, 20 bp, Artificial Sequence
  chemically synthesized
aataaattttataaagaaat

SEQ ID NO: 16558 - DNA, 20 bp, Artificial Sequence
  chemically synthesized
aagaaataagctaataccta

SEQ ID NO: 16559 - DNA, 20 bp, Artificial Sequence
  chemically synthesized
gaaataagctaatacctaca

SEQ ID NO: 16560 - DNA, 20 bp, Artificial Sequence
  chemically synthesized
acagagtgtttattaaatgc

SEQ ID NO: 16561 - DNA, 20 bp, Artificial Sequence
  chemically synthesized
cagagtgtttattaaatgct

SEQ ID NO: 16562 - DNA, 20 bp, Artificial Sequence
  chemically synthesized
tgtttattaaatgctaggca

SEQ ID NO: 16563 - DNA, 20 bp, Artificial Sequence
  chemically synthesized
taaatgctaggcacagttct

SEQ ID NO: 16564 - DNA, 20 bp, Artificial Sequence
  chemically synthesized
agttctgagtgatttacaac

SEQ ID NO: 16565 - DNA, 20 bp, Artificial Sequence
  chemically synthesized
taattttcacaacattatta

SEQ ID NO: 16566 - DNA, 20 bp, Artificial Sequence
  chemically synthesized
aattttcacaacattattac

SEQ ID NO: 16567 - DNA, 20 bp, Artificial Sequence
  chemically synthesized
tttcacaacattattacagg

SEQ ID NO: 16568 - DNA, 20 bp, Artificial Sequence
  chemically synthesized
ttacaggtagattttatata

SEQ ID NO: 16569 - DNA, 20 bp, Artificial Sequence
  chemically synthesized
acaggtagattttatatatg

SEQ ID NO: 16570 - DNA, 20 bp, Artificial Sequence
  chemically synthesized
attttatatatggagaaact

SEQ ID NO: 16571 - DNA, 20 bp, Artificial Sequence
  chemically synthesized
ttttatatatggagaaactg

SEQ ID NO: 16572 - DNA, 20 bp, Artificial Sequence
  chemically synthesized
tatatggagaaactgaggca

SEQ ID NO: 16573 - DNA, 20 bp, Artificial Sequence
  chemically synthesized
tatggagaaactgaggcaca

SEQ ID NO: 16574 - DNA, 20 bp, Artificial Sequence
  chemically synthesized
taataaatctcaacattacc

SEQ ID NO: 16575 - DNA, 20 bp, Artificial Sequence
  chemically synthesized
aataaatctcaacattaccc

SEQ ID NO: 16576 - DNA, 20 bp, Artificial Sequence
  chemically synthesized
tctcaacattacccaggtga

SEQ ID NO: 16577 - DNA, 20 bp, Artificial Sequence
  chemically synthesized
caacattacccaggtgatgg

SEQ ID NO: 16578 - DNA, 20 bp, Artificial Sequence
  chemically synthesized
acattacccaggtgatggtg

SEQ ID NO: 16579 - DNA, 20 bp, Artificial Sequence
  chemically synthesized
tacccaggtgatggtggagt

SEQ ID NO: 16580 - DNA, 20 bp, Artificial Sequence
  chemically synthesized
agttggaattccaaatcatg

SEQ ID NO: 16581 - DNA, 20 bp, Artificial Sequence
  chemically synthesized
caaatcatgcagtctgactt

SEQ ID NO: 16582 - DNA, 20 bp, Artificial Sequence
  chemically synthesized
atgcagtctgactttagctg

SEQ ID NO: 16583 - DNA, 20 bp, Artificial Sequence
  chemically synthesized
agtctgactttagctgtaga

SEQ ID NO: 16584 - DNA, 20 bp, Artificial Sequence
  chemically synthesized
tgactttagctgtagacagc

SEQ ID NO: 16585 - DNA, 20 bp, Artificial Sequence
  chemically synthesized
tttagctgtagacagcaaga

SEQ ID NO: 16586 - DNA, 20 bp, Artificial Sequence
  chemically synthesized
gctgtagacagcaagatagt

SEQ ID NO: 16587 - DNA, 20 bp, Artificial Sequence
  chemically synthesized
agacagcaagatagtaagta

SEQ ID NO: 16588 - DNA, 20 bp, Artificial Sequence
  chemically synthesized
gacagcaagatagtaagtaa

SEQ ID NO: 16589 - DNA, 20 bp, Artificial Sequence
  chemically synthesized
caagatagtaagtaaaggaa

SEQ ID NO: 16590 - DNA, 20 bp, Artificial Sequence
  chemically synthesized
agatagtaagtaaaggaatg

SEQ ID NO: 16591 - DNA, 20 bp, Artificial Sequence
  chemically synthesized
ggaatggagcaacaaattga

SEQ ID NO: 16592 - DNA, 20 bp, Artificial Sequence
  chemically synthesized
ttttgcttgtttgtttgaaa

SEQ ID NO: 16593 - DNA, 20 bp, Artificial Sequence
  chemically synthesized
tttgcttgtttgtttgaaac

SEQ ID NO: 16594 - DNA, 20 bp, Artificial Sequence
  chemically synthesized
ttgcttgtttgtttgaaaca

SEQ ID NO: 16595 - DNA, 20 bp, Artificial Sequence
  chemically synthesized
agggtctcactctgtcaccc

SEQ ID NO: 16596 - DNA, 20 bp, Artificial Sequence
  chemically synthesized
tctcactctgtcaccccggc

SEQ ID NO: 16597 - DNA, 20 bp, Artificial Sequence
  chemically synthesized
tcactctgtcaccccggctg

SEQ ID NO: 16598 - DNA, 20 bp, Artificial Sequence
  chemically synthesized
tcaccccggctggagtgcaa

SEQ ID NO: 16599 - DNA, 20 bp, Artificial Sequence
  chemically synthesized
tggtgcaatcttgctcactg

SEQ ID NO: 16600 - DNA, 20 bp, Artificial Sequence
  chemically synthesized
cttgctcactgaagcctcac

SEQ ID NO: 16601 - DNA, 20 bp, Artificial Sequence
  chemically synthesized
tgaagcctcactagaacgcc

SEQ ID NO: 16602 - DNA, 20 bp, Artificial Sequence
  chemically synthesized
ttcaattgatcctcctgctt

SEQ ID NO: 16603 - DNA, 20 bp, Artificial Sequence
  chemically synthesized
atcctcctgctttagcctct

SEQ ID NO: 16604 - DNA, 20 bp, Artificial Sequence
  chemically synthesized
tcctcctgctttagcctctc

SEQ ID NO: 16605 - DNA, 20 bp, Artificial Sequence
  chemically synthesized
tcctgctttagcctctcagg

SEQ ID NO: 16606 - DNA, 20 bp, Artificial Sequence
  chemically synthesized
gctttagcctctcaggtagc

SEQ ID NO: 16607 - DNA, 20 bp, Artificial Sequence
  chemically synthesized
ctttagcctctcaggtagct

SEQ ID NO: 16608 - DNA, 20 bp, Artificial Sequence
  chemically synthesized
ctctcaggtagctaggacta

SEQ ID NO: 16609 - DNA, 20 bp, Artificial Sequence
  chemically synthesized
tctcaggtagctaggactac

SEQ ID NO: 16610 - DNA, 20 bp, Artificial Sequence
  chemically synthesized
gtagctaggactacaggtgt

SEQ ID NO: 16611 - DNA, 20 bp, Artificial Sequence
  chemically synthesized
actacaggtgtgagcctcca

SEQ ID NO: 16612 - DNA, 20 bp, Artificial Sequence
  chemically synthesized
caggtgtgagcctccatggc

SEQ ID NO: 16613 - DNA, 20 bp, Artificial Sequence
  chemically synthesized
tgtgagcctccatggccagc

SEQ ID NO: 16614 - DNA, 20 bp, Artificial Sequence
  chemically synthesized
tgagcctccatggccagcta

SEQ ID NO: 16615 - DNA, 20 bp, Artificial Sequence
  chemically synthesized
agaaattttttaaatttctg

SEQ ID NO: 16616 - DNA, 20 bp, Artificial Sequence
  chemically synthesized
tttttaaatttctgtagaaa

SEQ ID NO: 16617 - DNA, 20 bp, Artificial Sequence
  chemically synthesized
ttttaaatttctgtagaaac

SEQ ID NO: 16618 - DNA, 20 bp, Artificial Sequence
  chemically synthesized
tttaaatttctgtagaaaca

SEQ ID NO: 16619 - DNA, 20 bp, Artificial Sequence
  chemically synthesized
cagggtctccctatgttccc

SEQ ID NO: 16620 - DNA, 20 bp, Artificial Sequence
  chemically synthesized
agggtctccctatgttcccc

SEQ ID NO: 16621 - DNA, 20 bp, Artificial Sequence
  chemically synthesized
tctccctatgttccccaggc

SEQ ID NO: 16622 - DNA, 20 bp, Artificial Sequence
  chemically synthesized
ccaggctggtatccaactct

SEQ ID NO: 16623 - DNA, 20 bp, Artificial Sequence
  chemically synthesized
ctcaaacaattctcccacct

SEQ ID NO: 16624 - DNA, 20 bp, Artificial Sequence
  chemically synthesized
tctcccacctcagccttgaa

SEQ ID NO: 16625 - DNA, 20 bp, Artificial Sequence
  chemically synthesized
cctcagccttgaaaagtgtt

SEQ ID NO: 16626 - DNA, 20 bp, Artificial Sequence
  chemically synthesized
cttgaaaagtgttgagatta

SEQ ID NO: 16627 - DNA, 20 bp, Artificial Sequence
  chemically synthesized
ttgaaaagtgttgagattac

SEQ ID NO: 16628 - DNA, 20 bp, Artificial Sequence
  chemically synthesized
acaggtgtgaatcaccatgc

SEQ ID NO: 16629 - DNA, 20 bp, Artificial Sequence
  chemically synthesized
caggtgtgaatcaccatgct

SEQ ID NO: 16630 - DNA, 20 bp, Artificial Sequence
  chemically synthesized
atcaccatgctgggccttga

SEQ ID NO: 16631 - DNA, 20 bp, Artificial Sequence
  chemically synthesized
gggccttgatggatctttaa

SEQ ID NO: 16632 - DNA, 20 bp, Artificial Sequence
  chemically synthesized
ccttgatggatctttaaaag

SEQ ID NO: 16633 - DNA, 20 bp, Artificial Sequence
  chemically synthesized
tgatggatctttaaaagtgg

SEQ ID NO: 16634 - DNA, 20 bp, Artificial Sequence
  chemically synthesized
gatggatctttaaaagtggt

SEQ ID NO: 16635 - DNA, 20 bp, Artificial Sequence
  chemically synthesized
atggatctttaaaagtggtg

SEQ ID NO: 16636 - DNA, 20 bp, Artificial Sequence
  chemically synthesized
tggatctttaaaagtggtgg

SEQ ID NO: 16637 - DNA, 20 bp, Artificial Sequence
  chemically synthesized
ggatctttaaaagtggtggg

SEQ ID NO: 16638 - DNA, 20 bp, Artificial Sequence
  chemically synthesized
tctttaaaagtggtgggggg

SEQ ID NO: 16639 - DNA, 20 bp, Artificial Sequence
  chemically synthesized
ctttaaaagtggtggggggt

SEQ ID NO: 16640 - DNA, 20 bp, Artificial Sequence
  chemically synthesized
ttaaaagtggtggggggtag

SEQ ID NO: 16641 - DNA, 20 bp, Artificial Sequence
  chemically synthesized
gtggtggggggtaggagaaa

SEQ ID NO: 16642 - DNA, 20 bp, Artificial Sequence
  chemically synthesized
ggtggggggtaggagaaaaa

SEQ ID NO: 16643 - DNA, 20 bp, Artificial Sequence
  chemically synthesized
gtggggggtaggagaaaaag

SEQ ID NO: 16644 - DNA, 20 bp, Artificial Sequence
  chemically synthesized
gggggtaggagaaaaagagg

SEQ ID NO: 16645 - DNA, 20 bp, Artificial Sequence
  chemically synthesized
aaaaagaggaagaacaaaaa

SEQ ID NO: 16646 - DNA, 20 bp, Artificial Sequence
  chemically synthesized
gaacaaaaacagtatcacga

SEQ ID NO: 16647 - DNA, 20 bp, Artificial Sequence
  chemically synthesized
tcacgaaagataaacatcgt

SEQ ID NO: 16648 - DNA, 20 bp, Artificial Sequence
  chemically synthesized
cacgaaagataaacatcgtt

SEQ ID NO: 16649 - DNA, 20 bp, Artificial Sequence
  chemically synthesized
agataaacatcgttaggtct

SEQ ID NO: 16650 - DNA, 20 bp, Artificial Sequence
  chemically synthesized
gataaacatcgttaggtctc

SEQ ID NO: 16651 - DNA, 20 bp, Artificial Sequence
  chemically synthesized
aaacatcgttaggtctcggg

SEQ ID NO: 16652 - DNA, 20 bp, Artificial Sequence
  chemically synthesized
aacatcgttaggtctcggga

SEQ ID NO: 16653 - DNA, 20 bp, Artificial Sequence
  chemically synthesized
tcgttaggtctcgggaagga

SEQ ID NO: 16654 - DNA, 20 bp, Artificial Sequence
  chemically synthesized
cgttaggtctcgggaaggat

SEQ ID NO: 16655 - DNA, 20 bp, Artificial Sequence
  chemically synthesized
ggatccttttcattttgctc

SEQ ID NO: 16656 - DNA, 20 bp, Artificial Sequence
  chemically synthesized
atccttttcattttgctcta

SEQ ID NO: 16657 - DNA, 20 bp, Artificial Sequence
  chemically synthesized
tttcattttgctctagagaa

SEQ ID NO: 16658 - DNA, 20 bp, Artificial Sequence
  chemically synthesized
tgctctagagaaaagccatt

SEQ ID NO: 16659 - DNA, 20 bp, Artificial Sequence
  chemically synthesized
acttctgtgttaacaaaaaa

SEQ ID NO: 16660 - DNA, 20 bp, Artificial Sequence
  chemically synthesized
tgtgttaacaaaaaacagcc

SEQ ID NO: 16661 - DNA, 20 bp, Artificial Sequence
  chemically synthesized
gttaacaaaaaacagccgag

SEQ ID NO: 16662 - DNA, 20 bp, Artificial Sequence
  chemically synthesized
caaaaaacagccgagtagcc

SEQ ID NO: 16663 - DNA, 20 bp, Artificial Sequence
  chemically synthesized
agtagcctagtattaaactt

SEQ ID NO: 16664 - DNA, 20 bp, Artificial Sequence
  chemically synthesized
tagcctagtattaaacttta

SEQ ID NO: 16665 - DNA, 20 bp, Artificial Sequence
  chemically synthesized
cctagtattaaactttagag

SEQ ID NO: 16666 - DNA, 20 bp, Artificial Sequence
  chemically synthesized
tttagagcagttgttcttta

SEQ ID NO: 16667 - DNA, 20 bp, Artificial Sequence
  chemically synthesized
gttgttctttacggcaatta

SEQ ID NO: 16668 - DNA, 20 bp, Artificial Sequence
  chemically synthesized
ttgttctttacggcaattac

SEQ ID NO: 16669 - DNA, 20 bp, Artificial Sequence
  chemically synthesized
tgttctttacggcaattaca

SEQ ID NO: 16670 - DNA, 20 bp, Artificial Sequence
  chemically synthesized
gttctttacggcaattacag

SEQ ID NO: 16671 - DNA, 20 bp, Artificial Sequence
  chemically synthesized
acggcaattacaggggcctt

SEQ ID NO: 16672 - DNA, 20 bp, Artificial Sequence
  chemically synthesized
cggcaattacaggggccttc

SEQ ID NO: 16673 - DNA, 20 bp, Artificial Sequence
  chemically synthesized
caattacaggggccttcagg

SEQ ID NO: 16674 - DNA, 20 bp, Artificial Sequence
  chemically synthesized
aggggccttcaggaagctga

SEQ ID NO: 16675 - DNA, 20 bp, Artificial Sequence
  chemically synthesized
ggccttcaggaagctgatgg

SEQ ID NO: 16676 - DNA, 20 bp, Artificial Sequence
  chemically synthesized
aggaagctgatggaagtgtg

SEQ ID NO: 16677 - DNA, 20 bp, Artificial Sequence
  chemically synthesized
gaagtgtgaagtcctcttct

SEQ ID NO: 16678 - DNA, 20 bp, Artificial Sequence
  chemically synthesized
agtgtgaagtcctcttctca

SEQ ID NO: 16679 - DNA, 20 bp, Artificial Sequence
  chemically synthesized
gaagtcctcttctcagagaa

SEQ ID NO: 16680 - DNA, 20 bp, Artificial Sequence
  chemically synthesized
atatacgtgcacctaatttt

SEQ ID NO: 16681 - DNA, 20 bp, Artificial Sequence
  chemically synthesized
atttttagatataatttctg

SEQ ID NO: 16682 - DNA, 20 bp, Artificial Sequence
  chemically synthesized
tttttagatataatttctga

SEQ ID NO: 16683 - DNA, 20 bp, Artificial Sequence
  chemically synthesized
agatataatttctgaaggtt

SEQ ID NO: 16684 - DNA, 20 bp, Artificial Sequence
  chemically synthesized
tgaaggtttagaaactcctt

SEQ ID NO: 16685 - DNA, 20 bp, Artificial Sequence
  chemically synthesized
ccttgagttcacttatatca

SEQ ID NO: 16686 - DNA, 20 bp, Artificial Sequence
  chemically synthesized
tatatcaaagtcctcacctt

SEQ ID NO: 16687 - DNA, 20 bp, Artificial Sequence
  chemically synthesized
cacctttagaactcctgtcc

SEQ ID NO: 16688 - DNA, 20 bp, Artificial Sequence
  chemically synthesized
ctttagaactcctgtcctag

SEQ ID NO: 16689 - DNA, 20 bp, Artificial Sequence
  chemically synthesized
ttagaactcctgtcctagaa

SEQ ID NO: 16690 - DNA, 20 bp, Artificial Sequence
  chemically synthesized
gaactcctgtcctagaagag

SEQ ID NO: 16691 - DNA, 20 bp, Artificial Sequence
  chemically synthesized
ttccataaccactttgactc

SEQ ID NO: 16692 - DNA, 20 bp, Artificial Sequence
  chemically synthesized
gccacttgtaccatgtaatt

SEQ ID NO: 16693 - DNA, 20 bp, Artificial Sequence
  chemically synthesized
cacttgtaccatgtaattca

SEQ ID NO: 16694 - DNA, 20 bp, Artificial Sequence
  chemically synthesized
acttgtaccatgtaattcag

SEQ ID NO: 16695 - DNA, 20 bp, Artificial Sequence
  chemically synthesized
taccatgtaattcagaggtg

SEQ ID NO: 16696 - DNA, 20 bp, Artificial Sequence
  chemically synthesized
taattcagaggtgtagtgtc

SEQ ID NO: 16697 - DNA, 20 bp, Artificial Sequence
  chemically synthesized
agaggtgtagtgtcaagact

SEQ ID NO: 16698 - DNA, 20 bp, Artificial Sequence
  chemically synthesized
gaggtgtagtgtcaagactg

SEQ ID NO: 16699 - DNA, 20 bp, Artificial Sequence
  chemically synthesized
ggtgtagtgtcaagactgag

SEQ ID NO: 16700 - DNA, 20 bp, Artificial Sequence
  chemically synthesized
gtgtagtgtcaagactgagg

SEQ ID NO: 16701 - DNA, 20 bp, Artificial Sequence
  chemically synthesized
tagtgtcaagactgaggagg

SEQ ID NO: 16702 - DNA, 20 bp, Artificial Sequence
  chemically synthesized
tgtcaagactgaggaggaag

SEQ ID NO: 16703 - DNA, 20 bp, Artificial Sequence
  chemically synthesized
gtcaagactgaggaggaagc

SEQ ID NO: 16704 - DNA, 20 bp, Artificial Sequence
  chemically synthesized
ggaagcaggtaaattatgtc

SEQ ID NO: 16705 - DNA, 20 bp, Artificial Sequence
  chemically synthesized
aattatgtccagcaatacgt

SEQ ID NO: 16706 - DNA, 20 bp, Artificial Sequence
  chemically synthesized
tgtccagcaatacgttggct

SEQ ID NO: 16707 - DNA, 20 bp, Artificial Sequence
  chemically synthesized
gtccagcaatacgttggctt

SEQ ID NO: 16708 - DNA, 20 bp, Artificial Sequence
  chemically synthesized
aggcaaaaacaaattgtttc

SEQ ID NO: 16709 - DNA, 20 bp, Artificial Sequence
  chemically synthesized
aattgtttctagtccatttt

SEQ ID NO: 16710 - DNA, 20 bp, Artificial Sequence
  chemically synthesized
ttgtttctagtccattttaa

SEQ ID NO: 16711 - DNA, 20 bp, Artificial Sequence
  chemically synthesized
tgtttctagtccattttaag

SEQ ID NO: 16712 - DNA, 20 bp, Artificial Sequence
  chemically synthesized
gtttctagtccattttaaga

SEQ ID NO: 16713 - DNA, 20 bp, Artificial Sequence
  chemically synthesized
tctagtccattttaagaggg

SEQ ID NO: 16714 - DNA, 20 bp, Artificial Sequence
  chemically synthesized
ttaagagggaagcatttatt

SEQ ID NO: 16715 - DNA, 20 bp, Artificial Sequence
  chemically synthesized
taagagggaagcatttattt

SEQ ID NO: 16716 - DNA, 20 bp, Artificial Sequence
  chemically synthesized
aagagggaagcatttattta

SEQ ID NO: 16717 - DNA, 20 bp, Artificial Sequence
  chemically synthesized
atttagggactacatcgctc

SEQ ID NO: 16718 - DNA, 20 bp, Artificial Sequence
  chemically synthesized
ccttaacatgttaatttctc

SEQ ID NO: 16719 - DNA, 20 bp, Artificial Sequence
  chemically synthesized
ttaacatgttaatttctcca

SEQ ID NO: 16720 - DNA, 20 bp, Artificial Sequence
  chemically synthesized
tccagagtttgtaatgttct

SEQ ID NO: 16721 - DNA, 20 bp, Artificial Sequence
  chemically synthesized
gagtttgtaatgttctgagc

SEQ ID NO: 16722 - DNA, 20 bp, Artificial Sequence
  chemically synthesized
atgttctgagcaagtgtgtg

SEQ ID NO: 16723 - DNA, 20 bp, Artificial Sequence
  chemically synthesized
ttctgagcaagtgtgtgcag

SEQ ID NO: 16724 - DNA, 20 bp, Artificial Sequence
  chemically synthesized
gtgtgcagaagaaatgattg

SEQ ID NO: 16725 - DNA, 20 bp, Artificial Sequence
  chemically synthesized
gcagaagaaatgattgtagt

SEQ ID NO: 16726 - DNA, 20 bp, Artificial Sequence
  chemically synthesized
gaaatgattgtagtaagacc

SEQ ID NO: 16727 - DNA, 20 bp, Artificial Sequence
  chemically synthesized
aaatgattgtagtaagacct

SEQ ID NO: 16728 - DNA, 20 bp, Artificial Sequence
  chemically synthesized
attgtagtaagacctgggca

SEQ ID NO: 16729 - DNA, 20 bp, Artificial Sequence
  chemically synthesized
ttgtagtaagacctgggcaa

SEQ ID NO: 16730 - DNA, 20 bp, Artificial Sequence
  chemically synthesized
gtagtaagacctgggcaaag

SEQ ID NO: 16731 - DNA, 20 bp, Artificial Sequence
  chemically synthesized
agtaagacctgggcaaagga

SEQ ID NO: 16732 - DNA, 20 bp, Artificial Sequence
  chemically synthesized
taagacctgggcaaaggaga

SEQ ID NO: 16733 - DNA, 20 bp, Artificial Sequence
  chemically synthesized
aaacatttttcccccacatt

SEQ ID NO: 16734 - DNA, 20 bp, Artificial Sequence
  chemically synthesized
aacatttttcccccacattt

SEQ ID NO: 16735 - DNA, 20 bp, Artificial Sequence
  chemically synthesized
ttgggcaaaactttccatcc

SEQ ID NO: 16736 - DNA, 20 bp, Artificial Sequence
  chemically synthesized
tgggcaaaactttccatcct

SEQ ID NO: 16737 - DNA, 20 bp, Artificial Sequence
  chemically synthesized
ttccatcctgggtcacacca

SEQ ID NO: 16738 - DNA, 20 bp, Artificial Sequence
  chemically synthesized
ctcctctcctctccctcaac

SEQ ID NO: 16739 - DNA, 20 bp, Artificial Sequence
  chemically synthesized
tcctctccctcaactggtaa

SEQ ID NO: 16740 - DNA, 20 bp, Artificial Sequence
  chemically synthesized
ccaaaacatacctgactact

SEQ ID NO: 16741 - DNA, 20 bp, Artificial Sequence
  chemically synthesized
cttagtacttcccactactg

SEQ ID NO: 16742 - DNA, 20 bp, Artificial Sequence
  chemically synthesized
gtacttcccactactgtgga

SEQ ID NO: 16743 - DNA, 20 bp, Artificial Sequence
  chemically synthesized
cactactgtggatagaattt

SEQ ID NO: 16744 - DNA, 20 bp, Artificial Sequence
  chemically synthesized
ctcattcattgttcataccc

SEQ ID NO: 16745 - DNA, 20 bp, Artificial Sequence
  chemically synthesized
cattcattgttcataccctg

SEQ ID NO: 16746 - DNA, 20 bp, Artificial Sequence
  chemically synthesized
ccctggagacaaaactcctt

SEQ ID NO: 16747 - DNA, 20 bp, Artificial Sequence
  chemically synthesized
cctggagacaaaactcctta

SEQ ID NO: 16748 - DNA, 20 bp, Artificial Sequence
  chemically synthesized
taaggctattaactccccct

SEQ ID NO: 16749 - DNA, 20 bp, Artificial Sequence
  chemically synthesized
tccccctgagcttcacaatc

SEQ ID NO: 16750 - DNA, 20 bp, Artificial Sequence
  chemically synthesized
gcttcacaatctagtccctg

SEQ ID NO: 16751 - DNA, 20 bp, Artificial Sequence
  chemically synthesized
cttcacaatctagtccctgc

SEQ ID NO: 16752 - DNA, 20 bp, Artificial Sequence
  chemically synthesized
tcctctccttttccctctct

SEQ ID NO: 16753 - DNA, 20 bp, Artificial Sequence
  chemically synthesized
ttccctctctgagccccgct

SEQ ID NO: 16754 - DNA, 20 bp, Artificial Sequence
  chemically synthesized
gccccgctcagatcttcgaa

SEQ ID NO: 16755 - DNA, 20 bp, Artificial Sequence
  chemically synthesized
cccgctcagatcttcgaaca

SEQ ID NO: 16756 - DNA, 20 bp, Artificial Sequence
  chemically synthesized
cagagaacacttctgcatct

SEQ ID NO: 16757 - DNA, 20 bp, Artificial Sequence
  chemically synthesized
cttctgcatcttggcatata

SEQ ID NO: 16758 - DNA, 20 bp, Artificial Sequence
  chemically synthesized
gcatatatagttctctcaca

SEQ ID NO: 16759 - DNA, 20 bp, Artificial Sequence
  chemically synthesized
atagaacgctttctcccctt

SEQ ID NO: 16760 - DNA, 20 bp, Artificial Sequence
  chemically synthesized
cctttagctatttatccttc

SEQ ID NO: 16761 - DNA, 20 bp, Artificial Sequence
  chemically synthesized
gctatttatccttcaagtgt

SEQ ID NO: 16762 - DNA, 20 bp, Artificial Sequence
  chemically synthesized
cagctcaaacatctcatcat

SEQ ID NO: 16763 - DNA, 20 bp, Artificial Sequence
  chemically synthesized
gctcaaacatctcatcatta

SEQ ID NO: 16764 - DNA, 20 bp, Artificial Sequence
  chemically synthesized
tcaaacatctcatcattaga

SEQ ID NO: 16765 - DNA, 20 bp, Artificial Sequence
  chemically synthesized
caaacatctcatcattagag

SEQ ID NO: 16766 - DNA, 20 bp, Artificial Sequence
  chemically synthesized
agaggtttttcccaaacctc

SEQ ID NO: 16767 - DNA, 20 bp, Artificial Sequence
  chemically synthesized
gaggtttttcccaaacctct

SEQ ID NO: 16768 - DNA, 20 bp, Artificial Sequence
  chemically synthesized
ttcccaaacctctaggtaac

SEQ ID NO: 16769 - DNA, 20 bp, Artificial Sequence
  chemically synthesized
tcccaaacctctaggtaact

SEQ ID NO: 16770 - DNA, 20 bp, Artificial Sequence
  chemically synthesized
aaacctctaggtaactaggt

SEQ ID NO: 16771 - DNA, 20 bp, Artificial Sequence
  chemically synthesized
agaaaccactccccattcca

SEQ ID NO: 16772 - DNA, 20 bp, Artificial Sequence
  chemically synthesized
ccattccacggtacactgta

SEQ ID NO: 16773 - DNA, 20 bp, Artificial Sequence
  chemically synthesized
cacggtacactgtatagtct

SEQ ID NO: 16774 - DNA, 20 bp, Artificial Sequence
  chemically synthesized
acggtacactgtatagtctt

SEQ ID NO: 16775 - DNA, 20 bp, Artificial Sequence
  chemically synthesized
ctgtatagtcttaggacacc

SEQ ID NO: 16776 - DNA, 20 bp, Artificial Sequence
  chemically synthesized
cttaggacacctggttccct

SEQ ID NO: 16777 - DNA, 20 bp, Artificial Sequence
  chemically synthesized
tacaaatttgtcaattcttg

SEQ ID NO: 16778 - DNA, 20 bp, Artificial Sequence
  chemically synthesized
tttgtcaattcttgaagatt

SEQ ID NO: 16779 - DNA, 20 bp, Artificial Sequence
  chemically synthesized
aattcttgaagattaagaat

SEQ ID NO: 16780 - DNA, 20 bp, Artificial Sequence
  chemically synthesized
actctatctccctcgcctct

SEQ ID NO: 16781 - DNA, 20 bp, Artificial Sequence
  chemically synthesized
tctcagtgcctgatacctaa

SEQ ID NO: 16782 - DNA, 20 bp, Artificial Sequence
  chemically synthesized
atccttactgaataataaaa

SEQ ID NO: 16783 - DNA, 20 bp, Artificial Sequence
  chemically synthesized
taaaatggattaatgaataa

SEQ ID NO: 16784 - DNA, 20 bp, Artificial Sequence
  chemically synthesized
gaataaaagcaataaatttc

SEQ ID NO: 16785 - DNA, 20 bp, Artificial Sequence
  chemically synthesized
aataaaagcaataaatttca

SEQ ID NO: 16786 - DNA, 20 bp, Artificial Sequence
  chemically synthesized
gttaatattaataaattaaa

SEQ ID NO: 16787 - DNA, 20 bp, Artificial Sequence
  chemically synthesized
ttaatattaataaattaaaa

SEQ ID NO: 16788 - DNA, 20 bp, Artificial Sequence
  chemically synthesized
aaattaaaaaggttattttg

SEQ ID NO: 16789 - DNA, 20 bp, Artificial Sequence
  chemically synthesized
aaaaggttattttgaagtct

SEQ ID NO: 16790 - DNA, 20 bp, Artificial Sequence
  chemically synthesized
ttattttgaagtctgagaat

SEQ ID NO: 16791 - DNA, 20 bp, Artificial Sequence
  chemically synthesized
tttcacgtttccattgttca

SEQ ID NO: 16792 - DNA, 20 bp, Artificial Sequence
  chemically synthesized
ttcacgtttccattgttcat

SEQ ID NO: 16793 - DNA, 20 bp, Artificial Sequence
  chemically synthesized
attgttcatgggcaaaattc

SEQ ID NO: 16794 - DNA, 20 bp, Artificial Sequence
  chemically synthesized
gttcatgggcaaaattctgg

SEQ ID NO: 16795 - DNA, 20 bp, Artificial Sequence
  chemically synthesized
atgggcaaaattctggcagc

SEQ ID NO: 16796 - DNA, 20 bp, Artificial Sequence
  chemically synthesized
tgggcaaaattctggcagca

SEQ ID NO: 16797 - DNA, 20 bp, Artificial Sequence
  chemically synthesized
gggcaaaattctggcagcaa

SEQ ID NO: 16798 - DNA, 20 bp, Artificial Sequence
  chemically synthesized
cagcaagggattcttctcct

SEQ ID NO: 16799 - DNA, 20 bp, Artificial Sequence
  chemically synthesized
taagaaaccttttgttttct

SEQ ID NO: 16800 - DNA, 20 bp, Artificial Sequence
  chemically synthesized
gaatacatttccttgtttgc

SEQ ID NO: 16801 - DNA, 20 bp, Artificial Sequence
  chemically synthesized
tccttgtttgccagaaaaca

SEQ ID NO: 16802 - DNA, 20 bp, Artificial Sequence
  chemically synthesized
tgtttgccagaaaacatggt

SEQ ID NO: 16803 - DNA, 20 bp, Artificial Sequence
  chemically synthesized
agaaaacatggtaagataac

SEQ ID NO: 16804 - DNA, 20 bp, Artificial Sequence
  chemically synthesized
aaaacatggtaagataactg

SEQ ID NO: 16805 - DNA, 20 bp, Artificial Sequence
  chemically synthesized
aacatggtaagataactgga

SEQ ID NO: 16806 - DNA, 20 bp, Artificial Sequence
  chemically synthesized
taacattcattttattcatg

SEQ ID NO: 16807 - DNA, 20 bp, Artificial Sequence
  chemically synthesized
ttcatgaagaaactgttatt

SEQ ID NO: 16808 - DNA, 20 bp, Artificial Sequence
  chemically synthesized
aagaaactgttattcagttt

SEQ ID NO: 16809 - DNA, 20 bp, Artificial Sequence
  chemically synthesized
agaaactgttattcagttta

SEQ ID NO: 16810 - DNA, 20 bp, Artificial Sequence
  chemically synthesized
gaaactgttattcagtttaa

SEQ ID NO: 16811 - DNA, 20 bp, Artificial Sequence
  chemically synthesized
aaactgttattcagtttaag

SEQ ID NO: 16812 - DNA, 20 bp, Artificial Sequence
  chemically synthesized
cagtttaaggggttcttttt

SEQ ID NO: 16813 - DNA, 20 bp, Artificial Sequence
  chemically synthesized
ttaaggggttctttttcaga

SEQ ID NO: 16814 - DNA, 20 bp, Artificial Sequence
  chemically synthesized
ggttctttttcagaaagttt

SEQ ID NO: 16815 - DNA, 20 bp, Artificial Sequence
  chemically synthesized
tcagaaagtttcagaaatcc

SEQ ID NO: 16816 - DNA, 20 bp, Artificial Sequence
  chemically synthesized
aatccaagacctttgactgc

SEQ ID NO: 16817 - DNA, 20 bp, Artificial Sequence
  chemically synthesized
gtactgtgttctttcatcta

SEQ ID NO: 16818 - DNA, 20 bp, Artificial Sequence
  chemically synthesized
tactgtgttctttcatctat

SEQ ID NO: 16819 - DNA, 20 bp, Artificial Sequence
  chemically synthesized
ggacatttcctttgaaaact

SEQ ID NO: 16820 - DNA, 20 bp, Artificial Sequence
  chemically synthesized
gacatttcctttgaaaactg

SEQ ID NO: 16821 - DNA, 20 bp, Artificial Sequence
  chemically synthesized
aatatttaattcttacataa

SEQ ID NO: 16822 - DNA, 20 bp, Artificial Sequence
  chemically synthesized
attcttacataatagtaaaa

SEQ ID NO: 16823 - DNA, 20 bp, Artificial Sequence
  chemically synthesized
ataatagtaaaaaagtgaat

SEQ ID NO: 16824 - DNA, 20 bp, Artificial Sequence
  chemically synthesized
gtaaaaaagtgaattggcct

SEQ ID NO: 16825 - DNA, 20 bp, Artificial Sequence
  chemically synthesized
aaagtgaattggccttggaa

SEQ ID NO: 16826 - DNA, 20 bp, Artificial Sequence
  chemically synthesized
cttggaaaagacctaaatcc

SEQ ID NO: 16827 - DNA, 20 bp, Artificial Sequence
  chemically synthesized
aatcaatttgctctatgaac

SEQ ID NO: 16828 - DNA, 20 bp, Artificial Sequence
  chemically synthesized
tcaatttgctctatgaactg

SEQ ID NO: 16829 - DNA, 20 bp, Artificial Sequence
  chemically synthesized
caatttgctctatgaactgg

SEQ ID NO: 16830 - DNA, 20 bp, Artificial Sequence
  chemically synthesized
atttgctctatgaactggag

SEQ ID NO: 16831 - DNA, 20 bp, Artificial Sequence
  chemically synthesized
tgctctatgaactggaggag

SEQ ID NO: 16832 - DNA, 20 bp, Artificial Sequence
  chemically synthesized
gctctatgaactggaggagt

SEQ ID NO: 16833 - DNA, 20 bp, Artificial Sequence
  chemically synthesized
gagtgggattcatgatctct

SEQ ID NO: 16834 - DNA, 20 bp, Artificial Sequence
  chemically synthesized
catatcactactatgaaatg

SEQ ID NO: 16835 - DNA, 20 bp, Artificial Sequence
  chemically synthesized
atatcactactatgaaatgc

SEQ ID NO: 16836 - DNA, 20 bp, Artificial Sequence
  chemically synthesized
tatcactactatgaaatgca

SEQ ID NO: 16837 - DNA, 20 bp, Artificial Sequence
  chemically synthesized
cactactatgaaatgcaggg

SEQ ID NO: 16838 - DNA, 20 bp, Artificial Sequence
  chemically synthesized
aattcaaatcattaaattta

SEQ ID NO: 16839 - DNA, 20 bp, Artificial Sequence
  chemically synthesized
cattaaatttaaagaaacta

SEQ ID NO: 16840 - DNA, 20 bp, Artificial Sequence
  chemically synthesized
taaatttaaagaaactatag

SEQ ID NO: 16841 - DNA, 20 bp, Artificial Sequence
  chemically synthesized
ctatagtggcaatgtattat

SEQ ID NO: 16842 - DNA, 20 bp, Artificial Sequence
  chemically synthesized
tatagtggcaatgtattatt

SEQ ID NO: 16843 - DNA, 20 bp, Artificial Sequence
  chemically synthesized
atgaaaatctcaaaccatac

SEQ ID NO: 16844 - DNA, 20 bp, Artificial Sequence
  chemically synthesized
tgaaaatctcaaaccatacc

SEQ ID NO: 16845 - DNA, 20 bp, Artificial Sequence
  chemically synthesized
gctatgataatattaaaata

SEQ ID NO: 16846 - DNA, 20 bp, Artificial Sequence
  chemically synthesized
attaaaataaagatacattg

SEQ ID NO: 16847 - DNA, 20 bp, Artificial Sequence
  chemically synthesized
aacttgtgtaaatcacattg

SEQ ID NO: 16848 - DNA, 20 bp, Artificial Sequence
  chemically synthesized
acttgtgtaaatcacattgt

SEQ ID NO: 16849 - DNA, 20 bp, Artificial Sequence
  chemically synthesized
cttgtgtaaatcacattgtg

SEQ ID NO: 16850 - DNA, 20 bp, Artificial Sequence
  chemically synthesized
aacacttcccttccccttga

SEQ ID NO: 16851 - DNA, 20 bp, Artificial Sequence
  chemically synthesized
acacttcccttccccttgaa

SEQ ID NO: 16852 - DNA, 20 bp, Artificial Sequence
  chemically synthesized
cacttcccttccccttgaaa

SEQ ID NO: 16853 - DNA, 20 bp, Artificial Sequence
  chemically synthesized
tccccttgaaagggaaatga

SEQ ID NO: 16854 - DNA, 20 bp, Artificial Sequence
  chemically synthesized
aaagggaaatgatagaaaat

SEQ ID NO: 16855 - DNA, 20 bp, Artificial Sequence
  chemically synthesized
atgatagaaaataagtatta

SEQ ID NO: 16856 - DNA, 20 bp, Artificial Sequence
  chemically synthesized
tgatagaaaataagtattaa

SEQ ID NO: 16857 - DNA, 20 bp, Artificial Sequence
  chemically synthesized
tagaaaataagtattaaagg

SEQ ID NO: 16858 - DNA, 20 bp, Artificial Sequence
  chemically synthesized
aataagtattaaaggcagct

SEQ ID NO: 16859 - DNA, 20 bp, Artificial Sequence
  chemically synthesized
ataagtattaaaggcagctt

SEQ ID NO: 16860 - DNA, 20 bp, Artificial Sequence
  chemically synthesized
taagtattaaaggcagctta

SEQ ID NO: 16861 - DNA, 20 bp, Artificial Sequence
  chemically synthesized
aagtattaaaggcagcttag

SEQ ID NO: 16862 - DNA, 20 bp, Artificial Sequence
  chemically synthesized
ttttcaaaaaaaaatccatt

SEQ ID NO: 16863 - DNA, 20 bp, Artificial Sequence
  chemically synthesized
attgagcattttctatgtac

SEQ ID NO: 16864 - DNA, 20 bp, Artificial Sequence
  chemically synthesized
ttgagcattttctatgtacc

SEQ ID NO: 16865 - DNA, 20 bp, Artificial Sequence
  chemically synthesized
ctatgtaccaggcactgttc

SEQ ID NO: 16866 - DNA, 20 bp, Artificial Sequence
  chemically synthesized
caggcactgttctagaccct

SEQ ID NO: 16867 - DNA, 20 bp, Artificial Sequence
  chemically synthesized
acacacatgctactgattat

SEQ ID NO: 16868 - DNA, 20 bp, Artificial Sequence
  chemically synthesized
ataagatccataaaataact

SEQ ID NO: 16869 - DNA, 20 bp, Artificial Sequence
  chemically synthesized
ataaaataacttagtttcac

SEQ ID NO: 16870 - DNA, 20 bp, Artificial Sequence
  chemically synthesized
tagtttcactggcgtgttcc

SEQ ID NO: 16871 - DNA, 20 bp, Artificial Sequence
  chemically synthesized
actggcgtgttcccagtgcc

SEQ ID NO: 16872 - DNA, 20 bp, Artificial Sequence
  chemically synthesized
ctggcgtgttcccagtgccc

SEQ ID NO: 16873 - DNA, 20 bp, Artificial Sequence
  chemically synthesized
tgttcccagtgcccaggtaa

SEQ ID NO: 16874 - DNA, 20 bp, Artificial Sequence
  chemically synthesized
attaatgtttgttaaatgat

SEQ ID NO: 16875 - DNA, 20 bp, Artificial Sequence
  chemically synthesized
tgtttgttaaatgatgagaa

SEQ ID NO: 16876 - DNA, 20 bp, Artificial Sequence
  chemically synthesized
tttgttaaatgatgagaaaa

SEQ ID NO: 16877 - DNA, 20 bp, Artificial Sequence
  chemically synthesized
ttgttaaatgatgagaaaag

SEQ ID NO: 16878 - DNA, 20 bp, Artificial Sequence
  chemically synthesized
taaatgatgagaaaagagga

SEQ ID NO: 16879 - DNA, 20 bp, Artificial Sequence
  chemically synthesized
atgatgagaaaagaggaaag

SEQ ID NO: 16880 - DNA, 20 bp, Artificial Sequence
  chemically synthesized
atgagaaaagaggaaagcag

SEQ ID NO: 16881 - DNA, 20 bp, Artificial Sequence
  chemically synthesized
tgagaaaagaggaaagcaga

SEQ ID NO: 16882 - DNA, 20 bp, Artificial Sequence
  chemically synthesized
gagaaaagaggaaagcagaa

SEQ ID NO: 16883 - DNA, 20 bp, Artificial Sequence
  chemically synthesized
agaaaagaggaaagcagaag

SEQ ID NO: 16884 - DNA, 20 bp, Artificial Sequence
  chemically synthesized
aaagcagaaggggctctgct

SEQ ID NO: 16885 - DNA, 20 bp, Artificial Sequence
  chemically synthesized
aagcagaaggggctctgctc

SEQ ID NO: 16886 - DNA, 20 bp, Artificial Sequence
  chemically synthesized
gaaggggctctgctcaggtg

SEQ ID NO: 16887 - DNA, 20 bp, Artificial Sequence
  chemically synthesized
aaggggctctgctcaggtgc

SEQ ID NO: 16888 - DNA, 20 bp, Artificial Sequence
  chemically synthesized
ctcaggtgcaggaacttgtg

SEQ ID NO: 16889 - DNA, 20 bp, Artificial Sequence
  chemically synthesized
caggtgcaggaacttgtgca

SEQ ID NO: 16890 - DNA, 20 bp, Artificial Sequence
  chemically synthesized
gaacttgtgcagagatcttc

SEQ ID NO: 16891 - DNA, 20 bp, Artificial Sequence
  chemically synthesized
agatcttctggactgattcc

SEQ ID NO: 16892 - DNA, 20 bp, Artificial Sequence
  chemically synthesized
gactgattcccagtgctaac

SEQ ID NO: 16893 - DNA, 20 bp, Artificial Sequence
  chemically synthesized
cagtgctaacaagtcccttc

SEQ ID NO: 16894 - DNA, 20 bp, Artificial Sequence
  chemically synthesized
ttccagttttatccaccaat

SEQ ID NO: 16895 - DNA, 20 bp, Artificial Sequence
  chemically synthesized
caccaataagctatgtcctt

SEQ ID NO: 16896 - DNA, 20 bp, Artificial Sequence
  chemically synthesized
ttgagctcctgcccactctc

SEQ ID NO: 16897 - DNA, 20 bp, Artificial Sequence
  chemically synthesized
gagctcctgcccactctcta

SEQ ID NO: 16898 - DNA, 20 bp, Artificial Sequence
  chemically synthesized
ctagagaaaacttttatttc

SEQ ID NO: 16899 - DNA, 20 bp, Artificial Sequence
  chemically synthesized
tagagaaaacttttatttca

SEQ ID NO: 16900 - DNA, 20 bp, Artificial Sequence
  chemically synthesized
ttttatttcaaggcatactc

SEQ ID NO: 16901 - DNA, 20 bp, Artificial Sequence
  chemically synthesized
tttatttcaaggcatactcc

SEQ ID NO: 16902 - DNA, 20 bp, Artificial Sequence
  chemically synthesized
actccgggattcacatgtga

SEQ ID NO: 16903 - DNA, 20 bp, Artificial Sequence
  chemically synthesized
tccgggattcacatgtgata

SEQ ID NO: 16904 - DNA, 20 bp, Artificial Sequence
  chemically synthesized
ggattcacatgtgatagaga

SEQ ID NO: 16905 - DNA, 20 bp, Artificial Sequence
  chemically synthesized
gatagagatggttctgttcc

SEQ ID NO: 16906 - DNA, 20 bp, Artificial Sequence
  chemically synthesized
atagagatggttctgttccc

SEQ ID NO: 16907 - DNA, 20 bp, Artificial Sequence
  chemically synthesized
ggttctgttcccaggaactt

SEQ ID NO: 16908 - DNA, 20 bp, Artificial Sequence
  chemically synthesized
gttctgttcccaggaacttt

SEQ ID NO: 16909 - DNA, 20 bp, Artificial Sequence
  chemically synthesized
ctttgggcatatttaaaaac

SEQ ID NO: 16910 - DNA, 20 bp, Artificial Sequence
  chemically synthesized
ggcatatttaaaaactggac

SEQ ID NO: 16911 - DNA, 20 bp, Artificial Sequence
  chemically synthesized
ggactggaaaaatttgtgac

SEQ ID NO: 16912 - DNA, 20 bp, Artificial Sequence
  chemically synthesized
gaaaaatttgtgactagaaa

SEQ ID NO: 16913 - DNA, 20 bp, Artificial Sequence
  chemically synthesized
aaaaatttgtgactagaaaa

SEQ ID NO: 16914 - DNA, 20 bp, Artificial Sequence
  chemically synthesized
ttaaaaacacatgctcattt

SEQ ID NO: 16915 - DNA, 20 bp, Artificial Sequence
  chemically synthesized
taaaaacacatgctcatttc

SEQ ID NO: 16916 - DNA, 20 bp, Artificial Sequence
  chemically synthesized
cacatgctcatttcaggata

SEQ ID NO: 16917 - DNA, 20 bp, Artificial Sequence
  chemically synthesized
atttcaggataaagatctct

SEQ ID NO: 16918 - DNA, 20 bp, Artificial Sequence
  chemically synthesized
tttcaggataaagatctctg

SEQ ID NO: 16919 - DNA, 20 bp, Artificial Sequence
  chemically synthesized
ggataaagatctctgaggaa

SEQ ID NO: 16920 - DNA, 20 bp, Artificial Sequence
  chemically synthesized
agaatacaaaataatttaaa

SEQ ID NO: 16921 - DNA, 20 bp, Artificial Sequence
  chemically synthesized
aataatttaaaaagaaacaa

SEQ ID NO: 16922 - DNA, 20 bp, Artificial Sequence
  chemically synthesized
ttaaaaagaaacaacagaaa

SEQ ID NO: 16923 - DNA, 20 bp, Artificial Sequence
  chemically synthesized
taaaaagaaacaacagaaac

SEQ ID NO: 16924 - DNA, 20 bp, Artificial Sequence
  chemically synthesized
atacttcacttctctgtaat

SEQ ID NO: 16925 - DNA, 20 bp, Artificial Sequence
  chemically synthesized
tacttcacttctctgtaata

SEQ ID NO: 16926 - DNA, 20 bp, Artificial Sequence
  chemically synthesized
taataaggtttctgtcctcc

SEQ ID NO: 16927 - DNA, 20 bp, Artificial Sequence
  chemically synthesized
gattctttctcactaaacta

SEQ ID NO: 16928 - DNA, 20 bp, Artificial Sequence
  chemically synthesized
ttctttctcactaaactaca

SEQ ID NO: 16929 - DNA, 20 bp, Artificial Sequence
  chemically synthesized
ctcactaaactacagagaat

SEQ ID NO: 16930 - DNA, 20 bp, Artificial Sequence
  chemically synthesized
gcattctgtccacttctaca

SEQ ID NO: 16931 - DNA, 20 bp, Artificial Sequence
  chemically synthesized
cattctgtccacttctacat

SEQ ID NO: 16932 - DNA, 20 bp, Artificial Sequence
  chemically synthesized
ttttatgaatgcatacacac

SEQ ID NO: 16933 - DNA, 20 bp, Artificial Sequence
  chemically synthesized
atacacacgagaactttgaa

SEQ ID NO: 16934 - DNA, 20 bp, Artificial Sequence
  chemically synthesized
acacgagaactttgaacagt

SEQ ID NO: 16935 - DNA, 20 bp, Artificial Sequence
  chemically synthesized
gaactttgaacagttagtat

SEQ ID NO: 16936 - DNA, 20 bp, Artificial Sequence
  chemically synthesized
aactttgaacagttagtata

SEQ ID NO: 16937 - DNA, 20 bp, Artificial Sequence
  chemically synthesized
taaggtgaattctgattttt

SEQ ID NO: 16938 - DNA, 20 bp, Artificial Sequence
  chemically synthesized
tatataatgcatttaatttt

SEQ ID NO: 16939 - DNA, 20 bp, Artificial Sequence
  chemically synthesized
atttaattttgagattatgc

SEQ ID NO: 16940 - DNA, 20 bp, Artificial Sequence
  chemically synthesized
gagattatgctggctctgat

SEQ ID NO: 16941 - DNA, 20 bp, Artificial Sequence
  chemically synthesized
tgctggctctgattagccaa

SEQ ID NO: 16942 - DNA, 20 bp, Artificial Sequence
  chemically synthesized
tggctctgattagccaaaag

SEQ ID NO: 16943 - DNA, 20 bp, Artificial Sequence
  chemically synthesized
ggctctgattagccaaaaga

SEQ ID NO: 16944 - DNA, 20 bp, Artificial Sequence
  chemically synthesized
tctgattagccaaaagaagg

SEQ ID NO: 16945 - DNA, 20 bp, Artificial Sequence
  chemically synthesized
ggaagtaatatatcacattc

SEQ ID NO: 16946 - DNA, 20 bp, Artificial Sequence
  chemically synthesized
tcacattctggttattattt

SEQ ID NO: 16947 - DNA, 20 bp, Artificial Sequence
  chemically synthesized
ggttattatttcagatcctt

SEQ ID NO: 16948 - DNA, 20 bp, Artificial Sequence
  chemically synthesized
gatcctttagattactgtaa

SEQ ID NO: 16949 - DNA, 20 bp, Artificial Sequence
  chemically synthesized
ttactgtaatagacatgaaa

SEQ ID NO: 16950 - DNA, 20 bp, Artificial Sequence
  chemically synthesized
cacaacacatgacataattt

SEQ ID NO: 16951 - DNA, 20 bp, Artificial Sequence
  chemically synthesized
tcagatcgtttaaatcacac

SEQ ID NO: 16952 - DNA, 20 bp, Artificial Sequence
  chemically synthesized
agtcatcactgccatttacc

SEQ ID NO: 16953 - DNA, 20 bp, Artificial Sequence
  chemically synthesized
actgccatttacccagcaat

SEQ ID NO: 16954 - DNA, 20 bp, Artificial Sequence
  chemically synthesized
ccatttacccagcaatcagt

SEQ ID NO: 16955 - DNA, 20 bp, Artificial Sequence
  chemically synthesized
atcagttggcttgattcttc

SEQ ID NO: 16956 - DNA, 20 bp, Artificial Sequence
  chemically synthesized
gcttgattcttcaagatctt

SEQ ID NO: 16957 - DNA, 20 bp, Artificial Sequence
  chemically synthesized
cttgattcttcaagatcttg

SEQ ID NO: 16958 - DNA, 20 bp, Artificial Sequence
  chemically synthesized
cttcaagatcttgaggaact

SEQ ID NO: 16959 - DNA, 20 bp, Artificial Sequence
  chemically synthesized
ctttgctaatgttccttcaa

SEQ ID NO: 16960 - DNA, 20 bp, Artificial Sequence
  chemically synthesized
tagtcttgacacttttaaac

SEQ ID NO: 16961 - DNA, 20 bp, Artificial Sequence
  chemically synthesized
gtcttgacacttttaaacta

SEQ ID NO: 16962 - DNA, 20 bp, Artificial Sequence
  chemically synthesized
cttgacacttttaaactaga

SEQ ID NO: 16963 - DNA, 20 bp, Artificial Sequence
  chemically synthesized
actagagagtataaacccac

SEQ ID NO: 16964 - DNA, 20 bp, Artificial Sequence
  chemically synthesized
ctagagagtataaacccaca

SEQ ID NO: 16965 - DNA, 20 bp, Artificial Sequence
  chemically synthesized
ggaattgttttataatttta

SEQ ID NO: 16966 - DNA, 20 bp, Artificial Sequence
  chemically synthesized
tttcaaaatcatttacattg

SEQ ID NO: 16967 - DNA, 20 bp, Artificial Sequence
  chemically synthesized
ctaccttgccttctcttacc

SEQ ID NO: 16968 - DNA, 20 bp, Artificial Sequence
  chemically synthesized
ttgccttctcttacccagca

SEQ ID NO: 16969 - DNA, 20 bp, Artificial Sequence
  chemically synthesized
ttctcttacccagcacagat

SEQ ID NO: 16970 - DNA, 20 bp, Artificial Sequence
  chemically synthesized
tctcttacccagcacagatg

SEQ ID NO: 16971 - DNA, 20 bp, Artificial Sequence
  chemically synthesized
ttattttataattcctacat

SEQ ID NO: 16972 - DNA, 20 bp, Artificial Sequence
  chemically synthesized
ttataattcctacataagca

SEQ ID NO: 16973 - DNA, 20 bp, Artificial Sequence
  chemically synthesized
cctacataagcatagcattg

SEQ ID NO: 16974 - DNA, 20 bp, Artificial Sequence
  chemically synthesized
aaaaattactttcattctga

SEQ ID NO: 16975 - DNA, 20 bp, Artificial Sequence
  chemically synthesized
aaaattactttcattctgaa

SEQ ID NO: 16976 - DNA, 20 bp, Artificial Sequence
  chemically synthesized
aattactttcattctgaaag

SEQ ID NO: 16977 - DNA, 20 bp, Artificial Sequence
  chemically synthesized
ctttcattctgaaaggagca

SEQ ID NO: 16978 - DNA, 20 bp, Artificial Sequence
  chemically synthesized
agcacagtattttgcctttt

SEQ ID NO: 16979 - DNA, 20 bp, Artificial Sequence
  chemically synthesized
acagtattttgccttttgag

SEQ ID NO: 16980 - DNA, 20 bp, Artificial Sequence
  chemically synthesized
tgaattaaaacattaattcc

SEQ ID NO: 16981 - DNA, 20 bp, Artificial Sequence
  chemically synthesized
tgtgaatatgaaacattctt

SEQ ID NO: 16982 - DNA, 20 bp, Artificial Sequence
  chemically synthesized
gcatttcatataattactaa

SEQ ID NO: 16983 - DNA, 20 bp, Artificial Sequence
  chemically synthesized
atataattactaacagaatg

SEQ ID NO: 16984 - DNA, 20 bp, Artificial Sequence
  chemically synthesized
ataattactaacagaatgta

SEQ ID NO: 16985 - DNA, 20 bp, Artificial Sequence
  chemically synthesized
tactaacagaatgtagagtt

SEQ ID NO: 16986 - DNA, 20 bp, Artificial Sequence
  chemically synthesized
actaacagaatgtagagttg

SEQ ID NO: 16987 - DNA, 20 bp, Artificial Sequence
  chemically synthesized
gtagagttgaggtttccaac

SEQ ID NO: 16988 - DNA, 20 bp, Artificial Sequence
  chemically synthesized
tttaattatactattttgct

SEQ ID NO: 16989 - DNA, 20 bp, Artificial Sequence
  chemically synthesized
atttctatgttgtcataata

SEQ ID NO: 16990 - DNA, 20 bp, Artificial Sequence
  chemically synthesized
taatttaaatgcacattcca

SEQ ID NO: 16991 - DNA, 20 bp, Artificial Sequence
  chemically synthesized
aaatgcacattccatggcaa

SEQ ID NO: 16992 - DNA, 20 bp, Artificial Sequence
  chemically synthesized
tccctcttcaacacatacac

SEQ ID NO: 16993 - DNA, 20 bp, Artificial Sequence
  chemically synthesized
catacacaagtctgtattca

SEQ ID NO: 16994 - DNA, 20 bp, Artificial Sequence
  chemically synthesized
gtattcatagcctgttgtaa

SEQ ID NO: 16995 - DNA, 20 bp, Artificial Sequence
  chemically synthesized
catagcctgttgtaatagac

SEQ ID NO: 16996 - DNA, 20 bp, Artificial Sequence
  chemically synthesized
atagcctgttgtaatagaca

SEQ ID NO: 16997 - DNA, 20 bp, Artificial Sequence
  chemically synthesized
gtaatagacaaggttaaatg

SEQ ID NO: 16998 - DNA, 20 bp, Artificial Sequence
  chemically synthesized
taaatgctttcctcactcac

SEQ ID NO: 16999 - DNA, 20 bp, Artificial Sequence
  chemically synthesized
tttcctcactcactagcaat

SEQ ID NO: 17000 - DNA, 20 bp, Artificial Sequence
  chemically synthesized
cactagcaattggttatcac

SEQ ID NO: 17001 - DNA, 20 bp, Artificial Sequence
  chemically synthesized
ctagcaattggttatcacta

SEQ ID NO: 17002 - DNA, 20 bp, Artificial Sequence
  chemically synthesized
agcaattggttatcactaga

SEQ ID NO: 17003 - DNA, 20 bp, Artificial Sequence
  chemically synthesized
aaatcttactctacattcct

SEQ ID NO: 17004 - DNA, 20 bp, Artificial Sequence
  chemically synthesized
ctctacattcctcagtcacc

SEQ ID NO: 17005 - DNA, 20 bp, Artificial Sequence
  chemically synthesized
cattcctcagtcacctagtg

SEQ ID NO: 17006 - DNA, 20 bp, Artificial Sequence
  chemically synthesized
attcctcagtcacctagtga

SEQ ID NO: 17007 - DNA, 20 bp, Artificial Sequence
  chemically synthesized
aaggtgtactgatccacctt

SEQ ID NO: 17008 - DNA, 20 bp, Artificial Sequence
  chemically synthesized
aggtgtactgatccaccttc

SEQ ID NO: 17009 - DNA, 20 bp, Artificial Sequence
  chemically synthesized
gtgtactgatccaccttcag

SEQ ID NO: 17010 - DNA, 20 bp, Artificial Sequence
  chemically synthesized
tactgatccaccttcaggag

SEQ ID NO: 17011 - DNA, 20 bp, Artificial Sequence
  chemically synthesized
ggagcagtacaaacctttat

SEQ ID NO: 17012 - DNA, 20 bp, Artificial Sequence
  chemically synthesized
acctttattggtcacttccc

SEQ ID NO: 17013 - DNA, 20 bp, Artificial Sequence
  chemically synthesized
tcacttcccaagcaacttca

SEQ ID NO: 17014 - DNA, 20 bp, Artificial Sequence
  chemically synthesized
acttcccaagcaacttcaaa

SEQ ID NO: 17015 - DNA, 20 bp, Artificial Sequence
  chemically synthesized
tcccaagcaacttcaaagag

SEQ ID NO: 17016 - DNA, 20 bp, Artificial Sequence
  chemically synthesized
aaagagcagtaactcctcca

SEQ ID NO: 17017 - DNA, 20 bp, Artificial Sequence
  chemically synthesized
aagagcagtaactcctccac

SEQ ID NO: 17018 - DNA, 20 bp, Artificial Sequence
  chemically synthesized
agcagtaactcctccacagg

SEQ ID NO: 17019 - DNA, 20 bp, Artificial Sequence
  chemically synthesized
gaagttcttcgacttcccac

SEQ ID NO: 17020 - DNA, 20 bp, Artificial Sequence
  chemically synthesized
aagttcttcgacttcccact

SEQ ID NO: 17021 - DNA, 20 bp, Artificial Sequence
  chemically synthesized
agttcttcgacttcccactg

SEQ ID NO: 17022 - DNA, 20 bp, Artificial Sequence
  chemically synthesized
tcttcgacttcccactgggg

SEQ ID NO: 17023 - DNA, 20 bp, Artificial Sequence
  chemically synthesized
tcccactggggaagcccacc

SEQ ID NO: 17024 - DNA, 20 bp, Artificial Sequence
  chemically synthesized
cccactggggaagcccaccc

SEQ ID NO: 17025 - DNA, 20 bp, Artificial Sequence
  chemically synthesized
ccactggggaagcccaccca

SEQ ID NO: 17026 - DNA, 20 bp, Artificial Sequence
  chemically synthesized
aagcccacccagggatgtta

SEQ ID NO: 17027 - DNA, 20 bp, Artificial Sequence
  chemically synthesized
gcccacccagggatgttaca

SEQ ID NO: 17028 - DNA, 20 bp, Artificial Sequence
  chemically synthesized
ccacccagggatgttacaga

SEQ ID NO: 17029 - DNA, 20 bp, Artificial Sequence
  chemically synthesized
cacccagggatgttacagag

SEQ ID NO: 17030 - DNA, 20 bp, Artificial Sequence
  chemically synthesized
acccagggatgttacagaga

SEQ ID NO: 17031 - DNA, 20 bp, Artificial Sequence
  chemically synthesized
gggatgttacagagagggat

SEQ ID NO: 17032 - DNA, 20 bp, Artificial Sequence
  chemically synthesized
acagagagggatcggcctcg

SEQ ID NO: 17033 - DNA, 20 bp, Artificial Sequence
  chemically synthesized
gcctcgaagcattcttctta

SEQ ID NO: 17034 - DNA, 20 bp, Artificial Sequence
  chemically synthesized
cattcttcttacagtcctcc

SEQ ID NO: 17035 - DNA, 20 bp, Artificial Sequence
  chemically synthesized
ctttgaattcctgtttcaat

SEQ ID NO: 17036 - DNA, 20 bp, Artificial Sequence
  chemically synthesized
gtttcaattagttgtaatcc

SEQ ID NO: 17037 - DNA, 20 bp, Artificial Sequence
  chemically synthesized
tttcaattagttgtaatccc

SEQ ID NO: 17038 - DNA, 20 bp, Artificial Sequence
  chemically synthesized
tcaattagttgtaatcccag

SEQ ID NO: 17039 - DNA, 20 bp, Artificial Sequence
  chemically synthesized
attagttgtaatcccaggag

SEQ ID NO: 17040 - DNA, 20 bp, Artificial Sequence
  chemically synthesized
tagttgtaatcccaggagaa

SEQ ID NO: 17041 - DNA, 20 bp, Artificial Sequence
  chemically synthesized
tcccaggagaagagaactta

SEQ ID NO: 17042 - DNA, 20 bp, Artificial Sequence
  chemically synthesized
cccaggagaagagaacttac

SEQ ID NO: 17043 - DNA, 20 bp, Artificial Sequence
  chemically synthesized
aagagaacttacaggcacaa

SEQ ID NO: 17044 - DNA, 20 bp, Artificial Sequence
  chemically synthesized
gaacttacaggcacaaaagt

SEQ ID NO: 17045 - DNA, 20 bp, Artificial Sequence
  chemically synthesized
acttacaggcacaaaagtta

SEQ ID NO: 17046 - DNA, 20 bp, Artificial Sequence
  chemically synthesized
acaggcacaaaagttagagt

SEQ ID NO: 17047 - DNA, 20 bp, Artificial Sequence
  chemically synthesized
ggcacaaaagttagagttgg

SEQ ID NO: 17048 - DNA, 20 bp, Artificial Sequence
  chemically synthesized
cacaaaagttagagttggta

SEQ ID NO: 17049 - DNA, 20 bp, Artificial Sequence
  chemically synthesized
gttagagttggtagagttac

SEQ ID NO: 17050 - DNA, 20 bp, Artificial Sequence
  chemically synthesized
ttagagttggtagagttacc

SEQ ID NO: 17051 - DNA, 20 bp, Artificial Sequence
  chemically synthesized
ttggtagagttaccaggctt

SEQ ID NO: 17052 - DNA, 20 bp, Artificial Sequence
  chemically synthesized
gtagagttaccaggctttgg

SEQ ID NO: 17053 - DNA, 20 bp, Artificial Sequence
  chemically synthesized
caggctttggtagcttctct

SEQ ID NO: 17054 - DNA, 20 bp, Artificial Sequence
  chemically synthesized
aggctttggtagcttctctt

SEQ ID NO: 17055 - DNA, 20 bp, Artificial Sequence
  chemically synthesized
agcttctcttgggaataaac

SEQ ID NO: 17056 - DNA, 20 bp, Artificial Sequence
  chemically synthesized
ttctcttgggaataaactag

SEQ ID NO: 17057 - DNA, 20 bp, Artificial Sequence
  chemically synthesized
gaaatcttatgtgcttccca

SEQ ID NO: 17058 - DNA, 20 bp, Artificial Sequence
  chemically synthesized
tgtgcttcccacagaattcc

SEQ ID NO: 17059 - DNA, 20 bp, Artificial Sequence
  chemically synthesized
gcttcccacagaattcctgg

SEQ ID NO: 17060 - DNA, 20 bp, Artificial Sequence
  chemically synthesized
tcccacagaattcctggtgg

SEQ ID NO: 17061 - DNA, 20 bp, Artificial Sequence
  chemically synthesized
cccacagaattcctggtgga

SEQ ID NO: 17062 - DNA, 20 bp, Artificial Sequence
  chemically synthesized
cacagaattcctggtggaag

SEQ ID NO: 17063 - DNA, 20 bp, Artificial Sequence
  chemically synthesized
acagaattcctggtggaagg

SEQ ID NO: 17064 - DNA, 20 bp, Artificial Sequence
  chemically synthesized
cctcctctttctcgtctttc

SEQ ID NO: 17065 - DNA, 20 bp, Artificial Sequence
  chemically synthesized
ctcctctttctcgtctttct

SEQ ID NO: 17066 - DNA, 20 bp, Artificial Sequence
  chemically synthesized
ctctttctcgtctttctggg

SEQ ID NO: 17067 - DNA, 20 bp, Artificial Sequence
  chemically synthesized
tctttctcgtctttctgggc

SEQ ID NO: 17068 - DNA, 20 bp, Artificial Sequence
  chemically synthesized
tctttctgggcaggtattgt

SEQ ID NO: 17069 - DNA, 20 bp, Artificial Sequence
  chemically synthesized
ctttctgggcaggtattgtg

SEQ ID NO: 17070 - DNA, 20 bp, Artificial Sequence
  chemically synthesized
ctgggcaggtattgtgagga

SEQ ID NO: 17071 - DNA, 20 bp, Artificial Sequence
  chemically synthesized
gaggacggtatctgccctgt

SEQ ID NO: 17072 - DNA, 20 bp, Artificial Sequence
  chemically synthesized
ccgtcctcacaatacctgcc

SEQ ID NO: 17073 - DNA, 20 bp, Artificial Sequence
  chemically synthesized
cctcacaatacctgcccaga

SEQ ID NO: 17074 - DNA, 20 bp, Artificial Sequence
  chemically synthesized
caatacctgcccagaaagac

SEQ ID NO: 17075 - DNA, 20 bp, Artificial Sequence
  chemically synthesized
acctgcccagaaagacgaga

SEQ ID NO: 17076 - DNA, 20 bp, Artificial Sequence
  chemically synthesized
ctgcccagaaagacgagaaa

SEQ ID NO: 17077 - DNA, 20 bp, Artificial Sequence
  chemically synthesized
tgcccagaaagacgagaaag

SEQ ID NO: 17078 - DNA, 20 bp, Artificial Sequence
  chemically synthesized
cccagaaagacgagaaagag

SEQ ID NO: 17079 - DNA, 20 bp, Artificial Sequence
  chemically synthesized
ccagaaagacgagaaagagg

SEQ ID NO: 17080 - DNA, 20 bp, Artificial Sequence
  chemically synthesized
gaaagacgagaaagaggagg

SEQ ID NO: 17081 - DNA, 20 bp, Artificial Sequence
  chemically synthesized
ggaagaattcctccttccac

SEQ ID NO: 17082 - DNA, 20 bp, Artificial Sequence
  chemically synthesized
gaagaattcctccttccacc

SEQ ID NO: 17083 - DNA, 20 bp, Artificial Sequence
  chemically synthesized
tccttccaccaggaattctg

SEQ ID NO: 17084 - DNA, 20 bp, Artificial Sequence
  chemically synthesized
ccttccaccaggaattctgt

SEQ ID NO: 17085 - DNA, 20 bp, Artificial Sequence
  chemically synthesized
tccaccaggaattctgtggg

SEQ ID NO: 17086 - DNA, 20 bp, Artificial Sequence
  chemically synthesized
gaattctgtgggaagcacat

SEQ ID NO: 17087 - DNA, 20 bp, Artificial Sequence
  chemically synthesized
cacataagatttcatgctac

SEQ ID NO: 17088 - DNA, 20 bp, Artificial Sequence
  chemically synthesized
catgctactagtttattccc

SEQ ID NO: 17089 - DNA, 20 bp, Artificial Sequence
  chemically synthesized
tgctactagtttattcccaa

SEQ ID NO: 17090 - DNA, 20 bp, Artificial Sequence
  chemically synthesized
tactagtttattcccaagag

SEQ ID NO: 17091 - DNA, 20 bp, Artificial Sequence
  chemically synthesized
attcccaagagaagctacca

SEQ ID NO: 17092 - DNA, 20 bp, Artificial Sequence
  chemically synthesized
caagagaagctaccaaagcc

SEQ ID NO: 17093 - DNA, 20 bp, Artificial Sequence
  chemically synthesized
actctaacttttgtgcctgt

SEQ ID NO: 17094 - DNA, 20 bp, Artificial Sequence
  chemically synthesized
gcctgtaagttctcttctcc

SEQ ID NO: 17095 - DNA, 20 bp, Artificial Sequence
  chemically synthesized
cctgtaagttctcttctcct

SEQ ID NO: 17096 - DNA, 20 bp, Artificial Sequence
  chemically synthesized
gggattacaactaattgaaa

SEQ ID NO: 17097 - DNA, 20 bp, Artificial Sequence
  chemically synthesized
ggattacaactaattgaaac

SEQ ID NO: 17098 - DNA, 20 bp, Artificial Sequence
  chemically synthesized
ctaattgaaacaggaattca

SEQ ID NO: 17099 - DNA, 20 bp, Artificial Sequence
  chemically synthesized
taattgaaacaggaattcaa

SEQ ID NO: 17100 - DNA, 20 bp, Artificial Sequence
  chemically synthesized
attgaaacaggaattcaaag

SEQ ID NO: 17101 - DNA, 20 bp, Artificial Sequence
  chemically synthesized
acaggaattcaaaggagtct

SEQ ID NO: 17102 - DNA, 20 bp, Artificial Sequence
  chemically synthesized
aggaattcaaaggagtctcg

SEQ ID NO: 17103 - DNA, 20 bp, Artificial Sequence
  chemically synthesized
ggaattcaaaggagtctcgg

SEQ ID NO: 17104 - DNA, 20 bp, Artificial Sequence
  chemically synthesized
aaggagtctcggaggactgt

SEQ ID NO: 17105 - DNA, 20 bp, Artificial Sequence
  chemically synthesized
gagtctcggaggactgtaag

SEQ ID NO: 17106 - DNA, 20 bp, Artificial Sequence
  chemically synthesized
gactgtaagaagaatgcttc

SEQ ID NO: 17107 - DNA, 20 bp, Artificial Sequence
  chemically synthesized
actgtaagaagaatgcttcg

SEQ ID NO: 17108 - DNA, 20 bp, Artificial Sequence
  chemically synthesized
atccctctctgtaacatccc

SEQ ID NO: 17109 - DNA, 20 bp, Artificial Sequence
  chemically synthesized
tccctctctgtaacatccct

SEQ ID NO: 17110 - DNA, 20 bp, Artificial Sequence
  chemically synthesized
ctctctgtaacatccctggg

SEQ ID NO: 17111 - DNA, 20 bp, Artificial Sequence
  chemically synthesized
tctctgtaacatccctgggt

SEQ ID NO: 17112 - DNA, 20 bp, Artificial Sequence
  chemically synthesized
catccctgggtgggcttccc

SEQ ID NO: 17113 - DNA, 20 bp, Artificial Sequence
  chemically synthesized
ccctgggtgggcttccccag

SEQ ID NO: 17114 - DNA, 20 bp, Artificial Sequence
  chemically synthesized
cctgggtgggcttccccagt

SEQ ID NO: 17115 - DNA, 20 bp, Artificial Sequence
  chemically synthesized
gggtgggcttccccagtggg

SEQ ID NO: 17116 - DNA, 20 bp, Artificial Sequence
  chemically synthesized
gcttccccagtgggaagtcg

SEQ ID NO: 17117 - DNA, 20 bp, Artificial Sequence
  chemically synthesized
ggaagtcgaagaacttcctg

SEQ ID NO: 17118 - DNA, 20 bp, Artificial Sequence
  chemically synthesized
aagtcgaagaacttcctgtg

SEQ ID NO: 17119 - DNA, 20 bp, Artificial Sequence
  chemically synthesized
agtcgaagaacttcctgtgg

SEQ ID NO: 17120 - DNA, 20 bp, Artificial Sequence
  chemically synthesized
tcgaagaacttcctgtggag

SEQ ID NO: 17121 - DNA, 20 bp, Artificial Sequence
  chemically synthesized
ggaggagttactgctctttg

SEQ ID NO: 17122 - DNA, 20 bp, Artificial Sequence
  chemically synthesized
tactgctctttgaagttgct

SEQ ID NO: 17123 - DNA, 20 bp, Artificial Sequence
  chemically synthesized
actgctctttgaagttgctt

SEQ ID NO: 17124 - DNA, 20 bp, Artificial Sequence
  chemically synthesized
gctctttgaagttgcttggg

SEQ ID NO: 17125 - DNA, 20 bp, Artificial Sequence
  chemically synthesized
tgcttgggaagtgaccaata

SEQ ID NO: 17126 - DNA, 20 bp, Artificial Sequence
  chemically synthesized
gcttgggaagtgaccaataa

SEQ ID NO: 17127 - DNA, 20 bp, Artificial Sequence
  chemically synthesized
aaaggtttgtactgctcctg

SEQ ID NO: 17128 - DNA, 20 bp, Artificial Sequence
  chemically synthesized
aaggtttgtactgctcctga

SEQ ID NO: 17129 - DNA, 20 bp, Artificial Sequence
  chemically synthesized
gtttgtactgctcctgaagg

SEQ ID NO: 17130 - DNA, 20 bp, Artificial Sequence
  chemically synthesized
tactgctcctgaaggtggat

SEQ ID NO: 17131 - DNA, 20 bp, Artificial Sequence
  chemically synthesized
gtggatcagtacaccttcac

SEQ ID NO: 17132 - DNA, 20 bp, Artificial Sequence
  chemically synthesized
tggatcagtacaccttcact

SEQ ID NO: 17133 - DNA, 20 bp, Artificial Sequence
  chemically synthesized
tacaccttcactaggtgact

SEQ ID NO: 17134 - DNA, 20 bp, Artificial Sequence
  chemically synthesized
acaccttcactaggtgactg

SEQ ID NO: 17135 - DNA, 20 bp, Artificial Sequence
  chemically synthesized
cactaggtgactgaggaatg

SEQ ID NO: 17136 - DNA, 20 bp, Artificial Sequence
  chemically synthesized
ctaggtgactgaggaatgta

SEQ ID NO: 17137 - DNA, 20 bp, Artificial Sequence
  chemically synthesized
gtgactgaggaatgtagagt

SEQ ID NO: 17138 - DNA, 20 bp, Artificial Sequence
  chemically synthesized
gaatgtagagtaagatttca

SEQ ID NO: 17139 - DNA, 20 bp, Artificial Sequence
  chemically synthesized
agatttcacagataactctc

SEQ ID NO: 17140 - DNA, 20 bp, Artificial Sequence
  chemically synthesized
ctctagtgataaccaattgc

SEQ ID NO: 17141 - DNA, 20 bp, Artificial Sequence
  chemically synthesized
agtgataaccaattgctagt

SEQ ID NO: 17142 - DNA, 20 bp, Artificial Sequence
  chemically synthesized
ataaccaattgctagtgagt

SEQ ID NO: 17143 - DNA, 20 bp, Artificial Sequence
  chemically synthesized
taaccaattgctagtgagtg

SEQ ID NO: 17144 - DNA, 20 bp, Artificial Sequence
  chemically synthesized
caattgctagtgagtgagga

SEQ ID NO: 17145 - DNA, 20 bp, Artificial Sequence
  chemically synthesized
gagtgaggaaagcatttaaa

SEQ ID NO: 17146 - DNA, 20 bp, Artificial Sequence
  chemically synthesized
atttaaacggaatatatatt

SEQ ID NO: 17147 - DNA, 20 bp, Artificial Sequence
  chemically synthesized
tttaaacggaatatatattt

SEQ ID NO: 17148 - DNA, 20 bp, Artificial Sequence
  chemically synthesized
tttaaccttgtctattacaa

SEQ ID NO: 17149 - DNA, 20 bp, Artificial Sequence
  chemically synthesized
ttaaccttgtctattacaac

SEQ ID NO: 17150 - DNA, 20 bp, Artificial Sequence
  chemically synthesized
attacaacaggctatgaata

SEQ ID NO: 17151 - DNA, 20 bp, Artificial Sequence
  chemically synthesized
acagacttgtgtatgtgttg

SEQ ID NO: 17152 - DNA, 20 bp, Artificial Sequence
  chemically synthesized
agacttgtgtatgtgttgaa

SEQ ID NO: 17153 - DNA, 20 bp, Artificial Sequence
  chemically synthesized
gacttgtgtatgtgttgaag

SEQ ID NO: 17154 - DNA, 20 bp, Artificial Sequence
  chemically synthesized
acttgtgtatgtgttgaaga

SEQ ID NO: 17155 - DNA, 20 bp, Artificial Sequence
  chemically synthesized
ttgtgtatgtgttgaagagg

SEQ ID NO: 17156 - DNA, 20 bp, Artificial Sequence
  chemically synthesized
gtatgtgttgaagagggaga

SEQ ID NO: 17157 - DNA, 20 bp, Artificial Sequence
  chemically synthesized
agggagaaagttgaaaatat

SEQ ID NO: 17158 - DNA, 20 bp, Artificial Sequence
  chemically synthesized
gaaaatattagccattgcca

SEQ ID NO: 17159 - DNA, 20 bp, Artificial Sequence
  chemically synthesized
aaatccatattatgacaaca

SEQ ID NO: 17160 - DNA, 20 bp, Artificial Sequence
  chemically synthesized
tatgacaacatagaaataaa

SEQ ID NO: 17161 - DNA, 20 bp, Artificial Sequence
  chemically synthesized
ttttgttttaaaatttttct

SEQ ID NO: 17162 - DNA, 20 bp, Artificial Sequence
  chemically synthesized
taaaatttttctcagcaaaa

SEQ ID NO: 17163 - DNA, 20 bp, Artificial Sequence
  chemically synthesized
tataattaaacattttattt

SEQ ID NO: 17164 - DNA, 20 bp, Artificial Sequence
  chemically synthesized
ataattaaacattttatttt

SEQ ID NO: 17165 - DNA, 20 bp, Artificial Sequence
  chemically synthesized
attaaacattttattttagg

SEQ ID NO: 17166 - DNA, 20 bp, Artificial Sequence
  chemically synthesized
taggaagatgtatatgtgat

SEQ ID NO: 17167 - DNA, 20 bp, Artificial Sequence
  chemically synthesized
gatgtatatgtgattagaac

SEQ ID NO: 17168 - DNA, 20 bp, Artificial Sequence
  chemically synthesized
tatatgtgattagaaccagt

SEQ ID NO: 17169 - DNA, 20 bp, Artificial Sequence
  chemically synthesized
acctcaactctacattctgt

SEQ ID NO: 17170 - DNA, 20 bp, Artificial Sequence
  chemically synthesized
agtaattatatgaaatgctt

SEQ ID NO: 17171 - DNA, 20 bp, Artificial Sequence
  chemically synthesized
gaatgtttcatattcacaat

SEQ ID NO: 17172 - DNA, 20 bp, Artificial Sequence
  chemically synthesized
tttcatattcacaattagct

SEQ ID NO: 17173 - DNA, 20 bp, Artificial Sequence
  chemically synthesized
ttggaattaatgttttaatt

SEQ ID NO: 17174 - DNA, 20 bp, Artificial Sequence
  chemically synthesized
tggaattaatgttttaattc

SEQ ID NO: 17175 - DNA, 20 bp, Artificial Sequence
  chemically synthesized
gaattaatgttttaattcag

SEQ ID NO: 17176 - DNA, 20 bp, Artificial Sequence
  chemically synthesized
ttaattcaggagcttctcaa

SEQ ID NO: 17177 - DNA, 20 bp, Artificial Sequence
  chemically synthesized
taattcaggagcttctcaaa

SEQ ID NO: 17178 - DNA, 20 bp, Artificial Sequence
  chemically synthesized
gcaaaatactgtgctccttt

SEQ ID NO: 17179 - DNA, 20 bp, Artificial Sequence
  chemically synthesized
ctgtgctcctttcagaatga

SEQ ID NO: 17180 - DNA, 20 bp, Artificial Sequence
  chemically synthesized
tcttcaatgctatgcttatg

SEQ ID NO: 17181 - DNA, 20 bp, Artificial Sequence
  chemically synthesized
cttcaatgctatgcttatgt

SEQ ID NO: 17182 - DNA, 20 bp, Artificial Sequence
  chemically synthesized
tatgtaggaattataaaata

SEQ ID NO: 17183 - DNA, 20 bp, Artificial Sequence
  chemically synthesized
aaattgataaaacaatttgc

SEQ ID NO: 17184 - DNA, 20 bp, Artificial Sequence
  chemically synthesized
tgataaaacaatttgcgagt

SEQ ID NO: 17185 - DNA, 20 bp, Artificial Sequence
  chemically synthesized
gataaaacaatttgcgagtg

SEQ ID NO: 17186 - DNA, 20 bp, Artificial Sequence
  chemically synthesized
aggtataacctcatctgtgc

SEQ ID NO: 17187 - DNA, 20 bp, Artificial Sequence
  chemically synthesized
ggtataacctcatctgtgct

SEQ ID NO: 17188 - DNA, 20 bp, Artificial Sequence
  chemically synthesized
taacctcatctgtgctgggt

SEQ ID NO: 17189 - DNA, 20 bp, Artificial Sequence
  chemically synthesized
acctcatctgtgctgggtaa

SEQ ID NO: 17190 - DNA, 20 bp, Artificial Sequence
  chemically synthesized
tcatctgtgctgggtaagag

SEQ ID NO: 17191 - DNA, 20 bp, Artificial Sequence
  chemically synthesized
catctgtgctgggtaagaga

SEQ ID NO: 17192 - DNA, 20 bp, Artificial Sequence
  chemically synthesized
tgtgctgggtaagagaaggc

SEQ ID NO: 17193 - DNA, 20 bp, Artificial Sequence
  chemically synthesized
gtgctgggtaagagaaggca

SEQ ID NO: 17194 - DNA, 20 bp, Artificial Sequence
  chemically synthesized
ctgggtaagagaaggcaagg

SEQ ID NO: 17195 - DNA, 20 bp, Artificial Sequence
  chemically synthesized
gggtaagagaaggcaaggta

SEQ ID NO: 17196 - DNA, 20 bp, Artificial Sequence
  chemically synthesized
tgtaaatgattttgaaaata

SEQ ID NO: 17197 - DNA, 20 bp, Artificial Sequence
  chemically synthesized
aattataaaacaattccttg

SEQ ID NO: 17198 - DNA, 20 bp, Artificial Sequence
  chemically synthesized
attataaaacaattccttgt

SEQ ID NO: 17199 - DNA, 20 bp, Artificial Sequence
  chemically synthesized
ccttgtgggtttatactctc

SEQ ID NO: 17200 - DNA, 20 bp, Artificial Sequence
  chemically synthesized
gtttatactctctagtttaa

SEQ ID NO: 17201 - DNA, 20 bp, Artificial Sequence
  chemically synthesized
ctctctagtttaaaagtgtc

SEQ ID NO: 17202 - DNA, 20 bp, Artificial Sequence
  chemically synthesized
taaaagtgtcaagactattg

SEQ ID NO: 17203 - DNA, 20 bp, Artificial Sequence
  chemically synthesized
aaaagtgtcaagactattga

SEQ ID NO: 17204 - DNA, 20 bp, Artificial Sequence
  chemically synthesized
caagactattgaaggaacat

SEQ ID NO: 17205 - DNA, 20 bp, Artificial Sequence
  chemically synthesized
ctattgaaggaacattagca

SEQ ID NO: 17206 - DNA, 20 bp, Artificial Sequence
  chemically synthesized
aaggaacattagcaaagaaa

SEQ ID NO: 17207 - DNA, 20 bp, Artificial Sequence
  chemically synthesized
cattagcaaagaaaaagtca

SEQ ID NO: 17208 - DNA, 20 bp, Artificial Sequence
  chemically synthesized
aagaaaaagtcatggttttg

SEQ ID NO: 17209 - DNA, 20 bp, Artificial Sequence
  chemically synthesized
agaaaaagtcatggttttga

SEQ ID NO: 17210 - DNA, 20 bp, Artificial Sequence
  chemically synthesized
aagtcatggttttgaaggct

SEQ ID NO: 17211 - DNA, 20 bp, Artificial Sequence
  chemically synthesized
ttttgaaggctgagttcctc

SEQ ID NO: 17212 - DNA, 20 bp, Artificial Sequence
  chemically synthesized
ctgagttcctcaagatcttg

SEQ ID NO: 17213 - DNA, 20 bp, Artificial Sequence
  chemically synthesized
cctcaagatcttgaagaatc

SEQ ID NO: 17214 - DNA, 20 bp, Artificial Sequence
  chemically synthesized
gaatcaagccaactgattgc

SEQ ID NO: 17215 - DNA, 20 bp, Artificial Sequence
  chemically synthesized
aatcaagccaactgattgct

SEQ ID NO: 17216 - DNA, 20 bp, Artificial Sequence
  chemically synthesized
ccaactgattgctgggtaaa

SEQ ID NO: 17217 - DNA, 20 bp, Artificial Sequence
  chemically synthesized
actgattgctgggtaaatgg

SEQ ID NO: 17218 - DNA, 20 bp, Artificial Sequence
  chemically synthesized
ttactatttcatgtctatta

SEQ ID NO: 17219 - DNA, 20 bp, Artificial Sequence
  chemically synthesized
atgtctattacagtaatcta

SEQ ID NO: 17220 - DNA, 20 bp, Artificial Sequence
  chemically synthesized
tgtctattacagtaatctaa

SEQ ID NO: 17221 - DNA, 20 bp, Artificial Sequence
  chemically synthesized
aaaggatctgaaataataac

SEQ ID NO: 17222 - DNA, 20 bp, Artificial Sequence
  chemically synthesized
gatatattacttccttcttt

SEQ ID NO: 17223 - DNA, 20 bp, Artificial Sequence
  chemically synthesized
acttccttcttttggctaat

SEQ ID NO: 17224 - DNA, 20 bp, Artificial Sequence
  chemically synthesized
ttccttcttttggctaatca

SEQ ID NO: 17225 - DNA, 20 bp, Artificial Sequence
  chemically synthesized
ttcttttggctaatcagagc

SEQ ID NO: 17226 - DNA, 20 bp, Artificial Sequence
  chemically synthesized
aaaattaaatgcattatata

SEQ ID NO: 17227 - DNA, 20 bp, Artificial Sequence
  chemically synthesized
tggcatgcattctgaaaaat

SEQ ID NO: 17228 - DNA, 20 bp, Artificial Sequence
  chemically synthesized
caccttatactaactgttca

SEQ ID NO: 17229 - DNA, 20 bp, Artificial Sequence
  chemically synthesized
attcataaaatcaaaattaa

SEQ ID NO: 17230 - DNA, 20 bp, Artificial Sequence
  chemically synthesized
aaaagtcaattttgcctatg

SEQ ID NO: 17231 - DNA, 20 bp, Artificial Sequence
  chemically synthesized
agtcaattttgcctatgtag

SEQ ID NO: 17232 - DNA, 20 bp, Artificial Sequence
  chemically synthesized
caattttgcctatgtagaag

SEQ ID NO: 17233 - DNA, 20 bp, Artificial Sequence
  chemically synthesized
tttgcctatgtagaagtgga

SEQ ID NO: 17234 - DNA, 20 bp, Artificial Sequence
  chemically synthesized
gaagtggacagaatgcatat

SEQ ID NO: 17235 - DNA, 20 bp, Artificial Sequence
  chemically synthesized
agtggacagaatgcatataa

SEQ ID NO: 17236 - DNA, 20 bp, Artificial Sequence
  chemically synthesized
agaatgcatataagagaaca

SEQ ID NO: 17237 - DNA, 20 bp, Artificial Sequence
  chemically synthesized
gcatataagagaacaaagca

SEQ ID NO: 17238 - DNA, 20 bp, Artificial Sequence
  chemically synthesized
aagcacggtcttattctctg

SEQ ID NO: 17239 - DNA, 20 bp, Artificial Sequence
  chemically synthesized
cggtcttattctctgtagtt

SEQ ID NO: 17240 - DNA, 20 bp, Artificial Sequence
  chemically synthesized
cttattctctgtagtttagt

SEQ ID NO: 17241 - DNA, 20 bp, Artificial Sequence
  chemically synthesized
ttctctgtagtttagtgaga

SEQ ID NO: 17242 - DNA, 20 bp, Artificial Sequence
  chemically synthesized
tagtttagtgagaaagaatc

SEQ ID NO: 17243 - DNA, 20 bp, Artificial Sequence
  chemically synthesized
agtttagtgagaaagaatct

SEQ ID NO: 17244 - DNA, 20 bp, Artificial Sequence
  chemically synthesized
tttagtgagaaagaatctag

SEQ ID NO: 17245 - DNA, 20 bp, Artificial Sequence
  chemically synthesized
ttagtgagaaagaatctagg

SEQ ID NO: 17246 - DNA, 20 bp, Artificial Sequence
  chemically synthesized
tgagaaagaatctaggagga

SEQ ID NO: 17247 - DNA, 20 bp, Artificial Sequence
  chemically synthesized
ggaggacagaaaccttatta

SEQ ID NO: 17248 - DNA, 20 bp, Artificial Sequence
  chemically synthesized
aggacagaaaccttattaca

SEQ ID NO: 17249 - DNA, 20 bp, Artificial Sequence
  chemically synthesized
acagaaaccttattacagag

SEQ ID NO: 17250 - DNA, 20 bp, Artificial Sequence
  chemically synthesized
aaccttattacagagaagtg

SEQ ID NO: 17251 - DNA, 20 bp, Artificial Sequence
  chemically synthesized
ttattttgtattcttttcct

SEQ ID NO: 17252 - DNA, 20 bp, Artificial Sequence
  chemically synthesized
attttgtattcttttcctca

SEQ ID NO: 17253 - DNA, 20 bp, Artificial Sequence
  chemically synthesized
agagatctttatcctgaaat

SEQ ID NO: 17254 - DNA, 20 bp, Artificial Sequence
  chemically synthesized
tgtttttaatgtcctttttc

SEQ ID NO: 17255 - DNA, 20 bp, Artificial Sequence
  chemically synthesized
tttctagtcacaaatttttc

SEQ ID NO: 17256 - DNA, 20 bp, Artificial Sequence
  chemically synthesized
agtcacaaatttttccagtc

SEQ ID NO: 17257 - DNA, 20 bp, Artificial Sequence
  chemically synthesized
ccagtttttaaatatgccca

SEQ ID NO: 17258 - DNA, 20 bp, Artificial Sequence
  chemically synthesized
ttaaatatgcccaaagttcc

SEQ ID NO: 17259 - DNA, 20 bp, Artificial Sequence
  chemically synthesized
taaatatgcccaaagttcct

SEQ ID NO: 17260 - DNA, 20 bp, Artificial Sequence
  chemically synthesized
atgcccaaagttcctgggaa

SEQ ID NO: 17261 - DNA, 20 bp, Artificial Sequence
  chemically synthesized
tctctatcacatgtgaatcc

SEQ ID NO: 17262 - DNA, 20 bp, Artificial Sequence
  chemically synthesized
tctatcacatgtgaatcccg

SEQ ID NO: 17263 - DNA, 20 bp, Artificial Sequence
  chemically synthesized
cggagtatgccttgaaataa

SEQ ID NO: 17264 - DNA, 20 bp, Artificial Sequence
  chemically synthesized
cttgaaataaaagttttctc

SEQ ID NO: 17265 - DNA, 20 bp, Artificial Sequence
  chemically synthesized
tgaaataaaagttttctcta

SEQ ID NO: 17266 - DNA, 20 bp, Artificial Sequence
  chemically synthesized
aaataaaagttttctctaga

SEQ ID NO: 17267 - DNA, 20 bp, Artificial Sequence
  chemically synthesized
taaaagttttctctagagag

SEQ ID NO: 17268 - DNA, 20 bp, Artificial Sequence
  chemically synthesized
aaaagttttctctagagagt

SEQ ID NO: 17269 - DNA, 20 bp, Artificial Sequence
  chemically synthesized
agttttctctagagagtggg

SEQ ID NO: 17270 - DNA, 20 bp, Artificial Sequence
  chemically synthesized
gttttctctagagagtgggc

SEQ ID NO: 17271 - DNA, 20 bp, Artificial Sequence
  chemically synthesized
tttctctagagagtgggcag

SEQ ID NO: 17272 - DNA, 20 bp, Artificial Sequence
  chemically synthesized
tagagagtgggcaggagctc

SEQ ID NO: 17273 - DNA, 20 bp, Artificial Sequence
  chemically synthesized
agagagtgggcaggagctca

SEQ ID NO: 17274 - DNA, 20 bp, Artificial Sequence
  chemically synthesized
tgggcaggagctcaaggaca

SEQ ID NO: 17275 - DNA, 20 bp, Artificial Sequence
  chemically synthesized
agctcaaggacatagcttat

SEQ ID NO: 17276 - DNA, 20 bp, Artificial Sequence
  chemically synthesized
tcaaggacatagcttattgg

SEQ ID NO: 17277 - DNA, 20 bp, Artificial Sequence
  chemically synthesized
agcttattggtggataaaac

SEQ ID NO: 17278 - DNA, 20 bp, Artificial Sequence
  chemically synthesized
ttattggtggataaaactgg

SEQ ID NO: 17279 - DNA, 20 bp, Artificial Sequence
  chemically synthesized
tattggtggataaaactgga

SEQ ID NO: 17280 - DNA, 20 bp, Artificial Sequence
  chemically synthesized
attggtggataaaactggaa

SEQ ID NO: 17281 - DNA, 20 bp, Artificial Sequence
  chemically synthesized
taaaactggaagggacttgt

SEQ ID NO: 17282 - DNA, 20 bp, Artificial Sequence
  chemically synthesized
tggaagggacttgttagcac

SEQ ID NO: 17283 - DNA, 20 bp, Artificial Sequence
  chemically synthesized
ggaagggacttgttagcact

SEQ ID NO: 17284 - DNA, 20 bp, Artificial Sequence
  chemically synthesized
gacttgttagcactgggaat

SEQ ID NO: 17285 - DNA, 20 bp, Artificial Sequence
  chemically synthesized
gttagcactgggaatcagtc

SEQ ID NO: 17286 - DNA, 20 bp, Artificial Sequence
  chemically synthesized
agcactgggaatcagtccag

SEQ ID NO: 17287 - DNA, 20 bp, Artificial Sequence
  chemically synthesized
agtccagaagatctctgcac

SEQ ID NO: 17288 - DNA, 20 bp, Artificial Sequence
  chemically synthesized
ctgcacaagttcctgcacct

SEQ ID NO: 17289 - DNA, 20 bp, Artificial Sequence
  chemically synthesized
cacaagttcctgcacctgag

SEQ ID NO: 17290 - DNA, 20 bp, Artificial Sequence
  chemically synthesized
caagttcctgcacctgagca

SEQ ID NO: 17291 - DNA, 20 bp, Artificial Sequence
  chemically synthesized
catcatttaacaaacattaa

SEQ ID NO: 17292 - DNA, 20 bp, Artificial Sequence
  chemically synthesized
tcatttaacaaacattaatg

SEQ ID NO: 17293 - DNA, 20 bp, Artificial Sequence
  chemically synthesized
attaatggagcactgttacc

SEQ ID NO: 17294 - DNA, 20 bp, Artificial Sequence
  chemically synthesized
ttaatggagcactgttacct

SEQ ID NO: 17295 - DNA, 20 bp, Artificial Sequence
  chemically synthesized
gagcactgttacctgggcac

SEQ ID NO: 17296 - DNA, 20 bp, Artificial Sequence
  chemically synthesized
agcactgttacctgggcact

SEQ ID NO: 17297 - DNA, 20 bp, Artificial Sequence
  chemically synthesized
cctgggcactgggaacacgc

SEQ ID NO: 17298 - DNA, 20 bp, Artificial Sequence
  chemically synthesized
gggaacacgccagtgaaact

SEQ ID NO: 17299 - DNA, 20 bp, Artificial Sequence
  chemically synthesized
agtgaaactaagttatttta

SEQ ID NO: 17300 - DNA, 20 bp, Artificial Sequence
  chemically synthesized
tattttatggatcttataat

SEQ ID NO: 17301 - DNA, 20 bp, Artificial Sequence
  chemically synthesized
tttatggatcttataatcag

SEQ ID NO: 17302 - DNA, 20 bp, Artificial Sequence
  chemically synthesized
agtagcatgtgtgttgatct

SEQ ID NO: 17303 - DNA, 20 bp, Artificial Sequence
  chemically synthesized
gtagcatgtgtgttgatctc

SEQ ID NO: 17304 - DNA, 20 bp, Artificial Sequence
  chemically synthesized
tagcatgtgtgttgatctca

SEQ ID NO: 17305 - DNA, 20 bp, Artificial Sequence
  chemically synthesized
tgtgtgttgatctcagggtc

SEQ ID NO: 17306 - DNA, 20 bp, Artificial Sequence
  chemically synthesized
gttgatctcagggtctagaa

SEQ ID NO: 17307 - DNA, 20 bp, Artificial Sequence
  chemically synthesized
tcagggtctagaacagtgcc

SEQ ID NO: 17308 - DNA, 20 bp, Artificial Sequence
  chemically synthesized
ctagaacagtgcctggtaca

SEQ ID NO: 17309 - DNA, 20 bp, Artificial Sequence
  chemically synthesized
ggtacatagaaaatgctcaa

SEQ ID NO: 17310 - DNA, 20 bp, Artificial Sequence
  chemically synthesized
aaatttgtttttcaacccct

SEQ ID NO: 17311 - DNA, 20 bp, Artificial Sequence
  chemically synthesized
ttttctatcatttccctttc

SEQ ID NO: 17312 - DNA, 20 bp, Artificial Sequence
  chemically synthesized
tttctatcatttccctttca

SEQ ID NO: 17313 - DNA, 20 bp, Artificial Sequence
  chemically synthesized
ttctatcatttccctttcaa

SEQ ID NO: 17314 - DNA, 20 bp, Artificial Sequence
  chemically synthesized
tctatcatttccctttcaag

SEQ ID NO: 17315 - DNA, 20 bp, Artificial Sequence
  chemically synthesized
atcatttccctttcaagggg

SEQ ID NO: 17316 - DNA, 20 bp, Artificial Sequence
  chemically synthesized
tcatttccctttcaagggga

SEQ ID NO: 17317 - DNA, 20 bp, Artificial Sequence
  chemically synthesized
catttccctttcaaggggaa

SEQ ID NO: 17318 - DNA, 20 bp, Artificial Sequence
  chemically synthesized
ttccctttcaaggggaaggg

SEQ ID NO: 17319 - DNA, 20 bp, Artificial Sequence
  chemically synthesized
ggggaagggaagtgtttttg

SEQ ID NO: 17320 - DNA, 20 bp, Artificial Sequence
  chemically synthesized
ggaagggaagtgtttttgtg

SEQ ID NO: 17321 - DNA, 20 bp, Artificial Sequence
  chemically synthesized
aagggaagtgtttttgtgga

SEQ ID NO: 17322 - DNA, 20 bp, Artificial Sequence
  chemically synthesized
agggaagtgtttttgtggag

SEQ ID NO: 17323 - DNA, 20 bp, Artificial Sequence
  chemically synthesized
ccccacaatgtgatttacac

SEQ ID NO: 17324 - DNA, 20 bp, Artificial Sequence
  chemically synthesized
tctttattttaatattatca

SEQ ID NO: 17325 - DNA, 20 bp, Artificial Sequence
  chemically synthesized
attttaatattatcatagcc

SEQ ID NO: 17326 - DNA, 20 bp, Artificial Sequence
  chemically synthesized
aatattatcatagcctggta

SEQ ID NO: 17327 - DNA, 20 bp, Artificial Sequence
  chemically synthesized
atcatagcctggtatggttt

SEQ ID NO: 17328 - DNA, 20 bp, Artificial Sequence
  chemically synthesized
tatggtttgagattttcata

SEQ ID NO: 17329 - DNA, 20 bp, Artificial Sequence
  chemically synthesized
gtttgagattttcatataga

SEQ ID NO: 17330 - DNA, 20 bp, Artificial Sequence
  chemically synthesized
ctaataatacattgccacta

SEQ ID NO: 17331 - DNA, 20 bp, Artificial Sequence
  chemically synthesized
ttttacttccctgcatttca

SEQ ID NO: 17332 - DNA, 20 bp, Artificial Sequence
  chemically synthesized
tacttccctgcatttcatag

SEQ ID NO: 17333 - DNA, 20 bp, Artificial Sequence
  chemically synthesized
gcatttcatagtagtgatat

SEQ ID NO: 17334 - DNA, 20 bp, Artificial Sequence
  chemically synthesized
catttcatagtagtgatatg

SEQ ID NO: 17335 - DNA, 20 bp, Artificial Sequence
  chemically synthesized
agtagtgatatgaggtatct

SEQ ID NO: 17336 - DNA, 20 bp, Artificial Sequence
  chemically synthesized
tagtgatatgaggtatctta

SEQ ID NO: 17337 - DNA, 20 bp, Artificial Sequence
  chemically synthesized
gatcatgaatcccactcctc

SEQ ID NO: 17338 - DNA, 20 bp, Artificial Sequence
  chemically synthesized
aatcccactcctccagttca

SEQ ID NO: 17339 - DNA, 20 bp, Artificial Sequence
  chemically synthesized
tcccactcctccagttcata

SEQ ID NO: 17340 - DNA, 20 bp, Artificial Sequence
  chemically synthesized
tcatagagcaaattgattcg

SEQ ID NO: 17341 - DNA, 20 bp, Artificial Sequence
  chemically synthesized
atagagcaaattgattcgta

SEQ ID NO: 17342 - DNA, 20 bp, Artificial Sequence
  chemically synthesized
tagagcaaattgattcgtag

SEQ ID NO: 17343 - DNA, 20 bp, Artificial Sequence
  chemically synthesized
cgtagaggtatttaatgatc

SEQ ID NO: 17344 - DNA, 20 bp, Artificial Sequence
  chemically synthesized
gtatttaatgatcaagcaaa

SEQ ID NO: 17345 - DNA, 20 bp, Artificial Sequence
  chemically synthesized
tttaatgatcaagcaaatgg

SEQ ID NO: 17346 - DNA, 20 bp, Artificial Sequence
  chemically synthesized
taatgatcaagcaaatggca

SEQ ID NO: 17347 - DNA, 20 bp, Artificial Sequence
  chemically synthesized
gatcaagcaaatggcagagt

SEQ ID NO: 17348 - DNA, 20 bp, Artificial Sequence
  chemically synthesized
atcaagcaaatggcagagtt

SEQ ID NO: 17349 - DNA, 20 bp, Artificial Sequence
  chemically synthesized
gcaaatggcagagttaggac

SEQ ID NO: 17350 - DNA, 20 bp, Artificial Sequence
  chemically synthesized
caaatggcagagttaggacc

SEQ ID NO: 17351 - DNA, 20 bp, Artificial Sequence
  chemically synthesized
gcagagttaggaccaggatt

SEQ ID NO: 17352 - DNA, 20 bp, Artificial Sequence
  chemically synthesized
cagagttaggaccaggattt

SEQ ID NO: 17353 - DNA, 20 bp, Artificial Sequence
  chemically synthesized
ccaggatttaggtcttttcc

SEQ ID NO: 17354 - DNA, 20 bp, Artificial Sequence
  chemically synthesized
caggatttaggtcttttcca

SEQ ID NO: 17355 - DNA, 20 bp, Artificial Sequence
  chemically synthesized
tcacttttttactattatgt

SEQ ID NO: 17356 - DNA, 20 bp, Artificial Sequence
  chemically synthesized
agaattaaatattaaaacct

SEQ ID NO: 17357 - DNA, 20 bp, Artificial Sequence
  chemically synthesized
tattaaaacctcagttttca

SEQ ID NO: 17358 - DNA, 20 bp, Artificial Sequence
  chemically synthesized
attaaaacctcagttttcaa

SEQ ID NO: 17359 - DNA, 20 bp, Artificial Sequence
  chemically synthesized
ttttcaaaggaaatgtccta

SEQ ID NO: 17360 - DNA, 20 bp, Artificial Sequence
  chemically synthesized
aggaaatgtcctatagatga

SEQ ID NO: 17361 - DNA, 20 bp, Artificial Sequence
  chemically synthesized
gtcctatagatgaaagaaca

SEQ ID NO: 17362 - DNA, 20 bp, Artificial Sequence
  chemically synthesized
atgaaagaacacagtacttg

SEQ ID NO: 17363 - DNA, 20 bp, Artificial Sequence
  chemically synthesized
gaacacagtacttgcagtca

SEQ ID NO: 17364 - DNA, 20 bp, Artificial Sequence
  chemically synthesized
aacacagtacttgcagtcaa

SEQ ID NO: 17365 - DNA, 20 bp, Artificial Sequence
  chemically synthesized
gtacttgcagtcaaaggtct

SEQ ID NO: 17366 - DNA, 20 bp, Artificial Sequence
  chemically synthesized
atttctgaaactttctgaaa

SEQ ID NO: 17367 - DNA, 20 bp, Artificial Sequence
  chemically synthesized
gaaccccttaaactgaataa

SEQ ID NO: 17368 - DNA, 20 bp, Artificial Sequence
  chemically synthesized
aaaatgaatgttatactctc

SEQ ID NO: 17369 - DNA, 20 bp, Artificial Sequence
  chemically synthesized
agttatcttaccatgttttc

SEQ ID NO: 17370 - DNA, 20 bp, Artificial Sequence
  chemically synthesized
taccatgttttctggcaaac

SEQ ID NO: 17371 - DNA, 20 bp, Artificial Sequence
  chemically synthesized
accatgttttctggcaaaca

SEQ ID NO: 17372 - DNA, 20 bp, Artificial Sequence
  chemically synthesized
aaggaaatgtattcacatcc

SEQ ID NO: 17373 - DNA, 20 bp, Artificial Sequence
  chemically synthesized
attcacatccaagaaaacaa

SEQ ID NO: 17374 - DNA, 20 bp, Artificial Sequence
  chemically synthesized
ttcacatccaagaaaacaaa

SEQ ID NO: 17375 - DNA, 20 bp, Artificial Sequence
  chemically synthesized
caagaaaacaaaaggtttct

SEQ ID NO: 17376 - DNA, 20 bp, Artificial Sequence
  chemically synthesized
aagaaaacaaaaggtttctt

SEQ ID NO: 17377 - DNA, 20 bp, Artificial Sequence
  chemically synthesized
gaaaacaaaaggtttcttag

SEQ ID NO: 17378 - DNA, 20 bp, Artificial Sequence
  chemically synthesized
aacaaaaggtttcttaggag

SEQ ID NO: 17379 - DNA, 20 bp, Artificial Sequence
  chemically synthesized
ggagaagaatcccttgctgc

SEQ ID NO: 17380 - DNA, 20 bp, Artificial Sequence
  chemically synthesized
agaattttgcccatgaacaa

SEQ ID NO: 17381 - DNA, 20 bp, Artificial Sequence
  chemically synthesized
tggaaacgtgaaaaacataa

SEQ ID NO: 17382 - DNA, 20 bp, Artificial Sequence
  chemically synthesized
acgtgaaaaacataacagat

SEQ ID NO: 17383 - DNA, 20 bp, Artificial Sequence
  chemically synthesized
gtgaaaaacataacagatga

SEQ ID NO: 17384 - DNA, 20 bp, Artificial Sequence
  chemically synthesized
gaaaaacataacagatgaga

SEQ ID NO: 17385 - DNA, 20 bp, Artificial Sequence
  chemically synthesized
cataacagatgagagagtca

SEQ ID NO: 17386 - DNA, 20 bp, Artificial Sequence
  chemically synthesized
acagatgagagagtcacagt

SEQ ID NO: 17387 - DNA, 20 bp, Artificial Sequence
  chemically synthesized
gagagagtcacagttagttt

SEQ ID NO: 17388 - DNA, 20 bp, Artificial Sequence
  chemically synthesized
agagagtcacagttagtttt

SEQ ID NO: 17389 - DNA, 20 bp, Artificial Sequence
  chemically synthesized
tagttttgggtactaattct

SEQ ID NO: 17390 - DNA, 20 bp, Artificial Sequence
  chemically synthesized
cattaatccattttattatt

SEQ ID NO: 17391 - DNA, 20 bp, Artificial Sequence
  chemically synthesized
aatccattttattattcagt

SEQ ID NO: 17392 - DNA, 20 bp, Artificial Sequence
  chemically synthesized
atccattttattattcagta

SEQ ID NO: 17393 - DNA, 20 bp, Artificial Sequence
  chemically synthesized
ttattcagtaaggattcatc

SEQ ID NO: 17394 - DNA, 20 bp, Artificial Sequence
  chemically synthesized
aggattcatcaagtgtctat

SEQ ID NO: 17395 - DNA, 20 bp, Artificial Sequence
  chemically synthesized
ggattcatcaagtgtctatt

SEQ ID NO: 17396 - DNA, 20 bp, Artificial Sequence
  chemically synthesized
atcaagtgtctattaggtat

SEQ ID NO: 17397 - DNA, 20 bp, Artificial Sequence
  chemically synthesized
tcaagtgtctattaggtatc

SEQ ID NO: 17398 - DNA, 20 bp, Artificial Sequence
  chemically synthesized
tctattaggtatcaggcact

SEQ ID NO: 17399 - DNA, 20 bp, Artificial Sequence
  chemically synthesized
tattaggtatcaggcactga

SEQ ID NO: 17400 - DNA, 20 bp, Artificial Sequence
  chemically synthesized
attaggtatcaggcactgag

SEQ ID NO: 17401 - DNA, 20 bp, Artificial Sequence
  chemically synthesized
ggtatcaggcactgagaggc

SEQ ID NO: 17402 - DNA, 20 bp, Artificial Sequence
  chemically synthesized
gtatcaggcactgagaggcg

SEQ ID NO: 17403 - DNA, 20 bp, Artificial Sequence
  chemically synthesized
tatcaggcactgagaggcga

SEQ ID NO: 17404 - DNA, 20 bp, Artificial Sequence
  chemically synthesized
tcaggcactgagaggcgagg

SEQ ID NO: 17405 - DNA, 20 bp, Artificial Sequence
  chemically synthesized
gcactgagaggcgagggaga

SEQ ID NO: 17406 - DNA, 20 bp, Artificial Sequence
  chemically synthesized
actgagaggcgagggagata

SEQ ID NO: 17407 - DNA, 20 bp, Artificial Sequence
  chemically synthesized
gaggcgagggagatagagtt

SEQ ID NO: 17408 - DNA, 20 bp, Artificial Sequence
  chemically synthesized
gggagatagagttaagaata

SEQ ID NO: 17409 - DNA, 20 bp, Artificial Sequence
  chemically synthesized
agaactgattcttaatcttc

SEQ ID NO: 17410 - DNA, 20 bp, Artificial Sequence
  chemically synthesized
ttcaagaattgacaaatttg

SEQ ID NO: 17411 - DNA, 20 bp, Artificial Sequence
  chemically synthesized
aagaattgacaaatttgtag

SEQ ID NO: 17412 - DNA, 20 bp, Artificial Sequence
  chemically synthesized
agaattgacaaatttgtaga

SEQ ID NO: 17413 - DNA, 20 bp, Artificial Sequence
  chemically synthesized
attgacaaatttgtagaagg

SEQ ID NO: 17414 - DNA, 20 bp, Artificial Sequence
  chemically synthesized
tagacattgaacatacaata

SEQ ID NO: 17415 - DNA, 20 bp, Artificial Sequence
  chemically synthesized
acaatacagtcaaatgtgat

SEQ ID NO: 17416 - DNA, 20 bp, Artificial Sequence
  chemically synthesized
cagtcaaatgtgatgagtgt

SEQ ID NO: 17417 - DNA, 20 bp, Artificial Sequence
  chemically synthesized
aatgtgatgagtgtgagact

SEQ ID NO: 17418 - DNA, 20 bp, Artificial Sequence
  chemically synthesized
atgtgatgagtgtgagacta

SEQ ID NO: 17419 - DNA, 20 bp, Artificial Sequence
  chemically synthesized
tgtgatgagtgtgagactaa

SEQ ID NO: 17420 - DNA, 20 bp, Artificial Sequence
  chemically synthesized
gagtgtgagactaagggaac

SEQ ID NO: 17421 - DNA, 20 bp, Artificial Sequence
  chemically synthesized
agtgtgagactaagggaacc

SEQ ID NO: 17422 - DNA, 20 bp, Artificial Sequence
  chemically synthesized
ctaagggaaccaggtgtcct

SEQ ID NO: 17423 - DNA, 20 bp, Artificial Sequence
  chemically synthesized
ccaggtgtcctaagactata

SEQ ID NO: 17424 - DNA, 20 bp, Artificial Sequence
  chemically synthesized
taagactatacagtgtaccg

SEQ ID NO: 17425 - DNA, 20 bp, Artificial Sequence
  chemically synthesized
ctatacagtgtaccgtggaa

SEQ ID NO: 17426 - DNA, 20 bp, Artificial Sequence
  chemically synthesized
tatacagtgtaccgtggaat

SEQ ID NO: 17427 - DNA, 20 bp, Artificial Sequence
  chemically synthesized
atacagtgtaccgtggaatg

SEQ ID NO: 17428 - DNA, 20 bp, Artificial Sequence
  chemically synthesized
acagtgtaccgtggaatggg

SEQ ID NO: 17429 - DNA, 20 bp, Artificial Sequence
  chemically synthesized
gtgtaccgtggaatggggag

SEQ ID NO: 17430 - DNA, 20 bp, Artificial Sequence
  chemically synthesized
atggggagtggtttctaacc

SEQ ID NO: 17431 - DNA, 20 bp, Artificial Sequence
  chemically synthesized
tggtttctaacctagttacc

SEQ ID NO: 17432 - DNA, 20 bp, Artificial Sequence
  chemically synthesized
gtttctaacctagttaccta

SEQ ID NO: 17433 - DNA, 20 bp, Artificial Sequence
  chemically synthesized
tttctaacctagttacctag

SEQ ID NO: 17434 - DNA, 20 bp, Artificial Sequence
  chemically synthesized
aacctagttacctagaggtt

SEQ ID NO: 17435 - DNA, 20 bp, Artificial Sequence
  chemically synthesized
acctagttacctagaggttt

SEQ ID NO: 17436 - DNA, 20 bp, Artificial Sequence
  chemically synthesized
ggaaaaacctctctaatgat

SEQ ID NO: 17437 - DNA, 20 bp, Artificial Sequence
  chemically synthesized
tctctaatgatgagatgttt

SEQ ID NO: 17438 - DNA, 20 bp, Artificial Sequence
  chemically synthesized
gatgtttgagctgacacttg

SEQ ID NO: 17439 - DNA, 20 bp, Artificial Sequence
  chemically synthesized
atgtttgagctgacacttga

SEQ ID NO: 17440 - DNA, 20 bp, Artificial Sequence
  chemically synthesized
gctgacacttgaaggataaa

SEQ ID NO: 17441 - DNA, 20 bp, Artificial Sequence
  chemically synthesized
acttgaaggataaatagcta

SEQ ID NO: 17442 - DNA, 20 bp, Artificial Sequence
  chemically synthesized
cttgaaggataaatagctaa

SEQ ID NO: 17443 - DNA, 20 bp, Artificial Sequence
  chemically synthesized
ttgaaggataaatagctaaa

SEQ ID NO: 17444 - DNA, 20 bp, Artificial Sequence
  chemically synthesized
tgaaggataaatagctaaag

SEQ ID NO: 17445 - DNA, 20 bp, Artificial Sequence
  chemically synthesized
aaggataaatagctaaaggg

SEQ ID NO: 17446 - DNA, 20 bp, Artificial Sequence
  chemically synthesized
ataaatagctaaaggggaga

SEQ ID NO: 17447 - DNA, 20 bp, Artificial Sequence
  chemically synthesized
ggggagaaagcgttctatgt

SEQ ID NO: 17448 - DNA, 20 bp, Artificial Sequence
  chemically synthesized
ggagaaagcgttctatgtga

SEQ ID NO: 17449 - DNA, 20 bp, Artificial Sequence
  chemically synthesized
gtgagagaactatatatgcc

SEQ ID NO: 17450 - DNA, 20 bp, Artificial Sequence
  chemically synthesized
gaactatatatgccaagatg

SEQ ID NO: 17451 - DNA, 20 bp, Artificial Sequence
  chemically synthesized
ctatatatgccaagatgcag

SEQ ID NO: 17452 - DNA, 20 bp, Artificial Sequence
  chemically synthesized
gcagaagtgttctctgttcg

SEQ ID NO: 17453 - DNA, 20 bp, Artificial Sequence
  chemically synthesized
tgttctctgttcgaagatct

SEQ ID NO: 17454 - DNA, 20 bp, Artificial Sequence
  chemically synthesized
tctctgttcgaagatctgag

SEQ ID NO: 17455 - DNA, 20 bp, Artificial Sequence
  chemically synthesized
ctctgttcgaagatctgagc

SEQ ID NO: 17456 - DNA, 20 bp, Artificial Sequence
  chemically synthesized
tctgttcgaagatctgagcg

SEQ ID NO: 17457 - DNA, 20 bp, Artificial Sequence
  chemically synthesized
tcgaagatctgagcggggct

SEQ ID NO: 17458 - DNA, 20 bp, Artificial Sequence
  chemically synthesized
gaagatctgagcggggctca

SEQ ID NO: 17459 - DNA, 20 bp, Artificial Sequence
  chemically synthesized
agatctgagcggggctcaga

SEQ ID NO: 17460 - DNA, 20 bp, Artificial Sequence
  chemically synthesized
gatctgagcggggctcagag

SEQ ID NO: 17461 - DNA, 20 bp, Artificial Sequence
  chemically synthesized
atctgagcggggctcagaga

SEQ ID NO: 17462 - DNA, 20 bp, Artificial Sequence
  chemically synthesized
agcggggctcagagagggaa

SEQ ID NO: 17463 - DNA, 20 bp, Artificial Sequence
  chemically synthesized
gcggggctcagagagggaaa

SEQ ID NO: 17464 - DNA, 20 bp, Artificial Sequence
  chemically synthesized
ggggctcagagagggaaaag

SEQ ID NO: 17465 - DNA, 20 bp, Artificial Sequence
  chemically synthesized
ggctcagagagggaaaagga

SEQ ID NO: 17466 - DNA, 20 bp, Artificial Sequence
  chemically synthesized
gctcagagagggaaaaggag

SEQ ID NO: 17467 - DNA, 20 bp, Artificial Sequence
  chemically synthesized
tcagagagggaaaaggagag

SEQ ID NO: 17468 - DNA, 20 bp, Artificial Sequence
  chemically synthesized
agggaaaaggagaggagtat

SEQ ID NO: 17469 - DNA, 20 bp, Artificial Sequence
  chemically synthesized
ggaaaaggagaggagtatga

SEQ ID NO: 17470 - DNA, 20 bp, Artificial Sequence
  chemically synthesized
aaaggagaggagtatgagag

SEQ ID NO: 17471 - DNA, 20 bp, Artificial Sequence
  chemically synthesized
gagaggagtatgagagaaga

SEQ ID NO: 17472 - DNA, 20 bp, Artificial Sequence
  chemically synthesized
agaggagtatgagagaagat

SEQ ID NO: 17473 - DNA, 20 bp, Artificial Sequence
  chemically synthesized
aggagtatgagagaagatgg

SEQ ID NO: 17474 - DNA, 20 bp, Artificial Sequence
  chemically synthesized
gagtatgagagaagatggga

SEQ ID NO: 17475 - DNA, 20 bp, Artificial Sequence
  chemically synthesized
gagaagatgggagagacctg

SEQ ID NO: 17476 - DNA, 20 bp, Artificial Sequence
  chemically synthesized
agaagatgggagagacctgc

SEQ ID NO: 17477 - DNA, 20 bp, Artificial Sequence
  chemically synthesized
gaagatgggagagacctgca

SEQ ID NO: 17478 - DNA, 20 bp, Artificial Sequence
  chemically synthesized
tgggagagacctgcagggac

SEQ ID NO: 17479 - DNA, 20 bp, Artificial Sequence
  chemically synthesized
cctgcagggactagattgtg

SEQ ID NO: 17480 - DNA, 20 bp, Artificial Sequence
  chemically synthesized
agggactagattgtgaagct

SEQ ID NO: 17481 - DNA, 20 bp, Artificial Sequence
  chemically synthesized
gggactagattgtgaagctc

SEQ ID NO: 17482 - DNA, 20 bp, Artificial Sequence
  chemically synthesized
ggactagattgtgaagctca

SEQ ID NO: 17483 - DNA, 20 bp, Artificial Sequence
  chemically synthesized
gactagattgtgaagctcag

SEQ ID NO: 17484 - DNA, 20 bp, Artificial Sequence
  chemically synthesized
actagattgtgaagctcagg

SEQ ID NO: 17485 - DNA, 20 bp, Artificial Sequence
  chemically synthesized
tagattgtgaagctcagggg

SEQ ID NO: 17486 - DNA, 20 bp, Artificial Sequence
  chemically synthesized
tgaagctcagggggagttaa

SEQ ID NO: 17487 - DNA, 20 bp, Artificial Sequence
  chemically synthesized
cagggggagttaatagcctt

SEQ ID NO: 17488 - DNA, 20 bp, Artificial Sequence
  chemically synthesized
agggggagttaatagcctta

SEQ ID NO: 17489 - DNA, 20 bp, Artificial Sequence
  chemically synthesized
ggggagttaatagccttaag

SEQ ID NO: 17490 - DNA, 20 bp, Artificial Sequence
  chemically synthesized
gccttaaggagttttgtctc

SEQ ID NO: 17491 - DNA, 20 bp, Artificial Sequence
  chemically synthesized
ccttaaggagttttgtctcc

SEQ ID NO: 17492 - DNA, 20 bp, Artificial Sequence
  chemically synthesized
cttaaggagttttgtctcca

SEQ ID NO: 17493 - DNA, 20 bp, Artificial Sequence
  chemically synthesized
ccagggtatgaacaatgaat

SEQ ID NO: 17494 - DNA, 20 bp, Artificial Sequence
  chemically synthesized
cagggtatgaacaatgaatg

SEQ ID NO: 17495 - DNA, 20 bp, Artificial Sequence
  chemically synthesized
gggtatgaacaatgaatgag

SEQ ID NO: 17496 - DNA, 20 bp, Artificial Sequence
  chemically synthesized
agtcactgaaattctatcca

SEQ ID NO: 17497 - DNA, 20 bp, Artificial Sequence
  chemically synthesized
cactgaaattctatccacag

SEQ ID NO: 17498 - DNA, 20 bp, Artificial Sequence
  chemically synthesized
tgaaattctatccacagtag

SEQ ID NO: 17499 - DNA, 20 bp, Artificial Sequence
  chemically synthesized
gaaattctatccacagtagt

SEQ ID NO: 17500 - DNA, 20 bp, Artificial Sequence
  chemically synthesized
attctatccacagtagtggg

SEQ ID NO: 17501 - DNA, 20 bp, Artificial Sequence
  chemically synthesized
ccacagtagtgggaagtact

SEQ ID NO: 17502 - DNA, 20 bp, Artificial Sequence
  chemically synthesized
cagtagtgggaagtactaag

SEQ ID NO: 17503 - DNA, 20 bp, Artificial Sequence
  chemically synthesized
agtgggaagtactaagtagt

SEQ ID NO: 17504 - DNA, 20 bp, Artificial Sequence
  chemically synthesized
gtgggaagtactaagtagtc

SEQ ID NO: 17505 - DNA, 20 bp, Artificial Sequence
  chemically synthesized
ctaagtagtcaggtatgttt

SEQ ID NO: 17506 - DNA, 20 bp, Artificial Sequence
  chemically synthesized
agtagtcaggtatgttttgg

SEQ ID NO: 17507 - DNA, 20 bp, Artificial Sequence
  chemically synthesized
agtcaggtatgttttggaag

SEQ ID NO: 17508 - DNA, 20 bp, Artificial Sequence
  chemically synthesized
tttggaagaagcactgttac

SEQ ID NO: 17509 - DNA, 20 bp, Artificial Sequence
  chemically synthesized
aagaagcactgttaccagtt

SEQ ID NO: 17510 - DNA, 20 bp, Artificial Sequence
  chemically synthesized
agaagcactgttaccagttg

SEQ ID NO: 17511 - DNA, 20 bp, Artificial Sequence
  chemically synthesized
gaagcactgttaccagttga

SEQ ID NO: 17512 - DNA, 20 bp, Artificial Sequence
  chemically synthesized
agcactgttaccagttgagg

SEQ ID NO: 17513 - DNA, 20 bp, Artificial Sequence
  chemically synthesized
cactgttaccagttgaggga

SEQ ID NO: 17514 - DNA, 20 bp, Artificial Sequence
  chemically synthesized
actgttaccagttgagggag

SEQ ID NO: 17515 - DNA, 20 bp, Artificial Sequence
  chemically synthesized
tgttaccagttgagggagag

SEQ ID NO: 17516 - DNA, 20 bp, Artificial Sequence
  chemically synthesized
ttaccagttgagggagagga

SEQ ID NO: 17517 - DNA, 20 bp, Artificial Sequence
  chemically synthesized
taccagttgagggagaggag

SEQ ID NO: 17518 - DNA, 20 bp, Artificial Sequence
  chemically synthesized
ccagttgagggagaggagag

SEQ ID NO: 17519 - DNA, 20 bp, Artificial Sequence
  chemically synthesized
cagttgagggagaggagagg

SEQ ID NO: 17520 - DNA, 20 bp, Artificial Sequence
  chemically synthesized
agttgagggagaggagagga

SEQ ID NO: 17521 - DNA, 20 bp, Artificial Sequence
  chemically synthesized
ggagaggagaggagggaaat

SEQ ID NO: 17522 - DNA, 20 bp, Artificial Sequence
  chemically synthesized
agaggagggaaattagactg

SEQ ID NO: 17523 - DNA, 20 bp, Artificial Sequence
  chemically synthesized
aattagactgtggtgtgacc

SEQ ID NO: 17524 - DNA, 20 bp, Artificial Sequence
  chemically synthesized
attagactgtggtgtgaccc

SEQ ID NO: 17525 - DNA, 20 bp, Artificial Sequence
  chemically synthesized
gactgtggtgtgacccagga

SEQ ID NO: 17526 - DNA, 20 bp, Artificial Sequence
  chemically synthesized
gtggtgtgacccaggatgga

SEQ ID NO: 17527 - DNA, 20 bp, Artificial Sequence
  chemically synthesized
tggaaagttttgcccaaatg

SEQ ID NO: 17528 - DNA, 20 bp, Artificial Sequence
  chemically synthesized
ggaaagttttgcccaaatgt

SEQ ID NO: 17529 - DNA, 20 bp, Artificial Sequence
  chemically synthesized
gaaagttttgcccaaatgtg

SEQ ID NO: 17530 - DNA, 20 bp, Artificial Sequence
  chemically synthesized
aaagttttgcccaaatgtgg

SEQ ID NO: 17531 - DNA, 20 bp, Artificial Sequence
  chemically synthesized
tgtttactctctcctttgcc

SEQ ID NO: 17532 - DNA, 20 bp, Artificial Sequence
  chemically synthesized
gtttactctctcctttgccc

SEQ ID NO: 17533 - DNA, 20 bp, Artificial Sequence
  chemically synthesized
ttcttctgcacacacttgct

SEQ ID NO: 17534 - DNA, 20 bp, Artificial Sequence
  chemically synthesized
gctcagaacattacaaactc

SEQ ID NO: 17535 - DNA, 20 bp, Artificial Sequence
  chemically synthesized
tcagaacattacaaactctg

SEQ ID NO: 17536 - DNA, 20 bp, Artificial Sequence
  chemically synthesized
tctggagaaattaacatgtt

SEQ ID NO: 17537 - DNA, 20 bp, Artificial Sequence
  chemically synthesized
ctggagaaattaacatgtta

SEQ ID NO: 17538 - DNA, 20 bp, Artificial Sequence
  chemically synthesized
attaacatgttaaggatatt

SEQ ID NO: 17539 - DNA, 20 bp, Artificial Sequence
  chemically synthesized
ttaacatgttaaggatattt

SEQ ID NO: 17540 - DNA, 20 bp, Artificial Sequence
  chemically synthesized
gatatttaggatcattaaaa

SEQ ID NO: 17541 - DNA, 20 bp, Artificial Sequence
  chemically synthesized
aatgttgtcacacataatga

SEQ ID NO: 17542 - DNA, 20 bp, Artificial Sequence
  chemically synthesized
cacataatgaaagttaattt

SEQ ID NO: 17543 - DNA, 20 bp, Artificial Sequence
  chemically synthesized
aagttaatttaagaattgta

SEQ ID NO: 17544 - DNA, 20 bp, Artificial Sequence
  chemically synthesized
tttaagaattgtaaagactt

SEQ ID NO: 17545 - DNA, 20 bp, Artificial Sequence
  chemically synthesized
ttgtaaagacttgagcgatg

SEQ ID NO: 17546 - DNA, 20 bp, Artificial Sequence
  chemically synthesized
taaatgcttccctcttaaaa

SEQ ID NO: 17547 - DNA, 20 bp, Artificial Sequence
  chemically synthesized
gcttccctcttaaaatggac

SEQ ID NO: 17548 - DNA, 20 bp, Artificial Sequence
  chemically synthesized
gaaacaatttgtttttgcct

SEQ ID NO: 17549 - DNA, 20 bp, Artificial Sequence
  chemically synthesized
tgcctaagccaacgtattgc

SEQ ID NO: 17550 - DNA, 20 bp, Artificial Sequence
  chemically synthesized
taatttacctgcttcctcct

SEQ ID NO: 17551 - DNA, 20 bp, Artificial Sequence
  chemically synthesized
cactacacctctgaattaca

SEQ ID NO: 17552 - DNA, 20 bp, Artificial Sequence
  chemically synthesized
acctctgaattacatggtac

SEQ ID NO: 17553 - DNA, 20 bp, Artificial Sequence
  chemically synthesized
tctgaattacatggtacaag

SEQ ID NO: 17554 - DNA, 20 bp, Artificial Sequence
  chemically synthesized
attacatggtacaagtggca

SEQ ID NO: 17555 - DNA, 20 bp, Artificial Sequence
  chemically synthesized
ttacatggtacaagtggcac

SEQ ID NO: 17556 - DNA, 20 bp, Artificial Sequence
  chemically synthesized
tacatggtacaagtggcaca

SEQ ID NO: 17557 - DNA, 20 bp, Artificial Sequence
  chemically synthesized
atggtacaagtggcacaggg

SEQ ID NO: 17558 - DNA, 20 bp, Artificial Sequence
  chemically synthesized
aagtggcacagggaagaatt

SEQ ID NO: 17559 - DNA, 20 bp, Artificial Sequence
  chemically synthesized
cagggaagaattcagaaaac

SEQ ID NO: 17560 - DNA, 20 bp, Artificial Sequence
  chemically synthesized
gggaagaattcagaaaacta

SEQ ID NO: 17561 - DNA, 20 bp, Artificial Sequence
  chemically synthesized
aattcagaaaactagagtca

SEQ ID NO: 17562 - DNA, 20 bp, Artificial Sequence
  chemically synthesized
tcagaaaactagagtcaaag

SEQ ID NO: 17563 - DNA, 20 bp, Artificial Sequence
  chemically synthesized
aactagagtcaaagtggtta

SEQ ID NO: 17564 - DNA, 20 bp, Artificial Sequence
  chemically synthesized
tagagtcaaagtggttatgg

SEQ ID NO: 17565 - DNA, 20 bp, Artificial Sequence
  chemically synthesized
atggaagaaattataataat

SEQ ID NO: 17566 - DNA, 20 bp, Artificial Sequence
  chemically synthesized
taataatgagtccactcttc

SEQ ID NO: 17567 - DNA, 20 bp, Artificial Sequence
  chemically synthesized
aataatgagtccactcttct

SEQ ID NO: 17568 - DNA, 20 bp, Artificial Sequence
  chemically synthesized
atgagtccactcttctagga

SEQ ID NO: 17569 - DNA, 20 bp, Artificial Sequence
  chemically synthesized
tgagtccactcttctaggac

SEQ ID NO: 17570 - DNA, 20 bp, Artificial Sequence
  chemically synthesized
agtccactcttctaggacag

SEQ ID NO: 17571 - DNA, 20 bp, Artificial Sequence
  chemically synthesized
cttctaggacaggagttcta

SEQ ID NO: 17572 - DNA, 20 bp, Artificial Sequence
  chemically synthesized
ttctaggacaggagttctaa

SEQ ID NO: 17573 - DNA, 20 bp, Artificial Sequence
  chemically synthesized
aggacaggagttctaaaggt

SEQ ID NO: 17574 - DNA, 20 bp, Artificial Sequence
  chemically synthesized
ggacaggagttctaaaggtg

SEQ ID NO: 17575 - DNA, 20 bp, Artificial Sequence
  chemically synthesized
aaaggtgaggactttgatat

SEQ ID NO: 17576 - DNA, 20 bp, Artificial Sequence
  chemically synthesized
actttgatataagtgaactc

SEQ ID NO: 17577 - DNA, 20 bp, Artificial Sequence
  chemically synthesized
ctttgatataagtgaactca

SEQ ID NO: 17578 - DNA, 20 bp, Artificial Sequence
  chemically synthesized
ttgatataagtgaactcaag

SEQ ID NO: 17579 - DNA, 20 bp, Artificial Sequence
  chemically synthesized
tcaaggagtttctaaacctt

SEQ ID NO: 17580 - DNA, 20 bp, Artificial Sequence
  chemically synthesized
cagaaattatatctaaaaat

SEQ ID NO: 17581 - DNA, 20 bp, Artificial Sequence
  chemically synthesized
agaaattatatctaaaaatt

SEQ ID NO: 17582 - DNA, 20 bp, Artificial Sequence
  chemically synthesized
aaaaattaggtgcacgtata

SEQ ID NO: 17583 - DNA, 20 bp, Artificial Sequence
  chemically synthesized
aattaggtgcacgtatatag

SEQ ID NO: 17584 - DNA, 20 bp, Artificial Sequence
  chemically synthesized
atatagaagtacttttctct

SEQ ID NO: 17585 - DNA, 20 bp, Artificial Sequence
  chemically synthesized
tagaagtacttttctctgag

SEQ ID NO: 17586 - DNA, 20 bp, Artificial Sequence
  chemically synthesized
gaagtacttttctctgagaa

SEQ ID NO: 17587 - DNA, 20 bp, Artificial Sequence
  chemically synthesized
aagtacttttctctgagaag

SEQ ID NO: 17588 - DNA, 20 bp, Artificial Sequence
  chemically synthesized
agaggacttcacacttccat

SEQ ID NO: 17589 - DNA, 20 bp, Artificial Sequence
  chemically synthesized
acacttccatcagcttcctg

SEQ ID NO: 17590 - DNA, 20 bp, Artificial Sequence
  chemically synthesized
cacttccatcagcttcctga

SEQ ID NO: 17591 - DNA, 20 bp, Artificial Sequence
  chemically synthesized
aggcccctgtaattgccgta

SEQ ID NO: 17592 - DNA, 20 bp, Artificial Sequence
  chemically synthesized
cgtaaagaacaactgctcta

SEQ ID NO: 17593 - DNA, 20 bp, Artificial Sequence
  chemically synthesized
actgctctaaagtttaatac

SEQ ID NO: 17594 - DNA, 20 bp, Artificial Sequence
  chemically synthesized
ctgctctaaagtttaatact

SEQ ID NO: 17595 - DNA, 20 bp, Artificial Sequence
  chemically synthesized
aagtttaatactaggctact

SEQ ID NO: 17596 - DNA, 20 bp, Artificial Sequence
  chemically synthesized
tcggctgttttttgttaaca

SEQ ID NO: 17597 - DNA, 20 bp, Artificial Sequence
  chemically synthesized
gctgttttttgttaacacag

SEQ ID NO: 17598 - DNA, 20 bp, Artificial Sequence
  chemically synthesized
taacacagaagttttccaaa

SEQ ID NO: 17599 - DNA, 20 bp, Artificial Sequence
  chemically synthesized
ttttccaaatggcttttctc

SEQ ID NO: 17600 - DNA, 20 bp, Artificial Sequence
  chemically synthesized
ttccaaatggcttttctcta

SEQ ID NO: 17601 - DNA, 20 bp, Artificial Sequence
  chemically synthesized
tttctctagagcaaaatgaa

SEQ ID NO: 17602 - DNA, 20 bp, Artificial Sequence
  chemically synthesized
ttctctagagcaaaatgaaa

SEQ ID NO: 17603 - DNA, 20 bp, Artificial Sequence
  chemically synthesized
aaaaggatcccatccttccc

SEQ ID NO: 17604 - DNA, 20 bp, Artificial Sequence
  chemically synthesized
cctaccccccaccactttta

SEQ ID NO: 17605 - DNA, 20 bp, Artificial Sequence
  chemically synthesized
accacttttaaagatccatc

SEQ ID NO: 17606 - DNA, 20 bp, Artificial Sequence
  chemically synthesized
ccacttttaaagatccatca

SEQ ID NO: 17607 - DNA, 20 bp, Artificial Sequence
  chemically synthesized
tttaaagatccatcaaggcc

SEQ ID NO: 17608 - DNA, 20 bp, Artificial Sequence
  chemically synthesized
agatccatcaaggcccagca

SEQ ID NO: 17609 - DNA, 20 bp, Artificial Sequence
  chemically synthesized
ctgtaatctcaacacttttc

SEQ ID NO: 17610 - DNA, 20 bp, Artificial Sequence
  chemically synthesized
tgtaatctcaacacttttca

SEQ ID NO: 17611 - DNA, 20 bp, Artificial Sequence
  chemically synthesized
tctcaacacttttcaaggct

SEQ ID NO: 17612 - DNA, 20 bp, Artificial Sequence
  chemically synthesized
ctcaacacttttcaaggctg

SEQ ID NO: 17613 - DNA, 20 bp, Artificial Sequence
  chemically synthesized
aacacttttcaaggctgagg

SEQ ID NO: 17614 - DNA, 20 bp, Artificial Sequence
  chemically synthesized
acacttttcaaggctgaggt

SEQ ID NO: 17615 - DNA, 20 bp, Artificial Sequence
  chemically synthesized
acttttcaaggctgaggtgg

SEQ ID NO: 17616 - DNA, 20 bp, Artificial Sequence
  chemically synthesized
ctgaggtgggagaattgttt

SEQ ID NO: 17617 - DNA, 20 bp, Artificial Sequence
  chemically synthesized
tgggagaattgtttgagacc

SEQ ID NO: 17618 - DNA, 20 bp, Artificial Sequence
  chemically synthesized
ggagaattgtttgagaccaa

SEQ ID NO: 17619 - DNA, 20 bp, Artificial Sequence
  chemically synthesized
aattgtttgagaccaagagt

SEQ ID NO: 17620 - DNA, 20 bp, Artificial Sequence
  chemically synthesized
tgagaccaagagttggatac

SEQ ID NO: 17621 - DNA, 20 bp, Artificial Sequence
  chemically synthesized
ccaagagttggataccagcc

SEQ ID NO: 17622 - DNA, 20 bp, Artificial Sequence
  chemically synthesized
caagagttggataccagcct

SEQ ID NO: 17623 - DNA, 20 bp, Artificial Sequence
  chemically synthesized
aagagttggataccagcctg

SEQ ID NO: 17624 - DNA, 20 bp, Artificial Sequence
  chemically synthesized
ggataccagcctggggaaca

SEQ ID NO: 17625 - DNA, 20 bp, Artificial Sequence
  chemically synthesized
gataccagcctggggaacat

SEQ ID NO: 17626 - DNA, 20 bp, Artificial Sequence
  chemically synthesized
ataccagcctggggaacata

SEQ ID NO: 17627 - DNA, 20 bp, Artificial Sequence
  chemically synthesized
accagcctggggaacatagg

SEQ ID NO: 17628 - DNA, 20 bp, Artificial Sequence
  chemically synthesized
atagggagaccctgtttcta

SEQ ID NO: 17629 - DNA, 20 bp, Artificial Sequence
  chemically synthesized
agaaatttaaaaaatttctc

SEQ ID NO: 17630 - DNA, 20 bp, Artificial Sequence
  chemically synthesized
atttaaaaaatttctctagc

SEQ ID NO: 17631 - DNA, 20 bp, Artificial Sequence
  chemically synthesized
aaaatttctctagctggcca

SEQ ID NO: 17632 - DNA, 20 bp, Artificial Sequence
  chemically synthesized
aatttctctagctggccatg

SEQ ID NO: 17633 - DNA, 20 bp, Artificial Sequence
  chemically synthesized
atttctctagctggccatgg

SEQ ID NO: 17634 - DNA, 20 bp, Artificial Sequence
  chemically synthesized
gccatggaggctcacacctg

SEQ ID NO: 17635 - DNA, 20 bp, Artificial Sequence
  chemically synthesized
gaggctcacacctgtagtcc

SEQ ID NO: 17636 - DNA, 20 bp, Artificial Sequence
  chemically synthesized
acctgtagtcctagctacct

SEQ ID NO: 17637 - DNA, 20 bp, Artificial Sequence
  chemically synthesized
ctgtagtcctagctacctga

SEQ ID NO: 17638 - DNA, 20 bp, Artificial Sequence
  chemically synthesized
tgtagtcctagctacctgag

SEQ ID NO: 17639 - DNA, 20 bp, Artificial Sequence
  chemically synthesized
cctagctacctgagaggcta

SEQ ID NO: 17640 - DNA, 20 bp, Artificial Sequence
  chemically synthesized
agctacctgagaggctaaag

SEQ ID NO: 17641 - DNA, 20 bp, Artificial Sequence
  chemically synthesized
gctacctgagaggctaaagc

SEQ ID NO: 17642 - DNA, 20 bp, Artificial Sequence
  chemically synthesized
tacctgagaggctaaagcag

SEQ ID NO: 17643 - DNA, 20 bp, Artificial Sequence
  chemically synthesized
acctgagaggctaaagcagg

SEQ ID NO: 17644 - DNA, 20 bp, Artificial Sequence
  chemically synthesized
gcaggaggatcaattgaatc

SEQ ID NO: 17645 - DNA, 20 bp, Artificial Sequence
  chemically synthesized
caggaggatcaattgaatcc

SEQ ID NO: 17646 - DNA, 20 bp, Artificial Sequence
  chemically synthesized
tcaattgaatccaggcgttc

SEQ ID NO: 17647 - DNA, 20 bp, Artificial Sequence
  chemically synthesized
ttgaatccaggcgttctagt

SEQ ID NO: 17648 - DNA, 20 bp, Artificial Sequence
  chemically synthesized
tgaatccaggcgttctagtg

SEQ ID NO: 17649 - DNA, 20 bp, Artificial Sequence
  chemically synthesized
caggcgttctagtgaggctt

SEQ ID NO: 17650 - DNA, 20 bp, Artificial Sequence
  chemically synthesized
cgttctagtgaggcttcagt

SEQ ID NO: 17651 - DNA, 20 bp, Artificial Sequence
  chemically synthesized
ctagtgaggcttcagtgagc

SEQ ID NO: 17652 - DNA, 20 bp, Artificial Sequence
  chemically synthesized
aagattgcaccattgcactc

SEQ ID NO: 17653 - DNA, 20 bp, Artificial Sequence
  chemically synthesized
ttgcaccattgcactccagc

SEQ ID NO: 17654 - DNA, 20 bp, Artificial Sequence
  chemically synthesized
tgcaccattgcactccagcc

SEQ ID NO: 17655 - DNA, 20 bp, Artificial Sequence
  chemically synthesized
gcaccattgcactccagccg

SEQ ID NO: 17656 - DNA, 20 bp, Artificial Sequence
  chemically synthesized
ttgcactccagccggggtga

SEQ ID NO: 17657 - DNA, 20 bp, Artificial Sequence
  chemically synthesized
gcactccagccggggtgaca

SEQ ID NO: 17658 - DNA, 20 bp, Artificial Sequence
  chemically synthesized
tccagccggggtgacagagt

SEQ ID NO: 17659 - DNA, 20 bp, Artificial Sequence
  chemically synthesized
agaccctgtttcaaacaaac

SEQ ID NO: 17660 - DNA, 20 bp, Artificial Sequence
  chemically synthesized
tgtttcaaacaaacaagcaa

SEQ ID NO: 17661 - DNA, 20 bp, Artificial Sequence
  chemically synthesized
aacaaacaagcaaaagcaaa

SEQ ID NO: 17662 - DNA, 20 bp, Artificial Sequence
  chemically synthesized
acttactatcttgctgtcta

SEQ ID NO: 17663 - DNA, 20 bp, Artificial Sequence
  chemically synthesized
tatcttgctgtctacagcta

SEQ ID NO: 17664 - DNA, 20 bp, Artificial Sequence
  chemically synthesized
ttgctgtctacagctaaagt

SEQ ID NO: 17665 - DNA, 20 bp, Artificial Sequence
  chemically synthesized
taaagtcagactgcatgatt

SEQ ID NO: 17666 - DNA, 20 bp, Artificial Sequence
  chemically synthesized
attccaactccaccatcacc

SEQ ID NO: 17667 - DNA, 20 bp, Artificial Sequence
  chemically synthesized
ttccaactccaccatcacct

SEQ ID NO: 17668 - DNA, 20 bp, Artificial Sequence
  chemically synthesized
accatcacctgggtaatgtt

SEQ ID NO: 17669 - DNA, 20 bp, Artificial Sequence
  chemically synthesized
taatgttgagatttattaca

SEQ ID NO: 17670 - DNA, 20 bp, Artificial Sequence
  chemically synthesized
tacatagcatctctgtgcct

SEQ ID NO: 17671 - DNA, 20 bp, Artificial Sequence
  chemically synthesized
aataatgttgtgaaaattaa

SEQ ID NO: 17672 - DNA, 20 bp, Artificial Sequence
  chemically synthesized
gtgaaaattaaaagaaatac

SEQ ID NO: 17673 - DNA, 20 bp, Artificial Sequence
  chemically synthesized
aataccagttgtaaatcact

SEQ ID NO: 17674 - DNA, 20 bp, Artificial Sequence
  chemically synthesized
aaatcactcagaactgtgcc

SEQ ID NO: 17675 - DNA, 20 bp, Artificial Sequence
  chemically synthesized
agcatttaataaacactctg

SEQ ID NO: 17676 - DNA, 20 bp, Artificial Sequence
  chemically synthesized
gcatttaataaacactctgt

SEQ ID NO: 17677 - DNA, 20 bp, Artificial Sequence
  chemically synthesized
aataaacactctgtaggtat

SEQ ID NO: 17678 - DNA, 20 bp, Artificial Sequence
  chemically synthesized
ataaaatttattcataaaat

SEQ ID NO: 17679 - DNA, 20 bp, Artificial Sequence
  chemically synthesized
taaaatttattcataaaatg

SEQ ID NO: 17680 - DNA, 20 bp, Artificial Sequence
  chemically synthesized
aatttattcataaaatgagg

SEQ ID NO: 17681 - DNA, 20 bp, Artificial Sequence
  chemically synthesized
tattcataaaatgaggaagt

SEQ ID NO: 17682 - DNA, 20 bp, Artificial Sequence
  chemically synthesized
tagctcatgtattgtcatac

SEQ ID NO: 17683 - DNA, 20 bp, Artificial Sequence
  chemically synthesized
taccagctttcactttgaat

SEQ ID NO: 17684 - DNA, 20 bp, Artificial Sequence
  chemically synthesized
attgcatttttaaacacaaa

SEQ ID NO: 17685 - DNA, 20 bp, Artificial Sequence
  chemically synthesized
tgcatttttaaacacaaaaa

SEQ ID NO: 17686 - DNA, 20 bp, Artificial Sequence
  chemically synthesized
aaacacaaaaagagaaataa

SEQ ID NO: 17687 - DNA, 20 bp, Artificial Sequence
  chemically synthesized
aacacaaaaagagaaataat

SEQ ID NO: 17688 - DNA, 20 bp, Artificial Sequence
  chemically synthesized
catcaatgttacttcaatca

SEQ ID NO: 17689 - DNA, 20 bp, Artificial Sequence
  chemically synthesized
atcaatgttacttcaatcac

SEQ ID NO: 17690 - DNA, 20 bp, Artificial Sequence
  chemically synthesized
tacttcaatcacgggatgca

SEQ ID NO: 17691 - DNA, 20 bp, Artificial Sequence
  chemically synthesized
atcacgggatgcatagtaat

SEQ ID NO: 17692 - DNA, 20 bp, Artificial Sequence
  chemically synthesized
tcacgggatgcatagtaatt

SEQ ID NO: 17693 - DNA, 20 bp, Artificial Sequence
  chemically synthesized
ctttgccctaattactgatg

SEQ ID NO: 17694 - DNA, 20 bp, Artificial Sequence
  chemically synthesized
ccctaattactgatgtggat

SEQ ID NO: 17695 - DNA, 20 bp, Artificial Sequence
  chemically synthesized
aattactgatgtggataagc

SEQ ID NO: 17696 - DNA, 20 bp, Artificial Sequence
  chemically synthesized
tactgatgtggataagccgg

SEQ ID NO: 17697 - DNA, 20 bp, Artificial Sequence
  chemically synthesized
actgatgtggataagccggt

SEQ ID NO: 17698 - DNA, 20 bp, Artificial Sequence
  chemically synthesized
aagccggtgggccatgtcaa

SEQ ID NO: 17699 - DNA, 20 bp, Artificial Sequence
  chemically synthesized
ggccatgtcaatggcatctc

SEQ ID NO: 17700 - DNA, 20 bp, Artificial Sequence
  chemically synthesized
atctatgtaaaaactatgct

SEQ ID NO: 17701 - DNA, 20 bp, Artificial Sequence
  chemically synthesized
aaaaactatgcttggttgca

SEQ ID NO: 17702 - DNA, 20 bp, Artificial Sequence
  chemically synthesized
atgcttggttgcacagcttc

SEQ ID NO: 17703 - DNA, 20 bp, Artificial Sequence
  chemically synthesized
tgcttggttgcacagcttca

SEQ ID NO: 17704 - DNA, 20 bp, Artificial Sequence
  chemically synthesized
tggttgcacagcttcaagga

SEQ ID NO: 17705 - DNA, 20 bp, Artificial Sequence
  chemically synthesized
cacagcttcaaggaaagcac

SEQ ID NO: 17706 - DNA, 20 bp, Artificial Sequence
  chemically synthesized
ctactcacttccttttcatt

SEQ ID NO: 17707 - DNA, 20 bp, Artificial Sequence
  chemically synthesized
ttcattcagcatgctatgtc

SEQ ID NO: 17708 - DNA, 20 bp, Artificial Sequence
  chemically synthesized
tcattcagcatgctatgtct

SEQ ID NO: 17709 - DNA, 20 bp, Artificial Sequence
  chemically synthesized
cccctttcatataaaatatt

SEQ ID NO: 17710 - DNA, 20 bp, Artificial Sequence
  chemically synthesized
cctttcatataaaatatttg

SEQ ID NO: 17711 - DNA, 20 bp, Artificial Sequence
  chemically synthesized
aatatttggagctgccattg

SEQ ID NO: 17712 - DNA, 20 bp, Artificial Sequence
  chemically synthesized
atatttggagctgccattgt

SEQ ID NO: 17713 - DNA, 20 bp, Artificial Sequence
  chemically synthesized
tttggagctgccattgtagg

SEQ ID NO: 17714 - DNA, 20 bp, Artificial Sequence
  chemically synthesized
agctgccattgtaggtagtg

SEQ ID NO: 17715 - DNA, 20 bp, Artificial Sequence
  chemically synthesized
gctgccattgtaggtagtgc

SEQ ID NO: 17716 - DNA, 20 bp, Artificial Sequence
  chemically synthesized
gccattgtaggtagtgcagg

SEQ ID NO: 17717 - DNA, 20 bp, Artificial Sequence
  chemically synthesized
agtgcaggtggtcttgttca

SEQ ID NO: 17718 - DNA, 20 bp, Artificial Sequence
  chemically synthesized
ggtggtcttgttcaaagtgt

SEQ ID NO: 17719 - DNA, 20 bp, Artificial Sequence
  chemically synthesized
gagtatcacctcccactgcc

SEQ ID NO: 17720 - DNA, 20 bp, Artificial Sequence
  chemically synthesized
acctcccactgccaagactg

SEQ ID NO: 17721 - DNA, 20 bp, Artificial Sequence
  chemically synthesized
cagctgctttgattttaact

SEQ ID NO: 17722 - DNA, 20 bp, Artificial Sequence
  chemically synthesized
agctgctttgattttaactg

SEQ ID NO: 17723 - DNA, 20 bp, Artificial Sequence
  chemically synthesized
tttgattttaactgaggatc

SEQ ID NO: 17724 - DNA, 20 bp, Artificial Sequence
  chemically synthesized
ttttaactgaggatctagaa

SEQ ID NO: 17725 - DNA, 20 bp, Artificial Sequence
  chemically synthesized
ctgaggatctagaaaagtgc

SEQ ID NO: 17726 - DNA, 20 bp, Artificial Sequence
  chemically synthesized
tgaggatctagaaaagtgct

SEQ ID NO: 17727 - DNA, 20 bp, Artificial Sequence
  chemically synthesized
tatttgctgacctttgtcac

SEQ ID NO: 17728 - DNA, 20 bp, Artificial Sequence
  chemically synthesized
ttgctgacctttgtcacaag

SEQ ID NO: 17729 - DNA, 20 bp, Artificial Sequence
  chemically synthesized
gcacctaatctccttcctac

SEQ ID NO: 17730 - DNA, 20 bp, Artificial Sequence
  chemically synthesized
gccttataaaatgatgttct

SEQ ID NO: 17731 - DNA, 20 bp, Artificial Sequence
  chemically synthesized
ctgcttctgcaactgtgttt

SEQ ID NO: 17732 - DNA, 20 bp, Artificial Sequence
  chemically synthesized
tctgcaactgtgttttggaa

SEQ ID NO: 17733 - DNA, 20 bp, Artificial Sequence
  chemically synthesized
ctgcaactgtgttttggaac

SEQ ID NO: 17734 - DNA, 20 bp, Artificial Sequence
  chemically synthesized
gcaactgtgttttggaacag

SEQ ID NO: 17735 - DNA, 20 bp, Artificial Sequence
  chemically synthesized
caactgtgttttggaacagg

SEQ ID NO: 17736 - DNA, 20 bp, Artificial Sequence
  chemically synthesized
aactgtgttttggaacagga

SEQ ID NO: 17737 - DNA, 20 bp, Artificial Sequence
  chemically synthesized
gtgttttggaacaggagggt

SEQ ID NO: 17738 - DNA, 20 bp, Artificial Sequence
  chemically synthesized
ttggaacaggagggtgagat

SEQ ID NO: 17739 - DNA, 20 bp, Artificial Sequence
  chemically synthesized
gaacaggagggtgagattag

SEQ ID NO: 17740 - DNA, 20 bp, Artificial Sequence
  chemically synthesized
agtagccacacacactgaaa

SEQ ID NO: 17741 - DNA, 20 bp, Artificial Sequence
  chemically synthesized
aaatagtcatatgacttcca

SEQ ID NO: 17742 - DNA, 20 bp, Artificial Sequence
  chemically synthesized
ttccaaagtctgtaattttt

SEQ ID NO: 17743 - DNA, 20 bp, Artificial Sequence
  chemically synthesized
atttttaagcatatacaaaa

SEQ ID NO: 17744 - DNA, 20 bp, Artificial Sequence
  chemically synthesized
tatgtgtgtatacatatata

SEQ ID NO: 17745 - DNA, 20 bp, Artificial Sequence
  chemically synthesized
tgtgtgtatacatatatata

SEQ ID NO: 17746 - DNA, 20 bp, Artificial Sequence
  chemically synthesized
tgtgtatacatatatataga

SEQ ID NO: 17747 - DNA, 20 bp, Artificial Sequence
  chemically synthesized
tgtatacatatatatagaga

SEQ ID NO: 17748 - DNA, 20 bp, Artificial Sequence
  chemically synthesized
tatacatatatatagagaga

SEQ ID NO: 17749 - DNA, 20 bp, Artificial Sequence
  chemically synthesized
catatatatagagagagaga

SEQ ID NO: 17750 - DNA, 20 bp, Artificial Sequence
  chemically synthesized
tatatatagagagagagaca

SEQ ID NO: 17751 - DNA, 20 bp, Artificial Sequence
  chemically synthesized
tatatagagagagagacaga

SEQ ID NO: 17752 - DNA, 20 bp, Artificial Sequence
  chemically synthesized
tatagagagagagacagaga

SEQ ID NO: 17753 - DNA, 20 bp, Artificial Sequence
  chemically synthesized
gagagagagacagagagaga

SEQ ID NO: 17754 - DNA, 20 bp, Artificial Sequence
  chemically synthesized
agagagagacagagagagat

SEQ ID NO: 17755 - DNA, 20 bp, Artificial Sequence
  chemically synthesized
gagagagacagagagagatg

SEQ ID NO: 17756 - DNA, 20 bp, Artificial Sequence
  chemically synthesized
agagagacagagagagatgg

SEQ ID NO: 17757 - DNA, 20 bp, Artificial Sequence
  chemically synthesized
agagacagagagagatgggg

SEQ ID NO: 17758 - DNA, 20 bp, Artificial Sequence
  chemically synthesized
agacagagagagatggggga

SEQ ID NO: 17759 - DNA, 20 bp, Artificial Sequence
  chemically synthesized
acagagagagatgggggaga

SEQ ID NO: 17760 - DNA, 20 bp, Artificial Sequence
  chemically synthesized
agagagagatgggggagaga

SEQ ID NO: 17761 - DNA, 20 bp, Artificial Sequence
  chemically synthesized
agagagatgggggagagaga

SEQ ID NO: 17762 - DNA, 20 bp, Artificial Sequence
  chemically synthesized
agagatgggggagagagaga

SEQ ID NO: 17763 - DNA, 20 bp, Artificial Sequence
  chemically synthesized
agatgggggagagagagaga

SEQ ID NO: 17764 - DNA, 20 bp, Artificial Sequence
  chemically synthesized
atgggggagagagagagaga

SEQ ID NO: 17765 - DNA, 20 bp, Artificial Sequence
  chemically synthesized
gggagagagagagagagagc

SEQ ID NO: 17766 - DNA, 20 bp, Artificial Sequence
  chemically synthesized
gagagagagagagagagcga

SEQ ID NO: 17767 - DNA, 20 bp, Artificial Sequence
  chemically synthesized
gagagagagagagagcgaga

SEQ ID NO: 17768 - DNA, 20 bp, Artificial Sequence
  chemically synthesized
gagagagagagagcgagaga

SEQ ID NO: 17769 - DNA, 20 bp, Artificial Sequence
  chemically synthesized
agagagagagagcgagagag

SEQ ID NO: 17770 - DNA, 20 bp, Artificial Sequence
  chemically synthesized
gagagagagcgagagagagg

SEQ ID NO: 17771 - DNA, 20 bp, Artificial Sequence
  chemically synthesized
gagagagcgagagagaggca

SEQ ID NO: 17772 - DNA, 20 bp, Artificial Sequence
  chemically synthesized
gagcgagagagaggcagaga

SEQ ID NO: 17773 - DNA, 20 bp, Artificial Sequence
  chemically synthesized
gcgagagagaggcagagaaa

SEQ ID NO: 17774 - DNA, 20 bp, Artificial Sequence
  chemically synthesized
agagaaagagatccttattt

SEQ ID NO: 17775 - DNA, 20 bp, Artificial Sequence
  chemically synthesized
tattctatacttctttgaaa

SEQ ID NO: 17776 - DNA, 20 bp, Artificial Sequence
  chemically synthesized
ttctttgaaatagtgatttt

SEQ ID NO: 17777 - DNA, 20 bp, Artificial Sequence
  chemically synthesized
aatagtgatttttagtaaat

SEQ ID NO: 17778 - DNA, 20 bp, Artificial Sequence
  chemically synthesized
agtgatttttagtaaattgg

SEQ ID NO: 17779 - DNA, 20 bp, Artificial Sequence
  chemically synthesized
tagtaaattggcagtgttgc

SEQ ID NO: 17780 - DNA, 20 bp, Artificial Sequence
  chemically synthesized
agtgttgccagatgacgact

SEQ ID NO: 17781 - DNA, 20 bp, Artificial Sequence
  chemically synthesized
tgttgccagatgacgactta

SEQ ID NO: 17782 - DNA, 20 bp, Artificial Sequence
  chemically synthesized
cctcattgttatatgtacca

SEQ ID NO: 17783 - DNA, 20 bp, Artificial Sequence
  chemically synthesized
cattgttatatgtaccatgg

SEQ ID NO: 17784 - DNA, 20 bp, Artificial Sequence
  chemically synthesized
tggtagctcatcttttcttt

SEQ ID NO: 17785 - DNA, 20 bp, Artificial Sequence
  chemically synthesized
ggtagctcatcttttctttc

SEQ ID NO: 17786 - DNA, 20 bp, Artificial Sequence
  chemically synthesized
tcatcttttctttcaggtga

SEQ ID NO: 17787 - DNA, 20 bp, Artificial Sequence
  chemically synthesized
ctttgtcctcacgctaaaca

SEQ ID NO: 17788 - DNA, 20 bp, Artificial Sequence
  chemically synthesized
acatagcccccatgttgttc

SEQ ID NO: 17789 - DNA, 20 bp, Artificial Sequence
  chemically synthesized
catagcccccatgttgttcc

SEQ ID NO: 17790 - DNA, 20 bp, Artificial Sequence
  chemically synthesized
cccatgttgttccaggaaaa

SEQ ID NO: 17791 - DNA, 20 bp, Artificial Sequence
  chemically synthesized
catgttgttccaggaaaata

SEQ ID NO: 17792 - DNA, 20 bp, Artificial Sequence
  chemically synthesized
atagagatcaataaaataca

SEQ ID NO: 17793 - DNA, 20 bp, Artificial Sequence
  chemically synthesized
aatacaaagtacttgtttga

SEQ ID NO: 17794 - DNA, 20 bp, Artificial Sequence
  chemically synthesized
aaagtacttgtttgaaagtg

SEQ ID NO: 17795 - DNA, 20 bp, Artificial Sequence
  chemically synthesized
aagtacttgtttgaaagtga

SEQ ID NO: 17796 - DNA, 20 bp, Artificial Sequence
  chemically synthesized
cttgtttgaaagtgaaggtt

SEQ ID NO: 17797 - DNA, 20 bp, Artificial Sequence
  chemically synthesized
aaattcaatgacctacgctg

SEQ ID NO: 17798 - DNA, 20 bp, Artificial Sequence
  chemically synthesized
gatcattcattaatgatatt

SEQ ID NO: 17799 - DNA, 20 bp, Artificial Sequence
  chemically synthesized
agtattttcttttttaatgt

SEQ ID NO: 17800 - DNA, 20 bp, Artificial Sequence
  chemically synthesized
agaataaaaccatttatttg

SEQ ID NO: 17801 - DNA, 20 bp, Artificial Sequence
  chemically synthesized
tatgtgtatgtaaatctcct

SEQ ID NO: 17802 - DNA, 20 bp, Artificial Sequence
  chemically synthesized
ttatacctcaaatatgaaaa

SEQ ID NO: 17803 - DNA, 20 bp, Artificial Sequence
  chemically synthesized
tatacctcaaatatgaaaat

SEQ ID NO: 17804 - DNA, 20 bp, Artificial Sequence
  chemically synthesized
tcttgcattcacttatattc

SEQ ID NO: 17805 - DNA, 20 bp, Artificial Sequence
  chemically synthesized
cacttatattctagcttgtt

SEQ ID NO: 17806 - DNA, 20 bp, Artificial Sequence
  chemically synthesized
cttatattctagcttgttaa

SEQ ID NO: 17807 - DNA, 20 bp, Artificial Sequence
  chemically synthesized
tatattctagcttgttaaga

SEQ ID NO: 17808 - DNA, 20 bp, Artificial Sequence
  chemically synthesized
attctagcttgttaagagag

SEQ ID NO: 17809 - DNA, 20 bp, Artificial Sequence
  chemically synthesized
agcttgttaagagagaagtt

SEQ ID NO: 17810 - DNA, 20 bp, Artificial Sequence
  chemically synthesized
gcttgttaagagagaagttt

SEQ ID NO: 17811 - DNA, 20 bp, Artificial Sequence
  chemically synthesized
cttgttaagagagaagtttg

SEQ ID NO: 17812 - DNA, 20 bp, Artificial Sequence
  chemically synthesized
ggcaaaatgtgctttataaa

SEQ ID NO: 17813 - DNA, 20 bp, Artificial Sequence
  chemically synthesized
ctttataaatagtaaaaact

SEQ ID NO: 17814 - DNA, 20 bp, Artificial Sequence
  chemically synthesized
tttataaatagtaaaaactg

SEQ ID NO: 17815 - DNA, 20 bp, Artificial Sequence
  chemically synthesized
gtaaaaactgaggtaaacta

SEQ ID NO: 17816 - DNA, 20 bp, Artificial Sequence
  chemically synthesized
ctgaggtaaactatagcaca

SEQ ID NO: 17817 - DNA, 20 bp, Artificial Sequence
  chemically synthesized
cacaaagtgtgctatataaa

SEQ ID NO: 17818 - DNA, 20 bp, Artificial Sequence
  chemically synthesized
ctatataaacagtaaaaacc

SEQ ID NO: 17819 - DNA, 20 bp, Artificial Sequence
  chemically synthesized
tatataaacagtaaaaaccg

SEQ ID NO: 17820 - DNA, 20 bp, Artificial Sequence
  chemically synthesized
taaaaaccgaggtaaaaata

SEQ ID NO: 17821 - DNA, 20 bp, Artificial Sequence
  chemically synthesized
aaaaaccgaggtaaaaatat

SEQ ID NO: 17822 - DNA, 20 bp, Artificial Sequence
  chemically synthesized
aaaaccgaggtaaaaatatg

SEQ ID NO: 17823 - DNA, 20 bp, Artificial Sequence
  chemically synthesized
aaccgaggtaaaaatatggg

SEQ ID NO: 17824 - DNA, 20 bp, Artificial Sequence
  chemically synthesized
accgaggtaaaaatatgggg

SEQ ID NO: 17825 - DNA, 20 bp, Artificial Sequence
  chemically synthesized
aaaatatggggaggacaaaa

SEQ ID NO: 17826 - DNA, 20 bp, Artificial Sequence
  chemically synthesized
aaatatggggaggacaaaaa

SEQ ID NO: 17827 - DNA, 20 bp, Artificial Sequence
  chemically synthesized
aatatggggaggacaaaaaa

SEQ ID NO: 17828 - DNA, 20 bp, Artificial Sequence
  chemically synthesized
aggacaaaaaagggctaaaa

SEQ ID NO: 17829 - DNA, 20 bp, Artificial Sequence
  chemically synthesized
aaaaagggctaaaatggtgt

SEQ ID NO: 17830 - DNA, 20 bp, Artificial Sequence
  chemically synthesized
ctaaaatggtgttggaatat

SEQ ID NO: 17831 - DNA, 20 bp, Artificial Sequence
  chemically synthesized
tggtgttggaatataagaaa

SEQ ID NO: 17832 - DNA, 20 bp, Artificial Sequence
  chemically synthesized
tgttggaatataagaaatag

SEQ ID NO: 17833 - DNA, 20 bp, Artificial Sequence
  chemically synthesized
aatataagaaatagcagtaa

SEQ ID NO: 17834 - DNA, 20 bp, Artificial Sequence
  chemically synthesized
ataagaaatagcagtaaaag

SEQ ID NO: 17835 - DNA, 20 bp, Artificial Sequence
  chemically synthesized
gcagtaaaagaagctcctca

SEQ ID NO: 17836 - DNA, 20 bp, Artificial Sequence
  chemically synthesized
taaaagaagctcctcacagc

SEQ ID NO: 17837 - DNA, 20 bp, Artificial Sequence
  chemically synthesized
agaagctcctcacagcaaga

SEQ ID NO: 17838 - DNA, 20 bp, Artificial Sequence
  chemically synthesized
ctcctcacagcaagacagta

SEQ ID NO: 17839 - DNA, 20 bp, Artificial Sequence
  chemically synthesized
tcctcacagcaagacagtac

SEQ ID NO: 17840 - DNA, 20 bp, Artificial Sequence
  chemically synthesized
cctcacagcaagacagtaca

SEQ ID NO: 17841 - DNA, 20 bp, Artificial Sequence
  chemically synthesized
agacagtacagggaaatgtc

SEQ ID NO: 17842 - DNA, 20 bp, Artificial Sequence
  chemically synthesized
acagtacagggaaatgtctg

SEQ ID NO: 17843 - DNA, 20 bp, Artificial Sequence
  chemically synthesized
cagtacagggaaatgtctgg

SEQ ID NO: 17844 - DNA, 20 bp, Artificial Sequence
  chemically synthesized
agtacagggaaatgtctgga

SEQ ID NO: 17845 - DNA, 20 bp, Artificial Sequence
  chemically synthesized
gggaaatgtctggagggaca

SEQ ID NO: 17846 - DNA, 20 bp, Artificial Sequence
  chemically synthesized
gacaaagatttacttacaat

SEQ ID NO: 17847 - DNA, 20 bp, Artificial Sequence
  chemically synthesized
acaaagatttacttacaatc

SEQ ID NO: 17848 - DNA, 20 bp, Artificial Sequence
  chemically synthesized
aatcaggcctcaaccaatat

SEQ ID NO: 17849 - DNA, 20 bp, Artificial Sequence
  chemically synthesized
tatgacgtgtttatatgtat

SEQ ID NO: 17850 - DNA, 20 bp, Artificial Sequence
  chemically synthesized
atgacgtgtttatatgtatc

SEQ ID NO: 17851 - DNA, 20 bp, Artificial Sequence
  chemically synthesized
gcatataatgtataatgatc

SEQ ID NO: 17852 - DNA, 20 bp, Artificial Sequence
  chemically synthesized
ataatgtataatgatcaagt

SEQ ID NO: 17853 - DNA, 20 bp, Artificial Sequence
  chemically synthesized
taatgtataatgatcaagtc

SEQ ID NO: 17854 - DNA, 20 bp, Artificial Sequence
  chemically synthesized
taatgatcaagtcaggtatt

SEQ ID NO: 17855 - DNA, 20 bp, Artificial Sequence
  chemically synthesized
aatgatcaagtcaggtattt

SEQ ID NO: 17856 - DNA, 20 bp, Artificial Sequence
  chemically synthesized
atgatcaagtcaggtatttg

SEQ ID NO: 17857 - DNA, 20 bp, Artificial Sequence
  chemically synthesized
tttggggtattcatcacctc

SEQ ID NO: 17858 - DNA, 20 bp, Artificial Sequence
  chemically synthesized
tatttatcgtttctatgtgt

SEQ ID NO: 17859 - DNA, 20 bp, Artificial Sequence
  chemically synthesized
atttatcgtttctatgtgtt

SEQ ID NO: 17860 - DNA, 20 bp, Artificial Sequence
  chemically synthesized
ctatgtgttaggaacatttc

SEQ ID NO: 17861 - DNA, 20 bp, Artificial Sequence
  chemically synthesized
cctactttgctattgaacat

SEQ ID NO: 17862 - DNA, 20 bp, Artificial Sequence
  chemically synthesized
tacacacctttctctacctc

SEQ ID NO: 17863 - DNA, 20 bp, Artificial Sequence
  chemically synthesized
ctacatgatattaacttttt

SEQ ID NO: 17864 - DNA, 20 bp, Artificial Sequence
  chemically synthesized
cttttttagctcccacatat

SEQ ID NO: 17865 - DNA, 20 bp, Artificial Sequence
  chemically synthesized
tttagctcccacatatcagt

SEQ ID NO: 17866 - DNA, 20 bp, Artificial Sequence
  chemically synthesized
aaaatttgtctttctatgcc

SEQ ID NO: 17867 - DNA, 20 bp, Artificial Sequence
  chemically synthesized
tcgtttaacataatgacttc

SEQ ID NO: 17868 - DNA, 20 bp, Artificial Sequence
  chemically synthesized
gaaatgattttatatttgta

SEQ ID NO: 17869 - DNA, 20 bp, Artificial Sequence
  chemically synthesized
tttcttcattcatccattga

SEQ ID NO: 17870 - DNA, 20 bp, Artificial Sequence
  chemically synthesized
ttcatccattgatggacact

SEQ ID NO: 17871 - DNA, 20 bp, Artificial Sequence
  chemically synthesized
tcatccattgatggacactt

SEQ ID NO: 17872 - DNA, 20 bp, Artificial Sequence
  chemically synthesized
gtgaatcgtgctgcaataaa

SEQ ID NO: 17873 - DNA, 20 bp, Artificial Sequence
  chemically synthesized
tcgtgctgcaataaacagtg

SEQ ID NO: 17874 - DNA, 20 bp, Artificial Sequence
  chemically synthesized
tgcaataaacagtgtggtac

SEQ ID NO: 17875 - DNA, 20 bp, Artificial Sequence
  chemically synthesized
tattctgaattcttttcctt

SEQ ID NO: 17876 - DNA, 20 bp, Artificial Sequence
  chemically synthesized
ttttcctttggataaatacc

SEQ ID NO: 17877 - DNA, 20 bp, Artificial Sequence
  chemically synthesized
ttggataaatacccagtaat

SEQ ID NO: 17878 - DNA, 20 bp, Artificial Sequence
  chemically synthesized
atacccagtaataagattgc

SEQ ID NO: 17879 - DNA, 20 bp, Artificial Sequence
  chemically synthesized
aagattgctggatcttatga

SEQ ID NO: 17880 - DNA, 20 bp, Artificial Sequence
  chemically synthesized
tcttatgatagttcaatttt

SEQ ID NO: 17881 - DNA, 20 bp, Artificial Sequence
  chemically synthesized
tagttcaatttttagctttt

SEQ ID NO: 17882 - DNA, 20 bp, Artificial Sequence
  chemically synthesized
aatctacatattgttttcca

SEQ ID NO: 17883 - DNA, 20 bp, Artificial Sequence
  chemically synthesized
ctacatattgttttccatag

SEQ ID NO: 17884 - DNA, 20 bp, Artificial Sequence
  chemically synthesized
ctaatttgcatgcttaccaa

SEQ ID NO: 17885 - DNA, 20 bp, Artificial Sequence
  chemically synthesized
tgcttaccaatagtgcctac

SEQ ID NO: 17886 - DNA, 20 bp, Artificial Sequence
  chemically synthesized
cttttccttcacatccttgc

SEQ ID NO: 17887 - DNA, 20 bp, Artificial Sequence
  chemically synthesized
taaatcatgatgattctaac

SEQ ID NO: 17888 - DNA, 20 bp, Artificial Sequence
  chemically synthesized
atgatgattctaactggcat

SEQ ID NO: 17889 - DNA, 20 bp, Artificial Sequence
  chemically synthesized
cataagatgatatctcattg

SEQ ID NO: 17890 - DNA, 20 bp, Artificial Sequence
  chemically synthesized
atttgcatttctctgatgat

SEQ ID NO: 17891 - DNA, 20 bp, Artificial Sequence
  chemically synthesized
ctctgatgattagtaatgtt

SEQ ID NO: 17892 - DNA, 20 bp, Artificial Sequence
  chemically synthesized
tcctttgccaattttttaat

SEQ ID NO: 17893 - DNA, 20 bp, Artificial Sequence
  chemically synthesized
ttatttgtttttccactgtt

SEQ ID NO: 17894 - DNA, 20 bp, Artificial Sequence
  chemically synthesized
tttccactgttgagttgttt

SEQ ID NO: 17895 - DNA, 20 bp, Artificial Sequence
  chemically synthesized
tttgagtttcttatatattc

SEQ ID NO: 17896 - DNA, 20 bp, Artificial Sequence
  chemically synthesized
tgagtttcttatatattctg

SEQ ID NO: 17897 - DNA, 20 bp, Artificial Sequence
  chemically synthesized
aaatattttctcgcattcaa

SEQ ID NO: 17898 - DNA, 20 bp, Artificial Sequence
  chemically synthesized
tgattgtttcctttactgtg

SEQ ID NO: 17899 - DNA, 20 bp, Artificial Sequence
  chemically synthesized
tttactgtgcagatgtattt

SEQ ID NO: 17900 - DNA, 20 bp, Artificial Sequence
  chemically synthesized
agatgtattttagcttaata

SEQ ID NO: 17901 - DNA, 20 bp, Artificial Sequence
  chemically synthesized
cttttgttgcctgtgctttt

SEQ ID NO: 17902 - DNA, 20 bp, Artificial Sequence
  chemically synthesized
ttttgttgcctgtgcttttg

SEQ ID NO: 17903 - DNA, 20 bp, Artificial Sequence
  chemically synthesized
tgcctgtgcttttgaggtct

SEQ ID NO: 17904 - DNA, 20 bp, Artificial Sequence
  chemically synthesized
ggccataaaatctttgccca

SEQ ID NO: 17905 - DNA, 20 bp, Artificial Sequence
  chemically synthesized
ttgcccaaagccatgtcttg

SEQ ID NO: 17906 - DNA, 20 bp, Artificial Sequence
  chemically synthesized
gtctcccttatgttttcttt

SEQ ID NO: 17907 - DNA, 20 bp, Artificial Sequence
  chemically synthesized
tcccttatgttttcttttag

SEQ ID NO: 17908 - DNA, 20 bp, Artificial Sequence
  chemically synthesized
gttttcttttagtagtttta

SEQ ID NO: 17909 - DNA, 20 bp, Artificial Sequence
  chemically synthesized
tttagtagttttatagtttt

SEQ ID NO: 17910 - DNA, 20 bp, Artificial Sequence
  chemically synthesized
tagttttaagttttatattt

SEQ ID NO: 17911 - DNA, 20 bp, Artificial Sequence
  chemically synthesized
ttaagtctttaatccatctt

SEQ ID NO: 17912 - DNA, 20 bp, Artificial Sequence
  chemically synthesized
aagtctttaatccatcttga

SEQ ID NO: 17913 - DNA, 20 bp, Artificial Sequence
  chemically synthesized
tcttgagagtacgttttata

SEQ ID NO: 17914 - DNA, 20 bp, Artificial Sequence
  chemically synthesized
acgttttatatggcaataaa

SEQ ID NO: 17915 - DNA, 20 bp, Artificial Sequence
  chemically synthesized
cgttttatatggcaataaat

SEQ ID NO: 17916 - DNA, 20 bp, Artificial Sequence
  chemically synthesized
gttttatatggcaataaata

SEQ ID NO: 17917 - DNA, 20 bp, Artificial Sequence
  chemically synthesized
ttttatatggcaataaatag

SEQ ID NO: 17918 - DNA, 20 bp, Artificial Sequence
  chemically synthesized
gcaataaataggggttgtat

SEQ ID NO: 17919 - DNA, 20 bp, Artificial Sequence
  chemically synthesized
caataaataggggttgtatt

SEQ ID NO: 17920 - DNA, 20 bp, Artificial Sequence
  chemically synthesized
catttttgcatctattgtac

SEQ ID NO: 17921 - DNA, 20 bp, Artificial Sequence
  chemically synthesized
atttttgcatctattgtaca

SEQ ID NO: 17922 - DNA, 20 bp, Artificial Sequence
  chemically synthesized
tttttgcatctattgtacaa

SEQ ID NO: 17923 - DNA, 20 bp, Artificial Sequence
  chemically synthesized
ttttgcatctattgtacaag

SEQ ID NO: 17924 - DNA, 20 bp, Artificial Sequence
  chemically synthesized
catctattgtacaaggggtt

SEQ ID NO: 17925 - DNA, 20 bp, Artificial Sequence
  chemically synthesized
tcttgatttgattctccatt

SEQ ID NO: 17926 - DNA, 20 bp, Artificial Sequence
  chemically synthesized
attctccatttggttgctgt

SEQ ID NO: 17927 - DNA, 20 bp, Artificial Sequence
  chemically synthesized
atttggttgctgttggtgta

SEQ ID NO: 17928 - DNA, 20 bp, Artificial Sequence
  chemically synthesized
tggttgctgttggtgtatag

SEQ ID NO: 17929 - DNA, 20 bp, Artificial Sequence
  chemically synthesized
gttgctgttggtgtatagaa

SEQ ID NO: 17930 - DNA, 20 bp, Artificial Sequence
  chemically synthesized
gtgtgcattcatcttgtatc

SEQ ID NO: 17931 - DNA, 20 bp, Artificial Sequence
  chemically synthesized
actttgctgaattattttat

SEQ ID NO: 17932 - DNA, 20 bp, Artificial Sequence
  chemically synthesized
ctgaattattttatcagttc

SEQ ID NO: 17933 - DNA, 20 bp, Artificial Sequence
  chemically synthesized
tgaattattttatcagttct

SEQ ID NO: 17934 - DNA, 20 bp, Artificial Sequence
  chemically synthesized
aattattttatcagttctag

SEQ ID NO: 17935 - DNA, 20 bp, Artificial Sequence
  chemically synthesized
tatcagttctaggagctttc

SEQ ID NO: 17936 - DNA, 20 bp, Artificial Sequence
  chemically synthesized
tcagttctaggagctttctg

SEQ ID NO: 17937 - DNA, 20 bp, Artificial Sequence
  chemically synthesized
cagttctaggagctttctgg

SEQ ID NO: 17938 - DNA, 20 bp, Artificial Sequence
  chemically synthesized
gttctaggagctttctggag

SEQ ID NO: 17939 - DNA, 20 bp, Artificial Sequence
  chemically synthesized
gagctttctggaggagtctt

SEQ ID NO: 17940 - DNA, 20 bp, Artificial Sequence
  chemically synthesized
agctttctggaggagtcttt

SEQ ID NO: 17941 - DNA, 20 bp, Artificial Sequence
  chemically synthesized
gctttctggaggagtcttta

SEQ ID NO: 17942 - DNA, 20 bp, Artificial Sequence
  chemically synthesized
gaggagtctttagggtttta

SEQ ID NO: 17943 - DNA, 20 bp, Artificial Sequence
  chemically synthesized
aggagtctttagggttttaa

SEQ ID NO: 17944 - DNA, 20 bp, Artificial Sequence
  chemically synthesized
aaggtaaatgatcatatcat

SEQ ID NO: 17945 - DNA, 20 bp, Artificial Sequence
  chemically synthesized
atgatcatatcatcagcaaa

SEQ ID NO: 17946 - DNA, 20 bp, Artificial Sequence
  chemically synthesized
atatcatcagcaaacagtga

SEQ ID NO: 17947 - DNA, 20 bp, Artificial Sequence
  chemically synthesized
tttgttttgtctgattgccc

SEQ ID NO: 17948 - DNA, 20 bp, Artificial Sequence
  chemically synthesized
ttttgtctgattgccctggc

SEQ ID NO: 17949 - DNA, 20 bp, Artificial Sequence
  chemically synthesized
tttgtctgattgccctggct

SEQ ID NO: 17950 - DNA, 20 bp, Artificial Sequence
  chemically synthesized
attgccctggctaggacttc

SEQ ID NO: 17951 - DNA, 20 bp, Artificial Sequence
  chemically synthesized
ggacttccagtactatgttg

SEQ ID NO: 17952 - DNA, 20 bp, Artificial Sequence
  chemically synthesized
acttccagtactatgttgaa

SEQ ID NO: 17953 - DNA, 20 bp, Artificial Sequence
  chemically synthesized
cttccagtactatgttgaag

SEQ ID NO: 17954 - DNA, 20 bp, Artificial Sequence
  chemically synthesized
tccagtactatgttgaagag

SEQ ID NO: 17955 - DNA, 20 bp, Artificial Sequence
  chemically synthesized
agtactatgttgaagaggag

SEQ ID NO: 17956 - DNA, 20 bp, Artificial Sequence
  chemically synthesized
ctatgttgaagaggagtggt

SEQ ID NO: 17957 - DNA, 20 bp, Artificial Sequence
  chemically synthesized
atgttgaagaggagtggtga

SEQ ID NO: 17958 - DNA, 20 bp, Artificial Sequence
  chemically synthesized
ttgaagaggagtggtgagag

SEQ ID NO: 17959 - DNA, 20 bp, Artificial Sequence
  chemically synthesized
tgaagaggagtggtgagagt

SEQ ID NO: 17960 - DNA, 20 bp, Artificial Sequence
  chemically synthesized
tgggcatccttgtcttgttc

SEQ ID NO: 17961 - DNA, 20 bp, Artificial Sequence
  chemically synthesized
ccttgtcttgttccagttct

SEQ ID NO: 17962 - DNA, 20 bp, Artificial Sequence
  chemically synthesized
ttgtcttgttccagttctca

SEQ ID NO: 17963 - DNA, 20 bp, Artificial Sequence
  chemically synthesized
tgtcttgttccagttctcag

SEQ ID NO: 17964 - DNA, 20 bp, Artificial Sequence
  chemically synthesized
gtcttgttccagttctcaga

SEQ ID NO: 17965 - DNA, 20 bp, Artificial Sequence
  chemically synthesized
ttccccattcaatattatgt

SEQ ID NO: 17966 - DNA, 20 bp, Artificial Sequence
  chemically synthesized
attcaatattatgttggctg

SEQ ID NO: 17967 - DNA, 20 bp, Artificial Sequence
  chemically synthesized
ttcaatattatgttggctgt

SEQ ID NO: 17968 - DNA, 20 bp, Artificial Sequence
  chemically synthesized
tgttggctgtgggtttgtca

SEQ ID NO: 17969 - DNA, 20 bp, Artificial Sequence
  chemically synthesized
ggctgtgggtttgtcacaga

SEQ ID NO: 17970 - DNA, 20 bp, Artificial Sequence
  chemically synthesized
cagatggcttttattacact

SEQ ID NO: 17971 - DNA, 20 bp, Artificial Sequence
  chemically synthesized
agatggcttttattacactg

SEQ ID NO: 17972 - DNA, 20 bp, Artificial Sequence
  chemically synthesized
tcttgtatgctgattttgct

SEQ ID NO: 17973 - DNA, 20 bp, Artificial Sequence
  chemically synthesized
ttttaatcataaatgtatgc

SEQ ID NO: 17974 - DNA, 20 bp, Artificial Sequence
  chemically synthesized
atgctttttctgcatctatt

SEQ ID NO: 17975 - DNA, 20 bp, Artificial Sequence
  chemically synthesized
tgtttttaaatctgtttatg

SEQ ID NO: 17976 - DNA, 20 bp, Artificial Sequence
  chemically synthesized
gtatcacacttattgacttg

SEQ ID NO: 17977 - DNA, 20 bp, Artificial Sequence
  chemically synthesized
tcaaaccaaccctgcatccc

SEQ ID NO: 17978 - DNA, 20 bp, Artificial Sequence
  chemically synthesized
ccaaccctgcatccctggca

SEQ ID NO: 17979 - DNA, 20 bp, Artificial Sequence
  chemically synthesized
gcatggaacctgcttgatca

SEQ ID NO: 17980 - DNA, 20 bp, Artificial Sequence
  chemically synthesized
tggaacctgcttgatcatgg

SEQ ID NO: 17981 - DNA, 20 bp, Artificial Sequence
  chemically synthesized
ttttgttatgttgttgaatt

SEQ ID NO: 17982 - DNA, 20 bp, Artificial Sequence
  chemically synthesized
tgttgttgaatttggttatc

SEQ ID NO: 17983 - DNA, 20 bp, Artificial Sequence
  chemically synthesized
tggttatctagtattttgtt

SEQ ID NO: 17984 - DNA, 20 bp, Artificial Sequence
  chemically synthesized
ggttatctagtattttgtta

SEQ ID NO: 17985 - DNA, 20 bp, Artificial Sequence
  chemically synthesized
tagtattttgttaaggattt

SEQ ID NO: 17986 - DNA, 20 bp, Artificial Sequence
  chemically synthesized
ttttagcatctatgttcatc

SEQ ID NO: 17987 - DNA, 20 bp, Artificial Sequence
  chemically synthesized
tttagcatctatgttcatca

SEQ ID NO: 17988 - DNA, 20 bp, Artificial Sequence
  chemically synthesized
tctatgttcatcaaggctat

SEQ ID NO: 17989 - DNA, 20 bp, Artificial Sequence
  chemically synthesized
tcatcaaggctatcagtctg

SEQ ID NO: 17990 - DNA, 20 bp, Artificial Sequence
  chemically synthesized
cagtctgtagttttcttttt

SEQ ID NO: 17991 - DNA, 20 bp, Artificial Sequence
  chemically synthesized
tttttggttatgtccttccc

SEQ ID NO: 17992 - DNA, 20 bp, Artificial Sequence
  chemically synthesized
gttatgtccttccctggttt

SEQ ID NO: 17993 - DNA, 20 bp, Artificial Sequence
  chemically synthesized
ccctggttttggtgtgatgc

SEQ ID NO: 17994 - DNA, 20 bp, Artificial Sequence
  chemically synthesized
ttggtgtgatgctggcttca

SEQ ID NO: 17995 - DNA, 20 bp, Artificial Sequence
  chemically synthesized
gctggcttcatagaatgaat

SEQ ID NO: 17996 - DNA, 20 bp, Artificial Sequence
  chemically synthesized
ctggcttcatagaatgaatt

SEQ ID NO: 17997 - DNA, 20 bp, Artificial Sequence
  chemically synthesized
tggcttcatagaatgaatta

SEQ ID NO: 17998 - DNA, 20 bp, Artificial Sequence
  chemically synthesized
cttcatagaatgaattaggg

SEQ ID NO: 17999 - DNA, 20 bp, Artificial Sequence
  chemically synthesized
ttcatagaatgaattagggc

SEQ ID NO: 18000 - DNA, 20 bp, Artificial Sequence
  chemically synthesized
ttccttctttatctgtcttg

SEQ ID NO: 18001 - DNA, 20 bp, Artificial Sequence
  chemically synthesized
tctttatctgtcttgtagaa

SEQ ID NO: 18002 - DNA, 20 bp, Artificial Sequence
  chemically synthesized
tcttgtagaatagtgtcaaa

SEQ ID NO: 18003 - DNA, 20 bp, Artificial Sequence
  chemically synthesized
gtagaatagtgtcaaaaaga

SEQ ID NO: 18004 - DNA, 20 bp, Artificial Sequence
  chemically synthesized
tagaatagtgtcaaaaagat

SEQ ID NO: 18005 - DNA, 20 bp, Artificial Sequence
  chemically synthesized
agaatagtgtcaaaaagatg

SEQ ID NO: 18006 - DNA, 20 bp, Artificial Sequence
  chemically synthesized
ccaattcctctttgaatgtc

SEQ ID NO: 18007 - DNA, 20 bp, Artificial Sequence
  chemically synthesized
attcctctttgaatgtctag

SEQ ID NO: 18008 - DNA, 20 bp, Artificial Sequence
  chemically synthesized
aattctgttgtgaatccatc

SEQ ID NO: 18009 - DNA, 20 bp, Artificial Sequence
  chemically synthesized
tctggtcctgaacttttttt

SEQ ID NO: 18010 - DNA, 20 bp, Artificial Sequence
  chemically synthesized
gtcctgaacttttttttggt

SEQ ID NO: 18011 - DNA, 20 bp, Artificial Sequence
  chemically synthesized
taaatctcactgcttgttat

SEQ ID NO: 18012 - DNA, 20 bp, Artificial Sequence
  chemically synthesized
actgcttgttattggtctgt

SEQ ID NO: 18013 - DNA, 20 bp, Artificial Sequence
  chemically synthesized
ggtctgttagtaaatttatt

SEQ ID NO: 18014 - DNA, 20 bp, Artificial Sequence
  chemically synthesized
gtctgttagtaaatttattg

SEQ ID NO: 18015 - DNA, 20 bp, Artificial Sequence
  chemically synthesized
atttattgaggctcatttca

SEQ ID NO: 18016 - DNA, 20 bp, Artificial Sequence
  chemically synthesized
tcatttcatggcctatcata

SEQ ID NO: 18017 - DNA, 20 bp, Artificial Sequence
  chemically synthesized
gcctatcatatggtctacct

SEQ ID NO: 18018 - DNA, 20 bp, Artificial Sequence
  chemically synthesized
ctatcatatggtctaccttg

SEQ ID NO: 18019 - DNA, 20 bp, Artificial Sequence
  chemically synthesized
aatttccacgcgctgttgaa

SEQ ID NO: 18020 - DNA, 20 bp, Artificial Sequence
  chemically synthesized
tgaatagaatgtgtgttctg

SEQ ID NO: 18021 - DNA, 20 bp, Artificial Sequence
  chemically synthesized
aatgtgtgttctgtggttat

SEQ ID NO: 18022 - DNA, 20 bp, Artificial Sequence
  chemically synthesized
atgttctgtatataactgtt

SEQ ID NO: 18023 - DNA, 20 bp, Artificial Sequence
  chemically synthesized
ctgttaagtccatttgttct

SEQ ID NO: 18024 - DNA, 20 bp, Artificial Sequence
  chemically synthesized
tgttaagtccatttgttcta

SEQ ID NO: 18025 - DNA, 20 bp, Artificial Sequence
  chemically synthesized
ttctgtcttgatgaactgtc

SEQ ID NO: 18026 - DNA, 20 bp, Artificial Sequence
  chemically synthesized
actgtctagtgctgtcaatg

SEQ ID NO: 18027 - DNA, 20 bp, Artificial Sequence
  chemically synthesized
gtgctgtcaatgaagtattg

SEQ ID NO: 18028 - DNA, 20 bp, Artificial Sequence
  chemically synthesized
ttgctgtctatctcatttct

SEQ ID NO: 18029 - DNA, 20 bp, Artificial Sequence
  chemically synthesized
tgctgtctatctcatttctt

SEQ ID NO: 18030 - DNA, 20 bp, Artificial Sequence
  chemically synthesized
atctcatttcttaggtctat

SEQ ID NO: 18031 - DNA, 20 bp, Artificial Sequence
  chemically synthesized
tagtaattgttctataaatt

SEQ ID NO: 18032 - DNA, 20 bp, Artificial Sequence
  chemically synthesized
agtaattgttctataaattt

SEQ ID NO: 18033 - DNA, 20 bp, Artificial Sequence
  chemically synthesized
taattgttctataaatttgg

SEQ ID NO: 18034 - DNA, 20 bp, Artificial Sequence
  chemically synthesized
ttctataaatttgggagctc

SEQ ID NO: 18035 - DNA, 20 bp, Artificial Sequence
  chemically synthesized
aaatttgggagctccagtgt

SEQ ID NO: 18036 - DNA, 20 bp, Artificial Sequence
  chemically synthesized
aatttgggagctccagtgtt

SEQ ID NO: 18037 - DNA, 20 bp, Artificial Sequence
  chemically synthesized
tgttaggtgcatatatgttt

SEQ ID NO: 18038 - DNA, 20 bp, Artificial Sequence
  chemically synthesized
agattgtgatattttcctgt

SEQ ID NO: 18039 - DNA, 20 bp, Artificial Sequence
  chemically synthesized
gtgatattttcctgttggac

SEQ ID NO: 18040 - DNA, 20 bp, Artificial Sequence
  chemically synthesized
tgatattttcctgttggaca

SEQ ID NO: 18041 - DNA, 20 bp, Artificial Sequence
  chemically synthesized
ttttaactgctgttgcttta

SEQ ID NO: 18042 - DNA, 20 bp, Artificial Sequence
  chemically synthesized
ttgttttgcctactcacttt

SEQ ID NO: 18043 - DNA, 20 bp, Artificial Sequence
  chemically synthesized
ttttgcctactcacttttgg

SEQ ID NO: 18044 - DNA, 20 bp, Artificial Sequence
  chemically synthesized
aatacctttttcaccctttt

SEQ ID NO: 18045 - DNA, 20 bp, Artificial Sequence
  chemically synthesized
acctttttcacccttttaag

SEQ ID NO: 18046 - DNA, 20 bp, Artificial Sequence
  chemically synthesized
ctttttcacccttttaagtg

SEQ ID NO: 18047 - DNA, 20 bp, Artificial Sequence
  chemically synthesized
acccttttaagtggagcatt

SEQ ID NO: 18048 - DNA, 20 bp, Artificial Sequence
  chemically synthesized
cccttttaagtggagcattt

SEQ ID NO: 18049 - DNA, 20 bp, Artificial Sequence
  chemically synthesized
aggccatttacattcaatgt

SEQ ID NO: 18050 - DNA, 20 bp, Artificial Sequence
  chemically synthesized
atgttagtaatgtaaatgcc

SEQ ID NO: 18051 - DNA, 20 bp, Artificial Sequence
  chemically synthesized
atgtaaatgcctggctatgc

SEQ ID NO: 18052 - DNA, 20 bp, Artificial Sequence
  chemically synthesized
tgtaaatgcctggctatgcc

SEQ ID NO: 18053 - DNA, 20 bp, Artificial Sequence
  chemically synthesized
aaatgcctggctatgccagg

SEQ ID NO: 18054 - DNA, 20 bp, Artificial Sequence
  chemically synthesized
aatgcctggctatgccaggc

SEQ ID NO: 18055 - DNA, 20 bp, Artificial Sequence
  chemically synthesized
ctggctatgccaggcaggaa

SEQ ID NO: 18056 - DNA, 20 bp, Artificial Sequence
  chemically synthesized
ccaggcaggaatggcctgct

SEQ ID NO: 18057 - DNA, 20 bp, Artificial Sequence
  chemically synthesized
caggcaggaatggcctgctc

SEQ ID NO: 18058 - DNA, 20 bp, Artificial Sequence
  chemically synthesized
aggcaggaatggcctgctca

SEQ ID NO: 18059 - DNA, 20 bp, Artificial Sequence
  chemically synthesized
gaatggcctgctcagggacc

SEQ ID NO: 18060 - DNA, 20 bp, Artificial Sequence
  chemically synthesized
ggcctgctcagggacccagt

SEQ ID NO: 18061 - DNA, 20 bp, Artificial Sequence
  chemically synthesized
tcagggacccagtgagctcc

SEQ ID NO: 18062 - DNA, 20 bp, Artificial Sequence
  chemically synthesized
cagggacccagtgagctccc

SEQ ID NO: 18063 - DNA, 20 bp, Artificial Sequence
  chemically synthesized
agggacccagtgagctccca

SEQ ID NO: 18064 - DNA, 20 bp, Artificial Sequence
  chemically synthesized
ctctacacctgtattttgct

SEQ ID NO: 18065 - DNA, 20 bp, Artificial Sequence
  chemically synthesized
tgtattttgctcagctctct

SEQ ID NO: 18066 - DNA, 20 bp, Artificial Sequence
  chemically synthesized
tctctaagttaactcaactc

SEQ ID NO: 18067 - DNA, 20 bp, Artificial Sequence
  chemically synthesized
ctctaagttaactcaactcc

SEQ ID NO: 18068 - DNA, 20 bp, Artificial Sequence
  chemically synthesized
aagttaactcaactccaggt

SEQ ID NO: 18069 - DNA, 20 bp, Artificial Sequence
  chemically synthesized
agttaactcaactccaggta

SEQ ID NO: 18070 - DNA, 20 bp, Artificial Sequence
  chemically synthesized
aactcaactccaggtaaggt

SEQ ID NO: 18071 - DNA, 20 bp, Artificial Sequence
  chemically synthesized
tcagaaacttctcccacaaa

SEQ ID NO: 18072 - DNA, 20 bp, Artificial Sequence
  chemically synthesized
ttctcccacaaacagacctt

SEQ ID NO: 18073 - DNA, 20 bp, Artificial Sequence
  chemically synthesized
aaacagaccttcagtttctc

SEQ ID NO: 18074 - DNA, 20 bp, Artificial Sequence
  chemically synthesized
cagaccttcagtttctccag

SEQ ID NO: 18075 - DNA, 20 bp, Artificial Sequence
  chemically synthesized
agaccttcagtttctccagt

SEQ ID NO: 18076 - DNA, 20 bp, Artificial Sequence
  chemically synthesized
accttcagtttctccagtgg

SEQ ID NO: 18077 - DNA, 20 bp, Artificial Sequence
  chemically synthesized
ctccagtgggagtgtgtgtt

SEQ ID NO: 18078 - DNA, 20 bp, Artificial Sequence
  chemically synthesized
tccagtgggagtgtgtgttt

SEQ ID NO: 18079 - DNA, 20 bp, Artificial Sequence
  chemically synthesized
cagtgggagtgtgtgtttag

SEQ ID NO: 18080 - DNA, 20 bp, Artificial Sequence
  chemically synthesized
gtgggagtgtgtgtttagga

SEQ ID NO: 18081 - DNA, 20 bp, Artificial Sequence
  chemically synthesized
tgggagtgtgtgtttaggag

SEQ ID NO: 18082 - DNA, 20 bp, Artificial Sequence
  chemically synthesized
ggagtgtgtgtttaggagag

SEQ ID NO: 18083 - DNA, 20 bp, Artificial Sequence
  chemically synthesized
gagtgtgtgtttaggagagg

SEQ ID NO: 18084 - DNA, 20 bp, Artificial Sequence
  chemically synthesized
atctccctttcccacttccg

SEQ ID NO: 18085 - DNA, 20 bp, Artificial Sequence
  chemically synthesized
ccctttcccacttccgcagt

SEQ ID NO: 18086 - DNA, 20 bp, Artificial Sequence
  chemically synthesized
cctttcccacttccgcagtt

SEQ ID NO: 18087 - DNA, 20 bp, Artificial Sequence
  chemically synthesized
ctttcccacttccgcagttg

SEQ ID NO: 18088 - DNA, 20 bp, Artificial Sequence
  chemically synthesized
ttccgcagttggggcactca

SEQ ID NO: 18089 - DNA, 20 bp, Artificial Sequence
  chemically synthesized
gttggggcactcacagtatt

SEQ ID NO: 18090 - DNA, 20 bp, Artificial Sequence
  chemically synthesized
ttggggcactcacagtattt

SEQ ID NO: 18091 - DNA, 20 bp, Artificial Sequence
  chemically synthesized
tggggcactcacagtatttg

SEQ ID NO: 18092 - DNA, 20 bp, Artificial Sequence
  chemically synthesized
acagtatttggggtgtctcc

SEQ ID NO: 18093 - DNA, 20 bp, Artificial Sequence
  chemically synthesized
cagtatttggggtgtctcct

SEQ ID NO: 18094 - DNA, 20 bp, Artificial Sequence
  chemically synthesized
ggggtgtctcctgggtcctg

SEQ ID NO: 18095 - DNA, 20 bp, Artificial Sequence
  chemically synthesized
gggtgtctcctgggtcctgc

SEQ ID NO: 18096 - DNA, 20 bp, Artificial Sequence
  chemically synthesized
gtgtctcctgggtcctgcag

SEQ ID NO: 18097 - DNA, 20 bp, Artificial Sequence
  chemically synthesized
caggagcaatctacttcctt

SEQ ID NO: 18098 - DNA, 20 bp, Artificial Sequence
  chemically synthesized
ggagcaatctacttccttca

SEQ ID NO: 18099 - DNA, 20 bp, Artificial Sequence
  chemically synthesized
gagcaatctacttccttcag

SEQ ID NO: 18100 - DNA, 20 bp, Artificial Sequence
  chemically synthesized
agcaatctacttccttcaga

SEQ ID NO: 18101 - DNA, 20 bp, Artificial Sequence
  chemically synthesized
tacttccttcagagggtctg

SEQ ID NO: 18102 - DNA, 20 bp, Artificial Sequence
  chemically synthesized
acttccttcagagggtctgt

SEQ ID NO: 18103 - DNA, 20 bp, Artificial Sequence
  chemically synthesized
agagggtctgtgggtcctct

SEQ ID NO: 18104 - DNA, 20 bp, Artificial Sequence
  chemically synthesized
gagggtctgtgggtcctctc

SEQ ID NO: 18105 - DNA, 20 bp, Artificial Sequence
  chemically synthesized
gtgggtcctctcaggattgc

SEQ ID NO: 18106 - DNA, 20 bp, Artificial Sequence
  chemically synthesized
ggattgctggtttgttcttg

SEQ ID NO: 18107 - DNA, 20 bp, Artificial Sequence
  chemically synthesized
ttgttcttgcagtctatctg

SEQ ID NO: 18108 - DNA, 20 bp, Artificial Sequence
  chemically synthesized
gcagctaaaattcacaatgc

SEQ ID NO: 18109 - DNA, 20 bp, Artificial Sequence
  chemically synthesized
acatgctgctctgtccatct

SEQ ID NO: 18110 - DNA, 20 bp, Artificial Sequence
  chemically synthesized
gctgctctgtccatctgagt

SEQ ID NO: 18111 - DNA, 20 bp, Artificial Sequence
  chemically synthesized
tgctctgtccatctgagttg

SEQ ID NO: 18112 - DNA, 20 bp, Artificial Sequence
  chemically synthesized
tctgagttggagctgcaatc

SEQ ID NO: 18113 - DNA, 20 bp, Artificial Sequence
  chemically synthesized
ctgagttggagctgcaatct

SEQ ID NO: 18114 - DNA, 20 bp, Artificial Sequence
  chemically synthesized
aggcctacctcccatccgcc

SEQ ID NO: 18115 - DNA, 20 bp, Artificial Sequence
  chemically synthesized
ctcccatccgccaagatcct

SEQ ID NO: 18116 - DNA, 20 bp, Artificial Sequence
  chemically synthesized
ccatccgccaagatcctgag

SEQ ID NO: 18117 - DNA, 20 bp, Artificial Sequence
  chemically synthesized
ccgccaagatcctgagaagt

SEQ ID NO: 18118 - DNA, 20 bp, Artificial Sequence
  chemically synthesized
cgccaagatcctgagaagtt

SEQ ID NO: 18119 - DNA, 20 bp, Artificial Sequence
  chemically synthesized
gccaagatcctgagaagttg

SEQ ID NO: 18120 - DNA, 20 bp, Artificial Sequence
  chemically synthesized
tggggattatatttcaacat

SEQ ID NO: 18121 - DNA, 20 bp, Artificial Sequence
  chemically synthesized
ttatatttcaacatgagatt

SEQ ID NO: 18122 - DNA, 20 bp, Artificial Sequence
  chemically synthesized
atatttcaacatgagatttg

SEQ ID NO: 18123 - DNA, 20 bp, Artificial Sequence
  chemically synthesized
tatttcaacatgagatttgg

SEQ ID NO: 18124 - DNA, 20 bp, Artificial Sequence
  chemically synthesized
atttcaacatgagatttgga

SEQ ID NO: 18125 - DNA, 20 bp, Artificial Sequence
  chemically synthesized
aacaaacatccaaaccatat

SEQ ID NO: 18126 - DNA, 20 bp, Artificial Sequence
  chemically synthesized
aaacatccaaaccatatcag

SEQ ID NO: 18127 - DNA, 20 bp, Artificial Sequence
  chemically synthesized
tccaaaccatatcagcagtc

SEQ ID NO: 18128 - DNA, 20 bp, Artificial Sequence
  chemically synthesized
cagttttattcttttgcaca

SEQ ID NO: 18129 - DNA, 20 bp, Artificial Sequence
  chemically synthesized
ttttgcacatggatatccaa

SEQ ID NO: 18130 - DNA, 20 bp, Artificial Sequence
  chemically synthesized
caatggatatccaatttttt

SEQ ID NO: 18131 - DNA, 20 bp, Artificial Sequence
  chemically synthesized
cacctttgttgaaaatctgt

SEQ ID NO: 18132 - DNA, 20 bp, Artificial Sequence
  chemically synthesized
atctgttggctataaatatg

SEQ ID NO: 18133 - DNA, 20 bp, Artificial Sequence
  chemically synthesized
taaatatgtggatgcatttc

SEQ ID NO: 18134 - DNA, 20 bp, Artificial Sequence
  chemically synthesized
aaatatgtggatgcatttct

SEQ ID NO: 18135 - DNA, 20 bp, Artificial Sequence
  chemically synthesized
ggttctctattctcttccat

SEQ ID NO: 18136 - DNA, 20 bp, Artificial Sequence
  chemically synthesized
ctattctcttccattggtct

SEQ ID NO: 18137 - DNA, 20 bp, Artificial Sequence
  chemically synthesized
ctaagtgtctgttctaatgt

SEQ ID NO: 18138 - DNA, 20 bp, Artificial Sequence
  chemically synthesized
aatgtcagtatcatgctgtt

SEQ ID NO: 18139 - DNA, 20 bp, Artificial Sequence
  chemically synthesized
atgtcagtatcatgctgttt

SEQ ID NO: 18140 - DNA, 20 bp, Artificial Sequence
  chemically synthesized
tttgtaatatactttgaaat

SEQ ID NO: 18141 - DNA, 20 bp, Artificial Sequence
  chemically synthesized
ttgtaatatactttgaaatc

SEQ ID NO: 18142 - DNA, 20 bp, Artificial Sequence
  chemically synthesized
taatatactttgaaatcagg

SEQ ID NO: 18143 - DNA, 20 bp, Artificial Sequence
  chemically synthesized
atcaggtagtatgatacctc

SEQ ID NO: 18144 - DNA, 20 bp, Artificial Sequence
  chemically synthesized
ctagcattgttcttttttca

SEQ ID NO: 18145 - DNA, 20 bp, Artificial Sequence
  chemically synthesized
tagcattgttcttttttcac

SEQ ID NO: 18146 - DNA, 20 bp, Artificial Sequence
  chemically synthesized
cttttttcacaggatgactt

SEQ ID NO: 18147 - DNA, 20 bp, Artificial Sequence
  chemically synthesized
cacaggatgactttggctac

SEQ ID NO: 18148 - DNA, 20 bp, Artificial Sequence
  chemically synthesized
caggatgactttggctactg

SEQ ID NO: 18149 - DNA, 20 bp, Artificial Sequence
  chemically synthesized
ttttaatttcatacaaattt

SEQ ID NO: 18150 - DNA, 20 bp, Artificial Sequence
  chemically synthesized
atttcatacaaattttagat

SEQ ID NO: 18151 - DNA, 20 bp, Artificial Sequence
  chemically synthesized
aaatgacattgctattttga

SEQ ID NO: 18152 - DNA, 20 bp, Artificial Sequence
  chemically synthesized
tgacattgctattttgatag

SEQ ID NO: 18153 - DNA, 20 bp, Artificial Sequence
  chemically synthesized
ctattttgatagcggtcata

SEQ ID NO: 18154 - DNA, 20 bp, Artificial Sequence
  chemically synthesized
tagcggtcatatagaatctg

SEQ ID NO: 18155 - DNA, 20 bp, Artificial Sequence
  chemically synthesized
atagaatctgtagattgctt

SEQ ID NO: 18156 - DNA, 20 bp, Artificial Sequence
  chemically synthesized
tagaatctgtagattgcttt

SEQ ID NO: 18157 - DNA, 20 bp, Artificial Sequence
  chemically synthesized
aatctgtagattgctttggg

SEQ ID NO: 18158 - DNA, 20 bp, Artificial Sequence
  chemically synthesized
gtagattgctttgggtagta

SEQ ID NO: 18159 - DNA, 20 bp, Artificial Sequence
  chemically synthesized
atttttctgatccatgaaca

SEQ ID NO: 18160 - DNA, 20 bp, Artificial Sequence
  chemically synthesized
tttttctgatccatgaacat

SEQ ID NO: 18161 - DNA, 20 bp, Artificial Sequence
  chemically synthesized
gtccttttcaattcttttat

SEQ ID NO: 18162 - DNA, 20 bp, Artificial Sequence
  chemically synthesized
attcttttatcagtgttttg

SEQ ID NO: 18163 - DNA, 20 bp, Artificial Sequence
  chemically synthesized
gtgttttgtagttttccgaa

SEQ ID NO: 18164 - DNA, 20 bp, Artificial Sequence
  chemically synthesized
gttttgtagttttccgaata

SEQ ID NO: 18165 - DNA, 20 bp, Artificial Sequence
  chemically synthesized
ttttgtagttttccgaatag

SEQ ID NO: 18166 - DNA, 20 bp, Artificial Sequence
  chemically synthesized
ttttccgaatagaggttttt

SEQ ID NO: 18167 - DNA, 20 bp, Artificial Sequence
  chemically synthesized
atagaggtttttcggttcct

SEQ ID NO: 18168 - DNA, 20 bp, Artificial Sequence
  chemically synthesized
tccctaaatattttattttt

SEQ ID NO: 18169 - DNA, 20 bp, Artificial Sequence
  chemically synthesized
tattttttagctattgtaaa

SEQ ID NO: 18170 - DNA, 20 bp, Artificial Sequence
  chemically synthesized
attttttagctattgtaaat

SEQ ID NO: 18171 - DNA, 20 bp, Artificial Sequence
  chemically synthesized
tgccttcttaatttccttct

SEQ ID NO: 18172 - DNA, 20 bp, Artificial Sequence
  chemically synthesized
ttcttaatttccttctcagc

SEQ ID NO: 18173 - DNA, 20 bp, Artificial Sequence
  chemically synthesized
cttctcagctagtttattat

SEQ ID NO: 18174 - DNA, 20 bp, Artificial Sequence
  chemically synthesized
gctagtttattattggtgtg

SEQ ID NO: 18175 - DNA, 20 bp, Artificial Sequence
  chemically synthesized
actttactgaatttattttt

SEQ ID NO: 18176 - DNA, 20 bp, Artificial Sequence
  chemically synthesized
tgaatttatttttcagcgct

SEQ ID NO: 18177 - DNA, 20 bp, Artificial Sequence
  chemically synthesized
aatttatttttcagcgctaa

SEQ ID NO: 18178 - DNA, 20 bp, Artificial Sequence
  chemically synthesized
tttcagcgctaagagtgctt

SEQ ID NO: 18179 - DNA, 20 bp, Artificial Sequence
  chemically synthesized
cagcgctaagagtgctttgg

SEQ ID NO: 18180 - DNA, 20 bp, Artificial Sequence
  chemically synthesized
gcgctaagagtgctttggtg

SEQ ID NO: 18181 - DNA, 20 bp, Artificial Sequence
  chemically synthesized
agagtgctttggtggagtct

SEQ ID NO: 18182 - DNA, 20 bp, Artificial Sequence
  chemically synthesized
tggtggagtcttggtttttc

SEQ ID NO: 18183 - DNA, 20 bp, Artificial Sequence
  chemically synthesized
ggtggagtcttggtttttct

SEQ ID NO: 18184 - DNA, 20 bp, Artificial Sequence
  chemically synthesized
aggtataaaatcatgtcatc

SEQ ID NO: 18185 - DNA, 20 bp, Artificial Sequence
  chemically synthesized
ataaaatcatgtcatctgga

SEQ ID NO: 18186 - DNA, 20 bp, Artificial Sequence
  chemically synthesized
aatcatgtcatctggaaaga

SEQ ID NO: 18187 - DNA, 20 bp, Artificial Sequence
  chemically synthesized
atgtcatctggaaagatgga

SEQ ID NO: 18188 - DNA, 20 bp, Artificial Sequence
  chemically synthesized
tctttctttctctgacctga

SEQ ID NO: 18189 - DNA, 20 bp, Artificial Sequence
  chemically synthesized
tttctctgacctgaaagctg

SEQ ID NO: 18190 - DNA, 20 bp, Artificial Sequence
  chemically synthesized
tctgacctgaaagctgtggc

SEQ ID NO: 18191 - DNA, 20 bp, Artificial Sequence
  chemically synthesized
ctgacctgaaagctgtggct

SEQ ID NO: 18192 - DNA, 20 bp, Artificial Sequence
  chemically synthesized
aaagctgtggctaggacttc

SEQ ID NO: 18193 - DNA, 20 bp, Artificial Sequence
  chemically synthesized
acttccagtattatattgaa

SEQ ID NO: 18194 - DNA, 20 bp, Artificial Sequence
  chemically synthesized
cttccagtattatattgaat

SEQ ID NO: 18195 - DNA, 20 bp, Artificial Sequence
  chemically synthesized
tccagtattatattgaatag

SEQ ID NO: 18196 - DNA, 20 bp, Artificial Sequence
  chemically synthesized
attatattgaataggagtga

SEQ ID NO: 18197 - DNA, 20 bp, Artificial Sequence
  chemically synthesized
atattgaataggagtgatgg

SEQ ID NO: 18198 - DNA, 20 bp, Artificial Sequence
  chemically synthesized
ttgaataggagtgatggaag

SEQ ID NO: 18199 - DNA, 20 bp, Artificial Sequence
  chemically synthesized
tgaataggagtgatggaagt

SEQ ID NO: 18200 - DNA, 20 bp, Artificial Sequence
  chemically synthesized
tgggcatccttattttgttt

SEQ ID NO: 18201 - DNA, 20 bp, Artificial Sequence
  chemically synthesized
ccttattttgtttcagttct

SEQ ID NO: 18202 - DNA, 20 bp, Artificial Sequence
  chemically synthesized
ttattttgtttcagttctta

SEQ ID NO: 18203 - DNA, 20 bp, Artificial Sequence
  chemically synthesized
tattttgtttcagttcttag

SEQ ID NO: 18204 - DNA, 20 bp, Artificial Sequence
  chemically synthesized
ttgtttcagttcttagagga

SEQ ID NO: 18205 - DNA, 20 bp, Artificial Sequence
  chemically synthesized
tgtttcagttcttagaggaa

SEQ ID NO: 18206 - DNA, 20 bp, Artificial Sequence
  chemically synthesized
gttcttagaggaaaggcttc

SEQ ID NO: 18207 - DNA, 20 bp, Artificial Sequence
  chemically synthesized
gcttccagcttttcccaatt

SEQ ID NO: 18208 - DNA, 20 bp, Artificial Sequence
  chemically synthesized
ttcccaattcagtatgatgt

SEQ ID NO: 18209 - DNA, 20 bp, Artificial Sequence
  chemically synthesized
attcagtatgatgttagctg

SEQ ID NO: 18210 - DNA, 20 bp, Artificial Sequence
  chemically synthesized
ttcagtatgatgttagctgt

SEQ ID NO: 18211 - DNA, 20 bp, Artificial Sequence
  chemically synthesized
tatatgacttttattatatt

SEQ ID NO: 18212 - DNA, 20 bp, Artificial Sequence
  chemically synthesized
agatatgttccttctatgat

SEQ ID NO: 18213 - DNA, 20 bp, Artificial Sequence
  chemically synthesized
gttccttctatgattggctg

SEQ ID NO: 18214 - DNA, 20 bp, Artificial Sequence
  chemically synthesized
cttctatgattggctgcaga

SEQ ID NO: 18215 - DNA, 20 bp, Artificial Sequence
  chemically synthesized
tgcagatagtttttatcatg

SEQ ID NO: 18216 - DNA, 20 bp, Artificial Sequence
  chemically synthesized
gcagatagtttttatcatga

SEQ ID NO: 18217 - DNA, 20 bp, Artificial Sequence
  chemically synthesized
atactttttctgtatctatt

SEQ ID NO: 18218 - DNA, 20 bp, Artificial Sequence
  chemically synthesized
tatctattgagatgatcata

SEQ ID NO: 18219 - DNA, 20 bp, Artificial Sequence
  chemically synthesized
ttgaactgttcttgcaaccc

SEQ ID NO: 18220 - DNA, 20 bp, Artificial Sequence
  chemically synthesized
gtataaatcccacttgatca

SEQ ID NO: 18221 - DNA, 20 bp, Artificial Sequence
  chemically synthesized
gatcatggtgtattatcttt

SEQ ID NO: 18222 - DNA, 20 bp, Artificial Sequence
  chemically synthesized
ttatcttttggatgtactgt

SEQ ID NO: 18223 - DNA, 20 bp, Artificial Sequence
  chemically synthesized
tttggatgtactgttggatt

SEQ ID NO: 18224 - DNA, 20 bp, Artificial Sequence
  chemically synthesized
tactgttggattcagtttgc

SEQ ID NO: 18225 - DNA, 20 bp, Artificial Sequence
  chemically synthesized
cagtttgctagtattttgtt

SEQ ID NO: 18226 - DNA, 20 bp, Artificial Sequence
  chemically synthesized
agtttgctagtattttgttg

SEQ ID NO: 18227 - DNA, 20 bp, Artificial Sequence
  chemically synthesized
ttttcacacctatgttccat

SEQ ID NO: 18228 - DNA, 20 bp, Artificial Sequence
  chemically synthesized
tttcacacctatgttccatc

SEQ ID NO: 18229 - DNA, 20 bp, Artificial Sequence
  chemically synthesized
ttcacacctatgttccatca

SEQ ID NO: 18230 - DNA, 20 bp, Artificial Sequence
  chemically synthesized
ccatcagggatattgacctg

SEQ ID NO: 18231 - DNA, 20 bp, Artificial Sequence
  chemically synthesized
tttttacttgcatccttgtc

SEQ ID NO: 18232 - DNA, 20 bp, Artificial Sequence
  chemically synthesized
cttgcatccttgtctggtta

SEQ ID NO: 18233 - DNA, 20 bp, Artificial Sequence
  chemically synthesized
tccttgtctggttatggaat

SEQ ID NO: 18234 - DNA, 20 bp, Artificial Sequence
  chemically synthesized
ccttgtctggttatggaatc

SEQ ID NO: 18235 - DNA, 20 bp, Artificial Sequence
  chemically synthesized
ttatggaatcaggataatac

SEQ ID NO: 18236 - DNA, 20 bp, Artificial Sequence
  chemically synthesized
aatcaggataatactggcct

SEQ ID NO: 18237 - DNA, 20 bp, Artificial Sequence
  chemically synthesized
tcaggataatactggcctca

SEQ ID NO: 18238 - DNA, 20 bp, Artificial Sequence
  chemically synthesized
taatactggcctcagagaat

SEQ ID NO: 18239 - DNA, 20 bp, Artificial Sequence
  chemically synthesized
actggcctcagagaatgagt

SEQ ID NO: 18240 - DNA, 20 bp, Artificial Sequence
  chemically synthesized
ctggcctcagagaatgagtt

SEQ ID NO: 18241 - DNA, 20 bp, Artificial Sequence
  chemically synthesized
tggcctcagagaatgagtta

SEQ ID NO: 18242 - DNA, 20 bp, Artificial Sequence
  chemically synthesized
gcctcagagaatgagttagg

SEQ ID NO: 18243 - DNA, 20 bp, Artificial Sequence
  chemically synthesized
ccttcctgtttaatttttaa

SEQ ID NO: 18244 - DNA, 20 bp, Artificial Sequence
  chemically synthesized
tttaatttttaaaagaattt

SEQ ID NO: 18245 - DNA, 20 bp, Artificial Sequence
  chemically synthesized
ttaatttttaaaagaattta

SEQ ID NO: 18246 - DNA, 20 bp, Artificial Sequence
  chemically synthesized
aatttttaaaagaatttaag

SEQ ID NO: 18247 - DNA, 20 bp, Artificial Sequence
  chemically synthesized
aagaatttaaggagacttgt

SEQ ID NO: 18248 - DNA, 20 bp, Artificial Sequence
  chemically synthesized
gacttgttagttttctttga

SEQ ID NO: 18249 - DNA, 20 bp, Artificial Sequence
  chemically synthesized
gttagttttctttgaaagtt

SEQ ID NO: 18250 - DNA, 20 bp, Artificial Sequence
  chemically synthesized
gaaagtttggtaaaatttga

SEQ ID NO: 18251 - DNA, 20 bp, Artificial Sequence
  chemically synthesized
tttggtaaaatttgacagta

SEQ ID NO: 18252 - DNA, 20 bp, Artificial Sequence
  chemically synthesized
aatttgacagtaaagccatc

SEQ ID NO: 18253 - DNA, 20 bp, Artificial Sequence
  chemically synthesized
ggtcttgaaattttcttttt

SEQ ID NO: 18254 - DNA, 20 bp, Artificial Sequence
  chemically synthesized
gtcttgaaattttctttttt

SEQ ID NO: 18255 - DNA, 20 bp, Artificial Sequence
  chemically synthesized
cttgaaattttcttttttgg

SEQ ID NO: 18256 - DNA, 20 bp, Artificial Sequence
  chemically synthesized
tcaatttcattattcattac

SEQ ID NO: 18257 - DNA, 20 bp, Artificial Sequence
  chemically synthesized
ttattcattactggtctgtt

SEQ ID NO: 18258 - DNA, 20 bp, Artificial Sequence
  chemically synthesized
tattcattactggtctgttc

SEQ ID NO: 18259 - DNA, 20 bp, Artificial Sequence
  chemically synthesized
attctttcttaattcaatct

SEQ ID NO: 18260 - DNA, 20 bp, Artificial Sequence
  chemically synthesized
ctttcttaattcaatcttgg

SEQ ID NO: 18261 - DNA, 20 bp, Artificial Sequence
  chemically synthesized
tttcttaattcaatcttggt

SEQ ID NO: 18262 - DNA, 20 bp, Artificial Sequence
  chemically synthesized
cttaattcaatcttggtagg

SEQ ID NO: 18263 - DNA, 20 bp, Artificial Sequence
  chemically synthesized
cttggtaggtggtatgtgtc

SEQ ID NO: 18264 - DNA, 20 bp, Artificial Sequence
  chemically synthesized
agaaatttattaatttcctc

SEQ ID NO: 18265 - DNA, 20 bp, Artificial Sequence
  chemically synthesized
ttaatttcctctagattttt

SEQ ID NO: 18266 - DNA, 20 bp, Artificial Sequence
  chemically synthesized
ctctagatttttcagttttt

SEQ ID NO: 18267 - DNA, 20 bp, Artificial Sequence
  chemically synthesized
tttttcagttttttagtgta

SEQ ID NO: 18268 - DNA, 20 bp, Artificial Sequence
  chemically synthesized
tagtgtatggttgttcataa

SEQ ID NO: 18269 - DNA, 20 bp, Artificial Sequence
  chemically synthesized
gataatcttttctatttctg

SEQ ID NO: 18270 - DNA, 20 bp, Artificial Sequence
  chemically synthesized
cttttctatttctgtggtat

SEQ ID NO: 18271 - DNA, 20 bp, Artificial Sequence
  chemically synthesized
atttctgattttctttattt

SEQ ID NO: 18272 - DNA, 20 bp, Artificial Sequence
  chemically synthesized
tcagtctcttctctttttct

SEQ ID NO: 18273 - DNA, 20 bp, Artificial Sequence
  chemically synthesized
tctcttctctttttcttggt

SEQ ID NO: 18274 - DNA, 20 bp, Artificial Sequence
  chemically synthesized
tctctttttcttggttagtc

SEQ ID NO: 18275 - DNA, 20 bp, Artificial Sequence
  chemically synthesized
tttttcttggttagtctagc

SEQ ID NO: 18276 - DNA, 20 bp, Artificial Sequence
  chemically synthesized
tttcttggttagtctagcta

SEQ ID NO: 18277 - DNA, 20 bp, Artificial Sequence
  chemically synthesized
ttgtttttctctatttcatt

SEQ ID NO: 18278 - DNA, 20 bp, Artificial Sequence
  chemically synthesized
cattttttctttccttctgc

SEQ ID NO: 18279 - DNA, 20 bp, Artificial Sequence
  chemically synthesized
ttctttccttctgctagttt

SEQ ID NO: 18280 - DNA, 20 bp, Artificial Sequence
  chemically synthesized
tctttccttctgctagtttt

SEQ ID NO: 18281 - DNA, 20 bp, Artificial Sequence
  chemically synthesized
gggttttgttcttgcttttc

SEQ ID NO: 18282 - DNA, 20 bp, Artificial Sequence
  chemically synthesized
tcttgcttttctagcttgtt

SEQ ID NO: 18283 - DNA, 20 bp, Artificial Sequence
  chemically synthesized
cttgcttttctagcttgttg

SEQ ID NO: 18284 - DNA, 20 bp, Artificial Sequence
  chemically synthesized
agcttgttgaggtacatgat

SEQ ID NO: 18285 - DNA, 20 bp, Artificial Sequence
  chemically synthesized
tctttctatgtttttaattt

SEQ ID NO: 18286 - DNA, 20 bp, Artificial Sequence
  chemically synthesized
taatttaagtgtttattgat

SEQ ID NO: 18287 - DNA, 20 bp, Artificial Sequence
  chemically synthesized
ttattgataagcttctctct

SEQ ID NO: 18288 - DNA, 20 bp, Artificial Sequence
  chemically synthesized
actgcttttgctgtatccca

SEQ ID NO: 18289 - DNA, 20 bp, Artificial Sequence
  chemically synthesized
ttcttgacataacgttcatt

SEQ ID NO: 18290 - DNA, 20 bp, Artificial Sequence
  chemically synthesized
tcttgacataacgttcattc

SEQ ID NO: 18291 - DNA, 20 bp, Artificial Sequence
  chemically synthesized
ttgacataacgttcattcag

SEQ ID NO: 18292 - DNA, 20 bp, Artificial Sequence
  chemically synthesized
ttaatttccatgtatttgta

SEQ ID NO: 18293 - DNA, 20 bp, Artificial Sequence
  chemically synthesized
taatttccatgtatttgtat

SEQ ID NO: 18294 - DNA, 20 bp, Artificial Sequence
  chemically synthesized
atgtatttgtataggtttta

SEQ ID NO: 18295 - DNA, 20 bp, Artificial Sequence
  chemically synthesized
tttttcttgttattgatttc

SEQ ID NO: 18296 - DNA, 20 bp, Artificial Sequence
  chemically synthesized
tttctagttttattccattg

SEQ ID NO: 18297 - DNA, 20 bp, Artificial Sequence
  chemically synthesized
gttttattccattgtggtct

SEQ ID NO: 18298 - DNA, 20 bp, Artificial Sequence
  chemically synthesized
ttattccattgtggtctgag

SEQ ID NO: 18299 - DNA, 20 bp, Artificial Sequence
  chemically synthesized
tgatttcaaatatttcaaat

SEQ ID NO: 18300 - DNA, 20 bp, Artificial Sequence
  chemically synthesized
tcaaatatttcaaattagtt

SEQ ID NO: 18301 - DNA, 20 bp, Artificial Sequence
  chemically synthesized
ttcttttgtgttctaacata

SEQ ID NO: 18302 - DNA, 20 bp, Artificial Sequence
  chemically synthesized
ttctaacatatggtgtatcc

SEQ ID NO: 18303 - DNA, 20 bp, Artificial Sequence
  chemically synthesized
tctaacatatggtgtatcct

SEQ ID NO: 18304 - DNA, 20 bp, Artificial Sequence
  chemically synthesized
ctaacatatggtgtatcctg

SEQ ID NO: 18305 - DNA, 20 bp, Artificial Sequence
  chemically synthesized
ggaatgcgtcatgtgctgat

SEQ ID NO: 18306 - DNA, 20 bp, Artificial Sequence
  chemically synthesized
gatgagataaatatattctg

SEQ ID NO: 18307 - DNA, 20 bp, Artificial Sequence
  chemically synthesized
taaatatattctgtagctgt

SEQ ID NO: 18308 - DNA, 20 bp, Artificial Sequence
  chemically synthesized
atgaaatattgtgtaaatgt

SEQ ID NO: 18309 - DNA, 20 bp, Artificial Sequence
  chemically synthesized
gtgtaaatgttagatccatt

SEQ ID NO: 18310 - DNA, 20 bp, Artificial Sequence
  chemically synthesized
tgttagatccatttggtcta

SEQ ID NO: 18311 - DNA, 20 bp, Artificial Sequence
  chemically synthesized
gatccatttggtctaaagtc

SEQ ID NO: 18312 - DNA, 20 bp, Artificial Sequence
  chemically synthesized
ttctttgttaattttctgtc

SEQ ID NO: 18313 - DNA, 20 bp, Artificial Sequence
  chemically synthesized
tagatgatctatctgatgct

SEQ ID NO: 18314 - DNA, 20 bp, Artificial Sequence
  chemically synthesized
gatctatctgatgctgagat

SEQ ID NO: 18315 - DNA, 20 bp, Artificial Sequence
  chemically synthesized
atccccaactattattgtat

SEQ ID NO: 18316 - DNA, 20 bp, Artificial Sequence
  chemically synthesized
taacatttgctttacatatc

SEQ ID NO: 18317 - DNA, 20 bp, Artificial Sequence
  chemically synthesized
ctttacatatctggatgctc

SEQ ID NO: 18318 - DNA, 20 bp, Artificial Sequence
  chemically synthesized
tatctggatgctctggtgtt

SEQ ID NO: 18319 - DNA, 20 bp, Artificial Sequence
  chemically synthesized
tggtgttgagtgtgaatgtt

SEQ ID NO: 18320 - DNA, 20 bp, Artificial Sequence
  chemically synthesized
atgtaatgacttttgtctct

SEQ ID NO: 18321 - DNA, 20 bp, Artificial Sequence
  chemically synthesized
ctcttagtgttttttattta

SEQ ID NO: 18322 - DNA, 20 bp, Artificial Sequence
  chemically synthesized
aaagtcaattttatctgtta

SEQ ID NO: 18323 - DNA, 20 bp, Artificial Sequence
  chemically synthesized
aagtcaattttatctgttat

SEQ ID NO: 18324 - DNA, 20 bp, Artificial Sequence
  chemically synthesized
taactacttttgctcatttt

SEQ ID NO: 18325 - DNA, 20 bp, Artificial Sequence
  chemically synthesized
atttttggtttctctttgta

SEQ ID NO: 18326 - DNA, 20 bp, Artificial Sequence
  chemically synthesized
tttggtttctctttgtatgg

SEQ ID NO: 18327 - DNA, 20 bp, Artificial Sequence
  chemically synthesized
atctttcatctttttacttt

SEQ ID NO: 18328 - DNA, 20 bp, Artificial Sequence
  chemically synthesized
cagtctatatttatctttac

SEQ ID NO: 18329 - DNA, 20 bp, Artificial Sequence
  chemically synthesized
ctatatttatctttacaagt

SEQ ID NO: 18330 - DNA, 20 bp, Artificial Sequence
  chemically synthesized
tttatctttacaagtgagat

SEQ ID NO: 18331 - DNA, 20 bp, Artificial Sequence
  chemically synthesized
caagtgagataagtttctta

SEQ ID NO: 18332 - DNA, 20 bp, Artificial Sequence
  chemically synthesized
aagtgagataagtttcttat

SEQ ID NO: 18333 - DNA, 20 bp, Artificial Sequence
  chemically synthesized
tgagataagtttcttatagg

SEQ ID NO: 18334 - DNA, 20 bp, Artificial Sequence
  chemically synthesized
tcttataggcagcttacaac

SEQ ID NO: 18335 - DNA, 20 bp, Artificial Sequence
  chemically synthesized
cttataggcagcttacaact

SEQ ID NO: 18336 - DNA, 20 bp, Artificial Sequence
  chemically synthesized
atttttgttttaaatctatt

SEQ ID NO: 18337 - DNA, 20 bp, Artificial Sequence
  chemically synthesized
ttgttttaaatctatttagc

SEQ ID NO: 18338 - DNA, 20 bp, Artificial Sequence
  chemically synthesized
ttagccagtctatatctttc

SEQ ID NO: 18339 - DNA, 20 bp, Artificial Sequence
  chemically synthesized
aatttaatccatttacatgc

SEQ ID NO: 18340 - DNA, 20 bp, Artificial Sequence
  chemically synthesized
atttaatccatttacatgca

SEQ ID NO: 18341 - DNA, 20 bp, Artificial Sequence
  chemically synthesized
caaggctattattgacatgt

SEQ ID NO: 18342 - DNA, 20 bp, Artificial Sequence
  chemically synthesized
aggctattattgacatgtga

SEQ ID NO: 18343 - DNA, 20 bp, Artificial Sequence
  chemically synthesized
ccattttgttaattgattcc

SEQ ID NO: 18344 - DNA, 20 bp, Artificial Sequence
  chemically synthesized
tggttgttttgttttttttt

SEQ ID NO: 18345 - DNA, 20 bp, Artificial Sequence
  chemically synthesized
tttcttattatttatgattg

SEQ ID NO: 18346 - DNA, 20 bp, Artificial Sequence
  chemically synthesized
tattatttatgattgtggtt

SEQ ID NO: 18347 - DNA, 20 bp, Artificial Sequence
  chemically synthesized
tgtggtttggtgattttctg

SEQ ID NO: 18348 - DNA, 20 bp, Artificial Sequence
  chemically synthesized
ggtttggtgattttctgtag

SEQ ID NO: 18349 - DNA, 20 bp, Artificial Sequence
  chemically synthesized
tttctgtagtggtaacgttt

SEQ ID NO: 18350 - DNA, 20 bp, Artificial Sequence
  chemically synthesized
ttatttgtgttttgctctac

SEQ ID NO: 18351 - DNA, 20 bp, Artificial Sequence
  chemically synthesized
ttgtgttttgctctaccagt

SEQ ID NO: 18352 - DNA, 20 bp, Artificial Sequence
  chemically synthesized
acctttgtgtgtcttcataa

SEQ ID NO: 18353 - DNA, 20 bp, Artificial Sequence
  chemically synthesized
tttgtgtgtcttcataatgg

SEQ ID NO: 18354 - DNA, 20 bp, Artificial Sequence
  chemically synthesized
tgtcctgtcactttcatgtg

SEQ ID NO: 18355 - DNA, 20 bp, Artificial Sequence
  chemically synthesized
gtcctgtcactttcatgtgt

SEQ ID NO: 18356 - DNA, 20 bp, Artificial Sequence
  chemically synthesized
tcccttaaatatttcttgta

SEQ ID NO: 18357 - DNA, 20 bp, Artificial Sequence
  chemically synthesized
ttaaatatttcttgtaaagc

SEQ ID NO: 18358 - DNA, 20 bp, Artificial Sequence
  chemically synthesized
tatttcttgtaaagccagtc

SEQ ID NO: 18359 - DNA, 20 bp, Artificial Sequence
  chemically synthesized
ttgtaaagccagtctagtga

SEQ ID NO: 18360 - DNA, 20 bp, Artificial Sequence
  chemically synthesized
tccttcaaatttttcttgcc

SEQ ID NO: 18361 - DNA, 20 bp, Artificial Sequence
  chemically synthesized
caaatttttcttgcccagaa

SEQ ID NO: 18362 - DNA, 20 bp, Artificial Sequence
  chemically synthesized
ttatttatccttcatttttg

SEQ ID NO: 18363 - DNA, 20 bp, Artificial Sequence
  chemically synthesized
tttttgaagaacaatgttgc

SEQ ID NO: 18364 - DNA, 20 bp, Artificial Sequence
  chemically synthesized
ttttgaagaacaatgttgct

SEQ ID NO: 18365 - DNA, 20 bp, Artificial Sequence
  chemically synthesized
gttgctgggtataacatcct

SEQ ID NO: 18366 - DNA, 20 bp, Artificial Sequence
  chemically synthesized
tatatcatcccatcttctcc

SEQ ID NO: 18367 - DNA, 20 bp, Artificial Sequence
  chemically synthesized
cccatcttctcctggcctgt

SEQ ID NO: 18368 - DNA, 20 bp, Artificial Sequence
  chemically synthesized
ccatcttctcctggcctgtg

SEQ ID NO: 18369 - DNA, 20 bp, Artificial Sequence
  chemically synthesized
tggcctgtgaggtttctgct

SEQ ID NO: 18370 - DNA, 20 bp, Artificial Sequence
  chemically synthesized
ctgttaatctgttaatcttg

SEQ ID NO: 18371 - DNA, 20 bp, Artificial Sequence
  chemically synthesized
ttaatctgttaatcttgtgg

SEQ ID NO: 18372 - DNA, 20 bp, Artificial Sequence
  chemically synthesized
tcttgtggaagttcccttat

SEQ ID NO: 18373 - DNA, 20 bp, Artificial Sequence
  chemically synthesized
gaagttcccttataagtgac

SEQ ID NO: 18374 - DNA, 20 bp, Artificial Sequence
  chemically synthesized
agacattttgcttgctgttt

SEQ ID NO: 18375 - DNA, 20 bp, Artificial Sequence
  chemically synthesized
acattttgcttgctgtttta

SEQ ID NO: 18376 - DNA, 20 bp, Artificial Sequence
  chemically synthesized
gttttagagttcttactctt

SEQ ID NO: 18377 - DNA, 20 bp, Artificial Sequence
  chemically synthesized
tcttactctttggcttttga

SEQ ID NO: 18378 - DNA, 20 bp, Artificial Sequence
  chemically synthesized
agtttgactataatgtgctg

SEQ ID NO: 18379 - DNA, 20 bp, Artificial Sequence
  chemically synthesized
tttgactataatgtgctgtg

SEQ ID NO: 18380 - DNA, 20 bp, Artificial Sequence
  chemically synthesized
gactataatgtgctgtggag

SEQ ID NO: 18381 - DNA, 20 bp, Artificial Sequence
  chemically synthesized
ctataatgtgctgtggagaa

SEQ ID NO: 18382 - DNA, 20 bp, Artificial Sequence
  chemically synthesized
gctttttgcattatattatt

SEQ ID NO: 18383 - DNA, 20 bp, Artificial Sequence
  chemically synthesized
ctttttgcattatattattt

SEQ ID NO: 18384 - DNA, 20 bp, Artificial Sequence
  chemically synthesized
atttctgattttcatttgtc

SEQ ID NO: 18385 - DNA, 20 bp, Artificial Sequence
  chemically synthesized
tggatgtctacatttcttgc

SEQ ID NO: 18386 - DNA, 20 bp, Artificial Sequence
  chemically synthesized
catttcttgctagacttgac

SEQ ID NO: 18387 - DNA, 20 bp, Artificial Sequence
  chemically synthesized
tgctagacttgacaagtttt

SEQ ID NO: 18388 - DNA, 20 bp, Artificial Sequence
  chemically synthesized
tcagctattgtgttgttacg

SEQ ID NO: 18389 - DNA, 20 bp, Artificial Sequence
  chemically synthesized
cagctattgtgttgttacgt

SEQ ID NO: 18390 - DNA, 20 bp, Artificial Sequence
  chemically synthesized
ttcatgttctctttaccttc

SEQ ID NO: 18391 - DNA, 20 bp, Artificial Sequence
  chemically synthesized
tcatgttctctttaccttct

SEQ ID NO: 18392 - DNA, 20 bp, Artificial Sequence
  chemically synthesized
ttgaatatttgttcacttta

SEQ ID NO: 18393 - DNA, 20 bp, Artificial Sequence
  chemically synthesized
tttcctttctatcatttgac

SEQ ID NO: 18394 - DNA, 20 bp, Artificial Sequence
  chemically synthesized
atttgaccagctaattttaa

SEQ ID NO: 18395 - DNA, 20 bp, Artificial Sequence
  chemically synthesized
attttaaaagacctgtcttc

SEQ ID NO: 18396 - DNA, 20 bp, Artificial Sequence
  chemically synthesized
cttgatctgatctattgttg

SEQ ID NO: 18397 - DNA, 20 bp, Artificial Sequence
  chemically synthesized
atttctttcaataaactctt

SEQ ID NO: 18398 - DNA, 20 bp, Artificial Sequence
  chemically synthesized
ttcaataaactcttcagtta

SEQ ID NO: 18399 - DNA, 20 bp, Artificial Sequence
  chemically synthesized
tcagttacagaatttctgtt

SEQ ID NO: 18400 - DNA, 20 bp, Artificial Sequence
  chemically synthesized
ttcttgttgtatctatctct

SEQ ID NO: 18401 - DNA, 20 bp, Artificial Sequence
  chemically synthesized
tcttgttgtatctatctctt

SEQ ID NO: 18402 - DNA, 20 bp, Artificial Sequence
  chemically synthesized
tttctttttattgtttatct

SEQ ID NO: 18403 - DNA, 20 bp, Artificial Sequence
  chemically synthesized
gagttctcttgtgtctcact

SEQ ID NO: 18404 - DNA, 20 bp, Artificial Sequence
  chemically synthesized
cttccttaatatcaacattt

SEQ ID NO: 18405 - DNA, 20 bp, Artificial Sequence
  chemically synthesized
acattttggattcttttttc

SEQ ID NO: 18406 - DNA, 20 bp, Artificial Sequence
  chemically synthesized
taaatgtcttttttttccac

SEQ ID NO: 18407 - DNA, 20 bp, Artificial Sequence
  chemically synthesized
tccactggcttatgttgctg

SEQ ID NO: 18408 - DNA, 20 bp, Artificial Sequence
  chemically synthesized
gaagaattattaaattcctt

SEQ ID NO: 18409 - DNA, 20 bp, Artificial Sequence
  chemically synthesized
gaattattaaattcctttgg

SEQ ID NO: 18410 - DNA, 20 bp, Artificial Sequence
  chemically synthesized
tgcattgatatctctgcatc

SEQ ID NO: 18411 - DNA, 20 bp, Artificial Sequence
  chemically synthesized
ggtgtaatgattgctgcttc

SEQ ID NO: 18412 - DNA, 20 bp, Artificial Sequence
  chemically synthesized
gttttgtaaatttgtttttg

SEQ ID NO: 18413 - DNA, 20 bp, Artificial Sequence
  chemically synthesized
ttttgtaaatttgtttttgt

SEQ ID NO: 18414 - DNA, 20 bp, Artificial Sequence
  chemically synthesized
tttgtaaatttgtttttgta

SEQ ID NO: 18415 - DNA, 20 bp, Artificial Sequence
  chemically synthesized
ttgtaaatttgtttttgtag

SEQ ID NO: 18416 - DNA, 20 bp, Artificial Sequence
  chemically synthesized
taaatttgtttttgtagggg

SEQ ID NO: 18417 - DNA, 20 bp, Artificial Sequence
  chemically synthesized
taggggaagacttttttctg

SEQ ID NO: 18418 - DNA, 20 bp, Artificial Sequence
  chemically synthesized
ttttttctgaagatgtatct

SEQ ID NO: 18419 - DNA, 20 bp, Artificial Sequence
  chemically synthesized
gatgtatcttggtgttgatt

SEQ ID NO: 18420 - DNA, 20 bp, Artificial Sequence
  chemically synthesized
gtatcttggtgttgattgag

SEQ ID NO: 18421 - DNA, 20 bp, Artificial Sequence
  chemically synthesized
tatcttggtgttgattgagt

SEQ ID NO: 18422 - DNA, 20 bp, Artificial Sequence
  chemically synthesized
atcttggtgttgattgagta

SEQ ID NO: 18423 - DNA, 20 bp, Artificial Sequence
  chemically synthesized
ggcactttgattttgatttc

SEQ ID NO: 18424 - DNA, 20 bp, Artificial Sequence
  chemically synthesized
gcactttgattttgatttct

SEQ ID NO: 18425 - DNA, 20 bp, Artificial Sequence
  chemically synthesized
ttttgatttctaggtgcata

SEQ ID NO: 18426 - DNA, 20 bp, Artificial Sequence
  chemically synthesized
tgatttctaggtgcatacag

SEQ ID NO: 18427 - DNA, 20 bp, Artificial Sequence
  chemically synthesized
tctaggtgcatacagcagca

SEQ ID NO: 18428 - DNA, 20 bp, Artificial Sequence
  chemically synthesized
gtcttcatattatttttttt

SEQ ID NO: 18429 - DNA, 20 bp, Artificial Sequence
  chemically synthesized
tattttttttcagctgccaa

SEQ ID NO: 18430 - DNA, 20 bp, Artificial Sequence
  chemically synthesized
tcagctgccaacagtatcat

SEQ ID NO: 18431 - DNA, 20 bp, Artificial Sequence
  chemically synthesized
atcagtgtctgtgatttttt

SEQ ID NO: 18432 - DNA, 20 bp, Artificial Sequence
  chemically synthesized
agtgtctgtgattttttcag

SEQ ID NO: 18433 - DNA, 20 bp, Artificial Sequence
  chemically synthesized
ctgtgattttttcagtggct

SEQ ID NO: 18434 - DNA, 20 bp, Artificial Sequence
  chemically synthesized
tgtgattttttcagtggctt

SEQ ID NO: 18435 - DNA, 20 bp, Artificial Sequence
  chemically synthesized
gtgattttttcagtggctta

SEQ ID NO: 18436 - DNA, 20 bp, Artificial Sequence
  chemically synthesized
gtggcttagggtgcatttgt

SEQ ID NO: 18437 - DNA, 20 bp, Artificial Sequence
  chemically synthesized
ttagggtgcatttgttagtg

SEQ ID NO: 18438 - DNA, 20 bp, Artificial Sequence
  chemically synthesized
tagggtgcatttgttagtga

SEQ ID NO: 18439 - DNA, 20 bp, Artificial Sequence
  chemically synthesized
ggtgcatttgttagtgaagg

SEQ ID NO: 18440 - DNA, 20 bp, Artificial Sequence
  chemically synthesized
ttgttagtgaaggtggtgat

SEQ ID NO: 18441 - DNA, 20 bp, Artificial Sequence
  chemically synthesized
tgttagtgaaggtggtgatg

SEQ ID NO: 18442 - DNA, 20 bp, Artificial Sequence
  chemically synthesized
aggtggtgatgaggttgtgc

SEQ ID NO: 18443 - DNA, 20 bp, Artificial Sequence
  chemically synthesized
gtggtgatgaggttgtgctg

SEQ ID NO: 18444 - DNA, 20 bp, Artificial Sequence
  chemically synthesized
gatgaggttgtgctggagac

SEQ ID NO: 18445 - DNA, 20 bp, Artificial Sequence
  chemically synthesized
gtgctggagacaagaatatc

SEQ ID NO: 18446 - DNA, 20 bp, Artificial Sequence
  chemically synthesized
ctggagacaagaatatcaag

SEQ ID NO: 18447 - DNA, 20 bp, Artificial Sequence
  chemically synthesized
tggagacaagaatatcaagt

SEQ ID NO: 18448 - DNA, 20 bp, Artificial Sequence
  chemically synthesized
gacaagaatatcaagtgggc

SEQ ID NO: 18449 - DNA, 20 bp, Artificial Sequence
  chemically synthesized
atatcaagtgggccagtcct

SEQ ID NO: 18450 - DNA, 20 bp, Artificial Sequence
  chemically synthesized
agtgggccagtccttggccc

SEQ ID NO: 18451 - DNA, 20 bp, Artificial Sequence
  chemically synthesized
gggccagtccttggccccag

SEQ ID NO: 18452 - DNA, 20 bp, Artificial Sequence
  chemically synthesized
ccagtccttggccccagtgg

SEQ ID NO: 18453 - DNA, 20 bp, Artificial Sequence
  chemically synthesized
gtccttggccccagtggtgg

SEQ ID NO: 18454 - DNA, 20 bp, Artificial Sequence
  chemically synthesized
cttggccccagtggtggtgg

SEQ ID NO: 18455 - DNA, 20 bp, Artificial Sequence
  chemically synthesized
ttggccccagtggtggtggt

SEQ ID NO: 18456 - DNA, 20 bp, Artificial Sequence
  chemically synthesized
cccagtggtggtggtgggcc

SEQ ID NO: 18457 - DNA, 20 bp, Artificial Sequence
  chemically synthesized
gggcctagcattcctgtcct

SEQ ID NO: 18458 - DNA, 20 bp, Artificial Sequence
  chemically synthesized
ggcctagcattcctgtcctt

SEQ ID NO: 18459 - DNA, 20 bp, Artificial Sequence
  chemically synthesized
attcctgtccttgggcccca

SEQ ID NO: 18460 - DNA, 20 bp, Artificial Sequence
  chemically synthesized
ggccccatggctgtgtacat

SEQ ID NO: 18461 - DNA, 20 bp, Artificial Sequence
  chemically synthesized
gctgtgtacattggcactga

SEQ ID NO: 18462 - DNA, 20 bp, Artificial Sequence
  chemically synthesized
acattggcactgatggtaat

SEQ ID NO: 18463 - DNA, 20 bp, Artificial Sequence
  chemically synthesized
ggcactgatggtaatgagtc

SEQ ID NO: 18464 - DNA, 20 bp, Artificial Sequence
  chemically synthesized
ctgatggtaatgagtctagt

SEQ ID NO: 18465 - DNA, 20 bp, Artificial Sequence
  chemically synthesized
tgatggtaatgagtctagtt

SEQ ID NO: 18466 - DNA, 20 bp, Artificial Sequence
  chemically synthesized
gtctagttgggttgattctt

SEQ ID NO: 18467 - DNA, 20 bp, Artificial Sequence
  chemically synthesized
tgggttgattctttggcctt

SEQ ID NO: 18468 - DNA, 20 bp, Artificial Sequence
  chemically synthesized
gggttgattctttggccttc

SEQ ID NO: 18469 - DNA, 20 bp, Artificial Sequence
  chemically synthesized
ttgattctttggccttcagg

SEQ ID NO: 18470 - DNA, 20 bp, Artificial Sequence
  chemically synthesized
tggccttcaggcagtttgct

SEQ ID NO: 18471 - DNA, 20 bp, Artificial Sequence
  chemically synthesized
ggccttcaggcagtttgctt

SEQ ID NO: 18472 - DNA, 20 bp, Artificial Sequence
  chemically synthesized
caggcagtttgcttgggtgt

SEQ ID NO: 18473 - DNA, 20 bp, Artificial Sequence
  chemically synthesized
gcagtttgcttgggtgtcag

SEQ ID NO: 18474 - DNA, 20 bp, Artificial Sequence
  chemically synthesized
gtttgcttgggtgtcagtag

SEQ ID NO: 18475 - DNA, 20 bp, Artificial Sequence
  chemically synthesized
ttgggtgtcagtagtggcca

SEQ ID NO: 18476 - DNA, 20 bp, Artificial Sequence
  chemically synthesized
ggtgtcagtagtggccatag

SEQ ID NO: 18477 - DNA, 20 bp, Artificial Sequence
  chemically synthesized
cagtagtggccatagtagac

SEQ ID NO: 18478 - DNA, 20 bp, Artificial Sequence
  chemically synthesized
agtagtggccatagtagact

SEQ ID NO: 18479 - DNA, 20 bp, Artificial Sequence
  chemically synthesized
gtggccatagtagactgggc

SEQ ID NO: 18480 - DNA, 20 bp, Artificial Sequence
  chemically synthesized
tagtagactgggctggtgtg

SEQ ID NO: 18481 - DNA, 20 bp, Artificial Sequence
  chemically synthesized
agtagactgggctggtgtgt

SEQ ID NO: 18482 - DNA, 20 bp, Artificial Sequence
  chemically synthesized
tgggctggtgtgtgggtcct

SEQ ID NO: 18483 - DNA, 20 bp, Artificial Sequence
  chemically synthesized
gggctggtgtgtgggtcctc

SEQ ID NO: 18484 - DNA, 20 bp, Artificial Sequence
  chemically synthesized
tgtgtgggtcctcaggcttc

SEQ ID NO: 18485 - DNA, 20 bp, Artificial Sequence
  chemically synthesized
tgggtcctcaggcttctgga

SEQ ID NO: 18486 - DNA, 20 bp, Artificial Sequence
  chemically synthesized
gtcctcaggcttctggacag

SEQ ID NO: 18487 - DNA, 20 bp, Artificial Sequence
  chemically synthesized
tcctcaggcttctggacagt

SEQ ID NO: 18488 - DNA, 20 bp, Artificial Sequence
  chemically synthesized
aggcttctggacagtgggtg

SEQ ID NO: 18489 - DNA, 20 bp, Artificial Sequence
  chemically synthesized
tctggacagtgggtgtggtg

SEQ ID NO: 18490 - DNA, 20 bp, Artificial Sequence
  chemically synthesized
ctggacagtgggtgtggtgt

SEQ ID NO: 18491 - DNA, 20 bp, Artificial Sequence
  chemically synthesized
agtgggtgtggtgtgggtga

SEQ ID NO: 18492 - DNA, 20 bp, Artificial Sequence
  chemically synthesized
tgtggtgtgggtgatggctg

SEQ ID NO: 18493 - DNA, 20 bp, Artificial Sequence
  chemically synthesized
ggtgatggctgtagcaactg

SEQ ID NO: 18494 - DNA, 20 bp, Artificial Sequence
  chemically synthesized
gtgatggctgtagcaactgc

SEQ ID NO: 18495 - DNA, 20 bp, Artificial Sequence
  chemically synthesized
gcaactgcaggacaaccctc

SEQ ID NO: 18496 - DNA, 20 bp, Artificial Sequence
  chemically synthesized
aggacaaccctctggctccc

SEQ ID NO: 18497 - DNA, 20 bp, Artificial Sequence
  chemically synthesized
acaaccctctggctcccaag

SEQ ID NO: 18498 - DNA, 20 bp, Artificial Sequence
  chemically synthesized
ggctcccaagcagtctgcac

SEQ ID NO: 18499 - DNA, 20 bp, Artificial Sequence
  chemically synthesized
caagcagtctgcactggtgt

SEQ ID NO: 18500 - DNA, 20 bp, Artificial Sequence
  chemically synthesized
gcagtctgcactggtgttgg

SEQ ID NO: 18501 - DNA, 20 bp, Artificial Sequence
  chemically synthesized
gtctgcactggtgttggtgg

SEQ ID NO: 18502 - DNA, 20 bp, Artificial Sequence
  chemically synthesized
ctggtgttggtggtggctgc

SEQ ID NO: 18503 - DNA, 20 bp, Artificial Sequence
  chemically synthesized
tggtgttggtggtggctgca

SEQ ID NO: 18504 - DNA, 20 bp, Artificial Sequence
  chemically synthesized
ggtgttggtggtggctgcaa

SEQ ID NO: 18505 - DNA, 20 bp, Artificial Sequence
  chemically synthesized
ggtggctgcaagggctgaat

SEQ ID NO: 18506 - DNA, 20 bp, Artificial Sequence
  chemically synthesized
gctgcaagggctgaatgagc

SEQ ID NO: 18507 - DNA, 20 bp, Artificial Sequence
  chemically synthesized
gggctgaatgagccagtctt

SEQ ID NO: 18508 - DNA, 20 bp, Artificial Sequence
  chemically synthesized
tgagccagtcttcagaccca

SEQ ID NO: 18509 - DNA, 20 bp, Artificial Sequence
  chemically synthesized
gagccagtcttcagacccac

SEQ ID NO: 18510 - DNA, 20 bp, Artificial Sequence
  chemically synthesized
ccagtcttcagacccacagg

SEQ ID NO: 18511 - DNA, 20 bp, Artificial Sequence
  chemically synthesized
agacccacaggtggcacatg

SEQ ID NO: 18512 - DNA, 20 bp, Artificial Sequence
  chemically synthesized
gacccacaggtggcacatgc

SEQ ID NO: 18513 - DNA, 20 bp, Artificial Sequence
  chemically synthesized
cccacaggtggcacatgcag

SEQ ID NO: 18514 - DNA, 20 bp, Artificial Sequence
  chemically synthesized
ccacaggtggcacatgcagg

SEQ ID NO: 18515 - DNA, 20 bp, Artificial Sequence
  chemically synthesized
gtggcacatgcaggaggtgc

SEQ ID NO: 18516 - DNA, 20 bp, Artificial Sequence
  chemically synthesized
gcaggaggtgccagttgtga

SEQ ID NO: 18517 - DNA, 20 bp, Artificial Sequence
  chemically synthesized
ggaggtgccagttgtgatgg

SEQ ID NO: 18518 - DNA, 20 bp, Artificial Sequence
  chemically synthesized
ggtgccagttgtgatggcag

SEQ ID NO: 18519 - DNA, 20 bp, Artificial Sequence
  chemically synthesized
gccagttgtgatggcagtgg

SEQ ID NO: 18520 - DNA, 20 bp, Artificial Sequence
  chemically synthesized
ttgtgatggcagtggcagat

SEQ ID NO: 18521 - DNA, 20 bp, Artificial Sequence
  chemically synthesized
tgtgatggcagtggcagatt

SEQ ID NO: 18522 - DNA, 20 bp, Artificial Sequence
  chemically synthesized
gatggcagtggcagattggg

SEQ ID NO: 18523 - DNA, 20 bp, Artificial Sequence
  chemically synthesized
atggcagtggcagattgggt

SEQ ID NO: 18524 - DNA, 20 bp, Artificial Sequence
  chemically synthesized
agattgggtaggcccatcat

SEQ ID NO: 18525 - DNA, 20 bp, Artificial Sequence
  chemically synthesized
gattgggtaggcccatcatc

SEQ ID NO: 18526 - DNA, 20 bp, Artificial Sequence
  chemically synthesized
taggcccatcatcaggcttc

SEQ ID NO: 18527 - DNA, 20 bp, Artificial Sequence
  chemically synthesized
aggcccatcatcaggcttct

SEQ ID NO: 18528 - DNA, 20 bp, Artificial Sequence
  chemically synthesized
gcccatcatcaggcttctgg

SEQ ID NO: 18529 - DNA, 20 bp, Artificial Sequence
  chemically synthesized
cccatcatcaggcttctggg

SEQ ID NO: 18530 - DNA, 20 bp, Artificial Sequence
  chemically synthesized
ccatcatcaggcttctggga

SEQ ID NO: 18531 - DNA, 20 bp, Artificial Sequence
  chemically synthesized
aggcttctgggagggttgct

SEQ ID NO: 18532 - DNA, 20 bp, Artificial Sequence
  chemically synthesized
ggcttctgggagggttgctt

SEQ ID NO: 18533 - DNA, 20 bp, Artificial Sequence
  chemically synthesized
tgggagggttgcttaggtac

SEQ ID NO: 18534 - DNA, 20 bp, Artificial Sequence
  chemically synthesized
ggttgcttaggtaccagtca

SEQ ID NO: 18535 - DNA, 20 bp, Artificial Sequence
  chemically synthesized
tgcttaggtaccagtcatgg

SEQ ID NO: 18536 - DNA, 20 bp, Artificial Sequence
  chemically synthesized
taggtaccagtcatggtgga

SEQ ID NO: 18537 - DNA, 20 bp, Artificial Sequence
  chemically synthesized
ccagtcatggtggatggcac

SEQ ID NO: 18538 - DNA, 20 bp, Artificial Sequence
  chemically synthesized
cagtcatggtggatggcaca

SEQ ID NO: 18539 - DNA, 20 bp, Artificial Sequence
  chemically synthesized
ggatggcacaaggctgtctc

SEQ ID NO: 18540 - DNA, 20 bp, Artificial Sequence
  chemically synthesized
gatggcacaaggctgtctct

SEQ ID NO: 18541 - DNA, 20 bp, Artificial Sequence
  chemically synthesized
caaggctgtctctgggttcc

SEQ ID NO: 18542 - DNA, 20 bp, Artificial Sequence
  chemically synthesized
gggttcccagacaacttgct

SEQ ID NO: 18543 - DNA, 20 bp, Artificial Sequence
  chemically synthesized
ggttcccagacaacttgctt

SEQ ID NO: 18544 - DNA, 20 bp, Artificial Sequence
  chemically synthesized
agacaacttgcttaggcatt

SEQ ID NO: 18545 - DNA, 20 bp, Artificial Sequence
  chemically synthesized
gacaacttgcttaggcattg

SEQ ID NO: 18546 - DNA, 20 bp, Artificial Sequence
  chemically synthesized
aacttgcttaggcattgagg

SEQ ID NO: 18547 - DNA, 20 bp, Artificial Sequence
  chemically synthesized
acttgcttaggcattgagga

SEQ ID NO: 18548 - DNA, 20 bp, Artificial Sequence
  chemically synthesized
cttaggcattgaggaaggca

SEQ ID NO: 18549 - DNA, 20 bp, Artificial Sequence
  chemically synthesized
ggcattgaggaaggcaaagc

SEQ ID NO: 18550 - DNA, 20 bp, Artificial Sequence
  chemically synthesized
gcattgaggaaggcaaagcc

SEQ ID NO: 18551 - DNA, 20 bp, Artificial Sequence
  chemically synthesized
tgaggaaggcaaagccaggc

SEQ ID NO: 18552 - DNA, 20 bp, Artificial Sequence
  chemically synthesized
gaggaaggcaaagccaggct

SEQ ID NO: 18553 - DNA, 20 bp, Artificial Sequence
  chemically synthesized
aggctgggtgttcctgacct

SEQ ID NO: 18554 - DNA, 20 bp, Artificial Sequence
  chemically synthesized
ggctgggtgttcctgacctc

SEQ ID NO: 18555 - DNA, 20 bp, Artificial Sequence
  chemically synthesized
gttcctgacctcaggccact

SEQ ID NO: 18556 - DNA, 20 bp, Artificial Sequence
  chemically synthesized
cctgacctcaggccactcag

SEQ ID NO: 18557 - DNA, 20 bp, Artificial Sequence
  chemically synthesized
aggccactcagtggtgtgtg

SEQ ID NO: 18558 - DNA, 20 bp, Artificial Sequence
  chemically synthesized
tcagtggtgtgtgtggacac

SEQ ID NO: 18559 - DNA, 20 bp, Artificial Sequence
  chemically synthesized
tgtgtggacaccggctatca

SEQ ID NO: 18560 - DNA, 20 bp, Artificial Sequence
  chemically synthesized
gtgtggacaccggctatcat

SEQ ID NO: 18561 - DNA, 20 bp, Artificial Sequence
  chemically synthesized
ggacaccggctatcataggc

SEQ ID NO: 18562 - DNA, 20 bp, Artificial Sequence
  chemically synthesized
acaccggctatcataggctg

SEQ ID NO: 18563 - DNA, 20 bp, Artificial Sequence
  chemically synthesized
ccggctatcataggctggag

SEQ ID NO: 18564 - DNA, 20 bp, Artificial Sequence
  chemically synthesized
ggctatcataggctggagtg

SEQ ID NO: 18565 - DNA, 20 bp, Artificial Sequence
  chemically synthesized
ggctggagtggagtgatcct

SEQ ID NO: 18566 - DNA, 20 bp, Artificial Sequence
  chemically synthesized
gctggagtggagtgatcctc

SEQ ID NO: 18567 - DNA, 20 bp, Artificial Sequence
  chemically synthesized
tggagtgatcctcaggcccc

SEQ ID NO: 18568 - DNA, 20 bp, Artificial Sequence
  chemically synthesized
agtgatcctcaggcccccag

SEQ ID NO: 18569 - DNA, 20 bp, Artificial Sequence
  chemically synthesized
aggcccccagcagaatgcct

SEQ ID NO: 18570 - DNA, 20 bp, Artificial Sequence
  chemically synthesized
agcagaatgcctgagtgaat

SEQ ID NO: 18571 - DNA, 20 bp, Artificial Sequence
  chemically synthesized
agaatgcctgagtgaattag

SEQ ID NO: 18572 - DNA, 20 bp, Artificial Sequence
  chemically synthesized
gcattgttgccctgctcttg

SEQ ID NO: 18573 - DNA, 20 bp, Artificial Sequence
  chemically synthesized
cattgttgccctgctcttga

SEQ ID NO: 18574 - DNA, 20 bp, Artificial Sequence
  chemically synthesized
attgttgccctgctcttgaa

SEQ ID NO: 18575 - DNA, 20 bp, Artificial Sequence
  chemically synthesized
ttgttgccctgctcttgaag

SEQ ID NO: 18576 - DNA, 20 bp, Artificial Sequence
  chemically synthesized
gccctgctcttgaaggggtg

SEQ ID NO: 18577 - DNA, 20 bp, Artificial Sequence
  chemically synthesized
ccctgctcttgaaggggtgc

SEQ ID NO: 18578 - DNA, 20 bp, Artificial Sequence
  chemically synthesized
cctgctcttgaaggggtgcg

SEQ ID NO: 18579 - DNA, 20 bp, Artificial Sequence
  chemically synthesized
ggtgcggggtgtgttgcttt

SEQ ID NO: 18580 - DNA, 20 bp, Artificial Sequence
  chemically synthesized
gcggggtgtgttgctttcag

SEQ ID NO: 18581 - DNA, 20 bp, Artificial Sequence
  chemically synthesized
gggtgtgttgctttcagtgg

SEQ ID NO: 18582 - DNA, 20 bp, Artificial Sequence
  chemically synthesized
tgtgttgctttcagtggcag

SEQ ID NO: 18583 - DNA, 20 bp, Artificial Sequence
  chemically synthesized
tcagtggcagcagctataaa

SEQ ID NO: 18584 - DNA, 20 bp, Artificial Sequence
  chemically synthesized
cagtggcagcagctataaat

SEQ ID NO: 18585 - DNA, 20 bp, Artificial Sequence
  chemically synthesized
agcagctataaatgggttgc

SEQ ID NO: 18586 - DNA, 20 bp, Artificial Sequence
  chemically synthesized
agctataaatgggttgctgg

SEQ ID NO: 18587 - DNA, 20 bp, Artificial Sequence
  chemically synthesized
gctataaatgggttgctggt

SEQ ID NO: 18588 - DNA, 20 bp, Artificial Sequence
  chemically synthesized
ttgctggtgggcatgtgttt

SEQ ID NO: 18589 - DNA, 20 bp, Artificial Sequence
  chemically synthesized
gtgggcatgtgtttcagccc

SEQ ID NO: 18590 - DNA, 20 bp, Artificial Sequence
  chemically synthesized
gcatgtgtttcagccccaga

SEQ ID NO: 18591 - DNA, 20 bp, Artificial Sequence
  chemically synthesized
tgtgtttcagccccagatgg

SEQ ID NO: 18592 - DNA, 20 bp, Artificial Sequence
  chemically synthesized
cagccccagatggtggctgc

SEQ ID NO: 18593 - DNA, 20 bp, Artificial Sequence
  chemically synthesized
ccccagatggtggctgcaag

SEQ ID NO: 18594 - DNA, 20 bp, Artificial Sequence
  chemically synthesized
cccagatggtggctgcaagt

SEQ ID NO: 18595 - DNA, 20 bp, Artificial Sequence
  chemically synthesized
ccagatggtggctgcaagtg

SEQ ID NO: 18596 - DNA, 20 bp, Artificial Sequence
  chemically synthesized
gatggtggctgcaagtgggg

SEQ ID NO: 18597 - DNA, 20 bp, Artificial Sequence
  chemically synthesized
caagtggggtagcattttct

SEQ ID NO: 18598 - DNA, 20 bp, Artificial Sequence
  chemically synthesized
aagtggggtagcattttctt

SEQ ID NO: 18599 - DNA, 20 bp, Artificial Sequence
  chemically synthesized
agtggggtagcattttctta

SEQ ID NO: 18600 - DNA, 20 bp, Artificial Sequence
  chemically synthesized
tggggtagcattttcttagg

SEQ ID NO: 18601 - DNA, 20 bp, Artificial Sequence
  chemically synthesized
ttagggagcttataaatgtg

SEQ ID NO: 18602 - DNA, 20 bp, Artificial Sequence
  chemically synthesized
gggagcttataaatgtgtag

SEQ ID NO: 18603 - DNA, 20 bp, Artificial Sequence
  chemically synthesized
atgtgtagcagccctgctac

SEQ ID NO: 18604 - DNA, 20 bp, Artificial Sequence
  chemically synthesized
tgtgtagcagccctgctact

SEQ ID NO: 18605 - DNA, 20 bp, Artificial Sequence
  chemically synthesized
gtgtagcagccctgctactg

SEQ ID NO: 18606 - DNA, 20 bp, Artificial Sequence
  chemically synthesized
tgtagcagccctgctactgg

SEQ ID NO: 18607 - DNA, 20 bp, Artificial Sequence
  chemically synthesized
agcagccctgctactggggg

SEQ ID NO: 18608 - DNA, 20 bp, Artificial Sequence
  chemically synthesized
gcagccctgctactgggggt

SEQ ID NO: 18609 - DNA, 20 bp, Artificial Sequence
  chemically synthesized
cagccctgctactgggggtg

SEQ ID NO: 18610 - DNA, 20 bp, Artificial Sequence
  chemically synthesized
agccctgctactgggggtgg

SEQ ID NO: 18611 - DNA, 20 bp, Artificial Sequence
  chemically synthesized
ccctgctactgggggtgggg

SEQ ID NO: 18612 - DNA, 20 bp, Artificial Sequence
  chemically synthesized
ctaatgacacactttatccc

SEQ ID NO: 18613 - DNA, 20 bp, Artificial Sequence
  chemically synthesized
acacactttatccctggtga

SEQ ID NO: 18614 - DNA, 20 bp, Artificial Sequence
  chemically synthesized
cactttatccctggtgacag

SEQ ID NO: 18615 - DNA, 20 bp, Artificial Sequence
  chemically synthesized
ttatccctggtgacagcagc

SEQ ID NO: 18616 - DNA, 20 bp, Artificial Sequence
  chemically synthesized
tccctggtgacagcagccag

SEQ ID NO: 18617 - DNA, 20 bp, Artificial Sequence
  chemically synthesized
ctggtgacagcagccagcag

SEQ ID NO: 18618 - DNA, 20 bp, Artificial Sequence
  chemically synthesized
cagcagccagcagtagcact

SEQ ID NO: 18619 - DNA, 20 bp, Artificial Sequence
  chemically synthesized
ccagcagtagcactcagctg

SEQ ID NO: 18620 - DNA, 20 bp, Artificial Sequence
  chemically synthesized
cagcagtagcactcagctgt

SEQ ID NO: 18621 - DNA, 20 bp, Artificial Sequence
  chemically synthesized
cagtagcactcagctgtggg

SEQ ID NO: 18622 - DNA, 20 bp, Artificial Sequence
  chemically synthesized
agtagcactcagctgtgggt

SEQ ID NO: 18623 - DNA, 20 bp, Artificial Sequence
  chemically synthesized
gtagcactcagctgtgggtg

SEQ ID NO: 18624 - DNA, 20 bp, Artificial Sequence
  chemically synthesized
tagcactcagctgtgggtgg

SEQ ID NO: 18625 - DNA, 20 bp, Artificial Sequence
  chemically synthesized
cagctgtgggtgggggatgt

SEQ ID NO: 18626 - DNA, 20 bp, Artificial Sequence
  chemically synthesized
ctgtgggtgggggatgtcag

SEQ ID NO: 18627 - DNA, 20 bp, Artificial Sequence
  chemically synthesized
gtgggtgggggatgtcagca

SEQ ID NO: 18628 - DNA, 20 bp, Artificial Sequence
  chemically synthesized
gggggatgtcagcagagctt

SEQ ID NO: 18629 - DNA, 20 bp, Artificial Sequence
  chemically synthesized
ggggatgtcagcagagcttc

SEQ ID NO: 18630 - DNA, 20 bp, Artificial Sequence
  chemically synthesized
gggatgtcagcagagcttca

SEQ ID NO: 18631 - DNA, 20 bp, Artificial Sequence
  chemically synthesized
tcagcagagcttcagggatg

SEQ ID NO: 18632 - DNA, 20 bp, Artificial Sequence
  chemically synthesized
agcagagcttcagggatgta

SEQ ID NO: 18633 - DNA, 20 bp, Artificial Sequence
  chemically synthesized
gcttcagggatgtagagatg

SEQ ID NO: 18634 - DNA, 20 bp, Artificial Sequence
  chemically synthesized
tgtagagatgcagatgatgt

SEQ ID NO: 18635 - DNA, 20 bp, Artificial Sequence
  chemically synthesized
gtagagatgcagatgatgtt

SEQ ID NO: 18636 - DNA, 20 bp, Artificial Sequence
  chemically synthesized
tagagatgcagatgatgttg

SEQ ID NO: 18637 - DNA, 20 bp, Artificial Sequence
  chemically synthesized
tgcagatgatgttggggtct

SEQ ID NO: 18638 - DNA, 20 bp, Artificial Sequence
  chemically synthesized
gcagatgatgttggggtctg

SEQ ID NO: 18639 - DNA, 20 bp, Artificial Sequence
  chemically synthesized
gtctgaggaacgatgtcatc

SEQ ID NO: 18640 - DNA, 20 bp, Artificial Sequence
  chemically synthesized
tgaggaacgatgtcatctgg

SEQ ID NO: 18641 - DNA, 20 bp, Artificial Sequence
  chemically synthesized
gaggaacgatgtcatctggt

SEQ ID NO: 18642 - DNA, 20 bp, Artificial Sequence
  chemically synthesized
cgatgtcatctggtgggtgt

SEQ ID NO: 18643 - DNA, 20 bp, Artificial Sequence
  chemically synthesized
gatgtcatctggtgggtgtt

SEQ ID NO: 18644 - DNA, 20 bp, Artificial Sequence
  chemically synthesized
tgggtgttgggctctcaaaa

SEQ ID NO: 18645 - DNA, 20 bp, Artificial Sequence
  chemically synthesized
caaaatggcaccttgctgct

SEQ ID NO: 18646 - DNA, 20 bp, Artificial Sequence
  chemically synthesized
ggcaccttgctgctcagtaa

SEQ ID NO: 18647 - DNA, 20 bp, Artificial Sequence
  chemically synthesized
gcaccttgctgctcagtaat

SEQ ID NO: 18648 - DNA, 20 bp, Artificial Sequence
  chemically synthesized
caccttgctgctcagtaatg

SEQ ID NO: 18649 - DNA, 20 bp, Artificial Sequence
  chemically synthesized
ttgctgctcagtaatgggga

SEQ ID NO: 18650 - DNA, 20 bp, Artificial Sequence
  chemically synthesized
ctgctcagtaatggggatgg

SEQ ID NO: 18651 - DNA, 20 bp, Artificial Sequence
  chemically synthesized
tgctcagtaatggggatggc

SEQ ID NO: 18652 - DNA, 20 bp, Artificial Sequence
  chemically synthesized
gctcagtaatggggatggca

SEQ ID NO: 18653 - DNA, 20 bp, Artificial Sequence
  chemically synthesized
ctcagtaatggggatggcag

SEQ ID NO: 18654 - DNA, 20 bp, Artificial Sequence
  chemically synthesized
agtaatggggatggcagggg

SEQ ID NO: 18655 - DNA, 20 bp, Artificial Sequence
  chemically synthesized
gtaatggggatggcaggggt

SEQ ID NO: 18656 - DNA, 20 bp, Artificial Sequence
  chemically synthesized
gggatggcaggggtgggacc

SEQ ID NO: 18657 - DNA, 20 bp, Artificial Sequence
  chemically synthesized
tggcaggggtgggacccagt

SEQ ID NO: 18658 - DNA, 20 bp, Artificial Sequence
  chemically synthesized
gcaggggtgggacccagtga

SEQ ID NO: 18659 - DNA, 20 bp, Artificial Sequence
  chemically synthesized
cccagtgagagctccttctc

SEQ ID NO: 18660 - DNA, 20 bp, Artificial Sequence
  chemically synthesized
cagtgagagctccttctctg

SEQ ID NO: 18661 - DNA, 20 bp, Artificial Sequence
  chemically synthesized
caatgcctttgtgcgattgc

SEQ ID NO: 18662 - DNA, 20 bp, Artificial Sequence
  chemically synthesized
aatgcctttgtgcgattgct

SEQ ID NO: 18663 - DNA, 20 bp, Artificial Sequence
  chemically synthesized
gcctttgtgcgattgctggg

SEQ ID NO: 18664 - DNA, 20 bp, Artificial Sequence
  chemically synthesized
tgctgggcagttccttatga

SEQ ID NO: 18665 - DNA, 20 bp, Artificial Sequence
  chemically synthesized
cagttccttatgatagtctc

SEQ ID NO: 18666 - DNA, 20 bp, Artificial Sequence
  chemically synthesized
agttccttatgatagtctca

SEQ ID NO: 18667 - DNA, 20 bp, Artificial Sequence
  chemically synthesized
tgatagtctcaaggcctgca

SEQ ID NO: 18668 - DNA, 20 bp, Artificial Sequence
  chemically synthesized
gtctcaaggcctgcatggtc

SEQ ID NO: 18669 - DNA, 20 bp, Artificial Sequence
  chemically synthesized
tctcaaggcctgcatggtca

SEQ ID NO: 18670 - DNA, 20 bp, Artificial Sequence
  chemically synthesized
ctcaaggcctgcatggtcaa

SEQ ID NO: 18671 - DNA, 20 bp, Artificial Sequence
  chemically synthesized
atggtcaagggactctcctg

SEQ ID NO: 18672 - DNA, 20 bp, Artificial Sequence
  chemically synthesized
tcaagggactctcctgtggc

SEQ ID NO: 18673 - DNA, 20 bp, Artificial Sequence
  chemically synthesized
caagggactctcctgtggct

SEQ ID NO: 18674 - DNA, 20 bp, Artificial Sequence
  chemically synthesized
tctcctgtggctaggattcc

SEQ ID NO: 18675 - DNA, 20 bp, Artificial Sequence
  chemically synthesized
tcctgtggctaggattcctg

SEQ ID NO: 18676 - DNA, 20 bp, Artificial Sequence
  chemically synthesized
gattcctggagtccataatg

SEQ ID NO: 18677 - DNA, 20 bp, Artificial Sequence
  chemically synthesized
tggagtccataatgcagatg

SEQ ID NO: 18678 - DNA, 20 bp, Artificial Sequence
  chemically synthesized
ataatgcagatgtggaccac

SEQ ID NO: 18679 - DNA, 20 bp, Artificial Sequence
  chemically synthesized
taatgcagatgtggaccact

SEQ ID NO: 18680 - DNA, 20 bp, Artificial Sequence
  chemically synthesized
atgcagatgtggaccactgg

SEQ ID NO: 18681 - DNA, 20 bp, Artificial Sequence
  chemically synthesized
agatgtggaccactgggagt

SEQ ID NO: 18682 - DNA, 20 bp, Artificial Sequence
  chemically synthesized
tcacttaactttcgatgcac

SEQ ID NO: 18683 - DNA, 20 bp, Artificial Sequence
  chemically synthesized
cacttaactttcgatgcact

SEQ ID NO: 18684 - DNA, 20 bp, Artificial Sequence
  chemically synthesized
acttaactttcgatgcactg

SEQ ID NO: 18685 - DNA, 20 bp, Artificial Sequence
  chemically synthesized
ttaactttcgatgcactggg

SEQ ID NO: 18686 - DNA, 20 bp, Artificial Sequence
  chemically synthesized
gatgcactggggagcctctc

SEQ ID NO: 18687 - DNA, 20 bp, Artificial Sequence
  chemically synthesized
ggggagcctctctggcctca

SEQ ID NO: 18688 - DNA, 20 bp, Artificial Sequence
  chemically synthesized
ggagcctctctggcctcaca

SEQ ID NO: 18689 - DNA, 20 bp, Artificial Sequence
  chemically synthesized
gagcctctctggcctcacag

SEQ ID NO: 18690 - DNA, 20 bp, Artificial Sequence
  chemically synthesized
gcctcacagaggatccctac

SEQ ID NO: 18691 - DNA, 20 bp, Artificial Sequence
  chemically synthesized
cctcacagaggatccctact

SEQ ID NO: 18692 - DNA, 20 bp, Artificial Sequence
  chemically synthesized
cacagaggatccctactggg

SEQ ID NO: 18693 - DNA, 20 bp, Artificial Sequence
  chemically synthesized
acagaggatccctactgggt

SEQ ID NO: 18694 - DNA, 20 bp, Artificial Sequence
  chemically synthesized
ttccctccccttcattgcct

SEQ ID NO: 18695 - DNA, 20 bp, Artificial Sequence
  chemically synthesized
gtcacttctctgttgaattc

SEQ ID NO: 18696 - DNA, 20 bp, Artificial Sequence
  chemically synthesized
ttccagaattctctcttatg

SEQ ID NO: 18697 - DNA, 20 bp, Artificial Sequence
  chemically synthesized
tccagaattctctcttatgt

SEQ ID NO: 18698 - DNA, 20 bp, Artificial Sequence
  chemically synthesized
ggattttctacttactattt

SEQ ID NO: 18699 - DNA, 20 bp, Artificial Sequence
  chemically synthesized
cttactattttggttctttg

SEQ ID NO: 18700 - DNA, 20 bp, Artificial Sequence
  chemically synthesized
tactattttggttctttgtg

SEQ ID NO: 18701 - DNA, 20 bp, Artificial Sequence
  chemically synthesized
actattttggttctttgtgg

SEQ ID NO: 18702 - DNA, 20 bp, Artificial Sequence
  chemically synthesized
tattttggttctttgtggag

SEQ ID NO: 18703 - DNA, 20 bp, Artificial Sequence
  chemically synthesized
attttggttctttgtggagg

SEQ ID NO: 18704 - DNA, 20 bp, Artificial Sequence
  chemically synthesized
tggttctttgtggaggaggt

SEQ ID NO: 18705 - DNA, 20 bp, Artificial Sequence
  chemically synthesized
tttgtggaggaggtgagtgt

SEQ ID NO: 18706 - DNA, 20 bp, Artificial Sequence
  chemically synthesized
aggtgagtgtcagctgccct

SEQ ID NO: 18707 - DNA, 20 bp, Artificial Sequence
  chemically synthesized
gagtgtcagctgcccttagt

SEQ ID NO: 18708 - DNA, 20 bp, Artificial Sequence
  chemically synthesized
gcccttagtcagtaatcttc

SEQ ID NO: 18709 - DNA, 20 bp, Artificial Sequence
  chemically synthesized
cccttcccttgaaatttttt

SEQ ID NO: 18710 - DNA, 20 bp, Artificial Sequence
  chemically synthesized
ctttatgtttttatttctaa

SEQ ID NO: 18711 - DNA, 20 bp, Artificial Sequence
  chemically synthesized
ttttatttctaatagactga

SEQ ID NO: 18712 - DNA, 20 bp, Artificial Sequence
  chemically synthesized
ttatttctaatagactgaaa

SEQ ID NO: 18713 - DNA, 20 bp, Artificial Sequence
  chemically synthesized
aatcatattttaaacactct

SEQ ID NO: 18714 - DNA, 20 bp, Artificial Sequence
  chemically synthesized
atcatattttaaacactcta

SEQ ID NO: 18715 - DNA, 20 bp, Artificial Sequence
  chemically synthesized
ttaaacactctaaggctata

SEQ ID NO: 18716 - DNA, 20 bp, Artificial Sequence
  chemically synthesized
taaacactctaaggctatat

SEQ ID NO: 18717 - DNA, 20 bp, Artificial Sequence
  chemically synthesized
aaacactctaaggctatatg

SEQ ID NO: 18718 - DNA, 20 bp, Artificial Sequence
  chemically synthesized
aacactctaaggctatatgg

SEQ ID NO: 18719 - DNA, 20 bp, Artificial Sequence
  chemically synthesized
gctatatgggggactatctg

SEQ ID NO: 18720 - DNA, 20 bp, Artificial Sequence
  chemically synthesized
ctatatgggggactatctga

SEQ ID NO: 18721 - DNA, 20 bp, Artificial Sequence
  chemically synthesized
gggggactatctgaaggcct

SEQ ID NO: 18722 - DNA, 20 bp, Artificial Sequence
  chemically synthesized
actatctgaaggcctcagat

SEQ ID NO: 18723 - DNA, 20 bp, Artificial Sequence
  chemically synthesized
tgaaggcctcagatgagtaa

SEQ ID NO: 18724 - DNA, 20 bp, Artificial Sequence
  chemically synthesized
aggcctcagatgagtaaaag

SEQ ID NO: 18725 - DNA, 20 bp, Artificial Sequence
  chemically synthesized
cctcagatgagtaaaagaag

SEQ ID NO: 18726 - DNA, 20 bp, Artificial Sequence
  chemically synthesized
gagtaaaagaagtagcgaat

SEQ ID NO: 18727 - DNA, 20 bp, Artificial Sequence
  chemically synthesized
atcatttgtttcttcaaata

SEQ ID NO: 18728 - DNA, 20 bp, Artificial Sequence
  chemically synthesized
tatttcccccttatgttctt

SEQ ID NO: 18729 - DNA, 20 bp, Artificial Sequence
  chemically synthesized
aaaaatgtttgcatctacca

SEQ ID NO: 18730 - DNA, 20 bp, Artificial Sequence
  chemically synthesized
aaatacgtaatctaacaaac

SEQ ID NO: 18731 - DNA, 20 bp, Artificial Sequence
  chemically synthesized
aatacgtaatctaacaaaca

SEQ ID NO: 18732 - DNA, 20 bp, Artificial Sequence
  chemically synthesized
ctaacaaacaaggatgtttt

SEQ ID NO: 18733 - DNA, 20 bp, Artificial Sequence
  chemically synthesized
aaggatgttttaagatctct

SEQ ID NO: 18734 - DNA, 20 bp, Artificial Sequence
  chemically synthesized
atgttttaagatctctgagt

SEQ ID NO: 18735 - DNA, 20 bp, Artificial Sequence
  chemically synthesized
agatctctgagtaagatgca

SEQ ID NO: 18736 - DNA, 20 bp, Artificial Sequence
  chemically synthesized
agatgcatagttgcaaataa

SEQ ID NO: 18737 - DNA, 20 bp, Artificial Sequence
  chemically synthesized
gatgcatagttgcaaataaa

SEQ ID NO: 18738 - DNA, 20 bp, Artificial Sequence
  chemically synthesized
tgcatagttgcaaataaaag

SEQ ID NO: 18739 - DNA, 20 bp, Artificial Sequence
  chemically synthesized
tgcaaataaaaggagttttc

SEQ ID NO: 18740 - DNA, 20 bp, Artificial Sequence
  chemically synthesized
gcaaataaaaggagttttca

SEQ ID NO: 18741 - DNA, 20 bp, Artificial Sequence
  chemically synthesized
atctaataaatgtgtaccat

SEQ ID NO: 18742 - DNA, 20 bp, Artificial Sequence
  chemically synthesized
tgtgtaccatcagaaactta

SEQ ID NO: 18743 - DNA, 20 bp, Artificial Sequence
  chemically synthesized
aaacttatggtatattctcc

SEQ ID NO: 18744 - DNA, 20 bp, Artificial Sequence
  chemically synthesized
tatggtatattctcctggaa

SEQ ID NO: 18745 - DNA, 20 bp, Artificial Sequence
  chemically synthesized
atattctcctggaaaagatg

SEQ ID NO: 18746 - DNA, 20 bp, Artificial Sequence
  chemically synthesized
tcctggaaaagatgaagatg

SEQ ID NO: 18747 - DNA, 20 bp, Artificial Sequence
  chemically synthesized
aagatgaagatgaagaaaat

SEQ ID NO: 18748 - DNA, 20 bp, Artificial Sequence
  chemically synthesized
agatgaagaaaataagtcta

SEQ ID NO: 18749 - DNA, 20 bp, Artificial Sequence
  chemically synthesized
tgaagaaaataagtctacag

SEQ ID NO: 18750 - DNA, 20 bp, Artificial Sequence
  chemically synthesized
aagaaaataagtctacagaa

SEQ ID NO: 18751 - DNA, 20 bp, Artificial Sequence
  chemically synthesized
agaaaataagtctacagaag

SEQ ID NO: 18752 - DNA, 20 bp, Artificial Sequence
  chemically synthesized
aaaataagtctacagaagag

SEQ ID NO: 18753 - DNA, 20 bp, Artificial Sequence
  chemically synthesized
acagaagaggagaaattctt

SEQ ID NO: 18754 - DNA, 20 bp, Artificial Sequence
  chemically synthesized
ttggaaattttgcatttttg

SEQ ID NO: 18755 - DNA, 20 bp, Artificial Sequence
  chemically synthesized
aaattttgcatttttgtgga

SEQ ID NO: 18756 - DNA, 20 bp, Artificial Sequence
  chemically synthesized
ttttgcatttttgtggatag

SEQ ID NO: 18757 - DNA, 20 bp, Artificial Sequence
  chemically synthesized
ttttgtggatagtggttttg

SEQ ID NO: 18758 - DNA, 20 bp, Artificial Sequence
  chemically synthesized
gtggatagtggttttgaaga

SEQ ID NO: 18759 - DNA, 20 bp, Artificial Sequence
  chemically synthesized
tagtggttttgaagaaagct

SEQ ID NO: 18760 - DNA, 20 bp, Artificial Sequence
  chemically synthesized
atatatttaaatatgttgct

SEQ ID NO: 18761 - DNA, 20 bp, Artificial Sequence
  chemically synthesized
gatgtgactcccacacttta

SEQ ID NO: 18762 - DNA, 20 bp, Artificial Sequence
  chemically synthesized
gactcccacactttaaagaa

SEQ ID NO: 18763 - DNA, 20 bp, Artificial Sequence
  chemically synthesized
taaagaaaagttcttcattt

SEQ ID NO: 18764 - DNA, 20 bp, Artificial Sequence
  chemically synthesized
ttttagttgcccttgcaaat

SEQ ID NO: 18765 - DNA, 20 bp, Artificial Sequence
  chemically synthesized
gttgcccttgcaaattggct

SEQ ID NO: 18766 - DNA, 20 bp, Artificial Sequence
  chemically synthesized
tcctcaacaaataattttga

SEQ ID NO: 18767 - DNA, 20 bp, Artificial Sequence
  chemically synthesized
tgatggtttctaaaattgtc

SEQ ID NO: 18768 - DNA, 20 bp, Artificial Sequence
  chemically synthesized
tctaaaattgtccagaattt

SEQ ID NO: 18769 - DNA, 20 bp, Artificial Sequence
  chemically synthesized
ctaaaattgtccagaatttg

SEQ ID NO: 18770 - DNA, 20 bp, Artificial Sequence
  chemically synthesized
ccagaatttgaggaaatact

SEQ ID NO: 18771 - DNA, 20 bp, Artificial Sequence
  chemically synthesized
tttgaggaaatacttagatg

SEQ ID NO: 18772 - DNA, 20 bp, Artificial Sequence
  chemically synthesized
gaggaaatacttagatgtag

SEQ ID NO: 18773 - DNA, 20 bp, Artificial Sequence
  chemically synthesized
gacatcaatttatgttaact

SEQ ID NO: 18774 - DNA, 20 bp, Artificial Sequence
  chemically synthesized
tgttaacttagatttattgt

SEQ ID NO: 18775 - DNA, 20 bp, Artificial Sequence
  chemically synthesized
aacttagatttattgttgga

SEQ ID NO: 18776 - DNA, 20 bp, Artificial Sequence
  chemically synthesized
agatttattgttggatggtt

SEQ ID NO: 18777 - DNA, 20 bp, Artificial Sequence
  chemically synthesized
taatcatgtctgttcttgtc

SEQ ID NO: 18778 - DNA, 20 bp, Artificial Sequence
  chemically synthesized
atgtctgttcttgtccagtc

SEQ ID NO: 18779 - DNA, 20 bp, Artificial Sequence
  chemically synthesized
tctgttcttgtccagtctag

SEQ ID NO: 18780 - DNA, 20 bp, Artificial Sequence
  chemically synthesized
acatctgaactgtgatttga

SEQ ID NO: 18781 - DNA, 20 bp, Artificial Sequence
  chemically synthesized
tttgacagtgtccttattat

SEQ ID NO: 18782 - DNA, 20 bp, Artificial Sequence
  chemically synthesized
tatcagactctgctcaatga

SEQ ID NO: 18783 - DNA, 20 bp, Artificial Sequence
  chemically synthesized
gtttaaacttctttttgata

SEQ ID NO: 18784 - DNA, 20 bp, Artificial Sequence
  chemically synthesized
cagtaaaaaacttttcctta

SEQ ID NO: 18785 - DNA, 20 bp, Artificial Sequence
  chemically synthesized
tccttaaagatgaaattctt

SEQ ID NO: 18786 - DNA, 20 bp, Artificial Sequence
  chemically synthesized
ccttaaagatgaaattctta

SEQ ID NO: 18787 - DNA, 20 bp, Artificial Sequence
  chemically synthesized
atgaaattcttaaggacaat

SEQ ID NO: 18788 - DNA, 20 bp, Artificial Sequence
  chemically synthesized
ttaaggacaattagcttgtg

SEQ ID NO: 18789 - DNA, 20 bp, Artificial Sequence
  chemically synthesized
tatgaaaattgcttgcattt

SEQ ID NO: 18790 - DNA, 20 bp, Artificial Sequence
  chemically synthesized
tgaaaattgcttgcattttg

SEQ ID NO: 18791 - DNA, 20 bp, Artificial Sequence
  chemically synthesized
cttgcattttggagttacat

SEQ ID NO: 18792 - DNA, 20 bp, Artificial Sequence
  chemically synthesized
tataaattaatgaatcctat

SEQ ID NO: 18793 - DNA, 20 bp, Artificial Sequence
  chemically synthesized
atcctattggtaccatataa

SEQ ID NO: 18794 - DNA, 20 bp, Artificial Sequence
  chemically synthesized
cttttgtgtctcgcctttca

SEQ ID NO: 18795 - DNA, 20 bp, Artificial Sequence
  chemically synthesized
ttttgtgtctcgcctttcaa

SEQ ID NO: 18796 - DNA, 20 bp, Artificial Sequence
  chemically synthesized
tttgtgtctcgcctttcaaa

SEQ ID NO: 18797 - DNA, 20 bp, Artificial Sequence
  chemically synthesized
tcaaagggcaattttccaaa

SEQ ID NO: 18798 - DNA, 20 bp, Artificial Sequence
  chemically synthesized
tccaaaaagtatattttgca

SEQ ID NO: 18799 - DNA, 20 bp, Artificial Sequence
  chemically synthesized
aaagtatattttgcatggct

SEQ ID NO: 18800 - DNA, 20 bp, Artificial Sequence
  chemically synthesized
aagtatattttgcatggctc

SEQ ID NO: 18801 - DNA, 20 bp, Artificial Sequence
  chemically synthesized
ttttgcatggctcaggctaa

SEQ ID NO: 18802 - DNA, 20 bp, Artificial Sequence
  chemically synthesized
caggctaaaagtaatgtctc

SEQ ID NO: 18803 - DNA, 20 bp, Artificial Sequence
  chemically synthesized
aaaagtaatgtctccagatg

SEQ ID NO: 18804 - DNA, 20 bp, Artificial Sequence
  chemically synthesized
cattgattgtgactattgat

SEQ ID NO: 18805 - DNA, 20 bp, Artificial Sequence
  chemically synthesized
ttgataagatttactatgta

SEQ ID NO: 18806 - DNA, 20 bp, Artificial Sequence
  chemically synthesized
agatttactatgtaaagtat

SEQ ID NO: 18807 - DNA, 20 bp, Artificial Sequence
  chemically synthesized
ctatgtaaagtataagttac

SEQ ID NO: 18808 - DNA, 20 bp, Artificial Sequence
  chemically synthesized
gttactggaataatacattt

SEQ ID NO: 18809 - DNA, 20 bp, Artificial Sequence
  chemically synthesized
aataatacatttaagaaata

SEQ ID NO: 18810 - DNA, 20 bp, Artificial Sequence
  chemically synthesized
aatacatttaagaaatatag

SEQ ID NO: 18811 - DNA, 20 bp, Artificial Sequence
  chemically synthesized
atagtagctattaaaacctg

SEQ ID NO: 18812 - DNA, 20 bp, Artificial Sequence
  chemically synthesized
aaacctgtagtctgatgaaa

SEQ ID NO: 18813 - DNA, 20 bp, Artificial Sequence
  chemically synthesized
tgaaatggaatatgttttga

SEQ ID NO: 18814 - DNA, 20 bp, Artificial Sequence
  chemically synthesized
atggaatatgttttgaaaga

SEQ ID NO: 18815 - DNA, 20 bp, Artificial Sequence
  chemically synthesized
gaatatgttttgaaagacag

SEQ ID NO: 18816 - DNA, 20 bp, Artificial Sequence
  chemically synthesized
gaaagacagcagtgaaaaat

SEQ ID NO: 18817 - DNA, 20 bp, Artificial Sequence
  chemically synthesized
agacagcagtgaaaaatgag

SEQ ID NO: 18818 - DNA, 20 bp, Artificial Sequence
  chemically synthesized
aaaaatgagaagtaatatat

SEQ ID NO: 18819 - DNA, 20 bp, Artificial Sequence
  chemically synthesized
taaaattgctttttgcaatt

SEQ ID NO: 18820 - DNA, 20 bp, Artificial Sequence
  chemically synthesized
tgctttttgcaattgagttg

SEQ ID NO: 18821 - DNA, 20 bp, Artificial Sequence
  chemically synthesized
attgagttgaagattgatgc

SEQ ID NO: 18822 - DNA, 20 bp, Artificial Sequence
  chemically synthesized
ttgagttgaagattgatgcc

SEQ ID NO: 18823 - DNA, 20 bp, Artificial Sequence
  chemically synthesized
tgccaggatcttattacctc

SEQ ID NO: 18824 - DNA, 20 bp, Artificial Sequence
  chemically synthesized
gccaggatcttattacctcc

SEQ ID NO: 18825 - DNA, 20 bp, Artificial Sequence
  chemically synthesized
attacctccaggatttcaca

SEQ ID NO: 18826 - DNA, 20 bp, Artificial Sequence
  chemically synthesized
ttacctccaggatttcacaa

SEQ ID NO: 18827 - DNA, 20 bp, Artificial Sequence
  chemically synthesized
gatttcacaaaggatttctt

SEQ ID NO: 18828 - DNA, 20 bp, Artificial Sequence
  chemically synthesized
cttgagtcatccccttgctc

SEQ ID NO: 18829 - DNA, 20 bp, Artificial Sequence
  chemically synthesized
cttgctctagctcatgaaca

SEQ ID NO: 18830 - DNA, 20 bp, Artificial Sequence
  chemically synthesized
tcatgaacaaagtattgctc

SEQ ID NO: 18831 - DNA, 20 bp, Artificial Sequence
  chemically synthesized
agtattgctcaagtaatcga

SEQ ID NO: 18832 - DNA, 20 bp, Artificial Sequence
  chemically synthesized
tctcacatgtgattattatt

SEQ ID NO: 18833 - DNA, 20 bp, Artificial Sequence
  chemically synthesized
attattatttagtgctgtca

SEQ ID NO: 18834 - DNA, 20 bp, Artificial Sequence
  chemically synthesized
ttattatttagtgctgtcac

SEQ ID NO: 18835 - DNA, 20 bp, Artificial Sequence
  chemically synthesized
tcacgggaaatatcctgcct

SEQ ID NO: 18836 - DNA, 20 bp, Artificial Sequence
  chemically synthesized
aatatcctgcctaagtttac

SEQ ID NO: 18837 - DNA, 20 bp, Artificial Sequence
  chemically synthesized
tatcctgcctaagtttactg

SEQ ID NO: 18838 - DNA, 20 bp, Artificial Sequence
  chemically synthesized
atcctgcctaagtttactgg

SEQ ID NO: 18839 - DNA, 20 bp, Artificial Sequence
  chemically synthesized
cctccctatgtcctcctacc

SEQ ID NO: 18840 - DNA, 20 bp, Artificial Sequence
  chemically synthesized
tttccttgcacactctactc

SEQ ID NO: 18841 - DNA, 20 bp, Artificial Sequence
  chemically synthesized
ttgcacactctactccagct

SEQ ID NO: 18842 - DNA, 20 bp, Artificial Sequence
  chemically synthesized
tgcacactctactccagctt

SEQ ID NO: 18843 - DNA, 20 bp, Artificial Sequence
  chemically synthesized
gcacactctactccagctta

SEQ ID NO: 18844 - DNA, 20 bp, Artificial Sequence
  chemically synthesized
ctctactccagcttagggcc

SEQ ID NO: 18845 - DNA, 20 bp, Artificial Sequence
  chemically synthesized
tctactccagcttagggcct

SEQ ID NO: 18846 - DNA, 20 bp, Artificial Sequence
  chemically synthesized
acccttttaattaccccatt

SEQ ID NO: 18847 - DNA, 20 bp, Artificial Sequence
  chemically synthesized
tcaatttttgccttttcaat

SEQ ID NO: 18848 - DNA, 20 bp, Artificial Sequence
  chemically synthesized
aaaatttatttatatatatt

SEQ ID NO: 18849 - DNA, 20 bp, Artificial Sequence
  chemically synthesized
atttatttatatatatttag

SEQ ID NO: 18850 - DNA, 20 bp, Artificial Sequence
  chemically synthesized
tttatttatatatatttaga

SEQ ID NO: 18851 - DNA, 20 bp, Artificial Sequence
  chemically synthesized
tatatttagaaggtatgtac

SEQ ID NO: 18852 - DNA, 20 bp, Artificial Sequence
  chemically synthesized
tcgttatcatgctgcttata

SEQ ID NO: 18853 - DNA, 20 bp, Artificial Sequence
  chemically synthesized
ctgcttataaagacatacct

SEQ ID NO: 18854 - DNA, 20 bp, Artificial Sequence
  chemically synthesized
tataaagacatacctgagac

SEQ ID NO: 18855 - DNA, 20 bp, Artificial Sequence
  chemically synthesized
ataaagacatacctgagact

SEQ ID NO: 18856 - DNA, 20 bp, Artificial Sequence
  chemically synthesized
cctgagactgggtaatttat

SEQ ID NO: 18857 - DNA, 20 bp, Artificial Sequence
  chemically synthesized
ctgagactgggtaatttata

SEQ ID NO: 18858 - DNA, 20 bp, Artificial Sequence
  chemically synthesized
aaaaacgtttaattgtctca

SEQ ID NO: 18859 - DNA, 20 bp, Artificial Sequence
  chemically synthesized
ttaattgtctcacagttcca

SEQ ID NO: 18860 - DNA, 20 bp, Artificial Sequence
  chemically synthesized
taattgtctcacagttccac

SEQ ID NO: 18861 - DNA, 20 bp, Artificial Sequence
  chemically synthesized
aattgtctcacagttccaca

SEQ ID NO: 18862 - DNA, 20 bp, Artificial Sequence
  chemically synthesized
gtctcacagttccacagggc

SEQ ID NO: 18863 - DNA, 20 bp, Artificial Sequence
  chemically synthesized
tctcacagttccacagggct

SEQ ID NO: 18864 - DNA, 20 bp, Artificial Sequence
  chemically synthesized
ctcacagttccacagggctg

SEQ ID NO: 18865 - DNA, 20 bp, Artificial Sequence
  chemically synthesized
cacagttccacagggctggg

SEQ ID NO: 18866 - DNA, 20 bp, Artificial Sequence
  chemically synthesized
acagttccacagggctgggg

SEQ ID NO: 18867 - DNA, 20 bp, Artificial Sequence
  chemically synthesized
ccacagggctggggaggcct

SEQ ID NO: 18868 - DNA, 20 bp, Artificial Sequence
  chemically synthesized
cacagggctggggaggcctc

SEQ ID NO: 18869 - DNA, 20 bp, Artificial Sequence
  chemically synthesized
cctcgggaaacttacaatca

SEQ ID NO: 18870 - DNA, 20 bp, Artificial Sequence
  chemically synthesized
cgggaaacttacaatcatgg

SEQ ID NO: 18871 - DNA, 20 bp, Artificial Sequence
  chemically synthesized
gaaacttacaatcatggcag

SEQ ID NO: 18872 - DNA, 20 bp, Artificial Sequence
  chemically synthesized
acttacaatcatggcagaag

SEQ ID NO: 18873 - DNA, 20 bp, Artificial Sequence
  chemically synthesized
caaacatgtccttcttcaca

SEQ ID NO: 18874 - DNA, 20 bp, Artificial Sequence
  chemically synthesized
acatgtccttcttcacatgg

SEQ ID NO: 18875 - DNA, 20 bp, Artificial Sequence
  chemically synthesized
tgtccttcttcacatggcag

SEQ ID NO: 18876 - DNA, 20 bp, Artificial Sequence
  chemically synthesized
cttcttcacatggcagcagc

SEQ ID NO: 18877 - DNA, 20 bp, Artificial Sequence
  chemically synthesized
cttcacatggcagcagcaag

SEQ ID NO: 18878 - DNA, 20 bp, Artificial Sequence
  chemically synthesized
cacatggcagcagcaagtag

SEQ ID NO: 18879 - DNA, 20 bp, Artificial Sequence
  chemically synthesized
cagcagcaagtagaagtgcc

SEQ ID NO: 18880 - DNA, 20 bp, Artificial Sequence
  chemically synthesized
caagtagaagtgccaagcaa

SEQ ID NO: 18881 - DNA, 20 bp, Artificial Sequence
  chemically synthesized
aagtagaagtgccaagcaaa

SEQ ID NO: 18882 - DNA, 20 bp, Artificial Sequence
  chemically synthesized
agtagaagtgccaagcaaaa

SEQ ID NO: 18883 - DNA, 20 bp, Artificial Sequence
  chemically synthesized
gtagaagtgccaagcaaaag

SEQ ID NO: 18884 - DNA, 20 bp, Artificial Sequence
  chemically synthesized
tagaagtgccaagcaaaagg

SEQ ID NO: 18885 - DNA, 20 bp, Artificial Sequence
  chemically synthesized
gtgccaagcaaaagggggaa

SEQ ID NO: 18886 - DNA, 20 bp, Artificial Sequence
  chemically synthesized
aaagccgcttataaaaccat

SEQ ID NO: 18887 - DNA, 20 bp, Artificial Sequence
  chemically synthesized
ataaaaccatcagatcttgt

SEQ ID NO: 18888 - DNA, 20 bp, Artificial Sequence
  chemically synthesized
ttgtaagaactcactatcac

SEQ ID NO: 18889 - DNA, 20 bp, Artificial Sequence
  chemically synthesized
taagaactcactatcacgag

SEQ ID NO: 18890 - DNA, 20 bp, Artificial Sequence
  chemically synthesized
agaactcactatcacgagaa

SEQ ID NO: 18891 - DNA, 20 bp, Artificial Sequence
  chemically synthesized
cactatcacgagaagagcat

SEQ ID NO: 18892 - DNA, 20 bp, Artificial Sequence
  chemically synthesized
ctatcacgagaagagcatga

SEQ ID NO: 18893 - DNA, 20 bp, Artificial Sequence
  chemically synthesized
aaatccctcccacaacacgt

SEQ ID NO: 18894 - DNA, 20 bp, Artificial Sequence
  chemically synthesized
aatccctcccacaacacgtg

SEQ ID NO: 18895 - DNA, 20 bp, Artificial Sequence
  chemically synthesized
cccacaacacgtgaggatta

SEQ ID NO: 18896 - DNA, 20 bp, Artificial Sequence
  chemically synthesized
ccacaacacgtgaggattat

SEQ ID NO: 18897 - DNA, 20 bp, Artificial Sequence
  chemically synthesized
gattatgggaactacaattc

SEQ ID NO: 18898 - DNA, 20 bp, Artificial Sequence
  chemically synthesized
tgggaactacaattcaagat

SEQ ID NO: 18899 - DNA, 20 bp, Artificial Sequence
  chemically synthesized
ctacaattcaagatgagatt

SEQ ID NO: 18900 - DNA, 20 bp, Artificial Sequence
  chemically synthesized
tacaattcaagatgagattt

SEQ ID NO: 18901 - DNA, 20 bp, Artificial Sequence
  chemically synthesized
aattcaagatgagatttggg

SEQ ID NO: 18902 - DNA, 20 bp, Artificial Sequence
  chemically synthesized
attcaagatgagatttgggt

SEQ ID NO: 18903 - DNA, 20 bp, Artificial Sequence
  chemically synthesized
ttcaagatgagatttgggtg

SEQ ID NO: 18904 - DNA, 20 bp, Artificial Sequence
  chemically synthesized
atgagatttgggtggggaca

SEQ ID NO: 18905 - DNA, 20 bp, Artificial Sequence
  chemically synthesized
atttgggtggggacacagtc

SEQ ID NO: 18906 - DNA, 20 bp, Artificial Sequence
  chemically synthesized
gggacacagtcaagctgtat

SEQ ID NO: 18907 - DNA, 20 bp, Artificial Sequence
  chemically synthesized
ggacacagtcaagctgtatc

SEQ ID NO: 18908 - DNA, 20 bp, Artificial Sequence
  chemically synthesized
gacacagtcaagctgtatca

SEQ ID NO: 18909 - DNA, 20 bp, Artificial Sequence
  chemically synthesized
gtcaagctgtatcagggtac

SEQ ID NO: 18910 - DNA, 20 bp, Artificial Sequence
  chemically synthesized
gctgtatcagggtacaagct

SEQ ID NO: 18911 - DNA, 20 bp, Artificial Sequence
  chemically synthesized
ctgtatcagggtacaagctc

SEQ ID NO: 18912 - DNA, 20 bp, Artificial Sequence
  chemically synthesized
ccttacatatgtatgttgca

SEQ ID NO: 18913 - DNA, 20 bp, Artificial Sequence
  chemically synthesized
tacatatgtatgttgcatag

SEQ ID NO: 18914 - DNA, 20 bp, Artificial Sequence
  chemically synthesized
atgtatgttgcatagtggtg

SEQ ID NO: 18915 - DNA, 20 bp, Artificial Sequence
  chemically synthesized
gttgcatagtggtgaagtct

SEQ ID NO: 18916 - DNA, 20 bp, Artificial Sequence
  chemically synthesized
agtggtgaagtctgagcttt

SEQ ID NO: 18917 - DNA, 20 bp, Artificial Sequence
  chemically synthesized
ggtgaagtctgagcttttag

SEQ ID NO: 18918 - DNA, 20 bp, Artificial Sequence
  chemically synthesized
ttagtggaccatcacctgaa

SEQ ID NO: 18919 - DNA, 20 bp, Artificial Sequence
  chemically synthesized
tgaatgttgtatccaatccg

SEQ ID NO: 18920 - DNA, 20 bp, Artificial Sequence
  chemically synthesized
gtatccaatccgtagttttt

SEQ ID NO: 18921 - DNA, 20 bp, Artificial Sequence
  chemically synthesized
cctatcctcccacctttctc

SEQ ID NO: 18922 - DNA, 20 bp, Artificial Sequence
  chemically synthesized
tcccacctttctctagtctc

SEQ ID NO: 18923 - DNA, 20 bp, Artificial Sequence
  chemically synthesized
gtctatgcttactcatcgtt

SEQ ID NO: 18924 - DNA, 20 bp, Artificial Sequence
  chemically synthesized
ctcatcgtttagctcccact

SEQ ID NO: 18925 - DNA, 20 bp, Artificial Sequence
  chemically synthesized
ccacttggctctcactaaat

SEQ ID NO: 18926 - DNA, 20 bp, Artificial Sequence
  chemically synthesized
gtgtttgactttctgtttct

SEQ ID NO: 18927 - DNA, 20 bp, Artificial Sequence
  chemically synthesized
tgtttctgagttatttcact

SEQ ID NO: 18928 - DNA, 20 bp, Artificial Sequence
  chemically synthesized
gtttctgagttatttcactg

SEQ ID NO: 18929 - DNA, 20 bp, Artificial Sequence
  chemically synthesized
tcactgaggataatgtcctc

SEQ ID NO: 18930 - DNA, 20 bp, Artificial Sequence
  chemically synthesized
tccagttctaaccatgtttc

SEQ ID NO: 18931 - DNA, 20 bp, Artificial Sequence
  chemically synthesized
cagttctaaccatgtttcta

SEQ ID NO: 18932 - DNA, 20 bp, Artificial Sequence
  chemically synthesized
ttctaaccatgtttctagag

SEQ ID NO: 18933 - DNA, 20 bp, Artificial Sequence
  chemically synthesized
catgatttcattctttttta

SEQ ID NO: 18934 - DNA, 20 bp, Artificial Sequence
  chemically synthesized
tttcattcttttttatggct

SEQ ID NO: 18935 - DNA, 20 bp, Artificial Sequence
  chemically synthesized
ttctttatccaatcgtccat

SEQ ID NO: 18936 - DNA, 20 bp, Artificial Sequence
  chemically synthesized
tttatccaatcgtccattgg

SEQ ID NO: 18937 - DNA, 20 bp, Artificial Sequence
  chemically synthesized
atcgtccattggtagacatt

SEQ ID NO: 18938 - DNA, 20 bp, Artificial Sequence
  chemically synthesized
tcgtccattggtagacattt

SEQ ID NO: 18939 - DNA, 20 bp, Artificial Sequence
  chemically synthesized
tgattccatatctttgctat

SEQ ID NO: 18940 - DNA, 20 bp, Artificial Sequence
  chemically synthesized
gattccatatctttgctatt

SEQ ID NO: 18941 - DNA, 20 bp, Artificial Sequence
  chemically synthesized
catatctttgctattgggaa

SEQ ID NO: 18942 - DNA, 20 bp, Artificial Sequence
  chemically synthesized
ctactttgaacatactaatg

SEQ ID NO: 18943 - DNA, 20 bp, Artificial Sequence
  chemically synthesized
taatatgatctctttcactt

SEQ ID NO: 18944 - DNA, 20 bp, Artificial Sequence
  chemically synthesized
aatatgatctctttcacttt

SEQ ID NO: 18945 - DNA, 20 bp, Artificial Sequence
  chemically synthesized
tttcactttgggtccatacc

SEQ ID NO: 18946 - DNA, 20 bp, Artificial Sequence
  chemically synthesized
cactttgggtccatacccag

SEQ ID NO: 18947 - DNA, 20 bp, Artificial Sequence
  chemically synthesized
tttgggtccatacccagtag

SEQ ID NO: 18948 - DNA, 20 bp, Artificial Sequence
  chemically synthesized
ttgggtccatacccagtagt

SEQ ID NO: 18949 - DNA, 20 bp, Artificial Sequence
  chemically synthesized
catacccagtagtgggattg

SEQ ID NO: 18950 - DNA, 20 bp, Artificial Sequence
  chemically synthesized
atacccagtagtgggattgc

SEQ ID NO: 18951 - DNA, 20 bp, Artificial Sequence
  chemically synthesized
agtgggattgcaggattgaa

SEQ ID NO: 18952 - DNA, 20 bp, Artificial Sequence
  chemically synthesized
gggattgcaggattgaatgg

SEQ ID NO: 18953 - DNA, 20 bp, Artificial Sequence
  chemically synthesized
ttgaatggtagttctgtttc

SEQ ID NO: 18954 - DNA, 20 bp, Artificial Sequence
  chemically synthesized
agttctgtttctagttcttt

SEQ ID NO: 18955 - DNA, 20 bp, Artificial Sequence
  chemically synthesized
tcttcatgctgtcttccata

SEQ ID NO: 18956 - DNA, 20 bp, Artificial Sequence
  chemically synthesized
ctaatttacattcttaccaa

SEQ ID NO: 18957 - DNA, 20 bp, Artificial Sequence
  chemically synthesized
cattcttaccaacagtgtat

SEQ ID NO: 18958 - DNA, 20 bp, Artificial Sequence
  chemically synthesized
gtttttgaactttataatga

SEQ ID NO: 18959 - DNA, 20 bp, Artificial Sequence
  chemically synthesized
ataatgatagccattctgac

SEQ ID NO: 18960 - DNA, 20 bp, Artificial Sequence
  chemically synthesized
atagccattctgactggcat

SEQ ID NO: 18961 - DNA, 20 bp, Artificial Sequence
  chemically synthesized
tagccattctgactggcata

SEQ ID NO: 18962 - DNA, 20 bp, Artificial Sequence
  chemically synthesized
gccattctgactggcataag

SEQ ID NO: 18963 - DNA, 20 bp, Artificial Sequence
  chemically synthesized
ccattctgactggcataagg

SEQ ID NO: 18964 - DNA, 20 bp, Artificial Sequence
  chemically synthesized
tggcataaggaggtatcata

SEQ ID NO: 18965 - DNA, 20 bp, Artificial Sequence
  chemically synthesized
cataaggaggtatcatatgg

SEQ ID NO: 18966 - DNA, 20 bp, Artificial Sequence
  chemically synthesized
aatttgcattctctgattat

SEQ ID NO: 18967 - DNA, 20 bp, Artificial Sequence
  chemically synthesized
aacttttttttgacgtttat

SEQ ID NO: 18968 - DNA, 20 bp, Artificial Sequence
  chemically synthesized
gccacttgtatgtcttcttt

SEQ ID NO: 18969 - DNA, 20 bp, Artificial Sequence
  chemically synthesized
tcttttggaaaatgtctgct

SEQ ID NO: 18970 - DNA, 20 bp, Artificial Sequence
  chemically synthesized
cttttggaaaatgtctgctc

SEQ ID NO: 18971 - DNA, 20 bp, Artificial Sequence
  chemically synthesized
aaaatgtctgctcaggacct

SEQ ID NO: 18972 - DNA, 20 bp, Artificial Sequence
  chemically synthesized
cctgagctcactgtatttgt

SEQ ID NO: 18973 - DNA, 20 bp, Artificial Sequence
  chemically synthesized
ctgagctcactgtatttgtc

SEQ ID NO: 18974 - DNA, 20 bp, Artificial Sequence
  chemically synthesized
tgagctcactgtatttgtca

SEQ ID NO: 18975 - DNA, 20 bp, Artificial Sequence
  chemically synthesized
ctgtatttgtcagggttccc

SEQ ID NO: 18976 - DNA, 20 bp, Artificial Sequence
  chemically synthesized
gtatttgtcagggttcccta

SEQ ID NO: 18977 - DNA, 20 bp, Artificial Sequence
  chemically synthesized
atttgtcagggttccctaga

SEQ ID NO: 18978 - DNA, 20 bp, Artificial Sequence
  chemically synthesized
gtcagggttccctagagaga

SEQ ID NO: 18979 - DNA, 20 bp, Artificial Sequence
  chemically synthesized
ccctagagagacagaactaa

SEQ ID NO: 18980 - DNA, 20 bp, Artificial Sequence
  chemically synthesized
cctagagagacagaactaat

SEQ ID NO: 18981 - DNA, 20 bp, Artificial Sequence
  chemically synthesized
tagagagacagaactaatag

SEQ ID NO: 18982 - DNA, 20 bp, Artificial Sequence
  chemically synthesized
gagacagaactaataggaga

SEQ ID NO: 18983 - DNA, 20 bp, Artificial Sequence
  chemically synthesized
cagaactaataggagataga

SEQ ID NO: 18984 - DNA, 20 bp, Artificial Sequence
  chemically synthesized
actaataggagatagataga

SEQ ID NO: 18985 - DNA, 20 bp, Artificial Sequence
  chemically synthesized
ataggagatagatagataga

SEQ ID NO: 18986 - DNA, 20 bp, Artificial Sequence
  chemically synthesized
gagatagatagatagataga

SEQ ID NO: 18987 - DNA, 20 bp, Artificial Sequence
  chemically synthesized
tagatagatagatagataga

SEQ ID NO: 18988 - DNA, 20 bp, Artificial Sequence
  chemically synthesized
tagatagatagatagataga

SEQ ID NO: 18989 - DNA, 20 bp, Artificial Sequence
  chemically synthesized
tagatagatagatagataga

SEQ ID NO: 18990 - DNA, 20 bp, Artificial Sequence
  chemically synthesized
tagatagatagatagataga

SEQ ID NO: 18991 - DNA, 20 bp, Artificial Sequence
  chemically synthesized
tagatagatagatagataga

SEQ ID NO: 18992 - DNA, 20 bp, Artificial Sequence
  chemically synthesized
gatagatagatagatagata

SEQ ID NO: 18993 - DNA, 20 bp, Artificial Sequence
  chemically synthesized
tagatagatagatatagatt

SEQ ID NO: 18994 - DNA, 20 bp, Artificial Sequence
  chemically synthesized
agatatagatttagatataa

SEQ ID NO: 18995 - DNA, 20 bp, Artificial Sequence
  chemically synthesized
gatatagatttagatataaa

SEQ ID NO: 18996 - DNA, 20 bp, Artificial Sequence
  chemically synthesized
atatagatttagatataaaa

SEQ ID NO: 18997 - DNA, 20 bp, Artificial Sequence
  chemically synthesized
atagatttagatataaaagg

SEQ ID NO: 18998 - DNA, 20 bp, Artificial Sequence
  chemically synthesized
gatataaaagggagtttatt

SEQ ID NO: 18999 - DNA, 20 bp, Artificial Sequence
  chemically synthesized
ataaaagggagtttattaag

SEQ ID NO: 19000 - DNA, 20 bp, Artificial Sequence
  chemically synthesized
gtgttaacttacacaatcac

SEQ ID NO: 19001 - DNA, 20 bp, Artificial Sequence
  chemically synthesized
tgttaacttacacaatcaca

SEQ ID NO: 19002 - DNA, 20 bp, Artificial Sequence
  chemically synthesized
acaatcacaaggtcccacaa

SEQ ID NO: 19003 - DNA, 20 bp, Artificial Sequence
  chemically synthesized
caatcacaaggtcccacaat

SEQ ID NO: 19004 - DNA, 20 bp, Artificial Sequence
  chemically synthesized
tcccacaataggccatctgc

SEQ ID NO: 19005 - DNA, 20 bp, Artificial Sequence
  chemically synthesized
cacaataggccatctgcaag

SEQ ID NO: 19006 - DNA, 20 bp, Artificial Sequence
  chemically synthesized
caataggccatctgcaagca

SEQ ID NO: 19007 - DNA, 20 bp, Artificial Sequence
  chemically synthesized
aataggccatctgcaagcag

SEQ ID NO: 19008 - DNA, 20 bp, Artificial Sequence
  chemically synthesized
taggccatctgcaagcagag

SEQ ID NO: 19009 - DNA, 20 bp, Artificial Sequence
  chemically synthesized
ccatctgcaagcagaggagc

SEQ ID NO: 19010 - DNA, 20 bp, Artificial Sequence
  chemically synthesized
catctgcaagcagaggagca

SEQ ID NO: 19011 - DNA, 20 bp, Artificial Sequence
  chemically synthesized
ctgcaagcagaggagcaagg

SEQ ID NO: 19012 - DNA, 20 bp, Artificial Sequence
  chemically synthesized
aagcagaggagcaaggaagc

SEQ ID NO: 19013 - DNA, 20 bp, Artificial Sequence
  chemically synthesized
aggagcaaggaagccagtcc

SEQ ID NO: 19014 - DNA, 20 bp, Artificial Sequence
  chemically synthesized
ggaagccagtccaagtccca

SEQ ID NO: 19015 - DNA, 20 bp, Artificial Sequence
  chemically synthesized
cagtccaagtcccaaagctg

SEQ ID NO: 19016 - DNA, 20 bp, Artificial Sequence
  chemically synthesized
agtccaagtcccaaagctga

SEQ ID NO: 19017 - DNA, 20 bp, Artificial Sequence
  chemically synthesized
agtcccaaagctgaaggact

SEQ ID NO: 19018 - DNA, 20 bp, Artificial Sequence
  chemically synthesized
tcccaaagctgaaggacttg

SEQ ID NO: 19019 - DNA, 20 bp, Artificial Sequence
  chemically synthesized
ggacttggagtccaatgttt

SEQ ID NO: 19020 - DNA, 20 bp, Artificial Sequence
  chemically synthesized
gacttggagtccaatgtttg

SEQ ID NO: 19021 - DNA, 20 bp, Artificial Sequence
  chemically synthesized
acttggagtccaatgtttga

SEQ ID NO: 19022 - DNA, 20 bp, Artificial Sequence
  chemically synthesized
tggagtccaatgtttgaggg

SEQ ID NO: 19023 - DNA, 20 bp, Artificial Sequence
  chemically synthesized
ggagtccaatgtttgagggc

SEQ ID NO: 19024 - DNA, 20 bp, Artificial Sequence
  chemically synthesized
gtccaatgtttgagggcagg

SEQ ID NO: 19025 - DNA, 20 bp, Artificial Sequence
  chemically synthesized
gtttgagggcaggaagcatc

SEQ ID NO: 19026 - DNA, 20 bp, Artificial Sequence
  chemically synthesized
agggcaggaagcatccagca

SEQ ID NO: 19027 - DNA, 20 bp, Artificial Sequence
  chemically synthesized
gggcaggaagcatccagcat

SEQ ID NO: 19028 - DNA, 20 bp, Artificial Sequence
  chemically synthesized
gcaggaagcatccagcatgg

SEQ ID NO: 19029 - DNA, 20 bp, Artificial Sequence
  chemically synthesized
gaagcatccagcatgggaga

SEQ ID NO: 19030 - DNA, 20 bp, Artificial Sequence
  chemically synthesized
tccagcatgggagaaagatg

SEQ ID NO: 19031 - DNA, 20 bp, Artificial Sequence
  chemically synthesized
ccagcatgggagaaagatgt

SEQ ID NO: 19032 - DNA, 20 bp, Artificial Sequence
  chemically synthesized
atgggagaaagatgtaggct

SEQ ID NO: 19033 - DNA, 20 bp, Artificial Sequence
  chemically synthesized
gggagaaagatgtaggcttg

SEQ ID NO: 19034 - DNA, 20 bp, Artificial Sequence
  chemically synthesized
ggagaaagatgtaggcttgg

SEQ ID NO: 19035 - DNA, 20 bp, Artificial Sequence
  chemically synthesized
aagatgtaggcttggaggct

SEQ ID NO: 19036 - DNA, 20 bp, Artificial Sequence
  chemically synthesized
tgtaggcttggaggctaagc

SEQ ID NO: 19037 - DNA, 20 bp, Artificial Sequence
  chemically synthesized
gcttggaggctaagccagtc

SEQ ID NO: 19038 - DNA, 20 bp, Artificial Sequence
  chemically synthesized
cttggaggctaagccagtcc

SEQ ID NO: 19039 - DNA, 20 bp, Artificial Sequence
  chemically synthesized
tttctgcctgctttatatcc

SEQ ID NO: 19040 - DNA, 20 bp, Artificial Sequence
  chemically synthesized
gctttatatcctggccacac

SEQ ID NO: 19041 - DNA, 20 bp, Artificial Sequence
  chemically synthesized
tggccacactggcaactgat

SEQ ID NO: 19042 - DNA, 20 bp, Artificial Sequence
  chemically synthesized
cacactggcaactgattaga

SEQ ID NO: 19043 - DNA, 20 bp, Artificial Sequence
  chemically synthesized
ctgattagatggtgcccacc

SEQ ID NO: 19044 - DNA, 20 bp, Artificial Sequence
  chemically synthesized
agatggtgcccacccagatt

SEQ ID NO: 19045 - DNA, 20 bp, Artificial Sequence
  chemically synthesized
gatggtgcccacccagatta

SEQ ID NO: 19046 - DNA, 20 bp, Artificial Sequence
  chemically synthesized
atggtgcccacccagattaa

SEQ ID NO: 19047 - DNA, 20 bp, Artificial Sequence
  chemically synthesized
gtgcccacccagattaaggg

SEQ ID NO: 19048 - DNA, 20 bp, Artificial Sequence
  chemically synthesized
tgcccacccagattaagggt

SEQ ID NO: 19049 - DNA, 20 bp, Artificial Sequence
  chemically synthesized
aagggtgggtctgcctttcc

SEQ ID NO: 19050 - DNA, 20 bp, Artificial Sequence
  chemically synthesized
actaaaatgttaatctcctt

SEQ ID NO: 19051 - DNA, 20 bp, Artificial Sequence
  chemically synthesized
ctcctttggcaataccctca

SEQ ID NO: 19052 - DNA, 20 bp, Artificial Sequence
  chemically synthesized
aataccctcacagacacact

SEQ ID NO: 19053 - DNA, 20 bp, Artificial Sequence
  chemically synthesized
ataccctcacagacacactc

SEQ ID NO: 19054 - DNA, 20 bp, Artificial Sequence
  chemically synthesized
ttgcacacttcaatccaatc

SEQ ID NO: 19055 - DNA, 20 bp, Artificial Sequence
  chemically synthesized
aatccaatcaagttgacact

SEQ ID NO: 19056 - DNA, 20 bp, Artificial Sequence
  chemically synthesized
cactcagtattaaccatcac

SEQ ID NO: 19057 - DNA, 20 bp, Artificial Sequence
  chemically synthesized
agtccatcgcttgtcaactt

SEQ ID NO: 19058 - DNA, 20 bp, Artificial Sequence
  chemically synthesized
tgagcctatacacatcccct

SEQ ID NO: 19059 - DNA, 20 bp, Artificial Sequence
  chemically synthesized
gagcctatacacatcccctg

SEQ ID NO: 19060 - DNA, 20 bp, Artificial Sequence
  chemically synthesized
tcatacattatcttcaaata

SEQ ID NO: 19061 - DNA, 20 bp, Artificial Sequence
  chemically synthesized
cttcaaataaagacaacaat

SEQ ID NO: 19062 - DNA, 20 bp, Artificial Sequence
  chemically synthesized
aatacttaaatgctgatatg

SEQ ID NO: 19063 - DNA, 20 bp, Artificial Sequence
  chemically synthesized
aaatcttatgtcacatgata

SEQ ID NO: 19064 - DNA, 20 bp, Artificial Sequence
  chemically synthesized
aatcttatgtcacatgataa

SEQ ID NO: 19065 - DNA, 20 bp, Artificial Sequence
  chemically synthesized
atgtcacatgataaaggaaa

SEQ ID NO: 19066 - DNA, 20 bp, Artificial Sequence
  chemically synthesized
tgtcacatgataaaggaaaa

SEQ ID NO: 19067 - DNA, 20 bp, Artificial Sequence
  chemically synthesized
cacatgataaaggaaaaagg

SEQ ID NO: 19068 - DNA, 20 bp, Artificial Sequence
  chemically synthesized
gtaaaatgtatatattttct

SEQ ID NO: 19069 - DNA, 20 bp, Artificial Sequence
  chemically synthesized
tgtatatattttcttagtac

SEQ ID NO: 19070 - DNA, 20 bp, Artificial Sequence
  chemically synthesized
tttcttagtacaagtgtata

SEQ ID NO: 19071 - DNA, 20 bp, Artificial Sequence
  chemically synthesized
tacaagtgtatacagacacg

SEQ ID NO: 19072 - DNA, 20 bp, Artificial Sequence
  chemically synthesized
acaagtgtatacagacacga

SEQ ID NO: 19073 - DNA, 20 bp, Artificial Sequence
  chemically synthesized
cacgaaggtgtttttaacaa

SEQ ID NO: 19074 - DNA, 20 bp, Artificial Sequence
  chemically synthesized
gaaggtgtttttaacaaaag

SEQ ID NO: 19075 - DNA, 20 bp, Artificial Sequence
  chemically synthesized
aaggtgtttttaacaaaaga

SEQ ID NO: 19076 - DNA, 20 bp, Artificial Sequence
  chemically synthesized
ggtgtttttaacaaaagaag

SEQ ID NO: 19077 - DNA, 20 bp, Artificial Sequence
  chemically synthesized
gtgtttttaacaaaagaagg

SEQ ID NO: 19078 - DNA, 20 bp, Artificial Sequence
  chemically synthesized
ggaaatactcatgacaatta

SEQ ID NO: 19079 - DNA, 20 bp, Artificial Sequence
  chemically synthesized
acagtccttgtatctgcaat

SEQ ID NO: 19080 - DNA, 20 bp, Artificial Sequence
  chemically synthesized
tgcaattggtcacgtgatcg

SEQ ID NO: 19081 - DNA, 20 bp, Artificial Sequence
  chemically synthesized
attggtcacgtgatcgtagc

SEQ ID NO: 19082 - DNA, 20 bp, Artificial Sequence
  chemically synthesized
ttctgtattccctttgccct

SEQ ID NO: 19083 - DNA, 20 bp, Artificial Sequence
  chemically synthesized
gtattccctttgccctcagc

SEQ ID NO: 19084 - DNA, 20 bp, Artificial Sequence
  chemically synthesized
tttgccctcagcaagcacct

SEQ ID NO: 19085 - DNA, 20 bp, Artificial Sequence
  chemically synthesized
gccctcagcaagcacctcag

SEQ ID NO: 19086 - DNA, 20 bp, Artificial Sequence
  chemically synthesized
ccctcagcaagcacctcagc

SEQ ID NO: 19087 - DNA, 20 bp, Artificial Sequence
  chemically synthesized
ttttttttttttttttttcc

SEQ ID NO: 19088 - DNA, 20 bp, Artificial Sequence
  chemically synthesized
tttttttttttttttcctgg

SEQ ID NO: 19089 - DNA, 20 bp, Artificial Sequence
  chemically synthesized
tttttttttttttcctggtg

SEQ ID NO: 19090 - DNA, 20 bp, Artificial Sequence
  chemically synthesized
gtgacccaaacctttatttg

SEQ ID NO: 19091 - DNA, 20 bp, Artificial Sequence
  chemically synthesized
cctttatttgtagtcctgcc

SEQ ID NO: 19092 - DNA, 20 bp, Artificial Sequence
  chemically synthesized
atttgtagtcctgcctggaa

SEQ ID NO: 19093 - DNA, 20 bp, Artificial Sequence
  chemically synthesized
gtcctgcctggaatggcctg

SEQ ID NO: 19094 - DNA, 20 bp, Artificial Sequence
  chemically synthesized
ctgcctggaatggcctgtag

SEQ ID NO: 19095 - DNA, 20 bp, Artificial Sequence
  chemically synthesized
tttcccactgaccttaattc

SEQ ID NO: 19096 - DNA, 20 bp, Artificial Sequence
  chemically synthesized
ttcccactgaccttaattcc

SEQ ID NO: 19097 - DNA, 20 bp, Artificial Sequence
  chemically synthesized
ctgaccttaattccaggaca

SEQ ID NO: 19098 - DNA, 20 bp, Artificial Sequence
  chemically synthesized
ttccaggacatggtaaaact

SEQ ID NO: 19099 - DNA, 20 bp, Artificial Sequence
  chemically synthesized
ccaggacatggtaaaactaa

SEQ ID NO: 19100 - DNA, 20 bp, Artificial Sequence
  chemically synthesized
aaaactaagagacaccctaa

SEQ ID NO: 19101 - DNA, 20 bp, Artificial Sequence
  chemically synthesized
acgcttccttacctccattg

SEQ ID NO: 19102 - DNA, 20 bp, Artificial Sequence
  chemically synthesized
gcttccttacctccattgtg

SEQ ID NO: 19103 - DNA, 20 bp, Artificial Sequence
  chemically synthesized
ttacctccattgtggagttg

SEQ ID NO: 19104 - DNA, 20 bp, Artificial Sequence
  chemically synthesized
gtagactgatttcatcttga

SEQ ID NO: 19105 - DNA, 20 bp, Artificial Sequence
  chemically synthesized
ctgatttcatcttgatagtc

SEQ ID NO: 19106 - DNA, 20 bp, Artificial Sequence
  chemically synthesized
tgatttcatcttgatagtct

SEQ ID NO: 19107 - DNA, 20 bp, Artificial Sequence
  chemically synthesized
atagtctgggttaatcaccg

SEQ ID NO: 19108 - DNA, 20 bp, Artificial Sequence
  chemically synthesized
caacactgtaactctcttct

SEQ ID NO: 19109 - DNA, 20 bp, Artificial Sequence
  chemically synthesized
cttcttagcctgttgactta

SEQ ID NO: 19110 - DNA, 20 bp, Artificial Sequence
  chemically synthesized
ttcttagcctgttgacttaa

SEQ ID NO: 19111 - DNA, 20 bp, Artificial Sequence
  chemically synthesized
ttagcctgttgacttaaagg

SEQ ID NO: 19112 - DNA, 20 bp, Artificial Sequence
  chemically synthesized
tagcctgttgacttaaaggt

SEQ ID NO: 19113 - DNA, 20 bp, Artificial Sequence
  chemically synthesized
gcctgttgacttaaaggtgg

SEQ ID NO: 19114 - DNA, 20 bp, Artificial Sequence
  chemically synthesized
cctgttgacttaaaggtggg

SEQ ID NO: 19115 - DNA, 20 bp, Artificial Sequence
  chemically synthesized
tgttgacttaaaggtgggag

SEQ ID NO: 19116 - DNA, 20 bp, Artificial Sequence
  chemically synthesized
ttaaaggtgggaggagccca

SEQ ID NO: 19117 - DNA, 20 bp, Artificial Sequence
  chemically synthesized
tgggaggagcccaaagtgtc

SEQ ID NO: 19118 - DNA, 20 bp, Artificial Sequence
  chemically synthesized
gggaggagcccaaagtgtcc

SEQ ID NO: 19119 - DNA, 20 bp, Artificial Sequence
  chemically synthesized
aggagcccaaagtgtccagg

SEQ ID NO: 19120 - DNA, 20 bp, Artificial Sequence
  chemically synthesized
caggtggcaatcttaatttg

SEQ ID NO: 19121 - DNA, 20 bp, Artificial Sequence
  chemically synthesized
aatcttaatttgcagtttaa

SEQ ID NO: 19122 - DNA, 20 bp, Artificial Sequence
  chemically synthesized
ggaatcattattgtgtcacc

SEQ ID NO: 19123 - DNA, 20 bp, Artificial Sequence
  chemically synthesized
atcattattgtgtcacctgg

SEQ ID NO: 19124 - DNA, 20 bp, Artificial Sequence
  chemically synthesized
attattgtgtcacctggcgg

SEQ ID NO: 19125 - DNA, 20 bp, Artificial Sequence
  chemically synthesized
ggcggcagtgttcctccctc

SEQ ID NO: 19126 - DNA, 20 bp, Artificial Sequence
  chemically synthesized
gtgttcctccctctggaact

SEQ ID NO: 19127 - DNA, 20 bp, Artificial Sequence
  chemically synthesized
cctctggaactaagacctct

SEQ ID NO: 19128 - DNA, 20 bp, Artificial Sequence
  chemically synthesized
tggaactaagacctctaagc

SEQ ID NO: 19129 - DNA, 20 bp, Artificial Sequence
  chemically synthesized
aactaagacctctaagccag

SEQ ID NO: 19130 - DNA, 20 bp, Artificial Sequence
  chemically synthesized
gccagcagaacataatgcca

SEQ ID NO: 19131 - DNA, 20 bp, Artificial Sequence
  chemically synthesized
ccagcagaacataatgccat

SEQ ID NO: 19132 - DNA, 20 bp, Artificial Sequence
  chemically synthesized
agaacataatgccatgggaa

SEQ ID NO: 19133 - DNA, 20 bp, Artificial Sequence
  chemically synthesized
gaacataatgccatgggaac

SEQ ID NO: 19134 - DNA, 20 bp, Artificial Sequence
  chemically synthesized
cataatgccatgggaacagg

SEQ ID NO: 19135 - DNA, 20 bp, Artificial Sequence
  chemically synthesized
acaggaagcaaaaattttgc

SEQ ID NO: 19136 - DNA, 20 bp, Artificial Sequence
  chemically synthesized
ggaagcaaaaattttgctag

SEQ ID NO: 19137 - DNA, 20 bp, Artificial Sequence
  chemically synthesized
aaattttgctagtggaacac

SEQ ID NO: 19138 - DNA, 20 bp, Artificial Sequence
  chemically synthesized
aattttgctagtggaacact

SEQ ID NO: 19139 - DNA, 20 bp, Artificial Sequence
  chemically synthesized
attttgctagtggaacacta

SEQ ID NO: 19140 - DNA, 20 bp, Artificial Sequence
  chemically synthesized
ttttgctagtggaacactag

SEQ ID NO: 19141 - DNA, 20 bp, Artificial Sequence
  chemically synthesized
tagtggaacactaggggtga

SEQ ID NO: 19142 - DNA, 20 bp, Artificial Sequence
  chemically synthesized
ggaacactaggggtgatggt

SEQ ID NO: 19143 - DNA, 20 bp, Artificial Sequence
  chemically synthesized
acactaggggtgatggtgag

SEQ ID NO: 19144 - DNA, 20 bp, Artificial Sequence
  chemically synthesized
cacttccaccctttgattcc

SEQ ID NO: 19145 - DNA, 20 bp, Artificial Sequence
  chemically synthesized
ggacccgtgaatcctgtcta

SEQ ID NO: 19146 - DNA, 20 bp, Artificial Sequence
  chemically synthesized
gacccgtgaatcctgtctat

SEQ ID NO: 19147 - DNA, 20 bp, Artificial Sequence
  chemically synthesized
cccgtgaatcctgtctatgg

SEQ ID NO: 19148 - DNA, 20 bp, Artificial Sequence
  chemically synthesized
aatcctgtctatgggagaaa

SEQ ID NO: 19149 - DNA, 20 bp, Artificial Sequence
  chemically synthesized
ggagaaacagtaccatatat

SEQ ID NO: 19150 - DNA, 20 bp, Artificial Sequence
  chemically synthesized
ccatatattggacactgatt

SEQ ID NO: 19151 - DNA, 20 bp, Artificial Sequence
  chemically synthesized
atatattggacactgattca

SEQ ID NO: 19152 - DNA, 20 bp, Artificial Sequence
  chemically synthesized
acactgattcagagcataca

SEQ ID NO: 19153 - DNA, 20 bp, Artificial Sequence
  chemically synthesized
tcagagcatacacagccttc

SEQ ID NO: 19154 - DNA, 20 bp, Artificial Sequence
  chemically synthesized
agagcatacacagccttctg

SEQ ID NO: 19155 - DNA, 20 bp, Artificial Sequence
  chemically synthesized
ccttctggagaactttgccc

SEQ ID NO: 19156 - DNA, 20 bp, Artificial Sequence
  chemically synthesized
cttctggagaactttgcccc

SEQ ID NO: 19157 - DNA, 20 bp, Artificial Sequence
  chemically synthesized
aactttgccccaggcctgca

SEQ ID NO: 19158 - DNA, 20 bp, Artificial Sequence
  chemically synthesized
gcctgcaaagtattgtcacc

SEQ ID NO: 19159 - DNA, 20 bp, Artificial Sequence
  chemically synthesized
gcaaagtattgtcacctagt

SEQ ID NO: 19160 - DNA, 20 bp, Artificial Sequence
  chemically synthesized
cattgtaatcgtgacttcaa

SEQ ID NO: 19161 - DNA, 20 bp, Artificial Sequence
  chemically synthesized
attgtaatcgtgacttcaaa

SEQ ID NO: 19162 - DNA, 20 bp, Artificial Sequence
  chemically synthesized
gacttcaaaaggccattcaa

SEQ ID NO: 19163 - DNA, 20 bp, Artificial Sequence
  chemically synthesized
aggccattcaaaagctgctt

SEQ ID NO: 19164 - DNA, 20 bp, Artificial Sequence
  chemically synthesized
ggccattcaaaagctgcttc

SEQ ID NO: 19165 - DNA, 20 bp, Artificial Sequence
  chemically synthesized
caaaagctgcttcaggatga

SEQ ID NO: 19166 - DNA, 20 bp, Artificial Sequence
  chemically synthesized
aaaagctgcttcaggatgat

SEQ ID NO: 19167 - DNA, 20 bp, Artificial Sequence
  chemically synthesized
aaagctgcttcaggatgata

SEQ ID NO: 19168 - DNA, 20 bp, Artificial Sequence
  chemically synthesized
cttcaggatgatagggatca

SEQ ID NO: 19169 - DNA, 20 bp, Artificial Sequence
  chemically synthesized
aggatgatagggatcatggt

SEQ ID NO: 19170 - DNA, 20 bp, Artificial Sequence
  chemically synthesized
gatagggatcatggtaagac

SEQ ID NO: 19171 - DNA, 20 bp, Artificial Sequence
  chemically synthesized
gtaagaccagtaaattccat

SEQ ID NO: 19172 - DNA, 20 bp, Artificial Sequence
  chemically synthesized
ccagtaaattccatgagcat

SEQ ID NO: 19173 - DNA, 20 bp, Artificial Sequence
  chemically synthesized
agcccactgtcacacttctt

SEQ ID NO: 19174 - DNA, 20 bp, Artificial Sequence
  chemically synthesized
gtcacacttctttagccata

SEQ ID NO: 19175 - DNA, 20 bp, Artificial Sequence
  chemically synthesized
cacttctttagccataaagt

SEQ ID NO: 19176 - DNA, 20 bp, Artificial Sequence
  chemically synthesized
ttctttagccataaagtgag

SEQ ID NO: 19177 - DNA, 20 bp, Artificial Sequence
  chemically synthesized
tagccataaagtgagtggct

SEQ ID NO: 19178 - DNA, 20 bp, Artificial Sequence
  chemically synthesized
cataaagtgagtggcttggt

SEQ ID NO: 19179 - DNA, 20 bp, Artificial Sequence
  chemically synthesized
aaagtgagtggcttggtcag

SEQ ID NO: 19180 - DNA, 20 bp, Artificial Sequence
  chemically synthesized
tggtcagaagcaatgctgtg

SEQ ID NO: 19181 - DNA, 20 bp, Artificial Sequence
  chemically synthesized
tgctgtgtggaataccatga

SEQ ID NO: 19182 - DNA, 20 bp, Artificial Sequence
  chemically synthesized
tgtgtggaataccatgacag

SEQ ID NO: 19183 - DNA, 20 bp, Artificial Sequence
  chemically synthesized
gaataccatgacagtggata

SEQ ID NO: 19184 - DNA, 20 bp, Artificial Sequence
  chemically synthesized
tacggcattctgtgattcca

SEQ ID NO: 19185 - DNA, 20 bp, Artificial Sequence
  chemically synthesized
gcattctgtgattccatgga

SEQ ID NO: 19186 - DNA, 20 bp, Artificial Sequence
  chemically synthesized
ttctgtgattccatggatgg

SEQ ID NO: 19187 - DNA, 20 bp, Artificial Sequence
  chemically synthesized
gattccatggatggtagtct

SEQ ID NO: 19188 - DNA, 20 bp, Artificial Sequence
  chemically synthesized
atggatggtagtcttggcat

SEQ ID NO: 19189 - DNA, 20 bp, Artificial Sequence
  chemically synthesized
gtagtcttggcataagcatt

SEQ ID NO: 19190 - DNA, 20 bp, Artificial Sequence
  chemically synthesized
cttggcataagcattgagtt

SEQ ID NO: 19191 - DNA, 20 bp, Artificial Sequence
  chemically synthesized
ttggcataagcattgagttc

SEQ ID NO: 19192 - DNA, 20 bp, Artificial Sequence
  chemically synthesized
ataagcattgagttcaggat

SEQ ID NO: 19193 - DNA, 20 bp, Artificial Sequence
  chemically synthesized
taagcattgagttcaggatt

SEQ ID NO: 19194 - DNA, 20 bp, Artificial Sequence
  chemically synthesized
aggattgggaaacccatatc

SEQ ID NO: 19195 - DNA, 20 bp, Artificial Sequence
  chemically synthesized
gattgggaaacccatatcca

SEQ ID NO: 19196 - DNA, 20 bp, Artificial Sequence
  chemically synthesized
gggaaacccatatccagagt

SEQ ID NO: 19197 - DNA, 20 bp, Artificial Sequence
  chemically synthesized
tccagagtaagtgtctattc

SEQ ID NO: 19198 - DNA, 20 bp, Artificial Sequence
  chemically synthesized
gagtaagtgtctattccagt

SEQ ID NO: 19199 - DNA, 20 bp, Artificial Sequence
  chemically synthesized
agtaagtgtctattccagtg

SEQ ID NO: 19200 - DNA, 20 bp, Artificial Sequence
  chemically synthesized
gtgtctattccagtgaggac

SEQ ID NO: 19201 - DNA, 20 bp, Artificial Sequence
  chemically synthesized
agcctctgccctttccatga

SEQ ID NO: 19202 - DNA, 20 bp, Artificial Sequence
  chemically synthesized
ctctgccctttccatgatgg

SEQ ID NO: 19203 - DNA, 20 bp, Artificial Sequence
  chemically synthesized
ctgccctttccatgatggaa

SEQ ID NO: 19204 - DNA, 20 bp, Artificial Sequence
  chemically synthesized
tgccctttccatgatggaag

SEQ ID NO: 19205 - DNA, 20 bp, Artificial Sequence
  chemically synthesized
caatataatcaacctgccac

SEQ ID NO: 19206 - DNA, 20 bp, Artificial Sequence
  chemically synthesized
aatataatcaacctgccacc

SEQ ID NO: 19207 - DNA, 20 bp, Artificial Sequence
  chemically synthesized
ataatcaacctgccaccagg

SEQ ID NO: 19208 - DNA, 20 bp, Artificial Sequence
  chemically synthesized
tcaacctgccaccaggtagc

SEQ ID NO: 19209 - DNA, 20 bp, Artificial Sequence
  chemically synthesized
ggtagctggctgatcacccc

SEQ ID NO: 19210 - DNA, 20 bp, Artificial Sequence
  chemically synthesized
gtagctggctgatcaccccg

SEQ ID NO: 19211 - DNA, 20 bp, Artificial Sequence
  chemically synthesized
tggctgatcaccccgaggaa

SEQ ID NO: 19212 - DNA, 20 bp, Artificial Sequence
  chemically synthesized
ccgaggaatggtgccatatc

SEQ ID NO: 19213 - DNA, 20 bp, Artificial Sequence
  chemically synthesized
cgaggaatggtgccatatca

SEQ ID NO: 19214 - DNA, 20 bp, Artificial Sequence
  chemically synthesized
gaggaatggtgccatatcaa

SEQ ID NO: 19215 - DNA, 20 bp, Artificial Sequence
  chemically synthesized
atggtgccatatcaagggct

SEQ ID NO: 19216 - DNA, 20 bp, Artificial Sequence
  chemically synthesized
ccatatcaagggcttagtgt

SEQ ID NO: 19217 - DNA, 20 bp, Artificial Sequence
  chemically synthesized
ttagtgttggtctctgatgc

SEQ ID NO: 19218 - DNA, 20 bp, Artificial Sequence
  chemically synthesized
tgttggtctctgatgctggc

SEQ ID NO: 19219 - DNA, 20 bp, Artificial Sequence
  chemically synthesized
tggtctctgatgctggcaag

SEQ ID NO: 19220 - DNA, 20 bp, Artificial Sequence
  chemically synthesized
tctctgatgctggcaagcag

SEQ ID NO: 19221 - DNA, 20 bp, Artificial Sequence
  chemically synthesized
atgctggcaagcagtggctg

SEQ ID NO: 19222 - DNA, 20 bp, Artificial Sequence
  chemically synthesized
tggcaagcagtggctgtggc

SEQ ID NO: 19223 - DNA, 20 bp, Artificial Sequence
  chemically synthesized
ggcaagcagtggctgtggcc

SEQ ID NO: 19224 - DNA, 20 bp, Artificial Sequence
  chemically synthesized
agcagtggctgtggccaggt

SEQ ID NO: 19225 - DNA, 20 bp, Artificial Sequence
  chemically synthesized
ggctgtggccaggtcagctt

SEQ ID NO: 19226 - DNA, 20 bp, Artificial Sequence
  chemically synthesized
gtggccaggtcagctttggt

SEQ ID NO: 19227 - DNA, 20 bp, Artificial Sequence
  chemically synthesized
gccaggtcagctttggtgag

SEQ ID NO: 19228 - DNA, 20 bp, Artificial Sequence
  chemically synthesized
aggtcagctttggtgagtgg

SEQ ID NO: 19229 - DNA, 20 bp, Artificial Sequence
  chemically synthesized
gagtggaagtccatgttgct

SEQ ID NO: 19230 - DNA, 20 bp, Artificial Sequence
  chemically synthesized
aagtccatgttgctgagccc

SEQ ID NO: 19231 - DNA, 20 bp, Artificial Sequence
  chemically synthesized
aacttccatccctgcaactg

SEQ ID NO: 19232 - DNA, 20 bp, Artificial Sequence
  chemically synthesized
aactgtggccactttgttca

SEQ ID NO: 19233 - DNA, 20 bp, Artificial Sequence
  chemically synthesized
actgtggccactttgttcat

SEQ ID NO: 19234 - DNA, 20 bp, Artificial Sequence
  chemically synthesized
cactttgttcatgggtccat

SEQ ID NO: 19235 - DNA, 20 bp, Artificial Sequence
  chemically synthesized
ggtccattggacgatgacat

SEQ ID NO: 19236 - DNA, 20 bp, Artificial Sequence
  chemically synthesized
ccattggacgatgacatgag

SEQ ID NO: 19237 - DNA, 20 bp, Artificial Sequence
  chemically synthesized
ggacgatgacatgagtggcc

SEQ ID NO: 19238 - DNA, 20 bp, Artificial Sequence
  chemically synthesized
gacgatgacatgagtggcct

SEQ ID NO: 19239 - DNA, 20 bp, Artificial Sequence
  chemically synthesized
tgacatgagtggcctgggaa

SEQ ID NO: 19240 - DNA, 20 bp, Artificial Sequence
  chemically synthesized
gacatgagtggcctgggaaa

SEQ ID NO: 19241 - DNA, 20 bp, Artificial Sequence
  chemically synthesized
gagtggcctgggaaaaggct

SEQ ID NO: 19242 - DNA, 20 bp, Artificial Sequence
  chemically synthesized
tggcctgggaaaaggctgag

SEQ ID NO: 19243 - DNA, 20 bp, Artificial Sequence
  chemically synthesized
aaaaggctgagtggtgtcca

SEQ ID NO: 19244 - DNA, 20 bp, Artificial Sequence
  chemically synthesized
tattaaaatcctcttctgct

SEQ ID NO: 19245 - DNA, 20 bp, Artificial Sequence
  chemically synthesized
attaaaatcctcttctgctg

SEQ ID NO: 19246 - DNA, 20 bp, Artificial Sequence
  chemically synthesized
cttctgctgaggtcacccat

SEQ ID NO: 19247 - DNA, 20 bp, Artificial Sequence
  chemically synthesized
tgctgaggtcacccattggt

SEQ ID NO: 19248 - DNA, 20 bp, Artificial Sequence
  chemically synthesized
cccattggtgagcactcaca

SEQ ID NO: 19249 - DNA, 20 bp, Artificial Sequence
  chemically synthesized
ccattggtgagcactcacat

SEQ ID NO: 19250 - DNA, 20 bp, Artificial Sequence
  chemically synthesized
atgggatgaaaatatctttg

SEQ ID NO: 19251 - DNA, 20 bp, Artificial Sequence
  chemically synthesized
ttgtagtttttgactaatca

SEQ ID NO: 19252 - DNA, 20 bp, Artificial Sequence
  chemically synthesized
gtagtttttgactaatcata

SEQ ID NO: 19253 - DNA, 20 bp, Artificial Sequence
  chemically synthesized
tagtttttgactaatcatag

SEQ ID NO: 19254 - DNA, 20 bp, Artificial Sequence
  chemically synthesized
tttctttgtcatcaattttc

SEQ ID NO: 19255 - DNA, 20 bp, Artificial Sequence
  chemically synthesized
tttccagtcatgctttttcc

SEQ ID NO: 19256 - DNA, 20 bp, Artificial Sequence
  chemically synthesized
tttccaagtccctgaccatc

SEQ ID NO: 19257 - DNA, 20 bp, Artificial Sequence
  chemically synthesized
tgaccatctagccaaacctt

SEQ ID NO: 19258 - DNA, 20 bp, Artificial Sequence
  chemically synthesized
tctagccaaacctttggcta

SEQ ID NO: 19259 - DNA, 20 bp, Artificial Sequence
  chemically synthesized
tttggctacagcccatgaat

SEQ ID NO: 19260 - DNA, 20 bp, Artificial Sequence
  chemically synthesized
taagtatataatcgcaaatc

SEQ ID NO: 19261 - DNA, 20 bp, Artificial Sequence
  chemically synthesized
gccatttctccttctgtgca

SEQ ID NO: 19262 - DNA, 20 bp, Artificial Sequence
  chemically synthesized
ttctgtgcaaagtgcacaac

SEQ ID NO: 19263 - DNA, 20 bp, Artificial Sequence
  chemically synthesized
tctgtgcaaagtgcacaacc

SEQ ID NO: 19264 - DNA, 20 bp, Artificial Sequence
  chemically synthesized
acaaccaggcacactgctca

SEQ ID NO: 19265 - DNA, 20 bp, Artificial Sequence
  chemically synthesized
ctgctcaaagttctgccaac

SEQ ID NO: 19266 - DNA, 20 bp, Artificial Sequence
  chemically synthesized
tgctcaaagttctgccaact

SEQ ID NO: 19267 - DNA, 20 bp, Artificial Sequence
  chemically synthesized
tcaaagttctgccaactagg

SEQ ID NO: 19268 - DNA, 20 bp, Artificial Sequence
  chemically synthesized
ttcccttcaccgttgtcctt

SEQ ID NO: 19269 - DNA, 20 bp, Artificial Sequence
  chemically synthesized
tcccttcaccgttgtccttc

SEQ ID NO: 19270 - DNA, 20 bp, Artificial Sequence
  chemically synthesized
cccttcaccgttgtccttca

SEQ ID NO: 19271 - DNA, 20 bp, Artificial Sequence
  chemically synthesized
gttgtccttcagggatgtcc

SEQ ID NO: 19272 - DNA, 20 bp, Artificial Sequence
  chemically synthesized
tccttcagggatgtcctaga

SEQ ID NO: 19273 - DNA, 20 bp, Artificial Sequence
  chemically synthesized
ccttcagggatgtcctagaa

SEQ ID NO: 19274 - DNA, 20 bp, Artificial Sequence
  chemically synthesized
cttcagggatgtcctagaaa

SEQ ID NO: 19275 - DNA, 20 bp, Artificial Sequence
  chemically synthesized
ttcagggatgtcctagaaag

SEQ ID NO: 19276 - DNA, 20 bp, Artificial Sequence
  chemically synthesized
gatgtcctagaaaggggctg

SEQ ID NO: 19277 - DNA, 20 bp, Artificial Sequence
  chemically synthesized
agaaaggggctgtagtgctg

SEQ ID NO: 19278 - DNA, 20 bp, Artificial Sequence
  chemically synthesized
gtgctgcggctgtccacttt

SEQ ID NO: 19279 - DNA, 20 bp, Artificial Sequence
  chemically synthesized
tgctgcggctgtccactttt

SEQ ID NO: 19280 - DNA, 20 bp, Artificial Sequence
  chemically synthesized
tgcggctgtccacttttggg

SEQ ID NO: 19281 - DNA, 20 bp, Artificial Sequence
  chemically synthesized
ggtggtgcctgcatatcgtg

SEQ ID NO: 19282 - DNA, 20 bp, Artificial Sequence
  chemically synthesized
gtgcagaactatctgtgaac

SEQ ID NO: 19283 - DNA, 20 bp, Artificial Sequence
  chemically synthesized
tgcagaactatctgtgaacc

SEQ ID NO: 19284 - DNA, 20 bp, Artificial Sequence
  chemically synthesized
actatctgtgaaccaggacc

SEQ ID NO: 19285 - DNA, 20 bp, Artificial Sequence
  chemically synthesized
ctagtcttctcttcctctgt

SEQ ID NO: 19286 - DNA, 20 bp, Artificial Sequence
  chemically synthesized
cttcctctgtcagctgatca

SEQ ID NO: 19287 - DNA, 20 bp, Artificial Sequence
  chemically synthesized
ttcctctgtcagctgatcat

SEQ ID NO: 19288 - DNA, 20 bp, Artificial Sequence
  chemically synthesized
tcctctgtcagctgatcata

SEQ ID NO: 19289 - DNA, 20 bp, Artificial Sequence
  chemically synthesized
gatcatagggaactccccat

SEQ ID NO: 19290 - DNA, 20 bp, Artificial Sequence
  chemically synthesized
ggaactccccatgagaccat

SEQ ID NO: 19291 - DNA, 20 bp, Artificial Sequence
  chemically synthesized
tccccatgagaccatcggtg

SEQ ID NO: 19292 - DNA, 20 bp, Artificial Sequence
  chemically synthesized
tgagaccatcggtgcagtct

SEQ ID NO: 19293 - DNA, 20 bp, Artificial Sequence
  chemically synthesized
gagaccatcggtgcagtctc

SEQ ID NO: 19294 - DNA, 20 bp, Artificial Sequence
  chemically synthesized
agaccatcggtgcagtctca

SEQ ID NO: 19295 - DNA, 20 bp, Artificial Sequence
  chemically synthesized
accatcggtgcagtctcagg

SEQ ID NO: 19296 - DNA, 20 bp, Artificial Sequence
  chemically synthesized
catcggtgcagtctcaggga

SEQ ID NO: 19297 - DNA, 20 bp, Artificial Sequence
  chemically synthesized
ggtgcagtctcagggagaga

SEQ ID NO: 19298 - DNA, 20 bp, Artificial Sequence
  chemically synthesized
gcagtctcagggagagaaag

SEQ ID NO: 19299 - DNA, 20 bp, Artificial Sequence
  chemically synthesized
agggagagaaagcagtgtgt

SEQ ID NO: 19300 - DNA, 20 bp, Artificial Sequence
  chemically synthesized
gggagagaaagcagtgtgtc

SEQ ID NO: 19301 - DNA, 20 bp, Artificial Sequence
  chemically synthesized
gagagaaagcagtgtgtcag

SEQ ID NO: 19302 - DNA, 20 bp, Artificial Sequence
  chemically synthesized
agaaagcagtgtgtcaggag

SEQ ID NO: 19303 - DNA, 20 bp, Artificial Sequence
  chemically synthesized
aaagcagtgtgtcaggagtg

SEQ ID NO: 19304 - DNA, 20 bp, Artificial Sequence
  chemically synthesized
tgtgtcaggagtggagacca

SEQ ID NO: 19305 - DNA, 20 bp, Artificial Sequence
  chemically synthesized
gtgtcaggagtggagaccat

SEQ ID NO: 19306 - DNA, 20 bp, Artificial Sequence
  chemically synthesized
agtggagaccatgggcattt

SEQ ID NO: 19307 - DNA, 20 bp, Artificial Sequence
  chemically synthesized
ccctttctcatgtaacttac

SEQ ID NO: 19308 - DNA, 20 bp, Artificial Sequence
  chemically synthesized
atgtaacttactagtgcctt

SEQ ID NO: 19309 - DNA, 20 bp, Artificial Sequence
  chemically synthesized
tgtaacttactagtgccttc

SEQ ID NO: 19310 - DNA, 20 bp, Artificial Sequence
  chemically synthesized
agtgccttcaggatctgctc

SEQ ID NO: 19311 - DNA, 20 bp, Artificial Sequence
  chemically synthesized
tgatgcaatgctgctgtgca

SEQ ID NO: 19312 - DNA, 20 bp, Artificial Sequence
  chemically synthesized
gctgtgcacagcccacttta

SEQ ID NO: 19313 - DNA, 20 bp, Artificial Sequence
  chemically synthesized
tgcacagcccactttatggc

SEQ ID NO: 19314 - DNA, 20 bp, Artificial Sequence
  chemically synthesized
cagcccactttatggctaga

SEQ ID NO: 19315 - DNA, 20 bp, Artificial Sequence
  chemically synthesized
cactttatggctagatggat

SEQ ID NO: 19316 - DNA, 20 bp, Artificial Sequence
  chemically synthesized
ttatggctagatggatcaga

SEQ ID NO: 19317 - DNA, 20 bp, Artificial Sequence
  chemically synthesized
tagatggatcagaaagcacc

SEQ ID NO: 19318 - DNA, 20 bp, Artificial Sequence
  chemically synthesized
agaaagcacccagttcatga

SEQ ID NO: 19319 - DNA, 20 bp, Artificial Sequence
  chemically synthesized
gaaagcacccagttcatgat

SEQ ID NO: 19320 - DNA, 20 bp, Artificial Sequence
  chemically synthesized
agcacccagttcatgatagg

SEQ ID NO: 19321 - DNA, 20 bp, Artificial Sequence
  chemically synthesized
ccagttcatgataggcagtt

SEQ ID NO: 19322 - DNA, 20 bp, Artificial Sequence
  chemically synthesized
cagttcatgataggcagttc

SEQ ID NO: 19323 - DNA, 20 bp, Artificial Sequence
  chemically synthesized
gataggcagttcaggtcaca

SEQ ID NO: 19324 - DNA, 20 bp, Artificial Sequence
  chemically synthesized
catggtgacttgatgactca

SEQ ID NO: 19325 - DNA, 20 bp, Artificial Sequence
  chemically synthesized
caaatatttcgtttccacca

SEQ ID NO: 19326 - DNA, 20 bp, Artificial Sequence
  chemically synthesized
atttcgtttccaccaaagcc

SEQ ID NO: 19327 - DNA, 20 bp, Artificial Sequence
  chemically synthesized
tttccaccaaagcccagtaa

SEQ ID NO: 19328 - DNA, 20 bp, Artificial Sequence
  chemically synthesized
ttccaccaaagcccagtaac

SEQ ID NO: 19329 - DNA, 20 bp, Artificial Sequence
  chemically synthesized
ccaaagcccagtaacaggcc

SEQ ID NO: 19330 - DNA, 20 bp, Artificial Sequence
  chemically synthesized
aaagcccagtaacaggccaa

SEQ ID NO: 19331 - DNA, 20 bp, Artificial Sequence
  chemically synthesized
gccaagagctttctccctaa

SEQ ID NO: 19332 - DNA, 20 bp, Artificial Sequence
  chemically synthesized
caagagctttctccctaaaa

SEQ ID NO: 19333 - DNA, 20 bp, Artificial Sequence
  chemically synthesized
agagctttctccctaaaaga

SEQ ID NO: 19334 - DNA, 20 bp, Artificial Sequence
  chemically synthesized
gctttctccctaaaagagag

SEQ ID NO: 19335 - DNA, 20 bp, Artificial Sequence
  chemically synthesized
taaaagagagtagttatctg

SEQ ID NO: 19336 - DNA, 20 bp, Artificial Sequence
  chemically synthesized
aagagagtagttatctgcag

SEQ ID NO: 19337 - DNA, 20 bp, Artificial Sequence
  chemically synthesized
gagtagttatctgcagaaga

SEQ ID NO: 19338 - DNA, 20 bp, Artificial Sequence
  chemically synthesized
tagttatctgcagaagatgg

SEQ ID NO: 19339 - DNA, 20 bp, Artificial Sequence
  chemically synthesized
agttatctgcagaagatggc

SEQ ID NO: 19340 - DNA, 20 bp, Artificial Sequence
  chemically synthesized
gttatctgcagaagatggca

SEQ ID NO: 19341 - DNA, 20 bp, Artificial Sequence
  chemically synthesized
agggccttgctccaaaatcc

SEQ ID NO: 19342 - DNA, 20 bp, Artificial Sequence
  chemically synthesized
ggccttgctccaaaatccta

SEQ ID NO: 19343 - DNA, 20 bp, Artificial Sequence
  chemically synthesized
gccttgctccaaaatcctag

SEQ ID NO: 19344 - DNA, 20 bp, Artificial Sequence
  chemically synthesized
tagaggcctccgctgtgatt

SEQ ID NO: 19345 - DNA, 20 bp, Artificial Sequence
  chemically synthesized
agcctgccaaatgctccaaa

SEQ ID NO: 19346 - DNA, 20 bp, Artificial Sequence
  chemically synthesized
ctccaaacagcatccctatc

SEQ ID NO: 19347 - DNA, 20 bp, Artificial Sequence
  chemically synthesized
ctatctggcactgacacctc

SEQ ID NO: 19348 - DNA, 20 bp, Artificial Sequence
  chemically synthesized
actgacacctcaagcatcat

SEQ ID NO: 19349 - DNA, 20 bp, Artificial Sequence
  chemically synthesized
tcaagcatcattggatctgc

SEQ ID NO: 19350 - DNA, 20 bp, Artificial Sequence
  chemically synthesized
caagcatcattggatctgct

SEQ ID NO: 19351 - DNA, 20 bp, Artificial Sequence
  chemically synthesized
attggatctgctaggtcata

SEQ ID NO: 19352 - DNA, 20 bp, Artificial Sequence
  chemically synthesized
tctgctaggtcatatggccc

SEQ ID NO: 19353 - DNA, 20 bp, Artificial Sequence
  chemically synthesized
gctaggtcatatggcccaag

SEQ ID NO: 19354 - DNA, 20 bp, Artificial Sequence
  chemically synthesized
gtcatatggcccaagtggca

SEQ ID NO: 19355 - DNA, 20 bp, Artificial Sequence
  chemically synthesized
atatggcccaagtggcatag

SEQ ID NO: 19356 - DNA, 20 bp, Artificial Sequence
  chemically synthesized
aagtggcatagcagcttgca

SEQ ID NO: 19357 - DNA, 20 bp, Artificial Sequence
  chemically synthesized
tggcatagcagcttgcacag

SEQ ID NO: 19358 - DNA, 20 bp, Artificial Sequence
  chemically synthesized
tagcagcttgcacagcagcc

SEQ ID NO: 19359 - DNA, 20 bp, Artificial Sequence
  chemically synthesized
tgcacagcagcctggacctg

SEQ ID NO: 19360 - DNA, 20 bp, Artificial Sequence
  chemically synthesized
acagcagcctggacctgtgg

SEQ ID NO: 19361 - DNA, 20 bp, Artificial Sequence
  chemically synthesized
agcagcctggacctgtggca

SEQ ID NO: 19362 - DNA, 20 bp, Artificial Sequence
  chemically synthesized
tgtggcagagccttctgttc

SEQ ID NO: 19363 - DNA, 20 bp, Artificial Sequence
  chemically synthesized
ttctggactccactcaaaac

SEQ ID NO: 19364 - DNA, 20 bp, Artificial Sequence
  chemically synthesized
tggactccactcaaaactgg

SEQ ID NO: 19365 - DNA, 20 bp, Artificial Sequence
  chemically synthesized
actcaaaactggcagccttt

SEQ ID NO: 19366 - DNA, 20 bp, Artificial Sequence
  chemically synthesized
cttttggatcactcgataaa

SEQ ID NO: 19367 - DNA, 20 bp, Artificial Sequence
  chemically synthesized
ttttggatcactcgataaat

SEQ ID NO: 19368 - DNA, 20 bp, Artificial Sequence
  chemically synthesized
ggatcactcgataaatgggc

SEQ ID NO: 19369 - DNA, 20 bp, Artificial Sequence
  chemically synthesized
atcactcgataaatgggcca

SEQ ID NO: 19370 - DNA, 20 bp, Artificial Sequence
  chemically synthesized
ccagagtaacacacccaaat

SEQ ID NO: 19371 - DNA, 20 bp, Artificial Sequence
  chemically synthesized
cagagtaacacacccaaatc

SEQ ID NO: 19372 - DNA, 20 bp, Artificial Sequence
  chemically synthesized
tgttgcctccaaaatccaaa

SEQ ID NO: 19373 - DNA, 20 bp, Artificial Sequence
  chemically synthesized
gttgcctccaaaatccaaat

SEQ ID NO: 19374 - DNA, 20 bp, Artificial Sequence
  chemically synthesized
caaaatccaaataggcccac

SEQ ID NO: 19375 - DNA, 20 bp, Artificial Sequence
  chemically synthesized
aaaatccaaataggcccact

SEQ ID NO: 19376 - DNA, 20 bp, Artificial Sequence
  chemically synthesized
taggcgttgtgcctatttct

SEQ ID NO: 19377 - DNA, 20 bp, Artificial Sequence
  chemically synthesized
tgtgcctatttcttggttgt

SEQ ID NO: 19378 - DNA, 20 bp, Artificial Sequence
  chemically synthesized
tgcctatttcttggttgtaa

SEQ ID NO: 19379 - DNA, 20 bp, Artificial Sequence
  chemically synthesized
ctatttcttggttgtaagag

SEQ ID NO: 19380 - DNA, 20 bp, Artificial Sequence
  chemically synthesized
gttgtaagagtggccaaatg

SEQ ID NO: 19381 - DNA, 20 bp, Artificial Sequence
  chemically synthesized
cagcaaattatccttcactt

SEQ ID NO: 19382 - DNA, 20 bp, Artificial Sequence
  chemically synthesized
caaattatccttcactttag

SEQ ID NO: 19383 - DNA, 20 bp, Artificial Sequence
  chemically synthesized
aaattatccttcactttaga

SEQ ID NO: 19384 - DNA, 20 bp, Artificial Sequence
  chemically synthesized
actttagaaggaatatctca

SEQ ID NO: 19385 - DNA, 20 bp, Artificial Sequence
  chemically synthesized
tttagaaggaatatctcaaa

SEQ ID NO: 19386 - DNA, 20 bp, Artificial Sequence
  chemically synthesized
ctcaaagagccccaaaccat

SEQ ID NO: 19387 - DNA, 20 bp, Artificial Sequence
  chemically synthesized
ggacccctataaattttact

SEQ ID NO: 19388 - DNA, 20 bp, Artificial Sequence
  chemically synthesized
gacccctataaattttactg

SEQ ID NO: 19389 - DNA, 20 bp, Artificial Sequence
  chemically synthesized
ccctataaattttactgagg

SEQ ID NO: 19390 - DNA, 20 bp, Artificial Sequence
  chemically synthesized
tataaattttactgaggtag

SEQ ID NO: 19391 - DNA, 20 bp, Artificial Sequence
  chemically synthesized
ataaattttactgaggtaga

SEQ ID NO: 19392 - DNA, 20 bp, Artificial Sequence
  chemically synthesized
agaaggtccctgaatttaat

SEQ ID NO: 19393 - DNA, 20 bp, Artificial Sequence
  chemically synthesized
aaatgtctcatcaataaatc

SEQ ID NO: 19394 - DNA, 20 bp, Artificial Sequence
  chemically synthesized
gtttgctacttcttgctcac

SEQ ID NO: 19395 - DNA, 20 bp, Artificial Sequence
  chemically synthesized
tacttcttgctcactagttc

SEQ ID NO: 19396 - DNA, 20 bp, Artificial Sequence
  chemically synthesized
tcttgctcactagttccagt

SEQ ID NO: 19397 - DNA, 20 bp, Artificial Sequence
  chemically synthesized
tcagcatgtcatcaatgtaa

SEQ ID NO: 19398 - DNA, 20 bp, Artificial Sequence
  chemically synthesized
tggaccactgtgatatcttg

SEQ ID NO: 19399 - DNA, 20 bp, Artificial Sequence
  chemically synthesized
accactgtgatatcttgtgg

SEQ ID NO: 19400 - DNA, 20 bp, Artificial Sequence
  chemically synthesized
gtgatatcttgtggaagtga

SEQ ID NO: 19401 - DNA, 20 bp, Artificial Sequence
  chemically synthesized
tgatatcttgtggaagtgaa

SEQ ID NO: 19402 - DNA, 20 bp, Artificial Sequence
  chemically synthesized
atcttgtggaagtgaaaggt

SEQ ID NO: 19403 - DNA, 20 bp, Artificial Sequence
  chemically synthesized
tgtggaagtgaaaggtgagc

SEQ ID NO: 19404 - DNA, 20 bp, Artificial Sequence
  chemically synthesized
tgagcaagttctctccaaat

SEQ ID NO: 19405 - DNA, 20 bp, Artificial Sequence
  chemically synthesized
gttctctccaaataagatta

SEQ ID NO: 19406 - DNA, 20 bp, Artificial Sequence
  chemically synthesized
ccaaataagattatggcaca

SEQ ID NO: 19407 - DNA, 20 bp, Artificial Sequence
  chemically synthesized
ataagattatggcacaaagc

SEQ ID NO: 19408 - DNA, 20 bp, Artificial Sequence
  chemically synthesized
aagattatggcacaaagctg

SEQ ID NO: 19409 - DNA, 20 bp, Artificial Sequence
  chemically synthesized
gattatggcacaaagctgga

SEQ ID NO: 19410 - DNA, 20 bp, Artificial Sequence
  chemically synthesized
tggagagttgatatactcct

SEQ ID NO: 19411 - DNA, 20 bp, Artificial Sequence
  chemically synthesized
ttttctttcatcactttgtc

SEQ ID NO: 19412 - DNA, 20 bp, Artificial Sequence
  chemically synthesized
actttgtccagcgaacttac

SEQ ID NO: 19413 - DNA, 20 bp, Artificial Sequence
  chemically synthesized
gttccttgattctccacata

SEQ ID NO: 19414 - DNA, 20 bp, Artificial Sequence
  chemically synthesized
gattctccacatatagtcaa

SEQ ID NO: 19415 - DNA, 20 bp, Artificial Sequence
  chemically synthesized
agtcaaaagtattatgtata

SEQ ID NO: 19416 - DNA, 20 bp, Artificial Sequence
  chemically synthesized
caaaagtattatgtatacag

SEQ ID NO: 19417 - DNA, 20 bp, Artificial Sequence
  chemically synthesized
ctaaattccttgcctctcac

SEQ ID NO: 19418 - DNA, 20 bp, Artificial Sequence
  chemically synthesized
cctctcacaagcgttgaatc

SEQ ID NO: 19419 - DNA, 20 bp, Artificial Sequence
  chemically synthesized
tctcacaagcgttgaatcaa

SEQ ID NO: 19420 - DNA, 20 bp, Artificial Sequence
  chemically synthesized
ctctctaaacaattgatgcc

SEQ ID NO: 19421 - DNA, 20 bp, Artificial Sequence
  chemically synthesized
tctctaaacaattgatgcca

SEQ ID NO: 19422 - DNA, 20 bp, Artificial Sequence
  chemically synthesized
caattgatgccaaggattat

SEQ ID NO: 19423 - DNA, 20 bp, Artificial Sequence
  chemically synthesized
atcagtgttctccataccat

SEQ ID NO: 19424 - DNA, 20 bp, Artificial Sequence
  chemically synthesized
agtgttctccataccattag

SEQ ID NO: 19425 - DNA, 20 bp, Artificial Sequence
  chemically synthesized
gttctccataccattagaag

SEQ ID NO: 19426 - DNA, 20 bp, Artificial Sequence
  chemically synthesized
tctccataccattagaagaa

SEQ ID NO: 19427 - DNA, 20 bp, Artificial Sequence
  chemically synthesized
accattagaagaagagtcct

SEQ ID NO: 19428 - DNA, 20 bp, Artificial Sequence
  chemically synthesized
agaagagtccttagcatatt

SEQ ID NO: 19429 - DNA, 20 bp, Artificial Sequence
  chemically synthesized
gaagagtccttagcatattt

SEQ ID NO: 19430 - DNA, 20 bp, Artificial Sequence
  chemically synthesized
tatttgggtctaatcatatt

SEQ ID NO: 19431 - DNA, 20 bp, Artificial Sequence
  chemically synthesized
ttgggtctaatcatattaag

SEQ ID NO: 19432 - DNA, 20 bp, Artificial Sequence
  chemically synthesized
tcatattaagcagccaactc

SEQ ID NO: 19433 - DNA, 20 bp, Artificial Sequence
  chemically synthesized
agaaaccccaaaaccaatga

SEQ ID NO: 19434 - DNA, 20 bp, Artificial Sequence
  chemically synthesized
tccttaatattctgttcctc

SEQ ID NO: 19435 - DNA, 20 bp, Artificial Sequence
  chemically synthesized
tgttcctctagaaccactcc

SEQ ID NO: 19436 - DNA, 20 bp, Artificial Sequence
  chemically synthesized
cctggtaccaaaatctgtat

SEQ ID NO: 19437 - DNA, 20 bp, Artificial Sequence
  chemically synthesized
ctggtaccaaaatctgtatt

SEQ ID NO: 19438 - DNA, 20 bp, Artificial Sequence
  chemically synthesized
tggtaccaaaatctgtatta

SEQ ID NO: 19439 - DNA, 20 bp, Artificial Sequence
  chemically synthesized
aaatctgtattagggttcta

SEQ ID NO: 19440 - DNA, 20 bp, Artificial Sequence
  chemically synthesized
atctgtattagggttctaca

SEQ ID NO: 19441 - DNA, 20 bp, Artificial Sequence
  chemically synthesized
attagggttctacagagaaa

SEQ ID NO: 19442 - DNA, 20 bp, Artificial Sequence
  chemically synthesized
ctacagagaaacagaattaa

SEQ ID NO: 19443 - DNA, 20 bp, Artificial Sequence
  chemically synthesized
tacagagaaacagaattaat

SEQ ID NO: 19444 - DNA, 20 bp, Artificial Sequence
  chemically synthesized
cagagaaacagaattaatag

SEQ ID NO: 19445 - DNA, 20 bp, Artificial Sequence
  chemically synthesized
ctctatatctatatctatat

SEQ ID NO: 19446 - DNA, 20 bp, Artificial Sequence
  chemically synthesized
ctatatctatatctatatga

SEQ ID NO: 19447 - DNA, 20 bp, Artificial Sequence
  chemically synthesized
ctatatgagagtttattatg

SEQ ID NO: 19448 - DNA, 20 bp, Artificial Sequence
  chemically synthesized
gtattgactcacatgttcac

SEQ ID NO: 19449 - DNA, 20 bp, Artificial Sequence
  chemically synthesized
tattgactcacatgttcaca

SEQ ID NO: 19450 - DNA, 20 bp, Artificial Sequence
  chemically synthesized
atgttcacaaggtcccaaaa

SEQ ID NO: 19451 - DNA, 20 bp, Artificial Sequence
  chemically synthesized
tgttcacaaggtcccaaaac

SEQ ID NO: 19452 - DNA, 20 bp, Artificial Sequence
  chemically synthesized
tcccaaaacaggccatctgc

SEQ ID NO: 19453 - DNA, 20 bp, Artificial Sequence
  chemically synthesized
aaacaggccatctgccagct

SEQ ID NO: 19454 - DNA, 20 bp, Artificial Sequence
  chemically synthesized
aacaggccatctgccagctg

SEQ ID NO: 19455 - DNA, 20 bp, Artificial Sequence
  chemically synthesized
ccatctgccagctgaggaac

SEQ ID NO: 19456 - DNA, 20 bp, Artificial Sequence
  chemically synthesized
catctgccagctgaggaaca

SEQ ID NO: 19457 - DNA, 20 bp, Artificial Sequence
  chemically synthesized
ctgccagctgaggaacaagg

SEQ ID NO: 19458 - DNA, 20 bp, Artificial Sequence
  chemically synthesized
cagctgaggaacaaggaagc

SEQ ID NO: 19459 - DNA, 20 bp, Artificial Sequence
  chemically synthesized
tgaggaacaaggaagctagt

SEQ ID NO: 19460 - DNA, 20 bp, Artificial Sequence
  chemically synthesized
aggaacaaggaagctagtcg

SEQ ID NO: 19461 - DNA, 20 bp, Artificial Sequence
  chemically synthesized
ggaagctagtcggagtccca

SEQ ID NO: 19462 - DNA, 20 bp, Artificial Sequence
  chemically synthesized
tagtcggagtcccaaagctg

SEQ ID NO: 19463 - DNA, 20 bp, Artificial Sequence
  chemically synthesized
agtcccaaagctgaagaacc

SEQ ID NO: 19464 - DNA, 20 bp, Artificial Sequence
  chemically synthesized
tcccaaagctgaagaacctg

SEQ ID NO: 19465 - DNA, 20 bp, Artificial Sequence
  chemically synthesized
gaacctggagttcaatgttc

SEQ ID NO: 19466 - DNA, 20 bp, Artificial Sequence
  chemically synthesized
aacctggagttcaatgttcc

SEQ ID NO: 19467 - DNA, 20 bp, Artificial Sequence
  chemically synthesized
acctggagttcaatgttcca

SEQ ID NO: 19468 - DNA, 20 bp, Artificial Sequence
  chemically synthesized
tggagttcaatgttccaggg

SEQ ID NO: 19469 - DNA, 20 bp, Artificial Sequence
  chemically synthesized
ggagttcaatgttccagggc

SEQ ID NO: 19470 - DNA, 20 bp, Artificial Sequence
  chemically synthesized
gttcaatgttccagggcagg

SEQ ID NO: 19471 - DNA, 20 bp, Artificial Sequence
  chemically synthesized
gttccagggcaggaagaatc

SEQ ID NO: 19472 - DNA, 20 bp, Artificial Sequence
  chemically synthesized
agggcaggaagaatccagca

SEQ ID NO: 19473 - DNA, 20 bp, Artificial Sequence
  chemically synthesized
gggcaggaagaatccagcat

SEQ ID NO: 19474 - DNA, 20 bp, Artificial Sequence
  chemically synthesized
gcaggaagaatccagcatgg

SEQ ID NO: 19475 - DNA, 20 bp, Artificial Sequence
  chemically synthesized
tccagcatgggagaaaaatg

SEQ ID NO: 19476 - DNA, 20 bp, Artificial Sequence
  chemically synthesized
ccagcatgggagaaaaatgt

SEQ ID NO: 19477 - DNA, 20 bp, Artificial Sequence
  chemically synthesized
catgggagaaaaatgtaggc

SEQ ID NO: 19478 - DNA, 20 bp, Artificial Sequence
  chemically synthesized
atgggagaaaaatgtaggct

SEQ ID NO: 19479 - DNA, 20 bp, Artificial Sequence
  chemically synthesized
aaaatgtaggctgggatgcc

SEQ ID NO: 19480 - DNA, 20 bp, Artificial Sequence
  chemically synthesized
gctgggatgccaagccaatc

SEQ ID NO: 19481 - DNA, 20 bp, Artificial Sequence
  chemically synthesized
tttctgcctgctttatatcc

SEQ ID NO: 19482 - DNA, 20 bp, Artificial Sequence
  chemically synthesized
gctttatatcctggctgtgc

SEQ ID NO: 19483 - DNA, 20 bp, Artificial Sequence
  chemically synthesized
tggctgtgctggcaactgat

SEQ ID NO: 19484 - DNA, 20 bp, Artificial Sequence
  chemically synthesized
tgtgctggcaactgattaga

SEQ ID NO: 19485 - DNA, 20 bp, Artificial Sequence
  chemically synthesized
ctgattagatggtgcccacc

SEQ ID NO: 19486 - DNA, 20 bp, Artificial Sequence
  chemically synthesized
agatggtgcccacccagatt

SEQ ID NO: 19487 - DNA, 20 bp, Artificial Sequence
  chemically synthesized
gatggtgcccacccagatta

SEQ ID NO: 19488 - DNA, 20 bp, Artificial Sequence
  chemically synthesized
atggtgcccacccagattaa

SEQ ID NO: 19489 - DNA, 20 bp, Artificial Sequence
  chemically synthesized
gtgcccacccagattaaggg

SEQ ID NO: 19490 - DNA, 20 bp, Artificial Sequence
  chemically synthesized
tgcccacccagattaagggt

SEQ ID NO: 19491 - DNA, 20 bp, Artificial Sequence
  chemically synthesized
aagggtgggtctgccttccc

SEQ ID NO: 19492 - DNA, 20 bp, Artificial Sequence
  chemically synthesized
actgaaatattaatctcctt

SEQ ID NO: 19493 - DNA, 20 bp, Artificial Sequence
  chemically synthesized
ctcctttggtaacaccctca

SEQ ID NO: 19494 - DNA, 20 bp, Artificial Sequence
  chemically synthesized
acaccctcacagacacaccc

SEQ ID NO: 19495 - DNA, 20 bp, Artificial Sequence
  chemically synthesized
gatcattactttgcatcctt

SEQ ID NO: 19496 - DNA, 20 bp, Artificial Sequence
  chemically synthesized
ttgcatccttcagtccaatc

SEQ ID NO: 19497 - DNA, 20 bp, Artificial Sequence
  chemically synthesized
agtccaatcaagttgacact

SEQ ID NO: 19498 - DNA, 20 bp, Artificial Sequence
  chemically synthesized
acactcagtattaaccatca

SEQ ID NO: 19499 - DNA, 20 bp, Artificial Sequence
  chemically synthesized
catcacagtcactttctaat

SEQ ID NO: 19500 - DNA, 20 bp, Artificial Sequence
  chemically synthesized
atcacagtcactttctaatg

SEQ ID NO: 19501 - DNA, 20 bp, Artificial Sequence
  chemically synthesized
cagtcactttctaatgaggt

SEQ ID NO: 19502 - DNA, 20 bp, Artificial Sequence
  chemically synthesized
aggttggtttttttgttgtt

SEQ ID NO: 19503 - DNA, 20 bp, Artificial Sequence
  chemically synthesized
ttttgttgttgagttccttg

SEQ ID NO: 19504 - DNA, 20 bp, Artificial Sequence
  chemically synthesized
tccttgtagattctgtatat

SEQ ID NO: 19505 - DNA, 20 bp, Artificial Sequence
  chemically synthesized
ttagccttttgttgcattca

SEQ ID NO: 19506 - DNA, 20 bp, Artificial Sequence
  chemically synthesized
aatttttttttctcattctg

SEQ ID NO: 19507 - DNA, 20 bp, Artificial Sequence
  chemically synthesized
atttttttttctcattctgt

SEQ ID NO: 19508 - DNA, 20 bp, Artificial Sequence
  chemically synthesized
atccgtttactctgttgatt

SEQ ID NO: 19509 - DNA, 20 bp, Artificial Sequence
  chemically synthesized
tctgttgattcggtcttttg

SEQ ID NO: 19510 - DNA, 20 bp, Artificial Sequence
  chemically synthesized
tgattcggtcttttgcggtg

SEQ ID NO: 19511 - DNA, 20 bp, Artificial Sequence
  chemically synthesized
ttcggtcttttgcggtgcag

SEQ ID NO: 19512 - DNA, 20 bp, Artificial Sequence
  chemically synthesized
tttgcggtgcagaagcattt

SEQ ID NO: 19513 - DNA, 20 bp, Artificial Sequence
  chemically synthesized
agaagcattttagtttaatt

SEQ ID NO: 19514 - DNA, 20 bp, Artificial Sequence
  chemically synthesized
gtttttgtttttgttgtgtt

SEQ ID NO: 19515 - DNA, 20 bp, Artificial Sequence
  chemically synthesized
tttttgttgtgtttagtttt

SEQ ID NO: 19516 - DNA, 20 bp, Artificial Sequence
  chemically synthesized
ttttgttgtgtttagttttg

SEQ ID NO: 19517 - DNA, 20 bp, Artificial Sequence
  chemically synthesized
tgtgtttagttttgaggact

SEQ ID NO: 19518 - DNA, 20 bp, Artificial Sequence
  chemically synthesized
ttggtcataaattctttgcc

SEQ ID NO: 19519 - DNA, 20 bp, Artificial Sequence
  chemically synthesized
tggtcataaattctttgcct

SEQ ID NO: 19520 - DNA, 20 bp, Artificial Sequence
  chemically synthesized
tctaatttttaatcctcttt

SEQ ID NO: 19521 - DNA, 20 bp, Artificial Sequence
  chemically synthesized
taatttttaatcctctttta

SEQ ID NO: 19522 - DNA, 20 bp, Artificial Sequence
  chemically synthesized
tttacccccatttgacacat

SEQ ID NO: 19523 - DNA, 20 bp, Artificial Sequence
  chemically synthesized
atttgacacatgagctaatt

SEQ ID NO: 19524 - DNA, 20 bp, Artificial Sequence
  chemically synthesized
aattgagccttctgtctgtt

SEQ ID NO: 19525 - DNA, 20 bp, Artificial Sequence
  chemically synthesized
gagccttctgtctgttaagt

SEQ ID NO: 19526 - DNA, 20 bp, Artificial Sequence
  chemically synthesized
tgtctgttaagtaagttgac

SEQ ID NO: 19527 - DNA, 20 bp, Artificial Sequence
  chemically synthesized
gttaagtaagttgactagtt

SEQ ID NO: 19528 - DNA, 20 bp, Artificial Sequence
  chemically synthesized
taagttgactagttcagtgt

SEQ ID NO: 19529 - DNA, 20 bp, Artificial Sequence
  chemically synthesized
tttttgccatcataatgctt

SEQ ID NO: 19530 - DNA, 20 bp, Artificial Sequence
  chemically synthesized
tactctccttaattttcccc

SEQ ID NO: 19531 - DNA, 20 bp, Artificial Sequence
  chemically synthesized
actctccttaattttccccc

SEQ ID NO: 19532 - DNA, 20 bp, Artificial Sequence
  chemically synthesized
tccttaattttcccccagga

SEQ ID NO: 19533 - DNA, 20 bp, Artificial Sequence
  chemically synthesized
tttcccccaggatggttttc

SEQ ID NO: 19534 - DNA, 20 bp, Artificial Sequence
  chemically synthesized
ccaggatggttttctagatg

SEQ ID NO: 19535 - DNA, 20 bp, Artificial Sequence
  chemically synthesized
ttttctagatgtggacttgc

SEQ ID NO: 19536 - DNA, 20 bp, Artificial Sequence
  chemically synthesized
atgtggacttgctggatcca

SEQ ID NO: 19537 - DNA, 20 bp, Artificial Sequence
  chemically synthesized
ccaaatgtatccatatattg

SEQ ID NO: 19538 - DNA, 20 bp, Artificial Sequence
  chemically synthesized
attgtggctttgtgttttaa

SEQ ID NO: 19539 - DNA, 20 bp, Artificial Sequence
  chemically synthesized
tgtggctttgtgttttaata

SEQ ID NO: 19540 - DNA, 20 bp, Artificial Sequence
  chemically synthesized
gtggctttgtgttttaatag

SEQ ID NO: 19541 - DNA, 20 bp, Artificial Sequence
  chemically synthesized
gctttgtgttttaatagagg

SEQ ID NO: 19542 - DNA, 20 bp, Artificial Sequence
  chemically synthesized
ttgtgttttaatagaggtag

SEQ ID NO: 19543 - DNA, 20 bp, Artificial Sequence
  chemically synthesized
aatagaggtagcagcaatat

SEQ ID NO: 19544 - DNA, 20 bp, Artificial Sequence
  chemically synthesized
tagaggtagcagcaatatta

SEQ ID NO: 19545 - DNA, 20 bp, Artificial Sequence
  chemically synthesized
agaggtagcagcaatattag

SEQ ID NO: 19546 - DNA, 20 bp, Artificial Sequence
  chemically synthesized
aggtagcagcaatattagag

SEQ ID NO: 19547 - DNA, 20 bp, Artificial Sequence
  chemically synthesized
gtagcagcaatattagagga

SEQ ID NO: 19548 - DNA, 20 bp, Artificial Sequence
  chemically synthesized
caatattagaggagagaatt

SEQ ID NO: 19549 - DNA, 20 bp, Artificial Sequence
  chemically synthesized
aatattagaggagagaatta

SEQ ID NO: 19550 - DNA, 20 bp, Artificial Sequence
  chemically synthesized
agagaattaaggaacgattc

SEQ ID NO: 19551 - DNA, 20 bp, Artificial Sequence
  chemically synthesized
attaaggaacgattctagtg

SEQ ID NO: 19552 - DNA, 20 bp, Artificial Sequence
  chemically synthesized
aaggaacgattctagtgtag

SEQ ID NO: 19553 - DNA, 20 bp, Artificial Sequence
  chemically synthesized
aggaacgattctagtgtagc

SEQ ID NO: 19554 - DNA, 20 bp, Artificial Sequence
  chemically synthesized
cgattctagtgtagcaggac

SEQ ID NO: 19555 - DNA, 20 bp, Artificial Sequence
  chemically synthesized
aagctgcatacaaaacccct

SEQ ID NO: 19556 - DNA, 20 bp, Artificial Sequence
  chemically synthesized
tacaaaacccctcagacacc

SEQ ID NO: 19557 - DNA, 20 bp, Artificial Sequence
  chemically synthesized
acccctcagacaccgagtta

SEQ ID NO: 19558 - DNA, 20 bp, Artificial Sequence
  chemically synthesized
cctcagacaccgagttaaag

SEQ ID NO: 19559 - DNA, 20 bp, Artificial Sequence
  chemically synthesized
ctcagacaccgagttaaaga

SEQ ID NO: 19560 - DNA, 20 bp, Artificial Sequence
  chemically synthesized
agacaccgagttaaagaagg

SEQ ID NO: 19561 - DNA, 20 bp, Artificial Sequence
  chemically synthesized
gacaccgagttaaagaagga

SEQ ID NO: 19562 - DNA, 20 bp, Artificial Sequence
  chemically synthesized
acaccgagttaaagaaggaa

SEQ ID NO: 19563 - DNA, 20 bp, Artificial Sequence
  chemically synthesized
aaagaaggaagggctttatt

SEQ ID NO: 19564 - DNA, 20 bp, Artificial Sequence
  chemically synthesized
aaggaagggctttattcggc

SEQ ID NO: 19565 - DNA, 20 bp, Artificial Sequence
  chemically synthesized
aggaagggctttattcggct

SEQ ID NO: 19566 - DNA, 20 bp, Artificial Sequence
  chemically synthesized
gaagggctttattcggctgg

SEQ ID NO: 19567 - DNA, 20 bp, Artificial Sequence
  chemically synthesized
gctttattcggctgggagct

SEQ ID NO: 19568 - DNA, 20 bp, Artificial Sequence
  chemically synthesized
ctttattcggctgggagctt

SEQ ID NO: 19569 - DNA, 20 bp, Artificial Sequence
  chemically synthesized
attcggctgggagcttgggc

SEQ ID NO: 19570 - DNA, 20 bp, Artificial Sequence
  chemically synthesized
gactcacatctccaacaacc

SEQ ID NO: 19571 - DNA, 20 bp, Artificial Sequence
  chemically synthesized
atctccaacaaccaagctct

SEQ ID NO: 19572 - DNA, 20 bp, Artificial Sequence
  chemically synthesized
ctccaacaaccaagctctca

SEQ ID NO: 19573 - DNA, 20 bp, Artificial Sequence
  chemically synthesized
aacaaccaagctctcagagt

SEQ ID NO: 19574 - DNA, 20 bp, Artificial Sequence
  chemically synthesized
gagcaattcctgtccctttt

SEQ ID NO: 19575 - DNA, 20 bp, Artificial Sequence
  chemically synthesized
agcaattcctgtccctttta

SEQ ID NO: 19576 - DNA, 20 bp, Artificial Sequence
  chemically synthesized
gcaattcctgtcccttttaa

SEQ ID NO: 19577 - DNA, 20 bp, Artificial Sequence
  chemically synthesized
ttttaagggcttacaactct

SEQ ID NO: 19578 - DNA, 20 bp, Artificial Sequence
  chemically synthesized
tttaagggcttacaactcta

SEQ ID NO: 19579 - DNA, 20 bp, Artificial Sequence
  chemically synthesized
ttaagggcttacaactctaa

SEQ ID NO: 19580 - DNA, 20 bp, Artificial Sequence
  chemically synthesized
taagggcttacaactctaag

SEQ ID NO: 19581 - DNA, 20 bp, Artificial Sequence
  chemically synthesized
aagggcttacaactctaagg

SEQ ID NO: 19582 - DNA, 20 bp, Artificial Sequence
  chemically synthesized
actctaagggggtacatgac

SEQ ID NO: 19583 - DNA, 20 bp, Artificial Sequence
  chemically synthesized
ctctaagggggtacatgact

SEQ ID NO: 19584 - DNA, 20 bp, Artificial Sequence
  chemically synthesized
tctaagggggtacatgactg

SEQ ID NO: 19585 - DNA, 20 bp, Artificial Sequence
  chemically synthesized
ctaagggggtacatgactgg

SEQ ID NO: 19586 - DNA, 20 bp, Artificial Sequence
  chemically synthesized
tgactgggggctgcatgcac

SEQ ID NO: 19587 - DNA, 20 bp, Artificial Sequence
  chemically synthesized
gggctgcatgcactggtcat

SEQ ID NO: 19588 - DNA, 20 bp, Artificial Sequence
  chemically synthesized
gcatgcactggtcatcagaa

SEQ ID NO: 19589 - DNA, 20 bp, Artificial Sequence
  chemically synthesized
cactggtcatcagaatggaa

SEQ ID NO: 19590 - DNA, 20 bp, Artificial Sequence
  chemically synthesized
gtcatcagaatggaacagaa

SEQ ID NO: 19591 - DNA, 20 bp, Artificial Sequence
  chemically synthesized
tcatcagaatggaacagaac

SEQ ID NO: 19592 - DNA, 20 bp, Artificial Sequence
  chemically synthesized
cagaatggaacagaacagga

SEQ ID NO: 19593 - DNA, 20 bp, Artificial Sequence
  chemically synthesized
agaatggaacagaacaggac

SEQ ID NO: 19594 - DNA, 20 bp, Artificial Sequence
  chemically synthesized
gaatggaacagaacaggaca

SEQ ID NO: 19595 - DNA, 20 bp, Artificial Sequence
  chemically synthesized
tttcacactgcttttccata

SEQ ID NO: 19596 - DNA, 20 bp, Artificial Sequence
  chemically synthesized
ctgcttttccatacagtgtc

SEQ ID NO: 19597 - DNA, 20 bp, Artificial Sequence
  chemically synthesized
catacagtgtctggaatcta

SEQ ID NO: 19598 - DNA, 20 bp, Artificial Sequence
  chemically synthesized
gaatctatagataacataac

SEQ ID NO: 19599 - DNA, 20 bp, Artificial Sequence
  chemically synthesized
ctatagataacataactggc

SEQ ID NO: 19600 - DNA, 20 bp, Artificial Sequence
  chemically synthesized
tatagataacataactggcc

SEQ ID NO: 19601 - DNA, 20 bp, Artificial Sequence
  chemically synthesized
gataacataactggccaggt

SEQ ID NO: 19602 - DNA, 20 bp, Artificial Sequence
  chemically synthesized
ataacataactggccaggtc

SEQ ID NO: 19603 - DNA, 20 bp, Artificial Sequence
  chemically synthesized
taacataactggccaggtca

SEQ ID NO: 19604 - DNA, 20 bp, Artificial Sequence
  chemically synthesized
aacataactggccaggtcag

SEQ ID NO: 19605 - DNA, 20 bp, Artificial Sequence
  chemically synthesized
gtcaggggtctatctttaac

SEQ ID NO: 19606 - DNA, 20 bp, Artificial Sequence
  chemically synthesized
tcaggggtctatctttaacc

SEQ ID NO: 19607 - DNA, 20 bp, Artificial Sequence
  chemically synthesized
ggtctatctttaaccaggcc

SEQ ID NO: 19608 - DNA, 20 bp, Artificial Sequence
  chemically synthesized
gtctatctttaaccaggccc

SEQ ID NO: 19609 - DNA, 20 bp, Artificial Sequence
  chemically synthesized
ctttaaccaggcccaggatg

SEQ ID NO: 19610 - DNA, 20 bp, Artificial Sequence
  chemically synthesized
ccaggcccaggatgtggtct

SEQ ID NO: 19611 - DNA, 20 bp, Artificial Sequence
  chemically synthesized
caggcccaggatgtggtctc

SEQ ID NO: 19612 - DNA, 20 bp, Artificial Sequence
  chemically synthesized
ggtctcaggctgtttgcctg

SEQ ID NO: 19613 - DNA, 20 bp, Artificial Sequence
  chemically synthesized
tggatttcatttctgccttt

SEQ ID NO: 19614 - DNA, 20 bp, Artificial Sequence
  chemically synthesized
gtttttacttcttctttctt

SEQ ID NO: 19615 - DNA, 20 bp, Artificial Sequence
  chemically synthesized
ttttacttcttctttctttg

SEQ ID NO: 19616 - DNA, 20 bp, Artificial Sequence
  chemically synthesized
tttacttcttctttctttgg

SEQ ID NO: 19617 - DNA, 20 bp, Artificial Sequence
  chemically synthesized
acttcttctttctttggagg

SEQ ID NO: 19618 - DNA, 20 bp, Artificial Sequence
  chemically synthesized
ctttctttggaggcagaaat

SEQ ID NO: 19619 - DNA, 20 bp, Artificial Sequence
  chemically synthesized
tttctttggaggcagaaatt

SEQ ID NO: 19620 - DNA, 20 bp, Artificial Sequence
  chemically synthesized
attgggcataaaacaatatg

SEQ ID NO: 19621 - DNA, 20 bp, Artificial Sequence
  chemically synthesized
ttgggcataaaacaatatga

SEQ ID NO: 19622 - DNA, 20 bp, Artificial Sequence
  chemically synthesized
tgggcataaaacaatatgaa

SEQ ID NO: 19623 - DNA, 20 bp, Artificial Sequence
  chemically synthesized
gcataaaacaatatgaaggg

SEQ ID NO: 19624 - DNA, 20 bp, Artificial Sequence
  chemically synthesized
agggtggtctcctcccttac

SEQ ID NO: 19625 - DNA, 20 bp, Artificial Sequence
  chemically synthesized
gggtggtctcctcccttact

SEQ ID NO: 19626 - DNA, 20 bp, Artificial Sequence
  chemically synthesized
tggtctcctcccttactagg

SEQ ID NO: 19627 - DNA, 20 bp, Artificial Sequence
  chemically synthesized
gtctcctcccttactaggaa

SEQ ID NO: 19628 - DNA, 20 bp, Artificial Sequence
  chemically synthesized
ctcctcccttactaggaaga

SEQ ID NO: 19629 - DNA, 20 bp, Artificial Sequence
  chemically synthesized
ggaagagagaaataccatgt

SEQ ID NO: 19630 - DNA, 20 bp, Artificial Sequence
  chemically synthesized
gaaatacgtatttgtgttat

SEQ ID NO: 19631 - DNA, 20 bp, Artificial Sequence
  chemically synthesized
tgtgttattggatttgacat

SEQ ID NO: 19632 - DNA, 20 bp, Artificial Sequence
  chemically synthesized
gtgttattggatttgacatc

SEQ ID NO: 19633 - DNA, 20 bp, Artificial Sequence
  chemically synthesized
tgttattggatttgacatcg

SEQ ID NO: 19634 - DNA, 20 bp, Artificial Sequence
  chemically synthesized
attggatttgacatcggggt

SEQ ID NO: 19635 - DNA, 20 bp, Artificial Sequence
  chemically synthesized
tttgacatcggggttggacc

SEQ ID NO: 19636 - DNA, 20 bp, Artificial Sequence
  chemically synthesized
catcttctatgaacatctat

SEQ ID NO: 19637 - DNA, 20 bp, Artificial Sequence
  chemically synthesized
aagcacgttctccttatcaa

SEQ ID NO: 19638 - DNA, 20 bp, Artificial Sequence
  chemically synthesized
agcacgttctccttatcaaa

SEQ ID NO: 19639 - DNA, 20 bp, Artificial Sequence
  chemically synthesized
ttatcaaaaggtactttgct

SEQ ID NO: 19640 - DNA, 20 bp, Artificial Sequence
  chemically synthesized
tactttgcttggtgctttaa

SEQ ID NO: 19641 - DNA, 20 bp, Artificial Sequence
  chemically synthesized
ttaaaagataaatgactatg

SEQ ID NO: 19642 - DNA, 20 bp, Artificial Sequence
  chemically synthesized
agataaatgactatgtagct

SEQ ID NO: 19643 - DNA, 20 bp, Artificial Sequence
  chemically synthesized
gataaatgactatgtagctt

SEQ ID NO: 19644 - DNA, 20 bp, Artificial Sequence
  chemically synthesized
taaatgactatgtagcttag

SEQ ID NO: 19645 - DNA, 20 bp, Artificial Sequence
  chemically synthesized
ttcttcataattgaaaacca

SEQ ID NO: 19646 - DNA, 20 bp, Artificial Sequence
  chemically synthesized
ttcataattgaaaaccacag

SEQ ID NO: 19647 - DNA, 20 bp, Artificial Sequence
  chemically synthesized
gctgttatttgaacatacct

SEQ ID NO: 19648 - DNA, 20 bp, Artificial Sequence
  chemically synthesized
gaacatacctgagccccttc

SEQ ID NO: 19649 - DNA, 20 bp, Artificial Sequence
  chemically synthesized
gagccccttctggaccactg

SEQ ID NO: 19650 - DNA, 20 bp, Artificial Sequence
  chemically synthesized
agccccttctggaccactgt

SEQ ID NO: 19651 - DNA, 20 bp, Artificial Sequence
  chemically synthesized
ccccttctggaccactgtag

SEQ ID NO: 19652 - DNA, 20 bp, Artificial Sequence
  chemically synthesized
cttctggaccactgtaggag

SEQ ID NO: 19653 - DNA, 20 bp, Artificial Sequence
  chemically synthesized
ttctggaccactgtaggaga

SEQ ID NO: 19654 - DNA, 20 bp, Artificial Sequence
  chemically synthesized
ctggaccactgtaggagaag

SEQ ID NO: 19655 - DNA, 20 bp, Artificial Sequence
  chemically synthesized
tggaccactgtaggagaagg

SEQ ID NO: 19656 - DNA, 20 bp, Artificial Sequence
  chemically synthesized
accactgtaggagaaggagg

SEQ ID NO: 19657 - DNA, 20 bp, Artificial Sequence
  chemically synthesized
cactgtaggagaaggaggaa

SEQ ID NO: 19658 - DNA, 20 bp, Artificial Sequence
  chemically synthesized
ctgtaggagaaggaggaaga

SEQ ID NO: 19659 - DNA, 20 bp, Artificial Sequence
  chemically synthesized
tgtaggagaaggaggaagag

SEQ ID NO: 19660 - DNA, 20 bp, Artificial Sequence
  chemically synthesized
agaaggaggaagagaggtga

SEQ ID NO: 19661 - DNA, 20 bp, Artificial Sequence
  chemically synthesized
tgaaagtgatttctgctgct

SEQ ID NO: 19662 - DNA, 20 bp, Artificial Sequence
  chemically synthesized
gaaagtgatttctgctgctg

SEQ ID NO: 19663 - DNA, 20 bp, Artificial Sequence
  chemically synthesized
aaagtgatttctgctgctga

SEQ ID NO: 19664 - DNA, 20 bp, Artificial Sequence
  chemically synthesized
gagggcatgtatgatgacaa

SEQ ID NO: 19665 - DNA, 20 bp, Artificial Sequence
  chemically synthesized
agggcatgtatgatgacaat

SEQ ID NO: 19666 - DNA, 20 bp, Artificial Sequence
  chemically synthesized
gtcctaactttgacactaca

SEQ ID NO: 19667 - DNA, 20 bp, Artificial Sequence
  chemically synthesized
ctttgacactacaaagtgac

SEQ ID NO: 19668 - DNA, 20 bp, Artificial Sequence
  chemically synthesized
ttgacactacaaagtgactg

SEQ ID NO: 19669 - DNA, 20 bp, Artificial Sequence
  chemically synthesized
ctacaaagtgactggagctt

SEQ ID NO: 19670 - DNA, 20 bp, Artificial Sequence
  chemically synthesized
tacaaagtgactggagcttt

SEQ ID NO: 19671 - DNA, 20 bp, Artificial Sequence
  chemically synthesized
aagtgactggagctttaggc

SEQ ID NO: 19672 - DNA, 20 bp, Artificial Sequence
  chemically synthesized
tgactggagctttaggcaag

SEQ ID NO: 19673 - DNA, 20 bp, Artificial Sequence
  chemically synthesized
agttactccaattgtctttt

SEQ ID NO: 19674 - DNA, 20 bp, Artificial Sequence
  chemically synthesized
ttttcagactctttcttttt

SEQ ID NO: 19675 - DNA, 20 bp, Artificial Sequence
  chemically synthesized
tttcagactctttctttttg

SEQ ID NO: 19676 - DNA, 20 bp, Artificial Sequence
  chemically synthesized
tgaggtatttgacctctttg

SEQ ID NO: 19677 - DNA, 20 bp, Artificial Sequence
  chemically synthesized
atttgacctctttgcggcat

SEQ ID NO: 19678 - DNA, 20 bp, Artificial Sequence
  chemically synthesized
gctgctatttcacatgcacc

SEQ ID NO: 19679 - DNA, 20 bp, Artificial Sequence
  chemically synthesized
gctatttcacatgcacctag

SEQ ID NO: 19680 - DNA, 20 bp, Artificial Sequence
  chemically synthesized
ctatttcacatgcacctaga

SEQ ID NO: 19681 - DNA, 20 bp, Artificial Sequence
  chemically synthesized
tatttcacatgcacctagaa

SEQ ID NO: 19682 - DNA, 20 bp, Artificial Sequence
  chemically synthesized
aagggactttaaaacatgca

SEQ ID NO: 19683 - DNA, 20 bp, Artificial Sequence
  chemically synthesized
aacatgcacagaattgaaca

SEQ ID NO: 19684 - DNA, 20 bp, Artificial Sequence
  chemically synthesized
atgcacagaattgaacaaag

SEQ ID NO: 19685 - DNA, 20 bp, Artificial Sequence
  chemically synthesized
acaaagcagtaaccattcgt

SEQ ID NO: 19686 - DNA, 20 bp, Artificial Sequence
  chemically synthesized
tcaaatactattatttttga

SEQ ID NO: 19687 - DNA, 20 bp, Artificial Sequence
  chemically synthesized
caaatactattatttttgaa

SEQ ID NO: 19688 - DNA, 20 bp, Artificial Sequence
  chemically synthesized
ttgaaaggtaaataaatcct

SEQ ID NO: 19689 - DNA, 20 bp, Artificial Sequence
  chemically synthesized
tgaaaggtaaataaatcctt

SEQ ID NO: 19690 - DNA, 20 bp, Artificial Sequence
  chemically synthesized
ggtaaataaatccttgggct

SEQ ID NO: 19691 - DNA, 20 bp, Artificial Sequence
  chemically synthesized
aaataaatccttgggcttag

SEQ ID NO: 19692 - DNA, 20 bp, Artificial Sequence
  chemically synthesized
attgctaacctgaatgataa

SEQ ID NO: 19693 - DNA, 20 bp, Artificial Sequence
  chemically synthesized
agaaacttttttccttttaa

SEQ ID NO: 19694 - DNA, 20 bp, Artificial Sequence
  chemically synthesized
acttttttccttttaacagt

SEQ ID NO: 19695 - DNA, 20 bp, Artificial Sequence
  chemically synthesized
ttttttccttttaacagttg

SEQ ID NO: 19696 - DNA, 20 bp, Artificial Sequence
  chemically synthesized
tttttccttttaacagttgg

SEQ ID NO: 19697 - DNA, 20 bp, Artificial Sequence
  chemically synthesized
gaggcatctatactgtgatt

SEQ ID NO: 19698 - DNA, 20 bp, Artificial Sequence
  chemically synthesized
tctatactgtgattcagaca

SEQ ID NO: 19699 - DNA, 20 bp, Artificial Sequence
  chemically synthesized
ctatactgtgattcagacaa

SEQ ID NO: 19700 - DNA, 20 bp, Artificial Sequence
  chemically synthesized
tcagacaaaggccaaaacaa

SEQ ID NO: 19701 - DNA, 20 bp, Artificial Sequence
  chemically synthesized
gacaaaggccaaaacaacag

SEQ ID NO: 19702 - DNA, 20 bp, Artificial Sequence
  chemically synthesized
ccaaaacaacagcagatgaa

SEQ ID NO: 19703 - DNA, 20 bp, Artificial Sequence
  chemically synthesized
caaaacaacagcagatgaat

SEQ ID NO: 19704 - DNA, 20 bp, Artificial Sequence
  chemically synthesized
aaaacaacagcagatgaatg

SEQ ID NO: 19705 - DNA, 20 bp, Artificial Sequence
  chemically synthesized
aacaacagcagatgaatggg

SEQ ID NO: 19706 - DNA, 20 bp, Artificial Sequence
  chemically synthesized
caacagcagatgaatgggga

SEQ ID NO: 19707 - DNA, 20 bp, Artificial Sequence
  chemically synthesized
gggagagaactattttctga

SEQ ID NO: 19708 - DNA, 20 bp, Artificial Sequence
  chemically synthesized
ggagagaactattttctgat

SEQ ID NO: 19709 - DNA, 20 bp, Artificial Sequence
  chemically synthesized
ttctgataggtccatatttt

SEQ ID NO: 19710 - DNA, 20 bp, Artificial Sequence
  chemically synthesized
catattttgagcataatatg

SEQ ID NO: 19711 - DNA, 20 bp, Artificial Sequence
  chemically synthesized
ttgagcataatatgaagact

SEQ ID NO: 19712 - DNA, 20 bp, Artificial Sequence
  chemically synthesized
tgagcataatatgaagactc

SEQ ID NO: 19713 - DNA, 20 bp, Artificial Sequence
  chemically synthesized
gcataatatgaagactcagg

SEQ ID NO: 19714 - DNA, 20 bp, Artificial Sequence
  chemically synthesized
atatgaagactcaggtggaa

SEQ ID NO: 19715 - DNA, 20 bp, Artificial Sequence
  chemically synthesized
gaacctgtaaatgatgctgt

SEQ ID NO: 19716 - DNA, 20 bp, Artificial Sequence
  chemically synthesized
cctgtaaatgatgctgtcag

SEQ ID NO: 19717 - DNA, 20 bp, Artificial Sequence
  chemically synthesized
tgtaaatgatgctgtcagaa

SEQ ID NO: 19718 - DNA, 20 bp, Artificial Sequence
  chemically synthesized
aaatgatgctgtcagaagag

SEQ ID NO: 19719 - DNA, 20 bp, Artificial Sequence
  chemically synthesized
tgatgctgtcagaagagcag

SEQ ID NO: 19720 - DNA, 20 bp, Artificial Sequence
  chemically synthesized
gagcagtggacgcaatgaat

SEQ ID NO: 19721 - DNA, 20 bp, Artificial Sequence
  chemically synthesized
gtggacgcaatgaataagca

SEQ ID NO: 19722 - DNA, 20 bp, Artificial Sequence
  chemically synthesized
caatgaataagcatggctgc

SEQ ID NO: 19723 - DNA, 20 bp, Artificial Sequence
  chemically synthesized
acaggttcacactgttccac

SEQ ID NO: 19724 - DNA, 20 bp, Artificial Sequence
  chemically synthesized
gctgttgttttggcctttgt

SEQ ID NO: 19725 - DNA, 20 bp, Artificial Sequence
  chemically synthesized
gcaatttgtttaaagtaata

SEQ ID NO: 19726 - DNA, 20 bp, Artificial Sequence
  chemically synthesized
taaagtaataagggatggaa

SEQ ID NO: 19727 - DNA, 20 bp, Artificial Sequence
  chemically synthesized
cagatttttaaattagcatt

SEQ ID NO: 19728 - DNA, 20 bp, Artificial Sequence
  chemically synthesized
atttaggatccactaagccc

SEQ ID NO: 19729 - DNA, 20 bp, Artificial Sequence
  chemically synthesized
catattgttaagggacacca

SEQ ID NO: 19730 - DNA, 20 bp, Artificial Sequence
  chemically synthesized
ggtcaaatacctcaaaaaga

SEQ ID NO: 19731 - DNA, 20 bp, Artificial Sequence
  chemically synthesized
aaagagtctgaaaagacaat

SEQ ID NO: 19732 - DNA, 20 bp, Artificial Sequence
  chemically synthesized
cccccagtcatgtaccccct

SEQ ID NO: 19733 - DNA, 20 bp, Artificial Sequence
  chemically synthesized
tgtaagcccttaaaagggac

SEQ ID NO: 19734 - DNA, 20 bp, Artificial Sequence
  chemically synthesized
agagcttggttgttggagat

SEQ ID NO: 19735 - DNA, 20 bp, Artificial Sequence
  chemically synthesized
agtcttgcccaagctcccag

SEQ ID NO: 19736 - DNA, 20 bp, Artificial Sequence
  chemically synthesized
cttctttaactcggtgtctg

SEQ ID NO: 19737 - DNA, 20 bp, Artificial Sequence
  chemically synthesized
tgcagcttgtcctgctacac

SEQ ID NO: 19738 - DNA, 20 bp, Artificial Sequence
  chemically synthesized
aaaacacaaagccacaatat

SEQ ID NO: 19739 - DNA, 20 bp, Artificial Sequence
  chemically synthesized
atttggaaaatatgcacact

SEQ ID NO: 19740 - DNA, 20 bp, Artificial Sequence
  chemically synthesized
catcctgggggaaaattaag

SEQ ID NO: 19741 - DNA, 20 bp, Artificial Sequence
  chemically synthesized
aaaattaaggagagtatgaa

SEQ ID NO: 19742 - DNA, 20 bp, Artificial Sequence
  chemically synthesized
aattagctcatgtgtcaaat

SEQ ID NO: 19743 - DNA, 20 bp, Artificial Sequence
  chemically synthesized
gggaaagacaggctctaaaa

SEQ ID NO: 19744 - DNA, 20 bp, Artificial Sequence
  chemically synthesized
aattagatgtggcctaggca

SEQ ID NO: 19745 - DNA, 20 bp, Artificial Sequence
  chemically synthesized
tgcttctgcaccgcaaaaga

SEQ ID NO: 19746 - DNA, 20 bp, Artificial Sequence
  chemically synthesized
accgcaaaagaccgaatcaa

SEQ ID NO: 19747 - DNA, 20 bp, Artificial Sequence
  chemically synthesized
agaccgaatcaacagagtaa

SEQ ID NO: 19748 - DNA, 20 bp, Artificial Sequence
  chemically synthesized
cagagtaaacggataaccta

SEQ ID NO: 19749 - DNA, 20 bp, Artificial Sequence
  chemically synthesized
agaaaaaaaaattgcaaact

SEQ ID NO: 19750 - DNA, 20 bp, Artificial Sequence
  chemically synthesized
tgcaacaaaaggctaatata

SEQ ID NO: 19751 - DNA, 20 bp, Artificial Sequence
  chemically synthesized
agtgactgtgatggttaata

SEQ ID NO: 19752 - DNA, 20 bp, Artificial Sequence
  chemically synthesized
gtgtcaacttgattggactg

SEQ ID NO: 19753 - DNA, 20 bp, Artificial Sequence
  chemically synthesized
aaggatgcaaagtaatgatc

SEQ ID NO: 19754 - DNA, 20 bp, Artificial Sequence
  chemically synthesized
atgatcttgggtgtgtctgt

SEQ ID NO: 19755 - DNA, 20 bp, Artificial Sequence
  chemically synthesized
aaggcagacccacccttaat

SEQ ID NO: 19756 - DNA, 20 bp, Artificial Sequence
  chemically synthesized
taatcagttgccagcacagc

SEQ ID NO: 19757 - DNA, 20 bp, Artificial Sequence
  chemically synthesized
gcctacatttttctcccatg

SEQ ID NO: 19758 - DNA, 20 bp, Artificial Sequence
  chemically synthesized
ttttgggaccttgtgaacat

SEQ ID NO: 19759 - DNA, 20 bp, Artificial Sequence
  chemically synthesized
ctaatacagattttggtacc

SEQ ID NO: 19760 - DNA, 20 bp, Artificial Sequence
  chemically synthesized
caggagtggttctagaggaa

SEQ ID NO: 19761 - DNA, 20 bp, Artificial Sequence
  chemically synthesized
ttctagaggaacagaatatt

SEQ ID NO: 19762 - DNA, 20 bp, Artificial Sequence
  chemically synthesized
gaggaacagaatattaagga

SEQ ID NO: 19763 - DNA, 20 bp, Artificial Sequence
  chemically synthesized
tggagttctttcattggttt

SEQ ID NO: 19764 - DNA, 20 bp, Artificial Sequence
  chemically synthesized
ttcattggttttggggtttc

SEQ ID NO: 19765 - DNA, 20 bp, Artificial Sequence
  chemically synthesized
tccttggcatcaattgttta

SEQ ID NO: 19766 - DNA, 20 bp, Artificial Sequence
  chemically synthesized
ttcaacgcttgtgagaggca

SEQ ID NO: 19767 - DNA, 20 bp, Artificial Sequence
  chemically synthesized
aatacttttgactatatgtg

SEQ ID NO: 19768 - DNA, 20 bp, Artificial Sequence
  chemically synthesized
tgaaagaaaatgatgaactc

SEQ ID NO: 19769 - DNA, 20 bp, Artificial Sequence
  chemically synthesized
agcaagaagtagcaaacaca

SEQ ID NO: 19770 - DNA, 20 bp, Artificial Sequence
  chemically synthesized
gatgagacatttgtgggaca

SEQ ID NO: 19771 - DNA, 20 bp, Artificial Sequence
  chemically synthesized
tctacctcagtaaaatttat

SEQ ID NO: 19772 - DNA, 20 bp, Artificial Sequence
  chemically synthesized
gagatattccttctaaagtg

SEQ ID NO: 19773 - DNA, 20 bp, Artificial Sequence
  chemically synthesized
acaacgcctagtgggcctat

SEQ ID NO: 19774 - DNA, 20 bp, Artificial Sequence
  chemically synthesized
ggaggcaacatattcctgat

SEQ ID NO: 19775 - DNA, 20 bp, Artificial Sequence
  chemically synthesized
gtgttactctggcccattta

SEQ ID NO: 19776 - DNA, 20 bp, Artificial Sequence
  chemically synthesized
gatccaaaaggctgccagtt

SEQ ID NO: 19777 - DNA, 20 bp, Artificial Sequence
  chemically synthesized
aaaaggctgccagttttgag

SEQ ID NO: 19778 - DNA, 20 bp, Artificial Sequence
  chemically synthesized
ttgaggtgtcagtgccagat

SEQ ID NO: 19779 - DNA, 20 bp, Artificial Sequence
  chemically synthesized
tgtttggagcatttggcagg

SEQ ID NO: 19780 - DNA, 20 bp, Artificial Sequence
  chemically synthesized
tgaatcacagcggaggcctc

SEQ ID NO: 19781 - DNA, 20 bp, Artificial Sequence
  chemically synthesized
tggaaacgaaatatttgact

SEQ ID NO: 19782 - DNA, 20 bp, Artificial Sequence
  chemically synthesized
cctgaactgcctatcatgaa

SEQ ID NO: 19783 - DNA, 20 bp, Artificial Sequence
  chemically synthesized
actgcaccgatggtctcatg

SEQ ID NO: 19784 - DNA, 20 bp, Artificial Sequence
  chemically synthesized
gaaatttggggaagaggtat

SEQ ID NO: 19785 - DNA, 20 bp, Artificial Sequence
  chemically synthesized
caaagatattttcatcccat

SEQ ID NO: 19786 - DNA, 20 bp, Artificial Sequence
  chemically synthesized
tcccatgtgagtgctcacca

SEQ ID NO: 19787 - DNA, 20 bp, Artificial Sequence
  chemically synthesized
aatgggtgacctcagcagaa

SEQ ID NO: 19788 - DNA, 20 bp, Artificial Sequence
  chemically synthesized
aagaggattttaataatcaa

SEQ ID NO: 19789 - DNA, 20 bp, Artificial Sequence
  chemically synthesized
gattttaataatcaagtgga

SEQ ID NO: 19790 - DNA, 20 bp, Artificial Sequence
  chemically synthesized
aacaaagtggccacagttgc

SEQ ID NO: 19791 - DNA, 20 bp, Artificial Sequence
  chemically synthesized
cttgatatggcaccattcct

SEQ ID NO: 19792 - DNA, 20 bp, Artificial Sequence
  chemically synthesized
gggcagaggcttgtcctcac

SEQ ID NO: 19793 - DNA, 20 bp, Artificial Sequence
  chemically synthesized
cactggaatagacacttact

SEQ ID NO: 19794 - DNA, 20 bp, Artificial Sequence
  chemically synthesized
aatagacacttactctggat

SEQ ID NO: 19795 - DNA, 20 bp, Artificial Sequence
  chemically synthesized
tatgccaagactaccatcca

SEQ ID NO: 19796 - DNA, 20 bp, Artificial Sequence
  chemically synthesized
gactaccatccatggaatca

SEQ ID NO: 19797 - DNA, 20 bp, Artificial Sequence
  chemically synthesized
tgacagtgggctcatgctca

SEQ ID NO: 19798 - DNA, 20 bp, Artificial Sequence
  chemically synthesized
ctatcatcctgaagcagctt

SEQ ID NO: 19799 - DNA, 20 bp, Artificial Sequence
  chemically synthesized
tccagaaggctgtgtatgct

SEQ ID NO: 19800 - DNA, 20 bp, Artificial Sequence
  chemically synthesized
ggtactgtttctcccataga

SEQ ID NO: 19801 - DNA, 20 bp, Artificial Sequence
  chemically synthesized
ttctcccatagacaggattc

SEQ ID NO: 19802 - DNA, 20 bp, Artificial Sequence
  chemically synthesized
tagacaggattcacgggtcc

SEQ ID NO: 19803 - DNA, 20 bp, Artificial Sequence
  chemically synthesized
attcacgggtccaggaatca

SEQ ID NO: 19804 - DNA, 20 bp, Artificial Sequence
  chemically synthesized
ttaagtcaacaggctaagaa

SEQ ID NO: 19805 - DNA, 20 bp, Artificial Sequence
  chemically synthesized
gaggtaaggaagcgtatgca

SEQ ID NO: 19806 - DNA, 20 bp, Artificial Sequence
  chemically synthesized
atggaatataggagatccat

SEQ ID NO: 19807 - DNA, 20 bp, Artificial Sequence
  chemically synthesized
ctcttagttttaccatgtcc

SEQ ID NO: 19808 - DNA, 20 bp, Artificial Sequence
  chemically synthesized
gcaggactacaaataaaggt

SEQ ID NO: 19809 - DNA, 20 bp, Artificial Sequence
  chemically synthesized
aggtgcttgctgagggcaaa

SEQ ID NO: 19810 - DNA, 20 bp, Artificial Sequence
  chemically synthesized
tgctgagggcaaagggaata

SEQ ID NO: 19811 - DNA, 20 bp, Artificial Sequence
  chemically synthesized
atacaaggactgtaattgtc

SEQ ID NO: 19812 - DNA, 20 bp, Artificial Sequence
  chemically synthesized
tatgtaatagcatttgcaat

SEQ ID NO: 19813 - DNA, 20 bp, Artificial Sequence
  chemically synthesized
ggtgcattttcaattgcacg

SEQ ID NO: 19814 - DNA, 20 bp, Artificial Sequence
  chemically synthesized
gaagataatgtatgacctca

SEQ ID NO: 19815 - DNA, 20 bp, Artificial Sequence
  chemically synthesized
tggacttgtgatggttaata

SEQ ID NO: 19816 - DNA, 20 bp, Artificial Sequence
  chemically synthesized
aatactgagtgtcaacttga

SEQ ID NO: 19817 - DNA, 20 bp, Artificial Sequence
  chemically synthesized
aagtgtgcaaagtattgatc

SEQ ID NO: 19818 - DNA, 20 bp, Artificial Sequence
  chemically synthesized
ttgatcctgagtgtgtctgt

SEQ ID NO: 19819 - DNA, 20 bp, Artificial Sequence
  chemically synthesized
aaggcagacccacccttaat

SEQ ID NO: 19820 - DNA, 20 bp, Artificial Sequence
  chemically synthesized
taatcagttgccagtgtggc

SEQ ID NO: 19821 - DNA, 20 bp, Artificial Sequence
  chemically synthesized
gcctacatctttctcccatg

SEQ ID NO: 19822 - DNA, 20 bp, Artificial Sequence
  chemically synthesized
ttcaacatcactaataatca

SEQ ID NO: 19823 - DNA, 20 bp, Artificial Sequence
  chemically synthesized
tgatacctccttatgccagt

SEQ ID NO: 19824 - DNA, 20 bp, Artificial Sequence
  chemically synthesized
caaaaacagcagatgttggt

SEQ ID NO: 19825 - DNA, 20 bp, Artificial Sequence
  chemically synthesized
aatgcttatacactgttggt

SEQ ID NO: 19826 - DNA, 20 bp, Artificial Sequence
  chemically synthesized
tcaatcctgcaatcccacta

SEQ ID NO: 19827 - DNA, 20 bp, Artificial Sequence
  chemically synthesized
tgttcccaatagcaaagata

SEQ ID NO: 19828 - DNA, 20 bp, Artificial Sequence
  chemically synthesized
aaatgtctaccaatggacga

SEQ ID NO: 19829 - DNA, 20 bp, Artificial Sequence
  chemically synthesized
tatattactcagccataaaa

SEQ ID NO: 19830 - DNA, 20 bp, Artificial Sequence
  chemically synthesized
agccaagtgggagctaaacg

SEQ ID NO: 19831 - DNA, 20 bp, Artificial Sequence
  chemically synthesized
gatgagtaagcatagacata

SEQ ID NO: 19832 - DNA, 20 bp, Artificial Sequence
  chemically synthesized
ttgagactagagaaaggtgg

SEQ ID NO: 19833 - DNA, 20 bp, Artificial Sequence
  chemically synthesized
ctagagaaaggtgggaggat

SEQ ID NO: 19834 - DNA, 20 bp, Artificial Sequence
  chemically synthesized
atggtgaggactgaaaaact

SEQ ID NO: 19835 - DNA, 20 bp, Artificial Sequence
  chemically synthesized
gaggactgaaaaactacgga

SEQ ID NO: 19836 - DNA, 20 bp, Artificial Sequence
  chemically synthesized
gtccccacccaaatctcatc

SEQ ID NO: 19837 - DNA, 20 bp, Artificial Sequence
  chemically synthesized
taatcctcacgtgttgtggg

SEQ ID NO: 19838 - DNA, 20 bp, Artificial Sequence
  chemically synthesized
agggatttggagggaggtaa

SEQ ID NO: 19839 - DNA, 20 bp, Artificial Sequence
  chemically synthesized
ctcatgctcttctcgtgata

SEQ ID NO: 19840 - DNA, 20 bp, Artificial Sequence
  chemically synthesized
gcaagcaaaatatcacttaa

SEQ ID NO: 19841 - DNA, 20 bp, Artificial Sequence
  chemically synthesized
tcacttaatggggtaattaa

SEQ ID NO: 19842 - DNA, 20 bp, Artificial Sequence
  chemically synthesized
agggtgaagaaattgggcaa

SEQ ID NO: 19843 - DNA, 20 bp, Artificial Sequence
  chemically synthesized
ggcaaatggatgtcatgagg

SEQ ID NO: 19844 - DNA, 20 bp, Artificial Sequence
  chemically synthesized
tcagagcccaggccctaagc

SEQ ID NO: 19845 - DNA, 20 bp, Artificial Sequence
  chemically synthesized
gcccaggccctaagctggag

SEQ ID NO: 19846 - DNA, 20 bp, Artificial Sequence
  chemically synthesized
tggagtagagtgtgcaagga

SEQ ID NO: 19847 - DNA, 20 bp, Artificial Sequence
  chemically synthesized
agtgtgcaaggaaagagtaa

SEQ ID NO: 19848 - DNA, 20 bp, Artificial Sequence
  chemically synthesized
gaaagagtaataggattgaa

SEQ ID NO: 19849 - DNA, 20 bp, Artificial Sequence
  chemically synthesized
ccaggtaggaggacataggg

SEQ ID NO: 19850 - DNA, 20 bp, Artificial Sequence
  chemically synthesized
agacctccagtaaacttagg

SEQ ID NO: 19851 - DNA, 20 bp, Artificial Sequence
  chemically synthesized
actaaataataatcacatgt

SEQ ID NO: 19852 - DNA, 20 bp, Artificial Sequence
  chemically synthesized
ttgttcatgagctagagcaa

SEQ ID NO: 19853 - DNA, 20 bp, Artificial Sequence
  chemically synthesized
atgctattatatggtaccaa

SEQ ID NO: 19854 - DNA, 20 bp, Artificial Sequence
  chemically synthesized
aaaatgcaagcaattttcat

SEQ ID NO: 19855 - DNA, 20 bp, Artificial Sequence
  chemically synthesized
tacacaagctaattgtcctt

SEQ ID NO: 19856 - DNA, 20 bp, Artificial Sequence
  chemically synthesized
aagtttaaactgtcattgag

SEQ ID NO: 19857 - DNA, 20 bp, Artificial Sequence
  chemically synthesized
cagatgttatgtgatgagga

SEQ ID NO: 19858 - DNA, 20 bp, Artificial Sequence
  chemically synthesized
agaacttttctttaaagtgt

SEQ ID NO: 19859 - DNA, 20 bp, Artificial Sequence
  chemically synthesized
acaaaaatgcaaaatttcca

SEQ ID NO: 19860 - DNA, 20 bp, Artificial Sequence
  chemically synthesized
ttcatcttcatcttttccag

SEQ ID NO: 19861 - DNA, 20 bp, Artificial Sequence
  chemically synthesized
gatagtcccccatatagcct

SEQ ID NO: 19862 - DNA, 20 bp, Artificial Sequence
  chemically synthesized
gtagaaaatcccacataaga

SEQ ID NO: 19863 - DNA, 20 bp, Artificial Sequence
  chemically synthesized
tcccacataagagagaattc

SEQ ID NO: 19864 - DNA, 20 bp, Artificial Sequence
  chemically synthesized
agcaaggaagcctacccagt

SEQ ID NO: 19865 - DNA, 20 bp, Artificial Sequence
  chemically synthesized
acatctgcattatggactcc

SEQ ID NO: 19866 - DNA, 20 bp, Artificial Sequence
  chemically synthesized
tccaggaatcctagccacag

SEQ ID NO: 19867 - DNA, 20 bp, Artificial Sequence
  chemically synthesized
ctccagagaaggagctctca

SEQ ID NO: 19868 - DNA, 20 bp, Artificial Sequence
  chemically synthesized
ctgacatcccccacccacag

SEQ ID NO: 19869 - DNA, 20 bp, Artificial Sequence
  chemically synthesized
tactgctggctgctgtcacc

SEQ ID NO: 19870 - DNA, 20 bp, Artificial Sequence
  chemically synthesized
aggcattctgctgggggcct

SEQ ID NO: 19871 - DNA, 20 bp, Artificial Sequence
  chemically synthesized
gccggtgtccacacacacca

SEQ ID NO: 19872 - DNA, 20 bp, Artificial Sequence
  chemically synthesized
acctcctgcatgtgccacct

SEQ ID NO: 19873 - DNA, 20 bp, Artificial Sequence
  chemically synthesized
tgcagactgcttgggagcca

SEQ ID NO: 19874 - DNA, 20 bp, Artificial Sequence
  chemically synthesized
agcaaactgcctgaaggcca

SEQ ID NO: 19875 - DNA, 20 bp, Artificial Sequence
  chemically synthesized
cagccatggggcccaaggac

SEQ ID NO: 19876 - DNA, 20 bp, Artificial Sequence
  chemically synthesized
aagaaatatgacacttccaa

SEQ ID NO: 19877 - DNA, 20 bp, Artificial Sequence
  chemically synthesized
atttataaaattctggaaaa

SEQ ID NO: 19878 - DNA, 20 bp, Artificial Sequence
  chemically synthesized
aagaaatcagaaaaacaatt

SEQ ID NO: 19879 - DNA, 20 bp, Artificial Sequence
  chemically synthesized
tcagaaaaacaattcaggat

SEQ ID NO: 19880 - DNA, 20 bp, Artificial Sequence
  chemically synthesized
acccaagagatagatacaac

SEQ ID NO: 19881 - DNA, 20 bp, Artificial Sequence
  chemically synthesized
aaacagaaattctgtaactg

SEQ ID NO: 19882 - DNA, 20 bp, Artificial Sequence
  chemically synthesized
aatgatagaaaggaaaaaaa

SEQ ID NO: 19883 - DNA, 20 bp, Artificial Sequence
  chemically synthesized
agtcaaactgtcaaaagcca

SEQ ID NO: 19884 - DNA, 20 bp, Artificial Sequence
  chemically synthesized
cctcacaggccaggagaaga

SEQ ID NO: 19885 - DNA, 20 bp, Artificial Sequence
  chemically synthesized
tgaaagaaaaaaatgacacc

SEQ ID NO: 19886 - DNA, 20 bp, Artificial Sequence
  chemically synthesized
aacattgttcttcaaaaatg

SEQ ID NO: 19887 - DNA, 20 bp, Artificial Sequence
  chemically synthesized
tctgggcaagaaaaatttga

SEQ ID NO: 19888 - DNA, 20 bp, Artificial Sequence
  chemically synthesized
gctttacaagaaatatttaa

SEQ ID NO: 19889 - DNA, 20 bp, Artificial Sequence
  chemically synthesized
gaaagaaagagagagagaga

SEQ ID NO: 19890 - DNA, 20 bp, Artificial Sequence
  chemically synthesized
aaaaaaaaaacaaaacaacc

SEQ ID NO: 19891 - DNA, 20 bp, Artificial Sequence
  chemically synthesized
gaatcaattaacaaaatggc

SEQ ID NO: 19892 - DNA, 20 bp, Artificial Sequence
  chemically synthesized
aataatagccttgcatgtaa

SEQ ID NO: 19893 - DNA, 20 bp, Artificial Sequence
  chemically synthesized
gataaaaggaacaattcagc

SEQ ID NO: 19894 - DNA, 20 bp, Artificial Sequence
  chemically synthesized
agcaaatgttattagatata

SEQ ID NO: 19895 - DNA, 20 bp, Artificial Sequence
  chemically synthesized
attagatataaagggtgaaa

SEQ ID NO: 19896 - DNA, 20 bp, Artificial Sequence
  chemically synthesized
aatccaatacaataatagtt

SEQ ID NO: 19897 - DNA, 20 bp, Artificial Sequence
  chemically synthesized
agaaaattaacaaagaaaca

SEQ ID NO: 19898 - DNA, 20 bp, Artificial Sequence
  chemically synthesized
taaacttgactttagaccaa

SEQ ID NO: 19899 - DNA, 20 bp, Artificial Sequence
  chemically synthesized
aatatttcatccaacagcta

SEQ ID NO: 19900 - DNA, 20 bp, Artificial Sequence
  chemically synthesized
tcagcacatgacgcattccc

SEQ ID NO: 19901 - DNA, 20 bp, Artificial Sequence
  chemically synthesized
agcatcttctcagaccacaa

SEQ ID NO: 19902 - DNA, 20 bp, Artificial Sequence
  chemically synthesized
ggaaattaaacaacatgctc

SEQ ID NO: 19903 - DNA, 20 bp, Artificial Sequence
  chemically synthesized
atacaacataggaaaagcca

SEQ ID NO: 19904 - DNA, 20 bp, Artificial Sequence
  chemically synthesized
aatagagaaaaacaacaaca

SEQ ID NO: 19905 - DNA, 20 bp, Artificial Sequence
  chemically synthesized
tgttatttaaaaaagataaa

SEQ ID NO: 19906 - DNA, 20 bp, Artificial Sequence
  chemically synthesized
acacataccacctaccaaga

SEQ ID NO: 19907 - DNA, 20 bp, Artificial Sequence
  chemically synthesized
ctaccaagattgaattaaga

SEQ ID NO: 19908 - DNA, 20 bp, Artificial Sequence
  chemically synthesized
aaaacctgaacagaccagta

SEQ ID NO: 19909 - DNA, 20 bp, Artificial Sequence
  chemically synthesized
accagtaatgaataatgaaa

SEQ ID NO: 19910 - DNA, 20 bp, Artificial Sequence
  chemically synthesized
cttttaaaaattaaacagga

SEQ ID NO: 19911 - DNA, 20 bp, Artificial Sequence
  chemically synthesized
tcctgattccataaccagac

SEQ ID NO: 19912 - DNA, 20 bp, Artificial Sequence
  chemically synthesized
ctcaacaaaatactagcaaa

SEQ ID NO: 19913 - DNA, 20 bp, Artificial Sequence
  chemically synthesized
gataatacaccatgatcaag

SEQ ID NO: 19914 - DNA, 20 bp, Artificial Sequence
  chemically synthesized
tgatcaagtgggatttatac

SEQ ID NO: 19915 - DNA, 20 bp, Artificial Sequence
  chemically synthesized
aacccacagctaacatcata

SEQ ID NO: 19916 - DNA, 20 bp, Artificial Sequence
  chemically synthesized
tctaagaactgaaacaaaat

SEQ ID NO: 19917 - DNA, 20 bp, Artificial Sequence
  chemically synthesized
agctaaaaaataaaatattt

SEQ ID NO: 19918 - DNA, 20 bp, Artificial Sequence
  chemically synthesized
aaactacaaaacactgataa

SEQ ID NO: 19919 - DNA, 20 bp, Artificial Sequence
  chemically synthesized
tggagagatatcctatgttc

SEQ ID NO: 19920 - DNA, 20 bp, Artificial Sequence
  chemically synthesized
agacacttagaccaatggaa

SEQ ID NO: 19921 - DNA, 20 bp, Artificial Sequence
  chemically synthesized
agattttcaacaaaggtgac

SEQ ID NO: 19922 - DNA, 20 bp, Artificial Sequence
  chemically synthesized
aagaaatggtgctgaaaaaa

SEQ ID NO: 19923 - DNA, 20 bp, Artificial Sequence
  chemically synthesized
ctgaaaaaattggatatcca

SEQ ID NO: 19924 - DNA, 20 bp, Artificial Sequence
  chemically synthesized
cattggatatccatgtgcaa

SEQ ID NO: 19925 - DNA, 20 bp, Artificial Sequence
  chemically synthesized
aactggactgctgatatggt

SEQ ID NO: 19926 - DNA, 20 bp, Artificial Sequence
  chemically synthesized
aaatataatccccaacttct

SEQ ID NO: 19927 - DNA, 20 bp, Artificial Sequence
  chemically synthesized
cccaacttctcaggatcttg

SEQ ID NO: 19928 - DNA, 20 bp, Artificial Sequence
  chemically synthesized
agcatgtggaggctcgcatt

SEQ ID NO: 19929 - DNA, 20 bp, Artificial Sequence
  chemically synthesized
caggagacaccccaaatact

SEQ ID NO: 19930 - DNA, 20 bp, Artificial Sequence
  chemically synthesized
gagaagtttctgaccttacc

SEQ ID NO: 19931 - DNA, 20 bp, Artificial Sequence
  chemically synthesized
gtttctgaccttacctggag

SEQ ID NO: 19932 - DNA, 20 bp, Artificial Sequence
  chemically synthesized
agaaaggccctgggagctca

SEQ ID NO: 19933 - DNA, 20 bp, Artificial Sequence
  chemically synthesized
aggcatttacattactaaca

SEQ ID NO: 19934 - DNA, 20 bp, Artificial Sequence
  chemically synthesized
ggcctaaatgctccacttaa

SEQ ID NO: 19935 - DNA, 20 bp, Artificial Sequence
  chemically synthesized
catgcaaatggccaccaaaa

SEQ ID NO: 19936 - DNA, 20 bp, Artificial Sequence
  chemically synthesized
agaaagtcaacaaaaaaata

SEQ ID NO: 19937 - DNA, 20 bp, Artificial Sequence
  chemically synthesized
aaaaaaaagttcaggaccag

SEQ ID NO: 19938 - DNA, 20 bp, Artificial Sequence
  chemically synthesized
aggaccagatggattcacaa

SEQ ID NO: 19939 - DNA, 20 bp, Artificial Sequence
  chemically synthesized
attctactagacattcaaag

SEQ ID NO: 19940 - DNA, 20 bp, Artificial Sequence
  chemically synthesized
gatcaagcaggttccatgcc

SEQ ID NO: 19941 - DNA, 20 bp, Artificial Sequence
  chemically synthesized
caggttccatgccagggatg

SEQ ID NO: 19942 - DNA, 20 bp, Artificial Sequence
  chemically synthesized
aacccacagccaacataata

SEQ ID NO: 19943 - DNA, 20 bp, Artificial Sequence
  chemically synthesized
tctgagaactggaacaagac

SEQ ID NO: 19944 - DNA, 20 bp, Artificial Sequence
  chemically synthesized
gcaaagtttccagatacaag

SEQ ID NO: 19945 - DNA, 20 bp, Artificial Sequence
  chemically synthesized
acaccaacagcaaccaaatg

SEQ ID NO: 19946 - DNA, 20 bp, Artificial Sequence
  chemically synthesized
atataaaacgtactctcaag

SEQ ID NO: 19947 - DNA, 20 bp, Artificial Sequence
  chemically synthesized
cacagtgaagagacaagctg

SEQ ID NO: 19948 - DNA, 20 bp, Artificial Sequence
  chemically synthesized
atatttgcatacatttgaca

SEQ ID NO: 19949 - DNA, 20 bp, Artificial Sequence
  chemically synthesized
tttgacaaggaattaatctc

SEQ ID NO: 19950 - DNA, 20 bp, Artificial Sequence
  chemically synthesized
atctcattaaaaaattggca

SEQ ID NO: 19951 - DNA, 20 bp, Artificial Sequence
  chemically synthesized
agaagacatacaaatgcaca

SEQ ID NO: 19952 - DNA, 20 bp, Artificial Sequence
  chemically synthesized
agatatcatcttatgccagt

SEQ ID NO: 19953 - DNA, 20 bp, Artificial Sequence
  chemically synthesized
aataaataacacatgctggc

SEQ ID NO: 19954 - DNA, 20 bp, Artificial Sequence
  chemically synthesized
aagatccagcaatcttatta

SEQ ID NO: 19955 - DNA, 20 bp, Artificial Sequence
  chemically synthesized
tgggtatttatccaaaggaa

SEQ ID NO: 19956 - DNA, 20 bp, Artificial Sequence
  chemically synthesized
ttatccaaaggaaaagaatt

SEQ ID NO: 19957 - DNA, 20 bp, Artificial Sequence
  chemically synthesized
gattcacattagcaaagata

SEQ ID NO: 19958 - DNA, 20 bp, Artificial Sequence
  chemically synthesized
atcaacctaagtgtccatca

SEQ ID NO: 19959 - DNA, 20 bp, Artificial Sequence
  chemically synthesized
acctaagtgtccatcaatgg

SEQ ID NO: 19960 - DNA, 20 bp, Artificial Sequence
  chemically synthesized
aatgtggtgtatacacacaa

SEQ ID NO: 19961 - DNA, 20 bp, Artificial Sequence
  chemically synthesized
atcatttcatttgcagcaac

SEQ ID NO: 19962 - DNA, 20 bp, Artificial Sequence
  chemically synthesized
aagttaatatcatgtaggta

SEQ ID NO: 19963 - DNA, 20 bp, Artificial Sequence
  chemically synthesized
aatatcatgtaggtagagag

SEQ ID NO: 19964 - DNA, 20 bp, Artificial Sequence
  chemically synthesized
gaaacaggcagttagataga

SEQ ID NO: 19965 - DNA, 20 bp, Artificial Sequence
  chemically synthesized
tctgatgttcaatagcaaag

SEQ ID NO: 19966 - DNA, 20 bp, Artificial Sequence
  chemically synthesized
aacgataaatacttgaggtg

SEQ ID NO: 19967 - DNA, 20 bp, Artificial Sequence
  chemically synthesized
aaacttctctcttaacaagc

SEQ ID NO: 19968 - DNA, 20 bp, Artificial Sequence
  chemically synthesized
cttaacaagctagaatataa

SEQ ID NO: 19969 - DNA, 20 bp, Artificial Sequence
  chemically synthesized
tgaatgcaagagcatagaga

SEQ ID NO: 19970 - DNA, 20 bp, Artificial Sequence
  chemically synthesized
gaaaatacttaatatcatta

SEQ ID NO: 19971 - DNA, 20 bp, Artificial Sequence
  chemically synthesized
ttttaccacagcgtaggtca

SEQ ID NO: 19972 - DNA, 20 bp, Artificial Sequence
  chemically synthesized
atcactatttcaaagaagta

SEQ ID NO: 19973 - DNA, 20 bp, Artificial Sequence
  chemically synthesized
gaatagatatcagccaaaat

SEQ ID NO: 19974 - DNA, 20 bp, Artificial Sequence
  chemically synthesized
aggggcctagacatagcatg

SEQ ID NO: 19975 - DNA, 20 bp, Artificial Sequence
  chemically synthesized
gcatgctgaatgaaaaggaa

SEQ ID NO: 19976 - DNA, 20 bp, Artificial Sequence
  chemically synthesized
tgagctaacttcctcatttt

SEQ ID NO: 19977 - DNA, 20 bp, Artificial Sequence
  chemically synthesized
aagaaataagctaataccta

SEQ ID NO: 19978 - DNA, 20 bp, Artificial Sequence
  chemically synthesized
attaaatgctaggcacagtt

SEQ ID NO: 19979 - DNA, 20 bp, Artificial Sequence
  chemically synthesized
caacattacccaggtgatgg

SEQ ID NO: 19980 - DNA, 20 bp, Artificial Sequence
  chemically synthesized
tacccaggtgatggtggagt

SEQ ID NO: 19981 - DNA, 20 bp, Artificial Sequence
  chemically synthesized
gacagcaagatagtaagtaa

SEQ ID NO: 19982 - DNA, 20 bp, Artificial Sequence
  chemically synthesized
aggaatggagcaacaaattg

SEQ ID NO: 19983 - DNA, 20 bp, Artificial Sequence
  chemically synthesized
ttttgcttgtttgtttgaaa

SEQ ID NO: 19984 - DNA, 20 bp, Artificial Sequence
  chemically synthesized
tctcactctgtcaccccggc

SEQ ID NO: 19985 - DNA, 20 bp, Artificial Sequence
  chemically synthesized
ctgaagcctcactagaacgc

SEQ ID NO: 19986 - DNA, 20 bp, Artificial Sequence
  chemically synthesized
tttttaaatttctgtagaaa

SEQ ID NO: 19987 - DNA, 20 bp, Artificial Sequence
  chemically synthesized
aaagtgttgagattacaggt

SEQ ID NO: 19988 - DNA, 20 bp, Artificial Sequence
  chemically synthesized
aatcaccatgctgggccttg

SEQ ID NO: 19989 - DNA, 20 bp, Artificial Sequence
  chemically synthesized
atggatctttaaaagtggtg

SEQ ID NO: 19990 - DNA, 20 bp, Artificial Sequence
  chemically synthesized
aaacatcgttaggtctcggg

SEQ ID NO: 19991 - DNA, 20 bp, Artificial Sequence
  chemically synthesized
tcgttaggtctcgggaagga

SEQ ID NO: 19992 - DNA, 20 bp, Artificial Sequence
  chemically synthesized
tctgtgttaacaaaaaacag

SEQ ID NO: 19993 - DNA, 20 bp, Artificial Sequence
  chemically synthesized
tctgaaggtttagaaactcc

SEQ ID NO: 19994 - DNA, 20 bp, Artificial Sequence
  chemically synthesized
ctttagaactcctgtcctag

SEQ ID NO: 19995 - DNA, 20 bp, Artificial Sequence
  chemically synthesized
accactttgactctagtttt

SEQ ID NO: 19996 - DNA, 20 bp, Artificial Sequence
  chemically synthesized
ccttaacatgttaatttctc

SEQ ID NO: 19997 - DNA, 20 bp, Artificial Sequence
  chemically synthesized
agtaagacctgggcaaagga

SEQ ID NO: 19998 - DNA, 20 bp, Artificial Sequence
  chemically synthesized
tttgggcaaaactttccatc

SEQ ID NO: 19999 - DNA, 20 bp, Artificial Sequence
  chemically synthesized
acttagtacttcccactact

SEQ ID NO: 20000 - DNA, 20 bp, Artificial Sequence
  chemically synthesized
gtacttcccactactgtgga

SEQ ID NO: 20001 - DNA, 20 bp, Artificial Sequence
  chemically synthesized
tttgtcaattcttgaagatt

SEQ ID NO: 20002 - DNA, 20 bp, Artificial Sequence
  chemically synthesized
tgatacctaatagacacttg

SEQ ID NO: 20003 - DNA, 20 bp, Artificial Sequence
  chemically synthesized
agacacttgatgaatcctta

SEQ ID NO: 20004 - DNA, 20 bp, Artificial Sequence
  chemically synthesized
aatccttactgaataataaa

SEQ ID NO: 20005 - DNA, 20 bp, Artificial Sequence
  chemically synthesized
ctgaataataaaatggatta

SEQ ID NO: 20006 - DNA, 20 bp, Artificial Sequence
  chemically synthesized
aaaaggttattttgaagtct

SEQ ID NO: 20007 - DNA, 20 bp, Artificial Sequence
  chemically synthesized
tgggcaaaattctggcagca

SEQ ID NO: 20008 - DNA, 20 bp, Artificial Sequence
  chemically synthesized
ctaagaaaccttttgttttc

SEQ ID NO: 20009 - DNA, 20 bp, Artificial Sequence
  chemically synthesized
aaccttttgttttcttggat

SEQ ID NO: 20010 - DNA, 20 bp, Artificial Sequence
  chemically synthesized
aaaacatggtaagataactg

SEQ ID NO: 20011 - DNA, 20 bp, Artificial Sequence
  chemically synthesized
agaaactgttattcagttta

SEQ ID NO: 20012 - DNA, 20 bp, Artificial Sequence
  chemically synthesized
tcttacataatagtaaaaaa

SEQ ID NO: 20013 - DNA, 20 bp, Artificial Sequence
  chemically synthesized
cttgatcattaaatacctct

SEQ ID NO: 20014 - DNA, 20 bp, Artificial Sequence
  chemically synthesized
caatttgctctatgaactgg

SEQ ID NO: 20015 - DNA, 20 bp, Artificial Sequence
  chemically synthesized
tgctctatgaactggaggag

SEQ ID NO: 20016 - DNA, 20 bp, Artificial Sequence
  chemically synthesized
tatagtggcaatgtattatt

SEQ ID NO: 20017 - DNA, 20 bp, Artificial Sequence
  chemically synthesized
ataagtattaaaggcagctt

SEQ ID NO: 20018 - DNA, 20 bp, Artificial Sequence
  chemically synthesized
ttttatttcaaggcatactc

SEQ ID NO: 20019 - DNA, 20 bp, Artificial Sequence
  chemically synthesized
ttaaaaacacatgctcattt

SEQ ID NO: 20020 - DNA, 20 bp, Artificial Sequence
  chemically synthesized
ggataaagatctctgaggaa

SEQ ID NO: 20021 - DNA, 20 bp, Artificial Sequence
  chemically synthesized
ttctttctcactaaactaca

SEQ ID NO: 20022 - DNA, 20 bp, Artificial Sequence
  chemically synthesized
tgacttttaattttgatttt

SEQ ID NO: 20023 - DNA, 20 bp, Artificial Sequence
  chemically synthesized
ctttgaacagttagtataag

SEQ ID NO: 20024 - DNA, 20 bp, Artificial Sequence
  chemically synthesized
taaggtgaattctgattttt

SEQ ID NO: 20025 - DNA, 20 bp, Artificial Sequence
  chemically synthesized
gtcttgacacttttaaacta

SEQ ID NO: 20026 - DNA, 20 bp, Artificial Sequence
  chemically synthesized
ctagagagtataaacccaca

SEQ ID NO: 20027 - DNA, 20 bp, Artificial Sequence
  chemically synthesized
ttttgccttttgagaagctc

SEQ ID NO: 20028 - DNA, 20 bp, Artificial Sequence
  chemically synthesized
acattaattccaagctaatt

SEQ ID NO: 20029 - DNA, 20 bp, Artificial Sequence
  chemically synthesized
gcatttcatataattactaa

SEQ ID NO: 20030 - DNA, 20 bp, Artificial Sequence
  chemically synthesized
atataattactaacagaatg

SEQ ID NO: 20031 - DNA, 20 bp, Artificial Sequence
  chemically synthesized
tatttctatgttgtcataat

SEQ ID NO: 20032 - DNA, 20 bp, Artificial Sequence
  chemically synthesized
ctagcaattggttatcacta

SEQ ID NO: 20033 - DNA, 20 bp, Artificial Sequence
  chemically synthesized
cccactggggaagcccaccc

SEQ ID NO: 20034 - DNA, 20 bp, Artificial Sequence
  chemically synthesized
cacccagggatgttacagag

SEQ ID NO: 20035 - DNA, 20 bp, Artificial Sequence
  chemically synthesized
tacagtcctccgagactcct

SEQ ID NO: 20036 - DNA, 20 bp, Artificial Sequence
  chemically synthesized
gaacttacaggcacaaaagt

SEQ ID NO: 20037 - DNA, 20 bp, Artificial Sequence
  chemically synthesized
ggcacaaaagttagagttgg

SEQ ID NO: 20038 - DNA, 20 bp, Artificial Sequence
  chemically synthesized
aggctttggtagcttctctt

SEQ ID NO: 20039 - DNA, 20 bp, Artificial Sequence
  chemically synthesized
gaaatcttatgtgcttccca

SEQ ID NO: 20040 - DNA, 20 bp, Artificial Sequence
  chemically synthesized
acagaattcctggtggaagg

SEQ ID NO: 20041 - DNA, 20 bp, Artificial Sequence
  chemically synthesized
gaaagacgagaaagaggagg

SEQ ID NO: 20042 - DNA, 20 bp, Artificial Sequence
  chemically synthesized
gaagaattcctccttccacc

SEQ ID NO: 20043 - DNA, 20 bp, Artificial Sequence
  chemically synthesized
gcctgtaagttctcttctcc

SEQ ID NO: 20044 - DNA, 20 bp, Artificial Sequence
  chemically synthesized
ggattacaactaattgaaac

SEQ ID NO: 20045 - DNA, 20 bp, Artificial Sequence
  chemically synthesized
taattgaaacaggaattcaa

SEQ ID NO: 20046 - DNA, 20 bp, Artificial Sequence
  chemically synthesized
gagtctcggaggactgtaag

SEQ ID NO: 20047 - DNA, 20 bp, Artificial Sequence
  chemically synthesized
gatccctctctgtaacatcc

SEQ ID NO: 20048 - DNA, 20 bp, Artificial Sequence
  chemically synthesized
agtcgaagaacttcctgtgg

SEQ ID NO: 20049 - DNA, 20 bp, Artificial Sequence
  chemically synthesized
ggtttgtactgctcctgaag

SEQ ID NO: 20050 - DNA, 20 bp, Artificial Sequence
  chemically synthesized
acaccttcactaggtgactg

SEQ ID NO: 20051 - DNA, 20 bp, Artificial Sequence
  chemically synthesized
cactaggtgactgaggaatg

SEQ ID NO: 20052 - DNA, 20 bp, Artificial Sequence
  chemically synthesized
ctagtgataaccaattgcta

SEQ ID NO: 20053 - DNA, 20 bp, Artificial Sequence
  chemically synthesized
gagtgaggaaagcatttaaa

SEQ ID NO: 20054 - DNA, 20 bp, Artificial Sequence
  chemically synthesized
cttgtctattacaacaggct

SEQ ID NO: 20055 - DNA, 20 bp, Artificial Sequence
  chemically synthesized
gaaaatattagccattgcca

SEQ ID NO: 20056 - DNA, 20 bp, Artificial Sequence
  chemically synthesized
agtaattatatgaaatgctt

SEQ ID NO: 20057 - DNA, 20 bp, Artificial Sequence
  chemically synthesized
tttcatattcacaattagct

SEQ ID NO: 20058 - DNA, 20 bp, Artificial Sequence
  chemically synthesized
gcaaaatactgtgctccttt

SEQ ID NO: 20059 - DNA, 20 bp, Artificial Sequence
  chemically synthesized
cttcaatgctatgcttatgt

SEQ ID NO: 20060 - DNA, 20 bp, Artificial Sequence
  chemically synthesized
tcaaattgataaaacaattt

SEQ ID NO: 20061 - DNA, 20 bp, Artificial Sequence
  chemically synthesized
gaggtataacctcatctgtg

SEQ ID NO: 20062 - DNA, 20 bp, Artificial Sequence
  chemically synthesized
aaattataaaacaattcctt

SEQ ID NO: 20063 - DNA, 20 bp, Artificial Sequence
  chemically synthesized
aaaagtcatggttttgaagg

SEQ ID NO: 20064 - DNA, 20 bp, Artificial Sequence
  chemically synthesized
ctgagttcctcaagatcttg

SEQ ID NO: 20065 - DNA, 20 bp, Artificial Sequence
  chemically synthesized
agaatcaagccaactgattg

SEQ ID NO: 20066 - DNA, 20 bp, Artificial Sequence
  chemically synthesized
atgtctattacagtaatcta

SEQ ID NO: 20067 - DNA, 20 bp, Artificial Sequence
  chemically synthesized
aaaggatctgaaataataac

SEQ ID NO: 20068 - DNA, 20 bp, Artificial Sequence
  chemically synthesized
tggcatgcattctgaaaaat

SEQ ID NO: 20069 - DNA, 20 bp, Artificial Sequence
  chemically synthesized
tttgcctatgtagaagtgga

SEQ ID NO: 20070 - DNA, 20 bp, Artificial Sequence
  chemically synthesized
ttctctgtagtttagtgaga

SEQ ID NO: 20071 - DNA, 20 bp, Artificial Sequence
  chemically synthesized
cagaaccatctctatcacat

SEQ ID NO: 20072 - DNA, 20 bp, Artificial Sequence
  chemically synthesized
tctctatcacatgtgaatcc

SEQ ID NO: 20073 - DNA, 20 bp, Artificial Sequence
  chemically synthesized
tgaaataaaagttttctcta

SEQ ID NO: 20074 - DNA, 20 bp, Artificial Sequence
  chemically synthesized
ctcaaggacatagcttattg

SEQ ID NO: 20075 - DNA, 20 bp, Artificial Sequence
  chemically synthesized
ggaagggacttgttagcact

SEQ ID NO: 20076 - DNA, 20 bp, Artificial Sequence
  chemically synthesized
cagtgaaactaagttatttt

SEQ ID NO: 20077 - DNA, 20 bp, Artificial Sequence
  chemically synthesized
agtagcatgtgtgttgatct

SEQ ID NO: 20078 - DNA, 20 bp, Artificial Sequence
  chemically synthesized
tggtacatagaaaatgctca

SEQ ID NO: 20079 - DNA, 20 bp, Artificial Sequence
  chemically synthesized
ggtttgagattttcatatag

SEQ ID NO: 20080 - DNA, 20 bp, Artificial Sequence
  chemically synthesized
gtttctttaaatttaatgat

SEQ ID NO: 20081 - DNA, 20 bp, Artificial Sequence
  chemically synthesized
tatgaggtatcttagagatc

SEQ ID NO: 20082 - DNA, 20 bp, Artificial Sequence
  chemically synthesized
tttaatgatcaagcaaatgg

SEQ ID NO: 20083 - DNA, 20 bp, Artificial Sequence
  chemically synthesized
gcaaatggcagagttaggac

SEQ ID NO: 20084 - DNA, 20 bp, Artificial Sequence
  chemically synthesized
tcacttttttactattatgt

SEQ ID NO: 20085 - DNA, 20 bp, Artificial Sequence
  chemically synthesized
agtacttgcagtcaaaggtc

SEQ ID NO: 20086 - DNA, 20 bp, Artificial Sequence
  chemically synthesized
ctgaaaaagaaccccttaaa

SEQ ID NO: 20087 - DNA, 20 bp, Artificial Sequence
  chemically synthesized
aactgaataacagtttcttc

SEQ ID NO: 20088 - DNA, 20 bp, Artificial Sequence
  chemically synthesized
acagtttcttcatgaataaa

SEQ ID NO: 20089 - DNA, 20 bp, Artificial Sequence
  chemically synthesized
aacaaaaggtttcttaggag

SEQ ID NO: 20090 - DNA, 20 bp, Artificial Sequence
  chemically synthesized
ggagaagaatcccttgctgc

SEQ ID NO: 20091 - DNA, 20 bp, Artificial Sequence
  chemically synthesized
gtgaaaaacataacagatga

SEQ ID NO: 20092 - DNA, 20 bp, Artificial Sequence
  chemically synthesized
tgagagagtcacagttagtt

SEQ ID NO: 20093 - DNA, 20 bp, Artificial Sequence
  chemically synthesized
aatccattttattattcagt

SEQ ID NO: 20094 - DNA, 20 bp, Artificial Sequence
  chemically synthesized
gcactgagaggcgagggaga

SEQ ID NO: 20095 - DNA, 20 bp, Artificial Sequence
  chemically synthesized
gaggcgagggagatagagtt

SEQ ID NO: 20096 - DNA, 20 bp, Artificial Sequence
  chemically synthesized
agaactgattcttaatcttc

SEQ ID NO: 20097 - DNA, 20 bp, Artificial Sequence
  chemically synthesized
atacaatacagtcaaatgtg

SEQ ID NO: 20098 - DNA, 20 bp, Artificial Sequence
  chemically synthesized
taagactatacagtgtaccg

SEQ ID NO: 20099 - DNA, 20 bp, Artificial Sequence
  chemically synthesized
atacagtgtaccgtggaatg

SEQ ID NO: 20100 - DNA, 20 bp, Artificial Sequence
  chemically synthesized
gatgtttgagctgacacttg

SEQ ID NO: 20101 - DNA, 20 bp, Artificial Sequence
  chemically synthesized
gctcagagagggaaaaggag

SEQ ID NO: 20102 - DNA, 20 bp, Artificial Sequence
  chemically synthesized
actagattgtgaagctcagg

SEQ ID NO: 20103 - DNA, 20 bp, Artificial Sequence
  chemically synthesized
agggggagttaatagcctta

SEQ ID NO: 20104 - DNA, 20 bp, Artificial Sequence
  chemically synthesized
gccttaaggagttttgtctc

SEQ ID NO: 20105 - DNA, 20 bp, Artificial Sequence
  chemically synthesized
ttgtctccagggtatgaaca

SEQ ID NO: 20106 - DNA, 20 bp, Artificial Sequence
  chemically synthesized
cagggtatgaacaatgaatg

SEQ ID NO: 20107 - DNA, 20 bp, Artificial Sequence
  chemically synthesized
aattagactgtggtgtgacc

SEQ ID NO: 20108 - DNA, 20 bp, Artificial Sequence
  chemically synthesized
tctggagaaattaacatgtt

SEQ ID NO: 20109 - DNA, 20 bp, Artificial Sequence
  chemically synthesized
attaacatgttaaggatatt

SEQ ID NO: 20110 - DNA, 20 bp, Artificial Sequence
  chemically synthesized
cacataatgaaagttaattt

SEQ ID NO: 20111 - DNA, 20 bp, Artificial Sequence
  chemically synthesized
tcagtcttgacactacacct

SEQ ID NO: 20112 - DNA, 20 bp, Artificial Sequence
  chemically synthesized
atggtacaagtggcacaggg

SEQ ID NO: 20113 - DNA, 20 bp, Artificial Sequence
  chemically synthesized
cagggaagaattcagaaaac

SEQ ID NO: 20114 - DNA, 20 bp, Artificial Sequence
  chemically synthesized
ttatggaagaaattataata

SEQ ID NO: 20115 - DNA, 20 bp, Artificial Sequence
  chemically synthesized
tgagtccactcttctaggac

SEQ ID NO: 20116 - DNA, 20 bp, Artificial Sequence
  chemically synthesized
ctttgatataagtgaactca

SEQ ID NO: 20117 - DNA, 20 bp, Artificial Sequence
  chemically synthesized
tttctctagagcaaaatgaa

SEQ ID NO: 20118 - DNA, 20 bp, Artificial Sequence
  chemically synthesized
acttttcaaggctgaggtgg

SEQ ID NO: 20119 - DNA, 20 bp, Artificial Sequence
  chemically synthesized
tgggagaattgtttgagacc

SEQ ID NO: 20120 - DNA, 20 bp, Artificial Sequence
  chemically synthesized
gaattgtttgagaccaagag

SEQ ID NO: 20121 - DNA, 20 bp, Artificial Sequence
  chemically synthesized
tacctgagaggctaaagcag

SEQ ID NO: 20122 - DNA, 20 bp, Artificial Sequence
  chemically synthesized
ggctaaagcaggaggatcaa

SEQ ID NO: 20123 - DNA, 20 bp, Artificial Sequence
  chemically synthesized
ttgcaccattgcactccagc

SEQ ID NO: 20124 - DNA, 20 bp, Artificial Sequence
  chemically synthesized
ttgcactccagccggggtga

SEQ ID NO: 20125 - DNA, 20 bp, Artificial Sequence
  chemically synthesized
taaagtcagactgcatgatt

SEQ ID NO: 20126 - DNA, 20 bp, Artificial Sequence
  chemically synthesized
aattccaactccaccatcac

SEQ ID NO: 20127 - DNA, 20 bp, Artificial Sequence
  chemically synthesized
ttgtcataccagctttcact

SEQ ID NO: 20128 - DNA, 20 bp, Artificial Sequence
  chemically synthesized
cataccagctttcactttga

SEQ ID NO: 20129 - DNA, 20 bp, Artificial Sequence
  chemically synthesized
catcaatgttacttcaatca

SEQ ID NO: 20130 - DNA, 20 bp, Artificial Sequence
  chemically synthesized
atcacgggatgcatagtaat

SEQ ID NO: 20131 - DNA, 20 bp, Artificial Sequence
  chemically synthesized
tctttgccctaattactgat

SEQ ID NO: 20132 - DNA, 20 bp, Artificial Sequence
  chemically synthesized
caggtggtcttgttcaaagt

SEQ ID NO: 20133 - DNA, 20 bp, Artificial Sequence
  chemically synthesized
cagctgctttgattttaact

SEQ ID NO: 20134 - DNA, 20 bp, Artificial Sequence
  chemically synthesized
gcaactgtgttttggaacag

SEQ ID NO: 20135 - DNA, 20 bp, Artificial Sequence
  chemically synthesized
agtgttgccagatgacgact

SEQ ID NO: 20136 - DNA, 20 bp, Artificial Sequence
  chemically synthesized
agtattttcttttttaatgt

SEQ ID NO: 20137 - DNA, 20 bp, Artificial Sequence
  chemically synthesized
tatacctcaaatatgaaaat

SEQ ID NO: 20138 - DNA, 20 bp, Artificial Sequence
  chemically synthesized
aaaaagggctaaaatggtgt

SEQ ID NO: 20139 - DNA, 20 bp, Artificial Sequence
  chemically synthesized
taatgatcaagtcaggtatt

SEQ ID NO: 20140 - DNA, 20 bp, Artificial Sequence
  chemically synthesized
atgattttatatttgtatgg

SEQ ID NO: 20141 - DNA, 20 bp, Artificial Sequence
  chemically synthesized
gattccatatctttgctaat

SEQ ID NO: 20142 - DNA, 20 bp, Artificial Sequence
  chemically synthesized
accagtatctgtttattatt

SEQ ID NO: 20143 - DNA, 20 bp, Artificial Sequence
  chemically synthesized
ttattctgaattcttttcct

SEQ ID NO: 20144 - DNA, 20 bp, Artificial Sequence
  chemically synthesized
aatacccagtaataagattg

SEQ ID NO: 20145 - DNA, 20 bp, Artificial Sequence
  chemically synthesized
catgcttaccaatagtgcct

SEQ ID NO: 20146 - DNA, 20 bp, Artificial Sequence
  chemically synthesized
gattatttgtttttccactg

SEQ ID NO: 20147 - DNA, 20 bp, Artificial Sequence
  chemically synthesized
tttttccactgttgagttgt

SEQ ID NO: 20148 - DNA, 20 bp, Artificial Sequence
  chemically synthesized
ttaagtctttaatccatctt

SEQ ID NO: 20149 - DNA, 20 bp, Artificial Sequence
  chemically synthesized
cgttttatatggcaataaat

SEQ ID NO: 20150 - DNA, 20 bp, Artificial Sequence
  chemically synthesized
atttttgcatctattgtaca

SEQ ID NO: 20151 - DNA, 20 bp, Artificial Sequence
  chemically synthesized
tgcatctattgtacaagggg

SEQ ID NO: 20152 - DNA, 20 bp, Artificial Sequence
  chemically synthesized
tggttgctgttggtgtatag

SEQ ID NO: 20153 - DNA, 20 bp, Artificial Sequence
  chemically synthesized
tcttgtatctggaaactttg

SEQ ID NO: 20154 - DNA, 20 bp, Artificial Sequence
  chemically synthesized
cagttctaggagctttctgg

SEQ ID NO: 20155 - DNA, 20 bp, Artificial Sequence
  chemically synthesized
gagctttctggaggagtctt

SEQ ID NO: 20156 - DNA, 20 bp, Artificial Sequence
  chemically synthesized
ttgacttcctctttactgat

SEQ ID NO: 20157 - DNA, 20 bp, Artificial Sequence
  chemically synthesized
cttccagtactatgttgaag

SEQ ID NO: 20158 - DNA, 20 bp, Artificial Sequence
  chemically synthesized
ctatgttgaagaggagtggt

SEQ ID NO: 20159 - DNA, 20 bp, Artificial Sequence
  chemically synthesized
gtcttgttccagttctcaga

SEQ ID NO: 20160 - DNA, 20 bp, Artificial Sequence
  chemically synthesized
cattcaatattatgttggct

SEQ ID NO: 20161 - DNA, 20 bp, Artificial Sequence
  chemically synthesized
attttaatcataaatgtatg

SEQ ID NO: 20162 - DNA, 20 bp, Artificial Sequence
  chemically synthesized
taaatgtatgctggattttg

SEQ ID NO: 20163 - DNA, 20 bp, Artificial Sequence
  chemically synthesized
atggaacctgcttgatcatg

SEQ ID NO: 20164 - DNA, 20 bp, Artificial Sequence
  chemically synthesized
attatctttttgttatgttg

SEQ ID NO: 20165 - DNA, 20 bp, Artificial Sequence
  chemically synthesized
tggttatctagtattttgtt

SEQ ID NO: 20166 - DNA, 20 bp, Artificial Sequence
  chemically synthesized
ttggtgtgatgctggcttca

SEQ ID NO: 20167 - DNA, 20 bp, Artificial Sequence
  chemically synthesized
tgtgatgctggcttcataga

SEQ ID NO: 20168 - DNA, 20 bp, Artificial Sequence
  chemically synthesized
ttccttctttatctgtcttg

SEQ ID NO: 20169 - DNA, 20 bp, Artificial Sequence
  chemically synthesized
agatggggaccaattcctct

SEQ ID NO: 20170 - DNA, 20 bp, Artificial Sequence
  chemically synthesized
attcctctttgaatgtctag

SEQ ID NO: 20171 - DNA, 20 bp, Artificial Sequence
  chemically synthesized
atgtctagtagaattctgtt

SEQ ID NO: 20172 - DNA, 20 bp, Artificial Sequence
  chemically synthesized
ggagaaatttccacgcgctg

SEQ ID NO: 20173 - DNA, 20 bp, Artificial Sequence
  chemically synthesized
aatttccacgcgctgttgaa

SEQ ID NO: 20174 - DNA, 20 bp, Artificial Sequence
  chemically synthesized
gaatgtgtgttctgtggtta

SEQ ID NO: 20175 - DNA, 20 bp, Artificial Sequence
  chemically synthesized
aatgcctggctatgccaggc

SEQ ID NO: 20176 - DNA, 20 bp, Artificial Sequence
  chemically synthesized
agaccttcagtttctccagt

SEQ ID NO: 20177 - DNA, 20 bp, Artificial Sequence
  chemically synthesized
ggagtgtgtgtttaggagag

SEQ ID NO: 20178 - DNA, 20 bp, Artificial Sequence
  chemically synthesized
gttggggcactcacagtatt

SEQ ID NO: 20179 - DNA, 20 bp, Artificial Sequence
  chemically synthesized
cacagtatttggggtgtctc

SEQ ID NO: 20180 - DNA, 20 bp, Artificial Sequence
  chemically synthesized
ggagcaatctacttccttca

SEQ ID NO: 20181 - DNA, 20 bp, Artificial Sequence
  chemically synthesized
ctacttccttcagagggtct

SEQ ID NO: 20182 - DNA, 20 bp, Artificial Sequence
  chemically synthesized
agagggtctgtgggtcctct

SEQ ID NO: 20183 - DNA, 20 bp, Artificial Sequence
  chemically synthesized
ccacatgctgctctgtccat

SEQ ID NO: 20184 - DNA, 20 bp, Artificial Sequence
  chemically synthesized
cgccaagatcctgagaagtt

SEQ ID NO: 20185 - DNA, 20 bp, Artificial Sequence
  chemically synthesized
ccagttttattcttttgcac

SEQ ID NO: 20186 - DNA, 20 bp, Artificial Sequence
  chemically synthesized
cttttgcacatggatatcca

SEQ ID NO: 20187 - DNA, 20 bp, Artificial Sequence
  chemically synthesized
aatctgttggctataaatat

SEQ ID NO: 20188 - DNA, 20 bp, Artificial Sequence
  chemically synthesized
ctagcattgttcttttttca

SEQ ID NO: 20189 - DNA, 20 bp, Artificial Sequence
  chemically synthesized
ctattttgatagcggtcata

SEQ ID NO: 20190 - DNA, 20 bp, Artificial Sequence
  chemically synthesized
tatagaatctgtagattgct

SEQ ID NO: 20191 - DNA, 20 bp, Artificial Sequence
  chemically synthesized
atttttctgatccatgaaca

SEQ ID NO: 20192 - DNA, 20 bp, Artificial Sequence
  chemically synthesized
tatcagtgttttgtagtttt

SEQ ID NO: 20193 - DNA, 20 bp, Artificial Sequence
  chemically synthesized
tattttttagctattgtaaa

SEQ ID NO: 20194 - DNA, 20 bp, Artificial Sequence
  chemically synthesized
ttttgtctcctgtaacttta

SEQ ID NO: 20195 - DNA, 20 bp, Artificial Sequence
  chemically synthesized
tgaatttatttttcagcgct

SEQ ID NO: 20196 - DNA, 20 bp, Artificial Sequence
  chemically synthesized
cagcgctaagagtgctttgg

SEQ ID NO: 20197 - DNA, 20 bp, Artificial Sequence
  chemically synthesized
ctaggacttccagtattata

SEQ ID NO: 20198 - DNA, 20 bp, Artificial Sequence
  chemically synthesized
cttccagtattatattgaat

SEQ ID NO: 20199 - DNA, 20 bp, Artificial Sequence
  chemically synthesized
aattcagtatgatgttagct

SEQ ID NO: 20200 - DNA, 20 bp, Artificial Sequence
  chemically synthesized
gcagatagtttttatcatga

SEQ ID NO: 20201 - DNA, 20 bp, Artificial Sequence
  chemically synthesized
tgatcatggtgtattatctt

SEQ ID NO: 20202 - DNA, 20 bp, Artificial Sequence
  chemically synthesized
attatcttttggatgtactg

SEQ ID NO: 20203 - DNA, 20 bp, Artificial Sequence
  chemically synthesized
cagtttgctagtattttgtt

SEQ ID NO: 20204 - DNA, 20 bp, Artificial Sequence
  chemically synthesized
tttcacacctatgttccatc

SEQ ID NO: 20205 - DNA, 20 bp, Artificial Sequence
  chemically synthesized
cttgcatccttgtctggtta

SEQ ID NO: 20206 - DNA, 20 bp, Artificial Sequence
  chemically synthesized
tccttgtctggttatggaat

SEQ ID NO: 20207 - DNA, 20 bp, Artificial Sequence
  chemically synthesized
tcaggataatactggcctca

SEQ ID NO: 20208 - DNA, 20 bp, Artificial Sequence
  chemically synthesized
gataatactggcctcagaga

SEQ ID NO: 20209 - DNA, 20 bp, Artificial Sequence
  chemically synthesized
gcctcagagaatgagttagg

SEQ ID NO: 20210 - DNA, 20 bp, Artificial Sequence
  chemically synthesized
ccttcctgtttaatttttaa

SEQ ID NO: 20211 - DNA, 20 bp, Artificial Sequence
  chemically synthesized
tttctttccttctgctagtt

SEQ ID NO: 20212 - DNA, 20 bp, Artificial Sequence
  chemically synthesized
ctaacatatggtgtatcctg

SEQ ID NO: 20213 - DNA, 20 bp, Artificial Sequence
  chemically synthesized
ataaatatattctgtagctg

SEQ ID NO: 20214 - DNA, 20 bp, Artificial Sequence
  chemically synthesized
gatctatctgatgctgagat

SEQ ID NO: 20215 - DNA, 20 bp, Artificial Sequence
  chemically synthesized
aatccccaactattattgta

SEQ ID NO: 20216 - DNA, 20 bp, Artificial Sequence
  chemically synthesized
ataacatttgctttacatat

SEQ ID NO: 20217 - DNA, 20 bp, Artificial Sequence
  chemically synthesized
catatctggatgctctggtg

SEQ ID NO: 20218 - DNA, 20 bp, Artificial Sequence
  chemically synthesized
tggatgctctggtgttgagt

SEQ ID NO: 20219 - DNA, 20 bp, Artificial Sequence
  chemically synthesized
tggtgttgagtgtgaatgtt

SEQ ID NO: 20220 - DNA, 20 bp, Artificial Sequence
  chemically synthesized
agaattgttatatactcttg

SEQ ID NO: 20221 - DNA, 20 bp, Artificial Sequence
  chemically synthesized
ttcttataggcagcttacaa

SEQ ID NO: 20222 - DNA, 20 bp, Artificial Sequence
  chemically synthesized
attttctgtagtggtaacgt

SEQ ID NO: 20223 - DNA, 20 bp, Artificial Sequence
  chemically synthesized
gtaaagccagtctagtgata

SEQ ID NO: 20224 - DNA, 20 bp, Artificial Sequence
  chemically synthesized
atttttgaagaacaatgttg

SEQ ID NO: 20225 - DNA, 20 bp, Artificial Sequence
  chemically synthesized
catttttttctttcactatt

SEQ ID NO: 20226 - DNA, 20 bp, Artificial Sequence
  chemically synthesized
agacattttgcttgctgttt

SEQ ID NO: 20227 - DNA, 20 bp, Artificial Sequence
  chemically synthesized
ctttttgcattatattattt

SEQ ID NO: 20228 - DNA, 20 bp, Artificial Sequence
  chemically synthesized
aatttctgattttcatttgt

SEQ ID NO: 20229 - DNA, 20 bp, Artificial Sequence
  chemically synthesized
ccttctgggaaactgcaaat

SEQ ID NO: 20230 - DNA, 20 bp, Artificial Sequence
  chemically synthesized
ctgatctattgttgaagttt

SEQ ID NO: 20231 - DNA, 20 bp, Artificial Sequence
  chemically synthesized
ttcaataaactcttcagtta

SEQ ID NO: 20232 - DNA, 20 bp, Artificial Sequence
  chemically synthesized
attcttgttgtatctatctc

SEQ ID NO: 20233 - DNA, 20 bp, Artificial Sequence
  chemically synthesized
gtaaatttctcattcatatc

SEQ ID NO: 20234 - DNA, 20 bp, Artificial Sequence
  chemically synthesized
gatttctttttattgtttat

SEQ ID NO: 20235 - DNA, 20 bp, Artificial Sequence
  chemically synthesized
gcttccttaatatcaacatt

SEQ ID NO: 20236 - DNA, 20 bp, Artificial Sequence
  chemically synthesized
acattttggattcttttttc

SEQ ID NO: 20237 - DNA, 20 bp, Artificial Sequence
  chemically synthesized
tccactggcttatgttgctg

SEQ ID NO: 20238 - DNA, 20 bp, Artificial Sequence
  chemically synthesized
aagatgtatcttggtgttga

SEQ ID NO: 20239 - DNA, 20 bp, Artificial Sequence
  chemically synthesized
ctgtgattttttcagtggct

SEQ ID NO: 20240 - DNA, 20 bp, Artificial Sequence
  chemically synthesized
gatgaggttgtgctggagac

SEQ ID NO: 20241 - DNA, 20 bp, Artificial Sequence
  chemically synthesized
gtacattggcactgatggta

SEQ ID NO: 20242 - DNA, 20 bp, Artificial Sequence
  chemically synthesized
actgatggtaatgagtctag

SEQ ID NO: 20243 - DNA, 20 bp, Artificial Sequence
  chemically synthesized
ttggccttcaggcagtttgc

SEQ ID NO: 20244 - DNA, 20 bp, Artificial Sequence
  chemically synthesized
atagtagactgggctggtgt

SEQ ID NO: 20245 - DNA, 20 bp, Artificial Sequence
  chemically synthesized
ggtcctcaggcttctggaca

SEQ ID NO: 20246 - DNA, 20 bp, Artificial Sequence
  chemically synthesized
ttctggacagtgggtgtggt

SEQ ID NO: 20247 - DNA, 20 bp, Artificial Sequence
  chemically synthesized
gttggtggtggctgcaaggg

SEQ ID NO: 20248 - DNA, 20 bp, Artificial Sequence
  chemically synthesized
gttgtgatggcagtggcaga

SEQ ID NO: 20249 - DNA, 20 bp, Artificial Sequence
  chemically synthesized
gcccatcatcaggcttctgg

SEQ ID NO: 20250 - DNA, 20 bp, Artificial Sequence
  chemically synthesized
ttgcttaggtaccagtcatg

SEQ ID NO: 20251 - DNA, 20 bp, Artificial Sequence
  chemically synthesized
tggatggcacaaggctgtct

SEQ ID NO: 20252 - DNA, 20 bp, Artificial Sequence
  chemically synthesized
ttgaggaaggcaaagccagg

SEQ ID NO: 20253 - DNA, 20 bp, Artificial Sequence
  chemically synthesized
ggacaccggctatcataggc

SEQ ID NO: 20254 - DNA, 20 bp, Artificial Sequence
  chemically synthesized
ccggctatcataggctggag

SEQ ID NO: 20255 - DNA, 20 bp, Artificial Sequence
  chemically synthesized
agtgatcctcaggcccccag

SEQ ID NO: 20256 - DNA, 20 bp, Artificial Sequence
  chemically synthesized
tcaggcccccagcagaatgc

SEQ ID NO: 20257 - DNA, 20 bp, Artificial Sequence
  chemically synthesized
gcccccagcagaatgcctga

SEQ ID NO: 20258 - DNA, 20 bp, Artificial Sequence
  chemically synthesized
cattgttgccctgctcttga

SEQ ID NO: 20259 - DNA, 20 bp, Artificial Sequence
  chemically synthesized
gccctgctcttgaaggggtg

SEQ ID NO: 20260 - DNA, 20 bp, Artificial Sequence
  chemically synthesized
ttcagtggcagcagctataa

SEQ ID NO: 20261 - DNA, 20 bp, Artificial Sequence
  chemically synthesized
ccccagatggtggctgcaag

SEQ ID NO: 20262 - DNA, 20 bp, Artificial Sequence
  chemically synthesized
tgtgtagcagccctgctact

SEQ ID NO: 20263 - DNA, 20 bp, Artificial Sequence
  chemically synthesized
agccctgctactgggggtgg

SEQ ID NO: 20264 - DNA, 20 bp, Artificial Sequence
  chemically synthesized
gccagcagtagcactcagct

SEQ ID NO: 20265 - DNA, 20 bp, Artificial Sequence
  chemically synthesized
gtagcactcagctgtgggtg

SEQ ID NO: 20266 - DNA, 20 bp, Artificial Sequence
  chemically synthesized
ggggatgtcagcagagcttc

SEQ ID NO: 20267 - DNA, 20 bp, Artificial Sequence
  chemically synthesized
tgtagagatgcagatgatgt

SEQ ID NO: 20268 - DNA, 20 bp, Artificial Sequence
  chemically synthesized
ctgaggaacgatgtcatctg

SEQ ID NO: 20269 - DNA, 20 bp, Artificial Sequence
  chemically synthesized
gcaccttgctgctcagtaat

SEQ ID NO: 20270 - DNA, 20 bp, Artificial Sequence
  chemically synthesized
tgctcagtaatggggatggc

SEQ ID NO: 20271 - DNA, 20 bp, Artificial Sequence
  chemically synthesized
tcaagggactctcctgtggc

SEQ ID NO: 20272 - DNA, 20 bp, Artificial Sequence
  chemically synthesized
tctcctgtggctaggattcc

SEQ ID NO: 20273 - DNA, 20 bp, Artificial Sequence
  chemically synthesized
taatgcagatgtggaccact

SEQ ID NO: 20274 - DNA, 20 bp, Artificial Sequence
  chemically synthesized
ggagcctctctggcctcaca

SEQ ID NO: 20275 - DNA, 20 bp, Artificial Sequence
  chemically synthesized
ggcctcacagaggatcccta

SEQ ID NO: 20276 - DNA, 20 bp, Artificial Sequence
  chemically synthesized
tgcttcctgtcacttctctg

SEQ ID NO: 20277 - DNA, 20 bp, Artificial Sequence
  chemically synthesized
gtcacttctctgttgaattc

SEQ ID NO: 20278 - DNA, 20 bp, Artificial Sequence
  chemically synthesized
ttccagaattctctcttatg

SEQ ID NO: 20279 - DNA, 20 bp, Artificial Sequence
  chemically synthesized
tttggttctttgtggaggag

SEQ ID NO: 20280 - DNA, 20 bp, Artificial Sequence
  chemically synthesized
ggactatctgaaggcctcag

SEQ ID NO: 20281 - DNA, 20 bp, Artificial Sequence
  chemically synthesized
tcagatgagtaaaagaagta

SEQ ID NO: 20282 - DNA, 20 bp, Artificial Sequence
  chemically synthesized
atcatttgtttcttcaaata

SEQ ID NO: 20283 - DNA, 20 bp, Artificial Sequence
  chemically synthesized
ttgcatctaccaaagtgtat

SEQ ID NO: 20284 - DNA, 20 bp, Artificial Sequence
  chemically synthesized
aaatacgtaatctaacaaac

SEQ ID NO: 20285 - DNA, 20 bp, Artificial Sequence
  chemically synthesized
acaaggatgttttaagatct

SEQ ID NO: 20286 - DNA, 20 bp, Artificial Sequence
  chemically synthesized
gatgcatagttgcaaataaa

SEQ ID NO: 20287 - DNA, 20 bp, Artificial Sequence
  chemically synthesized
tgcaaataaaaggagttttc

SEQ ID NO: 20288 - DNA, 20 bp, Artificial Sequence
  chemically synthesized
tttggaaattttgcattttt

SEQ ID NO: 20289 - DNA, 20 bp, Artificial Sequence
  chemically synthesized
tgatggtttctaaaattgtc

SEQ ID NO: 20290 - DNA, 20 bp, Artificial Sequence
  chemically synthesized
atgttaacttagatttattg

SEQ ID NO: 20291 - DNA, 20 bp, Artificial Sequence
  chemically synthesized
tatgaaaattgcttgcattt

SEQ ID NO: 20292 - DNA, 20 bp, Artificial Sequence
  chemically synthesized
ctcttctcctttataaatta

SEQ ID NO: 20293 - DNA, 20 bp, Artificial Sequence
  chemically synthesized
ctatgtaaagtataagttac

SEQ ID NO: 20294 - DNA, 20 bp, Artificial Sequence
  chemically synthesized
aaacctgtagtctgatgaaa

SEQ ID NO: 20295 - DNA, 20 bp, Artificial Sequence
  chemically synthesized
aataaaattgctttttgcaa

SEQ ID NO: 20296 - DNA, 20 bp, Artificial Sequence
  chemically synthesized
attgagttgaagattgatgc

SEQ ID NO: 20297 - DNA, 20 bp, Artificial Sequence
  chemically synthesized
tgccaggatcttattacctc

SEQ ID NO: 20298 - DNA, 20 bp, Artificial Sequence
  chemically synthesized
attacctccaggatttcaca

SEQ ID NO: 20299 - DNA, 20 bp, Artificial Sequence
  chemically synthesized
aggatttcacaaaggatttc

SEQ ID NO: 20300 - DNA, 20 bp, Artificial Sequence
  chemically synthesized
ttataaagacatacctgaga

SEQ ID NO: 20301 - DNA, 20 bp, Artificial Sequence
  chemically synthesized
cactatcacgagaagagcat

SEQ ID NO: 20302 - DNA, 20 bp, Artificial Sequence
  chemically synthesized
aaatccctcccacaacacgt

SEQ ID NO: 20303 - DNA, 20 bp, Artificial Sequence
  chemically synthesized
actacaattcaagatgagat

SEQ ID NO: 20304 - DNA, 20 bp, Artificial Sequence
  chemically synthesized
gggacacagtcaagctgtat

SEQ ID NO: 20305 - DNA, 20 bp, Artificial Sequence
  chemically synthesized
agctgtatcagggtacaagc

SEQ ID NO: 20306 - DNA, 20 bp, Artificial Sequence
  chemically synthesized
agtggaccatcacctgaaaa

SEQ ID NO: 20307 - DNA, 20 bp, Artificial Sequence
  chemically synthesized
ctgtgtttgactttctgttt

SEQ ID NO: 20308 - DNA, 20 bp, Artificial Sequence
  chemically synthesized
tgtttctgagttatttcact

SEQ ID NO: 20309 - DNA, 20 bp, Artificial Sequence
  chemically synthesized
gatttcattcttttttatgg

SEQ ID NO: 20310 - DNA, 20 bp, Artificial Sequence
  chemically synthesized
ttaatatgatctctttcact

SEQ ID NO: 20311 - DNA, 20 bp, Artificial Sequence
  chemically synthesized
tttgggtccatacccagtag

SEQ ID NO: 20312 - DNA, 20 bp, Artificial Sequence
  chemically synthesized
catacccagtagtgggattg

SEQ ID NO: 20313 - DNA, 20 bp, Artificial Sequence
  chemically synthesized
ccagtagtgggattgcagga

SEQ ID NO: 20314 - DNA, 20 bp, Artificial Sequence
  chemically synthesized
cctgagctcactgtatttgt

SEQ ID NO: 20315 - DNA, 20 bp, Artificial Sequence
  chemically synthesized
atatagatttagatataaaa

SEQ ID NO: 20316 - DNA, 20 bp, Artificial Sequence
  chemically synthesized
agtcccaaagctgaaggact

SEQ ID NO: 20317 - DNA, 20 bp, Artificial Sequence
  chemically synthesized
gcttggaggctaagccagtc

SEQ ID NO: 20318 - DNA, 20 bp, Artificial Sequence
  chemically synthesized
agatggtgcccacccagatt

SEQ ID NO: 20319 - DNA, 20 bp, Artificial Sequence
  chemically synthesized
ggtgcccacccagattaagg

SEQ ID NO: 20320 - DNA, 20 bp, Artificial Sequence
  chemically synthesized
aataccctcacagacacact

SEQ ID NO: 20321 - DNA, 20 bp, Artificial Sequence
  chemically synthesized
tttttttttttttttcctgg

SEQ ID NO: 20322 - DNA, 20 bp, Artificial Sequence
  chemically synthesized
cctttatttgtagtcctgcc

SEQ ID NO: 20323 - DNA, 20 bp, Artificial Sequence
  chemically synthesized
taaaactaagagacacccta

SEQ ID NO: 20324 - DNA, 20 bp, Artificial Sequence
  chemically synthesized
acgcttccttacctccattg

SEQ ID NO: 20325 - DNA, 20 bp, Artificial Sequence
  chemically synthesized
actgatttcatcttgatagt

SEQ ID NO: 20326 - DNA, 20 bp, Artificial Sequence
  chemically synthesized
aatcttaatttgcagtttaa

SEQ ID NO: 20327 - DNA, 20 bp, Artificial Sequence
  chemically synthesized
aattttgctagtggaacact

SEQ ID NO: 20328 - DNA, 20 bp, Artificial Sequence
  chemically synthesized
gtggaacactaggggtgatg

SEQ ID NO: 20329 - DNA, 20 bp, Artificial Sequence
  chemically synthesized
accctttgattcctggaccc

SEQ ID NO: 20330 - DNA, 20 bp, Artificial Sequence
  chemically synthesized
aggccattcaaaagctgctt

SEQ ID NO: 20331 - DNA, 20 bp, Artificial Sequence
  chemically synthesized
aaaagctgcttcaggatgat

SEQ ID NO: 20332 - DNA, 20 bp, Artificial Sequence
  chemically synthesized
cacacttctttagccataaa

SEQ ID NO: 20333 - DNA, 20 bp, Artificial Sequence
  chemically synthesized
tggtcagaagcaatgctgtg

SEQ ID NO: 20334 - DNA, 20 bp, Artificial Sequence
  chemically synthesized
ctgtgtggaataccatgaca

SEQ ID NO: 20335 - DNA, 20 bp, Artificial Sequence
  chemically synthesized
atacggcattctgtgattcc

SEQ ID NO: 20336 - DNA, 20 bp, Artificial Sequence
  chemically synthesized
tggtagtcttggcataagca

SEQ ID NO: 20337 - DNA, 20 bp, Artificial Sequence
  chemically synthesized
cttggcataagcattgagtt

SEQ ID NO: 20338 - DNA, 20 bp, Artificial Sequence
  chemically synthesized
aggattgggaaacccatatc

SEQ ID NO: 20339 - DNA, 20 bp, Artificial Sequence
  chemically synthesized
gtagctggctgatcaccccg

SEQ ID NO: 20340 - DNA, 20 bp, Artificial Sequence
  chemically synthesized
ctgtggccaggtcagctttg

SEQ ID NO: 20341 - DNA, 20 bp, Artificial Sequence
  chemically synthesized
caactgtggccactttgttc

SEQ ID NO: 20342 - DNA, 20 bp, Artificial Sequence
  chemically synthesized
tgggtccattggacgatgac

SEQ ID NO: 20343 - DNA, 20 bp, Artificial Sequence
  chemically synthesized
atgagtggcctgggaaaagg

SEQ ID NO: 20344 - DNA, 20 bp, Artificial Sequence
  chemically synthesized
aaaaggctgagtggtgtcca

SEQ ID NO: 20345 - DNA, 20 bp, Artificial Sequence
  chemically synthesized
cccattggtgagcactcaca

SEQ ID NO: 20346 - DNA, 20 bp, Artificial Sequence
  chemically synthesized
caaacctttggctacagccc

SEQ ID NO: 20347 - DNA, 20 bp, Artificial Sequence
  chemically synthesized
tcccttcaccgttgtccttc

SEQ ID NO: 20348 - DNA, 20 bp, Artificial Sequence
  chemically synthesized
agtgctgcggctgtccactt

SEQ ID NO: 20349 - DNA, 20 bp, Artificial Sequence
  chemically synthesized
gggagagaaagcagtgtgtc

SEQ ID NO: 20350 - DNA, 20 bp, Artificial Sequence
  chemically synthesized
atgtaacttactagtgcctt

SEQ ID NO: 20351 - DNA, 20 bp, Artificial Sequence
  chemically synthesized
acagcccactttatggctag

SEQ ID NO: 20352 - DNA, 20 bp, Artificial Sequence
  chemically synthesized
caagagctttctccctaaaa

SEQ ID NO: 20353 - DNA, 20 bp, Artificial Sequence
  chemically synthesized
cactgacacctcaagcatca

SEQ ID NO: 20354 - DNA, 20 bp, Artificial Sequence
  chemically synthesized
cactcaaaactggcagcctt

SEQ ID NO: 20355 - DNA, 20 bp, Artificial Sequence
  chemically synthesized
ggatcactcgataaatgggc

SEQ ID NO: 20356 - DNA, 20 bp, Artificial Sequence
  chemically synthesized
cagagtaacacacccaaatc

SEQ ID NO: 20357 - DNA, 20 bp, Artificial Sequence
  chemically synthesized
tgtgcctatttcttggttgt

SEQ ID NO: 20358 - DNA, 20 bp, Artificial Sequence
  chemically synthesized
aaattatccttcactttaga

SEQ ID NO: 20359 - DNA, 20 bp, Artificial Sequence
  chemically synthesized
tttactgaggtagaaggtcc

SEQ ID NO: 20360 - DNA, 20 bp, Artificial Sequence
  chemically synthesized
aagattatggcacaaagctg

SEQ ID NO: 20361 - DNA, 20 bp, Artificial Sequence
  chemically synthesized
gctggagagttgatatactc

SEQ ID NO: 20362 - DNA, 20 bp, Artificial Sequence
  chemically synthesized
ttccttgcctctcacaagcg

SEQ ID NO: 20363 - DNA, 20 bp, Artificial Sequence
  chemically synthesized
cctctcacaagcgttgaatc

SEQ ID NO: 20364 - DNA, 20 bp, Artificial Sequence
  chemically synthesized
ctctctaaacaattgatgcc

SEQ ID NO: 20365 - DNA, 20 bp, Artificial Sequence
  chemically synthesized
gttctccataccattagaag

SEQ ID NO: 20366 - DNA, 20 bp, Artificial Sequence
  chemically synthesized
aagaagagtccttagcatat

SEQ ID NO: 20367 - DNA, 20 bp, Artificial Sequence
  chemically synthesized
cctggtaccaaaatctgtat

SEQ ID NO: 20368 - DNA, 20 bp, Artificial Sequence
  chemically synthesized
attagggttctacagagaaa

SEQ ID NO: 20369 - DNA, 20 bp, Artificial Sequence
  chemically synthesized
ctctatatctatatctatat

SEQ ID NO: 20370 - DNA, 20 bp, Artificial Sequence
  chemically synthesized
tgaggaacaaggaagctagt

SEQ ID NO: 20371 - DNA, 20 bp, Artificial Sequence
  chemically synthesized
agtcccaaagctgaagaacc

SEQ ID NO: 20372 - DNA, 20 bp, Artificial Sequence
  chemically synthesized
gttcaatgttccagggcagg

SEQ ID NO: 20373 - DNA, 20 bp, Artificial Sequence
  chemically synthesized
catgggagaaaaatgtaggc

SEQ ID NO: 20374 - DNA, 20 bp, Artificial Sequence
  chemically synthesized
agatggtgcccacccagatt

SEQ ID NO: 20375 - DNA, 20 bp, Artificial Sequence
  chemically synthesized
ggtgcccacccagattaagg

SEQ ID NO: 20376 - DNA, 20 bp, Artificial Sequence
  chemically synthesized
tgaggttggtttttttgttg

SEQ ID NO: 20377 - DNA, 20 bp, Artificial Sequence
  chemically synthesized
tactctccttaattttcccc

SEQ ID NO: 20378 - DNA, 20 bp, Artificial Sequence
  chemically synthesized
gttttctagatgtggacttg

SEQ ID NO: 20379 - DNA, 20 bp, Artificial Sequence
  chemically synthesized
gtagcagcaatattagagga

SEQ ID NO: 20380 - DNA, 20 bp, Artificial Sequence
  chemically synthesized
catacaaaacccctcagaca

SEQ ID NO: 20381 - DNA, 20 bp, Artificial Sequence
  chemically synthesized
atctccaacaaccaagctct

SEQ ID NO: 20382 - DNA, 20 bp, Artificial Sequence
  chemically synthesized
ttaagggcttacaactctaa

SEQ ID NO: 20383 - DNA, 20 bp, Artificial Sequence
  chemically synthesized
gggctgcatgcactggtcat

SEQ ID NO: 20384 - DNA, 20 bp, Artificial Sequence
  chemically synthesized
agaatggaacagaacaggac

SEQ ID NO: 20385 - DNA, 20 bp, Artificial Sequence
  chemically synthesized
ctgcttttccatacagtgtc

SEQ ID NO: 20386 - DNA, 20 bp, Artificial Sequence
  chemically synthesized
ataacataactggccaggtc

SEQ ID NO: 20387 - DNA, 20 bp, Artificial Sequence
  chemically synthesized
ggtctatctttaaccaggcc

SEQ ID NO: 20388 - DNA, 20 bp, Artificial Sequence
  chemically synthesized
tggtctcaggctgtttgcct

SEQ ID NO: 20389 - DNA, 20 bp, Artificial Sequence
  chemically synthesized
attgggcataaaacaatatg

SEQ ID NO: 20390 - DNA, 20 bp, Artificial Sequence
  chemically synthesized
ggaagagagaaataccatgt

SEQ ID NO: 20391 - DNA, 20 bp, Artificial Sequence
  chemically synthesized
tgaaatacgtatttgtgtta

SEQ ID NO: 20392 - DNA, 20 bp, Artificial Sequence
  chemically synthesized
tgtgttattggatttgacat

SEQ ID NO: 20393 - DNA, 20 bp, Artificial Sequence
  chemically synthesized
tgagggcatgtatgatgaca

SEQ ID NO: 20394 - DNA, 20 bp, Artificial Sequence
  chemically synthesized
aagggactttaaaacatgca

SEQ ID NO: 20395 - DNA, 20 bp, Artificial Sequence
  chemically synthesized
taaataaatccttgggctta

SEQ ID NO: 20396 - DNA, 20 bp, Artificial Sequence
  chemically synthesized
actttaaacaaattgctaac

SEQ ID NO: 20397 - DNA, 20 bp, Artificial Sequence
  chemically synthesized
aaaggccaaaacaacagcag

SEQ ID NO: 20398 - DNA, 20 bp, Artificial Sequence
  chemically synthesized
tcagaagagcagtggacgca

SEQ ID NO: 20399 - DNA, 20 bp, Artificial Sequence
  chemically synthesized
atgctcaaaatatggaccta

SEQ ID NO: 20400 - DNA, 20 bp, Artificial Sequence
  chemically synthesized
aaagaggtcaaatacctcaa

SEQ ID NO: 20401 - DNA, 20 bp, Artificial Sequence
  chemically synthesized
catcatacatgccctcagca

SEQ ID NO: 20402 - DNA, 20 bp, Artificial Sequence
  chemically synthesized
ctgctgtggttttcaattat

SEQ ID NO: 20403 - DNA, 20 bp, Artificial Sequence
  chemically synthesized
tatgcccaatttctgcctcc

SEQ ID NO: 20404 - DNA, 20 bp, Artificial Sequence
  chemically synthesized
gaagaagtaaaaactaaaag

SEQ ID NO: 20405 - DNA, 20 bp, Artificial Sequence
  chemically synthesized
atgcagcttgtcctgctaca

SEQ ID NO: 20406 - DNA, 20 bp, Artificial Sequence
  chemically synthesized
tggatccagcaagtccacat

SEQ ID NO: 20407 - DNA, 20 bp, Artificial Sequence
  chemically synthesized
agcattatgatggcaaaaaa

SEQ ID NO: 20408 - DNA, 20 bp, Artificial Sequence
  chemically synthesized
aaattagatgtggcctaggc

SEQ ID NO: 20409 - DNA, 20 bp, Artificial Sequence
  chemically synthesized
acagagtaaacggataacct

SEQ ID NO: 20410 - DNA, 20 bp, Artificial Sequence
  chemically synthesized
taaacggataacctacagaa

SEQ ID NO: 20411 - DNA, 20 bp, Artificial Sequence
  chemically synthesized
atgcaacaaaaggctaatat

SEQ ID NO: 20412 - DNA, 20 bp, Artificial Sequence
  chemically synthesized
caacaaaaaaaccaacctca

SEQ ID NO: 20413 - DNA, 20 bp, Artificial Sequence
  chemically synthesized
acagccaggatataaagcag

SEQ ID NO: 20414 - DNA, 20 bp, Artificial Sequence
  chemically synthesized
ccaggagtggttctagagga

SEQ ID NO: 20415 - DNA, 20 bp, Artificial Sequence
  chemically synthesized
taatacttttgactatatgt

SEQ ID NO: 20416 - DNA, 20 bp, Artificial Sequence
  chemically synthesized
gttcgctggacaaagtgatg

SEQ ID NO: 20417 - DNA, 20 bp, Artificial Sequence
  chemically synthesized
catttggccactcttacaac

SEQ ID NO: 20418 - DNA, 20 bp, Artificial Sequence
  chemically synthesized
agataactactctcttttag

SEQ ID NO: 20419 - DNA, 20 bp, Artificial Sequence
  chemically synthesized
gaaggcactagtaagttaca

SEQ ID NO: 20420 - DNA, 20 bp, Artificial Sequence
  chemically synthesized
gttgtgcactttgcacagaa

SEQ ID NO: 20421 - DNA, 20 bp, Artificial Sequence
  chemically synthesized
atgactggaaaattgatgac

SEQ ID NO: 20422 - DNA, 20 bp, Artificial Sequence
  chemically synthesized
agactaccatccatggaatc

SEQ ID NO: 20423 - DNA, 20 bp, Artificial Sequence
  chemically synthesized
ttgctgagggcaaagggaat

SEQ ID NO: 20424 - DNA, 20 bp, Artificial Sequence
  chemically synthesized
gtgtctgtatacacttgtac

SEQ ID NO: 20425 - DNA, 20 bp, Artificial Sequence
  chemically synthesized
gtggccaggatataaagcag

SEQ ID NO: 20426 - DNA, 20 bp, Artificial Sequence
  chemically synthesized
gttcaacatcactaataatc

SEQ ID NO: 20427 - DNA, 20 bp, Artificial Sequence
  chemically synthesized
atgatacctccttatgccag

SEQ ID NO: 20428 - DNA, 20 bp, Artificial Sequence
  chemically synthesized
tgttggtgaggatgtggaga

SEQ ID NO: 20429 - DNA, 20 bp, Artificial Sequence
  chemically synthesized
aaatgcttatacactgttgg

SEQ ID NO: 20430 - DNA, 20 bp, Artificial Sequence
  chemically synthesized
catgaagatttcttaaagaa

SEQ ID NO: 20431 - DNA, 20 bp, Artificial Sequence
  chemically synthesized
ctaccaatggacgattggat

SEQ ID NO: 20432 - DNA, 20 bp, Artificial Sequence
  chemically synthesized
atatattactcagccataaa

SEQ ID NO: 20433 - DNA, 20 bp, Artificial Sequence
  chemically synthesized
agaatgaaatcatgtcttct

SEQ ID NO: 20434 - DNA, 20 bp, Artificial Sequence
  chemically synthesized
attatcctcagtgaaataac

SEQ ID NO: 20435 - DNA, 20 bp, Artificial Sequence
  chemically synthesized
ctcagtgaaataactcagaa

SEQ ID NO: 20436 - DNA, 20 bp, Artificial Sequence
  chemically synthesized
cgatgagtaagcatagacat

SEQ ID NO: 20437 - DNA, 20 bp, Artificial Sequence
  chemically synthesized
aataatagacacttgagact

SEQ ID NO: 20438 - DNA, 20 bp, Artificial Sequence
  chemically synthesized
aatggggtaattaaaagggt

SEQ ID NO: 20439 - DNA, 20 bp, Artificial Sequence
  chemically synthesized
cactaaataataatcacatg

SEQ ID NO: 20440 - DNA, 20 bp, Artificial Sequence
  chemically synthesized
gctagagcaaggggatgact

SEQ ID NO: 20441 - DNA, 20 bp, Artificial Sequence
  chemically synthesized
ctacacaagctaattgtcct

SEQ ID NO: 20442 - DNA, 20 bp, Artificial Sequence
  chemically synthesized
tcagatgttatgtgatgagg

SEQ ID NO: 20443 - DNA, 20 bp, Artificial Sequence
  chemically synthesized
atagaacacatgaggaggaa

SEQ ID NO: 20444 - DNA, 20 bp, Artificial Sequence
  chemically synthesized
tcctcaaattctggacaatt

SEQ ID NO: 20445 - DNA, 20 bp, Artificial Sequence
  chemically synthesized
cacaaaaatgcaaaatttcc

SEQ ID NO: 20446 - DNA, 20 bp, Artificial Sequence
  chemically synthesized
cttcatcttcatcttttcca

SEQ ID NO: 20447 - DNA, 20 bp, Artificial Sequence
  chemically synthesized
gaaatagagattctttattt

SEQ ID NO: 20448 - DNA, 20 bp, Artificial Sequence
  chemically synthesized
tgatttgggaaatgaaatga

SEQ ID NO: 20449 - DNA, 20 bp, Artificial Sequence
  chemically synthesized
gattatgctctttcagtcta

SEQ ID NO: 20450 - DNA, 20 bp, Artificial Sequence
  chemically synthesized
acaaagaaccaaaatagtaa

SEQ ID NO: 20451 - DNA, 20 bp, Artificial Sequence
  chemically synthesized
agtagaaaatcccacataag

SEQ ID NO: 20452 - DNA, 20 bp, Artificial Sequence
  chemically synthesized
ctacacatttataagctccc

SEQ ID NO: 20453 - DNA, 20 bp, Artificial Sequence
  chemically synthesized
aagcaaactgcctgaaggcc

SEQ ID NO: 20454 - DNA, 20 bp, Artificial Sequence
  chemically synthesized
gactatgctgctgtatgcac

SEQ ID NO: 20455 - DNA, 20 bp, Artificial Sequence
  chemically synthesized
atcaacaccaagatacatct

SEQ ID NO: 20456 - DNA, 20 bp, Artificial Sequence
  chemically synthesized
caaaataaacataaaaaggt

SEQ ID NO: 20457 - DNA, 20 bp, Artificial Sequence
  chemically synthesized
catttataaaattctggaaa

SEQ ID NO: 20458 - DNA, 20 bp, Artificial Sequence
  chemically synthesized
agaactcagataaacaataa

SEQ ID NO: 20459 - DNA, 20 bp, Artificial Sequence
  chemically synthesized
agataaacaataaaaagaaa

SEQ ID NO: 20460 - DNA, 20 bp, Artificial Sequence
  chemically synthesized
aaaacaattcaggatatgaa

SEQ ID NO: 20461 - DNA, 20 bp, Artificial Sequence
  chemically synthesized
tacccaagagatagatacaa

SEQ ID NO: 20462 - DNA, 20 bp, Artificial Sequence
  chemically synthesized
atacaacaagaatgaaccaa

SEQ ID NO: 20463 - DNA, 20 bp, Artificial Sequence
  chemically synthesized
tgtaactgaagagtttattg

SEQ ID NO: 20464 - DNA, 20 bp, Artificial Sequence
  chemically synthesized
acaatagatcagatcaagca

SEQ ID NO: 20465 - DNA, 20 bp, Artificial Sequence
  chemically synthesized
taaaattagctggtcaaatg

SEQ ID NO: 20466 - DNA, 20 bp, Artificial Sequence
  chemically synthesized
aaatgatagaaaggaaaaaa

SEQ ID NO: 20467 - DNA, 20 bp, Artificial Sequence
  chemically synthesized
tgaaaacttgtcaagtctag

SEQ ID NO: 20468 - DNA, 20 bp, Artificial Sequence
  chemically synthesized
gacatccagacaaatgaaaa

SEQ ID NO: 20469 - DNA, 20 bp, Artificial Sequence
  chemically synthesized
gattaacagcagatttctca

SEQ ID NO: 20470 - DNA, 20 bp, Artificial Sequence
  chemically synthesized
atgatatattcaaaatagtg

SEQ ID NO: 20471 - DNA, 20 bp, Artificial Sequence
  chemically synthesized
taaataaaatcttttctggg

SEQ ID NO: 20472 - DNA, 20 bp, Artificial Sequence
  chemically synthesized
ctatcactagactggcttta

SEQ ID NO: 20473 - DNA, 20 bp, Artificial Sequence
  chemically synthesized
gagcaaaacacaaataaaga

SEQ ID NO: 20474 - DNA, 20 bp, Artificial Sequence
  chemically synthesized
agaactcaaacgttaccact

SEQ ID NO: 20475 - DNA, 20 bp, Artificial Sequence
  chemically synthesized
caaaccacaatcataaataa

SEQ ID NO: 20476 - DNA, 20 bp, Artificial Sequence
  chemically synthesized
ccacaatcataaataataag

SEQ ID NO: 20477 - DNA, 20 bp, Artificial Sequence
  chemically synthesized
aatcataaataataagaaag

SEQ ID NO: 20478 - DNA, 20 bp, Artificial Sequence
  chemically synthesized
ataaataataagaaagaaag

SEQ ID NO: 20479 - DNA, 20 bp, Artificial Sequence
  chemically synthesized
ataataagaaagaaagaaag

SEQ ID NO: 20480 - DNA, 20 bp, Artificial Sequence
  chemically synthesized
agaaagaaagagagagagag

SEQ ID NO: 20481 - DNA, 20 bp, Artificial Sequence
  chemically synthesized
agagagagagagagagaatg

SEQ ID NO: 20482 - DNA, 20 bp, Artificial Sequence
  chemically synthesized
agagagagagagaatgaaag

SEQ ID NO: 20483 - DNA, 20 bp, Artificial Sequence
  chemically synthesized
aagaaagaaaaggaaggaag

SEQ ID NO: 20484 - DNA, 20 bp, Artificial Sequence
  chemically synthesized
acccagttgtaagctgccta

SEQ ID NO: 20485 - DNA, 20 bp, Artificial Sequence
  chemically synthesized
atgaaagatcttccatacaa

SEQ ID NO: 20486 - DNA, 20 bp, Artificial Sequence
  chemically synthesized
tattagatataaagggtgaa

SEQ ID NO: 20487 - DNA, 20 bp, Artificial Sequence
  chemically synthesized
gcatcagatagatcatctag

SEQ ID NO: 20488 - DNA, 20 bp, Artificial Sequence
  chemically synthesized
catctagacagaaaattaac

SEQ ID NO: 20489 - DNA, 20 bp, Artificial Sequence
  chemically synthesized
caatatttcatccaacagct

SEQ ID NO: 20490 - DNA, 20 bp, Artificial Sequence
  chemically synthesized
cagaccacaatggaataaaa

SEQ ID NO: 20491 - DNA, 20 bp, Artificial Sequence
  chemically synthesized
ataaaactagaaatcaataa

SEQ ID NO: 20492 - DNA, 20 bp, Artificial Sequence
  chemically synthesized
ctgaatgaacgttatgtcaa

SEQ ID NO: 20493 - DNA, 20 bp, Artificial Sequence
  chemically synthesized
taaacacttaaattaaaaac

SEQ ID NO: 20494 - DNA, 20 bp, Artificial Sequence
  chemically synthesized
taatcatgtacctcaacaag

SEQ ID NO: 20495 - DNA, 20 bp, Artificial Sequence
  chemically synthesized
aacccaaaactagcagaagg

SEQ ID NO: 20496 - DNA, 20 bp, Artificial Sequence
  chemically synthesized
acagaagaacttaatgaaat

SEQ ID NO: 20497 - DNA, 20 bp, Artificial Sequence
  chemically synthesized
atagctctagctagactaac

SEQ ID NO: 20498 - DNA, 20 bp, Artificial Sequence
  chemically synthesized
aaaagagaagagactgaaat

SEQ ID NO: 20499 - DNA, 20 bp, Artificial Sequence
  chemically synthesized
agagactgaaataaagaaaa

SEQ ID NO: 20500 - DNA, 20 bp, Artificial Sequence
  chemically synthesized
taaagaaaatcagaaataaa

SEQ ID NO: 20501 - DNA, 20 bp, Artificial Sequence
  chemically synthesized
aatatattacaaccgatacc

SEQ ID NO: 20502 - DNA, 20 bp, Artificial Sequence
  chemically synthesized
ttacaaccgataccacagaa

SEQ ID NO: 20503 - DNA, 20 bp, Artificial Sequence
  chemically synthesized
accacctaccaagattgaat

SEQ ID NO: 20504 - DNA, 20 bp, Artificial Sequence
  chemically synthesized
cctaccaagattgaattaag

SEQ ID NO: 20505 - DNA, 20 bp, Artificial Sequence
  chemically synthesized
caagattgaattaagaaaga

SEQ ID NO: 20506 - DNA, 20 bp, Artificial Sequence
  chemically synthesized
gtagtaaaaagtctcccaaa

SEQ ID NO: 20507 - DNA, 20 bp, Artificial Sequence
  chemically synthesized
tcaaattttaccaaactttc

SEQ ID NO: 20508 - DNA, 20 bp, Artificial Sequence
  chemically synthesized
atatgatcatctcaatagat

SEQ ID NO: 20509 - DNA, 20 bp, Artificial Sequence
  chemically synthesized
ctagccacagctttcaggtc

SEQ ID NO: 20510 - DNA, 20 bp, Artificial Sequence
  chemically synthesized
ccacagctttcaggtcagag

SEQ ID NO: 20511 - DNA, 20 bp, Artificial Sequence
  chemically synthesized
agctttcaggtcagagaaag

SEQ ID NO: 20512 - DNA, 20 bp, Artificial Sequence
  chemically synthesized
ttcaggtcagagaaagaaag

SEQ ID NO: 20513 - DNA, 20 bp, Artificial Sequence
  chemically synthesized
cagatgacatgattttatac

SEQ ID NO: 20514 - DNA, 20 bp, Artificial Sequence
  chemically synthesized
aaaactacaaaacactgata

SEQ ID NO: 20515 - DNA, 20 bp, Artificial Sequence
  chemically synthesized
tgataaaagaattgaaaagg

SEQ ID NO: 20516 - DNA, 20 bp, Artificial Sequence
  chemically synthesized
agatatcctatgttcatgga

SEQ ID NO: 20517 - DNA, 20 bp, Artificial Sequence
  chemically synthesized
aaatagcaatgtcatttttc

SEQ ID NO: 20518 - DNA, 20 bp, Artificial Sequence
  chemically synthesized
cagacacttagaccaatgga

SEQ ID NO: 20519 - DNA, 20 bp, Artificial Sequence
  chemically synthesized
aatggaagagaatagagaac

SEQ ID NO: 20520 - DNA, 20 bp, Artificial Sequence
  chemically synthesized
cagattttcaacaaaggtga

SEQ ID NO: 20521 - DNA, 20 bp, Artificial Sequence
  chemically synthesized
tgaggaaaggacacagtgtt

SEQ ID NO: 20522 - DNA, 20 bp, Artificial Sequence
  chemically synthesized
ccattggatatccatgtgca

SEQ ID NO: 20523 - DNA, 20 bp, Artificial Sequence
  chemically synthesized
cctaaacacacactcccact

SEQ ID NO: 20524 - DNA, 20 bp, Artificial Sequence
  chemically synthesized
tacaggtgtagaggaagcag

SEQ ID NO: 20525 - DNA, 20 bp, Artificial Sequence
  chemically synthesized
agaacaattactaatagacc

SEQ ID NO: 20526 - DNA, 20 bp, Artificial Sequence
  chemically synthesized
gcactagacagttcatcaag

SEQ ID NO: 20527 - DNA, 20 bp, Artificial Sequence
  chemically synthesized
caggaccagatggattcaca

SEQ ID NO: 20528 - DNA, 20 bp, Artificial Sequence
  chemically synthesized
cagggaaggacataaccaaa

SEQ ID NO: 20529 - DNA, 20 bp, Artificial Sequence
  chemically synthesized
acatgatcatctcaatagat

SEQ ID NO: 20530 - DNA, 20 bp, Artificial Sequence
  chemically synthesized
ccagggcaatcagacaaaac

SEQ ID NO: 20531 - DNA, 20 bp, Artificial Sequence
  chemically synthesized
ttaaaaccctaaagactcct

SEQ ID NO: 20532 - DNA, 20 bp, Artificial Sequence
  chemically synthesized
tacaccaacagcaaccaaat

SEQ ID NO: 20533 - DNA, 20 bp, Artificial Sequence
  chemically synthesized
ttaaaactataaaactacta

SEQ ID NO: 20534 - DNA, 20 bp, Artificial Sequence
  chemically synthesized
aagagacaagctgttgaatg

SEQ ID NO: 20535 - DNA, 20 bp, Artificial Sequence
  chemically synthesized
atttgacaaggaattaatct

SEQ ID NO: 20536 - DNA, 20 bp, Artificial Sequence
  chemically synthesized
gaattaatctccagaatata

SEQ ID NO: 20537 - DNA, 20 bp, Artificial Sequence
  chemically synthesized
gctcaacattactaatcatc

SEQ ID NO: 20538 - DNA, 20 bp, Artificial Sequence
  chemically synthesized
gagatatcatcttatgccag

SEQ ID NO: 20539 - DNA, 20 bp, Artificial Sequence
  chemically synthesized
ctgggtatttatccaaagga

SEQ ID NO: 20540 - DNA, 20 bp, Artificial Sequence
  chemically synthesized
tttatccaaaggaaaagaat

SEQ ID NO: 20541 - DNA, 20 bp, Artificial Sequence
  chemically synthesized
gtgtccatcaatggatgaat

SEQ ID NO: 20542 - DNA, 20 bp, Artificial Sequence
  chemically synthesized
ttaaacgaaataagccaggc

SEQ ID NO: 20543 - DNA, 20 bp, Artificial Sequence
  chemically synthesized
taatatcatgtaggtagaga

SEQ ID NO: 20544 - DNA, 20 bp, Artificial Sequence
  chemically synthesized
tgtaggtagagagtagaatg

SEQ ID NO: 20545 - DNA, 20 bp, Artificial Sequence
  chemically synthesized
gaatgacagaaaccagaggt

SEQ ID NO: 20546 - DNA, 20 bp, Artificial Sequence
  chemically synthesized
ttgtatatttcaaaatagta

SEQ ID NO: 20547 - DNA, 20 bp, Artificial Sequence
  chemically synthesized
tcttgaaatgttcctaacac

SEQ ID NO: 20548 - DNA, 20 bp, Artificial Sequence
  chemically synthesized
aaacacgtcatatatcaata

SEQ ID NO: 20549 - DNA, 20 bp, Artificial Sequence
  chemically synthesized
caaacttctctcttaacaag

SEQ ID NO: 20550 - DNA, 20 bp, Artificial Sequence
  chemically synthesized
ggttttattctgacattaaa

SEQ ID NO: 20551 - DNA, 20 bp, Artificial Sequence
  chemically synthesized
agtatcacaactttcacctg

SEQ ID NO: 20552 - DNA, 20 bp, Artificial Sequence
  chemically synthesized
aatcactatttcaaagaagt

SEQ ID NO: 20553 - DNA, 20 bp, Artificial Sequence
  chemically synthesized
tatacatattatacacatat

SEQ ID NO: 20554 - DNA, 20 bp, Artificial Sequence
  chemically synthesized
tccacatcagtaattagggc

SEQ ID NO: 20555 - DNA, 20 bp, Artificial Sequence
  chemically synthesized
attttatgaataaattttat

SEQ ID NO: 20556 - DNA, 20 bp, Artificial Sequence
  chemically synthesized
tacaggtagattttatatat

SEQ ID NO: 20557 - DNA, 20 bp, Artificial Sequence
  chemically synthesized
gtgagcctccatggccagct

SEQ ID NO: 20558 - DNA, 20 bp, Artificial Sequence
  chemically synthesized
gagaaattttttaaatttct

SEQ ID NO: 20559 - DNA, 20 bp, Artificial Sequence
  chemically synthesized
tttaaaagtggtggggggta

SEQ ID NO: 20560 - DNA, 20 bp, Artificial Sequence
  chemically synthesized
gatccttttcattttgctct

SEQ ID NO: 20561 - DNA, 20 bp, Artificial Sequence
  chemically synthesized
aagtgtgaagtcctcttctc

SEQ ID NO: 20562 - DNA, 20 bp, Artificial Sequence
  chemically synthesized
tagatataatttctgaaggt

SEQ ID NO: 20563 - DNA, 20 bp, Artificial Sequence
  chemically synthesized
gttctgagcaagtgtgtgca

SEQ ID NO: 20564 - DNA, 20 bp, Artificial Sequence
  chemically synthesized
agtacttcccactactgtgg

SEQ ID NO: 20565 - DNA, 20 bp, Artificial Sequence
  chemically synthesized
caaacctctaggtaactagg

SEQ ID NO: 20566 - DNA, 20 bp, Artificial Sequence
  chemically synthesized
atttgtcaattcttgaagat

SEQ ID NO: 20567 - DNA, 20 bp, Artificial Sequence
  chemically synthesized
aaaaaggttattttgaagtc

SEQ ID NO: 20568 - DNA, 20 bp, Artificial Sequence
  chemically synthesized
gcagcaagggattcttctcc

SEQ ID NO: 20569 - DNA, 20 bp, Artificial Sequence
  chemically synthesized
tgaatacatttccttgtttg

SEQ ID NO: 20570 - DNA, 20 bp, Artificial Sequence
  chemically synthesized
ataacattcattttattcat

SEQ ID NO: 20571 - DNA, 20 bp, Artificial Sequence
  chemically synthesized
tcagtttaaggggttctttt

SEQ ID NO: 20572 - DNA, 20 bp, Artificial Sequence
  chemically synthesized
gggttctttttcagaaagtt

SEQ ID NO: 20573 - DNA, 20 bp, Artificial Sequence
  chemically synthesized
aaattcaaatcattaaattt

SEQ ID NO: 20574 - DNA, 20 bp, Artificial Sequence
  chemically synthesized
ttccccttgaaagggaaatg

SEQ ID NO: 20575 - DNA, 20 bp, Artificial Sequence
  chemically synthesized
cattaatgtttgttaaatga

SEQ ID NO: 20576 - DNA, 20 bp, Artificial Sequence
  chemically synthesized
tgagctcctgcccactctct

SEQ ID NO: 20577 - DNA, 20 bp, Artificial Sequence
  chemically synthesized
tggactggaaaaatttgtga

SEQ ID NO: 20578 - DNA, 20 bp, Artificial Sequence
  chemically synthesized
aggataaagatctctgagga

SEQ ID NO: 20579 - DNA, 20 bp, Artificial Sequence
  chemically synthesized
aagaatacaaaataatttaa

SEQ ID NO: 20580 - DNA, 20 bp, Artificial Sequence
  chemically synthesized
aaataatttaaaaagaaaca

SEQ ID NO: 20581 - DNA, 20 bp, Artificial Sequence
  chemically synthesized
attctttctcactaaactac

SEQ ID NO: 20582 - DNA, 20 bp, Artificial Sequence
  chemically synthesized
ataaggtgaattctgatttt

SEQ ID NO: 20583 - DNA, 20 bp, Artificial Sequence
  chemically synthesized
tcctacataagcatagcatt

SEQ ID NO: 20584 - DNA, 20 bp, Artificial Sequence
  chemically synthesized
agcatttcatataattacta

SEQ ID NO: 20585 - DNA, 20 bp, Artificial Sequence
  chemically synthesized
gtttaattatactattttgc

SEQ ID NO: 20586 - DNA, 20 bp, Artificial Sequence
  chemically synthesized
tgaaatcttatgtgcttccc

SEQ ID NO: 20587 - DNA, 20 bp, Artificial Sequence
  chemically synthesized
accgtcctcacaatacctgc

SEQ ID NO: 20588 - DNA, 20 bp, Artificial Sequence
  chemically synthesized
acaatacctgcccagaaaga

SEQ ID NO: 20589 - DNA, 20 bp, Artificial Sequence
  chemically synthesized
agaaagacgagaaagaggag

SEQ ID NO: 20590 - DNA, 20 bp, Artificial Sequence
  chemically synthesized
ggagtctcggaggactgtaa

SEQ ID NO: 20591 - DNA, 20 bp, Artificial Sequence
  chemically synthesized
cttgtgtatgtgttgaagag

SEQ ID NO: 20592 - DNA, 20 bp, Artificial Sequence
  chemically synthesized
aaaatccatattatgacaac

SEQ ID NO: 20593 - DNA, 20 bp, Artificial Sequence
  chemically synthesized
tagtaattatatgaaatgct

SEQ ID NO: 20594 - DNA, 20 bp, Artificial Sequence
  chemically synthesized
ggcaaaatactgtgctcctt

SEQ ID NO: 20595 - DNA, 20 bp, Artificial Sequence
  chemically synthesized
ttatgtaggaattataaaat

SEQ ID NO: 20596 - DNA, 20 bp, Artificial Sequence
  chemically synthesized
actattgaaggaacattagc

SEQ ID NO: 20597 - DNA, 20 bp, Artificial Sequence
  chemically synthesized
gctgagttcctcaagatctt

SEQ ID NO: 20598 - DNA, 20 bp, Artificial Sequence
  chemically synthesized
taaaggatctgaaataataa

SEQ ID NO: 20599 - DNA, 20 bp, Artificial Sequence
  chemically synthesized
atggcatgcattctgaaaaa

SEQ ID NO: 20600 - DNA, 20 bp, Artificial Sequence
  chemically synthesized
ttttgcctatgtagaagtgg

SEQ ID NO: 20601 - DNA, 20 bp, Artificial Sequence
  chemically synthesized
tcttattctctgtagtttag

SEQ ID NO: 20602 - DNA, 20 bp, Artificial Sequence
  chemically synthesized
attctctgtagtttagtgag

SEQ ID NO: 20603 - DNA, 20 bp, Artificial Sequence
  chemically synthesized
gtgagaaagaatctaggagg

SEQ ID NO: 20604 - DNA, 20 bp, Artificial Sequence
  chemically synthesized
tctagaacagtgcctggtac

SEQ ID NO: 20605 - DNA, 20 bp, Artificial Sequence
  chemically synthesized
ttcacttttttactattatg

SEQ ID NO: 20606 - DNA, 20 bp, Artificial Sequence
  chemically synthesized
caaggaaatgtattcacatc

SEQ ID NO: 20607 - DNA, 20 bp, Artificial Sequence
  chemically synthesized
aaacaaaaggtttcttagga

SEQ ID NO: 20608 - DNA, 20 bp, Artificial Sequence
  chemically synthesized
aggagaagaatcccttgctg

SEQ ID NO: 20609 - DNA, 20 bp, Artificial Sequence
  chemically synthesized
agaggcgagggagatagagt

SEQ ID NO: 20610 - DNA, 20 bp, Artificial Sequence
  chemically synthesized
cagaactgattcttaatctt

SEQ ID NO: 20611 - DNA, 20 bp, Artificial Sequence
  chemically synthesized
gaaggataaatagctaaagg

SEQ ID NO: 20612 - DNA, 20 bp, Artificial Sequence
  chemically synthesized
ctcagaacattacaaactct

SEQ ID NO: 20613 - DNA, 20 bp, Artificial Sequence
  chemically synthesized
acacataatgaaagttaatt

SEQ ID NO: 20614 - DNA, 20 bp, Artificial Sequence
  chemically synthesized
tgcttccctcttaaaatgga

SEQ ID NO: 20615 - DNA, 20 bp, Artificial Sequence
  chemically synthesized
catggtacaagtggcacagg

SEQ ID NO: 20616 - DNA, 20 bp, Artificial Sequence
  chemically synthesized
caagtggcacagggaagaat

SEQ ID NO: 20617 - DNA, 20 bp, Artificial Sequence
  chemically synthesized
ctagagtcaaagtggttatg

SEQ ID NO: 20618 - DNA, 20 bp, Artificial Sequence
  chemically synthesized
ctcaaggagtttctaaacct

SEQ ID NO: 20619 - DNA, 20 bp, Artificial Sequence
  chemically synthesized
cacttttcaaggctgaggtg

SEQ ID NO: 20620 - DNA, 20 bp, Artificial Sequence
  chemically synthesized
catagggagaccctgtttct

SEQ ID NO: 20621 - DNA, 20 bp, Artificial Sequence
  chemically synthesized
taataatgttgtgaaaatta

SEQ ID NO: 20622 - DNA, 20 bp, Artificial Sequence
  chemically synthesized
ttgcatttttaaacacaaaa

SEQ ID NO: 20623 - DNA, 20 bp, Artificial Sequence
  chemically synthesized
ctttgattttaactgaggat

SEQ ID NO: 20624 - DNA, 20 bp, Artificial Sequence
  chemically synthesized
agagagagcgagagagaggc

SEQ ID NO: 20625 - DNA, 20 bp, Artificial Sequence
  chemically synthesized
aagtattttcttttttaatg

SEQ ID NO: 20626 - DNA, 20 bp, Artificial Sequence
  chemically synthesized
gctaaaatggtgttggaata

SEQ ID NO: 20627 - DNA, 20 bp, Artificial Sequence
  chemically synthesized
tttggtgtgatgctggcttc

SEQ ID NO: 20628 - DNA, 20 bp, Artificial Sequence
  chemically synthesized
gttccttctttatctgtctt

SEQ ID NO: 20629 - DNA, 20 bp, Artificial Sequence
  chemically synthesized
aattcctctttgaatgtcta

SEQ ID NO: 20630 - DNA, 20 bp, Artificial Sequence
  chemically synthesized
cctatcatatggtctacctt

SEQ ID NO: 20631 - DNA, 20 bp, Artificial Sequence
  chemically synthesized
aaatttccacgcgctgttga

SEQ ID NO: 20632 - DNA, 20 bp, Artificial Sequence
  chemically synthesized
taactcaactccaggtaagg

SEQ ID NO: 20633 - DNA, 20 bp, Artificial Sequence
  chemically synthesized
gctattttgatagcggtcat

SEQ ID NO: 20634 - DNA, 20 bp, Artificial Sequence
  chemically synthesized
agctagtttattattggtgt

SEQ ID NO: 20635 - DNA, 20 bp, Artificial Sequence
  chemically synthesized
atcaggataatactggcctc

SEQ ID NO: 20636 - DNA, 20 bp, Artificial Sequence
  chemically synthesized
ggcctcagagaatgagttag

SEQ ID NO: 20637 - DNA, 20 bp, Artificial Sequence
  chemically synthesized
tccttcctgtttaattttta

SEQ ID NO: 20638 - DNA, 20 bp, Artificial Sequence
  chemically synthesized
tcttggtaggtggtatgtgt

SEQ ID NO: 20639 - DNA, 20 bp, Artificial Sequence
  chemically synthesized
tgatctatctgatgctgaga

SEQ ID NO: 20640 - DNA, 20 bp, Artificial Sequence
  chemically synthesized
ctggtgttgagtgtgaatgt

SEQ ID NO: 20641 - DNA, 20 bp, Artificial Sequence
  chemically synthesized
ttccttcaaatttttcttgc

SEQ ID NO: 20642 - DNA, 20 bp, Artificial Sequence
  chemically synthesized
ctggcctgtgaggtttctgc

SEQ ID NO: 20643 - DNA, 20 bp, Artificial Sequence
  chemically synthesized
tttcaataaactcttcagtt

SEQ ID NO: 20644 - DNA, 20 bp, Artificial Sequence
  chemically synthesized
aacattttggattctttttt

SEQ ID NO: 20645 - DNA, 20 bp, Artificial Sequence
  chemically synthesized
ttccactggcttatgttgct

SEQ ID NO: 20646 - DNA, 20 bp, Artificial Sequence
  chemically synthesized
tgatgaggttgtgctggaga

SEQ ID NO: 20647 - DNA, 20 bp, Artificial Sequence
  chemically synthesized
gagtgatcctcaggccccca

SEQ ID NO: 20648 - DNA, 20 bp, Artificial Sequence
  chemically synthesized
tgtcacttctctgttgaatt

SEQ ID NO: 20649 - DNA, 20 bp, Artificial Sequence
  chemically synthesized
aatcatttgtttcttcaaat

SEQ ID NO: 20650 - DNA, 20 bp, Artificial Sequence
  chemically synthesized
catctaataaatgtgtacca

SEQ ID NO: 20651 - DNA, 20 bp, Artificial Sequence
  chemically synthesized
ctcctggaaaagatgaagat

SEQ ID NO: 20652 - DNA, 20 bp, Artificial Sequence
  chemically synthesized
gaaaataagtctacagaaga

SEQ ID NO: 20653 - DNA, 20 bp, Artificial Sequence
  chemically synthesized
tttttgtggatagtggtttt

SEQ ID NO: 20654 - DNA, 20 bp, Artificial Sequence
  chemically synthesized
agatgtgactcccacacttt

SEQ ID NO: 20655 - DNA, 20 bp, Artificial Sequence
  chemically synthesized
ttgatggtttctaaaattgt

SEQ ID NO: 20656 - DNA, 20 bp, Artificial Sequence
  chemically synthesized
agttactggaataatacatt

SEQ ID NO: 20657 - DNA, 20 bp, Artificial Sequence
  chemically synthesized
aacttacaatcatggcagaa

SEQ ID NO: 20658 - DNA, 20 bp, Artificial Sequence
  chemically synthesized
tagttctgtttctagttctt

SEQ ID NO: 20659 - DNA, 20 bp, Artificial Sequence
  chemically synthesized
ggcaggaagcatccagcatg

SEQ ID NO: 20660 - DNA, 20 bp, Artificial Sequence
  chemically synthesized
acccgtgaatcctgtctatg

SEQ ID NO: 20661 - DNA, 20 bp, Artificial Sequence
  chemically synthesized
gaaaaggctgagtggtgtcc

SEQ ID NO: 20662 - DNA, 20 bp, Artificial Sequence
  chemically synthesized
cgttgtccttcagggatgtc

SEQ ID NO: 20663 - DNA, 20 bp, Artificial Sequence
  chemically synthesized
ccatcggtgcagtctcaggg

SEQ ID NO: 20664 - DNA, 20 bp, Artificial Sequence
  chemically synthesized
ccactttatggctagatgga

SEQ ID NO: 20665 - DNA, 20 bp, Artificial Sequence
  chemically synthesized
atcatattaagcagccaact

SEQ ID NO: 20666 - DNA, 20 bp, Artificial Sequence
  chemically synthesized
aatctgtattagggttctac

SEQ ID NO: 20667 - DNA, 20 bp, Artificial Sequence
  chemically synthesized
tattagggttctacagagaa

SEQ ID NO: 20668 - DNA, 20 bp, Artificial Sequence
  chemically synthesized
agttcaatgttccagggcag

SEQ ID NO: 20669 - DNA, 20 bp, Artificial Sequence
  chemically synthesized
ggcaggaagaatccagcatg

SEQ ID NO: 20670 - DNA, 20 bp, Artificial Sequence
  chemically synthesized
ggtagcagcaatattagagg

SEQ ID NO: 20671 - DNA, 20 bp, Artificial Sequence
  chemically synthesized
ggggctgcatgcactggtca

SEQ ID NO: 20672 - DNA, 20 bp, Artificial Sequence
  chemically synthesized
tacttcttctttctttggag

SEQ ID NO: 20673 - DNA, 20 bp, Artificial Sequence
  chemically synthesized
tctcctcccttactaggaag

SEQ ID NO: 20674 - DNA, 20 bp, Artificial Sequence
  chemically synthesized
aggaagagagaaataccatg

SEQ ID NO: 20675 - DNA, 20 bp, Artificial Sequence
  chemically synthesized
gaagggactttaaaacatgc

SEQ ID NO: 20676 - DNA, 20 bp, Artificial Sequence
  chemically synthesized
aattgctaacctgaatgata

SEQ ID NO: 20677 - DNA, 20 bp, Artificial Sequence
  chemically synthesized
cctccaaagaaagaagaagt

SEQ ID NO: 20678 - DNA, 20 bp, Artificial Sequence
  chemically synthesized
aatattgctgctacctctat

SEQ ID NO: 20679 - DNA, 20 bp, Artificial Sequence
  chemically synthesized
atccagcaagtccacatcta

SEQ ID NO: 20680 - DNA, 20 bp, Artificial Sequence
  chemically synthesized
agaatttatgaccaagtcct

SEQ ID NO: 20681 - DNA, 20 bp, Artificial Sequence
  chemically synthesized
tcctcaaaactaaacacaac

SEQ ID NO: 20682 - DNA, 20 bp, Artificial Sequence
  chemically synthesized
aaactaaacacaacaaaaac

SEQ ID NO: 20683 - DNA, 20 bp, Artificial Sequence
  chemically synthesized
tacaaggaactcaacaacaa

SEQ ID NO: 20684 - DNA, 20 bp, Artificial Sequence
  chemically synthesized
atggacctctatgattagtc

SEQ ID NO: 20685 - DNA, 20 bp, Artificial Sequence
  chemically synthesized
tatttcctccttcttttgtt

SEQ ID NO: 20686 - DNA, 20 bp, Artificial Sequence
  chemically synthesized
ggatataaagcaggcagaaa

SEQ ID NO: 20687 - DNA, 20 bp, Artificial Sequence
  chemically synthesized
aataatcagagaatgcaaat

SEQ ID NO: 20688 - DNA, 20 bp, Artificial Sequence
  chemically synthesized
tggctatcattataaagttc

SEQ ID NO: 20689 - DNA, 20 bp, Artificial Sequence
  chemically synthesized
taggagtatggtgaggactg

SEQ ID NO: 20690 - DNA, 20 bp, Artificial Sequence
  chemically synthesized
catttttcactgctgtcttt

SEQ ID NO: 20691 - DNA, 20 bp, Artificial Sequence
  chemically synthesized
aaatatatctaagctttctt

SEQ ID NO: 20692 - DNA, 20 bp, Artificial Sequence
  chemically synthesized
tatttacattttttatcctt

SEQ ID NO: 20693 - DNA, 20 bp, Artificial Sequence
  chemically synthesized
tgcatcttactcagagatct

SEQ ID NO: 20694 - DNA, 20 bp, Artificial Sequence
  chemically synthesized
ttgggaaatgaaatgaaaag

SEQ ID NO: 20695 - DNA, 20 bp, Artificial Sequence
  chemically synthesized
tctttcagtctattagaaat

SEQ ID NO: 20696 - DNA, 20 bp, Artificial Sequence
  chemically synthesized
agaaaaaagtcttcccctac

SEQ ID NO: 20697 - DNA, 20 bp, Artificial Sequence
  chemically synthesized
cccctacaaaaacaaattta

SEQ ID NO: 20698 - DNA, 20 bp, Artificial Sequence
  chemically synthesized
aaacaataaaaagaaatcag

SEQ ID NO: 20699 - DNA, 20 bp, Artificial Sequence
  chemically synthesized
aagaaatacaaaatacattc

SEQ ID NO: 20700 - DNA, 20 bp, Artificial Sequence
  chemically synthesized
tacgtaacaacacaatagct

SEQ ID NO: 20701 - DNA, 20 bp, Artificial Sequence
  chemically synthesized
aagccaaagagtaagaactc

SEQ ID NO: 20702 - DNA, 20 bp, Artificial Sequence
  chemically synthesized
tatacaactaactggtagag

SEQ ID NO: 20703 - DNA, 20 bp, Artificial Sequence
  chemically synthesized
gaaaaggaaggaaggaagaa

SEQ ID NO: 20704 - DNA, 20 bp, Artificial Sequence
  chemically synthesized
aaggaaggaagaaaaaaaca

SEQ ID NO: 20705 - DNA, 20 bp, Artificial Sequence
  chemically synthesized
caaaacaaacaaactaaaaa

SEQ ID NO: 20706 - DNA, 20 bp, Artificial Sequence
  chemically synthesized
caaacaaactaaaaaaaaaa

SEQ ID NO: 20707 - DNA, 20 bp, Artificial Sequence
  chemically synthesized
atagactggctaaatagatt

SEQ ID NO: 20708 - DNA, 20 bp, Artificial Sequence
  chemically synthesized
gataaaattgactttaaata

SEQ ID NO: 20709 - DNA, 20 bp, Artificial Sequence
  chemically synthesized
cttctcagaccacaatggaa

SEQ ID NO: 20710 - DNA, 20 bp, Artificial Sequence
  chemically synthesized
aactagaaatcaataacaag

SEQ ID NO: 20711 - DNA, 20 bp, Artificial Sequence
  chemically synthesized
atcaataacaagaaaaactt

SEQ ID NO: 20712 - DNA, 20 bp, Artificial Sequence
  chemically synthesized
tatcaataaacacttaaatt

SEQ ID NO: 20713 - DNA, 20 bp, Artificial Sequence
  chemically synthesized
acaagctagaaaagcaagaa

SEQ ID NO: 20714 - DNA, 20 bp, Artificial Sequence
  chemically synthesized
agaaaagcaagaacaaaacc

SEQ ID NO: 20715 - DNA, 20 bp, Artificial Sequence
  chemically synthesized
aagaacttaatgaaatagag

SEQ ID NO: 20716 - DNA, 20 bp, Artificial Sequence
  chemically synthesized
ttatgaacaaccatacacta

SEQ ID NO: 20717 - DNA, 20 bp, Artificial Sequence
  chemically synthesized
gattgaattaagaaagaata

SEQ ID NO: 20718 - DNA, 20 bp, Artificial Sequence
  chemically synthesized
aattttaccaaactttcaaa

SEQ ID NO: 20719 - DNA, 20 bp, Artificial Sequence
  chemically synthesized
gacaaggatgcaagtaaaaa

SEQ ID NO: 20720 - DNA, 20 bp, Artificial Sequence
  chemically synthesized
atcacatcaacaaaaagaac

SEQ ID NO: 20721 - DNA, 20 bp, Artificial Sequence
  chemically synthesized
atttaacattccttcatgat

SEQ ID NO: 20722 - DNA, 20 bp, Artificial Sequence
  chemically synthesized
tgacatgattttatacctag

SEQ ID NO: 20723 - DNA, 20 bp, Artificial Sequence
  chemically synthesized
taaatttaaccaaggaaccg

SEQ ID NO: 20724 - DNA, 20 bp, Artificial Sequence
  chemically synthesized
aaccgaaaaacctctattcg

SEQ ID NO: 20725 - DNA, 20 bp, Artificial Sequence
  chemically synthesized
aacctctattcggaaaacta

SEQ ID NO: 20726 - DNA, 20 bp, Artificial Sequence
  chemically synthesized
gtcatttttcacagaaatgg

SEQ ID NO: 20727 - DNA, 20 bp, Artificial Sequence
  chemically synthesized
gatatccatgtgcaaaagaa

SEQ ID NO: 20728 - DNA, 20 bp, Artificial Sequence
  chemically synthesized
ggccaccaaaagtgagtagg

SEQ ID NO: 20729 - DNA, 20 bp, Artificial Sequence
  chemically synthesized
ctatgaagccagcatcacac

SEQ ID NO: 20730 - DNA, 20 bp, Artificial Sequence
  chemically synthesized
ggaaggacataaccaaaaaa

SEQ ID NO: 20731 - DNA, 20 bp, Artificial Sequence
  chemically synthesized
tacaccacataaacagattt

SEQ ID NO: 20732 - DNA, 20 bp, Artificial Sequence
  chemically synthesized
tcctagccagggcaatcaga

SEQ ID NO: 20733 - DNA, 20 bp, Artificial Sequence
  chemically synthesized
atgatatgatcatttacctt

SEQ ID NO: 20734 - DNA, 20 bp, Artificial Sequence
  chemically synthesized
aacccctatttattgccata

SEQ ID NO: 20735 - DNA, 20 bp, Artificial Sequence
  chemically synthesized
atggattaaagacttaaata

SEQ ID NO: 20736 - DNA, 20 bp, Artificial Sequence
  chemically synthesized
aaagacttaaatataaaact

SEQ ID NO: 20737 - DNA, 20 bp, Artificial Sequence
  chemically synthesized
aaatataaaacttaaaacta

SEQ ID NO: 20738 - DNA, 20 bp, Artificial Sequence
  chemically synthesized
aaactataaaactactaaaa

SEQ ID NO: 20739 - DNA, 20 bp, Artificial Sequence
  chemically synthesized
ctcaaacaactcaacagtgg

SEQ ID NO: 20740 - DNA, 20 bp, Artificial Sequence
  chemically synthesized
atcatcagagaaatgcaaat

SEQ ID NO: 20741 - DNA, 20 bp, Artificial Sequence
  chemically synthesized
aaattagtatagccactatg

SEQ ID NO: 20742 - DNA, 20 bp, Artificial Sequence
  chemically synthesized
aaagtagggtgattatagtt

SEQ ID NO: 20743 - DNA, 20 bp, Artificial Sequence
  chemically synthesized
acatataacaatgaggtggt

SEQ ID NO: 20744 - DNA, 20 bp, Artificial Sequence
  chemically synthesized
ctaatctcaccctcctgttc

SEQ ID NO: 20745 - DNA, 20 bp, Artificial Sequence
  chemically synthesized
aggagaaaaagaggaagaac

SEQ ID NO: 20746 - DNA, 20 bp, Artificial Sequence
  chemically synthesized
ctctagagaaaagccatttg

SEQ ID NO: 20747 - DNA, 20 bp, Artificial Sequence
  chemically synthesized
ggaaaacttctgtgttaaca

SEQ ID NO: 20748 - DNA, 20 bp, Artificial Sequence
  chemically synthesized
agcaatacgttggcttaggc

SEQ ID NO: 20749 - DNA, 20 bp, Artificial Sequence
  chemically synthesized
atttttcccccacatttggg

SEQ ID NO: 20750 - DNA, 20 bp, Artificial Sequence
  chemically synthesized
actggtaacagtgcttcttc

SEQ ID NO: 20751 - DNA, 20 bp, Artificial Sequence
  chemically synthesized
cattgttcataccctggaga

SEQ ID NO: 20752 - DNA, 20 bp, Artificial Sequence
  chemically synthesized
gaagtctgagaattagtacc

SEQ ID NO: 20753 - DNA, 20 bp, Artificial Sequence
  chemically synthesized
atacatttccttgtttgcca

SEQ ID NO: 20754 - DNA, 20 bp, Artificial Sequence
  chemically synthesized
atctataggacatttccttt

SEQ ID NO: 20755 - DNA, 20 bp, Artificial Sequence
  chemically synthesized
cattgtggggacctctccac

SEQ ID NO: 20756 - DNA, 20 bp, Artificial Sequence
  chemically synthesized
taaaggcagcttaggggttg

SEQ ID NO: 20757 - DNA, 20 bp, Artificial Sequence
  chemically synthesized
gctcctgcccactctctaga

SEQ ID NO: 20758 - DNA, 20 bp, Artificial Sequence
  chemically synthesized
caggaactttgggcatattt

SEQ ID NO: 20759 - DNA, 20 bp, Artificial Sequence
  chemically synthesized
gtgactagaaaaaggacatt

SEQ ID NO: 20760 - DNA, 20 bp, Artificial Sequence
  chemically synthesized
atcttgaggaactcagcctt

SEQ ID NO: 20761 - DNA, 20 bp, Artificial Sequence
  chemically synthesized
cttttgagaagctcctgaat

SEQ ID NO: 20762 - DNA, 20 bp, Artificial Sequence
  chemically synthesized
tattttgctgagaaaaattt

SEQ ID NO: 20763 - DNA, 20 bp, Artificial Sequence
  chemically synthesized
aataaagaaaatcaaattga

SEQ ID NO: 20764 - DNA, 20 bp, Artificial Sequence
  chemically synthesized
taaagacatctgtaaaatta

SEQ ID NO: 20765 - DNA, 20 bp, Artificial Sequence
  chemically synthesized
ggacatagcttattggtgga

SEQ ID NO: 20766 - DNA, 20 bp, Artificial Sequence
  chemically synthesized
attatgtaagaattaaatat

SEQ ID NO: 20767 - DNA, 20 bp, Artificial Sequence
  chemically synthesized
ggaaatgtattcacatccaa

SEQ ID NO: 20768 - DNA, 20 bp, Artificial Sequence
  chemically synthesized
ccatgaacaatggaaacgtg

SEQ ID NO: 20769 - DNA, 20 bp, Artificial Sequence
  chemically synthesized
tagttacctagaggtttggg

SEQ ID NO: 20770 - DNA, 20 bp, Artificial Sequence
  chemically synthesized
gtggcacagggaagaattca

SEQ ID NO: 20771 - DNA, 20 bp, Artificial Sequence
  chemically synthesized
gtgaaacacacgatctatgt

SEQ ID NO: 20772 - DNA, 20 bp, Artificial Sequence
  chemically synthesized
ttcaatgacctacgctgtgg

SEQ ID NO: 20773 - DNA, 20 bp, Artificial Sequence
  chemically synthesized
tttcttttttaatgtcagaa

SEQ ID NO: 20774 - DNA, 20 bp, Artificial Sequence
  chemically synthesized
aaatgtgctttataaatagt

SEQ ID NO: 20775 - DNA, 20 bp, Artificial Sequence
  chemically synthesized
aagtgtgctatataaacagt

SEQ ID NO: 20776 - DNA, 20 bp, Artificial Sequence
  chemically synthesized
tcaaggataaaaaatgtaaa

SEQ ID NO: 20777 - DNA, 20 bp, Artificial Sequence
  chemically synthesized
aacttctttttgatacagta

SEQ ID NO: 20778 - DNA, 20 bp, Artificial Sequence
  chemically synthesized
ttaagaaatatagtagctat

SEQ ID NO: 20779 - DNA, 20 bp, Artificial Sequence
  chemically synthesized
gactgggtaatttataagga

SEQ ID NO: 20780 - DNA, 20 bp, Artificial Sequence
  chemically synthesized
aaagggggaaaagccgctta

SEQ ID NO: 20781 - DNA, 20 bp, Artificial Sequence
  chemically synthesized
cataattatgcctaacatac

SEQ ID NO: 20782 - DNA, 20 bp, Artificial Sequence
  chemically synthesized
accttaattccaggacatgg

SEQ ID NO: 20783 - DNA, 20 bp, Artificial Sequence
  chemically synthesized
cttctgttctggactccact

SEQ ID NO: 20784 - DNA, 20 bp, Artificial Sequence
  chemically synthesized
gcagccaactccagaaaccc

SEQ ID NO: 20785 - DNA, 20 bp, Artificial Sequence
  chemically synthesized
ctcacatgttcacaaggtcc

SEQ ID NO: 20786 - DNA, 20 bp, Artificial Sequence
  chemically synthesized
gtagcaggacaagctgcata

SEQ ID NO: 20787 - DNA, 20 bp, Artificial Sequence
  chemically synthesized
ttggaggcagaaattgggca

SEQ ID NO: 20788 - DNA, 20 bp, Artificial Sequence
  chemically synthesized
taggagatttcttcataatt

SEQ ID NO: 20789 - DNA, 20 bp, Artificial Sequence
  chemically synthesized
catgcacctagaagggactt

SEQ ID NO: 20790 - DNA, 20 bp, Artificial Sequence
  chemically synthesized
actgtgattcagacaaaggc

SEQ ID NO: 20791 - DNA, 20 bp, Artificial Sequence
  chemically synthesized
ttctctccccattcatctgc

SEQ ID NO: 20792 - DNA, 20 bp, Artificial Sequence
  chemically synthesized
cctccaactgttaaaaggaa

SEQ ID NO: 20793 - DNA, 20 bp, Artificial Sequence
  chemically synthesized
tattatcattcaggttagca

SEQ ID NO: 20794 - DNA, 20 bp, Artificial Sequence
  chemically synthesized
taataagggatggaaatgag

SEQ ID NO: 20795 - DNA, 20 bp, Artificial Sequence
  chemically synthesized
catttaggatccactaagcc

SEQ ID NO: 20796 - DNA, 20 bp, Artificial Sequence
  chemically synthesized
aagggacaccaacgaatggt

SEQ ID NO: 20797 - DNA, 20 bp, Artificial Sequence
  chemically synthesized
actgctttgttcaattctgt

SEQ ID NO: 20798 - DNA, 20 bp, Artificial Sequence
  chemically synthesized
tatgttcaaataacagctgc

SEQ ID NO: 20799 - DNA, 20 bp, Artificial Sequence
  chemically synthesized
agtaccttttgataaggaga

SEQ ID NO: 20800 - DNA, 20 bp, Artificial Sequence
  chemically synthesized
tgcttatagatgttcataga

SEQ ID NO: 20801 - DNA, 20 bp, Artificial Sequence
  chemically synthesized
agggaggagaccacccttca

SEQ ID NO: 20802 - DNA, 20 bp, Artificial Sequence
  chemically synthesized
acctggccagttatgttatc

SEQ ID NO: 20803 - DNA, 20 bp, Artificial Sequence
  chemically synthesized
ggacaggaattgctcactct

SEQ ID NO: 20804 - DNA, 20 bp, Artificial Sequence
  chemically synthesized
cttctttaactcggtgtctg

SEQ ID NO: 20805 - DNA, 20 bp, Artificial Sequence
  chemically synthesized
ggtgtctgaggggttttgta

SEQ ID NO: 20806 - DNA, 20 bp, Artificial Sequence
  chemically synthesized
aattaaggagagtatgaaaa

SEQ ID NO: 20807 - DNA, 20 bp, Artificial Sequence
  chemically synthesized
caaatgggggtaaaataata

SEQ ID NO: 20808 - DNA, 20 bp, Artificial Sequence
  chemically synthesized
agggaaagacaggctctaaa

SEQ ID NO: 20809 - DNA, 20 bp, Artificial Sequence
  chemically synthesized
aatgggacttaattaaacta

SEQ ID NO: 20810 - DNA, 20 bp, Artificial Sequence
  chemically synthesized
atggttaatactgagtgtca

SEQ ID NO: 20811 - DNA, 20 bp, Artificial Sequence
  chemically synthesized
gtctgtgagggtgttaccaa

SEQ ID NO: 20812 - DNA, 20 bp, Artificial Sequence
  chemically synthesized
aggcagaaaaatgtgaaaag

SEQ ID NO: 20813 - DNA, 20 bp, Artificial Sequence
  chemically synthesized
gaaaaatgtgaaaaggctag

SEQ ID NO: 20814 - DNA, 20 bp, Artificial Sequence
  chemically synthesized
agcctacatttttctcccat

SEQ ID NO: 20815 - DNA, 20 bp, Artificial Sequence
  chemically synthesized
gaacattgaactccaggttc

SEQ ID NO: 20816 - DNA, 20 bp, Artificial Sequence
  chemically synthesized
tcttcagctttgggactccg

SEQ ID NO: 20817 - DNA, 20 bp, Artificial Sequence
  chemically synthesized
tgttcctcagctggcagatg

SEQ ID NO: 20818 - DNA, 20 bp, Artificial Sequence
  chemically synthesized
agatatatatctcctattaa

SEQ ID NO: 20819 - DNA, 20 bp, Artificial Sequence
  chemically synthesized
gtttctctgtagaaccctaa

SEQ ID NO: 20820 - DNA, 20 bp, Artificial Sequence
  chemically synthesized
attaaggatggagttctttc

SEQ ID NO: 20821 - DNA, 20 bp, Artificial Sequence
  chemically synthesized
tggagttctttcattggttt

SEQ ID NO: 20822 - DNA, 20 bp, Artificial Sequence
  chemically synthesized
gttttggggtttctggagtt

SEQ ID NO: 20823 - DNA, 20 bp, Artificial Sequence
  chemically synthesized
tttctggagttggctgctta

SEQ ID NO: 20824 - DNA, 20 bp, Artificial Sequence
  chemically synthesized
cactgataatccttggcatc

SEQ ID NO: 20825 - DNA, 20 bp, Artificial Sequence
  chemically synthesized
aaaataaatgcatttgacac

SEQ ID NO: 20826 - DNA, 20 bp, Artificial Sequence
  chemically synthesized
tgcatttgacactcttgatt

SEQ ID NO: 20827 - DNA, 20 bp, Artificial Sequence
  chemically synthesized
ggaacatagtgaagttggtt

SEQ ID NO: 20828 - DNA, 20 bp, Artificial Sequence
  chemically synthesized
actcaggagtatatcaactc

SEQ ID NO: 20829 - DNA, 20 bp, Artificial Sequence
  chemically synthesized
gagcaagaagtagcaaacac

SEQ ID NO: 20830 - DNA, 20 bp, Artificial Sequence
  chemically synthesized
ggacagaggatgggaaataa

SEQ ID NO: 20831 - DNA, 20 bp, Artificial Sequence
  chemically synthesized
agtaaaatttataggggtcc

SEQ ID NO: 20832 - DNA, 20 bp, Artificial Sequence
  chemically synthesized
cacaacgcctagtgggccta

SEQ ID NO: 20833 - DNA, 20 bp, Artificial Sequence
  chemically synthesized
ggattttggaggcaacatat

SEQ ID NO: 20834 - DNA, 20 bp, Artificial Sequence
  chemically synthesized
atcgagtgatccaaaaggct

SEQ ID NO: 20835 - DNA, 20 bp, Artificial Sequence
  chemically synthesized
atatgacctagcagatccaa

SEQ ID NO: 20836 - DNA, 20 bp, Artificial Sequence
  chemically synthesized
gtgtcagtgccagataggga

SEQ ID NO: 20837 - DNA, 20 bp, Artificial Sequence
  chemically synthesized
ctgaatcacagcggaggcct

SEQ ID NO: 20838 - DNA, 20 bp, Artificial Sequence
  chemically synthesized
agaaagctcttggcctgtta

SEQ ID NO: 20839 - DNA, 20 bp, Artificial Sequence
  chemically synthesized
tgaactgcctatcatgaact

SEQ ID NO: 20840 - DNA, 20 bp, Artificial Sequence
  chemically synthesized
agcaaatggaagtggtatat

SEQ ID NO: 20841 - DNA, 20 bp, Artificial Sequence
  chemically synthesized
tggaagtggtatatatgcga

SEQ ID NO: 20842 - DNA, 20 bp, Artificial Sequence
  chemically synthesized
catggtctccactcctgaca

SEQ ID NO: 20843 - DNA, 20 bp, Artificial Sequence
  chemically synthesized
tttgcacagaaggagaaatg

SEQ ID NO: 20844 - DNA, 20 bp, Artificial Sequence
  chemically synthesized
agaaggagaaatggccagat

SEQ ID NO: 20845 - DNA, 20 bp, Artificial Sequence
  chemically synthesized
cttattcatgggctgtagcc

SEQ ID NO: 20846 - DNA, 20 bp, Artificial Sequence
  chemically synthesized
agaggtatgtggatggacct

SEQ ID NO: 20847 - DNA, 20 bp, Artificial Sequence
  chemically synthesized
caatgggtgacctcagcaga

SEQ ID NO: 20848 - DNA, 20 bp, Artificial Sequence
  chemically synthesized
cacagttgcagggatggaag

SEQ ID NO: 20849 - DNA, 20 bp, Artificial Sequence
  chemically synthesized
aaagctgacctggccacagc

SEQ ID NO: 20850 - DNA, 20 bp, Artificial Sequence
  chemically synthesized
cagccagctacctggtggca

SEQ ID NO: 20851 - DNA, 20 bp, Artificial Sequence
  chemically synthesized
tcttccatcatggaaagggc

SEQ ID NO: 20852 - DNA, 20 bp, Artificial Sequence
  chemically synthesized
aatagacacttactctggat

SEQ ID NO: 20853 - DNA, 20 bp, Artificial Sequence
  chemically synthesized
gggtttcccaatcctgaact

SEQ ID NO: 20854 - DNA, 20 bp, Artificial Sequence
  chemically synthesized
tgtcatggtattccacacag

SEQ ID NO: 20855 - DNA, 20 bp, Artificial Sequence
  chemically synthesized
catgatccctatcatcctga

SEQ ID NO: 20856 - DNA, 20 bp, Artificial Sequence
  chemically synthesized
ttttgaatggccttttgaag

SEQ ID NO: 20857 - DNA, 20 bp, Artificial Sequence
  chemically synthesized
aatcagtgtccaatatatgg

SEQ ID NO: 20858 - DNA, 20 bp, Artificial Sequence
  chemically synthesized
tggtactgtttctcccatag

SEQ ID NO: 20859 - DNA, 20 bp, Artificial Sequence
  chemically synthesized
tagtgttccactagcaaaat

SEQ ID NO: 20860 - DNA, 20 bp, Artificial Sequence
  chemically synthesized
ttcccatggcattatgttct

SEQ ID NO: 20861 - DNA, 20 bp, Artificial Sequence
  chemically synthesized
actgccgccaggtgacacaa

SEQ ID NO: 20862 - DNA, 20 bp, Artificial Sequence
  chemically synthesized
tgattccattaaactgcaaa

SEQ ID NO: 20863 - DNA, 20 bp, Artificial Sequence
  chemically synthesized
gagagttacagtgttggctg

SEQ ID NO: 20864 - DNA, 20 bp, Artificial Sequence
  chemically synthesized
ggagatccattagggtgtct

SEQ ID NO: 20865 - DNA, 20 bp, Artificial Sequence
  chemically synthesized
ttccaggcaggactacaaat

SEQ ID NO: 20866 - DNA, 20 bp, Artificial Sequence
  chemically synthesized
aaaaaagacaagacctgctg

SEQ ID NO: 20867 - DNA, 20 bp, Artificial Sequence
  chemically synthesized
tttttcctttatcatgtgac

SEQ ID NO: 20868 - DNA, 20 bp, Artificial Sequence
  chemically synthesized
atatcagcatttaagtattg

SEQ ID NO: 20869 - DNA, 20 bp, Artificial Sequence
  chemically synthesized
ttatgtaatagcatttgcaa

SEQ ID NO: 20870 - DNA, 20 bp, Artificial Sequence
  chemically synthesized
gcattttcaattgcacgaag

SEQ ID NO: 20871 - DNA, 20 bp, Artificial Sequence
  chemically synthesized
atggttaatactgagtgtca

SEQ ID NO: 20872 - DNA, 20 bp, Artificial Sequence
  chemically synthesized
taatactgagtgtcaacttg

SEQ ID NO: 20873 - DNA, 20 bp, Artificial Sequence
  chemically synthesized
gtctgtgagggtattgccaa

SEQ ID NO: 20874 - DNA, 20 bp, Artificial Sequence
  chemically synthesized
aaaacatgtgaaaatcctgg

SEQ ID NO: 20875 - DNA, 20 bp, Artificial Sequence
  chemically synthesized
ctacatctttctcccatgct

SEQ ID NO: 20876 - DNA, 20 bp, Artificial Sequence
  chemically synthesized
aaacattggactccaagtcc

SEQ ID NO: 20877 - DNA, 20 bp, Artificial Sequence
  chemically synthesized
ccttcagctttgggacttgg

SEQ ID NO: 20878 - DNA, 20 bp, Artificial Sequence
  chemically synthesized
ttggactggcttccttgctc

SEQ ID NO: 20879 - DNA, 20 bp, Artificial Sequence
  chemically synthesized
agatggcctattgtgggacc

SEQ ID NO: 20880 - DNA, 20 bp, Artificial Sequence
  chemically synthesized
gtgaggatgtggagacaaga

SEQ ID NO: 20881 - DNA, 20 bp, Artificial Sequence
  chemically synthesized
aaactttatggaagacagca

SEQ ID NO: 20882 - DNA, 20 bp, Artificial Sequence
  chemically synthesized
caacctaaatgtctaccaat

SEQ ID NO: 20883 - DNA, 20 bp, Artificial Sequence
  chemically synthesized
tatggtgaggactgaaaaac

SEQ ID NO: 20884 - DNA, 20 bp, Artificial Sequence
  chemically synthesized
aacatacatatgtaaggaac

SEQ ID NO: 20885 - DNA, 20 bp, Artificial Sequence
  chemically synthesized
aacccgagcttgtaccctga

SEQ ID NO: 20886 - DNA, 20 bp, Artificial Sequence
  chemically synthesized
ataatcctcacgtgttgtgg

SEQ ID NO: 20887 - DNA, 20 bp, Artificial Sequence
  chemically synthesized
agtgagttcttacaagatct

SEQ ID NO: 20888 - DNA, 20 bp, Artificial Sequence
  chemically synthesized
caagatctgatggttttata

SEQ ID NO: 20889 - DNA, 20 bp, Artificial Sequence
  chemically synthesized
ttataagcggcttttccccc

SEQ ID NO: 20890 - DNA, 20 bp, Artificial Sequence
  chemically synthesized
ctgctgccatgtgaagaagg

SEQ ID NO: 20891 - DNA, 20 bp, Artificial Sequence
  chemically synthesized
tgccatgtgaagaaggacat

SEQ ID NO: 20892 - DNA, 20 bp, Artificial Sequence
  chemically synthesized
catgtttgtttcttcttctg

SEQ ID NO: 20893 - DNA, 20 bp, Artificial Sequence
  chemically synthesized
tttcttcttctgccatgatt

SEQ ID NO: 20894 - DNA, 20 bp, Artificial Sequence
  chemically synthesized
tgtggaactgtgagacaatt

SEQ ID NO: 20895 - DNA, 20 bp, Artificial Sequence
  chemically synthesized
aaaaatataaaataaattag

SEQ ID NO: 20896 - DNA, 20 bp, Artificial Sequence
  chemically synthesized
gagtgtgcaaggaaagagta

SEQ ID NO: 20897 - DNA, 20 bp, Artificial Sequence
  chemically synthesized
gtgagaatacacaaataatc

SEQ ID NO: 20898 - DNA, 20 bp, Artificial Sequence
  chemically synthesized
atattccatttcatcagact

SEQ ID NO: 20899 - DNA, 20 bp, Artificial Sequence
  chemically synthesized
gatgctattatatggtacca

SEQ ID NO: 20900 - DNA, 20 bp, Artificial Sequence
  chemically synthesized
taagaatttcatctttaagg

SEQ ID NO: 20901 - DNA, 20 bp, Artificial Sequence
  chemically synthesized
agttttttactgtatcaaaa

SEQ ID NO: 20902 - DNA, 20 bp, Artificial Sequence
  chemically synthesized
tctagactggacaagaacag

SEQ ID NO: 20903 - DNA, 20 bp, Artificial Sequence
  chemically synthesized
agcaacatatttaaatatat

SEQ ID NO: 20904 - DNA, 20 bp, Artificial Sequence
  chemically synthesized
cttttccaggagaatatacc

SEQ ID NO: 20905 - DNA, 20 bp, Artificial Sequence
  chemically synthesized
tctgatggtacacatttatt

SEQ ID NO: 20906 - DNA, 20 bp, Artificial Sequence
  chemically synthesized
actcagagatcttaaaacat

SEQ ID NO: 20907 - DNA, 20 bp, Artificial Sequence
  chemically synthesized
atcttaaaacatccttgttt

SEQ ID NO: 20908 - DNA, 20 bp, Artificial Sequence
  chemically synthesized
tgaagaacataagggggaaa

SEQ ID NO: 20909 - DNA, 20 bp, Artificial Sequence
  chemically synthesized
gattctttatttgaagaaac

SEQ ID NO: 20910 - DNA, 20 bp, Artificial Sequence
  chemically synthesized
tttatttgaagaaacaaatg

SEQ ID NO: 20911 - DNA, 20 bp, Artificial Sequence
  chemically synthesized
tagtcccccatatagcctta

SEQ ID NO: 20912 - DNA, 20 bp, Artificial Sequence
  chemically synthesized
atagccttagagtgtttaaa

SEQ ID NO: 20913 - DNA, 20 bp, Artificial Sequence
  chemically synthesized
gtctattagaaataaaaaca

SEQ ID NO: 20914 - DNA, 20 bp, Artificial Sequence
  chemically synthesized
gcttaaaaaatttcaaggga

SEQ ID NO: 20915 - DNA, 20 bp, Artificial Sequence
  chemically synthesized
aaatttcaagggaaggggct

SEQ ID NO: 20916 - DNA, 20 bp, Artificial Sequence
  chemically synthesized
ctgaggtcaggaacacccag

SEQ ID NO: 20917 - DNA, 20 bp, Artificial Sequence
  chemically synthesized
ccaccaccaacaccagtgca

SEQ ID NO: 20918 - DNA, 20 bp, Artificial Sequence
  chemically synthesized
aaacagaaattctgtaactg

SEQ ID NO: 20919 - DNA, 20 bp, Artificial Sequence
  chemically synthesized
agtgaacaaatattcaaatt

SEQ ID NO: 20920 - DNA, 20 bp, Artificial Sequence
  chemically synthesized
tcacttataagggaacttcc

SEQ ID NO: 20921 - DNA, 20 bp, Artificial Sequence
  chemically synthesized
aagggaacttccacaagatt

SEQ ID NO: 20922 - DNA, 20 bp, Artificial Sequence
  chemically synthesized
cacaagattaacagattaac

SEQ ID NO: 20923 - DNA, 20 bp, Artificial Sequence
  chemically synthesized
aaggaattcactatcactag

SEQ ID NO: 20924 - DNA, 20 bp, Artificial Sequence
  chemically synthesized
caataatagccttgcatgta

SEQ ID NO: 20925 - DNA, 20 bp, Artificial Sequence
  chemically synthesized
tgaaagatatagactggcta

SEQ ID NO: 20926 - DNA, 20 bp, Artificial Sequence
  chemically synthesized
gaatccaatacaataatagt

SEQ ID NO: 20927 - DNA, 20 bp, Artificial Sequence
  chemically synthesized
cagaaaattaacaaagaaac

SEQ ID NO: 20928 - DNA, 20 bp, Artificial Sequence
  chemically synthesized
agcaaaagcagtgctaagag

SEQ ID NO: 20929 - DNA, 20 bp, Artificial Sequence
  chemically synthesized
acacttaaattaaaaacata

SEQ ID NO: 20930 - DNA, 20 bp, Artificial Sequence
  chemically synthesized
aaatagagaaaaacaacaac

SEQ ID NO: 20931 - DNA, 20 bp, Artificial Sequence
  chemically synthesized
aaccgataccacagaaatag

SEQ ID NO: 20932 - DNA, 20 bp, Artificial Sequence
  chemically synthesized
ttctggacacataccaccta

SEQ ID NO: 20933 - DNA, 20 bp, Artificial Sequence
  chemically synthesized
aaaagaaaatttcaagacca

SEQ ID NO: 20934 - DNA, 20 bp, Artificial Sequence
  chemically synthesized
attctctgaggccagtatta

SEQ ID NO: 20935 - DNA, 20 bp, Artificial Sequence
  chemically synthesized
agataatacaccatgatcaa

SEQ ID NO: 20936 - DNA, 20 bp, Artificial Sequence
  chemically synthesized
ataatactggaagtcctagc

SEQ ID NO: 20937 - DNA, 20 bp, Artificial Sequence
  chemically synthesized
actgtccatctttccagatg

SEQ ID NO: 20938 - DNA, 20 bp, Artificial Sequence
  chemically synthesized
aaatcagcatatgaaacaag

SEQ ID NO: 20939 - DNA, 20 bp, Artificial Sequence
  chemically synthesized
ccatactacccaaagcaatc

SEQ ID NO: 20940 - DNA, 20 bp, Artificial Sequence
  chemically synthesized
aatgctagaggtatcatact

SEQ ID NO: 20941 - DNA, 20 bp, Artificial Sequence
  chemically synthesized
gcatccacatatttatagcc

SEQ ID NO: 20942 - DNA, 20 bp, Artificial Sequence
  chemically synthesized
gaataaaactggactgctga

SEQ ID NO: 20943 - DNA, 20 bp, Artificial Sequence
  chemically synthesized
ctggactgctgatatggttt

SEQ ID NO: 20944 - DNA, 20 bp, Artificial Sequence
  chemically synthesized
cttggcggatgggaggtagg

SEQ ID NO: 20945 - DNA, 20 bp, Artificial Sequence
  chemically synthesized
cccacagaccctctgaagga

SEQ ID NO: 20946 - DNA, 20 bp, Artificial Sequence
  chemically synthesized
tcccactggagaaactgaag

SEQ ID NO: 20947 - DNA, 20 bp, Artificial Sequence
  chemically synthesized
actgaaggtctgtttgtggg

SEQ ID NO: 20948 - DNA, 20 bp, Artificial Sequence
  chemically synthesized
cagaaagtcaacaaaaaaat

SEQ ID NO: 20949 - DNA, 20 bp, Artificial Sequence
  chemically synthesized
taacagaccaataacaagca

SEQ ID NO: 20950 - DNA, 20 bp, Artificial Sequence
  chemically synthesized
caaaaaaaagttcaggacca

SEQ ID NO: 20951 - DNA, 20 bp, Artificial Sequence
  chemically synthesized
ttccatgccagggatgcagg

SEQ ID NO: 20952 - DNA, 20 bp, Artificial Sequence
  chemically synthesized
taagtgtgatacaccacata

SEQ ID NO: 20953 - DNA, 20 bp, Artificial Sequence
  chemically synthesized
caacaaaatccagcatacat

SEQ ID NO: 20954 - DNA, 20 bp, Artificial Sequence
  chemically synthesized
taaagaggaagtcaaactgt

SEQ ID NO: 20955 - DNA, 20 bp, Artificial Sequence
  chemically synthesized
gaactgataaaataattcag

SEQ ID NO: 20956 - DNA, 20 bp, Artificial Sequence
  chemically synthesized
catataaaacgtactctcaa

SEQ ID NO: 20957 - DNA, 20 bp, Artificial Sequence
  chemically synthesized
ataagggagacacttcaaga

SEQ ID NO: 20958 - DNA, 20 bp, Artificial Sequence
  chemically synthesized
cttcaagacatggctttggg

SEQ ID NO: 20959 - DNA, 20 bp, Artificial Sequence
  chemically synthesized
tcttatgccagttagaatca

SEQ ID NO: 20960 - DNA, 20 bp, Artificial Sequence
  chemically synthesized
agccactatggaaaacaata

SEQ ID NO: 20961 - DNA, 20 bp, Artificial Sequence
  chemically synthesized
ataaacagatactggtacca

SEQ ID NO: 20962 - DNA, 20 bp, Artificial Sequence
  chemically synthesized
gtaccacactgtttattgca

SEQ ID NO: 20963 - DNA, 20 bp, Artificial Sequence
  chemically synthesized
tgatgttcaatagcaaagta

SEQ ID NO: 20964 - DNA, 20 bp, Artificial Sequence
  chemically synthesized
tcgatctcatattggttgag

SEQ ID NO: 20965 - DNA, 20 bp, Artificial Sequence
  chemically synthesized
ccctgtactgtcttgctgtg

SEQ ID NO: 20966 - DNA, 20 bp, Artificial Sequence
  chemically synthesized
tgtcctccccatatttttac

SEQ ID NO: 20967 - DNA, 20 bp, Artificial Sequence
  chemically synthesized
catatttttacctcggtttt

SEQ ID NO: 20968 - DNA, 20 bp, Artificial Sequence
  chemically synthesized
ttatatagcacactttgtgc

SEQ ID NO: 20969 - DNA, 20 bp, Artificial Sequence
  chemically synthesized
cactttgtgctatagtttac

SEQ ID NO: 20970 - DNA, 20 bp, Artificial Sequence
  chemically synthesized
catatttgaggtataaacca

SEQ ID NO: 20971 - DNA, 20 bp, Artificial Sequence
  chemically synthesized
tatttttaaatctgcaaata

SEQ ID NO: 20972 - DNA, 20 bp, Artificial Sequence
  chemically synthesized
acttaatatcattaatgaat

SEQ ID NO: 20973 - DNA, 20 bp, Artificial Sequence
  chemically synthesized
ttcctggaacaacatggggg

SEQ ID NO: 20974 - DNA, 20 bp, Artificial Sequence
  chemically synthesized
gagaaatttcactattttgt

SEQ ID NO: 20975 - DNA, 20 bp, Artificial Sequence
  chemically synthesized
aggcagcaggtctggtagga

SEQ ID NO: 20976 - DNA, 20 bp, Artificial Sequence
  chemically synthesized
tgaaaaggaagtgagtagac

SEQ ID NO: 20977 - DNA, 20 bp, Artificial Sequence
  chemically synthesized
cttgaagctgtgcaaccaag

SEQ ID NO: 20978 - DNA, 20 bp, Artificial Sequence
  chemically synthesized
gcatagtttttacatagatc

SEQ ID NO: 20979 - DNA, 20 bp, Artificial Sequence
  chemically synthesized
tgtgtttcacatggtgtgat

SEQ ID NO: 20980 - DNA, 20 bp, Artificial Sequence
  chemically synthesized
agatgccattgacatggccc

SEQ ID NO: 20981 - DNA, 20 bp, Artificial Sequence
  chemically synthesized
aatcctaattactatgcatc

SEQ ID NO: 20982 - DNA, 20 bp, Artificial Sequence
  chemically synthesized
ttttcctattatttctcttt

SEQ ID NO: 20983 - DNA, 20 bp, Artificial Sequence
  chemically synthesized
gaaataagctaatacctaca

SEQ ID NO: 20984 - DNA, 20 bp, Artificial Sequence
  chemically synthesized
taaatgctaggcacagttct

SEQ ID NO: 20985 - DNA, 20 bp, Artificial Sequence
  chemically synthesized
attttcacaacattattaca

SEQ ID NO: 20986 - DNA, 20 bp, Artificial Sequence
  chemically synthesized
agcaacaaattgatggatct

SEQ ID NO: 20987 - DNA, 20 bp, Artificial Sequence
  chemically synthesized
aaattgatggatctttttgc

SEQ ID NO: 20988 - DNA, 20 bp, Artificial Sequence
  chemically synthesized
tgatggatctttttgctttt

SEQ ID NO: 20989 - DNA, 20 bp, Artificial Sequence
  chemically synthesized
ggatctttttgcttttgctt

SEQ ID NO: 20990 - DNA, 20 bp, Artificial Sequence
  chemically synthesized
actgaagcctcactagaacg

SEQ ID NO: 20991 - DNA, 20 bp, Artificial Sequence
  chemically synthesized
cgcctggattcaattgatcc

SEQ ID NO: 20992 - DNA, 20 bp, Artificial Sequence
  chemically synthesized
cacctcagccttgaaaagtg

SEQ ID NO: 20993 - DNA, 20 bp, Artificial Sequence
  chemically synthesized
aatttttagatataatttct

SEQ ID NO: 20994 - DNA, 20 bp, Artificial Sequence
  chemically synthesized
tcttccataaccactttgac

SEQ ID NO: 20995 - DNA, 20 bp, Artificial Sequence
  chemically synthesized
taaattatgtccagcaatac

SEQ ID NO: 20996 - DNA, 20 bp, Artificial Sequence
  chemically synthesized
cgttggcttaggcaaaaaca

SEQ ID NO: 20997 - DNA, 20 bp, Artificial Sequence
  chemically synthesized
ccttaacatgttaatttctc

SEQ ID NO: 20998 - DNA, 20 bp, Artificial Sequence
  chemically synthesized
tgagcaagtgtgtgcagaag

SEQ ID NO: 20999 - DNA, 20 bp, Artificial Sequence
  chemically synthesized
tcctctccctcaactggtaa

SEQ ID NO: 21000 - DNA, 20 bp, Artificial Sequence
  chemically synthesized
cttaaggctattaactcccc

SEQ ID NO: 21001 - DNA, 20 bp, Artificial Sequence
  chemically synthesized
atatatagttctctcacata

SEQ ID NO: 21002 - DNA, 20 bp, Artificial Sequence
  chemically synthesized
ctcaaacatctcatcattag

SEQ ID NO: 21003 - DNA, 20 bp, Artificial Sequence
  chemically synthesized
tctacaaatttgtcaattct

SEQ ID NO: 21004 - DNA, 20 bp, Artificial Sequence
  chemically synthesized
gaatccttactgaataataa

SEQ ID NO: 21005 - DNA, 20 bp, Artificial Sequence
  chemically synthesized
aactgtgactctctcatctg

SEQ ID NO: 21006 - DNA, 20 bp, Artificial Sequence
  chemically synthesized
tctctcatctgttatgtttt

SEQ ID NO: 21007 - DNA, 20 bp, Artificial Sequence
  chemically synthesized
atgggcaaaattctggcagc

SEQ ID NO: 21008 - DNA, 20 bp, Artificial Sequence
  chemically synthesized
gattcttctcctaagaaacc

SEQ ID NO: 21009 - DNA, 20 bp, Artificial Sequence
  chemically synthesized
tcttggatgtgaatacattt

SEQ ID NO: 21010 - DNA, 20 bp, Artificial Sequence
  chemically synthesized
tattcatgaagaaactgtta

SEQ ID NO: 21011 - DNA, 20 bp, Artificial Sequence
  chemically synthesized
gtttaaggggttctttttca

SEQ ID NO: 21012 - DNA, 20 bp, Artificial Sequence
  chemically synthesized
aggacatttcctttgaaaac

SEQ ID NO: 21013 - DNA, 20 bp, Artificial Sequence
  chemically synthesized
atcctggtcctaactctgcc

SEQ ID NO: 21014 - DNA, 20 bp, Artificial Sequence
  chemically synthesized
ttgctctatgaactggagga

SEQ ID NO: 21015 - DNA, 20 bp, Artificial Sequence
  chemically synthesized
gatagaaaataagtattaaa

SEQ ID NO: 21016 - DNA, 20 bp, Artificial Sequence
  chemically synthesized
cctgagatcaacacacatgc

SEQ ID NO: 21017 - DNA, 20 bp, Artificial Sequence
  chemically synthesized
ttataagatccataaaataa

SEQ ID NO: 21018 - DNA, 20 bp, Artificial Sequence
  chemically synthesized
cccaggtaacagtgctccat

SEQ ID NO: 21019 - DNA, 20 bp, Artificial Sequence
  chemically synthesized
acttgtgcagagatcttctg

SEQ ID NO: 21020 - DNA, 20 bp, Artificial Sequence
  chemically synthesized
cccagtgctaacaagtccct

SEQ ID NO: 21021 - DNA, 20 bp, Artificial Sequence
  chemically synthesized
cttttatttcaaggcatact

SEQ ID NO: 21022 - DNA, 20 bp, Artificial Sequence
  chemically synthesized
aatacttcacttctctgtaa

SEQ ID NO: 21023 - DNA, 20 bp, Artificial Sequence
  chemically synthesized
tgtaataaggtttctgtcct

SEQ ID NO: 21024 - DNA, 20 bp, Artificial Sequence
  chemically synthesized
ctaaactacagagaataaga

SEQ ID NO: 21025 - DNA, 20 bp, Artificial Sequence
  chemically synthesized
taggcaaaattgacttttaa

SEQ ID NO: 21026 - DNA, 20 bp, Artificial Sequence
  chemically synthesized
aacagttagtataaggtgaa

SEQ ID NO: 21027 - DNA, 20 bp, Artificial Sequence
  chemically synthesized
catatataatgcatttaatt

SEQ ID NO: 21028 - DNA, 20 bp, Artificial Sequence
  chemically synthesized
taattttgagattatgctgg

SEQ ID NO: 21029 - DNA, 20 bp, Artificial Sequence
  chemically synthesized
ctggttattatttcagatcc

SEQ ID NO: 21030 - DNA, 20 bp, Artificial Sequence
  chemically synthesized
caacacatgacataatttca

SEQ ID NO: 21031 - DNA, 20 bp, Artificial Sequence
  chemically synthesized
tgccatttacccagcaatca

SEQ ID NO: 21032 - DNA, 20 bp, Artificial Sequence
  chemically synthesized
atttacccagcaatcagttg

SEQ ID NO: 21033 - DNA, 20 bp, Artificial Sequence
  chemically synthesized
gagagtataaacccacaagg

SEQ ID NO: 21034 - DNA, 20 bp, Artificial Sequence
  chemically synthesized
gaggttatacctcactcgca

SEQ ID NO: 21035 - DNA, 20 bp, Artificial Sequence
  chemically synthesized
actcgcaaattgttttatca

SEQ ID NO: 21036 - DNA, 20 bp, Artificial Sequence
  chemically synthesized
ttactaacagaatgtagagt

SEQ ID NO: 21037 - DNA, 20 bp, Artificial Sequence
  chemically synthesized
atatacatcttcctaaaata

SEQ ID NO: 21038 - DNA, 20 bp, Artificial Sequence
  chemically synthesized
ttatttctatgttgtcataa

SEQ ID NO: 21039 - DNA, 20 bp, Artificial Sequence
  chemically synthesized
aaatgtagcctaaatatata

SEQ ID NO: 21040 - DNA, 20 bp, Artificial Sequence
  chemically synthesized
cctaaatatatattccgttt

SEQ ID NO: 21041 - DNA, 20 bp, Artificial Sequence
  chemically synthesized
cctccgagactcctttgaat

SEQ ID NO: 21042 - DNA, 20 bp, Artificial Sequence
  chemically synthesized
agttagagttggtagagtta

SEQ ID NO: 21043 - DNA, 20 bp, Artificial Sequence
  chemically synthesized
tggtagagttaccaggcttt

SEQ ID NO: 21044 - DNA, 20 bp, Artificial Sequence
  chemically synthesized
aactagtagcatgaaatctt

SEQ ID NO: 21045 - DNA, 20 bp, Artificial Sequence
  chemically synthesized
aggaattctgtgggaagcac

SEQ ID NO: 21046 - DNA, 20 bp, Artificial Sequence
  chemically synthesized
agcacataagatttcatgct

SEQ ID NO: 21047 - DNA, 20 bp, Artificial Sequence
  chemically synthesized
tgcctgtaagttctcttctc

SEQ ID NO: 21048 - DNA, 20 bp, Artificial Sequence
  chemically synthesized
gtctcggaggactgtaagaa

SEQ ID NO: 21049 - DNA, 20 bp, Artificial Sequence
  chemically synthesized
cctctctgtaacatccctgg

SEQ ID NO: 21050 - DNA, 20 bp, Artificial Sequence
  chemically synthesized
gaggagttactgctctttga

SEQ ID NO: 21051 - DNA, 20 bp, Artificial Sequence
  chemically synthesized
ttgcttgggaagtgaccaat

SEQ ID NO: 21052 - DNA, 20 bp, Artificial Sequence
  chemically synthesized
aggtgactgaggaatgtaga

SEQ ID NO: 21053 - DNA, 20 bp, Artificial Sequence
  chemically synthesized
aaaaagttaatatttacatt

SEQ ID NO: 21054 - DNA, 20 bp, Artificial Sequence
  chemically synthesized
tttattttaggaagatgtat

SEQ ID NO: 21055 - DNA, 20 bp, Artificial Sequence
  chemically synthesized
attctgttagtaattatatg

SEQ ID NO: 21056 - DNA, 20 bp, Artificial Sequence
  chemically synthesized
taattatatgaaatgcttaa

SEQ ID NO: 21057 - DNA, 20 bp, Artificial Sequence
  chemically synthesized
aagaatgtttcatattcaca

SEQ ID NO: 21058 - DNA, 20 bp, Artificial Sequence
  chemically synthesized
attcacaattagcttggaat

SEQ ID NO: 21059 - DNA, 20 bp, Artificial Sequence
  chemically synthesized
tggaattaatgttttaattc

SEQ ID NO: 21060 - DNA, 20 bp, Artificial Sequence
  chemically synthesized
agtaatttttttcttcaatg

SEQ ID NO: 21061 - DNA, 20 bp, Artificial Sequence
  chemically synthesized
aaggtagagaaccacaatgt

SEQ ID NO: 21062 - DNA, 20 bp, Artificial Sequence
  chemically synthesized
aaattataaaacaattcctt

SEQ ID NO: 21063 - DNA, 20 bp, Artificial Sequence
  chemically synthesized
ttccttgtgggtttatactc

SEQ ID NO: 21064 - DNA, 20 bp, Artificial Sequence
  chemically synthesized
aacattagcaaagaaaaagt

SEQ ID NO: 21065 - DNA, 20 bp, Artificial Sequence
  chemically synthesized
agatcttgaagaatcaagcc

SEQ ID NO: 21066 - DNA, 20 bp, Artificial Sequence
  chemically synthesized
gtaaatggcagtgatgactt

SEQ ID NO: 21067 - DNA, 20 bp, Artificial Sequence
  chemically synthesized
taacacatttatttttcatt

SEQ ID NO: 21068 - DNA, 20 bp, Artificial Sequence
  chemically synthesized
caaagcacggtcttattctc

SEQ ID NO: 21069 - DNA, 20 bp, Artificial Sequence
  chemically synthesized
aagtgaagtattttatgtgt

SEQ ID NO: 21070 - DNA, 20 bp, Artificial Sequence
  chemically synthesized
attttatgtgtacctgtttc

SEQ ID NO: 21071 - DNA, 20 bp, Artificial Sequence
  chemically synthesized
atctttatcctgaaatgagc

SEQ ID NO: 21072 - DNA, 20 bp, Artificial Sequence
  chemically synthesized
ctagtcacaaatttttccag

SEQ ID NO: 21073 - DNA, 20 bp, Artificial Sequence
  chemically synthesized
cccggagtatgccttgaaat

SEQ ID NO: 21074 - DNA, 20 bp, Artificial Sequence
  chemically synthesized
agtgggcaggagctcaagga

SEQ ID NO: 21075 - DNA, 20 bp, Artificial Sequence
  chemically synthesized
ctgcacctgagcagagcccc

SEQ ID NO: 21076 - DNA, 20 bp, Artificial Sequence
  chemically synthesized
ctggtacatagaaaatgctc

SEQ ID NO: 21077 - DNA, 20 bp, Artificial Sequence
  chemically synthesized
atggatttttttttgaaaaa

SEQ ID NO: 21078 - DNA, 20 bp, Artificial Sequence
  chemically synthesized
ttccctttcaaggggaaggg

SEQ ID NO: 21079 - DNA, 20 bp, Artificial Sequence
  chemically synthesized
tttgtggagaggtccccaca

SEQ ID NO: 21080 - DNA, 20 bp, Artificial Sequence
  chemically synthesized
ttaatattatcatagcctgg

SEQ ID NO: 21081 - DNA, 20 bp, Artificial Sequence
  chemically synthesized
ttatcatagcctggtatggt

SEQ ID NO: 21082 - DNA, 20 bp, Artificial Sequence
  chemically synthesized
ttcatatagatggataatta

SEQ ID NO: 21083 - DNA, 20 bp, Artificial Sequence
  chemically synthesized
tcctaataatacattgccac

SEQ ID NO: 21084 - DNA, 20 bp, Artificial Sequence
  chemically synthesized
cactatagtttctttaaatt

SEQ ID NO: 21085 - DNA, 20 bp, Artificial Sequence
  chemically synthesized
ctcctccagttcatagagca

SEQ ID NO: 21086 - DNA, 20 bp, Artificial Sequence
  chemically synthesized
agcaaatggcagagttagga

SEQ ID NO: 21087 - DNA, 20 bp, Artificial Sequence
  chemically synthesized
taagaattaaatattaaaac

SEQ ID NO: 21088 - DNA, 20 bp, Artificial Sequence
  chemically synthesized
cagtacttgcagtcaaaggt

SEQ ID NO: 21089 - DNA, 20 bp, Artificial Sequence
  chemically synthesized
aagaaccccttaaactgaat

SEQ ID NO: 21090 - DNA, 20 bp, Artificial Sequence
  chemically synthesized
tatactctccagttatctta

SEQ ID NO: 21091 - DNA, 20 bp, Artificial Sequence
  chemically synthesized
tattcacatccaagaaaaca

SEQ ID NO: 21092 - DNA, 20 bp, Artificial Sequence
  chemically synthesized
taacagatgagagagtcaca

SEQ ID NO: 21093 - DNA, 20 bp, Artificial Sequence
  chemically synthesized
ttaatattaaccttgaaatt

SEQ ID NO: 21094 - DNA, 20 bp, Artificial Sequence
  chemically synthesized
taatccattttattattcag

SEQ ID NO: 21095 - DNA, 20 bp, Artificial Sequence
  chemically synthesized
agatagagttaagaatacag

SEQ ID NO: 21096 - DNA, 20 bp, Artificial Sequence
  chemically synthesized
cagtgtaccgtggaatgggg

SEQ ID NO: 21097 - DNA, 20 bp, Artificial Sequence
  chemically synthesized
ggtttctaacctagttacct

SEQ ID NO: 21098 - DNA, 20 bp, Artificial Sequence
  chemically synthesized
gaaaaacctctctaatgatg

SEQ ID NO: 21099 - DNA, 20 bp, Artificial Sequence
  chemically synthesized
gatgggagagacctgcaggg

SEQ ID NO: 21100 - DNA, 20 bp, Artificial Sequence
  chemically synthesized
agggggagttaatagcctta

SEQ ID NO: 21101 - DNA, 20 bp, Artificial Sequence
  chemically synthesized
gggaagtactaagtagtcag

SEQ ID NO: 21102 - DNA, 20 bp, Artificial Sequence
  chemically synthesized
ctgtggtgtgacccaggatg

SEQ ID NO: 21103 - DNA, 20 bp, Artificial Sequence
  chemically synthesized
tttgcccaaatgtgggggaa

SEQ ID NO: 21104 - DNA, 20 bp, Artificial Sequence
  chemically synthesized
aggatatttaggatcattaa

SEQ ID NO: 21105 - DNA, 20 bp, Artificial Sequence
  chemically synthesized
gagcgatgtagtccctaaat

SEQ ID NO: 21106 - DNA, 20 bp, Artificial Sequence
  chemically synthesized
cttaaaatggactagaaaca

SEQ ID NO: 21107 - DNA, 20 bp, Artificial Sequence
  chemically synthesized
cgtattgctggacataattt

SEQ ID NO: 21108 - DNA, 20 bp, Artificial Sequence
  chemically synthesized
ctttgatataagtgaactca

SEQ ID NO: 21109 - DNA, 20 bp, Artificial Sequence
  chemically synthesized
gaagaggacttcacacttcc

SEQ ID NO: 21110 - DNA, 20 bp, Artificial Sequence
  chemically synthesized
gccgtaaagaacaactgctc

SEQ ID NO: 21111 - DNA, 20 bp, Artificial Sequence
  chemically synthesized
agtttaatactaggctactc

SEQ ID NO: 21112 - DNA, 20 bp, Artificial Sequence
  chemically synthesized
cggctgttttttgttaacac

SEQ ID NO: 21113 - DNA, 20 bp, Artificial Sequence
  chemically synthesized
gttaacacagaagttttcca

SEQ ID NO: 21114 - DNA, 20 bp, Artificial Sequence
  chemically synthesized
ccatccttcccgagacctaa

SEQ ID NO: 21115 - DNA, 20 bp, Artificial Sequence
  chemically synthesized
acgatgtttatctttcgtga

SEQ ID NO: 21116 - DNA, 20 bp, Artificial Sequence
  chemically synthesized
agatccatcaaggcccagca

SEQ ID NO: 21117 - DNA, 20 bp, Artificial Sequence
  chemically synthesized
tttcaaggctgaggtgggag

SEQ ID NO: 21118 - DNA, 20 bp, Artificial Sequence
  chemically synthesized
gcctggggaacatagggaga

SEQ ID NO: 21119 - DNA, 20 bp, Artificial Sequence
  chemically synthesized
attgaatccaggcgttctag

SEQ ID NO: 21120 - DNA, 20 bp, Artificial Sequence
  chemically synthesized
ttctagtgaggcttcagtga

SEQ ID NO: 21121 - DNA, 20 bp, Artificial Sequence
  chemically synthesized
gccggggtgacagagtgaga

SEQ ID NO: 21122 - DNA, 20 bp, Artificial Sequence
  chemically synthesized
tctacagctaaagtcagact

SEQ ID NO: 21123 - DNA, 20 bp, Artificial Sequence
  chemically synthesized
ccaccatcacctgggtaatg

SEQ ID NO: 21124 - DNA, 20 bp, Artificial Sequence
  chemically synthesized
attacatagcatctctgtgc

SEQ ID NO: 21125 - DNA, 20 bp, Artificial Sequence
  chemically synthesized
ttaataaacactctgtaggt

SEQ ID NO: 21126 - DNA, 20 bp, Artificial Sequence
  chemically synthesized
gttagctcatgtattgtcat

SEQ ID NO: 21127 - DNA, 20 bp, Artificial Sequence
  chemically synthesized
aatcacgggatgcatagtaa

SEQ ID NO: 21128 - DNA, 20 bp, Artificial Sequence
  chemically synthesized
acacacgatctatgtaaaaa

SEQ ID NO: 21129 - DNA, 20 bp, Artificial Sequence
  chemically synthesized
gtaaaaactatgcttggttg

SEQ ID NO: 21130 - DNA, 20 bp, Artificial Sequence
  chemically synthesized
cctcccactgccaagactgc

SEQ ID NO: 21131 - DNA, 20 bp, Artificial Sequence
  chemically synthesized
cactgccaagactgcagctg

SEQ ID NO: 21132 - DNA, 20 bp, Artificial Sequence
  chemically synthesized
tctaagtgtataatgacttc

SEQ ID NO: 21133 - DNA, 20 bp, Artificial Sequence
  chemically synthesized
gacttcctctgcttctgcaa

SEQ ID NO: 21134 - DNA, 20 bp, Artificial Sequence
  chemically synthesized
ctgtgttttggaacaggagg

SEQ ID NO: 21135 - DNA, 20 bp, Artificial Sequence
  chemically synthesized
tattctatacttctttgaaa

SEQ ID NO: 21136 - DNA, 20 bp, Artificial Sequence
  chemically synthesized
agtgttgccagatgacgact

SEQ ID NO: 21137 - DNA, 20 bp, Artificial Sequence
  chemically synthesized
agatcaataaaatacaaagt

SEQ ID NO: 21138 - DNA, 20 bp, Artificial Sequence
  chemically synthesized
tcagaataaaaccatttatt

SEQ ID NO: 21139 - DNA, 20 bp, Artificial Sequence
  chemically synthesized
tatatgtgtatgtaaatctc

SEQ ID NO: 21140 - DNA, 20 bp, Artificial Sequence
  chemically synthesized
gctcttgcattcacttatat

SEQ ID NO: 21141 - DNA, 20 bp, Artificial Sequence
  chemically synthesized
atattctagcttgttaagag

SEQ ID NO: 21142 - DNA, 20 bp, Artificial Sequence
  chemically synthesized
agagagaagtttggggcaaa

SEQ ID NO: 21143 - DNA, 20 bp, Artificial Sequence
  chemically synthesized
cagggaaatgtctggaggga

SEQ ID NO: 21144 - DNA, 20 bp, Artificial Sequence
  chemically synthesized
ctttcttttattgatatatg

SEQ ID NO: 21145 - DNA, 20 bp, Artificial Sequence
  chemically synthesized
tattcatcacctcaagtatt

SEQ ID NO: 21146 - DNA, 20 bp, Artificial Sequence
  chemically synthesized
ctattttgaaatatacaata

SEQ ID NO: 21147 - DNA, 20 bp, Artificial Sequence
  chemically synthesized
catattccttctatctaact

SEQ ID NO: 21148 - DNA, 20 bp, Artificial Sequence
  chemically synthesized
cgtacacacctttctctacc

SEQ ID NO: 21149 - DNA, 20 bp, Artificial Sequence
  chemically synthesized
gcaaaatttgtctttctatg

SEQ ID NO: 21150 - DNA, 20 bp, Artificial Sequence
  chemically synthesized
gtctttctatgcctggctta

SEQ ID NO: 21151 - DNA, 20 bp, Artificial Sequence
  chemically synthesized
tttcgtttaacataatgact

SEQ ID NO: 21152 - DNA, 20 bp, Artificial Sequence
  chemically synthesized
catccatgttgctgcaaatg

SEQ ID NO: 21153 - DNA, 20 bp, Artificial Sequence
  chemically synthesized
catccattgatggacactta

SEQ ID NO: 21154 - DNA, 20 bp, Artificial Sequence
  chemically synthesized
ataaacagtgtggtaccagt

SEQ ID NO: 21155 - DNA, 20 bp, Artificial Sequence
  chemically synthesized
ctttggataaatacccagta

SEQ ID NO: 21156 - DNA, 20 bp, Artificial Sequence
  chemically synthesized
gatcttatgatagttcaatt

SEQ ID NO: 21157 - DNA, 20 bp, Artificial Sequence
  chemically synthesized
agctttttggtaaatctaca

SEQ ID NO: 21158 - DNA, 20 bp, Artificial Sequence
  chemically synthesized
catagtggctatactaattt

SEQ ID NO: 21159 - DNA, 20 bp, Artificial Sequence
  chemically synthesized
ttattaatttatttaaatca

SEQ ID NO: 21160 - DNA, 20 bp, Artificial Sequence
  chemically synthesized
ggcataagatgatatctcat

SEQ ID NO: 21161 - DNA, 20 bp, Artificial Sequence
  chemically synthesized
aagatgatatctcattgtgg

SEQ ID NO: 21162 - DNA, 20 bp, Artificial Sequence
  chemically synthesized
ggttttgatttgcatttctc

SEQ ID NO: 21163 - DNA, 20 bp, Artificial Sequence
  chemically synthesized
tatcctttgccaatttttta

SEQ ID NO: 21164 - DNA, 20 bp, Artificial Sequence
  chemically synthesized
gccaattttttaatgagatt

SEQ ID NO: 21165 - DNA, 20 bp, Artificial Sequence
  chemically synthesized
tatttgtttttccactgttg

SEQ ID NO: 21166 - DNA, 20 bp, Artificial Sequence
  chemically synthesized
tttttccactgttgagttgt

SEQ ID NO: 21167 - DNA, 20 bp, Artificial Sequence
  chemically synthesized
tttgagtttcttatatattc

SEQ ID NO: 21168 - DNA, 20 bp, Artificial Sequence
  chemically synthesized
gcaaatattttctcgcattc

SEQ ID NO: 21169 - DNA, 20 bp, Artificial Sequence
  chemically synthesized
aacagcttgtctcttcactg

SEQ ID NO: 21170 - DNA, 20 bp, Artificial Sequence
  chemically synthesized
gcttgtctcttcactgtgtt

SEQ ID NO: 21171 - DNA, 20 bp, Artificial Sequence
  chemically synthesized
cctttactgtgcagatgtat

SEQ ID NO: 21172 - DNA, 20 bp, Artificial Sequence
  chemically synthesized
atatagtcccatttgtctat

SEQ ID NO: 21173 - DNA, 20 bp, Artificial Sequence
  chemically synthesized
tctatttttgcttttgttgc

SEQ ID NO: 21174 - DNA, 20 bp, Artificial Sequence
  chemically synthesized
catgtcttgaagtgtctccc

SEQ ID NO: 21175 - DNA, 20 bp, Artificial Sequence
  chemically synthesized
tctcccttatgttttctttt

SEQ ID NO: 21176 - DNA, 20 bp, Artificial Sequence
  chemically synthesized
atgttttcttttagtagttt

SEQ ID NO: 21177 - DNA, 20 bp, Artificial Sequence
  chemically synthesized
cttttagtagttttatagtt

SEQ ID NO: 21178 - DNA, 20 bp, Artificial Sequence
  chemically synthesized
gtctttaatccatcttgaga

SEQ ID NO: 21179 - DNA, 20 bp, Artificial Sequence
  chemically synthesized
tattgtacaaggggttgagt

SEQ ID NO: 21180 - DNA, 20 bp, Artificial Sequence
  chemically synthesized
tacaaggggttgagttcttg

SEQ ID NO: 21181 - DNA, 20 bp, Artificial Sequence
  chemically synthesized
ctgttggtgtatagaagagt

SEQ ID NO: 21182 - DNA, 20 bp, Artificial Sequence
  chemically synthesized
tgaattattttatcagttct

SEQ ID NO: 21183 - DNA, 20 bp, Artificial Sequence
  chemically synthesized
gagctttctggaggagtctt

SEQ ID NO: 21184 - DNA, 20 bp, Artificial Sequence
  chemically synthesized
tcatatcatcagcaaacagt

SEQ ID NO: 21185 - DNA, 20 bp, Artificial Sequence
  chemically synthesized
tgacagtttgacttcctctt

SEQ ID NO: 21186 - DNA, 20 bp, Artificial Sequence
  chemically synthesized
gatttgaatgccctttattt

SEQ ID NO: 21187 - DNA, 20 bp, Artificial Sequence
  chemically synthesized
gccctttatttctttgtttt

SEQ ID NO: 21188 - DNA, 20 bp, Artificial Sequence
  chemically synthesized
cttgttccagttctcagagg

SEQ ID NO: 21189 - DNA, 20 bp, Artificial Sequence
  chemically synthesized
cattcaatattatgttggct

SEQ ID NO: 21190 - DNA, 20 bp, Artificial Sequence
  chemically synthesized
ttggctgtgggtttgtcaca

SEQ ID NO: 21191 - DNA, 20 bp, Artificial Sequence
  chemically synthesized
actgaggtatgtctcttgta

SEQ ID NO: 21192 - DNA, 20 bp, Artificial Sequence
  chemically synthesized
cattttaatcataaatgtat

SEQ ID NO: 21193 - DNA, 20 bp, Artificial Sequence
  chemically synthesized
aatgtatgctggattttgtt

SEQ ID NO: 21194 - DNA, 20 bp, Artificial Sequence
  chemically synthesized
tattgagatgatcatgtaat

SEQ ID NO: 21195 - DNA, 20 bp, Artificial Sequence
  chemically synthesized
catgtaatttttgtttttaa

SEQ ID NO: 21196 - DNA, 20 bp, Artificial Sequence
  chemically synthesized
ccctgcatccctggcatgga

SEQ ID NO: 21197 - DNA, 20 bp, Artificial Sequence
  chemically synthesized
catggaacctgcttgatcat

SEQ ID NO: 21198 - DNA, 20 bp, Artificial Sequence
  chemically synthesized
ttggttatctagtattttgt

SEQ ID NO: 21199 - DNA, 20 bp, Artificial Sequence
  chemically synthesized
gttcatcaaggctatcagtc

SEQ ID NO: 21200 - DNA, 20 bp, Artificial Sequence
  chemically synthesized
cttttttggttatgtccttc

SEQ ID NO: 21201 - DNA, 20 bp, Artificial Sequence
  chemically synthesized
ttccctggttttggtgtgat

SEQ ID NO: 21202 - DNA, 20 bp, Artificial Sequence
  chemically synthesized
tttaattaccaattaaatct

SEQ ID NO: 21203 - DNA, 20 bp, Artificial Sequence
  chemically synthesized
agctccagtgttaggtgcat

SEQ ID NO: 21204 - DNA, 20 bp, Artificial Sequence
  chemically synthesized
agtgttaggtgcatatatgt

SEQ ID NO: 21205 - DNA, 20 bp, Artificial Sequence
  chemically synthesized
tctttgtctcttttaactgc

SEQ ID NO: 21206 - DNA, 20 bp, Artificial Sequence
  chemically synthesized
tcttttaactgctgttgctt

SEQ ID NO: 21207 - DNA, 20 bp, Artificial Sequence
  chemically synthesized
ttaactgctgttgctttaaa

SEQ ID NO: 21208 - DNA, 20 bp, Artificial Sequence
  chemically synthesized
tgagctcccagggcctttct

SEQ ID NO: 21209 - DNA, 20 bp, Artificial Sequence
  chemically synthesized
acttctcccacaaacagacc

SEQ ID NO: 21210 - DNA, 20 bp, Artificial Sequence
  chemically synthesized
tcagtttctccagtgggagt

SEQ ID NO: 21211 - DNA, 20 bp, Artificial Sequence
  chemically synthesized
cagagggtctgtgggtcctc

SEQ ID NO: 21212 - DNA, 20 bp, Artificial Sequence
  chemically synthesized
ctgtgggtcctctcaggatt

SEQ ID NO: 21213 - DNA, 20 bp, Artificial Sequence
  chemically synthesized
ccgccaagatcctgagaagt

SEQ ID NO: 21214 - DNA, 20 bp, Artificial Sequence
  chemically synthesized
gttggggattatatttcaac

SEQ ID NO: 21215 - DNA, 20 bp, Artificial Sequence
  chemically synthesized
catccaaaccatatcagcag

SEQ ID NO: 21216 - DNA, 20 bp, Artificial Sequence
  chemically synthesized
ctgttctaatgtcagtatca

SEQ ID NO: 21217 - DNA, 20 bp, Artificial Sequence
  chemically synthesized
ttttttaatttcatacaaat

SEQ ID NO: 21218 - DNA, 20 bp, Artificial Sequence
  chemically synthesized
taatttcatacaaattttag

SEQ ID NO: 21219 - DNA, 20 bp, Artificial Sequence
  chemically synthesized
gatagcggtcatatagaatc

SEQ ID NO: 21220 - DNA, 20 bp, Artificial Sequence
  chemically synthesized
gcggtcatatagaatctgta

SEQ ID NO: 21221 - DNA, 20 bp, Artificial Sequence
  chemically synthesized
tgaacataggatatctctcc

SEQ ID NO: 21222 - DNA, 20 bp, Artificial Sequence
  chemically synthesized
gtccttttcaattcttttat

SEQ ID NO: 21223 - DNA, 20 bp, Artificial Sequence
  chemically synthesized
caattcttttatcagtgttt

SEQ ID NO: 21224 - DNA, 20 bp, Artificial Sequence
  chemically synthesized
tgttttgtagttttccgaat

SEQ ID NO: 21225 - DNA, 20 bp, Artificial Sequence
  chemically synthesized
ttattttttagctattgtaa

SEQ ID NO: 21226 - DNA, 20 bp, Artificial Sequence
  chemically synthesized
ccttcttaatttccttctca

SEQ ID NO: 21227 - DNA, 20 bp, Artificial Sequence
  chemically synthesized
ttattattggtgtgtagaaa

SEQ ID NO: 21228 - DNA, 20 bp, Artificial Sequence
  chemically synthesized
tattggtgtgtagaaacatt

SEQ ID NO: 21229 - DNA, 20 bp, Artificial Sequence
  chemically synthesized
gaaacattgcttgtttcata

SEQ ID NO: 21230 - DNA, 20 bp, Artificial Sequence
  chemically synthesized
aatttatttttcagcgctaa

SEQ ID NO: 21231 - DNA, 20 bp, Artificial Sequence
  chemically synthesized
taagagtgctttggtggagt

SEQ ID NO: 21232 - DNA, 20 bp, Artificial Sequence
  chemically synthesized
tcatgtcatctggaaagatg

SEQ ID NO: 21233 - DNA, 20 bp, Artificial Sequence
  chemically synthesized
gatggaagtgggcatcctta

SEQ ID NO: 21234 - DNA, 20 bp, Artificial Sequence
  chemically synthesized
tttgtttcagttcttagagg

SEQ ID NO: 21235 - DNA, 20 bp, Artificial Sequence
  chemically synthesized
cagttcttagaggaaaggct

SEQ ID NO: 21236 - DNA, 20 bp, Artificial Sequence
  chemically synthesized
aattcagtatgatgttagct

SEQ ID NO: 21237 - DNA, 20 bp, Artificial Sequence
  chemically synthesized
tatattgagatatgttcctt

SEQ ID NO: 21238 - DNA, 20 bp, Artificial Sequence
  chemically synthesized
tccttctatgattggctgca

SEQ ID NO: 21239 - DNA, 20 bp, Artificial Sequence
  chemically synthesized
tgtatctattgagatgatca

SEQ ID NO: 21240 - DNA, 20 bp, Artificial Sequence
  chemically synthesized
ttgatgtgatgtatcacatt

SEQ ID NO: 21241 - DNA, 20 bp, Artificial Sequence
  chemically synthesized
tattatcttttggatgtact

SEQ ID NO: 21242 - DNA, 20 bp, Artificial Sequence
  chemically synthesized
cttttggatgtactgttgga

SEQ ID NO: 21243 - DNA, 20 bp, Artificial Sequence
  chemically synthesized
tcagtttgctagtattttgt

SEQ ID NO: 21244 - DNA, 20 bp, Artificial Sequence
  chemically synthesized
ttccatcagggatattgacc

SEQ ID NO: 21245 - DNA, 20 bp, Artificial Sequence
  chemically synthesized
atgagttagggagaattcct

SEQ ID NO: 21246 - DNA, 20 bp, Artificial Sequence
  chemically synthesized
aaaagaatttaaggagactt

SEQ ID NO: 21247 - DNA, 20 bp, Artificial Sequence
  chemically synthesized
gagacttgttagttttcttt

SEQ ID NO: 21248 - DNA, 20 bp, Artificial Sequence
  chemically synthesized
ttttttgggagactttttac

SEQ ID NO: 21249 - DNA, 20 bp, Artificial Sequence
  chemically synthesized
attattcattactggtctgt

SEQ ID NO: 21250 - DNA, 20 bp, Artificial Sequence
  chemically synthesized
ccagaaatttattaatttcc

SEQ ID NO: 21251 - DNA, 20 bp, Artificial Sequence
  chemically synthesized
tattaatttcctctagattt

SEQ ID NO: 21252 - DNA, 20 bp, Artificial Sequence
  chemically synthesized
taatatattttcttttttat

SEQ ID NO: 21253 - DNA, 20 bp, Artificial Sequence
  chemically synthesized
tcattttgctaatcccttgt

SEQ ID NO: 21254 - DNA, 20 bp, Artificial Sequence
  chemically synthesized
ttcattttttctttccttct

SEQ ID NO: 21255 - DNA, 20 bp, Artificial Sequence
  chemically synthesized
tttctttccttctgctagtt

SEQ ID NO: 21256 - DNA, 20 bp, Artificial Sequence
  chemically synthesized
ctgctagttttgggttttgt

SEQ ID NO: 21257 - DNA, 20 bp, Artificial Sequence
  chemically synthesized
ttgggttttgttcttgcttt

SEQ ID NO: 21258 - DNA, 20 bp, Artificial Sequence
  chemically synthesized
cttttctagcttgttgaggt

SEQ ID NO: 21259 - DNA, 20 bp, Artificial Sequence
  chemically synthesized
ctagcttgttgaggtacatg

SEQ ID NO: 21260 - DNA, 20 bp, Artificial Sequence
  chemically synthesized
attatatatttgaaatcttt

SEQ ID NO: 21261 - DNA, 20 bp, Artificial Sequence
  chemically synthesized
tctttctatgtttttaattt

SEQ ID NO: 21262 - DNA, 20 bp, Artificial Sequence
  chemically synthesized
tttaatttaagtgtttattg

SEQ ID NO: 21263 - DNA, 20 bp, Artificial Sequence
  chemically synthesized
ttgataagcttctctcttag

SEQ ID NO: 21264 - DNA, 20 bp, Artificial Sequence
  chemically synthesized
gcactgcttttgctgtatcc

SEQ ID NO: 21265 - DNA, 20 bp, Artificial Sequence
  chemically synthesized
tatgttgtatttcaattttc

SEQ ID NO: 21266 - DNA, 20 bp, Artificial Sequence
  chemically synthesized
tttcatttgtttcaaaaaat

SEQ ID NO: 21267 - DNA, 20 bp, Artificial Sequence
  chemically synthesized
ataacgttcattcaggagca

SEQ ID NO: 21268 - DNA, 20 bp, Artificial Sequence
  chemically synthesized
tttaatttccatgtatttgt

SEQ ID NO: 21269 - DNA, 20 bp, Artificial Sequence
  chemically synthesized
ccatgtatttgtataggttt

SEQ ID NO: 21270 - DNA, 20 bp, Artificial Sequence
  chemically synthesized
ggttttaaagtttttcttgt

SEQ ID NO: 21271 - DNA, 20 bp, Artificial Sequence
  chemically synthesized
agtttttcttgttattgatt

SEQ ID NO: 21272 - DNA, 20 bp, Artificial Sequence
  chemically synthesized
tattccattgtggtctgaga

SEQ ID NO: 21273 - DNA, 20 bp, Artificial Sequence
  chemically synthesized
gtggtctgagaagatgctta

SEQ ID NO: 21274 - DNA, 20 bp, Artificial Sequence
  chemically synthesized
tagatccatttggtctaaag

SEQ ID NO: 21275 - DNA, 20 bp, Artificial Sequence
  chemically synthesized
tctaaagtcaagtttaaatc

SEQ ID NO: 21276 - DNA, 20 bp, Artificial Sequence
  chemically synthesized
tctagatgatctatctgatg

SEQ ID NO: 21277 - DNA, 20 bp, Artificial Sequence
  chemically synthesized
aaatccccaactattattgt

SEQ ID NO: 21278 - DNA, 20 bp, Artificial Sequence
  chemically synthesized
caccctttatatctaataac

SEQ ID NO: 21279 - DNA, 20 bp, Artificial Sequence
  chemically synthesized
gatgctctggtgttgagtgt

SEQ ID NO: 21280 - DNA, 20 bp, Artificial Sequence
  chemically synthesized
atgtaatgacttttgtctct

SEQ ID NO: 21281 - DNA, 20 bp, Artificial Sequence
  chemically synthesized
tataactacttttgctcatt

SEQ ID NO: 21282 - DNA, 20 bp, Artificial Sequence
  chemically synthesized
tatttatctttacaagtgag

SEQ ID NO: 21283 - DNA, 20 bp, Artificial Sequence
  chemically synthesized
agtgagataagtttcttata

SEQ ID NO: 21284 - DNA, 20 bp, Artificial Sequence
  chemically synthesized
agcttacaactgggtcatat

SEQ ID NO: 21285 - DNA, 20 bp, Artificial Sequence
  chemically synthesized
caaggctattattgacatgt

SEQ ID NO: 21286 - DNA, 20 bp, Artificial Sequence
  chemically synthesized
cttattcctgccattttgtt

SEQ ID NO: 21287 - DNA, 20 bp, Artificial Sequence
  chemically synthesized
cattttgttaattgattcct

SEQ ID NO: 21288 - DNA, 20 bp, Artificial Sequence
  chemically synthesized
tgttaattgattcctggttg

SEQ ID NO: 21289 - DNA, 20 bp, Artificial Sequence
  chemically synthesized
cctggttgttttgttttttt

SEQ ID NO: 21290 - DNA, 20 bp, Artificial Sequence
  chemically synthesized
gttgttttgtttttttttta

SEQ ID NO: 21291 - DNA, 20 bp, Artificial Sequence
  chemically synthesized
ttttgttttttttttagttt

SEQ ID NO: 21292 - DNA, 20 bp, Artificial Sequence
  chemically synthesized
ttttttttagtttgtttgtt

SEQ ID NO: 21293 - DNA, 20 bp, Artificial Sequence
  chemically synthesized
ctttctttctttcttattat

SEQ ID NO: 21294 - DNA, 20 bp, Artificial Sequence
  chemically synthesized
tctttcttattatttatgat

SEQ ID NO: 21295 - DNA, 20 bp, Artificial Sequence
  chemically synthesized
tattatttatgattgtggtt

SEQ ID NO: 21296 - DNA, 20 bp, Artificial Sequence
  chemically synthesized
ttggtgattttctgtagtgg

SEQ ID NO: 21297 - DNA, 20 bp, Artificial Sequence
  chemically synthesized
gagttctttctcttctttat

SEQ ID NO: 21298 - DNA, 20 bp, Artificial Sequence
  chemically synthesized
ttcaaatttttcttgcccag

SEQ ID NO: 21299 - DNA, 20 bp, Artificial Sequence
  chemically synthesized
tcccatcttctcctggcctg

SEQ ID NO: 21300 - DNA, 20 bp, Artificial Sequence
  chemically synthesized
cccttataagtgactagaca

SEQ ID NO: 21301 - DNA, 20 bp, Artificial Sequence
  chemically synthesized
aagtgactagacattttgct

SEQ ID NO: 21302 - DNA, 20 bp, Artificial Sequence
  chemically synthesized
ctgttttagagttcttactc

SEQ ID NO: 21303 - DNA, 20 bp, Artificial Sequence
  chemically synthesized
gttcttactctttggctttt

SEQ ID NO: 21304 - DNA, 20 bp, Artificial Sequence
  chemically synthesized
gactataatgtgctgtggag

SEQ ID NO: 21305 - DNA, 20 bp, Artificial Sequence
  chemically synthesized
gcattatattatttgggaat

SEQ ID NO: 21306 - DNA, 20 bp, Artificial Sequence
  chemically synthesized
tacatttcttgctagacttg

SEQ ID NO: 21307 - DNA, 20 bp, Artificial Sequence
  chemically synthesized
ttcagctattgtgttgttac

SEQ ID NO: 21308 - DNA, 20 bp, Artificial Sequence
  chemically synthesized
ttcaagttctgaaatttttc

SEQ ID NO: 21309 - DNA, 20 bp, Artificial Sequence
  chemically synthesized
tgcttgatctgatctattgt

SEQ ID NO: 21310 - DNA, 20 bp, Artificial Sequence
  chemically synthesized
aaactcttcagttacagaat

SEQ ID NO: 21311 - DNA, 20 bp, Artificial Sequence
  chemically synthesized
aatttctcattcatatcctg

SEQ ID NO: 21312 - DNA, 20 bp, Artificial Sequence
  chemically synthesized
attcatatcctgaattgttt

SEQ ID NO: 21313 - DNA, 20 bp, Artificial Sequence
  chemically synthesized
ttgtttttctgatttctttt

SEQ ID NO: 21314 - DNA, 20 bp, Artificial Sequence
  chemically synthesized
ctgagttctcttgtgtctca

SEQ ID NO: 21315 - DNA, 20 bp, Artificial Sequence
  chemically synthesized
agcttccttaatatcaacat

SEQ ID NO: 21316 - DNA, 20 bp, Artificial Sequence
  chemically synthesized
tataaatgtcttttttttcc

SEQ ID NO: 21317 - DNA, 20 bp, Artificial Sequence
  chemically synthesized
tgtcatatttcttcaccttt

SEQ ID NO: 21318 - DNA, 20 bp, Artificial Sequence
  chemically synthesized
tgatatctctgcatctggtg

SEQ ID NO: 21319 - DNA, 20 bp, Artificial Sequence
  chemically synthesized
tctgcatctggtgtaatgat

SEQ ID NO: 21320 - DNA, 20 bp, Artificial Sequence
  chemically synthesized
ctggtgtaatgattgctgct

SEQ ID NO: 21321 - DNA, 20 bp, Artificial Sequence
  chemically synthesized
tgctgcttccagttttgtaa

SEQ ID NO: 21322 - DNA, 20 bp, Artificial Sequence
  chemically synthesized
tttctgaagatgtatcttgg

SEQ ID NO: 21323 - DNA, 20 bp, Artificial Sequence
  chemically synthesized
ggtgttgattgagtagggca

SEQ ID NO: 21324 - DNA, 20 bp, Artificial Sequence
  chemically synthesized
gattgagtagggcactttga

SEQ ID NO: 21325 - DNA, 20 bp, Artificial Sequence
  chemically synthesized
gccaacagtatcatcagtgt

SEQ ID NO: 21326 - DNA, 20 bp, Artificial Sequence
  chemically synthesized
tcagtgtctgtgattttttc

SEQ ID NO: 21327 - DNA, 20 bp, Artificial Sequence
  chemically synthesized
gatggtaatgagtctagttg

SEQ ID NO: 21328 - DNA, 20 bp, Artificial Sequence
  chemically synthesized
ggttgattctttggccttca

SEQ ID NO: 21329 - DNA, 20 bp, Artificial Sequence
  chemically synthesized
gattctttggccttcaggca

SEQ ID NO: 21330 - DNA, 20 bp, Artificial Sequence
  chemically synthesized
ctgggctggtgtgtgggtcc

SEQ ID NO: 21331 - DNA, 20 bp, Artificial Sequence
  chemically synthesized
gtgccagttgtgatggcagt

SEQ ID NO: 21332 - DNA, 20 bp, Artificial Sequence
  chemically synthesized
cagattgggtaggcccatca

SEQ ID NO: 21333 - DNA, 20 bp, Artificial Sequence
  chemically synthesized
catcatcaggcttctgggag

SEQ ID NO: 21334 - DNA, 20 bp, Artificial Sequence
  chemically synthesized
tgtctctgggttcccagaca

SEQ ID NO: 21335 - DNA, 20 bp, Artificial Sequence
  chemically synthesized
tcttgaaggggtgcggggtg

SEQ ID NO: 21336 - DNA, 20 bp, Artificial Sequence
  chemically synthesized
taaatgggttgctggtgggc

SEQ ID NO: 21337 - DNA, 20 bp, Artificial Sequence
  chemically synthesized
agtggggtagcattttctta

SEQ ID NO: 21338 - DNA, 20 bp, Artificial Sequence
  chemically synthesized
ctgtgggtgggggatgtcag

SEQ ID NO: 21339 - DNA, 20 bp, Artificial Sequence
  chemically synthesized
ttctctggagcaatgccttt

SEQ ID NO: 21340 - DNA, 20 bp, Artificial Sequence
  chemically synthesized
gtcaagggactctcctgtgg

SEQ ID NO: 21341 - DNA, 20 bp, Artificial Sequence
  chemically synthesized
tcacagaggatccctactgg

SEQ ID NO: 21342 - DNA, 20 bp, Artificial Sequence
  chemically synthesized
gatccctactgggtaggctt

SEQ ID NO: 21343 - DNA, 20 bp, Artificial Sequence
  chemically synthesized
tccctccccttcattgcctt

SEQ ID NO: 21344 - DNA, 20 bp, Artificial Sequence
  chemically synthesized
attccagaattctctcttat

SEQ ID NO: 21345 - DNA, 20 bp, Artificial Sequence
  chemically synthesized
gccccttcccttgaaatttt

SEQ ID NO: 21346 - DNA, 20 bp, Artificial Sequence
  chemically synthesized
cccttgaaattttttaagct

SEQ ID NO: 21347 - DNA, 20 bp, Artificial Sequence
  chemically synthesized
agaagtagcgaattagttaa

SEQ ID NO: 21348 - DNA, 20 bp, Artificial Sequence
  chemically synthesized
ttcatttcccaaatcaaatc

SEQ ID NO: 21349 - DNA, 20 bp, Artificial Sequence
  chemically synthesized
ttatgttcttcagcaaataa

SEQ ID NO: 21350 - DNA, 20 bp, Artificial Sequence
  chemically synthesized
atacgtaatctaacaaacaa

SEQ ID NO: 21351 - DNA, 20 bp, Artificial Sequence
  chemically synthesized
gatgcatagttgcaaataaa

SEQ ID NO: 21352 - DNA, 20 bp, Artificial Sequence
  chemically synthesized
aattttgcatttttgtggat

SEQ ID NO: 21353 - DNA, 20 bp, Artificial Sequence
  chemically synthesized
ttgtggatagtggttttgaa

SEQ ID NO: 21354 - DNA, 20 bp, Artificial Sequence
  chemically synthesized
tagttgcccttgcaaattgg

SEQ ID NO: 21355 - DNA, 20 bp, Artificial Sequence
  chemically synthesized
tttcctcaacaaataatttt

SEQ ID NO: 21356 - DNA, 20 bp, Artificial Sequence
  chemically synthesized
atgacatcaatttatgttaa

SEQ ID NO: 21357 - DNA, 20 bp, Artificial Sequence
  chemically synthesized
tgtctgttcttgtccagtct

SEQ ID NO: 21358 - DNA, 20 bp, Artificial Sequence
  chemically synthesized
ttcttgtccagtctagaagt

SEQ ID NO: 21359 - DNA, 20 bp, Artificial Sequence
  chemically synthesized
ctcatcacataacatctgaa

SEQ ID NO: 21360 - DNA, 20 bp, Artificial Sequence
  chemically synthesized
attatcagactctgctcaat

SEQ ID NO: 21361 - DNA, 20 bp, Artificial Sequence
  chemically synthesized
agatgaaattcttaaggaca

SEQ ID NO: 21362 - DNA, 20 bp, Artificial Sequence
  chemically synthesized
cttgtgtagactcatatgaa

SEQ ID NO: 21363 - DNA, 20 bp, Artificial Sequence
  chemically synthesized
atgaagttctactttgtgac

SEQ ID NO: 21364 - DNA, 20 bp, Artificial Sequence
  chemically synthesized
accattgattgtgactattg

SEQ ID NO: 21365 - DNA, 20 bp, Artificial Sequence
  chemically synthesized
ctgtagtctgatgaaatgga

SEQ ID NO: 21366 - DNA, 20 bp, Artificial Sequence
  chemically synthesized
aagtaatatataagtaataa

SEQ ID NO: 21367 - DNA, 20 bp, Artificial Sequence
  chemically synthesized
attgctttttgcaattgagt

SEQ ID NO: 21368 - DNA, 20 bp, Artificial Sequence
  chemically synthesized
atgccaggatcttattacct

SEQ ID NO: 21369 - DNA, 20 bp, Artificial Sequence
  chemically synthesized
tattacctccaggatttcac

SEQ ID NO: 21370 - DNA, 20 bp, Artificial Sequence
  chemically synthesized
aaagtattgctcaagtaatc

SEQ ID NO: 21371 - DNA, 20 bp, Artificial Sequence
  chemically synthesized
gattatttgtgtattctcac

SEQ ID NO: 21372 - DNA, 20 bp, Artificial Sequence
  chemically synthesized
tgtcacgggaaatatcctgc

SEQ ID NO: 21373 - DNA, 20 bp, Artificial Sequence
  chemically synthesized
tctttccttgcacactctac

SEQ ID NO: 21374 - DNA, 20 bp, Artificial Sequence
  chemically synthesized
aattaccccattaagtgata

SEQ ID NO: 21375 - DNA, 20 bp, Artificial Sequence
  chemically synthesized
tatgtactagttcgttatca

SEQ ID NO: 21376 - DNA, 20 bp, Artificial Sequence
  chemically synthesized
ctgggtaatttataaggaaa

SEQ ID NO: 21377 - DNA, 20 bp, Artificial Sequence
  chemically synthesized
tgccaagcaaaagggggaaa

SEQ ID NO: 21378 - DNA, 20 bp, Artificial Sequence
  chemically synthesized
gagcatgagagtaacctcct

SEQ ID NO: 21379 - DNA, 20 bp, Artificial Sequence
  chemically synthesized
caaatccctcccacaacacg

SEQ ID NO: 21380 - DNA, 20 bp, Artificial Sequence
  chemically synthesized
tatgggaactacaattcaag

SEQ ID NO: 21381 - DNA, 20 bp, Artificial Sequence
  chemically synthesized
atgttgcatagtggtgaagt

SEQ ID NO: 21382 - DNA, 20 bp, Artificial Sequence
  chemically synthesized
agtgaatgttgtatccaatc

SEQ ID NO: 21383 - DNA, 20 bp, Artificial Sequence
  chemically synthesized
tattatttcattctatatgt

SEQ ID NO: 21384 - DNA, 20 bp, Artificial Sequence
  chemically synthesized
tctatatgtctatgcttact

SEQ ID NO: 21385 - DNA, 20 bp, Artificial Sequence
  chemically synthesized
tctcactaaatgagaacata

SEQ ID NO: 21386 - DNA, 20 bp, Artificial Sequence
  chemically synthesized
agaacatactgtgtttgact

SEQ ID NO: 21387 - DNA, 20 bp, Artificial Sequence
  chemically synthesized
ataatgtcctccagttctaa

SEQ ID NO: 21388 - DNA, 20 bp, Artificial Sequence
  chemically synthesized
taaccatgtttctagagaag

SEQ ID NO: 21389 - DNA, 20 bp, Artificial Sequence
  chemically synthesized
cgtccattggtagacattta

SEQ ID NO: 21390 - DNA, 20 bp, Artificial Sequence
  chemically synthesized
ctttgggtccatacccagta

SEQ ID NO: 21391 - DNA, 20 bp, Artificial Sequence
  chemically synthesized
ccatacccagtagtgggatt

SEQ ID NO: 21392 - DNA, 20 bp, Artificial Sequence
  chemically synthesized
attgcaggattgaatggtag

SEQ ID NO: 21393 - DNA, 20 bp, Artificial Sequence
  chemically synthesized
aatcttcatgctgtcttcca

SEQ ID NO: 21394 - DNA, 20 bp, Artificial Sequence
  chemically synthesized
tccacatcctcaccaacatc

SEQ ID NO: 21395 - DNA, 20 bp, Artificial Sequence
  chemically synthesized
ggcataaggaggtatcatat

SEQ ID NO: 21396 - DNA, 20 bp, Artificial Sequence
  chemically synthesized
tggtggttttaatttgcatt

SEQ ID NO: 21397 - DNA, 20 bp, Artificial Sequence
  chemically synthesized
agtgatgttgaacttttttt

SEQ ID NO: 21398 - DNA, 20 bp, Artificial Sequence
  chemically synthesized
tagatagatagatagataga

SEQ ID NO: 21399 - DNA, 20 bp, Artificial Sequence
  chemically synthesized
atatagatttagatataaaa

SEQ ID NO: 21400 - DNA, 20 bp, Artificial Sequence
  chemically synthesized
aagctgaaggacttggagtc

SEQ ID NO: 21401 - DNA, 20 bp, Artificial Sequence
  chemically synthesized
atccagcatgggagaaagat

SEQ ID NO: 21402 - DNA, 20 bp, Artificial Sequence
  chemically synthesized
ggcttggaggctaagccagt

SEQ ID NO: 21403 - DNA, 20 bp, Artificial Sequence
  chemically synthesized
taagccagtccaggattttc

SEQ ID NO: 21404 - DNA, 20 bp, Artificial Sequence
  chemically synthesized
ttttcacatgttttttttct

SEQ ID NO: 21405 - DNA, 20 bp, Artificial Sequence
  chemically synthesized
tatatcctggccacactggc

SEQ ID NO: 21406 - DNA, 20 bp, Artificial Sequence
  chemically synthesized
aactgattagatggtgccca

SEQ ID NO: 21407 - DNA, 20 bp, Artificial Sequence
  chemically synthesized
agtattaaccatcacaagtc

SEQ ID NO: 21408 - DNA, 20 bp, Artificial Sequence
  chemically synthesized
acaagtgtatacagacacga

SEQ ID NO: 21409 - DNA, 20 bp, Artificial Sequence
  chemically synthesized
tcctgcctggaatggcctgt

SEQ ID NO: 21410 - DNA, 20 bp, Artificial Sequence
  chemically synthesized
ggatctcctatattccatgc

SEQ ID NO: 21411 - DNA, 20 bp, Artificial Sequence
  chemically synthesized
acctccattgtggagttgta

SEQ ID NO: 21412 - DNA, 20 bp, Artificial Sequence
  chemically synthesized
tccaggtggcaatcttaatt

SEQ ID NO: 21413 - DNA, 20 bp, Artificial Sequence
  chemically synthesized
cttccacttccacttccacc

SEQ ID NO: 21414 - DNA, 20 bp, Artificial Sequence
  chemically synthesized
aaacagtaccatatattgga

SEQ ID NO: 21415 - DNA, 20 bp, Artificial Sequence
  chemically synthesized
acttcaaaaggccattcaaa

SEQ ID NO: 21416 - DNA, 20 bp, Artificial Sequence
  chemically synthesized
acttctttagccataaagtg

SEQ ID NO: 21417 - DNA, 20 bp, Artificial Sequence
  chemically synthesized
atgacagtggatacggcatt

SEQ ID NO: 21418 - DNA, 20 bp, Artificial Sequence
  chemically synthesized
tcttggcataagcattgagt

SEQ ID NO: 21419 - DNA, 20 bp, Artificial Sequence
  chemically synthesized
ccgaggaatggtgccatatc

SEQ ID NO: 21420 - DNA, 20 bp, Artificial Sequence
  chemically synthesized
caagcagtggctgtggccag

SEQ ID NO: 21421 - DNA, 20 bp, Artificial Sequence
  chemically synthesized
cagaattgatcatcctatcc

SEQ ID NO: 21422 - DNA, 20 bp, Artificial Sequence
  chemically synthesized
acatgggatgaaaatatctt

SEQ ID NO: 21423 - DNA, 20 bp, Artificial Sequence
  chemically synthesized
ctttgtcatcaattttccag

SEQ ID NO: 21424 - DNA, 20 bp, Artificial Sequence
  chemically synthesized
gctcaaagttctgccaacta

SEQ ID NO: 21425 - DNA, 20 bp, Artificial Sequence
  chemically synthesized
tgatgactcatagtcaaata

SEQ ID NO: 21426 - DNA, 20 bp, Artificial Sequence
  chemically synthesized
ccaaagcccagtaacaggcc

SEQ ID NO: 21427 - DNA, 20 bp, Artificial Sequence
  chemically synthesized
caaaatcctagaggcctccg

SEQ ID NO: 21428 - DNA, 20 bp, Artificial Sequence
  chemically synthesized
tcatatggcccaagtggcat

SEQ ID NO: 21429 - DNA, 20 bp, Artificial Sequence
  chemically synthesized
gtagaaggtccctgaattta

SEQ ID NO: 21430 - DNA, 20 bp, Artificial Sequence
  chemically synthesized
atgtctcatcaataaatcca

SEQ ID NO: 21431 - DNA, 20 bp, Artificial Sequence
  chemically synthesized
ggtgagcaagttctctccaa

SEQ ID NO: 21432 - DNA, 20 bp, Artificial Sequence
  chemically synthesized
ccaaccaacttcactatgtt

SEQ ID NO: 21433 - DNA, 20 bp, Artificial Sequence
  chemically synthesized
actctctaaacaattgatgc

SEQ ID NO: 21434 - DNA, 20 bp, Artificial Sequence
  chemically synthesized
ctctatatctatatctatat

SEQ ID NO: 21435 - DNA, 20 bp, Artificial Sequence
  chemically synthesized
tagccttttcacatttttct

SEQ ID NO: 21436 - DNA, 20 bp, Artificial Sequence
  chemically synthesized
tatatcctggctgtgctggc

SEQ ID NO: 21437 - DNA, 20 bp, Artificial Sequence
  chemically synthesized
aactgattagatggtgccca

SEQ ID NO: 21438 - DNA, 20 bp, Artificial Sequence
  chemically synthesized
cacagtcactttctaatgag

SEQ ID NO: 21439 - DNA, 20 bp, Artificial Sequence
  chemically synthesized
ttttttgttgttgagttcct

SEQ ID NO: 21440 - DNA, 20 bp, Artificial Sequence
  chemically synthesized
tattagccttttgttgcatt

SEQ ID NO: 21441 - DNA, 20 bp, Artificial Sequence
  chemically synthesized
tttttctcattctgtaggtt

SEQ ID NO: 21442 - DNA, 20 bp, Artificial Sequence
  chemically synthesized
tgtaggttatccgtttactc

SEQ ID NO: 21443 - DNA, 20 bp, Artificial Sequence
  chemically synthesized
cttttgcggtgcagaagcat

SEQ ID NO: 21444 - DNA, 20 bp, Artificial Sequence
  chemically synthesized
agtttaattaagtcccattt

SEQ ID NO: 21445 - DNA, 20 bp, Artificial Sequence
  chemically synthesized
attaagtcccatttgtctgt

SEQ ID NO: 21446 - DNA, 20 bp, Artificial Sequence
  chemically synthesized
tttgtctgtttttgtttttg

SEQ ID NO: 21447 - DNA, 20 bp, Artificial Sequence
  chemically synthesized
ctgtttttgtttttgttgtg

SEQ ID NO: 21448 - DNA, 20 bp, Artificial Sequence
  chemically synthesized
aagttgactagttcagtgta

SEQ ID NO: 21449 - DNA, 20 bp, Artificial Sequence
  chemically synthesized
tttctaattttttgccatca

SEQ ID NO: 21450 - DNA, 20 bp, Artificial Sequence
  chemically synthesized
tctccttaattttcccccag

SEQ ID NO: 21451 - DNA, 20 bp, Artificial Sequence
  chemically synthesized
ttccaaatgtatccatatat

SEQ ID NO: 21452 - DNA, 20 bp, Artificial Sequence
  chemically synthesized
tgtatccatatattgtggct

SEQ ID NO: 21453 - DNA, 20 bp, Artificial Sequence
  chemically synthesized
tattagaggagagaattaag

SEQ ID NO: 21454 - DNA, 20 bp, Artificial Sequence
  chemically synthesized
agacaccgagttaaagaagg

SEQ ID NO: 21455 - DNA, 20 bp, Artificial Sequence
  chemically synthesized
aggaagggctttattcggct

SEQ ID NO: 21456 - DNA, 20 bp, Artificial Sequence
  chemically synthesized
gagcaattcctgtccctttt

SEQ ID NO: 21457 - DNA, 20 bp, Artificial Sequence
  chemically synthesized
cagaatggaacagaacagga

SEQ ID NO: 21458 - DNA, 20 bp, Artificial Sequence
  chemically synthesized
gaacaggacagggattttca

SEQ ID NO: 21459 - DNA, 20 bp, Artificial Sequence
  chemically synthesized
aggcccaggatgtggtctca

SEQ ID NO: 21460 - DNA, 20 bp, Artificial Sequence
  chemically synthesized
gtggtctcaggctgtttgcc

SEQ ID NO: 21461 - DNA, 20 bp, Artificial Sequence
  chemically synthesized
tgtggatttcatttctgcct

SEQ ID NO: 21462 - DNA, 20 bp, Artificial Sequence
  chemically synthesized
atgaaatacgtatttgtgtt

SEQ ID NO: 21463 - DNA, 20 bp, Artificial Sequence
  chemically synthesized
gttctccttatcaaaaggta

SEQ ID NO: 21464 - DNA, 20 bp, Artificial Sequence
  chemically synthesized
ttatcaaaaggtactttgct

SEQ ID NO: 21465 - DNA, 20 bp, Artificial Sequence
  chemically synthesized
ctttaaaagataaatgacta

SEQ ID NO: 21466 - DNA, 20 bp, Artificial Sequence
  chemically synthesized
gataaatgactatgtagctt

SEQ ID NO: 21467 - DNA, 20 bp, Artificial Sequence
  chemically synthesized
agaaggaggaagagaggtga

SEQ ID NO: 21468 - DNA, 20 bp, Artificial Sequence
  chemically synthesized
ctttgacactacaaagtgac

SEQ ID NO: 21469 - DNA, 20 bp, Artificial Sequence
  chemically synthesized
tttgaaaggtaaataaatcc

SEQ ID NO: 21470 - DNA, 20 bp, Artificial Sequence
  chemically synthesized
aacagttggaggcatctata

SEQ ID NO: 21471 - DNA, 22 bp, Artificial Sequence
  chemically synthesized
gcagccatgcttattcattgcg

SEQ ID NO: 21472 - DNA, 22 bp, Artificial Sequence
  chemically synthesized
attcattgcgtccactgctctt

SEQ ID NO: 21473 - DNA, 22 bp, Artificial Sequence
  chemically synthesized
ttcattgcgtccactgctcttc

SEQ ID NO: 21474 - DNA, 22 bp, Artificial Sequence
  chemically synthesized
attgcgtccactgctcttctga

SEQ ID NO: 21475 - DNA, 22 bp, Artificial Sequence
  chemically synthesized
cgtccactgctcttctgacagc

SEQ ID NO: 21476 - DNA, 22 bp, Artificial Sequence
  chemically synthesized
ctcttctgacagcatcatttac

SEQ ID NO: 21477 - DNA, 22 bp, Artificial Sequence
  chemically synthesized
ttctgacagcatcatttacagg

SEQ ID NO: 21478 - DNA, 22 bp, Artificial Sequence
  chemically synthesized
ctgacagcatcatttacaggtt

SEQ ID NO: 21479 - DNA, 22 bp, Artificial Sequence
  chemically synthesized
tgacagcatcatttacaggttc

SEQ ID NO: 21480 - DNA, 22 bp, Artificial Sequence
  chemically synthesized
acagcatcatttacaggttcac

SEQ ID NO: 21481 - DNA, 22 bp, Artificial Sequence
  chemically synthesized
acaggttcacactgttccacct

SEQ ID NO: 21482 - DNA, 22 bp, Artificial Sequence
  chemically synthesized
caggttcacactgttccacctg

SEQ ID NO: 21483 - DNA, 22 bp, Artificial Sequence
  chemically synthesized
acactgttccacctgagtcttc

SEQ ID NO: 21484 - DNA, 22 bp, Artificial Sequence
  chemically synthesized
ttccacctgagtcttcatatta

SEQ ID NO: 21485 - DNA, 22 bp, Artificial Sequence
  chemically synthesized
cacctgagtcttcatattatgc

SEQ ID NO: 21486 - DNA, 22 bp, Artificial Sequence
  chemically synthesized
agtcttcatattatgctcaaaa

SEQ ID NO: 21487 - DNA, 22 bp, Artificial Sequence
  chemically synthesized
catattatgctcaaaatatgga

SEQ ID NO: 21488 - DNA, 22 bp, Artificial Sequence
  chemically synthesized
atattatgctcaaaatatggac

SEQ ID NO: 21489 - DNA, 22 bp, Artificial Sequence
  chemically synthesized
tgctcaaaatatggacctatca

SEQ ID NO: 21490 - DNA, 22 bp, Artificial Sequence
  chemically synthesized
aaaatatggacctatcagaaaa

SEQ ID NO: 21491 - DNA, 22 bp, Artificial Sequence
  chemically synthesized
tcagaaaatagttctctcccca

SEQ ID NO: 21492 - DNA, 22 bp, Artificial Sequence
  chemically synthesized
tctccccattcatctgctgttg

SEQ ID NO: 21493 - DNA, 22 bp, Artificial Sequence
  chemically synthesized
tccccattcatctgctgttgtt

SEQ ID NO: 21494 - DNA, 22 bp, Artificial Sequence
  chemically synthesized
cccattcatctgctgttgtttt

SEQ ID NO: 21495 - DNA, 22 bp, Artificial Sequence
  chemically synthesized
atctgctgttgttttggccttt

SEQ ID NO: 21496 - DNA, 22 bp, Artificial Sequence
  chemically synthesized
ctgttgttttggcctttgtctg

SEQ ID NO: 21497 - DNA, 22 bp, Artificial Sequence
  chemically synthesized
ttgttttggcctttgtctgaat

SEQ ID NO: 21498 - DNA, 22 bp, Artificial Sequence
  chemically synthesized
ttttggcctttgtctgaatcac

SEQ ID NO: 21499 - DNA, 22 bp, Artificial Sequence
  chemically synthesized
tggcctttgtctgaatcacagt

SEQ ID NO: 21500 - DNA, 22 bp, Artificial Sequence
  chemically synthesized
ggcctttgtctgaatcacagta

SEQ ID NO: 21501 - DNA, 22 bp, Artificial Sequence
  chemically synthesized
gcctttgtctgaatcacagtat

SEQ ID NO: 21502 - DNA, 22 bp, Artificial Sequence
  chemically synthesized
tgtctgaatcacagtatagatg

SEQ ID NO: 21503 - DNA, 22 bp, Artificial Sequence
  chemically synthesized
gtctgaatcacagtatagatgc

SEQ ID NO: 21504 - DNA, 22 bp, Artificial Sequence
  chemically synthesized
tctgaatcacagtatagatgcc

SEQ ID NO: 21505 - DNA, 22 bp, Artificial Sequence
  chemically synthesized
aatcacagtatagatgcctcca

SEQ ID NO: 21506 - DNA, 22 bp, Artificial Sequence
  chemically synthesized
caactgttaaaaggaaaaaagt

SEQ ID NO: 21507 - DNA, 22 bp, Artificial Sequence
  chemically synthesized
ttaaaaggaaaaaagtttctat

SEQ ID NO: 21508 - DNA, 22 bp, Artificial Sequence
  chemically synthesized
aaaggaaaaaagtttctattat

SEQ ID NO: 21509 - DNA, 22 bp, Artificial Sequence
  chemically synthesized
ctattatcattcaggttagcaa

SEQ ID NO: 21510 - DNA, 22 bp, Artificial Sequence
  chemically synthesized
tattatcattcaggttagcaat

SEQ ID NO: 21511 - DNA, 22 bp, Artificial Sequence
  chemically synthesized
ttatcattcaggttagcaattt

SEQ ID NO: 21512 - DNA, 22 bp, Artificial Sequence
  chemically synthesized
tcattcaggttagcaatttgtt

SEQ ID NO: 21513 - DNA, 22 bp, Artificial Sequence
  chemically synthesized
aggttagcaatttgtttaaagt

SEQ ID NO: 21514 - DNA, 22 bp, Artificial Sequence
  chemically synthesized
gcaatttgtttaaagtaataag

SEQ ID NO: 21515 - DNA, 22 bp, Artificial Sequence
  chemically synthesized
gtttaaagtaataagggatgga

SEQ ID NO: 21516 - DNA, 22 bp, Artificial Sequence
  chemically synthesized
tttaaagtaataagggatggaa

SEQ ID NO: 21517 - DNA, 22 bp, Artificial Sequence
  chemically synthesized
aaagtaataagggatggaaatg

SEQ ID NO: 21518 - DNA, 22 bp, Artificial Sequence
  chemically synthesized
aagtaataagggatggaaatga

SEQ ID NO: 21519 - DNA, 22 bp, Artificial Sequence
  chemically synthesized
agatttttaaattagcatttag

SEQ ID NO: 21520 - DNA, 22 bp, Artificial Sequence
  chemically synthesized
ttaaattagcatttaggatcca

SEQ ID NO: 21521 - DNA, 22 bp, Artificial Sequence
  chemically synthesized
taaattagcatttaggatccac

SEQ ID NO: 21522 - DNA, 22 bp, Artificial Sequence
  chemically synthesized
aaattagcatttaggatccact

SEQ ID NO: 21523 - DNA, 22 bp, Artificial Sequence
  chemically synthesized
aattagcatttaggatccacta

SEQ ID NO: 21524 - DNA, 22 bp, Artificial Sequence
  chemically synthesized
gcatttaggatccactaagccc

SEQ ID NO: 21525 - DNA, 22 bp, Artificial Sequence
  chemically synthesized
aggatccactaagcccaaggat

SEQ ID NO: 21526 - DNA, 22 bp, Artificial Sequence
  chemically synthesized
ggatccactaagcccaaggatt

SEQ ID NO: 21527 - DNA, 22 bp, Artificial Sequence
  chemically synthesized
agcccaaggatttatttacctt

SEQ ID NO: 21528 - DNA, 22 bp, Artificial Sequence
  chemically synthesized
atttacctttcaaaaataatag

SEQ ID NO: 21529 - DNA, 22 bp, Artificial Sequence
  chemically synthesized
tttacctttcaaaaataatagt

SEQ ID NO: 21530 - DNA, 22 bp, Artificial Sequence
  chemically synthesized
acctttcaaaaataatagtatt

SEQ ID NO: 21531 - DNA, 22 bp, Artificial Sequence
  chemically synthesized
cctttcaaaaataatagtattt

SEQ ID NO: 21532 - DNA, 22 bp, Artificial Sequence
  chemically synthesized
tcaaaaataatagtatttgaca

SEQ ID NO: 21533 - DNA, 22 bp, Artificial Sequence
  chemically synthesized
caaaaataatagtatttgacat

SEQ ID NO: 21534 - DNA, 22 bp, Artificial Sequence
  chemically synthesized
aaaaataatagtatttgacata

SEQ ID NO: 21535 - DNA, 22 bp, Artificial Sequence
  chemically synthesized
gacatattgttaagggacacca

SEQ ID NO: 21536 - DNA, 22 bp, Artificial Sequence
  chemically synthesized
acatattgttaagggacaccaa

SEQ ID NO: 21537 - DNA, 22 bp, Artificial Sequence
  chemically synthesized
ttaagggacaccaacgaatggt

SEQ ID NO: 21538 - DNA, 22 bp, Artificial Sequence
  chemically synthesized
agggacaccaacgaatggttac

SEQ ID NO: 21539 - DNA, 22 bp, Artificial Sequence
  chemically synthesized
ctgctttgttcaattctgtgca

SEQ ID NO: 21540 - DNA, 22 bp, Artificial Sequence
  chemically synthesized
ctttgttcaattctgtgcatgt

SEQ ID NO: 21541 - DNA, 22 bp, Artificial Sequence
  chemically synthesized
tgttcaattctgtgcatgtttt

SEQ ID NO: 21542 - DNA, 22 bp, Artificial Sequence
  chemically synthesized
gttcaattctgtgcatgtttta

SEQ ID NO: 21543 - DNA, 22 bp, Artificial Sequence
  chemically synthesized
ttcaattctgtgcatgttttaa

SEQ ID NO: 21544 - DNA, 22 bp, Artificial Sequence
  chemically synthesized
aattctgtgcatgttttaaagt

SEQ ID NO: 21545 - DNA, 22 bp, Artificial Sequence
  chemically synthesized
tgtgcatgttttaaagtccctt

SEQ ID NO: 21546 - DNA, 22 bp, Artificial Sequence
  chemically synthesized
tgcatgttttaaagtcccttct

SEQ ID NO: 21547 - DNA, 22 bp, Artificial Sequence
  chemically synthesized
taaagtcccttctaggtgcatg

SEQ ID NO: 21548 - DNA, 22 bp, Artificial Sequence
  chemically synthesized
aaagtcccttctaggtgcatgt

SEQ ID NO: 21549 - DNA, 22 bp, Artificial Sequence
  chemically synthesized
aagtcccttctaggtgcatgtg

SEQ ID NO: 21550 - DNA, 22 bp, Artificial Sequence
  chemically synthesized
ctaggtgcatgtgaaatagcag

SEQ ID NO: 21551 - DNA, 22 bp, Artificial Sequence
  chemically synthesized
taggtgcatgtgaaatagcagc

SEQ ID NO: 21552 - DNA, 22 bp, Artificial Sequence
  chemically synthesized
ggtgcatgtgaaatagcagcag

SEQ ID NO: 21553 - DNA, 22 bp, Artificial Sequence
  chemically synthesized
atgccgcaaagaggtcaaatac

SEQ ID NO: 21554 - DNA, 22 bp, Artificial Sequence
  chemically synthesized
aaaaagaaagagtctgaaaaga

SEQ ID NO: 21555 - DNA, 22 bp, Artificial Sequence
  chemically synthesized
aaaagacaattggagtaactac

SEQ ID NO: 21556 - DNA, 22 bp, Artificial Sequence
  chemically synthesized
gagtaactacttgcctaaagct

SEQ ID NO: 21557 - DNA, 22 bp, Artificial Sequence
  chemically synthesized
cttgcctaaagctccagtcact

SEQ ID NO: 21558 - DNA, 22 bp, Artificial Sequence
  chemically synthesized
gcctaaagctccagtcactttg

SEQ ID NO: 21559 - DNA, 22 bp, Artificial Sequence
  chemically synthesized
cctaaagctccagtcactttgt

SEQ ID NO: 21560 - DNA, 22 bp, Artificial Sequence
  chemically synthesized
aagctccagtcactttgtagtg

SEQ ID NO: 21561 - DNA, 22 bp, Artificial Sequence
  chemically synthesized
cagtcactttgtagtgtcaaag

SEQ ID NO: 21562 - DNA, 22 bp, Artificial Sequence
  chemically synthesized
tgtagtgtcaaagttaggacaa

SEQ ID NO: 21563 - DNA, 22 bp, Artificial Sequence
  chemically synthesized
gtagtgtcaaagttaggacaaa

SEQ ID NO: 21564 - DNA, 22 bp, Artificial Sequence
  chemically synthesized
tagtgtcaaagttaggacaaat

SEQ ID NO: 21565 - DNA, 22 bp, Artificial Sequence
  chemically synthesized
ggacaaatacccattgtcatca

SEQ ID NO: 21566 - DNA, 22 bp, Artificial Sequence
  chemically synthesized
tcatcatacatgccctcagcag

SEQ ID NO: 21567 - DNA, 22 bp, Artificial Sequence
  chemically synthesized
agcagcagaaatcactttcacc

SEQ ID NO: 21568 - DNA, 22 bp, Artificial Sequence
  chemically synthesized
tcacctctcttcctccttctcc

SEQ ID NO: 21569 - DNA, 22 bp, Artificial Sequence
  chemically synthesized
cacctctcttcctccttctcct

SEQ ID NO: 21570 - DNA, 22 bp, Artificial Sequence
  chemically synthesized
acctctcttcctccttctccta

SEQ ID NO: 21571 - DNA, 22 bp, Artificial Sequence
  chemically synthesized
tcttcctccttctcctacagtg

SEQ ID NO: 21572 - DNA, 22 bp, Artificial Sequence
  chemically synthesized
ttcctccttctcctacagtggt

SEQ ID NO: 21573 - DNA, 22 bp, Artificial Sequence
  chemically synthesized
cctccttctcctacagtggtcc

SEQ ID NO: 21574 - DNA, 22 bp, Artificial Sequence
  chemically synthesized
ctccttctcctacagtggtcca

SEQ ID NO: 21575 - DNA, 22 bp, Artificial Sequence
  chemically synthesized
cttctcctacagtggtccagaa

SEQ ID NO: 21576 - DNA, 22 bp, Artificial Sequence
  chemically synthesized
ctcctacagtggtccagaaggg

SEQ ID NO: 21577 - DNA, 22 bp, Artificial Sequence
  chemically synthesized
tcctacagtggtccagaagggg

SEQ ID NO: 21578 - DNA, 22 bp, Artificial Sequence
  chemically synthesized
ctacagtggtccagaaggggct

SEQ ID NO: 21579 - DNA, 22 bp, Artificial Sequence
  chemically synthesized
cagtggtccagaaggggctcag

SEQ ID NO: 21580 - DNA, 22 bp, Artificial Sequence
  chemically synthesized
aggtatgttcaaataacagctg

SEQ ID NO: 21581 - DNA, 22 bp, Artificial Sequence
  chemically synthesized
aaataacagctgctgtggtttt

SEQ ID NO: 21582 - DNA, 22 bp, Artificial Sequence
  chemically synthesized
ctgtggttttcaattatgaaga

SEQ ID NO: 21583 - DNA, 22 bp, Artificial Sequence
  chemically synthesized
tggttttcaattatgaagaaat

SEQ ID NO: 21584 - DNA, 22 bp, Artificial Sequence
  chemically synthesized
tcaattatgaagaaatctccta

SEQ ID NO: 21585 - DNA, 22 bp, Artificial Sequence
  chemically synthesized
caattatgaagaaatctcctaa

SEQ ID NO: 21586 - DNA, 22 bp, Artificial Sequence
  chemically synthesized
aattatgaagaaatctcctaag

SEQ ID NO: 21587 - DNA, 22 bp, Artificial Sequence
  chemically synthesized
tgaagaaatctcctaagctaca

SEQ ID NO: 21588 - DNA, 22 bp, Artificial Sequence
  chemically synthesized
ctaagctacatagtcatttatc

SEQ ID NO: 21589 - DNA, 22 bp, Artificial Sequence
  chemically synthesized
agctacatagtcatttatcttt

SEQ ID NO: 21590 - DNA, 22 bp, Artificial Sequence
  chemically synthesized
catagtcatttatcttttaaag

SEQ ID NO: 21591 - DNA, 22 bp, Artificial Sequence
  chemically synthesized
atcttttaaagcaccaagcaaa

SEQ ID NO: 21592 - DNA, 22 bp, Artificial Sequence
  chemically synthesized
tcttttaaagcaccaagcaaag

SEQ ID NO: 21593 - DNA, 22 bp, Artificial Sequence
  chemically synthesized
ttaaagcaccaagcaaagtacc

SEQ ID NO: 21594 - DNA, 22 bp, Artificial Sequence
  chemically synthesized
taaagcaccaagcaaagtacct

SEQ ID NO: 21595 - DNA, 22 bp, Artificial Sequence
  chemically synthesized
aaagcaccaagcaaagtacctt

SEQ ID NO: 21596 - DNA, 22 bp, Artificial Sequence
  chemically synthesized
aagcaccaagcaaagtaccttt

SEQ ID NO: 21597 - DNA, 22 bp, Artificial Sequence
  chemically synthesized
ttgataaggagaacgtgcttat

SEQ ID NO: 21598 - DNA, 22 bp, Artificial Sequence
  chemically synthesized
tgataaggagaacgtgcttata

SEQ ID NO: 21599 - DNA, 22 bp, Artificial Sequence
  chemically synthesized
gataaggagaacgtgcttatag

SEQ ID NO: 21600 - DNA, 22 bp, Artificial Sequence
  chemically synthesized
ataaggagaacgtgcttataga

SEQ ID NO: 21601 - DNA, 22 bp, Artificial Sequence
  chemically synthesized
atagatgttcatagaagatgct

SEQ ID NO: 21602 - DNA, 22 bp, Artificial Sequence
  chemically synthesized
tagatgttcatagaagatgctt

SEQ ID NO: 21603 - DNA, 22 bp, Artificial Sequence
  chemically synthesized
atagaagatgcttggtccaacc

SEQ ID NO: 21604 - DNA, 22 bp, Artificial Sequence
  chemically synthesized
ggtccaaccccgatgtcaaatc

SEQ ID NO: 21605 - DNA, 22 bp, Artificial Sequence
  chemically synthesized
gtccaaccccgatgtcaaatcc

SEQ ID NO: 21606 - DNA, 22 bp, Artificial Sequence
  chemically synthesized
cattctcacatggtatttctct

SEQ ID NO: 21607 - DNA, 22 bp, Artificial Sequence
  chemically synthesized
attctcacatggtatttctctc

SEQ ID NO: 21608 - DNA, 22 bp, Artificial Sequence
  chemically synthesized
tcacatggtatttctctcttcc

SEQ ID NO: 21609 - DNA, 22 bp, Artificial Sequence
  chemically synthesized
acatggtatttctctcttccta

SEQ ID NO: 21610 - DNA, 22 bp, Artificial Sequence
  chemically synthesized
ctctcttcctagtaagggagga

SEQ ID NO: 21611 - DNA, 22 bp, Artificial Sequence
  chemically synthesized
tctcttcctagtaagggaggag

SEQ ID NO: 21612 - DNA, 22 bp, Artificial Sequence
  chemically synthesized
tcttcctagtaagggaggagac

SEQ ID NO: 21613 - DNA, 22 bp, Artificial Sequence
  chemically synthesized
ttcctagtaagggaggagacca

SEQ ID NO: 21614 - DNA, 22 bp, Artificial Sequence
  chemically synthesized
cctagtaagggaggagaccacc

SEQ ID NO: 21615 - DNA, 22 bp, Artificial Sequence
  chemically synthesized
ctagtaagggaggagaccaccc

SEQ ID NO: 21616 - DNA, 22 bp, Artificial Sequence
  chemically synthesized
gtaagggaggagaccacccttc

SEQ ID NO: 21617 - DNA, 22 bp, Artificial Sequence
  chemically synthesized
catattgttttatgcccaattt

SEQ ID NO: 21618 - DNA, 22 bp, Artificial Sequence
  chemically synthesized
atattgttttatgcccaatttc

SEQ ID NO: 21619 - DNA, 22 bp, Artificial Sequence
  chemically synthesized
ttttatgcccaatttctgcctc

SEQ ID NO: 21620 - DNA, 22 bp, Artificial Sequence
  chemically synthesized
tatgcccaatttctgcctccaa

SEQ ID NO: 21621 - DNA, 22 bp, Artificial Sequence
  chemically synthesized
atgcccaatttctgcctccaaa

SEQ ID NO: 21622 - DNA, 22 bp, Artificial Sequence
  chemically synthesized
tgcccaatttctgcctccaaag

SEQ ID NO: 21623 - DNA, 22 bp, Artificial Sequence
  chemically synthesized
ctgcctccaaagaaagaagaag

SEQ ID NO: 21624 - DNA, 22 bp, Artificial Sequence
  chemically synthesized
tgcctccaaagaaagaagaagt

SEQ ID NO: 21625 - DNA, 22 bp, Artificial Sequence
  chemically synthesized
cctccaaagaaagaagaagtaa

SEQ ID NO: 21626 - DNA, 22 bp, Artificial Sequence
  chemically synthesized
caaagaaagaagaagtaaaaac

SEQ ID NO: 21627 - DNA, 22 bp, Artificial Sequence
  chemically synthesized
aaaggcagaaatgaaatccaca

SEQ ID NO: 21628 - DNA, 22 bp, Artificial Sequence
  chemically synthesized
agaccacatcctgggcctggtt

SEQ ID NO: 21629 - DNA, 22 bp, Artificial Sequence
  chemically synthesized
ggcctggttaaagatagacccc

SEQ ID NO: 21630 - DNA, 22 bp, Artificial Sequence
  chemically synthesized
gttaaagatagacccctgacct

SEQ ID NO: 21631 - DNA, 22 bp, Artificial Sequence
  chemically synthesized
aagatagacccctgacctggcc

SEQ ID NO: 21632 - DNA, 22 bp, Artificial Sequence
  chemically synthesized
acctggccagttatgttatcta

SEQ ID NO: 21633 - DNA, 22 bp, Artificial Sequence
  chemically synthesized
gccagttatgttatctatagat

SEQ ID NO: 21634 - DNA, 22 bp, Artificial Sequence
  chemically synthesized
tgttatctatagattccagaca

SEQ ID NO: 21635 - DNA, 22 bp, Artificial Sequence
  chemically synthesized
tctatagattccagacactgta

SEQ ID NO: 21636 - DNA, 22 bp, Artificial Sequence
  chemically synthesized
tagattccagacactgtatgga

SEQ ID NO: 21637 - DNA, 22 bp, Artificial Sequence
  chemically synthesized
cagacactgtatggaaaagcag

SEQ ID NO: 21638 - DNA, 22 bp, Artificial Sequence
  chemically synthesized
tatggaaaagcagtgtgaaaat

SEQ ID NO: 21639 - DNA, 22 bp, Artificial Sequence
  chemically synthesized
tcctgttctgttccattctgat

SEQ ID NO: 21640 - DNA, 22 bp, Artificial Sequence
  chemically synthesized
ttctgttccattctgatgacca

SEQ ID NO: 21641 - DNA, 22 bp, Artificial Sequence
  chemically synthesized
tgttccattctgatgaccagtg

SEQ ID NO: 21642 - DNA, 22 bp, Artificial Sequence
  chemically synthesized
ttccattctgatgaccagtgca

SEQ ID NO: 21643 - DNA, 22 bp, Artificial Sequence
  chemically synthesized
cattctgatgaccagtgcatgc

SEQ ID NO: 21644 - DNA, 22 bp, Artificial Sequence
  chemically synthesized
tgatgaccagtgcatgcagccc

SEQ ID NO: 21645 - DNA, 22 bp, Artificial Sequence
  chemically synthesized
atgaccagtgcatgcagccccc

SEQ ID NO: 21646 - DNA, 22 bp, Artificial Sequence
  chemically synthesized
agagttgtaagcccttaaaagg

SEQ ID NO: 21647 - DNA, 22 bp, Artificial Sequence
  chemically synthesized
gagttgtaagcccttaaaaggg

SEQ ID NO: 21648 - DNA, 22 bp, Artificial Sequence
  chemically synthesized
taagcccttaaaagggacagga

SEQ ID NO: 21649 - DNA, 22 bp, Artificial Sequence
  chemically synthesized
aaaagggacaggaattgctcac

SEQ ID NO: 21650 - DNA, 22 bp, Artificial Sequence
  chemically synthesized
aaagggacaggaattgctcact

SEQ ID NO: 21651 - DNA, 22 bp, Artificial Sequence
  chemically synthesized
ctcactctgagagcttggttgt

SEQ ID NO: 21652 - DNA, 22 bp, Artificial Sequence
  chemically synthesized
actctgagagcttggttgttgg

SEQ ID NO: 21653 - DNA, 22 bp, Artificial Sequence
  chemically synthesized
tgagagcttggttgttggagat

SEQ ID NO: 21654 - DNA, 22 bp, Artificial Sequence
  chemically synthesized
agagcttggttgttggagatgt

SEQ ID NO: 21655 - DNA, 22 bp, Artificial Sequence
  chemically synthesized
ggttgttggagatgtgagtctt

SEQ ID NO: 21656 - DNA, 22 bp, Artificial Sequence
  chemically synthesized
gttgttggagatgtgagtcttg

SEQ ID NO: 21657 - DNA, 22 bp, Artificial Sequence
  chemically synthesized
ttggagatgtgagtcttgccca

SEQ ID NO: 21658 - DNA, 22 bp, Artificial Sequence
  chemically synthesized
gagatgtgagtcttgcccaagc

SEQ ID NO: 21659 - DNA, 22 bp, Artificial Sequence
  chemically synthesized
gcccaagctcccagccgaataa

SEQ ID NO: 21660 - DNA, 22 bp, Artificial Sequence
  chemically synthesized
cccaagctcccagccgaataaa

SEQ ID NO: 21661 - DNA, 22 bp, Artificial Sequence
  chemically synthesized
ccagccgaataaagcccttcct

SEQ ID NO: 21662 - DNA, 22 bp, Artificial Sequence
  chemically synthesized
ccttctttaactcggtgtctga

SEQ ID NO: 21663 - DNA, 22 bp, Artificial Sequence
  chemically synthesized
cttctttaactcggtgtctgag

SEQ ID NO: 21664 - DNA, 22 bp, Artificial Sequence
  chemically synthesized
ctttaactcggtgtctgagggg

SEQ ID NO: 21665 - DNA, 22 bp, Artificial Sequence
  chemically synthesized
tttaactcggtgtctgaggggt

SEQ ID NO: 21666 - DNA, 22 bp, Artificial Sequence
  chemically synthesized
taactcggtgtctgaggggttt

SEQ ID NO: 21667 - DNA, 22 bp, Artificial Sequence
  chemically synthesized
aactcggtgtctgaggggtttt

SEQ ID NO: 21668 - DNA, 22 bp, Artificial Sequence
  chemically synthesized
actcggtgtctgaggggttttg

SEQ ID NO: 21669 - DNA, 22 bp, Artificial Sequence
  chemically synthesized
ggtgtctgaggggttttgtatg

SEQ ID NO: 21670 - DNA, 22 bp, Artificial Sequence
  chemically synthesized
aggggttttgtatgcagcttgt

SEQ ID NO: 21671 - DNA, 22 bp, Artificial Sequence
  chemically synthesized
tgtatgcagcttgtcctgctac

SEQ ID NO: 21672 - DNA, 22 bp, Artificial Sequence
  chemically synthesized
gtatgcagcttgtcctgctaca

SEQ ID NO: 21673 - DNA, 22 bp, Artificial Sequence
  chemically synthesized
tatgcagcttgtcctgctacac

SEQ ID NO: 21674 - DNA, 22 bp, Artificial Sequence
  chemically synthesized
gtcctgctacactagaatcgtt

SEQ ID NO: 21675 - DNA, 22 bp, Artificial Sequence
  chemically synthesized
tcctgctacactagaatcgttc

SEQ ID NO: 21676 - DNA, 22 bp, Artificial Sequence
  chemically synthesized
ctacactagaatcgttccttaa

SEQ ID NO: 21677 - DNA, 22 bp, Artificial Sequence
  chemically synthesized
cactagaatcgttccttaattc

SEQ ID NO: 21678 - DNA, 22 bp, Artificial Sequence
  chemically synthesized
gaatcgttccttaattctctcc

SEQ ID NO: 21679 - DNA, 22 bp, Artificial Sequence
  chemically synthesized
cttaattctctcctctaatatt

SEQ ID NO: 21680 - DNA, 22 bp, Artificial Sequence
  chemically synthesized
aattctctcctctaatattgct

SEQ ID NO: 21681 - DNA, 22 bp, Artificial Sequence
  chemically synthesized
attctctcctctaatattgctg

SEQ ID NO: 21682 - DNA, 22 bp, Artificial Sequence
  chemically synthesized
tctcctctaatattgctgctac

SEQ ID NO: 21683 - DNA, 22 bp, Artificial Sequence
  chemically synthesized
tcctctaatattgctgctacct

SEQ ID NO: 21684 - DNA, 22 bp, Artificial Sequence
  chemically synthesized
ctctaatattgctgctacctct

SEQ ID NO: 21685 - DNA, 22 bp, Artificial Sequence
  chemically synthesized
taatattgctgctacctctatt

SEQ ID NO: 21686 - DNA, 22 bp, Artificial Sequence
  chemically synthesized
atattgctgctacctctattaa

SEQ ID NO: 21687 - DNA, 22 bp, Artificial Sequence
  chemically synthesized
ctgctacctctattaaaacaca

SEQ ID NO: 21688 - DNA, 22 bp, Artificial Sequence
  chemically synthesized
ctacctctattaaaacacaaag

SEQ ID NO: 21689 - DNA, 22 bp, Artificial Sequence
  chemically synthesized
cctctattaaaacacaaagcca

SEQ ID NO: 21690 - DNA, 22 bp, Artificial Sequence
  chemically synthesized
tattaaaacacaaagccacaat

SEQ ID NO: 21691 - DNA, 22 bp, Artificial Sequence
  chemically synthesized
ttaaaacacaaagccacaatat

SEQ ID NO: 21692 - DNA, 22 bp, Artificial Sequence
  chemically synthesized
aaacacaaagccacaatatatg

SEQ ID NO: 21693 - DNA, 22 bp, Artificial Sequence
  chemically synthesized
ggaaaatatgcacactttggat

SEQ ID NO: 21694 - DNA, 22 bp, Artificial Sequence
  chemically synthesized
gaaaatatgcacactttggatc

SEQ ID NO: 21695 - DNA, 22 bp, Artificial Sequence
  chemically synthesized
tggatccagcaagtccacatct

SEQ ID NO: 21696 - DNA, 22 bp, Artificial Sequence
  chemically synthesized
ggatccagcaagtccacatcta

SEQ ID NO: 21697 - DNA, 22 bp, Artificial Sequence
  chemically synthesized
gatccagcaagtccacatctag

SEQ ID NO: 21698 - DNA, 22 bp, Artificial Sequence
  chemically synthesized
gaaaaccatcctgggggaaaat

SEQ ID NO: 21699 - DNA, 22 bp, Artificial Sequence
  chemically synthesized
ggggaaaattaaggagagtatg

SEQ ID NO: 21700 - DNA, 22 bp, Artificial Sequence
  chemically synthesized
aggagagtatgaaaaggatgtt

SEQ ID NO: 21701 - DNA, 22 bp, Artificial Sequence
  chemically synthesized
actaaagcattatgatggcaaa

SEQ ID NO: 21702 - DNA, 22 bp, Artificial Sequence
  chemically synthesized
ctaaagcattatgatggcaaaa

SEQ ID NO: 21703 - DNA, 22 bp, Artificial Sequence
  chemically synthesized
aagcattatgatggcaaaaaat

SEQ ID NO: 21704 - DNA, 22 bp, Artificial Sequence
  chemically synthesized
tgatggcaaaaaattagaaaca

SEQ ID NO: 21705 - DNA, 22 bp, Artificial Sequence
  chemically synthesized
gaaacaacttacactgaactag

SEQ ID NO: 21706 - DNA, 22 bp, Artificial Sequence
  chemically synthesized
acactgaactagtcaacttact

SEQ ID NO: 21707 - DNA, 22 bp, Artificial Sequence
  chemically synthesized
cactgaactagtcaacttactt

SEQ ID NO: 21708 - DNA, 22 bp, Artificial Sequence
  chemically synthesized
aactagtcaacttacttaacag

SEQ ID NO: 21709 - DNA, 22 bp, Artificial Sequence
  chemically synthesized
gtcaacttacttaacagacaga

SEQ ID NO: 21710 - DNA, 22 bp, Artificial Sequence
  chemically synthesized
acttaacagacagaaggctcaa

SEQ ID NO: 21711 - DNA, 22 bp, Artificial Sequence
  chemically synthesized
cttaacagacagaaggctcaat

SEQ ID NO: 21712 - DNA, 22 bp, Artificial Sequence
  chemically synthesized
aacagacagaaggctcaattag

SEQ ID NO: 21713 - DNA, 22 bp, Artificial Sequence
  chemically synthesized
acagacagaaggctcaattagc

SEQ ID NO: 21714 - DNA, 22 bp, Artificial Sequence
  chemically synthesized
aattagctcatgtgtcaaatgg

SEQ ID NO: 21715 - DNA, 22 bp, Artificial Sequence
  chemically synthesized
gctcatgtgtcaaatgggggta

SEQ ID NO: 21716 - DNA, 22 bp, Artificial Sequence
  chemically synthesized
atgtgtcaaatgggggtaaaat

SEQ ID NO: 21717 - DNA, 22 bp, Artificial Sequence
  chemically synthesized
agtttggagggaaagacaggct

SEQ ID NO: 21718 - DNA, 22 bp, Artificial Sequence
  chemically synthesized
gtttggagggaaagacaggctc

SEQ ID NO: 21719 - DNA, 22 bp, Artificial Sequence
  chemically synthesized
ggagggaaagacaggctctaaa

SEQ ID NO: 21720 - DNA, 22 bp, Artificial Sequence
  chemically synthesized
gagggaaagacaggctctaaaa

SEQ ID NO: 21721 - DNA, 22 bp, Artificial Sequence
  chemically synthesized
taaaagaggattaaaaattaga

SEQ ID NO: 21722 - DNA, 22 bp, Artificial Sequence
  chemically synthesized
aaagaggattaaaaattagatg

SEQ ID NO: 21723 - DNA, 22 bp, Artificial Sequence
  chemically synthesized
aaaattagatgtggcctaggca

SEQ ID NO: 21724 - DNA, 22 bp, Artificial Sequence
  chemically synthesized
gatgtggcctaggcaaagaatt

SEQ ID NO: 21725 - DNA, 22 bp, Artificial Sequence
  chemically synthesized
ggcaaagaatttatgaccaagt

SEQ ID NO: 21726 - DNA, 22 bp, Artificial Sequence
  chemically synthesized
atgaccaagtcctcaaaactaa

SEQ ID NO: 21727 - DNA, 22 bp, Artificial Sequence
  chemically synthesized
tgaccaagtcctcaaaactaaa

SEQ ID NO: 21728 - DNA, 22 bp, Artificial Sequence
  chemically synthesized
aaaactaaacacaacaaaaaca

SEQ ID NO: 21729 - DNA, 22 bp, Artificial Sequence
  chemically synthesized
aacacaacaaaaacaaaaacag

SEQ ID NO: 21730 - DNA, 22 bp, Artificial Sequence
  chemically synthesized
aattaaactaaaatgcttctgc

SEQ ID NO: 21731 - DNA, 22 bp, Artificial Sequence
  chemically synthesized
attaaactaaaatgcttctgca

SEQ ID NO: 21732 - DNA, 22 bp, Artificial Sequence
  chemically synthesized
aactaaaatgcttctgcaccgc

SEQ ID NO: 21733 - DNA, 22 bp, Artificial Sequence
  chemically synthesized
aaatgcttctgcaccgcaaaag

SEQ ID NO: 21734 - DNA, 22 bp, Artificial Sequence
  chemically synthesized
ctgcaccgcaaaagaccgaatc

SEQ ID NO: 21735 - DNA, 22 bp, Artificial Sequence
  chemically synthesized
tgcaccgcaaaagaccgaatca

SEQ ID NO: 21736 - DNA, 22 bp, Artificial Sequence
  chemically synthesized
caccgcaaaagaccgaatcaac

SEQ ID NO: 21737 - DNA, 22 bp, Artificial Sequence
  chemically synthesized
cagaatgagaaaaaaaaattgc

SEQ ID NO: 21738 - DNA, 22 bp, Artificial Sequence
  chemically synthesized
caaactatgaatgcaacaaaag

SEQ ID NO: 21739 - DNA, 22 bp, Artificial Sequence
  chemically synthesized
tgaatgcaacaaaaggctaata

SEQ ID NO: 21740 - DNA, 22 bp, Artificial Sequence
  chemically synthesized
atatacagaatctacaaggaac

SEQ ID NO: 21741 - DNA, 22 bp, Artificial Sequence
  chemically synthesized
caaggaactcaacaacaaaaaa

SEQ ID NO: 21742 - DNA, 22 bp, Artificial Sequence
  chemically synthesized
aacaacaaaaaaaccaacctca

SEQ ID NO: 21743 - DNA, 22 bp, Artificial Sequence
  chemically synthesized
attagaaagtgactgtgatggt

SEQ ID NO: 21744 - DNA, 22 bp, Artificial Sequence
  chemically synthesized
gaaagtgactgtgatggttaat

SEQ ID NO: 21745 - DNA, 22 bp, Artificial Sequence
  chemically synthesized
tgatggttaatactgagtgtca

SEQ ID NO: 21746 - DNA, 22 bp, Artificial Sequence
  chemically synthesized
atactgagtgtcaacttgattg

SEQ ID NO: 21747 - DNA, 22 bp, Artificial Sequence
  chemically synthesized
agtgtcaacttgattggactga

SEQ ID NO: 21748 - DNA, 22 bp, Artificial Sequence
  chemically synthesized
gattggactgaaggatgcaaag

SEQ ID NO: 21749 - DNA, 22 bp, Artificial Sequence
  chemically synthesized
attggactgaaggatgcaaagt

SEQ ID NO: 21750 - DNA, 22 bp, Artificial Sequence
  chemically synthesized
gactgaaggatgcaaagtaatg

SEQ ID NO: 21751 - DNA, 22 bp, Artificial Sequence
  chemically synthesized
aaggatgcaaagtaatgatctt

SEQ ID NO: 21752 - DNA, 22 bp, Artificial Sequence
  chemically synthesized
gggtgtgtctgtgagggtgtta

SEQ ID NO: 21753 - DNA, 22 bp, Artificial Sequence
  chemically synthesized
ggtgtgtctgtgagggtgttac

SEQ ID NO: 21754 - DNA, 22 bp, Artificial Sequence
  chemically synthesized
tgagggtgttaccaaaggagat

SEQ ID NO: 21755 - DNA, 22 bp, Artificial Sequence
  chemically synthesized
ccaaaggagattaatatttcag

SEQ ID NO: 21756 - DNA, 22 bp, Artificial Sequence
  chemically synthesized
atatttcagtcagtgggctggg

SEQ ID NO: 21757 - DNA, 22 bp, Artificial Sequence
  chemically synthesized
cagtcagtgggctggggaaggc

SEQ ID NO: 21758 - DNA, 22 bp, Artificial Sequence
  chemically synthesized
agtcagtgggctggggaaggca

SEQ ID NO: 21759 - DNA, 22 bp, Artificial Sequence
  chemically synthesized
gggaaggcagacccacccttaa

SEQ ID NO: 21760 - DNA, 22 bp, Artificial Sequence
  chemically synthesized
aatctgggtgggcaccatctaa

SEQ ID NO: 21761 - DNA, 22 bp, Artificial Sequence
  chemically synthesized
atctgggtgggcaccatctaat

SEQ ID NO: 21762 - DNA, 22 bp, Artificial Sequence
  chemically synthesized
ggtgggcaccatctaatcagtt

SEQ ID NO: 21763 - DNA, 22 bp, Artificial Sequence
  chemically synthesized
atcagttgccagcacagccagg

SEQ ID NO: 21764 - DNA, 22 bp, Artificial Sequence
  chemically synthesized
ccagcacagccaggatataaag

SEQ ID NO: 21765 - DNA, 22 bp, Artificial Sequence
  chemically synthesized
gattggcttggcatcccagcct

SEQ ID NO: 21766 - DNA, 22 bp, Artificial Sequence
  chemically synthesized
gcttggcatcccagcctacatt

SEQ ID NO: 21767 - DNA, 22 bp, Artificial Sequence
  chemically synthesized
ggcatcccagcctacatttttc

SEQ ID NO: 21768 - DNA, 22 bp, Artificial Sequence
  chemically synthesized
gcatcccagcctacatttttct

SEQ ID NO: 21769 - DNA, 22 bp, Artificial Sequence
  chemically synthesized
catttttctcccatgctggatt

SEQ ID NO: 21770 - DNA, 22 bp, Artificial Sequence
  chemically synthesized
ttctcccatgctggattcttcc

SEQ ID NO: 21771 - DNA, 22 bp, Artificial Sequence
  chemically synthesized
tctcccatgctggattcttcct

SEQ ID NO: 21772 - DNA, 22 bp, Artificial Sequence
  chemically synthesized
ctcccatgctggattcttcctg

SEQ ID NO: 21773 - DNA, 22 bp, Artificial Sequence
  chemically synthesized
tcccatgctggattcttcctgc

SEQ ID NO: 21774 - DNA, 22 bp, Artificial Sequence
  chemically synthesized
ccatgctggattcttcctgccc

SEQ ID NO: 21775 - DNA, 22 bp, Artificial Sequence
  chemically synthesized
gattcttcctgccctggaacat

SEQ ID NO: 21776 - DNA, 22 bp, Artificial Sequence
  chemically synthesized
ttcctgccctggaacattgaac

SEQ ID NO: 21777 - DNA, 22 bp, Artificial Sequence
  chemically synthesized
cctgccctggaacattgaactc

SEQ ID NO: 21778 - DNA, 22 bp, Artificial Sequence
  chemically synthesized
ctgccctggaacattgaactcc

SEQ ID NO: 21779 - DNA, 22 bp, Artificial Sequence
  chemically synthesized
ccctggaacattgaactccagg

SEQ ID NO: 21780 - DNA, 22 bp, Artificial Sequence
  chemically synthesized
gaacattgaactccaggttctt

SEQ ID NO: 21781 - DNA, 22 bp, Artificial Sequence
  chemically synthesized
aactccaggttcttcagctttg

SEQ ID NO: 21782 - DNA, 22 bp, Artificial Sequence
  chemically synthesized
caggttcttcagctttgggact

SEQ ID NO: 21783 - DNA, 22 bp, Artificial Sequence
  chemically synthesized
ttcagctttgggactccgacta

SEQ ID NO: 21784 - DNA, 22 bp, Artificial Sequence
  chemically synthesized
cagctttgggactccgactagc

SEQ ID NO: 21785 - DNA, 22 bp, Artificial Sequence
  chemically synthesized
agctttgggactccgactagct

SEQ ID NO: 21786 - DNA, 22 bp, Artificial Sequence
  chemically synthesized
tgggactccgactagcttcctt

SEQ ID NO: 21787 - DNA, 22 bp, Artificial Sequence
  chemically synthesized
gggactccgactagcttccttg

SEQ ID NO: 21788 - DNA, 22 bp, Artificial Sequence
  chemically synthesized
ggactccgactagcttccttgt

SEQ ID NO: 21789 - DNA, 22 bp, Artificial Sequence
  chemically synthesized
cgactagcttccttgttcctca

SEQ ID NO: 21790 - DNA, 22 bp, Artificial Sequence
  chemically synthesized
gcttccttgttcctcagctggc

SEQ ID NO: 21791 - DNA, 22 bp, Artificial Sequence
  chemically synthesized
ccttgttcctcagctggcagat

SEQ ID NO: 21792 - DNA, 22 bp, Artificial Sequence
  chemically synthesized
cttgttcctcagctggcagatg

SEQ ID NO: 21793 - DNA, 22 bp, Artificial Sequence
  chemically synthesized
gttcctcagctggcagatggcc

SEQ ID NO: 21794 - DNA, 22 bp, Artificial Sequence
  chemically synthesized
ttcctcagctggcagatggcct

SEQ ID NO: 21795 - DNA, 22 bp, Artificial Sequence
  chemically synthesized
ctcagctggcagatggcctgtt

SEQ ID NO: 21796 - DNA, 22 bp, Artificial Sequence
  chemically synthesized
agctggcagatggcctgttttg

SEQ ID NO: 21797 - DNA, 22 bp, Artificial Sequence
  chemically synthesized
gcagatggcctgttttgggacc

SEQ ID NO: 21798 - DNA, 22 bp, Artificial Sequence
  chemically synthesized
ttttgggaccttgtgaacatgt

SEQ ID NO: 21799 - DNA, 22 bp, Artificial Sequence
  chemically synthesized
tgggaccttgtgaacatgtgag

SEQ ID NO: 21800 - DNA, 22 bp, Artificial Sequence
  chemically synthesized
gggaccttgtgaacatgtgagt

SEQ ID NO: 21801 - DNA, 22 bp, Artificial Sequence
  chemically synthesized
ggaccttgtgaacatgtgagtc

SEQ ID NO: 21802 - DNA, 22 bp, Artificial Sequence
  chemically synthesized
gtgaacatgtgagtcaatacta

SEQ ID NO: 21803 - DNA, 22 bp, Artificial Sequence
  chemically synthesized
tgaacatgtgagtcaatactac

SEQ ID NO: 21804 - DNA, 22 bp, Artificial Sequence
  chemically synthesized
cataataaactctcatatagat

SEQ ID NO: 21805 - DNA, 22 bp, Artificial Sequence
  chemically synthesized
tcatatagatatagatatagag

SEQ ID NO: 21806 - DNA, 22 bp, Artificial Sequence
  chemically synthesized
atatagatatagatatagagat

SEQ ID NO: 21807 - DNA, 22 bp, Artificial Sequence
  chemically synthesized
ctattaattctgtttctctgta

SEQ ID NO: 21808 - DNA, 22 bp, Artificial Sequence
  chemically synthesized
ttaattctgtttctctgtagaa

SEQ ID NO: 21809 - DNA, 22 bp, Artificial Sequence
  chemically synthesized
attctgtttctctgtagaaccc

SEQ ID NO: 21810 - DNA, 22 bp, Artificial Sequence
  chemically synthesized
tgtttctctgtagaaccctaat

SEQ ID NO: 21811 - DNA, 22 bp, Artificial Sequence
  chemically synthesized
tttctctgtagaaccctaatac

SEQ ID NO: 21812 - DNA, 22 bp, Artificial Sequence
  chemically synthesized
ctctgtagaaccctaatacaga

SEQ ID NO: 21813 - DNA, 22 bp, Artificial Sequence
  chemically synthesized
tctgtagaaccctaatacagat

SEQ ID NO: 21814 - DNA, 22 bp, Artificial Sequence
  chemically synthesized
tgtagaaccctaatacagattt

SEQ ID NO: 21815 - DNA, 22 bp, Artificial Sequence
  chemically synthesized
tagaaccctaatacagattttg

SEQ ID NO: 21816 - DNA, 22 bp, Artificial Sequence
  chemically synthesized
atacagattttggtaccaggag

SEQ ID NO: 21817 - DNA, 22 bp, Artificial Sequence
  chemically synthesized
tggtaccaggagtggttctaga

SEQ ID NO: 21818 - DNA, 22 bp, Artificial Sequence
  chemically synthesized
ggtaccaggagtggttctagag

SEQ ID NO: 21819 - DNA, 22 bp, Artificial Sequence
  chemically synthesized
gtaccaggagtggttctagagg

SEQ ID NO: 21820 - DNA, 22 bp, Artificial Sequence
  chemically synthesized
tagaggaacagaatattaagga

SEQ ID NO: 21821 - DNA, 22 bp, Artificial Sequence
  chemically synthesized
gaggaacagaatattaaggatg

SEQ ID NO: 21822 - DNA, 22 bp, Artificial Sequence
  chemically synthesized
aggatggagttctttcattggt

SEQ ID NO: 21823 - DNA, 22 bp, Artificial Sequence
  chemically synthesized
tttcattggttttggggtttct

SEQ ID NO: 21824 - DNA, 22 bp, Artificial Sequence
  chemically synthesized
tcattggttttggggtttctgg

SEQ ID NO: 21825 - DNA, 22 bp, Artificial Sequence
  chemically synthesized
cattggttttggggtttctgga

SEQ ID NO: 21826 - DNA, 22 bp, Artificial Sequence
  chemically synthesized
attggttttggggtttctggag

SEQ ID NO: 21827 - DNA, 22 bp, Artificial Sequence
  chemically synthesized
gttttggggtttctggagttgg

SEQ ID NO: 21828 - DNA, 22 bp, Artificial Sequence
  chemically synthesized
tggggtttctggagttggctgc

SEQ ID NO: 21829 - DNA, 22 bp, Artificial Sequence
  chemically synthesized
ggggtttctggagttggctgct

SEQ ID NO: 21830 - DNA, 22 bp, Artificial Sequence
  chemically synthesized
gggtttctggagttggctgctt

SEQ ID NO: 21831 - DNA, 22 bp, Artificial Sequence
  chemically synthesized
ctggagttggctgcttaatatg

SEQ ID NO: 21832 - DNA, 22 bp, Artificial Sequence
  chemically synthesized
tggagttggctgcttaatatga

SEQ ID NO: 21833 - DNA, 22 bp, Artificial Sequence
  chemically synthesized
gagttggctgcttaatatgatt

SEQ ID NO: 21834 - DNA, 22 bp, Artificial Sequence
  chemically synthesized
gctgcttaatatgattagaccc

SEQ ID NO: 21835 - DNA, 22 bp, Artificial Sequence
  chemically synthesized
cttaatatgattagacccaaat

SEQ ID NO: 21836 - DNA, 22 bp, Artificial Sequence
  chemically synthesized
aatatgattagacccaaatatg

SEQ ID NO: 21837 - DNA, 22 bp, Artificial Sequence
  chemically synthesized
atatgattagacccaaatatgc

SEQ ID NO: 21838 - DNA, 22 bp, Artificial Sequence
  chemically synthesized
gacccaaatatgctaaggactc

SEQ ID NO: 21839 - DNA, 22 bp, Artificial Sequence
  chemically synthesized
aggactcttcttctaatggtat

SEQ ID NO: 21840 - DNA, 22 bp, Artificial Sequence
  chemically synthesized
ttcttctaatggtatggagaac

SEQ ID NO: 21841 - DNA, 22 bp, Artificial Sequence
  chemically synthesized
cttctaatggtatggagaacac

SEQ ID NO: 21842 - DNA, 22 bp, Artificial Sequence
  chemically synthesized
ttctaatggtatggagaacact

SEQ ID NO: 21843 - DNA, 22 bp, Artificial Sequence
  chemically synthesized
ctaatggtatggagaacactga

SEQ ID NO: 21844 - DNA, 22 bp, Artificial Sequence
  chemically synthesized
taatggtatggagaacactgat

SEQ ID NO: 21845 - DNA, 22 bp, Artificial Sequence
  chemically synthesized
atggtatggagaacactgataa

SEQ ID NO: 21846 - DNA, 22 bp, Artificial Sequence
  chemically synthesized
ataatccttggcatcaattgtt

SEQ ID NO: 21847 - DNA, 22 bp, Artificial Sequence
  chemically synthesized
ggcatcaattgtttagagagtt

SEQ ID NO: 21848 - DNA, 22 bp, Artificial Sequence
  chemically synthesized
gcatcaattgtttagagagtta

SEQ ID NO: 21849 - DNA, 22 bp, Artificial Sequence
  chemically synthesized
tttagagagttatgcaaaataa

SEQ ID NO: 21850 - DNA, 22 bp, Artificial Sequence
  chemically synthesized
agagagttatgcaaaataaatg

SEQ ID NO: 21851 - DNA, 22 bp, Artificial Sequence
  chemically synthesized
gagagttatgcaaaataaatgc

SEQ ID NO: 21852 - DNA, 22 bp, Artificial Sequence
  chemically synthesized
tgcaaaataaatgcatttgaca

SEQ ID NO: 21853 - DNA, 22 bp, Artificial Sequence
  chemically synthesized
gacactcttgattcaacgcttg

SEQ ID NO: 21854 - DNA, 22 bp, Artificial Sequence
  chemically synthesized
acactcttgattcaacgcttgt

SEQ ID NO: 21855 - DNA, 22 bp, Artificial Sequence
  chemically synthesized
ttgattcaacgcttgtgagagg

SEQ ID NO: 21856 - DNA, 22 bp, Artificial Sequence
  chemically synthesized
gattcaacgcttgtgagaggca

SEQ ID NO: 21857 - DNA, 22 bp, Artificial Sequence
  chemically synthesized
attcaacgcttgtgagaggcaa

SEQ ID NO: 21858 - DNA, 22 bp, Artificial Sequence
  chemically synthesized
aacgcttgtgagaggcaaggaa

SEQ ID NO: 21859 - DNA, 22 bp, Artificial Sequence
  chemically synthesized
gtgagaggcaaggaatttagct

SEQ ID NO: 21860 - DNA, 22 bp, Artificial Sequence
  chemically synthesized
tgagaggcaaggaatttagcta

SEQ ID NO: 21861 - DNA, 22 bp, Artificial Sequence
  chemically synthesized
agctactgtatacataatactt

SEQ ID NO: 21862 - DNA, 22 bp, Artificial Sequence
  chemically synthesized
gctactgtatacataatacttt

SEQ ID NO: 21863 - DNA, 22 bp, Artificial Sequence
  chemically synthesized
ctgtatacataatacttttgac

SEQ ID NO: 21864 - DNA, 22 bp, Artificial Sequence
  chemically synthesized
tatacataatacttttgactat

SEQ ID NO: 21865 - DNA, 22 bp, Artificial Sequence
  chemically synthesized
ttgactatatgtggagaatcaa

SEQ ID NO: 21866 - DNA, 22 bp, Artificial Sequence
  chemically synthesized
tgactatatgtggagaatcaag

SEQ ID NO: 21867 - DNA, 22 bp, Artificial Sequence
  chemically synthesized
gactatatgtggagaatcaagg

SEQ ID NO: 21868 - DNA, 22 bp, Artificial Sequence
  chemically synthesized
actatatgtggagaatcaagga

SEQ ID NO: 21869 - DNA, 22 bp, Artificial Sequence
  chemically synthesized
tatgtggagaatcaaggaacat

SEQ ID NO: 21870 - DNA, 22 bp, Artificial Sequence
  chemically synthesized
gttggttgcttgtaagttcgct

SEQ ID NO: 21871 - DNA, 22 bp, Artificial Sequence
  chemically synthesized
gttgcttgtaagttcgctggac

SEQ ID NO: 21872 - DNA, 22 bp, Artificial Sequence
  chemically synthesized
cttgtaagttcgctggacaaag

SEQ ID NO: 21873 - DNA, 22 bp, Artificial Sequence
  chemically synthesized
gtaagttcgctggacaaagtga

SEQ ID NO: 21874 - DNA, 22 bp, Artificial Sequence
  chemically synthesized
taagttcgctggacaaagtgat

SEQ ID NO: 21875 - DNA, 22 bp, Artificial Sequence
  chemically synthesized
gctggacaaagtgatgaaagaa

SEQ ID NO: 21876 - DNA, 22 bp, Artificial Sequence
  chemically synthesized
gacaaagtgatgaaagaaaatg

SEQ ID NO: 21877 - DNA, 22 bp, Artificial Sequence
  chemically synthesized
aggagtatatcaactctccagc

SEQ ID NO: 21878 - DNA, 22 bp, Artificial Sequence
  chemically synthesized
tccagctttgtgccataatctt

SEQ ID NO: 21879 - DNA, 22 bp, Artificial Sequence
  chemically synthesized
cagctttgtgccataatcttat

SEQ ID NO: 21880 - DNA, 22 bp, Artificial Sequence
  chemically synthesized
tgtgccataatcttatttggag

SEQ ID NO: 21881 - DNA, 22 bp, Artificial Sequence
  chemically synthesized
gtgccataatcttatttggaga

SEQ ID NO: 21882 - DNA, 22 bp, Artificial Sequence
  chemically synthesized
tgccataatcttatttggagag

SEQ ID NO: 21883 - DNA, 22 bp, Artificial Sequence
  chemically synthesized
atttggagagaacttgctcacc

SEQ ID NO: 21884 - DNA, 22 bp, Artificial Sequence
  chemically synthesized
tttggagagaacttgctcacct

SEQ ID NO: 21885 - DNA, 22 bp, Artificial Sequence
  chemically synthesized
ggagagaacttgctcacctttc

SEQ ID NO: 21886 - DNA, 22 bp, Artificial Sequence
  chemically synthesized
gagagaacttgctcacctttca

SEQ ID NO: 21887 - DNA, 22 bp, Artificial Sequence
  chemically synthesized
gctcacctttcacttccacaag

SEQ ID NO: 21888 - DNA, 22 bp, Artificial Sequence
  chemically synthesized
ctcacctttcacttccacaaga

SEQ ID NO: 21889 - DNA, 22 bp, Artificial Sequence
  chemically synthesized
acctttcacttccacaagatat

SEQ ID NO: 21890 - DNA, 22 bp, Artificial Sequence
  chemically synthesized
tcacttccacaagatatcacag

SEQ ID NO: 21891 - DNA, 22 bp, Artificial Sequence
  chemically synthesized
cacttccacaagatatcacagt

SEQ ID NO: 21892 - DNA, 22 bp, Artificial Sequence
  chemically synthesized
acttccacaagatatcacagtg

SEQ ID NO: 21893 - DNA, 22 bp, Artificial Sequence
  chemically synthesized
ccacaagatatcacagtggtcc

SEQ ID NO: 21894 - DNA, 22 bp, Artificial Sequence
  chemically synthesized
cacaagatatcacagtggtcca

SEQ ID NO: 21895 - DNA, 22 bp, Artificial Sequence
  chemically synthesized
cattgatgacatgctgactgga

SEQ ID NO: 21896 - DNA, 22 bp, Artificial Sequence
  chemically synthesized
atgacatgctgactggaactag

SEQ ID NO: 21897 - DNA, 22 bp, Artificial Sequence
  chemically synthesized
actggaactagtgagcaagaag

SEQ ID NO: 21898 - DNA, 22 bp, Artificial Sequence
  chemically synthesized
gaactagtgagcaagaagtagc

SEQ ID NO: 21899 - DNA, 22 bp, Artificial Sequence
  chemically synthesized
gtgagcaagaagtagcaaacac

SEQ ID NO: 21900 - DNA, 22 bp, Artificial Sequence
  chemically synthesized
gatttattgatgagacatttgt

SEQ ID NO: 21901 - DNA, 22 bp, Artificial Sequence
  chemically synthesized
attgatgagacatttgtgggac

SEQ ID NO: 21902 - DNA, 22 bp, Artificial Sequence
  chemically synthesized
ttgatgagacatttgtgggaca

SEQ ID NO: 21903 - DNA, 22 bp, Artificial Sequence
  chemically synthesized
atgagacatttgtgggacagag

SEQ ID NO: 21904 - DNA, 22 bp, Artificial Sequence
  chemically synthesized
gtgggacagaggatgggaaata

SEQ ID NO: 21905 - DNA, 22 bp, Artificial Sequence
  chemically synthesized
tgggacagaggatgggaaataa

SEQ ID NO: 21906 - DNA, 22 bp, Artificial Sequence
  chemically synthesized
attaaattcagggaccttctac

SEQ ID NO: 21907 - DNA, 22 bp, Artificial Sequence
  chemically synthesized
aattcagggaccttctacctca

SEQ ID NO: 21908 - DNA, 22 bp, Artificial Sequence
  chemically synthesized
agggaccttctacctcagtaaa

SEQ ID NO: 21909 - DNA, 22 bp, Artificial Sequence
  chemically synthesized
ctacctcagtaaaatttatagg

SEQ ID NO: 21910 - DNA, 22 bp, Artificial Sequence
  chemically synthesized
tacctcagtaaaatttataggg

SEQ ID NO: 21911 - DNA, 22 bp, Artificial Sequence
  chemically synthesized
cctcagtaaaatttataggggt

SEQ ID NO: 21912 - DNA, 22 bp, Artificial Sequence
  chemically synthesized
agtaaaatttataggggtccaa

SEQ ID NO: 21913 - DNA, 22 bp, Artificial Sequence
  chemically synthesized
ataggggtccaatggtttgggg

SEQ ID NO: 21914 - DNA, 22 bp, Artificial Sequence
  chemically synthesized
taggggtccaatggtttggggc

SEQ ID NO: 21915 - DNA, 22 bp, Artificial Sequence
  chemically synthesized
ggggctctttgagatattcctt

SEQ ID NO: 21916 - DNA, 22 bp, Artificial Sequence
  chemically synthesized
gggctctttgagatattccttc

SEQ ID NO: 21917 - DNA, 22 bp, Artificial Sequence
  chemically synthesized
tttgagatattccttctaaagt

SEQ ID NO: 21918 - DNA, 22 bp, Artificial Sequence
  chemically synthesized
tgagatattccttctaaagtga

SEQ ID NO: 21919 - DNA, 22 bp, Artificial Sequence
  chemically synthesized
gagatattccttctaaagtgaa

SEQ ID NO: 21920 - DNA, 22 bp, Artificial Sequence
  chemically synthesized
agatattccttctaaagtgaag

SEQ ID NO: 21921 - DNA, 22 bp, Artificial Sequence
  chemically synthesized
cttctaaagtgaaggataattt

SEQ ID NO: 21922 - DNA, 22 bp, Artificial Sequence
  chemically synthesized
ctaaagtgaaggataatttgct

SEQ ID NO: 21923 - DNA, 22 bp, Artificial Sequence
  chemically synthesized
taaagtgaaggataatttgctg

SEQ ID NO: 21924 - DNA, 22 bp, Artificial Sequence
  chemically synthesized
aagtgaaggataatttgctgca

SEQ ID NO: 21925 - DNA, 22 bp, Artificial Sequence
  chemically synthesized
gctgcatttggccactcttaca

SEQ ID NO: 21926 - DNA, 22 bp, Artificial Sequence
  chemically synthesized
ctgcatttggccactcttacaa

SEQ ID NO: 21927 - DNA, 22 bp, Artificial Sequence
  chemically synthesized
catttggccactcttacaacca

SEQ ID NO: 21928 - DNA, 22 bp, Artificial Sequence
  chemically synthesized
ggccactcttacaaccaagaaa

SEQ ID NO: 21929 - DNA, 22 bp, Artificial Sequence
  chemically synthesized
gccactcttacaaccaagaaat

SEQ ID NO: 21930 - DNA, 22 bp, Artificial Sequence
  chemically synthesized
ttacaaccaagaaataggcaca

SEQ ID NO: 21931 - DNA, 22 bp, Artificial Sequence
  chemically synthesized
acaaccaagaaataggcacaac

SEQ ID NO: 21932 - DNA, 22 bp, Artificial Sequence
  chemically synthesized
caaccaagaaataggcacaacg

SEQ ID NO: 21933 - DNA, 22 bp, Artificial Sequence
  chemically synthesized
gtgggcctatttggattttgga

SEQ ID NO: 21934 - DNA, 22 bp, Artificial Sequence
  chemically synthesized
tttggattttggaggcaacata

SEQ ID NO: 21935 - DNA, 22 bp, Artificial Sequence
  chemically synthesized
ggattttggaggcaacatattc

SEQ ID NO: 21936 - DNA, 22 bp, Artificial Sequence
  chemically synthesized
gattttggaggcaacatattcc

SEQ ID NO: 21937 - DNA, 22 bp, Artificial Sequence
  chemically synthesized
tggaggcaacatattcctgatt

SEQ ID NO: 21938 - DNA, 22 bp, Artificial Sequence
  chemically synthesized
ggaggcaacatattcctgattt

SEQ ID NO: 21939 - DNA, 22 bp, Artificial Sequence
  chemically synthesized
gaggcaacatattcctgatttg

SEQ ID NO: 21940 - DNA, 22 bp, Artificial Sequence
  chemically synthesized
ctgatttgggtgtgttactctg

SEQ ID NO: 21941 - DNA, 22 bp, Artificial Sequence
  chemically synthesized
atttgggtgtgttactctggcc

SEQ ID NO: 21942 - DNA, 22 bp, Artificial Sequence
  chemically synthesized
gggtgtgttactctggcccatt

SEQ ID NO: 21943 - DNA, 22 bp, Artificial Sequence
  chemically synthesized
ggtgtgttactctggcccattt

SEQ ID NO: 21944 - DNA, 22 bp, Artificial Sequence
  chemically synthesized
ctctggcccatttatcgagtga

SEQ ID NO: 21945 - DNA, 22 bp, Artificial Sequence
  chemically synthesized
tggcccatttatcgagtgatcc

SEQ ID NO: 21946 - DNA, 22 bp, Artificial Sequence
  chemically synthesized
gcccatttatcgagtgatccaa

SEQ ID NO: 21947 - DNA, 22 bp, Artificial Sequence
  chemically synthesized
atcgagtgatccaaaaggctgc

SEQ ID NO: 21948 - DNA, 22 bp, Artificial Sequence
  chemically synthesized
tcgagtgatccaaaaggctgcc

SEQ ID NO: 21949 - DNA, 22 bp, Artificial Sequence
  chemically synthesized
ccagttttgagtggagtccaga

SEQ ID NO: 21950 - DNA, 22 bp, Artificial Sequence
  chemically synthesized
tgagtggagtccagaacagaag

SEQ ID NO: 21951 - DNA, 22 bp, Artificial Sequence
  chemically synthesized
gagtggagtccagaacagaagg

SEQ ID NO: 21952 - DNA, 22 bp, Artificial Sequence
  chemically synthesized
agtggagtccagaacagaaggc

SEQ ID NO: 21953 - DNA, 22 bp, Artificial Sequence
  chemically synthesized
tgccacaggtccaggctgctgt

SEQ ID NO: 21954 - DNA, 22 bp, Artificial Sequence
  chemically synthesized
ccacaggtccaggctgctgtgc

SEQ ID NO: 21955 - DNA, 22 bp, Artificial Sequence
  chemically synthesized
ctgtgcaagctgctatgccact

SEQ ID NO: 21956 - DNA, 22 bp, Artificial Sequence
  chemically synthesized
tgcaagctgctatgccacttgg

SEQ ID NO: 21957 - DNA, 22 bp, Artificial Sequence
  chemically synthesized
ctatgccacttgggccatatga

SEQ ID NO: 21958 - DNA, 22 bp, Artificial Sequence
  chemically synthesized
tgccacttgggccatatgacct

SEQ ID NO: 21959 - DNA, 22 bp, Artificial Sequence
  chemically synthesized
gggccatatgacctagcagatc

SEQ ID NO: 21960 - DNA, 22 bp, Artificial Sequence
  chemically synthesized
ggccatatgacctagcagatcc

SEQ ID NO: 21961 - DNA, 22 bp, Artificial Sequence
  chemically synthesized
gcagatccaatgatgcttgagg

SEQ ID NO: 21962 - DNA, 22 bp, Artificial Sequence
  chemically synthesized
gaggtgtcagtgccagataggg

SEQ ID NO: 21963 - DNA, 22 bp, Artificial Sequence
  chemically synthesized
aggtgtcagtgccagataggga

SEQ ID NO: 21964 - DNA, 22 bp, Artificial Sequence
  chemically synthesized
tttggagcatttggcaggctga

SEQ ID NO: 21965 - DNA, 22 bp, Artificial Sequence
  chemically synthesized
ggagcatttggcaggctgaatc

SEQ ID NO: 21966 - DNA, 22 bp, Artificial Sequence
  chemically synthesized
gagcatttggcaggctgaatca

SEQ ID NO: 21967 - DNA, 22 bp, Artificial Sequence
  chemically synthesized
ggcaggctgaatcacagcggag

SEQ ID NO: 21968 - DNA, 22 bp, Artificial Sequence
  chemically synthesized
gcaggctgaatcacagcggagg

SEQ ID NO: 21969 - DNA, 22 bp, Artificial Sequence
  chemically synthesized
aatcacagcggaggcctctagg

SEQ ID NO: 21970 - DNA, 22 bp, Artificial Sequence
  chemically synthesized
taggattttggagcaaggccct

SEQ ID NO: 21971 - DNA, 22 bp, Artificial Sequence
  chemically synthesized
ggattttggagcaaggccctgc

SEQ ID NO: 21972 - DNA, 22 bp, Artificial Sequence
  chemically synthesized
tggagcaaggccctgccatctt

SEQ ID NO: 21973 - DNA, 22 bp, Artificial Sequence
  chemically synthesized
ggagcaaggccctgccatcttc

SEQ ID NO: 21974 - DNA, 22 bp, Artificial Sequence
  chemically synthesized
gagcaaggccctgccatcttct

SEQ ID NO: 21975 - DNA, 22 bp, Artificial Sequence
  chemically synthesized
ccatcttctgcagataactact

SEQ ID NO: 21976 - DNA, 22 bp, Artificial Sequence
  chemically synthesized
ctgcagataactactctctttt

SEQ ID NO: 21977 - DNA, 22 bp, Artificial Sequence
  chemically synthesized
tgcagataactactctctttta

SEQ ID NO: 21978 - DNA, 22 bp, Artificial Sequence
  chemically synthesized
cagataactactctcttttagg

SEQ ID NO: 21979 - DNA, 22 bp, Artificial Sequence
  chemically synthesized
ctctcttttagggagaaagctc

SEQ ID NO: 21980 - DNA, 22 bp, Artificial Sequence
  chemically synthesized
tcttttagggagaaagctcttg

SEQ ID NO: 21981 - DNA, 22 bp, Artificial Sequence
  chemically synthesized
ttttagggagaaagctcttggc

SEQ ID NO: 21982 - DNA, 22 bp, Artificial Sequence
  chemically synthesized
ttagggagaaagctcttggcct

SEQ ID NO: 21983 - DNA, 22 bp, Artificial Sequence
  chemically synthesized
tagggagaaagctcttggcctg

SEQ ID NO: 21984 - DNA, 22 bp, Artificial Sequence
  chemically synthesized
agggagaaagctcttggcctgt

SEQ ID NO: 21985 - DNA, 22 bp, Artificial Sequence
  chemically synthesized
gggagaaagctcttggcctgtt

SEQ ID NO: 21986 - DNA, 22 bp, Artificial Sequence
  chemically synthesized
ttggcctgttactgggctttgg

SEQ ID NO: 21987 - DNA, 22 bp, Artificial Sequence
  chemically synthesized
ggcctgttactgggctttggtg

SEQ ID NO: 21988 - DNA, 22 bp, Artificial Sequence
  chemically synthesized
gcctgttactgggctttggtgg

SEQ ID NO: 21989 - DNA, 22 bp, Artificial Sequence
  chemically synthesized
ttactgggctttggtggaaacg

SEQ ID NO: 21990 - DNA, 22 bp, Artificial Sequence
  chemically synthesized
ctgggctttggtggaaacgaaa

SEQ ID NO: 21991 - DNA, 22 bp, Artificial Sequence
  chemically synthesized
ggctttggtggaaacgaaatat

SEQ ID NO: 21992 - DNA, 22 bp, Artificial Sequence
  chemically synthesized
tggtggaaacgaaatatttgac

SEQ ID NO: 21993 - DNA, 22 bp, Artificial Sequence
  chemically synthesized
ggtggaaacgaaatatttgact

SEQ ID NO: 21994 - DNA, 22 bp, Artificial Sequence
  chemically synthesized
gtggaaacgaaatatttgacta

SEQ ID NO: 21995 - DNA, 22 bp, Artificial Sequence
  chemically synthesized
gactatgagtcatcaagtcacc

SEQ ID NO: 21996 - DNA, 22 bp, Artificial Sequence
  chemically synthesized
actatgagtcatcaagtcacca

SEQ ID NO: 21997 - DNA, 22 bp, Artificial Sequence
  chemically synthesized
tgagtcatcaagtcaccatgtg

SEQ ID NO: 21998 - DNA, 22 bp, Artificial Sequence
  chemically synthesized
aactgcctatcatgaactgggt

SEQ ID NO: 21999 - DNA, 22 bp, Artificial Sequence
  chemically synthesized
cctatcatgaactgggtgcttt

SEQ ID NO: 22000 - DNA, 22 bp, Artificial Sequence
  chemically synthesized
tcatgaactgggtgctttctga

SEQ ID NO: 22001 - DNA, 22 bp, Artificial Sequence
  chemically synthesized
ggtgctttctgatccatctagc

SEQ ID NO: 22002 - DNA, 22 bp, Artificial Sequence
  chemically synthesized
tctgatccatctagccataaag

SEQ ID NO: 22003 - DNA, 22 bp, Artificial Sequence
  chemically synthesized
ctgatccatctagccataaagt

SEQ ID NO: 22004 - DNA, 22 bp, Artificial Sequence
  chemically synthesized
tgatccatctagccataaagtg

SEQ ID NO: 22005 - DNA, 22 bp, Artificial Sequence
  chemically synthesized
atccatctagccataaagtggg

SEQ ID NO: 22006 - DNA, 22 bp, Artificial Sequence
  chemically synthesized
gccataaagtgggctgtgcaca

SEQ ID NO: 22007 - DNA, 22 bp, Artificial Sequence
  chemically synthesized
tgcacagcagcattgcatcagc

SEQ ID NO: 22008 - DNA, 22 bp, Artificial Sequence
  chemically synthesized
catcagcaaatggaagtggtat

SEQ ID NO: 22009 - DNA, 22 bp, Artificial Sequence
  chemically synthesized
ggcttgagcagatcctgaaggc

SEQ ID NO: 22010 - DNA, 22 bp, Artificial Sequence
  chemically synthesized
gagcagatcctgaaggcactag

SEQ ID NO: 22011 - DNA, 22 bp, Artificial Sequence
  chemically synthesized
agcagatcctgaaggcactagt

SEQ ID NO: 22012 - DNA, 22 bp, Artificial Sequence
  chemically synthesized
aaggcactagtaagttacatga

SEQ ID NO: 22013 - DNA, 22 bp, Artificial Sequence
  chemically synthesized
gtaagttacatgagaaaggggc

SEQ ID NO: 22014 - DNA, 22 bp, Artificial Sequence
  chemically synthesized
catgagaaaggggctcaaatgc

SEQ ID NO: 22015 - DNA, 22 bp, Artificial Sequence
  chemically synthesized
aaatgcccatggtctccactcc

SEQ ID NO: 22016 - DNA, 22 bp, Artificial Sequence
  chemically synthesized
cactcctgacacactgctttct

SEQ ID NO: 22017 - DNA, 22 bp, Artificial Sequence
  chemically synthesized
ctgacacactgctttctctccc

SEQ ID NO: 22018 - DNA, 22 bp, Artificial Sequence
  chemically synthesized
acacactgctttctctccctga

SEQ ID NO: 22019 - DNA, 22 bp, Artificial Sequence
  chemically synthesized
ctttctctccctgagactgcac

SEQ ID NO: 22020 - DNA, 22 bp, Artificial Sequence
  chemically synthesized
tctctccctgagactgcaccga

SEQ ID NO: 22021 - DNA, 22 bp, Artificial Sequence
  chemically synthesized
ctctccctgagactgcaccgat

SEQ ID NO: 22022 - DNA, 22 bp, Artificial Sequence
  chemically synthesized
tctccctgagactgcaccgatg

SEQ ID NO: 22023 - DNA, 22 bp, Artificial Sequence
  chemically synthesized
tccctgagactgcaccgatggt

SEQ ID NO: 22024 - DNA, 22 bp, Artificial Sequence
  chemically synthesized
cctgagactgcaccgatggtct

SEQ ID NO: 22025 - DNA, 22 bp, Artificial Sequence
  chemically synthesized
agactgcaccgatggtctcatg

SEQ ID NO: 22026 - DNA, 22 bp, Artificial Sequence
  chemically synthesized
caccgatggtctcatggggagt

SEQ ID NO: 22027 - DNA, 22 bp, Artificial Sequence
  chemically synthesized
atggggagttccctatgatcag

SEQ ID NO: 22028 - DNA, 22 bp, Artificial Sequence
  chemically synthesized
cctatgatcagctgacagagga

SEQ ID NO: 22029 - DNA, 22 bp, Artificial Sequence
  chemically synthesized
tgatcagctgacagaggaagag

SEQ ID NO: 22030 - DNA, 22 bp, Artificial Sequence
  chemically synthesized
acagaggaagagaagactaggt

SEQ ID NO: 22031 - DNA, 22 bp, Artificial Sequence
  chemically synthesized
ggtcctggttcacagatagttc

SEQ ID NO: 22032 - DNA, 22 bp, Artificial Sequence
  chemically synthesized
gttcacagatagttctgcacga

SEQ ID NO: 22033 - DNA, 22 bp, Artificial Sequence
  chemically synthesized
acagatagttctgcacgatatg

SEQ ID NO: 22034 - DNA, 22 bp, Artificial Sequence
  chemically synthesized
tgcacgatatgcaggcaccacc

SEQ ID NO: 22035 - DNA, 22 bp, Artificial Sequence
  chemically synthesized
cacgatatgcaggcaccaccca

SEQ ID NO: 22036 - DNA, 22 bp, Artificial Sequence
  chemically synthesized
cagcccctttctaggacatccc

SEQ ID NO: 22037 - DNA, 22 bp, Artificial Sequence
  chemically synthesized
tctaggacatccctgaaggaca

SEQ ID NO: 22038 - DNA, 22 bp, Artificial Sequence
  chemically synthesized
ctaggacatccctgaaggacaa

SEQ ID NO: 22039 - DNA, 22 bp, Artificial Sequence
  chemically synthesized
taggacatccctgaaggacaac

SEQ ID NO: 22040 - DNA, 22 bp, Artificial Sequence
  chemically synthesized
ggacatccctgaaggacaacgg

SEQ ID NO: 22041 - DNA, 22 bp, Artificial Sequence
  chemically synthesized
aaggacaacggtgaagggaaat

SEQ ID NO: 22042 - DNA, 22 bp, Artificial Sequence
  chemically synthesized
cctagttggcagaactttgagc

SEQ ID NO: 22043 - DNA, 22 bp, Artificial Sequence
  chemically synthesized
ctagttggcagaactttgagca

SEQ ID NO: 22044 - DNA, 22 bp, Artificial Sequence
  chemically synthesized
gttggcagaactttgagcagtg

SEQ ID NO: 22045 - DNA, 22 bp, Artificial Sequence
  chemically synthesized
gcagaactttgagcagtgtgcc

SEQ ID NO: 22046 - DNA, 22 bp, Artificial Sequence
  chemically synthesized
tgagcagtgtgcctggttgtgc

SEQ ID NO: 22047 - DNA, 22 bp, Artificial Sequence
  chemically synthesized
gagcagtgtgcctggttgtgca

SEQ ID NO: 22048 - DNA, 22 bp, Artificial Sequence
  chemically synthesized
agcagtgtgcctggttgtgcac

SEQ ID NO: 22049 - DNA, 22 bp, Artificial Sequence
  chemically synthesized
gttgtgcactttgcacagaagg

SEQ ID NO: 22050 - DNA, 22 bp, Artificial Sequence
  chemically synthesized
tgcactttgcacagaaggagaa

SEQ ID NO: 22051 - DNA, 22 bp, Artificial Sequence
  chemically synthesized
tgcacagaaggagaaatggcca

SEQ ID NO: 22052 - DNA, 22 bp, Artificial Sequence
  chemically synthesized
gcacagaaggagaaatggccag

SEQ ID NO: 22053 - DNA, 22 bp, Artificial Sequence
  chemically synthesized
cacagaaggagaaatggccaga

SEQ ID NO: 22054 - DNA, 22 bp, Artificial Sequence
  chemically synthesized
gcgattatatacttattcatgg

SEQ ID NO: 22055 - DNA, 22 bp, Artificial Sequence
  chemically synthesized
cgattatatacttattcatggg

SEQ ID NO: 22056 - DNA, 22 bp, Artificial Sequence
  chemically synthesized
tatacttattcatgggctgtag

SEQ ID NO: 22057 - DNA, 22 bp, Artificial Sequence
  chemically synthesized
attcatgggctgtagccaaagg

SEQ ID NO: 22058 - DNA, 22 bp, Artificial Sequence
  chemically synthesized
ttcatgggctgtagccaaaggt

SEQ ID NO: 22059 - DNA, 22 bp, Artificial Sequence
  chemically synthesized
atgggctgtagccaaaggtttg

SEQ ID NO: 22060 - DNA, 22 bp, Artificial Sequence
  chemically synthesized
tagccaaaggtttggctagatg

SEQ ID NO: 22061 - DNA, 22 bp, Artificial Sequence
  chemically synthesized
ggctagatggtcagggacttgg

SEQ ID NO: 22062 - DNA, 22 bp, Artificial Sequence
  chemically synthesized
gctagatggtcagggacttgga

SEQ ID NO: 22063 - DNA, 22 bp, Artificial Sequence
  chemically synthesized
gatggtcagggacttggaaaaa

SEQ ID NO: 22064 - DNA, 22 bp, Artificial Sequence
  chemically synthesized
ggaaaaagcatgactggaaaat

SEQ ID NO: 22065 - DNA, 22 bp, Artificial Sequence
  chemically synthesized
gaaaaagcatgactggaaaatt

SEQ ID NO: 22066 - DNA, 22 bp, Artificial Sequence
  chemically synthesized
gaaaattgatgacaaagaaatt

SEQ ID NO: 22067 - DNA, 22 bp, Artificial Sequence
  chemically synthesized
atgacaaagaaatttggggaag

SEQ ID NO: 22068 - DNA, 22 bp, Artificial Sequence
  chemically synthesized
ggggaagaggtatgtggatgga

SEQ ID NO: 22069 - DNA, 22 bp, Artificial Sequence
  chemically synthesized
gggaagaggtatgtggatggac

SEQ ID NO: 22070 - DNA, 22 bp, Artificial Sequence
  chemically synthesized
tatgattagtcaaaaactacaa

SEQ ID NO: 22071 - DNA, 22 bp, Artificial Sequence
  chemically synthesized
tgattagtcaaaaactacaaag

SEQ ID NO: 22072 - DNA, 22 bp, Artificial Sequence
  chemically synthesized
gtcaaaaactacaaagatattt

SEQ ID NO: 22073 - DNA, 22 bp, Artificial Sequence
  chemically synthesized
caaagatattttcatcccatgt

SEQ ID NO: 22074 - DNA, 22 bp, Artificial Sequence
  chemically synthesized
tcatcccatgtgagtgctcacc

SEQ ID NO: 22075 - DNA, 22 bp, Artificial Sequence
  chemically synthesized
catcccatgtgagtgctcacca

SEQ ID NO: 22076 - DNA, 22 bp, Artificial Sequence
  chemically synthesized
atcccatgtgagtgctcaccaa

SEQ ID NO: 22077 - DNA, 22 bp, Artificial Sequence
  chemically synthesized
accaatgggtgacctcagcaga

SEQ ID NO: 22078 - DNA, 22 bp, Artificial Sequence
  chemically synthesized
agcagaagaggattttaataat

SEQ ID NO: 22079 - DNA, 22 bp, Artificial Sequence
  chemically synthesized
taataatcaagtggataggatg

SEQ ID NO: 22080 - DNA, 22 bp, Artificial Sequence
  chemically synthesized
aataatcaagtggataggatga

SEQ ID NO: 22081 - DNA, 22 bp, Artificial Sequence
  chemically synthesized
ataatcaagtggataggatgat

SEQ ID NO: 22082 - DNA, 22 bp, Artificial Sequence
  chemically synthesized
tgtggacaccactcagcctttt

SEQ ID NO: 22083 - DNA, 22 bp, Artificial Sequence
  chemically synthesized
tggacaccactcagccttttcc

SEQ ID NO: 22084 - DNA, 22 bp, Artificial Sequence
  chemically synthesized
agccttttcccaggccactcat

SEQ ID NO: 22085 - DNA, 22 bp, Artificial Sequence
  chemically synthesized
ttcccaggccactcatgtcatc

SEQ ID NO: 22086 - DNA, 22 bp, Artificial Sequence
  chemically synthesized
tcccaggccactcatgtcatcg

SEQ ID NO: 22087 - DNA, 22 bp, Artificial Sequence
  chemically synthesized
cccaggccactcatgtcatcgt

SEQ ID NO: 22088 - DNA, 22 bp, Artificial Sequence
  chemically synthesized
ccaggccactcatgtcatcgtc

SEQ ID NO: 22089 - DNA, 22 bp, Artificial Sequence
  chemically synthesized
atgtcatcgtccaatggaccca

SEQ ID NO: 22090 - DNA, 22 bp, Artificial Sequence
  chemically synthesized
cagggatggaagttatgcttgg

SEQ ID NO: 22091 - DNA, 22 bp, Artificial Sequence
  chemically synthesized
tgcttgggctcagcaacatgga

SEQ ID NO: 22092 - DNA, 22 bp, Artificial Sequence
  chemically synthesized
gggctcagcaacatggacttcc

SEQ ID NO: 22093 - DNA, 22 bp, Artificial Sequence
  chemically synthesized
ggctcagcaacatggacttcca

SEQ ID NO: 22094 - DNA, 22 bp, Artificial Sequence
  chemically synthesized
agcaacatggacttccactcac

SEQ ID NO: 22095 - DNA, 22 bp, Artificial Sequence
  chemically synthesized
ccactcaccaaagctgacctgg

SEQ ID NO: 22096 - DNA, 22 bp, Artificial Sequence
  chemically synthesized
cactcaccaaagctgacctggc

SEQ ID NO: 22097 - DNA, 22 bp, Artificial Sequence
  chemically synthesized
accaaagctgacctggccacag

SEQ ID NO: 22098 - DNA, 22 bp, Artificial Sequence
  chemically synthesized
acctggccacagccactgcttg

SEQ ID NO: 22099 - DNA, 22 bp, Artificial Sequence
  chemically synthesized
gccacagccactgcttgccagc

SEQ ID NO: 22100 - DNA, 22 bp, Artificial Sequence
  chemically synthesized
cttgccagcatcagagaccaac

SEQ ID NO: 22101 - DNA, 22 bp, Artificial Sequence
  chemically synthesized
gccagcatcagagaccaacact

SEQ ID NO: 22102 - DNA, 22 bp, Artificial Sequence
  chemically synthesized
ccagcatcagagaccaacacta

SEQ ID NO: 22103 - DNA, 22 bp, Artificial Sequence
  chemically synthesized
agcccttgatatggcaccattc

SEQ ID NO: 22104 - DNA, 22 bp, Artificial Sequence
  chemically synthesized
gatatggcaccattcctcgggg

SEQ ID NO: 22105 - DNA, 22 bp, Artificial Sequence
  chemically synthesized
atatggcaccattcctcggggt

SEQ ID NO: 22106 - DNA, 22 bp, Artificial Sequence
  chemically synthesized
ctcggggtgatcagccagctac

SEQ ID NO: 22107 - DNA, 22 bp, Artificial Sequence
  chemically synthesized
ggggtgatcagccagctacctg

SEQ ID NO: 22108 - DNA, 22 bp, Artificial Sequence
  chemically synthesized
cctggtggcaggttgattatat

SEQ ID NO: 22109 - DNA, 22 bp, Artificial Sequence
  chemically synthesized
gtggcaggttgattatattgga

SEQ ID NO: 22110 - DNA, 22 bp, Artificial Sequence
  chemically synthesized
attatattggacctcttccatc

SEQ ID NO: 22111 - DNA, 22 bp, Artificial Sequence
  chemically synthesized
tattggacctcttccatcatgg

SEQ ID NO: 22112 - DNA, 22 bp, Artificial Sequence
  chemically synthesized
gacctcttccatcatggaaagg

SEQ ID NO: 22113 - DNA, 22 bp, Artificial Sequence
  chemically synthesized
ttccatcatggaaagggcagag

SEQ ID NO: 22114 - DNA, 22 bp, Artificial Sequence
  chemically synthesized
ccatcatggaaagggcagaggc

SEQ ID NO: 22115 - DNA, 22 bp, Artificial Sequence
  chemically synthesized
catcatggaaagggcagaggct

SEQ ID NO: 22116 - DNA, 22 bp, Artificial Sequence
  chemically synthesized
gtcctcactggaatagacactt

SEQ ID NO: 22117 - DNA, 22 bp, Artificial Sequence
  chemically synthesized
tcctcactggaatagacactta

SEQ ID NO: 22118 - DNA, 22 bp, Artificial Sequence
  chemically synthesized
actggaatagacacttactctg

SEQ ID NO: 22119 - DNA, 22 bp, Artificial Sequence
  chemically synthesized
gaatagacacttactctggata

SEQ ID NO: 22120 - DNA, 22 bp, Artificial Sequence
  chemically synthesized
actctggatatgggtttcccaa

SEQ ID NO: 22121 - DNA, 22 bp, Artificial Sequence
  chemically synthesized
ctctggatatgggtttcccaat

SEQ ID NO: 22122 - DNA, 22 bp, Artificial Sequence
  chemically synthesized
tggatatgggtttcccaatcct

SEQ ID NO: 22123 - DNA, 22 bp, Artificial Sequence
  chemically synthesized
gatatgggtttcccaatcctga

SEQ ID NO: 22124 - DNA, 22 bp, Artificial Sequence
  chemically synthesized
cccaatcctgaactcaatgctt

SEQ ID NO: 22125 - DNA, 22 bp, Artificial Sequence
  chemically synthesized
ccaatcctgaactcaatgctta

SEQ ID NO: 22126 - DNA, 22 bp, Artificial Sequence
  chemically synthesized
aactcaatgcttatgccaagac

SEQ ID NO: 22127 - DNA, 22 bp, Artificial Sequence
  chemically synthesized
aatgcttatgccaagactacca

SEQ ID NO: 22128 - DNA, 22 bp, Artificial Sequence
  chemically synthesized
atgccaagactaccatccatgg

SEQ ID NO: 22129 - DNA, 22 bp, Artificial Sequence
  chemically synthesized
tgccaagactaccatccatgga

SEQ ID NO: 22130 - DNA, 22 bp, Artificial Sequence
  chemically synthesized
ccatccatggaatcacagaatg

SEQ ID NO: 22131 - DNA, 22 bp, Artificial Sequence
  chemically synthesized
tcatggtattccacacagcatt

SEQ ID NO: 22132 - DNA, 22 bp, Artificial Sequence
  chemically synthesized
cacacagcattgcttctgacca

SEQ ID NO: 22133 - DNA, 22 bp, Artificial Sequence
  chemically synthesized
cttctgaccaagccactcactt

SEQ ID NO: 22134 - DNA, 22 bp, Artificial Sequence
  chemically synthesized
ctgaccaagccactcactttat

SEQ ID NO: 22135 - DNA, 22 bp, Artificial Sequence
  chemically synthesized
tgaccaagccactcactttatg

SEQ ID NO: 22136 - DNA, 22 bp, Artificial Sequence
  chemically synthesized
accaagccactcactttatggc

SEQ ID NO: 22137 - DNA, 22 bp, Artificial Sequence
  chemically synthesized
actttatggctaaagaagtgtg

SEQ ID NO: 22138 - DNA, 22 bp, Artificial Sequence
  chemically synthesized
tatggctaaagaagtgtgacag

SEQ ID NO: 22139 - DNA, 22 bp, Artificial Sequence
  chemically synthesized
atggctaaagaagtgtgacagt

SEQ ID NO: 22140 - DNA, 22 bp, Artificial Sequence
  chemically synthesized
tggctaaagaagtgtgacagtg

SEQ ID NO: 22141 - DNA, 22 bp, Artificial Sequence
  chemically synthesized
aagaagtgtgacagtgggctca

SEQ ID NO: 22142 - DNA, 22 bp, Artificial Sequence
  chemically synthesized
atgctcatggaatttactggtc

SEQ ID NO: 22143 - DNA, 22 bp, Artificial Sequence
  chemically synthesized
atggaatttactggtcttacca

SEQ ID NO: 22144 - DNA, 22 bp, Artificial Sequence
  chemically synthesized
actggtcttaccatgatcccta

SEQ ID NO: 22145 - DNA, 22 bp, Artificial Sequence
  chemically synthesized
ctggtcttaccatgatccctat

SEQ ID NO: 22146 - DNA, 22 bp, Artificial Sequence
  chemically synthesized
gtcttaccatgatccctatcat

SEQ ID NO: 22147 - DNA, 22 bp, Artificial Sequence
  chemically synthesized
accatgatccctatcatcctga

SEQ ID NO: 22148 - DNA, 22 bp, Artificial Sequence
  chemically synthesized
ccatgatccctatcatcctgaa

SEQ ID NO: 22149 - DNA, 22 bp, Artificial Sequence
  chemically synthesized
tcatcctgaagcagcttttgaa

SEQ ID NO: 22150 - DNA, 22 bp, Artificial Sequence
  chemically synthesized
aagcagcttttgaatggccttt

SEQ ID NO: 22151 - DNA, 22 bp, Artificial Sequence
  chemically synthesized
ttgaatggccttttgaagtcac

SEQ ID NO: 22152 - DNA, 22 bp, Artificial Sequence
  chemically synthesized
tgaatggccttttgaagtcacg

SEQ ID NO: 22153 - DNA, 22 bp, Artificial Sequence
  chemically synthesized
gaatggccttttgaagtcacga

SEQ ID NO: 22154 - DNA, 22 bp, Artificial Sequence
  chemically synthesized
aatggccttttgaagtcacgat

SEQ ID NO: 22155 - DNA, 22 bp, Artificial Sequence
  chemically synthesized
ttgaagtcacgattacaatgcc

SEQ ID NO: 22156 - DNA, 22 bp, Artificial Sequence
  chemically synthesized
tgaagtcacgattacaatgcca

SEQ ID NO: 22157 - DNA, 22 bp, Artificial Sequence
  chemically synthesized
gaagtcacgattacaatgccaa

SEQ ID NO: 22158 - DNA, 22 bp, Artificial Sequence
  chemically synthesized
aagtcacgattacaatgccaac

SEQ ID NO: 22159 - DNA, 22 bp, Artificial Sequence
  chemically synthesized
caatgccaactaggtgacaata

SEQ ID NO: 22160 - DNA, 22 bp, Artificial Sequence
  chemically synthesized
ggtgacaatactttgcaggcct

SEQ ID NO: 22161 - DNA, 22 bp, Artificial Sequence
  chemically synthesized
tgcaggcctggggcaaagttct

SEQ ID NO: 22162 - DNA, 22 bp, Artificial Sequence
  chemically synthesized
gcaggcctggggcaaagttctc

SEQ ID NO: 22163 - DNA, 22 bp, Artificial Sequence
  chemically synthesized
caggcctggggcaaagttctcc

SEQ ID NO: 22164 - DNA, 22 bp, Artificial Sequence
  chemically synthesized
gggcaaagttctccagaaggct

SEQ ID NO: 22165 - DNA, 22 bp, Artificial Sequence
  chemically synthesized
tccagaaggctgtgtatgctct

SEQ ID NO: 22166 - DNA, 22 bp, Artificial Sequence
  chemically synthesized
cagaaggctgtgtatgctctga

SEQ ID NO: 22167 - DNA, 22 bp, Artificial Sequence
  chemically synthesized
tgtatgctctgaatcagtgtcc

SEQ ID NO: 22168 - DNA, 22 bp, Artificial Sequence
  chemically synthesized
tgaatcagtgtccaatatatgg

SEQ ID NO: 22169 - DNA, 22 bp, Artificial Sequence
  chemically synthesized
aatcagtgtccaatatatggta

SEQ ID NO: 22170 - DNA, 22 bp, Artificial Sequence
  chemically synthesized
tttctcccatagacaggattca

SEQ ID NO: 22171 - DNA, 22 bp, Artificial Sequence
  chemically synthesized
ctcccatagacaggattcacgg

SEQ ID NO: 22172 - DNA, 22 bp, Artificial Sequence
  chemically synthesized
tcccatagacaggattcacggg

SEQ ID NO: 22173 - DNA, 22 bp, Artificial Sequence
  chemically synthesized
ccatagacaggattcacgggtc

SEQ ID NO: 22174 - DNA, 22 bp, Artificial Sequence
  chemically synthesized
acgggtccaggaatcaaagggt

SEQ ID NO: 22175 - DNA, 22 bp, Artificial Sequence
  chemically synthesized
accatcacccctagtgttccac

SEQ ID NO: 22176 - DNA, 22 bp, Artificial Sequence
  chemically synthesized
gtgttccactagcaaaattttt

SEQ ID NO: 22177 - DNA, 22 bp, Artificial Sequence
  chemically synthesized
cactagcaaaatttttgcttcc

SEQ ID NO: 22178 - DNA, 22 bp, Artificial Sequence
  chemically synthesized
gcaaaatttttgcttcctgttc

SEQ ID NO: 22179 - DNA, 22 bp, Artificial Sequence
  chemically synthesized
ttgcttcctgttcccatggcat

SEQ ID NO: 22180 - DNA, 22 bp, Artificial Sequence
  chemically synthesized
tgcttcctgttcccatggcatt

SEQ ID NO: 22181 - DNA, 22 bp, Artificial Sequence
  chemically synthesized
gcttcctgttcccatggcatta

SEQ ID NO: 22182 - DNA, 22 bp, Artificial Sequence
  chemically synthesized
cttcctgttcccatggcattat

SEQ ID NO: 22183 - DNA, 22 bp, Artificial Sequence
  chemically synthesized
cctgttcccatggcattatgtt

SEQ ID NO: 22184 - DNA, 22 bp, Artificial Sequence
  chemically synthesized
ctgttcccatggcattatgttc

SEQ ID NO: 22185 - DNA, 22 bp, Artificial Sequence
  chemically synthesized
ttcccatggcattatgttctgc

SEQ ID NO: 22186 - DNA, 22 bp, Artificial Sequence
  chemically synthesized
ccatggcattatgttctgctgg

SEQ ID NO: 22187 - DNA, 22 bp, Artificial Sequence
  chemically synthesized
tgttctgctggcttagaggtct

SEQ ID NO: 22188 - DNA, 22 bp, Artificial Sequence
  chemically synthesized
tgctggcttagaggtcttagtt

SEQ ID NO: 22189 - DNA, 22 bp, Artificial Sequence
  chemically synthesized
ctggcttagaggtcttagttcc

SEQ ID NO: 22190 - DNA, 22 bp, Artificial Sequence
  chemically synthesized
gcttagaggtcttagttccaga

SEQ ID NO: 22191 - DNA, 22 bp, Artificial Sequence
  chemically synthesized
agaggtcttagttccagaggga

SEQ ID NO: 22192 - DNA, 22 bp, Artificial Sequence
  chemically synthesized
gaggtcttagttccagagggag

SEQ ID NO: 22193 - DNA, 22 bp, Artificial Sequence
  chemically synthesized
agttccagagggaggaacactg

SEQ ID NO: 22194 - DNA, 22 bp, Artificial Sequence
  chemically synthesized
gttccagagggaggaacactgc

SEQ ID NO: 22195 - DNA, 22 bp, Artificial Sequence
  chemically synthesized
cagagggaggaacactgccgcc

SEQ ID NO: 22196 - DNA, 22 bp, Artificial Sequence
  chemically synthesized
ccgccaggtgacacaataatga

SEQ ID NO: 22197 - DNA, 22 bp, Artificial Sequence
  chemically synthesized
cattaaactgcaaattaagatt

SEQ ID NO: 22198 - DNA, 22 bp, Artificial Sequence
  chemically synthesized
aactgcaaattaagattgccac

SEQ ID NO: 22199 - DNA, 22 bp, Artificial Sequence
  chemically synthesized
caaattaagattgccacctgga

SEQ ID NO: 22200 - DNA, 22 bp, Artificial Sequence
  chemically synthesized
agattgccacctggacactttg

SEQ ID NO: 22201 - DNA, 22 bp, Artificial Sequence
  chemically synthesized
ccacctggacactttgggctcc

SEQ ID NO: 22202 - DNA, 22 bp, Artificial Sequence
  chemically synthesized
gacactttgggctcctcccacc

SEQ ID NO: 22203 - DNA, 22 bp, Artificial Sequence
  chemically synthesized
tgggctcctcccacctttaagt

SEQ ID NO: 22204 - DNA, 22 bp, Artificial Sequence
  chemically synthesized
gggctcctcccacctttaagtc

SEQ ID NO: 22205 - DNA, 22 bp, Artificial Sequence
  chemically synthesized
ggctcctcccacctttaagtca

SEQ ID NO: 22206 - DNA, 22 bp, Artificial Sequence
  chemically synthesized
ctcccacctttaagtcaacagg

SEQ ID NO: 22207 - DNA, 22 bp, Artificial Sequence
  chemically synthesized
ccacctttaagtcaacaggcta

SEQ ID NO: 22208 - DNA, 22 bp, Artificial Sequence
  chemically synthesized
taagtcaacaggctaagaagag

SEQ ID NO: 22209 - DNA, 22 bp, Artificial Sequence
  chemically synthesized
aagtcaacaggctaagaagaga

SEQ ID NO: 22210 - DNA, 22 bp, Artificial Sequence
  chemically synthesized
agtcaacaggctaagaagagag

SEQ ID NO: 22211 - DNA, 22 bp, Artificial Sequence
  chemically synthesized
agaagagagttacagtgttggc

SEQ ID NO: 22212 - DNA, 22 bp, Artificial Sequence
  chemically synthesized
cagtgttggctgcggtgattaa

SEQ ID NO: 22213 - DNA, 22 bp, Artificial Sequence
  chemically synthesized
gctgcggtgattaacccagact

SEQ ID NO: 22214 - DNA, 22 bp, Artificial Sequence
  chemically synthesized
cggtgattaacccagactatca

SEQ ID NO: 22215 - DNA, 22 bp, Artificial Sequence
  chemically synthesized
acccagactatcaagatgaaat

SEQ ID NO: 22216 - DNA, 22 bp, Artificial Sequence
  chemically synthesized
tcaagatgaaatcagtctacaa

SEQ ID NO: 22217 - DNA, 22 bp, Artificial Sequence
  chemically synthesized
caactccacaatggaggtaagg

SEQ ID NO: 22218 - DNA, 22 bp, Artificial Sequence
  chemically synthesized
cacaatggaggtaaggaagcgt

SEQ ID NO: 22219 - DNA, 22 bp, Artificial Sequence
  chemically synthesized
gggtgtctcttagttttaccat

SEQ ID NO: 22220 - DNA, 22 bp, Artificial Sequence
  chemically synthesized
ttagttttaccatgtcctggaa

SEQ ID NO: 22221 - DNA, 22 bp, Artificial Sequence
  chemically synthesized
agttttaccatgtcctggaatt

SEQ ID NO: 22222 - DNA, 22 bp, Artificial Sequence
  chemically synthesized
gttttaccatgtcctggaatta

SEQ ID NO: 22223 - DNA, 22 bp, Artificial Sequence
  chemically synthesized
taccatgtcctggaattaaggt

SEQ ID NO: 22224 - DNA, 22 bp, Artificial Sequence
  chemically synthesized
accatgtcctggaattaaggtc

SEQ ID NO: 22225 - DNA, 22 bp, Artificial Sequence
  chemically synthesized
ccatgtcctggaattaaggtca

SEQ ID NO: 22226 - DNA, 22 bp, Artificial Sequence
  chemically synthesized
gaattaaggtcagtgggaaact

SEQ ID NO: 22227 - DNA, 22 bp, Artificial Sequence
  chemically synthesized
aggtcagtgggaaactactaca

SEQ ID NO: 22228 - DNA, 22 bp, Artificial Sequence
  chemically synthesized
ctacaggccattccaggcagga

SEQ ID NO: 22229 - DNA, 22 bp, Artificial Sequence
  chemically synthesized
caggccattccaggcaggacta

SEQ ID NO: 22230 - DNA, 22 bp, Artificial Sequence
  chemically synthesized
caggcaggactacaaataaagg

SEQ ID NO: 22231 - DNA, 22 bp, Artificial Sequence
  chemically synthesized
caaataaaggtttgggtcactc

SEQ ID NO: 22232 - DNA, 22 bp, Artificial Sequence
  chemically synthesized
gggtcactccaccaggaaaaaa

SEQ ID NO: 22233 - DNA, 22 bp, Artificial Sequence
  chemically synthesized
ggtcactccaccaggaaaaaaa

SEQ ID NO: 22234 - DNA, 22 bp, Artificial Sequence
  chemically synthesized
caccaggaaaaaaaaaaaaaaa

SEQ ID NO: 22235 - DNA, 22 bp, Artificial Sequence
  chemically synthesized
ctgaggtgcttgctgagggcaa

SEQ ID NO: 22236 - DNA, 22 bp, Artificial Sequence
  chemically synthesized
aggtgcttgctgagggcaaagg

SEQ ID NO: 22237 - DNA, 22 bp, Artificial Sequence
  chemically synthesized
gctgagggcaaagggaatacag

SEQ ID NO: 22238 - DNA, 22 bp, Artificial Sequence
  chemically synthesized
ctgagggcaaagggaatacaga

SEQ ID NO: 22239 - DNA, 22 bp, Artificial Sequence
  chemically synthesized
agggcaaagggaatacagaata

SEQ ID NO: 22240 - DNA, 22 bp, Artificial Sequence
  chemically synthesized
cgatcacgtgaccaattgcaga

SEQ ID NO: 22241 - DNA, 22 bp, Artificial Sequence
  chemically synthesized
cagatacaaggactgtaattgt

SEQ ID NO: 22242 - DNA, 22 bp, Artificial Sequence
  chemically synthesized
taattgtcatgagtatttcctc

SEQ ID NO: 22243 - DNA, 22 bp, Artificial Sequence
  chemically synthesized
tcatgagtatttcctccttctt

SEQ ID NO: 22244 - DNA, 22 bp, Artificial Sequence
  chemically synthesized
cctccttcttttgttaaaaaca

SEQ ID NO: 22245 - DNA, 22 bp, Artificial Sequence
  chemically synthesized
ctccttcttttgttaaaaacac

SEQ ID NO: 22246 - DNA, 22 bp, Artificial Sequence
  chemically synthesized
cttcttttgttaaaaacacctt

SEQ ID NO: 22247 - DNA, 22 bp, Artificial Sequence
  chemically synthesized
cttttgttaaaaacaccttcgt

SEQ ID NO: 22248 - DNA, 22 bp, Artificial Sequence
  chemically synthesized
ttttgttaaaaacaccttcgtg

SEQ ID NO: 22249 - DNA, 22 bp, Artificial Sequence
  chemically synthesized
ttgttaaaaacaccttcgtgtc

SEQ ID NO: 22250 - DNA, 22 bp, Artificial Sequence
  chemically synthesized
tgttaaaaacaccttcgtgtct

SEQ ID NO: 22251 - DNA, 22 bp, Artificial Sequence
  chemically synthesized
gttaaaaacaccttcgtgtctg

SEQ ID NO: 22252 - DNA, 22 bp, Artificial Sequence
  chemically synthesized
ttaaaaacaccttcgtgtctgt

SEQ ID NO: 22253 - DNA, 22 bp, Artificial Sequence
  chemically synthesized
aaaacaccttcgtgtctgtata

SEQ ID NO: 22254 - DNA, 22 bp, Artificial Sequence
  chemically synthesized
cgtgtctgtatacacttgtact

SEQ ID NO: 22255 - DNA, 22 bp, Artificial Sequence
  chemically synthesized
gtgtctgtatacacttgtacta

SEQ ID NO: 22256 - DNA, 22 bp, Artificial Sequence
  chemically synthesized
tatacacttgtactaagaaaat

SEQ ID NO: 22257 - DNA, 22 bp, Artificial Sequence
  chemically synthesized
gtactaagaaaatatatacatt

SEQ ID NO: 22258 - DNA, 22 bp, Artificial Sequence
  chemically synthesized
tactaagaaaatatatacattt

SEQ ID NO: 22259 - DNA, 22 bp, Artificial Sequence
  chemically synthesized
agaaaatatatacattttactt

SEQ ID NO: 22260 - DNA, 22 bp, Artificial Sequence
  chemically synthesized
tacttcctttttcctttatcat

SEQ ID NO: 22261 - DNA, 22 bp, Artificial Sequence
  chemically synthesized
acttcctttttcctttatcatg

SEQ ID NO: 22262 - DNA, 22 bp, Artificial Sequence
  chemically synthesized
cttcctttttcctttatcatgt

SEQ ID NO: 22263 - DNA, 22 bp, Artificial Sequence
  chemically synthesized
cctttttcctttatcatgtgac

SEQ ID NO: 22264 - DNA, 22 bp, Artificial Sequence
  chemically synthesized
ctttttcctttatcatgtgaca

SEQ ID NO: 22265 - DNA, 22 bp, Artificial Sequence
  chemically synthesized
tttcctttatcatgtgacataa

SEQ ID NO: 22266 - DNA, 22 bp, Artificial Sequence
  chemically synthesized
ttcctttatcatgtgacataag

SEQ ID NO: 22267 - DNA, 22 bp, Artificial Sequence
  chemically synthesized
tcctttatcatgtgacataaga

SEQ ID NO: 22268 - DNA, 22 bp, Artificial Sequence
  chemically synthesized
cctttatcatgtgacataagat

SEQ ID NO: 22269 - DNA, 22 bp, Artificial Sequence
  chemically synthesized
ctttatcatgtgacataagatt

SEQ ID NO: 22270 - DNA, 22 bp, Artificial Sequence
  chemically synthesized
tatcatgtgacataagatttat

SEQ ID NO: 22271 - DNA, 22 bp, Artificial Sequence
  chemically synthesized
atcatgtgacataagatttatt

SEQ ID NO: 22272 - DNA, 22 bp, Artificial Sequence
  chemically synthesized
tcatgtgacataagatttattg

SEQ ID NO: 22273 - DNA, 22 bp, Artificial Sequence
  chemically synthesized
attgacttcatatcagcattta

SEQ ID NO: 22274 - DNA, 22 bp, Artificial Sequence
  chemically synthesized
ttgacttcatatcagcatttaa

SEQ ID NO: 22275 - DNA, 22 bp, Artificial Sequence
  chemically synthesized
acttcatatcagcatttaagta

SEQ ID NO: 22276 - DNA, 22 bp, Artificial Sequence
  chemically synthesized
catatcagcatttaagtattgt

SEQ ID NO: 22277 - DNA, 22 bp, Artificial Sequence
  chemically synthesized
atatcagcatttaagtattgtt

SEQ ID NO: 22278 - DNA, 22 bp, Artificial Sequence
  chemically synthesized
aagtattgttaagtttatgtaa

SEQ ID NO: 22279 - DNA, 22 bp, Artificial Sequence
  chemically synthesized
agtattgttaagtttatgtaat

SEQ ID NO: 22280 - DNA, 22 bp, Artificial Sequence
  chemically synthesized
ttaagtttatgtaatagcattt

SEQ ID NO: 22281 - DNA, 22 bp, Artificial Sequence
  chemically synthesized
agtttatgtaatagcatttgca

SEQ ID NO: 22282 - DNA, 22 bp, Artificial Sequence
  chemically synthesized
atgtaatagcatttgcaatggg

SEQ ID NO: 22283 - DNA, 22 bp, Artificial Sequence
  chemically synthesized
tgtaatagcatttgcaatgggg

SEQ ID NO: 22284 - DNA, 22 bp, Artificial Sequence
  chemically synthesized
gcaatggggattggtgcatttt

SEQ ID NO: 22285 - DNA, 22 bp, Artificial Sequence
  chemically synthesized
caatggggattggtgcattttc

SEQ ID NO: 22286 - DNA, 22 bp, Artificial Sequence
  chemically synthesized
gtgcattttcaattgcacgaag

SEQ ID NO: 22287 - DNA, 22 bp, Artificial Sequence
  chemically synthesized
tcaattgcacgaaggatagttt

SEQ ID NO: 22288 - DNA, 22 bp, Artificial Sequence
  chemically synthesized
caattgcacgaaggatagtttt

SEQ ID NO: 22289 - DNA, 22 bp, Artificial Sequence
  chemically synthesized
aattgcacgaaggatagtttta

SEQ ID NO: 22290 - DNA, 22 bp, Artificial Sequence
  chemically synthesized
cacgaaggatagttttagtatg

SEQ ID NO: 22291 - DNA, 22 bp, Artificial Sequence
  chemically synthesized
tagtatgttaggcataattatg

SEQ ID NO: 22292 - DNA, 22 bp, Artificial Sequence
  chemically synthesized
agtatgttaggcataattatga

SEQ ID NO: 22293 - DNA, 22 bp, Artificial Sequence
  chemically synthesized
gtatgttaggcataattatgac

SEQ ID NO: 22294 - DNA, 22 bp, Artificial Sequence
  chemically synthesized
ggcataattatgacttattgtt

SEQ ID NO: 22295 - DNA, 22 bp, Artificial Sequence
  chemically synthesized
tgacttattgttgtctttattt

SEQ ID NO: 22296 - DNA, 22 bp, Artificial Sequence
  chemically synthesized
attgttgtctttatttgaagat

SEQ ID NO: 22297 - DNA, 22 bp, Artificial Sequence
  chemically synthesized
ttgttgtctttatttgaagata

SEQ ID NO: 22298 - DNA, 22 bp, Artificial Sequence
  chemically synthesized
ttgtctttatttgaagataatg

SEQ ID NO: 22299 - DNA, 22 bp, Artificial Sequence
  chemically synthesized
tctttatttgaagataatgtat

SEQ ID NO: 22300 - DNA, 22 bp, Artificial Sequence
  chemically synthesized
tatttgaagataatgtatgacc

SEQ ID NO: 22301 - DNA, 22 bp, Artificial Sequence
  chemically synthesized
atttgaagataatgtatgacct

SEQ ID NO: 22302 - DNA, 22 bp, Artificial Sequence
  chemically synthesized
tttgaagataatgtatgacctc

SEQ ID NO: 22303 - DNA, 22 bp, Artificial Sequence
  chemically synthesized
gaagataatgtatgacctcagg

SEQ ID NO: 22304 - DNA, 22 bp, Artificial Sequence
  chemically synthesized
aagataatgtatgacctcaggg

SEQ ID NO: 22305 - DNA, 22 bp, Artificial Sequence
  chemically synthesized
aggggatgtgtataggctcaag

SEQ ID NO: 22306 - DNA, 22 bp, Artificial Sequence
  chemically synthesized
aagttgacaagcgatggacttg

SEQ ID NO: 22307 - DNA, 22 bp, Artificial Sequence
  chemically synthesized
acaagcgatggacttgtgatgg

SEQ ID NO: 22308 - DNA, 22 bp, Artificial Sequence
  chemically synthesized
gtgatggttaatactgagtgtc

SEQ ID NO: 22309 - DNA, 22 bp, Artificial Sequence
  chemically synthesized
tgatggttaatactgagtgtca

SEQ ID NO: 22310 - DNA, 22 bp, Artificial Sequence
  chemically synthesized
atactgagtgtcaacttgattg

SEQ ID NO: 22311 - DNA, 22 bp, Artificial Sequence
  chemically synthesized
agtgtcaacttgattggattga

SEQ ID NO: 22312 - DNA, 22 bp, Artificial Sequence
  chemically synthesized
gattggattgaagtgtgcaaag

SEQ ID NO: 22313 - DNA, 22 bp, Artificial Sequence
  chemically synthesized
attggattgaagtgtgcaaagt

SEQ ID NO: 22314 - DNA, 22 bp, Artificial Sequence
  chemically synthesized
gattgaagtgtgcaaagtattg

SEQ ID NO: 22315 - DNA, 22 bp, Artificial Sequence
  chemically synthesized
aagtgtgcaaagtattgatcct

SEQ ID NO: 22316 - DNA, 22 bp, Artificial Sequence
  chemically synthesized
atcctgagtgtgtctgtgaggg

SEQ ID NO: 22317 - DNA, 22 bp, Artificial Sequence
  chemically synthesized
agtgtgtctgtgagggtattgc

SEQ ID NO: 22318 - DNA, 22 bp, Artificial Sequence
  chemically synthesized
tgagggtattgccaaaggagat

SEQ ID NO: 22319 - DNA, 22 bp, Artificial Sequence
  chemically synthesized
ccaaaggagattaacattttag

SEQ ID NO: 22320 - DNA, 22 bp, Artificial Sequence
  chemically synthesized
acattttagtcagtgggctggg

SEQ ID NO: 22321 - DNA, 22 bp, Artificial Sequence
  chemically synthesized
tagtcagtgggctgggaaaggc

SEQ ID NO: 22322 - DNA, 22 bp, Artificial Sequence
  chemically synthesized
agtcagtgggctgggaaaggca

SEQ ID NO: 22323 - DNA, 22 bp, Artificial Sequence
  chemically synthesized
gtcagtgggctgggaaaggcag

SEQ ID NO: 22324 - DNA, 22 bp, Artificial Sequence
  chemically synthesized
ggaaaggcagacccacccttaa

SEQ ID NO: 22325 - DNA, 22 bp, Artificial Sequence
  chemically synthesized
aatctgggtgggcaccatctaa

SEQ ID NO: 22326 - DNA, 22 bp, Artificial Sequence
  chemically synthesized
atctgggtgggcaccatctaat

SEQ ID NO: 22327 - DNA, 22 bp, Artificial Sequence
  chemically synthesized
ggtgggcaccatctaatcagtt

SEQ ID NO: 22328 - DNA, 22 bp, Artificial Sequence
  chemically synthesized
atcagttgccagtgtggccagg

SEQ ID NO: 22329 - DNA, 22 bp, Artificial Sequence
  chemically synthesized
ccagtgtggccaggatataaag

SEQ ID NO: 22330 - DNA, 22 bp, Artificial Sequence
  chemically synthesized
gactggcttagcctccaagcct

SEQ ID NO: 22331 - DNA, 22 bp, Artificial Sequence
  chemically synthesized
gcttagcctccaagcctacatc

SEQ ID NO: 22332 - DNA, 22 bp, Artificial Sequence
  chemically synthesized
agcctccaagcctacatctttc

SEQ ID NO: 22333 - DNA, 22 bp, Artificial Sequence
  chemically synthesized
gcctccaagcctacatctttct

SEQ ID NO: 22334 - DNA, 22 bp, Artificial Sequence
  chemically synthesized
caagcctacatctttctcccat

SEQ ID NO: 22335 - DNA, 22 bp, Artificial Sequence
  chemically synthesized
catctttctcccatgctggatg

SEQ ID NO: 22336 - DNA, 22 bp, Artificial Sequence
  chemically synthesized
tctcccatgctggatgcttcct

SEQ ID NO: 22337 - DNA, 22 bp, Artificial Sequence
  chemically synthesized
ctcccatgctggatgcttcctg

SEQ ID NO: 22338 - DNA, 22 bp, Artificial Sequence
  chemically synthesized
tcccatgctggatgcttcctgc

SEQ ID NO: 22339 - DNA, 22 bp, Artificial Sequence
  chemically synthesized
ccatgctggatgcttcctgccc

SEQ ID NO: 22340 - DNA, 22 bp, Artificial Sequence
  chemically synthesized
gatgcttcctgccctcaaacat

SEQ ID NO: 22341 - DNA, 22 bp, Artificial Sequence
  chemically synthesized
cctgccctcaaacattggactc

SEQ ID NO: 22342 - DNA, 22 bp, Artificial Sequence
  chemically synthesized
ctgccctcaaacattggactcc

SEQ ID NO: 22343 - DNA, 22 bp, Artificial Sequence
  chemically synthesized
ccctcaaacattggactccaag

SEQ ID NO: 22344 - DNA, 22 bp, Artificial Sequence
  chemically synthesized
aaacattggactccaagtcctt

SEQ ID NO: 22345 - DNA, 22 bp, Artificial Sequence
  chemically synthesized
gactccaagtccttcagctttg

SEQ ID NO: 22346 - DNA, 22 bp, Artificial Sequence
  chemically synthesized
caagtccttcagctttgggact

SEQ ID NO: 22347 - DNA, 22 bp, Artificial Sequence
  chemically synthesized
cagctttgggacttggactggc

SEQ ID NO: 22348 - DNA, 22 bp, Artificial Sequence
  chemically synthesized
agctttgggacttggactggct

SEQ ID NO: 22349 - DNA, 22 bp, Artificial Sequence
  chemically synthesized
tgggacttggactggcttcctt

SEQ ID NO: 22350 - DNA, 22 bp, Artificial Sequence
  chemically synthesized
gggacttggactggcttccttg

SEQ ID NO: 22351 - DNA, 22 bp, Artificial Sequence
  chemically synthesized
ggacttggactggcttccttgc

SEQ ID NO: 22352 - DNA, 22 bp, Artificial Sequence
  chemically synthesized
ggactggcttccttgctcctct

SEQ ID NO: 22353 - DNA, 22 bp, Artificial Sequence
  chemically synthesized
gactggcttccttgctcctctg

SEQ ID NO: 22354 - DNA, 22 bp, Artificial Sequence
  chemically synthesized
gcttccttgctcctctgcttgc

SEQ ID NO: 22355 - DNA, 22 bp, Artificial Sequence
  chemically synthesized
ccttgctcctctgcttgcagat

SEQ ID NO: 22356 - DNA, 22 bp, Artificial Sequence
  chemically synthesized
cttgctcctctgcttgcagatg

SEQ ID NO: 22357 - DNA, 22 bp, Artificial Sequence
  chemically synthesized
gctcctctgcttgcagatggcc

SEQ ID NO: 22358 - DNA, 22 bp, Artificial Sequence
  chemically synthesized
ctcctctgcttgcagatggcct

SEQ ID NO: 22359 - DNA, 22 bp, Artificial Sequence
  chemically synthesized
ctctgcttgcagatggcctatt

SEQ ID NO: 22360 - DNA, 22 bp, Artificial Sequence
  chemically synthesized
tgcttgcagatggcctattgtg

SEQ ID NO: 22361 - DNA, 22 bp, Artificial Sequence
  chemically synthesized
cttgcagatggcctattgtggg

SEQ ID NO: 22362 - DNA, 22 bp, Artificial Sequence
  chemically synthesized
gcagatggcctattgtgggacc

SEQ ID NO: 22363 - DNA, 22 bp, Artificial Sequence
  chemically synthesized
cagatggcctattgtgggacct

SEQ ID NO: 22364 - DNA, 22 bp, Artificial Sequence
  chemically synthesized
ttgtgggaccttgtgattgtgt

SEQ ID NO: 22365 - DNA, 22 bp, Artificial Sequence
  chemically synthesized
tgggaccttgtgattgtgtaag

SEQ ID NO: 22366 - DNA, 22 bp, Artificial Sequence
  chemically synthesized
gtgattgtgtaagttaacacta

SEQ ID NO: 22367 - DNA, 22 bp, Artificial Sequence
  chemically synthesized
tgattgtgtaagttaacactac

SEQ ID NO: 22368 - DNA, 22 bp, Artificial Sequence
  chemically synthesized
tgtaagttaacactacttaata

SEQ ID NO: 22369 - DNA, 22 bp, Artificial Sequence
  chemically synthesized
acactacttaataaactccctt

SEQ ID NO: 22370 - DNA, 22 bp, Artificial Sequence
  chemically synthesized
cttaataaactcccttttatat

SEQ ID NO: 22371 - DNA, 22 bp, Artificial Sequence
  chemically synthesized
aataaactcccttttatatcta

SEQ ID NO: 22372 - DNA, 22 bp, Artificial Sequence
  chemically synthesized
ataaactcccttttatatctaa

SEQ ID NO: 22373 - DNA, 22 bp, Artificial Sequence
  chemically synthesized
ccttttatatctaaatctatat

SEQ ID NO: 22374 - DNA, 22 bp, Artificial Sequence
  chemically synthesized
ttatatctaaatctatatctat

SEQ ID NO: 22375 - DNA, 22 bp, Artificial Sequence
  chemically synthesized
tatatctaaatctatatctatc

SEQ ID NO: 22376 - DNA, 22 bp, Artificial Sequence
  chemically synthesized
atatctaaatctatatctatct

SEQ ID NO: 22377 - DNA, 22 bp, Artificial Sequence
  chemically synthesized
tatctaaatctatatctatcta

SEQ ID NO: 22378 - DNA, 22 bp, Artificial Sequence
  chemically synthesized
aatctatatctatctatctatc

SEQ ID NO: 22379 - DNA, 22 bp, Artificial Sequence
  chemically synthesized
tatctatctatctatctatcta

SEQ ID NO: 22380 - DNA, 22 bp, Artificial Sequence
  chemically synthesized
tctatctatctatctatctatc

SEQ ID NO: 22381 - DNA, 22 bp, Artificial Sequence
  chemically synthesized
tctatctatctatctatctatc

SEQ ID NO: 22382 - DNA, 22 bp, Artificial Sequence
  chemically synthesized
tctatctatctatctatctatc

SEQ ID NO: 22383 - DNA, 22 bp, Artificial Sequence
  chemically synthesized
tctatctatctatctatctatc

SEQ ID NO: 22384 - DNA, 22 bp, Artificial Sequence
  chemically synthesized
tctatctatctatctatctatc

SEQ ID NO: 22385 - DNA, 22 bp, Artificial Sequence
  chemically synthesized
tctatctatctatctatctcct

SEQ ID NO: 22386 - DNA, 22 bp, Artificial Sequence
  chemically synthesized
tctatctatctatctcctatta

SEQ ID NO: 22387 - DNA, 22 bp, Artificial Sequence
  chemically synthesized
tctatctatctcctattagttc

SEQ ID NO: 22388 - DNA, 22 bp, Artificial Sequence
  chemically synthesized
tctatctcctattagttctgtc

SEQ ID NO: 22389 - DNA, 22 bp, Artificial Sequence
  chemically synthesized
tctcctattagttctgtctctc

SEQ ID NO: 22390 - DNA, 22 bp, Artificial Sequence
  chemically synthesized
ctattagttctgtctctctagg

SEQ ID NO: 22391 - DNA, 22 bp, Artificial Sequence
  chemically synthesized
ttagttctgtctctctagggaa

SEQ ID NO: 22392 - DNA, 22 bp, Artificial Sequence
  chemically synthesized
gttctgtctctctagggaaccc

SEQ ID NO: 22393 - DNA, 22 bp, Artificial Sequence
  chemically synthesized
tgtctctctagggaaccctgac

SEQ ID NO: 22394 - DNA, 22 bp, Artificial Sequence
  chemically synthesized
tctctctagggaaccctgacaa

SEQ ID NO: 22395 - DNA, 22 bp, Artificial Sequence
  chemically synthesized
tctagggaaccctgacaaatac

SEQ ID NO: 22396 - DNA, 22 bp, Artificial Sequence
  chemically synthesized
tagggaaccctgacaaatacag

SEQ ID NO: 22397 - DNA, 22 bp, Artificial Sequence
  chemically synthesized
gggaaccctgacaaatacagtg

SEQ ID NO: 22398 - DNA, 22 bp, Artificial Sequence
  chemically synthesized
acaaatacagtgagctcaggtc

SEQ ID NO: 22399 - DNA, 22 bp, Artificial Sequence
  chemically synthesized
aggtcctgagcagacattttcc

SEQ ID NO: 22400 - DNA, 22 bp, Artificial Sequence
  chemically synthesized
agcagacattttccaaaagaag

SEQ ID NO: 22401 - DNA, 22 bp, Artificial Sequence
  chemically synthesized
tccaaaagaagacatacaagtg

SEQ ID NO: 22402 - DNA, 22 bp, Artificial Sequence
  chemically synthesized
ccaaaagaagacatacaagtgg

SEQ ID NO: 22403 - DNA, 22 bp, Artificial Sequence
  chemically synthesized
caaaagaagacatacaagtggc

SEQ ID NO: 22404 - DNA, 22 bp, Artificial Sequence
  chemically synthesized
aacatcactaataatcagagaa

SEQ ID NO: 22405 - DNA, 22 bp, Artificial Sequence
  chemically synthesized
ataatcagagaatgcaaattaa

SEQ ID NO: 22406 - DNA, 22 bp, Artificial Sequence
  chemically synthesized
aaaccaccatatgatacctcct

SEQ ID NO: 22407 - DNA, 22 bp, Artificial Sequence
  chemically synthesized
cttatgccagtcagaatggcta

SEQ ID NO: 22408 - DNA, 22 bp, Artificial Sequence
  chemically synthesized
atgccagtcagaatggctatca

SEQ ID NO: 22409 - DNA, 22 bp, Artificial Sequence
  chemically synthesized
tgccagtcagaatggctatcat

SEQ ID NO: 22410 - DNA, 22 bp, Artificial Sequence
  chemically synthesized
tcattataaagttcaaaaacag

SEQ ID NO: 22411 - DNA, 22 bp, Artificial Sequence
  chemically synthesized
taaagttcaaaaacagcagatg

SEQ ID NO: 22412 - DNA, 22 bp, Artificial Sequence
  chemically synthesized
aaaaacagcagatgttggtgag

SEQ ID NO: 22413 - DNA, 22 bp, Artificial Sequence
  chemically synthesized
gtgaggatgtggagacaagaaa

SEQ ID NO: 22414 - DNA, 22 bp, Artificial Sequence
  chemically synthesized
atacactgttggtaagaatgta

SEQ ID NO: 22415 - DNA, 22 bp, Artificial Sequence
  chemically synthesized
tacactgttggtaagaatgtaa

SEQ ID NO: 22416 - DNA, 22 bp, Artificial Sequence
  chemically synthesized
ttggtaagaatgtaaattagta

SEQ ID NO: 22417 - DNA, 22 bp, Artificial Sequence
  chemically synthesized
gtaagaatgtaaattagtacaa

SEQ ID NO: 22418 - DNA, 22 bp, Artificial Sequence
  chemically synthesized
gtacaaactttatggaagacag

SEQ ID NO: 22419 - DNA, 22 bp, Artificial Sequence
  chemically synthesized
tatggaagacagcatgaagatt

SEQ ID NO: 22420 - DNA, 22 bp, Artificial Sequence
  chemically synthesized
atggaagacagcatgaagattt

SEQ ID NO: 22421 - DNA, 22 bp, Artificial Sequence
  chemically synthesized
tggaagacagcatgaagatttc

SEQ ID NO: 22422 - DNA, 22 bp, Artificial Sequence
  chemically synthesized
cttaaagaactagaaacagaac

SEQ ID NO: 22423 - DNA, 22 bp, Artificial Sequence
  chemically synthesized
ttaaagaactagaaacagaact

SEQ ID NO: 22424 - DNA, 22 bp, Artificial Sequence
  chemically synthesized
aaagaactagaaacagaactac

SEQ ID NO: 22425 - DNA, 22 bp, Artificial Sequence
  chemically synthesized
aagaactagaaacagaactacc

SEQ ID NO: 22426 - DNA, 22 bp, Artificial Sequence
  chemically synthesized
gaaacagaactaccattcaatc

SEQ ID NO: 22427 - DNA, 22 bp, Artificial Sequence
  chemically synthesized
ccattcaatcctgcaatcccac

SEQ ID NO: 22428 - DNA, 22 bp, Artificial Sequence
  chemically synthesized
aatcctgcaatcccactactgg

SEQ ID NO: 22429 - DNA, 22 bp, Artificial Sequence
  chemically synthesized
caatcccactactgggtatgga

SEQ ID NO: 22430 - DNA, 22 bp, Artificial Sequence
  chemically synthesized
ctgggtatggacccaaagtgaa

SEQ ID NO: 22431 - DNA, 22 bp, Artificial Sequence
  chemically synthesized
ggtatggacccaaagtgaaaga

SEQ ID NO: 22432 - DNA, 22 bp, Artificial Sequence
  chemically synthesized
aaaaagatatctgcattagtat

SEQ ID NO: 22433 - DNA, 22 bp, Artificial Sequence
  chemically synthesized
cattagtatgttcaaagtagca

SEQ ID NO: 22434 - DNA, 22 bp, Artificial Sequence
  chemically synthesized
gtatgttcaaagtagcactgtt

SEQ ID NO: 22435 - DNA, 22 bp, Artificial Sequence
  chemically synthesized
aaagtagcactgttcccaatag

SEQ ID NO: 22436 - DNA, 22 bp, Artificial Sequence
  chemically synthesized
ttcccaatagcaaagatatgga

SEQ ID NO: 22437 - DNA, 22 bp, Artificial Sequence
  chemically synthesized
ccaatagcaaagatatggaatc

SEQ ID NO: 22438 - DNA, 22 bp, Artificial Sequence
  chemically synthesized
aatgtctaccaatggacgattg

SEQ ID NO: 22439 - DNA, 22 bp, Artificial Sequence
  chemically synthesized
ccaatggacgattggataaaga

SEQ ID NO: 22440 - DNA, 22 bp, Artificial Sequence
  chemically synthesized
gataaagaaaatgtggtgtata

SEQ ID NO: 22441 - DNA, 22 bp, Artificial Sequence
  chemically synthesized
atatacatatatattactcagc

SEQ ID NO: 22442 - DNA, 22 bp, Artificial Sequence
  chemically synthesized
tatacatatatattactcagcc

SEQ ID NO: 22443 - DNA, 22 bp, Artificial Sequence
  chemically synthesized
ctcagccataaaaaagaatgaa

SEQ ID NO: 22444 - DNA, 22 bp, Artificial Sequence
  chemically synthesized
agccataaaaaagaatgaaatc

SEQ ID NO: 22445 - DNA, 22 bp, Artificial Sequence
  chemically synthesized
ctctagaaacatggttagaact

SEQ ID NO: 22446 - DNA, 22 bp, Artificial Sequence
  chemically synthesized
tctagaaacatggttagaactg

SEQ ID NO: 22447 - DNA, 22 bp, Artificial Sequence
  chemically synthesized
tagaaacatggttagaactgga

SEQ ID NO: 22448 - DNA, 22 bp, Artificial Sequence
  chemically synthesized
gaaacatggttagaactggagg

SEQ ID NO: 22449 - DNA, 22 bp, Artificial Sequence
  chemically synthesized
gaactggaggacattatcctca

SEQ ID NO: 22450 - DNA, 22 bp, Artificial Sequence
  chemically synthesized
gaggacattatcctcagtgaaa

SEQ ID NO: 22451 - DNA, 22 bp, Artificial Sequence
  chemically synthesized
tcctcagtgaaataactcagaa

SEQ ID NO: 22452 - DNA, 22 bp, Artificial Sequence
  chemically synthesized
agtgaaataactcagaaacaga

SEQ ID NO: 22453 - DNA, 22 bp, Artificial Sequence
  chemically synthesized
agaaacagaaagtcaaacacag

SEQ ID NO: 22454 - DNA, 22 bp, Artificial Sequence
  chemically synthesized
tcatttagtgagagccaagtgg

SEQ ID NO: 22455 - DNA, 22 bp, Artificial Sequence
  chemically synthesized
atttagtgagagccaagtggga

SEQ ID NO: 22456 - DNA, 22 bp, Artificial Sequence
  chemically synthesized
agtgagagccaagtgggagcta

SEQ ID NO: 22457 - DNA, 22 bp, Artificial Sequence
  chemically synthesized
gtgagagccaagtgggagctaa

SEQ ID NO: 22458 - DNA, 22 bp, Artificial Sequence
  chemically synthesized
aacgatgagtaagcatagacat

SEQ ID NO: 22459 - DNA, 22 bp, Artificial Sequence
  chemically synthesized
gagactagagaaaggtgggagg

SEQ ID NO: 22460 - DNA, 22 bp, Artificial Sequence
  chemically synthesized
agactagagaaaggtgggagga

SEQ ID NO: 22461 - DNA, 22 bp, Artificial Sequence
  chemically synthesized
gagaaaggtgggaggataggag

SEQ ID NO: 22462 - DNA, 22 bp, Artificial Sequence
  chemically synthesized
aaaaactacggattggatacaa

SEQ ID NO: 22463 - DNA, 22 bp, Artificial Sequence
  chemically synthesized
cggattggatacaacattcact

SEQ ID NO: 22464 - DNA, 22 bp, Artificial Sequence
  chemically synthesized
gatacaacattcacttttcagg

SEQ ID NO: 22465 - DNA, 22 bp, Artificial Sequence
  chemically synthesized
acttttcaggtgatggtccact

SEQ ID NO: 22466 - DNA, 22 bp, Artificial Sequence
  chemically synthesized
ttcaggtgatggtccactaaaa

SEQ ID NO: 22467 - DNA, 22 bp, Artificial Sequence
  chemically synthesized
tcaggtgatggtccactaaaag

SEQ ID NO: 22468 - DNA, 22 bp, Artificial Sequence
  chemically synthesized
caggtgatggtccactaaaagc

SEQ ID NO: 22469 - DNA, 22 bp, Artificial Sequence
  chemically synthesized
aggtgatggtccactaaaagct

SEQ ID NO: 22470 - DNA, 22 bp, Artificial Sequence
  chemically synthesized
aaagctcagacttcaccactat

SEQ ID NO: 22471 - DNA, 22 bp, Artificial Sequence
  chemically synthesized
agacttcaccactatgcaacat

SEQ ID NO: 22472 - DNA, 22 bp, Artificial Sequence
  chemically synthesized
caccactatgcaacatacatat

SEQ ID NO: 22473 - DNA, 22 bp, Artificial Sequence
  chemically synthesized
accactatgcaacatacatatg

SEQ ID NO: 22474 - DNA, 22 bp, Artificial Sequence
  chemically synthesized
tgcaacatacatatgtaaggaa

SEQ ID NO: 22475 - DNA, 22 bp, Artificial Sequence
  chemically synthesized
gtaccctgatacagcttgactg

SEQ ID NO: 22476 - DNA, 22 bp, Artificial Sequence
  chemically synthesized
taccctgatacagcttgactgt

SEQ ID NO: 22477 - DNA, 22 bp, Artificial Sequence
  chemically synthesized
atacagcttgactgtgtcccca

SEQ ID NO: 22478 - DNA, 22 bp, Artificial Sequence
  chemically synthesized
gactgtgtccccacccaaatct

SEQ ID NO: 22479 - DNA, 22 bp, Artificial Sequence
  chemically synthesized
actgtgtccccacccaaatctc

SEQ ID NO: 22480 - DNA, 22 bp, Artificial Sequence
  chemically synthesized
tgtccccacccaaatctcatct

SEQ ID NO: 22481 - DNA, 22 bp, Artificial Sequence
  chemically synthesized
atcttgaattgtagttcccata

SEQ ID NO: 22482 - DNA, 22 bp, Artificial Sequence
  chemically synthesized
gaattgtagttcccataatcct

SEQ ID NO: 22483 - DNA, 22 bp, Artificial Sequence
  chemically synthesized
aattgtagttcccataatcctc

SEQ ID NO: 22484 - DNA, 22 bp, Artificial Sequence
  chemically synthesized
tagttcccataatcctcacgtg

SEQ ID NO: 22485 - DNA, 22 bp, Artificial Sequence
  chemically synthesized
ccataatcctcacgtgttgtgg

SEQ ID NO: 22486 - DNA, 22 bp, Artificial Sequence
  chemically synthesized
acgtgttgtgggagggatttgg

SEQ ID NO: 22487 - DNA, 22 bp, Artificial Sequence
  chemically synthesized
tgggagggatttggagggaggt

SEQ ID NO: 22488 - DNA, 22 bp, Artificial Sequence
  chemically synthesized
ggagggaggtaattgaatcata

SEQ ID NO: 22489 - DNA, 22 bp, Artificial Sequence
  chemically synthesized
gagggaggtaattgaatcatag

SEQ ID NO: 22490 - DNA, 22 bp, Artificial Sequence
  chemically synthesized
aatcatagaggaggttactctc

SEQ ID NO: 22491 - DNA, 22 bp, Artificial Sequence
  chemically synthesized
ctctcatgctcttctcgtgata

SEQ ID NO: 22492 - DNA, 22 bp, Artificial Sequence
  chemically synthesized
tcatgctcttctcgtgatagtg

SEQ ID NO: 22493 - DNA, 22 bp, Artificial Sequence
  chemically synthesized
atgctcttctcgtgatagtgag

SEQ ID NO: 22494 - DNA, 22 bp, Artificial Sequence
  chemically synthesized
ttctcgtgatagtgagttctta

SEQ ID NO: 22495 - DNA, 22 bp, Artificial Sequence
  chemically synthesized
ctcgtgatagtgagttcttaca

SEQ ID NO: 22496 - DNA, 22 bp, Artificial Sequence
  chemically synthesized
tcgtgatagtgagttcttacaa

SEQ ID NO: 22497 - DNA, 22 bp, Artificial Sequence
  chemically synthesized
gtgatagtgagttcttacaaga

SEQ ID NO: 22498 - DNA, 22 bp, Artificial Sequence
  chemically synthesized
ttacaagatctgatggttttat

SEQ ID NO: 22499 - DNA, 22 bp, Artificial Sequence
  chemically synthesized
acaagatctgatggttttataa

SEQ ID NO: 22500 - DNA, 22 bp, Artificial Sequence
  chemically synthesized
caagatctgatggttttataag

SEQ ID NO: 22501 - DNA, 22 bp, Artificial Sequence
  chemically synthesized
atggttttataagcggcttttc

SEQ ID NO: 22502 - DNA, 22 bp, Artificial Sequence
  chemically synthesized
tataagcggcttttcccccttt

SEQ ID NO: 22503 - DNA, 22 bp, Artificial Sequence
  chemically synthesized
ataagcggcttttccccctttt

SEQ ID NO: 22504 - DNA, 22 bp, Artificial Sequence
  chemically synthesized
taagcggcttttcccccttttg

SEQ ID NO: 22505 - DNA, 22 bp, Artificial Sequence
  chemically synthesized
ttcccccttttgcttggcactt

SEQ ID NO: 22506 - DNA, 22 bp, Artificial Sequence
  chemically synthesized
tcccccttttgcttggcacttc

SEQ ID NO: 22507 - DNA, 22 bp, Artificial Sequence
  chemically synthesized
cccccttttgcttggcacttct

SEQ ID NO: 22508 - DNA, 22 bp, Artificial Sequence
  chemically synthesized
ccccttttgcttggcacttcta

SEQ ID NO: 22509 - DNA, 22 bp, Artificial Sequence
  chemically synthesized
ttgcttggcacttctacttgct

SEQ ID NO: 22510 - DNA, 22 bp, Artificial Sequence
  chemically synthesized
tgcttggcacttctacttgctg

SEQ ID NO: 22511 - DNA, 22 bp, Artificial Sequence
  chemically synthesized
gcttggcacttctacttgctgc

SEQ ID NO: 22512 - DNA, 22 bp, Artificial Sequence
  chemically synthesized
cttggcacttctacttgctgct

SEQ ID NO: 22513 - DNA, 22 bp, Artificial Sequence
  chemically synthesized
ggcacttctacttgctgctgcc

SEQ ID NO: 22514 - DNA, 22 bp, Artificial Sequence
  chemically synthesized
gcacttctacttgctgctgcca

SEQ ID NO: 22515 - DNA, 22 bp, Artificial Sequence
  chemically synthesized
ctacttgctgctgccatgtgaa

SEQ ID NO: 22516 - DNA, 22 bp, Artificial Sequence
  chemically synthesized
tacttgctgctgccatgtgaag

SEQ ID NO: 22517 - DNA, 22 bp, Artificial Sequence
  chemically synthesized
cttgctgctgccatgtgaagaa

SEQ ID NO: 22518 - DNA, 22 bp, Artificial Sequence
  chemically synthesized
gctgctgccatgtgaagaagga

SEQ ID NO: 22519 - DNA, 22 bp, Artificial Sequence
  chemically synthesized
ctgctgccatgtgaagaaggac

SEQ ID NO: 22520 - DNA, 22 bp, Artificial Sequence
  chemically synthesized
ctgccatgtgaagaaggacatg

SEQ ID NO: 22521 - DNA, 22 bp, Artificial Sequence
  chemically synthesized
ccatgtgaagaaggacatgttt

SEQ ID NO: 22522 - DNA, 22 bp, Artificial Sequence
  chemically synthesized
gtttcttcttctgccatgattg

SEQ ID NO: 22523 - DNA, 22 bp, Artificial Sequence
  chemically synthesized
tttcttcttctgccatgattgt

SEQ ID NO: 22524 - DNA, 22 bp, Artificial Sequence
  chemically synthesized
cttcttctgccatgattgtaag

SEQ ID NO: 22525 - DNA, 22 bp, Artificial Sequence
  chemically synthesized
ttcttctgccatgattgtaagt

SEQ ID NO: 22526 - DNA, 22 bp, Artificial Sequence
  chemically synthesized
cttctgccatgattgtaagttt

SEQ ID NO: 22527 - DNA, 22 bp, Artificial Sequence
  chemically synthesized
ttctgccatgattgtaagtttc

SEQ ID NO: 22528 - DNA, 22 bp, Artificial Sequence
  chemically synthesized
ctgccatgattgtaagtttccc

SEQ ID NO: 22529 - DNA, 22 bp, Artificial Sequence
  chemically synthesized
tgccatgattgtaagtttcccg

SEQ ID NO: 22530 - DNA, 22 bp, Artificial Sequence
  chemically synthesized
ccatgattgtaagtttcccgag

SEQ ID NO: 22531 - DNA, 22 bp, Artificial Sequence
  chemically synthesized
taagtttcccgaggcctcccca

SEQ ID NO: 22532 - DNA, 22 bp, Artificial Sequence
  chemically synthesized
cccgaggcctccccagccctgt

SEQ ID NO: 22533 - DNA, 22 bp, Artificial Sequence
  chemically synthesized
ccgaggcctccccagccctgtg

SEQ ID NO: 22534 - DNA, 22 bp, Artificial Sequence
  chemically synthesized
cccagccctgtggaactgtgag

SEQ ID NO: 22535 - DNA, 22 bp, Artificial Sequence
  chemically synthesized
tggaactgtgagacaattaaac

SEQ ID NO: 22536 - DNA, 22 bp, Artificial Sequence
  chemically synthesized
tgagacaattaaacgttttttc

SEQ ID NO: 22537 - DNA, 22 bp, Artificial Sequence
  chemically synthesized
aacgttttttccttataaatta

SEQ ID NO: 22538 - DNA, 22 bp, Artificial Sequence
  chemically synthesized
tttccttataaattacccagtc

SEQ ID NO: 22539 - DNA, 22 bp, Artificial Sequence
  chemically synthesized
ttccttataaattacccagtct

SEQ ID NO: 22540 - DNA, 22 bp, Artificial Sequence
  chemically synthesized
tccttataaattacccagtctc

SEQ ID NO: 22541 - DNA, 22 bp, Artificial Sequence
  chemically synthesized
ccttataaattacccagtctca

SEQ ID NO: 22542 - DNA, 22 bp, Artificial Sequence
  chemically synthesized
cttataaattacccagtctcag

SEQ ID NO: 22543 - DNA, 22 bp, Artificial Sequence
  chemically synthesized
ataaattacccagtctcaggta

SEQ ID NO: 22544 - DNA, 22 bp, Artificial Sequence
  chemically synthesized
taaattacccagtctcaggtat

SEQ ID NO: 22545 - DNA, 22 bp, Artificial Sequence
  chemically synthesized
cccagtctcaggtatgtcttta

SEQ ID NO: 22546 - DNA, 22 bp, Artificial Sequence
  chemically synthesized
aggtatgtctttataagcagca

SEQ ID NO: 22547 - DNA, 22 bp, Artificial Sequence
  chemically synthesized
tataagcagcatgataacgaac

SEQ ID NO: 22548 - DNA, 22 bp, Artificial Sequence
  chemically synthesized
ataagcagcatgataacgaact

SEQ ID NO: 22549 - DNA, 22 bp, Artificial Sequence
  chemically synthesized
taagcagcatgataacgaacta

SEQ ID NO: 22550 - DNA, 22 bp, Artificial Sequence
  chemically synthesized
gtacataccttctaaatatata

SEQ ID NO: 22551 - DNA, 22 bp, Artificial Sequence
  chemically synthesized
ctaaatatatataaataaattt

SEQ ID NO: 22552 - DNA, 22 bp, Artificial Sequence
  chemically synthesized
taaatatatataaataaatttt

SEQ ID NO: 22553 - DNA, 22 bp, Artificial Sequence
  chemically synthesized
aatatatataaataaattttaa

SEQ ID NO: 22554 - DNA, 22 bp, Artificial Sequence
  chemically synthesized
taaaaatataaaataaattaga

SEQ ID NO: 22555 - DNA, 22 bp, Artificial Sequence
  chemically synthesized
aaaaatataaaataaattagat

SEQ ID NO: 22556 - DNA, 22 bp, Artificial Sequence
  chemically synthesized
aaaatataaaataaattagatc

SEQ ID NO: 22557 - DNA, 22 bp, Artificial Sequence
  chemically synthesized
gatctgattgaaaaggcaaaaa

SEQ ID NO: 22558 - DNA, 22 bp, Artificial Sequence
  chemically synthesized
attgaaaaggcaaaaattgagc

SEQ ID NO: 22559 - DNA, 22 bp, Artificial Sequence
  chemically synthesized
aaaaggcaaaaattgagcaagc

SEQ ID NO: 22560 - DNA, 22 bp, Artificial Sequence
  chemically synthesized
agcaagcaaaatatcacttaat

SEQ ID NO: 22561 - DNA, 22 bp, Artificial Sequence
  chemically synthesized
aatggggtaattaaaagggtga

SEQ ID NO: 22562 - DNA, 22 bp, Artificial Sequence
  chemically synthesized
atggggtaattaaaagggtgaa

SEQ ID NO: 22563 - DNA, 22 bp, Artificial Sequence
  chemically synthesized
aaagggtgaagaaattgggcaa

SEQ ID NO: 22564 - DNA, 22 bp, Artificial Sequence
  chemically synthesized
ggcaaatggatgtcatgaggag

SEQ ID NO: 22565 - DNA, 22 bp, Artificial Sequence
  chemically synthesized
ttaggcagaggtaatggtcaga

SEQ ID NO: 22566 - DNA, 22 bp, Artificial Sequence
  chemically synthesized
taggcagaggtaatggtcagag

SEQ ID NO: 22567 - DNA, 22 bp, Artificial Sequence
  chemically synthesized
aggcagaggtaatggtcagagc

SEQ ID NO: 22568 - DNA, 22 bp, Artificial Sequence
  chemically synthesized
ggcagaggtaatggtcagagcc

SEQ ID NO: 22569 - DNA, 22 bp, Artificial Sequence
  chemically synthesized
agctggagtagagtgtgcaagg

SEQ ID NO: 22570 - DNA, 22 bp, Artificial Sequence
  chemically synthesized
gagtagagtgtgcaaggaaaga

SEQ ID NO: 22571 - DNA, 22 bp, Artificial Sequence
  chemically synthesized
aaaaggataaccaggtaggagg

SEQ ID NO: 22572 - DNA, 22 bp, Artificial Sequence
  chemically synthesized
cagtaaacttaggcaggatatt

SEQ ID NO: 22573 - DNA, 22 bp, Artificial Sequence
  chemically synthesized
aggcaggatatttcccgtgaca

SEQ ID NO: 22574 - DNA, 22 bp, Artificial Sequence
  chemically synthesized
ggcaggatatttcccgtgacag

SEQ ID NO: 22575 - DNA, 22 bp, Artificial Sequence
  chemically synthesized
cccgtgacagcactaaataata

SEQ ID NO: 22576 - DNA, 22 bp, Artificial Sequence
  chemically synthesized
ccgtgacagcactaaataataa

SEQ ID NO: 22577 - DNA, 22 bp, Artificial Sequence
  chemically synthesized
aataataatcacatgtgagaat

SEQ ID NO: 22578 - DNA, 22 bp, Artificial Sequence
  chemically synthesized
tcgattacttgagcaatacttt

SEQ ID NO: 22579 - DNA, 22 bp, Artificial Sequence
  chemically synthesized
cttgagcaatactttgttcatg

SEQ ID NO: 22580 - DNA, 22 bp, Artificial Sequence
  chemically synthesized
gagcaatactttgttcatgagc

SEQ ID NO: 22581 - DNA, 22 bp, Artificial Sequence
  chemically synthesized
agcaatactttgttcatgagct

SEQ ID NO: 22582 - DNA, 22 bp, Artificial Sequence
  chemically synthesized
tgttcatgagctagagcaaggg

SEQ ID NO: 22583 - DNA, 22 bp, Artificial Sequence
  chemically synthesized
gttcatgagctagagcaagggg

SEQ ID NO: 22584 - DNA, 22 bp, Artificial Sequence
  chemically synthesized
ttcatgagctagagcaagggga

SEQ ID NO: 22585 - DNA, 22 bp, Artificial Sequence
  chemically synthesized
atgagctagagcaaggggatga

SEQ ID NO: 22586 - DNA, 22 bp, Artificial Sequence
  chemically synthesized
gagcaaggggatgactcaagaa

SEQ ID NO: 22587 - DNA, 22 bp, Artificial Sequence
  chemically synthesized
aagaaatcctttgtgaaatcct

SEQ ID NO: 22588 - DNA, 22 bp, Artificial Sequence
  chemically synthesized
tgtgaaatcctggaggtaataa

SEQ ID NO: 22589 - DNA, 22 bp, Artificial Sequence
  chemically synthesized
gtgaaatcctggaggtaataag

SEQ ID NO: 22590 - DNA, 22 bp, Artificial Sequence
  chemically synthesized
tgaaatcctggaggtaataaga

SEQ ID NO: 22591 - DNA, 22 bp, Artificial Sequence
  chemically synthesized
gaggtaataagatcctggcatc

SEQ ID NO: 22592 - DNA, 22 bp, Artificial Sequence
  chemically synthesized
gcatcaatcttcaactcaattg

SEQ ID NO: 22593 - DNA, 22 bp, Artificial Sequence
  chemically synthesized
caactcaattgcaaaaagcaat

SEQ ID NO: 22594 - DNA, 22 bp, Artificial Sequence
  chemically synthesized
aactcaattgcaaaaagcaatt

SEQ ID NO: 22595 - DNA, 22 bp, Artificial Sequence
  chemically synthesized
aattgcaaaaagcaattttatt

SEQ ID NO: 22596 - DNA, 22 bp, Artificial Sequence
  chemically synthesized
caaaaagcaattttattactta

SEQ ID NO: 22597 - DNA, 22 bp, Artificial Sequence
  chemically synthesized
tattacttatatattacttctc

SEQ ID NO: 22598 - DNA, 22 bp, Artificial Sequence
  chemically synthesized
attacttatatattacttctca

SEQ ID NO: 22599 - DNA, 22 bp, Artificial Sequence
  chemically synthesized
ttacttatatattacttctcat

SEQ ID NO: 22600 - DNA, 22 bp, Artificial Sequence
  chemically synthesized
cttatatattacttctcatttt

SEQ ID NO: 22601 - DNA, 22 bp, Artificial Sequence
  chemically synthesized
atatattacttctcatttttca

SEQ ID NO: 22602 - DNA, 22 bp, Artificial Sequence
  chemically synthesized
tatattacttctcatttttcac

SEQ ID NO: 22603 - DNA, 22 bp, Artificial Sequence
  chemically synthesized
cttctcatttttcactgctgtc

SEQ ID NO: 22604 - DNA, 22 bp, Artificial Sequence
  chemically synthesized
ctcatttttcactgctgtcttt

SEQ ID NO: 22605 - DNA, 22 bp, Artificial Sequence
  chemically synthesized
tcatttttcactgctgtctttc

SEQ ID NO: 22606 - DNA, 22 bp, Artificial Sequence
  chemically synthesized
atttttcactgctgtctttcaa

SEQ ID NO: 22607 - DNA, 22 bp, Artificial Sequence
  chemically synthesized
ttcactgctgtctttcaaaaca

SEQ ID NO: 22608 - DNA, 22 bp, Artificial Sequence
  chemically synthesized
tcactgctgtctttcaaaacat

SEQ ID NO: 22609 - DNA, 22 bp, Artificial Sequence
  chemically synthesized
cactgctgtctttcaaaacata

SEQ ID NO: 22610 - DNA, 22 bp, Artificial Sequence
  chemically synthesized
actgctgtctttcaaaacatat

SEQ ID NO: 22611 - DNA, 22 bp, Artificial Sequence
  chemically synthesized
ctgtctttcaaaacatattcca

SEQ ID NO: 22612 - DNA, 22 bp, Artificial Sequence
  chemically synthesized
tctttcaaaacatattccattt

SEQ ID NO: 22613 - DNA, 22 bp, Artificial Sequence
  chemically synthesized
tcaaaacatattccatttcatc

SEQ ID NO: 22614 - DNA, 22 bp, Artificial Sequence
  chemically synthesized
caaaacatattccatttcatca

SEQ ID NO: 22615 - DNA, 22 bp, Artificial Sequence
  chemically synthesized
aaaacatattccatttcatcag

SEQ ID NO: 22616 - DNA, 22 bp, Artificial Sequence
  chemically synthesized
catttcatcagactacaggttt

SEQ ID NO: 22617 - DNA, 22 bp, Artificial Sequence
  chemically synthesized
catcagactacaggttttaata

SEQ ID NO: 22618 - DNA, 22 bp, Artificial Sequence
  chemically synthesized
atcagactacaggttttaatag

SEQ ID NO: 22619 - DNA, 22 bp, Artificial Sequence
  chemically synthesized
caggttttaatagctactatat

SEQ ID NO: 22620 - DNA, 22 bp, Artificial Sequence
  chemically synthesized
taatagctactatatttcttaa

SEQ ID NO: 22621 - DNA, 22 bp, Artificial Sequence
  chemically synthesized
aatagctactatatttcttaaa

SEQ ID NO: 22622 - DNA, 22 bp, Artificial Sequence
  chemically synthesized
atagctactatatttcttaaat

SEQ ID NO: 22623 - DNA, 22 bp, Artificial Sequence
  chemically synthesized
ctatatttcttaaatgtattat

SEQ ID NO: 22624 - DNA, 22 bp, Artificial Sequence
  chemically synthesized
tatttcttaaatgtattattcc

SEQ ID NO: 22625 - DNA, 22 bp, Artificial Sequence
  chemically synthesized
cttaaatgtattattccagtaa

SEQ ID NO: 22626 - DNA, 22 bp, Artificial Sequence
  chemically synthesized
ttaaatgtattattccagtaac

SEQ ID NO: 22627 - DNA, 22 bp, Artificial Sequence
  chemically synthesized
aaatgtattattccagtaactt

SEQ ID NO: 22628 - DNA, 22 bp, Artificial Sequence
  chemically synthesized
aatgtattattccagtaactta

SEQ ID NO: 22629 - DNA, 22 bp, Artificial Sequence
  chemically synthesized
ttccagtaacttatactttaca

SEQ ID NO: 22630 - DNA, 22 bp, Artificial Sequence
  chemically synthesized
cagtaacttatactttacatag

SEQ ID NO: 22631 - DNA, 22 bp, Artificial Sequence
  chemically synthesized
atactttacatagtaaatctta

SEQ ID NO: 22632 - DNA, 22 bp, Artificial Sequence
  chemically synthesized
tactttacatagtaaatcttat

SEQ ID NO: 22633 - DNA, 22 bp, Artificial Sequence
  chemically synthesized
tacatagtaaatcttatcaata

SEQ ID NO: 22634 - DNA, 22 bp, Artificial Sequence
  chemically synthesized
acatagtaaatcttatcaatag

SEQ ID NO: 22635 - DNA, 22 bp, Artificial Sequence
  chemically synthesized
catagtaaatcttatcaatagt

SEQ ID NO: 22636 - DNA, 22 bp, Artificial Sequence
  chemically synthesized
atcaatagtcacaatcaatggt

SEQ ID NO: 22637 - DNA, 22 bp, Artificial Sequence
  chemically synthesized
tcaatagtcacaatcaatggtc

SEQ ID NO: 22638 - DNA, 22 bp, Artificial Sequence
  chemically synthesized
catctggagacattacttttag

SEQ ID NO: 22639 - DNA, 22 bp, Artificial Sequence
  chemically synthesized
atctggagacattacttttagc

SEQ ID NO: 22640 - DNA, 22 bp, Artificial Sequence
  chemically synthesized
gagacattacttttagcctgag

SEQ ID NO: 22641 - DNA, 22 bp, Artificial Sequence
  chemically synthesized
cttttagcctgagccatgcaaa

SEQ ID NO: 22642 - DNA, 22 bp, Artificial Sequence
  chemically synthesized
ttagcctgagccatgcaaaata

SEQ ID NO: 22643 - DNA, 22 bp, Artificial Sequence
  chemically synthesized
tagcctgagccatgcaaaatat

SEQ ID NO: 22644 - DNA, 22 bp, Artificial Sequence
  chemically synthesized
agcctgagccatgcaaaatata

SEQ ID NO: 22645 - DNA, 22 bp, Artificial Sequence
  chemically synthesized
gcctgagccatgcaaaatatac

SEQ ID NO: 22646 - DNA, 22 bp, Artificial Sequence
  chemically synthesized
agccatgcaaaatatacttttt

SEQ ID NO: 22647 - DNA, 22 bp, Artificial Sequence
  chemically synthesized
tttggaaaattgccctttgaaa

SEQ ID NO: 22648 - DNA, 22 bp, Artificial Sequence
  chemically synthesized
ttggaaaattgccctttgaaag

SEQ ID NO: 22649 - DNA, 22 bp, Artificial Sequence
  chemically synthesized
tggaaaattgccctttgaaagg

SEQ ID NO: 22650 - DNA, 22 bp, Artificial Sequence
  chemically synthesized
ggaaaattgccctttgaaaggc

SEQ ID NO: 22651 - DNA, 22 bp, Artificial Sequence
  chemically synthesized
gaaaattgccctttgaaaggcg

SEQ ID NO: 22652 - DNA, 22 bp, Artificial Sequence
  chemically synthesized
ccctttgaaaggcgagacacaa

SEQ ID NO: 22653 - DNA, 22 bp, Artificial Sequence
  chemically synthesized
tgaaaggcgagacacaaaaggc

SEQ ID NO: 22654 - DNA, 22 bp, Artificial Sequence
  chemically synthesized
gaaaggcgagacacaaaaggca

SEQ ID NO: 22655 - DNA, 22 bp, Artificial Sequence
  chemically synthesized
aaaggcgagacacaaaaggcaa

SEQ ID NO: 22656 - DNA, 22 bp, Artificial Sequence
  chemically synthesized
atgctattatatggtaccaata

SEQ ID NO: 22657 - DNA, 22 bp, Artificial Sequence
  chemically synthesized
ttatatggtaccaataggattc

SEQ ID NO: 22658 - DNA, 22 bp, Artificial Sequence
  chemically synthesized
tatggtaccaataggattcatt

SEQ ID NO: 22659 - DNA, 22 bp, Artificial Sequence
  chemically synthesized
attaatttataaaggagaagag

SEQ ID NO: 22660 - DNA, 22 bp, Artificial Sequence
  chemically synthesized
atttataaaggagaagagctaa

SEQ ID NO: 22661 - DNA, 22 bp, Artificial Sequence
  chemically synthesized
ataaaggagaagagctaatgta

SEQ ID NO: 22662 - DNA, 22 bp, Artificial Sequence
  chemically synthesized
taaaggagaagagctaatgtaa

SEQ ID NO: 22663 - DNA, 22 bp, Artificial Sequence
  chemically synthesized
atgtaactccaaaatgcaagca

SEQ ID NO: 22664 - DNA, 22 bp, Artificial Sequence
  chemically synthesized
caaaatgcaagcaattttcata

SEQ ID NO: 22665 - DNA, 22 bp, Artificial Sequence
  chemically synthesized
tcatatgagtctacacaagcta

SEQ ID NO: 22666 - DNA, 22 bp, Artificial Sequence
  chemically synthesized
catatgagtctacacaagctaa

SEQ ID NO: 22667 - DNA, 22 bp, Artificial Sequence
  chemically synthesized
atatgagtctacacaagctaat

SEQ ID NO: 22668 - DNA, 22 bp, Artificial Sequence
  chemically synthesized
cacaagctaattgtccttaaga

SEQ ID NO: 22669 - DNA, 22 bp, Artificial Sequence
  chemically synthesized
attgtccttaagaatttcatct

SEQ ID NO: 22670 - DNA, 22 bp, Artificial Sequence
  chemically synthesized
tccttaagaatttcatctttaa

SEQ ID NO: 22671 - DNA, 22 bp, Artificial Sequence
  chemically synthesized
aagaatttcatctttaaggaaa

SEQ ID NO: 22672 - DNA, 22 bp, Artificial Sequence
  chemically synthesized
agaatttcatctttaaggaaaa

SEQ ID NO: 22673 - DNA, 22 bp, Artificial Sequence
  chemically synthesized
catctttaaggaaaagtttttt

SEQ ID NO: 22674 - DNA, 22 bp, Artificial Sequence
  chemically synthesized
atctttaaggaaaagtttttta

SEQ ID NO: 22675 - DNA, 22 bp, Artificial Sequence
  chemically synthesized
taaggaaaagttttttactgta

SEQ ID NO: 22676 - DNA, 22 bp, Artificial Sequence
  chemically synthesized
aaggaaaagttttttactgtat

SEQ ID NO: 22677 - DNA, 22 bp, Artificial Sequence
  chemically synthesized
aggaaaagttttttactgtatc

SEQ ID NO: 22678 - DNA, 22 bp, Artificial Sequence
  chemically synthesized
tttactgtatcaaaaagaagtt

SEQ ID NO: 22679 - DNA, 22 bp, Artificial Sequence
  chemically synthesized
ttactgtatcaaaaagaagttt

SEQ ID NO: 22680 - DNA, 22 bp, Artificial Sequence
  chemically synthesized
tactgtatcaaaaagaagttta

SEQ ID NO: 22681 - DNA, 22 bp, Artificial Sequence
  chemically synthesized
actgtatcaaaaagaagtttaa

SEQ ID NO: 22682 - DNA, 22 bp, Artificial Sequence
  chemically synthesized
ctgtatcaaaaagaagtttaaa

SEQ ID NO: 22683 - DNA, 22 bp, Artificial Sequence
  chemically synthesized
tatcaaaaagaagtttaaactg

SEQ ID NO: 22684 - DNA, 22 bp, Artificial Sequence
  chemically synthesized
aaactgtcattgagcagagtct

SEQ ID NO: 22685 - DNA, 22 bp, Artificial Sequence
  chemically synthesized
aactgtcattgagcagagtctg

SEQ ID NO: 22686 - DNA, 22 bp, Artificial Sequence
  chemically synthesized
tcattgagcagagtctgataat

SEQ ID NO: 22687 - DNA, 22 bp, Artificial Sequence
  chemically synthesized
agcagagtctgataataaggac

SEQ ID NO: 22688 - DNA, 22 bp, Artificial Sequence
  chemically synthesized
ataataaggacactgtcaaatc

SEQ ID NO: 22689 - DNA, 22 bp, Artificial Sequence
  chemically synthesized
tcaaatcacagttcagatgtta

SEQ ID NO: 22690 - DNA, 22 bp, Artificial Sequence
  chemically synthesized
agatgttatgtgatgaggacag

SEQ ID NO: 22691 - DNA, 22 bp, Artificial Sequence
  chemically synthesized
tgtgatgaggacagaatagaac

SEQ ID NO: 22692 - DNA, 22 bp, Artificial Sequence
  chemically synthesized
ctagactggacaagaacagaca

SEQ ID NO: 22693 - DNA, 22 bp, Artificial Sequence
  chemically synthesized
tagactggacaagaacagacat

SEQ ID NO: 22694 - DNA, 22 bp, Artificial Sequence
  chemically synthesized
gactggacaagaacagacatga

SEQ ID NO: 22695 - DNA, 22 bp, Artificial Sequence
  chemically synthesized
gacaagaacagacatgattaac

SEQ ID NO: 22696 - DNA, 22 bp, Artificial Sequence
  chemically synthesized
acttaaccatccaacaataaat

SEQ ID NO: 22697 - DNA, 22 bp, Artificial Sequence
  chemically synthesized
aaccatccaacaataaatctaa

SEQ ID NO: 22698 - DNA, 22 bp, Artificial Sequence
  chemically synthesized
accatccaacaataaatctaag

SEQ ID NO: 22699 - DNA, 22 bp, Artificial Sequence
  chemically synthesized
agttaacataaattgatgtcat

SEQ ID NO: 22700 - DNA, 22 bp, Artificial Sequence
  chemically synthesized
acataaattgatgtcatctact

SEQ ID NO: 22701 - DNA, 22 bp, Artificial Sequence
  chemically synthesized
atgtcatctactacatctaagt

SEQ ID NO: 22702 - DNA, 22 bp, Artificial Sequence
  chemically synthesized
ctacatctaagtatttcctcaa

SEQ ID NO: 22703 - DNA, 22 bp, Artificial Sequence
  chemically synthesized
catctaagtatttcctcaaatt

SEQ ID NO: 22704 - DNA, 22 bp, Artificial Sequence
  chemically synthesized
agtatttcctcaaattctggac

SEQ ID NO: 22705 - DNA, 22 bp, Artificial Sequence
  chemically synthesized
cctcaaattctggacaatttta

SEQ ID NO: 22706 - DNA, 22 bp, Artificial Sequence
  chemically synthesized
ctcaaattctggacaattttag

SEQ ID NO: 22707 - DNA, 22 bp, Artificial Sequence
  chemically synthesized
aaattctggacaattttagaaa

SEQ ID NO: 22708 - DNA, 22 bp, Artificial Sequence
  chemically synthesized
tggacaattttagaaaccatca

SEQ ID NO: 22709 - DNA, 22 bp, Artificial Sequence
  chemically synthesized
gacaattttagaaaccatcaaa

SEQ ID NO: 22710 - DNA, 22 bp, Artificial Sequence
  chemically synthesized
tagaaaccatcaaaattatttg

SEQ ID NO: 22711 - DNA, 22 bp, Artificial Sequence
  chemically synthesized
agaaaccatcaaaattatttgt

SEQ ID NO: 22712 - DNA, 22 bp, Artificial Sequence
  chemically synthesized
gaaaccatcaaaattatttgtt

SEQ ID NO: 22713 - DNA, 22 bp, Artificial Sequence
  chemically synthesized
tttgttgaggaaaaataaactt

SEQ ID NO: 22714 - DNA, 22 bp, Artificial Sequence
  chemically synthesized
gttgaggaaaaataaacttagc

SEQ ID NO: 22715 - DNA, 22 bp, Artificial Sequence
  chemically synthesized
ttgaggaaaaataaacttagcc

SEQ ID NO: 22716 - DNA, 22 bp, Artificial Sequence
  chemically synthesized
aggaaaaataaacttagccaat

SEQ ID NO: 22717 - DNA, 22 bp, Artificial Sequence
  chemically synthesized
agccaatttgcaagggcaacta

SEQ ID NO: 22718 - DNA, 22 bp, Artificial Sequence
  chemically synthesized
gccaatttgcaagggcaactaa

SEQ ID NO: 22719 - DNA, 22 bp, Artificial Sequence
  chemically synthesized
gcaagggcaactaaaatgaaga

SEQ ID NO: 22720 - DNA, 22 bp, Artificial Sequence
  chemically synthesized
caagggcaactaaaatgaagaa

SEQ ID NO: 22721 - DNA, 22 bp, Artificial Sequence
  chemically synthesized
aaatgaagaacttttctttaaa

SEQ ID NO: 22722 - DNA, 22 bp, Artificial Sequence
  chemically synthesized
ttctttaaagtgtgggagtcac

SEQ ID NO: 22723 - DNA, 22 bp, Artificial Sequence
  chemically synthesized
tctttaaagtgtgggagtcaca

SEQ ID NO: 22724 - DNA, 22 bp, Artificial Sequence
  chemically synthesized
ctttaaagtgtgggagtcacat

SEQ ID NO: 22725 - DNA, 22 bp, Artificial Sequence
  chemically synthesized
tttaaagtgtgggagtcacatc

SEQ ID NO: 22726 - DNA, 22 bp, Artificial Sequence
  chemically synthesized
taaagtgtgggagtcacatctt

SEQ ID NO: 22727 - DNA, 22 bp, Artificial Sequence
  chemically synthesized
aaagtgtgggagtcacatctta

SEQ ID NO: 22728 - DNA, 22 bp, Artificial Sequence
  chemically synthesized
aagtgtgggagtcacatcttag

SEQ ID NO: 22729 - DNA, 22 bp, Artificial Sequence
  chemically synthesized
agcaacatatttaaatatatct

SEQ ID NO: 22730 - DNA, 22 bp, Artificial Sequence
  chemically synthesized
gcaacatatttaaatatatcta

SEQ ID NO: 22731 - DNA, 22 bp, Artificial Sequence
  chemically synthesized
aaatatatctaagctttcttca

SEQ ID NO: 22732 - DNA, 22 bp, Artificial Sequence
  chemically synthesized
aatatatctaagctttcttcaa

SEQ ID NO: 22733 - DNA, 22 bp, Artificial Sequence
  chemically synthesized
agctttcttcaaaaccactatc

SEQ ID NO: 22734 - DNA, 22 bp, Artificial Sequence
  chemically synthesized
tcttcaaaaccactatccacaa

SEQ ID NO: 22735 - DNA, 22 bp, Artificial Sequence
  chemically synthesized
cttcaaaaccactatccacaaa

SEQ ID NO: 22736 - DNA, 22 bp, Artificial Sequence
  chemically synthesized
ttcaaaaccactatccacaaaa

SEQ ID NO: 22737 - DNA, 22 bp, Artificial Sequence
  chemically synthesized
caaaaccactatccacaaaaat

SEQ ID NO: 22738 - DNA, 22 bp, Artificial Sequence
  chemically synthesized
aaaaccactatccacaaaaatg

SEQ ID NO: 22739 - DNA, 22 bp, Artificial Sequence
  chemically synthesized
tccacaaaaatgcaaaatttcc

SEQ ID NO: 22740 - DNA, 22 bp, Artificial Sequence
  chemically synthesized
ccaaagaatttctcctcttctg

SEQ ID NO: 22741 - DNA, 22 bp, Artificial Sequence
  chemically synthesized
caaagaatttctcctcttctgt

SEQ ID NO: 22742 - DNA, 22 bp, Artificial Sequence
  chemically synthesized
ctcctcttctgtagacttattt

SEQ ID NO: 22743 - DNA, 22 bp, Artificial Sequence
  chemically synthesized
tcctcttctgtagacttatttt

SEQ ID NO: 22744 - DNA, 22 bp, Artificial Sequence
  chemically synthesized
ctcttctgtagacttattttct

SEQ ID NO: 22745 - DNA, 22 bp, Artificial Sequence
  chemically synthesized
ttctgtagacttattttcttca

SEQ ID NO: 22746 - DNA, 22 bp, Artificial Sequence
  chemically synthesized
ctgtagacttattttcttcatc

SEQ ID NO: 22747 - DNA, 22 bp, Artificial Sequence
  chemically synthesized
tgtagacttattttcttcatct

SEQ ID NO: 22748 - DNA, 22 bp, Artificial Sequence
  chemically synthesized
tagacttattttcttcatcttc

SEQ ID NO: 22749 - DNA, 22 bp, Artificial Sequence
  chemically synthesized
attttcttcatcttcatctttt

SEQ ID NO: 22750 - DNA, 22 bp, Artificial Sequence
  chemically synthesized
ttttcttcatcttcatcttttc

SEQ ID NO: 22751 - DNA, 22 bp, Artificial Sequence
  chemically synthesized
tcttcatcttcatcttttccag

SEQ ID NO: 22752 - DNA, 22 bp, Artificial Sequence
  chemically synthesized
cttcatcttcatcttttccagg

SEQ ID NO: 22753 - DNA, 22 bp, Artificial Sequence
  chemically synthesized
ttcatcttcatcttttccagga

SEQ ID NO: 22754 - DNA, 22 bp, Artificial Sequence
  chemically synthesized
catcttcatcttttccaggaga

SEQ ID NO: 22755 - DNA, 22 bp, Artificial Sequence
  chemically synthesized
atcttcatcttttccaggagaa

SEQ ID NO: 22756 - DNA, 22 bp, Artificial Sequence
  chemically synthesized
catcttttccaggagaatatac

SEQ ID NO: 22757 - DNA, 22 bp, Artificial Sequence
  chemically synthesized
atcttttccaggagaatatacc

SEQ ID NO: 22758 - DNA, 22 bp, Artificial Sequence
  chemically synthesized
ttccaggagaatataccataag

SEQ ID NO: 22759 - DNA, 22 bp, Artificial Sequence
  chemically synthesized
tccaggagaatataccataagt

SEQ ID NO: 22760 - DNA, 22 bp, Artificial Sequence
  chemically synthesized
ccaggagaatataccataagtt

SEQ ID NO: 22761 - DNA, 22 bp, Artificial Sequence
  chemically synthesized
caggagaatataccataagttt

SEQ ID NO: 22762 - DNA, 22 bp, Artificial Sequence
  chemically synthesized
ctgatggtacacatttattaga

SEQ ID NO: 22763 - DNA, 22 bp, Artificial Sequence
  chemically synthesized
tgatggtacacatttattagat

SEQ ID NO: 22764 - DNA, 22 bp, Artificial Sequence
  chemically synthesized
atggtacacatttattagatgt

SEQ ID NO: 22765 - DNA, 22 bp, Artificial Sequence
  chemically synthesized
attagatgttttatttacattt

SEQ ID NO: 22766 - DNA, 22 bp, Artificial Sequence
  chemically synthesized
ttagatgttttatttacatttt

SEQ ID NO: 22767 - DNA, 22 bp, Artificial Sequence
  chemically synthesized
gatgttttatttacatttttta

SEQ ID NO: 22768 - DNA, 22 bp, Artificial Sequence
  chemically synthesized
tatttacattttttatccttga

SEQ ID NO: 22769 - DNA, 22 bp, Artificial Sequence
  chemically synthesized
atttacattttttatccttgaa

SEQ ID NO: 22770 - DNA, 22 bp, Artificial Sequence
  chemically synthesized
tttacattttttatccttgaaa

SEQ ID NO: 22771 - DNA, 22 bp, Artificial Sequence
  chemically synthesized
acattttttatccttgaaaact

SEQ ID NO: 22772 - DNA, 22 bp, Artificial Sequence
  chemically synthesized
cattttttatccttgaaaactc

SEQ ID NO: 22773 - DNA, 22 bp, Artificial Sequence
  chemically synthesized
tttatccttgaaaactcctttt

SEQ ID NO: 22774 - DNA, 22 bp, Artificial Sequence
  chemically synthesized
ttatccttgaaaactcctttta

SEQ ID NO: 22775 - DNA, 22 bp, Artificial Sequence
  chemically synthesized
tatccttgaaaactccttttat

SEQ ID NO: 22776 - DNA, 22 bp, Artificial Sequence
  chemically synthesized
atccttgaaaactccttttatt

SEQ ID NO: 22777 - DNA, 22 bp, Artificial Sequence
  chemically synthesized
tccttgaaaactccttttattt

SEQ ID NO: 22778 - DNA, 22 bp, Artificial Sequence
  chemically synthesized
gaaaactccttttatttgcaac

SEQ ID NO: 22779 - DNA, 22 bp, Artificial Sequence
  chemically synthesized
aaaactccttttatttgcaact

SEQ ID NO: 22780 - DNA, 22 bp, Artificial Sequence
  chemically synthesized
cttttatttgcaactatgcatc

SEQ ID NO: 22781 - DNA, 22 bp, Artificial Sequence
  chemically synthesized
ttatttgcaactatgcatctta

SEQ ID NO: 22782 - DNA, 22 bp, Artificial Sequence
  chemically synthesized
tatttgcaactatgcatcttac

SEQ ID NO: 22783 - DNA, 22 bp, Artificial Sequence
  chemically synthesized
atttgcaactatgcatcttact

SEQ ID NO: 22784 - DNA, 22 bp, Artificial Sequence
  chemically synthesized
tttgcaactatgcatcttactc

SEQ ID NO: 22785 - DNA, 22 bp, Artificial Sequence
  chemically synthesized
gcaactatgcatcttactcaga

SEQ ID NO: 22786 - DNA, 22 bp, Artificial Sequence
  chemically synthesized
caactatgcatcttactcagag

SEQ ID NO: 22787 - DNA, 22 bp, Artificial Sequence
  chemically synthesized
tgcatcttactcagagatctta

SEQ ID NO: 22788 - DNA, 22 bp, Artificial Sequence
  chemically synthesized
actcagagatcttaaaacatcc

SEQ ID NO: 22789 - DNA, 22 bp, Artificial Sequence
  chemically synthesized
ctcagagatcttaaaacatcct

SEQ ID NO: 22790 - DNA, 22 bp, Artificial Sequence
  chemically synthesized
agagatcttaaaacatccttgt

SEQ ID NO: 22791 - DNA, 22 bp, Artificial Sequence
  chemically synthesized
aaaacatccttgtttgttagat

SEQ ID NO: 22792 - DNA, 22 bp, Artificial Sequence
  chemically synthesized
aaacatccttgtttgttagatt

SEQ ID NO: 22793 - DNA, 22 bp, Artificial Sequence
  chemically synthesized
gtttgttagattacgtatttca

SEQ ID NO: 22794 - DNA, 22 bp, Artificial Sequence
  chemically synthesized
tttgttagattacgtatttcaa

SEQ ID NO: 22795 - DNA, 22 bp, Artificial Sequence
  chemically synthesized
gttagattacgtatttcaaatt

SEQ ID NO: 22796 - DNA, 22 bp, Artificial Sequence
  chemically synthesized
ttagattacgtatttcaaattc

SEQ ID NO: 22797 - DNA, 22 bp, Artificial Sequence
  chemically synthesized
gattacgtatttcaaattcata

SEQ ID NO: 22798 - DNA, 22 bp, Artificial Sequence
  chemically synthesized
cgtatttcaaattcatatacac

SEQ ID NO: 22799 - DNA, 22 bp, Artificial Sequence
  chemically synthesized
caaattcatatacactttggta

SEQ ID NO: 22800 - DNA, 22 bp, Artificial Sequence
  chemically synthesized
aaattcatatacactttggtag

SEQ ID NO: 22801 - DNA, 22 bp, Artificial Sequence
  chemically synthesized
atatacactttggtagatgcaa

SEQ ID NO: 22802 - DNA, 22 bp, Artificial Sequence
  chemically synthesized
tggtagatgcaaacatttttat

SEQ ID NO: 22803 - DNA, 22 bp, Artificial Sequence
  chemically synthesized
ggtagatgcaaacatttttatt

SEQ ID NO: 22804 - DNA, 22 bp, Artificial Sequence
  chemically synthesized
gtagatgcaaacatttttattt

SEQ ID NO: 22805 - DNA, 22 bp, Artificial Sequence
  chemically synthesized
ttatttgctgaagaacataagg

SEQ ID NO: 22806 - DNA, 22 bp, Artificial Sequence
  chemically synthesized
tatttgctgaagaacataaggg

SEQ ID NO: 22807 - DNA, 22 bp, Artificial Sequence
  chemically synthesized
atttgctgaagaacataagggg

SEQ ID NO: 22808 - DNA, 22 bp, Artificial Sequence
  chemically synthesized
tttgctgaagaacataaggggg

SEQ ID NO: 22809 - DNA, 22 bp, Artificial Sequence
  chemically synthesized
gctgaagaacataagggggaaa

SEQ ID NO: 22810 - DNA, 22 bp, Artificial Sequence
  chemically synthesized
ctgaagaacataagggggaaat

SEQ ID NO: 22811 - DNA, 22 bp, Artificial Sequence
  chemically synthesized
aagaacataagggggaaataga

SEQ ID NO: 22812 - DNA, 22 bp, Artificial Sequence
  chemically synthesized
tttatttgaagaaacaaatgat

SEQ ID NO: 22813 - DNA, 22 bp, Artificial Sequence
  chemically synthesized
tatttgaagaaacaaatgattt

SEQ ID NO: 22814 - DNA, 22 bp, Artificial Sequence
  chemically synthesized
atttgaagaaacaaatgatttg

SEQ ID NO: 22815 - DNA, 22 bp, Artificial Sequence
  chemically synthesized
tttgaagaaacaaatgatttga

SEQ ID NO: 22816 - DNA, 22 bp, Artificial Sequence
  chemically synthesized
gaagaaacaaatgatttgattt

SEQ ID NO: 22817 - DNA, 22 bp, Artificial Sequence
  chemically synthesized
aagaaacaaatgatttgatttg

SEQ ID NO: 22818 - DNA, 22 bp, Artificial Sequence
  chemically synthesized
gatttgggaaatgaaatgaaaa

SEQ ID NO: 22819 - DNA, 22 bp, Artificial Sequence
  chemically synthesized
atttgggaaatgaaatgaaaag

SEQ ID NO: 22820 - DNA, 22 bp, Artificial Sequence
  chemically synthesized
gggaaatgaaatgaaaagaaaa

SEQ ID NO: 22821 - DNA, 22 bp, Artificial Sequence
  chemically synthesized
ggaaatgaaatgaaaagaaaaa

SEQ ID NO: 22822 - DNA, 22 bp, Artificial Sequence
  chemically synthesized
actaattcgctacttcttttac

SEQ ID NO: 22823 - DNA, 22 bp, Artificial Sequence
  chemically synthesized
attcgctacttcttttactcat

SEQ ID NO: 22824 - DNA, 22 bp, Artificial Sequence
  chemically synthesized
gctacttcttttactcatctga

SEQ ID NO: 22825 - DNA, 22 bp, Artificial Sequence
  chemically synthesized
cttcttttactcatctgaggcc

SEQ ID NO: 22826 - DNA, 22 bp, Artificial Sequence
  chemically synthesized
cttttactcatctgaggccttc

SEQ ID NO: 22827 - DNA, 22 bp, Artificial Sequence
  chemically synthesized
ttttactcatctgaggccttca

SEQ ID NO: 22828 - DNA, 22 bp, Artificial Sequence
  chemically synthesized
ttactcatctgaggccttcaga

SEQ ID NO: 22829 - DNA, 22 bp, Artificial Sequence
  chemically synthesized
tactcatctgaggccttcagat

SEQ ID NO: 22830 - DNA, 22 bp, Artificial Sequence
  chemically synthesized
actcatctgaggccttcagata

SEQ ID NO: 22831 - DNA, 22 bp, Artificial Sequence
  chemically synthesized
ctcatctgaggccttcagatag

SEQ ID NO: 22832 - DNA, 22 bp, Artificial Sequence
  chemically synthesized
atctgaggccttcagatagtcc

SEQ ID NO: 22833 - DNA, 22 bp, Artificial Sequence
  chemically synthesized
aggccttcagatagtcccccat

SEQ ID NO: 22834 - DNA, 22 bp, Artificial Sequence
  chemically synthesized
cagatagtcccccatatagcct

SEQ ID NO: 22835 - DNA, 22 bp, Artificial Sequence
  chemically synthesized
agatagtcccccatatagcctt

SEQ ID NO: 22836 - DNA, 22 bp, Artificial Sequence
  chemically synthesized
agagtgtttaaaatatgattat

SEQ ID NO: 22837 - DNA, 22 bp, Artificial Sequence
  chemically synthesized
gagtgtttaaaatatgattatg

SEQ ID NO: 22838 - DNA, 22 bp, Artificial Sequence
  chemically synthesized
aaaatatgattatgctctttca

SEQ ID NO: 22839 - DNA, 22 bp, Artificial Sequence
  chemically synthesized
aaatatgattatgctctttcag

SEQ ID NO: 22840 - DNA, 22 bp, Artificial Sequence
  chemically synthesized
tgctctttcagtctattagaaa

SEQ ID NO: 22841 - DNA, 22 bp, Artificial Sequence
  chemically synthesized
tttcagtctattagaaataaaa

SEQ ID NO: 22842 - DNA, 22 bp, Artificial Sequence
  chemically synthesized
tcagtctattagaaataaaaac

SEQ ID NO: 22843 - DNA, 22 bp, Artificial Sequence
  chemically synthesized
cagtctattagaaataaaaaca

SEQ ID NO: 22844 - DNA, 22 bp, Artificial Sequence
  chemically synthesized
agtctattagaaataaaaacat

SEQ ID NO: 22845 - DNA, 22 bp, Artificial Sequence
  chemically synthesized
ttagaaataaaaacataaagct

SEQ ID NO: 22846 - DNA, 22 bp, Artificial Sequence
  chemically synthesized
gaaataaaaacataaagcttaa

SEQ ID NO: 22847 - DNA, 22 bp, Artificial Sequence
  chemically synthesized
aaaaaatttcaagggaaggggc

SEQ ID NO: 22848 - DNA, 22 bp, Artificial Sequence
  chemically synthesized
aaaaatttcaagggaaggggct

SEQ ID NO: 22849 - DNA, 22 bp, Artificial Sequence
  chemically synthesized
caagggaaggggcttgaagatt

SEQ ID NO: 22850 - DNA, 22 bp, Artificial Sequence
  chemically synthesized
aagggaaggggcttgaagatta

SEQ ID NO: 22851 - DNA, 22 bp, Artificial Sequence
  chemically synthesized
gaagattactgactaagggcag

SEQ ID NO: 22852 - DNA, 22 bp, Artificial Sequence
  chemically synthesized
aagattactgactaagggcagc

SEQ ID NO: 22853 - DNA, 22 bp, Artificial Sequence
  chemically synthesized
ctgactaagggcagctgacact

SEQ ID NO: 22854 - DNA, 22 bp, Artificial Sequence
  chemically synthesized
actaagggcagctgacactcac

SEQ ID NO: 22855 - DNA, 22 bp, Artificial Sequence
  chemically synthesized
agggcagctgacactcacctcc

SEQ ID NO: 22856 - DNA, 22 bp, Artificial Sequence
  chemically synthesized
acactcacctcctccacaaaga

SEQ ID NO: 22857 - DNA, 22 bp, Artificial Sequence
  chemically synthesized
acctcctccacaaagaaccaaa

SEQ ID NO: 22858 - DNA, 22 bp, Artificial Sequence
  chemically synthesized
ctccacaaagaaccaaaatagt

SEQ ID NO: 22859 - DNA, 22 bp, Artificial Sequence
  chemically synthesized
cacaaagaaccaaaatagtaag

SEQ ID NO: 22860 - DNA, 22 bp, Artificial Sequence
  chemically synthesized
tggaattcaacagagaagtgac

SEQ ID NO: 22861 - DNA, 22 bp, Artificial Sequence
  chemically synthesized
gaattcaacagagaagtgacag

SEQ ID NO: 22862 - DNA, 22 bp, Artificial Sequence
  chemically synthesized
aacagagaagtgacaggaagca

SEQ ID NO: 22863 - DNA, 22 bp, Artificial Sequence
  chemically synthesized
aggcaatgaaggggagggaagc

SEQ ID NO: 22864 - DNA, 22 bp, Artificial Sequence
  chemically synthesized
cccagtagggatcctctgtgag

SEQ ID NO: 22865 - DNA, 22 bp, Artificial Sequence
  chemically synthesized
tgtgaggccagagaggctcccc

SEQ ID NO: 22866 - DNA, 22 bp, Artificial Sequence
  chemically synthesized
tgaggccagagaggctccccag

SEQ ID NO: 22867 - DNA, 22 bp, Artificial Sequence
  chemically synthesized
cccagtgcatcgaaagttaagt

SEQ ID NO: 22868 - DNA, 22 bp, Artificial Sequence
  chemically synthesized
agtgactgactcccagtggtcc

SEQ ID NO: 22869 - DNA, 22 bp, Artificial Sequence
  chemically synthesized
actcccagtggtccacatctgc

SEQ ID NO: 22870 - DNA, 22 bp, Artificial Sequence
  chemically synthesized
ccagtggtccacatctgcatta

SEQ ID NO: 22871 - DNA, 22 bp, Artificial Sequence
  chemically synthesized
cattatggactccaggaatcct

SEQ ID NO: 22872 - DNA, 22 bp, Artificial Sequence
  chemically synthesized
tggactccaggaatcctagcca

SEQ ID NO: 22873 - DNA, 22 bp, Artificial Sequence
  chemically synthesized
caggaatcctagccacaggaga

SEQ ID NO: 22874 - DNA, 22 bp, Artificial Sequence
  chemically synthesized
gccacaggagagtcccttgacc

SEQ ID NO: 22875 - DNA, 22 bp, Artificial Sequence
  chemically synthesized
gaccatgcaggccttgagacta

SEQ ID NO: 22876 - DNA, 22 bp, Artificial Sequence
  chemically synthesized
accatgcaggccttgagactat

SEQ ID NO: 22877 - DNA, 22 bp, Artificial Sequence
  chemically synthesized
gagactatcataaggaactgcc

SEQ ID NO: 22878 - DNA, 22 bp, Artificial Sequence
  chemically synthesized
agactatcataaggaactgccc

SEQ ID NO: 22879 - DNA, 22 bp, Artificial Sequence
  chemically synthesized
tcataaggaactgcccagcaat

SEQ ID NO: 22880 - DNA, 22 bp, Artificial Sequence
  chemically synthesized
cccagcaatcgcacaaaggcat

SEQ ID NO: 22881 - DNA, 22 bp, Artificial Sequence
  chemically synthesized
ctccagagaaggagctctcact

SEQ ID NO: 22882 - DNA, 22 bp, Artificial Sequence
  chemically synthesized
cagagaaggagctctcactggg

SEQ ID NO: 22883 - DNA, 22 bp, Artificial Sequence
  chemically synthesized
tcactgggtcccacccctgcca

SEQ ID NO: 22884 - DNA, 22 bp, Artificial Sequence
  chemically synthesized
actgggtcccacccctgccatc

SEQ ID NO: 22885 - DNA, 22 bp, Artificial Sequence
  chemically synthesized
ggtcccacccctgccatcccca

SEQ ID NO: 22886 - DNA, 22 bp, Artificial Sequence
  chemically synthesized
ccatccccattactgagcagca

SEQ ID NO: 22887 - DNA, 22 bp, Artificial Sequence
  chemically synthesized
ctgagcagcaaggtgccatttt

SEQ ID NO: 22888 - DNA, 22 bp, Artificial Sequence
  chemically synthesized
agcagcaaggtgccattttgag

SEQ ID NO: 22889 - DNA, 22 bp, Artificial Sequence
  chemically synthesized
tgagagcccaacacccaccaga

SEQ ID NO: 22890 - DNA, 22 bp, Artificial Sequence
  chemically synthesized
gagagcccaacacccaccagat

SEQ ID NO: 22891 - DNA, 22 bp, Artificial Sequence
  chemically synthesized
agagcccaacacccaccagatg

SEQ ID NO: 22892 - DNA, 22 bp, Artificial Sequence
  chemically synthesized
ctcagaccccaacatcatctgc

SEQ ID NO: 22893 - DNA, 22 bp, Artificial Sequence
  chemically synthesized
agaccccaacatcatctgcatc

SEQ ID NO: 22894 - DNA, 22 bp, Artificial Sequence
  chemically synthesized
catctctacatccctgaagctc

SEQ ID NO: 22895 - DNA, 22 bp, Artificial Sequence
  chemically synthesized
tacatccctgaagctctgctga

SEQ ID NO: 22896 - DNA, 22 bp, Artificial Sequence
  chemically synthesized
catccctgaagctctgctgaca

SEQ ID NO: 22897 - DNA, 22 bp, Artificial Sequence
  chemically synthesized
aagctctgctgacatcccccac

SEQ ID NO: 22898 - DNA, 22 bp, Artificial Sequence
  chemically synthesized
tgctgacatcccccacccacag

SEQ ID NO: 22899 - DNA, 22 bp, Artificial Sequence
  chemically synthesized
ctgacatcccccacccacagct

SEQ ID NO: 22900 - DNA, 22 bp, Artificial Sequence
  chemically synthesized
acatcccccacccacagctgag

SEQ ID NO: 22901 - DNA, 22 bp, Artificial Sequence
  chemically synthesized
agtgctactgctggctgctgtc

SEQ ID NO: 22902 - DNA, 22 bp, Artificial Sequence
  chemically synthesized
ctgctggctgctgtcaccaggg

SEQ ID NO: 22903 - DNA, 22 bp, Artificial Sequence
  chemically synthesized
ctggctgctgtcaccagggata

SEQ ID NO: 22904 - DNA, 22 bp, Artificial Sequence
  chemically synthesized
gctgctgtcaccagggataaag

SEQ ID NO: 22905 - DNA, 22 bp, Artificial Sequence
  chemically synthesized
ctgtcaccagggataaagtgtg

SEQ ID NO: 22906 - DNA, 22 bp, Artificial Sequence
  chemically synthesized
tcaccagggataaagtgtgtca

SEQ ID NO: 22907 - DNA, 22 bp, Artificial Sequence
  chemically synthesized
gaagtggactcccccaccccca

SEQ ID NO: 22908 - DNA, 22 bp, Artificial Sequence
  chemically synthesized
ccccacccccagtagcagggct

SEQ ID NO: 22909 - DNA, 22 bp, Artificial Sequence
  chemically synthesized
ctacacatttataagctcccta

SEQ ID NO: 22910 - DNA, 22 bp, Artificial Sequence
  chemically synthesized
cacatttataagctccctaaga

SEQ ID NO: 22911 - DNA, 22 bp, Artificial Sequence
  chemically synthesized
ataagctccctaagaaaatgct

SEQ ID NO: 22912 - DNA, 22 bp, Artificial Sequence
  chemically synthesized
taagctccctaagaaaatgcta

SEQ ID NO: 22913 - DNA, 22 bp, Artificial Sequence
  chemically synthesized
cctaagaaaatgctaccccact

SEQ ID NO: 22914 - DNA, 22 bp, Artificial Sequence
  chemically synthesized
agaaaatgctaccccacttgca

SEQ ID NO: 22915 - DNA, 22 bp, Artificial Sequence
  chemically synthesized
ccccacttgcagccaccatctg

SEQ ID NO: 22916 - DNA, 22 bp, Artificial Sequence
  chemically synthesized
gcagccaccatctggggctgaa

SEQ ID NO: 22917 - DNA, 22 bp, Artificial Sequence
  chemically synthesized
cagccaccatctggggctgaaa

SEQ ID NO: 22918 - DNA, 22 bp, Artificial Sequence
  chemically synthesized
gggctgaaacacatgcccacca

SEQ ID NO: 22919 - DNA, 22 bp, Artificial Sequence
  chemically synthesized
aaacacatgcccaccagcaacc

SEQ ID NO: 22920 - DNA, 22 bp, Artificial Sequence
  chemically synthesized
atagctgctgccactgaaagca

SEQ ID NO: 22921 - DNA, 22 bp, Artificial Sequence
  chemically synthesized
tagctgctgccactgaaagcaa

SEQ ID NO: 22922 - DNA, 22 bp, Artificial Sequence
  chemically synthesized
ctgccactgaaagcaacacacc

SEQ ID NO: 22923 - DNA, 22 bp, Artificial Sequence
  chemically synthesized
ccactgaaagcaacacaccccg

SEQ ID NO: 22924 - DNA, 22 bp, Artificial Sequence
  chemically synthesized
aaagcaacacaccccgcacccc

SEQ ID NO: 22925 - DNA, 22 bp, Artificial Sequence
  chemically synthesized
caagagcagggcaacaatgcag

SEQ ID NO: 22926 - DNA, 22 bp, Artificial Sequence
  chemically synthesized
aagagcagggcaacaatgcagt

SEQ ID NO: 22927 - DNA, 22 bp, Artificial Sequence
  chemically synthesized
ctaattcactcaggcattctgc

SEQ ID NO: 22928 - DNA, 22 bp, Artificial Sequence
  chemically synthesized
attcactcaggcattctgctgg

SEQ ID NO: 22929 - DNA, 22 bp, Artificial Sequence
  chemically synthesized
actcaggcattctgctgggggc

SEQ ID NO: 22930 - DNA, 22 bp, Artificial Sequence
  chemically synthesized
aggcattctgctgggggcctga

SEQ ID NO: 22931 - DNA, 22 bp, Artificial Sequence
  chemically synthesized
tgctgggggcctgaggatcact

SEQ ID NO: 22932 - DNA, 22 bp, Artificial Sequence
  chemically synthesized
ctgggggcctgaggatcactcc

SEQ ID NO: 22933 - DNA, 22 bp, Artificial Sequence
  chemically synthesized
ggggcctgaggatcactccact

SEQ ID NO: 22934 - DNA, 22 bp, Artificial Sequence
  chemically synthesized
aggatcactccactccagccta

SEQ ID NO: 22935 - DNA, 22 bp, Artificial Sequence
  chemically synthesized
cactccagcctatgatagccgg

SEQ ID NO: 22936 - DNA, 22 bp, Artificial Sequence
  chemically synthesized
cagcctatgatagccggtgtcc

SEQ ID NO: 22937 - DNA, 22 bp, Artificial Sequence
  chemically synthesized
tgatagccggtgtccacacaca

SEQ ID NO: 22938 - DNA, 22 bp, Artificial Sequence
  chemically synthesized
agtggcctgaggtcaggaacac

SEQ ID NO: 22939 - DNA, 22 bp, Artificial Sequence
  chemically synthesized
aggtcaggaacacccagcctgg

SEQ ID NO: 22940 - DNA, 22 bp, Artificial Sequence
  chemically synthesized
gctttgccttcctcaatgccta

SEQ ID NO: 22941 - DNA, 22 bp, Artificial Sequence
  chemically synthesized
tgccttcctcaatgcctaagca

SEQ ID NO: 22942 - DNA, 22 bp, Artificial Sequence
  chemically synthesized
gccttcctcaatgcctaagcaa

SEQ ID NO: 22943 - DNA, 22 bp, Artificial Sequence
  chemically synthesized
ccttcctcaatgcctaagcaag

SEQ ID NO: 22944 - DNA, 22 bp, Artificial Sequence
  chemically synthesized
cctcaatgcctaagcaagttgt

SEQ ID NO: 22945 - DNA, 22 bp, Artificial Sequence
  chemically synthesized
ctcaatgcctaagcaagttgtc

SEQ ID NO: 22946 - DNA, 22 bp, Artificial Sequence
  chemically synthesized
aatgcctaagcaagttgtctgg

SEQ ID NO: 22947 - DNA, 22 bp, Artificial Sequence
  chemically synthesized
agcaagttgtctgggaacccag

SEQ ID NO: 22948 - DNA, 22 bp, Artificial Sequence
  chemically synthesized
tctgggaacccagagacagcct

SEQ ID NO: 22949 - DNA, 22 bp, Artificial Sequence
  chemically synthesized
ggaacccagagacagccttgtg

SEQ ID NO: 22950 - DNA, 22 bp, Artificial Sequence
  chemically synthesized
gtgccatccaccatgactggta

SEQ ID NO: 22951 - DNA, 22 bp, Artificial Sequence
  chemically synthesized
tgccatccaccatgactggtac

SEQ ID NO: 22952 - DNA, 22 bp, Artificial Sequence
  chemically synthesized
gtacctaagcaaccctcccaga

SEQ ID NO: 22953 - DNA, 22 bp, Artificial Sequence
  chemically synthesized
agcaaccctcccagaagcctga

SEQ ID NO: 22954 - DNA, 22 bp, Artificial Sequence
  chemically synthesized
ccagaagcctgatgatgggcct

SEQ ID NO: 22955 - DNA, 22 bp, Artificial Sequence
  chemically synthesized
atgatgggcctacccaatctgc

SEQ ID NO: 22956 - DNA, 22 bp, Artificial Sequence
  chemically synthesized
cccaatctgccactgccatcac

SEQ ID NO: 22957 - DNA, 22 bp, Artificial Sequence
  chemically synthesized
ccactgccatcacaactggcac

SEQ ID NO: 22958 - DNA, 22 bp, Artificial Sequence
  chemically synthesized
ccatcacaactggcacctcctg

SEQ ID NO: 22959 - DNA, 22 bp, Artificial Sequence
  chemically synthesized
gcacctcctgcatgtgccacct

SEQ ID NO: 22960 - DNA, 22 bp, Artificial Sequence
  chemically synthesized
ctgcatgtgccacctgtgggtc

SEQ ID NO: 22961 - DNA, 22 bp, Artificial Sequence
  chemically synthesized
catgtgccacctgtgggtctga

SEQ ID NO: 22962 - DNA, 22 bp, Artificial Sequence
  chemically synthesized
tgggtctgaagactggctcatt

SEQ ID NO: 22963 - DNA, 22 bp, Artificial Sequence
  chemically synthesized
aagactggctcattcagccctt

SEQ ID NO: 22964 - DNA, 22 bp, Artificial Sequence
  chemically synthesized
gctcattcagcccttgcagcca

SEQ ID NO: 22965 - DNA, 22 bp, Artificial Sequence
  chemically synthesized
attcagcccttgcagccaccac

SEQ ID NO: 22966 - DNA, 22 bp, Artificial Sequence
  chemically synthesized
agcccttgcagccaccaccaac

SEQ ID NO: 22967 - DNA, 22 bp, Artificial Sequence
  chemically synthesized
gcagccaccaccaacaccagtg

SEQ ID NO: 22968 - DNA, 22 bp, Artificial Sequence
  chemically synthesized
cagccaccaccaacaccagtgc

SEQ ID NO: 22969 - DNA, 22 bp, Artificial Sequence
  chemically synthesized
cttgggagccagagggttgtcc

SEQ ID NO: 22970 - DNA, 22 bp, Artificial Sequence
  chemically synthesized
gggagccagagggttgtcctgc

SEQ ID NO: 22971 - DNA, 22 bp, Artificial Sequence
  chemically synthesized
ggagccagagggttgtcctgca

SEQ ID NO: 22972 - DNA, 22 bp, Artificial Sequence
  chemically synthesized
tcctgcagttgctacagccatc

SEQ ID NO: 22973 - DNA, 22 bp, Artificial Sequence
  chemically synthesized
cagttgctacagccatcaccca

SEQ ID NO: 22974 - DNA, 22 bp, Artificial Sequence
  chemically synthesized
ctacagccatcacccacaccac

SEQ ID NO: 22975 - DNA, 22 bp, Artificial Sequence
  chemically synthesized
cagccatcacccacaccacacc

SEQ ID NO: 22976 - DNA, 22 bp, Artificial Sequence
  chemically synthesized
tccagaagcctgaggacccaca

SEQ ID NO: 22977 - DNA, 22 bp, Artificial Sequence
  chemically synthesized
aggacccacacaccagcccagt

SEQ ID NO: 22978 - DNA, 22 bp, Artificial Sequence
  chemically synthesized
ctatggccactactgacaccca

SEQ ID NO: 22979 - DNA, 22 bp, Artificial Sequence
  chemically synthesized
tggccactactgacacccaagc

SEQ ID NO: 22980 - DNA, 22 bp, Artificial Sequence
  chemically synthesized
ctgacacccaagcaaactgcct

SEQ ID NO: 22981 - DNA, 22 bp, Artificial Sequence
  chemically synthesized
acacccaagcaaactgcctgaa

SEQ ID NO: 22982 - DNA, 22 bp, Artificial Sequence
  chemically synthesized
cctgaaggccaaagaatcaacc

SEQ ID NO: 22983 - DNA, 22 bp, Artificial Sequence
  chemically synthesized
aaggccaaagaatcaacccaac

SEQ ID NO: 22984 - DNA, 22 bp, Artificial Sequence
  chemically synthesized
gactcattaccatcagtgccaa

SEQ ID NO: 22985 - DNA, 22 bp, Artificial Sequence
  chemically synthesized
attaccatcagtgccaatgtac

SEQ ID NO: 22986 - DNA, 22 bp, Artificial Sequence
  chemically synthesized
ccatcagtgccaatgtacacag

SEQ ID NO: 22987 - DNA, 22 bp, Artificial Sequence
  chemically synthesized
ggcccaccaccaccactggggc

SEQ ID NO: 22988 - DNA, 22 bp, Artificial Sequence
  chemically synthesized
gggccaaggactggcccacttg

SEQ ID NO: 22989 - DNA, 22 bp, Artificial Sequence
  chemically synthesized
gcccacttgatattcttgtctc

SEQ ID NO: 22990 - DNA, 22 bp, Artificial Sequence
  chemically synthesized
gatattcttgtctccagcacaa

SEQ ID NO: 22991 - DNA, 22 bp, Artificial Sequence
  chemically synthesized
atattcttgtctccagcacaac

SEQ ID NO: 22992 - DNA, 22 bp, Artificial Sequence
  chemically synthesized
ttgtctccagcacaacctcatc

SEQ ID NO: 22993 - DNA, 22 bp, Artificial Sequence
  chemically synthesized
gtctccagcacaacctcatcac

SEQ ID NO: 22994 - DNA, 22 bp, Artificial Sequence
  chemically synthesized
tctccagcacaacctcatcacc

SEQ ID NO: 22995 - DNA, 22 bp, Artificial Sequence
  chemically synthesized
cagcacaacctcatcaccacct

SEQ ID NO: 22996 - DNA, 22 bp, Artificial Sequence
  chemically synthesized
atcaccaccttcactaacaaat

SEQ ID NO: 22997 - DNA, 22 bp, Artificial Sequence
  chemically synthesized
cactaacaaatgcaccctaagc

SEQ ID NO: 22998 - DNA, 22 bp, Artificial Sequence
  chemically synthesized
actaacaaatgcaccctaagcc

SEQ ID NO: 22999 - DNA, 22 bp, Artificial Sequence
  chemically synthesized
acaaatgcaccctaagccactg

SEQ ID NO: 23000 - DNA, 22 bp, Artificial Sequence
  chemically synthesized
agccactgaaaaaatcacagac

SEQ ID NO: 23001 - DNA, 22 bp, Artificial Sequence
  chemically synthesized
aaaaaatcacagacactgatga

SEQ ID NO: 23002 - DNA, 22 bp, Artificial Sequence
  chemically synthesized
atgatactgttggcagctgaaa

SEQ ID NO: 23003 - DNA, 22 bp, Artificial Sequence
  chemically synthesized
ttggcagctgaaaaaaaataat

SEQ ID NO: 23004 - DNA, 22 bp, Artificial Sequence
  chemically synthesized
gcagctgaaaaaaaataatatg

SEQ ID NO: 23005 - DNA, 22 bp, Artificial Sequence
  chemically synthesized
aaaaaaaataatatgaagacta

SEQ ID NO: 23006 - DNA, 22 bp, Artificial Sequence
  chemically synthesized
tgctgctgtatgcacctagaaa

SEQ ID NO: 23007 - DNA, 22 bp, Artificial Sequence
  chemically synthesized
ctgtatgcacctagaaatcaaa

SEQ ID NO: 23008 - DNA, 22 bp, Artificial Sequence
  chemically synthesized
tatgcacctagaaatcaaaatc

SEQ ID NO: 23009 - DNA, 22 bp, Artificial Sequence
  chemically synthesized
gaaatcaaaatcaaagtgccct

SEQ ID NO: 23010 - DNA, 22 bp, Artificial Sequence
  chemically synthesized
ctcaatcaacaccaagatacat

SEQ ID NO: 23011 - DNA, 22 bp, Artificial Sequence
  chemically synthesized
aatcaacaccaagatacatctt

SEQ ID NO: 23012 - DNA, 22 bp, Artificial Sequence
  chemically synthesized
cagaaaaaagtcttcccctaca

SEQ ID NO: 23013 - DNA, 22 bp, Artificial Sequence
  chemically synthesized
agaaaaaagtcttcccctacaa

SEQ ID NO: 23014 - DNA, 22 bp, Artificial Sequence
  chemically synthesized
cccctacaaaaacaaatttaca

SEQ ID NO: 23015 - DNA, 22 bp, Artificial Sequence
  chemically synthesized
ccctacaaaaacaaatttacaa

SEQ ID NO: 23016 - DNA, 22 bp, Artificial Sequence
  chemically synthesized
caaaaacaaatttacaaaactg

SEQ ID NO: 23017 - DNA, 22 bp, Artificial Sequence
  chemically synthesized
acaaaactggaagcagcaatca

SEQ ID NO: 23018 - DNA, 22 bp, Artificial Sequence
  chemically synthesized
caaaactggaagcagcaatcat

SEQ ID NO: 23019 - DNA, 22 bp, Artificial Sequence
  chemically synthesized
gaagcagcaatcattacaccag

SEQ ID NO: 23020 - DNA, 22 bp, Artificial Sequence
  chemically synthesized
caccagatgcagagatatcaat

SEQ ID NO: 23021 - DNA, 22 bp, Artificial Sequence
  chemically synthesized
ccaaaggaatttaataattctt

SEQ ID NO: 23022 - DNA, 22 bp, Artificial Sequence
  chemically synthesized
caaaggaatttaataattcttc

SEQ ID NO: 23023 - DNA, 22 bp, Artificial Sequence
  chemically synthesized
aataattcttcagcaacataag

SEQ ID NO: 23024 - DNA, 22 bp, Artificial Sequence
  chemically synthesized
ataattcttcagcaacataagc

SEQ ID NO: 23025 - DNA, 22 bp, Artificial Sequence
  chemically synthesized
ttcagcaacataagccagtgga

SEQ ID NO: 23026 - DNA, 22 bp, Artificial Sequence
  chemically synthesized
cagcaacataagccagtggaaa

SEQ ID NO: 23027 - DNA, 22 bp, Artificial Sequence
  chemically synthesized
agcaacataagccagtggaaaa

SEQ ID NO: 23028 - DNA, 22 bp, Artificial Sequence
  chemically synthesized
ataaaattctggaaaaaagaat

SEQ ID NO: 23029 - DNA, 22 bp, Artificial Sequence
  chemically synthesized
taaaattctggaaaaaagaatc

SEQ ID NO: 23030 - DNA, 22 bp, Artificial Sequence
  chemically synthesized
tggaaaaaagaatccaaaatgt

SEQ ID NO: 23031 - DNA, 22 bp, Artificial Sequence
  chemically synthesized
gaaaaaagaatccaaaatgttg

SEQ ID NO: 23032 - DNA, 22 bp, Artificial Sequence
  chemically synthesized
atattaaggaagctcagtgaga

SEQ ID NO: 23033 - DNA, 22 bp, Artificial Sequence
  chemically synthesized
aggaagctcagtgagacacaag

SEQ ID NO: 23034 - DNA, 22 bp, Artificial Sequence
  chemically synthesized
agtgagacacaagagaactcag

SEQ ID NO: 23035 - DNA, 22 bp, Artificial Sequence
  chemically synthesized
agataaacaataaaaagaaatc

SEQ ID NO: 23036 - DNA, 22 bp, Artificial Sequence
  chemically synthesized
aggatatgaatgagaaatttac

SEQ ID NO: 23037 - DNA, 22 bp, Artificial Sequence
  chemically synthesized
acccaagagatagatacaacaa

SEQ ID NO: 23038 - DNA, 22 bp, Artificial Sequence
  chemically synthesized
cccaagagatagatacaacaag

SEQ ID NO: 23039 - DNA, 22 bp, Artificial Sequence
  chemically synthesized
tgtaactgaagagtttattgaa

SEQ ID NO: 23040 - DNA, 22 bp, Artificial Sequence
  chemically synthesized
taactgaagagtttattgaaag

SEQ ID NO: 23041 - DNA, 22 bp, Artificial Sequence
  chemically synthesized
aagagtttattgaaagaaatac

SEQ ID NO: 23042 - DNA, 22 bp, Artificial Sequence
  chemically synthesized
attgaaagaaatacaaaataca

SEQ ID NO: 23043 - DNA, 22 bp, Artificial Sequence
  chemically synthesized
ttgaaagaaatacaaaatacat

SEQ ID NO: 23044 - DNA, 22 bp, Artificial Sequence
  chemically synthesized
aaagaaatacaaaatacattca

SEQ ID NO: 23045 - DNA, 22 bp, Artificial Sequence
  chemically synthesized
aaaaacttcaacaatagatcag

SEQ ID NO: 23046 - DNA, 22 bp, Artificial Sequence
  chemically synthesized
caacaatagatcagatcaagca

SEQ ID NO: 23047 - DNA, 22 bp, Artificial Sequence
  chemically synthesized
aacaatagatcagatcaagcag

SEQ ID NO: 23048 - DNA, 22 bp, Artificial Sequence
  chemically synthesized
cagaacttgaagacaggtcttt

SEQ ID NO: 23049 - DNA, 22 bp, Artificial Sequence
  chemically synthesized
agaacttgaagacaggtctttt

SEQ ID NO: 23050 - DNA, 22 bp, Artificial Sequence
  chemically synthesized
gaagacaggtcttttaaaatta

SEQ ID NO: 23051 - DNA, 22 bp, Artificial Sequence
  chemically synthesized
aagacaggtcttttaaaattag

SEQ ID NO: 23052 - DNA, 22 bp, Artificial Sequence
  chemically synthesized
ttaaaattagctggtcaaatga

SEQ ID NO: 23053 - DNA, 22 bp, Artificial Sequence
  chemically synthesized
taaaattagctggtcaaatgat

SEQ ID NO: 23054 - DNA, 22 bp, Artificial Sequence
  chemically synthesized
aaaattagctggtcaaatgata

SEQ ID NO: 23055 - DNA, 22 bp, Artificial Sequence
  chemically synthesized
aaattagctggtcaaatgatag

SEQ ID NO: 23056 - DNA, 22 bp, Artificial Sequence
  chemically synthesized
gctggtcaaatgatagaaagga

SEQ ID NO: 23057 - DNA, 22 bp, Artificial Sequence
  chemically synthesized
gtcaaatgatagaaaggaaaaa

SEQ ID NO: 23058 - DNA, 22 bp, Artificial Sequence
  chemically synthesized
taaagtgaacaaatattcaaat

SEQ ID NO: 23059 - DNA, 22 bp, Artificial Sequence
  chemically synthesized
aaatttgcagtttcccagaagg

SEQ ID NO: 23060 - DNA, 22 bp, Artificial Sequence
  chemically synthesized
gcagtttcccagaaggtaaaga

SEQ ID NO: 23061 - DNA, 22 bp, Artificial Sequence
  chemically synthesized
cagtttcccagaaggtaaagag

SEQ ID NO: 23062 - DNA, 22 bp, Artificial Sequence
  chemically synthesized
cccagaaggtaaagagaacatg

SEQ ID NO: 23063 - DNA, 22 bp, Artificial Sequence
  chemically synthesized
ccagaaggtaaagagaacatga

SEQ ID NO: 23064 - DNA, 22 bp, Artificial Sequence
  chemically synthesized
cgtaacaacacaatagctgaaa

SEQ ID NO: 23065 - DNA, 22 bp, Artificial Sequence
  chemically synthesized
aaaacttgtcaagtctagcaag

SEQ ID NO: 23066 - DNA, 22 bp, Artificial Sequence
  chemically synthesized
gtcaagtctagcaagaaatgta

SEQ ID NO: 23067 - DNA, 22 bp, Artificial Sequence
  chemically synthesized
tcaagtctagcaagaaatgtag

SEQ ID NO: 23068 - DNA, 22 bp, Artificial Sequence
  chemically synthesized
gcaagaaatgtagacatccaga

SEQ ID NO: 23069 - DNA, 22 bp, Artificial Sequence
  chemically synthesized
ccaaataatataatgcaaaaag

SEQ ID NO: 23070 - DNA, 22 bp, Artificial Sequence
  chemically synthesized
ttctccacagcacattatagtc

SEQ ID NO: 23071 - DNA, 22 bp, Artificial Sequence
  chemically synthesized
ctccacagcacattatagtcaa

SEQ ID NO: 23072 - DNA, 22 bp, Artificial Sequence
  chemically synthesized
tccacagcacattatagtcaaa

SEQ ID NO: 23073 - DNA, 22 bp, Artificial Sequence
  chemically synthesized
cacagcacattatagtcaaact

SEQ ID NO: 23074 - DNA, 22 bp, Artificial Sequence
  chemically synthesized
tagtcaaactgtcaaaagccaa

SEQ ID NO: 23075 - DNA, 22 bp, Artificial Sequence
  chemically synthesized
tcaaaagccaaagagtaagaac

SEQ ID NO: 23076 - DNA, 22 bp, Artificial Sequence
  chemically synthesized
taaaacagcaagcaaaatgtct

SEQ ID NO: 23077 - DNA, 22 bp, Artificial Sequence
  chemically synthesized
aaacagcaagcaaaatgtctag

SEQ ID NO: 23078 - DNA, 22 bp, Artificial Sequence
  chemically synthesized
gtcacttataagggaacttcca

SEQ ID NO: 23079 - DNA, 22 bp, Artificial Sequence
  chemically synthesized
ataagggaacttccacaagatt

SEQ ID NO: 23080 - DNA, 22 bp, Artificial Sequence
  chemically synthesized
taagggaacttccacaagatta

SEQ ID NO: 23081 - DNA, 22 bp, Artificial Sequence
  chemically synthesized
ccacaagattaacagattaaca

SEQ ID NO: 23082 - DNA, 22 bp, Artificial Sequence
  chemically synthesized
cacaagattaacagattaacag

SEQ ID NO: 23083 - DNA, 22 bp, Artificial Sequence
  chemically synthesized
acagattaacagcagatttctc

SEQ ID NO: 23084 - DNA, 22 bp, Artificial Sequence
  chemically synthesized
acagcagatttctcagcagaaa

SEQ ID NO: 23085 - DNA, 22 bp, Artificial Sequence
  chemically synthesized
ctcagcagaaacctcacaggcc

SEQ ID NO: 23086 - DNA, 22 bp, Artificial Sequence
  chemically synthesized
tcagcagaaacctcacaggcca

SEQ ID NO: 23087 - DNA, 22 bp, Artificial Sequence
  chemically synthesized
agcagaaacctcacaggccagg

SEQ ID NO: 23088 - DNA, 22 bp, Artificial Sequence
  chemically synthesized
acaggccaggagaagatgggat

SEQ ID NO: 23089 - DNA, 22 bp, Artificial Sequence
  chemically synthesized
aaaatagtgaaagaaaaaaatg

SEQ ID NO: 23090 - DNA, 22 bp, Artificial Sequence
  chemically synthesized
tacccagcaacattgttcttca

SEQ ID NO: 23091 - DNA, 22 bp, Artificial Sequence
  chemically synthesized
ttcttcaaaaatgaaggataaa

SEQ ID NO: 23092 - DNA, 22 bp, Artificial Sequence
  chemically synthesized
ttcaaaaatgaaggataaataa

SEQ ID NO: 23093 - DNA, 22 bp, Artificial Sequence
  chemically synthesized
caaaaatgaaggataaataaaa

SEQ ID NO: 23094 - DNA, 22 bp, Artificial Sequence
  chemically synthesized
aaaaatgaaggataaataaaat

SEQ ID NO: 23095 - DNA, 22 bp, Artificial Sequence
  chemically synthesized
ttctgggcaagaaaaatttgaa

SEQ ID NO: 23096 - DNA, 22 bp, Artificial Sequence
  chemically synthesized
tctgggcaagaaaaatttgaag

SEQ ID NO: 23097 - DNA, 22 bp, Artificial Sequence
  chemically synthesized
ctgggcaagaaaaatttgaagg

SEQ ID NO: 23098 - DNA, 22 bp, Artificial Sequence
  chemically synthesized
tgggcaagaaaaatttgaagga

SEQ ID NO: 23099 - DNA, 22 bp, Artificial Sequence
  chemically synthesized
ggcaagaaaaatttgaaggaat

SEQ ID NO: 23100 - DNA, 22 bp, Artificial Sequence
  chemically synthesized
gaaggaattcactatcactaga

SEQ ID NO: 23101 - DNA, 22 bp, Artificial Sequence
  chemically synthesized
aaggaattcactatcactagac

SEQ ID NO: 23102 - DNA, 22 bp, Artificial Sequence
  chemically synthesized
actatcactagactggctttac

SEQ ID NO: 23103 - DNA, 22 bp, Artificial Sequence
  chemically synthesized
tcactagactggctttacaaga

SEQ ID NO: 23104 - DNA, 22 bp, Artificial Sequence
  chemically synthesized
gactggctttacaagaaatatt

SEQ ID NO: 23105 - DNA, 22 bp, Artificial Sequence
  chemically synthesized
gctttacaagaaatatttaagg

SEQ ID NO: 23106 - DNA, 22 bp, Artificial Sequence
  chemically synthesized
tacaagaaatatttaagggagt

SEQ ID NO: 23107 - DNA, 22 bp, Artificial Sequence
  chemically synthesized
acaagaaatatttaagggagtc

SEQ ID NO: 23108 - DNA, 22 bp, Artificial Sequence
  chemically synthesized
caagaaatatttaagggagtcc

SEQ ID NO: 23109 - DNA, 22 bp, Artificial Sequence
  chemically synthesized
aagggagtcctacacatgaaag

SEQ ID NO: 23110 - DNA, 22 bp, Artificial Sequence
  chemically synthesized
agggagtcctacacatgaaagt

SEQ ID NO: 23111 - DNA, 22 bp, Artificial Sequence
  chemically synthesized
cacatgaaagtgacaggacact

SEQ ID NO: 23112 - DNA, 22 bp, Artificial Sequence
  chemically synthesized
ccattatgaagacacacaaagg

SEQ ID NO: 23113 - DNA, 22 bp, Artificial Sequence
  chemically synthesized
tgaagacacacaaaggtataca

SEQ ID NO: 23114 - DNA, 22 bp, Artificial Sequence
  chemically synthesized
actggtagagcaaaacacaaat

SEQ ID NO: 23115 - DNA, 22 bp, Artificial Sequence
  chemically synthesized
gtagagcaaaacacaaataaag

SEQ ID NO: 23116 - DNA, 22 bp, Artificial Sequence
  chemically synthesized
aaacgttaccactacagaaaat

SEQ ID NO: 23117 - DNA, 22 bp, Artificial Sequence
  chemically synthesized
ccactacagaaaatcaccaaac

SEQ ID NO: 23118 - DNA, 22 bp, Artificial Sequence
  chemically synthesized
cagaaaatcaccaaaccacaat

SEQ ID NO: 23119 - DNA, 22 bp, Artificial Sequence
  chemically synthesized
aaaaaaaaacaaaacaaccagg

SEQ ID NO: 23120 - DNA, 22 bp, Artificial Sequence
  chemically synthesized
acaaaatggcaggaataagctc

SEQ ID NO: 23121 - DNA, 22 bp, Artificial Sequence
  chemically synthesized
tcacatgtcaataatagccttg

SEQ ID NO: 23122 - DNA, 22 bp, Artificial Sequence
  chemically synthesized
acatgtcaataatagccttgca

SEQ ID NO: 23123 - DNA, 22 bp, Artificial Sequence
  chemically synthesized
gcatgtaaatggattaaattgt

SEQ ID NO: 23124 - DNA, 22 bp, Artificial Sequence
  chemically synthesized
catgtaaatggattaaattgtt

SEQ ID NO: 23125 - DNA, 22 bp, Artificial Sequence
  chemically synthesized
aattgttacttgaaagatatag

SEQ ID NO: 23126 - DNA, 22 bp, Artificial Sequence
  chemically synthesized
ttacttgaaagatatagactgg

SEQ ID NO: 23127 - DNA, 22 bp, Artificial Sequence
  chemically synthesized
cttgaaagatatagactggcta

SEQ ID NO: 23128 - DNA, 22 bp, Artificial Sequence
  chemically synthesized
gaaagatatagactggctaaat

SEQ ID NO: 23129 - DNA, 22 bp, Artificial Sequence
  chemically synthesized
aaagatatagactggctaaata

SEQ ID NO: 23130 - DNA, 22 bp, Artificial Sequence
  chemically synthesized
gctaaatagatttaaaacaaaa

SEQ ID NO: 23131 - DNA, 22 bp, Artificial Sequence
  chemically synthesized
aatagatttaaaacaaaaatat

SEQ ID NO: 23132 - DNA, 22 bp, Artificial Sequence
  chemically synthesized
aaaacaaaaatatgacccagtt

SEQ ID NO: 23133 - DNA, 22 bp, Artificial Sequence
  chemically synthesized
aaacaaaaatatgacccagttg

SEQ ID NO: 23134 - DNA, 22 bp, Artificial Sequence
  chemically synthesized
taagctgcctataagaaactta

SEQ ID NO: 23135 - DNA, 22 bp, Artificial Sequence
  chemically synthesized
cctataagaaacttatctcact

SEQ ID NO: 23136 - DNA, 22 bp, Artificial Sequence
  chemically synthesized
taagaaacttatctcacttgta

SEQ ID NO: 23137 - DNA, 22 bp, Artificial Sequence
  chemically synthesized
atctcacttgtaaagataaata

SEQ ID NO: 23138 - DNA, 22 bp, Artificial Sequence
  chemically synthesized
tctcacttgtaaagataaatat

SEQ ID NO: 23139 - DNA, 22 bp, Artificial Sequence
  chemically synthesized
acttgtaaagataaatatagac

SEQ ID NO: 23140 - DNA, 22 bp, Artificial Sequence
  chemically synthesized
gtaaagataaatatagactgaa

SEQ ID NO: 23141 - DNA, 22 bp, Artificial Sequence
  chemically synthesized
taaagataaatatagactgaaa

SEQ ID NO: 23142 - DNA, 22 bp, Artificial Sequence
  chemically synthesized
aaagtaaaaagatgaaagatct

SEQ ID NO: 23143 - DNA, 22 bp, Artificial Sequence
  chemically synthesized
ccatacaaagagaaaccaaaaa

SEQ ID NO: 23144 - DNA, 22 bp, Artificial Sequence
  chemically synthesized
catacaaagagaaaccaaaaat

SEQ ID NO: 23145 - DNA, 22 bp, Artificial Sequence
  chemically synthesized
tacctataacagataaaattga

SEQ ID NO: 23146 - DNA, 22 bp, Artificial Sequence
  chemically synthesized
taacagataaaattgactttaa

SEQ ID NO: 23147 - DNA, 22 bp, Artificial Sequence
  chemically synthesized
actttaaataaaaaacactaag

SEQ ID NO: 23148 - DNA, 22 bp, Artificial Sequence
  chemically synthesized
taaataaaaaacactaagagac

SEQ ID NO: 23149 - DNA, 22 bp, Artificial Sequence
  chemically synthesized
aaataaaaaacactaagagaca

SEQ ID NO: 23150 - DNA, 22 bp, Artificial Sequence
  chemically synthesized
aataaaaaacactaagagacaa

SEQ ID NO: 23151 - DNA, 22 bp, Artificial Sequence
  chemically synthesized
agagacaaaagtcattacataa

SEQ ID NO: 23152 - DNA, 22 bp, Artificial Sequence
  chemically synthesized
cataatgataaaaggaacaatt

SEQ ID NO: 23153 - DNA, 22 bp, Artificial Sequence
  chemically synthesized
agcaagagtatataacaattct

SEQ ID NO: 23154 - DNA, 22 bp, Artificial Sequence
  chemically synthesized
taaacattcacactcaacacca

SEQ ID NO: 23155 - DNA, 22 bp, Artificial Sequence
  chemically synthesized
aacattcacactcaacaccaga

SEQ ID NO: 23156 - DNA, 22 bp, Artificial Sequence
  chemically synthesized
acactcaacaccagagcatcca

SEQ ID NO: 23157 - DNA, 22 bp, Artificial Sequence
  chemically synthesized
aacaccagagcatccagatatg

SEQ ID NO: 23158 - DNA, 22 bp, Artificial Sequence
  chemically synthesized
ttagatataaagggtgaaatag

SEQ ID NO: 23159 - DNA, 22 bp, Artificial Sequence
  chemically synthesized
gatataaagggtgaaatagaat

SEQ ID NO: 23160 - DNA, 22 bp, Artificial Sequence
  chemically synthesized
gggatttcaacattctaatctc

SEQ ID NO: 23161 - DNA, 22 bp, Artificial Sequence
  chemically synthesized
caacattctaatctcagcatca

SEQ ID NO: 23162 - DNA, 22 bp, Artificial Sequence
  chemically synthesized
aacattctaatctcagcatcag

SEQ ID NO: 23163 - DNA, 22 bp, Artificial Sequence
  chemically synthesized
taatctcagcatcagatagatc

SEQ ID NO: 23164 - DNA, 22 bp, Artificial Sequence
  chemically synthesized
atctcagcatcagatagatcat

SEQ ID NO: 23165 - DNA, 22 bp, Artificial Sequence
  chemically synthesized
agcatcagatagatcatctaga

SEQ ID NO: 23166 - DNA, 22 bp, Artificial Sequence
  chemically synthesized
gacagaaaattaacaaagaaac

SEQ ID NO: 23167 - DNA, 22 bp, Artificial Sequence
  chemically synthesized
acaaagaaacattggatttaaa

SEQ ID NO: 23168 - DNA, 22 bp, Artificial Sequence
  chemically synthesized
gatttaaacttgactttagacc

SEQ ID NO: 23169 - DNA, 22 bp, Artificial Sequence
  chemically synthesized
aaacttgactttagaccaaatg

SEQ ID NO: 23170 - DNA, 22 bp, Artificial Sequence
  chemically synthesized
aacttgactttagaccaaatgg

SEQ ID NO: 23171 - DNA, 22 bp, Artificial Sequence
  chemically synthesized
gactttagaccaaatggatcta

SEQ ID NO: 23172 - DNA, 22 bp, Artificial Sequence
  chemically synthesized
actttagaccaaatggatctaa

SEQ ID NO: 23173 - DNA, 22 bp, Artificial Sequence
  chemically synthesized
tagaccaaatggatctaacatt

SEQ ID NO: 23174 - DNA, 22 bp, Artificial Sequence
  chemically synthesized
agaccaaatggatctaacattt

SEQ ID NO: 23175 - DNA, 22 bp, Artificial Sequence
  chemically synthesized
gaccaaatggatctaacattta

SEQ ID NO: 23176 - DNA, 22 bp, Artificial Sequence
  chemically synthesized
acatttacacaatatttcatcc

SEQ ID NO: 23177 - DNA, 22 bp, Artificial Sequence
  chemically synthesized
acacaatatttcatccaacagc

SEQ ID NO: 23178 - DNA, 22 bp, Artificial Sequence
  chemically synthesized
cacaatatttcatccaacagct

SEQ ID NO: 23179 - DNA, 22 bp, Artificial Sequence
  chemically synthesized
catccaacagctacagaatata

SEQ ID NO: 23180 - DNA, 22 bp, Artificial Sequence
  chemically synthesized
atccaacagctacagaatatat

SEQ ID NO: 23181 - DNA, 22 bp, Artificial Sequence
  chemically synthesized
cagaatatatttatctcatcag

SEQ ID NO: 23182 - DNA, 22 bp, Artificial Sequence
  chemically synthesized
atctcatcagcacatgacgcat

SEQ ID NO: 23183 - DNA, 22 bp, Artificial Sequence
  chemically synthesized
tctcatcagcacatgacgcatt

SEQ ID NO: 23184 - DNA, 22 bp, Artificial Sequence
  chemically synthesized
atcagcacatgacgcattcccc

SEQ ID NO: 23185 - DNA, 22 bp, Artificial Sequence
  chemically synthesized
cccaggatacaccatatgttag

SEQ ID NO: 23186 - DNA, 22 bp, Artificial Sequence
  chemically synthesized
gaacacaaaagaagtctcaact

SEQ ID NO: 23187 - DNA, 22 bp, Artificial Sequence
  chemically synthesized
aactaatttgaaatatttgaaa

SEQ ID NO: 23188 - DNA, 22 bp, Artificial Sequence
  chemically synthesized
atttgaaatatttgaaatcata

SEQ ID NO: 23189 - DNA, 22 bp, Artificial Sequence
  chemically synthesized
gaaatatttgaaatcatattaa

SEQ ID NO: 23190 - DNA, 22 bp, Artificial Sequence
  chemically synthesized
aaatatttgaaatcatattaag

SEQ ID NO: 23191 - DNA, 22 bp, Artificial Sequence
  chemically synthesized
gaaatcatattaagcatcttct

SEQ ID NO: 23192 - DNA, 22 bp, Artificial Sequence
  chemically synthesized
aaatcatattaagcatcttctc

SEQ ID NO: 23193 - DNA, 22 bp, Artificial Sequence
  chemically synthesized
agcatcttctcagaccacaatg

SEQ ID NO: 23194 - DNA, 22 bp, Artificial Sequence
  chemically synthesized
ctcagaccacaatggaataaaa

SEQ ID NO: 23195 - DNA, 22 bp, Artificial Sequence
  chemically synthesized
tcagaccacaatggaataaaac

SEQ ID NO: 23196 - DNA, 22 bp, Artificial Sequence
  chemically synthesized
agaccacaatggaataaaacta

SEQ ID NO: 23197 - DNA, 22 bp, Artificial Sequence
  chemically synthesized
gaaatcaataacaagaaaaact

SEQ ID NO: 23198 - DNA, 22 bp, Artificial Sequence
  chemically synthesized
taaaacctatacaaatacatgg

SEQ ID NO: 23199 - DNA, 22 bp, Artificial Sequence
  chemically synthesized
aaaacctatacaaatacatgga

SEQ ID NO: 23200 - DNA, 22 bp, Artificial Sequence
  chemically synthesized
aaacctatacaaatacatggaa

SEQ ID NO: 23201 - DNA, 22 bp, Artificial Sequence
  chemically synthesized
tacaaatacatggaaattaaac

SEQ ID NO: 23202 - DNA, 22 bp, Artificial Sequence
  chemically synthesized
aacaacatgctcctgaatgaac

SEQ ID NO: 23203 - DNA, 22 bp, Artificial Sequence
  chemically synthesized
ctgaatgaacgttatgtcaaga

SEQ ID NO: 23204 - DNA, 22 bp, Artificial Sequence
  chemically synthesized
aatgaacgttatgtcaagaaga

SEQ ID NO: 23205 - DNA, 22 bp, Artificial Sequence
  chemically synthesized
tgtcaagaagaaaattaagaag

SEQ ID NO: 23206 - DNA, 22 bp, Artificial Sequence
  chemically synthesized
agaaggaaatcaaaaatttttt

SEQ ID NO: 23207 - DNA, 22 bp, Artificial Sequence
  chemically synthesized
tttgaaacaaatgaaaattgaa

SEQ ID NO: 23208 - DNA, 22 bp, Artificial Sequence
  chemically synthesized
ttgaaacaaatgaaaattgaaa

SEQ ID NO: 23209 - DNA, 22 bp, Artificial Sequence
  chemically synthesized
tgaaacaaatgaaaattgaaat

SEQ ID NO: 23210 - DNA, 22 bp, Artificial Sequence
  chemically synthesized
gaaacaaatgaaaattgaaata

SEQ ID NO: 23211 - DNA, 22 bp, Artificial Sequence
  chemically synthesized
aaacaaatgaaaattgaaatac

SEQ ID NO: 23212 - DNA, 22 bp, Artificial Sequence
  chemically synthesized
aaatacaacataggaaaagcca

SEQ ID NO: 23213 - DNA, 22 bp, Artificial Sequence
  chemically synthesized
agagagaagcttatcaataaac

SEQ ID NO: 23214 - DNA, 22 bp, Artificial Sequence
  chemically synthesized
atcaataaacacttaaattaaa

SEQ ID NO: 23215 - DNA, 22 bp, Artificial Sequence
  chemically synthesized
tcaataaacacttaaattaaaa

SEQ ID NO: 23216 - DNA, 22 bp, Artificial Sequence
  chemically synthesized
aaattaaaaacatagaaagatt

SEQ ID NO: 23217 - DNA, 22 bp, Artificial Sequence
  chemically synthesized
aattaaaaacatagaaagattt

SEQ ID NO: 23218 - DNA, 22 bp, Artificial Sequence
  chemically synthesized
aaaacatagaaagatttcaaat

SEQ ID NO: 23219 - DNA, 22 bp, Artificial Sequence
  chemically synthesized
caaatatataatctaatcatgt

SEQ ID NO: 23220 - DNA, 22 bp, Artificial Sequence
  chemically synthesized
aaatatataatctaatcatgta

SEQ ID NO: 23221 - DNA, 22 bp, Artificial Sequence
  chemically synthesized
atcatgtacctcaacaagctag

SEQ ID NO: 23222 - DNA, 22 bp, Artificial Sequence
  chemically synthesized
aacaagctagaaaagcaagaac

SEQ ID NO: 23223 - DNA, 22 bp, Artificial Sequence
  chemically synthesized
gaaaagcaagaacaaaacccaa

SEQ ID NO: 23224 - DNA, 22 bp, Artificial Sequence
  chemically synthesized
gcagaaggaaagaaaaaatgaa

SEQ ID NO: 23225 - DNA, 22 bp, Artificial Sequence
  chemically synthesized
aatgaaatagagaaaaacaaca

SEQ ID NO: 23226 - DNA, 22 bp, Artificial Sequence
  chemically synthesized
atgaaatagagaaaaacaacaa

SEQ ID NO: 23227 - DNA, 22 bp, Artificial Sequence
  chemically synthesized
gcaaaatgaaaagttgttattt

SEQ ID NO: 23228 - DNA, 22 bp, Artificial Sequence
  chemically synthesized
ttatttaaaaaagataaaatgg

SEQ ID NO: 23229 - DNA, 22 bp, Artificial Sequence
  chemically synthesized
tttaaaaaagataaaatggata

SEQ ID NO: 23230 - DNA, 22 bp, Artificial Sequence
  chemically synthesized
aaaaaagataaaatggatatag

SEQ ID NO: 23231 - DNA, 22 bp, Artificial Sequence
  chemically synthesized
aaaaagataaaatggatatagc

SEQ ID NO: 23232 - DNA, 22 bp, Artificial Sequence
  chemically synthesized
tagctagactaaccaagaaaaa

SEQ ID NO: 23233 - DNA, 22 bp, Artificial Sequence
  chemically synthesized
gctagactaaccaagaaaaaga

SEQ ID NO: 23234 - DNA, 22 bp, Artificial Sequence
  chemically synthesized
gactaaccaagaaaaagagaag

SEQ ID NO: 23235 - DNA, 22 bp, Artificial Sequence
  chemically synthesized
accaagaaaaagagaagagact

SEQ ID NO: 23236 - DNA, 22 bp, Artificial Sequence
  chemically synthesized
aaataaagaaaatcagaaataa

SEQ ID NO: 23237 - DNA, 22 bp, Artificial Sequence
  chemically synthesized
caaccgataccacagaaataga

SEQ ID NO: 23238 - DNA, 22 bp, Artificial Sequence
  chemically synthesized
tcagagactattatgaacaacc

SEQ ID NO: 23239 - DNA, 22 bp, Artificial Sequence
  chemically synthesized
ttatgaacaaccatacactaaa

SEQ ID NO: 23240 - DNA, 22 bp, Artificial Sequence
  chemically synthesized
tgaacaaccatacactaaaaaa

SEQ ID NO: 23241 - DNA, 22 bp, Artificial Sequence
  chemically synthesized
aaaaactgaaaaatctagagga

SEQ ID NO: 23242 - DNA, 22 bp, Artificial Sequence
  chemically synthesized
aaaaatctagaggaaattaata

SEQ ID NO: 23243 - DNA, 22 bp, Artificial Sequence
  chemically synthesized
gaggaaattaataaatttctgg

SEQ ID NO: 23244 - DNA, 22 bp, Artificial Sequence
  chemically synthesized
ataaatttctggacacatacca

SEQ ID NO: 23245 - DNA, 22 bp, Artificial Sequence
  chemically synthesized
ctggacacataccacctaccaa

SEQ ID NO: 23246 - DNA, 22 bp, Artificial Sequence
  chemically synthesized
tggacacataccacctaccaag

SEQ ID NO: 23247 - DNA, 22 bp, Artificial Sequence
  chemically synthesized
gacacataccacctaccaagat

SEQ ID NO: 23248 - DNA, 22 bp, Artificial Sequence
  chemically synthesized
ccaagattgaattaagaaagaa

SEQ ID NO: 23249 - DNA, 22 bp, Artificial Sequence
  chemically synthesized
aattaagaaagaatagaaaacc

SEQ ID NO: 23250 - DNA, 22 bp, Artificial Sequence
  chemically synthesized
agaaagaatagaaaacctgaac

SEQ ID NO: 23251 - DNA, 22 bp, Artificial Sequence
  chemically synthesized
aacagaccagtaatgaataatg

SEQ ID NO: 23252 - DNA, 22 bp, Artificial Sequence
  chemically synthesized
aatcagtagtaaaaagtctccc

SEQ ID NO: 23253 - DNA, 22 bp, Artificial Sequence
  chemically synthesized
ccaaaaaagaaaatttcaagac

SEQ ID NO: 23254 - DNA, 22 bp, Artificial Sequence
  chemically synthesized
caagaccagatggctttactgt

SEQ ID NO: 23255 - DNA, 22 bp, Artificial Sequence
  chemically synthesized
aagaccagatggctttactgtc

SEQ ID NO: 23256 - DNA, 22 bp, Artificial Sequence
  chemically synthesized
tactgtcaaattttaccaaact

SEQ ID NO: 23257 - DNA, 22 bp, Artificial Sequence
  chemically synthesized
actgtcaaattttaccaaactt

SEQ ID NO: 23258 - DNA, 22 bp, Artificial Sequence
  chemically synthesized
ctgtcaaattttaccaaacttt

SEQ ID NO: 23259 - DNA, 22 bp, Artificial Sequence
  chemically synthesized
tcaaattttaccaaactttcaa

SEQ ID NO: 23260 - DNA, 22 bp, Artificial Sequence
  chemically synthesized
taccaaactttcaaagaaaact

SEQ ID NO: 23261 - DNA, 22 bp, Artificial Sequence
  chemically synthesized
accaaactttcaaagaaaacta

SEQ ID NO: 23262 - DNA, 22 bp, Artificial Sequence
  chemically synthesized
ccaaactttcaaagaaaactaa

SEQ ID NO: 23263 - DNA, 22 bp, Artificial Sequence
  chemically synthesized
tcaaagaaaactaacaagtctc

SEQ ID NO: 23264 - DNA, 22 bp, Artificial Sequence
  chemically synthesized
caaagaaaactaacaagtctcc

SEQ ID NO: 23265 - DNA, 22 bp, Artificial Sequence
  chemically synthesized
aaagaaaactaacaagtctcct

SEQ ID NO: 23266 - DNA, 22 bp, Artificial Sequence
  chemically synthesized
acaagtctccttaaattctttt

SEQ ID NO: 23267 - DNA, 22 bp, Artificial Sequence
  chemically synthesized
cttaaattcttttaaaaattaa

SEQ ID NO: 23268 - DNA, 22 bp, Artificial Sequence
  chemically synthesized
aaattcttttaaaaattaaaca

SEQ ID NO: 23269 - DNA, 22 bp, Artificial Sequence
  chemically synthesized
aattcttttaaaaattaaacag

SEQ ID NO: 23270 - DNA, 22 bp, Artificial Sequence
  chemically synthesized
ttttaaaaattaaacaggaagg

SEQ ID NO: 23271 - DNA, 22 bp, Artificial Sequence
  chemically synthesized
ttaaaaattaaacaggaaggaa

SEQ ID NO: 23272 - DNA, 22 bp, Artificial Sequence
  chemically synthesized
taaaaattaaacaggaaggaat

SEQ ID NO: 23273 - DNA, 22 bp, Artificial Sequence
  chemically synthesized
aaaaattaaacaggaaggaatt

SEQ ID NO: 23274 - DNA, 22 bp, Artificial Sequence
  chemically synthesized
aaaattaaacaggaaggaattc

SEQ ID NO: 23275 - DNA, 22 bp, Artificial Sequence
  chemically synthesized
aacaggaaggaattctccctaa

SEQ ID NO: 23276 - DNA, 22 bp, Artificial Sequence
  chemically synthesized
tccctaactcattctctgaggc

SEQ ID NO: 23277 - DNA, 22 bp, Artificial Sequence
  chemically synthesized
cctaactcattctctgaggcca

SEQ ID NO: 23278 - DNA, 22 bp, Artificial Sequence
  chemically synthesized
actcattctctgaggccagtat

SEQ ID NO: 23279 - DNA, 22 bp, Artificial Sequence
  chemically synthesized
attctctgaggccagtattatc

SEQ ID NO: 23280 - DNA, 22 bp, Artificial Sequence
  chemically synthesized
tctgaggccagtattatcctga

SEQ ID NO: 23281 - DNA, 22 bp, Artificial Sequence
  chemically synthesized
tgaggccagtattatcctgatt

SEQ ID NO: 23282 - DNA, 22 bp, Artificial Sequence
  chemically synthesized
aggccagtattatcctgattcc

SEQ ID NO: 23283 - DNA, 22 bp, Artificial Sequence
  chemically synthesized
tcctgattccataaccagacaa

SEQ ID NO: 23284 - DNA, 22 bp, Artificial Sequence
  chemically synthesized
attccataaccagacaaggatg

SEQ ID NO: 23285 - DNA, 22 bp, Artificial Sequence
  chemically synthesized
cataaccagacaaggatgcaag

SEQ ID NO: 23286 - DNA, 22 bp, Artificial Sequence
  chemically synthesized
caggtcaatatccctgatggaa

SEQ ID NO: 23287 - DNA, 22 bp, Artificial Sequence
  chemically synthesized
atggaacataggtgtgaaaatc

SEQ ID NO: 23288 - DNA, 22 bp, Artificial Sequence
  chemically synthesized
aacaaaatactagcaaactgaa

SEQ ID NO: 23289 - DNA, 22 bp, Artificial Sequence
  chemically synthesized
gcaaactgaatccaacagtaca

SEQ ID NO: 23290 - DNA, 22 bp, Artificial Sequence
  chemically synthesized
aatccaacagtacatccaaaag

SEQ ID NO: 23291 - DNA, 22 bp, Artificial Sequence
  chemically synthesized
atactagggttgcaagaacagt

SEQ ID NO: 23292 - DNA, 22 bp, Artificial Sequence
  chemically synthesized
tactagggttgcaagaacagtt

SEQ ID NO: 23293 - DNA, 22 bp, Artificial Sequence
  chemically synthesized
gggttgcaagaacagttcaaat

SEQ ID NO: 23294 - DNA, 22 bp, Artificial Sequence
  chemically synthesized
caagaacagttcaaatcaataa

SEQ ID NO: 23295 - DNA, 22 bp, Artificial Sequence
  chemically synthesized
aaatcaataaatgtgatacatc

SEQ ID NO: 23296 - DNA, 22 bp, Artificial Sequence
  chemically synthesized
aatagatacagaaaaagtattt

SEQ ID NO: 23297 - DNA, 22 bp, Artificial Sequence
  chemically synthesized
gataaaatttaacattccttca

SEQ ID NO: 23298 - DNA, 22 bp, Artificial Sequence
  chemically synthesized
ataaaatttaacattccttcat

SEQ ID NO: 23299 - DNA, 22 bp, Artificial Sequence
  chemically synthesized
aacattccttcatgataaaaac

SEQ ID NO: 23300 - DNA, 22 bp, Artificial Sequence
  chemically synthesized
acattccttcatgataaaaact

SEQ ID NO: 23301 - DNA, 22 bp, Artificial Sequence
  chemically synthesized
cttcatgataaaaactatctgc

SEQ ID NO: 23302 - DNA, 22 bp, Artificial Sequence
  chemically synthesized
catgataaaaactatctgcagc

SEQ ID NO: 23303 - DNA, 22 bp, Artificial Sequence
  chemically synthesized
atgataaaaactatctgcagcc

SEQ ID NO: 23304 - DNA, 22 bp, Artificial Sequence
  chemically synthesized
tctgcagccaatcatagaagga

SEQ ID NO: 23305 - DNA, 22 bp, Artificial Sequence
  chemically synthesized
cagccaatcatagaaggaacat

SEQ ID NO: 23306 - DNA, 22 bp, Artificial Sequence
  chemically synthesized
aatataataaaagtcatatatg

SEQ ID NO: 23307 - DNA, 22 bp, Artificial Sequence
  chemically synthesized
acatcatactgaattgggaaaa

SEQ ID NO: 23308 - DNA, 22 bp, Artificial Sequence
  chemically synthesized
aattgggaaaagctggaagcct

SEQ ID NO: 23309 - DNA, 22 bp, Artificial Sequence
  chemically synthesized
ggaaaagctggaagcctttcct

SEQ ID NO: 23310 - DNA, 22 bp, Artificial Sequence
  chemically synthesized
gaagcctttcctctaagaactg

SEQ ID NO: 23311 - DNA, 22 bp, Artificial Sequence
  chemically synthesized
tcctctaagaactgaaacaaaa

SEQ ID NO: 23312 - DNA, 22 bp, Artificial Sequence
  chemically synthesized
cctctaagaactgaaacaaaat

SEQ ID NO: 23313 - DNA, 22 bp, Artificial Sequence
  chemically synthesized
ctctaagaactgaaacaaaata

SEQ ID NO: 23314 - DNA, 22 bp, Artificial Sequence
  chemically synthesized
taagaactgaaacaaaataagg

SEQ ID NO: 23315 - DNA, 22 bp, Artificial Sequence
  chemically synthesized
agaactgaaacaaaataaggat

SEQ ID NO: 23316 - DNA, 22 bp, Artificial Sequence
  chemically synthesized
aaacaaaataaggatgcccact

SEQ ID NO: 23317 - DNA, 22 bp, Artificial Sequence
  chemically synthesized
ccatcactcctattcaatataa

SEQ ID NO: 23318 - DNA, 22 bp, Artificial Sequence
  chemically synthesized
catcactcctattcaatataat

SEQ ID NO: 23319 - DNA, 22 bp, Artificial Sequence
  chemically synthesized
ctattcaatataatactggaag

SEQ ID NO: 23320 - DNA, 22 bp, Artificial Sequence
  chemically synthesized
ttcaatataatactggaagtcc

SEQ ID NO: 23321 - DNA, 22 bp, Artificial Sequence
  chemically synthesized
aatataatactggaagtcctag

SEQ ID NO: 23322 - DNA, 22 bp, Artificial Sequence
  chemically synthesized
gaagtcctagccacagctttca

SEQ ID NO: 23323 - DNA, 22 bp, Artificial Sequence
  chemically synthesized
gccacagctttcaggtcagaga

SEQ ID NO: 23324 - DNA, 22 bp, Artificial Sequence
  chemically synthesized
tcaggtcagagaaagaaagaaa

SEQ ID NO: 23325 - DNA, 22 bp, Artificial Sequence
  chemically synthesized
caggtcagagaaagaaagaaag

SEQ ID NO: 23326 - DNA, 22 bp, Artificial Sequence
  chemically synthesized
aggtcagagaaagaaagaaaga

SEQ ID NO: 23327 - DNA, 22 bp, Artificial Sequence
  chemically synthesized
tccatctttccagatgacatga

SEQ ID NO: 23328 - DNA, 22 bp, Artificial Sequence
  chemically synthesized
tccagatgacatgattttatac

SEQ ID NO: 23329 - DNA, 22 bp, Artificial Sequence
  chemically synthesized
ccagatgacatgattttatacc

SEQ ID NO: 23330 - DNA, 22 bp, Artificial Sequence
  chemically synthesized
cagatgacatgattttatacct

SEQ ID NO: 23331 - DNA, 22 bp, Artificial Sequence
  chemically synthesized
tatacctagaaaaaccaagact

SEQ ID NO: 23332 - DNA, 22 bp, Artificial Sequence
  chemically synthesized
atacctagaaaaaccaagactc

SEQ ID NO: 23333 - DNA, 22 bp, Artificial Sequence
  chemically synthesized
tacctagaaaaaccaagactcc

SEQ ID NO: 23334 - DNA, 22 bp, Artificial Sequence
  chemically synthesized
gaaaaaccaagactccaccaaa

SEQ ID NO: 23335 - DNA, 22 bp, Artificial Sequence
  chemically synthesized
caccaaagcactcttagcgctg

SEQ ID NO: 23336 - DNA, 22 bp, Artificial Sequence
  chemically synthesized
ttagcgctgaaaaataaattca

SEQ ID NO: 23337 - DNA, 22 bp, Artificial Sequence
  chemically synthesized
agcgctgaaaaataaattcagt

SEQ ID NO: 23338 - DNA, 22 bp, Artificial Sequence
  chemically synthesized
gcgctgaaaaataaattcagta

SEQ ID NO: 23339 - DNA, 22 bp, Artificial Sequence
  chemically synthesized
aaaaataaattcagtaaagtta

SEQ ID NO: 23340 - DNA, 22 bp, Artificial Sequence
  chemically synthesized
agtaaagttacaggagacaaaa

SEQ ID NO: 23341 - DNA, 22 bp, Artificial Sequence
  chemically synthesized
caggagacaaaatcagcatatg

SEQ ID NO: 23342 - DNA, 22 bp, Artificial Sequence
  chemically synthesized
ctacacaccaataataaactag

SEQ ID NO: 23343 - DNA, 22 bp, Artificial Sequence
  chemically synthesized
tacacaccaataataaactagc

SEQ ID NO: 23344 - DNA, 22 bp, Artificial Sequence
  chemically synthesized
cacaccaataataaactagctg

SEQ ID NO: 23345 - DNA, 22 bp, Artificial Sequence
  chemically synthesized
gctgagaaggaaattaagaagg

SEQ ID NO: 23346 - DNA, 22 bp, Artificial Sequence
  chemically synthesized
agaaggaaattaagaaggcaat

SEQ ID NO: 23347 - DNA, 22 bp, Artificial Sequence
  chemically synthesized
agaaggcaatcccatttacaat

SEQ ID NO: 23348 - DNA, 22 bp, Artificial Sequence
  chemically synthesized
acaatagctaaaaaataaaata

SEQ ID NO: 23349 - DNA, 22 bp, Artificial Sequence
  chemically synthesized
caatagctaaaaaataaaatat

SEQ ID NO: 23350 - DNA, 22 bp, Artificial Sequence
  chemically synthesized
aaaaataaaatatttagggata

SEQ ID NO: 23351 - DNA, 22 bp, Artificial Sequence
  chemically synthesized
agggataaatttaaccaaggaa

SEQ ID NO: 23352 - DNA, 22 bp, Artificial Sequence
  chemically synthesized
gggataaatttaaccaaggaac

SEQ ID NO: 23353 - DNA, 22 bp, Artificial Sequence
  chemically synthesized
aaccaaggaaccgaaaaacctc

SEQ ID NO: 23354 - DNA, 22 bp, Artificial Sequence
  chemically synthesized
accaaggaaccgaaaaacctct

SEQ ID NO: 23355 - DNA, 22 bp, Artificial Sequence
  chemically synthesized
tattcggaaaactacaaaacac

SEQ ID NO: 23356 - DNA, 22 bp, Artificial Sequence
  chemically synthesized
ttcggaaaactacaaaacactg

SEQ ID NO: 23357 - DNA, 22 bp, Artificial Sequence
  chemically synthesized
ggaaaactacaaaacactgata

SEQ ID NO: 23358 - DNA, 22 bp, Artificial Sequence
  chemically synthesized
caaaacactgataaaagaattg

SEQ ID NO: 23359 - DNA, 22 bp, Artificial Sequence
  chemically synthesized
ataaaagaattgaaaaggacag

SEQ ID NO: 23360 - DNA, 22 bp, Artificial Sequence
  chemically synthesized
aaaaggacagaaacaaatggag

SEQ ID NO: 23361 - DNA, 22 bp, Artificial Sequence
  chemically synthesized
tgttcatggatcagaaaaatta

SEQ ID NO: 23362 - DNA, 22 bp, Artificial Sequence
  chemically synthesized
atggatcagaaaaattaatatt

SEQ ID NO: 23363 - DNA, 22 bp, Artificial Sequence
  chemically synthesized
atattgttaaaatggccatact

SEQ ID NO: 23364 - DNA, 22 bp, Artificial Sequence
  chemically synthesized
ttaaaatggccatactacccaa

SEQ ID NO: 23365 - DNA, 22 bp, Artificial Sequence
  chemically synthesized
aaatggccatactacccaaagc

SEQ ID NO: 23366 - DNA, 22 bp, Artificial Sequence
  chemically synthesized
cccaaagcaatctacagattct

SEQ ID NO: 23367 - DNA, 22 bp, Artificial Sequence
  chemically synthesized
cagattctatatgaccgctatc

SEQ ID NO: 23368 - DNA, 22 bp, Artificial Sequence
  chemically synthesized
tatatgaccgctatcaaaatag

SEQ ID NO: 23369 - DNA, 22 bp, Artificial Sequence
  chemically synthesized
tatgaccgctatcaaaatagca

SEQ ID NO: 23370 - DNA, 22 bp, Artificial Sequence
  chemically synthesized
tcaaaatagcaatgtcattttt

SEQ ID NO: 23371 - DNA, 22 bp, Artificial Sequence
  chemically synthesized
ttcacagaaatggaaaaaccaa

SEQ ID NO: 23372 - DNA, 22 bp, Artificial Sequence
  chemically synthesized
tcacagaaatggaaaaaccaat

SEQ ID NO: 23373 - DNA, 22 bp, Artificial Sequence
  chemically synthesized
cacagaaatggaaaaaccaatc

SEQ ID NO: 23374 - DNA, 22 bp, Artificial Sequence
  chemically synthesized
acagaaatggaaaaaccaatct

SEQ ID NO: 23375 - DNA, 22 bp, Artificial Sequence
  chemically synthesized
aaatttgtatgaaattaaaaaa

SEQ ID NO: 23376 - DNA, 22 bp, Artificial Sequence
  chemically synthesized
gtatgaaattaaaaaatagctc

SEQ ID NO: 23377 - DNA, 22 bp, Artificial Sequence
  chemically synthesized
tatgaaattaaaaaatagctcc

SEQ ID NO: 23378 - DNA, 22 bp, Artificial Sequence
  chemically synthesized
aaaaatagctccagtagccaaa

SEQ ID NO: 23379 - DNA, 22 bp, Artificial Sequence
  chemically synthesized
cagtagccaaagtcatcctgtg

SEQ ID NO: 23380 - DNA, 22 bp, Artificial Sequence
  chemically synthesized
tgaaaaaagaacaatgctagag

SEQ ID NO: 23381 - DNA, 22 bp, Artificial Sequence
  chemically synthesized
gaggtatcatactacctgattt

SEQ ID NO: 23382 - DNA, 22 bp, Artificial Sequence
  chemically synthesized
cctgatttcaaagtatattaca

SEQ ID NO: 23383 - DNA, 22 bp, Artificial Sequence
  chemically synthesized
atttcaaagtatattacaaaag

SEQ ID NO: 23384 - DNA, 22 bp, Artificial Sequence
  chemically synthesized
caaagtatattacaaaagtata

SEQ ID NO: 23385 - DNA, 22 bp, Artificial Sequence
  chemically synthesized
aaagtatattacaaaagtatag

SEQ ID NO: 23386 - DNA, 22 bp, Artificial Sequence
  chemically synthesized
caaaagtataggaacctaaaca

SEQ ID NO: 23387 - DNA, 22 bp, Artificial Sequence
  chemically synthesized
aacagcatgatactgacattag

SEQ ID NO: 23388 - DNA, 22 bp, Artificial Sequence
  chemically synthesized
acattagaacagacacttagac

SEQ ID NO: 23389 - DNA, 22 bp, Artificial Sequence
  chemically synthesized
gaacagacacttagaccaatgg

SEQ ID NO: 23390 - DNA, 22 bp, Artificial Sequence
  chemically synthesized
agaccaatggaagagaatagag

SEQ ID NO: 23391 - DNA, 22 bp, Artificial Sequence
  chemically synthesized
gaccaatggaagagaatagaga

SEQ ID NO: 23392 - DNA, 22 bp, Artificial Sequence
  chemically synthesized
gaaatgcatccacatatttata

SEQ ID NO: 23393 - DNA, 22 bp, Artificial Sequence
  chemically synthesized
atagccaacagattttcaacaa

SEQ ID NO: 23394 - DNA, 22 bp, Artificial Sequence
  chemically synthesized
tagccaacagattttcaacaaa

SEQ ID NO: 23395 - DNA, 22 bp, Artificial Sequence
  chemically synthesized
tcaacaaaggtgacaagaatat

SEQ ID NO: 23396 - DNA, 22 bp, Artificial Sequence
  chemically synthesized
caacaaaggtgacaagaatata

SEQ ID NO: 23397 - DNA, 22 bp, Artificial Sequence
  chemically synthesized
aacaaaggtgacaagaatatac

SEQ ID NO: 23398 - DNA, 22 bp, Artificial Sequence
  chemically synthesized
aggaaaggacacagtgttcaag

SEQ ID NO: 23399 - DNA, 22 bp, Artificial Sequence
  chemically synthesized
aagaaatggtgctgaaaaaatt

SEQ ID NO: 23400 - DNA, 22 bp, Artificial Sequence
  chemically synthesized
aaaaaattggatatccattgga

SEQ ID NO: 23401 - DNA, 22 bp, Artificial Sequence
  chemically synthesized
gatatccattggatatccatgt

SEQ ID NO: 23402 - DNA, 22 bp, Artificial Sequence
  chemically synthesized
gatatccatgtgcaaaagaata

SEQ ID NO: 23403 - DNA, 22 bp, Artificial Sequence
  chemically synthesized
gactgctgatatggtttggatg

SEQ ID NO: 23404 - DNA, 22 bp, Artificial Sequence
  chemically synthesized
ctgatatggtttggatgtttgt

SEQ ID NO: 23405 - DNA, 22 bp, Artificial Sequence
  chemically synthesized
atatggtttggatgtttgttcc

SEQ ID NO: 23406 - DNA, 22 bp, Artificial Sequence
  chemically synthesized
ggatgtttgttccctccaaatc

SEQ ID NO: 23407 - DNA, 22 bp, Artificial Sequence
  chemically synthesized
gatgtttgttccctccaaatct

SEQ ID NO: 23408 - DNA, 22 bp, Artificial Sequence
  chemically synthesized
gttccctccaaatctcatgttg

SEQ ID NO: 23409 - DNA, 22 bp, Artificial Sequence
  chemically synthesized
ttccctccaaatctcatgttga

SEQ ID NO: 23410 - DNA, 22 bp, Artificial Sequence
  chemically synthesized
cctccaaatctcatgttgaaat

SEQ ID NO: 23411 - DNA, 22 bp, Artificial Sequence
  chemically synthesized
caaatctcatgttgaaatataa

SEQ ID NO: 23412 - DNA, 22 bp, Artificial Sequence
  chemically synthesized
atgttgaaatataatccccaac

SEQ ID NO: 23413 - DNA, 22 bp, Artificial Sequence
  chemically synthesized
aaatataatccccaacttctca

SEQ ID NO: 23414 - DNA, 22 bp, Artificial Sequence
  chemically synthesized
ctcaggatcttggcggatggga

SEQ ID NO: 23415 - DNA, 22 bp, Artificial Sequence
  chemically synthesized
tcaggatcttggcggatgggag

SEQ ID NO: 23416 - DNA, 22 bp, Artificial Sequence
  chemically synthesized
aggatcttggcggatgggaggt

SEQ ID NO: 23417 - DNA, 22 bp, Artificial Sequence
  chemically synthesized
ggcggatgggaggtaggcctag

SEQ ID NO: 23418 - DNA, 22 bp, Artificial Sequence
  chemically synthesized
gcggatgggaggtaggcctaga

SEQ ID NO: 23419 - DNA, 22 bp, Artificial Sequence
  chemically synthesized
gattgcagctccaactcagatg

SEQ ID NO: 23420 - DNA, 22 bp, Artificial Sequence
  chemically synthesized
cagctccaactcagatggacag

SEQ ID NO: 23421 - DNA, 22 bp, Artificial Sequence
  chemically synthesized
caactcagatggacagagcagc

SEQ ID NO: 23422 - DNA, 22 bp, Artificial Sequence
  chemically synthesized
agatggacagagcagcatgtgg

SEQ ID NO: 23423 - DNA, 22 bp, Artificial Sequence
  chemically synthesized
gcattgtgaattttagctgcag

SEQ ID NO: 23424 - DNA, 22 bp, Artificial Sequence
  chemically synthesized
tgaattttagctgcagatagac

SEQ ID NO: 23425 - DNA, 22 bp, Artificial Sequence
  chemically synthesized
tagctgcagatagactgcaaga

SEQ ID NO: 23426 - DNA, 22 bp, Artificial Sequence
  chemically synthesized
agctgcagatagactgcaagaa

SEQ ID NO: 23427 - DNA, 22 bp, Artificial Sequence
  chemically synthesized
gctgcagatagactgcaagaac

SEQ ID NO: 23428 - DNA, 22 bp, Artificial Sequence
  chemically synthesized
cagatagactgcaagaacaaac

SEQ ID NO: 23429 - DNA, 22 bp, Artificial Sequence
  chemically synthesized
caagaacaaaccagcaatcctg

SEQ ID NO: 23430 - DNA, 22 bp, Artificial Sequence
  chemically synthesized
agaggacccacagaccctctga

SEQ ID NO: 23431 - DNA, 22 bp, Artificial Sequence
  chemically synthesized
tgaaggaagtagattgctcctg

SEQ ID NO: 23432 - DNA, 22 bp, Artificial Sequence
  chemically synthesized
aaggaagtagattgctcctgca

SEQ ID NO: 23433 - DNA, 22 bp, Artificial Sequence
  chemically synthesized
ctcctgcaggacccaggagaca

SEQ ID NO: 23434 - DNA, 22 bp, Artificial Sequence
  chemically synthesized
ctgcaggacccaggagacaccc

SEQ ID NO: 23435 - DNA, 22 bp, Artificial Sequence
  chemically synthesized
caggacccaggagacaccccaa

SEQ ID NO: 23436 - DNA, 22 bp, Artificial Sequence
  chemically synthesized
tgagtgccccaactgcggaagt

SEQ ID NO: 23437 - DNA, 22 bp, Artificial Sequence
  chemically synthesized
cggaagtgggaaagggagatcc

SEQ ID NO: 23438 - DNA, 22 bp, Artificial Sequence
  chemically synthesized
ctctcctaaacacacactccca

SEQ ID NO: 23439 - DNA, 22 bp, Artificial Sequence
  chemically synthesized
tcctaaacacacactcccactg

SEQ ID NO: 23440 - DNA, 22 bp, Artificial Sequence
  chemically synthesized
ctaaacacacactcccactgga

SEQ ID NO: 23441 - DNA, 22 bp, Artificial Sequence
  chemically synthesized
aacacacactcccactggagaa

SEQ ID NO: 23442 - DNA, 22 bp, Artificial Sequence
  chemically synthesized
ccactggagaaactgaaggtct

SEQ ID NO: 23443 - DNA, 22 bp, Artificial Sequence
  chemically synthesized
gagaaactgaaggtctgtttgt

SEQ ID NO: 23444 - DNA, 22 bp, Artificial Sequence
  chemically synthesized
aaggtctgtttgtgggagaagt

SEQ ID NO: 23445 - DNA, 22 bp, Artificial Sequence
  chemically synthesized
tttgtgggagaagtttctgacc

SEQ ID NO: 23446 - DNA, 22 bp, Artificial Sequence
  chemically synthesized
gtgggagaagtttctgacctta

SEQ ID NO: 23447 - DNA, 22 bp, Artificial Sequence
  chemically synthesized
tgggagaagtttctgaccttac

SEQ ID NO: 23448 - DNA, 22 bp, Artificial Sequence
  chemically synthesized
ctgaccttacctggagttgagt

SEQ ID NO: 23449 - DNA, 22 bp, Artificial Sequence
  chemically synthesized
tgaccttacctggagttgagtt

SEQ ID NO: 23450 - DNA, 22 bp, Artificial Sequence
  chemically synthesized
accttacctggagttgagttaa

SEQ ID NO: 23451 - DNA, 22 bp, Artificial Sequence
  chemically synthesized
acctggagttgagttaacttag

SEQ ID NO: 23452 - DNA, 22 bp, Artificial Sequence
  chemically synthesized
cctggagttgagttaacttaga

SEQ ID NO: 23453 - DNA, 22 bp, Artificial Sequence
  chemically synthesized
gagttgagttaacttagagagc

SEQ ID NO: 23454 - DNA, 22 bp, Artificial Sequence
  chemically synthesized
agttaacttagagagctgagca

SEQ ID NO: 23455 - DNA, 22 bp, Artificial Sequence
  chemically synthesized
acttagagagctgagcaaaata

SEQ ID NO: 23456 - DNA, 22 bp, Artificial Sequence
  chemically synthesized
agagagctgagcaaaatacagg

SEQ ID NO: 23457 - DNA, 22 bp, Artificial Sequence
  chemically synthesized
gagagctgagcaaaatacaggt

SEQ ID NO: 23458 - DNA, 22 bp, Artificial Sequence
  chemically synthesized
agcaaaatacaggtgtagagga

SEQ ID NO: 23459 - DNA, 22 bp, Artificial Sequence
  chemically synthesized
ggagctcactgggtccctgagc

SEQ ID NO: 23460 - DNA, 22 bp, Artificial Sequence
  chemically synthesized
actgggtccctgagcaggccat

SEQ ID NO: 23461 - DNA, 22 bp, Artificial Sequence
  chemically synthesized
ggtccctgagcaggccattcct

SEQ ID NO: 23462 - DNA, 22 bp, Artificial Sequence
  chemically synthesized
agcaggccattcctgcctggca

SEQ ID NO: 23463 - DNA, 22 bp, Artificial Sequence
  chemically synthesized
ctgcctggcatagccaggcatt

SEQ ID NO: 23464 - DNA, 22 bp, Artificial Sequence
  chemically synthesized
cctggcatagccaggcatttac

SEQ ID NO: 23465 - DNA, 22 bp, Artificial Sequence
  chemically synthesized
gcatagccaggcatttacatta

SEQ ID NO: 23466 - DNA, 22 bp, Artificial Sequence
  chemically synthesized
acattactaacattgaatgtaa

SEQ ID NO: 23467 - DNA, 22 bp, Artificial Sequence
  chemically synthesized
cattactaacattgaatgtaaa

SEQ ID NO: 23468 - DNA, 22 bp, Artificial Sequence
  chemically synthesized
ctaacattgaatgtaaatggcc

SEQ ID NO: 23469 - DNA, 22 bp, Artificial Sequence
  chemically synthesized
acattgaatgtaaatggcctaa

SEQ ID NO: 23470 - DNA, 22 bp, Artificial Sequence
  chemically synthesized
aatgtaaatggcctaaatgctc

SEQ ID NO: 23471 - DNA, 22 bp, Artificial Sequence
  chemically synthesized
aatgctccacttaaaagggtga

SEQ ID NO: 23472 - DNA, 22 bp, Artificial Sequence
  chemically synthesized
cacttaaaagggtgaaaaaggt

SEQ ID NO: 23473 - DNA, 22 bp, Artificial Sequence
  chemically synthesized
aaaagggtgaaaaaggtatttc

SEQ ID NO: 23474 - DNA, 22 bp, Artificial Sequence
  chemically synthesized
aaagggtgaaaaaggtatttca

SEQ ID NO: 23475 - DNA, 22 bp, Artificial Sequence
  chemically synthesized
catgcaaatggccaccaaaagt

SEQ ID NO: 23476 - DNA, 22 bp, Artificial Sequence
  chemically synthesized
atgcaaatggccaccaaaagtg

SEQ ID NO: 23477 - DNA, 22 bp, Artificial Sequence
  chemically synthesized
taaagcaacagcagttaaaaga

SEQ ID NO: 23478 - DNA, 22 bp, Artificial Sequence
  chemically synthesized
aaagcaacagcagttaaaagag

SEQ ID NO: 23479 - DNA, 22 bp, Artificial Sequence
  chemically synthesized
aagcaacagcagttaaaagaga

SEQ ID NO: 23480 - DNA, 22 bp, Artificial Sequence
  chemically synthesized
aaagagacaaagagggacatta

SEQ ID NO: 23481 - DNA, 22 bp, Artificial Sequence
  chemically synthesized
tataatggtaaaaggccttgtc

SEQ ID NO: 23482 - DNA, 22 bp, Artificial Sequence
  chemically synthesized
gtccaacaggaaaatatcacaa

SEQ ID NO: 23483 - DNA, 22 bp, Artificial Sequence
  chemically synthesized
tccaacaggaaaatatcacaat

SEQ ID NO: 23484 - DNA, 22 bp, Artificial Sequence
  chemically synthesized
aaacatatatgcacctaacact

SEQ ID NO: 23485 - DNA, 22 bp, Artificial Sequence
  chemically synthesized
aacatatatgcacctaacactg

SEQ ID NO: 23486 - DNA, 22 bp, Artificial Sequence
  chemically synthesized
acactggagctcccaaatttat

SEQ ID NO: 23487 - DNA, 22 bp, Artificial Sequence
  chemically synthesized
gagctcccaaatttatagaaca

SEQ ID NO: 23488 - DNA, 22 bp, Artificial Sequence
  chemically synthesized
ccaaatttatagaacaattact

SEQ ID NO: 23489 - DNA, 22 bp, Artificial Sequence
  chemically synthesized
atagaacaattactaatagacc

SEQ ID NO: 23490 - DNA, 22 bp, Artificial Sequence
  chemically synthesized
tagaacaattactaatagacct

SEQ ID NO: 23491 - DNA, 22 bp, Artificial Sequence
  chemically synthesized
ctaatagacctaagaaatgaga

SEQ ID NO: 23492 - DNA, 22 bp, Artificial Sequence
  chemically synthesized
atagacctaagaaatgagatag

SEQ ID NO: 23493 - DNA, 22 bp, Artificial Sequence
  chemically synthesized
agaaatgagatagacagcaaca

SEQ ID NO: 23494 - DNA, 22 bp, Artificial Sequence
  chemically synthesized
caatacttcattgacagcacta

SEQ ID NO: 23495 - DNA, 22 bp, Artificial Sequence
  chemically synthesized
aatacttcattgacagcactag

SEQ ID NO: 23496 - DNA, 22 bp, Artificial Sequence
  chemically synthesized
cattgacagcactagacagttc

SEQ ID NO: 23497 - DNA, 22 bp, Artificial Sequence
  chemically synthesized
attgacagcactagacagttca

SEQ ID NO: 23498 - DNA, 22 bp, Artificial Sequence
  chemically synthesized
acagcactagacagttcatcaa

SEQ ID NO: 23499 - DNA, 22 bp, Artificial Sequence
  chemically synthesized
gacagttcatcaagacagaaag

SEQ ID NO: 23500 - DNA, 22 bp, Artificial Sequence
  chemically synthesized
atcaagacagaaagtcaacaaa

SEQ ID NO: 23501 - DNA, 22 bp, Artificial Sequence
  chemically synthesized
aaattataccttagaacaaatg

SEQ ID NO: 23502 - DNA, 22 bp, Artificial Sequence
  chemically synthesized
aattataccttagaacaaatgg

SEQ ID NO: 23503 - DNA, 22 bp, Artificial Sequence
  chemically synthesized
taccttagaacaaatggactta

SEQ ID NO: 23504 - DNA, 22 bp, Artificial Sequence
  chemically synthesized
agaacaaatggacttaacagtt

SEQ ID NO: 23505 - DNA, 22 bp, Artificial Sequence
  chemically synthesized
gaacaaatggacttaacagtta

SEQ ID NO: 23506 - DNA, 22 bp, Artificial Sequence
  chemically synthesized
aacagttatatacagaacattt

SEQ ID NO: 23507 - DNA, 22 bp, Artificial Sequence
  chemically synthesized
acagttatatacagaacatttc

SEQ ID NO: 23508 - DNA, 22 bp, Artificial Sequence
  chemically synthesized
tatacagaacatttcatccaat

SEQ ID NO: 23509 - DNA, 22 bp, Artificial Sequence
  chemically synthesized
catccaataaccacagaacaca

SEQ ID NO: 23510 - DNA, 22 bp, Artificial Sequence
  chemically synthesized
atccaataaccacagaacacac

SEQ ID NO: 23511 - DNA, 22 bp, Artificial Sequence
  chemically synthesized
tattcaacagcgcgtggaaatt

SEQ ID NO: 23512 - DNA, 22 bp, Artificial Sequence
  chemically synthesized
ttcaacagcgcgtggaaatttc

SEQ ID NO: 23513 - DNA, 22 bp, Artificial Sequence
  chemically synthesized
aacagcgcgtggaaatttctcc

SEQ ID NO: 23514 - DNA, 22 bp, Artificial Sequence
  chemically synthesized
ctccaaggtagaccatatgata

SEQ ID NO: 23515 - DNA, 22 bp, Artificial Sequence
  chemically synthesized
tccaaggtagaccatatgatag

SEQ ID NO: 23516 - DNA, 22 bp, Artificial Sequence
  chemically synthesized
caaggtagaccatatgataggc

SEQ ID NO: 23517 - DNA, 22 bp, Artificial Sequence
  chemically synthesized
aataaatttactaacagaccaa

SEQ ID NO: 23518 - DNA, 22 bp, Artificial Sequence
  chemically synthesized
actaacagaccaataacaagca

SEQ ID NO: 23519 - DNA, 22 bp, Artificial Sequence
  chemically synthesized
ctaacagaccaataacaagcag

SEQ ID NO: 23520 - DNA, 22 bp, Artificial Sequence
  chemically synthesized
acagaccaataacaagcagtga

SEQ ID NO: 23521 - DNA, 22 bp, Artificial Sequence
  chemically synthesized
aattggtaattaaaaaattacc

SEQ ID NO: 23522 - DNA, 22 bp, Artificial Sequence
  chemically synthesized
attggtaattaaaaaattacca

SEQ ID NO: 23523 - DNA, 22 bp, Artificial Sequence
  chemically synthesized
gtaattaaaaaattaccaacca

SEQ ID NO: 23524 - DNA, 22 bp, Artificial Sequence
  chemically synthesized
aaaaattaccaaccaaaaaaaa

SEQ ID NO: 23525 - DNA, 22 bp, Artificial Sequence
  chemically synthesized
ccaaccaaaaaaaagttcagga

SEQ ID NO: 23526 - DNA, 22 bp, Artificial Sequence
  chemically synthesized
aggaccagatggattcacaaca

SEQ ID NO: 23527 - DNA, 22 bp, Artificial Sequence
  chemically synthesized
acaacagaattctactagacat

SEQ ID NO: 23528 - DNA, 22 bp, Artificial Sequence
  chemically synthesized
tactagacattcaaagaggaat

SEQ ID NO: 23529 - DNA, 22 bp, Artificial Sequence
  chemically synthesized
ctagacattcaaagaggaattg

SEQ ID NO: 23530 - DNA, 22 bp, Artificial Sequence
  chemically synthesized
gacattcaaagaggaattggtc

SEQ ID NO: 23531 - DNA, 22 bp, Artificial Sequence
  chemically synthesized
aaagaggaattggtccccatct

SEQ ID NO: 23532 - DNA, 22 bp, Artificial Sequence
  chemically synthesized
gtccccatctttttgacactat

SEQ ID NO: 23533 - DNA, 22 bp, Artificial Sequence
  chemically synthesized
tttgacactattctacaagaca

SEQ ID NO: 23534 - DNA, 22 bp, Artificial Sequence
  chemically synthesized
ttgacactattctacaagacag

SEQ ID NO: 23535 - DNA, 22 bp, Artificial Sequence
  chemically synthesized
tgacactattctacaagacaga

SEQ ID NO: 23536 - DNA, 22 bp, Artificial Sequence
  chemically synthesized
gacactattctacaagacagat

SEQ ID NO: 23537 - DNA, 22 bp, Artificial Sequence
  chemically synthesized
acactattctacaagacagata

SEQ ID NO: 23538 - DNA, 22 bp, Artificial Sequence
  chemically synthesized
ttctacaagacagataaagaag

SEQ ID NO: 23539 - DNA, 22 bp, Artificial Sequence
  chemically synthesized
tacaagacagataaagaaggaa

SEQ ID NO: 23540 - DNA, 22 bp, Artificial Sequence
  chemically synthesized
caagacagataaagaaggaacc

SEQ ID NO: 23541 - DNA, 22 bp, Artificial Sequence
  chemically synthesized
ccctaattcattctatgaagcc

SEQ ID NO: 23542 - DNA, 22 bp, Artificial Sequence
  chemically synthesized
attcattctatgaagccagcat

SEQ ID NO: 23543 - DNA, 22 bp, Artificial Sequence
  chemically synthesized
attctatgaagccagcatcaca

SEQ ID NO: 23544 - DNA, 22 bp, Artificial Sequence
  chemically synthesized
tatgaagccagcatcacaccaa

SEQ ID NO: 23545 - DNA, 22 bp, Artificial Sequence
  chemically synthesized
tgaagccagcatcacaccaaaa

SEQ ID NO: 23546 - DNA, 22 bp, Artificial Sequence
  chemically synthesized
cagactgatagccttgatgaac

SEQ ID NO: 23547 - DNA, 22 bp, Artificial Sequence
  chemically synthesized
atagccttgatgaacatagatg

SEQ ID NO: 23548 - DNA, 22 bp, Artificial Sequence
  chemically synthesized
gatgaacatagatgctaaaatc

SEQ ID NO: 23549 - DNA, 22 bp, Artificial Sequence
  chemically synthesized
atgaacatagatgctaaaatcc

SEQ ID NO: 23550 - DNA, 22 bp, Artificial Sequence
  chemically synthesized
aaatccttaacaaaatactaga

SEQ ID NO: 23551 - DNA, 22 bp, Artificial Sequence
  chemically synthesized
aacaaaatactagataaccaaa

SEQ ID NO: 23552 - DNA, 22 bp, Artificial Sequence
  chemically synthesized
acaaaatactagataaccaaat

SEQ ID NO: 23553 - DNA, 22 bp, Artificial Sequence
  chemically synthesized
gataaccaaattcaacaacata

SEQ ID NO: 23554 - DNA, 22 bp, Artificial Sequence
  chemically synthesized
aacaacataacaaaaagataat

SEQ ID NO: 23555 - DNA, 22 bp, Artificial Sequence
  chemically synthesized
catgccagggatgcagggttgg

SEQ ID NO: 23556 - DNA, 22 bp, Artificial Sequence
  chemically synthesized
gtttgacatctgcaagtcaata

SEQ ID NO: 23557 - DNA, 22 bp, Artificial Sequence
  chemically synthesized
gacatctgcaagtcaataagtg

SEQ ID NO: 23558 - DNA, 22 bp, Artificial Sequence
  chemically synthesized
acatctgcaagtcaataagtgt

SEQ ID NO: 23559 - DNA, 22 bp, Artificial Sequence
  chemically synthesized
caagtcaataagtgtgatacac

SEQ ID NO: 23560 - DNA, 22 bp, Artificial Sequence
  chemically synthesized
aaaaacaaaaattacatgatca

SEQ ID NO: 23561 - DNA, 22 bp, Artificial Sequence
  chemically synthesized
aaaacaaaaattacatgatcat

SEQ ID NO: 23562 - DNA, 22 bp, Artificial Sequence
  chemically synthesized
catgatcatctcaatagatgca

SEQ ID NO: 23563 - DNA, 22 bp, Artificial Sequence
  chemically synthesized
aatagatgcagaaaaagcattc

SEQ ID NO: 23564 - DNA, 22 bp, Artificial Sequence
  chemically synthesized
aacaaaatccagcatacattta

SEQ ID NO: 23565 - DNA, 22 bp, Artificial Sequence
  chemically synthesized
atgattaaaatgctcagcaaaa

SEQ ID NO: 23566 - DNA, 22 bp, Artificial Sequence
  chemically synthesized
tgattaaaatgctcagcaaaat

SEQ ID NO: 23567 - DNA, 22 bp, Artificial Sequence
  chemically synthesized
aaatgctcagcaaaatcagcat

SEQ ID NO: 23568 - DNA, 22 bp, Artificial Sequence
  chemically synthesized
agcaaaatcagcatacaagaga

SEQ ID NO: 23569 - DNA, 22 bp, Artificial Sequence
  chemically synthesized
agtgtaataaaagccatctgtg

SEQ ID NO: 23570 - DNA, 22 bp, Artificial Sequence
  chemically synthesized
tgacaaacccacagccaacata

SEQ ID NO: 23571 - DNA, 22 bp, Artificial Sequence
  chemically synthesized
aatggggaaaagttgaaagcat

SEQ ID NO: 23572 - DNA, 22 bp, Artificial Sequence
  chemically synthesized
aaagcattccctctgagaactg

SEQ ID NO: 23573 - DNA, 22 bp, Artificial Sequence
  chemically synthesized
cctctgagaactggaacaagac

SEQ ID NO: 23574 - DNA, 22 bp, Artificial Sequence
  chemically synthesized
tgagaactggaacaagacaagg

SEQ ID NO: 23575 - DNA, 22 bp, Artificial Sequence
  chemically synthesized
agaactggaacaagacaaggat

SEQ ID NO: 23576 - DNA, 22 bp, Artificial Sequence
  chemically synthesized
gaacaagacaaggatgcccact

SEQ ID NO: 23577 - DNA, 22 bp, Artificial Sequence
  chemically synthesized
tcaccactcctcttcaacatag

SEQ ID NO: 23578 - DNA, 22 bp, Artificial Sequence
  chemically synthesized
accactcctcttcaacatagta

SEQ ID NO: 23579 - DNA, 22 bp, Artificial Sequence
  chemically synthesized
ctcttcaacatagtactggaag

SEQ ID NO: 23580 - DNA, 22 bp, Artificial Sequence
  chemically synthesized
ttcaacatagtactggaagtcc

SEQ ID NO: 23581 - DNA, 22 bp, Artificial Sequence
  chemically synthesized
caacatagtactggaagtccta

SEQ ID NO: 23582 - DNA, 22 bp, Artificial Sequence
  chemically synthesized
aacatagtactggaagtcctag

SEQ ID NO: 23583 - DNA, 22 bp, Artificial Sequence
  chemically synthesized
gaagtcctagccagggcaatca

SEQ ID NO: 23584 - DNA, 22 bp, Artificial Sequence
  chemically synthesized
gccagggcaatcagacaaaaca

SEQ ID NO: 23585 - DNA, 22 bp, Artificial Sequence
  chemically synthesized
aaatcagtaaagaggaagtcaa

SEQ ID NO: 23586 - DNA, 22 bp, Artificial Sequence
  chemically synthesized
tcactgtttgctgatgatatga

SEQ ID NO: 23587 - DNA, 22 bp, Artificial Sequence
  chemically synthesized
tttgctgatgatatgatcattt

SEQ ID NO: 23588 - DNA, 22 bp, Artificial Sequence
  chemically synthesized
gctgatgatatgatcatttacc

SEQ ID NO: 23589 - DNA, 22 bp, Artificial Sequence
  chemically synthesized
ctgatgatatgatcatttacct

SEQ ID NO: 23590 - DNA, 22 bp, Artificial Sequence
  chemically synthesized
atgatatgatcatttaccttta

SEQ ID NO: 23591 - DNA, 22 bp, Artificial Sequence
  chemically synthesized
acctttaaaaccctaaagactc

SEQ ID NO: 23592 - DNA, 22 bp, Artificial Sequence
  chemically synthesized
cctttaaaaccctaaagactcc

SEQ ID NO: 23593 - DNA, 22 bp, Artificial Sequence
  chemically synthesized
taaaaccctaaagactcctcca

SEQ ID NO: 23594 - DNA, 22 bp, Artificial Sequence
  chemically synthesized
aaaaccctaaagactcctccag

SEQ ID NO: 23595 - DNA, 22 bp, Artificial Sequence
  chemically synthesized
aaaccctaaagactcctccaga

SEQ ID NO: 23596 - DNA, 22 bp, Artificial Sequence
  chemically synthesized
aagactcctccagaaagctcct

SEQ ID NO: 23597 - DNA, 22 bp, Artificial Sequence
  chemically synthesized
ctccagaaagctcctagaactg

SEQ ID NO: 23598 - DNA, 22 bp, Artificial Sequence
  chemically synthesized
cagaaagctcctagaactgata

SEQ ID NO: 23599 - DNA, 22 bp, Artificial Sequence
  chemically synthesized
ctagaactgataaaataattca

SEQ ID NO: 23600 - DNA, 22 bp, Artificial Sequence
  chemically synthesized
gaactgataaaataattcagca

SEQ ID NO: 23601 - DNA, 22 bp, Artificial Sequence
  chemically synthesized
ataaaataattcagcaaagttt

SEQ ID NO: 23602 - DNA, 22 bp, Artificial Sequence
  chemically synthesized
agcaaagtttccagatacaaga

SEQ ID NO: 23603 - DNA, 22 bp, Artificial Sequence
  chemically synthesized
ccagatacaagatgaatgcaca

SEQ ID NO: 23604 - DNA, 22 bp, Artificial Sequence
  chemically synthesized
cagatacaagatgaatgcacac

SEQ ID NO: 23605 - DNA, 22 bp, Artificial Sequence
  chemically synthesized
ttctatacaccaacagcaacca

SEQ ID NO: 23606 - DNA, 22 bp, Artificial Sequence
  chemically synthesized
ctatacaccaacagcaaccaaa

SEQ ID NO: 23607 - DNA, 22 bp, Artificial Sequence
  chemically synthesized
tatacaccaacagcaaccaaat

SEQ ID NO: 23608 - DNA, 22 bp, Artificial Sequence
  chemically synthesized
tacaccaacagcaaccaaatgg

SEQ ID NO: 23609 - DNA, 22 bp, Artificial Sequence
  chemically synthesized
aaccccttgtacaatagatgca

SEQ ID NO: 23610 - DNA, 22 bp, Artificial Sequence
  chemically synthesized
gtacaatagatgcaaaaatggc

SEQ ID NO: 23611 - DNA, 22 bp, Artificial Sequence
  chemically synthesized
tacaatagatgcaaaaatggcc

SEQ ID NO: 23612 - DNA, 22 bp, Artificial Sequence
  chemically synthesized
atacaacccctatttattgcca

SEQ ID NO: 23613 - DNA, 22 bp, Artificial Sequence
  chemically synthesized
tttattgccatataaaacgtac

SEQ ID NO: 23614 - DNA, 22 bp, Artificial Sequence
  chemically synthesized
attgccatataaaacgtactct

SEQ ID NO: 23615 - DNA, 22 bp, Artificial Sequence
  chemically synthesized
ttgccatataaaacgtactctc

SEQ ID NO: 23616 - DNA, 22 bp, Artificial Sequence
  chemically synthesized
ccatataaaacgtactctcaag

SEQ ID NO: 23617 - DNA, 22 bp, Artificial Sequence
  chemically synthesized
tcaagatggattaaagacttaa

SEQ ID NO: 23618 - DNA, 22 bp, Artificial Sequence
  chemically synthesized
aagatggattaaagacttaaat

SEQ ID NO: 23619 - DNA, 22 bp, Artificial Sequence
  chemically synthesized
aagacttaaatataaaacttaa

SEQ ID NO: 23620 - DNA, 22 bp, Artificial Sequence
  chemically synthesized
aaatataaaacttaaaactata

SEQ ID NO: 23621 - DNA, 22 bp, Artificial Sequence
  chemically synthesized
aatataaaacttaaaactataa

SEQ ID NO: 23622 - DNA, 22 bp, Artificial Sequence
  chemically synthesized
aaaactataaaactactaaaag

SEQ ID NO: 23623 - DNA, 22 bp, Artificial Sequence
  chemically synthesized
aaactataaaactactaaaaga

SEQ ID NO: 23624 - DNA, 22 bp, Artificial Sequence
  chemically synthesized
taaaactactaaaagaaaacat

SEQ ID NO: 23625 - DNA, 22 bp, Artificial Sequence
  chemically synthesized
ctaaaagaaaacataagggaga

SEQ ID NO: 23626 - DNA, 22 bp, Artificial Sequence
  chemically synthesized
aaagaaaacataagggagacac

SEQ ID NO: 23627 - DNA, 22 bp, Artificial Sequence
  chemically synthesized
caagacatggctttgggcaaag

SEQ ID NO: 23628 - DNA, 22 bp, Artificial Sequence
  chemically synthesized
aagacatggctttgggcaaaga

SEQ ID NO: 23629 - DNA, 22 bp, Artificial Sequence
  chemically synthesized
tgggcaaagattttatggccaa

SEQ ID NO: 23630 - DNA, 22 bp, Artificial Sequence
  chemically synthesized
gggcaaagattttatggccaag

SEQ ID NO: 23631 - DNA, 22 bp, Artificial Sequence
  chemically synthesized
ggcaaagattttatggccaaga

SEQ ID NO: 23632 - DNA, 22 bp, Artificial Sequence
  chemically synthesized
tatggccaagacctcaaaagca

SEQ ID NO: 23633 - DNA, 22 bp, Artificial Sequence
  chemically synthesized
atggccaagacctcaaaagcac

SEQ ID NO: 23634 - DNA, 22 bp, Artificial Sequence
  chemically synthesized
tggccaagacctcaaaagcaca

SEQ ID NO: 23635 - DNA, 22 bp, Artificial Sequence
  chemically synthesized
aaaagcacaggcaacaaaagca

SEQ ID NO: 23636 - DNA, 22 bp, Artificial Sequence
  chemically synthesized
tattaagctaaaatacatctgc

SEQ ID NO: 23637 - DNA, 22 bp, Artificial Sequence
  chemically synthesized
agctaaaatacatctgcacagt

SEQ ID NO: 23638 - DNA, 22 bp, Artificial Sequence
  chemically synthesized
aaatacatctgcacagtaaagg

SEQ ID NO: 23639 - DNA, 22 bp, Artificial Sequence
  chemically synthesized
cacagtaaaggaaacaatcaac

SEQ ID NO: 23640 - DNA, 22 bp, Artificial Sequence
  chemically synthesized
ttgaatgcgagaaaatatttgc

SEQ ID NO: 23641 - DNA, 22 bp, Artificial Sequence
  chemically synthesized
aatgcgagaaaatatttgcata

SEQ ID NO: 23642 - DNA, 22 bp, Artificial Sequence
  chemically synthesized
gcatacatttgacaaggaatta

SEQ ID NO: 23643 - DNA, 22 bp, Artificial Sequence
  chemically synthesized
catacatttgacaaggaattaa

SEQ ID NO: 23644 - DNA, 22 bp, Artificial Sequence
  chemically synthesized
gacaaggaattaatctccagaa

SEQ ID NO: 23645 - DNA, 22 bp, Artificial Sequence
  chemically synthesized
acaaggaattaatctccagaat

SEQ ID NO: 23646 - DNA, 22 bp, Artificial Sequence
  chemically synthesized
atctccagaatatataagaaac

SEQ ID NO: 23647 - DNA, 22 bp, Artificial Sequence
  chemically synthesized
cagaatatataagaaactcaaa

SEQ ID NO: 23648 - DNA, 22 bp, Artificial Sequence
  chemically synthesized
aaacaactcaacagtggaaaaa

SEQ ID NO: 23649 - DNA, 22 bp, Artificial Sequence
  chemically synthesized
aacagtggaaaaacaaataatc

SEQ ID NO: 23650 - DNA, 22 bp, Artificial Sequence
  chemically synthesized
attaaaaaattggcaaaggata

SEQ ID NO: 23651 - DNA, 22 bp, Artificial Sequence
  chemically synthesized
aaaaattggcaaaggatatttt

SEQ ID NO: 23652 - DNA, 22 bp, Artificial Sequence
  chemically synthesized
gcaaaggatatttttcaaaaga

SEQ ID NO: 23653 - DNA, 22 bp, Artificial Sequence
  chemically synthesized
ttcaaaagaagacatacaaatg

SEQ ID NO: 23654 - DNA, 22 bp, Artificial Sequence
  chemically synthesized
tcaaaagaagacatacaaatgc

SEQ ID NO: 23655 - DNA, 22 bp, Artificial Sequence
  chemically synthesized
caaaagaagacatacaaatgca

SEQ ID NO: 23656 - DNA, 22 bp, Artificial Sequence
  chemically synthesized
aaaagaagacatacaaatgcac

SEQ ID NO: 23657 - DNA, 22 bp, Artificial Sequence
  chemically synthesized
ctcaacattactaatcatcaga

SEQ ID NO: 23658 - DNA, 22 bp, Artificial Sequence
  chemically synthesized
aacattactaatcatcagagaa

SEQ ID NO: 23659 - DNA, 22 bp, Artificial Sequence
  chemically synthesized
ctaatcatcagagaaatgcaaa

SEQ ID NO: 23660 - DNA, 22 bp, Artificial Sequence
  chemically synthesized
atcatcagagaaatgcaaatca

SEQ ID NO: 23661 - DNA, 22 bp, Artificial Sequence
  chemically synthesized
atgccagttagaatcatcatga

SEQ ID NO: 23662 - DNA, 22 bp, Artificial Sequence
  chemically synthesized
tgccagttagaatcatcatgat

SEQ ID NO: 23663 - DNA, 22 bp, Artificial Sequence
  chemically synthesized
gaatcatcatgatttaaataaa

SEQ ID NO: 23664 - DNA, 22 bp, Artificial Sequence
  chemically synthesized
aaataaattaataaataaataa

SEQ ID NO: 23665 - DNA, 22 bp, Artificial Sequence
  chemically synthesized
aataaattaataaataaataac

SEQ ID NO: 23666 - DNA, 22 bp, Artificial Sequence
  chemically synthesized
ataaataaataacacatgctgg

SEQ ID NO: 23667 - DNA, 22 bp, Artificial Sequence
  chemically synthesized
gcaaggatgtgaaggaaaaggc

SEQ ID NO: 23668 - DNA, 22 bp, Artificial Sequence
  chemically synthesized
gtaggcactattggtaagcatg

SEQ ID NO: 23669 - DNA, 22 bp, Artificial Sequence
  chemically synthesized
ttggtaagcatgcaaattagta

SEQ ID NO: 23670 - DNA, 22 bp, Artificial Sequence
  chemically synthesized
gtaagcatgcaaattagtatag

SEQ ID NO: 23671 - DNA, 22 bp, Artificial Sequence
  chemically synthesized
gtatagccactatggaaaacaa

SEQ ID NO: 23672 - DNA, 22 bp, Artificial Sequence
  chemically synthesized
tggaaaacaatatgtagattta

SEQ ID NO: 23673 - DNA, 22 bp, Artificial Sequence
  chemically synthesized
accaaaaagctaaaaattgaac

SEQ ID NO: 23674 - DNA, 22 bp, Artificial Sequence
  chemically synthesized
ccaaaaagctaaaaattgaact

SEQ ID NO: 23675 - DNA, 22 bp, Artificial Sequence
  chemically synthesized
aaaattgaactatcataagatc

SEQ ID NO: 23676 - DNA, 22 bp, Artificial Sequence
  chemically synthesized
aactatcataagatccagcaat

SEQ ID NO: 23677 - DNA, 22 bp, Artificial Sequence
  chemically synthesized
tcataagatccagcaatcttat

SEQ ID NO: 23678 - DNA, 22 bp, Artificial Sequence
  chemically synthesized
attactgggtatttatccaaag

SEQ ID NO: 23679 - DNA, 22 bp, Artificial Sequence
  chemically synthesized
ttactgggtatttatccaaagg

SEQ ID NO: 23680 - DNA, 22 bp, Artificial Sequence
  chemically synthesized
ctgggtatttatccaaaggaaa

SEQ ID NO: 23681 - DNA, 22 bp, Artificial Sequence
  chemically synthesized
ggtatttatccaaaggaaaaga

SEQ ID NO: 23682 - DNA, 22 bp, Artificial Sequence
  chemically synthesized
atccaaaggaaaagaattcaga

SEQ ID NO: 23683 - DNA, 22 bp, Artificial Sequence
  chemically synthesized
tccaaaggaaaagaattcagaa

SEQ ID NO: 23684 - DNA, 22 bp, Artificial Sequence
  chemically synthesized
agaataataaacagatactggt

SEQ ID NO: 23685 - DNA, 22 bp, Artificial Sequence
  chemically synthesized
gtaccacactgtttattgcagc

SEQ ID NO: 23686 - DNA, 22 bp, Artificial Sequence
  chemically synthesized
tttattgcagcacgattcacat

SEQ ID NO: 23687 - DNA, 22 bp, Artificial Sequence
  chemically synthesized
attgcagcacgattcacattag

SEQ ID NO: 23688 - DNA, 22 bp, Artificial Sequence
  chemically synthesized
ttgcagcacgattcacattagc

SEQ ID NO: 23689 - DNA, 22 bp, Artificial Sequence
  chemically synthesized
cagcacgattcacattagcaaa

SEQ ID NO: 23690 - DNA, 22 bp, Artificial Sequence
  chemically synthesized
acattagcaaagatatggaatc

SEQ ID NO: 23691 - DNA, 22 bp, Artificial Sequence
  chemically synthesized
gcaaagatatggaatcaaccta

SEQ ID NO: 23692 - DNA, 22 bp, Artificial Sequence
  chemically synthesized
agtgtccatcaatggatgaatg

SEQ ID NO: 23693 - DNA, 22 bp, Artificial Sequence
  chemically synthesized
aatattattcaaccatacaaat

SEQ ID NO: 23694 - DNA, 22 bp, Artificial Sequence
  chemically synthesized
ttcaaccatacaaatataaaat

SEQ ID NO: 23695 - DNA, 22 bp, Artificial Sequence
  chemically synthesized
aaccatacaaatataaaatcat

SEQ ID NO: 23696 - DNA, 22 bp, Artificial Sequence
  chemically synthesized
catttgcagcaacatggatgaa

SEQ ID NO: 23697 - DNA, 22 bp, Artificial Sequence
  chemically synthesized
atttgcagcaacatggatgaaa

SEQ ID NO: 23698 - DNA, 22 bp, Artificial Sequence
  chemically synthesized
gcagcaacatggatgaaactgg

SEQ ID NO: 23699 - DNA, 22 bp, Artificial Sequence
  chemically synthesized
cagcaacatggatgaaactgga

SEQ ID NO: 23700 - DNA, 22 bp, Artificial Sequence
  chemically synthesized
gaagtcattatgttaaacgaaa

SEQ ID NO: 23701 - DNA, 22 bp, Artificial Sequence
  chemically synthesized
tgttaaacgaaataagccaggc

SEQ ID NO: 23702 - DNA, 22 bp, Artificial Sequence
  chemically synthesized
aacgaaataagccaggcataga

SEQ ID NO: 23703 - DNA, 22 bp, Artificial Sequence
  chemically synthesized
tgcatgttctcactgatatgtg

SEQ ID NO: 23704 - DNA, 22 bp, Artificial Sequence
  chemically synthesized
gcatgttctcactgatatgtgg

SEQ ID NO: 23705 - DNA, 22 bp, Artificial Sequence
  chemically synthesized
catgttctcactgatatgtggg

SEQ ID NO: 23706 - DNA, 22 bp, Artificial Sequence
  chemically synthesized
tcactgatatgtgggagctaaa

SEQ ID NO: 23707 - DNA, 22 bp, Artificial Sequence
  chemically synthesized
actgatatgtgggagctaaaaa

SEQ ID NO: 23708 - DNA, 22 bp, Artificial Sequence
  chemically synthesized
atatgtgggagctaaaaaagtt

SEQ ID NO: 23709 - DNA, 22 bp, Artificial Sequence
  chemically synthesized
aaaaagttaatatcatgtaggt

SEQ ID NO: 23710 - DNA, 22 bp, Artificial Sequence
  chemically synthesized
atatcatgtaggtagagagtag

SEQ ID NO: 23711 - DNA, 22 bp, Artificial Sequence
  chemically synthesized
tgggaggaagggagacgaagag

SEQ ID NO: 23712 - DNA, 22 bp, Artificial Sequence
  chemically synthesized
gttaatggaaacaggcagttag

SEQ ID NO: 23713 - DNA, 22 bp, Artificial Sequence
  chemically synthesized
atggaaacaggcagttagatag

SEQ ID NO: 23714 - DNA, 22 bp, Artificial Sequence
  chemically synthesized
gatagaaggaatatgttctgat

SEQ ID NO: 23715 - DNA, 22 bp, Artificial Sequence
  chemically synthesized
tgatgttcaatagcaaagtagg

SEQ ID NO: 23716 - DNA, 22 bp, Artificial Sequence
  chemically synthesized
atgttcaatagcaaagtagggt

SEQ ID NO: 23717 - DNA, 22 bp, Artificial Sequence
  chemically synthesized
aatagcaaagtagggtgattat

SEQ ID NO: 23718 - DNA, 22 bp, Artificial Sequence
  chemically synthesized
tagttaaaaacaatatattgta

SEQ ID NO: 23719 - DNA, 22 bp, Artificial Sequence
  chemically synthesized
aaaacaatatattgtatatttc

SEQ ID NO: 23720 - DNA, 22 bp, Artificial Sequence
  chemically synthesized
tatatttcaaaatagtagaaga

SEQ ID NO: 23721 - DNA, 22 bp, Artificial Sequence
  chemically synthesized
caaaatagtagaagaaaggtct

SEQ ID NO: 23722 - DNA, 22 bp, Artificial Sequence
  chemically synthesized
aaaatagtagaagaaaggtctt

SEQ ID NO: 23723 - DNA, 22 bp, Artificial Sequence
  chemically synthesized
gaaatgttcctaacacatagaa

SEQ ID NO: 23724 - DNA, 22 bp, Artificial Sequence
  chemically synthesized
aaatgttcctaacacatagaaa

SEQ ID NO: 23725 - DNA, 22 bp, Artificial Sequence
  chemically synthesized
ctaacacatagaaacgataaat

SEQ ID NO: 23726 - DNA, 22 bp, Artificial Sequence
  chemically synthesized
acacatagaaacgataaatact

SEQ ID NO: 23727 - DNA, 22 bp, Artificial Sequence
  chemically synthesized
gaggtgatgaataccccaaata

SEQ ID NO: 23728 - DNA, 22 bp, Artificial Sequence
  chemically synthesized
aggtgatgaataccccaaatac

SEQ ID NO: 23729 - DNA, 22 bp, Artificial Sequence
  chemically synthesized
acttgatcattatacattatat

SEQ ID NO: 23730 - DNA, 22 bp, Artificial Sequence
  chemically synthesized
gatcattatacattatatgcat

SEQ ID NO: 23731 - DNA, 22 bp, Artificial Sequence
  chemically synthesized
atcattatacattatatgcatg

SEQ ID NO: 23732 - DNA, 22 bp, Artificial Sequence
  chemically synthesized
tacattatatgcatgtaacaaa

SEQ ID NO: 23733 - DNA, 22 bp, Artificial Sequence
  chemically synthesized
tatgcatgtaacaaaatgtcac

SEQ ID NO: 23734 - DNA, 22 bp, Artificial Sequence
  chemically synthesized
atacatataaacacgtcatata

SEQ ID NO: 23735 - DNA, 22 bp, Artificial Sequence
  chemically synthesized
atattggttgaggcctgattgt

SEQ ID NO: 23736 - DNA, 22 bp, Artificial Sequence
  chemically synthesized
gttgaggcctgattgtaagtaa

SEQ ID NO: 23737 - DNA, 22 bp, Artificial Sequence
  chemically synthesized
aggcctgattgtaagtaaatct

SEQ ID NO: 23738 - DNA, 22 bp, Artificial Sequence
  chemically synthesized
attgtaagtaaatctttgtccc

SEQ ID NO: 23739 - DNA, 22 bp, Artificial Sequence
  chemically synthesized
taagtaaatctttgtccctcca

SEQ ID NO: 23740 - DNA, 22 bp, Artificial Sequence
  chemically synthesized
tgtccctccagacatttccctg

SEQ ID NO: 23741 - DNA, 22 bp, Artificial Sequence
  chemically synthesized
gtccctccagacatttccctgt

SEQ ID NO: 23742 - DNA, 22 bp, Artificial Sequence
  chemically synthesized
tccctccagacatttccctgta

SEQ ID NO: 23743 - DNA, 22 bp, Artificial Sequence
  chemically synthesized
cagacatttccctgtactgtct

SEQ ID NO: 23744 - DNA, 22 bp, Artificial Sequence
  chemically synthesized
ccctgtactgtcttgctgtgag

SEQ ID NO: 23745 - DNA, 22 bp, Artificial Sequence
  chemically synthesized
cctgtactgtcttgctgtgagg

SEQ ID NO: 23746 - DNA, 22 bp, Artificial Sequence
  chemically synthesized
tactgtcttgctgtgaggagct

SEQ ID NO: 23747 - DNA, 22 bp, Artificial Sequence
  chemically synthesized
tcttgctgtgaggagcttcttt

SEQ ID NO: 23748 - DNA, 22 bp, Artificial Sequence
  chemically synthesized
gctgtgaggagcttcttttact

SEQ ID NO: 23749 - DNA, 22 bp, Artificial Sequence
  chemically synthesized
ctgtgaggagcttcttttactg

SEQ ID NO: 23750 - DNA, 22 bp, Artificial Sequence
  chemically synthesized
tgaggagcttcttttactgcta

SEQ ID NO: 23751 - DNA, 22 bp, Artificial Sequence
  chemically synthesized
cttttactgctatttcttatat

SEQ ID NO: 23752 - DNA, 22 bp, Artificial Sequence
  chemically synthesized
ttttactgctatttcttatatt

SEQ ID NO: 23753 - DNA, 22 bp, Artificial Sequence
  chemically synthesized
ttactgctatttcttatattcc

SEQ ID NO: 23754 - DNA, 22 bp, Artificial Sequence
  chemically synthesized
tactgctatttcttatattcca

SEQ ID NO: 23755 - DNA, 22 bp, Artificial Sequence
  chemically synthesized
actgctatttcttatattccaa

SEQ ID NO: 23756 - DNA, 22 bp, Artificial Sequence
  chemically synthesized
ctgctatttcttatattccaac

SEQ ID NO: 23757 - DNA, 22 bp, Artificial Sequence
  chemically synthesized
ctatttcttatattccaacacc

SEQ ID NO: 23758 - DNA, 22 bp, Artificial Sequence
  chemically synthesized
tttcttatattccaacaccatt

SEQ ID NO: 23759 - DNA, 22 bp, Artificial Sequence
  chemically synthesized
cttatattccaacaccatttta

SEQ ID NO: 23760 - DNA, 22 bp, Artificial Sequence
  chemically synthesized
ttatattccaacaccattttag

SEQ ID NO: 23761 - DNA, 22 bp, Artificial Sequence
  chemically synthesized
atattccaacaccattttagcc

SEQ ID NO: 23762 - DNA, 22 bp, Artificial Sequence
  chemically synthesized
tattccaacaccattttagccc

SEQ ID NO: 23763 - DNA, 22 bp, Artificial Sequence
  chemically synthesized
caacaccattttagcccttttt

SEQ ID NO: 23764 - DNA, 22 bp, Artificial Sequence
  chemically synthesized
tagcccttttttgtcctcccca

SEQ ID NO: 23765 - DNA, 22 bp, Artificial Sequence
  chemically synthesized
agcccttttttgtcctccccat

SEQ ID NO: 23766 - DNA, 22 bp, Artificial Sequence
  chemically synthesized
gcccttttttgtcctccccata

SEQ ID NO: 23767 - DNA, 22 bp, Artificial Sequence
  chemically synthesized
ttttgtcctccccatattttta

SEQ ID NO: 23768 - DNA, 22 bp, Artificial Sequence
  chemically synthesized
tttgtcctccccatatttttac

SEQ ID NO: 23769 - DNA, 22 bp, Artificial Sequence
  chemically synthesized
ttgtcctccccatatttttacc

SEQ ID NO: 23770 - DNA, 22 bp, Artificial Sequence
  chemically synthesized
tgtcctccccatatttttacct

SEQ ID NO: 23771 - DNA, 22 bp, Artificial Sequence
  chemically synthesized
gtcctccccatatttttacctc

SEQ ID NO: 23772 - DNA, 22 bp, Artificial Sequence
  chemically synthesized
tcctccccatatttttacctcg

SEQ ID NO: 23773 - DNA, 22 bp, Artificial Sequence
  chemically synthesized
cccatatttttacctcggtttt

SEQ ID NO: 23774 - DNA, 22 bp, Artificial Sequence
  chemically synthesized
ttacctcggtttttactgttta

SEQ ID NO: 23775 - DNA, 22 bp, Artificial Sequence
  chemically synthesized
tacctcggtttttactgtttat

SEQ ID NO: 23776 - DNA, 22 bp, Artificial Sequence
  chemically synthesized
acctcggtttttactgtttata

SEQ ID NO: 23777 - DNA, 22 bp, Artificial Sequence
  chemically synthesized
cctcggtttttactgtttatat

SEQ ID NO: 23778 - DNA, 22 bp, Artificial Sequence
  chemically synthesized
ggtttttactgtttatatagca

SEQ ID NO: 23779 - DNA, 22 bp, Artificial Sequence
  chemically synthesized
ttactgtttatatagcacactt

SEQ ID NO: 23780 - DNA, 22 bp, Artificial Sequence
  chemically synthesized
tactgtttatatagcacacttt

SEQ ID NO: 23781 - DNA, 22 bp, Artificial Sequence
  chemically synthesized
actgtttatatagcacactttg

SEQ ID NO: 23782 - DNA, 22 bp, Artificial Sequence
  chemically synthesized
ctgtttatatagcacactttgt

SEQ ID NO: 23783 - DNA, 22 bp, Artificial Sequence
  chemically synthesized
tttatatagcacactttgtgct

SEQ ID NO: 23784 - DNA, 22 bp, Artificial Sequence
  chemically synthesized
atatagcacactttgtgctata

SEQ ID NO: 23785 - DNA, 22 bp, Artificial Sequence
  chemically synthesized
tatagcacactttgtgctatag

SEQ ID NO: 23786 - DNA, 22 bp, Artificial Sequence
  chemically synthesized
tgtgctatagtttacctcagtt

SEQ ID NO: 23787 - DNA, 22 bp, Artificial Sequence
  chemically synthesized
gtgctatagtttacctcagttt

SEQ ID NO: 23788 - DNA, 22 bp, Artificial Sequence
  chemically synthesized
tgctatagtttacctcagtttt

SEQ ID NO: 23789 - DNA, 22 bp, Artificial Sequence
  chemically synthesized
tagtttacctcagtttttacta

SEQ ID NO: 23790 - DNA, 22 bp, Artificial Sequence
  chemically synthesized
acctcagtttttactatttata

SEQ ID NO: 23791 - DNA, 22 bp, Artificial Sequence
  chemically synthesized
cctcagtttttactatttataa

SEQ ID NO: 23792 - DNA, 22 bp, Artificial Sequence
  chemically synthesized
agtttttactatttataaagca

SEQ ID NO: 23793 - DNA, 22 bp, Artificial Sequence
  chemically synthesized
ttactatttataaagcacattt

SEQ ID NO: 23794 - DNA, 22 bp, Artificial Sequence
  chemically synthesized
tactatttataaagcacatttt

SEQ ID NO: 23795 - DNA, 22 bp, Artificial Sequence
  chemically synthesized
actatttataaagcacattttg

SEQ ID NO: 23796 - DNA, 22 bp, Artificial Sequence
  chemically synthesized
ctatttataaagcacattttgc

SEQ ID NO: 23797 - DNA, 22 bp, Artificial Sequence
  chemically synthesized
tttataaagcacattttgcccc

SEQ ID NO: 23798 - DNA, 22 bp, Artificial Sequence
  chemically synthesized
ataaagcacattttgccccaaa

SEQ ID NO: 23799 - DNA, 22 bp, Artificial Sequence
  chemically synthesized
taaagcacattttgccccaaac

SEQ ID NO: 23800 - DNA, 22 bp, Artificial Sequence
  chemically synthesized
tgccccaaacttctctcttaac

SEQ ID NO: 23801 - DNA, 22 bp, Artificial Sequence
  chemically synthesized
gccccaaacttctctcttaaca

SEQ ID NO: 23802 - DNA, 22 bp, Artificial Sequence
  chemically synthesized
ccccaaacttctctcttaacaa

SEQ ID NO: 23803 - DNA, 22 bp, Artificial Sequence
  chemically synthesized
ctctcttaacaagctagaatat

SEQ ID NO: 23804 - DNA, 22 bp, Artificial Sequence
  chemically synthesized
tctcttaacaagctagaatata

SEQ ID NO: 23805 - DNA, 22 bp, Artificial Sequence
  chemically synthesized
tcttaacaagctagaatataag

SEQ ID NO: 23806 - DNA, 22 bp, Artificial Sequence
  chemically synthesized
ttaacaagctagaatataagtg

SEQ ID NO: 23807 - DNA, 22 bp, Artificial Sequence
  chemically synthesized
aacaagctagaatataagtgaa

SEQ ID NO: 23808 - DNA, 22 bp, Artificial Sequence
  chemically synthesized
acaagctagaatataagtgaat

SEQ ID NO: 23809 - DNA, 22 bp, Artificial Sequence
  chemically synthesized
gaatataagtgaatgcaagagc

SEQ ID NO: 23810 - DNA, 22 bp, Artificial Sequence
  chemically synthesized
ctattttcatatttgaggtata

SEQ ID NO: 23811 - DNA, 22 bp, Artificial Sequence
  chemically synthesized
ttttcatatttgaggtataaac

SEQ ID NO: 23812 - DNA, 22 bp, Artificial Sequence
  chemically synthesized
tcatatttgaggtataaaccaa

SEQ ID NO: 23813 - DNA, 22 bp, Artificial Sequence
  chemically synthesized
catatttgaggtataaaccaag

SEQ ID NO: 23814 - DNA, 22 bp, Artificial Sequence
  chemically synthesized
atatttgaggtataaaccaagg

SEQ ID NO: 23815 - DNA, 22 bp, Artificial Sequence
  chemically synthesized
gaggtataaaccaaggagattt

SEQ ID NO: 23816 - DNA, 22 bp, Artificial Sequence
  chemically synthesized
aggtataaaccaaggagattta

SEQ ID NO: 23817 - DNA, 22 bp, Artificial Sequence
  chemically synthesized
acatacacatatatatttttaa

SEQ ID NO: 23818 - DNA, 22 bp, Artificial Sequence
  chemically synthesized
catacacatatatatttttaaa

SEQ ID NO: 23819 - DNA, 22 bp, Artificial Sequence
  chemically synthesized
ttaaatctgcaaataaatggtt

SEQ ID NO: 23820 - DNA, 22 bp, Artificial Sequence
  chemically synthesized
taaatctgcaaataaatggttt

SEQ ID NO: 23821 - DNA, 22 bp, Artificial Sequence
  chemically synthesized
aaatctgcaaataaatggtttt

SEQ ID NO: 23822 - DNA, 22 bp, Artificial Sequence
  chemically synthesized
aatctgcaaataaatggtttta

SEQ ID NO: 23823 - DNA, 22 bp, Artificial Sequence
  chemically synthesized
caaataaatggttttattctga

SEQ ID NO: 23824 - DNA, 22 bp, Artificial Sequence
  chemically synthesized
tattctgacattaaaaaagaaa

SEQ ID NO: 23825 - DNA, 22 bp, Artificial Sequence
  chemically synthesized
attctgacattaaaaaagaaaa

SEQ ID NO: 23826 - DNA, 22 bp, Artificial Sequence
  chemically synthesized
ttctgacattaaaaaagaaaat

SEQ ID NO: 23827 - DNA, 22 bp, Artificial Sequence
  chemically synthesized
tgacattaaaaaagaaaatact

SEQ ID NO: 23828 - DNA, 22 bp, Artificial Sequence
  chemically synthesized
acattaaaaaagaaaatactta

SEQ ID NO: 23829 - DNA, 22 bp, Artificial Sequence
  chemically synthesized
aaaaagaaaatacttaatatca

SEQ ID NO: 23830 - DNA, 22 bp, Artificial Sequence
  chemically synthesized
aatatcattaatgaatgatcgt

SEQ ID NO: 23831 - DNA, 22 bp, Artificial Sequence
  chemically synthesized
atatcattaatgaatgatcgtt

SEQ ID NO: 23832 - DNA, 22 bp, Artificial Sequence
  chemically synthesized
atgaatgatcgttttaccacag

SEQ ID NO: 23833 - DNA, 22 bp, Artificial Sequence
  chemically synthesized
taccacagcgtaggtcattgaa

SEQ ID NO: 23834 - DNA, 22 bp, Artificial Sequence
  chemically synthesized
accacagcgtaggtcattgaat

SEQ ID NO: 23835 - DNA, 22 bp, Artificial Sequence
  chemically synthesized
ccacagcgtaggtcattgaatt

SEQ ID NO: 23836 - DNA, 22 bp, Artificial Sequence
  chemically synthesized
aatttgaacttaaccttcactt

SEQ ID NO: 23837 - DNA, 22 bp, Artificial Sequence
  chemically synthesized
gaacttaaccttcactttcaaa

SEQ ID NO: 23838 - DNA, 22 bp, Artificial Sequence
  chemically synthesized
aacttaaccttcactttcaaac

SEQ ID NO: 23839 - DNA, 22 bp, Artificial Sequence
  chemically synthesized
aaccttcactttcaaacaagta

SEQ ID NO: 23840 - DNA, 22 bp, Artificial Sequence
  chemically synthesized
accttcactttcaaacaagtac

SEQ ID NO: 23841 - DNA, 22 bp, Artificial Sequence
  chemically synthesized
cactttcaaacaagtactttgt

SEQ ID NO: 23842 - DNA, 22 bp, Artificial Sequence
  chemically synthesized
actttcaaacaagtactttgta

SEQ ID NO: 23843 - DNA, 22 bp, Artificial Sequence
  chemically synthesized
tcaaacaagtactttgtatttt

SEQ ID NO: 23844 - DNA, 22 bp, Artificial Sequence
  chemically synthesized
caaacaagtactttgtatttta

SEQ ID NO: 23845 - DNA, 22 bp, Artificial Sequence
  chemically synthesized
aaacaagtactttgtattttat

SEQ ID NO: 23846 - DNA, 22 bp, Artificial Sequence
  chemically synthesized
tgtattttattgatctctattt

SEQ ID NO: 23847 - DNA, 22 bp, Artificial Sequence
  chemically synthesized
gtattttattgatctctatttt

SEQ ID NO: 23848 - DNA, 22 bp, Artificial Sequence
  chemically synthesized
tattttattgatctctattttc

SEQ ID NO: 23849 - DNA, 22 bp, Artificial Sequence
  chemically synthesized
tattgatctctattttcctgga

SEQ ID NO: 23850 - DNA, 22 bp, Artificial Sequence
  chemically synthesized
attgatctctattttcctggaa

SEQ ID NO: 23851 - DNA, 22 bp, Artificial Sequence
  chemically synthesized
ttgatctctattttcctggaac

SEQ ID NO: 23852 - DNA, 22 bp, Artificial Sequence
  chemically synthesized
atctctattttcctggaacaac

SEQ ID NO: 23853 - DNA, 22 bp, Artificial Sequence
  chemically synthesized
tattttcctggaacaacatggg

SEQ ID NO: 23854 - DNA, 22 bp, Artificial Sequence
  chemically synthesized
ttttcctggaacaacatggggg

SEQ ID NO: 23855 - DNA, 22 bp, Artificial Sequence
  chemically synthesized
tcctggaacaacatgggggcta

SEQ ID NO: 23856 - DNA, 22 bp, Artificial Sequence
  chemically synthesized
cctggaacaacatgggggctat

SEQ ID NO: 23857 - DNA, 22 bp, Artificial Sequence
  chemically synthesized
ctggaacaacatgggggctatg

SEQ ID NO: 23858 - DNA, 22 bp, Artificial Sequence
  chemically synthesized
gaacaacatgggggctatgttt

SEQ ID NO: 23859 - DNA, 22 bp, Artificial Sequence
  chemically synthesized
tgtttagcgtgaggacaaagta

SEQ ID NO: 23860 - DNA, 22 bp, Artificial Sequence
  chemically synthesized
agcgtgaggacaaagtatcaca

SEQ ID NO: 23861 - DNA, 22 bp, Artificial Sequence
  chemically synthesized
gcgtgaggacaaagtatcacaa

SEQ ID NO: 23862 - DNA, 22 bp, Artificial Sequence
  chemically synthesized
tcacctgaaagaaaagatgagc

SEQ ID NO: 23863 - DNA, 22 bp, Artificial Sequence
  chemically synthesized
cacctgaaagaaaagatgagct

SEQ ID NO: 23864 - DNA, 22 bp, Artificial Sequence
  chemically synthesized
acctgaaagaaaagatgagcta

SEQ ID NO: 23865 - DNA, 22 bp, Artificial Sequence
  chemically synthesized
aaagaaaagatgagctaccatg

SEQ ID NO: 23866 - DNA, 22 bp, Artificial Sequence
  chemically synthesized
ccatggtacatataacaatgag

SEQ ID NO: 23867 - DNA, 22 bp, Artificial Sequence
  chemically synthesized
aaactctaagtcgtcatctggc

SEQ ID NO: 23868 - DNA, 22 bp, Artificial Sequence
  chemically synthesized
taagtcgtcatctggcaacact

SEQ ID NO: 23869 - DNA, 22 bp, Artificial Sequence
  chemically synthesized
agtcgtcatctggcaacactgc

SEQ ID NO: 23870 - DNA, 22 bp, Artificial Sequence
  chemically synthesized
gcaacactgccaatttactaaa

SEQ ID NO: 23871 - DNA, 22 bp, Artificial Sequence
  chemically synthesized
ccaatttactaaaaatcactat

SEQ ID NO: 23872 - DNA, 22 bp, Artificial Sequence
  chemically synthesized
actaaaaatcactatttcaaag

SEQ ID NO: 23873 - DNA, 22 bp, Artificial Sequence
  chemically synthesized
ctaaaaatcactatttcaaaga

SEQ ID NO: 23874 - DNA, 22 bp, Artificial Sequence
  chemically synthesized
aaaatcactatttcaaagaagt

SEQ ID NO: 23875 - DNA, 22 bp, Artificial Sequence
  chemically synthesized
tttcaaagaagtatagaataga

SEQ ID NO: 23876 - DNA, 22 bp, Artificial Sequence
  chemically synthesized
caaagaagtatagaatagatat

SEQ ID NO: 23877 - DNA, 22 bp, Artificial Sequence
  chemically synthesized
aaagaagtatagaatagatatc

SEQ ID NO: 23878 - DNA, 22 bp, Artificial Sequence
  chemically synthesized
tttctctgcctctctctcgctc

SEQ ID NO: 23879 - DNA, 22 bp, Artificial Sequence
  chemically synthesized
tctctgcctctctctcgctctc

SEQ ID NO: 23880 - DNA, 22 bp, Artificial Sequence
  chemically synthesized
ctctgcctctctctcgctctct

SEQ ID NO: 23881 - DNA, 22 bp, Artificial Sequence
  chemically synthesized
tctgcctctctctcgctctctc

SEQ ID NO: 23882 - DNA, 22 bp, Artificial Sequence
  chemically synthesized
tgcctctctctcgctctctctc

SEQ ID NO: 23883 - DNA, 22 bp, Artificial Sequence
  chemically synthesized
cctctctctcgctctctctctc

SEQ ID NO: 23884 - DNA, 22 bp, Artificial Sequence
  chemically synthesized
tctctcgctctctctctctctc

SEQ ID NO: 23885 - DNA, 22 bp, Artificial Sequence
  chemically synthesized
tctcgctctctctctctctctc

SEQ ID NO: 23886 - DNA, 22 bp, Artificial Sequence
  chemically synthesized
tcgctctctctctctctctccc

SEQ ID NO: 23887 - DNA, 22 bp, Artificial Sequence
  chemically synthesized
gctctctctctctctctccccc

SEQ ID NO: 23888 - DNA, 22 bp, Artificial Sequence
  chemically synthesized
tctctctctctctcccccatct

SEQ ID NO: 23889 - DNA, 22 bp, Artificial Sequence
  chemically synthesized
tctctctctctcccccatctct

SEQ ID NO: 23890 - DNA, 22 bp, Artificial Sequence
  chemically synthesized
tctctctctcccccatctctct

SEQ ID NO: 23891 - DNA, 22 bp, Artificial Sequence
  chemically synthesized
tctctctcccccatctctctct

SEQ ID NO: 23892 - DNA, 22 bp, Artificial Sequence
  chemically synthesized
tctctcccccatctctctctgt

SEQ ID NO: 23893 - DNA, 22 bp, Artificial Sequence
  chemically synthesized
tctcccccatctctctctgtct

SEQ ID NO: 23894 - DNA, 22 bp, Artificial Sequence
  chemically synthesized
tcccccatctctctctgtctct

SEQ ID NO: 23895 - DNA, 22 bp, Artificial Sequence
  chemically synthesized
ccccatctctctctgtctctct

SEQ ID NO: 23896 - DNA, 22 bp, Artificial Sequence
  chemically synthesized
tctctgtctctctctctatata

SEQ ID NO: 23897 - DNA, 22 bp, Artificial Sequence
  chemically synthesized
tctgtctctctctctatatata

SEQ ID NO: 23898 - DNA, 22 bp, Artificial Sequence
  chemically synthesized
tgtctctctctctatatatatg

SEQ ID NO: 23899 - DNA, 22 bp, Artificial Sequence
  chemically synthesized
tctctctctctatatatatgta

SEQ ID NO: 23900 - DNA, 22 bp, Artificial Sequence
  chemically synthesized
tctctctatatatatgtataca

SEQ ID NO: 23901 - DNA, 22 bp, Artificial Sequence
  chemically synthesized
tctctatatatatgtatacaca

SEQ ID NO: 23902 - DNA, 22 bp, Artificial Sequence
  chemically synthesized
tctatatatatgtatacacaca

SEQ ID NO: 23903 - DNA, 22 bp, Artificial Sequence
  chemically synthesized
tatatatatgtatacacacata

SEQ ID NO: 23904 - DNA, 22 bp, Artificial Sequence
  chemically synthesized
tatatatgtatacacacatata

SEQ ID NO: 23905 - DNA, 22 bp, Artificial Sequence
  chemically synthesized
tacacatatggagaaatttcac

SEQ ID NO: 23906 - DNA, 22 bp, Artificial Sequence
  chemically synthesized
cactattttgtatatgcttaaa

SEQ ID NO: 23907 - DNA, 22 bp, Artificial Sequence
  chemically synthesized
actattttgtatatgcttaaaa

SEQ ID NO: 23908 - DNA, 22 bp, Artificial Sequence
  chemically synthesized
ttttgtatatgcttaaaaatta

SEQ ID NO: 23909 - DNA, 22 bp, Artificial Sequence
  chemically synthesized
tgtatatgcttaaaaattacag

SEQ ID NO: 23910 - DNA, 22 bp, Artificial Sequence
  chemically synthesized
gtatatgcttaaaaattacaga

SEQ ID NO: 23911 - DNA, 22 bp, Artificial Sequence
  chemically synthesized
tatatgcttaaaaattacagac

SEQ ID NO: 23912 - DNA, 22 bp, Artificial Sequence
  chemically synthesized
aaaaattacagactttggaagt

SEQ ID NO: 23913 - DNA, 22 bp, Artificial Sequence
  chemically synthesized
aaaattacagactttggaagtc

SEQ ID NO: 23914 - DNA, 22 bp, Artificial Sequence
  chemically synthesized
cagactttggaagtcatatgac

SEQ ID NO: 23915 - DNA, 22 bp, Artificial Sequence
  chemically synthesized
tggaagtcatatgactatttca

SEQ ID NO: 23916 - DNA, 22 bp, Artificial Sequence
  chemically synthesized
ggaagtcatatgactatttcag

SEQ ID NO: 23917 - DNA, 22 bp, Artificial Sequence
  chemically synthesized
gaagtcatatgactatttcagt

SEQ ID NO: 23918 - DNA, 22 bp, Artificial Sequence
  chemically synthesized
tttcagtgtgtgtggctactaa

SEQ ID NO: 23919 - DNA, 22 bp, Artificial Sequence
  chemically synthesized
cagtgtgtgtggctactaatct

SEQ ID NO: 23920 - DNA, 22 bp, Artificial Sequence
  chemically synthesized
agtgtgtgtggctactaatctc

SEQ ID NO: 23921 - DNA, 22 bp, Artificial Sequence
  chemically synthesized
ctaatctcaccctcctgttcca

SEQ ID NO: 23922 - DNA, 22 bp, Artificial Sequence
  chemically synthesized
atctcaccctcctgttccaaaa

SEQ ID NO: 23923 - DNA, 22 bp, Artificial Sequence
  chemically synthesized
accctcctgttccaaaacacag

SEQ ID NO: 23924 - DNA, 22 bp, Artificial Sequence
  chemically synthesized
ctgttccaaaacacagttgcag

SEQ ID NO: 23925 - DNA, 22 bp, Artificial Sequence
  chemically synthesized
ttccaaaacacagttgcagaag

SEQ ID NO: 23926 - DNA, 22 bp, Artificial Sequence
  chemically synthesized
caaaacacagttgcagaagcag

SEQ ID NO: 23927 - DNA, 22 bp, Artificial Sequence
  chemically synthesized
cagaagcagaggaagtcattat

SEQ ID NO: 23928 - DNA, 22 bp, Artificial Sequence
  chemically synthesized
tacacttagaacatcattttat

SEQ ID NO: 23929 - DNA, 22 bp, Artificial Sequence
  chemically synthesized
agaacatcattttataaggcag

SEQ ID NO: 23930 - DNA, 22 bp, Artificial Sequence
  chemically synthesized
gaacatcattttataaggcagc

SEQ ID NO: 23931 - DNA, 22 bp, Artificial Sequence
  chemically synthesized
tataaggcagcaggtctggtag

SEQ ID NO: 23932 - DNA, 22 bp, Artificial Sequence
  chemically synthesized
ataaggcagcaggtctggtagg

SEQ ID NO: 23933 - DNA, 22 bp, Artificial Sequence
  chemically synthesized
taaggcagcaggtctggtagga

SEQ ID NO: 23934 - DNA, 22 bp, Artificial Sequence
  chemically synthesized
gtaggaaggagattaggtgcta

SEQ ID NO: 23935 - DNA, 22 bp, Artificial Sequence
  chemically synthesized
ggtgctacttgtgacaaaggtc

SEQ ID NO: 23936 - DNA, 22 bp, Artificial Sequence
  chemically synthesized
cttgtgacaaaggtcagcaaat

SEQ ID NO: 23937 - DNA, 22 bp, Artificial Sequence
  chemically synthesized
gtgacaaaggtcagcaaatatt

SEQ ID NO: 23938 - DNA, 22 bp, Artificial Sequence
  chemically synthesized
tgacaaaggtcagcaaatattt

SEQ ID NO: 23939 - DNA, 22 bp, Artificial Sequence
  chemically synthesized
gtgttcccagcacttttctaga

SEQ ID NO: 23940 - DNA, 22 bp, Artificial Sequence
  chemically synthesized
tgttcccagcacttttctagat

SEQ ID NO: 23941 - DNA, 22 bp, Artificial Sequence
  chemically synthesized
ccagcacttttctagatcctca

SEQ ID NO: 23942 - DNA, 22 bp, Artificial Sequence
  chemically synthesized
ttctagatcctcagttaaaatc

SEQ ID NO: 23943 - DNA, 22 bp, Artificial Sequence
  chemically synthesized
tctagatcctcagttaaaatca

SEQ ID NO: 23944 - DNA, 22 bp, Artificial Sequence
  chemically synthesized
ctagatcctcagttaaaatcaa

SEQ ID NO: 23945 - DNA, 22 bp, Artificial Sequence
  chemically synthesized
tagatcctcagttaaaatcaaa

SEQ ID NO: 23946 - DNA, 22 bp, Artificial Sequence
  chemically synthesized
gatcctcagttaaaatcaaagc

SEQ ID NO: 23947 - DNA, 22 bp, Artificial Sequence
  chemically synthesized
agttaaaatcaaagcagctgca

SEQ ID NO: 23948 - DNA, 22 bp, Artificial Sequence
  chemically synthesized
aaatcaaagcagctgcagtctt

SEQ ID NO: 23949 - DNA, 22 bp, Artificial Sequence
  chemically synthesized
cagtcttggcagtgggaggtga

SEQ ID NO: 23950 - DNA, 22 bp, Artificial Sequence
  chemically synthesized
ggcagtgggaggtgatactcac

SEQ ID NO: 23951 - DNA, 22 bp, Artificial Sequence
  chemically synthesized
gcagtgggaggtgatactcaca

SEQ ID NO: 23952 - DNA, 22 bp, Artificial Sequence
  chemically synthesized
acactttgaacaagaccacctg

SEQ ID NO: 23953 - DNA, 22 bp, Artificial Sequence
  chemically synthesized
tgaacaagaccacctgcactac

SEQ ID NO: 23954 - DNA, 22 bp, Artificial Sequence
  chemically synthesized
gaacaagaccacctgcactacc

SEQ ID NO: 23955 - DNA, 22 bp, Artificial Sequence
  chemically synthesized
aacaagaccacctgcactacct

SEQ ID NO: 23956 - DNA, 22 bp, Artificial Sequence
  chemically synthesized
cactacctacaatggcagctcc

SEQ ID NO: 23957 - DNA, 22 bp, Artificial Sequence
  chemically synthesized
cctacaatggcagctccaaata

SEQ ID NO: 23958 - DNA, 22 bp, Artificial Sequence
  chemically synthesized
caatggcagctccaaatatttt

SEQ ID NO: 23959 - DNA, 22 bp, Artificial Sequence
  chemically synthesized
caaatattttatatgaaagggg

SEQ ID NO: 23960 - DNA, 22 bp, Artificial Sequence
  chemically synthesized
tatatgaaaggggcctagacat

SEQ ID NO: 23961 - DNA, 22 bp, Artificial Sequence
  chemically synthesized
atatgaaaggggcctagacata

SEQ ID NO: 23962 - DNA, 22 bp, Artificial Sequence
  chemically synthesized
tatgaaaggggcctagacatag

SEQ ID NO: 23963 - DNA, 22 bp, Artificial Sequence
  chemically synthesized
gacatagcatgctgaatgaaaa

SEQ ID NO: 23964 - DNA, 22 bp, Artificial Sequence
  chemically synthesized
aatgaaaaggaagtgagtagac

SEQ ID NO: 23965 - DNA, 22 bp, Artificial Sequence
  chemically synthesized
gtgctttccttgaagctgtgca

SEQ ID NO: 23966 - DNA, 22 bp, Artificial Sequence
  chemically synthesized
tccttgaagctgtgcaaccaag

SEQ ID NO: 23967 - DNA, 22 bp, Artificial Sequence
  chemically synthesized
ccttgaagctgtgcaaccaagc

SEQ ID NO: 23968 - DNA, 22 bp, Artificial Sequence
  chemically synthesized
cttgaagctgtgcaaccaagca

SEQ ID NO: 23969 - DNA, 22 bp, Artificial Sequence
  chemically synthesized
gaagctgtgcaaccaagcatag

SEQ ID NO: 23970 - DNA, 22 bp, Artificial Sequence
  chemically synthesized
aagctgtgcaaccaagcatagt

SEQ ID NO: 23971 - DNA, 22 bp, Artificial Sequence
  chemically synthesized
tgcaaccaagcatagtttttac

SEQ ID NO: 23972 - DNA, 22 bp, Artificial Sequence
  chemically synthesized
ttacatagatcgtgtgtttcac

SEQ ID NO: 23973 - DNA, 22 bp, Artificial Sequence
  chemically synthesized
tacatagatcgtgtgtttcaca

SEQ ID NO: 23974 - DNA, 22 bp, Artificial Sequence
  chemically synthesized
acatagatcgtgtgtttcacat

SEQ ID NO: 23975 - DNA, 22 bp, Artificial Sequence
  chemically synthesized
catagatcgtgtgtttcacatg

SEQ ID NO: 23976 - DNA, 22 bp, Artificial Sequence
  chemically synthesized
cacatggtgtgataacagcttg

SEQ ID NO: 23977 - DNA, 22 bp, Artificial Sequence
  chemically synthesized
acatggtgtgataacagcttga

SEQ ID NO: 23978 - DNA, 22 bp, Artificial Sequence
  chemically synthesized
gagatgccattgacatggccca

SEQ ID NO: 23979 - DNA, 22 bp, Artificial Sequence
  chemically synthesized
agatgccattgacatggcccac

SEQ ID NO: 23980 - DNA, 22 bp, Artificial Sequence
  chemically synthesized
acatggcccaccggcttatcca

SEQ ID NO: 23981 - DNA, 22 bp, Artificial Sequence
  chemically synthesized
atccacatcagtaattagggca

SEQ ID NO: 23982 - DNA, 22 bp, Artificial Sequence
  chemically synthesized
tccacatcagtaattagggcaa

SEQ ID NO: 23983 - DNA, 22 bp, Artificial Sequence
  chemically synthesized
gggcaaagaaatcctaattact

SEQ ID NO: 23984 - DNA, 22 bp, Artificial Sequence
  chemically synthesized
attactatgcatcccgtgattg

SEQ ID NO: 23985 - DNA, 22 bp, Artificial Sequence
  chemically synthesized
ctatgcatcccgtgattgaagt

SEQ ID NO: 23986 - DNA, 22 bp, Artificial Sequence
  chemically synthesized
tgcatcccgtgattgaagtaac

SEQ ID NO: 23987 - DNA, 22 bp, Artificial Sequence
  chemically synthesized
aagtaacattgatgtatacata

SEQ ID NO: 23988 - DNA, 22 bp, Artificial Sequence
  chemically synthesized
atgtatacatattttttcctat

SEQ ID NO: 23989 - DNA, 22 bp, Artificial Sequence
  chemically synthesized
tttcctattatttctctttttg

SEQ ID NO: 23990 - DNA, 22 bp, Artificial Sequence
  chemically synthesized
ttcctattatttctctttttgt

SEQ ID NO: 23991 - DNA, 22 bp, Artificial Sequence
  chemically synthesized
tcctattatttctctttttgtg

SEQ ID NO: 23992 - DNA, 22 bp, Artificial Sequence
  chemically synthesized
cctattatttctctttttgtgt

SEQ ID NO: 23993 - DNA, 22 bp, Artificial Sequence
  chemically synthesized
ctattatttctctttttgtgtt

SEQ ID NO: 23994 - DNA, 22 bp, Artificial Sequence
  chemically synthesized
ttatttctctttttgtgtttaa

SEQ ID NO: 23995 - DNA, 22 bp, Artificial Sequence
  chemically synthesized
tttctctttttgtgtttaaaaa

SEQ ID NO: 23996 - DNA, 22 bp, Artificial Sequence
  chemically synthesized
ctctttttgtgtttaaaaatgc

SEQ ID NO: 23997 - DNA, 22 bp, Artificial Sequence
  chemically synthesized
tctttttgtgtttaaaaatgca

SEQ ID NO: 23998 - DNA, 22 bp, Artificial Sequence
  chemically synthesized
tttttgtgtttaaaaatgcaat

SEQ ID NO: 23999 - DNA, 22 bp, Artificial Sequence
  chemically synthesized
tttgtgtttaaaaatgcaatta

SEQ ID NO: 24000 - DNA, 22 bp, Artificial Sequence
  chemically synthesized
ttgtgtttaaaaatgcaattat

SEQ ID NO: 24001 - DNA, 22 bp, Artificial Sequence
  chemically synthesized
tgtgtttaaaaatgcaattatg

SEQ ID NO: 24002 - DNA, 22 bp, Artificial Sequence
  chemically synthesized
gtgtttaaaaatgcaattatgg

SEQ ID NO: 24003 - DNA, 22 bp, Artificial Sequence
  chemically synthesized
tgtttaaaaatgcaattatgga

SEQ ID NO: 24004 - DNA, 22 bp, Artificial Sequence
  chemically synthesized
aaaaatgcaattatggactcat

SEQ ID NO: 24005 - DNA, 22 bp, Artificial Sequence
  chemically synthesized
aaaatgcaattatggactcatt

SEQ ID NO: 24006 - DNA, 22 bp, Artificial Sequence
  chemically synthesized
tggactcattcaaagtgaaagc

SEQ ID NO: 24007 - DNA, 22 bp, Artificial Sequence
  chemically synthesized
attcaaagtgaaagctggtatg

SEQ ID NO: 24008 - DNA, 22 bp, Artificial Sequence
  chemically synthesized
aaagtgaaagctggtatgacaa

SEQ ID NO: 24009 - DNA, 22 bp, Artificial Sequence
  chemically synthesized
gtatgacaatacatgagctaac

SEQ ID NO: 24010 - DNA, 22 bp, Artificial Sequence
  chemically synthesized
acttcctcattttatgaataaa

SEQ ID NO: 24011 - DNA, 22 bp, Artificial Sequence
  chemically synthesized
cctcattttatgaataaatttt

SEQ ID NO: 24012 - DNA, 22 bp, Artificial Sequence
  chemically synthesized
ctcattttatgaataaatttta

SEQ ID NO: 24013 - DNA, 22 bp, Artificial Sequence
  chemically synthesized
attttatgaataaattttataa

SEQ ID NO: 24014 - DNA, 22 bp, Artificial Sequence
  chemically synthesized
tatgaataaattttataaagaa

SEQ ID NO: 24015 - DNA, 22 bp, Artificial Sequence
  chemically synthesized
atgaataaattttataaagaaa

SEQ ID NO: 24016 - DNA, 22 bp, Artificial Sequence
  chemically synthesized
tgaataaattttataaagaaat

SEQ ID NO: 24017 - DNA, 22 bp, Artificial Sequence
  chemically synthesized
tataaagaaataagctaatacc

SEQ ID NO: 24018 - DNA, 22 bp, Artificial Sequence
  chemically synthesized
ataaagaaataagctaatacct

SEQ ID NO: 24019 - DNA, 22 bp, Artificial Sequence
  chemically synthesized
taaagaaataagctaataccta

SEQ ID NO: 24020 - DNA, 22 bp, Artificial Sequence
  chemically synthesized
atacctacagagtgtttattaa

SEQ ID NO: 24021 - DNA, 22 bp, Artificial Sequence
  chemically synthesized
cagagtgtttattaaatgctag

SEQ ID NO: 24022 - DNA, 22 bp, Artificial Sequence
  chemically synthesized
attaaatgctaggcacagttct

SEQ ID NO: 24023 - DNA, 22 bp, Artificial Sequence
  chemically synthesized
ttaaatgctaggcacagttctg

SEQ ID NO: 24024 - DNA, 22 bp, Artificial Sequence
  chemically synthesized
aatgctaggcacagttctgagt

SEQ ID NO: 24025 - DNA, 22 bp, Artificial Sequence
  chemically synthesized
ggcacagttctgagtgatttac

SEQ ID NO: 24026 - DNA, 22 bp, Artificial Sequence
  chemically synthesized
tgagtgatttacaactggtatt

SEQ ID NO: 24027 - DNA, 22 bp, Artificial Sequence
  chemically synthesized
agtgatttacaactggtatttc

SEQ ID NO: 24028 - DNA, 22 bp, Artificial Sequence
  chemically synthesized
acaactggtatttcttttaatt

SEQ ID NO: 24029 - DNA, 22 bp, Artificial Sequence
  chemically synthesized
caactggtatttcttttaattt

SEQ ID NO: 24030 - DNA, 22 bp, Artificial Sequence
  chemically synthesized
gtatttcttttaattttcacaa

SEQ ID NO: 24031 - DNA, 22 bp, Artificial Sequence
  chemically synthesized
cttttaattttcacaacattat

SEQ ID NO: 24032 - DNA, 22 bp, Artificial Sequence
  chemically synthesized
ttttaattttcacaacattatt

SEQ ID NO: 24033 - DNA, 22 bp, Artificial Sequence
  chemically synthesized
ttaattttcacaacattattac

SEQ ID NO: 24034 - DNA, 22 bp, Artificial Sequence
  chemically synthesized
taattttcacaacattattaca

SEQ ID NO: 24035 - DNA, 22 bp, Artificial Sequence
  chemically synthesized
aattttcacaacattattacag

SEQ ID NO: 24036 - DNA, 22 bp, Artificial Sequence
  chemically synthesized
attttcacaacattattacagg

SEQ ID NO: 24037 - DNA, 22 bp, Artificial Sequence
  chemically synthesized
tcacaacattattacaggtaga

SEQ ID NO: 24038 - DNA, 22 bp, Artificial Sequence
  chemically synthesized
cacaacattattacaggtagat

SEQ ID NO: 24039 - DNA, 22 bp, Artificial Sequence
  chemically synthesized
acaacattattacaggtagatt

SEQ ID NO: 24040 - DNA, 22 bp, Artificial Sequence
  chemically synthesized
ttacaggtagattttatatatg

SEQ ID NO: 24041 - DNA, 22 bp, Artificial Sequence
  chemically synthesized
caggtagattttatatatggag

SEQ ID NO: 24042 - DNA, 22 bp, Artificial Sequence
  chemically synthesized
tatatatggagaaactgaggca

SEQ ID NO: 24043 - DNA, 22 bp, Artificial Sequence
  chemically synthesized
atatatggagaaactgaggcac

SEQ ID NO: 24044 - DNA, 22 bp, Artificial Sequence
  chemically synthesized
tatatggagaaactgaggcaca

SEQ ID NO: 24045 - DNA, 22 bp, Artificial Sequence
  chemically synthesized
aggcacagagatgctatgtaat

SEQ ID NO: 24046 - DNA, 22 bp, Artificial Sequence
  chemically synthesized
tgtaataaatctcaacattacc

SEQ ID NO: 24047 - DNA, 22 bp, Artificial Sequence
  chemically synthesized
aacattacccaggtgatggtgg

SEQ ID NO: 24048 - DNA, 22 bp, Artificial Sequence
  chemically synthesized
cccaggtgatggtggagttgga

SEQ ID NO: 24049 - DNA, 22 bp, Artificial Sequence
  chemically synthesized
gaattccaaatcatgcagtctg

SEQ ID NO: 24050 - DNA, 22 bp, Artificial Sequence
  chemically synthesized
caaatcatgcagtctgacttta

SEQ ID NO: 24051 - DNA, 22 bp, Artificial Sequence
  chemically synthesized
actttagctgtagacagcaaga

SEQ ID NO: 24052 - DNA, 22 bp, Artificial Sequence
  chemically synthesized
tagctgtagacagcaagatagt

SEQ ID NO: 24053 - DNA, 22 bp, Artificial Sequence
  chemically synthesized
agctgtagacagcaagatagta

SEQ ID NO: 24054 - DNA, 22 bp, Artificial Sequence
  chemically synthesized
gctgtagacagcaagatagtaa

SEQ ID NO: 24055 - DNA, 22 bp, Artificial Sequence
  chemically synthesized
tagacagcaagatagtaagtaa

SEQ ID NO: 24056 - DNA, 22 bp, Artificial Sequence
  chemically synthesized
atggatctttttgcttttgctt

SEQ ID NO: 24057 - DNA, 22 bp, Artificial Sequence
  chemically synthesized
tttgcttttgcttgtttgtttg

SEQ ID NO: 24058 - DNA, 22 bp, Artificial Sequence
  chemically synthesized
ttgcttttgcttgtttgtttga

SEQ ID NO: 24059 - DNA, 22 bp, Artificial Sequence
  chemically synthesized
tgcttttgcttgtttgtttgaa

SEQ ID NO: 24060 - DNA, 22 bp, Artificial Sequence
  chemically synthesized
gcttttgcttgtttgtttgaaa

SEQ ID NO: 24061 - DNA, 22 bp, Artificial Sequence
  chemically synthesized
cttttgcttgtttgtttgaaac

SEQ ID NO: 24062 - DNA, 22 bp, Artificial Sequence
  chemically synthesized
ttgcttgtttgtttgaaacagg

SEQ ID NO: 24063 - DNA, 22 bp, Artificial Sequence
  chemically synthesized
tgcttgtttgtttgaaacaggg

SEQ ID NO: 24064 - DNA, 22 bp, Artificial Sequence
  chemically synthesized
gcttgtttgtttgaaacagggt

SEQ ID NO: 24065 - DNA, 22 bp, Artificial Sequence
  chemically synthesized
cttgtttgtttgaaacagggtc

SEQ ID NO: 24066 - DNA, 22 bp, Artificial Sequence
  chemically synthesized
gtttgtttgaaacagggtctca

SEQ ID NO: 24067 - DNA, 22 bp, Artificial Sequence
  chemically synthesized
tttgtttgaaacagggtctcac

SEQ ID NO: 24068 - DNA, 22 bp, Artificial Sequence
  chemically synthesized
gtttgaaacagggtctcactct

SEQ ID NO: 24069 - DNA, 22 bp, Artificial Sequence
  chemically synthesized
tttgaaacagggtctcactctg

SEQ ID NO: 24070 - DNA, 22 bp, Artificial Sequence
  chemically synthesized
gaaacagggtctcactctgtca

SEQ ID NO: 24071 - DNA, 22 bp, Artificial Sequence
  chemically synthesized
aaacagggtctcactctgtcac

SEQ ID NO: 24072 - DNA, 22 bp, Artificial Sequence
  chemically synthesized
actctgtcaccccggctggagt

SEQ ID NO: 24073 - DNA, 22 bp, Artificial Sequence
  chemically synthesized
tgtcaccccggctggagtgcaa

SEQ ID NO: 24074 - DNA, 22 bp, Artificial Sequence
  chemically synthesized
tcaccccggctggagtgcaatg

SEQ ID NO: 24075 - DNA, 22 bp, Artificial Sequence
  chemically synthesized
gagtgcaatggtgcaatcttgc

SEQ ID NO: 24076 - DNA, 22 bp, Artificial Sequence
  chemically synthesized
gctcactgaagcctcactagaa

SEQ ID NO: 24077 - DNA, 22 bp, Artificial Sequence
  chemically synthesized
ctcactgaagcctcactagaac

SEQ ID NO: 24078 - DNA, 22 bp, Artificial Sequence
  chemically synthesized
actgaagcctcactagaacgcc

SEQ ID NO: 24079 - DNA, 22 bp, Artificial Sequence
  chemically synthesized
aagcctcactagaacgcctgga

SEQ ID NO: 24080 - DNA, 22 bp, Artificial Sequence
  chemically synthesized
actagaacgcctggattcaatt

SEQ ID NO: 24081 - DNA, 22 bp, Artificial Sequence
  chemically synthesized
gaacgcctggattcaattgatc

SEQ ID NO: 24082 - DNA, 22 bp, Artificial Sequence
  chemically synthesized
gattcaattgatcctcctgctt

SEQ ID NO: 24083 - DNA, 22 bp, Artificial Sequence
  chemically synthesized
aattgatcctcctgctttagcc

SEQ ID NO: 24084 - DNA, 22 bp, Artificial Sequence
  chemically synthesized
atcctcctgctttagcctctca

SEQ ID NO: 24085 - DNA, 22 bp, Artificial Sequence
  chemically synthesized
ctgctttagcctctcaggtagc

SEQ ID NO: 24086 - DNA, 22 bp, Artificial Sequence
  chemically synthesized
ctttagcctctcaggtagctag

SEQ ID NO: 24087 - DNA, 22 bp, Artificial Sequence
  chemically synthesized
tagcctctcaggtagctaggac

SEQ ID NO: 24088 - DNA, 22 bp, Artificial Sequence
  chemically synthesized
agcctctcaggtagctaggact

SEQ ID NO: 24089 - DNA, 22 bp, Artificial Sequence
  chemically synthesized
gcctctcaggtagctaggacta

SEQ ID NO: 24090 - DNA, 22 bp, Artificial Sequence
  chemically synthesized
tcaggtagctaggactacaggt

SEQ ID NO: 24091 - DNA, 22 bp, Artificial Sequence
  chemically synthesized
aggtagctaggactacaggtgt

SEQ ID NO: 24092 - DNA, 22 bp, Artificial Sequence
  chemically synthesized
ggactacaggtgtgagcctcca

SEQ ID NO: 24093 - DNA, 22 bp, Artificial Sequence
  chemically synthesized
caggtgtgagcctccatggcca

SEQ ID NO: 24094 - DNA, 22 bp, Artificial Sequence
  chemically synthesized
catggccagctagagaaatttt

SEQ ID NO: 24095 - DNA, 22 bp, Artificial Sequence
  chemically synthesized
gagaaattttttaaatttctgt

SEQ ID NO: 24096 - DNA, 22 bp, Artificial Sequence
  chemically synthesized
tttaaatttctgtagaaacagg

SEQ ID NO: 24097 - DNA, 22 bp, Artificial Sequence
  chemically synthesized
ttaaatttctgtagaaacaggg

SEQ ID NO: 24098 - DNA, 22 bp, Artificial Sequence
  chemically synthesized
taaatttctgtagaaacagggt

SEQ ID NO: 24099 - DNA, 22 bp, Artificial Sequence
  chemically synthesized
aaatttctgtagaaacagggtc

SEQ ID NO: 24100 - DNA, 22 bp, Artificial Sequence
  chemically synthesized
aatttctgtagaaacagggtct

SEQ ID NO: 24101 - DNA, 22 bp, Artificial Sequence
  chemically synthesized
ctgtagaaacagggtctcccta

SEQ ID NO: 24102 - DNA, 22 bp, Artificial Sequence
  chemically synthesized
tgtagaaacagggtctccctat

SEQ ID NO: 24103 - DNA, 22 bp, Artificial Sequence
  chemically synthesized
tagaaacagggtctccctatgt

SEQ ID NO: 24104 - DNA, 22 bp, Artificial Sequence
  chemically synthesized
cctatgttccccaggctggtat

SEQ ID NO: 24105 - DNA, 22 bp, Artificial Sequence
  chemically synthesized
tgttccccaggctggtatccaa

SEQ ID NO: 24106 - DNA, 22 bp, Artificial Sequence
  chemically synthesized
cccaggctggtatccaactctt

SEQ ID NO: 24107 - DNA, 22 bp, Artificial Sequence
  chemically synthesized
gtatccaactcttggtctcaaa

SEQ ID NO: 24108 - DNA, 22 bp, Artificial Sequence
  chemically synthesized
ttggtctcaaacaattctccca

SEQ ID NO: 24109 - DNA, 22 bp, Artificial Sequence
  chemically synthesized
ggtctcaaacaattctcccacc

SEQ ID NO: 24110 - DNA, 22 bp, Artificial Sequence
  chemically synthesized
gtctcaaacaattctcccacct

SEQ ID NO: 24111 - DNA, 22 bp, Artificial Sequence
  chemically synthesized
aaacaattctcccacctcagcc

SEQ ID NO: 24112 - DNA, 22 bp, Artificial Sequence
  chemically synthesized
tcccacctcagccttgaaaagt

SEQ ID NO: 24113 - DNA, 22 bp, Artificial Sequence
  chemically synthesized
ccacctcagccttgaaaagtgt

SEQ ID NO: 24114 - DNA, 22 bp, Artificial Sequence
  chemically synthesized
agccttgaaaagtgttgagatt

SEQ ID NO: 24115 - DNA, 22 bp, Artificial Sequence
  chemically synthesized
gaaaagtgttgagattacaggt

SEQ ID NO: 24116 - DNA, 22 bp, Artificial Sequence
  chemically synthesized
aaaagtgttgagattacaggtg

SEQ ID NO: 24117 - DNA, 22 bp, Artificial Sequence
  chemically synthesized
agattacaggtgtgaatcacca

SEQ ID NO: 24118 - DNA, 22 bp, Artificial Sequence
  chemically synthesized
caggtgtgaatcaccatgctgg

SEQ ID NO: 24119 - DNA, 22 bp, Artificial Sequence
  chemically synthesized
ggccttgatggatctttaaaag

SEQ ID NO: 24120 - DNA, 22 bp, Artificial Sequence
  chemically synthesized
gatggatctttaaaagtggtgg

SEQ ID NO: 24121 - DNA, 22 bp, Artificial Sequence
  chemically synthesized
atggatctttaaaagtggtggg

SEQ ID NO: 24122 - DNA, 22 bp, Artificial Sequence
  chemically synthesized
taaaagtggtggggggtaggag

SEQ ID NO: 24123 - DNA, 22 bp, Artificial Sequence
  chemically synthesized
aaaagtggtggggggtaggaga

SEQ ID NO: 24124 - DNA, 22 bp, Artificial Sequence
  chemically synthesized
aaagtggtggggggtaggagaa

SEQ ID NO: 24125 - DNA, 22 bp, Artificial Sequence
  chemically synthesized
ggtctcgggaaggatgggatcc

SEQ ID NO: 24126 - DNA, 22 bp, Artificial Sequence
  chemically synthesized
gggaaggatgggatccttttca

SEQ ID NO: 24127 - DNA, 22 bp, Artificial Sequence
  chemically synthesized
ttcattttgctctagagaaaag

SEQ ID NO: 24128 - DNA, 22 bp, Artificial Sequence
  chemically synthesized
tcattttgctctagagaaaagc

SEQ ID NO: 24129 - DNA, 22 bp, Artificial Sequence
  chemically synthesized
cattttgctctagagaaaagcc

SEQ ID NO: 24130 - DNA, 22 bp, Artificial Sequence
  chemically synthesized
attttgctctagagaaaagcca

SEQ ID NO: 24131 - DNA, 22 bp, Artificial Sequence
  chemically synthesized
tgctctagagaaaagccatttg

SEQ ID NO: 24132 - DNA, 22 bp, Artificial Sequence
  chemically synthesized
gctctagagaaaagccatttgg

SEQ ID NO: 24133 - DNA, 22 bp, Artificial Sequence
  chemically synthesized
ctctagagaaaagccatttgga

SEQ ID NO: 24134 - DNA, 22 bp, Artificial Sequence
  chemically synthesized
tagagaaaagccatttggaaaa

SEQ ID NO: 24135 - DNA, 22 bp, Artificial Sequence
  chemically synthesized
gagaaaagccatttggaaaact

SEQ ID NO: 24136 - DNA, 22 bp, Artificial Sequence
  chemically synthesized
ggaaaacttctgtgttaacaaa

SEQ ID NO: 24137 - DNA, 22 bp, Artificial Sequence
  chemically synthesized
gaaaacttctgtgttaacaaaa

SEQ ID NO: 24138 - DNA, 22 bp, Artificial Sequence
  chemically synthesized
ctgtgttaacaaaaaacagccg

SEQ ID NO: 24139 - DNA, 22 bp, Artificial Sequence
  chemically synthesized
tgtgttaacaaaaaacagccga

SEQ ID NO: 24140 - DNA, 22 bp, Artificial Sequence
  chemically synthesized
tgttaacaaaaaacagccgagt

SEQ ID NO: 24141 - DNA, 22 bp, Artificial Sequence
  chemically synthesized
acaaaaaacagccgagtagcct

SEQ ID NO: 24142 - DNA, 22 bp, Artificial Sequence
  chemically synthesized
gtattaaactttagagcagttg

SEQ ID NO: 24143 - DNA, 22 bp, Artificial Sequence
  chemically synthesized
aactttagagcagttgttcttt

SEQ ID NO: 24144 - DNA, 22 bp, Artificial Sequence
  chemically synthesized
tagagcagttgttctttacggc

SEQ ID NO: 24145 - DNA, 22 bp, Artificial Sequence
  chemically synthesized
agagcagttgttctttacggca

SEQ ID NO: 24146 - DNA, 22 bp, Artificial Sequence
  chemically synthesized
gagcagttgttctttacggcaa

SEQ ID NO: 24147 - DNA, 22 bp, Artificial Sequence
  chemically synthesized
ttctttacggcaattacagggg

SEQ ID NO: 24148 - DNA, 22 bp, Artificial Sequence
  chemically synthesized
tttacggcaattacaggggcct

SEQ ID NO: 24149 - DNA, 22 bp, Artificial Sequence
  chemically synthesized
tacggcaattacaggggccttc

SEQ ID NO: 24150 - DNA, 22 bp, Artificial Sequence
  chemically synthesized
acggcaattacaggggccttca

SEQ ID NO: 24151 - DNA, 22 bp, Artificial Sequence
  chemically synthesized
cggcaattacaggggccttcag

SEQ ID NO: 24152 - DNA, 22 bp, Artificial Sequence
  chemically synthesized
caggggccttcaggaagctgat

SEQ ID NO: 24153 - DNA, 22 bp, Artificial Sequence
  chemically synthesized
caggaagctgatggaagtgtga

SEQ ID NO: 24154 - DNA, 22 bp, Artificial Sequence
  chemically synthesized
aggaagctgatggaagtgtgaa

SEQ ID NO: 24155 - DNA, 22 bp, Artificial Sequence
  chemically synthesized
atggaagtgtgaagtcctcttc

SEQ ID NO: 24156 - DNA, 22 bp, Artificial Sequence
  chemically synthesized
ttctcagagaaaagtacttcta

SEQ ID NO: 24157 - DNA, 22 bp, Artificial Sequence
  chemically synthesized
ctcagagaaaagtacttctata

SEQ ID NO: 24158 - DNA, 22 bp, Artificial Sequence
  chemically synthesized
tcagagaaaagtacttctatat

SEQ ID NO: 24159 - DNA, 22 bp, Artificial Sequence
  chemically synthesized
agagaaaagtacttctatatac

SEQ ID NO: 24160 - DNA, 22 bp, Artificial Sequence
  chemically synthesized
ctatatacgtgcacctaatttt

SEQ ID NO: 24161 - DNA, 22 bp, Artificial Sequence
  chemically synthesized
tatatacgtgcacctaattttt

SEQ ID NO: 24162 - DNA, 22 bp, Artificial Sequence
  chemically synthesized
tatacgtgcacctaatttttag

SEQ ID NO: 24163 - DNA, 22 bp, Artificial Sequence
  chemically synthesized
atttttagatataatttctgaa

SEQ ID NO: 24164 - DNA, 22 bp, Artificial Sequence
  chemically synthesized
ttagatataatttctgaaggtt

SEQ ID NO: 24165 - DNA, 22 bp, Artificial Sequence
  chemically synthesized
tagatataatttctgaaggttt

SEQ ID NO: 24166 - DNA, 22 bp, Artificial Sequence
  chemically synthesized
agatataatttctgaaggttta

SEQ ID NO: 24167 - DNA, 22 bp, Artificial Sequence
  chemically synthesized
gatataatttctgaaggtttag

SEQ ID NO: 24168 - DNA, 22 bp, Artificial Sequence
  chemically synthesized
ctgaaggtttagaaactccttg

SEQ ID NO: 24169 - DNA, 22 bp, Artificial Sequence
  chemically synthesized
tgaaggtttagaaactccttga

SEQ ID NO: 24170 - DNA, 22 bp, Artificial Sequence
  chemically synthesized
aaggtttagaaactccttgagt

SEQ ID NO: 24171 - DNA, 22 bp, Artificial Sequence
  chemically synthesized
agaaactccttgagttcactta

SEQ ID NO: 24172 - DNA, 22 bp, Artificial Sequence
  chemically synthesized
gaaactccttgagttcacttat

SEQ ID NO: 24173 - DNA, 22 bp, Artificial Sequence
  chemically synthesized
cttgagttcacttatatcaaag

SEQ ID NO: 24174 - DNA, 22 bp, Artificial Sequence
  chemically synthesized
gagttcacttatatcaaagtcc

SEQ ID NO: 24175 - DNA, 22 bp, Artificial Sequence
  chemically synthesized
agttcacttatatcaaagtcct

SEQ ID NO: 24176 - DNA, 22 bp, Artificial Sequence
  chemically synthesized
acttatatcaaagtcctcacct

SEQ ID NO: 24177 - DNA, 22 bp, Artificial Sequence
  chemically synthesized
atatcaaagtcctcacctttag

SEQ ID NO: 24178 - DNA, 22 bp, Artificial Sequence
  chemically synthesized
tatcaaagtcctcacctttaga

SEQ ID NO: 24179 - DNA, 22 bp, Artificial Sequence
  chemically synthesized
acctttagaactcctgtcctag

SEQ ID NO: 24180 - DNA, 22 bp, Artificial Sequence
  chemically synthesized
tagaactcctgtcctagaagag

SEQ ID NO: 24181 - DNA, 22 bp, Artificial Sequence
  chemically synthesized
agaactcctgtcctagaagagt

SEQ ID NO: 24182 - DNA, 22 bp, Artificial Sequence
  chemically synthesized
gaactcctgtcctagaagagtg

SEQ ID NO: 24183 - DNA, 22 bp, Artificial Sequence
  chemically synthesized
ctgtcctagaagagtggactca

SEQ ID NO: 24184 - DNA, 22 bp, Artificial Sequence
  chemically synthesized
tcctagaagagtggactcatta

SEQ ID NO: 24185 - DNA, 22 bp, Artificial Sequence
  chemically synthesized
gaagagtggactcattattata

SEQ ID NO: 24186 - DNA, 22 bp, Artificial Sequence
  chemically synthesized
attattataatttcttccataa

SEQ ID NO: 24187 - DNA, 22 bp, Artificial Sequence
  chemically synthesized
ttataatttcttccataaccac

SEQ ID NO: 24188 - DNA, 22 bp, Artificial Sequence
  chemically synthesized
taatttcttccataaccacttt

SEQ ID NO: 24189 - DNA, 22 bp, Artificial Sequence
  chemically synthesized
cttccataaccactttgactct

SEQ ID NO: 24190 - DNA, 22 bp, Artificial Sequence
  chemically synthesized
ttccataaccactttgactcta

SEQ ID NO: 24191 - DNA, 22 bp, Artificial Sequence
  chemically synthesized
ccataaccactttgactctagt

SEQ ID NO: 24192 - DNA, 22 bp, Artificial Sequence
  chemically synthesized
cataaccactttgactctagtt

SEQ ID NO: 24193 - DNA, 22 bp, Artificial Sequence
  chemically synthesized
tgactctagttttctgaattct

SEQ ID NO: 24194 - DNA, 22 bp, Artificial Sequence
  chemically synthesized
gactctagttttctgaattctt

SEQ ID NO: 24195 - DNA, 22 bp, Artificial Sequence
  chemically synthesized
actctagttttctgaattcttc

SEQ ID NO: 24196 - DNA, 22 bp, Artificial Sequence
  chemically synthesized
tagttttctgaattcttccctg

SEQ ID NO: 24197 - DNA, 22 bp, Artificial Sequence
  chemically synthesized
gttttctgaattcttccctgtg

SEQ ID NO: 24198 - DNA, 22 bp, Artificial Sequence
  chemically synthesized
tctgaattcttccctgtgccac

SEQ ID NO: 24199 - DNA, 22 bp, Artificial Sequence
  chemically synthesized
ctgaattcttccctgtgccact

SEQ ID NO: 24200 - DNA, 22 bp, Artificial Sequence
  chemically synthesized
tgaattcttccctgtgccactt

SEQ ID NO: 24201 - DNA, 22 bp, Artificial Sequence
  chemically synthesized
aattcttccctgtgccacttgt

SEQ ID NO: 24202 - DNA, 22 bp, Artificial Sequence
  chemically synthesized
ttccctgtgccacttgtaccat

SEQ ID NO: 24203 - DNA, 22 bp, Artificial Sequence
  chemically synthesized
ccctgtgccacttgtaccatgt

SEQ ID NO: 24204 - DNA, 22 bp, Artificial Sequence
  chemically synthesized
cctgtgccacttgtaccatgta

SEQ ID NO: 24205 - DNA, 22 bp, Artificial Sequence
  chemically synthesized
tgccacttgtaccatgtaattc

SEQ ID NO: 24206 - DNA, 22 bp, Artificial Sequence
  chemically synthesized
gtaccatgtaattcagaggtgt

SEQ ID NO: 24207 - DNA, 22 bp, Artificial Sequence
  chemically synthesized
taccatgtaattcagaggtgta

SEQ ID NO: 24208 - DNA, 22 bp, Artificial Sequence
  chemically synthesized
agaggtgtagtgtcaagactga

SEQ ID NO: 24209 - DNA, 22 bp, Artificial Sequence
  chemically synthesized
aggaggaagcaggtaaattatg

SEQ ID NO: 24210 - DNA, 22 bp, Artificial Sequence
  chemically synthesized
tgtccagcaatacgttggctta

SEQ ID NO: 24211 - DNA, 22 bp, Artificial Sequence
  chemically synthesized
gcttaggcaaaaacaaattgtt

SEQ ID NO: 24212 - DNA, 22 bp, Artificial Sequence
  chemically synthesized
aggcaaaaacaaattgtttcta

SEQ ID NO: 24213 - DNA, 22 bp, Artificial Sequence
  chemically synthesized
ggcaaaaacaaattgtttctag

SEQ ID NO: 24214 - DNA, 22 bp, Artificial Sequence
  chemically synthesized
tttctagtccattttaagaggg

SEQ ID NO: 24215 - DNA, 22 bp, Artificial Sequence
  chemically synthesized
ctagtccattttaagagggaag

SEQ ID NO: 24216 - DNA, 22 bp, Artificial Sequence
  chemically synthesized
tagtccattttaagagggaagc

SEQ ID NO: 24217 - DNA, 22 bp, Artificial Sequence
  chemically synthesized
gtccattttaagagggaagcat

SEQ ID NO: 24218 - DNA, 22 bp, Artificial Sequence
  chemically synthesized
taagagggaagcatttatttag

SEQ ID NO: 24219 - DNA, 22 bp, Artificial Sequence
  chemically synthesized
aagagggaagcatttatttagg

SEQ ID NO: 24220 - DNA, 22 bp, Artificial Sequence
  chemically synthesized
agagggaagcatttatttaggg

SEQ ID NO: 24221 - DNA, 22 bp, Artificial Sequence
  chemically synthesized
atttagggactacatcgctcaa

SEQ ID NO: 24222 - DNA, 22 bp, Artificial Sequence
  chemically synthesized
tttagggactacatcgctcaag

SEQ ID NO: 24223 - DNA, 22 bp, Artificial Sequence
  chemically synthesized
agggactacatcgctcaagtct

SEQ ID NO: 24224 - DNA, 22 bp, Artificial Sequence
  chemically synthesized
gggactacatcgctcaagtctt

SEQ ID NO: 24225 - DNA, 22 bp, Artificial Sequence
  chemically synthesized
catcgctcaagtctttacaatt

SEQ ID NO: 24226 - DNA, 22 bp, Artificial Sequence
  chemically synthesized
aagtctttacaattcttaaatt

SEQ ID NO: 24227 - DNA, 22 bp, Artificial Sequence
  chemically synthesized
tacaattcttaaattaactttc

SEQ ID NO: 24228 - DNA, 22 bp, Artificial Sequence
  chemically synthesized
acaattcttaaattaactttca

SEQ ID NO: 24229 - DNA, 22 bp, Artificial Sequence
  chemically synthesized
caattcttaaattaactttcat

SEQ ID NO: 24230 - DNA, 22 bp, Artificial Sequence
  chemically synthesized
ttaaattaactttcattatgtg

SEQ ID NO: 24231 - DNA, 22 bp, Artificial Sequence
  chemically synthesized
aaattaactttcattatgtgtg

SEQ ID NO: 24232 - DNA, 22 bp, Artificial Sequence
  chemically synthesized
aattaactttcattatgtgtga

SEQ ID NO: 24233 - DNA, 22 bp, Artificial Sequence
  chemically synthesized
actttcattatgtgtgacaaca

SEQ ID NO: 24234 - DNA, 22 bp, Artificial Sequence
  chemically synthesized
tcattatgtgtgacaacattta

SEQ ID NO: 24235 - DNA, 22 bp, Artificial Sequence
  chemically synthesized
cattatgtgtgacaacatttat

SEQ ID NO: 24236 - DNA, 22 bp, Artificial Sequence
  chemically synthesized
attatgtgtgacaacatttatt

SEQ ID NO: 24237 - DNA, 22 bp, Artificial Sequence
  chemically synthesized
tgtgtgacaacatttattaaac

SEQ ID NO: 24238 - DNA, 22 bp, Artificial Sequence
  chemically synthesized
attaaacttttttaatgatcct

SEQ ID NO: 24239 - DNA, 22 bp, Artificial Sequence
  chemically synthesized
ttaaacttttttaatgatccta

SEQ ID NO: 24240 - DNA, 22 bp, Artificial Sequence
  chemically synthesized
aacttttttaatgatcctaaat

SEQ ID NO: 24241 - DNA, 22 bp, Artificial Sequence
  chemically synthesized
ttttaatgatcctaaatatcct

SEQ ID NO: 24242 - DNA, 22 bp, Artificial Sequence
  chemically synthesized
tttaatgatcctaaatatcctt

SEQ ID NO: 24243 - DNA, 22 bp, Artificial Sequence
  chemically synthesized
ttaatgatcctaaatatcctta

SEQ ID NO: 24244 - DNA, 22 bp, Artificial Sequence
  chemically synthesized
taatgatcctaaatatccttaa

SEQ ID NO: 24245 - DNA, 22 bp, Artificial Sequence
  chemically synthesized
aatgatcctaaatatccttaac

SEQ ID NO: 24246 - DNA, 22 bp, Artificial Sequence
  chemically synthesized
atgatcctaaatatccttaaca

SEQ ID NO: 24247 - DNA, 22 bp, Artificial Sequence
  chemically synthesized
aatatccttaacatgttaattt

SEQ ID NO: 24248 - DNA, 22 bp, Artificial Sequence
  chemically synthesized
aacatgttaatttctccagagt

SEQ ID NO: 24249 - DNA, 22 bp, Artificial Sequence
  chemically synthesized
acatgttaatttctccagagtt

SEQ ID NO: 24250 - DNA, 22 bp, Artificial Sequence
  chemically synthesized
atttctccagagtttgtaatgt

SEQ ID NO: 24251 - DNA, 22 bp, Artificial Sequence
  chemically synthesized
ctccagagtttgtaatgttctg

SEQ ID NO: 24252 - DNA, 22 bp, Artificial Sequence
  chemically synthesized
tccagagtttgtaatgttctga

SEQ ID NO: 24253 - DNA, 22 bp, Artificial Sequence
  chemically synthesized
cagagtttgtaatgttctgagc

SEQ ID NO: 24254 - DNA, 22 bp, Artificial Sequence
  chemically synthesized
gtaatgttctgagcaagtgtgt

SEQ ID NO: 24255 - DNA, 22 bp, Artificial Sequence
  chemically synthesized
taatgttctgagcaagtgtgtg

SEQ ID NO: 24256 - DNA, 22 bp, Artificial Sequence
  chemically synthesized
tgagcaagtgtgtgcagaagaa

SEQ ID NO: 24257 - DNA, 22 bp, Artificial Sequence
  chemically synthesized
agcaagtgtgtgcagaagaaat

SEQ ID NO: 24258 - DNA, 22 bp, Artificial Sequence
  chemically synthesized
tagtaagacctgggcaaaggag

SEQ ID NO: 24259 - DNA, 22 bp, Artificial Sequence
  chemically synthesized
ggcaaaggagagagtaaacatt

SEQ ID NO: 24260 - DNA, 22 bp, Artificial Sequence
  chemically synthesized
ttcccccacatttgggcaaaac

SEQ ID NO: 24261 - DNA, 22 bp, Artificial Sequence
  chemically synthesized
tcccccacatttgggcaaaact

SEQ ID NO: 24262 - DNA, 22 bp, Artificial Sequence
  chemically synthesized
cccccacatttgggcaaaactt

SEQ ID NO: 24263 - DNA, 22 bp, Artificial Sequence
  chemically synthesized
ccccacatttgggcaaaacttt

SEQ ID NO: 24264 - DNA, 22 bp, Artificial Sequence
  chemically synthesized
gggcaaaactttccatcctggg

SEQ ID NO: 24265 - DNA, 22 bp, Artificial Sequence
  chemically synthesized
ggcaaaactttccatcctgggt

SEQ ID NO: 24266 - DNA, 22 bp, Artificial Sequence
  chemically synthesized
tccatcctgggtcacaccacag

SEQ ID NO: 24267 - DNA, 22 bp, Artificial Sequence
  chemically synthesized
ccatcctgggtcacaccacagt

SEQ ID NO: 24268 - DNA, 22 bp, Artificial Sequence
  chemically synthesized
catcctgggtcacaccacagtc

SEQ ID NO: 24269 - DNA, 22 bp, Artificial Sequence
  chemically synthesized
ggtcacaccacagtctaatttc

SEQ ID NO: 24270 - DNA, 22 bp, Artificial Sequence
  chemically synthesized
atttccctcctctcctctccct

SEQ ID NO: 24271 - DNA, 22 bp, Artificial Sequence
  chemically synthesized
ccctcctctcctctccctcaac

SEQ ID NO: 24272 - DNA, 22 bp, Artificial Sequence
  chemically synthesized
cctcctctcctctccctcaact

SEQ ID NO: 24273 - DNA, 22 bp, Artificial Sequence
  chemically synthesized
ctctcctctccctcaactggta

SEQ ID NO: 24274 - DNA, 22 bp, Artificial Sequence
  chemically synthesized
tcctctccctcaactggtaaca

SEQ ID NO: 24275 - DNA, 22 bp, Artificial Sequence
  chemically synthesized
ctctccctcaactggtaacagt

SEQ ID NO: 24276 - DNA, 22 bp, Artificial Sequence
  chemically synthesized
tccctcaactggtaacagtgct

SEQ ID NO: 24277 - DNA, 22 bp, Artificial Sequence
  chemically synthesized
cctcaactggtaacagtgcttc

SEQ ID NO: 24278 - DNA, 22 bp, Artificial Sequence
  chemically synthesized
aactggtaacagtgcttcttcc

SEQ ID NO: 24279 - DNA, 22 bp, Artificial Sequence
  chemically synthesized
gtaacagtgcttcttccaaaac

SEQ ID NO: 24280 - DNA, 22 bp, Artificial Sequence
  chemically synthesized
cttccaaaacatacctgactac

SEQ ID NO: 24281 - DNA, 22 bp, Artificial Sequence
  chemically synthesized
ttccaaaacatacctgactact

SEQ ID NO: 24282 - DNA, 22 bp, Artificial Sequence
  chemically synthesized
ccaaaacatacctgactactta

SEQ ID NO: 24283 - DNA, 22 bp, Artificial Sequence
  chemically synthesized
caaaacatacctgactacttag

SEQ ID NO: 24284 - DNA, 22 bp, Artificial Sequence
  chemically synthesized
actacttagtacttcccactac

SEQ ID NO: 24285 - DNA, 22 bp, Artificial Sequence
  chemically synthesized
cttagtacttcccactactgtg

SEQ ID NO: 24286 - DNA, 22 bp, Artificial Sequence
  chemically synthesized
agtacttcccactactgtggat

SEQ ID NO: 24287 - DNA, 22 bp, Artificial Sequence
  chemically synthesized
gtacttcccactactgtggata

SEQ ID NO: 24288 - DNA, 22 bp, Artificial Sequence
  chemically synthesized
cccactactgtggatagaattt

SEQ ID NO: 24289 - DNA, 22 bp, Artificial Sequence
  chemically synthesized
ccactactgtggatagaatttc

SEQ ID NO: 24290 - DNA, 22 bp, Artificial Sequence
  chemically synthesized
ctgtggatagaatttcagtgac

SEQ ID NO: 24291 - DNA, 22 bp, Artificial Sequence
  chemically synthesized
tggatagaatttcagtgactcc

SEQ ID NO: 24292 - DNA, 22 bp, Artificial Sequence
  chemically synthesized
cagtgactcctcattcattgtt

SEQ ID NO: 24293 - DNA, 22 bp, Artificial Sequence
  chemically synthesized
agtgactcctcattcattgttc

SEQ ID NO: 24294 - DNA, 22 bp, Artificial Sequence
  chemically synthesized
ctcattcattgttcataccctg

SEQ ID NO: 24295 - DNA, 22 bp, Artificial Sequence
  chemically synthesized
attcattgttcataccctggag

SEQ ID NO: 24296 - DNA, 22 bp, Artificial Sequence
  chemically synthesized
attgttcataccctggagacaa

SEQ ID NO: 24297 - DNA, 22 bp, Artificial Sequence
  chemically synthesized
ttcataccctggagacaaaact

SEQ ID NO: 24298 - DNA, 22 bp, Artificial Sequence
  chemically synthesized
ataccctggagacaaaactcct

SEQ ID NO: 24299 - DNA, 22 bp, Artificial Sequence
  chemically synthesized
gagacaaaactccttaaggcta

SEQ ID NO: 24300 - DNA, 22 bp, Artificial Sequence
  chemically synthesized
cttaaggctattaactccccct

SEQ ID NO: 24301 - DNA, 22 bp, Artificial Sequence
  chemically synthesized
aaggctattaactccccctgag

SEQ ID NO: 24302 - DNA, 22 bp, Artificial Sequence
  chemically synthesized
aggctattaactccccctgagc

SEQ ID NO: 24303 - DNA, 22 bp, Artificial Sequence
  chemically synthesized
ttaactccccctgagcttcaca

SEQ ID NO: 24304 - DNA, 22 bp, Artificial Sequence
  chemically synthesized
actccccctgagcttcacaatc

SEQ ID NO: 24305 - DNA, 22 bp, Artificial Sequence
  chemically synthesized
cccctgagcttcacaatctagt

SEQ ID NO: 24306 - DNA, 22 bp, Artificial Sequence
  chemically synthesized
agcttcacaatctagtccctgc

SEQ ID NO: 24307 - DNA, 22 bp, Artificial Sequence
  chemically synthesized
cacaatctagtccctgcaggtc

SEQ ID NO: 24308 - DNA, 22 bp, Artificial Sequence
  chemically synthesized
acaatctagtccctgcaggtct

SEQ ID NO: 24309 - DNA, 22 bp, Artificial Sequence
  chemically synthesized
gtccctgcaggtctctcccatc

SEQ ID NO: 24310 - DNA, 22 bp, Artificial Sequence
  chemically synthesized
caggtctctcccatcttctctc

SEQ ID NO: 24311 - DNA, 22 bp, Artificial Sequence
  chemically synthesized
tcccatcttctctcatactcct

SEQ ID NO: 24312 - DNA, 22 bp, Artificial Sequence
  chemically synthesized
ccatcttctctcatactcctct

SEQ ID NO: 24313 - DNA, 22 bp, Artificial Sequence
  chemically synthesized
ctctcatactcctctccttttc

SEQ ID NO: 24314 - DNA, 22 bp, Artificial Sequence
  chemically synthesized
tctcatactcctctccttttcc

SEQ ID NO: 24315 - DNA, 22 bp, Artificial Sequence
  chemically synthesized
tcatactcctctccttttccct

SEQ ID NO: 24316 - DNA, 22 bp, Artificial Sequence
  chemically synthesized
atactcctctccttttccctct

SEQ ID NO: 24317 - DNA, 22 bp, Artificial Sequence
  chemically synthesized
ctctccttttccctctctgagc

SEQ ID NO: 24318 - DNA, 22 bp, Artificial Sequence
  chemically synthesized
tccttttccctctctgagcccc

SEQ ID NO: 24319 - DNA, 22 bp, Artificial Sequence
  chemically synthesized
cttttccctctctgagccccgc

SEQ ID NO: 24320 - DNA, 22 bp, Artificial Sequence
  chemically synthesized
ttccctctctgagccccgctca

SEQ ID NO: 24321 - DNA, 22 bp, Artificial Sequence
  chemically synthesized
tccctctctgagccccgctcag

SEQ ID NO: 24322 - DNA, 22 bp, Artificial Sequence
  chemically synthesized
ccctctctgagccccgctcaga

SEQ ID NO: 24323 - DNA, 22 bp, Artificial Sequence
  chemically synthesized
cctctctgagccccgctcagat

SEQ ID NO: 24324 - DNA, 22 bp, Artificial Sequence
  chemically synthesized
tctgagccccgctcagatcttc

SEQ ID NO: 24325 - DNA, 22 bp, Artificial Sequence
  chemically synthesized
tgagccccgctcagatcttcga

SEQ ID NO: 24326 - DNA, 22 bp, Artificial Sequence
  chemically synthesized
agccccgctcagatcttcgaac

SEQ ID NO: 24327 - DNA, 22 bp, Artificial Sequence
  chemically synthesized
agatcttcgaacagagaacact

SEQ ID NO: 24328 - DNA, 22 bp, Artificial Sequence
  chemically synthesized
cgaacagagaacacttctgcat

SEQ ID NO: 24329 - DNA, 22 bp, Artificial Sequence
  chemically synthesized
gaacagagaacacttctgcatc

SEQ ID NO: 24330 - DNA, 22 bp, Artificial Sequence
  chemically synthesized
ctgcatcttggcatatatagtt

SEQ ID NO: 24331 - DNA, 22 bp, Artificial Sequence
  chemically synthesized
tgcatcttggcatatatagttc

SEQ ID NO: 24332 - DNA, 22 bp, Artificial Sequence
  chemically synthesized
catcttggcatatatagttctc

SEQ ID NO: 24333 - DNA, 22 bp, Artificial Sequence
  chemically synthesized
ggcatatatagttctctcacat

SEQ ID NO: 24334 - DNA, 22 bp, Artificial Sequence
  chemically synthesized
gcatatatagttctctcacata

SEQ ID NO: 24335 - DNA, 22 bp, Artificial Sequence
  chemically synthesized
tctcacatagaacgctttctcc

SEQ ID NO: 24336 - DNA, 22 bp, Artificial Sequence
  chemically synthesized
tcacatagaacgctttctcccc

SEQ ID NO: 24337 - DNA, 22 bp, Artificial Sequence
  chemically synthesized
acatagaacgctttctcccctt

SEQ ID NO: 24338 - DNA, 22 bp, Artificial Sequence
  chemically synthesized
tctcccctttagctatttatcc

SEQ ID NO: 24339 - DNA, 22 bp, Artificial Sequence
  chemically synthesized
ctcccctttagctatttatcct

SEQ ID NO: 24340 - DNA, 22 bp, Artificial Sequence
  chemically synthesized
tcccctttagctatttatcctt

SEQ ID NO: 24341 - DNA, 22 bp, Artificial Sequence
  chemically synthesized
ccctttagctatttatccttca

SEQ ID NO: 24342 - DNA, 22 bp, Artificial Sequence
  chemically synthesized
tagctatttatccttcaagtgt

SEQ ID NO: 24343 - DNA, 22 bp, Artificial Sequence
  chemically synthesized
agctatttatccttcaagtgtc

SEQ ID NO: 24344 - DNA, 22 bp, Artificial Sequence
  chemically synthesized
gctatttatccttcaagtgtca

SEQ ID NO: 24345 - DNA, 22 bp, Artificial Sequence
  chemically synthesized
tttatccttcaagtgtcagctc

SEQ ID NO: 24346 - DNA, 22 bp, Artificial Sequence
  chemically synthesized
atccttcaagtgtcagctcaaa

SEQ ID NO: 24347 - DNA, 22 bp, Artificial Sequence
  chemically synthesized
tccttcaagtgtcagctcaaac

SEQ ID NO: 24348 - DNA, 22 bp, Artificial Sequence
  chemically synthesized
caagtgtcagctcaaacatctc

SEQ ID NO: 24349 - DNA, 22 bp, Artificial Sequence
  chemically synthesized
aagtgtcagctcaaacatctca

SEQ ID NO: 24350 - DNA, 22 bp, Artificial Sequence
  chemically synthesized
aaacatctcatcattagagagg

SEQ ID NO: 24351 - DNA, 22 bp, Artificial Sequence
  chemically synthesized
atcattagagaggtttttccca

SEQ ID NO: 24352 - DNA, 22 bp, Artificial Sequence
  chemically synthesized
gagaggtttttcccaaacctct

SEQ ID NO: 24353 - DNA, 22 bp, Artificial Sequence
  chemically synthesized
ttcccaaacctctaggtaacta

SEQ ID NO: 24354 - DNA, 22 bp, Artificial Sequence
  chemically synthesized
tcccaaacctctaggtaactag

SEQ ID NO: 24355 - DNA, 22 bp, Artificial Sequence
  chemically synthesized
cccaaacctctaggtaactagg

SEQ ID NO: 24356 - DNA, 22 bp, Artificial Sequence
  chemically synthesized
ccaaacctctaggtaactaggt

SEQ ID NO: 24357 - DNA, 22 bp, Artificial Sequence
  chemically synthesized
taggtaactaggttagaaacca

SEQ ID NO: 24358 - DNA, 22 bp, Artificial Sequence
  chemically synthesized
ggtaactaggttagaaaccact

SEQ ID NO: 24359 - DNA, 22 bp, Artificial Sequence
  chemically synthesized
ggttagaaaccactccccattc

SEQ ID NO: 24360 - DNA, 22 bp, Artificial Sequence
  chemically synthesized
gaaaccactccccattccacgg

SEQ ID NO: 24361 - DNA, 22 bp, Artificial Sequence
  chemically synthesized
cccattccacggtacactgtat

SEQ ID NO: 24362 - DNA, 22 bp, Artificial Sequence
  chemically synthesized
cacggtacactgtatagtctta

SEQ ID NO: 24363 - DNA, 22 bp, Artificial Sequence
  chemically synthesized
tatagtcttaggacacctggtt

SEQ ID NO: 24364 - DNA, 22 bp, Artificial Sequence
  chemically synthesized
aggacacctggttcccttagtc

SEQ ID NO: 24365 - DNA, 22 bp, Artificial Sequence
  chemically synthesized
ggacacctggttcccttagtct

SEQ ID NO: 24366 - DNA, 22 bp, Artificial Sequence
  chemically synthesized
gttcccttagtctcacactcat

SEQ ID NO: 24367 - DNA, 22 bp, Artificial Sequence
  chemically synthesized
ccttagtctcacactcatcaca

SEQ ID NO: 24368 - DNA, 22 bp, Artificial Sequence
  chemically synthesized
agtctcacactcatcacatttg

SEQ ID NO: 24369 - DNA, 22 bp, Artificial Sequence
  chemically synthesized
gtctcacactcatcacatttga

SEQ ID NO: 24370 - DNA, 22 bp, Artificial Sequence
  chemically synthesized
acactcatcacatttgactgta

SEQ ID NO: 24371 - DNA, 22 bp, Artificial Sequence
  chemically synthesized
atcacatttgactgtattgtat

SEQ ID NO: 24372 - DNA, 22 bp, Artificial Sequence
  chemically synthesized
gactgtattgtatgttcaatgt

SEQ ID NO: 24373 - DNA, 22 bp, Artificial Sequence
  chemically synthesized
actgtattgtatgttcaatgtc

SEQ ID NO: 24374 - DNA, 22 bp, Artificial Sequence
  chemically synthesized
tattgtatgttcaatgtctacc

SEQ ID NO: 24375 - DNA, 22 bp, Artificial Sequence
  chemically synthesized
tatgttcaatgtctaccttcta

SEQ ID NO: 24376 - DNA, 22 bp, Artificial Sequence
  chemically synthesized
aatgtctaccttctacaaattt

SEQ ID NO: 24377 - DNA, 22 bp, Artificial Sequence
  chemically synthesized
ccttctacaaatttgtcaattc

SEQ ID NO: 24378 - DNA, 22 bp, Artificial Sequence
  chemically synthesized
ctacaaatttgtcaattcttga

SEQ ID NO: 24379 - DNA, 22 bp, Artificial Sequence
  chemically synthesized
tacaaatttgtcaattcttgaa

SEQ ID NO: 24380 - DNA, 22 bp, Artificial Sequence
  chemically synthesized
caaatttgtcaattcttgaaga

SEQ ID NO: 24381 - DNA, 22 bp, Artificial Sequence
  chemically synthesized
gtcaattcttgaagattaagaa

SEQ ID NO: 24382 - DNA, 22 bp, Artificial Sequence
  chemically synthesized
tcaattcttgaagattaagaat

SEQ ID NO: 24383 - DNA, 22 bp, Artificial Sequence
  chemically synthesized
ttgaagattaagaatcagttct

SEQ ID NO: 24384 - DNA, 22 bp, Artificial Sequence
  chemically synthesized
gaagattaagaatcagttctgt

SEQ ID NO: 24385 - DNA, 22 bp, Artificial Sequence
  chemically synthesized
aagattaagaatcagttctgta

SEQ ID NO: 24386 - DNA, 22 bp, Artificial Sequence
  chemically synthesized
agaatcagttctgtattcttaa

SEQ ID NO: 24387 - DNA, 22 bp, Artificial Sequence
  chemically synthesized
tgtattcttaactctatctccc

SEQ ID NO: 24388 - DNA, 22 bp, Artificial Sequence
  chemically synthesized
tattcttaactctatctccctc

SEQ ID NO: 24389 - DNA, 22 bp, Artificial Sequence
  chemically synthesized
ttaactctatctccctcgcctc

SEQ ID NO: 24390 - DNA, 22 bp, Artificial Sequence
  chemically synthesized
aactctatctccctcgcctctc

SEQ ID NO: 24391 - DNA, 22 bp, Artificial Sequence
  chemically synthesized
actctatctccctcgcctctca

SEQ ID NO: 24392 - DNA, 22 bp, Artificial Sequence
  chemically synthesized
tatctccctcgcctctcagtgc

SEQ ID NO: 24393 - DNA, 22 bp, Artificial Sequence
  chemically synthesized
tctccctcgcctctcagtgcct

SEQ ID NO: 24394 - DNA, 22 bp, Artificial Sequence
  chemically synthesized
cctcgcctctcagtgcctgata

SEQ ID NO: 24395 - DNA, 22 bp, Artificial Sequence
  chemically synthesized
gcctctcagtgcctgataccta

SEQ ID NO: 24396 - DNA, 22 bp, Artificial Sequence
  chemically synthesized
tcagtgcctgatacctaataga

SEQ ID NO: 24397 - DNA, 22 bp, Artificial Sequence
  chemically synthesized
agtgcctgatacctaatagaca

SEQ ID NO: 24398 - DNA, 22 bp, Artificial Sequence
  chemically synthesized
atacctaatagacacttgatga

SEQ ID NO: 24399 - DNA, 22 bp, Artificial Sequence
  chemically synthesized
atagacacttgatgaatcctta

SEQ ID NO: 24400 - DNA, 22 bp, Artificial Sequence
  chemically synthesized
gatgaatccttactgaataata

SEQ ID NO: 24401 - DNA, 22 bp, Artificial Sequence
  chemically synthesized
atgaatccttactgaataataa

SEQ ID NO: 24402 - DNA, 22 bp, Artificial Sequence
  chemically synthesized
actgaataataaaatggattaa

SEQ ID NO: 24403 - DNA, 22 bp, Artificial Sequence
  chemically synthesized
ctgaataataaaatggattaat

SEQ ID NO: 24404 - DNA, 22 bp, Artificial Sequence
  chemically synthesized
aataataaaatggattaatgaa

SEQ ID NO: 24405 - DNA, 22 bp, Artificial Sequence
  chemically synthesized
atgaataaaagcaataaatttc

SEQ ID NO: 24406 - DNA, 22 bp, Artificial Sequence
  chemically synthesized
caaggttaatattaataaatta

SEQ ID NO: 24407 - DNA, 22 bp, Artificial Sequence
  chemically synthesized
aaggttaatattaataaattaa

SEQ ID NO: 24408 - DNA, 22 bp, Artificial Sequence
  chemically synthesized
atattaataaattaaaaaggtt

SEQ ID NO: 24409 - DNA, 22 bp, Artificial Sequence
  chemically synthesized
ataaattaaaaaggttattttg

SEQ ID NO: 24410 - DNA, 22 bp, Artificial Sequence
  chemically synthesized
aaaaggttattttgaagtctga

SEQ ID NO: 24411 - DNA, 22 bp, Artificial Sequence
  chemically synthesized
ttttgaagtctgagaattagta

SEQ ID NO: 24412 - DNA, 22 bp, Artificial Sequence
  chemically synthesized
tgaagtctgagaattagtaccc

SEQ ID NO: 24413 - DNA, 22 bp, Artificial Sequence
  chemically synthesized
gaagtctgagaattagtaccca

SEQ ID NO: 24414 - DNA, 22 bp, Artificial Sequence
  chemically synthesized
aagtctgagaattagtacccaa

SEQ ID NO: 24415 - DNA, 22 bp, Artificial Sequence
  chemically synthesized
agaattagtacccaaaactaac

SEQ ID NO: 24416 - DNA, 22 bp, Artificial Sequence
  chemically synthesized
gtacccaaaactaactgtgact

SEQ ID NO: 24417 - DNA, 22 bp, Artificial Sequence
  chemically synthesized
actgtgactctctcatctgtta

SEQ ID NO: 24418 - DNA, 22 bp, Artificial Sequence
  chemically synthesized
tgactctctcatctgttatgtt

SEQ ID NO: 24419 - DNA, 22 bp, Artificial Sequence
  chemically synthesized
tctcatctgttatgtttttcac

SEQ ID NO: 24420 - DNA, 22 bp, Artificial Sequence
  chemically synthesized
tcatctgttatgtttttcacgt

SEQ ID NO: 24421 - DNA, 22 bp, Artificial Sequence
  chemically synthesized
atctgttatgtttttcacgttt

SEQ ID NO: 24422 - DNA, 22 bp, Artificial Sequence
  chemically synthesized
ttatgtttttcacgtttccatt

SEQ ID NO: 24423 - DNA, 22 bp, Artificial Sequence
  chemically synthesized
tgtttttcacgtttccattgtt

SEQ ID NO: 24424 - DNA, 22 bp, Artificial Sequence
  chemically synthesized
ttcacgtttccattgttcatgg

SEQ ID NO: 24425 - DNA, 22 bp, Artificial Sequence
  chemically synthesized
tcacgtttccattgttcatggg

SEQ ID NO: 24426 - DNA, 22 bp, Artificial Sequence
  chemically synthesized
cacgtttccattgttcatgggc

SEQ ID NO: 24427 - DNA, 22 bp, Artificial Sequence
  chemically synthesized
acgtttccattgttcatgggca

SEQ ID NO: 24428 - DNA, 22 bp, Artificial Sequence
  chemically synthesized
ccattgttcatgggcaaaattc

SEQ ID NO: 24429 - DNA, 22 bp, Artificial Sequence
  chemically synthesized
cattgttcatgggcaaaattct

SEQ ID NO: 24430 - DNA, 22 bp, Artificial Sequence
  chemically synthesized
ttcatgggcaaaattctggcag

SEQ ID NO: 24431 - DNA, 22 bp, Artificial Sequence
  chemically synthesized
atgggcaaaattctggcagcaa

SEQ ID NO: 24432 - DNA, 22 bp, Artificial Sequence
  chemically synthesized
tggcagcaagggattcttctcc

SEQ ID NO: 24433 - DNA, 22 bp, Artificial Sequence
  chemically synthesized
gcagcaagggattcttctccta

SEQ ID NO: 24434 - DNA, 22 bp, Artificial Sequence
  chemically synthesized
ttctcctaagaaaccttttgtt

SEQ ID NO: 24435 - DNA, 22 bp, Artificial Sequence
  chemically synthesized
ctcctaagaaaccttttgtttt

SEQ ID NO: 24436 - DNA, 22 bp, Artificial Sequence
  chemically synthesized
tcctaagaaaccttttgttttc

SEQ ID NO: 24437 - DNA, 22 bp, Artificial Sequence
  chemically synthesized
ctaagaaaccttttgttttctt

SEQ ID NO: 24438 - DNA, 22 bp, Artificial Sequence
  chemically synthesized
agaaaccttttgttttcttgga

SEQ ID NO: 24439 - DNA, 22 bp, Artificial Sequence
  chemically synthesized
ttgttttcttggatgtgaatac

SEQ ID NO: 24440 - DNA, 22 bp, Artificial Sequence
  chemically synthesized
tgttttcttggatgtgaataca

SEQ ID NO: 24441 - DNA, 22 bp, Artificial Sequence
  chemically synthesized
gttttcttggatgtgaatacat

SEQ ID NO: 24442 - DNA, 22 bp, Artificial Sequence
  chemically synthesized
ttttcttggatgtgaatacatt

SEQ ID NO: 24443 - DNA, 22 bp, Artificial Sequence
  chemically synthesized
tcttggatgtgaatacatttcc

SEQ ID NO: 24444 - DNA, 22 bp, Artificial Sequence
  chemically synthesized
cttggatgtgaatacatttcct

SEQ ID NO: 24445 - DNA, 22 bp, Artificial Sequence
  chemically synthesized
ttggatgtgaatacatttcctt

SEQ ID NO: 24446 - DNA, 22 bp, Artificial Sequence
  chemically synthesized
ggatgtgaatacatttccttgt

SEQ ID NO: 24447 - DNA, 22 bp, Artificial Sequence
  chemically synthesized
gatgtgaatacatttccttgtt

SEQ ID NO: 24448 - DNA, 22 bp, Artificial Sequence
  chemically synthesized
ccttgtttgccagaaaacatgg

SEQ ID NO: 24449 - DNA, 22 bp, Artificial Sequence
  chemically synthesized
cttgtttgccagaaaacatggt

SEQ ID NO: 24450 - DNA, 22 bp, Artificial Sequence
  chemically synthesized
gtttgccagaaaacatggtaag

SEQ ID NO: 24451 - DNA, 22 bp, Artificial Sequence
  chemically synthesized
tttgccagaaaacatggtaaga

SEQ ID NO: 24452 - DNA, 22 bp, Artificial Sequence
  chemically synthesized
gccagaaaacatggtaagataa

SEQ ID NO: 24453 - DNA, 22 bp, Artificial Sequence
  chemically synthesized
ccagaaaacatggtaagataac

SEQ ID NO: 24454 - DNA, 22 bp, Artificial Sequence
  chemically synthesized
gagagtataacattcattttat

SEQ ID NO: 24455 - DNA, 22 bp, Artificial Sequence
  chemically synthesized
attttattcatgaagaaactgt

SEQ ID NO: 24456 - DNA, 22 bp, Artificial Sequence
  chemically synthesized
tattcatgaagaaactgttatt

SEQ ID NO: 24457 - DNA, 22 bp, Artificial Sequence
  chemically synthesized
attcatgaagaaactgttattc

SEQ ID NO: 24458 - DNA, 22 bp, Artificial Sequence
  chemically synthesized
ttcatgaagaaactgttattca

SEQ ID NO: 24459 - DNA, 22 bp, Artificial Sequence
  chemically synthesized
atgaagaaactgttattcagtt

SEQ ID NO: 24460 - DNA, 22 bp, Artificial Sequence
  chemically synthesized
ttattcagtttaaggggttctt

SEQ ID NO: 24461 - DNA, 22 bp, Artificial Sequence
  chemically synthesized
ttcagtttaaggggttcttttt

SEQ ID NO: 24462 - DNA, 22 bp, Artificial Sequence
  chemically synthesized
agtttaaggggttctttttcag

SEQ ID NO: 24463 - DNA, 22 bp, Artificial Sequence
  chemically synthesized
aaggggttctttttcagaaagt

SEQ ID NO: 24464 - DNA, 22 bp, Artificial Sequence
  chemically synthesized
aggggttctttttcagaaagtt

SEQ ID NO: 24465 - DNA, 22 bp, Artificial Sequence
  chemically synthesized
tttttcagaaagtttcagaaat

SEQ ID NO: 24466 - DNA, 22 bp, Artificial Sequence
  chemically synthesized
tttcagaaagtttcagaaatcc

SEQ ID NO: 24467 - DNA, 22 bp, Artificial Sequence
  chemically synthesized
ttcagaaagtttcagaaatcca

SEQ ID NO: 24468 - DNA, 22 bp, Artificial Sequence
  chemically synthesized
tcagaaagtttcagaaatccaa

SEQ ID NO: 24469 - DNA, 22 bp, Artificial Sequence
  chemically synthesized
cagaaagtttcagaaatccaag

SEQ ID NO: 24470 - DNA, 22 bp, Artificial Sequence
  chemically synthesized
agaaagtttcagaaatccaaga

SEQ ID NO: 24471 - DNA, 22 bp, Artificial Sequence
  chemically synthesized
cagaaatccaagacctttgact

SEQ ID NO: 24472 - DNA, 22 bp, Artificial Sequence
  chemically synthesized
agaaatccaagacctttgactg

SEQ ID NO: 24473 - DNA, 22 bp, Artificial Sequence
  chemically synthesized
tgactgcaagtactgtgttctt

SEQ ID NO: 24474 - DNA, 22 bp, Artificial Sequence
  chemically synthesized
gactgcaagtactgtgttcttt

SEQ ID NO: 24475 - DNA, 22 bp, Artificial Sequence
  chemically synthesized
actgcaagtactgtgttctttc

SEQ ID NO: 24476 - DNA, 22 bp, Artificial Sequence
  chemically synthesized
caagtactgtgttctttcatct

SEQ ID NO: 24477 - DNA, 22 bp, Artificial Sequence
  chemically synthesized
tgttctttcatctataggacat

SEQ ID NO: 24478 - DNA, 22 bp, Artificial Sequence
  chemically synthesized
tttcatctataggacatttcct

SEQ ID NO: 24479 - DNA, 22 bp, Artificial Sequence
  chemically synthesized
tcatctataggacatttccttt

SEQ ID NO: 24480 - DNA, 22 bp, Artificial Sequence
  chemically synthesized
catctataggacatttcctttg

SEQ ID NO: 24481 - DNA, 22 bp, Artificial Sequence
  chemically synthesized
atctataggacatttcctttga

SEQ ID NO: 24482 - DNA, 22 bp, Artificial Sequence
  chemically synthesized
taggacatttcctttgaaaact

SEQ ID NO: 24483 - DNA, 22 bp, Artificial Sequence
  chemically synthesized
cctttgaaaactgaggttttaa

SEQ ID NO: 24484 - DNA, 22 bp, Artificial Sequence
  chemically synthesized
ctttgaaaactgaggttttaat

SEQ ID NO: 24485 - DNA, 22 bp, Artificial Sequence
  chemically synthesized
tgaaaactgaggttttaatatt

SEQ ID NO: 24486 - DNA, 22 bp, Artificial Sequence
  chemically synthesized
gaaaactgaggttttaatattt

SEQ ID NO: 24487 - DNA, 22 bp, Artificial Sequence
  chemically synthesized
aaaactgaggttttaatattta

SEQ ID NO: 24488 - DNA, 22 bp, Artificial Sequence
  chemically synthesized
aggttttaatatttaattctta

SEQ ID NO: 24489 - DNA, 22 bp, Artificial Sequence
  chemically synthesized
taatatttaattcttacataat

SEQ ID NO: 24490 - DNA, 22 bp, Artificial Sequence
  chemically synthesized
aatatttaattcttacataata

SEQ ID NO: 24491 - DNA, 22 bp, Artificial Sequence
  chemically synthesized
atatttaattcttacataatag

SEQ ID NO: 24492 - DNA, 22 bp, Artificial Sequence
  chemically synthesized
aattcttacataatagtaaaaa

SEQ ID NO: 24493 - DNA, 22 bp, Artificial Sequence
  chemically synthesized
attcttacataatagtaaaaaa

SEQ ID NO: 24494 - DNA, 22 bp, Artificial Sequence
  chemically synthesized
ttacataatagtaaaaaagtga

SEQ ID NO: 24495 - DNA, 22 bp, Artificial Sequence
  chemically synthesized
acataatagtaaaaaagtgaat

SEQ ID NO: 24496 - DNA, 22 bp, Artificial Sequence
  chemically synthesized
cataatagtaaaaaagtgaatt

SEQ ID NO: 24497 - DNA, 22 bp, Artificial Sequence
  chemically synthesized
gccttggaaaagacctaaatcc

SEQ ID NO: 24498 - DNA, 22 bp, Artificial Sequence
  chemically synthesized
ggaaaagacctaaatcctggtc

SEQ ID NO: 24499 - DNA, 22 bp, Artificial Sequence
  chemically synthesized
gaaaagacctaaatcctggtcc

SEQ ID NO: 24500 - DNA, 22 bp, Artificial Sequence
  chemically synthesized
aatcctggtcctaactctgcca

SEQ ID NO: 24501 - DNA, 22 bp, Artificial Sequence
  chemically synthesized
gtcctaactctgccatttgctt

SEQ ID NO: 24502 - DNA, 22 bp, Artificial Sequence
  chemically synthesized
actctgccatttgcttgatcat

SEQ ID NO: 24503 - DNA, 22 bp, Artificial Sequence
  chemically synthesized
tgccatttgcttgatcattaaa

SEQ ID NO: 24504 - DNA, 22 bp, Artificial Sequence
  chemically synthesized
ccatttgcttgatcattaaata

SEQ ID NO: 24505 - DNA, 22 bp, Artificial Sequence
  chemically synthesized
gcttgatcattaaatacctcta

SEQ ID NO: 24506 - DNA, 22 bp, Artificial Sequence
  chemically synthesized
cttgatcattaaatacctctac

SEQ ID NO: 24507 - DNA, 22 bp, Artificial Sequence
  chemically synthesized
gatcattaaatacctctacgaa

SEQ ID NO: 24508 - DNA, 22 bp, Artificial Sequence
  chemically synthesized
atcattaaatacctctacgaat

SEQ ID NO: 24509 - DNA, 22 bp, Artificial Sequence
  chemically synthesized
aatacctctacgaatcaatttg

SEQ ID NO: 24510 - DNA, 22 bp, Artificial Sequence
  chemically synthesized
tacgaatcaatttgctctatga

SEQ ID NO: 24511 - DNA, 22 bp, Artificial Sequence
  chemically synthesized
cgaatcaatttgctctatgaac

SEQ ID NO: 24512 - DNA, 22 bp, Artificial Sequence
  chemically synthesized
gctctatgaactggaggagtgg

SEQ ID NO: 24513 - DNA, 22 bp, Artificial Sequence
  chemically synthesized
ctctatgaactggaggagtggg

SEQ ID NO: 24514 - DNA, 22 bp, Artificial Sequence
  chemically synthesized
tatgaactggaggagtgggatt

SEQ ID NO: 24515 - DNA, 22 bp, Artificial Sequence
  chemically synthesized
tgaactggaggagtgggattca

SEQ ID NO: 24516 - DNA, 22 bp, Artificial Sequence
  chemically synthesized
gaggagtgggattcatgatctc

SEQ ID NO: 24517 - DNA, 22 bp, Artificial Sequence
  chemically synthesized
atgatctctaagatacctcata

SEQ ID NO: 24518 - DNA, 22 bp, Artificial Sequence
  chemically synthesized
taagatacctcatatcactact

SEQ ID NO: 24519 - DNA, 22 bp, Artificial Sequence
  chemically synthesized
agatacctcatatcactactat

SEQ ID NO: 24520 - DNA, 22 bp, Artificial Sequence
  chemically synthesized
atatcactactatgaaatgcag

SEQ ID NO: 24521 - DNA, 22 bp, Artificial Sequence
  chemically synthesized
ctatgaaatgcagggaagtaaa

SEQ ID NO: 24522 - DNA, 22 bp, Artificial Sequence
  chemically synthesized
tgaaatgcagggaagtaaaaat

SEQ ID NO: 24523 - DNA, 22 bp, Artificial Sequence
  chemically synthesized
aaatcattaaatttaaagaaac

SEQ ID NO: 24524 - DNA, 22 bp, Artificial Sequence
  chemically synthesized
aatttaaagaaactatagtggc

SEQ ID NO: 24525 - DNA, 22 bp, Artificial Sequence
  chemically synthesized
aaagaaactatagtggcaatgt

SEQ ID NO: 24526 - DNA, 22 bp, Artificial Sequence
  chemically synthesized
aagaaactatagtggcaatgta

SEQ ID NO: 24527 - DNA, 22 bp, Artificial Sequence
  chemically synthesized
tagtggcaatgtattattagga

SEQ ID NO: 24528 - DNA, 22 bp, Artificial Sequence
  chemically synthesized
ttaggaataaacacaataatta

SEQ ID NO: 24529 - DNA, 22 bp, Artificial Sequence
  chemically synthesized
ggaataaacacaataattatcc

SEQ ID NO: 24530 - DNA, 22 bp, Artificial Sequence
  chemically synthesized
tccatctatatgaaaatctcaa

SEQ ID NO: 24531 - DNA, 22 bp, Artificial Sequence
  chemically synthesized
tatgaaaatctcaaaccatacc

SEQ ID NO: 24532 - DNA, 22 bp, Artificial Sequence
  chemically synthesized
aaaccataccaggctatgataa

SEQ ID NO: 24533 - DNA, 22 bp, Artificial Sequence
  chemically synthesized
tgataatattaaaataaagata

SEQ ID NO: 24534 - DNA, 22 bp, Artificial Sequence
  chemically synthesized
aaataaagatacattgaagatg

SEQ ID NO: 24535 - DNA, 22 bp, Artificial Sequence
  chemically synthesized
aagatgatatcaacttgtgtaa

SEQ ID NO: 24536 - DNA, 22 bp, Artificial Sequence
  chemically synthesized
gtgtaaatcacattgtggggac

SEQ ID NO: 24537 - DNA, 22 bp, Artificial Sequence
  chemically synthesized
tgtaaatcacattgtggggacc

SEQ ID NO: 24538 - DNA, 22 bp, Artificial Sequence
  chemically synthesized
tggggacctctccacaaaaaca

SEQ ID NO: 24539 - DNA, 22 bp, Artificial Sequence
  chemically synthesized
tccacaaaaacacttcccttcc

SEQ ID NO: 24540 - DNA, 22 bp, Artificial Sequence
  chemically synthesized
cacaaaaacacttcccttcccc

SEQ ID NO: 24541 - DNA, 22 bp, Artificial Sequence
  chemically synthesized
cccttccccttgaaagggaaat

SEQ ID NO: 24542 - DNA, 22 bp, Artificial Sequence
  chemically synthesized
ccttccccttgaaagggaaatg

SEQ ID NO: 24543 - DNA, 22 bp, Artificial Sequence
  chemically synthesized
ccccttgaaagggaaatgatag

SEQ ID NO: 24544 - DNA, 22 bp, Artificial Sequence
  chemically synthesized
cccttgaaagggaaatgataga

SEQ ID NO: 24545 - DNA, 22 bp, Artificial Sequence
  chemically synthesized
gaaagggaaatgatagaaaata

SEQ ID NO: 24546 - DNA, 22 bp, Artificial Sequence
  chemically synthesized
aaagggaaatgatagaaaataa

SEQ ID NO: 24547 - DNA, 22 bp, Artificial Sequence
  chemically synthesized
aaggcagcttaggggttgaaaa

SEQ ID NO: 24548 - DNA, 22 bp, Artificial Sequence
  chemically synthesized
aggggttgaaaaacaaattttt

SEQ ID NO: 24549 - DNA, 22 bp, Artificial Sequence
  chemically synthesized
ggggttgaaaaacaaatttttt

SEQ ID NO: 24550 - DNA, 22 bp, Artificial Sequence
  chemically synthesized
aaaaacaaattttttcaaaaaa

SEQ ID NO: 24551 - DNA, 22 bp, Artificial Sequence
  chemically synthesized
tttcaaaaaaaaatccattgag

SEQ ID NO: 24552 - DNA, 22 bp, Artificial Sequence
  chemically synthesized
ttcaaaaaaaaatccattgagc

SEQ ID NO: 24553 - DNA, 22 bp, Artificial Sequence
  chemically synthesized
tcaaaaaaaaatccattgagca

SEQ ID NO: 24554 - DNA, 22 bp, Artificial Sequence
  chemically synthesized
caaaaaaaaatccattgagcat

SEQ ID NO: 24555 - DNA, 22 bp, Artificial Sequence
  chemically synthesized
aaaaaaaaatccattgagcatt

SEQ ID NO: 24556 - DNA, 22 bp, Artificial Sequence
  chemically synthesized
agcattttctatgtaccaggca

SEQ ID NO: 24557 - DNA, 22 bp, Artificial Sequence
  chemically synthesized
tctatgtaccaggcactgttct

SEQ ID NO: 24558 - DNA, 22 bp, Artificial Sequence
  chemically synthesized
ctatgtaccaggcactgttcta

SEQ ID NO: 24559 - DNA, 22 bp, Artificial Sequence
  chemically synthesized
tatgtaccaggcactgttctag

SEQ ID NO: 24560 - DNA, 22 bp, Artificial Sequence
  chemically synthesized
tgtaccaggcactgttctagac

SEQ ID NO: 24561 - DNA, 22 bp, Artificial Sequence
  chemically synthesized
ttctagaccctgagatcaacac

SEQ ID NO: 24562 - DNA, 22 bp, Artificial Sequence
  chemically synthesized
tagaccctgagatcaacacaca

SEQ ID NO: 24563 - DNA, 22 bp, Artificial Sequence
  chemically synthesized
gaccctgagatcaacacacatg

SEQ ID NO: 24564 - DNA, 22 bp, Artificial Sequence
  chemically synthesized
agatcaacacacatgctactga

SEQ ID NO: 24565 - DNA, 22 bp, Artificial Sequence
  chemically synthesized
ctgattataagatccataaaat

SEQ ID NO: 24566 - DNA, 22 bp, Artificial Sequence
  chemically synthesized
attataagatccataaaataac

SEQ ID NO: 24567 - DNA, 22 bp, Artificial Sequence
  chemically synthesized
taagatccataaaataacttag

SEQ ID NO: 24568 - DNA, 22 bp, Artificial Sequence
  chemically synthesized
agtttcactggcgtgttcccag

SEQ ID NO: 24569 - DNA, 22 bp, Artificial Sequence
  chemically synthesized
gtttcactggcgtgttcccagt

SEQ ID NO: 24570 - DNA, 22 bp, Artificial Sequence
  chemically synthesized
cactggcgtgttcccagtgccc

SEQ ID NO: 24571 - DNA, 22 bp, Artificial Sequence
  chemically synthesized
actggcgtgttcccagtgccca

SEQ ID NO: 24572 - DNA, 22 bp, Artificial Sequence
  chemically synthesized
gcgtgttcccagtgcccaggta

SEQ ID NO: 24573 - DNA, 22 bp, Artificial Sequence
  chemically synthesized
ccagtgcccaggtaacagtgct

SEQ ID NO: 24574 - DNA, 22 bp, Artificial Sequence
  chemically synthesized
cattaatgtttgttaaatgatg

SEQ ID NO: 24575 - DNA, 22 bp, Artificial Sequence
  chemically synthesized
atgtttgttaaatgatgagaaa

SEQ ID NO: 24576 - DNA, 22 bp, Artificial Sequence
  chemically synthesized
gttaaatgatgagaaaagagga

SEQ ID NO: 24577 - DNA, 22 bp, Artificial Sequence
  chemically synthesized
ttaaatgatgagaaaagaggaa

SEQ ID NO: 24578 - DNA, 22 bp, Artificial Sequence
  chemically synthesized
aatgatgagaaaagaggaaagc

SEQ ID NO: 24579 - DNA, 22 bp, Artificial Sequence
  chemically synthesized
tgctcaggtgcaggaacttgtg

SEQ ID NO: 24580 - DNA, 22 bp, Artificial Sequence
  chemically synthesized
ctcaggtgcaggaacttgtgca

SEQ ID NO: 24581 - DNA, 22 bp, Artificial Sequence
  chemically synthesized
aggtgcaggaacttgtgcagag

SEQ ID NO: 24582 - DNA, 22 bp, Artificial Sequence
  chemically synthesized
gtgcagagatcttctggactga

SEQ ID NO: 24583 - DNA, 22 bp, Artificial Sequence
  chemically synthesized
tgcagagatcttctggactgat

SEQ ID NO: 24584 - DNA, 22 bp, Artificial Sequence
  chemically synthesized
ctggactgattcccagtgctaa

SEQ ID NO: 24585 - DNA, 22 bp, Artificial Sequence
  chemically synthesized
tggactgattcccagtgctaac

SEQ ID NO: 24586 - DNA, 22 bp, Artificial Sequence
  chemically synthesized
gactgattcccagtgctaacaa

SEQ ID NO: 24587 - DNA, 22 bp, Artificial Sequence
  chemically synthesized
attcccagtgctaacaagtccc

SEQ ID NO: 24588 - DNA, 22 bp, Artificial Sequence
  chemically synthesized
ccagtgctaacaagtcccttcc

SEQ ID NO: 24589 - DNA, 22 bp, Artificial Sequence
  chemically synthesized
acaagtcccttccagttttatc

SEQ ID NO: 24590 - DNA, 22 bp, Artificial Sequence
  chemically synthesized
ccagttttatccaccaataagc

SEQ ID NO: 24591 - DNA, 22 bp, Artificial Sequence
  chemically synthesized
cagttttatccaccaataagct

SEQ ID NO: 24592 - DNA, 22 bp, Artificial Sequence
  chemically synthesized
tatccaccaataagctatgtcc

SEQ ID NO: 24593 - DNA, 22 bp, Artificial Sequence
  chemically synthesized
atccaccaataagctatgtcct

SEQ ID NO: 24594 - DNA, 22 bp, Artificial Sequence
  chemically synthesized
tccaccaataagctatgtcctt

SEQ ID NO: 24595 - DNA, 22 bp, Artificial Sequence
  chemically synthesized
tgtccttgagctcctgcccact

SEQ ID NO: 24596 - DNA, 22 bp, Artificial Sequence
  chemically synthesized
gagctcctgcccactctctaga

SEQ ID NO: 24597 - DNA, 22 bp, Artificial Sequence
  chemically synthesized
agctcctgcccactctctagag

SEQ ID NO: 24598 - DNA, 22 bp, Artificial Sequence
  chemically synthesized
ctgcccactctctagagaaaac

SEQ ID NO: 24599 - DNA, 22 bp, Artificial Sequence
  chemically synthesized
cccactctctagagaaaacttt

SEQ ID NO: 24600 - DNA, 22 bp, Artificial Sequence
  chemically synthesized
tctagagaaaacttttatttca

SEQ ID NO: 24601 - DNA, 22 bp, Artificial Sequence
  chemically synthesized
tagagaaaacttttatttcaag

SEQ ID NO: 24602 - DNA, 22 bp, Artificial Sequence
  chemically synthesized
gagaaaacttttatttcaaggc

SEQ ID NO: 24603 - DNA, 22 bp, Artificial Sequence
  chemically synthesized
ttatttcaaggcatactccggg

SEQ ID NO: 24604 - DNA, 22 bp, Artificial Sequence
  chemically synthesized
tatttcaaggcatactccggga

SEQ ID NO: 24605 - DNA, 22 bp, Artificial Sequence
  chemically synthesized
atttcaaggcatactccgggat

SEQ ID NO: 24606 - DNA, 22 bp, Artificial Sequence
  chemically synthesized
tttcaaggcatactccgggatt

SEQ ID NO: 24607 - DNA, 22 bp, Artificial Sequence
  chemically synthesized
caaggcatactccgggattcac

SEQ ID NO: 24608 - DNA, 22 bp, Artificial Sequence
  chemically synthesized
aaggcatactccgggattcaca

SEQ ID NO: 24609 - DNA, 22 bp, Artificial Sequence
  chemically synthesized
cgggattcacatgtgatagaga

SEQ ID NO: 24610 - DNA, 22 bp, Artificial Sequence
  chemically synthesized
acatgtgatagagatggttctg

SEQ ID NO: 24611 - DNA, 22 bp, Artificial Sequence
  chemically synthesized
tgttcccaggaactttgggcat

SEQ ID NO: 24612 - DNA, 22 bp, Artificial Sequence
  chemically synthesized
ttcccaggaactttgggcatat

SEQ ID NO: 24613 - DNA, 22 bp, Artificial Sequence
  chemically synthesized
ccaggaactttgggcatattta

SEQ ID NO: 24614 - DNA, 22 bp, Artificial Sequence
  chemically synthesized
tgggcatatttaaaaactggac

SEQ ID NO: 24615 - DNA, 22 bp, Artificial Sequence
  chemically synthesized
gggcatatttaaaaactggact

SEQ ID NO: 24616 - DNA, 22 bp, Artificial Sequence
  chemically synthesized
ggcatatttaaaaactggactg

SEQ ID NO: 24617 - DNA, 22 bp, Artificial Sequence
  chemically synthesized
aaaaactggactggaaaaattt

SEQ ID NO: 24618 - DNA, 22 bp, Artificial Sequence
  chemically synthesized
aaaactggactggaaaaatttg

SEQ ID NO: 24619 - DNA, 22 bp, Artificial Sequence
  chemically synthesized
gactggaaaaatttgtgactag

SEQ ID NO: 24620 - DNA, 22 bp, Artificial Sequence
  chemically synthesized
gaaaaatttgtgactagaaaaa

SEQ ID NO: 24621 - DNA, 22 bp, Artificial Sequence
  chemically synthesized
gtgactagaaaaaggacattaa

SEQ ID NO: 24622 - DNA, 22 bp, Artificial Sequence
  chemically synthesized
tgactagaaaaaggacattaaa

SEQ ID NO: 24623 - DNA, 22 bp, Artificial Sequence
  chemically synthesized
gaaaaaggacattaaaaacaca

SEQ ID NO: 24624 - DNA, 22 bp, Artificial Sequence
  chemically synthesized
aaaacacatgctcatttcagga

SEQ ID NO: 24625 - DNA, 22 bp, Artificial Sequence
  chemically synthesized
atttcaggataaagatctctga

SEQ ID NO: 24626 - DNA, 22 bp, Artificial Sequence
  chemically synthesized
caggataaagatctctgaggaa

SEQ ID NO: 24627 - DNA, 22 bp, Artificial Sequence
  chemically synthesized
aggataaagatctctgaggaaa

SEQ ID NO: 24628 - DNA, 22 bp, Artificial Sequence
  chemically synthesized
tgaggaaaagaatacaaaataa

SEQ ID NO: 24629 - DNA, 22 bp, Artificial Sequence
  chemically synthesized
aggaaaagaatacaaaataatt

SEQ ID NO: 24630 - DNA, 22 bp, Artificial Sequence
  chemically synthesized
aaaaagaaacaacagaaacagg

SEQ ID NO: 24631 - DNA, 22 bp, Artificial Sequence
  chemically synthesized
aaaagaaacaacagaaacaggt

SEQ ID NO: 24632 - DNA, 22 bp, Artificial Sequence
  chemically synthesized
cacttctctgtaataaggtttc

SEQ ID NO: 24633 - DNA, 22 bp, Artificial Sequence
  chemically synthesized
acttctctgtaataaggtttct

SEQ ID NO: 24634 - DNA, 22 bp, Artificial Sequence
  chemically synthesized
ctctgtaataaggtttctgtcc

SEQ ID NO: 24635 - DNA, 22 bp, Artificial Sequence
  chemically synthesized
tctgtaataaggtttctgtcct

SEQ ID NO: 24636 - DNA, 22 bp, Artificial Sequence
  chemically synthesized
tgtaataaggtttctgtcctcc

SEQ ID NO: 24637 - DNA, 22 bp, Artificial Sequence
  chemically synthesized
taataaggtttctgtcctccta

SEQ ID NO: 24638 - DNA, 22 bp, Artificial Sequence
  chemically synthesized
ctgtcctcctagattctttctc

SEQ ID NO: 24639 - DNA, 22 bp, Artificial Sequence
  chemically synthesized
tgtcctcctagattctttctca

SEQ ID NO: 24640 - DNA, 22 bp, Artificial Sequence
  chemically synthesized
tcctcctagattctttctcact

SEQ ID NO: 24641 - DNA, 22 bp, Artificial Sequence
  chemically synthesized
ctagattctttctcactaaact

SEQ ID NO: 24642 - DNA, 22 bp, Artificial Sequence
  chemically synthesized
gattctttctcactaaactaca

SEQ ID NO: 24643 - DNA, 22 bp, Artificial Sequence
  chemically synthesized
tttctcactaaactacagagaa

SEQ ID NO: 24644 - DNA, 22 bp, Artificial Sequence
  chemically synthesized
tctcactaaactacagagaata

SEQ ID NO: 24645 - DNA, 22 bp, Artificial Sequence
  chemically synthesized
ctcactaaactacagagaataa

SEQ ID NO: 24646 - DNA, 22 bp, Artificial Sequence
  chemically synthesized
tcactaaactacagagaataag

SEQ ID NO: 24647 - DNA, 22 bp, Artificial Sequence
  chemically synthesized
actaaactacagagaataagac

SEQ ID NO: 24648 - DNA, 22 bp, Artificial Sequence
  chemically synthesized
aactacagagaataagaccgtg

SEQ ID NO: 24649 - DNA, 22 bp, Artificial Sequence
  chemically synthesized
cagagaataagaccgtgctttg

SEQ ID NO: 24650 - DNA, 22 bp, Artificial Sequence
  chemically synthesized
tgttctcttatatgcattctgt

SEQ ID NO: 24651 - DNA, 22 bp, Artificial Sequence
  chemically synthesized
gttctcttatatgcattctgtc

SEQ ID NO: 24652 - DNA, 22 bp, Artificial Sequence
  chemically synthesized
ttctcttatatgcattctgtcc

SEQ ID NO: 24653 - DNA, 22 bp, Artificial Sequence
  chemically synthesized
tcttatatgcattctgtccact

SEQ ID NO: 24654 - DNA, 22 bp, Artificial Sequence
  chemically synthesized
ttatatgcattctgtccacttc

SEQ ID NO: 24655 - DNA, 22 bp, Artificial Sequence
  chemically synthesized
atatgcattctgtccacttcta

SEQ ID NO: 24656 - DNA, 22 bp, Artificial Sequence
  chemically synthesized
tatgcattctgtccacttctac

SEQ ID NO: 24657 - DNA, 22 bp, Artificial Sequence
  chemically synthesized
tgtccacttctacataggcaaa

SEQ ID NO: 24658 - DNA, 22 bp, Artificial Sequence
  chemically synthesized
tccacttctacataggcaaaat

SEQ ID NO: 24659 - DNA, 22 bp, Artificial Sequence
  chemically synthesized
ctacataggcaaaattgacttt

SEQ ID NO: 24660 - DNA, 22 bp, Artificial Sequence
  chemically synthesized
tacataggcaaaattgactttt

SEQ ID NO: 24661 - DNA, 22 bp, Artificial Sequence
  chemically synthesized
cataggcaaaattgacttttaa

SEQ ID NO: 24662 - DNA, 22 bp, Artificial Sequence
  chemically synthesized
acttttaattttgattttatga

SEQ ID NO: 24663 - DNA, 22 bp, Artificial Sequence
  chemically synthesized
ttaattttgattttatgaatgc

SEQ ID NO: 24664 - DNA, 22 bp, Artificial Sequence
  chemically synthesized
taattttgattttatgaatgca

SEQ ID NO: 24665 - DNA, 22 bp, Artificial Sequence
  chemically synthesized
aattttgattttatgaatgcat

SEQ ID NO: 24666 - DNA, 22 bp, Artificial Sequence
  chemically synthesized
attttgattttatgaatgcata

SEQ ID NO: 24667 - DNA, 22 bp, Artificial Sequence
  chemically synthesized
tgattttatgaatgcatacaca

SEQ ID NO: 24668 - DNA, 22 bp, Artificial Sequence
  chemically synthesized
gattttatgaatgcatacacac

SEQ ID NO: 24669 - DNA, 22 bp, Artificial Sequence
  chemically synthesized
attttatgaatgcatacacacg

SEQ ID NO: 24670 - DNA, 22 bp, Artificial Sequence
  chemically synthesized
tatgaatgcatacacacgagaa

SEQ ID NO: 24671 - DNA, 22 bp, Artificial Sequence
  chemically synthesized
atgaatgcatacacacgagaac

SEQ ID NO: 24672 - DNA, 22 bp, Artificial Sequence
  chemically synthesized
tgaatgcatacacacgagaact

SEQ ID NO: 24673 - DNA, 22 bp, Artificial Sequence
  chemically synthesized
tgaacagttagtataaggtgaa

SEQ ID NO: 24674 - DNA, 22 bp, Artificial Sequence
  chemically synthesized
gaacagttagtataaggtgaat

SEQ ID NO: 24675 - DNA, 22 bp, Artificial Sequence
  chemically synthesized
aacagttagtataaggtgaatt

SEQ ID NO: 24676 - DNA, 22 bp, Artificial Sequence
  chemically synthesized
gtataaggtgaattctgatttt

SEQ ID NO: 24677 - DNA, 22 bp, Artificial Sequence
  chemically synthesized
tgatttttcagaatgcatgcca

SEQ ID NO: 24678 - DNA, 22 bp, Artificial Sequence
  chemically synthesized
atttttcagaatgcatgccata

SEQ ID NO: 24679 - DNA, 22 bp, Artificial Sequence
  chemically synthesized
ttcagaatgcatgccatatata

SEQ ID NO: 24680 - DNA, 22 bp, Artificial Sequence
  chemically synthesized
tcagaatgcatgccatatataa

SEQ ID NO: 24681 - DNA, 22 bp, Artificial Sequence
  chemically synthesized
cagaatgcatgccatatataat

SEQ ID NO: 24682 - DNA, 22 bp, Artificial Sequence
  chemically synthesized
agaatgcatgccatatataatg

SEQ ID NO: 24683 - DNA, 22 bp, Artificial Sequence
  chemically synthesized
aattttgagattatgctggctc

SEQ ID NO: 24684 - DNA, 22 bp, Artificial Sequence
  chemically synthesized
attttgagattatgctggctct

SEQ ID NO: 24685 - DNA, 22 bp, Artificial Sequence
  chemically synthesized
tgagattatgctggctctgatt

SEQ ID NO: 24686 - DNA, 22 bp, Artificial Sequence
  chemically synthesized
gagattatgctggctctgatta

SEQ ID NO: 24687 - DNA, 22 bp, Artificial Sequence
  chemically synthesized
agattatgctggctctgattag

SEQ ID NO: 24688 - DNA, 22 bp, Artificial Sequence
  chemically synthesized
tgctggctctgattagccaaaa

SEQ ID NO: 24689 - DNA, 22 bp, Artificial Sequence
  chemically synthesized
gctctgattagccaaaagaagg

SEQ ID NO: 24690 - DNA, 22 bp, Artificial Sequence
  chemically synthesized
tgattagccaaaagaaggaagt

SEQ ID NO: 24691 - DNA, 22 bp, Artificial Sequence
  chemically synthesized
attagccaaaagaaggaagtaa

SEQ ID NO: 24692 - DNA, 22 bp, Artificial Sequence
  chemically synthesized
gccaaaagaaggaagtaatata

SEQ ID NO: 24693 - DNA, 22 bp, Artificial Sequence
  chemically synthesized
tggttattatttcagatccttt

SEQ ID NO: 24694 - DNA, 22 bp, Artificial Sequence
  chemically synthesized
gttattatttcagatcctttag

SEQ ID NO: 24695 - DNA, 22 bp, Artificial Sequence
  chemically synthesized
ttatttcagatcctttagatta

SEQ ID NO: 24696 - DNA, 22 bp, Artificial Sequence
  chemically synthesized
tttcagatcctttagattactg

SEQ ID NO: 24697 - DNA, 22 bp, Artificial Sequence
  chemically synthesized
cagatcctttagattactgtaa

SEQ ID NO: 24698 - DNA, 22 bp, Artificial Sequence
  chemically synthesized
agatcctttagattactgtaat

SEQ ID NO: 24699 - DNA, 22 bp, Artificial Sequence
  chemically synthesized
tagattactgtaatagacatga

SEQ ID NO: 24700 - DNA, 22 bp, Artificial Sequence
  chemically synthesized
agattactgtaatagacatgaa

SEQ ID NO: 24701 - DNA, 22 bp, Artificial Sequence
  chemically synthesized
gattactgtaatagacatgaaa

SEQ ID NO: 24702 - DNA, 22 bp, Artificial Sequence
  chemically synthesized
ctgtaatagacatgaaatagta

SEQ ID NO: 24703 - DNA, 22 bp, Artificial Sequence
  chemically synthesized
taatagacatgaaatagtaaac

SEQ ID NO: 24704 - DNA, 22 bp, Artificial Sequence
  chemically synthesized
tatatcacaacacatgacataa

SEQ ID NO: 24705 - DNA, 22 bp, Artificial Sequence
  chemically synthesized
cagatcgtttaaatcacacaag

SEQ ID NO: 24706 - DNA, 22 bp, Artificial Sequence
  chemically synthesized
agatcgtttaaatcacacaagt

SEQ ID NO: 24707 - DNA, 22 bp, Artificial Sequence
  chemically synthesized
aaatcacacaagtcatcactgc

SEQ ID NO: 24708 - DNA, 22 bp, Artificial Sequence
  chemically synthesized
aatcacacaagtcatcactgcc

SEQ ID NO: 24709 - DNA, 22 bp, Artificial Sequence
  chemically synthesized
ccatttacccagcaatcagttg

SEQ ID NO: 24710 - DNA, 22 bp, Artificial Sequence
  chemically synthesized
acccagcaatcagttggcttga

SEQ ID NO: 24711 - DNA, 22 bp, Artificial Sequence
  chemically synthesized
cccagcaatcagttggcttgat

SEQ ID NO: 24712 - DNA, 22 bp, Artificial Sequence
  chemically synthesized
gcttgattcttcaagatcttga

SEQ ID NO: 24713 - DNA, 22 bp, Artificial Sequence
  chemically synthesized
gattcttcaagatcttgaggaa

SEQ ID NO: 24714 - DNA, 22 bp, Artificial Sequence
  chemically synthesized
attcttcaagatcttgaggaac

SEQ ID NO: 24715 - DNA, 22 bp, Artificial Sequence
  chemically synthesized
ttcaagatcttgaggaactcag

SEQ ID NO: 24716 - DNA, 22 bp, Artificial Sequence
  chemically synthesized
caagatcttgaggaactcagcc

SEQ ID NO: 24717 - DNA, 22 bp, Artificial Sequence
  chemically synthesized
aagatcttgaggaactcagcct

SEQ ID NO: 24718 - DNA, 22 bp, Artificial Sequence
  chemically synthesized
gaggaactcagccttcaaaacc

SEQ ID NO: 24719 - DNA, 22 bp, Artificial Sequence
  chemically synthesized
aggaactcagccttcaaaacca

SEQ ID NO: 24720 - DNA, 22 bp, Artificial Sequence
  chemically synthesized
agccttcaaaaccatgactttt

SEQ ID NO: 24721 - DNA, 22 bp, Artificial Sequence
  chemically synthesized
caaaaccatgactttttctttg

SEQ ID NO: 24722 - DNA, 22 bp, Artificial Sequence
  chemically synthesized
aaaaccatgactttttctttgc

SEQ ID NO: 24723 - DNA, 22 bp, Artificial Sequence
  chemically synthesized
tttctttgctaatgttccttca

SEQ ID NO: 24724 - DNA, 22 bp, Artificial Sequence
  chemically synthesized
ttctttgctaatgttccttcaa

SEQ ID NO: 24725 - DNA, 22 bp, Artificial Sequence
  chemically synthesized
tctttgctaatgttccttcaat

SEQ ID NO: 24726 - DNA, 22 bp, Artificial Sequence
  chemically synthesized
ctttgctaatgttccttcaata

SEQ ID NO: 24727 - DNA, 22 bp, Artificial Sequence
  chemically synthesized
tttgctaatgttccttcaatag

SEQ ID NO: 24728 - DNA, 22 bp, Artificial Sequence
  chemically synthesized
tgctaatgttccttcaatagtc

SEQ ID NO: 24729 - DNA, 22 bp, Artificial Sequence
  chemically synthesized
gctaatgttccttcaatagtct

SEQ ID NO: 24730 - DNA, 22 bp, Artificial Sequence
  chemically synthesized
ctaatgttccttcaatagtctt

SEQ ID NO: 24731 - DNA, 22 bp, Artificial Sequence
  chemically synthesized
atgttccttcaatagtcttgac

SEQ ID NO: 24732 - DNA, 22 bp, Artificial Sequence
  chemically synthesized
cttcaatagtcttgacactttt

SEQ ID NO: 24733 - DNA, 22 bp, Artificial Sequence
  chemically synthesized
caatagtcttgacacttttaaa

SEQ ID NO: 24734 - DNA, 22 bp, Artificial Sequence
  chemically synthesized
aatagtcttgacacttttaaac

SEQ ID NO: 24735 - DNA, 22 bp, Artificial Sequence
  chemically synthesized
gacacttttaaactagagagta

SEQ ID NO: 24736 - DNA, 22 bp, Artificial Sequence
  chemically synthesized
acacttttaaactagagagtat

SEQ ID NO: 24737 - DNA, 22 bp, Artificial Sequence
  chemically synthesized
ttaaactagagagtataaaccc

SEQ ID NO: 24738 - DNA, 22 bp, Artificial Sequence
  chemically synthesized
taaactagagagtataaaccca

SEQ ID NO: 24739 - DNA, 22 bp, Artificial Sequence
  chemically synthesized
aaactagagagtataaacccac

SEQ ID NO: 24740 - DNA, 22 bp, Artificial Sequence
  chemically synthesized
aactagagagtataaacccaca

SEQ ID NO: 24741 - DNA, 22 bp, Artificial Sequence
  chemically synthesized
gagagtataaacccacaaggaa

SEQ ID NO: 24742 - DNA, 22 bp, Artificial Sequence
  chemically synthesized
ttttataattttacagatgtct

SEQ ID NO: 24743 - DNA, 22 bp, Artificial Sequence
  chemically synthesized
tataattttacagatgtcttta

SEQ ID NO: 24744 - DNA, 22 bp, Artificial Sequence
  chemically synthesized
ataattttacagatgtctttat

SEQ ID NO: 24745 - DNA, 22 bp, Artificial Sequence
  chemically synthesized
taattttacagatgtctttatt

SEQ ID NO: 24746 - DNA, 22 bp, Artificial Sequence
  chemically synthesized
tacagatgtctttattttcaaa

SEQ ID NO: 24747 - DNA, 22 bp, Artificial Sequence
  chemically synthesized
acagatgtctttattttcaaaa

SEQ ID NO: 24748 - DNA, 22 bp, Artificial Sequence
  chemically synthesized
cagatgtctttattttcaaaat

SEQ ID NO: 24749 - DNA, 22 bp, Artificial Sequence
  chemically synthesized
tattttcaaaatcatttacatt

SEQ ID NO: 24750 - DNA, 22 bp, Artificial Sequence
  chemically synthesized
attttcaaaatcatttacattg

SEQ ID NO: 24751 - DNA, 22 bp, Artificial Sequence
  chemically synthesized
ttttcaaaatcatttacattgt

SEQ ID NO: 24752 - DNA, 22 bp, Artificial Sequence
  chemically synthesized
tcaaaatcatttacattgtggt

SEQ ID NO: 24753 - DNA, 22 bp, Artificial Sequence
  chemically synthesized
caaaatcatttacattgtggtt

SEQ ID NO: 24754 - DNA, 22 bp, Artificial Sequence
  chemically synthesized
aaaatcatttacattgtggttc

SEQ ID NO: 24755 - DNA, 22 bp, Artificial Sequence
  chemically synthesized
acattgtggttctctaccttgc

SEQ ID NO: 24756 - DNA, 22 bp, Artificial Sequence
  chemically synthesized
cattgtggttctctaccttgcc

SEQ ID NO: 24757 - DNA, 22 bp, Artificial Sequence
  chemically synthesized
tggttctctaccttgccttctc

SEQ ID NO: 24758 - DNA, 22 bp, Artificial Sequence
  chemically synthesized
tctaccttgccttctcttaccc

SEQ ID NO: 24759 - DNA, 22 bp, Artificial Sequence
  chemically synthesized
taccttgccttctcttacccag

SEQ ID NO: 24760 - DNA, 22 bp, Artificial Sequence
  chemically synthesized
ccttgccttctcttacccagca

SEQ ID NO: 24761 - DNA, 22 bp, Artificial Sequence
  chemically synthesized
gccttctcttacccagcacaga

SEQ ID NO: 24762 - DNA, 22 bp, Artificial Sequence
  chemically synthesized
ccttctcttacccagcacagat

SEQ ID NO: 24763 - DNA, 22 bp, Artificial Sequence
  chemically synthesized
ctcttacccagcacagatgagg

SEQ ID NO: 24764 - DNA, 22 bp, Artificial Sequence
  chemically synthesized
tcttacccagcacagatgaggt

SEQ ID NO: 24765 - DNA, 22 bp, Artificial Sequence
  chemically synthesized
ttacccagcacagatgaggtta

SEQ ID NO: 24766 - DNA, 22 bp, Artificial Sequence
  chemically synthesized
acccagcacagatgaggttata

SEQ ID NO: 24767 - DNA, 22 bp, Artificial Sequence
  chemically synthesized
cccagcacagatgaggttatac

SEQ ID NO: 24768 - DNA, 22 bp, Artificial Sequence
  chemically synthesized
tacctcactcgcaaattgtttt

SEQ ID NO: 24769 - DNA, 22 bp, Artificial Sequence
  chemically synthesized
actcgcaaattgttttatcaat

SEQ ID NO: 24770 - DNA, 22 bp, Artificial Sequence
  chemically synthesized
gcaaattgttttatcaatttga

SEQ ID NO: 24771 - DNA, 22 bp, Artificial Sequence
  chemically synthesized
ttttatcaatttgattttcttt

SEQ ID NO: 24772 - DNA, 22 bp, Artificial Sequence
  chemically synthesized
tatcaatttgattttctttatt

SEQ ID NO: 24773 - DNA, 22 bp, Artificial Sequence
  chemically synthesized
atcaatttgattttctttattt

SEQ ID NO: 24774 - DNA, 22 bp, Artificial Sequence
  chemically synthesized
tcaatttgattttctttatttt

SEQ ID NO: 24775 - DNA, 22 bp, Artificial Sequence
  chemically synthesized
gattttctttattttataattc

SEQ ID NO: 24776 - DNA, 22 bp, Artificial Sequence
  chemically synthesized
attttctttattttataattcc

SEQ ID NO: 24777 - DNA, 22 bp, Artificial Sequence
  chemically synthesized
tctttattttataattcctaca

SEQ ID NO: 24778 - DNA, 22 bp, Artificial Sequence
  chemically synthesized
ctttattttataattcctacat

SEQ ID NO: 24779 - DNA, 22 bp, Artificial Sequence
  chemically synthesized
tttattttataattcctacata

SEQ ID NO: 24780 - DNA, 22 bp, Artificial Sequence
  chemically synthesized
tattttataattcctacataag

SEQ ID NO: 24781 - DNA, 22 bp, Artificial Sequence
  chemically synthesized
attttataattcctacataagc

SEQ ID NO: 24782 - DNA, 22 bp, Artificial Sequence
  chemically synthesized
ttttataattcctacataagca

SEQ ID NO: 24783 - DNA, 22 bp, Artificial Sequence
  chemically synthesized
tataattcctacataagcatag

SEQ ID NO: 24784 - DNA, 22 bp, Artificial Sequence
  chemically synthesized
ataattcctacataagcatagc

SEQ ID NO: 24785 - DNA, 22 bp, Artificial Sequence
  chemically synthesized
taattcctacataagcatagca

SEQ ID NO: 24786 - DNA, 22 bp, Artificial Sequence
  chemically synthesized
ctacataagcatagcattgaag

SEQ ID NO: 24787 - DNA, 22 bp, Artificial Sequence
  chemically synthesized
cataagcatagcattgaagaaa

SEQ ID NO: 24788 - DNA, 22 bp, Artificial Sequence
  chemically synthesized
aagaaaaaaattactttcattc

SEQ ID NO: 24789 - DNA, 22 bp, Artificial Sequence
  chemically synthesized
ctttcattctgaaaggagcaca

SEQ ID NO: 24790 - DNA, 22 bp, Artificial Sequence
  chemically synthesized
tcattctgaaaggagcacagta

SEQ ID NO: 24791 - DNA, 22 bp, Artificial Sequence
  chemically synthesized
cattctgaaaggagcacagtat

SEQ ID NO: 24792 - DNA, 22 bp, Artificial Sequence
  chemically synthesized
attctgaaaggagcacagtatt

SEQ ID NO: 24793 - DNA, 22 bp, Artificial Sequence
  chemically synthesized
tgaaaggagcacagtattttgc

SEQ ID NO: 24794 - DNA, 22 bp, Artificial Sequence
  chemically synthesized
aaaggagcacagtattttgcct

SEQ ID NO: 24795 - DNA, 22 bp, Artificial Sequence
  chemically synthesized
tgccttttgagaagctcctgaa

SEQ ID NO: 24796 - DNA, 22 bp, Artificial Sequence
  chemically synthesized
gccttttgagaagctcctgaat

SEQ ID NO: 24797 - DNA, 22 bp, Artificial Sequence
  chemically synthesized
ccttttgagaagctcctgaatt

SEQ ID NO: 24798 - DNA, 22 bp, Artificial Sequence
  chemically synthesized
ttgagaagctcctgaattaaaa

SEQ ID NO: 24799 - DNA, 22 bp, Artificial Sequence
  chemically synthesized
tgagaagctcctgaattaaaac

SEQ ID NO: 24800 - DNA, 22 bp, Artificial Sequence
  chemically synthesized
gagaagctcctgaattaaaaca

SEQ ID NO: 24801 - DNA, 22 bp, Artificial Sequence
  chemically synthesized
agaagctcctgaattaaaacat

SEQ ID NO: 24802 - DNA, 22 bp, Artificial Sequence
  chemically synthesized
ctgaattaaaacattaattcca

SEQ ID NO: 24803 - DNA, 22 bp, Artificial Sequence
  chemically synthesized
aattaaaacattaattccaagc

SEQ ID NO: 24804 - DNA, 22 bp, Artificial Sequence
  chemically synthesized
aaacattaattccaagctaatt

SEQ ID NO: 24805 - DNA, 22 bp, Artificial Sequence
  chemically synthesized
attccaagctaattgtgaatat

SEQ ID NO: 24806 - DNA, 22 bp, Artificial Sequence
  chemically synthesized
caagctaattgtgaatatgaaa

SEQ ID NO: 24807 - DNA, 22 bp, Artificial Sequence
  chemically synthesized
attgtgaatatgaaacattctt

SEQ ID NO: 24808 - DNA, 22 bp, Artificial Sequence
  chemically synthesized
tgaatatgaaacattcttaagc

SEQ ID NO: 24809 - DNA, 22 bp, Artificial Sequence
  chemically synthesized
ttaagcatttcatataattact

SEQ ID NO: 24810 - DNA, 22 bp, Artificial Sequence
  chemically synthesized
aagcatttcatataattactaa

SEQ ID NO: 24811 - DNA, 22 bp, Artificial Sequence
  chemically synthesized
agcatttcatataattactaac

SEQ ID NO: 24812 - DNA, 22 bp, Artificial Sequence
  chemically synthesized
catataattactaacagaatgt

SEQ ID NO: 24813 - DNA, 22 bp, Artificial Sequence
  chemically synthesized
atataattactaacagaatgta

SEQ ID NO: 24814 - DNA, 22 bp, Artificial Sequence
  chemically synthesized
ctaacagaatgtagagttgagg

SEQ ID NO: 24815 - DNA, 22 bp, Artificial Sequence
  chemically synthesized
acagaatgtagagttgaggttt

SEQ ID NO: 24816 - DNA, 22 bp, Artificial Sequence
  chemically synthesized
aggtttccaactggttctaatc

SEQ ID NO: 24817 - DNA, 22 bp, Artificial Sequence
  chemically synthesized
ccaactggttctaatcacatat

SEQ ID NO: 24818 - DNA, 22 bp, Artificial Sequence
  chemically synthesized
caactggttctaatcacatata

SEQ ID NO: 24819 - DNA, 22 bp, Artificial Sequence
  chemically synthesized
gttctaatcacatatacatctt

SEQ ID NO: 24820 - DNA, 22 bp, Artificial Sequence
  chemically synthesized
taatcacatatacatcttccta

SEQ ID NO: 24821 - DNA, 22 bp, Artificial Sequence
  chemically synthesized
atcacatatacatcttcctaaa

SEQ ID NO: 24822 - DNA, 22 bp, Artificial Sequence
  chemically synthesized
cctaaaataaaatgtttaatta

SEQ ID NO: 24823 - DNA, 22 bp, Artificial Sequence
  chemically synthesized
ctaaaataaaatgtttaattat

SEQ ID NO: 24824 - DNA, 22 bp, Artificial Sequence
  chemically synthesized
aaataaaatgtttaattatact

SEQ ID NO: 24825 - DNA, 22 bp, Artificial Sequence
  chemically synthesized
aattatactattttgctgagaa

SEQ ID NO: 24826 - DNA, 22 bp, Artificial Sequence
  chemically synthesized
attatactattttgctgagaaa

SEQ ID NO: 24827 - DNA, 22 bp, Artificial Sequence
  chemically synthesized
tactattttgctgagaaaaatt

SEQ ID NO: 24828 - DNA, 22 bp, Artificial Sequence
  chemically synthesized
ttttgctgagaaaaattttaaa

SEQ ID NO: 24829 - DNA, 22 bp, Artificial Sequence
  chemically synthesized
tgctgagaaaaattttaaaaca

SEQ ID NO: 24830 - DNA, 22 bp, Artificial Sequence
  chemically synthesized
gctgagaaaaattttaaaacaa

SEQ ID NO: 24831 - DNA, 22 bp, Artificial Sequence
  chemically synthesized
ctgagaaaaattttaaaacaaa

SEQ ID NO: 24832 - DNA, 22 bp, Artificial Sequence
  chemically synthesized
agaaaaattttaaaacaaaaaa

SEQ ID NO: 24833 - DNA, 22 bp, Artificial Sequence
  chemically synthesized
taaaacaaaaaatgtaaatatt

SEQ ID NO: 24834 - DNA, 22 bp, Artificial Sequence
  chemically synthesized
aaaacaaaaaatgtaaatatta

SEQ ID NO: 24835 - DNA, 22 bp, Artificial Sequence
  chemically synthesized
aaacaaaaaatgtaaatattaa

SEQ ID NO: 24836 - DNA, 22 bp, Artificial Sequence
  chemically synthesized
actttttatttctatgttgtca

SEQ ID NO: 24837 - DNA, 22 bp, Artificial Sequence
  chemically synthesized
tttatttctatgttgtcataat

SEQ ID NO: 24838 - DNA, 22 bp, Artificial Sequence
  chemically synthesized
ttatttctatgttgtcataata

SEQ ID NO: 24839 - DNA, 22 bp, Artificial Sequence
  chemically synthesized
tatttctatgttgtcataatat

SEQ ID NO: 24840 - DNA, 22 bp, Artificial Sequence
  chemically synthesized
atttctatgttgtcataatatg

SEQ ID NO: 24841 - DNA, 22 bp, Artificial Sequence
  chemically synthesized
tttctatgttgtcataatatgg

SEQ ID NO: 24842 - DNA, 22 bp, Artificial Sequence
  chemically synthesized
ctatgttgtcataatatggatt

SEQ ID NO: 24843 - DNA, 22 bp, Artificial Sequence
  chemically synthesized
tatgttgtcataatatggattt

SEQ ID NO: 24844 - DNA, 22 bp, Artificial Sequence
  chemically synthesized
tgttgtcataatatggatttta

SEQ ID NO: 24845 - DNA, 22 bp, Artificial Sequence
  chemically synthesized
tcataatatggattttaaattt

SEQ ID NO: 24846 - DNA, 22 bp, Artificial Sequence
  chemically synthesized
taaattttaatttaaatgcaca

SEQ ID NO: 24847 - DNA, 22 bp, Artificial Sequence
  chemically synthesized
aaattttaatttaaatgcacat

SEQ ID NO: 24848 - DNA, 22 bp, Artificial Sequence
  chemically synthesized
aattttaatttaaatgcacatt

SEQ ID NO: 24849 - DNA, 22 bp, Artificial Sequence
  chemically synthesized
taatttaaatgcacattccatg

SEQ ID NO: 24850 - DNA, 22 bp, Artificial Sequence
  chemically synthesized
aatttaaatgcacattccatgg

SEQ ID NO: 24851 - DNA, 22 bp, Artificial Sequence
  chemically synthesized
atttaaatgcacattccatggc

SEQ ID NO: 24852 - DNA, 22 bp, Artificial Sequence
  chemically synthesized
aaatgcacattccatggcaatg

SEQ ID NO: 24853 - DNA, 22 bp, Artificial Sequence
  chemically synthesized
aatgcacattccatggcaatgg

SEQ ID NO: 24854 - DNA, 22 bp, Artificial Sequence
  chemically synthesized
catggcaatggctaatattttc

SEQ ID NO: 24855 - DNA, 22 bp, Artificial Sequence
  chemically synthesized
atattttcaactttctccctct

SEQ ID NO: 24856 - DNA, 22 bp, Artificial Sequence
  chemically synthesized
tcaactttctccctcttcaaca

SEQ ID NO: 24857 - DNA, 22 bp, Artificial Sequence
  chemically synthesized
caactttctccctcttcaacac

SEQ ID NO: 24858 - DNA, 22 bp, Artificial Sequence
  chemically synthesized
aactttctccctcttcaacaca

SEQ ID NO: 24859 - DNA, 22 bp, Artificial Sequence
  chemically synthesized
tctccctcttcaacacatacac

SEQ ID NO: 24860 - DNA, 22 bp, Artificial Sequence
  chemically synthesized
ctccctcttcaacacatacaca

SEQ ID NO: 24861 - DNA, 22 bp, Artificial Sequence
  chemically synthesized
tccctcttcaacacatacacaa

SEQ ID NO: 24862 - DNA, 22 bp, Artificial Sequence
  chemically synthesized
cctcttcaacacatacacaagt

SEQ ID NO: 24863 - DNA, 22 bp, Artificial Sequence
  chemically synthesized
ttcaacacatacacaagtctgt

SEQ ID NO: 24864 - DNA, 22 bp, Artificial Sequence
  chemically synthesized
caacacatacacaagtctgtat

SEQ ID NO: 24865 - DNA, 22 bp, Artificial Sequence
  chemically synthesized
aacacatacacaagtctgtatt

SEQ ID NO: 24866 - DNA, 22 bp, Artificial Sequence
  chemically synthesized
tattcatagcctgttgtaatag

SEQ ID NO: 24867 - DNA, 22 bp, Artificial Sequence
  chemically synthesized
atagcctgttgtaatagacaag

SEQ ID NO: 24868 - DNA, 22 bp, Artificial Sequence
  chemically synthesized
ttgtaatagacaaggttaaatg

SEQ ID NO: 24869 - DNA, 22 bp, Artificial Sequence
  chemically synthesized
taatagacaaggttaaatgtag

SEQ ID NO: 24870 - DNA, 22 bp, Artificial Sequence
  chemically synthesized
aatgtagcctaaatatatattc

SEQ ID NO: 24871 - DNA, 22 bp, Artificial Sequence
  chemically synthesized
aatatatattccgtttaaatgc

SEQ ID NO: 24872 - DNA, 22 bp, Artificial Sequence
  chemically synthesized
cgtttaaatgctttcctcactc

SEQ ID NO: 24873 - DNA, 22 bp, Artificial Sequence
  chemically synthesized
aaatgctttcctcactcactag

SEQ ID NO: 24874 - DNA, 22 bp, Artificial Sequence
  chemically synthesized
aatgctttcctcactcactagc

SEQ ID NO: 24875 - DNA, 22 bp, Artificial Sequence
  chemically synthesized
tcctcactcactagcaattggt

SEQ ID NO: 24876 - DNA, 22 bp, Artificial Sequence
  chemically synthesized
cctcactcactagcaattggtt

SEQ ID NO: 24877 - DNA, 22 bp, Artificial Sequence
  chemically synthesized
ctcactcactagcaattggtta

SEQ ID NO: 24878 - DNA, 22 bp, Artificial Sequence
  chemically synthesized
actcactagcaattggttatca

SEQ ID NO: 24879 - DNA, 22 bp, Artificial Sequence
  chemically synthesized
actagcaattggttatcactag

SEQ ID NO: 24880 - DNA, 22 bp, Artificial Sequence
  chemically synthesized
gcaattggttatcactagagag

SEQ ID NO: 24881 - DNA, 22 bp, Artificial Sequence
  chemically synthesized
gttatcactagagagttatctg

SEQ ID NO: 24882 - DNA, 22 bp, Artificial Sequence
  chemically synthesized
tcactagagagttatctgtgaa

SEQ ID NO: 24883 - DNA, 22 bp, Artificial Sequence
  chemically synthesized
gagagttatctgtgaaatctta

SEQ ID NO: 24884 - DNA, 22 bp, Artificial Sequence
  chemically synthesized
tctgtgaaatcttactctacat

SEQ ID NO: 24885 - DNA, 22 bp, Artificial Sequence
  chemically synthesized
tgaaatcttactctacattcct

SEQ ID NO: 24886 - DNA, 22 bp, Artificial Sequence
  chemically synthesized
actctacattcctcagtcacct

SEQ ID NO: 24887 - DNA, 22 bp, Artificial Sequence
  chemically synthesized
ctctacattcctcagtcaccta

SEQ ID NO: 24888 - DNA, 22 bp, Artificial Sequence
  chemically synthesized
tacattcctcagtcacctagtg

SEQ ID NO: 24889 - DNA, 22 bp, Artificial Sequence
  chemically synthesized
cattcctcagtcacctagtgaa

SEQ ID NO: 24890 - DNA, 22 bp, Artificial Sequence
  chemically synthesized
ctcagtcacctagtgaaggtgt

SEQ ID NO: 24891 - DNA, 22 bp, Artificial Sequence
  chemically synthesized
agtcacctagtgaaggtgtact

SEQ ID NO: 24892 - DNA, 22 bp, Artificial Sequence
  chemically synthesized
gtgaaggtgtactgatccacct

SEQ ID NO: 24893 - DNA, 22 bp, Artificial Sequence
  chemically synthesized
atccaccttcaggagcagtaca

SEQ ID NO: 24894 - DNA, 22 bp, Artificial Sequence
  chemically synthesized
caggagcagtacaaacctttat

SEQ ID NO: 24895 - DNA, 22 bp, Artificial Sequence
  chemically synthesized
aggagcagtacaaacctttatt

SEQ ID NO: 24896 - DNA, 22 bp, Artificial Sequence
  chemically synthesized
tattggtcacttcccaagcaac

SEQ ID NO: 24897 - DNA, 22 bp, Artificial Sequence
  chemically synthesized
attggtcacttcccaagcaact

SEQ ID NO: 24898 - DNA, 22 bp, Artificial Sequence
  chemically synthesized
ttggtcacttcccaagcaactt

SEQ ID NO: 24899 - DNA, 22 bp, Artificial Sequence
  chemically synthesized
gtcacttcccaagcaacttcaa

SEQ ID NO: 24900 - DNA, 22 bp, Artificial Sequence
  chemically synthesized
cccaagcaacttcaaagagcag

SEQ ID NO: 24901 - DNA, 22 bp, Artificial Sequence
  chemically synthesized
ccaagcaacttcaaagagcagt

SEQ ID NO: 24902 - DNA, 22 bp, Artificial Sequence
  chemically synthesized
caaagagcagtaactcctccac

SEQ ID NO: 24903 - DNA, 22 bp, Artificial Sequence
  chemically synthesized
aaagagcagtaactcctccaca

SEQ ID NO: 24904 - DNA, 22 bp, Artificial Sequence
  chemically synthesized
ctccacaggaagttcttcgact

SEQ ID NO: 24905 - DNA, 22 bp, Artificial Sequence
  chemically synthesized
cacaggaagttcttcgacttcc

SEQ ID NO: 24906 - DNA, 22 bp, Artificial Sequence
  chemically synthesized
ttcgacttcccactggggaagc

SEQ ID NO: 24907 - DNA, 22 bp, Artificial Sequence
  chemically synthesized
cgacttcccactggggaagccc

SEQ ID NO: 24908 - DNA, 22 bp, Artificial Sequence
  chemically synthesized
gacttcccactggggaagccca

SEQ ID NO: 24909 - DNA, 22 bp, Artificial Sequence
  chemically synthesized
cccactggggaagcccacccag

SEQ ID NO: 24910 - DNA, 22 bp, Artificial Sequence
  chemically synthesized
ccactggggaagcccacccagg

SEQ ID NO: 24911 - DNA, 22 bp, Artificial Sequence
  chemically synthesized
gggaagcccacccagggatgtt

SEQ ID NO: 24912 - DNA, 22 bp, Artificial Sequence
  chemically synthesized
cagagagggatcggcctcgaag

SEQ ID NO: 24913 - DNA, 22 bp, Artificial Sequence
  chemically synthesized
gaagcattcttcttacagtcct

SEQ ID NO: 24914 - DNA, 22 bp, Artificial Sequence
  chemically synthesized
ttcttacagtcctccgagactc

SEQ ID NO: 24915 - DNA, 22 bp, Artificial Sequence
  chemically synthesized
cttacagtcctccgagactcct

SEQ ID NO: 24916 - DNA, 22 bp, Artificial Sequence
  chemically synthesized
ttacagtcctccgagactcctt

SEQ ID NO: 24917 - DNA, 22 bp, Artificial Sequence
  chemically synthesized
acagtcctccgagactcctttg

SEQ ID NO: 24918 - DNA, 22 bp, Artificial Sequence
  chemically synthesized
cagtcctccgagactcctttga

SEQ ID NO: 24919 - DNA, 22 bp, Artificial Sequence
  chemically synthesized
cgagactcctttgaattcctgt

SEQ ID NO: 24920 - DNA, 22 bp, Artificial Sequence
  chemically synthesized
ctttgaattcctgtttcaatta

SEQ ID NO: 24921 - DNA, 22 bp, Artificial Sequence
  chemically synthesized
tgaattcctgtttcaattagtt

SEQ ID NO: 24922 - DNA, 22 bp, Artificial Sequence
  chemically synthesized
gaattcctgtttcaattagttg

SEQ ID NO: 24923 - DNA, 22 bp, Artificial Sequence
  chemically synthesized
aattcctgtttcaattagttgt

SEQ ID NO: 24924 - DNA, 22 bp, Artificial Sequence
  chemically synthesized
ctgtttcaattagttgtaatcc

SEQ ID NO: 24925 - DNA, 22 bp, Artificial Sequence
  chemically synthesized
tttcaattagttgtaatcccag

SEQ ID NO: 24926 - DNA, 22 bp, Artificial Sequence
  chemically synthesized
caattagttgtaatcccaggag

SEQ ID NO: 24927 - DNA, 22 bp, Artificial Sequence
  chemically synthesized
aattagttgtaatcccaggaga

SEQ ID NO: 24928 - DNA, 22 bp, Artificial Sequence
  chemically synthesized
gttgtaatcccaggagaagaga

SEQ ID NO: 24929 - DNA, 22 bp, Artificial Sequence
  chemically synthesized
taatcccaggagaagagaactt

SEQ ID NO: 24930 - DNA, 22 bp, Artificial Sequence
  chemically synthesized
acaggcacaaaagttagagttg

SEQ ID NO: 24931 - DNA, 22 bp, Artificial Sequence
  chemically synthesized
caggcacaaaagttagagttgg

SEQ ID NO: 24932 - DNA, 22 bp, Artificial Sequence
  chemically synthesized
gagttggtagagttaccaggct

SEQ ID NO: 24933 - DNA, 22 bp, Artificial Sequence
  chemically synthesized
gtagagttaccaggctttggta

SEQ ID NO: 24934 - DNA, 22 bp, Artificial Sequence
  chemically synthesized
ccaggctttggtagcttctctt

SEQ ID NO: 24935 - DNA, 22 bp, Artificial Sequence
  chemically synthesized
tggtagcttctcttgggaataa

SEQ ID NO: 24936 - DNA, 22 bp, Artificial Sequence
  chemically synthesized
ggtagcttctcttgggaataaa

SEQ ID NO: 24937 - DNA, 22 bp, Artificial Sequence
  chemically synthesized
gtagcttctcttgggaataaac

SEQ ID NO: 24938 - DNA, 22 bp, Artificial Sequence
  chemically synthesized
ctcttgggaataaactagtagc

SEQ ID NO: 24939 - DNA, 22 bp, Artificial Sequence
  chemically synthesized
tcttgggaataaactagtagca

SEQ ID NO: 24940 - DNA, 22 bp, Artificial Sequence
  chemically synthesized
ttgggaataaactagtagcatg

SEQ ID NO: 24941 - DNA, 22 bp, Artificial Sequence
  chemically synthesized
gggaataaactagtagcatgaa

SEQ ID NO: 24942 - DNA, 22 bp, Artificial Sequence
  chemically synthesized
ggaataaactagtagcatgaaa

SEQ ID NO: 24943 - DNA, 22 bp, Artificial Sequence
  chemically synthesized
gtagcatgaaatcttatgtgct

SEQ ID NO: 24944 - DNA, 22 bp, Artificial Sequence
  chemically synthesized
atgtgcttcccacagaattcct

SEQ ID NO: 24945 - DNA, 22 bp, Artificial Sequence
  chemically synthesized
tgtgcttcccacagaattcctg

SEQ ID NO: 24946 - DNA, 22 bp, Artificial Sequence
  chemically synthesized
cccacagaattcctggtggaag

SEQ ID NO: 24947 - DNA, 22 bp, Artificial Sequence
  chemically synthesized
ccacagaattcctggtggaagg

SEQ ID NO: 24948 - DNA, 22 bp, Artificial Sequence
  chemically synthesized
ctggtggaaggaggaattcttc

SEQ ID NO: 24949 - DNA, 22 bp, Artificial Sequence
  chemically synthesized
gtggaaggaggaattcttcctc

SEQ ID NO: 24950 - DNA, 22 bp, Artificial Sequence
  chemically synthesized
ttcctcctctttctcgtctttc

SEQ ID NO: 24951 - DNA, 22 bp, Artificial Sequence
  chemically synthesized
cctcctctttctcgtctttctg

SEQ ID NO: 24952 - DNA, 22 bp, Artificial Sequence
  chemically synthesized
ctcctctttctcgtctttctgg

SEQ ID NO: 24953 - DNA, 22 bp, Artificial Sequence
  chemically synthesized
ctctttctcgtctttctgggca

SEQ ID NO: 24954 - DNA, 22 bp, Artificial Sequence
  chemically synthesized
tttctcgtctttctgggcaggt

SEQ ID NO: 24955 - DNA, 22 bp, Artificial Sequence
  chemically synthesized
tctcgtctttctgggcaggtat

SEQ ID NO: 24956 - DNA, 22 bp, Artificial Sequence
  chemically synthesized
ctcgtctttctgggcaggtatt

SEQ ID NO: 24957 - DNA, 22 bp, Artificial Sequence
  chemically synthesized
tcgtctttctgggcaggtattg

SEQ ID NO: 24958 - DNA, 22 bp, Artificial Sequence
  chemically synthesized
gtctttctgggcaggtattgtg

SEQ ID NO: 24959 - DNA, 22 bp, Artificial Sequence
  chemically synthesized
tctgggcaggtattgtgaggac

SEQ ID NO: 24960 - DNA, 22 bp, Artificial Sequence
  chemically synthesized
ctgggcaggtattgtgaggacg

SEQ ID NO: 24961 - DNA, 22 bp, Artificial Sequence
  chemically synthesized
tgggcaggtattgtgaggacgg

SEQ ID NO: 24962 - DNA, 22 bp, Artificial Sequence
  chemically synthesized
ggcaggtattgtgaggacggta

SEQ ID NO: 24963 - DNA, 22 bp, Artificial Sequence
  chemically synthesized
tgaggacggtatctgccctgtc

SEQ ID NO: 24964 - DNA, 22 bp, Artificial Sequence
  chemically synthesized
acagggcagataccgtcctcac

SEQ ID NO: 24965 - DNA, 22 bp, Artificial Sequence
  chemically synthesized
acaatacctgcccagaaagacg

SEQ ID NO: 24966 - DNA, 22 bp, Artificial Sequence
  chemically synthesized
cccagaaagacgagaaagagga

SEQ ID NO: 24967 - DNA, 22 bp, Artificial Sequence
  chemically synthesized
ctccttccaccaggaattctgt

SEQ ID NO: 24968 - DNA, 22 bp, Artificial Sequence
  chemically synthesized
cttccaccaggaattctgtggg

SEQ ID NO: 24969 - DNA, 22 bp, Artificial Sequence
  chemically synthesized
ccaccaggaattctgtgggaag

SEQ ID NO: 24970 - DNA, 22 bp, Artificial Sequence
  chemically synthesized
caccaggaattctgtgggaagc

SEQ ID NO: 24971 - DNA, 22 bp, Artificial Sequence
  chemically synthesized
tgtgggaagcacataagatttc

SEQ ID NO: 24972 - DNA, 22 bp, Artificial Sequence
  chemically synthesized
tgggaagcacataagatttcat

SEQ ID NO: 24973 - DNA, 22 bp, Artificial Sequence
  chemically synthesized
catgctactagtttattcccaa

SEQ ID NO: 24974 - DNA, 22 bp, Artificial Sequence
  chemically synthesized
atgctactagtttattcccaag

SEQ ID NO: 24975 - DNA, 22 bp, Artificial Sequence
  chemically synthesized
ctagtttattcccaagagaagc

SEQ ID NO: 24976 - DNA, 22 bp, Artificial Sequence
  chemically synthesized
gtttattcccaagagaagctac

SEQ ID NO: 24977 - DNA, 22 bp, Artificial Sequence
  chemically synthesized
attcccaagagaagctaccaaa

SEQ ID NO: 24978 - DNA, 22 bp, Artificial Sequence
  chemically synthesized
ttcccaagagaagctaccaaag

SEQ ID NO: 24979 - DNA, 22 bp, Artificial Sequence
  chemically synthesized
ccaagagaagctaccaaagcct

SEQ ID NO: 24980 - DNA, 22 bp, Artificial Sequence
  chemically synthesized
ccaaagcctggtaactctacca

SEQ ID NO: 24981 - DNA, 22 bp, Artificial Sequence
  chemically synthesized
gtaactctaccaactctaactt

SEQ ID NO: 24982 - DNA, 22 bp, Artificial Sequence
  chemically synthesized
taccaactctaacttttgtgcc

SEQ ID NO: 24983 - DNA, 22 bp, Artificial Sequence
  chemically synthesized
ccaactctaacttttgtgcctg

SEQ ID NO: 24984 - DNA, 22 bp, Artificial Sequence
  chemically synthesized
taacttttgtgcctgtaagttc

SEQ ID NO: 24985 - DNA, 22 bp, Artificial Sequence
  chemically synthesized
acttttgtgcctgtaagttctc

SEQ ID NO: 24986 - DNA, 22 bp, Artificial Sequence
  chemically synthesized
ttgtgcctgtaagttctcttct

SEQ ID NO: 24987 - DNA, 22 bp, Artificial Sequence
  chemically synthesized
tgtgcctgtaagttctcttctc

SEQ ID NO: 24988 - DNA, 22 bp, Artificial Sequence
  chemically synthesized
gtgcctgtaagttctcttctcc

SEQ ID NO: 24989 - DNA, 22 bp, Artificial Sequence
  chemically synthesized
tgcctgtaagttctcttctcct

SEQ ID NO: 24990 - DNA, 22 bp, Artificial Sequence
  chemically synthesized
taagttctcttctcctgggatt

SEQ ID NO: 24991 - DNA, 22 bp, Artificial Sequence
  chemically synthesized
tcttctcctgggattacaacta

SEQ ID NO: 24992 - DNA, 22 bp, Artificial Sequence
  chemically synthesized
ttctcctgggattacaactaat

SEQ ID NO: 24993 - DNA, 22 bp, Artificial Sequence
  chemically synthesized
ctcctgggattacaactaattg

SEQ ID NO: 24994 - DNA, 22 bp, Artificial Sequence
  chemically synthesized
tcctgggattacaactaattga

SEQ ID NO: 24995 - DNA, 22 bp, Artificial Sequence
  chemically synthesized
ctgggattacaactaattgaaa

SEQ ID NO: 24996 - DNA, 22 bp, Artificial Sequence
  chemically synthesized
ggattacaactaattgaaacag

SEQ ID NO: 24997 - DNA, 22 bp, Artificial Sequence
  chemically synthesized
caactaattgaaacaggaattc

SEQ ID NO: 24998 - DNA, 22 bp, Artificial Sequence
  chemically synthesized
attgaaacaggaattcaaagga

SEQ ID NO: 24999 - DNA, 22 bp, Artificial Sequence
  chemically synthesized
aaacaggaattcaaaggagtct

SEQ ID NO: 25000 - DNA, 22 bp, Artificial Sequence
  chemically synthesized
aaaggagtctcggaggactgta

SEQ ID NO: 25001 - DNA, 22 bp, Artificial Sequence
  chemically synthesized
ggaggactgtaagaagaatgct

SEQ ID NO: 25002 - DNA, 22 bp, Artificial Sequence
  chemically synthesized
taagaagaatgcttcgaggccg

SEQ ID NO: 25003 - DNA, 22 bp, Artificial Sequence
  chemically synthesized
cgaggccgatccctctctgtaa

SEQ ID NO: 25004 - DNA, 22 bp, Artificial Sequence
  chemically synthesized
gaggccgatccctctctgtaac

SEQ ID NO: 25005 - DNA, 22 bp, Artificial Sequence
  chemically synthesized
tctgtaacatccctgggtgggc

SEQ ID NO: 25006 - DNA, 22 bp, Artificial Sequence
  chemically synthesized
tgtaacatccctgggtgggctt

SEQ ID NO: 25007 - DNA, 22 bp, Artificial Sequence
  chemically synthesized
taacatccctgggtgggcttcc

SEQ ID NO: 25008 - DNA, 22 bp, Artificial Sequence
  chemically synthesized
ggtgggcttccccagtgggaag

SEQ ID NO: 25009 - DNA, 22 bp, Artificial Sequence
  chemically synthesized
ccccagtgggaagtcgaagaac

SEQ ID NO: 25010 - DNA, 22 bp, Artificial Sequence
  chemically synthesized
cccagtgggaagtcgaagaact

SEQ ID NO: 25011 - DNA, 22 bp, Artificial Sequence
  chemically synthesized
cctgtggaggagttactgctct

SEQ ID NO: 25012 - DNA, 22 bp, Artificial Sequence
  chemically synthesized
ctgtggaggagttactgctctt

SEQ ID NO: 25013 - DNA, 22 bp, Artificial Sequence
  chemically synthesized
tggaggagttactgctctttga

SEQ ID NO: 25014 - DNA, 22 bp, Artificial Sequence
  chemically synthesized
ctgctctttgaagttgcttggg

SEQ ID NO: 25015 - DNA, 22 bp, Artificial Sequence
  chemically synthesized
ctctttgaagttgcttgggaag

SEQ ID NO: 25016 - DNA, 22 bp, Artificial Sequence
  chemically synthesized
tttgaagttgcttgggaagtga

SEQ ID NO: 25017 - DNA, 22 bp, Artificial Sequence
  chemically synthesized
tgaagttgcttgggaagtgacc

SEQ ID NO: 25018 - DNA, 22 bp, Artificial Sequence
  chemically synthesized
gaagttgcttgggaagtgacca

SEQ ID NO: 25019 - DNA, 22 bp, Artificial Sequence
  chemically synthesized
aagttgcttgggaagtgaccaa

SEQ ID NO: 25020 - DNA, 22 bp, Artificial Sequence
  chemically synthesized
cttgggaagtgaccaataaagg

SEQ ID NO: 25021 - DNA, 22 bp, Artificial Sequence
  chemically synthesized
gggaagtgaccaataaaggttt

SEQ ID NO: 25022 - DNA, 22 bp, Artificial Sequence
  chemically synthesized
ggaagtgaccaataaaggtttg

SEQ ID NO: 25023 - DNA, 22 bp, Artificial Sequence
  chemically synthesized
gtactgctcctgaaggtggatc

SEQ ID NO: 25024 - DNA, 22 bp, Artificial Sequence
  chemically synthesized
tactgctcctgaaggtggatca

SEQ ID NO: 25025 - DNA, 22 bp, Artificial Sequence
  chemically synthesized
ctcctgaaggtggatcagtaca

SEQ ID NO: 25026 - DNA, 22 bp, Artificial Sequence
  chemically synthesized
ctgaaggtggatcagtacacct

SEQ ID NO: 25027 - DNA, 22 bp, Artificial Sequence
  chemically synthesized
aaggtggatcagtacaccttca

SEQ ID NO: 25028 - DNA, 22 bp, Artificial Sequence
  chemically synthesized
cactaggtgactgaggaatgta

SEQ ID NO: 25029 - DNA, 22 bp, Artificial Sequence
  chemically synthesized
actaggtgactgaggaatgtag

SEQ ID NO: 25030 - DNA, 22 bp, Artificial Sequence
  chemically synthesized
ggtgactgaggaatgtagagta

SEQ ID NO: 25031 - DNA, 22 bp, Artificial Sequence
  chemically synthesized
aggaatgtagagtaagatttca

SEQ ID NO: 25032 - DNA, 22 bp, Artificial Sequence
  chemically synthesized
cacagataactctctagtgata

SEQ ID NO: 25033 - DNA, 22 bp, Artificial Sequence
  chemically synthesized
acagataactctctagtgataa

SEQ ID NO: 25034 - DNA, 22 bp, Artificial Sequence
  chemically synthesized
tctagtgataaccaattgctag

SEQ ID NO: 25035 - DNA, 22 bp, Artificial Sequence
  chemically synthesized
tagtgataaccaattgctagtg

SEQ ID NO: 25036 - DNA, 22 bp, Artificial Sequence
  chemically synthesized
gtgataaccaattgctagtgag

SEQ ID NO: 25037 - DNA, 22 bp, Artificial Sequence
  chemically synthesized
ctagtgagtgaggaaagcattt

SEQ ID NO: 25038 - DNA, 22 bp, Artificial Sequence
  chemically synthesized
gtgagtgaggaaagcatttaaa

SEQ ID NO: 25039 - DNA, 22 bp, Artificial Sequence
  chemically synthesized
aaacggaatatatatttaggct

SEQ ID NO: 25040 - DNA, 22 bp, Artificial Sequence
  chemically synthesized
aacggaatatatatttaggcta

SEQ ID NO: 25041 - DNA, 22 bp, Artificial Sequence
  chemically synthesized
aggctacatttaaccttgtcta

SEQ ID NO: 25042 - DNA, 22 bp, Artificial Sequence
  chemically synthesized
ggctacatttaaccttgtctat

SEQ ID NO: 25043 - DNA, 22 bp, Artificial Sequence
  chemically synthesized
catttaaccttgtctattacaa

SEQ ID NO: 25044 - DNA, 22 bp, Artificial Sequence
  chemically synthesized
aaccttgtctattacaacaggc

SEQ ID NO: 25045 - DNA, 22 bp, Artificial Sequence
  chemically synthesized
accttgtctattacaacaggct

SEQ ID NO: 25046 - DNA, 22 bp, Artificial Sequence
  chemically synthesized
gtctattacaacaggctatgaa

SEQ ID NO: 25047 - DNA, 22 bp, Artificial Sequence
  chemically synthesized
tctattacaacaggctatgaat

SEQ ID NO: 25048 - DNA, 22 bp, Artificial Sequence
  chemically synthesized
ttacaacaggctatgaatacag

SEQ ID NO: 25049 - DNA, 22 bp, Artificial Sequence
  chemically synthesized
caacaggctatgaatacagact

SEQ ID NO: 25050 - DNA, 22 bp, Artificial Sequence
  chemically synthesized
tgaatacagacttgtgtatgtg

SEQ ID NO: 25051 - DNA, 22 bp, Artificial Sequence
  chemically synthesized
gtgtatgtgttgaagagggaga

SEQ ID NO: 25052 - DNA, 22 bp, Artificial Sequence
  chemically synthesized
tgtatgtgttgaagagggagaa

SEQ ID NO: 25053 - DNA, 22 bp, Artificial Sequence
  chemically synthesized
aagagggagaaagttgaaaata

SEQ ID NO: 25054 - DNA, 22 bp, Artificial Sequence
  chemically synthesized
aaaatattagccattgccatgg

SEQ ID NO: 25055 - DNA, 22 bp, Artificial Sequence
  chemically synthesized
gccattgccatggaatgtgcat

SEQ ID NO: 25056 - DNA, 22 bp, Artificial Sequence
  chemically synthesized
ccatggaatgtgcatttaaatt

SEQ ID NO: 25057 - DNA, 22 bp, Artificial Sequence
  chemically synthesized
aaattaaaatttaaaatccata

SEQ ID NO: 25058 - DNA, 22 bp, Artificial Sequence
  chemically synthesized
aattaaaatttaaaatccatat

SEQ ID NO: 25059 - DNA, 22 bp, Artificial Sequence
  chemically synthesized
aaatttaaaatccatattatga

SEQ ID NO: 25060 - DNA, 22 bp, Artificial Sequence
  chemically synthesized
aaaatccatattatgacaacat

SEQ ID NO: 25061 - DNA, 22 bp, Artificial Sequence
  chemically synthesized
aaatccatattatgacaacata

SEQ ID NO: 25062 - DNA, 22 bp, Artificial Sequence
  chemically synthesized
tgacaacatagaaataaaaagt

SEQ ID NO: 25063 - DNA, 22 bp, Artificial Sequence
  chemically synthesized
atatttacattttttgttttaa

SEQ ID NO: 25064 - DNA, 22 bp, Artificial Sequence
  chemically synthesized
acattttttgttttaaaatttt

SEQ ID NO: 25065 - DNA, 22 bp, Artificial Sequence
  chemically synthesized
cattttttgttttaaaattttt

SEQ ID NO: 25066 - DNA, 22 bp, Artificial Sequence
  chemically synthesized
tttgttttaaaatttttctcag

SEQ ID NO: 25067 - DNA, 22 bp, Artificial Sequence
  chemically synthesized
ttgttttaaaatttttctcagc

SEQ ID NO: 25068 - DNA, 22 bp, Artificial Sequence
  chemically synthesized
tgttttaaaatttttctcagca

SEQ ID NO: 25069 - DNA, 22 bp, Artificial Sequence
  chemically synthesized
gttttaaaatttttctcagcaa

SEQ ID NO: 25070 - DNA, 22 bp, Artificial Sequence
  chemically synthesized
ttttaaaatttttctcagcaaa

SEQ ID NO: 25071 - DNA, 22 bp, Artificial Sequence
  chemically synthesized
taaaatttttctcagcaaaata

SEQ ID NO: 25072 - DNA, 22 bp, Artificial Sequence
  chemically synthesized
aaaatttttctcagcaaaatag

SEQ ID NO: 25073 - DNA, 22 bp, Artificial Sequence
  chemically synthesized
aaatttttctcagcaaaatagt

SEQ ID NO: 25074 - DNA, 22 bp, Artificial Sequence
  chemically synthesized
ttctcagcaaaatagtataatt

SEQ ID NO: 25075 - DNA, 22 bp, Artificial Sequence
  chemically synthesized
tctcagcaaaatagtataatta

SEQ ID NO: 25076 - DNA, 22 bp, Artificial Sequence
  chemically synthesized
ctcagcaaaatagtataattaa

SEQ ID NO: 25077 - DNA, 22 bp, Artificial Sequence
  chemically synthesized
tcagcaaaatagtataattaaa

SEQ ID NO: 25078 - DNA, 22 bp, Artificial Sequence
  chemically synthesized
agcaaaatagtataattaaaca

SEQ ID NO: 25079 - DNA, 22 bp, Artificial Sequence
  chemically synthesized
aacattttattttaggaagatg

SEQ ID NO: 25080 - DNA, 22 bp, Artificial Sequence
  chemically synthesized
tattttaggaagatgtatatgt

SEQ ID NO: 25081 - DNA, 22 bp, Artificial Sequence
  chemically synthesized
attttaggaagatgtatatgtg

SEQ ID NO: 25082 - DNA, 22 bp, Artificial Sequence
  chemically synthesized
ttttaggaagatgtatatgtga

SEQ ID NO: 25083 - DNA, 22 bp, Artificial Sequence
  chemically synthesized
taggaagatgtatatgtgatta

SEQ ID NO: 25084 - DNA, 22 bp, Artificial Sequence
  chemically synthesized
aggaagatgtatatgtgattag

SEQ ID NO: 25085 - DNA, 22 bp, Artificial Sequence
  chemically synthesized
ggaagatgtatatgtgattaga

SEQ ID NO: 25086 - DNA, 22 bp, Artificial Sequence
  chemically synthesized
gaaccagttggaaacctcaact

SEQ ID NO: 25087 - DNA, 22 bp, Artificial Sequence
  chemically synthesized
gaaacctcaactctacattctg

SEQ ID NO: 25088 - DNA, 22 bp, Artificial Sequence
  chemically synthesized
aactctacattctgttagtaat

SEQ ID NO: 25089 - DNA, 22 bp, Artificial Sequence
  chemically synthesized
tacattctgttagtaattatat

SEQ ID NO: 25090 - DNA, 22 bp, Artificial Sequence
  chemically synthesized
cattctgttagtaattatatga

SEQ ID NO: 25091 - DNA, 22 bp, Artificial Sequence
  chemically synthesized
tgttagtaattatatgaaatgc

SEQ ID NO: 25092 - DNA, 22 bp, Artificial Sequence
  chemically synthesized
ttagtaattatatgaaatgctt

SEQ ID NO: 25093 - DNA, 22 bp, Artificial Sequence
  chemically synthesized
gtaattatatgaaatgcttaag

SEQ ID NO: 25094 - DNA, 22 bp, Artificial Sequence
  chemically synthesized
tatgaaatgcttaagaatgttt

SEQ ID NO: 25095 - DNA, 22 bp, Artificial Sequence
  chemically synthesized
aagaatgtttcatattcacaat

SEQ ID NO: 25096 - DNA, 22 bp, Artificial Sequence
  chemically synthesized
agaatgtttcatattcacaatt

SEQ ID NO: 25097 - DNA, 22 bp, Artificial Sequence
  chemically synthesized
catattcacaattagcttggaa

SEQ ID NO: 25098 - DNA, 22 bp, Artificial Sequence
  chemically synthesized
atattcacaattagcttggaat

SEQ ID NO: 25099 - DNA, 22 bp, Artificial Sequence
  chemically synthesized
acaattagcttggaattaatgt

SEQ ID NO: 25100 - DNA, 22 bp, Artificial Sequence
  chemically synthesized
gcttggaattaatgttttaatt

SEQ ID NO: 25101 - DNA, 22 bp, Artificial Sequence
  chemically synthesized
ggaattaatgttttaattcagg

SEQ ID NO: 25102 - DNA, 22 bp, Artificial Sequence
  chemically synthesized
gaattaatgttttaattcagga

SEQ ID NO: 25103 - DNA, 22 bp, Artificial Sequence
  chemically synthesized
atgttttaattcaggagcttct

SEQ ID NO: 25104 - DNA, 22 bp, Artificial Sequence
  chemically synthesized
taattcaggagcttctcaaaag

SEQ ID NO: 25105 - DNA, 22 bp, Artificial Sequence
  chemically synthesized
aattcaggagcttctcaaaagg

SEQ ID NO: 25106 - DNA, 22 bp, Artificial Sequence
  chemically synthesized
attcaggagcttctcaaaaggc

SEQ ID NO: 25107 - DNA, 22 bp, Artificial Sequence
  chemically synthesized
aggagcttctcaaaaggcaaaa

SEQ ID NO: 25108 - DNA, 22 bp, Artificial Sequence
  chemically synthesized
ctcaaaaggcaaaatactgtgc

SEQ ID NO: 25109 - DNA, 22 bp, Artificial Sequence
  chemically synthesized
tcaaaaggcaaaatactgtgct

SEQ ID NO: 25110 - DNA, 22 bp, Artificial Sequence
  chemically synthesized
aaaaggcaaaatactgtgctcc

SEQ ID NO: 25111 - DNA, 22 bp, Artificial Sequence
  chemically synthesized
tgctcctttcagaatgaaagta

SEQ ID NO: 25112 - DNA, 22 bp, Artificial Sequence
  chemically synthesized
ctttcagaatgaaagtaatttt

SEQ ID NO: 25113 - DNA, 22 bp, Artificial Sequence
  chemically synthesized
tcagaatgaaagtaattttttt

SEQ ID NO: 25114 - DNA, 22 bp, Artificial Sequence
  chemically synthesized
cagaatgaaagtaatttttttc

SEQ ID NO: 25115 - DNA, 22 bp, Artificial Sequence
  chemically synthesized
agaatgaaagtaatttttttct

SEQ ID NO: 25116 - DNA, 22 bp, Artificial Sequence
  chemically synthesized
ttttcttcaatgctatgcttat

SEQ ID NO: 25117 - DNA, 22 bp, Artificial Sequence
  chemically synthesized
tttcttcaatgctatgcttatg

SEQ ID NO: 25118 - DNA, 22 bp, Artificial Sequence
  chemically synthesized
ttcttcaatgctatgcttatgt

SEQ ID NO: 25119 - DNA, 22 bp, Artificial Sequence
  chemically synthesized
tcttcaatgctatgcttatgta

SEQ ID NO: 25120 - DNA, 22 bp, Artificial Sequence
  chemically synthesized
cttcaatgctatgcttatgtag

SEQ ID NO: 25121 - DNA, 22 bp, Artificial Sequence
  chemically synthesized
ttcaatgctatgcttatgtagg

SEQ ID NO: 25122 - DNA, 22 bp, Artificial Sequence
  chemically synthesized
caatgctatgcttatgtaggaa

SEQ ID NO: 25123 - DNA, 22 bp, Artificial Sequence
  chemically synthesized
aatgctatgcttatgtaggaat

SEQ ID NO: 25124 - DNA, 22 bp, Artificial Sequence
  chemically synthesized
tgcttatgtaggaattataaaa

SEQ ID NO: 25125 - DNA, 22 bp, Artificial Sequence
  chemically synthesized
atgtaggaattataaaataaag

SEQ ID NO: 25126 - DNA, 22 bp, Artificial Sequence
  chemically synthesized
tgtaggaattataaaataaaga

SEQ ID NO: 25127 - DNA, 22 bp, Artificial Sequence
  chemically synthesized
taaaataaagaaaatcaaattg

SEQ ID NO: 25128 - DNA, 22 bp, Artificial Sequence
  chemically synthesized
ataaaacaatttgcgagtgagg

SEQ ID NO: 25129 - DNA, 22 bp, Artificial Sequence
  chemically synthesized
gcgagtgaggtataacctcatc

SEQ ID NO: 25130 - DNA, 22 bp, Artificial Sequence
  chemically synthesized
cgagtgaggtataacctcatct

SEQ ID NO: 25131 - DNA, 22 bp, Artificial Sequence
  chemically synthesized
atctgtgctgggtaagagaagg

SEQ ID NO: 25132 - DNA, 22 bp, Artificial Sequence
  chemically synthesized
tgctgggtaagagaaggcaagg

SEQ ID NO: 25133 - DNA, 22 bp, Artificial Sequence
  chemically synthesized
ggtaagagaaggcaaggtagag

SEQ ID NO: 25134 - DNA, 22 bp, Artificial Sequence
  chemically synthesized
tgaaaataaagacatctgtaaa

SEQ ID NO: 25135 - DNA, 22 bp, Artificial Sequence
  chemically synthesized
gaaaataaagacatctgtaaaa

SEQ ID NO: 25136 - DNA, 22 bp, Artificial Sequence
  chemically synthesized
aaaataaagacatctgtaaaat

SEQ ID NO: 25137 - DNA, 22 bp, Artificial Sequence
  chemically synthesized
taaaattataaaacaattcctt

SEQ ID NO: 25138 - DNA, 22 bp, Artificial Sequence
  chemically synthesized
taaaacaattccttgtgggttt

SEQ ID NO: 25139 - DNA, 22 bp, Artificial Sequence
  chemically synthesized
cttgtgggtttatactctctag

SEQ ID NO: 25140 - DNA, 22 bp, Artificial Sequence
  chemically synthesized
gtgggtttatactctctagttt

SEQ ID NO: 25141 - DNA, 22 bp, Artificial Sequence
  chemically synthesized
tgggtttatactctctagttta

SEQ ID NO: 25142 - DNA, 22 bp, Artificial Sequence
  chemically synthesized
atactctctagtttaaaagtgt

SEQ ID NO: 25143 - DNA, 22 bp, Artificial Sequence
  chemically synthesized
tactctctagtttaaaagtgtc

SEQ ID NO: 25144 - DNA, 22 bp, Artificial Sequence
  chemically synthesized
tctagtttaaaagtgtcaagac

SEQ ID NO: 25145 - DNA, 22 bp, Artificial Sequence
  chemically synthesized
tagtttaaaagtgtcaagacta

SEQ ID NO: 25146 - DNA, 22 bp, Artificial Sequence
  chemically synthesized
gtttaaaagtgtcaagactatt

SEQ ID NO: 25147 - DNA, 22 bp, Artificial Sequence
  chemically synthesized
aaaagtgtcaagactattgaag

SEQ ID NO: 25148 - DNA, 22 bp, Artificial Sequence
  chemically synthesized
aaagtgtcaagactattgaagg

SEQ ID NO: 25149 - DNA, 22 bp, Artificial Sequence
  chemically synthesized
ttgaaggaacattagcaaagaa

SEQ ID NO: 25150 - DNA, 22 bp, Artificial Sequence
  chemically synthesized
aaggaacattagcaaagaaaaa

SEQ ID NO: 25151 - DNA, 22 bp, Artificial Sequence
  chemically synthesized
gcaaagaaaaagtcatggtttt

SEQ ID NO: 25152 - DNA, 22 bp, Artificial Sequence
  chemically synthesized
tgaaggctgagttcctcaagat

SEQ ID NO: 25153 - DNA, 22 bp, Artificial Sequence
  chemically synthesized
gaaggctgagttcctcaagatc

SEQ ID NO: 25154 - DNA, 22 bp, Artificial Sequence
  chemically synthesized
aaggctgagttcctcaagatct

SEQ ID NO: 25155 - DNA, 22 bp, Artificial Sequence
  chemically synthesized
agttcctcaagatcttgaagaa

SEQ ID NO: 25156 - DNA, 22 bp, Artificial Sequence
  chemically synthesized
ctcaagatcttgaagaatcaag

SEQ ID NO: 25157 - DNA, 22 bp, Artificial Sequence
  chemically synthesized
aagatcttgaagaatcaagcca

SEQ ID NO: 25158 - DNA, 22 bp, Artificial Sequence
  chemically synthesized
gaagaatcaagccaactgattg

SEQ ID NO: 25159 - DNA, 22 bp, Artificial Sequence
  chemically synthesized
aagaatcaagccaactgattgc

SEQ ID NO: 25160 - DNA, 22 bp, Artificial Sequence
  chemically synthesized
attgctgggtaaatggcagtga

SEQ ID NO: 25161 - DNA, 22 bp, Artificial Sequence
  chemically synthesized
ctgggtaaatggcagtgatgac

SEQ ID NO: 25162 - DNA, 22 bp, Artificial Sequence
  chemically synthesized
ggtaaatggcagtgatgacttg

SEQ ID NO: 25163 - DNA, 22 bp, Artificial Sequence
  chemically synthesized
gtgtgatttaaacgatctgaaa

SEQ ID NO: 25164 - DNA, 22 bp, Artificial Sequence
  chemically synthesized
tgtgatttaaacgatctgaaat

SEQ ID NO: 25165 - DNA, 22 bp, Artificial Sequence
  chemically synthesized
aaacgatctgaaattatgtcat

SEQ ID NO: 25166 - DNA, 22 bp, Artificial Sequence
  chemically synthesized
aacgatctgaaattatgtcatg

SEQ ID NO: 25167 - DNA, 22 bp, Artificial Sequence
  chemically synthesized
aaattatgtcatgtgttgtgat

SEQ ID NO: 25168 - DNA, 22 bp, Artificial Sequence
  chemically synthesized
tgtcatgtgttgtgatatataa

SEQ ID NO: 25169 - DNA, 22 bp, Artificial Sequence
  chemically synthesized
tgatatataacacatttatttt

SEQ ID NO: 25170 - DNA, 22 bp, Artificial Sequence
  chemically synthesized
atttttcattttgtgtttacta

SEQ ID NO: 25171 - DNA, 22 bp, Artificial Sequence
  chemically synthesized
tttttcattttgtgtttactat

SEQ ID NO: 25172 - DNA, 22 bp, Artificial Sequence
  chemically synthesized
ttcattttgtgtttactatttc

SEQ ID NO: 25173 - DNA, 22 bp, Artificial Sequence
  chemically synthesized
tcattttgtgtttactatttca

SEQ ID NO: 25174 - DNA, 22 bp, Artificial Sequence
  chemically synthesized
cattttgtgtttactatttcat

SEQ ID NO: 25175 - DNA, 22 bp, Artificial Sequence
  chemically synthesized
attttgtgtttactatttcatg

SEQ ID NO: 25176 - DNA, 22 bp, Artificial Sequence
  chemically synthesized
tgtgtttactatttcatgtcta

SEQ ID NO: 25177 - DNA, 22 bp, Artificial Sequence
  chemically synthesized
gtgtttactatttcatgtctat

SEQ ID NO: 25178 - DNA, 22 bp, Artificial Sequence
  chemically synthesized
tgtttactatttcatgtctatt

SEQ ID NO: 25179 - DNA, 22 bp, Artificial Sequence
  chemically synthesized
actatttcatgtctattacagt

SEQ ID NO: 25180 - DNA, 22 bp, Artificial Sequence
  chemically synthesized
ctatttcatgtctattacagta

SEQ ID NO: 25181 - DNA, 22 bp, Artificial Sequence
  chemically synthesized
tttcatgtctattacagtaatc

SEQ ID NO: 25182 - DNA, 22 bp, Artificial Sequence
  chemically synthesized
catgtctattacagtaatctaa

SEQ ID NO: 25183 - DNA, 22 bp, Artificial Sequence
  chemically synthesized
atgtctattacagtaatctaaa

SEQ ID NO: 25184 - DNA, 22 bp, Artificial Sequence
  chemically synthesized
ttacagtaatctaaaggatctg

SEQ ID NO: 25185 - DNA, 22 bp, Artificial Sequence
  chemically synthesized
cagtaatctaaaggatctgaaa

SEQ ID NO: 25186 - DNA, 22 bp, Artificial Sequence
  chemically synthesized
aaggatctgaaataataaccag

SEQ ID NO: 25187 - DNA, 22 bp, Artificial Sequence
  chemically synthesized
aaataataaccagaatgtgata

SEQ ID NO: 25188 - DNA, 22 bp, Artificial Sequence
  chemically synthesized
cttccttcttttggctaatcag

SEQ ID NO: 25189 - DNA, 22 bp, Artificial Sequence
  chemically synthesized
ccttcttttggctaatcagagc

SEQ ID NO: 25190 - DNA, 22 bp, Artificial Sequence
  chemically synthesized
cttcttttggctaatcagagcc

SEQ ID NO: 25191 - DNA, 22 bp, Artificial Sequence
  chemically synthesized
cttttggctaatcagagccagc

SEQ ID NO: 25192 - DNA, 22 bp, Artificial Sequence
  chemically synthesized
ttttggctaatcagagccagca

SEQ ID NO: 25193 - DNA, 22 bp, Artificial Sequence
  chemically synthesized
ttggctaatcagagccagcata

SEQ ID NO: 25194 - DNA, 22 bp, Artificial Sequence
  chemically synthesized
tggctaatcagagccagcataa

SEQ ID NO: 25195 - DNA, 22 bp, Artificial Sequence
  chemically synthesized
ggctaatcagagccagcataat

SEQ ID NO: 25196 - DNA, 22 bp, Artificial Sequence
  chemically synthesized
gctaatcagagccagcataatc

SEQ ID NO: 25197 - DNA, 22 bp, Artificial Sequence
  chemically synthesized
atcagagccagcataatctcaa

SEQ ID NO: 25198 - DNA, 22 bp, Artificial Sequence
  chemically synthesized
aaaattaaatgcattatatatg

SEQ ID NO: 25199 - DNA, 22 bp, Artificial Sequence
  chemically synthesized
aatgcattatatatggcatgca

SEQ ID NO: 25200 - DNA, 22 bp, Artificial Sequence
  chemically synthesized
tatatggcatgcattctgaaaa

SEQ ID NO: 25201 - DNA, 22 bp, Artificial Sequence
  chemically synthesized
tgaaaaatcagaattcacctta

SEQ ID NO: 25202 - DNA, 22 bp, Artificial Sequence
  chemically synthesized
aaaaatcagaattcaccttata

SEQ ID NO: 25203 - DNA, 22 bp, Artificial Sequence
  chemically synthesized
accttatactaactgttcaaag

SEQ ID NO: 25204 - DNA, 22 bp, Artificial Sequence
  chemically synthesized
atactaactgttcaaagttctc

SEQ ID NO: 25205 - DNA, 22 bp, Artificial Sequence
  chemically synthesized
tactaactgttcaaagttctcg

SEQ ID NO: 25206 - DNA, 22 bp, Artificial Sequence
  chemically synthesized
actgttcaaagttctcgtgtgt

SEQ ID NO: 25207 - DNA, 22 bp, Artificial Sequence
  chemically synthesized
ttcaaagttctcgtgtgtatgc

SEQ ID NO: 25208 - DNA, 22 bp, Artificial Sequence
  chemically synthesized
aaagttctcgtgtgtatgcatt

SEQ ID NO: 25209 - DNA, 22 bp, Artificial Sequence
  chemically synthesized
tcgtgtgtatgcattcataaaa

SEQ ID NO: 25210 - DNA, 22 bp, Artificial Sequence
  chemically synthesized
gtgtgtatgcattcataaaatc

SEQ ID NO: 25211 - DNA, 22 bp, Artificial Sequence
  chemically synthesized
ataaaatcaaaattaaaagtca

SEQ ID NO: 25212 - DNA, 22 bp, Artificial Sequence
  chemically synthesized
aaagtcaattttgcctatgtag

SEQ ID NO: 25213 - DNA, 22 bp, Artificial Sequence
  chemically synthesized
tgcctatgtagaagtggacaga

SEQ ID NO: 25214 - DNA, 22 bp, Artificial Sequence
  chemically synthesized
gcctatgtagaagtggacagaa

SEQ ID NO: 25215 - DNA, 22 bp, Artificial Sequence
  chemically synthesized
cctatgtagaagtggacagaat

SEQ ID NO: 25216 - DNA, 22 bp, Artificial Sequence
  chemically synthesized
tgtagaagtggacagaatgcat

SEQ ID NO: 25217 - DNA, 22 bp, Artificial Sequence
  chemically synthesized
attctctgtagtttagtgagaa

SEQ ID NO: 25218 - DNA, 22 bp, Artificial Sequence
  chemically synthesized
ttctctgtagtttagtgagaaa

SEQ ID NO: 25219 - DNA, 22 bp, Artificial Sequence
  chemically synthesized
tctgtagtttagtgagaaagaa

SEQ ID NO: 25220 - DNA, 22 bp, Artificial Sequence
  chemically synthesized
tgtagtttagtgagaaagaatc

SEQ ID NO: 25221 - DNA, 22 bp, Artificial Sequence
  chemically synthesized
tagtttagtgagaaagaatcta

SEQ ID NO: 25222 - DNA, 22 bp, Artificial Sequence
  chemically synthesized
agtgagaaagaatctaggagga

SEQ ID NO: 25223 - DNA, 22 bp, Artificial Sequence
  chemically synthesized
gtgagaaagaatctaggaggac

SEQ ID NO: 25224 - DNA, 22 bp, Artificial Sequence
  chemically synthesized
ggaggacagaaaccttattaca

SEQ ID NO: 25225 - DNA, 22 bp, Artificial Sequence
  chemically synthesized
attacagagaagtgaagtattt

SEQ ID NO: 25226 - DNA, 22 bp, Artificial Sequence
  chemically synthesized
ttacagagaagtgaagtatttt

SEQ ID NO: 25227 - DNA, 22 bp, Artificial Sequence
  chemically synthesized
cagagaagtgaagtattttatg

SEQ ID NO: 25228 - DNA, 22 bp, Artificial Sequence
  chemically synthesized
tatgtgtacctgtttctgttgt

SEQ ID NO: 25229 - DNA, 22 bp, Artificial Sequence
  chemically synthesized
atgtgtacctgtttctgttgtt

SEQ ID NO: 25230 - DNA, 22 bp, Artificial Sequence
  chemically synthesized
tgtgtacctgtttctgttgttt

SEQ ID NO: 25231 - DNA, 22 bp, Artificial Sequence
  chemically synthesized
tttctgttgtttctttttaaat

SEQ ID NO: 25232 - DNA, 22 bp, Artificial Sequence
  chemically synthesized
ctgttgtttctttttaaattat

SEQ ID NO: 25233 - DNA, 22 bp, Artificial Sequence
  chemically synthesized
tgttgtttctttttaaattatt

SEQ ID NO: 25234 - DNA, 22 bp, Artificial Sequence
  chemically synthesized
ttgtttctttttaaattatttt

SEQ ID NO: 25235 - DNA, 22 bp, Artificial Sequence
  chemically synthesized
tttctttttaaattattttgta

SEQ ID NO: 25236 - DNA, 22 bp, Artificial Sequence
  chemically synthesized
ctttttaaattattttgtattc

SEQ ID NO: 25237 - DNA, 22 bp, Artificial Sequence
  chemically synthesized
tttttaaattattttgtattct

SEQ ID NO: 25238 - DNA, 22 bp, Artificial Sequence
  chemically synthesized
tttaaattattttgtattcttt

SEQ ID NO: 25239 - DNA, 22 bp, Artificial Sequence
  chemically synthesized
ttaaattattttgtattctttt

SEQ ID NO: 25240 - DNA, 22 bp, Artificial Sequence
  chemically synthesized
taaattattttgtattcttttc

SEQ ID NO: 25241 - DNA, 22 bp, Artificial Sequence
  chemically synthesized
aaattattttgtattcttttcc

SEQ ID NO: 25242 - DNA, 22 bp, Artificial Sequence
  chemically synthesized
aattattttgtattcttttcct

SEQ ID NO: 25243 - DNA, 22 bp, Artificial Sequence
  chemically synthesized
ttttgtattcttttcctcagag

SEQ ID NO: 25244 - DNA, 22 bp, Artificial Sequence
  chemically synthesized
tgtattcttttcctcagagatc

SEQ ID NO: 25245 - DNA, 22 bp, Artificial Sequence
  chemically synthesized
gtattcttttcctcagagatct

SEQ ID NO: 25246 - DNA, 22 bp, Artificial Sequence
  chemically synthesized
tattcttttcctcagagatctt

SEQ ID NO: 25247 - DNA, 22 bp, Artificial Sequence
  chemically synthesized
ttttcctcagagatctttatcc

SEQ ID NO: 25248 - DNA, 22 bp, Artificial Sequence
  chemically synthesized
ttcctcagagatctttatcctg

SEQ ID NO: 25249 - DNA, 22 bp, Artificial Sequence
  chemically synthesized
tcctcagagatctttatcctga

SEQ ID NO: 25250 - DNA, 22 bp, Artificial Sequence
  chemically synthesized
cctcagagatctttatcctgaa

SEQ ID NO: 25251 - DNA, 22 bp, Artificial Sequence
  chemically synthesized
ctcagagatctttatcctgaaa

SEQ ID NO: 25252 - DNA, 22 bp, Artificial Sequence
  chemically synthesized
agagatctttatcctgaaatga

SEQ ID NO: 25253 - DNA, 22 bp, Artificial Sequence
  chemically synthesized
tatcctgaaatgagcatgtgtt

SEQ ID NO: 25254 - DNA, 22 bp, Artificial Sequence
  chemically synthesized
atcctgaaatgagcatgtgttt

SEQ ID NO: 25255 - DNA, 22 bp, Artificial Sequence
  chemically synthesized
tcctgaaatgagcatgtgtttt

SEQ ID NO: 25256 - DNA, 22 bp, Artificial Sequence
  chemically synthesized
aaatgagcatgtgtttttaatg

SEQ ID NO: 25257 - DNA, 22 bp, Artificial Sequence
  chemically synthesized
ttaatgtcctttttctagtcac

SEQ ID NO: 25258 - DNA, 22 bp, Artificial Sequence
  chemically synthesized
taatgtcctttttctagtcaca

SEQ ID NO: 25259 - DNA, 22 bp, Artificial Sequence
  chemically synthesized
aatgtcctttttctagtcacaa

SEQ ID NO: 25260 - DNA, 22 bp, Artificial Sequence
  chemically synthesized
atgtcctttttctagtcacaaa

SEQ ID NO: 25261 - DNA, 22 bp, Artificial Sequence
  chemically synthesized
tttctagtcacaaatttttcca

SEQ ID NO: 25262 - DNA, 22 bp, Artificial Sequence
  chemically synthesized
ttctagtcacaaatttttccag

SEQ ID NO: 25263 - DNA, 22 bp, Artificial Sequence
  chemically synthesized
tctagtcacaaatttttccagt

SEQ ID NO: 25264 - DNA, 22 bp, Artificial Sequence
  chemically synthesized
ctagtcacaaatttttccagtc

SEQ ID NO: 25265 - DNA, 22 bp, Artificial Sequence
  chemically synthesized
tagtcacaaatttttccagtcc

SEQ ID NO: 25266 - DNA, 22 bp, Artificial Sequence
  chemically synthesized
gtcacaaatttttccagtccag

SEQ ID NO: 25267 - DNA, 22 bp, Artificial Sequence
  chemically synthesized
ttccagtccagtttttaaatat

SEQ ID NO: 25268 - DNA, 22 bp, Artificial Sequence
  chemically synthesized
tccagtccagtttttaaatatg

SEQ ID NO: 25269 - DNA, 22 bp, Artificial Sequence
  chemically synthesized
ccagtccagtttttaaatatgc

SEQ ID NO: 25270 - DNA, 22 bp, Artificial Sequence
  chemically synthesized
cagtccagtttttaaatatgcc

SEQ ID NO: 25271 - DNA, 22 bp, Artificial Sequence
  chemically synthesized
ttaaatatgcccaaagttcctg

SEQ ID NO: 25272 - DNA, 22 bp, Artificial Sequence
  chemically synthesized
taaatatgcccaaagttcctgg

SEQ ID NO: 25273 - DNA, 22 bp, Artificial Sequence
  chemically synthesized
aaatatgcccaaagttcctggg

SEQ ID NO: 25274 - DNA, 22 bp, Artificial Sequence
  chemically synthesized
aatatgcccaaagttcctggga

SEQ ID NO: 25275 - DNA, 22 bp, Artificial Sequence
  chemically synthesized
ctgggaacagaaccatctctat

SEQ ID NO: 25276 - DNA, 22 bp, Artificial Sequence
  chemically synthesized
ggaacagaaccatctctatcac

SEQ ID NO: 25277 - DNA, 22 bp, Artificial Sequence
  chemically synthesized
tatcacatgtgaatcccggagt

SEQ ID NO: 25278 - DNA, 22 bp, Artificial Sequence
  chemically synthesized
tcacatgtgaatcccggagtat

SEQ ID NO: 25279 - DNA, 22 bp, Artificial Sequence
  chemically synthesized
gaaataaaagttttctctagag

SEQ ID NO: 25280 - DNA, 22 bp, Artificial Sequence
  chemically synthesized
aaataaaagttttctctagaga

SEQ ID NO: 25281 - DNA, 22 bp, Artificial Sequence
  chemically synthesized
tctctagagagtgggcaggagc

SEQ ID NO: 25282 - DNA, 22 bp, Artificial Sequence
  chemically synthesized
ctctagagagtgggcaggagct

SEQ ID NO: 25283 - DNA, 22 bp, Artificial Sequence
  chemically synthesized
tctagagagtgggcaggagctc

SEQ ID NO: 25284 - DNA, 22 bp, Artificial Sequence
  chemically synthesized
tagagagtgggcaggagctcaa

SEQ ID NO: 25285 - DNA, 22 bp, Artificial Sequence
  chemically synthesized
gagagtgggcaggagctcaagg

SEQ ID NO: 25286 - DNA, 22 bp, Artificial Sequence
  chemically synthesized
aaggacatagcttattggtgga

SEQ ID NO: 25287 - DNA, 22 bp, Artificial Sequence
  chemically synthesized
attggtggataaaactggaagg

SEQ ID NO: 25288 - DNA, 22 bp, Artificial Sequence
  chemically synthesized
ttggtggataaaactggaaggg

SEQ ID NO: 25289 - DNA, 22 bp, Artificial Sequence
  chemically synthesized
gtggataaaactggaagggact

SEQ ID NO: 25290 - DNA, 22 bp, Artificial Sequence
  chemically synthesized
gaagggacttgttagcactggg

SEQ ID NO: 25291 - DNA, 22 bp, Artificial Sequence
  chemically synthesized
gttagcactgggaatcagtcca

SEQ ID NO: 25292 - DNA, 22 bp, Artificial Sequence
  chemically synthesized
ttagcactgggaatcagtccag

SEQ ID NO: 25293 - DNA, 22 bp, Artificial Sequence
  chemically synthesized
gcactgggaatcagtccagaag

SEQ ID NO: 25294 - DNA, 22 bp, Artificial Sequence
  chemically synthesized
ggaatcagtccagaagatctct

SEQ ID NO: 25295 - DNA, 22 bp, Artificial Sequence
  chemically synthesized
tgcacaagttcctgcacctgag

SEQ ID NO: 25296 - DNA, 22 bp, Artificial Sequence
  chemically synthesized
cacaagttcctgcacctgagca

SEQ ID NO: 25297 - DNA, 22 bp, Artificial Sequence
  chemically synthesized
ctgcacctgagcagagcccctt

SEQ ID NO: 25298 - DNA, 22 bp, Artificial Sequence
  chemically synthesized
cacctgagcagagccccttctg

SEQ ID NO: 25299 - DNA, 22 bp, Artificial Sequence
  chemically synthesized
agcagagccccttctgctttcc

SEQ ID NO: 25300 - DNA, 22 bp, Artificial Sequence
  chemically synthesized
ctgctttcctcttttctcatca

SEQ ID NO: 25301 - DNA, 22 bp, Artificial Sequence
  chemically synthesized
tgctttcctcttttctcatcat

SEQ ID NO: 25302 - DNA, 22 bp, Artificial Sequence
  chemically synthesized
ctttcctcttttctcatcattt

SEQ ID NO: 25303 - DNA, 22 bp, Artificial Sequence
  chemically synthesized
tcctcttttctcatcatttaac

SEQ ID NO: 25304 - DNA, 22 bp, Artificial Sequence
  chemically synthesized
cctcttttctcatcatttaaca

SEQ ID NO: 25305 - DNA, 22 bp, Artificial Sequence
  chemically synthesized
ctcttttctcatcatttaacaa

SEQ ID NO: 25306 - DNA, 22 bp, Artificial Sequence
  chemically synthesized
ttttctcatcatttaacaaaca

SEQ ID NO: 25307 - DNA, 22 bp, Artificial Sequence
  chemically synthesized
ttctcatcatttaacaaacatt

SEQ ID NO: 25308 - DNA, 22 bp, Artificial Sequence
  chemically synthesized
tctcatcatttaacaaacatta

SEQ ID NO: 25309 - DNA, 22 bp, Artificial Sequence
  chemically synthesized
ctcatcatttaacaaacattaa

SEQ ID NO: 25310 - DNA, 22 bp, Artificial Sequence
  chemically synthesized
tcatcatttaacaaacattaat

SEQ ID NO: 25311 - DNA, 22 bp, Artificial Sequence
  chemically synthesized
atcatttaacaaacattaatgg

SEQ ID NO: 25312 - DNA, 22 bp, Artificial Sequence
  chemically synthesized
aacaaacattaatggagcactg

SEQ ID NO: 25313 - DNA, 22 bp, Artificial Sequence
  chemically synthesized
acaaacattaatggagcactgt

SEQ ID NO: 25314 - DNA, 22 bp, Artificial Sequence
  chemically synthesized
atggagcactgttacctgggca

SEQ ID NO: 25315 - DNA, 22 bp, Artificial Sequence
  chemically synthesized
ttacctgggcactgggaacacg

SEQ ID NO: 25316 - DNA, 22 bp, Artificial Sequence
  chemically synthesized
cctgggcactgggaacacgcca

SEQ ID NO: 25317 - DNA, 22 bp, Artificial Sequence
  chemically synthesized
ggcactgggaacacgccagtga

SEQ ID NO: 25318 - DNA, 22 bp, Artificial Sequence
  chemically synthesized
ggaacacgccagtgaaactaag

SEQ ID NO: 25319 - DNA, 22 bp, Artificial Sequence
  chemically synthesized
agttattttatggatcttataa

SEQ ID NO: 25320 - DNA, 22 bp, Artificial Sequence
  chemically synthesized
ttttatggatcttataatcagt

SEQ ID NO: 25321 - DNA, 22 bp, Artificial Sequence
  chemically synthesized
tatggatcttataatcagtagc

SEQ ID NO: 25322 - DNA, 22 bp, Artificial Sequence
  chemically synthesized
atggatcttataatcagtagca

SEQ ID NO: 25323 - DNA, 22 bp, Artificial Sequence
  chemically synthesized
tggatcttataatcagtagcat

SEQ ID NO: 25324 - DNA, 22 bp, Artificial Sequence
  chemically synthesized
ataatcagtagcatgtgtgttg

SEQ ID NO: 25325 - DNA, 22 bp, Artificial Sequence
  chemically synthesized
taatcagtagcatgtgtgttga

SEQ ID NO: 25326 - DNA, 22 bp, Artificial Sequence
  chemically synthesized
atctcagggtctagaacagtgc

SEQ ID NO: 25327 - DNA, 22 bp, Artificial Sequence
  chemically synthesized
agggtctagaacagtgcctggt

SEQ ID NO: 25328 - DNA, 22 bp, Artificial Sequence
  chemically synthesized
gaacagtgcctggtacatagaa

SEQ ID NO: 25329 - DNA, 22 bp, Artificial Sequence
  chemically synthesized
gtacatagaaaatgctcaatgg

SEQ ID NO: 25330 - DNA, 22 bp, Artificial Sequence
  chemically synthesized
aatggatttttttttgaaaaaa

SEQ ID NO: 25331 - DNA, 22 bp, Artificial Sequence
  chemically synthesized
ttttttgaaaaaatttgttttt

SEQ ID NO: 25332 - DNA, 22 bp, Artificial Sequence
  chemically synthesized
tttttgaaaaaatttgtttttc

SEQ ID NO: 25333 - DNA, 22 bp, Artificial Sequence
  chemically synthesized
ttttgaaaaaatttgtttttca

SEQ ID NO: 25334 - DNA, 22 bp, Artificial Sequence
  chemically synthesized
tttgaaaaaatttgtttttcaa

SEQ ID NO: 25335 - DNA, 22 bp, Artificial Sequence
  chemically synthesized
ttgaaaaaatttgtttttcaac

SEQ ID NO: 25336 - DNA, 22 bp, Artificial Sequence
  chemically synthesized
tgaaaaaatttgtttttcaacc

SEQ ID NO: 25337 - DNA, 22 bp, Artificial Sequence
  chemically synthesized
gaaaaaatttgtttttcaaccc

SEQ ID NO: 25338 - DNA, 22 bp, Artificial Sequence
  chemically synthesized
aaaaaatttgtttttcaacccc

SEQ ID NO: 25339 - DNA, 22 bp, Artificial Sequence
  chemically synthesized
gtttttcaacccctaagctgcc

SEQ ID NO: 25340 - DNA, 22 bp, Artificial Sequence
  chemically synthesized
tttttcaacccctaagctgcct

SEQ ID NO: 25341 - DNA, 22 bp, Artificial Sequence
  chemically synthesized
ttcaacccctaagctgccttta

SEQ ID NO: 25342 - DNA, 22 bp, Artificial Sequence
  chemically synthesized
tcaacccctaagctgcctttaa

SEQ ID NO: 25343 - DNA, 22 bp, Artificial Sequence
  chemically synthesized
caacccctaagctgcctttaat

SEQ ID NO: 25344 - DNA, 22 bp, Artificial Sequence
  chemically synthesized
aacccctaagctgcctttaata

SEQ ID NO: 25345 - DNA, 22 bp, Artificial Sequence
  chemically synthesized
agctgcctttaatacttatttt

SEQ ID NO: 25346 - DNA, 22 bp, Artificial Sequence
  chemically synthesized
cctttaatacttattttctatc

SEQ ID NO: 25347 - DNA, 22 bp, Artificial Sequence
  chemically synthesized
taatacttattttctatcattt

SEQ ID NO: 25348 - DNA, 22 bp, Artificial Sequence
  chemically synthesized
aatacttattttctatcatttc

SEQ ID NO: 25349 - DNA, 22 bp, Artificial Sequence
  chemically synthesized
atacttattttctatcatttcc

SEQ ID NO: 25350 - DNA, 22 bp, Artificial Sequence
  chemically synthesized
attttctatcatttccctttca

SEQ ID NO: 25351 - DNA, 22 bp, Artificial Sequence
  chemically synthesized
ttttctatcatttccctttcaa

SEQ ID NO: 25352 - DNA, 22 bp, Artificial Sequence
  chemically synthesized
tctatcatttccctttcaaggg

SEQ ID NO: 25353 - DNA, 22 bp, Artificial Sequence
  chemically synthesized
ctatcatttccctttcaagggg

SEQ ID NO: 25354 - DNA, 22 bp, Artificial Sequence
  chemically synthesized
tatcatttccctttcaagggga

SEQ ID NO: 25355 - DNA, 22 bp, Artificial Sequence
  chemically synthesized
tcatttccctttcaaggggaag

SEQ ID NO: 25356 - DNA, 22 bp, Artificial Sequence
  chemically synthesized
ccctttcaaggggaagggaagt

SEQ ID NO: 25357 - DNA, 22 bp, Artificial Sequence
  chemically synthesized
cctttcaaggggaagggaagtg

SEQ ID NO: 25358 - DNA, 22 bp, Artificial Sequence
  chemically synthesized
tcaaggggaagggaagtgtttt

SEQ ID NO: 25359 - DNA, 22 bp, Artificial Sequence
  chemically synthesized
caaggggaagggaagtgttttt

SEQ ID NO: 25360 - DNA, 22 bp, Artificial Sequence
  chemically synthesized
aaggggaagggaagtgtttttg

SEQ ID NO: 25361 - DNA, 22 bp, Artificial Sequence
  chemically synthesized
ttgtggagaggtccccacaatg

SEQ ID NO: 25362 - DNA, 22 bp, Artificial Sequence
  chemically synthesized
tgtggagaggtccccacaatgt

SEQ ID NO: 25363 - DNA, 22 bp, Artificial Sequence
  chemically synthesized
gtggagaggtccccacaatgtg

SEQ ID NO: 25364 - DNA, 22 bp, Artificial Sequence
  chemically synthesized
tggagaggtccccacaatgtga

SEQ ID NO: 25365 - DNA, 22 bp, Artificial Sequence
  chemically synthesized
acacaagttgatatcatcttca

SEQ ID NO: 25366 - DNA, 22 bp, Artificial Sequence
  chemically synthesized
cacaagttgatatcatcttcaa

SEQ ID NO: 25367 - DNA, 22 bp, Artificial Sequence
  chemically synthesized
atatcatcttcaatgtatcttt

SEQ ID NO: 25368 - DNA, 22 bp, Artificial Sequence
  chemically synthesized
caatgtatctttattttaatat

SEQ ID NO: 25369 - DNA, 22 bp, Artificial Sequence
  chemically synthesized
aatgtatctttattttaatatt

SEQ ID NO: 25370 - DNA, 22 bp, Artificial Sequence
  chemically synthesized
tattttaatattatcatagcct

SEQ ID NO: 25371 - DNA, 22 bp, Artificial Sequence
  chemically synthesized
attttaatattatcatagcctg

SEQ ID NO: 25372 - DNA, 22 bp, Artificial Sequence
  chemically synthesized
ttttaatattatcatagcctgg

SEQ ID NO: 25373 - DNA, 22 bp, Artificial Sequence
  chemically synthesized
taatattatcatagcctggtat

SEQ ID NO: 25374 - DNA, 22 bp, Artificial Sequence
  chemically synthesized
aatattatcatagcctggtatg

SEQ ID NO: 25375 - DNA, 22 bp, Artificial Sequence
  chemically synthesized
atattatcatagcctggtatgg

SEQ ID NO: 25376 - DNA, 22 bp, Artificial Sequence
  chemically synthesized
tcatagcctggtatggtttgag

SEQ ID NO: 25377 - DNA, 22 bp, Artificial Sequence
  chemically synthesized
gtatggtttgagattttcatat

SEQ ID NO: 25378 - DNA, 22 bp, Artificial Sequence
  chemically synthesized
gagattttcatatagatggata

SEQ ID NO: 25379 - DNA, 22 bp, Artificial Sequence
  chemically synthesized
agattttcatatagatggataa

SEQ ID NO: 25380 - DNA, 22 bp, Artificial Sequence
  chemically synthesized
tcatatagatggataattattg

SEQ ID NO: 25381 - DNA, 22 bp, Artificial Sequence
  chemically synthesized
catatagatggataattattgt

SEQ ID NO: 25382 - DNA, 22 bp, Artificial Sequence
  chemically synthesized
atatagatggataattattgtg

SEQ ID NO: 25383 - DNA, 22 bp, Artificial Sequence
  chemically synthesized
ttgtgtttattcctaataatac

SEQ ID NO: 25384 - DNA, 22 bp, Artificial Sequence
  chemically synthesized
tgtttattcctaataatacatt

SEQ ID NO: 25385 - DNA, 22 bp, Artificial Sequence
  chemically synthesized
attcctaataatacattgccac

SEQ ID NO: 25386 - DNA, 22 bp, Artificial Sequence
  chemically synthesized
ttcctaataatacattgccact

SEQ ID NO: 25387 - DNA, 22 bp, Artificial Sequence
  chemically synthesized
ctaataatacattgccactata

SEQ ID NO: 25388 - DNA, 22 bp, Artificial Sequence
  chemically synthesized
ataatacattgccactatagtt

SEQ ID NO: 25389 - DNA, 22 bp, Artificial Sequence
  chemically synthesized
ccactatagtttctttaaattt

SEQ ID NO: 25390 - DNA, 22 bp, Artificial Sequence
  chemically synthesized
tagtttctttaaatttaatgat

SEQ ID NO: 25391 - DNA, 22 bp, Artificial Sequence
  chemically synthesized
ctttaaatttaatgatttgaat

SEQ ID NO: 25392 - DNA, 22 bp, Artificial Sequence
  chemically synthesized
tttaaatttaatgatttgaatt

SEQ ID NO: 25393 - DNA, 22 bp, Artificial Sequence
  chemically synthesized
taaatttaatgatttgaatttt

SEQ ID NO: 25394 - DNA, 22 bp, Artificial Sequence
  chemically synthesized
aaatttaatgatttgaattttt

SEQ ID NO: 25395 - DNA, 22 bp, Artificial Sequence
  chemically synthesized
aatttaatgatttgaattttta

SEQ ID NO: 25396 - DNA, 22 bp, Artificial Sequence
  chemically synthesized
aatgatttgaatttttacttcc

SEQ ID NO: 25397 - DNA, 22 bp, Artificial Sequence
  chemically synthesized
atgatttgaatttttacttccc

SEQ ID NO: 25398 - DNA, 22 bp, Artificial Sequence
  chemically synthesized
gaatttttacttccctgcattt

SEQ ID NO: 25399 - DNA, 22 bp, Artificial Sequence
  chemically synthesized
aatttttacttccctgcatttc

SEQ ID NO: 25400 - DNA, 22 bp, Artificial Sequence
  chemically synthesized
ttacttccctgcatttcatagt

SEQ ID NO: 25401 - DNA, 22 bp, Artificial Sequence
  chemically synthesized
tacttccctgcatttcatagta

SEQ ID NO: 25402 - DNA, 22 bp, Artificial Sequence
  chemically synthesized
acttccctgcatttcatagtag

SEQ ID NO: 25403 - DNA, 22 bp, Artificial Sequence
  chemically synthesized
cttccctgcatttcatagtagt

SEQ ID NO: 25404 - DNA, 22 bp, Artificial Sequence
  chemically synthesized
ccctgcatttcatagtagtgat

SEQ ID NO: 25405 - DNA, 22 bp, Artificial Sequence
  chemically synthesized
cctgcatttcatagtagtgata

SEQ ID NO: 25406 - DNA, 22 bp, Artificial Sequence
  chemically synthesized
catttcatagtagtgatatgag

SEQ ID NO: 25407 - DNA, 22 bp, Artificial Sequence
  chemically synthesized
catagtagtgatatgaggtatc

SEQ ID NO: 25408 - DNA, 22 bp, Artificial Sequence
  chemically synthesized
atagtagtgatatgaggtatct

SEQ ID NO: 25409 - DNA, 22 bp, Artificial Sequence
  chemically synthesized
agagatcatgaatcccactcct

SEQ ID NO: 25410 - DNA, 22 bp, Artificial Sequence
  chemically synthesized
gagatcatgaatcccactcctc

SEQ ID NO: 25411 - DNA, 22 bp, Artificial Sequence
  chemically synthesized
ctccagttcatagagcaaattg

SEQ ID NO: 25412 - DNA, 22 bp, Artificial Sequence
  chemically synthesized
cagttcatagagcaaattgatt

SEQ ID NO: 25413 - DNA, 22 bp, Artificial Sequence
  chemically synthesized
atagagcaaattgattcgtaga

SEQ ID NO: 25414 - DNA, 22 bp, Artificial Sequence
  chemically synthesized
attcgtagaggtatttaatgat

SEQ ID NO: 25415 - DNA, 22 bp, Artificial Sequence
  chemically synthesized
gtagaggtatttaatgatcaag

SEQ ID NO: 25416 - DNA, 22 bp, Artificial Sequence
  chemically synthesized
aatgatcaagcaaatggcagag

SEQ ID NO: 25417 - DNA, 22 bp, Artificial Sequence
  chemically synthesized
atgatcaagcaaatggcagagt

SEQ ID NO: 25418 - DNA, 22 bp, Artificial Sequence
  chemically synthesized
ggaccaggatttaggtcttttc

SEQ ID NO: 25419 - DNA, 22 bp, Artificial Sequence
  chemically synthesized
aggtcttttccaaggccaattc

SEQ ID NO: 25420 - DNA, 22 bp, Artificial Sequence
  chemically synthesized
ggtcttttccaaggccaattca

SEQ ID NO: 25421 - DNA, 22 bp, Artificial Sequence
  chemically synthesized
ttccaaggccaattcacttttt

SEQ ID NO: 25422 - DNA, 22 bp, Artificial Sequence
  chemically synthesized
tccaaggccaattcactttttt

SEQ ID NO: 25423 - DNA, 22 bp, Artificial Sequence
  chemically synthesized
ccaaggccaattcactttttta

SEQ ID NO: 25424 - DNA, 22 bp, Artificial Sequence
  chemically synthesized
caaggccaattcacttttttac

SEQ ID NO: 25425 - DNA, 22 bp, Artificial Sequence
  chemically synthesized
acttttttactattatgtaaga

SEQ ID NO: 25426 - DNA, 22 bp, Artificial Sequence
  chemically synthesized
ttttactattatgtaagaatta

SEQ ID NO: 25427 - DNA, 22 bp, Artificial Sequence
  chemically synthesized
tttactattatgtaagaattaa

SEQ ID NO: 25428 - DNA, 22 bp, Artificial Sequence
  chemically synthesized
ttactattatgtaagaattaaa

SEQ ID NO: 25429 - DNA, 22 bp, Artificial Sequence
  chemically synthesized
tactattatgtaagaattaaat

SEQ ID NO: 25430 - DNA, 22 bp, Artificial Sequence
  chemically synthesized
actattatgtaagaattaaata

SEQ ID NO: 25431 - DNA, 22 bp, Artificial Sequence
  chemically synthesized
ctattatgtaagaattaaatat

SEQ ID NO: 25432 - DNA, 22 bp, Artificial Sequence
  chemically synthesized
ttatgtaagaattaaatattaa

SEQ ID NO: 25433 - DNA, 22 bp, Artificial Sequence
  chemically synthesized
tgtaagaattaaatattaaaac

SEQ ID NO: 25434 - DNA, 22 bp, Artificial Sequence
  chemically synthesized
aatattaaaacctcagttttca

SEQ ID NO: 25435 - DNA, 22 bp, Artificial Sequence
  chemically synthesized
aaacctcagttttcaaaggaaa

SEQ ID NO: 25436 - DNA, 22 bp, Artificial Sequence
  chemically synthesized
agttttcaaaggaaatgtccta

SEQ ID NO: 25437 - DNA, 22 bp, Artificial Sequence
  chemically synthesized
tcaaaggaaatgtcctatagat

SEQ ID NO: 25438 - DNA, 22 bp, Artificial Sequence
  chemically synthesized
caaaggaaatgtcctatagatg

SEQ ID NO: 25439 - DNA, 22 bp, Artificial Sequence
  chemically synthesized
aaaggaaatgtcctatagatga

SEQ ID NO: 25440 - DNA, 22 bp, Artificial Sequence
  chemically synthesized
tagatgaaagaacacagtactt

SEQ ID NO: 25441 - DNA, 22 bp, Artificial Sequence
  chemically synthesized
gcagtcaaaggtcttggatttc

SEQ ID NO: 25442 - DNA, 22 bp, Artificial Sequence
  chemically synthesized
cagtcaaaggtcttggatttct

SEQ ID NO: 25443 - DNA, 22 bp, Artificial Sequence
  chemically synthesized
ggatttctgaaactttctgaaa

SEQ ID NO: 25444 - DNA, 22 bp, Artificial Sequence
  chemically synthesized
gatttctgaaactttctgaaaa

SEQ ID NO: 25445 - DNA, 22 bp, Artificial Sequence
  chemically synthesized
ctgaaactttctgaaaaagaac

SEQ ID NO: 25446 - DNA, 22 bp, Artificial Sequence
  chemically synthesized
tgaaactttctgaaaaagaacc

SEQ ID NO: 25447 - DNA, 22 bp, Artificial Sequence
  chemically synthesized
aaactttctgaaaaagaacccc

SEQ ID NO: 25448 - DNA, 22 bp, Artificial Sequence
  chemically synthesized
tctgaaaaagaaccccttaaac

SEQ ID NO: 25449 - DNA, 22 bp, Artificial Sequence
  chemically synthesized
ctgaaaaagaaccccttaaact

SEQ ID NO: 25450 - DNA, 22 bp, Artificial Sequence
  chemically synthesized
tgaaaaagaaccccttaaactg

SEQ ID NO: 25451 - DNA, 22 bp, Artificial Sequence
  chemically synthesized
aaaaagaaccccttaaactgaa

SEQ ID NO: 25452 - DNA, 22 bp, Artificial Sequence
  chemically synthesized
aaactgaataacagtttcttca

SEQ ID NO: 25453 - DNA, 22 bp, Artificial Sequence
  chemically synthesized
aactgaataacagtttcttcat

SEQ ID NO: 25454 - DNA, 22 bp, Artificial Sequence
  chemically synthesized
aataacagtttcttcatgaata

SEQ ID NO: 25455 - DNA, 22 bp, Artificial Sequence
  chemically synthesized
cttcatgaataaaatgaatgtt

SEQ ID NO: 25456 - DNA, 22 bp, Artificial Sequence
  chemically synthesized
ttcatgaataaaatgaatgtta

SEQ ID NO: 25457 - DNA, 22 bp, Artificial Sequence
  chemically synthesized
catgaataaaatgaatgttata

SEQ ID NO: 25458 - DNA, 22 bp, Artificial Sequence
  chemically synthesized
atgaataaaatgaatgttatac

SEQ ID NO: 25459 - DNA, 22 bp, Artificial Sequence
  chemically synthesized
tactctccagttatcttaccat

SEQ ID NO: 25460 - DNA, 22 bp, Artificial Sequence
  chemically synthesized
tccagttatcttaccatgtttt

SEQ ID NO: 25461 - DNA, 22 bp, Artificial Sequence
  chemically synthesized
cagttatcttaccatgttttct

SEQ ID NO: 25462 - DNA, 22 bp, Artificial Sequence
  chemically synthesized
tcttaccatgttttctggcaaa

SEQ ID NO: 25463 - DNA, 22 bp, Artificial Sequence
  chemically synthesized
accatgttttctggcaaacaag

SEQ ID NO: 25464 - DNA, 22 bp, Artificial Sequence
  chemically synthesized
ccatgttttctggcaaacaagg

SEQ ID NO: 25465 - DNA, 22 bp, Artificial Sequence
  chemically synthesized
tctggcaaacaaggaaatgtat

SEQ ID NO: 25466 - DNA, 22 bp, Artificial Sequence
  chemically synthesized
ctggcaaacaaggaaatgtatt

SEQ ID NO: 25467 - DNA, 22 bp, Artificial Sequence
  chemically synthesized
tggcaaacaaggaaatgtattc

SEQ ID NO: 25468 - DNA, 22 bp, Artificial Sequence
  chemically synthesized
gcaaacaaggaaatgtattcac

SEQ ID NO: 25469 - DNA, 22 bp, Artificial Sequence
  chemically synthesized
acatccaagaaaacaaaaggtt

SEQ ID NO: 25470 - DNA, 22 bp, Artificial Sequence
  chemically synthesized
cttaggagaagaatcccttgct

SEQ ID NO: 25471 - DNA, 22 bp, Artificial Sequence
  chemically synthesized
ttaggagaagaatcccttgctg

SEQ ID NO: 25472 - DNA, 22 bp, Artificial Sequence
  chemically synthesized
aggagaagaatcccttgctgcc

SEQ ID NO: 25473 - DNA, 22 bp, Artificial Sequence
  chemically synthesized
ggagaagaatcccttgctgcca

SEQ ID NO: 25474 - DNA, 22 bp, Artificial Sequence
  chemically synthesized
gctgccagaattttgcccatga

SEQ ID NO: 25475 - DNA, 22 bp, Artificial Sequence
  chemically synthesized
ctgccagaattttgcccatgaa

SEQ ID NO: 25476 - DNA, 22 bp, Artificial Sequence
  chemically synthesized
ccagaattttgcccatgaacaa

SEQ ID NO: 25477 - DNA, 22 bp, Artificial Sequence
  chemically synthesized
tgcccatgaacaatggaaacgt

SEQ ID NO: 25478 - DNA, 22 bp, Artificial Sequence
  chemically synthesized
gcccatgaacaatggaaacgtg

SEQ ID NO: 25479 - DNA, 22 bp, Artificial Sequence
  chemically synthesized
cccatgaacaatggaaacgtga

SEQ ID NO: 25480 - DNA, 22 bp, Artificial Sequence
  chemically synthesized
gttttgggtactaattctcaga

SEQ ID NO: 25481 - DNA, 22 bp, Artificial Sequence
  chemically synthesized
tgggtactaattctcagacttc

SEQ ID NO: 25482 - DNA, 22 bp, Artificial Sequence
  chemically synthesized
gggtactaattctcagacttca

SEQ ID NO: 25483 - DNA, 22 bp, Artificial Sequence
  chemically synthesized
ggtactaattctcagacttcaa

SEQ ID NO: 25484 - DNA, 22 bp, Artificial Sequence
  chemically synthesized
attctcagacttcaaaataacc

SEQ ID NO: 25485 - DNA, 22 bp, Artificial Sequence
  chemically synthesized
tcagacttcaaaataacctttt

SEQ ID NO: 25486 - DNA, 22 bp, Artificial Sequence
  chemically synthesized
agacttcaaaataaccttttta

SEQ ID NO: 25487 - DNA, 22 bp, Artificial Sequence
  chemically synthesized
caaaataacctttttaatttat

SEQ ID NO: 25488 - DNA, 22 bp, Artificial Sequence
  chemically synthesized
aaaataacctttttaatttatt

SEQ ID NO: 25489 - DNA, 22 bp, Artificial Sequence
  chemically synthesized
tttaatttattaatattaacct

SEQ ID NO: 25490 - DNA, 22 bp, Artificial Sequence
  chemically synthesized
ttaatttattaatattaacctt

SEQ ID NO: 25491 - DNA, 22 bp, Artificial Sequence
  chemically synthesized
taatttattaatattaaccttg

SEQ ID NO: 25492 - DNA, 22 bp, Artificial Sequence
  chemically synthesized
aatttattaatattaaccttga

SEQ ID NO: 25493 - DNA, 22 bp, Artificial Sequence
  chemically synthesized
atttattaatattaaccttgaa

SEQ ID NO: 25494 - DNA, 22 bp, Artificial Sequence
  chemically synthesized
attaatattaaccttgaaattt

SEQ ID NO: 25495 - DNA, 22 bp, Artificial Sequence
  chemically synthesized
ttaatattaaccttgaaattta

SEQ ID NO: 25496 - DNA, 22 bp, Artificial Sequence
  chemically synthesized
atattaaccttgaaatttattg

SEQ ID NO: 25497 - DNA, 22 bp, Artificial Sequence
  chemically synthesized
accttgaaatttattgctttta

SEQ ID NO: 25498 - DNA, 22 bp, Artificial Sequence
  chemically synthesized
gaaatttattgcttttattcat

SEQ ID NO: 25499 - DNA, 22 bp, Artificial Sequence
  chemically synthesized
aaatttattgcttttattcatt

SEQ ID NO: 25500 - DNA, 22 bp, Artificial Sequence
  chemically synthesized
attgcttttattcattaatcca

SEQ ID NO: 25501 - DNA, 22 bp, Artificial Sequence
  chemically synthesized
ttgcttttattcattaatccat

SEQ ID NO: 25502 - DNA, 22 bp, Artificial Sequence
  chemically synthesized
cttttattcattaatccatttt

SEQ ID NO: 25503 - DNA, 22 bp, Artificial Sequence
  chemically synthesized
ttattcattaatccattttatt

SEQ ID NO: 25504 - DNA, 22 bp, Artificial Sequence
  chemically synthesized
tattcattaatccattttatta

SEQ ID NO: 25505 - DNA, 22 bp, Artificial Sequence
  chemically synthesized
attcattaatccattttattat

SEQ ID NO: 25506 - DNA, 22 bp, Artificial Sequence
  chemically synthesized
ttcattaatccattttattatt

SEQ ID NO: 25507 - DNA, 22 bp, Artificial Sequence
  chemically synthesized
attaatccattttattattcag

SEQ ID NO: 25508 - DNA, 22 bp, Artificial Sequence
  chemically synthesized
atccattttattattcagtaag

SEQ ID NO: 25509 - DNA, 22 bp, Artificial Sequence
  chemically synthesized
tattattcagtaaggattcatc

SEQ ID NO: 25510 - DNA, 22 bp, Artificial Sequence
  chemically synthesized
attattcagtaaggattcatca

SEQ ID NO: 25511 - DNA, 22 bp, Artificial Sequence
  chemically synthesized
ttattcagtaaggattcatcaa

SEQ ID NO: 25512 - DNA, 22 bp, Artificial Sequence
  chemically synthesized
ttcagtaaggattcatcaagtg

SEQ ID NO: 25513 - DNA, 22 bp, Artificial Sequence
  chemically synthesized
agtaaggattcatcaagtgtct

SEQ ID NO: 25514 - DNA, 22 bp, Artificial Sequence
  chemically synthesized
atcaagtgtctattaggtatca

SEQ ID NO: 25515 - DNA, 22 bp, Artificial Sequence
  chemically synthesized
ttaggtatcaggcactgagagg

SEQ ID NO: 25516 - DNA, 22 bp, Artificial Sequence
  chemically synthesized
ggtatcaggcactgagaggcga

SEQ ID NO: 25517 - DNA, 22 bp, Artificial Sequence
  chemically synthesized
agaggcgagggagatagagtta

SEQ ID NO: 25518 - DNA, 22 bp, Artificial Sequence
  chemically synthesized
agaatacagaactgattcttaa

SEQ ID NO: 25519 - DNA, 22 bp, Artificial Sequence
  chemically synthesized
attcttaatcttcaagaattga

SEQ ID NO: 25520 - DNA, 22 bp, Artificial Sequence
  chemically synthesized
ttaatcttcaagaattgacaaa

SEQ ID NO: 25521 - DNA, 22 bp, Artificial Sequence
  chemically synthesized
aatcttcaagaattgacaaatt

SEQ ID NO: 25522 - DNA, 22 bp, Artificial Sequence
  chemically synthesized
atcttcaagaattgacaaattt

SEQ ID NO: 25523 - DNA, 22 bp, Artificial Sequence
  chemically synthesized
caagaattgacaaatttgtaga

SEQ ID NO: 25524 - DNA, 22 bp, Artificial Sequence
  chemically synthesized
aagaattgacaaatttgtagaa

SEQ ID NO: 25525 - DNA, 22 bp, Artificial Sequence
  chemically synthesized
acaaatttgtagaaggtagaca

SEQ ID NO: 25526 - DNA, 22 bp, Artificial Sequence
  chemically synthesized
gtagaaggtagacattgaacat

SEQ ID NO: 25527 - DNA, 22 bp, Artificial Sequence
  chemically synthesized
tagaaggtagacattgaacata

SEQ ID NO: 25528 - DNA, 22 bp, Artificial Sequence
  chemically synthesized
aacatacaatacagtcaaatgt

SEQ ID NO: 25529 - DNA, 22 bp, Artificial Sequence
  chemically synthesized
agggaaccaggtgtcctaagac

SEQ ID NO: 25530 - DNA, 22 bp, Artificial Sequence
  chemically synthesized
agactatacagtgtaccgtgga

SEQ ID NO: 25531 - DNA, 22 bp, Artificial Sequence
  chemically synthesized
tacagtgtaccgtggaatgggg

SEQ ID NO: 25532 - DNA, 22 bp, Artificial Sequence
  chemically synthesized
ctaacctagttacctagaggtt

SEQ ID NO: 25533 - DNA, 22 bp, Artificial Sequence
  chemically synthesized
taacctagttacctagaggttt

SEQ ID NO: 25534 - DNA, 22 bp, Artificial Sequence
  chemically synthesized
acctagttacctagaggtttgg

SEQ ID NO: 25535 - DNA, 22 bp, Artificial Sequence
  chemically synthesized
gttacctagaggtttgggaaaa

SEQ ID NO: 25536 - DNA, 22 bp, Artificial Sequence
  chemically synthesized
cctagaggtttgggaaaaacct

SEQ ID NO: 25537 - DNA, 22 bp, Artificial Sequence
  chemically synthesized
gaggtttgggaaaaacctctct

SEQ ID NO: 25538 - DNA, 22 bp, Artificial Sequence
  chemically synthesized
gggaaaaacctctctaatgatg

SEQ ID NO: 25539 - DNA, 22 bp, Artificial Sequence
  chemically synthesized
ggaaaaacctctctaatgatga

SEQ ID NO: 25540 - DNA, 22 bp, Artificial Sequence
  chemically synthesized
tctaatgatgagatgtttgagc

SEQ ID NO: 25541 - DNA, 22 bp, Artificial Sequence
  chemically synthesized
taatgatgagatgtttgagctg

SEQ ID NO: 25542 - DNA, 22 bp, Artificial Sequence
  chemically synthesized
atgatgagatgtttgagctgac

SEQ ID NO: 25543 - DNA, 22 bp, Artificial Sequence
  chemically synthesized
gagctgacacttgaaggataaa

SEQ ID NO: 25544 - DNA, 22 bp, Artificial Sequence
  chemically synthesized
agctgacacttgaaggataaat

SEQ ID NO: 25545 - DNA, 22 bp, Artificial Sequence
  chemically synthesized
acacttgaaggataaatagcta

SEQ ID NO: 25546 - DNA, 22 bp, Artificial Sequence
  chemically synthesized
gaaggataaatagctaaagggg

SEQ ID NO: 25547 - DNA, 22 bp, Artificial Sequence
  chemically synthesized
aaggataaatagctaaagggga

SEQ ID NO: 25548 - DNA, 22 bp, Artificial Sequence
  chemically synthesized
aaggggagaaagcgttctatgt

SEQ ID NO: 25549 - DNA, 22 bp, Artificial Sequence
  chemically synthesized
tatgtgagagaactatatatgc

SEQ ID NO: 25550 - DNA, 22 bp, Artificial Sequence
  chemically synthesized
tgtgagagaactatatatgcca

SEQ ID NO: 25551 - DNA, 22 bp, Artificial Sequence
  chemically synthesized
tatatgccaagatgcagaagtg

SEQ ID NO: 25552 - DNA, 22 bp, Artificial Sequence
  chemically synthesized
tctgttcgaagatctgagcggg

SEQ ID NO: 25553 - DNA, 22 bp, Artificial Sequence
  chemically synthesized
tgttcgaagatctgagcggggc

SEQ ID NO: 25554 - DNA, 22 bp, Artificial Sequence
  chemically synthesized
ttcgaagatctgagcggggctc

SEQ ID NO: 25555 - DNA, 22 bp, Artificial Sequence
  chemically synthesized
gaagatctgagcggggctcaga

SEQ ID NO: 25556 - DNA, 22 bp, Artificial Sequence
  chemically synthesized
agcggggctcagagagggaaaa

SEQ ID NO: 25557 - DNA, 22 bp, Artificial Sequence
  chemically synthesized
agagagggaaaaggagaggagt

SEQ ID NO: 25558 - DNA, 22 bp, Artificial Sequence
  chemically synthesized
cagggactagattgtgaagctc

SEQ ID NO: 25559 - DNA, 22 bp, Artificial Sequence
  chemically synthesized
gattgtgaagctcagggggagt

SEQ ID NO: 25560 - DNA, 22 bp, Artificial Sequence
  chemically synthesized
tgaagctcagggggagttaata

SEQ ID NO: 25561 - DNA, 22 bp, Artificial Sequence
  chemically synthesized
agggggagttaatagccttaag

SEQ ID NO: 25562 - DNA, 22 bp, Artificial Sequence
  chemically synthesized
atagccttaaggagttttgtct

SEQ ID NO: 25563 - DNA, 22 bp, Artificial Sequence
  chemically synthesized
aaggagttttgtctccagggta

SEQ ID NO: 25564 - DNA, 22 bp, Artificial Sequence
  chemically synthesized
aggagttttgtctccagggtat

SEQ ID NO: 25565 - DNA, 22 bp, Artificial Sequence
  chemically synthesized
tgtctccagggtatgaacaatg

SEQ ID NO: 25566 - DNA, 22 bp, Artificial Sequence
  chemically synthesized
gtctccagggtatgaacaatga

SEQ ID NO: 25567 - DNA, 22 bp, Artificial Sequence
  chemically synthesized
tctccagggtatgaacaatgaa

SEQ ID NO: 25568 - DNA, 22 bp, Artificial Sequence
  chemically synthesized
cagggtatgaacaatgaatgag

SEQ ID NO: 25569 - DNA, 22 bp, Artificial Sequence
  chemically synthesized
aaattctatccacagtagtggg

SEQ ID NO: 25570 - DNA, 22 bp, Artificial Sequence
  chemically synthesized
tatccacagtagtgggaagtac

SEQ ID NO: 25571 - DNA, 22 bp, Artificial Sequence
  chemically synthesized
tccacagtagtgggaagtacta

SEQ ID NO: 25572 - DNA, 22 bp, Artificial Sequence
  chemically synthesized
agtagtcaggtatgttttggaa

SEQ ID NO: 25573 - DNA, 22 bp, Artificial Sequence
  chemically synthesized
tggaagaagcactgttaccagt

SEQ ID NO: 25574 - DNA, 22 bp, Artificial Sequence
  chemically synthesized
ggaagaagcactgttaccagtt

SEQ ID NO: 25575 - DNA, 22 bp, Artificial Sequence
  chemically synthesized
gaagaagcactgttaccagttg

SEQ ID NO: 25576 - DNA, 22 bp, Artificial Sequence
  chemically synthesized
ttaccagttgagggagaggaga

SEQ ID NO: 25577 - DNA, 22 bp, Artificial Sequence
  chemically synthesized
ccagttgagggagaggagagga

SEQ ID NO: 25578 - DNA, 22 bp, Artificial Sequence
  chemically synthesized
agggagaggagaggagggaaat

SEQ ID NO: 25579 - DNA, 22 bp, Artificial Sequence
  chemically synthesized
gactgtggtgtgacccaggatg

SEQ ID NO: 25580 - DNA, 22 bp, Artificial Sequence
  chemically synthesized
tggtgtgacccaggatggaaag

SEQ ID NO: 25581 - DNA, 22 bp, Artificial Sequence
  chemically synthesized
tgcccaaatgtgggggaaaaat

SEQ ID NO: 25582 - DNA, 22 bp, Artificial Sequence
  chemically synthesized
gcccaaatgtgggggaaaaatg

SEQ ID NO: 25583 - DNA, 22 bp, Artificial Sequence
  chemically synthesized
cccaaatgtgggggaaaaatgt

SEQ ID NO: 25584 - DNA, 22 bp, Artificial Sequence
  chemically synthesized
actctctcctttgcccaggtct

SEQ ID NO: 25585 - DNA, 22 bp, Artificial Sequence
  chemically synthesized
ctctctcctttgcccaggtctt

SEQ ID NO: 25586 - DNA, 22 bp, Artificial Sequence
  chemically synthesized
tctcctttgcccaggtcttact

SEQ ID NO: 25587 - DNA, 22 bp, Artificial Sequence
  chemically synthesized
tcctttgcccaggtcttactac

SEQ ID NO: 25588 - DNA, 22 bp, Artificial Sequence
  chemically synthesized
ctttgcccaggtcttactacaa

SEQ ID NO: 25589 - DNA, 22 bp, Artificial Sequence
  chemically synthesized
tgcccaggtcttactacaatca

SEQ ID NO: 25590 - DNA, 22 bp, Artificial Sequence
  chemically synthesized
gcccaggtcttactacaatcat

SEQ ID NO: 25591 - DNA, 22 bp, Artificial Sequence
  chemically synthesized
cccaggtcttactacaatcatt

SEQ ID NO: 25592 - DNA, 22 bp, Artificial Sequence
  chemically synthesized
actacaatcatttcttctgcac

SEQ ID NO: 25593 - DNA, 22 bp, Artificial Sequence
  chemically synthesized
ctacaatcatttcttctgcaca

SEQ ID NO: 25594 - DNA, 22 bp, Artificial Sequence
  chemically synthesized
caatcatttcttctgcacacac

SEQ ID NO: 25595 - DNA, 22 bp, Artificial Sequence
  chemically synthesized
cttctgcacacacttgctcaga

SEQ ID NO: 25596 - DNA, 22 bp, Artificial Sequence
  chemically synthesized
ttctgcacacacttgctcagaa

SEQ ID NO: 25597 - DNA, 22 bp, Artificial Sequence
  chemically synthesized
ctgcacacacttgctcagaaca

SEQ ID NO: 25598 - DNA, 22 bp, Artificial Sequence
  chemically synthesized
tgcacacacttgctcagaacat

SEQ ID NO: 25599 - DNA, 22 bp, Artificial Sequence
  chemically synthesized
cacacacttgctcagaacatta

SEQ ID NO: 25600 - DNA, 22 bp, Artificial Sequence
  chemically synthesized
gctcagaacattacaaactctg

SEQ ID NO: 25601 - DNA, 22 bp, Artificial Sequence
  chemically synthesized
ctcagaacattacaaactctgg

SEQ ID NO: 25602 - DNA, 22 bp, Artificial Sequence
  chemically synthesized
agaacattacaaactctggaga

SEQ ID NO: 25603 - DNA, 22 bp, Artificial Sequence
  chemically synthesized
caaactctggagaaattaacat

SEQ ID NO: 25604 - DNA, 22 bp, Artificial Sequence
  chemically synthesized
tggagaaattaacatgttaagg

SEQ ID NO: 25605 - DNA, 22 bp, Artificial Sequence
  chemically synthesized
gagaaattaacatgttaaggat

SEQ ID NO: 25606 - DNA, 22 bp, Artificial Sequence
  chemically synthesized
acatgttaaggatatttaggat

SEQ ID NO: 25607 - DNA, 22 bp, Artificial Sequence
  chemically synthesized
aggatatttaggatcattaaaa

SEQ ID NO: 25608 - DNA, 22 bp, Artificial Sequence
  chemically synthesized
aggatcattaaaaaagtttaat

SEQ ID NO: 25609 - DNA, 22 bp, Artificial Sequence
  chemically synthesized
ggatcattaaaaaagtttaata

SEQ ID NO: 25610 - DNA, 22 bp, Artificial Sequence
  chemically synthesized
aaaaagtttaataaatgttgtc

SEQ ID NO: 25611 - DNA, 22 bp, Artificial Sequence
  chemically synthesized
aataaatgttgtcacacataat

SEQ ID NO: 25612 - DNA, 22 bp, Artificial Sequence
  chemically synthesized
ataaatgttgtcacacataatg

SEQ ID NO: 25613 - DNA, 22 bp, Artificial Sequence
  chemically synthesized
tcacacataatgaaagttaatt

SEQ ID NO: 25614 - DNA, 22 bp, Artificial Sequence
  chemically synthesized
atttaagaattgtaaagacttg

SEQ ID NO: 25615 - DNA, 22 bp, Artificial Sequence
  chemically synthesized
aagaattgtaaagacttgagcg

SEQ ID NO: 25616 - DNA, 22 bp, Artificial Sequence
  chemically synthesized
agaattgtaaagacttgagcga

SEQ ID NO: 25617 - DNA, 22 bp, Artificial Sequence
  chemically synthesized
taaagacttgagcgatgtagtc

SEQ ID NO: 25618 - DNA, 22 bp, Artificial Sequence
  chemically synthesized
gagcgatgtagtccctaaataa

SEQ ID NO: 25619 - DNA, 22 bp, Artificial Sequence
  chemically synthesized
agcgatgtagtccctaaataaa

SEQ ID NO: 25620 - DNA, 22 bp, Artificial Sequence
  chemically synthesized
aataaatgcttccctcttaaaa

SEQ ID NO: 25621 - DNA, 22 bp, Artificial Sequence
  chemically synthesized
ccctcttaaaatggactagaaa

SEQ ID NO: 25622 - DNA, 22 bp, Artificial Sequence
  chemically synthesized
cctcttaaaatggactagaaac

SEQ ID NO: 25623 - DNA, 22 bp, Artificial Sequence
  chemically synthesized
ttaaaatggactagaaacaatt

SEQ ID NO: 25624 - DNA, 22 bp, Artificial Sequence
  chemically synthesized
aaaatggactagaaacaatttg

SEQ ID NO: 25625 - DNA, 22 bp, Artificial Sequence
  chemically synthesized
aaatggactagaaacaatttgt

SEQ ID NO: 25626 - DNA, 22 bp, Artificial Sequence
  chemically synthesized
gaaacaatttgtttttgcctaa

SEQ ID NO: 25627 - DNA, 22 bp, Artificial Sequence
  chemically synthesized
gtttttgcctaagccaacgtat

SEQ ID NO: 25628 - DNA, 22 bp, Artificial Sequence
  chemically synthesized
tttttgcctaagccaacgtatt

SEQ ID NO: 25629 - DNA, 22 bp, Artificial Sequence
  chemically synthesized
ttgcctaagccaacgtattgct

SEQ ID NO: 25630 - DNA, 22 bp, Artificial Sequence
  chemically synthesized
tgcctaagccaacgtattgctg

SEQ ID NO: 25631 - DNA, 22 bp, Artificial Sequence
  chemically synthesized
gcctaagccaacgtattgctgg

SEQ ID NO: 25632 - DNA, 22 bp, Artificial Sequence
  chemically synthesized
cctaagccaacgtattgctgga

SEQ ID NO: 25633 - DNA, 22 bp, Artificial Sequence
  chemically synthesized
agccaacgtattgctggacata

SEQ ID NO: 25634 - DNA, 22 bp, Artificial Sequence
  chemically synthesized
ctggacataatttacctgcttc

SEQ ID NO: 25635 - DNA, 22 bp, Artificial Sequence
  chemically synthesized
gacataatttacctgcttcctc

SEQ ID NO: 25636 - DNA, 22 bp, Artificial Sequence
  chemically synthesized
acctgcttcctcctcagtcttg

SEQ ID NO: 25637 - DNA, 22 bp, Artificial Sequence
  chemically synthesized
cctgcttcctcctcagtcttga

SEQ ID NO: 25638 - DNA, 22 bp, Artificial Sequence
  chemically synthesized
cttcctcctcagtcttgacact

SEQ ID NO: 25639 - DNA, 22 bp, Artificial Sequence
  chemically synthesized
cctcctcagtcttgacactaca

SEQ ID NO: 25640 - DNA, 22 bp, Artificial Sequence
  chemically synthesized
ctcctcagtcttgacactacac

SEQ ID NO: 25641 - DNA, 22 bp, Artificial Sequence
  chemically synthesized
ctcagtcttgacactacacctc

SEQ ID NO: 25642 - DNA, 22 bp, Artificial Sequence
  chemically synthesized
agtcttgacactacacctctga

SEQ ID NO: 25643 - DNA, 22 bp, Artificial Sequence
  chemically synthesized
gacactacacctctgaattaca

SEQ ID NO: 25644 - DNA, 22 bp, Artificial Sequence
  chemically synthesized
acactacacctctgaattacat

SEQ ID NO: 25645 - DNA, 22 bp, Artificial Sequence
  chemically synthesized
cacctctgaattacatggtaca

SEQ ID NO: 25646 - DNA, 22 bp, Artificial Sequence
  chemically synthesized
tgaattacatggtacaagtggc

SEQ ID NO: 25647 - DNA, 22 bp, Artificial Sequence
  chemically synthesized
aattacatggtacaagtggcac

SEQ ID NO: 25648 - DNA, 22 bp, Artificial Sequence
  chemically synthesized
catggtacaagtggcacaggga

SEQ ID NO: 25649 - DNA, 22 bp, Artificial Sequence
  chemically synthesized
agaaaactagagtcaaagtggt

SEQ ID NO: 25650 - DNA, 22 bp, Artificial Sequence
  chemically synthesized
gagtcaaagtggttatggaaga

SEQ ID NO: 25651 - DNA, 22 bp, Artificial Sequence
  chemically synthesized
tggaagaaattataataatgag

SEQ ID NO: 25652 - DNA, 22 bp, Artificial Sequence
  chemically synthesized
taataatgagtccactcttcta

SEQ ID NO: 25653 - DNA, 22 bp, Artificial Sequence
  chemically synthesized
ttctaggacaggagttctaaag

SEQ ID NO: 25654 - DNA, 22 bp, Artificial Sequence
  chemically synthesized
ctaggacaggagttctaaaggt

SEQ ID NO: 25655 - DNA, 22 bp, Artificial Sequence
  chemically synthesized
taggacaggagttctaaaggtg

SEQ ID NO: 25656 - DNA, 22 bp, Artificial Sequence
  chemically synthesized
ggacaggagttctaaaggtgag

SEQ ID NO: 25657 - DNA, 22 bp, Artificial Sequence
  chemically synthesized
taaaggtgaggactttgatata

SEQ ID NO: 25658 - DNA, 22 bp, Artificial Sequence
  chemically synthesized
aaggtgaggactttgatataag

SEQ ID NO: 25659 - DNA, 22 bp, Artificial Sequence
  chemically synthesized
tgatataagtgaactcaaggag

SEQ ID NO: 25660 - DNA, 22 bp, Artificial Sequence
  chemically synthesized
gatataagtgaactcaaggagt

SEQ ID NO: 25661 - DNA, 22 bp, Artificial Sequence
  chemically synthesized
atataagtgaactcaaggagtt

SEQ ID NO: 25662 - DNA, 22 bp, Artificial Sequence
  chemically synthesized
aaggagtttctaaaccttcaga

SEQ ID NO: 25663 - DNA, 22 bp, Artificial Sequence
  chemically synthesized
ctaaaccttcagaaattatatc

SEQ ID NO: 25664 - DNA, 22 bp, Artificial Sequence
  chemically synthesized
taaaccttcagaaattatatct

SEQ ID NO: 25665 - DNA, 22 bp, Artificial Sequence
  chemically synthesized
aaccttcagaaattatatctaa

SEQ ID NO: 25666 - DNA, 22 bp, Artificial Sequence
  chemically synthesized
cagaaattatatctaaaaatta

SEQ ID NO: 25667 - DNA, 22 bp, Artificial Sequence
  chemically synthesized
agaaattatatctaaaaattag

SEQ ID NO: 25668 - DNA, 22 bp, Artificial Sequence
  chemically synthesized
tatctaaaaattaggtgcacgt

SEQ ID NO: 25669 - DNA, 22 bp, Artificial Sequence
  chemically synthesized
aaaattaggtgcacgtatatag

SEQ ID NO: 25670 - DNA, 22 bp, Artificial Sequence
  chemically synthesized
ggtgcacgtatatagaagtact

SEQ ID NO: 25671 - DNA, 22 bp, Artificial Sequence
  chemically synthesized
ttctctgagaagaggacttcac

SEQ ID NO: 25672 - DNA, 22 bp, Artificial Sequence
  chemically synthesized
tctctgagaagaggacttcaca

SEQ ID NO: 25673 - DNA, 22 bp, Artificial Sequence
  chemically synthesized
ctctgagaagaggacttcacac

SEQ ID NO: 25674 - DNA, 22 bp, Artificial Sequence
  chemically synthesized
tctgagaagaggacttcacact

SEQ ID NO: 25675 - DNA, 22 bp, Artificial Sequence
  chemically synthesized
tgagaagaggacttcacacttc

SEQ ID NO: 25676 - DNA, 22 bp, Artificial Sequence
  chemically synthesized
agaagaggacttcacacttcca

SEQ ID NO: 25677 - DNA, 22 bp, Artificial Sequence
  chemically synthesized
cacacttccatcagcttcctga

SEQ ID NO: 25678 - DNA, 22 bp, Artificial Sequence
  chemically synthesized
acacttccatcagcttcctgaa

SEQ ID NO: 25679 - DNA, 22 bp, Artificial Sequence
  chemically synthesized
ccatcagcttcctgaaggcccc

SEQ ID NO: 25680 - DNA, 22 bp, Artificial Sequence
  chemically synthesized
catcagcttcctgaaggcccct

SEQ ID NO: 25681 - DNA, 22 bp, Artificial Sequence
  chemically synthesized
cctgaaggcccctgtaattgcc

SEQ ID NO: 25682 - DNA, 22 bp, Artificial Sequence
  chemically synthesized
ctgaaggcccctgtaattgccg

SEQ ID NO: 25683 - DNA, 22 bp, Artificial Sequence
  chemically synthesized
aaggcccctgtaattgccgtaa

SEQ ID NO: 25684 - DNA, 22 bp, Artificial Sequence
  chemically synthesized
taattgccgtaaagaacaactg

SEQ ID NO: 25685 - DNA, 22 bp, Artificial Sequence
  chemically synthesized
ccgtaaagaacaactgctctaa

SEQ ID NO: 25686 - DNA, 22 bp, Artificial Sequence
  chemically synthesized
ctctaaagtttaatactaggct

SEQ ID NO: 25687 - DNA, 22 bp, Artificial Sequence
  chemically synthesized
taaagtttaatactaggctact

SEQ ID NO: 25688 - DNA, 22 bp, Artificial Sequence
  chemically synthesized
aagtttaatactaggctactcg

SEQ ID NO: 25689 - DNA, 22 bp, Artificial Sequence
  chemically synthesized
aatactaggctactcggctgtt

SEQ ID NO: 25690 - DNA, 22 bp, Artificial Sequence
  chemically synthesized
atactaggctactcggctgttt

SEQ ID NO: 25691 - DNA, 22 bp, Artificial Sequence
  chemically synthesized
ggctactcggctgttttttgtt

SEQ ID NO: 25692 - DNA, 22 bp, Artificial Sequence
  chemically synthesized
ctcggctgttttttgttaacac

SEQ ID NO: 25693 - DNA, 22 bp, Artificial Sequence
  chemically synthesized
ggctgttttttgttaacacaga

SEQ ID NO: 25694 - DNA, 22 bp, Artificial Sequence
  chemically synthesized
ttttttgttaacacagaagttt

SEQ ID NO: 25695 - DNA, 22 bp, Artificial Sequence
  chemically synthesized
tttgttaacacagaagttttcc

SEQ ID NO: 25696 - DNA, 22 bp, Artificial Sequence
  chemically synthesized
ttgttaacacagaagttttcca

SEQ ID NO: 25697 - DNA, 22 bp, Artificial Sequence
  chemically synthesized
tgttaacacagaagttttccaa

SEQ ID NO: 25698 - DNA, 22 bp, Artificial Sequence
  chemically synthesized
gttaacacagaagttttccaaa

SEQ ID NO: 25699 - DNA, 22 bp, Artificial Sequence
  chemically synthesized
ttaacacagaagttttccaaat

SEQ ID NO: 25700 - DNA, 22 bp, Artificial Sequence
  chemically synthesized
acacagaagttttccaaatggc

SEQ ID NO: 25701 - DNA, 22 bp, Artificial Sequence
  chemically synthesized
tccaaatggcttttctctagag

SEQ ID NO: 25702 - DNA, 22 bp, Artificial Sequence
  chemically synthesized
ccaaatggcttttctctagagc

SEQ ID NO: 25703 - DNA, 22 bp, Artificial Sequence
  chemically synthesized
caaatggcttttctctagagca

SEQ ID NO: 25704 - DNA, 22 bp, Artificial Sequence
  chemically synthesized
ttctctagagcaaaatgaaaag

SEQ ID NO: 25705 - DNA, 22 bp, Artificial Sequence
  chemically synthesized
tctctagagcaaaatgaaaagg

SEQ ID NO: 25706 - DNA, 22 bp, Artificial Sequence
  chemically synthesized
ctctagagcaaaatgaaaagga

SEQ ID NO: 25707 - DNA, 22 bp, Artificial Sequence
  chemically synthesized
tctagagcaaaatgaaaaggat

SEQ ID NO: 25708 - DNA, 22 bp, Artificial Sequence
  chemically synthesized
tagagcaaaatgaaaaggatcc

SEQ ID NO: 25709 - DNA, 22 bp, Artificial Sequence
  chemically synthesized
gagcaaaatgaaaaggatccca

SEQ ID NO: 25710 - DNA, 22 bp, Artificial Sequence
  chemically synthesized
cccgagacctaacgatgtttat

SEQ ID NO: 25711 - DNA, 22 bp, Artificial Sequence
  chemically synthesized
ccgagacctaacgatgtttatc

SEQ ID NO: 25712 - DNA, 22 bp, Artificial Sequence
  chemically synthesized
acgatgtttatctttcgtgata

SEQ ID NO: 25713 - DNA, 22 bp, Artificial Sequence
  chemically synthesized
atctttcgtgatactgtttttg

SEQ ID NO: 25714 - DNA, 22 bp, Artificial Sequence
  chemically synthesized
tctttcgtgatactgtttttgt

SEQ ID NO: 25715 - DNA, 22 bp, Artificial Sequence
  chemically synthesized
tcgtgatactgtttttgttctt

SEQ ID NO: 25716 - DNA, 22 bp, Artificial Sequence
  chemically synthesized
cgtgatactgtttttgttcttc

SEQ ID NO: 25717 - DNA, 22 bp, Artificial Sequence
  chemically synthesized
gtgatactgtttttgttcttcc

SEQ ID NO: 25718 - DNA, 22 bp, Artificial Sequence
  chemically synthesized
tttttgttcttcctctttttct

SEQ ID NO: 25719 - DNA, 22 bp, Artificial Sequence
  chemically synthesized
ttgttcttcctctttttctcct

SEQ ID NO: 25720 - DNA, 22 bp, Artificial Sequence
  chemically synthesized
tgttcttcctctttttctccta

SEQ ID NO: 25721 - DNA, 22 bp, Artificial Sequence
  chemically synthesized
gttcttcctctttttctcctac

SEQ ID NO: 25722 - DNA, 22 bp, Artificial Sequence
  chemically synthesized
ttcttcctctttttctcctacc

SEQ ID NO: 25723 - DNA, 22 bp, Artificial Sequence
  chemically synthesized
ttcctctttttctcctaccccc

SEQ ID NO: 25724 - DNA, 22 bp, Artificial Sequence
  chemically synthesized
cctctttttctcctacccccca

SEQ ID NO: 25725 - DNA, 22 bp, Artificial Sequence
  chemically synthesized
ctctttttctcctaccccccac

SEQ ID NO: 25726 - DNA, 22 bp, Artificial Sequence
  chemically synthesized
tttttctcctaccccccaccac

SEQ ID NO: 25727 - DNA, 22 bp, Artificial Sequence
  chemically synthesized
tttctcctaccccccaccactt

SEQ ID NO: 25728 - DNA, 22 bp, Artificial Sequence
  chemically synthesized
ttctcctaccccccaccacttt

SEQ ID NO: 25729 - DNA, 22 bp, Artificial Sequence
  chemically synthesized
tctcctaccccccaccactttt

SEQ ID NO: 25730 - DNA, 22 bp, Artificial Sequence
  chemically synthesized
ctcctaccccccaccactttta

SEQ ID NO: 25731 - DNA, 22 bp, Artificial Sequence
  chemically synthesized
tcctaccccccaccacttttaa

SEQ ID NO: 25732 - DNA, 22 bp, Artificial Sequence
  chemically synthesized
ctaccccccaccacttttaaag

SEQ ID NO: 25733 - DNA, 22 bp, Artificial Sequence
  chemically synthesized
ccccccaccacttttaaagatc

SEQ ID NO: 25734 - DNA, 22 bp, Artificial Sequence
  chemically synthesized
ttaaagatccatcaaggcccag

SEQ ID NO: 25735 - DNA, 22 bp, Artificial Sequence
  chemically synthesized
taaagatccatcaaggcccagc

SEQ ID NO: 25736 - DNA, 22 bp, Artificial Sequence
  chemically synthesized
aaagatccatcaaggcccagca

SEQ ID NO: 25737 - DNA, 22 bp, Artificial Sequence
  chemically synthesized
aagatccatcaaggcccagcat

SEQ ID NO: 25738 - DNA, 22 bp, Artificial Sequence
  chemically synthesized
acacctgtaatctcaacacttt

SEQ ID NO: 25739 - DNA, 22 bp, Artificial Sequence
  chemically synthesized
taatctcaacacttttcaaggc

SEQ ID NO: 25740 - DNA, 22 bp, Artificial Sequence
  chemically synthesized
aacacttttcaaggctgaggtg

SEQ ID NO: 25741 - DNA, 22 bp, Artificial Sequence
  chemically synthesized
ttcaaggctgaggtgggagaat

SEQ ID NO: 25742 - DNA, 22 bp, Artificial Sequence
  chemically synthesized
tcaaggctgaggtgggagaatt

SEQ ID NO: 25743 - DNA, 22 bp, Artificial Sequence
  chemically synthesized
caaggctgaggtgggagaattg

SEQ ID NO: 25744 - DNA, 22 bp, Artificial Sequence
  chemically synthesized
aaggctgaggtgggagaattgt

SEQ ID NO: 25745 - DNA, 22 bp, Artificial Sequence
  chemically synthesized
aggtgggagaattgtttgagac

SEQ ID NO: 25746 - DNA, 22 bp, Artificial Sequence
  chemically synthesized
tttgagaccaagagttggatac

SEQ ID NO: 25747 - DNA, 22 bp, Artificial Sequence
  chemically synthesized
gagaccaagagttggataccag

SEQ ID NO: 25748 - DNA, 22 bp, Artificial Sequence
  chemically synthesized
agaccaagagttggataccagc

SEQ ID NO: 25749 - DNA, 22 bp, Artificial Sequence
  chemically synthesized
gataccagcctggggaacatag

SEQ ID NO: 25750 - DNA, 22 bp, Artificial Sequence
  chemically synthesized
gggaacatagggagaccctgtt

SEQ ID NO: 25751 - DNA, 22 bp, Artificial Sequence
  chemically synthesized
tttctacagaaatttaaaaaat

SEQ ID NO: 25752 - DNA, 22 bp, Artificial Sequence
  chemically synthesized
ctacagaaatttaaaaaatttc

SEQ ID NO: 25753 - DNA, 22 bp, Artificial Sequence
  chemically synthesized
tacagaaatttaaaaaatttct

SEQ ID NO: 25754 - DNA, 22 bp, Artificial Sequence
  chemically synthesized
cagaaatttaaaaaatttctct

SEQ ID NO: 25755 - DNA, 22 bp, Artificial Sequence
  chemically synthesized
aaaaaatttctctagctggcca

SEQ ID NO: 25756 - DNA, 22 bp, Artificial Sequence
  chemically synthesized
aaaaatttctctagctggccat

SEQ ID NO: 25757 - DNA, 22 bp, Artificial Sequence
  chemically synthesized
ctctagctggccatggaggctc

SEQ ID NO: 25758 - DNA, 22 bp, Artificial Sequence
  chemically synthesized
tctagctggccatggaggctca

SEQ ID NO: 25759 - DNA, 22 bp, Artificial Sequence
  chemically synthesized
tagctggccatggaggctcaca

SEQ ID NO: 25760 - DNA, 22 bp, Artificial Sequence
  chemically synthesized
gctggccatggaggctcacacc

SEQ ID NO: 25761 - DNA, 22 bp, Artificial Sequence
  chemically synthesized
gccatggaggctcacacctgta

SEQ ID NO: 25762 - DNA, 22 bp, Artificial Sequence
  chemically synthesized
acacctgtagtcctagctacct

SEQ ID NO: 25763 - DNA, 22 bp, Artificial Sequence
  chemically synthesized
tagtcctagctacctgagaggc

SEQ ID NO: 25764 - DNA, 22 bp, Artificial Sequence
  chemically synthesized
gctacctgagaggctaaagcag

SEQ ID NO: 25765 - DNA, 22 bp, Artificial Sequence
  chemically synthesized
cctgagaggctaaagcaggagg

SEQ ID NO: 25766 - DNA, 22 bp, Artificial Sequence
  chemically synthesized
agaggctaaagcaggaggatca

SEQ ID NO: 25767 - DNA, 22 bp, Artificial Sequence
  chemically synthesized
aagcaggaggatcaattgaatc

SEQ ID NO: 25768 - DNA, 22 bp, Artificial Sequence
  chemically synthesized
aatccaggcgttctagtgaggc

SEQ ID NO: 25769 - DNA, 22 bp, Artificial Sequence
  chemically synthesized
tagtgaggcttcagtgagcaag

SEQ ID NO: 25770 - DNA, 22 bp, Artificial Sequence
  chemically synthesized
gtgaggcttcagtgagcaagat

SEQ ID NO: 25771 - DNA, 22 bp, Artificial Sequence
  chemically synthesized
cagtgagcaagattgcaccatt

SEQ ID NO: 25772 - DNA, 22 bp, Artificial Sequence
  chemically synthesized
agtgagcaagattgcaccattg

SEQ ID NO: 25773 - DNA, 22 bp, Artificial Sequence
  chemically synthesized
caccattgcactccagccgggg

SEQ ID NO: 25774 - DNA, 22 bp, Artificial Sequence
  chemically synthesized
cactccagccggggtgacagag

SEQ ID NO: 25775 - DNA, 22 bp, Artificial Sequence
  chemically synthesized
cagccggggtgacagagtgaga

SEQ ID NO: 25776 - DNA, 22 bp, Artificial Sequence
  chemically synthesized
tttcaaacaaacaagcaaaagc

SEQ ID NO: 25777 - DNA, 22 bp, Artificial Sequence
  chemically synthesized
caaacaaacaagcaaaagcaaa

SEQ ID NO: 25778 - DNA, 22 bp, Artificial Sequence
  chemically synthesized
aaacaaacaagcaaaagcaaaa

SEQ ID NO: 25779 - DNA, 22 bp, Artificial Sequence
  chemically synthesized
gttgctccattcctttacttac

SEQ ID NO: 25780 - DNA, 22 bp, Artificial Sequence
  chemically synthesized
ttgctccattcctttacttact

SEQ ID NO: 25781 - DNA, 22 bp, Artificial Sequence
  chemically synthesized
ctccattcctttacttactatc

SEQ ID NO: 25782 - DNA, 22 bp, Artificial Sequence
  chemically synthesized
cattcctttacttactatcttg

SEQ ID NO: 25783 - DNA, 22 bp, Artificial Sequence
  chemically synthesized
ctttacttactatcttgctgtc

SEQ ID NO: 25784 - DNA, 22 bp, Artificial Sequence
  chemically synthesized
tacttactatcttgctgtctac

SEQ ID NO: 25785 - DNA, 22 bp, Artificial Sequence
  chemically synthesized
acttactatcttgctgtctaca

SEQ ID NO: 25786 - DNA, 22 bp, Artificial Sequence
  chemically synthesized
cttactatcttgctgtctacag

SEQ ID NO: 25787 - DNA, 22 bp, Artificial Sequence
  chemically synthesized
actatcttgctgtctacagcta

SEQ ID NO: 25788 - DNA, 22 bp, Artificial Sequence
  chemically synthesized
ctatcttgctgtctacagctaa

SEQ ID NO: 25789 - DNA, 22 bp, Artificial Sequence
  chemically synthesized
tcttgctgtctacagctaaagt

SEQ ID NO: 25790 - DNA, 22 bp, Artificial Sequence
  chemically synthesized
gctgtctacagctaaagtcaga

SEQ ID NO: 25791 - DNA, 22 bp, Artificial Sequence
  chemically synthesized
ctgtctacagctaaagtcagac

SEQ ID NO: 25792 - DNA, 22 bp, Artificial Sequence
  chemically synthesized
tctacagctaaagtcagactgc

SEQ ID NO: 25793 - DNA, 22 bp, Artificial Sequence
  chemically synthesized
cagctaaagtcagactgcatga

SEQ ID NO: 25794 - DNA, 22 bp, Artificial Sequence
  chemically synthesized
aagtcagactgcatgatttgga

SEQ ID NO: 25795 - DNA, 22 bp, Artificial Sequence
  chemically synthesized
catgatttggaattccaactcc

SEQ ID NO: 25796 - DNA, 22 bp, Artificial Sequence
  chemically synthesized
ggaattccaactccaccatcac

SEQ ID NO: 25797 - DNA, 22 bp, Artificial Sequence
  chemically synthesized
gaattccaactccaccatcacc

SEQ ID NO: 25798 - DNA, 22 bp, Artificial Sequence
  chemically synthesized
caactccaccatcacctgggta

SEQ ID NO: 25799 - DNA, 22 bp, Artificial Sequence
  chemically synthesized
caccatcacctgggtaatgttg

SEQ ID NO: 25800 - DNA, 22 bp, Artificial Sequence
  chemically synthesized
ggtaatgttgagatttattaca

SEQ ID NO: 25801 - DNA, 22 bp, Artificial Sequence
  chemically synthesized
agatttattacatagcatctct

SEQ ID NO: 25802 - DNA, 22 bp, Artificial Sequence
  chemically synthesized
attacatagcatctctgtgcct

SEQ ID NO: 25803 - DNA, 22 bp, Artificial Sequence
  chemically synthesized
ttacatagcatctctgtgcctc

SEQ ID NO: 25804 - DNA, 22 bp, Artificial Sequence
  chemically synthesized
catagcatctctgtgcctcagt

SEQ ID NO: 25805 - DNA, 22 bp, Artificial Sequence
  chemically synthesized
tgtgcctcagtttctccatata

SEQ ID NO: 25806 - DNA, 22 bp, Artificial Sequence
  chemically synthesized
tgcctcagtttctccatatata

SEQ ID NO: 25807 - DNA, 22 bp, Artificial Sequence
  chemically synthesized
agtttctccatatataaaatct

SEQ ID NO: 25808 - DNA, 22 bp, Artificial Sequence
  chemically synthesized
ctccatatataaaatctacctg

SEQ ID NO: 25809 - DNA, 22 bp, Artificial Sequence
  chemically synthesized
tccatatataaaatctacctgt

SEQ ID NO: 25810 - DNA, 22 bp, Artificial Sequence
  chemically synthesized
catatataaaatctacctgtaa

SEQ ID NO: 25811 - DNA, 22 bp, Artificial Sequence
  chemically synthesized
cctgtaataatgttgtgaaaat

SEQ ID NO: 25812 - DNA, 22 bp, Artificial Sequence
  chemically synthesized
taataatgttgtgaaaattaaa

SEQ ID NO: 25813 - DNA, 22 bp, Artificial Sequence
  chemically synthesized
tgaaaattaaaagaaataccag

SEQ ID NO: 25814 - DNA, 22 bp, Artificial Sequence
  chemically synthesized
aaagaaataccagttgtaaatc

SEQ ID NO: 25815 - DNA, 22 bp, Artificial Sequence
  chemically synthesized
taaatcactcagaactgtgcct

SEQ ID NO: 25816 - DNA, 22 bp, Artificial Sequence
  chemically synthesized
agaactgtgcctagcatttaat

SEQ ID NO: 25817 - DNA, 22 bp, Artificial Sequence
  chemically synthesized
tgcctagcatttaataaacact

SEQ ID NO: 25818 - DNA, 22 bp, Artificial Sequence
  chemically synthesized
gcatttaataaacactctgtag

SEQ ID NO: 25819 - DNA, 22 bp, Artificial Sequence
  chemically synthesized
aataaacactctgtaggtatta

SEQ ID NO: 25820 - DNA, 22 bp, Artificial Sequence
  chemically synthesized
ataaacactctgtaggtattag

SEQ ID NO: 25821 - DNA, 22 bp, Artificial Sequence
  chemically synthesized
tgtaggtattagcttatttctt

SEQ ID NO: 25822 - DNA, 22 bp, Artificial Sequence
  chemically synthesized
taggtattagcttatttcttta

SEQ ID NO: 25823 - DNA, 22 bp, Artificial Sequence
  chemically synthesized
gcttatttctttataaaattta

SEQ ID NO: 25824 - DNA, 22 bp, Artificial Sequence
  chemically synthesized
atttctttataaaatttattca

SEQ ID NO: 25825 - DNA, 22 bp, Artificial Sequence
  chemically synthesized
tttctttataaaatttattcat

SEQ ID NO: 25826 - DNA, 22 bp, Artificial Sequence
  chemically synthesized
ctttataaaatttattcataaa

SEQ ID NO: 25827 - DNA, 22 bp, Artificial Sequence
  chemically synthesized
tttataaaatttattcataaaa

SEQ ID NO: 25828 - DNA, 22 bp, Artificial Sequence
  chemically synthesized
tataaaatttattcataaaatg

SEQ ID NO: 25829 - DNA, 22 bp, Artificial Sequence
  chemically synthesized
ataaaatttattcataaaatga

SEQ ID NO: 25830 - DNA, 22 bp, Artificial Sequence
  chemically synthesized
taaaatttattcataaaatgag

SEQ ID NO: 25831 - DNA, 22 bp, Artificial Sequence
  chemically synthesized
attcataaaatgaggaagttag

SEQ ID NO: 25832 - DNA, 22 bp, Artificial Sequence
  chemically synthesized
ttcataaaatgaggaagttagc

SEQ ID NO: 25833 - DNA, 22 bp, Artificial Sequence
  chemically synthesized
ataaaatgaggaagttagctca

SEQ ID NO: 25834 - DNA, 22 bp, Artificial Sequence
  chemically synthesized
gctcatgtattgtcataccagc

SEQ ID NO: 25835 - DNA, 22 bp, Artificial Sequence
  chemically synthesized
atgtattgtcataccagctttc

SEQ ID NO: 25836 - DNA, 22 bp, Artificial Sequence
  chemically synthesized
tcataccagctttcactttgaa

SEQ ID NO: 25837 - DNA, 22 bp, Artificial Sequence
  chemically synthesized
tcactttgaatgagtccataat

SEQ ID NO: 25838 - DNA, 22 bp, Artificial Sequence
  chemically synthesized
cactttgaatgagtccataatt

SEQ ID NO: 25839 - DNA, 22 bp, Artificial Sequence
  chemically synthesized
actttgaatgagtccataattg

SEQ ID NO: 25840 - DNA, 22 bp, Artificial Sequence
  chemically synthesized
tgaatgagtccataattgcatt

SEQ ID NO: 25841 - DNA, 22 bp, Artificial Sequence
  chemically synthesized
gaatgagtccataattgcattt

SEQ ID NO: 25842 - DNA, 22 bp, Artificial Sequence
  chemically synthesized
aatgagtccataattgcatttt

SEQ ID NO: 25843 - DNA, 22 bp, Artificial Sequence
  chemically synthesized
catttttaaacacaaaaagaga

SEQ ID NO: 25844 - DNA, 22 bp, Artificial Sequence
  chemically synthesized
ttaaacacaaaaagagaaataa

SEQ ID NO: 25845 - DNA, 22 bp, Artificial Sequence
  chemically synthesized
taaacacaaaaagagaaataat

SEQ ID NO: 25846 - DNA, 22 bp, Artificial Sequence
  chemically synthesized
aaacacaaaaagagaaataata

SEQ ID NO: 25847 - DNA, 22 bp, Artificial Sequence
  chemically synthesized
aacacaaaaagagaaataatag

SEQ ID NO: 25848 - DNA, 22 bp, Artificial Sequence
  chemically synthesized
cttcaatcacgggatgcatagt

SEQ ID NO: 25849 - DNA, 22 bp, Artificial Sequence
  chemically synthesized
caatcacgggatgcatagtaat

SEQ ID NO: 25850 - DNA, 22 bp, Artificial Sequence
  chemically synthesized
aatcacgggatgcatagtaatt

SEQ ID NO: 25851 - DNA, 22 bp, Artificial Sequence
  chemically synthesized
ggatttctttgccctaattact

SEQ ID NO: 25852 - DNA, 22 bp, Artificial Sequence
  chemically synthesized
ctttgccctaattactgatgtg

SEQ ID NO: 25853 - DNA, 22 bp, Artificial Sequence
  chemically synthesized
tttgccctaattactgatgtgg

SEQ ID NO: 25854 - DNA, 22 bp, Artificial Sequence
  chemically synthesized
tgccctaattactgatgtggat

SEQ ID NO: 25855 - DNA, 22 bp, Artificial Sequence
  chemically synthesized
gccctaattactgatgtggata

SEQ ID NO: 25856 - DNA, 22 bp, Artificial Sequence
  chemically synthesized
ccctaattactgatgtggataa

SEQ ID NO: 25857 - DNA, 22 bp, Artificial Sequence
  chemically synthesized
attactgatgtggataagccgg

SEQ ID NO: 25858 - DNA, 22 bp, Artificial Sequence
  chemically synthesized
ctgatgtggataagccggtggg

SEQ ID NO: 25859 - DNA, 22 bp, Artificial Sequence
  chemically synthesized
atgtggataagccggtgggcca

SEQ ID NO: 25860 - DNA, 22 bp, Artificial Sequence
  chemically synthesized
aagctgttatcacaccatgtga

SEQ ID NO: 25861 - DNA, 22 bp, Artificial Sequence
  chemically synthesized
ttatcacaccatgtgaaacaca

SEQ ID NO: 25862 - DNA, 22 bp, Artificial Sequence
  chemically synthesized
tcacaccatgtgaaacacacga

SEQ ID NO: 25863 - DNA, 22 bp, Artificial Sequence
  chemically synthesized
tgtaaaaactatgcttggttgc

SEQ ID NO: 25864 - DNA, 22 bp, Artificial Sequence
  chemically synthesized
tgcttggttgcacagcttcaag

SEQ ID NO: 25865 - DNA, 22 bp, Artificial Sequence
  chemically synthesized
ggttgcacagcttcaaggaaag

SEQ ID NO: 25866 - DNA, 22 bp, Artificial Sequence
  chemically synthesized
gttgcacagcttcaaggaaagc

SEQ ID NO: 25867 - DNA, 22 bp, Artificial Sequence
  chemically synthesized
cacagcttcaaggaaagcacta

SEQ ID NO: 25868 - DNA, 22 bp, Artificial Sequence
  chemically synthesized
caaggaaagcactagtctactc

SEQ ID NO: 25869 - DNA, 22 bp, Artificial Sequence
  chemically synthesized
aaggaaagcactagtctactca

SEQ ID NO: 25870 - DNA, 22 bp, Artificial Sequence
  chemically synthesized
gtctactcacttccttttcatt

SEQ ID NO: 25871 - DNA, 22 bp, Artificial Sequence
  chemically synthesized
ctcacttccttttcattcagca

SEQ ID NO: 25872 - DNA, 22 bp, Artificial Sequence
  chemically synthesized
acttccttttcattcagcatgc

SEQ ID NO: 25873 - DNA, 22 bp, Artificial Sequence
  chemically synthesized
ccttttcattcagcatgctatg

SEQ ID NO: 25874 - DNA, 22 bp, Artificial Sequence
  chemically synthesized
cttttcattcagcatgctatgt

SEQ ID NO: 25875 - DNA, 22 bp, Artificial Sequence
  chemically synthesized
ttcattcagcatgctatgtcta

SEQ ID NO: 25876 - DNA, 22 bp, Artificial Sequence
  chemically synthesized
tcattcagcatgctatgtctag

SEQ ID NO: 25877 - DNA, 22 bp, Artificial Sequence
  chemically synthesized
cattcagcatgctatgtctagg

SEQ ID NO: 25878 - DNA, 22 bp, Artificial Sequence
  chemically synthesized
attcagcatgctatgtctaggc

SEQ ID NO: 25879 - DNA, 22 bp, Artificial Sequence
  chemically synthesized
agcatgctatgtctaggcccct

SEQ ID NO: 25880 - DNA, 22 bp, Artificial Sequence
  chemically synthesized
tgtctaggcccctttcatataa

SEQ ID NO: 25881 - DNA, 22 bp, Artificial Sequence
  chemically synthesized
ggcccctttcatataaaatatt

SEQ ID NO: 25882 - DNA, 22 bp, Artificial Sequence
  chemically synthesized
tcatataaaatatttggagctg

SEQ ID NO: 25883 - DNA, 22 bp, Artificial Sequence
  chemically synthesized
catataaaatatttggagctgc

SEQ ID NO: 25884 - DNA, 22 bp, Artificial Sequence
  chemically synthesized
atataaaatatttggagctgcc

SEQ ID NO: 25885 - DNA, 22 bp, Artificial Sequence
  chemically synthesized
ggagctgccattgtaggtagtg

SEQ ID NO: 25886 - DNA, 22 bp, Artificial Sequence
  chemically synthesized
gagctgccattgtaggtagtgc

SEQ ID NO: 25887 - DNA, 22 bp, Artificial Sequence
  chemically synthesized
ccattgtaggtagtgcaggtgg

SEQ ID NO: 25888 - DNA, 22 bp, Artificial Sequence
  chemically synthesized
taggtagtgcaggtggtcttgt

SEQ ID NO: 25889 - DNA, 22 bp, Artificial Sequence
  chemically synthesized
gttcaaagtgtgagtatcacct

SEQ ID NO: 25890 - DNA, 22 bp, Artificial Sequence
  chemically synthesized
ttcaaagtgtgagtatcacctc

SEQ ID NO: 25891 - DNA, 22 bp, Artificial Sequence
  chemically synthesized
aaagtgtgagtatcacctccca

SEQ ID NO: 25892 - DNA, 22 bp, Artificial Sequence
  chemically synthesized
ccactgccaagactgcagctgc

SEQ ID NO: 25893 - DNA, 22 bp, Artificial Sequence
  chemically synthesized
ccaagactgcagctgctttgat

SEQ ID NO: 25894 - DNA, 22 bp, Artificial Sequence
  chemically synthesized
cagctgctttgattttaactga

SEQ ID NO: 25895 - DNA, 22 bp, Artificial Sequence
  chemically synthesized
ctttgattttaactgaggatct

SEQ ID NO: 25896 - DNA, 22 bp, Artificial Sequence
  chemically synthesized
tgattttaactgaggatctaga

SEQ ID NO: 25897 - DNA, 22 bp, Artificial Sequence
  chemically synthesized
gattttaactgaggatctagaa

SEQ ID NO: 25898 - DNA, 22 bp, Artificial Sequence
  chemically synthesized
attttaactgaggatctagaaa

SEQ ID NO: 25899 - DNA, 22 bp, Artificial Sequence
  chemically synthesized
taactgaggatctagaaaagtg

SEQ ID NO: 25900 - DNA, 22 bp, Artificial Sequence
  chemically synthesized
aactgaggatctagaaaagtgc

SEQ ID NO: 25901 - DNA, 22 bp, Artificial Sequence
  chemically synthesized
actgaggatctagaaaagtgct

SEQ ID NO: 25902 - DNA, 22 bp, Artificial Sequence
  chemically synthesized
aggatctagaaaagtgctggga

SEQ ID NO: 25903 - DNA, 22 bp, Artificial Sequence
  chemically synthesized
gaaaagtgctgggaacacaaat

SEQ ID NO: 25904 - DNA, 22 bp, Artificial Sequence
  chemically synthesized
ggaacacaaatatttgctgacc

SEQ ID NO: 25905 - DNA, 22 bp, Artificial Sequence
  chemically synthesized
gctgacctttgtcacaagtagc

SEQ ID NO: 25906 - DNA, 22 bp, Artificial Sequence
  chemically synthesized
ctgacctttgtcacaagtagca

SEQ ID NO: 25907 - DNA, 22 bp, Artificial Sequence
  chemically synthesized
acctttgtcacaagtagcacct

SEQ ID NO: 25908 - DNA, 22 bp, Artificial Sequence
  chemically synthesized
tgtcacaagtagcacctaatct

SEQ ID NO: 25909 - DNA, 22 bp, Artificial Sequence
  chemically synthesized
gtcacaagtagcacctaatctc

SEQ ID NO: 25910 - DNA, 22 bp, Artificial Sequence
  chemically synthesized
tcacaagtagcacctaatctcc

SEQ ID NO: 25911 - DNA, 22 bp, Artificial Sequence
  chemically synthesized
atctccttcctaccagacctgc

SEQ ID NO: 25912 - DNA, 22 bp, Artificial Sequence
  chemically synthesized
cttcctaccagacctgctgcct

SEQ ID NO: 25913 - DNA, 22 bp, Artificial Sequence
  chemically synthesized
cctaccagacctgctgccttat

SEQ ID NO: 25914 - DNA, 22 bp, Artificial Sequence
  chemically synthesized
ctaccagacctgctgccttata

SEQ ID NO: 25915 - DNA, 22 bp, Artificial Sequence
  chemically synthesized
ccagacctgctgccttataaaa

SEQ ID NO: 25916 - DNA, 22 bp, Artificial Sequence
  chemically synthesized
ctgccttataaaatgatgttct

SEQ ID NO: 25917 - DNA, 22 bp, Artificial Sequence
  chemically synthesized
ccttataaaatgatgttctaag

SEQ ID NO: 25918 - DNA, 22 bp, Artificial Sequence
  chemically synthesized
ataaaatgatgttctaagtgta

SEQ ID NO: 25919 - DNA, 22 bp, Artificial Sequence
  chemically synthesized
taaaatgatgttctaagtgtat

SEQ ID NO: 25920 - DNA, 22 bp, Artificial Sequence
  chemically synthesized
taagtgtataatgacttcctct

SEQ ID NO: 25921 - DNA, 22 bp, Artificial Sequence
  chemically synthesized
agtgtataatgacttcctctgc

SEQ ID NO: 25922 - DNA, 22 bp, Artificial Sequence
  chemically synthesized
cctctgcttctgcaactgtgtt

SEQ ID NO: 25923 - DNA, 22 bp, Artificial Sequence
  chemically synthesized
ctctgcttctgcaactgtgttt

SEQ ID NO: 25924 - DNA, 22 bp, Artificial Sequence
  chemically synthesized
tgcttctgcaactgtgttttgg

SEQ ID NO: 25925 - DNA, 22 bp, Artificial Sequence
  chemically synthesized
cttctgcaactgtgttttggaa

SEQ ID NO: 25926 - DNA, 22 bp, Artificial Sequence
  chemically synthesized
ctgcaactgtgttttggaacag

SEQ ID NO: 25927 - DNA, 22 bp, Artificial Sequence
  chemically synthesized
tgcaactgtgttttggaacagg

SEQ ID NO: 25928 - DNA, 22 bp, Artificial Sequence
  chemically synthesized
caactgtgttttggaacaggag

SEQ ID NO: 25929 - DNA, 22 bp, Artificial Sequence
  chemically synthesized
tgttttggaacaggagggtgag

SEQ ID NO: 25930 - DNA, 22 bp, Artificial Sequence
  chemically synthesized
tggaacaggagggtgagattag

SEQ ID NO: 25931 - DNA, 22 bp, Artificial Sequence
  chemically synthesized
ggaacaggagggtgagattagt

SEQ ID NO: 25932 - DNA, 22 bp, Artificial Sequence
  chemically synthesized
gaacaggagggtgagattagta

SEQ ID NO: 25933 - DNA, 22 bp, Artificial Sequence
  chemically synthesized
gtagccacacacactgaaatag

SEQ ID NO: 25934 - DNA, 22 bp, Artificial Sequence
  chemically synthesized
aaatagtcatatgacttccaaa

SEQ ID NO: 25935 - DNA, 22 bp, Artificial Sequence
  chemically synthesized
ccaaagtctgtaatttttaagc

SEQ ID NO: 25936 - DNA, 22 bp, Artificial Sequence
  chemically synthesized
caaagtctgtaatttttaagca

SEQ ID NO: 25937 - DNA, 22 bp, Artificial Sequence
  chemically synthesized
taatttttaagcatatacaaaa

SEQ ID NO: 25938 - DNA, 22 bp, Artificial Sequence
  chemically synthesized
ttaagcatatacaaaatagtga

SEQ ID NO: 25939 - DNA, 22 bp, Artificial Sequence
  chemically synthesized
taagcatatacaaaatagtgaa

SEQ ID NO: 25940 - DNA, 22 bp, Artificial Sequence
  chemically synthesized
aagcatatacaaaatagtgaaa

SEQ ID NO: 25941 - DNA, 22 bp, Artificial Sequence
  chemically synthesized
agcatatacaaaatagtgaaat

SEQ ID NO: 25942 - DNA, 22 bp, Artificial Sequence
  chemically synthesized
ctccatatgtgtataatatgta

SEQ ID NO: 25943 - DNA, 22 bp, Artificial Sequence
  chemically synthesized
tccatatgtgtataatatgtat

SEQ ID NO: 25944 - DNA, 22 bp, Artificial Sequence
  chemically synthesized
catatgtgtataatatgtatat

SEQ ID NO: 25945 - DNA, 22 bp, Artificial Sequence
  chemically synthesized
attttggctgatatctattcta

SEQ ID NO: 25946 - DNA, 22 bp, Artificial Sequence
  chemically synthesized
ttttggctgatatctattctat

SEQ ID NO: 25947 - DNA, 22 bp, Artificial Sequence
  chemically synthesized
tggctgatatctattctatact

SEQ ID NO: 25948 - DNA, 22 bp, Artificial Sequence
  chemically synthesized
ggctgatatctattctatactt

SEQ ID NO: 25949 - DNA, 22 bp, Artificial Sequence
  chemically synthesized
gctgatatctattctatacttc

SEQ ID NO: 25950 - DNA, 22 bp, Artificial Sequence
  chemically synthesized
atatctattctatacttctttg

SEQ ID NO: 25951 - DNA, 22 bp, Artificial Sequence
  chemically synthesized
ttctatacttctttgaaatagt

SEQ ID NO: 25952 - DNA, 22 bp, Artificial Sequence
  chemically synthesized
tatacttctttgaaatagtgat

SEQ ID NO: 25953 - DNA, 22 bp, Artificial Sequence
  chemically synthesized
tacttctttgaaatagtgattt

SEQ ID NO: 25954 - DNA, 22 bp, Artificial Sequence
  chemically synthesized
ctttgaaatagtgatttttagt

SEQ ID NO: 25955 - DNA, 22 bp, Artificial Sequence
  chemically synthesized
tttgaaatagtgatttttagta

SEQ ID NO: 25956 - DNA, 22 bp, Artificial Sequence
  chemically synthesized
tgaaatagtgatttttagtaaa

SEQ ID NO: 25957 - DNA, 22 bp, Artificial Sequence
  chemically synthesized
gaaatagtgatttttagtaaat

SEQ ID NO: 25958 - DNA, 22 bp, Artificial Sequence
  chemically synthesized
aaatagtgatttttagtaaatt

SEQ ID NO: 25959 - DNA, 22 bp, Artificial Sequence
  chemically synthesized
ttagtaaattggcagtgttgcc

SEQ ID NO: 25960 - DNA, 22 bp, Artificial Sequence
  chemically synthesized
tagtaaattggcagtgttgcca

SEQ ID NO: 25961 - DNA, 22 bp, Artificial Sequence
  chemically synthesized
agtaaattggcagtgttgccag

SEQ ID NO: 25962 - DNA, 22 bp, Artificial Sequence
  chemically synthesized
gtaaattggcagtgttgccaga

SEQ ID NO: 25963 - DNA, 22 bp, Artificial Sequence
  chemically synthesized
gcagtgttgccagatgacgact

SEQ ID NO: 25964 - DNA, 22 bp, Artificial Sequence
  chemically synthesized
ccagatgacgacttagagtttt

SEQ ID NO: 25965 - DNA, 22 bp, Artificial Sequence
  chemically synthesized
agagttttaaccacctcattgt

SEQ ID NO: 25966 - DNA, 22 bp, Artificial Sequence
  chemically synthesized
gagttttaaccacctcattgtt

SEQ ID NO: 25967 - DNA, 22 bp, Artificial Sequence
  chemically synthesized
taaccacctcattgttatatgt

SEQ ID NO: 25968 - DNA, 22 bp, Artificial Sequence
  chemically synthesized
aaccacctcattgttatatgta

SEQ ID NO: 25969 - DNA, 22 bp, Artificial Sequence
  chemically synthesized
accacctcattgttatatgtac

SEQ ID NO: 25970 - DNA, 22 bp, Artificial Sequence
  chemically synthesized
attgttatatgtaccatggtag

SEQ ID NO: 25971 - DNA, 22 bp, Artificial Sequence
  chemically synthesized
ttatatgtaccatggtagctca

SEQ ID NO: 25972 - DNA, 22 bp, Artificial Sequence
  chemically synthesized
tatgtaccatggtagctcatct

SEQ ID NO: 25973 - DNA, 22 bp, Artificial Sequence
  chemically synthesized
atcttttctttcaggtgaaagt

SEQ ID NO: 25974 - DNA, 22 bp, Artificial Sequence
  chemically synthesized
ttctttcaggtgaaagttgtga

SEQ ID NO: 25975 - DNA, 22 bp, Artificial Sequence
  chemically synthesized
tctttcaggtgaaagttgtgat

SEQ ID NO: 25976 - DNA, 22 bp, Artificial Sequence
  chemically synthesized
ctttcaggtgaaagttgtgata

SEQ ID NO: 25977 - DNA, 22 bp, Artificial Sequence
  chemically synthesized
tttcaggtgaaagttgtgatac

SEQ ID NO: 25978 - DNA, 22 bp, Artificial Sequence
  chemically synthesized
tcaggtgaaagttgtgatactt

SEQ ID NO: 25979 - DNA, 22 bp, Artificial Sequence
  chemically synthesized
caggtgaaagttgtgatacttt

SEQ ID NO: 25980 - DNA, 22 bp, Artificial Sequence
  chemically synthesized
aggtgaaagttgtgatactttg

SEQ ID NO: 25981 - DNA, 22 bp, Artificial Sequence
  chemically synthesized
tgatactttgtcctcacgctaa

SEQ ID NO: 25982 - DNA, 22 bp, Artificial Sequence
  chemically synthesized
tgtcctcacgctaaacatagcc

SEQ ID NO: 25983 - DNA, 22 bp, Artificial Sequence
  chemically synthesized
gtcctcacgctaaacatagccc

SEQ ID NO: 25984 - DNA, 22 bp, Artificial Sequence
  chemically synthesized
tcctcacgctaaacatagcccc

SEQ ID NO: 25985 - DNA, 22 bp, Artificial Sequence
  chemically synthesized
acgctaaacatagcccccatgt

SEQ ID NO: 25986 - DNA, 22 bp, Artificial Sequence
  chemically synthesized
aacatagcccccatgttgttcc

SEQ ID NO: 25987 - DNA, 22 bp, Artificial Sequence
  chemically synthesized
ttccaggaaaatagagatcaat

SEQ ID NO: 25988 - DNA, 22 bp, Artificial Sequence
  chemically synthesized
caggaaaatagagatcaataaa

SEQ ID NO: 25989 - DNA, 22 bp, Artificial Sequence
  chemically synthesized
gtttgaaagtgaaggttaagtt

SEQ ID NO: 25990 - DNA, 22 bp, Artificial Sequence
  chemically synthesized
tttgaaagtgaaggttaagttc

SEQ ID NO: 25991 - DNA, 22 bp, Artificial Sequence
  chemically synthesized
gaaagtgaaggttaagttcaaa

SEQ ID NO: 25992 - DNA, 22 bp, Artificial Sequence
  chemically synthesized
aaagtgaaggttaagttcaaat

SEQ ID NO: 25993 - DNA, 22 bp, Artificial Sequence
  chemically synthesized
agttcaaattcaatgacctacg

SEQ ID NO: 25994 - DNA, 22 bp, Artificial Sequence
  chemically synthesized
aaattcaatgacctacgctgtg

SEQ ID NO: 25995 - DNA, 22 bp, Artificial Sequence
  chemically synthesized
aatgacctacgctgtggtaaaa

SEQ ID NO: 25996 - DNA, 22 bp, Artificial Sequence
  chemically synthesized
cgctgtggtaaaacgatcattc

SEQ ID NO: 25997 - DNA, 22 bp, Artificial Sequence
  chemically synthesized
tggtaaaacgatcattcattaa

SEQ ID NO: 25998 - DNA, 22 bp, Artificial Sequence
  chemically synthesized
attaatgatattaagtattttc

SEQ ID NO: 25999 - DNA, 22 bp, Artificial Sequence
  chemically synthesized
atgatattaagtattttctttt

SEQ ID NO: 26000 - DNA, 22 bp, Artificial Sequence
  chemically synthesized
agtattttcttttttaatgtca

SEQ ID NO: 26001 - DNA, 22 bp, Artificial Sequence
  chemically synthesized
tcttttttaatgtcagaataaa

SEQ ID NO: 26002 - DNA, 22 bp, Artificial Sequence
  chemically synthesized
cttttttaatgtcagaataaaa

SEQ ID NO: 26003 - DNA, 22 bp, Artificial Sequence
  chemically synthesized
ttttttaatgtcagaataaaac

SEQ ID NO: 26004 - DNA, 22 bp, Artificial Sequence
  chemically synthesized
ttttaatgtcagaataaaacca

SEQ ID NO: 26005 - DNA, 22 bp, Artificial Sequence
  chemically synthesized
tttaatgtcagaataaaaccat

SEQ ID NO: 26006 - DNA, 22 bp, Artificial Sequence
  chemically synthesized
ttaatgtcagaataaaaccatt

SEQ ID NO: 26007 - DNA, 22 bp, Artificial Sequence
  chemically synthesized
taatgtcagaataaaaccattt

SEQ ID NO: 26008 - DNA, 22 bp, Artificial Sequence
  chemically synthesized
aatgtcagaataaaaccattta

SEQ ID NO: 26009 - DNA, 22 bp, Artificial Sequence
  chemically synthesized
atgtcagaataaaaccatttat

SEQ ID NO: 26010 - DNA, 22 bp, Artificial Sequence
  chemically synthesized
atttgcagatttaaaaatatat

SEQ ID NO: 26011 - DNA, 22 bp, Artificial Sequence
  chemically synthesized
tttgcagatttaaaaatatata

SEQ ID NO: 26012 - DNA, 22 bp, Artificial Sequence
  chemically synthesized
gcagatttaaaaatatatatgt

SEQ ID NO: 26013 - DNA, 22 bp, Artificial Sequence
  chemically synthesized
cagatttaaaaatatatatgtg

SEQ ID NO: 26014 - DNA, 22 bp, Artificial Sequence
  chemically synthesized
aaaaatatatatgtgtatgtaa

SEQ ID NO: 26015 - DNA, 22 bp, Artificial Sequence
  chemically synthesized
aaaatatatatgtgtatgtaaa

SEQ ID NO: 26016 - DNA, 22 bp, Artificial Sequence
  chemically synthesized
cttggtttatacctcaaatatg

SEQ ID NO: 26017 - DNA, 22 bp, Artificial Sequence
  chemically synthesized
ggtttatacctcaaatatgaaa

SEQ ID NO: 26018 - DNA, 22 bp, Artificial Sequence
  chemically synthesized
gtttatacctcaaatatgaaaa

SEQ ID NO: 26019 - DNA, 22 bp, Artificial Sequence
  chemically synthesized
atacctcaaatatgaaaatagg

SEQ ID NO: 26020 - DNA, 22 bp, Artificial Sequence
  chemically synthesized
tacctcaaatatgaaaatagga

SEQ ID NO: 26021 - DNA, 22 bp, Artificial Sequence
  chemically synthesized
aaatatgaaaataggaatgacc

SEQ ID NO: 26022 - DNA, 22 bp, Artificial Sequence
  chemically synthesized
tctctatgctcttgcattcact

SEQ ID NO: 26023 - DNA, 22 bp, Artificial Sequence
  chemically synthesized
tatgctcttgcattcacttata

SEQ ID NO: 26024 - DNA, 22 bp, Artificial Sequence
  chemically synthesized
tgctcttgcattcacttatatt

SEQ ID NO: 26025 - DNA, 22 bp, Artificial Sequence
  chemically synthesized
ttgcattcacttatattctagc

SEQ ID NO: 26026 - DNA, 22 bp, Artificial Sequence
  chemically synthesized
gcattcacttatattctagctt

SEQ ID NO: 26027 - DNA, 22 bp, Artificial Sequence
  chemically synthesized
cattcacttatattctagcttg

SEQ ID NO: 26028 - DNA, 22 bp, Artificial Sequence
  chemically synthesized
acttatattctagcttgttaag

SEQ ID NO: 26029 - DNA, 22 bp, Artificial Sequence
  chemically synthesized
atattctagcttgttaagagag

SEQ ID NO: 26030 - DNA, 22 bp, Artificial Sequence
  chemically synthesized
tattctagcttgttaagagaga

SEQ ID NO: 26031 - DNA, 22 bp, Artificial Sequence
  chemically synthesized
tagcttgttaagagagaagttt

SEQ ID NO: 26032 - DNA, 22 bp, Artificial Sequence
  chemically synthesized
gcttgttaagagagaagtttgg

SEQ ID NO: 26033 - DNA, 22 bp, Artificial Sequence
  chemically synthesized
gttaagagagaagtttggggca

SEQ ID NO: 26034 - DNA, 22 bp, Artificial Sequence
  chemically synthesized
ttaagagagaagtttggggcaa

SEQ ID NO: 26035 - DNA, 22 bp, Artificial Sequence
  chemically synthesized
agagagaagtttggggcaaaat

SEQ ID NO: 26036 - DNA, 22 bp, Artificial Sequence
  chemically synthesized
ggggcaaaatgtgctttataaa

SEQ ID NO: 26037 - DNA, 22 bp, Artificial Sequence
  chemically synthesized
gggcaaaatgtgctttataaat

SEQ ID NO: 26038 - DNA, 22 bp, Artificial Sequence
  chemically synthesized
tataaatagtaaaaactgaggt

SEQ ID NO: 26039 - DNA, 22 bp, Artificial Sequence
  chemically synthesized
ataaatagtaaaaactgaggta

SEQ ID NO: 26040 - DNA, 22 bp, Artificial Sequence
  chemically synthesized
taaatagtaaaaactgaggtaa

SEQ ID NO: 26041 - DNA, 22 bp, Artificial Sequence
  chemically synthesized
aggtaaactatagcacaaagtg

SEQ ID NO: 26042 - DNA, 22 bp, Artificial Sequence
  chemically synthesized
tagcacaaagtgtgctatataa

SEQ ID NO: 26043 - DNA, 22 bp, Artificial Sequence
  chemically synthesized
tataaacagtaaaaaccgaggt

SEQ ID NO: 26044 - DNA, 22 bp, Artificial Sequence
  chemically synthesized
aaatggtgttggaatataagaa

SEQ ID NO: 26045 - DNA, 22 bp, Artificial Sequence
  chemically synthesized
gaatataagaaatagcagtaaa

SEQ ID NO: 26046 - DNA, 22 bp, Artificial Sequence
  chemically synthesized
ctcacagcaagacagtacaggg

SEQ ID NO: 26047 - DNA, 22 bp, Artificial Sequence
  chemically synthesized
acagcaagacagtacagggaaa

SEQ ID NO: 26048 - DNA, 22 bp, Artificial Sequence
  chemically synthesized
gagggacaaagatttacttaca

SEQ ID NO: 26049 - DNA, 22 bp, Artificial Sequence
  chemically synthesized
acttacaatcaggcctcaacca

SEQ ID NO: 26050 - DNA, 22 bp, Artificial Sequence
  chemically synthesized
cttacaatcaggcctcaaccaa

SEQ ID NO: 26051 - DNA, 22 bp, Artificial Sequence
  chemically synthesized
acaatcaggcctcaaccaatat

SEQ ID NO: 26052 - DNA, 22 bp, Artificial Sequence
  chemically synthesized
caatcaggcctcaaccaatatg

SEQ ID NO: 26053 - DNA, 22 bp, Artificial Sequence
  chemically synthesized
aaccaatatgagatcgactttc

SEQ ID NO: 26054 - DNA, 22 bp, Artificial Sequence
  chemically synthesized
tcttttattgatatatgacgtg

SEQ ID NO: 26055 - DNA, 22 bp, Artificial Sequence
  chemically synthesized
cttttattgatatatgacgtgt

SEQ ID NO: 26056 - DNA, 22 bp, Artificial Sequence
  chemically synthesized
ttttattgatatatgacgtgtt

SEQ ID NO: 26057 - DNA, 22 bp, Artificial Sequence
  chemically synthesized
ttattgatatatgacgtgttta

SEQ ID NO: 26058 - DNA, 22 bp, Artificial Sequence
  chemically synthesized
tattgatatatgacgtgtttat

SEQ ID NO: 26059 - DNA, 22 bp, Artificial Sequence
  chemically synthesized
attgatatatgacgtgtttata

SEQ ID NO: 26060 - DNA, 22 bp, Artificial Sequence
  chemically synthesized
ttgatatatgacgtgtttatat

SEQ ID NO: 26061 - DNA, 22 bp, Artificial Sequence
  chemically synthesized
atatatgacgtgtttatatgta

SEQ ID NO: 26062 - DNA, 22 bp, Artificial Sequence
  chemically synthesized
atatgtatcaggtacatgtgac

SEQ ID NO: 26063 - DNA, 22 bp, Artificial Sequence
  chemically synthesized
tatgtatcaggtacatgtgaca

SEQ ID NO: 26064 - DNA, 22 bp, Artificial Sequence
  chemically synthesized
tgttacatgcatataatgtata

SEQ ID NO: 26065 - DNA, 22 bp, Artificial Sequence
  chemically synthesized
gttacatgcatataatgtataa

SEQ ID NO: 26066 - DNA, 22 bp, Artificial Sequence
  chemically synthesized
ttacatgcatataatgtataat

SEQ ID NO: 26067 - DNA, 22 bp, Artificial Sequence
  chemically synthesized
catgcatataatgtataatgat

SEQ ID NO: 26068 - DNA, 22 bp, Artificial Sequence
  chemically synthesized
ggggtattcatcacctcaagta

SEQ ID NO: 26069 - DNA, 22 bp, Artificial Sequence
  chemically synthesized
gggtattcatcacctcaagtat

SEQ ID NO: 26070 - DNA, 22 bp, Artificial Sequence
  chemically synthesized
atcacctcaagtatttatcgtt

SEQ ID NO: 26071 - DNA, 22 bp, Artificial Sequence
  chemically synthesized
aagtatttatcgtttctatgtg

SEQ ID NO: 26072 - DNA, 22 bp, Artificial Sequence
  chemically synthesized
atcgtttctatgtgttaggaac

SEQ ID NO: 26073 - DNA, 22 bp, Artificial Sequence
  chemically synthesized
tcgtttctatgtgttaggaaca

SEQ ID NO: 26074 - DNA, 22 bp, Artificial Sequence
  chemically synthesized
ctatgtgttaggaacatttcaa

SEQ ID NO: 26075 - DNA, 22 bp, Artificial Sequence
  chemically synthesized
tatgtgttaggaacatttcaag

SEQ ID NO: 26076 - DNA, 22 bp, Artificial Sequence
  chemically synthesized
tgtgttaggaacatttcaagac

SEQ ID NO: 26077 - DNA, 22 bp, Artificial Sequence
  chemically synthesized
ggaacatttcaagacctttctt

SEQ ID NO: 26078 - DNA, 22 bp, Artificial Sequence
  chemically synthesized
caagacctttcttctactattt

SEQ ID NO: 26079 - DNA, 22 bp, Artificial Sequence
  chemically synthesized
aagacctttcttctactatttt

SEQ ID NO: 26080 - DNA, 22 bp, Artificial Sequence
  chemically synthesized
tcttctactattttgaaatata

SEQ ID NO: 26081 - DNA, 22 bp, Artificial Sequence
  chemically synthesized
cttctactattttgaaatatac

SEQ ID NO: 26082 - DNA, 22 bp, Artificial Sequence
  chemically synthesized
ttctactattttgaaatataca

SEQ ID NO: 26083 - DNA, 22 bp, Artificial Sequence
  chemically synthesized
ctactattttgaaatatacaat

SEQ ID NO: 26084 - DNA, 22 bp, Artificial Sequence
  chemically synthesized
tactattttgaaatatacaata

SEQ ID NO: 26085 - DNA, 22 bp, Artificial Sequence
  chemically synthesized
ctattttgaaatatacaatata

SEQ ID NO: 26086 - DNA, 22 bp, Artificial Sequence
  chemically synthesized
ttttgaaatatacaatatattg

SEQ ID NO: 26087 - DNA, 22 bp, Artificial Sequence
  chemically synthesized
tgaaatatacaatatattgttt

SEQ ID NO: 26088 - DNA, 22 bp, Artificial Sequence
  chemically synthesized
gaaatatacaatatattgtttt

SEQ ID NO: 26089 - DNA, 22 bp, Artificial Sequence
  chemically synthesized
aaatatacaatatattgttttt

SEQ ID NO: 26090 - DNA, 22 bp, Artificial Sequence
  chemically synthesized
tttttaactataatcaccctac

SEQ ID NO: 26091 - DNA, 22 bp, Artificial Sequence
  chemically synthesized
ttaactataatcaccctacttt

SEQ ID NO: 26092 - DNA, 22 bp, Artificial Sequence
  chemically synthesized
taactataatcaccctactttg

SEQ ID NO: 26093 - DNA, 22 bp, Artificial Sequence
  chemically synthesized
aactataatcaccctactttgc

SEQ ID NO: 26094 - DNA, 22 bp, Artificial Sequence
  chemically synthesized
actataatcaccctactttgct

SEQ ID NO: 26095 - DNA, 22 bp, Artificial Sequence
  chemically synthesized
taatcaccctactttgctattg

SEQ ID NO: 26096 - DNA, 22 bp, Artificial Sequence
  chemically synthesized
ctttgctattgaacatcagaac

SEQ ID NO: 26097 - DNA, 22 bp, Artificial Sequence
  chemically synthesized
tgctattgaacatcagaacata

SEQ ID NO: 26098 - DNA, 22 bp, Artificial Sequence
  chemically synthesized
gctattgaacatcagaacatat

SEQ ID NO: 26099 - DNA, 22 bp, Artificial Sequence
  chemically synthesized
ctattgaacatcagaacatatt

SEQ ID NO: 26100 - DNA, 22 bp, Artificial Sequence
  chemically synthesized
ttgaacatcagaacatattcct

SEQ ID NO: 26101 - DNA, 22 bp, Artificial Sequence
  chemically synthesized
aacatcagaacatattccttct

SEQ ID NO: 26102 - DNA, 22 bp, Artificial Sequence
  chemically synthesized
cttctatctaactgcctgtttc

SEQ ID NO: 26103 - DNA, 22 bp, Artificial Sequence
  chemically synthesized
ctatctaactgcctgtttccat

SEQ ID NO: 26104 - DNA, 22 bp, Artificial Sequence
  chemically synthesized
tatctaactgcctgtttccatt

SEQ ID NO: 26105 - DNA, 22 bp, Artificial Sequence
  chemically synthesized
tctaactgcctgtttccattaa

SEQ ID NO: 26106 - DNA, 22 bp, Artificial Sequence
  chemically synthesized
actgcctgtttccattaaccaa

SEQ ID NO: 26107 - DNA, 22 bp, Artificial Sequence
  chemically synthesized
cctgtttccattaaccaacttc

SEQ ID NO: 26108 - DNA, 22 bp, Artificial Sequence
  chemically synthesized
tttccattaaccaacttctctt

SEQ ID NO: 26109 - DNA, 22 bp, Artificial Sequence
  chemically synthesized
ccattaaccaacttctcttcgt

SEQ ID NO: 26110 - DNA, 22 bp, Artificial Sequence
  chemically synthesized
cattaaccaacttctcttcgtc

SEQ ID NO: 26111 - DNA, 22 bp, Artificial Sequence
  chemically synthesized
accaacttctcttcgtctccct

SEQ ID NO: 26112 - DNA, 22 bp, Artificial Sequence
  chemically synthesized
ctcttcgtctcccttcctccca

SEQ ID NO: 26113 - DNA, 22 bp, Artificial Sequence
  chemically synthesized
tcttcgtctcccttcctcccat

SEQ ID NO: 26114 - DNA, 22 bp, Artificial Sequence
  chemically synthesized
ttcgtctcccttcctcccataa

SEQ ID NO: 26115 - DNA, 22 bp, Artificial Sequence
  chemically synthesized
cgtctcccttcctcccataacg

SEQ ID NO: 26116 - DNA, 22 bp, Artificial Sequence
  chemically synthesized
gtctcccttcctcccataacgt

SEQ ID NO: 26117 - DNA, 22 bp, Artificial Sequence
  chemically synthesized
ccttcctcccataacgtacaca

SEQ ID NO: 26118 - DNA, 22 bp, Artificial Sequence
  chemically synthesized
cctcccataacgtacacacctt

SEQ ID NO: 26119 - DNA, 22 bp, Artificial Sequence
  chemically synthesized
ctcccataacgtacacaccttt

SEQ ID NO: 26120 - DNA, 22 bp, Artificial Sequence
  chemically synthesized
ccataacgtacacacctttctc

SEQ ID NO: 26121 - DNA, 22 bp, Artificial Sequence
  chemically synthesized
tctctacctctggtttctgtca

SEQ ID NO: 26122 - DNA, 22 bp, Artificial Sequence
  chemically synthesized
ctctacctctggtttctgtcat

SEQ ID NO: 26123 - DNA, 22 bp, Artificial Sequence
  chemically synthesized
tctacctctggtttctgtcatt

SEQ ID NO: 26124 - DNA, 22 bp, Artificial Sequence
  chemically synthesized
tacctctggtttctgtcattct

SEQ ID NO: 26125 - DNA, 22 bp, Artificial Sequence
  chemically synthesized
cctctggtttctgtcattctac

SEQ ID NO: 26126 - DNA, 22 bp, Artificial Sequence
  chemically synthesized
tggtttctgtcattctactctc

SEQ ID NO: 26127 - DNA, 22 bp, Artificial Sequence
  chemically synthesized
gtttctgtcattctactctcta

SEQ ID NO: 26128 - DNA, 22 bp, Artificial Sequence
  chemically synthesized
ctgtcattctactctctaccta

SEQ ID NO: 26129 - DNA, 22 bp, Artificial Sequence
  chemically synthesized
tgtcattctactctctacctac

SEQ ID NO: 26130 - DNA, 22 bp, Artificial Sequence
  chemically synthesized
tcattctactctctacctacat

SEQ ID NO: 26131 - DNA, 22 bp, Artificial Sequence
  chemically synthesized
tactctctacctacatgatatt

SEQ ID NO: 26132 - DNA, 22 bp, Artificial Sequence
  chemically synthesized
ctctctacctacatgatattaa

SEQ ID NO: 26133 - DNA, 22 bp, Artificial Sequence
  chemically synthesized
tctacctacatgatattaactt

SEQ ID NO: 26134 - DNA, 22 bp, Artificial Sequence
  chemically synthesized
tacctacatgatattaactttt

SEQ ID NO: 26135 - DNA, 22 bp, Artificial Sequence
  chemically synthesized
cctacatgatattaactttttt

SEQ ID NO: 26136 - DNA, 22 bp, Artificial Sequence
  chemically synthesized
catgatattaacttttttagct

SEQ ID NO: 26137 - DNA, 22 bp, Artificial Sequence
  chemically synthesized
acttttttagctcccacatatc

SEQ ID NO: 26138 - DNA, 22 bp, Artificial Sequence
  chemically synthesized
ttttagctcccacatatcagtg

SEQ ID NO: 26139 - DNA, 22 bp, Artificial Sequence
  chemically synthesized
tttagctcccacatatcagtga

SEQ ID NO: 26140 - DNA, 22 bp, Artificial Sequence
  chemically synthesized
ttagctcccacatatcagtgag

SEQ ID NO: 26141 - DNA, 22 bp, Artificial Sequence
  chemically synthesized
tagctcccacatatcagtgaga

SEQ ID NO: 26142 - DNA, 22 bp, Artificial Sequence
  chemically synthesized
agctcccacatatcagtgagaa

SEQ ID NO: 26143 - DNA, 22 bp, Artificial Sequence
  chemically synthesized
gctcccacatatcagtgagaac

SEQ ID NO: 26144 - DNA, 22 bp, Artificial Sequence
  chemically synthesized
ccacatatcagtgagaacatgc

SEQ ID NO: 26145 - DNA, 22 bp, Artificial Sequence
  chemically synthesized
gtctttctatgcctggcttatt

SEQ ID NO: 26146 - DNA, 22 bp, Artificial Sequence
  chemically synthesized
tctttctatgcctggcttattt

SEQ ID NO: 26147 - DNA, 22 bp, Artificial Sequence
  chemically synthesized
tctatgcctggcttatttcgtt

SEQ ID NO: 26148 - DNA, 22 bp, Artificial Sequence
  chemically synthesized
ctatgcctggcttatttcgttt

SEQ ID NO: 26149 - DNA, 22 bp, Artificial Sequence
  chemically synthesized
tatgcctggcttatttcgttta

SEQ ID NO: 26150 - DNA, 22 bp, Artificial Sequence
  chemically synthesized
tgcctggcttatttcgtttaac

SEQ ID NO: 26151 - DNA, 22 bp, Artificial Sequence
  chemically synthesized
gcttatttcgtttaacataatg

SEQ ID NO: 26152 - DNA, 22 bp, Artificial Sequence
  chemically synthesized
atttcgtttaacataatgactt

SEQ ID NO: 26153 - DNA, 22 bp, Artificial Sequence
  chemically synthesized
tttcgtttaacataatgacttc

SEQ ID NO: 26154 - DNA, 22 bp, Artificial Sequence
  chemically synthesized
cgtttaacataatgacttccag

SEQ ID NO: 26155 - DNA, 22 bp, Artificial Sequence
  chemically synthesized
gtttaacataatgacttccagt

SEQ ID NO: 26156 - DNA, 22 bp, Artificial Sequence
  chemically synthesized
aacataatgacttccagtttca

SEQ ID NO: 26157 - DNA, 22 bp, Artificial Sequence
  chemically synthesized
acataatgacttccagtttcat

SEQ ID NO: 26158 - DNA, 22 bp, Artificial Sequence
  chemically synthesized
ccagtttcatccatgttgctgc

SEQ ID NO: 26159 - DNA, 22 bp, Artificial Sequence
  chemically synthesized
cagtttcatccatgttgctgca

SEQ ID NO: 26160 - DNA, 22 bp, Artificial Sequence
  chemically synthesized
catccatgttgctgcaaatgaa

SEQ ID NO: 26161 - DNA, 22 bp, Artificial Sequence
  chemically synthesized
atccatgttgctgcaaatgaaa

SEQ ID NO: 26162 - DNA, 22 bp, Artificial Sequence
  chemically synthesized
ctgcaaatgaaatgattttata

SEQ ID NO: 26163 - DNA, 22 bp, Artificial Sequence
  chemically synthesized
caaatgaaatgattttatattt

SEQ ID NO: 26164 - DNA, 22 bp, Artificial Sequence
  chemically synthesized
tatatttgtatggttgaataat

SEQ ID NO: 26165 - DNA, 22 bp, Artificial Sequence
  chemically synthesized
atatttgtatggttgaataata

SEQ ID NO: 26166 - DNA, 22 bp, Artificial Sequence
  chemically synthesized
tatttgtatggttgaataatat

SEQ ID NO: 26167 - DNA, 22 bp, Artificial Sequence
  chemically synthesized
gtatggttgaataatattcaat

SEQ ID NO: 26168 - DNA, 22 bp, Artificial Sequence
  chemically synthesized
tatggttgaataatattcaatt

SEQ ID NO: 26169 - DNA, 22 bp, Artificial Sequence
  chemically synthesized
aataatattcaattgtgtgtat

SEQ ID NO: 26170 - DNA, 22 bp, Artificial Sequence
  chemically synthesized
aattgtgtgtatacaccacatt

SEQ ID NO: 26171 - DNA, 22 bp, Artificial Sequence
  chemically synthesized
tgtgtatacaccacattttctt

SEQ ID NO: 26172 - DNA, 22 bp, Artificial Sequence
  chemically synthesized
tcttcattcatccattgatgga

SEQ ID NO: 26173 - DNA, 22 bp, Artificial Sequence
  chemically synthesized
cttcattcatccattgatggac

SEQ ID NO: 26174 - DNA, 22 bp, Artificial Sequence
  chemically synthesized
ttcattcatccattgatggaca

SEQ ID NO: 26175 - DNA, 22 bp, Artificial Sequence
  chemically synthesized
cattcatccattgatggacact

SEQ ID NO: 26176 - DNA, 22 bp, Artificial Sequence
  chemically synthesized
attcatccattgatggacactt

SEQ ID NO: 26177 - DNA, 22 bp, Artificial Sequence
  chemically synthesized
atccattgatggacacttaggt

SEQ ID NO: 26178 - DNA, 22 bp, Artificial Sequence
  chemically synthesized
atggacacttaggttgattcca

SEQ ID NO: 26179 - DNA, 22 bp, Artificial Sequence
  chemically synthesized
aggttgattccatatctttgct

SEQ ID NO: 26180 - DNA, 22 bp, Artificial Sequence
  chemically synthesized
ggttgattccatatctttgcta

SEQ ID NO: 26181 - DNA, 22 bp, Artificial Sequence
  chemically synthesized
attccatatctttgctaatgtg

SEQ ID NO: 26182 - DNA, 22 bp, Artificial Sequence
  chemically synthesized
catatctttgctaatgtgaatc

SEQ ID NO: 26183 - DNA, 22 bp, Artificial Sequence
  chemically synthesized
tgctaatgtgaatcgtgctgca

SEQ ID NO: 26184 - DNA, 22 bp, Artificial Sequence
  chemically synthesized
gctaatgtgaatcgtgctgcaa

SEQ ID NO: 26185 - DNA, 22 bp, Artificial Sequence
  chemically synthesized
ctaatgtgaatcgtgctgcaat

SEQ ID NO: 26186 - DNA, 22 bp, Artificial Sequence
  chemically synthesized
atgtgaatcgtgctgcaataaa

SEQ ID NO: 26187 - DNA, 22 bp, Artificial Sequence
  chemically synthesized
caataaacagtgtggtaccagt

SEQ ID NO: 26188 - DNA, 22 bp, Artificial Sequence
  chemically synthesized
tttattattctgaattcttttc

SEQ ID NO: 26189 - DNA, 22 bp, Artificial Sequence
  chemically synthesized
attattctgaattcttttcctt

SEQ ID NO: 26190 - DNA, 22 bp, Artificial Sequence
  chemically synthesized
ttattctgaattcttttccttt

SEQ ID NO: 26191 - DNA, 22 bp, Artificial Sequence
  chemically synthesized
ttctgaattcttttcctttgga

SEQ ID NO: 26192 - DNA, 22 bp, Artificial Sequence
  chemically synthesized
tgaattcttttcctttggataa

SEQ ID NO: 26193 - DNA, 22 bp, Artificial Sequence
  chemically synthesized
aattcttttcctttggataaat

SEQ ID NO: 26194 - DNA, 22 bp, Artificial Sequence
  chemically synthesized
ttttcctttggataaataccca

SEQ ID NO: 26195 - DNA, 22 bp, Artificial Sequence
  chemically synthesized
ttcctttggataaatacccagt

SEQ ID NO: 26196 - DNA, 22 bp, Artificial Sequence
  chemically synthesized
tcctttggataaatacccagta

SEQ ID NO: 26197 - DNA, 22 bp, Artificial Sequence
  chemically synthesized
cctttggataaatacccagtaa

SEQ ID NO: 26198 - DNA, 22 bp, Artificial Sequence
  chemically synthesized
ctttggataaatacccagtaat

SEQ ID NO: 26199 - DNA, 22 bp, Artificial Sequence
  chemically synthesized
tggataaatacccagtaataag

SEQ ID NO: 26200 - DNA, 22 bp, Artificial Sequence
  chemically synthesized
ggataaatacccagtaataaga

SEQ ID NO: 26201 - DNA, 22 bp, Artificial Sequence
  chemically synthesized
gataaatacccagtaataagat

SEQ ID NO: 26202 - DNA, 22 bp, Artificial Sequence
  chemically synthesized
ctggatcttatgatagttcaat

SEQ ID NO: 26203 - DNA, 22 bp, Artificial Sequence
  chemically synthesized
gatcttatgatagttcaatttt

SEQ ID NO: 26204 - DNA, 22 bp, Artificial Sequence
  chemically synthesized
atgatagttcaatttttagctt

SEQ ID NO: 26205 - DNA, 22 bp, Artificial Sequence
  chemically synthesized
tgatagttcaatttttagcttt

SEQ ID NO: 26206 - DNA, 22 bp, Artificial Sequence
  chemically synthesized
aatttttagctttttggtaaat

SEQ ID NO: 26207 - DNA, 22 bp, Artificial Sequence
  chemically synthesized
ttagctttttggtaaatctaca

SEQ ID NO: 26208 - DNA, 22 bp, Artificial Sequence
  chemically synthesized
tagctttttggtaaatctacat

SEQ ID NO: 26209 - DNA, 22 bp, Artificial Sequence
  chemically synthesized
agctttttggtaaatctacata

SEQ ID NO: 26210 - DNA, 22 bp, Artificial Sequence
  chemically synthesized
gctttttggtaaatctacatat

SEQ ID NO: 26211 - DNA, 22 bp, Artificial Sequence
  chemically synthesized
tttggtaaatctacatattgtt

SEQ ID NO: 26212 - DNA, 22 bp, Artificial Sequence
  chemically synthesized
ttggtaaatctacatattgttt

SEQ ID NO: 26213 - DNA, 22 bp, Artificial Sequence
  chemically synthesized
tggtaaatctacatattgtttt

SEQ ID NO: 26214 - DNA, 22 bp, Artificial Sequence
  chemically synthesized
ggtaaatctacatattgttttc

SEQ ID NO: 26215 - DNA, 22 bp, Artificial Sequence
  chemically synthesized
gtaaatctacatattgttttcc

SEQ ID NO: 26216 - DNA, 22 bp, Artificial Sequence
  chemically synthesized
catattgttttccatagtggct

SEQ ID NO: 26217 - DNA, 22 bp, Artificial Sequence
  chemically synthesized
ttttccatagtggctatactaa

SEQ ID NO: 26218 - DNA, 22 bp, Artificial Sequence
  chemically synthesized
tccatagtggctatactaattt

SEQ ID NO: 26219 - DNA, 22 bp, Artificial Sequence
  chemically synthesized
ccatagtggctatactaatttg

SEQ ID NO: 26220 - DNA, 22 bp, Artificial Sequence
  chemically synthesized
catagtggctatactaatttgc

SEQ ID NO: 26221 - DNA, 22 bp, Artificial Sequence
  chemically synthesized
tactaatttgcatgcttaccaa

SEQ ID NO: 26222 - DNA, 22 bp, Artificial Sequence
  chemically synthesized
atttgcatgcttaccaatagtg

SEQ ID NO: 26223 - DNA, 22 bp, Artificial Sequence
  chemically synthesized
gcatgcttaccaatagtgccta

SEQ ID NO: 26224 - DNA, 22 bp, Artificial Sequence
  chemically synthesized
catgcttaccaatagtgcctac

SEQ ID NO: 26225 - DNA, 22 bp, Artificial Sequence
  chemically synthesized
accaatagtgcctacgagtgcc

SEQ ID NO: 26226 - DNA, 22 bp, Artificial Sequence
  chemically synthesized
ccaatagtgcctacgagtgcct

SEQ ID NO: 26227 - DNA, 22 bp, Artificial Sequence
  chemically synthesized
cgagtgccttttccttcacatc

SEQ ID NO: 26228 - DNA, 22 bp, Artificial Sequence
  chemically synthesized
ttccttcacatccttgccagca

SEQ ID NO: 26229 - DNA, 22 bp, Artificial Sequence
  chemically synthesized
tccttcacatccttgccagcat

SEQ ID NO: 26230 - DNA, 22 bp, Artificial Sequence
  chemically synthesized
ccttcacatccttgccagcatg

SEQ ID NO: 26231 - DNA, 22 bp, Artificial Sequence
  chemically synthesized
cttcacatccttgccagcatgt

SEQ ID NO: 26232 - DNA, 22 bp, Artificial Sequence
  chemically synthesized
cacatccttgccagcatgtgtt

SEQ ID NO: 26233 - DNA, 22 bp, Artificial Sequence
  chemically synthesized
acatccttgccagcatgtgtta

SEQ ID NO: 26234 - DNA, 22 bp, Artificial Sequence
  chemically synthesized
gccagcatgtgttatttattta

SEQ ID NO: 26235 - DNA, 22 bp, Artificial Sequence
  chemically synthesized
ccagcatgtgttatttatttat

SEQ ID NO: 26236 - DNA, 22 bp, Artificial Sequence
  chemically synthesized
tttatttattaatttatttaaa

SEQ ID NO: 26237 - DNA, 22 bp, Artificial Sequence
  chemically synthesized
atttattaatttatttaaatca

SEQ ID NO: 26238 - DNA, 22 bp, Artificial Sequence
  chemically synthesized
tttattaatttatttaaatcat

SEQ ID NO: 26239 - DNA, 22 bp, Artificial Sequence
  chemically synthesized
attaatttatttaaatcatgat

SEQ ID NO: 26240 - DNA, 22 bp, Artificial Sequence
  chemically synthesized
ttaatttatttaaatcatgatg

SEQ ID NO: 26241 - DNA, 22 bp, Artificial Sequence
  chemically synthesized
atttatttaaatcatgatgatt

SEQ ID NO: 26242 - DNA, 22 bp, Artificial Sequence
  chemically synthesized
atttaaatcatgatgattctaa

SEQ ID NO: 26243 - DNA, 22 bp, Artificial Sequence
  chemically synthesized
tttaaatcatgatgattctaac

SEQ ID NO: 26244 - DNA, 22 bp, Artificial Sequence
  chemically synthesized
aaatcatgatgattctaactgg

SEQ ID NO: 26245 - DNA, 22 bp, Artificial Sequence
  chemically synthesized
aatcatgatgattctaactggc

SEQ ID NO: 26246 - DNA, 22 bp, Artificial Sequence
  chemically synthesized
taactggcataagatgatatct

SEQ ID NO: 26247 - DNA, 22 bp, Artificial Sequence
  chemically synthesized
actggcataagatgatatctca

SEQ ID NO: 26248 - DNA, 22 bp, Artificial Sequence
  chemically synthesized
gcataagatgatatctcattgt

SEQ ID NO: 26249 - DNA, 22 bp, Artificial Sequence
  chemically synthesized
attgtggttttgatttgcattt

SEQ ID NO: 26250 - DNA, 22 bp, Artificial Sequence
  chemically synthesized
tggttttgatttgcatttctct

SEQ ID NO: 26251 - DNA, 22 bp, Artificial Sequence
  chemically synthesized
tgatttgcatttctctgatgat

SEQ ID NO: 26252 - DNA, 22 bp, Artificial Sequence
  chemically synthesized
gatttgcatttctctgatgatt

SEQ ID NO: 26253 - DNA, 22 bp, Artificial Sequence
  chemically synthesized
atttgcatttctctgatgatta

SEQ ID NO: 26254 - DNA, 22 bp, Artificial Sequence
  chemically synthesized
gcatttctctgatgattagtaa

SEQ ID NO: 26255 - DNA, 22 bp, Artificial Sequence
  chemically synthesized
catttctctgatgattagtaat

SEQ ID NO: 26256 - DNA, 22 bp, Artificial Sequence
  chemically synthesized
ctctgatgattagtaatgttga

SEQ ID NO: 26257 - DNA, 22 bp, Artificial Sequence
  chemically synthesized
tctgatgattagtaatgttgag

SEQ ID NO: 26258 - DNA, 22 bp, Artificial Sequence
  chemically synthesized
tgatgattagtaatgttgagca

SEQ ID NO: 26259 - DNA, 22 bp, Artificial Sequence
  chemically synthesized
atgattagtaatgttgagcaat

SEQ ID NO: 26260 - DNA, 22 bp, Artificial Sequence
  chemically synthesized
gtaatgttgagcaatttcccca

SEQ ID NO: 26261 - DNA, 22 bp, Artificial Sequence
  chemically synthesized
agcaatttccccatacccattg

SEQ ID NO: 26262 - DNA, 22 bp, Artificial Sequence
  chemically synthesized
ccccatacccattgtgcatttg

SEQ ID NO: 26263 - DNA, 22 bp, Artificial Sequence
  chemically synthesized
cccatacccattgtgcatttgt

SEQ ID NO: 26264 - DNA, 22 bp, Artificial Sequence
  chemically synthesized
tgcatttgtatgtcttcttttg

SEQ ID NO: 26265 - DNA, 22 bp, Artificial Sequence
  chemically synthesized
gtatgtcttcttttgaaaaata

SEQ ID NO: 26266 - DNA, 22 bp, Artificial Sequence
  chemically synthesized
tatgtcttcttttgaaaaatat

SEQ ID NO: 26267 - DNA, 22 bp, Artificial Sequence
  chemically synthesized
cttttgaaaaatatcctttgcc

SEQ ID NO: 26268 - DNA, 22 bp, Artificial Sequence
  chemically synthesized
ttttgaaaaatatcctttgcca

SEQ ID NO: 26269 - DNA, 22 bp, Artificial Sequence
  chemically synthesized
ttgaaaaatatcctttgccaat

SEQ ID NO: 26270 - DNA, 22 bp, Artificial Sequence
  chemically synthesized
tgaaaaatatcctttgccaatt

SEQ ID NO: 26271 - DNA, 22 bp, Artificial Sequence
  chemically synthesized
gaaaaatatcctttgccaattt

SEQ ID NO: 26272 - DNA, 22 bp, Artificial Sequence
  chemically synthesized
aaaaatatcctttgccaatttt

SEQ ID NO: 26273 - DNA, 22 bp, Artificial Sequence
  chemically synthesized
tgccaattttttaatgagatta

SEQ ID NO: 26274 - DNA, 22 bp, Artificial Sequence
  chemically synthesized
gccaattttttaatgagattat

SEQ ID NO: 26275 - DNA, 22 bp, Artificial Sequence
  chemically synthesized
ccaattttttaatgagattatt

SEQ ID NO: 26276 - DNA, 22 bp, Artificial Sequence
  chemically synthesized
tttaatgagattatttgttttt

SEQ ID NO: 26277 - DNA, 22 bp, Artificial Sequence
  chemically synthesized
ttaatgagattatttgtttttc

SEQ ID NO: 26278 - DNA, 22 bp, Artificial Sequence
  chemically synthesized
taatgagattatttgtttttcc

SEQ ID NO: 26279 - DNA, 22 bp, Artificial Sequence
  chemically synthesized
aatgagattatttgtttttcca

SEQ ID NO: 26280 - DNA, 22 bp, Artificial Sequence
  chemically synthesized
atgagattatttgtttttccac

SEQ ID NO: 26281 - DNA, 22 bp, Artificial Sequence
  chemically synthesized
tttgtttttccactgttgagtt

SEQ ID NO: 26282 - DNA, 22 bp, Artificial Sequence
  chemically synthesized
gtttttccactgttgagttgtt

SEQ ID NO: 26283 - DNA, 22 bp, Artificial Sequence
  chemically synthesized
tttttccactgttgagttgttt

SEQ ID NO: 26284 - DNA, 22 bp, Artificial Sequence
  chemically synthesized
ttccactgttgagttgtttgag

SEQ ID NO: 26285 - DNA, 22 bp, Artificial Sequence
  chemically synthesized
tccactgttgagttgtttgagt

SEQ ID NO: 26286 - DNA, 22 bp, Artificial Sequence
  chemically synthesized
ccactgttgagttgtttgagtt

SEQ ID NO: 26287 - DNA, 22 bp, Artificial Sequence
  chemically synthesized
cactgttgagttgtttgagttt

SEQ ID NO: 26288 - DNA, 22 bp, Artificial Sequence
  chemically synthesized
ttgagttgtttgagtttcttat

SEQ ID NO: 26289 - DNA, 22 bp, Artificial Sequence
  chemically synthesized
agttgtttgagtttcttatata

SEQ ID NO: 26290 - DNA, 22 bp, Artificial Sequence
  chemically synthesized
tttgagtttcttatatattctg

SEQ ID NO: 26291 - DNA, 22 bp, Artificial Sequence
  chemically synthesized
gagtttcttatatattctggag

SEQ ID NO: 26292 - DNA, 22 bp, Artificial Sequence
  chemically synthesized
agtttcttatatattctggaga

SEQ ID NO: 26293 - DNA, 22 bp, Artificial Sequence
  chemically synthesized
cttatatattctggagattaat

SEQ ID NO: 26294 - DNA, 22 bp, Artificial Sequence
  chemically synthesized
ttatatattctggagattaatt

SEQ ID NO: 26295 - DNA, 22 bp, Artificial Sequence
  chemically synthesized
atatattctggagattaattcc

SEQ ID NO: 26296 - DNA, 22 bp, Artificial Sequence
  chemically synthesized
tatattctggagattaattcct

SEQ ID NO: 26297 - DNA, 22 bp, Artificial Sequence
  chemically synthesized
tggagattaattccttgtcaaa

SEQ ID NO: 26298 - DNA, 22 bp, Artificial Sequence
  chemically synthesized
gagattaattccttgtcaaatg

SEQ ID NO: 26299 - DNA, 22 bp, Artificial Sequence
  chemically synthesized
attccttgtcaaatgtatgcaa

SEQ ID NO: 26300 - DNA, 22 bp, Artificial Sequence
  chemically synthesized
cttgtcaaatgtatgcaaatat

SEQ ID NO: 26301 - DNA, 22 bp, Artificial Sequence
  chemically synthesized
gtcaaatgtatgcaaatatttt

SEQ ID NO: 26302 - DNA, 22 bp, Artificial Sequence
  chemically synthesized
tcaaatgtatgcaaatattttc

SEQ ID NO: 26303 - DNA, 22 bp, Artificial Sequence
  chemically synthesized
tctcgcattcaacagcttgtct

SEQ ID NO: 26304 - DNA, 22 bp, Artificial Sequence
  chemically synthesized
ctcgcattcaacagcttgtctc

SEQ ID NO: 26305 - DNA, 22 bp, Artificial Sequence
  chemically synthesized
tcgcattcaacagcttgtctct

SEQ ID NO: 26306 - DNA, 22 bp, Artificial Sequence
  chemically synthesized
gcattcaacagcttgtctcttc

SEQ ID NO: 26307 - DNA, 22 bp, Artificial Sequence
  chemically synthesized
aacagcttgtctcttcactgtg

SEQ ID NO: 26308 - DNA, 22 bp, Artificial Sequence
  chemically synthesized
gtctcttcactgtgttgattgt

SEQ ID NO: 26309 - DNA, 22 bp, Artificial Sequence
  chemically synthesized
tctcttcactgtgttgattgtt

SEQ ID NO: 26310 - DNA, 22 bp, Artificial Sequence
  chemically synthesized
ttcactgtgttgattgtttcct

SEQ ID NO: 26311 - DNA, 22 bp, Artificial Sequence
  chemically synthesized
cactgtgttgattgtttccttt

SEQ ID NO: 26312 - DNA, 22 bp, Artificial Sequence
  chemically synthesized
actgtgttgattgtttccttta

SEQ ID NO: 26313 - DNA, 22 bp, Artificial Sequence
  chemically synthesized
tgttgattgtttcctttactgt

SEQ ID NO: 26314 - DNA, 22 bp, Artificial Sequence
  chemically synthesized
attgtttcctttactgtgcaga

SEQ ID NO: 26315 - DNA, 22 bp, Artificial Sequence
  chemically synthesized
tttcctttactgtgcagatgta

SEQ ID NO: 26316 - DNA, 22 bp, Artificial Sequence
  chemically synthesized
cctttactgtgcagatgtattt

SEQ ID NO: 26317 - DNA, 22 bp, Artificial Sequence
  chemically synthesized
ctttactgtgcagatgtatttt

SEQ ID NO: 26318 - DNA, 22 bp, Artificial Sequence
  chemically synthesized
tactgtgcagatgtattttagc

SEQ ID NO: 26319 - DNA, 22 bp, Artificial Sequence
  chemically synthesized
actgtgcagatgtattttagct

SEQ ID NO: 26320 - DNA, 22 bp, Artificial Sequence
  chemically synthesized
ctgtgcagatgtattttagctt

SEQ ID NO: 26321 - DNA, 22 bp, Artificial Sequence
  chemically synthesized
tgcagatgtattttagcttaat

SEQ ID NO: 26322 - DNA, 22 bp, Artificial Sequence
  chemically synthesized
tagcttaatatagtcccatttg

SEQ ID NO: 26323 - DNA, 22 bp, Artificial Sequence
  chemically synthesized
agcttaatatagtcccatttgt

SEQ ID NO: 26324 - DNA, 22 bp, Artificial Sequence
  chemically synthesized
gcttaatatagtcccatttgtc

SEQ ID NO: 26325 - DNA, 22 bp, Artificial Sequence
  chemically synthesized
aatatagtcccatttgtctatt

SEQ ID NO: 26326 - DNA, 22 bp, Artificial Sequence
  chemically synthesized
atatagtcccatttgtctattt

SEQ ID NO: 26327 - DNA, 22 bp, Artificial Sequence
  chemically synthesized
gtctatttttgcttttgttgcc

SEQ ID NO: 26328 - DNA, 22 bp, Artificial Sequence
  chemically synthesized
tctatttttgcttttgttgcct

SEQ ID NO: 26329 - DNA, 22 bp, Artificial Sequence
  chemically synthesized
tttttgcttttgttgcctgtgc

SEQ ID NO: 26330 - DNA, 22 bp, Artificial Sequence
  chemically synthesized
ttgcttttgttgcctgtgcttt

SEQ ID NO: 26331 - DNA, 22 bp, Artificial Sequence
  chemically synthesized
tgcttttgttgcctgtgctttt

SEQ ID NO: 26332 - DNA, 22 bp, Artificial Sequence
  chemically synthesized
gcttttgttgcctgtgcttttg

SEQ ID NO: 26333 - DNA, 22 bp, Artificial Sequence
  chemically synthesized
cttttgttgcctgtgcttttga

SEQ ID NO: 26334 - DNA, 22 bp, Artificial Sequence
  chemically synthesized
ttgttgcctgtgcttttgaggt

SEQ ID NO: 26335 - DNA, 22 bp, Artificial Sequence
  chemically synthesized
tgttgcctgtgcttttgaggtc

SEQ ID NO: 26336 - DNA, 22 bp, Artificial Sequence
  chemically synthesized
gttgcctgtgcttttgaggtct

SEQ ID NO: 26337 - DNA, 22 bp, Artificial Sequence
  chemically synthesized
ttgcctgtgcttttgaggtctt

SEQ ID NO: 26338 - DNA, 22 bp, Artificial Sequence
  chemically synthesized
cctgtgcttttgaggtcttggc

SEQ ID NO: 26339 - DNA, 22 bp, Artificial Sequence
  chemically synthesized
tgcttttgaggtcttggccata

SEQ ID NO: 26340 - DNA, 22 bp, Artificial Sequence
  chemically synthesized
ttgaggtcttggccataaaatc

SEQ ID NO: 26341 - DNA, 22 bp, Artificial Sequence
  chemically synthesized
tgaggtcttggccataaaatct

SEQ ID NO: 26342 - DNA, 22 bp, Artificial Sequence
  chemically synthesized
gaggtcttggccataaaatctt

SEQ ID NO: 26343 - DNA, 22 bp, Artificial Sequence
  chemically synthesized
aggtcttggccataaaatcttt

SEQ ID NO: 26344 - DNA, 22 bp, Artificial Sequence
  chemically synthesized
ggccataaaatctttgcccaaa

SEQ ID NO: 26345 - DNA, 22 bp, Artificial Sequence
  chemically synthesized
gccataaaatctttgcccaaag

SEQ ID NO: 26346 - DNA, 22 bp, Artificial Sequence
  chemically synthesized
tgcccaaagccatgtcttgaag

SEQ ID NO: 26347 - DNA, 22 bp, Artificial Sequence
  chemically synthesized
gcccaaagccatgtcttgaagt

SEQ ID NO: 26348 - DNA, 22 bp, Artificial Sequence
  chemically synthesized
cccaaagccatgtcttgaagtg

SEQ ID NO: 26349 - DNA, 22 bp, Artificial Sequence
  chemically synthesized
gaagtgtctcccttatgttttc

SEQ ID NO: 26350 - DNA, 22 bp, Artificial Sequence
  chemically synthesized
aagtgtctcccttatgttttct

SEQ ID NO: 26351 - DNA, 22 bp, Artificial Sequence
  chemically synthesized
ccttatgttttcttttagtagt

SEQ ID NO: 26352 - DNA, 22 bp, Artificial Sequence
  chemically synthesized
atgttttcttttagtagtttta

SEQ ID NO: 26353 - DNA, 22 bp, Artificial Sequence
  chemically synthesized
tgttttcttttagtagttttat

SEQ ID NO: 26354 - DNA, 22 bp, Artificial Sequence
  chemically synthesized
tcttttagtagttttatagttt

SEQ ID NO: 26355 - DNA, 22 bp, Artificial Sequence
  chemically synthesized
cttttagtagttttatagtttt

SEQ ID NO: 26356 - DNA, 22 bp, Artificial Sequence
  chemically synthesized
ttttagtagttttatagtttta

SEQ ID NO: 26357 - DNA, 22 bp, Artificial Sequence
  chemically synthesized
ttagtagttttatagttttaag

SEQ ID NO: 26358 - DNA, 22 bp, Artificial Sequence
  chemically synthesized
tagtagttttatagttttaagt

SEQ ID NO: 26359 - DNA, 22 bp, Artificial Sequence
  chemically synthesized
agtagttttatagttttaagtt

SEQ ID NO: 26360 - DNA, 22 bp, Artificial Sequence
  chemically synthesized
gtagttttatagttttaagttt

SEQ ID NO: 26361 - DNA, 22 bp, Artificial Sequence
  chemically synthesized
tatagttttaagttttatattt

SEQ ID NO: 26362 - DNA, 22 bp, Artificial Sequence
  chemically synthesized
atagttttaagttttatattta

SEQ ID NO: 26363 - DNA, 22 bp, Artificial Sequence
  chemically synthesized
tagttttaagttttatatttaa

SEQ ID NO: 26364 - DNA, 22 bp, Artificial Sequence
  chemically synthesized
taagttttatatttaagtcttt

SEQ ID NO: 26365 - DNA, 22 bp, Artificial Sequence
  chemically synthesized
aagttttatatttaagtcttta

SEQ ID NO: 26366 - DNA, 22 bp, Artificial Sequence
  chemically synthesized
agttttatatttaagtctttaa

SEQ ID NO: 26367 - DNA, 22 bp, Artificial Sequence
  chemically synthesized
tatatttaagtctttaatccat

SEQ ID NO: 26368 - DNA, 22 bp, Artificial Sequence
  chemically synthesized
atatttaagtctttaatccatc

SEQ ID NO: 26369 - DNA, 22 bp, Artificial Sequence
  chemically synthesized
tatttaagtctttaatccatct

SEQ ID NO: 26370 - DNA, 22 bp, Artificial Sequence
  chemically synthesized
aagtctttaatccatcttgaga

SEQ ID NO: 26371 - DNA, 22 bp, Artificial Sequence
  chemically synthesized
agtctttaatccatcttgagag

SEQ ID NO: 26372 - DNA, 22 bp, Artificial Sequence
  chemically synthesized
taatccatcttgagagtacgtt

SEQ ID NO: 26373 - DNA, 22 bp, Artificial Sequence
  chemically synthesized
aatccatcttgagagtacgttt

SEQ ID NO: 26374 - DNA, 22 bp, Artificial Sequence
  chemically synthesized
atccatcttgagagtacgtttt

SEQ ID NO: 26375 - DNA, 22 bp, Artificial Sequence
  chemically synthesized
gagagtacgttttatatggcaa

SEQ ID NO: 26376 - DNA, 22 bp, Artificial Sequence
  chemically synthesized
agagtacgttttatatggcaat

SEQ ID NO: 26377 - DNA, 22 bp, Artificial Sequence
  chemically synthesized
tatatggcaataaataggggtt

SEQ ID NO: 26378 - DNA, 22 bp, Artificial Sequence
  chemically synthesized
atatggcaataaataggggttg

SEQ ID NO: 26379 - DNA, 22 bp, Artificial Sequence
  chemically synthesized
tatggcaataaataggggttgt

SEQ ID NO: 26380 - DNA, 22 bp, Artificial Sequence
  chemically synthesized
tattaggccatttttgcatcta

SEQ ID NO: 26381 - DNA, 22 bp, Artificial Sequence
  chemically synthesized
ggccatttttgcatctattgta

SEQ ID NO: 26382 - DNA, 22 bp, Artificial Sequence
  chemically synthesized
ttgcatctattgtacaaggggt

SEQ ID NO: 26383 - DNA, 22 bp, Artificial Sequence
  chemically synthesized
tgcatctattgtacaaggggtt

SEQ ID NO: 26384 - DNA, 22 bp, Artificial Sequence
  chemically synthesized
gcatctattgtacaaggggttg

SEQ ID NO: 26385 - DNA, 22 bp, Artificial Sequence
  chemically synthesized
catctattgtacaaggggttga

SEQ ID NO: 26386 - DNA, 22 bp, Artificial Sequence
  chemically synthesized
ttgtacaaggggttgagttctt

SEQ ID NO: 26387 - DNA, 22 bp, Artificial Sequence
  chemically synthesized
tacaaggggttgagttcttgat

SEQ ID NO: 26388 - DNA, 22 bp, Artificial Sequence
  chemically synthesized
agttcttgatttgattctccat

SEQ ID NO: 26389 - DNA, 22 bp, Artificial Sequence
  chemically synthesized
ttgatttgattctccatttggt

SEQ ID NO: 26390 - DNA, 22 bp, Artificial Sequence
  chemically synthesized
gatttgattctccatttggttg

SEQ ID NO: 26391 - DNA, 22 bp, Artificial Sequence
  chemically synthesized
atttgattctccatttggttgc

SEQ ID NO: 26392 - DNA, 22 bp, Artificial Sequence
  chemically synthesized
gattctccatttggttgctgtt

SEQ ID NO: 26393 - DNA, 22 bp, Artificial Sequence
  chemically synthesized
attctccatttggttgctgttg

SEQ ID NO: 26394 - DNA, 22 bp, Artificial Sequence
  chemically synthesized
tccatttggttgctgttggtgt

SEQ ID NO: 26395 - DNA, 22 bp, Artificial Sequence
  chemically synthesized
catttggttgctgttggtgtat

SEQ ID NO: 26396 - DNA, 22 bp, Artificial Sequence
  chemically synthesized
ggttgctgttggtgtatagaag

SEQ ID NO: 26397 - DNA, 22 bp, Artificial Sequence
  chemically synthesized
gttgctgttggtgtatagaaga

SEQ ID NO: 26398 - DNA, 22 bp, Artificial Sequence
  chemically synthesized
ctgttggtgtatagaagagtta

SEQ ID NO: 26399 - DNA, 22 bp, Artificial Sequence
  chemically synthesized
ttggtgtatagaagagttactg

SEQ ID NO: 26400 - DNA, 22 bp, Artificial Sequence
  chemically synthesized
gtgtatagaagagttactgatt

SEQ ID NO: 26401 - DNA, 22 bp, Artificial Sequence
  chemically synthesized
ctgatttgtgtgcattcatctt

SEQ ID NO: 26402 - DNA, 22 bp, Artificial Sequence
  chemically synthesized
atttgtgtgcattcatcttgta

SEQ ID NO: 26403 - DNA, 22 bp, Artificial Sequence
  chemically synthesized
gtgtgcattcatcttgtatctg

SEQ ID NO: 26404 - DNA, 22 bp, Artificial Sequence
  chemically synthesized
tgtgcattcatcttgtatctgg

SEQ ID NO: 26405 - DNA, 22 bp, Artificial Sequence
  chemically synthesized
atcttgtatctggaaactttgc

SEQ ID NO: 26406 - DNA, 22 bp, Artificial Sequence
  chemically synthesized
gtatctggaaactttgctgaat

SEQ ID NO: 26407 - DNA, 22 bp, Artificial Sequence
  chemically synthesized
tatctggaaactttgctgaatt

SEQ ID NO: 26408 - DNA, 22 bp, Artificial Sequence
  chemically synthesized
gaaactttgctgaattatttta

SEQ ID NO: 26409 - DNA, 22 bp, Artificial Sequence
  chemically synthesized
tgctgaattattttatcagttc

SEQ ID NO: 26410 - DNA, 22 bp, Artificial Sequence
  chemically synthesized
gctgaattattttatcagttct

SEQ ID NO: 26411 - DNA, 22 bp, Artificial Sequence
  chemically synthesized
ctgaattattttatcagttcta

SEQ ID NO: 26412 - DNA, 22 bp, Artificial Sequence
  chemically synthesized
aattattttatcagttctagga

SEQ ID NO: 26413 - DNA, 22 bp, Artificial Sequence
  chemically synthesized
ttttatcagttctaggagcttt

SEQ ID NO: 26414 - DNA, 22 bp, Artificial Sequence
  chemically synthesized
tatcagttctaggagctttctg

SEQ ID NO: 26415 - DNA, 22 bp, Artificial Sequence
  chemically synthesized
atcagttctaggagctttctgg

SEQ ID NO: 26416 - DNA, 22 bp, Artificial Sequence
  chemically synthesized
tcagttctaggagctttctgga

SEQ ID NO: 26417 - DNA, 22 bp, Artificial Sequence
  chemically synthesized
taggagctttctggaggagtct

SEQ ID NO: 26418 - DNA, 22 bp, Artificial Sequence
  chemically synthesized
ggagctttctggaggagtcttt

SEQ ID NO: 26419 - DNA, 22 bp, Artificial Sequence
  chemically synthesized
tctggaggagtctttagggttt

SEQ ID NO: 26420 - DNA, 22 bp, Artificial Sequence
  chemically synthesized
ctggaggagtctttagggtttt

SEQ ID NO: 26421 - DNA, 22 bp, Artificial Sequence
  chemically synthesized
tggaggagtctttagggtttta

SEQ ID NO: 26422 - DNA, 22 bp, Artificial Sequence
  chemically synthesized
gaggagtctttagggttttaaa

SEQ ID NO: 26423 - DNA, 22 bp, Artificial Sequence
  chemically synthesized
tagggttttaaaggtaaatgat

SEQ ID NO: 26424 - DNA, 22 bp, Artificial Sequence
  chemically synthesized
agggttttaaaggtaaatgatc

SEQ ID NO: 26425 - DNA, 22 bp, Artificial Sequence
  chemically synthesized
gggttttaaaggtaaatgatca

SEQ ID NO: 26426 - DNA, 22 bp, Artificial Sequence
  chemically synthesized
taaaggtaaatgatcatatcat

SEQ ID NO: 26427 - DNA, 22 bp, Artificial Sequence
  chemically synthesized
aaaggtaaatgatcatatcatc

SEQ ID NO: 26428 - DNA, 22 bp, Artificial Sequence
  chemically synthesized
aaggtaaatgatcatatcatca

SEQ ID NO: 26429 - DNA, 22 bp, Artificial Sequence
  chemically synthesized
gacttcctctttactgatttga

SEQ ID NO: 26430 - DNA, 22 bp, Artificial Sequence
  chemically synthesized
acttcctctttactgatttgaa

SEQ ID NO: 26431 - DNA, 22 bp, Artificial Sequence
  chemically synthesized
cctctttactgatttgaatgcc

SEQ ID NO: 26432 - DNA, 22 bp, Artificial Sequence
  chemically synthesized
ctctttactgatttgaatgccc

SEQ ID NO: 26433 - DNA, 22 bp, Artificial Sequence
  chemically synthesized
tttactgatttgaatgcccttt

SEQ ID NO: 26434 - DNA, 22 bp, Artificial Sequence
  chemically synthesized
tactgatttgaatgccctttat

SEQ ID NO: 26435 - DNA, 22 bp, Artificial Sequence
  chemically synthesized
actgatttgaatgccctttatt

SEQ ID NO: 26436 - DNA, 22 bp, Artificial Sequence
  chemically synthesized
ctgatttgaatgccctttattt

SEQ ID NO: 26437 - DNA, 22 bp, Artificial Sequence
  chemically synthesized
atttgaatgccctttatttctt

SEQ ID NO: 26438 - DNA, 22 bp, Artificial Sequence
  chemically synthesized
gaatgccctttatttctttgtt

SEQ ID NO: 26439 - DNA, 22 bp, Artificial Sequence
  chemically synthesized
aatgccctttatttctttgttt

SEQ ID NO: 26440 - DNA, 22 bp, Artificial Sequence
  chemically synthesized
tatttctttgttttgtctgatt

SEQ ID NO: 26441 - DNA, 22 bp, Artificial Sequence
  chemically synthesized
atttctttgttttgtctgattg

SEQ ID NO: 26442 - DNA, 22 bp, Artificial Sequence
  chemically synthesized
tttctttgttttgtctgattgc

SEQ ID NO: 26443 - DNA, 22 bp, Artificial Sequence
  chemically synthesized
ctttgttttgtctgattgccct

SEQ ID NO: 26444 - DNA, 22 bp, Artificial Sequence
  chemically synthesized
tttgttttgtctgattgccctg

SEQ ID NO: 26445 - DNA, 22 bp, Artificial Sequence
  chemically synthesized
tgttttgtctgattgccctggc

SEQ ID NO: 26446 - DNA, 22 bp, Artificial Sequence
  chemically synthesized
gttttgtctgattgccctggct

SEQ ID NO: 26447 - DNA, 22 bp, Artificial Sequence
  chemically synthesized
ttttgtctgattgccctggcta

SEQ ID NO: 26448 - DNA, 22 bp, Artificial Sequence
  chemically synthesized
tgtctgattgccctggctagga

SEQ ID NO: 26449 - DNA, 22 bp, Artificial Sequence
  chemically synthesized
gtctgattgccctggctaggac

SEQ ID NO: 26450 - DNA, 22 bp, Artificial Sequence
  chemically synthesized
tctgattgccctggctaggact

SEQ ID NO: 26451 - DNA, 22 bp, Artificial Sequence
  chemically synthesized
attgccctggctaggacttcca

SEQ ID NO: 26452 - DNA, 22 bp, Artificial Sequence
  chemically synthesized
ccctggctaggacttccagtac

SEQ ID NO: 26453 - DNA, 22 bp, Artificial Sequence
  chemically synthesized
gctaggacttccagtactatgt

SEQ ID NO: 26454 - DNA, 22 bp, Artificial Sequence
  chemically synthesized
ggacttccagtactatgttgaa

SEQ ID NO: 26455 - DNA, 22 bp, Artificial Sequence
  chemically synthesized
ccagtactatgttgaagaggag

SEQ ID NO: 26456 - DNA, 22 bp, Artificial Sequence
  chemically synthesized
cagtactatgttgaagaggagt

SEQ ID NO: 26457 - DNA, 22 bp, Artificial Sequence
  chemically synthesized
tgttgaagaggagtggtgagag

SEQ ID NO: 26458 - DNA, 22 bp, Artificial Sequence
  chemically synthesized
aagaggagtggtgagagtgggc

SEQ ID NO: 26459 - DNA, 22 bp, Artificial Sequence
  chemically synthesized
gtcttgttccagttctcagagg

SEQ ID NO: 26460 - DNA, 22 bp, Artificial Sequence
  chemically synthesized
tcttgttccagttctcagaggg

SEQ ID NO: 26461 - DNA, 22 bp, Artificial Sequence
  chemically synthesized
gttccagttctcagagggaatg

SEQ ID NO: 26462 - DNA, 22 bp, Artificial Sequence
  chemically synthesized
ttccagttctcagagggaatgc

SEQ ID NO: 26463 - DNA, 22 bp, Artificial Sequence
  chemically synthesized
cagttctcagagggaatgcttt

SEQ ID NO: 26464 - DNA, 22 bp, Artificial Sequence
  chemically synthesized
tcagagggaatgctttcaactt

SEQ ID NO: 26465 - DNA, 22 bp, Artificial Sequence
  chemically synthesized
agagggaatgctttcaactttt

SEQ ID NO: 26466 - DNA, 22 bp, Artificial Sequence
  chemically synthesized
tcaacttttccccattcaatat

SEQ ID NO: 26467 - DNA, 22 bp, Artificial Sequence
  chemically synthesized
caacttttccccattcaatatt

SEQ ID NO: 26468 - DNA, 22 bp, Artificial Sequence
  chemically synthesized
aacttttccccattcaatatta

SEQ ID NO: 26469 - DNA, 22 bp, Artificial Sequence
  chemically synthesized
ttccccattcaatattatgttg

SEQ ID NO: 26470 - DNA, 22 bp, Artificial Sequence
  chemically synthesized
tccccattcaatattatgttgg

SEQ ID NO: 26471 - DNA, 22 bp, Artificial Sequence
  chemically synthesized
ccccattcaatattatgttggc

SEQ ID NO: 26472 - DNA, 22 bp, Artificial Sequence
  chemically synthesized
cccattcaatattatgttggct

SEQ ID NO: 26473 - DNA, 22 bp, Artificial Sequence
  chemically synthesized
aatattatgttggctgtgggtt

SEQ ID NO: 26474 - DNA, 22 bp, Artificial Sequence
  chemically synthesized
tgttggctgtgggtttgtcaca

SEQ ID NO: 26475 - DNA, 22 bp, Artificial Sequence
  chemically synthesized
gctgtgggtttgtcacagatgg

SEQ ID NO: 26476 - DNA, 22 bp, Artificial Sequence
  chemically synthesized
tgggtttgtcacagatggcttt

SEQ ID NO: 26477 - DNA, 22 bp, Artificial Sequence
  chemically synthesized
gtcacagatggcttttattaca

SEQ ID NO: 26478 - DNA, 22 bp, Artificial Sequence
  chemically synthesized
tcacagatggcttttattacac

SEQ ID NO: 26479 - DNA, 22 bp, Artificial Sequence
  chemically synthesized
ttattacactgaggtatgtctc

SEQ ID NO: 26480 - DNA, 22 bp, Artificial Sequence
  chemically synthesized
tattacactgaggtatgtctct

SEQ ID NO: 26481 - DNA, 22 bp, Artificial Sequence
  chemically synthesized
attacactgaggtatgtctctt

SEQ ID NO: 26482 - DNA, 22 bp, Artificial Sequence
  chemically synthesized
ttacactgaggtatgtctcttg

SEQ ID NO: 26483 - DNA, 22 bp, Artificial Sequence
  chemically synthesized
cactgaggtatgtctcttgtat

SEQ ID NO: 26484 - DNA, 22 bp, Artificial Sequence
  chemically synthesized
aggtatgtctcttgtatgctga

SEQ ID NO: 26485 - DNA, 22 bp, Artificial Sequence
  chemically synthesized
ttgtatgctgattttgctgagc

SEQ ID NO: 26486 - DNA, 22 bp, Artificial Sequence
  chemically synthesized
gtatgctgattttgctgagcat

SEQ ID NO: 26487 - DNA, 22 bp, Artificial Sequence
  chemically synthesized
tatgctgattttgctgagcatt

SEQ ID NO: 26488 - DNA, 22 bp, Artificial Sequence
  chemically synthesized
attttgctgagcattttaatca

SEQ ID NO: 26489 - DNA, 22 bp, Artificial Sequence
  chemically synthesized
tgctgagcattttaatcataaa

SEQ ID NO: 26490 - DNA, 22 bp, Artificial Sequence
  chemically synthesized
gctgagcattttaatcataaat

SEQ ID NO: 26491 - DNA, 22 bp, Artificial Sequence
  chemically synthesized
ctgagcattttaatcataaatg

SEQ ID NO: 26492 - DNA, 22 bp, Artificial Sequence
  chemically synthesized
agcattttaatcataaatgtat

SEQ ID NO: 26493 - DNA, 22 bp, Artificial Sequence
  chemically synthesized
taatcataaatgtatgctggat

SEQ ID NO: 26494 - DNA, 22 bp, Artificial Sequence
  chemically synthesized
aatcataaatgtatgctggatt

SEQ ID NO: 26495 - DNA, 22 bp, Artificial Sequence
  chemically synthesized
atcataaatgtatgctggattt

SEQ ID NO: 26496 - DNA, 22 bp, Artificial Sequence
  chemically synthesized
gattttgttgaatgctttttct

SEQ ID NO: 26497 - DNA, 22 bp, Artificial Sequence
  chemically synthesized
tgttgaatgctttttctgcatc

SEQ ID NO: 26498 - DNA, 22 bp, Artificial Sequence
  chemically synthesized
gttgaatgctttttctgcatct

SEQ ID NO: 26499 - DNA, 22 bp, Artificial Sequence
  chemically synthesized
ttgaatgctttttctgcatcta

SEQ ID NO: 26500 - DNA, 22 bp, Artificial Sequence
  chemically synthesized
aatgctttttctgcatctattg

SEQ ID NO: 26501 - DNA, 22 bp, Artificial Sequence
  chemically synthesized
tttctgcatctattgagatgat

SEQ ID NO: 26502 - DNA, 22 bp, Artificial Sequence
  chemically synthesized
ttctgcatctattgagatgatc

SEQ ID NO: 26503 - DNA, 22 bp, Artificial Sequence
  chemically synthesized
tctgcatctattgagatgatca

SEQ ID NO: 26504 - DNA, 22 bp, Artificial Sequence
  chemically synthesized
ctgcatctattgagatgatcat

SEQ ID NO: 26505 - DNA, 22 bp, Artificial Sequence
  chemically synthesized
tgcatctattgagatgatcatg

SEQ ID NO: 26506 - DNA, 22 bp, Artificial Sequence
  chemically synthesized
catctattgagatgatcatgta

SEQ ID NO: 26507 - DNA, 22 bp, Artificial Sequence
  chemically synthesized
ttgagatgatcatgtaattttt

SEQ ID NO: 26508 - DNA, 22 bp, Artificial Sequence
  chemically synthesized
agatgatcatgtaatttttgtt

SEQ ID NO: 26509 - DNA, 22 bp, Artificial Sequence
  chemically synthesized
ttgtttttaaatctgtttatgt

SEQ ID NO: 26510 - DNA, 22 bp, Artificial Sequence
  chemically synthesized
tgtttttaaatctgtttatgtg

SEQ ID NO: 26511 - DNA, 22 bp, Artificial Sequence
  chemically synthesized
gtttttaaatctgtttatgtgg

SEQ ID NO: 26512 - DNA, 22 bp, Artificial Sequence
  chemically synthesized
tttttaaatctgtttatgtggt

SEQ ID NO: 26513 - DNA, 22 bp, Artificial Sequence
  chemically synthesized
ttaaatctgtttatgtggtgta

SEQ ID NO: 26514 - DNA, 22 bp, Artificial Sequence
  chemically synthesized
taaatctgtttatgtggtgtat

SEQ ID NO: 26515 - DNA, 22 bp, Artificial Sequence
  chemically synthesized
aaatctgtttatgtggtgtatc

SEQ ID NO: 26516 - DNA, 22 bp, Artificial Sequence
  chemically synthesized
aatctgtttatgtggtgtatca

SEQ ID NO: 26517 - DNA, 22 bp, Artificial Sequence
  chemically synthesized
tttatgtggtgtatcacactta

SEQ ID NO: 26518 - DNA, 22 bp, Artificial Sequence
  chemically synthesized
atgtggtgtatcacacttattg

SEQ ID NO: 26519 - DNA, 22 bp, Artificial Sequence
  chemically synthesized
tgtggtgtatcacacttattga

SEQ ID NO: 26520 - DNA, 22 bp, Artificial Sequence
  chemically synthesized
attgacttgcagatgtcaaacc

SEQ ID NO: 26521 - DNA, 22 bp, Artificial Sequence
  chemically synthesized
ttgacttgcagatgtcaaacca

SEQ ID NO: 26522 - DNA, 22 bp, Artificial Sequence
  chemically synthesized
acttgcagatgtcaaaccaacc

SEQ ID NO: 26523 - DNA, 22 bp, Artificial Sequence
  chemically synthesized
gcagatgtcaaaccaaccctgc

SEQ ID NO: 26524 - DNA, 22 bp, Artificial Sequence
  chemically synthesized
cagatgtcaaaccaaccctgca

SEQ ID NO: 26525 - DNA, 22 bp, Artificial Sequence
  chemically synthesized
catccctggcatggaacctgct

SEQ ID NO: 26526 - DNA, 22 bp, Artificial Sequence
  chemically synthesized
gcatggaacctgcttgatcatg

SEQ ID NO: 26527 - DNA, 22 bp, Artificial Sequence
  chemically synthesized
cttgatcatggtggattatctt

SEQ ID NO: 26528 - DNA, 22 bp, Artificial Sequence
  chemically synthesized
gatcatggtggattatcttttt

SEQ ID NO: 26529 - DNA, 22 bp, Artificial Sequence
  chemically synthesized
atcatggtggattatctttttg

SEQ ID NO: 26530 - DNA, 22 bp, Artificial Sequence
  chemically synthesized
tctttttgttatgttgttgaat

SEQ ID NO: 26531 - DNA, 22 bp, Artificial Sequence
  chemically synthesized
tttgttatgttgttgaatttgg

SEQ ID NO: 26532 - DNA, 22 bp, Artificial Sequence
  chemically synthesized
ttgttatgttgttgaatttggt

SEQ ID NO: 26533 - DNA, 22 bp, Artificial Sequence
  chemically synthesized
tgttatgttgttgaatttggtt

SEQ ID NO: 26534 - DNA, 22 bp, Artificial Sequence
  chemically synthesized
gttatgttgttgaatttggtta

SEQ ID NO: 26535 - DNA, 22 bp, Artificial Sequence
  chemically synthesized
ttatgttgttgaatttggttat

SEQ ID NO: 26536 - DNA, 22 bp, Artificial Sequence
  chemically synthesized
tgttgttgaatttggttatcta

SEQ ID NO: 26537 - DNA, 22 bp, Artificial Sequence
  chemically synthesized
ttgaatttggttatctagtatt

SEQ ID NO: 26538 - DNA, 22 bp, Artificial Sequence
  chemically synthesized
aatttggttatctagtattttg

SEQ ID NO: 26539 - DNA, 22 bp, Artificial Sequence
  chemically synthesized
ggttatctagtattttgttaag

SEQ ID NO: 26540 - DNA, 22 bp, Artificial Sequence
  chemically synthesized
gttatctagtattttgttaagg

SEQ ID NO: 26541 - DNA, 22 bp, Artificial Sequence
  chemically synthesized
tctagtattttgttaaggattt

SEQ ID NO: 26542 - DNA, 22 bp, Artificial Sequence
  chemically synthesized
gtattttgttaaggattttagc

SEQ ID NO: 26543 - DNA, 22 bp, Artificial Sequence
  chemically synthesized
tgttaaggattttagcatctat

SEQ ID NO: 26544 - DNA, 22 bp, Artificial Sequence
  chemically synthesized
gttaaggattttagcatctatg

SEQ ID NO: 26545 - DNA, 22 bp, Artificial Sequence
  chemically synthesized
ttaaggattttagcatctatgt

SEQ ID NO: 26546 - DNA, 22 bp, Artificial Sequence
  chemically synthesized
aggattttagcatctatgttca

SEQ ID NO: 26547 - DNA, 22 bp, Artificial Sequence
  chemically synthesized
tagcatctatgttcatcaaggc

SEQ ID NO: 26548 - DNA, 22 bp, Artificial Sequence
  chemically synthesized
agcatctatgttcatcaaggct

SEQ ID NO: 26549 - DNA, 22 bp, Artificial Sequence
  chemically synthesized
gcatctatgttcatcaaggcta

SEQ ID NO: 26550 - DNA, 22 bp, Artificial Sequence
  chemically synthesized
tgttcatcaaggctatcagtct

SEQ ID NO: 26551 - DNA, 22 bp, Artificial Sequence
  chemically synthesized
atcaaggctatcagtctgtagt

SEQ ID NO: 26552 - DNA, 22 bp, Artificial Sequence
  chemically synthesized
tcagtctgtagttttctttttt

SEQ ID NO: 26553 - DNA, 22 bp, Artificial Sequence
  chemically synthesized
tagttttcttttttggttatgt

SEQ ID NO: 26554 - DNA, 22 bp, Artificial Sequence
  chemically synthesized
tcttttttggttatgtccttcc

SEQ ID NO: 26555 - DNA, 22 bp, Artificial Sequence
  chemically synthesized
cttttttggttatgtccttccc

SEQ ID NO: 26556 - DNA, 22 bp, Artificial Sequence
  chemically synthesized
ttttttggttatgtccttccct

SEQ ID NO: 26557 - DNA, 22 bp, Artificial Sequence
  chemically synthesized
ttttggttatgtccttccctgg

SEQ ID NO: 26558 - DNA, 22 bp, Artificial Sequence
  chemically synthesized
tttggttatgtccttccctggt

SEQ ID NO: 26559 - DNA, 22 bp, Artificial Sequence
  chemically synthesized
ttggttatgtccttccctggtt

SEQ ID NO: 26560 - DNA, 22 bp, Artificial Sequence
  chemically synthesized
tggttatgtccttccctggttt

SEQ ID NO: 26561 - DNA, 22 bp, Artificial Sequence
  chemically synthesized
ggttatgtccttccctggtttt

SEQ ID NO: 26562 - DNA, 22 bp, Artificial Sequence
  chemically synthesized
gttatgtccttccctggttttg

SEQ ID NO: 26563 - DNA, 22 bp, Artificial Sequence
  chemically synthesized
tgtccttccctggttttggtgt

SEQ ID NO: 26564 - DNA, 22 bp, Artificial Sequence
  chemically synthesized
ccctggttttggtgtgatgctg

SEQ ID NO: 26565 - DNA, 22 bp, Artificial Sequence
  chemically synthesized
cctggttttggtgtgatgctgg

SEQ ID NO: 26566 - DNA, 22 bp, Artificial Sequence
  chemically synthesized
gttttggtgtgatgctggcttc

SEQ ID NO: 26567 - DNA, 22 bp, Artificial Sequence
  chemically synthesized
tggtgtgatgctggcttcatag

SEQ ID NO: 26568 - DNA, 22 bp, Artificial Sequence
  chemically synthesized
ggtgtgatgctggcttcataga

SEQ ID NO: 26569 - DNA, 22 bp, Artificial Sequence
  chemically synthesized
gtgtgatgctggcttcatagaa

SEQ ID NO: 26570 - DNA, 22 bp, Artificial Sequence
  chemically synthesized
gcttcatagaatgaattagggc

SEQ ID NO: 26571 - DNA, 22 bp, Artificial Sequence
  chemically synthesized
catagaatgaattagggcaggt

SEQ ID NO: 26572 - DNA, 22 bp, Artificial Sequence
  chemically synthesized
atagaatgaattagggcaggtt

SEQ ID NO: 26573 - DNA, 22 bp, Artificial Sequence
  chemically synthesized
gggcaggttccttctttatctg

SEQ ID NO: 26574 - DNA, 22 bp, Artificial Sequence
  chemically synthesized
cttctttatctgtcttgtagaa

SEQ ID NO: 26575 - DNA, 22 bp, Artificial Sequence
  chemically synthesized
ctttatctgtcttgtagaatag

SEQ ID NO: 26576 - DNA, 22 bp, Artificial Sequence
  chemically synthesized
tttatctgtcttgtagaatagt

SEQ ID NO: 26577 - DNA, 22 bp, Artificial Sequence
  chemically synthesized
tatctgtcttgtagaatagtgt

SEQ ID NO: 26578 - DNA, 22 bp, Artificial Sequence
  chemically synthesized
atctgtcttgtagaatagtgtc

SEQ ID NO: 26579 - DNA, 22 bp, Artificial Sequence
  chemically synthesized
tctgtcttgtagaatagtgtca

SEQ ID NO: 26580 - DNA, 22 bp, Artificial Sequence
  chemically synthesized
tcttgtagaatagtgtcaaaaa

SEQ ID NO: 26581 - DNA, 22 bp, Artificial Sequence
  chemically synthesized
gtagaatagtgtcaaaaagatg

SEQ ID NO: 26582 - DNA, 22 bp, Artificial Sequence
  chemically synthesized
tagaatagtgtcaaaaagatgg

SEQ ID NO: 26583 - DNA, 22 bp, Artificial Sequence
  chemically synthesized
ctctttgaatgtctagtagaat

SEQ ID NO: 26584 - DNA, 22 bp, Artificial Sequence
  chemically synthesized
tttgaatgtctagtagaattct

SEQ ID NO: 26585 - DNA, 22 bp, Artificial Sequence
  chemically synthesized
tgaatgtctagtagaattctgt

SEQ ID NO: 26586 - DNA, 22 bp, Artificial Sequence
  chemically synthesized
gaatgtctagtagaattctgtt

SEQ ID NO: 26587 - DNA, 22 bp, Artificial Sequence
  chemically synthesized
aatgtctagtagaattctgttg

SEQ ID NO: 26588 - DNA, 22 bp, Artificial Sequence
  chemically synthesized
gtagaattctgttgtgaatcca

SEQ ID NO: 26589 - DNA, 22 bp, Artificial Sequence
  chemically synthesized
tgttgtgaatccatctggtcct

SEQ ID NO: 26590 - DNA, 22 bp, Artificial Sequence
  chemically synthesized
ttgtgaatccatctggtcctga

SEQ ID NO: 26591 - DNA, 22 bp, Artificial Sequence
  chemically synthesized
tgaatccatctggtcctgaact

SEQ ID NO: 26592 - DNA, 22 bp, Artificial Sequence
  chemically synthesized
gtcctgaacttttttttggttg

SEQ ID NO: 26593 - DNA, 22 bp, Artificial Sequence
  chemically synthesized
aacttttttttggttggtaatt

SEQ ID NO: 26594 - DNA, 22 bp, Artificial Sequence
  chemically synthesized
ttttttggttggtaatttttta

SEQ ID NO: 26595 - DNA, 22 bp, Artificial Sequence
  chemically synthesized
tttttggttggtaattttttaa

SEQ ID NO: 26596 - DNA, 22 bp, Artificial Sequence
  chemically synthesized
ttttggttggtaattttttaat

SEQ ID NO: 26597 - DNA, 22 bp, Artificial Sequence
  chemically synthesized
tttggttggtaattttttaatt

SEQ ID NO: 26598 - DNA, 22 bp, Artificial Sequence
  chemically synthesized
ttggttggtaattttttaatta

SEQ ID NO: 26599 - DNA, 22 bp, Artificial Sequence
  chemically synthesized
tggttggtaattttttaattac

SEQ ID NO: 26600 - DNA, 22 bp, Artificial Sequence
  chemically synthesized
ggttggtaattttttaattacc

SEQ ID NO: 26601 - DNA, 22 bp, Artificial Sequence
  chemically synthesized
gttggtaattttttaattacca

SEQ ID NO: 26602 - DNA, 22 bp, Artificial Sequence
  chemically synthesized
gtaattttttaattaccaatta

SEQ ID NO: 26603 - DNA, 22 bp, Artificial Sequence
  chemically synthesized
tttaattaccaattaaatctca

SEQ ID NO: 26604 - DNA, 22 bp, Artificial Sequence
  chemically synthesized
ttaattaccaattaaatctcac

SEQ ID NO: 26605 - DNA, 22 bp, Artificial Sequence
  chemically synthesized
taattaccaattaaatctcact

SEQ ID NO: 26606 - DNA, 22 bp, Artificial Sequence
  chemically synthesized
aattaccaattaaatctcactg

SEQ ID NO: 26607 - DNA, 22 bp, Artificial Sequence
  chemically synthesized
attaccaattaaatctcactgc

SEQ ID NO: 26608 - DNA, 22 bp, Artificial Sequence
  chemically synthesized
ccaattaaatctcactgcttgt

SEQ ID NO: 26609 - DNA, 22 bp, Artificial Sequence
  chemically synthesized
aatctcactgcttgttattggt

SEQ ID NO: 26610 - DNA, 22 bp, Artificial Sequence
  chemically synthesized
actgcttgttattggtctgtta

SEQ ID NO: 26611 - DNA, 22 bp, Artificial Sequence
  chemically synthesized
cttgttattggtctgttagtaa

SEQ ID NO: 26612 - DNA, 22 bp, Artificial Sequence
  chemically synthesized
gttattggtctgttagtaaatt

SEQ ID NO: 26613 - DNA, 22 bp, Artificial Sequence
  chemically synthesized
ttattggtctgttagtaaattt

SEQ ID NO: 26614 - DNA, 22 bp, Artificial Sequence
  chemically synthesized
ttggtctgttagtaaatttatt

SEQ ID NO: 26615 - DNA, 22 bp, Artificial Sequence
  chemically synthesized
gtctgttagtaaatttattgag

SEQ ID NO: 26616 - DNA, 22 bp, Artificial Sequence
  chemically synthesized
ttagtaaatttattgaggctca

SEQ ID NO: 26617 - DNA, 22 bp, Artificial Sequence
  chemically synthesized
gtaaatttattgaggctcattt

SEQ ID NO: 26618 - DNA, 22 bp, Artificial Sequence
  chemically synthesized
attgaggctcatttcatggcct

SEQ ID NO: 26619 - DNA, 22 bp, Artificial Sequence
  chemically synthesized
ttgaggctcatttcatggccta

SEQ ID NO: 26620 - DNA, 22 bp, Artificial Sequence
  chemically synthesized
aggctcatttcatggcctatca

SEQ ID NO: 26621 - DNA, 22 bp, Artificial Sequence
  chemically synthesized
atttcatggcctatcatatggt

SEQ ID NO: 26622 - DNA, 22 bp, Artificial Sequence
  chemically synthesized
catggcctatcatatggtctac

SEQ ID NO: 26623 - DNA, 22 bp, Artificial Sequence
  chemically synthesized
atggcctatcatatggtctacc

SEQ ID NO: 26624 - DNA, 22 bp, Artificial Sequence
  chemically synthesized
tcatatggtctaccttggagaa

SEQ ID NO: 26625 - DNA, 22 bp, Artificial Sequence
  chemically synthesized
ccttggagaaatttccacgcgc

SEQ ID NO: 26626 - DNA, 22 bp, Artificial Sequence
  chemically synthesized
ggagaaatttccacgcgctgtt

SEQ ID NO: 26627 - DNA, 22 bp, Artificial Sequence
  chemically synthesized
gagaaatttccacgcgctgttg

SEQ ID NO: 26628 - DNA, 22 bp, Artificial Sequence
  chemically synthesized
ccacgcgctgttgaatagaatg

SEQ ID NO: 26629 - DNA, 22 bp, Artificial Sequence
  chemically synthesized
cacgcgctgttgaatagaatgt

SEQ ID NO: 26630 - DNA, 22 bp, Artificial Sequence
  chemically synthesized
ttgaatagaatgtgtgttctgt

SEQ ID NO: 26631 - DNA, 22 bp, Artificial Sequence
  chemically synthesized
aatagaatgtgtgttctgtggt

SEQ ID NO: 26632 - DNA, 22 bp, Artificial Sequence
  chemically synthesized
tgtggttattggatgaaatgtt

SEQ ID NO: 26633 - DNA, 22 bp, Artificial Sequence
  chemically synthesized
tggttattggatgaaatgttct

SEQ ID NO: 26634 - DNA, 22 bp, Artificial Sequence
  chemically synthesized
ttggatgaaatgttctgtatat

SEQ ID NO: 26635 - DNA, 22 bp, Artificial Sequence
  chemically synthesized
gatgaaatgttctgtatataac

SEQ ID NO: 26636 - DNA, 22 bp, Artificial Sequence
  chemically synthesized
tgtatataactgttaagtccat

SEQ ID NO: 26637 - DNA, 22 bp, Artificial Sequence
  chemically synthesized
tatataactgttaagtccattt

SEQ ID NO: 26638 - DNA, 22 bp, Artificial Sequence
  chemically synthesized
ttaagtccatttgttctaaggt

SEQ ID NO: 26639 - DNA, 22 bp, Artificial Sequence
  chemically synthesized
agtccatttgttctaaggtata

SEQ ID NO: 26640 - DNA, 22 bp, Artificial Sequence
  chemically synthesized
gttctaaggtataatttaaatc

SEQ ID NO: 26641 - DNA, 22 bp, Artificial Sequence
  chemically synthesized
ttctaaggtataatttaaatcc

SEQ ID NO: 26642 - DNA, 22 bp, Artificial Sequence
  chemically synthesized
taaggtataatttaaatccatt

SEQ ID NO: 26643 - DNA, 22 bp, Artificial Sequence
  chemically synthesized
aggtataatttaaatccattat

SEQ ID NO: 26644 - DNA, 22 bp, Artificial Sequence
  chemically synthesized
aaatccattatttttttgttga

SEQ ID NO: 26645 - DNA, 22 bp, Artificial Sequence
  chemically synthesized
aatccattatttttttgttgac

SEQ ID NO: 26646 - DNA, 22 bp, Artificial Sequence
  chemically synthesized
tttttttgttgactttctgtct

SEQ ID NO: 26647 - DNA, 22 bp, Artificial Sequence
  chemically synthesized
ttttgttgactttctgtcttga

SEQ ID NO: 26648 - DNA, 22 bp, Artificial Sequence
  chemically synthesized
tttgttgactttctgtcttgat

SEQ ID NO: 26649 - DNA, 22 bp, Artificial Sequence
  chemically synthesized
ttgttgactttctgtcttgatg

SEQ ID NO: 26650 - DNA, 22 bp, Artificial Sequence
  chemically synthesized
tgttgactttctgtcttgatga

SEQ ID NO: 26651 - DNA, 22 bp, Artificial Sequence
  chemically synthesized
gttgactttctgtcttgatgaa

SEQ ID NO: 26652 - DNA, 22 bp, Artificial Sequence
  chemically synthesized
ttgactttctgtcttgatgaac

SEQ ID NO: 26653 - DNA, 22 bp, Artificial Sequence
  chemically synthesized
actttctgtcttgatgaactgt

SEQ ID NO: 26654 - DNA, 22 bp, Artificial Sequence
  chemically synthesized
tctgtcttgatgaactgtctag

SEQ ID NO: 26655 - DNA, 22 bp, Artificial Sequence
  chemically synthesized
ctgtcttgatgaactgtctagt

SEQ ID NO: 26656 - DNA, 22 bp, Artificial Sequence
  chemically synthesized
tgtcttgatgaactgtctagtg

SEQ ID NO: 26657 - DNA, 22 bp, Artificial Sequence
  chemically synthesized
tcttgatgaactgtctagtgct

SEQ ID NO: 26658 - DNA, 22 bp, Artificial Sequence
  chemically synthesized
gatgaactgtctagtgctgtca

SEQ ID NO: 26659 - DNA, 22 bp, Artificial Sequence
  chemically synthesized
atgaactgtctagtgctgtcaa

SEQ ID NO: 26660 - DNA, 22 bp, Artificial Sequence
  chemically synthesized
tctagtgctgtcaatgaagtat

SEQ ID NO: 26661 - DNA, 22 bp, Artificial Sequence
  chemically synthesized
gtgctgtcaatgaagtattgaa

SEQ ID NO: 26662 - DNA, 22 bp, Artificial Sequence
  chemically synthesized
tcaatgaagtattgaagtcccc

SEQ ID NO: 26663 - DNA, 22 bp, Artificial Sequence
  chemically synthesized
aagtcccccactattattgtgt

SEQ ID NO: 26664 - DNA, 22 bp, Artificial Sequence
  chemically synthesized
ttattgtgttgctgtctatctc

SEQ ID NO: 26665 - DNA, 22 bp, Artificial Sequence
  chemically synthesized
ttgtgttgctgtctatctcatt

SEQ ID NO: 26666 - DNA, 22 bp, Artificial Sequence
  chemically synthesized
tgttgctgtctatctcatttct

SEQ ID NO: 26667 - DNA, 22 bp, Artificial Sequence
  chemically synthesized
ctgtctatctcatttcttaggt

SEQ ID NO: 26668 - DNA, 22 bp, Artificial Sequence
  chemically synthesized
tctatctcatttcttaggtcta

SEQ ID NO: 26669 - DNA, 22 bp, Artificial Sequence
  chemically synthesized
tctcatttcttaggtctattag

SEQ ID NO: 26670 - DNA, 22 bp, Artificial Sequence
  chemically synthesized
atttcttaggtctattagtaat

SEQ ID NO: 26671 - DNA, 22 bp, Artificial Sequence
  chemically synthesized
cttaggtctattagtaattgtt

SEQ ID NO: 26672 - DNA, 22 bp, Artificial Sequence
  chemically synthesized
ttaggtctattagtaattgttc

SEQ ID NO: 26673 - DNA, 22 bp, Artificial Sequence
  chemically synthesized
aggtctattagtaattgttcta

SEQ ID NO: 26674 - DNA, 22 bp, Artificial Sequence
  chemically synthesized
ggtctattagtaattgttctat

SEQ ID NO: 26675 - DNA, 22 bp, Artificial Sequence
  chemically synthesized
ttagtaattgttctataaattt

SEQ ID NO: 26676 - DNA, 22 bp, Artificial Sequence
  chemically synthesized
gtaattgttctataaatttggg

SEQ ID NO: 26677 - DNA, 22 bp, Artificial Sequence
  chemically synthesized
ttctataaatttgggagctcca

SEQ ID NO: 26678 - DNA, 22 bp, Artificial Sequence
  chemically synthesized
tataaatttgggagctccagtg

SEQ ID NO: 26679 - DNA, 22 bp, Artificial Sequence
  chemically synthesized
taaatttgggagctccagtgtt

SEQ ID NO: 26680 - DNA, 22 bp, Artificial Sequence
  chemically synthesized
gggagctccagtgttaggtgca

SEQ ID NO: 26681 - DNA, 22 bp, Artificial Sequence
  chemically synthesized
ggagctccagtgttaggtgcat

SEQ ID NO: 26682 - DNA, 22 bp, Artificial Sequence
  chemically synthesized
cagtgttaggtgcatatatgtt

SEQ ID NO: 26683 - DNA, 22 bp, Artificial Sequence
  chemically synthesized
ggtgcatatatgtttaagattg

SEQ ID NO: 26684 - DNA, 22 bp, Artificial Sequence
  chemically synthesized
aagattgtgatattttcctgtt

SEQ ID NO: 26685 - DNA, 22 bp, Artificial Sequence
  chemically synthesized
agattgtgatattttcctgttg

SEQ ID NO: 26686 - DNA, 22 bp, Artificial Sequence
  chemically synthesized
tgatattttcctgttggacaag

SEQ ID NO: 26687 - DNA, 22 bp, Artificial Sequence
  chemically synthesized
tcctgttggacaaggcctttta

SEQ ID NO: 26688 - DNA, 22 bp, Artificial Sequence
  chemically synthesized
cctgttggacaaggccttttac

SEQ ID NO: 26689 - DNA, 22 bp, Artificial Sequence
  chemically synthesized
ctgttggacaaggccttttacc

SEQ ID NO: 26690 - DNA, 22 bp, Artificial Sequence
  chemically synthesized
ttggacaaggccttttaccatt

SEQ ID NO: 26691 - DNA, 22 bp, Artificial Sequence
  chemically synthesized
gacaaggccttttaccattata

SEQ ID NO: 26692 - DNA, 22 bp, Artificial Sequence
  chemically synthesized
ttaccattatataatgtccctc

SEQ ID NO: 26693 - DNA, 22 bp, Artificial Sequence
  chemically synthesized
taccattatataatgtccctct

SEQ ID NO: 26694 - DNA, 22 bp, Artificial Sequence
  chemically synthesized
accattatataatgtccctctt

SEQ ID NO: 26695 - DNA, 22 bp, Artificial Sequence
  chemically synthesized
ccattatataatgtccctcttt

SEQ ID NO: 26696 - DNA, 22 bp, Artificial Sequence
  chemically synthesized
tataatgtccctctttgtctct

SEQ ID NO: 26697 - DNA, 22 bp, Artificial Sequence
  chemically synthesized
tttgtctcttttaactgctgtt

SEQ ID NO: 26698 - DNA, 22 bp, Artificial Sequence
  chemically synthesized
tgtctcttttaactgctgttgc

SEQ ID NO: 26699 - DNA, 22 bp, Artificial Sequence
  chemically synthesized
gtctcttttaactgctgttgct

SEQ ID NO: 26700 - DNA, 22 bp, Artificial Sequence
  chemically synthesized
tctcttttaactgctgttgctt

SEQ ID NO: 26701 - DNA, 22 bp, Artificial Sequence
  chemically synthesized
ttttaactgctgttgctttaaa

SEQ ID NO: 26702 - DNA, 22 bp, Artificial Sequence
  chemically synthesized
ttaactgctgttgctttaaagt

SEQ ID NO: 26703 - DNA, 22 bp, Artificial Sequence
  chemically synthesized
taactgctgttgctttaaagtt

SEQ ID NO: 26704 - DNA, 22 bp, Artificial Sequence
  chemically synthesized
aactgctgttgctttaaagttt

SEQ ID NO: 26705 - DNA, 22 bp, Artificial Sequence
  chemically synthesized
actgctgttgctttaaagtttg

SEQ ID NO: 26706 - DNA, 22 bp, Artificial Sequence
  chemically synthesized
ctgttgctttaaagtttgtttt

SEQ ID NO: 26707 - DNA, 22 bp, Artificial Sequence
  chemically synthesized
ttgctttaaagtttgttttgcc

SEQ ID NO: 26708 - DNA, 22 bp, Artificial Sequence
  chemically synthesized
ctttaaagtttgttttgcctac

SEQ ID NO: 26709 - DNA, 22 bp, Artificial Sequence
  chemically synthesized
taaagtttgttttgcctactca

SEQ ID NO: 26710 - DNA, 22 bp, Artificial Sequence
  chemically synthesized
aaagtttgttttgcctactcac

SEQ ID NO: 26711 - DNA, 22 bp, Artificial Sequence
  chemically synthesized
aagtttgttttgcctactcact

SEQ ID NO: 26712 - DNA, 22 bp, Artificial Sequence
  chemically synthesized
gttttgcctactcacttttggt

SEQ ID NO: 26713 - DNA, 22 bp, Artificial Sequence
  chemically synthesized
ttttgcctactcacttttggtg

SEQ ID NO: 26714 - DNA, 22 bp, Artificial Sequence
  chemically synthesized
tgcctactcacttttggtggcc

SEQ ID NO: 26715 - DNA, 22 bp, Artificial Sequence
  chemically synthesized
gcctactcacttttggtggcca

SEQ ID NO: 26716 - DNA, 22 bp, Artificial Sequence
  chemically synthesized
cctactcacttttggtggccat

SEQ ID NO: 26717 - DNA, 22 bp, Artificial Sequence
  chemically synthesized
ctcacttttggtggccatttgc

SEQ ID NO: 26718 - DNA, 22 bp, Artificial Sequence
  chemically synthesized
acttttggtggccatttgcatg

SEQ ID NO: 26719 - DNA, 22 bp, Artificial Sequence
  chemically synthesized
ttggtggccatttgcatgaaat

SEQ ID NO: 26720 - DNA, 22 bp, Artificial Sequence
  chemically synthesized
tggtggccatttgcatgaaata

SEQ ID NO: 26721 - DNA, 22 bp, Artificial Sequence
  chemically synthesized
ggtggccatttgcatgaaatac

SEQ ID NO: 26722 - DNA, 22 bp, Artificial Sequence
  chemically synthesized
gtggccatttgcatgaaatacc

SEQ ID NO: 26723 - DNA, 22 bp, Artificial Sequence
  chemically synthesized
gcatgaaatacctttttcaccc

SEQ ID NO: 26724 - DNA, 22 bp, Artificial Sequence
  chemically synthesized
catgaaatacctttttcaccct

SEQ ID NO: 26725 - DNA, 22 bp, Artificial Sequence
  chemically synthesized
tttcacccttttaagtggagca

SEQ ID NO: 26726 - DNA, 22 bp, Artificial Sequence
  chemically synthesized
ttcacccttttaagtggagcat

SEQ ID NO: 26727 - DNA, 22 bp, Artificial Sequence
  chemically synthesized
tcacccttttaagtggagcatt

SEQ ID NO: 26728 - DNA, 22 bp, Artificial Sequence
  chemically synthesized
cacccttttaagtggagcattt

SEQ ID NO: 26729 - DNA, 22 bp, Artificial Sequence
  chemically synthesized
acccttttaagtggagcattta

SEQ ID NO: 26730 - DNA, 22 bp, Artificial Sequence
  chemically synthesized
ttaagtggagcatttaggccat

SEQ ID NO: 26731 - DNA, 22 bp, Artificial Sequence
  chemically synthesized
taagtggagcatttaggccatt

SEQ ID NO: 26732 - DNA, 22 bp, Artificial Sequence
  chemically synthesized
aagtggagcatttaggccattt

SEQ ID NO: 26733 - DNA, 22 bp, Artificial Sequence
  chemically synthesized
agtggagcatttaggccattta

SEQ ID NO: 26734 - DNA, 22 bp, Artificial Sequence
  chemically synthesized
aggccatttacattcaatgtta

SEQ ID NO: 26735 - DNA, 22 bp, Artificial Sequence
  chemically synthesized
ggccatttacattcaatgttag

SEQ ID NO: 26736 - DNA, 22 bp, Artificial Sequence
  chemically synthesized
acattcaatgttagtaatgtaa

SEQ ID NO: 26737 - DNA, 22 bp, Artificial Sequence
  chemically synthesized
cattcaatgttagtaatgtaaa

SEQ ID NO: 26738 - DNA, 22 bp, Artificial Sequence
  chemically synthesized
aatgttagtaatgtaaatgcct

SEQ ID NO: 26739 - DNA, 22 bp, Artificial Sequence
  chemically synthesized
gtaatgtaaatgcctggctatg

SEQ ID NO: 26740 - DNA, 22 bp, Artificial Sequence
  chemically synthesized
gctatgccaggcaggaatggcc

SEQ ID NO: 26741 - DNA, 22 bp, Artificial Sequence
  chemically synthesized
tgccaggcaggaatggcctgct

SEQ ID NO: 26742 - DNA, 22 bp, Artificial Sequence
  chemically synthesized
ctcagggacccagtgagctccc

SEQ ID NO: 26743 - DNA, 22 bp, Artificial Sequence
  chemically synthesized
agggacccagtgagctcccagg

SEQ ID NO: 26744 - DNA, 22 bp, Artificial Sequence
  chemically synthesized
ccagggcctttctcactgcttc

SEQ ID NO: 26745 - DNA, 22 bp, Artificial Sequence
  chemically synthesized
tctcactgcttcctctacacct

SEQ ID NO: 26746 - DNA, 22 bp, Artificial Sequence
  chemically synthesized
ctcactgcttcctctacacctg

SEQ ID NO: 26747 - DNA, 22 bp, Artificial Sequence
  chemically synthesized
tcactgcttcctctacacctgt

SEQ ID NO: 26748 - DNA, 22 bp, Artificial Sequence
  chemically synthesized
actgcttcctctacacctgtat

SEQ ID NO: 26749 - DNA, 22 bp, Artificial Sequence
  chemically synthesized
cttcctctacacctgtattttg

SEQ ID NO: 26750 - DNA, 22 bp, Artificial Sequence
  chemically synthesized
cctctacacctgtattttgctc

SEQ ID NO: 26751 - DNA, 22 bp, Artificial Sequence
  chemically synthesized
ctctacacctgtattttgctca

SEQ ID NO: 26752 - DNA, 22 bp, Artificial Sequence
  chemically synthesized
tacacctgtattttgctcagct

SEQ ID NO: 26753 - DNA, 22 bp, Artificial Sequence
  chemically synthesized
cacctgtattttgctcagctct

SEQ ID NO: 26754 - DNA, 22 bp, Artificial Sequence
  chemically synthesized
tattttgctcagctctctaagt

SEQ ID NO: 26755 - DNA, 22 bp, Artificial Sequence
  chemically synthesized
tgctcagctctctaagttaact

SEQ ID NO: 26756 - DNA, 22 bp, Artificial Sequence
  chemically synthesized
gctcagctctctaagttaactc

SEQ ID NO: 26757 - DNA, 22 bp, Artificial Sequence
  chemically synthesized
ctcagctctctaagttaactca

SEQ ID NO: 26758 - DNA, 22 bp, Artificial Sequence
  chemically synthesized
agctctctaagttaactcaact

SEQ ID NO: 26759 - DNA, 22 bp, Artificial Sequence
  chemically synthesized
tctaagttaactcaactccagg

SEQ ID NO: 26760 - DNA, 22 bp, Artificial Sequence
  chemically synthesized
taagttaactcaactccaggta

SEQ ID NO: 26761 - DNA, 22 bp, Artificial Sequence
  chemically synthesized
agttaactcaactccaggtaag

SEQ ID NO: 26762 - DNA, 22 bp, Artificial Sequence
  chemically synthesized
actcaactccaggtaaggtcag

SEQ ID NO: 26763 - DNA, 22 bp, Artificial Sequence
  chemically synthesized
aactccaggtaaggtcagaaac

SEQ ID NO: 26764 - DNA, 22 bp, Artificial Sequence
  chemically synthesized
caggtaaggtcagaaacttctc

SEQ ID NO: 26765 - DNA, 22 bp, Artificial Sequence
  chemically synthesized
ctcccacaaacagaccttcagt

SEQ ID NO: 26766 - DNA, 22 bp, Artificial Sequence
  chemically synthesized
tcccacaaacagaccttcagtt

SEQ ID NO: 26767 - DNA, 22 bp, Artificial Sequence
  chemically synthesized
ccacaaacagaccttcagtttc

SEQ ID NO: 26768 - DNA, 22 bp, Artificial Sequence
  chemically synthesized
cagtttctccagtgggagtgtg

SEQ ID NO: 26769 - DNA, 22 bp, Artificial Sequence
  chemically synthesized
agtttctccagtgggagtgtgt

SEQ ID NO: 26770 - DNA, 22 bp, Artificial Sequence
  chemically synthesized
ctccagtgggagtgtgtgttta

SEQ ID NO: 26771 - DNA, 22 bp, Artificial Sequence
  chemically synthesized
tccagtgggagtgtgtgtttag

SEQ ID NO: 26772 - DNA, 22 bp, Artificial Sequence
  chemically synthesized
cagtgggagtgtgtgtttagga

SEQ ID NO: 26773 - DNA, 22 bp, Artificial Sequence
  chemically synthesized
aggagaggaggatctccctttc

SEQ ID NO: 26774 - DNA, 22 bp, Artificial Sequence
  chemically synthesized
ggagaggaggatctccctttcc

SEQ ID NO: 26775 - DNA, 22 bp, Artificial Sequence
  chemically synthesized
cctttcccacttccgcagttgg

SEQ ID NO: 26776 - DNA, 22 bp, Artificial Sequence
  chemically synthesized
tcccacttccgcagttggggca

SEQ ID NO: 26777 - DNA, 22 bp, Artificial Sequence
  chemically synthesized
cccacttccgcagttggggcac

SEQ ID NO: 26778 - DNA, 22 bp, Artificial Sequence
  chemically synthesized
ccacttccgcagttggggcact

SEQ ID NO: 26779 - DNA, 22 bp, Artificial Sequence
  chemically synthesized
ccgcagttggggcactcacagt

SEQ ID NO: 26780 - DNA, 22 bp, Artificial Sequence
  chemically synthesized
cgcagttggggcactcacagta

SEQ ID NO: 26781 - DNA, 22 bp, Artificial Sequence
  chemically synthesized
gggcactcacagtatttggggt

SEQ ID NO: 26782 - DNA, 22 bp, Artificial Sequence
  chemically synthesized
acagtatttggggtgtctcctg

SEQ ID NO: 26783 - DNA, 22 bp, Artificial Sequence
  chemically synthesized
ggggtgtctcctgggtcctgca

SEQ ID NO: 26784 - DNA, 22 bp, Artificial Sequence
  chemically synthesized
gggtgtctcctgggtcctgcag

SEQ ID NO: 26785 - DNA, 22 bp, Artificial Sequence
  chemically synthesized
ctgggtcctgcaggagcaatct

SEQ ID NO: 26786 - DNA, 22 bp, Artificial Sequence
  chemically synthesized
ggtcctgcaggagcaatctact

SEQ ID NO: 26787 - DNA, 22 bp, Artificial Sequence
  chemically synthesized
caggagcaatctacttccttca

SEQ ID NO: 26788 - DNA, 22 bp, Artificial Sequence
  chemically synthesized
cttccttcagagggtctgtggg

SEQ ID NO: 26789 - DNA, 22 bp, Artificial Sequence
  chemically synthesized
ccttcagagggtctgtgggtcc

SEQ ID NO: 26790 - DNA, 22 bp, Artificial Sequence
  chemically synthesized
cttcagagggtctgtgggtcct

SEQ ID NO: 26791 - DNA, 22 bp, Artificial Sequence
  chemically synthesized
cagagggtctgtgggtcctctc

SEQ ID NO: 26792 - DNA, 22 bp, Artificial Sequence
  chemically synthesized
agagggtctgtgggtcctctca

SEQ ID NO: 26793 - DNA, 22 bp, Artificial Sequence
  chemically synthesized
tgggtcctctcaggattgctgg

SEQ ID NO: 26794 - DNA, 22 bp, Artificial Sequence
  chemically synthesized
tcaggattgctggtttgttctt

SEQ ID NO: 26795 - DNA, 22 bp, Artificial Sequence
  chemically synthesized
aggattgctggtttgttcttgc

SEQ ID NO: 26796 - DNA, 22 bp, Artificial Sequence
  chemically synthesized
ctggtttgttcttgcagtctat

SEQ ID NO: 26797 - DNA, 22 bp, Artificial Sequence
  chemically synthesized
gtttgttcttgcagtctatctg

SEQ ID NO: 26798 - DNA, 22 bp, Artificial Sequence
  chemically synthesized
gttcttgcagtctatctgcagc

SEQ ID NO: 26799 - DNA, 22 bp, Artificial Sequence
  chemically synthesized
ttcttgcagtctatctgcagct

SEQ ID NO: 26800 - DNA, 22 bp, Artificial Sequence
  chemically synthesized
ttgcagtctatctgcagctaaa

SEQ ID NO: 26801 - DNA, 22 bp, Artificial Sequence
  chemically synthesized
gcagtctatctgcagctaaaat

SEQ ID NO: 26802 - DNA, 22 bp, Artificial Sequence
  chemically synthesized
cagtctatctgcagctaaaatt

SEQ ID NO: 26803 - DNA, 22 bp, Artificial Sequence
  chemically synthesized
tctgcagctaaaattcacaatg

SEQ ID NO: 26804 - DNA, 22 bp, Artificial Sequence
  chemically synthesized
cagctaaaattcacaatgcgag

SEQ ID NO: 26805 - DNA, 22 bp, Artificial Sequence
  chemically synthesized
aaattcacaatgcgagcctcca

SEQ ID NO: 26806 - DNA, 22 bp, Artificial Sequence
  chemically synthesized
acaatgcgagcctccacatgct

SEQ ID NO: 26807 - DNA, 22 bp, Artificial Sequence
  chemically synthesized
cacatgctgctctgtccatctg

SEQ ID NO: 26808 - DNA, 22 bp, Artificial Sequence
  chemically synthesized
ctctgtccatctgagttggagc

SEQ ID NO: 26809 - DNA, 22 bp, Artificial Sequence
  chemically synthesized
tgtccatctgagttggagctgc

SEQ ID NO: 26810 - DNA, 22 bp, Artificial Sequence
  chemically synthesized
tccatctgagttggagctgcaa

SEQ ID NO: 26811 - DNA, 22 bp, Artificial Sequence
  chemically synthesized
agttggagctgcaatctaggcc

SEQ ID NO: 26812 - DNA, 22 bp, Artificial Sequence
  chemically synthesized
gagctgcaatctaggcctacct

SEQ ID NO: 26813 - DNA, 22 bp, Artificial Sequence
  chemically synthesized
caatctaggcctacctcccatc

SEQ ID NO: 26814 - DNA, 22 bp, Artificial Sequence
  chemically synthesized
ggcctacctcccatccgccaag

SEQ ID NO: 26815 - DNA, 22 bp, Artificial Sequence
  chemically synthesized
cctcccatccgccaagatcctg

SEQ ID NO: 26816 - DNA, 22 bp, Artificial Sequence
  chemically synthesized
ccatccgccaagatcctgagaa

SEQ ID NO: 26817 - DNA, 22 bp, Artificial Sequence
  chemically synthesized
agaagttggggattatatttca

SEQ ID NO: 26818 - DNA, 22 bp, Artificial Sequence
  chemically synthesized
gggattatatttcaacatgaga

SEQ ID NO: 26819 - DNA, 22 bp, Artificial Sequence
  chemically synthesized
tatttcaacatgagatttggag

SEQ ID NO: 26820 - DNA, 22 bp, Artificial Sequence
  chemically synthesized
caacatgagatttggagggaac

SEQ ID NO: 26821 - DNA, 22 bp, Artificial Sequence
  chemically synthesized
aacatgagatttggagggaaca

SEQ ID NO: 26822 - DNA, 22 bp, Artificial Sequence
  chemically synthesized
ggagggaacaaacatccaaacc

SEQ ID NO: 26823 - DNA, 22 bp, Artificial Sequence
  chemically synthesized
gagggaacaaacatccaaacca

SEQ ID NO: 26824 - DNA, 22 bp, Artificial Sequence
  chemically synthesized
tattcttttgcacatggatatc

SEQ ID NO: 26825 - DNA, 22 bp, Artificial Sequence
  chemically synthesized
attcttttgcacatggatatcc

SEQ ID NO: 26826 - DNA, 22 bp, Artificial Sequence
  chemically synthesized
ttcttttgcacatggatatcca

SEQ ID NO: 26827 - DNA, 22 bp, Artificial Sequence
  chemically synthesized
ttttgcacatggatatccaatg

SEQ ID NO: 26828 - DNA, 22 bp, Artificial Sequence
  chemically synthesized
ttgcacatggatatccaatgga

SEQ ID NO: 26829 - DNA, 22 bp, Artificial Sequence
  chemically synthesized
tgcacatggatatccaatggat

SEQ ID NO: 26830 - DNA, 22 bp, Artificial Sequence
  chemically synthesized
gcacatggatatccaatggata

SEQ ID NO: 26831 - DNA, 22 bp, Artificial Sequence
  chemically synthesized
cacatggatatccaatggatat

SEQ ID NO: 26832 - DNA, 22 bp, Artificial Sequence
  chemically synthesized
tttcagcaccatttcttgaaca

SEQ ID NO: 26833 - DNA, 22 bp, Artificial Sequence
  chemically synthesized
ttcagcaccatttcttgaacac

SEQ ID NO: 26834 - DNA, 22 bp, Artificial Sequence
  chemically synthesized
tcagcaccatttcttgaacact

SEQ ID NO: 26835 - DNA, 22 bp, Artificial Sequence
  chemically synthesized
cagcaccatttcttgaacactg

SEQ ID NO: 26836 - DNA, 22 bp, Artificial Sequence
  chemically synthesized
agcaccatttcttgaacactgt

SEQ ID NO: 26837 - DNA, 22 bp, Artificial Sequence
  chemically synthesized
cttgaacactgtgtcctttcct

SEQ ID NO: 26838 - DNA, 22 bp, Artificial Sequence
  chemically synthesized
ttgaacactgtgtcctttcctc

SEQ ID NO: 26839 - DNA, 22 bp, Artificial Sequence
  chemically synthesized
gaacactgtgtcctttcctcaa

SEQ ID NO: 26840 - DNA, 22 bp, Artificial Sequence
  chemically synthesized
aacactgtgtcctttcctcaat

SEQ ID NO: 26841 - DNA, 22 bp, Artificial Sequence
  chemically synthesized
tgtcctttcctcaatgtatatt

SEQ ID NO: 26842 - DNA, 22 bp, Artificial Sequence
  chemically synthesized
tcctcaatgtatattcttgtca

SEQ ID NO: 26843 - DNA, 22 bp, Artificial Sequence
  chemically synthesized
cctcaatgtatattcttgtcac

SEQ ID NO: 26844 - DNA, 22 bp, Artificial Sequence
  chemically synthesized
ctcaatgtatattcttgtcacc

SEQ ID NO: 26845 - DNA, 22 bp, Artificial Sequence
  chemically synthesized
aatgtatattcttgtcaccttt

SEQ ID NO: 26846 - DNA, 22 bp, Artificial Sequence
  chemically synthesized
ttgtcacctttgttgaaaatct

SEQ ID NO: 26847 - DNA, 22 bp, Artificial Sequence
  chemically synthesized
gtcacctttgttgaaaatctgt

SEQ ID NO: 26848 - DNA, 22 bp, Artificial Sequence
  chemically synthesized
tcacctttgttgaaaatctgtt

SEQ ID NO: 26849 - DNA, 22 bp, Artificial Sequence
  chemically synthesized
tgttgaaaatctgttggctata

SEQ ID NO: 26850 - DNA, 22 bp, Artificial Sequence
  chemically synthesized
gttgaaaatctgttggctataa

SEQ ID NO: 26851 - DNA, 22 bp, Artificial Sequence
  chemically synthesized
ttgaaaatctgttggctataaa

SEQ ID NO: 26852 - DNA, 22 bp, Artificial Sequence
  chemically synthesized
aaaatctgttggctataaatat

SEQ ID NO: 26853 - DNA, 22 bp, Artificial Sequence
  chemically synthesized
ttggctataaatatgtggatgc

SEQ ID NO: 26854 - DNA, 22 bp, Artificial Sequence
  chemically synthesized
gctataaatatgtggatgcatt

SEQ ID NO: 26855 - DNA, 22 bp, Artificial Sequence
  chemically synthesized
taaatatgtggatgcatttcta

SEQ ID NO: 26856 - DNA, 22 bp, Artificial Sequence
  chemically synthesized
ctaggttctctattctcttcca

SEQ ID NO: 26857 - DNA, 22 bp, Artificial Sequence
  chemically synthesized
taggttctctattctcttccat

SEQ ID NO: 26858 - DNA, 22 bp, Artificial Sequence
  chemically synthesized
ggttctctattctcttccattg

SEQ ID NO: 26859 - DNA, 22 bp, Artificial Sequence
  chemically synthesized
tctattctcttccattggtcta

SEQ ID NO: 26860 - DNA, 22 bp, Artificial Sequence
  chemically synthesized
tattctcttccattggtctaag

SEQ ID NO: 26861 - DNA, 22 bp, Artificial Sequence
  chemically synthesized
ttctcttccattggtctaagtg

SEQ ID NO: 26862 - DNA, 22 bp, Artificial Sequence
  chemically synthesized
tcttccattggtctaagtgtct

SEQ ID NO: 26863 - DNA, 22 bp, Artificial Sequence
  chemically synthesized
ttccattggtctaagtgtctgt

SEQ ID NO: 26864 - DNA, 22 bp, Artificial Sequence
  chemically synthesized
ccattggtctaagtgtctgttc

SEQ ID NO: 26865 - DNA, 22 bp, Artificial Sequence
  chemically synthesized
cattggtctaagtgtctgttct

SEQ ID NO: 26866 - DNA, 22 bp, Artificial Sequence
  chemically synthesized
gtctaagtgtctgttctaatgt

SEQ ID NO: 26867 - DNA, 22 bp, Artificial Sequence
  chemically synthesized
agtgtctgttctaatgtcagta

SEQ ID NO: 26868 - DNA, 22 bp, Artificial Sequence
  chemically synthesized
ttctaatgtcagtatcatgctg

SEQ ID NO: 26869 - DNA, 22 bp, Artificial Sequence
  chemically synthesized
taatgtcagtatcatgctgttt

SEQ ID NO: 26870 - DNA, 22 bp, Artificial Sequence
  chemically synthesized
atgtcagtatcatgctgtttag

SEQ ID NO: 26871 - DNA, 22 bp, Artificial Sequence
  chemically synthesized
tttaggttcctatacttttgta

SEQ ID NO: 26872 - DNA, 22 bp, Artificial Sequence
  chemically synthesized
aggttcctatacttttgtaata

SEQ ID NO: 26873 - DNA, 22 bp, Artificial Sequence
  chemically synthesized
ggttcctatacttttgtaatat

SEQ ID NO: 26874 - DNA, 22 bp, Artificial Sequence
  chemically synthesized
ctatacttttgtaatatacttt

SEQ ID NO: 26875 - DNA, 22 bp, Artificial Sequence
  chemically synthesized
tacttttgtaatatactttgaa

SEQ ID NO: 26876 - DNA, 22 bp, Artificial Sequence
  chemically synthesized
ttgtaatatactttgaaatcag

SEQ ID NO: 26877 - DNA, 22 bp, Artificial Sequence
  chemically synthesized
tgtaatatactttgaaatcagg

SEQ ID NO: 26878 - DNA, 22 bp, Artificial Sequence
  chemically synthesized
gtaatatactttgaaatcaggt

SEQ ID NO: 26879 - DNA, 22 bp, Artificial Sequence
  chemically synthesized
taatatactttgaaatcaggta

SEQ ID NO: 26880 - DNA, 22 bp, Artificial Sequence
  chemically synthesized
tgaaatcaggtagtatgatacc

SEQ ID NO: 26881 - DNA, 22 bp, Artificial Sequence
  chemically synthesized
gaaatcaggtagtatgatacct

SEQ ID NO: 26882 - DNA, 22 bp, Artificial Sequence
  chemically synthesized
aaatcaggtagtatgatacctc

SEQ ID NO: 26883 - DNA, 22 bp, Artificial Sequence
  chemically synthesized
tagcattgttcttttttcacag

SEQ ID NO: 26884 - DNA, 22 bp, Artificial Sequence
  chemically synthesized
gcattgttcttttttcacagga

SEQ ID NO: 26885 - DNA, 22 bp, Artificial Sequence
  chemically synthesized
ttcttttttcacaggatgactt

SEQ ID NO: 26886 - DNA, 22 bp, Artificial Sequence
  chemically synthesized
ttttttcacaggatgactttgg

SEQ ID NO: 26887 - DNA, 22 bp, Artificial Sequence
  chemically synthesized
ttttcacaggatgactttggct

SEQ ID NO: 26888 - DNA, 22 bp, Artificial Sequence
  chemically synthesized
tttcacaggatgactttggcta

SEQ ID NO: 26889 - DNA, 22 bp, Artificial Sequence
  chemically synthesized
ttcacaggatgactttggctac

SEQ ID NO: 26890 - DNA, 22 bp, Artificial Sequence
  chemically synthesized
tcacaggatgactttggctact

SEQ ID NO: 26891 - DNA, 22 bp, Artificial Sequence
  chemically synthesized
cacaggatgactttggctactg

SEQ ID NO: 26892 - DNA, 22 bp, Artificial Sequence
  chemically synthesized
acaggatgactttggctactgg

SEQ ID NO: 26893 - DNA, 22 bp, Artificial Sequence
  chemically synthesized
tggctactggagctatttttta

SEQ ID NO: 26894 - DNA, 22 bp, Artificial Sequence
  chemically synthesized
ggctactggagctattttttaa

SEQ ID NO: 26895 - DNA, 22 bp, Artificial Sequence
  chemically synthesized
gctactggagctattttttaat

SEQ ID NO: 26896 - DNA, 22 bp, Artificial Sequence
  chemically synthesized
ctggagctattttttaatttca

SEQ ID NO: 26897 - DNA, 22 bp, Artificial Sequence
  chemically synthesized
gagctattttttaatttcatac

SEQ ID NO: 26898 - DNA, 22 bp, Artificial Sequence
  chemically synthesized
ttttttaatttcatacaaattt

SEQ ID NO: 26899 - DNA, 22 bp, Artificial Sequence
  chemically synthesized
tttaatttcatacaaattttag

SEQ ID NO: 26900 - DNA, 22 bp, Artificial Sequence
  chemically synthesized
ttaatttcatacaaattttaga

SEQ ID NO: 26901 - DNA, 22 bp, Artificial Sequence
  chemically synthesized
taatttcatacaaattttagat

SEQ ID NO: 26902 - DNA, 22 bp, Artificial Sequence
  chemically synthesized
aatttcatacaaattttagatt

SEQ ID NO: 26903 - DNA, 22 bp, Artificial Sequence
  chemically synthesized
atttcatacaaattttagattg

SEQ ID NO: 26904 - DNA, 22 bp, Artificial Sequence
  chemically synthesized
catacaaattttagattggttt

SEQ ID NO: 26905 - DNA, 22 bp, Artificial Sequence
  chemically synthesized
atacaaattttagattggtttt

SEQ ID NO: 26906 - DNA, 22 bp, Artificial Sequence
  chemically synthesized
tagattggtttttccatttctg

SEQ ID NO: 26907 - DNA, 22 bp, Artificial Sequence
  chemically synthesized
agattggtttttccatttctgt

SEQ ID NO: 26908 - DNA, 22 bp, Artificial Sequence
  chemically synthesized
gattggtttttccatttctgtg

SEQ ID NO: 26909 - DNA, 22 bp, Artificial Sequence
  chemically synthesized
gtttttccatttctgtgaaaaa

SEQ ID NO: 26910 - DNA, 22 bp, Artificial Sequence
  chemically synthesized
ttccatttctgtgaaaaatgac

SEQ ID NO: 26911 - DNA, 22 bp, Artificial Sequence
  chemically synthesized
tccatttctgtgaaaaatgaca

SEQ ID NO: 26912 - DNA, 22 bp, Artificial Sequence
  chemically synthesized
ccatttctgtgaaaaatgacat

SEQ ID NO: 26913 - DNA, 22 bp, Artificial Sequence
  chemically synthesized
catttctgtgaaaaatgacatt

SEQ ID NO: 26914 - DNA, 22 bp, Artificial Sequence
  chemically synthesized
ctgtgaaaaatgacattgctat

SEQ ID NO: 26915 - DNA, 22 bp, Artificial Sequence
  chemically synthesized
tgtgaaaaatgacattgctatt

SEQ ID NO: 26916 - DNA, 22 bp, Artificial Sequence
  chemically synthesized
tgaaaaatgacattgctatttt

SEQ ID NO: 26917 - DNA, 22 bp, Artificial Sequence
  chemically synthesized
ctattttgatagcggtcatata

SEQ ID NO: 26918 - DNA, 22 bp, Artificial Sequence
  chemically synthesized
ttttgatagcggtcatatagaa

SEQ ID NO: 26919 - DNA, 22 bp, Artificial Sequence
  chemically synthesized
tgatagcggtcatatagaatct

SEQ ID NO: 26920 - DNA, 22 bp, Artificial Sequence
  chemically synthesized
gatagcggtcatatagaatctg

SEQ ID NO: 26921 - DNA, 22 bp, Artificial Sequence
  chemically synthesized
atagcggtcatatagaatctgt

SEQ ID NO: 26922 - DNA, 22 bp, Artificial Sequence
  chemically synthesized
tagattgctttgggtagtatgg

SEQ ID NO: 26923 - DNA, 22 bp, Artificial Sequence
  chemically synthesized
ctttgggtagtatggccatttt

SEQ ID NO: 26924 - DNA, 22 bp, Artificial Sequence
  chemically synthesized
tgggtagtatggccattttaac

SEQ ID NO: 26925 - DNA, 22 bp, Artificial Sequence
  chemically synthesized
gggtagtatggccattttaaca

SEQ ID NO: 26926 - DNA, 22 bp, Artificial Sequence
  chemically synthesized
ggtagtatggccattttaacaa

SEQ ID NO: 26927 - DNA, 22 bp, Artificial Sequence
  chemically synthesized
taacaatattaatttttctgat

SEQ ID NO: 26928 - DNA, 22 bp, Artificial Sequence
  chemically synthesized
aacaatattaatttttctgatc

SEQ ID NO: 26929 - DNA, 22 bp, Artificial Sequence
  chemically synthesized
acaatattaatttttctgatcc

SEQ ID NO: 26930 - DNA, 22 bp, Artificial Sequence
  chemically synthesized
atttttctgatccatgaacata

SEQ ID NO: 26931 - DNA, 22 bp, Artificial Sequence
  chemically synthesized
ttctgatccatgaacataggat

SEQ ID NO: 26932 - DNA, 22 bp, Artificial Sequence
  chemically synthesized
tctgatccatgaacataggata

SEQ ID NO: 26933 - DNA, 22 bp, Artificial Sequence
  chemically synthesized
ctgatccatgaacataggatat

SEQ ID NO: 26934 - DNA, 22 bp, Artificial Sequence
  chemically synthesized
tgatccatgaacataggatatc

SEQ ID NO: 26935 - DNA, 22 bp, Artificial Sequence
  chemically synthesized
atccatgaacataggatatctc

SEQ ID NO: 26936 - DNA, 22 bp, Artificial Sequence
  chemically synthesized
tccatttgtttctgtccttttc

SEQ ID NO: 26937 - DNA, 22 bp, Artificial Sequence
  chemically synthesized
catttgtttctgtccttttcaa

SEQ ID NO: 26938 - DNA, 22 bp, Artificial Sequence
  chemically synthesized
gtttctgtccttttcaattctt

SEQ ID NO: 26939 - DNA, 22 bp, Artificial Sequence
  chemically synthesized
tttctgtccttttcaattcttt

SEQ ID NO: 26940 - DNA, 22 bp, Artificial Sequence
  chemically synthesized
ctgtccttttcaattcttttat

SEQ ID NO: 26941 - DNA, 22 bp, Artificial Sequence
  chemically synthesized
tgtccttttcaattcttttatc

SEQ ID NO: 26942 - DNA, 22 bp, Artificial Sequence
  chemically synthesized
tccttttcaattcttttatcag

SEQ ID NO: 26943 - DNA, 22 bp, Artificial Sequence
  chemically synthesized
ttcaattcttttatcagtgttt

SEQ ID NO: 26944 - DNA, 22 bp, Artificial Sequence
  chemically synthesized
tcaattcttttatcagtgtttt

SEQ ID NO: 26945 - DNA, 22 bp, Artificial Sequence
  chemically synthesized
caattcttttatcagtgttttg

SEQ ID NO: 26946 - DNA, 22 bp, Artificial Sequence
  chemically synthesized
aattcttttatcagtgttttgt

SEQ ID NO: 26947 - DNA, 22 bp, Artificial Sequence
  chemically synthesized
ttttatcagtgttttgtagttt

SEQ ID NO: 26948 - DNA, 22 bp, Artificial Sequence
  chemically synthesized
ttatcagtgttttgtagttttc

SEQ ID NO: 26949 - DNA, 22 bp, Artificial Sequence
  chemically synthesized
tatcagtgttttgtagttttcc

SEQ ID NO: 26950 - DNA, 22 bp, Artificial Sequence
  chemically synthesized
atcagtgttttgtagttttccg

SEQ ID NO: 26951 - DNA, 22 bp, Artificial Sequence
  chemically synthesized
tcagtgttttgtagttttccga

SEQ ID NO: 26952 - DNA, 22 bp, Artificial Sequence
  chemically synthesized
tgtagttttccgaatagaggtt

SEQ ID NO: 26953 - DNA, 22 bp, Artificial Sequence
  chemically synthesized
gtagttttccgaatagaggttt

SEQ ID NO: 26954 - DNA, 22 bp, Artificial Sequence
  chemically synthesized
tagttttccgaatagaggtttt

SEQ ID NO: 26955 - DNA, 22 bp, Artificial Sequence
  chemically synthesized
tccgaatagaggtttttcggtt

SEQ ID NO: 26956 - DNA, 22 bp, Artificial Sequence
  chemically synthesized
ccgaatagaggtttttcggttc

SEQ ID NO: 26957 - DNA, 22 bp, Artificial Sequence
  chemically synthesized
cgaatagaggtttttcggttcc

SEQ ID NO: 26958 - DNA, 22 bp, Artificial Sequence
  chemically synthesized
ttcggttccttggttaaattta

SEQ ID NO: 26959 - DNA, 22 bp, Artificial Sequence
  chemically synthesized
tcggttccttggttaaatttat

SEQ ID NO: 26960 - DNA, 22 bp, Artificial Sequence
  chemically synthesized
cggttccttggttaaatttatc

SEQ ID NO: 26961 - DNA, 22 bp, Artificial Sequence
  chemically synthesized
ggttccttggttaaatttatcc

SEQ ID NO: 26962 - DNA, 22 bp, Artificial Sequence
  chemically synthesized
cttggttaaatttatccctaaa

SEQ ID NO: 26963 - DNA, 22 bp, Artificial Sequence
  chemically synthesized
ggttaaatttatccctaaatat

SEQ ID NO: 26964 - DNA, 22 bp, Artificial Sequence
  chemically synthesized
gttaaatttatccctaaatatt

SEQ ID NO: 26965 - DNA, 22 bp, Artificial Sequence
  chemically synthesized
aatttatccctaaatattttat

SEQ ID NO: 26966 - DNA, 22 bp, Artificial Sequence
  chemically synthesized
atccctaaatattttatttttt

SEQ ID NO: 26967 - DNA, 22 bp, Artificial Sequence
  chemically synthesized
tccctaaatattttatttttta

SEQ ID NO: 26968 - DNA, 22 bp, Artificial Sequence
  chemically synthesized
aatattttattttttagctatt

SEQ ID NO: 26969 - DNA, 22 bp, Artificial Sequence
  chemically synthesized
tattttttagctattgtaaatg

SEQ ID NO: 26970 - DNA, 22 bp, Artificial Sequence
  chemically synthesized
attttttagctattgtaaatgg

SEQ ID NO: 26971 - DNA, 22 bp, Artificial Sequence
  chemically synthesized
ttttttagctattgtaaatggg

SEQ ID NO: 26972 - DNA, 22 bp, Artificial Sequence
  chemically synthesized
tttagctattgtaaatgggatt

SEQ ID NO: 26973 - DNA, 22 bp, Artificial Sequence
  chemically synthesized
ttagctattgtaaatgggattg

SEQ ID NO: 26974 - DNA, 22 bp, Artificial Sequence
  chemically synthesized
tagctattgtaaatgggattgc

SEQ ID NO: 26975 - DNA, 22 bp, Artificial Sequence
  chemically synthesized
agctattgtaaatgggattgcc

SEQ ID NO: 26976 - DNA, 22 bp, Artificial Sequence
  chemically synthesized
gctattgtaaatgggattgcct

SEQ ID NO: 26977 - DNA, 22 bp, Artificial Sequence
  chemically synthesized
ttgtaaatgggattgccttctt

SEQ ID NO: 26978 - DNA, 22 bp, Artificial Sequence
  chemically synthesized
taaatgggattgccttcttaat

SEQ ID NO: 26979 - DNA, 22 bp, Artificial Sequence
  chemically synthesized
ccttcttaatttccttctcagc

SEQ ID NO: 26980 - DNA, 22 bp, Artificial Sequence
  chemically synthesized
cttaatttccttctcagctagt

SEQ ID NO: 26981 - DNA, 22 bp, Artificial Sequence
  chemically synthesized
ttaatttccttctcagctagtt

SEQ ID NO: 26982 - DNA, 22 bp, Artificial Sequence
  chemically synthesized
aatttccttctcagctagttta

SEQ ID NO: 26983 - DNA, 22 bp, Artificial Sequence
  chemically synthesized
atttccttctcagctagtttat

SEQ ID NO: 26984 - DNA, 22 bp, Artificial Sequence
  chemically synthesized
ccttctcagctagtttattatt

SEQ ID NO: 26985 - DNA, 22 bp, Artificial Sequence
  chemically synthesized
cttctcagctagtttattattg

SEQ ID NO: 26986 - DNA, 22 bp, Artificial Sequence
  chemically synthesized
ctcagctagtttattattggtg

SEQ ID NO: 26987 - DNA, 22 bp, Artificial Sequence
  chemically synthesized
tcagctagtttattattggtgt

SEQ ID NO: 26988 - DNA, 22 bp, Artificial Sequence
  chemically synthesized
agctagtttattattggtgtgt

SEQ ID NO: 26989 - DNA, 22 bp, Artificial Sequence
  chemically synthesized
gtttattattggtgtgtagaaa

SEQ ID NO: 26990 - DNA, 22 bp, Artificial Sequence
  chemically synthesized
attattggtgtgtagaaacatt

SEQ ID NO: 26991 - DNA, 22 bp, Artificial Sequence
  chemically synthesized
ttattggtgtgtagaaacattg

SEQ ID NO: 26992 - DNA, 22 bp, Artificial Sequence
  chemically synthesized
ttggtgtgtagaaacattgctt

SEQ ID NO: 26993 - DNA, 22 bp, Artificial Sequence
  chemically synthesized
gtgtgtagaaacattgcttgtt

SEQ ID NO: 26994 - DNA, 22 bp, Artificial Sequence
  chemically synthesized
cttgtttcatatgctgattttg

SEQ ID NO: 26995 - DNA, 22 bp, Artificial Sequence
  chemically synthesized
gtttcatatgctgattttgtct

SEQ ID NO: 26996 - DNA, 22 bp, Artificial Sequence
  chemically synthesized
tttcatatgctgattttgtctc

SEQ ID NO: 26997 - DNA, 22 bp, Artificial Sequence
  chemically synthesized
catatgctgattttgtctcctg

SEQ ID NO: 26998 - DNA, 22 bp, Artificial Sequence
  chemically synthesized
atatgctgattttgtctcctgt

SEQ ID NO: 26999 - DNA, 22 bp, Artificial Sequence
  chemically synthesized
attttgtctcctgtaactttac

SEQ ID NO: 27000 - DNA, 22 bp, Artificial Sequence
  chemically synthesized
tgtctcctgtaactttactgaa

SEQ ID NO: 27001 - DNA, 22 bp, Artificial Sequence
  chemically synthesized
gtctcctgtaactttactgaat

SEQ ID NO: 27002 - DNA, 22 bp, Artificial Sequence
  chemically synthesized
tctcctgtaactttactgaatt

SEQ ID NO: 27003 - DNA, 22 bp, Artificial Sequence
  chemically synthesized
ctgtaactttactgaatttatt

SEQ ID NO: 27004 - DNA, 22 bp, Artificial Sequence
  chemically synthesized
taactttactgaatttattttt

SEQ ID NO: 27005 - DNA, 22 bp, Artificial Sequence
  chemically synthesized
tactgaatttatttttcagcgc

SEQ ID NO: 27006 - DNA, 22 bp, Artificial Sequence
  chemically synthesized
actgaatttatttttcagcgct

SEQ ID NO: 27007 - DNA, 22 bp, Artificial Sequence
  chemically synthesized
ctgaatttatttttcagcgcta

SEQ ID NO: 27008 - DNA, 22 bp, Artificial Sequence
  chemically synthesized
aatttatttttcagcgctaaga

SEQ ID NO: 27009 - DNA, 22 bp, Artificial Sequence
  chemically synthesized
atttttcagcgctaagagtgct

SEQ ID NO: 27010 - DNA, 22 bp, Artificial Sequence
  chemically synthesized
tttttcagcgctaagagtgctt

SEQ ID NO: 27011 - DNA, 22 bp, Artificial Sequence
  chemically synthesized
ttcagcgctaagagtgctttgg

SEQ ID NO: 27012 - DNA, 22 bp, Artificial Sequence
  chemically synthesized
tcagcgctaagagtgctttggt

SEQ ID NO: 27013 - DNA, 22 bp, Artificial Sequence
  chemically synthesized
cagcgctaagagtgctttggtg

SEQ ID NO: 27014 - DNA, 22 bp, Artificial Sequence
  chemically synthesized
agcgctaagagtgctttggtgg

SEQ ID NO: 27015 - DNA, 22 bp, Artificial Sequence
  chemically synthesized
agagtgctttggtggagtcttg

SEQ ID NO: 27016 - DNA, 22 bp, Artificial Sequence
  chemically synthesized
tggtggagtcttggtttttcta

SEQ ID NO: 27017 - DNA, 22 bp, Artificial Sequence
  chemically synthesized
ggtggagtcttggtttttctag

SEQ ID NO: 27018 - DNA, 22 bp, Artificial Sequence
  chemically synthesized
gtggagtcttggtttttctagg

SEQ ID NO: 27019 - DNA, 22 bp, Artificial Sequence
  chemically synthesized
ggtttttctaggtataaaatca

SEQ ID NO: 27020 - DNA, 22 bp, Artificial Sequence
  chemically synthesized
gtttttctaggtataaaatcat

SEQ ID NO: 27021 - DNA, 22 bp, Artificial Sequence
  chemically synthesized
ttctaggtataaaatcatgtca

SEQ ID NO: 27022 - DNA, 22 bp, Artificial Sequence
  chemically synthesized
tctaggtataaaatcatgtcat

SEQ ID NO: 27023 - DNA, 22 bp, Artificial Sequence
  chemically synthesized
ctaggtataaaatcatgtcatc

SEQ ID NO: 27024 - DNA, 22 bp, Artificial Sequence
  chemically synthesized
taggtataaaatcatgtcatct

SEQ ID NO: 27025 - DNA, 22 bp, Artificial Sequence
  chemically synthesized
ggtataaaatcatgtcatctgg

SEQ ID NO: 27026 - DNA, 22 bp, Artificial Sequence
  chemically synthesized
gaaagatggacagtttgacttc

SEQ ID NO: 27027 - DNA, 22 bp, Artificial Sequence
  chemically synthesized
gacttcatcttttcctatttgc

SEQ ID NO: 27028 - DNA, 22 bp, Artificial Sequence
  chemically synthesized
acttcatcttttcctatttgca

SEQ ID NO: 27029 - DNA, 22 bp, Artificial Sequence
  chemically synthesized
catcttttcctatttgcatgcc

SEQ ID NO: 27030 - DNA, 22 bp, Artificial Sequence
  chemically synthesized
atcttttcctatttgcatgcct

SEQ ID NO: 27031 - DNA, 22 bp, Artificial Sequence
  chemically synthesized
ttcctatttgcatgccttttct

SEQ ID NO: 27032 - DNA, 22 bp, Artificial Sequence
  chemically synthesized
tcctatttgcatgccttttctt

SEQ ID NO: 27033 - DNA, 22 bp, Artificial Sequence
  chemically synthesized
cctatttgcatgccttttcttt

SEQ ID NO: 27034 - DNA, 22 bp, Artificial Sequence
  chemically synthesized
ctatttgcatgccttttctttc

SEQ ID NO: 27035 - DNA, 22 bp, Artificial Sequence
  chemically synthesized
tttgcatgccttttctttcttt

SEQ ID NO: 27036 - DNA, 22 bp, Artificial Sequence
  chemically synthesized
gcatgccttttctttctttctt

SEQ ID NO: 27037 - DNA, 22 bp, Artificial Sequence
  chemically synthesized
catgccttttctttctttcttt

SEQ ID NO: 27038 - DNA, 22 bp, Artificial Sequence
  chemically synthesized
ttctttctttctttctctgacc

SEQ ID NO: 27039 - DNA, 22 bp, Artificial Sequence
  chemically synthesized
tctttctttctttctctgacct

SEQ ID NO: 27040 - DNA, 22 bp, Artificial Sequence
  chemically synthesized
ctttctttctttctctgacctg

SEQ ID NO: 27041 - DNA, 22 bp, Artificial Sequence
  chemically synthesized
tttctttctttctctgacctga

SEQ ID NO: 27042 - DNA, 22 bp, Artificial Sequence
  chemically synthesized
tctttctttctctgacctgaaa

SEQ ID NO: 27043 - DNA, 22 bp, Artificial Sequence
  chemically synthesized
ctttctttctctgacctgaaag

SEQ ID NO: 27044 - DNA, 22 bp, Artificial Sequence
  chemically synthesized
tttctttctctgacctgaaagc

SEQ ID NO: 27045 - DNA, 22 bp, Artificial Sequence
  chemically synthesized
tctttctctgacctgaaagctg

SEQ ID NO: 27046 - DNA, 22 bp, Artificial Sequence
  chemically synthesized
ctttctctgacctgaaagctgt

SEQ ID NO: 27047 - DNA, 22 bp, Artificial Sequence
  chemically synthesized
tttctctgacctgaaagctgtg

SEQ ID NO: 27048 - DNA, 22 bp, Artificial Sequence
  chemically synthesized
tctctgacctgaaagctgtggc

SEQ ID NO: 27049 - DNA, 22 bp, Artificial Sequence
  chemically synthesized
ctctgacctgaaagctgtggct

SEQ ID NO: 27050 - DNA, 22 bp, Artificial Sequence
  chemically synthesized
tctgacctgaaagctgtggcta

SEQ ID NO: 27051 - DNA, 22 bp, Artificial Sequence
  chemically synthesized
tgacctgaaagctgtggctagg

SEQ ID NO: 27052 - DNA, 22 bp, Artificial Sequence
  chemically synthesized
acctgaaagctgtggctaggac

SEQ ID NO: 27053 - DNA, 22 bp, Artificial Sequence
  chemically synthesized
aaagctgtggctaggacttcca

SEQ ID NO: 27054 - DNA, 22 bp, Artificial Sequence
  chemically synthesized
tggctaggacttccagtattat

SEQ ID NO: 27055 - DNA, 22 bp, Artificial Sequence
  chemically synthesized
ggacttccagtattatattgaa

SEQ ID NO: 27056 - DNA, 22 bp, Artificial Sequence
  chemically synthesized
ccagtattatattgaataggag

SEQ ID NO: 27057 - DNA, 22 bp, Artificial Sequence
  chemically synthesized
cagtattatattgaataggagt

SEQ ID NO: 27058 - DNA, 22 bp, Artificial Sequence
  chemically synthesized
tattgaataggagtgatggaag

SEQ ID NO: 27059 - DNA, 22 bp, Artificial Sequence
  chemically synthesized
aataggagtgatggaagtgggc

SEQ ID NO: 27060 - DNA, 22 bp, Artificial Sequence
  chemically synthesized
attttgtttcagttcttagagg

SEQ ID NO: 27061 - DNA, 22 bp, Artificial Sequence
  chemically synthesized
ttttgtttcagttcttagagga

SEQ ID NO: 27062 - DNA, 22 bp, Artificial Sequence
  chemically synthesized
tgtttcagttcttagaggaaag

SEQ ID NO: 27063 - DNA, 22 bp, Artificial Sequence
  chemically synthesized
gtttcagttcttagaggaaagg

SEQ ID NO: 27064 - DNA, 22 bp, Artificial Sequence
  chemically synthesized
tttcagttcttagaggaaaggc

SEQ ID NO: 27065 - DNA, 22 bp, Artificial Sequence
  chemically synthesized
cagttcttagaggaaaggcttc

SEQ ID NO: 27066 - DNA, 22 bp, Artificial Sequence
  chemically synthesized
agttcttagaggaaaggcttcc

SEQ ID NO: 27067 - DNA, 22 bp, Artificial Sequence
  chemically synthesized
ttagaggaaaggcttccagctt

SEQ ID NO: 27068 - DNA, 22 bp, Artificial Sequence
  chemically synthesized
agaggaaaggcttccagctttt

SEQ ID NO: 27069 - DNA, 22 bp, Artificial Sequence
  chemically synthesized
gaggaaaggcttccagcttttc

SEQ ID NO: 27070 - DNA, 22 bp, Artificial Sequence
  chemically synthesized
ccagcttttcccaattcagtat

SEQ ID NO: 27071 - DNA, 22 bp, Artificial Sequence
  chemically synthesized
cagcttttcccaattcagtatg

SEQ ID NO: 27072 - DNA, 22 bp, Artificial Sequence
  chemically synthesized
ttcccaattcagtatgatgtta

SEQ ID NO: 27073 - DNA, 22 bp, Artificial Sequence
  chemically synthesized
tcccaattcagtatgatgttag

SEQ ID NO: 27074 - DNA, 22 bp, Artificial Sequence
  chemically synthesized
cccaattcagtatgatgttagc

SEQ ID NO: 27075 - DNA, 22 bp, Artificial Sequence
  chemically synthesized
ccaattcagtatgatgttagct

SEQ ID NO: 27076 - DNA, 22 bp, Artificial Sequence
  chemically synthesized
agtatgatgttagctgtgggtt

SEQ ID NO: 27077 - DNA, 22 bp, Artificial Sequence
  chemically synthesized
gctgtgggtttgtcatatatga

SEQ ID NO: 27078 - DNA, 22 bp, Artificial Sequence
  chemically synthesized
tgggtttgtcatatatgacttt

SEQ ID NO: 27079 - DNA, 22 bp, Artificial Sequence
  chemically synthesized
gtcatatatgacttttattata

SEQ ID NO: 27080 - DNA, 22 bp, Artificial Sequence
  chemically synthesized
tcatatatgacttttattatat

SEQ ID NO: 27081 - DNA, 22 bp, Artificial Sequence
  chemically synthesized
ttattatattgagatatgttcc

SEQ ID NO: 27082 - DNA, 22 bp, Artificial Sequence
  chemically synthesized
tattatattgagatatgttcct

SEQ ID NO: 27083 - DNA, 22 bp, Artificial Sequence
  chemically synthesized
attatattgagatatgttcctt

SEQ ID NO: 27084 - DNA, 22 bp, Artificial Sequence
  chemically synthesized
ttatattgagatatgttccttc

SEQ ID NO: 27085 - DNA, 22 bp, Artificial Sequence
  chemically synthesized
tattgagatatgttccttctat

SEQ ID NO: 27086 - DNA, 22 bp, Artificial Sequence
  chemically synthesized
agatatgttccttctatgattg

SEQ ID NO: 27087 - DNA, 22 bp, Artificial Sequence
  chemically synthesized
cttctatgattggctgcagata

SEQ ID NO: 27088 - DNA, 22 bp, Artificial Sequence
  chemically synthesized
ctatgattggctgcagatagtt

SEQ ID NO: 27089 - DNA, 22 bp, Artificial Sequence
  chemically synthesized
tatgattggctgcagatagttt

SEQ ID NO: 27090 - DNA, 22 bp, Artificial Sequence
  chemically synthesized
tgattggctgcagatagttttt

SEQ ID NO: 27091 - DNA, 22 bp, Artificial Sequence
  chemically synthesized
gctgcagatagtttttatcatg

SEQ ID NO: 27092 - DNA, 22 bp, Artificial Sequence
  chemically synthesized
cagatagtttttatcatgaagg

SEQ ID NO: 27093 - DNA, 22 bp, Artificial Sequence
  chemically synthesized
ttatcatgaaggaatgttaaat

SEQ ID NO: 27094 - DNA, 22 bp, Artificial Sequence
  chemically synthesized
tatcatgaaggaatgttaaatt

SEQ ID NO: 27095 - DNA, 22 bp, Artificial Sequence
  chemically synthesized
atcatgaaggaatgttaaattt

SEQ ID NO: 27096 - DNA, 22 bp, Artificial Sequence
  chemically synthesized
tcatgaaggaatgttaaatttt

SEQ ID NO: 27097 - DNA, 22 bp, Artificial Sequence
  chemically synthesized
aattttatcaaatactttttct

SEQ ID NO: 27098 - DNA, 22 bp, Artificial Sequence
  chemically synthesized
tatcaaatactttttctgtatc

SEQ ID NO: 27099 - DNA, 22 bp, Artificial Sequence
  chemically synthesized
atcaaatactttttctgtatct

SEQ ID NO: 27100 - DNA, 22 bp, Artificial Sequence
  chemically synthesized
tcaaatactttttctgtatcta

SEQ ID NO: 27101 - DNA, 22 bp, Artificial Sequence
  chemically synthesized
tttctgtatctattgagatgat

SEQ ID NO: 27102 - DNA, 22 bp, Artificial Sequence
  chemically synthesized
ttctgtatctattgagatgatc

SEQ ID NO: 27103 - DNA, 22 bp, Artificial Sequence
  chemically synthesized
tctgtatctattgagatgatca

SEQ ID NO: 27104 - DNA, 22 bp, Artificial Sequence
  chemically synthesized
ctgtatctattgagatgatcat

SEQ ID NO: 27105 - DNA, 22 bp, Artificial Sequence
  chemically synthesized
tgtatctattgagatgatcata

SEQ ID NO: 27106 - DNA, 22 bp, Artificial Sequence
  chemically synthesized
tatctattgagatgatcatatg

SEQ ID NO: 27107 - DNA, 22 bp, Artificial Sequence
  chemically synthesized
ttgagatgatcatatggttttt

SEQ ID NO: 27108 - DNA, 22 bp, Artificial Sequence
  chemically synthesized
agatgatcatatggtttttgtt

SEQ ID NO: 27109 - DNA, 22 bp, Artificial Sequence
  chemically synthesized
ttgttctttttgttgatgtgat

SEQ ID NO: 27110 - DNA, 22 bp, Artificial Sequence
  chemically synthesized
tgttctttttgttgatgtgatg

SEQ ID NO: 27111 - DNA, 22 bp, Artificial Sequence
  chemically synthesized
gttctttttgttgatgtgatgt

SEQ ID NO: 27112 - DNA, 22 bp, Artificial Sequence
  chemically synthesized
ttctttttgttgatgtgatgta

SEQ ID NO: 27113 - DNA, 22 bp, Artificial Sequence
  chemically synthesized
tttttgttgatgtgatgtatca

SEQ ID NO: 27114 - DNA, 22 bp, Artificial Sequence
  chemically synthesized
tttgttgatgtgatgtatcaca

SEQ ID NO: 27115 - DNA, 22 bp, Artificial Sequence
  chemically synthesized
ttgttgatgtgatgtatcacat

SEQ ID NO: 27116 - DNA, 22 bp, Artificial Sequence
  chemically synthesized
tgttgatgtgatgtatcacatt

SEQ ID NO: 27117 - DNA, 22 bp, Artificial Sequence
  chemically synthesized
gttgatgtgatgtatcacattt

SEQ ID NO: 27118 - DNA, 22 bp, Artificial Sequence
  chemically synthesized
ttgatgtgatgtatcacattta

SEQ ID NO: 27119 - DNA, 22 bp, Artificial Sequence
  chemically synthesized
atgtgatgtatcacatttattg

SEQ ID NO: 27120 - DNA, 22 bp, Artificial Sequence
  chemically synthesized
attgatttgaactgttcttgca

SEQ ID NO: 27121 - DNA, 22 bp, Artificial Sequence
  chemically synthesized
ttgatttgaactgttcttgcaa

SEQ ID NO: 27122 - DNA, 22 bp, Artificial Sequence
  chemically synthesized
atttgaactgttcttgcaaccc

SEQ ID NO: 27123 - DNA, 22 bp, Artificial Sequence
  chemically synthesized
gaactgttcttgcaaccctagt

SEQ ID NO: 27124 - DNA, 22 bp, Artificial Sequence
  chemically synthesized
aactgttcttgcaaccctagta

SEQ ID NO: 27125 - DNA, 22 bp, Artificial Sequence
  chemically synthesized
ttcttgcaaccctagtataaat

SEQ ID NO: 27126 - DNA, 22 bp, Artificial Sequence
  chemically synthesized
ttgcaaccctagtataaatccc

SEQ ID NO: 27127 - DNA, 22 bp, Artificial Sequence
  chemically synthesized
gcaaccctagtataaatcccac

SEQ ID NO: 27128 - DNA, 22 bp, Artificial Sequence
  chemically synthesized
caaccctagtataaatcccact

SEQ ID NO: 27129 - DNA, 22 bp, Artificial Sequence
  chemically synthesized
gtataaatcccacttgatcatg

SEQ ID NO: 27130 - DNA, 22 bp, Artificial Sequence
  chemically synthesized
gatcatggtgtattatcttttg

SEQ ID NO: 27131 - DNA, 22 bp, Artificial Sequence
  chemically synthesized
atcatggtgtattatcttttgg

SEQ ID NO: 27132 - DNA, 22 bp, Artificial Sequence
  chemically synthesized
tcttttggatgtactgttggat

SEQ ID NO: 27133 - DNA, 22 bp, Artificial Sequence
  chemically synthesized
ttggatgtactgttggattcag

SEQ ID NO: 27134 - DNA, 22 bp, Artificial Sequence
  chemically synthesized
tggatgtactgttggattcagt

SEQ ID NO: 27135 - DNA, 22 bp, Artificial Sequence
  chemically synthesized
ggatgtactgttggattcagtt

SEQ ID NO: 27136 - DNA, 22 bp, Artificial Sequence
  chemically synthesized
gatgtactgttggattcagttt

SEQ ID NO: 27137 - DNA, 22 bp, Artificial Sequence
  chemically synthesized
ttggattcagtttgctagtatt

SEQ ID NO: 27138 - DNA, 22 bp, Artificial Sequence
  chemically synthesized
gattcagtttgctagtattttg

SEQ ID NO: 27139 - DNA, 22 bp, Artificial Sequence
  chemically synthesized
agtttgctagtattttgttgag

SEQ ID NO: 27140 - DNA, 22 bp, Artificial Sequence
  chemically synthesized
gctagtattttgttgaggattt

SEQ ID NO: 27141 - DNA, 22 bp, Artificial Sequence
  chemically synthesized
ctagtattttgttgaggatttt

SEQ ID NO: 27142 - DNA, 22 bp, Artificial Sequence
  chemically synthesized
gtattttgttgaggattttcac

SEQ ID NO: 27143 - DNA, 22 bp, Artificial Sequence
  chemically synthesized
tgttgaggattttcacacctat

SEQ ID NO: 27144 - DNA, 22 bp, Artificial Sequence
  chemically synthesized
gttgaggattttcacacctatg

SEQ ID NO: 27145 - DNA, 22 bp, Artificial Sequence
  chemically synthesized
ttgaggattttcacacctatgt

SEQ ID NO: 27146 - DNA, 22 bp, Artificial Sequence
  chemically synthesized
aggattttcacacctatgttcc

SEQ ID NO: 27147 - DNA, 22 bp, Artificial Sequence
  chemically synthesized
tcacacctatgttccatcaggg

SEQ ID NO: 27148 - DNA, 22 bp, Artificial Sequence
  chemically synthesized
cacacctatgttccatcaggga

SEQ ID NO: 27149 - DNA, 22 bp, Artificial Sequence
  chemically synthesized
acacctatgttccatcagggat

SEQ ID NO: 27150 - DNA, 22 bp, Artificial Sequence
  chemically synthesized
tgttccatcagggatattgacc

SEQ ID NO: 27151 - DNA, 22 bp, Artificial Sequence
  chemically synthesized
catcagggatattgacctgcag

SEQ ID NO: 27152 - DNA, 22 bp, Artificial Sequence
  chemically synthesized
acctgcagttttatttttactt

SEQ ID NO: 27153 - DNA, 22 bp, Artificial Sequence
  chemically synthesized
cagttttatttttacttgcatc

SEQ ID NO: 27154 - DNA, 22 bp, Artificial Sequence
  chemically synthesized
tatttttacttgcatccttgtc

SEQ ID NO: 27155 - DNA, 22 bp, Artificial Sequence
  chemically synthesized
atttttacttgcatccttgtct

SEQ ID NO: 27156 - DNA, 22 bp, Artificial Sequence
  chemically synthesized
tttttacttgcatccttgtctg

SEQ ID NO: 27157 - DNA, 22 bp, Artificial Sequence
  chemically synthesized
ttacttgcatccttgtctggtt

SEQ ID NO: 27158 - DNA, 22 bp, Artificial Sequence
  chemically synthesized
tacttgcatccttgtctggtta

SEQ ID NO: 27159 - DNA, 22 bp, Artificial Sequence
  chemically synthesized
acttgcatccttgtctggttat

SEQ ID NO: 27160 - DNA, 22 bp, Artificial Sequence
  chemically synthesized
cttgcatccttgtctggttatg

SEQ ID NO: 27161 - DNA, 22 bp, Artificial Sequence
  chemically synthesized
gcatccttgtctggttatggaa

SEQ ID NO: 27162 - DNA, 22 bp, Artificial Sequence
  chemically synthesized
catccttgtctggttatggaat

SEQ ID NO: 27163 - DNA, 22 bp, Artificial Sequence
  chemically synthesized
gtctggttatggaatcaggata

SEQ ID NO: 27164 - DNA, 22 bp, Artificial Sequence
  chemically synthesized
tctggttatggaatcaggataa

SEQ ID NO: 27165 - DNA, 22 bp, Artificial Sequence
  chemically synthesized
gttatggaatcaggataatact

SEQ ID NO: 27166 - DNA, 22 bp, Artificial Sequence
  chemically synthesized
tggaatcaggataatactggcc

SEQ ID NO: 27167 - DNA, 22 bp, Artificial Sequence
  chemically synthesized
gcctcagagaatgagttaggga

SEQ ID NO: 27168 - DNA, 22 bp, Artificial Sequence
  chemically synthesized
agagaatgagttagggagaatt

SEQ ID NO: 27169 - DNA, 22 bp, Artificial Sequence
  chemically synthesized
gggagaattccttcctgtttaa

SEQ ID NO: 27170 - DNA, 22 bp, Artificial Sequence
  chemically synthesized
cttcctgtttaatttttaaaag

SEQ ID NO: 27171 - DNA, 22 bp, Artificial Sequence
  chemically synthesized
cctgtttaatttttaaaagaat

SEQ ID NO: 27172 - DNA, 22 bp, Artificial Sequence
  chemically synthesized
ctgtttaatttttaaaagaatt

SEQ ID NO: 27173 - DNA, 22 bp, Artificial Sequence
  chemically synthesized
tttaatttttaaaagaatttaa

SEQ ID NO: 27174 - DNA, 22 bp, Artificial Sequence
  chemically synthesized
aatttttaaaagaatttaagga

SEQ ID NO: 27175 - DNA, 22 bp, Artificial Sequence
  chemically synthesized
atttttaaaagaatttaaggag

SEQ ID NO: 27176 - DNA, 22 bp, Artificial Sequence
  chemically synthesized
ttaaaagaatttaaggagactt

SEQ ID NO: 27177 - DNA, 22 bp, Artificial Sequence
  chemically synthesized
taaaagaatttaaggagacttg

SEQ ID NO: 27178 - DNA, 22 bp, Artificial Sequence
  chemically synthesized
aaaagaatttaaggagacttgt

SEQ ID NO: 27179 - DNA, 22 bp, Artificial Sequence
  chemically synthesized
aaagaatttaaggagacttgtt

SEQ ID NO: 27180 - DNA, 22 bp, Artificial Sequence
  chemically synthesized
aaggagacttgttagttttctt

SEQ ID NO: 27181 - DNA, 22 bp, Artificial Sequence
  chemically synthesized
aggagacttgttagttttcttt

SEQ ID NO: 27182 - DNA, 22 bp, Artificial Sequence
  chemically synthesized
gttagttttctttgaaagtttg

SEQ ID NO: 27183 - DNA, 22 bp, Artificial Sequence
  chemically synthesized
ttagttttctttgaaagtttgg

SEQ ID NO: 27184 - DNA, 22 bp, Artificial Sequence
  chemically synthesized
gttttctttgaaagtttggtaa

SEQ ID NO: 27185 - DNA, 22 bp, Artificial Sequence
  chemically synthesized
tctttgaaagtttggtaaaatt

SEQ ID NO: 27186 - DNA, 22 bp, Artificial Sequence
  chemically synthesized
ctttgaaagtttggtaaaattt

SEQ ID NO: 27187 - DNA, 22 bp, Artificial Sequence
  chemically synthesized
tttgaaagtttggtaaaatttg

SEQ ID NO: 27188 - DNA, 22 bp, Artificial Sequence
  chemically synthesized
tgaaagtttggtaaaatttgac

SEQ ID NO: 27189 - DNA, 22 bp, Artificial Sequence
  chemically synthesized
gaaagtttggtaaaatttgaca

SEQ ID NO: 27190 - DNA, 22 bp, Artificial Sequence
  chemically synthesized
aaagtttggtaaaatttgacag

SEQ ID NO: 27191 - DNA, 22 bp, Artificial Sequence
  chemically synthesized
ggtaaaatttgacagtaaagcc

SEQ ID NO: 27192 - DNA, 22 bp, Artificial Sequence
  chemically synthesized
gtaaaatttgacagtaaagcca

SEQ ID NO: 27193 - DNA, 22 bp, Artificial Sequence
  chemically synthesized
gacagtaaagccatctggtctt

SEQ ID NO: 27194 - DNA, 22 bp, Artificial Sequence
  chemically synthesized
acagtaaagccatctggtcttg

SEQ ID NO: 27195 - DNA, 22 bp, Artificial Sequence
  chemically synthesized
gtcttgaaattttcttttttgg

SEQ ID NO: 27196 - DNA, 22 bp, Artificial Sequence
  chemically synthesized
gaaattttcttttttgggagac

SEQ ID NO: 27197 - DNA, 22 bp, Artificial Sequence
  chemically synthesized
aaattttcttttttgggagact

SEQ ID NO: 27198 - DNA, 22 bp, Artificial Sequence
  chemically synthesized
tcttttttgggagactttttac

SEQ ID NO: 27199 - DNA, 22 bp, Artificial Sequence
  chemically synthesized
cttttttgggagactttttact

SEQ ID NO: 27200 - DNA, 22 bp, Artificial Sequence
  chemically synthesized
ttttttgggagactttttacta

SEQ ID NO: 27201 - DNA, 22 bp, Artificial Sequence
  chemically synthesized
ttttgggagactttttactact

SEQ ID NO: 27202 - DNA, 22 bp, Artificial Sequence
  chemically synthesized
tttgggagactttttactactg

SEQ ID NO: 27203 - DNA, 22 bp, Artificial Sequence
  chemically synthesized
ttgggagactttttactactga

SEQ ID NO: 27204 - DNA, 22 bp, Artificial Sequence
  chemically synthesized
tgggagactttttactactgat

SEQ ID NO: 27205 - DNA, 22 bp, Artificial Sequence
  chemically synthesized
gggagactttttactactgatt

SEQ ID NO: 27206 - DNA, 22 bp, Artificial Sequence
  chemically synthesized
ggagactttttactactgattc

SEQ ID NO: 27207 - DNA, 22 bp, Artificial Sequence
  chemically synthesized
tttactactgattcaatttcat

SEQ ID NO: 27208 - DNA, 22 bp, Artificial Sequence
  chemically synthesized
ttactactgattcaatttcatt

SEQ ID NO: 27209 - DNA, 22 bp, Artificial Sequence
  chemically synthesized
tactactgattcaatttcatta

SEQ ID NO: 27210 - DNA, 22 bp, Artificial Sequence
  chemically synthesized
actactgattcaatttcattat

SEQ ID NO: 27211 - DNA, 22 bp, Artificial Sequence
  chemically synthesized
ctactgattcaatttcattatt

SEQ ID NO: 27212 - DNA, 22 bp, Artificial Sequence
  chemically synthesized
ctgattcaatttcattattcat

SEQ ID NO: 27213 - DNA, 22 bp, Artificial Sequence
  chemically synthesized
attcaatttcattattcattac

SEQ ID NO: 27214 - DNA, 22 bp, Artificial Sequence
  chemically synthesized
aatttcattattcattactggt

SEQ ID NO: 27215 - DNA, 22 bp, Artificial Sequence
  chemically synthesized
cattattcattactggtctgtt

SEQ ID NO: 27216 - DNA, 22 bp, Artificial Sequence
  chemically synthesized
attattcattactggtctgttc

SEQ ID NO: 27217 - DNA, 22 bp, Artificial Sequence
  chemically synthesized
ttcattactggtctgttcaggt

SEQ ID NO: 27218 - DNA, 22 bp, Artificial Sequence
  chemically synthesized
attactggtctgttcaggtttt

SEQ ID NO: 27219 - DNA, 22 bp, Artificial Sequence
  chemically synthesized
ctggtctgttcaggttttctat

SEQ ID NO: 27220 - DNA, 22 bp, Artificial Sequence
  chemically synthesized
gtctgttcaggttttctattct

SEQ ID NO: 27221 - DNA, 22 bp, Artificial Sequence
  chemically synthesized
ttcaggttttctattctttctt

SEQ ID NO: 27222 - DNA, 22 bp, Artificial Sequence
  chemically synthesized
aggttttctattctttcttaat

SEQ ID NO: 27223 - DNA, 22 bp, Artificial Sequence
  chemically synthesized
tctattctttcttaattcaatc

SEQ ID NO: 27224 - DNA, 22 bp, Artificial Sequence
  chemically synthesized
ctattctttcttaattcaatct

SEQ ID NO: 27225 - DNA, 22 bp, Artificial Sequence
  chemically synthesized
tattctttcttaattcaatctt

SEQ ID NO: 27226 - DNA, 22 bp, Artificial Sequence
  chemically synthesized
ttctttcttaattcaatcttgg

SEQ ID NO: 27227 - DNA, 22 bp, Artificial Sequence
  chemically synthesized
tttcttaattcaatcttggtag

SEQ ID NO: 27228 - DNA, 22 bp, Artificial Sequence
  chemically synthesized
tcttaattcaatcttggtaggt

SEQ ID NO: 27229 - DNA, 22 bp, Artificial Sequence
  chemically synthesized
cttaattcaatcttggtaggtg

SEQ ID NO: 27230 - DNA, 22 bp, Artificial Sequence
  chemically synthesized
ttaattcaatcttggtaggtgg

SEQ ID NO: 27231 - DNA, 22 bp, Artificial Sequence
  chemically synthesized
aattcaatcttggtaggtggta

SEQ ID NO: 27232 - DNA, 22 bp, Artificial Sequence
  chemically synthesized
attcaatcttggtaggtggtat

SEQ ID NO: 27233 - DNA, 22 bp, Artificial Sequence
  chemically synthesized
aatcttggtaggtggtatgtgt

SEQ ID NO: 27234 - DNA, 22 bp, Artificial Sequence
  chemically synthesized
ggtaggtggtatgtgtccagaa

SEQ ID NO: 27235 - DNA, 22 bp, Artificial Sequence
  chemically synthesized
gtaggtggtatgtgtccagaaa

SEQ ID NO: 27236 - DNA, 22 bp, Artificial Sequence
  chemically synthesized
attaatttcctctagatttttc

SEQ ID NO: 27237 - DNA, 22 bp, Artificial Sequence
  chemically synthesized
ttaatttcctctagatttttca

SEQ ID NO: 27238 - DNA, 22 bp, Artificial Sequence
  chemically synthesized
atttcctctagatttttcagtt

SEQ ID NO: 27239 - DNA, 22 bp, Artificial Sequence
  chemically synthesized
cctctagatttttcagtttttt

SEQ ID NO: 27240 - DNA, 22 bp, Artificial Sequence
  chemically synthesized
ctctagatttttcagtttttta

SEQ ID NO: 27241 - DNA, 22 bp, Artificial Sequence
  chemically synthesized
tagatttttcagttttttagtg

SEQ ID NO: 27242 - DNA, 22 bp, Artificial Sequence
  chemically synthesized
gatttttcagttttttagtgta

SEQ ID NO: 27243 - DNA, 22 bp, Artificial Sequence
  chemically synthesized
ttcagttttttagtgtatggtt

SEQ ID NO: 27244 - DNA, 22 bp, Artificial Sequence
  chemically synthesized
tcagttttttagtgtatggttg

SEQ ID NO: 27245 - DNA, 22 bp, Artificial Sequence
  chemically synthesized
cagttttttagtgtatggttgt

SEQ ID NO: 27246 - DNA, 22 bp, Artificial Sequence
  chemically synthesized
agttttttagtgtatggttgtt

SEQ ID NO: 27247 - DNA, 22 bp, Artificial Sequence
  chemically synthesized
tttagtgtatggttgttcataa

SEQ ID NO: 27248 - DNA, 22 bp, Artificial Sequence
  chemically synthesized
ttagtgtatggttgttcataat

SEQ ID NO: 27249 - DNA, 22 bp, Artificial Sequence
  chemically synthesized
tagtgtatggttgttcataata

SEQ ID NO: 27250 - DNA, 22 bp, Artificial Sequence
  chemically synthesized
agtgtatggttgttcataatag

SEQ ID NO: 27251 - DNA, 22 bp, Artificial Sequence
  chemically synthesized
gtgtatggttgttcataatagt

SEQ ID NO: 27252 - DNA, 22 bp, Artificial Sequence
  chemically synthesized
ttcataatagtctctgataatc

SEQ ID NO: 27253 - DNA, 22 bp, Artificial Sequence
  chemically synthesized
ataatagtctctgataatcttt

SEQ ID NO: 27254 - DNA, 22 bp, Artificial Sequence
  chemically synthesized
tgataatcttttctatttctgt

SEQ ID NO: 27255 - DNA, 22 bp, Artificial Sequence
  chemically synthesized
ataatcttttctatttctgtgg

SEQ ID NO: 27256 - DNA, 22 bp, Artificial Sequence
  chemically synthesized
ttctatttctgtggtatcggtt

SEQ ID NO: 27257 - DNA, 22 bp, Artificial Sequence
  chemically synthesized
tctatttctgtggtatcggttg

SEQ ID NO: 27258 - DNA, 22 bp, Artificial Sequence
  chemically synthesized
ctatttctgtggtatcggttgt

SEQ ID NO: 27259 - DNA, 22 bp, Artificial Sequence
  chemically synthesized
tatttctgtggtatcggttgta

SEQ ID NO: 27260 - DNA, 22 bp, Artificial Sequence
  chemically synthesized
tttctgtggtatcggttgtaat

SEQ ID NO: 27261 - DNA, 22 bp, Artificial Sequence
  chemically synthesized
ctgtggtatcggttgtaatata

SEQ ID NO: 27262 - DNA, 22 bp, Artificial Sequence
  chemically synthesized
tgtggtatcggttgtaatatat

SEQ ID NO: 27263 - DNA, 22 bp, Artificial Sequence
  chemically synthesized
tggtatcggttgtaatatattt

SEQ ID NO: 27264 - DNA, 22 bp, Artificial Sequence
  chemically synthesized
taatatattttcttttttattt

SEQ ID NO: 27265 - DNA, 22 bp, Artificial Sequence
  chemically synthesized
tcttttttatttctgattttct

SEQ ID NO: 27266 - DNA, 22 bp, Artificial Sequence
  chemically synthesized
cttttttatttctgattttctt

SEQ ID NO: 27267 - DNA, 22 bp, Artificial Sequence
  chemically synthesized
ttttttatttctgattttcttt

SEQ ID NO: 27268 - DNA, 22 bp, Artificial Sequence
  chemically synthesized
ttttatttctgattttctttat

SEQ ID NO: 27269 - DNA, 22 bp, Artificial Sequence
  chemically synthesized
tttatttctgattttctttatt

SEQ ID NO: 27270 - DNA, 22 bp, Artificial Sequence
  chemically synthesized
ttatttctgattttctttattt

SEQ ID NO: 27271 - DNA, 22 bp, Artificial Sequence
  chemically synthesized
tatttctgattttctttatttc

SEQ ID NO: 27272 - DNA, 22 bp, Artificial Sequence
  chemically synthesized
atttctgattttctttatttca

SEQ ID NO: 27273 - DNA, 22 bp, Artificial Sequence
  chemically synthesized
tttctgattttctttatttcag

SEQ ID NO: 27274 - DNA, 22 bp, Artificial Sequence
  chemically synthesized
ctgattttctttatttcagtct

SEQ ID NO: 27275 - DNA, 22 bp, Artificial Sequence
  chemically synthesized
tgattttctttatttcagtctc

SEQ ID NO: 27276 - DNA, 22 bp, Artificial Sequence
  chemically synthesized
attttctttatttcagtctctt

SEQ ID NO: 27277 - DNA, 22 bp, Artificial Sequence
  chemically synthesized
tctttatttcagtctcttctct

SEQ ID NO: 27278 - DNA, 22 bp, Artificial Sequence
  chemically synthesized
ctttatttcagtctcttctctt

SEQ ID NO: 27279 - DNA, 22 bp, Artificial Sequence
  chemically synthesized
tttatttcagtctcttctcttt

SEQ ID NO: 27280 - DNA, 22 bp, Artificial Sequence
  chemically synthesized
tatttcagtctcttctcttttt

SEQ ID NO: 27281 - DNA, 22 bp, Artificial Sequence
  chemically synthesized
atttcagtctcttctctttttc

SEQ ID NO: 27282 - DNA, 22 bp, Artificial Sequence
  chemically synthesized
tttcagtctcttctctttttct

SEQ ID NO: 27283 - DNA, 22 bp, Artificial Sequence
  chemically synthesized
cagtctcttctctttttcttgg

SEQ ID NO: 27284 - DNA, 22 bp, Artificial Sequence
  chemically synthesized
agtctcttctctttttcttggt

SEQ ID NO: 27285 - DNA, 22 bp, Artificial Sequence
  chemically synthesized
ttctctttttcttggttagtct

SEQ ID NO: 27286 - DNA, 22 bp, Artificial Sequence
  chemically synthesized
ctctttttcttggttagtctag

SEQ ID NO: 27287 - DNA, 22 bp, Artificial Sequence
  chemically synthesized
tctttttcttggttagtctagc

SEQ ID NO: 27288 - DNA, 22 bp, Artificial Sequence
  chemically synthesized
tttttcttggttagtctagcta

SEQ ID NO: 27289 - DNA, 22 bp, Artificial Sequence
  chemically synthesized
tttcttggttagtctagctaga

SEQ ID NO: 27290 - DNA, 22 bp, Artificial Sequence
  chemically synthesized
ttcttggttagtctagctagag

SEQ ID NO: 27291 - DNA, 22 bp, Artificial Sequence
  chemically synthesized
tcttggttagtctagctagagc

SEQ ID NO: 27292 - DNA, 22 bp, Artificial Sequence
  chemically synthesized
cttggttagtctagctagagct

SEQ ID NO: 27293 - DNA, 22 bp, Artificial Sequence
  chemically synthesized
ttggttagtctagctagagcta

SEQ ID NO: 27294 - DNA, 22 bp, Artificial Sequence
  chemically synthesized
ggttagtctagctagagctata

SEQ ID NO: 27295 - DNA, 22 bp, Artificial Sequence
  chemically synthesized
gttagtctagctagagctatat

SEQ ID NO: 27296 - DNA, 22 bp, Artificial Sequence
  chemically synthesized
gtctagctagagctatatccat

SEQ ID NO: 27297 - DNA, 22 bp, Artificial Sequence
  chemically synthesized
gctagagctatatccattttat

SEQ ID NO: 27298 - DNA, 22 bp, Artificial Sequence
  chemically synthesized
gagctatatccattttatcttt

SEQ ID NO: 27299 - DNA, 22 bp, Artificial Sequence
  chemically synthesized
tatccattttatcttttttaaa

SEQ ID NO: 27300 - DNA, 22 bp, Artificial Sequence
  chemically synthesized
tatcttttttaaataacaactt

SEQ ID NO: 27301 - DNA, 22 bp, Artificial Sequence
  chemically synthesized
atcttttttaaataacaacttt

SEQ ID NO: 27302 - DNA, 22 bp, Artificial Sequence
  chemically synthesized
tcttttttaaataacaactttt

SEQ ID NO: 27303 - DNA, 22 bp, Artificial Sequence
  chemically synthesized
ttttaaataacaacttttcatt

SEQ ID NO: 27304 - DNA, 22 bp, Artificial Sequence
  chemically synthesized
tttaaataacaacttttcattt

SEQ ID NO: 27305 - DNA, 22 bp, Artificial Sequence
  chemically synthesized
ttaaataacaacttttcatttt

SEQ ID NO: 27306 - DNA, 22 bp, Artificial Sequence
  chemically synthesized
taaataacaacttttcattttg

SEQ ID NO: 27307 - DNA, 22 bp, Artificial Sequence
  chemically synthesized
aaataacaacttttcattttgc

SEQ ID NO: 27308 - DNA, 22 bp, Artificial Sequence
  chemically synthesized
aataacaacttttcattttgct

SEQ ID NO: 27309 - DNA, 22 bp, Artificial Sequence
  chemically synthesized
ttcattttgctaatcccttgtt

SEQ ID NO: 27310 - DNA, 22 bp, Artificial Sequence
  chemically synthesized
tcattttgctaatcccttgttg

SEQ ID NO: 27311 - DNA, 22 bp, Artificial Sequence
  chemically synthesized
cattttgctaatcccttgttgt

SEQ ID NO: 27312 - DNA, 22 bp, Artificial Sequence
  chemically synthesized
attttgctaatcccttgttgtt

SEQ ID NO: 27313 - DNA, 22 bp, Artificial Sequence
  chemically synthesized
tgctaatcccttgttgttgttt

SEQ ID NO: 27314 - DNA, 22 bp, Artificial Sequence
  chemically synthesized
gctaatcccttgttgttgtttt

SEQ ID NO: 27315 - DNA, 22 bp, Artificial Sequence
  chemically synthesized
ctaatcccttgttgttgttttt

SEQ ID NO: 27316 - DNA, 22 bp, Artificial Sequence
  chemically synthesized
atcccttgttgttgtttttctc

SEQ ID NO: 27317 - DNA, 22 bp, Artificial Sequence
  chemically synthesized
gttgttgtttttctctatttca

SEQ ID NO: 27318 - DNA, 22 bp, Artificial Sequence
  chemically synthesized
ttgttgtttttctctatttcat

SEQ ID NO: 27319 - DNA, 22 bp, Artificial Sequence
  chemically synthesized
ttgtttttctctatttcattaa

SEQ ID NO: 27320 - DNA, 22 bp, Artificial Sequence
  chemically synthesized
tttttctctatttcattaagtt

SEQ ID NO: 27321 - DNA, 22 bp, Artificial Sequence
  chemically synthesized
ttctctatttcattaagttctt

SEQ ID NO: 27322 - DNA, 22 bp, Artificial Sequence
  chemically synthesized
tctctatttcattaagttcttc

SEQ ID NO: 27323 - DNA, 22 bp, Artificial Sequence
  chemically synthesized
ctctatttcattaagttcttct

SEQ ID NO: 27324 - DNA, 22 bp, Artificial Sequence
  chemically synthesized
tctatttcattaagttcttctg

SEQ ID NO: 27325 - DNA, 22 bp, Artificial Sequence
  chemically synthesized
tatttcattaagttcttctgtt

SEQ ID NO: 27326 - DNA, 22 bp, Artificial Sequence
  chemically synthesized
tttcattaagttcttctgttct

SEQ ID NO: 27327 - DNA, 22 bp, Artificial Sequence
  chemically synthesized
cattaagttcttctgttcttca

SEQ ID NO: 27328 - DNA, 22 bp, Artificial Sequence
  chemically synthesized
attaagttcttctgttcttcat

SEQ ID NO: 27329 - DNA, 22 bp, Artificial Sequence
  chemically synthesized
agttcttctgttcttcattttt

SEQ ID NO: 27330 - DNA, 22 bp, Artificial Sequence
  chemically synthesized
ttctgttcttcattttttcttt

SEQ ID NO: 27331 - DNA, 22 bp, Artificial Sequence
  chemically synthesized
ctgttcttcattttttctttcc

SEQ ID NO: 27332 - DNA, 22 bp, Artificial Sequence
  chemically synthesized
tgttcttcattttttctttcct

SEQ ID NO: 27333 - DNA, 22 bp, Artificial Sequence
  chemically synthesized
ttcttcattttttctttccttc

SEQ ID NO: 27334 - DNA, 22 bp, Artificial Sequence
  chemically synthesized
ttcattttttctttccttctgc

SEQ ID NO: 27335 - DNA, 22 bp, Artificial Sequence
  chemically synthesized
cattttttctttccttctgcta

SEQ ID NO: 27336 - DNA, 22 bp, Artificial Sequence
  chemically synthesized
attttttctttccttctgctag

SEQ ID NO: 27337 - DNA, 22 bp, Artificial Sequence
  chemically synthesized
tttctttccttctgctagtttt

SEQ ID NO: 27338 - DNA, 22 bp, Artificial Sequence
  chemically synthesized
ttctttccttctgctagttttg

SEQ ID NO: 27339 - DNA, 22 bp, Artificial Sequence
  chemically synthesized
tctttccttctgctagttttgg

SEQ ID NO: 27340 - DNA, 22 bp, Artificial Sequence
  chemically synthesized
ctttccttctgctagttttggg

SEQ ID NO: 27341 - DNA, 22 bp, Artificial Sequence
  chemically synthesized
tttccttctgctagttttgggt

SEQ ID NO: 27342 - DNA, 22 bp, Artificial Sequence
  chemically synthesized
tccttctgctagttttgggttt

SEQ ID NO: 27343 - DNA, 22 bp, Artificial Sequence
  chemically synthesized
ccttctgctagttttgggtttt

SEQ ID NO: 27344 - DNA, 22 bp, Artificial Sequence
  chemically synthesized
cttctgctagttttgggttttg

SEQ ID NO: 27345 - DNA, 22 bp, Artificial Sequence
  chemically synthesized
ctgctagttttgggttttgttc

SEQ ID NO: 27346 - DNA, 22 bp, Artificial Sequence
  chemically synthesized
tgctagttttgggttttgttct

SEQ ID NO: 27347 - DNA, 22 bp, Artificial Sequence
  chemically synthesized
ctagttttgggttttgttcttg

SEQ ID NO: 27348 - DNA, 22 bp, Artificial Sequence
  chemically synthesized
gttttgggttttgttcttgctt

SEQ ID NO: 27349 - DNA, 22 bp, Artificial Sequence
  chemically synthesized
tgggttttgttcttgcttttct

SEQ ID NO: 27350 - DNA, 22 bp, Artificial Sequence
  chemically synthesized
gggttttgttcttgcttttcta

SEQ ID NO: 27351 - DNA, 22 bp, Artificial Sequence
  chemically synthesized
ggttttgttcttgcttttctag

SEQ ID NO: 27352 - DNA, 22 bp, Artificial Sequence
  chemically synthesized
tgttcttgcttttctagcttgt

SEQ ID NO: 27353 - DNA, 22 bp, Artificial Sequence
  chemically synthesized
gttcttgcttttctagcttgtt

SEQ ID NO: 27354 - DNA, 22 bp, Artificial Sequence
  chemically synthesized
ttcttgcttttctagcttgttg

SEQ ID NO: 27355 - DNA, 22 bp, Artificial Sequence
  chemically synthesized
ttgcttttctagcttgttgagg

SEQ ID NO: 27356 - DNA, 22 bp, Artificial Sequence
  chemically synthesized
gcttttctagcttgttgaggta

SEQ ID NO: 27357 - DNA, 22 bp, Artificial Sequence
  chemically synthesized
cttttctagcttgttgaggtac

SEQ ID NO: 27358 - DNA, 22 bp, Artificial Sequence
  chemically synthesized
ttctagcttgttgaggtacatg

SEQ ID NO: 27359 - DNA, 22 bp, Artificial Sequence
  chemically synthesized
tctagcttgttgaggtacatga

SEQ ID NO: 27360 - DNA, 22 bp, Artificial Sequence
  chemically synthesized
ctagcttgttgaggtacatgat

SEQ ID NO: 27361 - DNA, 22 bp, Artificial Sequence
  chemically synthesized
tagcttgttgaggtacatgatt

SEQ ID NO: 27362 - DNA, 22 bp, Artificial Sequence
  chemically synthesized
gcttgttgaggtacatgattag

SEQ ID NO: 27363 - DNA, 22 bp, Artificial Sequence
  chemically synthesized
gttgaggtacatgattagatta

SEQ ID NO: 27364 - DNA, 22 bp, Artificial Sequence
  chemically synthesized
ttgaggtacatgattagattat

SEQ ID NO: 27365 - DNA, 22 bp, Artificial Sequence
  chemically synthesized
aggtacatgattagattatata

SEQ ID NO: 27366 - DNA, 22 bp, Artificial Sequence
  chemically synthesized
gattatatatttgaaatctttc

SEQ ID NO: 27367 - DNA, 22 bp, Artificial Sequence
  chemically synthesized
tatatttgaaatctttctatgt

SEQ ID NO: 27368 - DNA, 22 bp, Artificial Sequence
  chemically synthesized
gaaatctttctatgtttttaat

SEQ ID NO: 27369 - DNA, 22 bp, Artificial Sequence
  chemically synthesized
aaatctttctatgtttttaatt

SEQ ID NO: 27370 - DNA, 22 bp, Artificial Sequence
  chemically synthesized
tctatgtttttaatttaagtgt

SEQ ID NO: 27371 - DNA, 22 bp, Artificial Sequence
  chemically synthesized
ctatgtttttaatttaagtgtt

SEQ ID NO: 27372 - DNA, 22 bp, Artificial Sequence
  chemically synthesized
tatgtttttaatttaagtgttt

SEQ ID NO: 27373 - DNA, 22 bp, Artificial Sequence
  chemically synthesized
tgtttttaatttaagtgtttat

SEQ ID NO: 27374 - DNA, 22 bp, Artificial Sequence
  chemically synthesized
ttaatttaagtgtttattgata

SEQ ID NO: 27375 - DNA, 22 bp, Artificial Sequence
  chemically synthesized
taatttaagtgtttattgataa

SEQ ID NO: 27376 - DNA, 22 bp, Artificial Sequence
  chemically synthesized
aatttaagtgtttattgataag

SEQ ID NO: 27377 - DNA, 22 bp, Artificial Sequence
  chemically synthesized
atttaagtgtttattgataagc

SEQ ID NO: 27378 - DNA, 22 bp, Artificial Sequence
  chemically synthesized
aagtgtttattgataagcttct

SEQ ID NO: 27379 - DNA, 22 bp, Artificial Sequence
  chemically synthesized
agtgtttattgataagcttctc

SEQ ID NO: 27380 - DNA, 22 bp, Artificial Sequence
  chemically synthesized
attgataagcttctctcttagc

SEQ ID NO: 27381 - DNA, 22 bp, Artificial Sequence
  chemically synthesized
ttgataagcttctctcttagca

SEQ ID NO: 27382 - DNA, 22 bp, Artificial Sequence
  chemically synthesized
ataagcttctctcttagcactg

SEQ ID NO: 27383 - DNA, 22 bp, Artificial Sequence
  chemically synthesized
ctctcttagcactgcttttgct

SEQ ID NO: 27384 - DNA, 22 bp, Artificial Sequence
  chemically synthesized
tctcttagcactgcttttgctg

SEQ ID NO: 27385 - DNA, 22 bp, Artificial Sequence
  chemically synthesized
tcttagcactgcttttgctgta

SEQ ID NO: 27386 - DNA, 22 bp, Artificial Sequence
  chemically synthesized
ttagcactgcttttgctgtatc

SEQ ID NO: 27387 - DNA, 22 bp, Artificial Sequence
  chemically synthesized
agcactgcttttgctgtatccc

SEQ ID NO: 27388 - DNA, 22 bp, Artificial Sequence
  chemically synthesized
gcactgcttttgctgtatccca

SEQ ID NO: 27389 - DNA, 22 bp, Artificial Sequence
  chemically synthesized
cttttgctgtatcccatggctt

SEQ ID NO: 27390 - DNA, 22 bp, Artificial Sequence
  chemically synthesized
ttgctgtatcccatggcttttc

SEQ ID NO: 27391 - DNA, 22 bp, Artificial Sequence
  chemically synthesized
tgctgtatcccatggcttttcc

SEQ ID NO: 27392 - DNA, 22 bp, Artificial Sequence
  chemically synthesized
gctgtatcccatggcttttcct

SEQ ID NO: 27393 - DNA, 22 bp, Artificial Sequence
  chemically synthesized
ctgtatcccatggcttttccta

SEQ ID NO: 27394 - DNA, 22 bp, Artificial Sequence
  chemically synthesized
tatcccatggcttttcctatgt

SEQ ID NO: 27395 - DNA, 22 bp, Artificial Sequence
  chemically synthesized
ttcctatgttgtatttcaattt

SEQ ID NO: 27396 - DNA, 22 bp, Artificial Sequence
  chemically synthesized
tcctatgttgtatttcaatttt

SEQ ID NO: 27397 - DNA, 22 bp, Artificial Sequence
  chemically synthesized
cctatgttgtatttcaattttc

SEQ ID NO: 27398 - DNA, 22 bp, Artificial Sequence
  chemically synthesized
ctatgttgtatttcaattttca

SEQ ID NO: 27399 - DNA, 22 bp, Artificial Sequence
  chemically synthesized
tgttgtatttcaattttcattt

SEQ ID NO: 27400 - DNA, 22 bp, Artificial Sequence
  chemically synthesized
tatttcaattttcatttgtttc

SEQ ID NO: 27401 - DNA, 22 bp, Artificial Sequence
  chemically synthesized
caattttcatttgtttcaaaaa

SEQ ID NO: 27402 - DNA, 22 bp, Artificial Sequence
  chemically synthesized
aattttcatttgtttcaaaaaa

SEQ ID NO: 27403 - DNA, 22 bp, Artificial Sequence
  chemically synthesized
tcatttgtttcaaaaaattttt

SEQ ID NO: 27404 - DNA, 22 bp, Artificial Sequence
  chemically synthesized
catttgtttcaaaaaatttttg

SEQ ID NO: 27405 - DNA, 22 bp, Artificial Sequence
  chemically synthesized
atttgtttcaaaaaatttttga

SEQ ID NO: 27406 - DNA, 22 bp, Artificial Sequence
  chemically synthesized
gtttcaaaaaatttttgatttc

SEQ ID NO: 27407 - DNA, 22 bp, Artificial Sequence
  chemically synthesized
tttcaaaaaatttttgatttcc

SEQ ID NO: 27408 - DNA, 22 bp, Artificial Sequence
  chemically synthesized
caaaaaatttttgatttccttc

SEQ ID NO: 27409 - DNA, 22 bp, Artificial Sequence
  chemically synthesized
aaaaaatttttgatttccttct

SEQ ID NO: 27410 - DNA, 22 bp, Artificial Sequence
  chemically synthesized
ttgatttccttcttaattttct

SEQ ID NO: 27411 - DNA, 22 bp, Artificial Sequence
  chemically synthesized
tgatttccttcttaattttctt

SEQ ID NO: 27412 - DNA, 22 bp, Artificial Sequence
  chemically synthesized
gatttccttcttaattttcttc

SEQ ID NO: 27413 - DNA, 22 bp, Artificial Sequence
  chemically synthesized
atttccttcttaattttcttct

SEQ ID NO: 27414 - DNA, 22 bp, Artificial Sequence
  chemically synthesized
ccttcttaattttcttcttgac

SEQ ID NO: 27415 - DNA, 22 bp, Artificial Sequence
  chemically synthesized
cttcttaattttcttcttgaca

SEQ ID NO: 27416 - DNA, 22 bp, Artificial Sequence
  chemically synthesized
cttaattttcttcttgacataa

SEQ ID NO: 27417 - DNA, 22 bp, Artificial Sequence
  chemically synthesized
ttaattttcttcttgacataac

SEQ ID NO: 27418 - DNA, 22 bp, Artificial Sequence
  chemically synthesized
aattttcttcttgacataacgt

SEQ ID NO: 27419 - DNA, 22 bp, Artificial Sequence
  chemically synthesized
attttcttcttgacataacgtt

SEQ ID NO: 27420 - DNA, 22 bp, Artificial Sequence
  chemically synthesized
tcttcttgacataacgttcatt

SEQ ID NO: 27421 - DNA, 22 bp, Artificial Sequence
  chemically synthesized
cttcttgacataacgttcattc

SEQ ID NO: 27422 - DNA, 22 bp, Artificial Sequence
  chemically synthesized
ttcttgacataacgttcattca

SEQ ID NO: 27423 - DNA, 22 bp, Artificial Sequence
  chemically synthesized
cttgacataacgttcattcagg

SEQ ID NO: 27424 - DNA, 22 bp, Artificial Sequence
  chemically synthesized
ttgacataacgttcattcagga

SEQ ID NO: 27425 - DNA, 22 bp, Artificial Sequence
  chemically synthesized
gacataacgttcattcaggagc

SEQ ID NO: 27426 - DNA, 22 bp, Artificial Sequence
  chemically synthesized
acataacgttcattcaggagca

SEQ ID NO: 27427 - DNA, 22 bp, Artificial Sequence
  chemically synthesized
attcaggagcatgttgtttaat

SEQ ID NO: 27428 - DNA, 22 bp, Artificial Sequence
  chemically synthesized
aggagcatgttgtttaatttcc

SEQ ID NO: 27429 - DNA, 22 bp, Artificial Sequence
  chemically synthesized
tttaatttccatgtatttgtat

SEQ ID NO: 27430 - DNA, 22 bp, Artificial Sequence
  chemically synthesized
aatttccatgtatttgtatagg

SEQ ID NO: 27431 - DNA, 22 bp, Artificial Sequence
  chemically synthesized
atttccatgtatttgtataggt

SEQ ID NO: 27432 - DNA, 22 bp, Artificial Sequence
  chemically synthesized
ccatgtatttgtataggtttta

SEQ ID NO: 27433 - DNA, 22 bp, Artificial Sequence
  chemically synthesized
catgtatttgtataggttttaa

SEQ ID NO: 27434 - DNA, 22 bp, Artificial Sequence
  chemically synthesized
gtataggttttaaagtttttct

SEQ ID NO: 27435 - DNA, 22 bp, Artificial Sequence
  chemically synthesized
tataggttttaaagtttttctt

SEQ ID NO: 27436 - DNA, 22 bp, Artificial Sequence
  chemically synthesized
taaagtttttcttgttattgat

SEQ ID NO: 27437 - DNA, 22 bp, Artificial Sequence
  chemically synthesized
aaagtttttcttgttattgatt

SEQ ID NO: 27438 - DNA, 22 bp, Artificial Sequence
  chemically synthesized
aagtttttcttgttattgattt

SEQ ID NO: 27439 - DNA, 22 bp, Artificial Sequence
  chemically synthesized
ttcttgttattgatttctagtt

SEQ ID NO: 27440 - DNA, 22 bp, Artificial Sequence
  chemically synthesized
tcttgttattgatttctagttt

SEQ ID NO: 27441 - DNA, 22 bp, Artificial Sequence
  chemically synthesized
cttgttattgatttctagtttt

SEQ ID NO: 27442 - DNA, 22 bp, Artificial Sequence
  chemically synthesized
ttgttattgatttctagtttta

SEQ ID NO: 27443 - DNA, 22 bp, Artificial Sequence
  chemically synthesized
gttattgatttctagttttatt

SEQ ID NO: 27444 - DNA, 22 bp, Artificial Sequence
  chemically synthesized
ttattgatttctagttttattc

SEQ ID NO: 27445 - DNA, 22 bp, Artificial Sequence
  chemically synthesized
ttgatttctagttttattccat

SEQ ID NO: 27446 - DNA, 22 bp, Artificial Sequence
  chemically synthesized
atttctagttttattccattgt

SEQ ID NO: 27447 - DNA, 22 bp, Artificial Sequence
  chemically synthesized
ctagttttattccattgtggtc

SEQ ID NO: 27448 - DNA, 22 bp, Artificial Sequence
  chemically synthesized
tagttttattccattgtggtct

SEQ ID NO: 27449 - DNA, 22 bp, Artificial Sequence
  chemically synthesized
gttttattccattgtggtctga

SEQ ID NO: 27450 - DNA, 22 bp, Artificial Sequence
  chemically synthesized
tattccattgtggtctgagaag

SEQ ID NO: 27451 - DNA, 22 bp, Artificial Sequence
  chemically synthesized
attccattgtggtctgagaaga

SEQ ID NO: 27452 - DNA, 22 bp, Artificial Sequence
  chemically synthesized
ttccattgtggtctgagaagat

SEQ ID NO: 27453 - DNA, 22 bp, Artificial Sequence
  chemically synthesized
cattgtggtctgagaagatgct

SEQ ID NO: 27454 - DNA, 22 bp, Artificial Sequence
  chemically synthesized
tggtctgagaagatgcttaata

SEQ ID NO: 27455 - DNA, 22 bp, Artificial Sequence
  chemically synthesized
agaagatgcttaatatgatttc

SEQ ID NO: 27456 - DNA, 22 bp, Artificial Sequence
  chemically synthesized
aatatgatttcaaatatttcaa

SEQ ID NO: 27457 - DNA, 22 bp, Artificial Sequence
  chemically synthesized
atatgatttcaaatatttcaaa

SEQ ID NO: 27458 - DNA, 22 bp, Artificial Sequence
  chemically synthesized
caaatatttcaaattagttgag

SEQ ID NO: 27459 - DNA, 22 bp, Artificial Sequence
  chemically synthesized
aaatatttcaaattagttgaga

SEQ ID NO: 27460 - DNA, 22 bp, Artificial Sequence
  chemically synthesized
caaattagttgagacttctttt

SEQ ID NO: 27461 - DNA, 22 bp, Artificial Sequence
  chemically synthesized
aaattagttgagacttcttttg

SEQ ID NO: 27462 - DNA, 22 bp, Artificial Sequence
  chemically synthesized
gttgagacttcttttgtgttct

SEQ ID NO: 27463 - DNA, 22 bp, Artificial Sequence
  chemically synthesized
agacttcttttgtgttctaaca

SEQ ID NO: 27464 - DNA, 22 bp, Artificial Sequence
  chemically synthesized
cttttgtgttctaacatatggt

SEQ ID NO: 27465 - DNA, 22 bp, Artificial Sequence
  chemically synthesized
ttttgtgttctaacatatggtg

SEQ ID NO: 27466 - DNA, 22 bp, Artificial Sequence
  chemically synthesized
ttgtgttctaacatatggtgta

SEQ ID NO: 27467 - DNA, 22 bp, Artificial Sequence
  chemically synthesized
tgtgttctaacatatggtgtat

SEQ ID NO: 27468 - DNA, 22 bp, Artificial Sequence
  chemically synthesized
gtgttctaacatatggtgtatc

SEQ ID NO: 27469 - DNA, 22 bp, Artificial Sequence
  chemically synthesized
tgttctaacatatggtgtatcc

SEQ ID NO: 27470 - DNA, 22 bp, Artificial Sequence
  chemically synthesized
taacatatggtgtatcctgggg

SEQ ID NO: 27471 - DNA, 22 bp, Artificial Sequence
  chemically synthesized
acatatggtgtatcctggggaa

SEQ ID NO: 27472 - DNA, 22 bp, Artificial Sequence
  chemically synthesized
gggaatgcgtcatgtgctgatg

SEQ ID NO: 27473 - DNA, 22 bp, Artificial Sequence
  chemically synthesized
atgagataaatatattctgtag

SEQ ID NO: 27474 - DNA, 22 bp, Artificial Sequence
  chemically synthesized
tgtagctgttggatgaaatatt

SEQ ID NO: 27475 - DNA, 22 bp, Artificial Sequence
  chemically synthesized
tagctgttggatgaaatattgt

SEQ ID NO: 27476 - DNA, 22 bp, Artificial Sequence
  chemically synthesized
ttggatgaaatattgtgtaaat

SEQ ID NO: 27477 - DNA, 22 bp, Artificial Sequence
  chemically synthesized
gatgaaatattgtgtaaatgtt

SEQ ID NO: 27478 - DNA, 22 bp, Artificial Sequence
  chemically synthesized
tgtaaatgttagatccatttgg

SEQ ID NO: 27479 - DNA, 22 bp, Artificial Sequence
  chemically synthesized
gatccatttggtctaaagtcaa

SEQ ID NO: 27480 - DNA, 22 bp, Artificial Sequence
  chemically synthesized
ggtctaaagtcaagtttaaatc

SEQ ID NO: 27481 - DNA, 22 bp, Artificial Sequence
  chemically synthesized
gtctaaagtcaagtttaaatcc

SEQ ID NO: 27482 - DNA, 22 bp, Artificial Sequence
  chemically synthesized
aagtcaagtttaaatccaatgt

SEQ ID NO: 27483 - DNA, 22 bp, Artificial Sequence
  chemically synthesized
aaatccaatgtttctttgttaa

SEQ ID NO: 27484 - DNA, 22 bp, Artificial Sequence
  chemically synthesized
aatccaatgtttctttgttaat

SEQ ID NO: 27485 - DNA, 22 bp, Artificial Sequence
  chemically synthesized
ctttgttaattttctgtctaga

SEQ ID NO: 27486 - DNA, 22 bp, Artificial Sequence
  chemically synthesized
tttgttaattttctgtctagat

SEQ ID NO: 27487 - DNA, 22 bp, Artificial Sequence
  chemically synthesized
tgttaattttctgtctagatga

SEQ ID NO: 27488 - DNA, 22 bp, Artificial Sequence
  chemically synthesized
gttaattttctgtctagatgat

SEQ ID NO: 27489 - DNA, 22 bp, Artificial Sequence
  chemically synthesized
ttaattttctgtctagatgatc

SEQ ID NO: 27490 - DNA, 22 bp, Artificial Sequence
  chemically synthesized
attttctgtctagatgatctat

SEQ ID NO: 27491 - DNA, 22 bp, Artificial Sequence
  chemically synthesized
tctgtctagatgatctatctga

SEQ ID NO: 27492 - DNA, 22 bp, Artificial Sequence
  chemically synthesized
ctgtctagatgatctatctgat

SEQ ID NO: 27493 - DNA, 22 bp, Artificial Sequence
  chemically synthesized
tgtctagatgatctatctgatg

SEQ ID NO: 27494 - DNA, 22 bp, Artificial Sequence
  chemically synthesized
tctagatgatctatctgatgct

SEQ ID NO: 27495 - DNA, 22 bp, Artificial Sequence
  chemically synthesized
gatgatctatctgatgctgaga

SEQ ID NO: 27496 - DNA, 22 bp, Artificial Sequence
  chemically synthesized
tctgatgctgagattagaatgt

SEQ ID NO: 27497 - DNA, 22 bp, Artificial Sequence
  chemically synthesized
atgctgagattagaatgttgaa

SEQ ID NO: 27498 - DNA, 22 bp, Artificial Sequence
  chemically synthesized
agattagaatgttgaaatcccc

SEQ ID NO: 27499 - DNA, 22 bp, Artificial Sequence
  chemically synthesized
gaatgttgaaatccccaactat

SEQ ID NO: 27500 - DNA, 22 bp, Artificial Sequence
  chemically synthesized
aaatccccaactattattgtat

SEQ ID NO: 27501 - DNA, 22 bp, Artificial Sequence
  chemically synthesized
ttattgtattggattctatttc

SEQ ID NO: 27502 - DNA, 22 bp, Artificial Sequence
  chemically synthesized
ttgtattggattctatttcacc

SEQ ID NO: 27503 - DNA, 22 bp, Artificial Sequence
  chemically synthesized
tattggattctatttcaccctt

SEQ ID NO: 27504 - DNA, 22 bp, Artificial Sequence
  chemically synthesized
gattctatttcaccctttatat

SEQ ID NO: 27505 - DNA, 22 bp, Artificial Sequence
  chemically synthesized
tatttcaccctttatatctaat

SEQ ID NO: 27506 - DNA, 22 bp, Artificial Sequence
  chemically synthesized
tttcaccctttatatctaataa

SEQ ID NO: 27507 - DNA, 22 bp, Artificial Sequence
  chemically synthesized
caccctttatatctaataacat

SEQ ID NO: 27508 - DNA, 22 bp, Artificial Sequence
  chemically synthesized
accctttatatctaataacatt

SEQ ID NO: 27509 - DNA, 22 bp, Artificial Sequence
  chemically synthesized
tatatctaataacatttgcttt

SEQ ID NO: 27510 - DNA, 22 bp, Artificial Sequence
  chemically synthesized
atatctaataacatttgcttta

SEQ ID NO: 27511 - DNA, 22 bp, Artificial Sequence
  chemically synthesized
tatctaataacatttgctttac

SEQ ID NO: 27512 - DNA, 22 bp, Artificial Sequence
  chemically synthesized
ataacatttgctttacatatct

SEQ ID NO: 27513 - DNA, 22 bp, Artificial Sequence
  chemically synthesized
gctttacatatctggatgctct

SEQ ID NO: 27514 - DNA, 22 bp, Artificial Sequence
  chemically synthesized
ctttacatatctggatgctctg

SEQ ID NO: 27515 - DNA, 22 bp, Artificial Sequence
  chemically synthesized
tacatatctggatgctctggtg

SEQ ID NO: 27516 - DNA, 22 bp, Artificial Sequence
  chemically synthesized
acatatctggatgctctggtgt

SEQ ID NO: 27517 - DNA, 22 bp, Artificial Sequence
  chemically synthesized
catatctggatgctctggtgtt

SEQ ID NO: 27518 - DNA, 22 bp, Artificial Sequence
  chemically synthesized
gatgctctggtgttgagtgtga

SEQ ID NO: 27519 - DNA, 22 bp, Artificial Sequence
  chemically synthesized
tggtgttgagtgtgaatgttta

SEQ ID NO: 27520 - DNA, 22 bp, Artificial Sequence
  chemically synthesized
gtgttgagtgtgaatgtttaga

SEQ ID NO: 27521 - DNA, 22 bp, Artificial Sequence
  chemically synthesized
agtgtgaatgtttagaattgtt

SEQ ID NO: 27522 - DNA, 22 bp, Artificial Sequence
  chemically synthesized
agaattgttatatactcttgct

SEQ ID NO: 27523 - DNA, 22 bp, Artificial Sequence
  chemically synthesized
gaattgttatatactcttgctg

SEQ ID NO: 27524 - DNA, 22 bp, Artificial Sequence
  chemically synthesized
ttatatactcttgctgaattgt

SEQ ID NO: 27525 - DNA, 22 bp, Artificial Sequence
  chemically synthesized
tatactcttgctgaattgttcc

SEQ ID NO: 27526 - DNA, 22 bp, Artificial Sequence
  chemically synthesized
ttgctgaattgttccttttatc

SEQ ID NO: 27527 - DNA, 22 bp, Artificial Sequence
  chemically synthesized
gctgaattgttccttttatcat

SEQ ID NO: 27528 - DNA, 22 bp, Artificial Sequence
  chemically synthesized
ctgaattgttccttttatcatt

SEQ ID NO: 27529 - DNA, 22 bp, Artificial Sequence
  chemically synthesized
aattgttccttttatcattatg

SEQ ID NO: 27530 - DNA, 22 bp, Artificial Sequence
  chemically synthesized
ttccttttatcattatgtaatg

SEQ ID NO: 27531 - DNA, 22 bp, Artificial Sequence
  chemically synthesized
cttttatcattatgtaatgact

SEQ ID NO: 27532 - DNA, 22 bp, Artificial Sequence
  chemically synthesized
ttatcattatgtaatgactttt

SEQ ID NO: 27533 - DNA, 22 bp, Artificial Sequence
  chemically synthesized
tatcattatgtaatgacttttg

SEQ ID NO: 27534 - DNA, 22 bp, Artificial Sequence
  chemically synthesized
atcattatgtaatgacttttgt

SEQ ID NO: 27535 - DNA, 22 bp, Artificial Sequence
  chemically synthesized
tcattatgtaatgacttttgtc

SEQ ID NO: 27536 - DNA, 22 bp, Artificial Sequence
  chemically synthesized
tgtaatgacttttgtctcttag

SEQ ID NO: 27537 - DNA, 22 bp, Artificial Sequence
  chemically synthesized
ttgtctcttagtgttttttatt

SEQ ID NO: 27538 - DNA, 22 bp, Artificial Sequence
  chemically synthesized
tgtctcttagtgttttttattt

SEQ ID NO: 27539 - DNA, 22 bp, Artificial Sequence
  chemically synthesized
gtctcttagtgttttttattta

SEQ ID NO: 27540 - DNA, 22 bp, Artificial Sequence
  chemically synthesized
tctcttagtgttttttatttaa

SEQ ID NO: 27541 - DNA, 22 bp, Artificial Sequence
  chemically synthesized
ttagtgttttttatttaaagtc

SEQ ID NO: 27542 - DNA, 22 bp, Artificial Sequence
  chemically synthesized
agtgttttttatttaaagtcaa

SEQ ID NO: 27543 - DNA, 22 bp, Artificial Sequence
  chemically synthesized
gtgttttttatttaaagtcaat

SEQ ID NO: 27544 - DNA, 22 bp, Artificial Sequence
  chemically synthesized
tttatttaaagtcaattttatc

SEQ ID NO: 27545 - DNA, 22 bp, Artificial Sequence
  chemically synthesized
ttatttaaagtcaattttatct

SEQ ID NO: 27546 - DNA, 22 bp, Artificial Sequence
  chemically synthesized
tatttaaagtcaattttatctg

SEQ ID NO: 27547 - DNA, 22 bp, Artificial Sequence
  chemically synthesized
atttaaagtcaattttatctgt

SEQ ID NO: 27548 - DNA, 22 bp, Artificial Sequence
  chemically synthesized
tttaaagtcaattttatctgtt

SEQ ID NO: 27549 - DNA, 22 bp, Artificial Sequence
  chemically synthesized
aaagtcaattttatctgttata

SEQ ID NO: 27550 - DNA, 22 bp, Artificial Sequence
  chemically synthesized
aagtcaattttatctgttatag

SEQ ID NO: 27551 - DNA, 22 bp, Artificial Sequence
  chemically synthesized
tatctgttataggtataactac

SEQ ID NO: 27552 - DNA, 22 bp, Artificial Sequence
  chemically synthesized
atctgttataggtataactact

SEQ ID NO: 27553 - DNA, 22 bp, Artificial Sequence
  chemically synthesized
tctgttataggtataactactt

SEQ ID NO: 27554 - DNA, 22 bp, Artificial Sequence
  chemically synthesized
ttataggtataactacttttgc

SEQ ID NO: 27555 - DNA, 22 bp, Artificial Sequence
  chemically synthesized
taggtataactacttttgctca

SEQ ID NO: 27556 - DNA, 22 bp, Artificial Sequence
  chemically synthesized
cttttgctcatttttggtttct

SEQ ID NO: 27557 - DNA, 22 bp, Artificial Sequence
  chemically synthesized
ttgctcatttttggtttctctt

SEQ ID NO: 27558 - DNA, 22 bp, Artificial Sequence
  chemically synthesized
tgctcatttttggtttctcttt

SEQ ID NO: 27559 - DNA, 22 bp, Artificial Sequence
  chemically synthesized
gctcatttttggtttctctttg

SEQ ID NO: 27560 - DNA, 22 bp, Artificial Sequence
  chemically synthesized
ctcatttttggtttctctttgt

SEQ ID NO: 27561 - DNA, 22 bp, Artificial Sequence
  chemically synthesized
atttttggtttctctttgtatg

SEQ ID NO: 27562 - DNA, 22 bp, Artificial Sequence
  chemically synthesized
ttggtttctctttgtatggaag

SEQ ID NO: 27563 - DNA, 22 bp, Artificial Sequence
  chemically synthesized
tggtttctctttgtatggaaga

SEQ ID NO: 27564 - DNA, 22 bp, Artificial Sequence
  chemically synthesized
ggtttctctttgtatggaagat

SEQ ID NO: 27565 - DNA, 22 bp, Artificial Sequence
  chemically synthesized
gtttctctttgtatggaagatc

SEQ ID NO: 27566 - DNA, 22 bp, Artificial Sequence
  chemically synthesized
ctctttgtatggaagatctttc

SEQ ID NO: 27567 - DNA, 22 bp, Artificial Sequence
  chemically synthesized
tctttgtatggaagatctttca

SEQ ID NO: 27568 - DNA, 22 bp, Artificial Sequence
  chemically synthesized
tttgtatggaagatctttcatc

SEQ ID NO: 27569 - DNA, 22 bp, Artificial Sequence
  chemically synthesized
tgtatggaagatctttcatctt

SEQ ID NO: 27570 - DNA, 22 bp, Artificial Sequence
  chemically synthesized
gtatggaagatctttcatcttt

SEQ ID NO: 27571 - DNA, 22 bp, Artificial Sequence
  chemically synthesized
tatggaagatctttcatctttt

SEQ ID NO: 27572 - DNA, 22 bp, Artificial Sequence
  chemically synthesized
tcatctttttactttcagtcta

SEQ ID NO: 27573 - DNA, 22 bp, Artificial Sequence
  chemically synthesized
catctttttactttcagtctat

SEQ ID NO: 27574 - DNA, 22 bp, Artificial Sequence
  chemically synthesized
atctttttactttcagtctata

SEQ ID NO: 27575 - DNA, 22 bp, Artificial Sequence
  chemically synthesized
tttactttcagtctatatttat

SEQ ID NO: 27576 - DNA, 22 bp, Artificial Sequence
  chemically synthesized
ttactttcagtctatatttatc

SEQ ID NO: 27577 - DNA, 22 bp, Artificial Sequence
  chemically synthesized
tactttcagtctatatttatct

SEQ ID NO: 27578 - DNA, 22 bp, Artificial Sequence
  chemically synthesized
actttcagtctatatttatctt

SEQ ID NO: 27579 - DNA, 22 bp, Artificial Sequence
  chemically synthesized
ctttcagtctatatttatcttt

SEQ ID NO: 27580 - DNA, 22 bp, Artificial Sequence
  chemically synthesized
tcagtctatatttatctttaca

SEQ ID NO: 27581 - DNA, 22 bp, Artificial Sequence
  chemically synthesized
cagtctatatttatctttacaa

SEQ ID NO: 27582 - DNA, 22 bp, Artificial Sequence
  chemically synthesized
agtctatatttatctttacaag

SEQ ID NO: 27583 - DNA, 22 bp, Artificial Sequence
  chemically synthesized
tatttatctttacaagtgagat

SEQ ID NO: 27584 - DNA, 22 bp, Artificial Sequence
  chemically synthesized
atctttacaagtgagataagtt

SEQ ID NO: 27585 - DNA, 22 bp, Artificial Sequence
  chemically synthesized
tctttacaagtgagataagttt

SEQ ID NO: 27586 - DNA, 22 bp, Artificial Sequence
  chemically synthesized
tacaagtgagataagtttctta

SEQ ID NO: 27587 - DNA, 22 bp, Artificial Sequence
  chemically synthesized
acaagtgagataagtttcttat

SEQ ID NO: 27588 - DNA, 22 bp, Artificial Sequence
  chemically synthesized
caagtgagataagtttcttata

SEQ ID NO: 27589 - DNA, 22 bp, Artificial Sequence
  chemically synthesized
cttataggcagcttacaactgg

SEQ ID NO: 27590 - DNA, 22 bp, Artificial Sequence
  chemically synthesized
ttataggcagcttacaactggg

SEQ ID NO: 27591 - DNA, 22 bp, Artificial Sequence
  chemically synthesized
ataggcagcttacaactgggtc

SEQ ID NO: 27592 - DNA, 22 bp, Artificial Sequence
  chemically synthesized
taggcagcttacaactgggtca

SEQ ID NO: 27593 - DNA, 22 bp, Artificial Sequence
  chemically synthesized
acaactgggtcatatttttgtt

SEQ ID NO: 27594 - DNA, 22 bp, Artificial Sequence
  chemically synthesized
caactgggtcatatttttgttt

SEQ ID NO: 27595 - DNA, 22 bp, Artificial Sequence
  chemically synthesized
ggtcatatttttgttttaaatc

SEQ ID NO: 27596 - DNA, 22 bp, Artificial Sequence
  chemically synthesized
ttgttttaaatctatttagcca

SEQ ID NO: 27597 - DNA, 22 bp, Artificial Sequence
  chemically synthesized
tgttttaaatctatttagccag

SEQ ID NO: 27598 - DNA, 22 bp, Artificial Sequence
  chemically synthesized
gttttaaatctatttagccagt

SEQ ID NO: 27599 - DNA, 22 bp, Artificial Sequence
  chemically synthesized
ttttaaatctatttagccagtc

SEQ ID NO: 27600 - DNA, 22 bp, Artificial Sequence
  chemically synthesized
taaatctatttagccagtctat

SEQ ID NO: 27601 - DNA, 22 bp, Artificial Sequence
  chemically synthesized
aaatctatttagccagtctata

SEQ ID NO: 27602 - DNA, 22 bp, Artificial Sequence
  chemically synthesized
aatctatttagccagtctatat

SEQ ID NO: 27603 - DNA, 22 bp, Artificial Sequence
  chemically synthesized
tttagccagtctatatctttca

SEQ ID NO: 27604 - DNA, 22 bp, Artificial Sequence
  chemically synthesized
agccagtctatatctttcaagt

SEQ ID NO: 27605 - DNA, 22 bp, Artificial Sequence
  chemically synthesized
gccagtctatatctttcaagta

SEQ ID NO: 27606 - DNA, 22 bp, Artificial Sequence
  chemically synthesized
tatctttcaagtaacaatttaa

SEQ ID NO: 27607 - DNA, 22 bp, Artificial Sequence
  chemically synthesized
tcaagtaacaatttaatccatt

SEQ ID NO: 27608 - DNA, 22 bp, Artificial Sequence
  chemically synthesized
caagtaacaatttaatccattt

SEQ ID NO: 27609 - DNA, 22 bp, Artificial Sequence
  chemically synthesized
aagtaacaatttaatccattta

SEQ ID NO: 27610 - DNA, 22 bp, Artificial Sequence
  chemically synthesized
aatccatttacatgcaaggcta

SEQ ID NO: 27611 - DNA, 22 bp, Artificial Sequence
  chemically synthesized
atccatttacatgcaaggctat

SEQ ID NO: 27612 - DNA, 22 bp, Artificial Sequence
  chemically synthesized
acatgcaaggctattattgaca

SEQ ID NO: 27613 - DNA, 22 bp, Artificial Sequence
  chemically synthesized
catgcaaggctattattgacat

SEQ ID NO: 27614 - DNA, 22 bp, Artificial Sequence
  chemically synthesized
ttattgacatgtgagagcttat

SEQ ID NO: 27615 - DNA, 22 bp, Artificial Sequence
  chemically synthesized
ttgacatgtgagagcttattcc

SEQ ID NO: 27616 - DNA, 22 bp, Artificial Sequence
  chemically synthesized
acatgtgagagcttattcctgc

SEQ ID NO: 27617 - DNA, 22 bp, Artificial Sequence
  chemically synthesized
attcctgccattttgttaattg

SEQ ID NO: 27618 - DNA, 22 bp, Artificial Sequence
  chemically synthesized
ttcctgccattttgttaattga

SEQ ID NO: 27619 - DNA, 22 bp, Artificial Sequence
  chemically synthesized
ctgccattttgttaattgattc

SEQ ID NO: 27620 - DNA, 22 bp, Artificial Sequence
  chemically synthesized
ccattttgttaattgattcctg

SEQ ID NO: 27621 - DNA, 22 bp, Artificial Sequence
  chemically synthesized
tgttaattgattcctggttgtt

SEQ ID NO: 27622 - DNA, 22 bp, Artificial Sequence
  chemically synthesized
gttaattgattcctggttgttt

SEQ ID NO: 27623 - DNA, 22 bp, Artificial Sequence
  chemically synthesized
ttaattgattcctggttgtttt

SEQ ID NO: 27624 - DNA, 22 bp, Artificial Sequence
  chemically synthesized
attgattcctggttgttttgtt

SEQ ID NO: 27625 - DNA, 22 bp, Artificial Sequence
  chemically synthesized
attcctggttgttttgtttttt

SEQ ID NO: 27626 - DNA, 22 bp, Artificial Sequence
  chemically synthesized
ctggttgttttgtttttttttt

SEQ ID NO: 27627 - DNA, 22 bp, Artificial Sequence
  chemically synthesized
gttgttttgttttttttttagt

SEQ ID NO: 27628 - DNA, 22 bp, Artificial Sequence
  chemically synthesized
ttttgttttttttttagtttgt

SEQ ID NO: 27629 - DNA, 22 bp, Artificial Sequence
  chemically synthesized
tgttttttttttagtttgtttg

SEQ ID NO: 27630 - DNA, 22 bp, Artificial Sequence
  chemically synthesized
gttttttttttagtttgtttgt

SEQ ID NO: 27631 - DNA, 22 bp, Artificial Sequence
  chemically synthesized
ttttttttttagtttgtttgtt

SEQ ID NO: 27632 - DNA, 22 bp, Artificial Sequence
  chemically synthesized
tttttttagtttgtttgttttg

SEQ ID NO: 27633 - DNA, 22 bp, Artificial Sequence
  chemically synthesized
ttttttagtttgtttgttttgt

SEQ ID NO: 27634 - DNA, 22 bp, Artificial Sequence
  chemically synthesized
tttttagtttgtttgttttgtg

SEQ ID NO: 27635 - DNA, 22 bp, Artificial Sequence
  chemically synthesized
ttttagtttgtttgttttgtgt

SEQ ID NO: 27636 - DNA, 22 bp, Artificial Sequence
  chemically synthesized
tttagtttgtttgttttgtgtt

SEQ ID NO: 27637 - DNA, 22 bp, Artificial Sequence
  chemically synthesized
ttagtttgtttgttttgtgttt

SEQ ID NO: 27638 - DNA, 22 bp, Artificial Sequence
  chemically synthesized
tagtttgtttgttttgtgtttt

SEQ ID NO: 27639 - DNA, 22 bp, Artificial Sequence
  chemically synthesized
agtttgtttgttttgtgttttt

SEQ ID NO: 27640 - DNA, 22 bp, Artificial Sequence
  chemically synthesized
gtttgtttgttttgtgtttttt

SEQ ID NO: 27641 - DNA, 22 bp, Artificial Sequence
  chemically synthesized
gtttgttttgtgtttttttctt

SEQ ID NO: 27642 - DNA, 22 bp, Artificial Sequence
  chemically synthesized
tttgttttgtgtttttttcttc

SEQ ID NO: 27643 - DNA, 22 bp, Artificial Sequence
  chemically synthesized
gttttgtgtttttttcttcctt

SEQ ID NO: 27644 - DNA, 22 bp, Artificial Sequence
  chemically synthesized
ttttgtgtttttttcttccttc

SEQ ID NO: 27645 - DNA, 22 bp, Artificial Sequence
  chemically synthesized
tgtgtttttttcttccttcctt

SEQ ID NO: 27646 - DNA, 22 bp, Artificial Sequence
  chemically synthesized
gtgtttttttcttccttccttc

SEQ ID NO: 27647 - DNA, 22 bp, Artificial Sequence
  chemically synthesized
tgtttttttcttccttccttcc

SEQ ID NO: 27648 - DNA, 22 bp, Artificial Sequence
  chemically synthesized
ttttcttccttccttccttttc

SEQ ID NO: 27649 - DNA, 22 bp, Artificial Sequence
  chemically synthesized
tttcttccttccttccttttct

SEQ ID NO: 27650 - DNA, 22 bp, Artificial Sequence
  chemically synthesized
ttcttccttccttccttttctt

SEQ ID NO: 27651 - DNA, 22 bp, Artificial Sequence
  chemically synthesized
tcttccttccttccttttcttt

SEQ ID NO: 27652 - DNA, 22 bp, Artificial Sequence
  chemically synthesized
cttccttccttccttttctttc

SEQ ID NO: 27653 - DNA, 22 bp, Artificial Sequence
  chemically synthesized
ttccttccttccttttctttct

SEQ ID NO: 27654 - DNA, 22 bp, Artificial Sequence
  chemically synthesized
ccttccttccttttctttcttt

SEQ ID NO: 27655 - DNA, 22 bp, Artificial Sequence
  chemically synthesized
cttccttccttttctttctttc

SEQ ID NO: 27656 - DNA, 22 bp, Artificial Sequence
  chemically synthesized
ccttccttttctttctttcatt

SEQ ID NO: 27657 - DNA, 22 bp, Artificial Sequence
  chemically synthesized
cttccttttctttctttcattc

SEQ ID NO: 27658 - DNA, 22 bp, Artificial Sequence
  chemically synthesized
ccttttctttctttcattctct

SEQ ID NO: 27659 - DNA, 22 bp, Artificial Sequence
  chemically synthesized
cttttctttctttcattctctc

SEQ ID NO: 27660 - DNA, 22 bp, Artificial Sequence
  chemically synthesized
ttctttctttcattctctctct

SEQ ID NO: 27661 - DNA, 22 bp, Artificial Sequence
  chemically synthesized
tctttctttcattctctctctc

SEQ ID NO: 27662 - DNA, 22 bp, Artificial Sequence
  chemically synthesized
ctttctttcattctctctctct

SEQ ID NO: 27663 - DNA, 22 bp, Artificial Sequence
  chemically synthesized
tttctttcattctctctctctc

SEQ ID NO: 27664 - DNA, 22 bp, Artificial Sequence
  chemically synthesized
tctttcattctctctctctctc

SEQ ID NO: 27665 - DNA, 22 bp, Artificial Sequence
  chemically synthesized
ctttcattctctctctctctct

SEQ ID NO: 27666 - DNA, 22 bp, Artificial Sequence
  chemically synthesized
tttcattctctctctctctctc

SEQ ID NO: 27667 - DNA, 22 bp, Artificial Sequence
  chemically synthesized
tcattctctctctctctctctt

SEQ ID NO: 27668 - DNA, 22 bp, Artificial Sequence
  chemically synthesized
cattctctctctctctctcttt

SEQ ID NO: 27669 - DNA, 22 bp, Artificial Sequence
  chemically synthesized
attctctctctctctctctttc

SEQ ID NO: 27670 - DNA, 22 bp, Artificial Sequence
  chemically synthesized
tctctctctctctctttctttc

SEQ ID NO: 27671 - DNA, 22 bp, Artificial Sequence
  chemically synthesized
tctctctctctctttctttctt

SEQ ID NO: 27672 - DNA, 22 bp, Artificial Sequence
  chemically synthesized
tctctctctctttctttctttc

SEQ ID NO: 27673 - DNA, 22 bp, Artificial Sequence
  chemically synthesized
tctctctctttctttctttctt

SEQ ID NO: 27674 - DNA, 22 bp, Artificial Sequence
  chemically synthesized
tctctctttctttctttctttc

SEQ ID NO: 27675 - DNA, 22 bp, Artificial Sequence
  chemically synthesized
tctctttctttctttctttctt

SEQ ID NO: 27676 - DNA, 22 bp, Artificial Sequence
  chemically synthesized
tctttctttctttctttctttc

SEQ ID NO: 27677 - DNA, 22 bp, Artificial Sequence
  chemically synthesized
tttctttctttctttctttctt

SEQ ID NO: 27678 - DNA, 22 bp, Artificial Sequence
  chemically synthesized
tctttctttctttctttcttat

SEQ ID NO: 27679 - DNA, 22 bp, Artificial Sequence
  chemically synthesized
ctttctttctttctttcttatt

SEQ ID NO: 27680 - DNA, 22 bp, Artificial Sequence
  chemically synthesized
tttctttctttctttcttatta

SEQ ID NO: 27681 - DNA, 22 bp, Artificial Sequence
  chemically synthesized
tctttctttctttcttattatt

SEQ ID NO: 27682 - DNA, 22 bp, Artificial Sequence
  chemically synthesized
ctttctttctttcttattattt

SEQ ID NO: 27683 - DNA, 22 bp, Artificial Sequence
  chemically synthesized
tttctttctttcttattattta

SEQ ID NO: 27684 - DNA, 22 bp, Artificial Sequence
  chemically synthesized
tctttctttcttattatttatg

SEQ ID NO: 27685 - DNA, 22 bp, Artificial Sequence
  chemically synthesized
ctttctttcttattatttatga

SEQ ID NO: 27686 - DNA, 22 bp, Artificial Sequence
  chemically synthesized
tttctttcttattatttatgat

SEQ ID NO: 27687 - DNA, 22 bp, Artificial Sequence
  chemically synthesized
tctttcttattatttatgattg

SEQ ID NO: 27688 - DNA, 22 bp, Artificial Sequence
  chemically synthesized
ctttcttattatttatgattgt

SEQ ID NO: 27689 - DNA, 22 bp, Artificial Sequence
  chemically synthesized
tttcttattatttatgattgtg

SEQ ID NO: 27690 - DNA, 22 bp, Artificial Sequence
  chemically synthesized
tcttattatttatgattgtggt

SEQ ID NO: 27691 - DNA, 22 bp, Artificial Sequence
  chemically synthesized
cttattatttatgattgtggtt

SEQ ID NO: 27692 - DNA, 22 bp, Artificial Sequence
  chemically synthesized
ttattatttatgattgtggttt

SEQ ID NO: 27693 - DNA, 22 bp, Artificial Sequence
  chemically synthesized
attatttatgattgtggtttgg

SEQ ID NO: 27694 - DNA, 22 bp, Artificial Sequence
  chemically synthesized
ttatttatgattgtggtttggt

SEQ ID NO: 27695 - DNA, 22 bp, Artificial Sequence
  chemically synthesized
tttatgattgtggtttggtgat

SEQ ID NO: 27696 - DNA, 22 bp, Artificial Sequence
  chemically synthesized
atgattgtggtttggtgatttt

SEQ ID NO: 27697 - DNA, 22 bp, Artificial Sequence
  chemically synthesized
tgattgtggtttggtgattttc

SEQ ID NO: 27698 - DNA, 22 bp, Artificial Sequence
  chemically synthesized
tggtttggtgattttctgtagt

SEQ ID NO: 27699 - DNA, 22 bp, Artificial Sequence
  chemically synthesized
ggtgattttctgtagtggtaac

SEQ ID NO: 27700 - DNA, 22 bp, Artificial Sequence
  chemically synthesized
gtgattttctgtagtggtaacg

SEQ ID NO: 27701 - DNA, 22 bp, Artificial Sequence
  chemically synthesized
tctgtagtggtaacgtttgagt

SEQ ID NO: 27702 - DNA, 22 bp, Artificial Sequence
  chemically synthesized
ctgtagtggtaacgtttgagtt

SEQ ID NO: 27703 - DNA, 22 bp, Artificial Sequence
  chemically synthesized
tgtagtggtaacgtttgagttc

SEQ ID NO: 27704 - DNA, 22 bp, Artificial Sequence
  chemically synthesized
tagtggtaacgtttgagttctt

SEQ ID NO: 27705 - DNA, 22 bp, Artificial Sequence
  chemically synthesized
gagttctttctcttctttattt

SEQ ID NO: 27706 - DNA, 22 bp, Artificial Sequence
  chemically synthesized
agttctttctcttctttatttg

SEQ ID NO: 27707 - DNA, 22 bp, Artificial Sequence
  chemically synthesized
tttctcttctttatttgtgttt

SEQ ID NO: 27708 - DNA, 22 bp, Artificial Sequence
  chemically synthesized
tctcttctttatttgtgttttg

SEQ ID NO: 27709 - DNA, 22 bp, Artificial Sequence
  chemically synthesized
ctcttctttatttgtgttttgc

SEQ ID NO: 27710 - DNA, 22 bp, Artificial Sequence
  chemically synthesized
tcttctttatttgtgttttgct

SEQ ID NO: 27711 - DNA, 22 bp, Artificial Sequence
  chemically synthesized
ttctttatttgtgttttgctct

SEQ ID NO: 27712 - DNA, 22 bp, Artificial Sequence
  chemically synthesized
ctttatttgtgttttgctctac

SEQ ID NO: 27713 - DNA, 22 bp, Artificial Sequence
  chemically synthesized
tttatttgtgttttgctctacc

SEQ ID NO: 27714 - DNA, 22 bp, Artificial Sequence
  chemically synthesized
tatttgtgttttgctctaccag

SEQ ID NO: 27715 - DNA, 22 bp, Artificial Sequence
  chemically synthesized
atttgtgttttgctctaccagt

SEQ ID NO: 27716 - DNA, 22 bp, Artificial Sequence
  chemically synthesized
tttgtgttttgctctaccagtt

SEQ ID NO: 27717 - DNA, 22 bp, Artificial Sequence
  chemically synthesized
gtgttttgctctaccagttagt

SEQ ID NO: 27718 - DNA, 22 bp, Artificial Sequence
  chemically synthesized
tgttttgctctaccagttagtt

SEQ ID NO: 27719 - DNA, 22 bp, Artificial Sequence
  chemically synthesized
tgctctaccagttagttgtata

SEQ ID NO: 27720 - DNA, 22 bp, Artificial Sequence
  chemically synthesized
gctctaccagttagttgtatac

SEQ ID NO: 27721 - DNA, 22 bp, Artificial Sequence
  chemically synthesized
ctctaccagttagttgtatacc

SEQ ID NO: 27722 - DNA, 22 bp, Artificial Sequence
  chemically synthesized
taccagttagttgtataccttt

SEQ ID NO: 27723 - DNA, 22 bp, Artificial Sequence
  chemically synthesized
ccagttagttgtatacctttgt

SEQ ID NO: 27724 - DNA, 22 bp, Artificial Sequence
  chemically synthesized
gttgtatacctttgtgtgtctt

SEQ ID NO: 27725 - DNA, 22 bp, Artificial Sequence
  chemically synthesized
tatacctttgtgtgtcttcata

SEQ ID NO: 27726 - DNA, 22 bp, Artificial Sequence
  chemically synthesized
tgtgtgtcttcataatggcagt

SEQ ID NO: 27727 - DNA, 22 bp, Artificial Sequence
  chemically synthesized
gtgtgtcttcataatggcagtg

SEQ ID NO: 27728 - DNA, 22 bp, Artificial Sequence
  chemically synthesized
tgtgtcttcataatggcagtgt

SEQ ID NO: 27729 - DNA, 22 bp, Artificial Sequence
  chemically synthesized
cataatggcagtgtcctgtcac

SEQ ID NO: 27730 - DNA, 22 bp, Artificial Sequence
  chemically synthesized
ataatggcagtgtcctgtcact

SEQ ID NO: 27731 - DNA, 22 bp, Artificial Sequence
  chemically synthesized
tcactttcatgtgtaggactcc

SEQ ID NO: 27732 - DNA, 22 bp, Artificial Sequence
  chemically synthesized
tcatgtgtaggactcccttaaa

SEQ ID NO: 27733 - DNA, 22 bp, Artificial Sequence
  chemically synthesized
catgtgtaggactcccttaaat

SEQ ID NO: 27734 - DNA, 22 bp, Artificial Sequence
  chemically synthesized
atgtgtaggactcccttaaata

SEQ ID NO: 27735 - DNA, 22 bp, Artificial Sequence
  chemically synthesized
ccttaaatatttcttgtaaagc

SEQ ID NO: 27736 - DNA, 22 bp, Artificial Sequence
  chemically synthesized
aaatatttcttgtaaagccagt

SEQ ID NO: 27737 - DNA, 22 bp, Artificial Sequence
  chemically synthesized
aatatttcttgtaaagccagtc

SEQ ID NO: 27738 - DNA, 22 bp, Artificial Sequence
  chemically synthesized
cttgtaaagccagtctagtgat

SEQ ID NO: 27739 - DNA, 22 bp, Artificial Sequence
  chemically synthesized
ttgtaaagccagtctagtgata

SEQ ID NO: 27740 - DNA, 22 bp, Artificial Sequence
  chemically synthesized
gtaaagccagtctagtgatagt

SEQ ID NO: 27741 - DNA, 22 bp, Artificial Sequence
  chemically synthesized
taaagccagtctagtgatagtg

SEQ ID NO: 27742 - DNA, 22 bp, Artificial Sequence
  chemically synthesized
gtgatagtgaattccttcaaat

SEQ ID NO: 27743 - DNA, 22 bp, Artificial Sequence
  chemically synthesized
cttcaaatttttcttgcccaga

SEQ ID NO: 27744 - DNA, 22 bp, Artificial Sequence
  chemically synthesized
caaatttttcttgcccagaaaa

SEQ ID NO: 27745 - DNA, 22 bp, Artificial Sequence
  chemically synthesized
aaatttttcttgcccagaaaag

SEQ ID NO: 27746 - DNA, 22 bp, Artificial Sequence
  chemically synthesized
ttcttgcccagaaaagatttta

SEQ ID NO: 27747 - DNA, 22 bp, Artificial Sequence
  chemically synthesized
tcttgcccagaaaagattttat

SEQ ID NO: 27748 - DNA, 22 bp, Artificial Sequence
  chemically synthesized
cttgcccagaaaagattttatt

SEQ ID NO: 27749 - DNA, 22 bp, Artificial Sequence
  chemically synthesized
ttgcccagaaaagattttattt

SEQ ID NO: 27750 - DNA, 22 bp, Artificial Sequence
  chemically synthesized
gcccagaaaagattttatttat

SEQ ID NO: 27751 - DNA, 22 bp, Artificial Sequence
  chemically synthesized
cccagaaaagattttatttatc

SEQ ID NO: 27752 - DNA, 22 bp, Artificial Sequence
  chemically synthesized
tatttatccttcatttttgaag

SEQ ID NO: 27753 - DNA, 22 bp, Artificial Sequence
  chemically synthesized
atttatccttcatttttgaaga

SEQ ID NO: 27754 - DNA, 22 bp, Artificial Sequence
  chemically synthesized
tttatccttcatttttgaagaa

SEQ ID NO: 27755 - DNA, 22 bp, Artificial Sequence
  chemically synthesized
atccttcatttttgaagaacaa

SEQ ID NO: 27756 - DNA, 22 bp, Artificial Sequence
  chemically synthesized
tccttcatttttgaagaacaat

SEQ ID NO: 27757 - DNA, 22 bp, Artificial Sequence
  chemically synthesized
catttttgaagaacaatgttgc

SEQ ID NO: 27758 - DNA, 22 bp, Artificial Sequence
  chemically synthesized
atttttgaagaacaatgttgct

SEQ ID NO: 27759 - DNA, 22 bp, Artificial Sequence
  chemically synthesized
ttgaagaacaatgttgctgggt

SEQ ID NO: 27760 - DNA, 22 bp, Artificial Sequence
  chemically synthesized
tgaagaacaatgttgctgggta

SEQ ID NO: 27761 - DNA, 22 bp, Artificial Sequence
  chemically synthesized
gaagaacaatgttgctgggtat

SEQ ID NO: 27762 - DNA, 22 bp, Artificial Sequence
  chemically synthesized
aagaacaatgttgctgggtata

SEQ ID NO: 27763 - DNA, 22 bp, Artificial Sequence
  chemically synthesized
ctgggtataacatccttggtgt

SEQ ID NO: 27764 - DNA, 22 bp, Artificial Sequence
  chemically synthesized
ggtataacatccttggtgtcat

SEQ ID NO: 27765 - DNA, 22 bp, Artificial Sequence
  chemically synthesized
ggtgtcatttttttctttcact

SEQ ID NO: 27766 - DNA, 22 bp, Artificial Sequence
  chemically synthesized
gtgtcatttttttctttcacta

SEQ ID NO: 27767 - DNA, 22 bp, Artificial Sequence
  chemically synthesized
ttttctttcactattttgaata

SEQ ID NO: 27768 - DNA, 22 bp, Artificial Sequence
  chemically synthesized
tttctttcactattttgaatat

SEQ ID NO: 27769 - DNA, 22 bp, Artificial Sequence
  chemically synthesized
ttctttcactattttgaatata

SEQ ID NO: 27770 - DNA, 22 bp, Artificial Sequence
  chemically synthesized
tctttcactattttgaatatat

SEQ ID NO: 27771 - DNA, 22 bp, Artificial Sequence
  chemically synthesized
ctttcactattttgaatatatc

SEQ ID NO: 27772 - DNA, 22 bp, Artificial Sequence
  chemically synthesized
tttcactattttgaatatatca

SEQ ID NO: 27773 - DNA, 22 bp, Artificial Sequence
  chemically synthesized
tcactattttgaatatatcatc

SEQ ID NO: 27774 - DNA, 22 bp, Artificial Sequence
  chemically synthesized
cactattttgaatatatcatcc

SEQ ID NO: 27775 - DNA, 22 bp, Artificial Sequence
  chemically synthesized
actattttgaatatatcatccc

SEQ ID NO: 27776 - DNA, 22 bp, Artificial Sequence
  chemically synthesized
ttttgaatatatcatcccatct

SEQ ID NO: 27777 - DNA, 22 bp, Artificial Sequence
  chemically synthesized
tgaatatatcatcccatcttct

SEQ ID NO: 27778 - DNA, 22 bp, Artificial Sequence
  chemically synthesized
gaatatatcatcccatcttctc

SEQ ID NO: 27779 - DNA, 22 bp, Artificial Sequence
  chemically synthesized
aatatatcatcccatcttctcc

SEQ ID NO: 27780 - DNA, 22 bp, Artificial Sequence
  chemically synthesized
ctcctggcctgtgaggtttctg

SEQ ID NO: 27781 - DNA, 22 bp, Artificial Sequence
  chemically synthesized
tcctggcctgtgaggtttctgc

SEQ ID NO: 27782 - DNA, 22 bp, Artificial Sequence
  chemically synthesized
ctggcctgtgaggtttctgctg

SEQ ID NO: 27783 - DNA, 22 bp, Artificial Sequence
  chemically synthesized
gcctgtgaggtttctgctgaga

SEQ ID NO: 27784 - DNA, 22 bp, Artificial Sequence
  chemically synthesized
tgaggtttctgctgagaaatct

SEQ ID NO: 27785 - DNA, 22 bp, Artificial Sequence
  chemically synthesized
ctgctgagaaatctgctgttaa

SEQ ID NO: 27786 - DNA, 22 bp, Artificial Sequence
  chemically synthesized
tgctgagaaatctgctgttaat

SEQ ID NO: 27787 - DNA, 22 bp, Artificial Sequence
  chemically synthesized
ctgagaaatctgctgttaatct

SEQ ID NO: 27788 - DNA, 22 bp, Artificial Sequence
  chemically synthesized
agaaatctgctgttaatctgtt

SEQ ID NO: 27789 - DNA, 22 bp, Artificial Sequence
  chemically synthesized
ctgttaatctgttaatcttgtg

SEQ ID NO: 27790 - DNA, 22 bp, Artificial Sequence
  chemically synthesized
ttaatctgttaatcttgtggaa

SEQ ID NO: 27791 - DNA, 22 bp, Artificial Sequence
  chemically synthesized
atctgttaatcttgtggaagtt

SEQ ID NO: 27792 - DNA, 22 bp, Artificial Sequence
  chemically synthesized
ttaatcttgtggaagttccctt

SEQ ID NO: 27793 - DNA, 22 bp, Artificial Sequence
  chemically synthesized
atcttgtggaagttcccttata

SEQ ID NO: 27794 - DNA, 22 bp, Artificial Sequence
  chemically synthesized
gtggaagttcccttataagtga

SEQ ID NO: 27795 - DNA, 22 bp, Artificial Sequence
  chemically synthesized
tggaagttcccttataagtgac

SEQ ID NO: 27796 - DNA, 22 bp, Artificial Sequence
  chemically synthesized
ccttataagtgactagacattt

SEQ ID NO: 27797 - DNA, 22 bp, Artificial Sequence
  chemically synthesized
ataagtgactagacattttgct

SEQ ID NO: 27798 - DNA, 22 bp, Artificial Sequence
  chemically synthesized
taagtgactagacattttgctt

SEQ ID NO: 27799 - DNA, 22 bp, Artificial Sequence
  chemically synthesized
gacattttgcttgctgttttag

SEQ ID NO: 27800 - DNA, 22 bp, Artificial Sequence
  chemically synthesized
tgcttgctgttttagagttctt

SEQ ID NO: 27801 - DNA, 22 bp, Artificial Sequence
  chemically synthesized
gcttgctgttttagagttctta

SEQ ID NO: 27802 - DNA, 22 bp, Artificial Sequence
  chemically synthesized
cttgctgttttagagttcttac

SEQ ID NO: 27803 - DNA, 22 bp, Artificial Sequence
  chemically synthesized
gctgttttagagttcttactct

SEQ ID NO: 27804 - DNA, 22 bp, Artificial Sequence
  chemically synthesized
ctgttttagagttcttactctt

SEQ ID NO: 27805 - DNA, 22 bp, Artificial Sequence
  chemically synthesized
ttttagagttcttactctttgg

SEQ ID NO: 27806 - DNA, 22 bp, Artificial Sequence
  chemically synthesized
tagagttcttactctttggctt

SEQ ID NO: 27807 - DNA, 22 bp, Artificial Sequence
  chemically synthesized
agagttcttactctttggcttt

SEQ ID NO: 27808 - DNA, 22 bp, Artificial Sequence
  chemically synthesized
gagttcttactctttggctttt

SEQ ID NO: 27809 - DNA, 22 bp, Artificial Sequence
  chemically synthesized
ttactctttggcttttgacagt

SEQ ID NO: 27810 - DNA, 22 bp, Artificial Sequence
  chemically synthesized
actctttggcttttgacagttt

SEQ ID NO: 27811 - DNA, 22 bp, Artificial Sequence
  chemically synthesized
ctctttggcttttgacagtttg

SEQ ID NO: 27812 - DNA, 22 bp, Artificial Sequence
  chemically synthesized
tttggcttttgacagtttgact

SEQ ID NO: 27813 - DNA, 22 bp, Artificial Sequence
  chemically synthesized
tggcttttgacagtttgactat

SEQ ID NO: 27814 - DNA, 22 bp, Artificial Sequence
  chemically synthesized
ggcttttgacagtttgactata

SEQ ID NO: 27815 - DNA, 22 bp, Artificial Sequence
  chemically synthesized
gcttttgacagtttgactataa

SEQ ID NO: 27816 - DNA, 22 bp, Artificial Sequence
  chemically synthesized
ttgacagtttgactataatgtg

SEQ ID NO: 27817 - DNA, 22 bp, Artificial Sequence
  chemically synthesized
tgacagtttgactataatgtgc

SEQ ID NO: 27818 - DNA, 22 bp, Artificial Sequence
  chemically synthesized
gacagtttgactataatgtgct

SEQ ID NO: 27819 - DNA, 22 bp, Artificial Sequence
  chemically synthesized
acagtttgactataatgtgctg

SEQ ID NO: 27820 - DNA, 22 bp, Artificial Sequence
  chemically synthesized
gactataatgtgctgtggagaa

SEQ ID NO: 27821 - DNA, 22 bp, Artificial Sequence
  chemically synthesized
actataatgtgctgtggagaag

SEQ ID NO: 27822 - DNA, 22 bp, Artificial Sequence
  chemically synthesized
taatgtgctgtggagaagagct

SEQ ID NO: 27823 - DNA, 22 bp, Artificial Sequence
  chemically synthesized
tggagaagagctttttgcatta

SEQ ID NO: 27824 - DNA, 22 bp, Artificial Sequence
  chemically synthesized
tttgcattatattatttgggaa

SEQ ID NO: 27825 - DNA, 22 bp, Artificial Sequence
  chemically synthesized
ttgcattatattatttgggaat

SEQ ID NO: 27826 - DNA, 22 bp, Artificial Sequence
  chemically synthesized
tgcattatattatttgggaatt

SEQ ID NO: 27827 - DNA, 22 bp, Artificial Sequence
  chemically synthesized
gcattatattatttgggaattt

SEQ ID NO: 27828 - DNA, 22 bp, Artificial Sequence
  chemically synthesized
cattatattatttgggaatttc

SEQ ID NO: 27829 - DNA, 22 bp, Artificial Sequence
  chemically synthesized
tattatttgggaatttctgatt

SEQ ID NO: 27830 - DNA, 22 bp, Artificial Sequence
  chemically synthesized
tttgggaatttctgattttcat

SEQ ID NO: 27831 - DNA, 22 bp, Artificial Sequence
  chemically synthesized
gggaatttctgattttcatttg

SEQ ID NO: 27832 - DNA, 22 bp, Artificial Sequence
  chemically synthesized
ggaatttctgattttcatttgt

SEQ ID NO: 27833 - DNA, 22 bp, Artificial Sequence
  chemically synthesized
ctgattttcatttgtctggatg

SEQ ID NO: 27834 - DNA, 22 bp, Artificial Sequence
  chemically synthesized
tgattttcatttgtctggatgt

SEQ ID NO: 27835 - DNA, 22 bp, Artificial Sequence
  chemically synthesized
attttcatttgtctggatgtct

SEQ ID NO: 27836 - DNA, 22 bp, Artificial Sequence
  chemically synthesized
tcatttgtctggatgtctacat

SEQ ID NO: 27837 - DNA, 22 bp, Artificial Sequence
  chemically synthesized
catttgtctggatgtctacatt

SEQ ID NO: 27838 - DNA, 22 bp, Artificial Sequence
  chemically synthesized
atttgtctggatgtctacattt

SEQ ID NO: 27839 - DNA, 22 bp, Artificial Sequence
  chemically synthesized
gtctggatgtctacatttcttg

SEQ ID NO: 27840 - DNA, 22 bp, Artificial Sequence
  chemically synthesized
tctggatgtctacatttcttgc

SEQ ID NO: 27841 - DNA, 22 bp, Artificial Sequence
  chemically synthesized
gatgtctacatttcttgctaga

SEQ ID NO: 27842 - DNA, 22 bp, Artificial Sequence
  chemically synthesized
catttcttgctagacttgacaa

SEQ ID NO: 27843 - DNA, 22 bp, Artificial Sequence
  chemically synthesized
cttgctagacttgacaagtttt

SEQ ID NO: 27844 - DNA, 22 bp, Artificial Sequence
  chemically synthesized
ttgctagacttgacaagttttc

SEQ ID NO: 27845 - DNA, 22 bp, Artificial Sequence
  chemically synthesized
gctagacttgacaagttttcag

SEQ ID NO: 27846 - DNA, 22 bp, Artificial Sequence
  chemically synthesized
ctagacttgacaagttttcagc

SEQ ID NO: 27847 - DNA, 22 bp, Artificial Sequence
  chemically synthesized
gacttgacaagttttcagctat

SEQ ID NO: 27848 - DNA, 22 bp, Artificial Sequence
  chemically synthesized
gacaagttttcagctattgtgt

SEQ ID NO: 27849 - DNA, 22 bp, Artificial Sequence
  chemically synthesized
acaagttttcagctattgtgtt

SEQ ID NO: 27850 - DNA, 22 bp, Artificial Sequence
  chemically synthesized
tcagctattgtgttgttacgta

SEQ ID NO: 27851 - DNA, 22 bp, Artificial Sequence
  chemically synthesized
cagctattgtgttgttacgtag

SEQ ID NO: 27852 - DNA, 22 bp, Artificial Sequence
  chemically synthesized
agctattgtgttgttacgtagg

SEQ ID NO: 27853 - DNA, 22 bp, Artificial Sequence
  chemically synthesized
ttgtgttgttacgtaggtttcc

SEQ ID NO: 27854 - DNA, 22 bp, Artificial Sequence
  chemically synthesized
tgttgttacgtaggtttcctac

SEQ ID NO: 27855 - DNA, 22 bp, Artificial Sequence
  chemically synthesized
ttacgtaggtttcctacacctt

SEQ ID NO: 27856 - DNA, 22 bp, Artificial Sequence
  chemically synthesized
cgtaggtttcctacacctttca

SEQ ID NO: 27857 - DNA, 22 bp, Artificial Sequence
  chemically synthesized
cctacacctttcatgttctctt

SEQ ID NO: 27858 - DNA, 22 bp, Artificial Sequence
  chemically synthesized
ctacacctttcatgttctcttt

SEQ ID NO: 27859 - DNA, 22 bp, Artificial Sequence
  chemically synthesized
cacctttcatgttctctttacc

SEQ ID NO: 27860 - DNA, 22 bp, Artificial Sequence
  chemically synthesized
tcatgttctctttaccttctgg

SEQ ID NO: 27861 - DNA, 22 bp, Artificial Sequence
  chemically synthesized
catgttctctttaccttctggg

SEQ ID NO: 27862 - DNA, 22 bp, Artificial Sequence
  chemically synthesized
atgttctctttaccttctggga

SEQ ID NO: 27863 - DNA, 22 bp, Artificial Sequence
  chemically synthesized
tctttaccttctgggaaactgc

SEQ ID NO: 27864 - DNA, 22 bp, Artificial Sequence
  chemically synthesized
tttaccttctgggaaactgcaa

SEQ ID NO: 27865 - DNA, 22 bp, Artificial Sequence
  chemically synthesized
taccttctgggaaactgcaaat

SEQ ID NO: 27866 - DNA, 22 bp, Artificial Sequence
  chemically synthesized
accttctgggaaactgcaaatt

SEQ ID NO: 27867 - DNA, 22 bp, Artificial Sequence
  chemically synthesized
ccttctgggaaactgcaaattt

SEQ ID NO: 27868 - DNA, 22 bp, Artificial Sequence
  chemically synthesized
ctgggaaactgcaaatttgaat

SEQ ID NO: 27869 - DNA, 22 bp, Artificial Sequence
  chemically synthesized
tgggaaactgcaaatttgaata

SEQ ID NO: 27870 - DNA, 22 bp, Artificial Sequence
  chemically synthesized
ggaaactgcaaatttgaatatt

SEQ ID NO: 27871 - DNA, 22 bp, Artificial Sequence
  chemically synthesized
caaatttgaatatttgttcact

SEQ ID NO: 27872 - DNA, 22 bp, Artificial Sequence
  chemically synthesized
gaatatttgttcactttatagt

SEQ ID NO: 27873 - DNA, 22 bp, Artificial Sequence
  chemically synthesized
aatatttgttcactttatagtg

SEQ ID NO: 27874 - DNA, 22 bp, Artificial Sequence
  chemically synthesized
gttcactttatagtgcctcata

SEQ ID NO: 27875 - DNA, 22 bp, Artificial Sequence
  chemically synthesized
ttcactttatagtgcctcatat

SEQ ID NO: 27876 - DNA, 22 bp, Artificial Sequence
  chemically synthesized
actttatagtgcctcatatgtc

SEQ ID NO: 27877 - DNA, 22 bp, Artificial Sequence
  chemically synthesized
tatagtgcctcatatgtcacat

SEQ ID NO: 27878 - DNA, 22 bp, Artificial Sequence
  chemically synthesized
atagtgcctcatatgtcacata

SEQ ID NO: 27879 - DNA, 22 bp, Artificial Sequence
  chemically synthesized
tagtgcctcatatgtcacatac

SEQ ID NO: 27880 - DNA, 22 bp, Artificial Sequence
  chemically synthesized
atatgtcacatacactttgttc

SEQ ID NO: 27881 - DNA, 22 bp, Artificial Sequence
  chemically synthesized
tgttcattctttttttttcctt

SEQ ID NO: 27882 - DNA, 22 bp, Artificial Sequence
  chemically synthesized
gttcattctttttttttccttt

SEQ ID NO: 27883 - DNA, 22 bp, Artificial Sequence
  chemically synthesized
ttcattctttttttttcctttc

SEQ ID NO: 27884 - DNA, 22 bp, Artificial Sequence
  chemically synthesized
attctttttttttcctttctat

SEQ ID NO: 27885 - DNA, 22 bp, Artificial Sequence
  chemically synthesized
tttttttttcctttctatcatt

SEQ ID NO: 27886 - DNA, 22 bp, Artificial Sequence
  chemically synthesized
tttttttcctttctatcatttg

SEQ ID NO: 27887 - DNA, 22 bp, Artificial Sequence
  chemically synthesized
ttttttcctttctatcatttga

SEQ ID NO: 27888 - DNA, 22 bp, Artificial Sequence
  chemically synthesized
tttttcctttctatcatttgac

SEQ ID NO: 27889 - DNA, 22 bp, Artificial Sequence
  chemically synthesized
ttttcctttctatcatttgacc

SEQ ID NO: 27890 - DNA, 22 bp, Artificial Sequence
  chemically synthesized
tttcctttctatcatttgacca

SEQ ID NO: 27891 - DNA, 22 bp, Artificial Sequence
  chemically synthesized
ttcctttctatcatttgaccag

SEQ ID NO: 27892 - DNA, 22 bp, Artificial Sequence
  chemically synthesized
tcctttctatcatttgaccagc

SEQ ID NO: 27893 - DNA, 22 bp, Artificial Sequence
  chemically synthesized
cctttctatcatttgaccagct

SEQ ID NO: 27894 - DNA, 22 bp, Artificial Sequence
  chemically synthesized
ctttctatcatttgaccagcta

SEQ ID NO: 27895 - DNA, 22 bp, Artificial Sequence
  chemically synthesized
tctatcatttgaccagctaatt

SEQ ID NO: 27896 - DNA, 22 bp, Artificial Sequence
  chemically synthesized
ctatcatttgaccagctaattt

SEQ ID NO: 27897 - DNA, 22 bp, Artificial Sequence
  chemically synthesized
tatcatttgaccagctaatttt

SEQ ID NO: 27898 - DNA, 22 bp, Artificial Sequence
  chemically synthesized
tcatttgaccagctaattttaa

SEQ ID NO: 27899 - DNA, 22 bp, Artificial Sequence
  chemically synthesized
gaccagctaattttaaaagacc

SEQ ID NO: 27900 - DNA, 22 bp, Artificial Sequence
  chemically synthesized
accagctaattttaaaagacct

SEQ ID NO: 27901 - DNA, 22 bp, Artificial Sequence
  chemically synthesized
attttaaaagacctgtcttcaa

SEQ ID NO: 27902 - DNA, 22 bp, Artificial Sequence
  chemically synthesized
taaaagacctgtcttcaagttc

SEQ ID NO: 27903 - DNA, 22 bp, Artificial Sequence
  chemically synthesized
aaaagacctgtcttcaagttct

SEQ ID NO: 27904 - DNA, 22 bp, Artificial Sequence
  chemically synthesized
aaagacctgtcttcaagttctg

SEQ ID NO: 27905 - DNA, 22 bp, Artificial Sequence
  chemically synthesized
tcttcaagttctgaaatttttc

SEQ ID NO: 27906 - DNA, 22 bp, Artificial Sequence
  chemically synthesized
caagttctgaaatttttcttct

SEQ ID NO: 27907 - DNA, 22 bp, Artificial Sequence
  chemically synthesized
aagttctgaaatttttcttctg

SEQ ID NO: 27908 - DNA, 22 bp, Artificial Sequence
  chemically synthesized
tgaaatttttcttctgcttgat

SEQ ID NO: 27909 - DNA, 22 bp, Artificial Sequence
  chemically synthesized
aaatttttcttctgcttgatct

SEQ ID NO: 27910 - DNA, 22 bp, Artificial Sequence
  chemically synthesized
ttcttctgcttgatctgatcta

SEQ ID NO: 27911 - DNA, 22 bp, Artificial Sequence
  chemically synthesized
tcttctgcttgatctgatctat

SEQ ID NO: 27912 - DNA, 22 bp, Artificial Sequence
  chemically synthesized
cttctgcttgatctgatctatt

SEQ ID NO: 27913 - DNA, 22 bp, Artificial Sequence
  chemically synthesized
ttctgcttgatctgatctattg

SEQ ID NO: 27914 - DNA, 22 bp, Artificial Sequence
  chemically synthesized
ctgcttgatctgatctattgtt

SEQ ID NO: 27915 - DNA, 22 bp, Artificial Sequence
  chemically synthesized
tgcttgatctgatctattgttg

SEQ ID NO: 27916 - DNA, 22 bp, Artificial Sequence
  chemically synthesized
cttgatctgatctattgttgaa

SEQ ID NO: 27917 - DNA, 22 bp, Artificial Sequence
  chemically synthesized
gatctgatctattgttgaagtt

SEQ ID NO: 27918 - DNA, 22 bp, Artificial Sequence
  chemically synthesized
atctgatctattgttgaagttt

SEQ ID NO: 27919 - DNA, 22 bp, Artificial Sequence
  chemically synthesized
atctattgttgaagtttttgaa

SEQ ID NO: 27920 - DNA, 22 bp, Artificial Sequence
  chemically synthesized
ttgttgaagtttttgaatgtat

SEQ ID NO: 27921 - DNA, 22 bp, Artificial Sequence
  chemically synthesized
ttgaagtttttgaatgtatttt

SEQ ID NO: 27922 - DNA, 22 bp, Artificial Sequence
  chemically synthesized
aagtttttgaatgtattttgta

SEQ ID NO: 27923 - DNA, 22 bp, Artificial Sequence
  chemically synthesized
ttgaatgtattttgtatttctt

SEQ ID NO: 27924 - DNA, 22 bp, Artificial Sequence
  chemically synthesized
tgaatgtattttgtatttcttt

SEQ ID NO: 27925 - DNA, 22 bp, Artificial Sequence
  chemically synthesized
gaatgtattttgtatttctttc

SEQ ID NO: 27926 - DNA, 22 bp, Artificial Sequence
  chemically synthesized
aatgtattttgtatttctttca

SEQ ID NO: 27927 - DNA, 22 bp, Artificial Sequence
  chemically synthesized
tgtatttctttcaataaactct

SEQ ID NO: 27928 - DNA, 22 bp, Artificial Sequence
  chemically synthesized
gtatttctttcaataaactctt

SEQ ID NO: 27929 - DNA, 22 bp, Artificial Sequence
  chemically synthesized
tatttctttcaataaactcttc

SEQ ID NO: 27930 - DNA, 22 bp, Artificial Sequence
  chemically synthesized
ctttcaataaactcttcagtta

SEQ ID NO: 27931 - DNA, 22 bp, Artificial Sequence
  chemically synthesized
tttcaataaactcttcagttac

SEQ ID NO: 27932 - DNA, 22 bp, Artificial Sequence
  chemically synthesized
tcaataaactcttcagttacag

SEQ ID NO: 27933 - DNA, 22 bp, Artificial Sequence
  chemically synthesized
caataaactcttcagttacaga

SEQ ID NO: 27934 - DNA, 22 bp, Artificial Sequence
  chemically synthesized
aataaactcttcagttacagaa

SEQ ID NO: 27935 - DNA, 22 bp, Artificial Sequence
  chemically synthesized
ttcagttacagaatttctgttt

SEQ ID NO: 27936 - DNA, 22 bp, Artificial Sequence
  chemically synthesized
cagttacagaatttctgtttgg

SEQ ID NO: 27937 - DNA, 22 bp, Artificial Sequence
  chemically synthesized
agttacagaatttctgtttggt

SEQ ID NO: 27938 - DNA, 22 bp, Artificial Sequence
  chemically synthesized
cagaatttctgtttggttcatt

SEQ ID NO: 27939 - DNA, 22 bp, Artificial Sequence
  chemically synthesized
ctgtttggttcattcttgttgt

SEQ ID NO: 27940 - DNA, 22 bp, Artificial Sequence
  chemically synthesized
tgtttggttcattcttgttgta

SEQ ID NO: 27941 - DNA, 22 bp, Artificial Sequence
  chemically synthesized
tttggttcattcttgttgtatc

SEQ ID NO: 27942 - DNA, 22 bp, Artificial Sequence
  chemically synthesized
ggttcattcttgttgtatctat

SEQ ID NO: 27943 - DNA, 22 bp, Artificial Sequence
  chemically synthesized
gttcattcttgttgtatctatc

SEQ ID NO: 27944 - DNA, 22 bp, Artificial Sequence
  chemically synthesized
attcttgttgtatctatctctt

SEQ ID NO: 27945 - DNA, 22 bp, Artificial Sequence
  chemically synthesized
ttgttgtatctatctcttgggt

SEQ ID NO: 27946 - DNA, 22 bp, Artificial Sequence
  chemically synthesized
gttgtatctatctcttgggtaa

SEQ ID NO: 27947 - DNA, 22 bp, Artificial Sequence
  chemically synthesized
ttgtatctatctcttgggtaaa

SEQ ID NO: 27948 - DNA, 22 bp, Artificial Sequence
  chemically synthesized
tatctatctcttgggtaaattt

SEQ ID NO: 27949 - DNA, 22 bp, Artificial Sequence
  chemically synthesized
tctcttgggtaaatttctcatt

SEQ ID NO: 27950 - DNA, 22 bp, Artificial Sequence
  chemically synthesized
ttgggtaaatttctcattcata

SEQ ID NO: 27951 - DNA, 22 bp, Artificial Sequence
  chemically synthesized
gggtaaatttctcattcatatc

SEQ ID NO: 27952 - DNA, 22 bp, Artificial Sequence
  chemically synthesized
ggtaaatttctcattcatatcc

SEQ ID NO: 27953 - DNA, 22 bp, Artificial Sequence
  chemically synthesized
ctcattcatatcctgaattgtt

SEQ ID NO: 27954 - DNA, 22 bp, Artificial Sequence
  chemically synthesized
tcattcatatcctgaattgttt

SEQ ID NO: 27955 - DNA, 22 bp, Artificial Sequence
  chemically synthesized
attcatatcctgaattgttttt

SEQ ID NO: 27956 - DNA, 22 bp, Artificial Sequence
  chemically synthesized
atatcctgaattgtttttctga

SEQ ID NO: 27957 - DNA, 22 bp, Artificial Sequence
  chemically synthesized
aattgtttttctgatttctttt

SEQ ID NO: 27958 - DNA, 22 bp, Artificial Sequence
  chemically synthesized
tttttctgatttctttttattg

SEQ ID NO: 27959 - DNA, 22 bp, Artificial Sequence
  chemically synthesized
ttctgatttctttttattgttt

SEQ ID NO: 27960 - DNA, 22 bp, Artificial Sequence
  chemically synthesized
tctgatttctttttattgttta

SEQ ID NO: 27961 - DNA, 22 bp, Artificial Sequence
  chemically synthesized
ctgatttctttttattgtttat

SEQ ID NO: 27962 - DNA, 22 bp, Artificial Sequence
  chemically synthesized
tgatttctttttattgtttatc

SEQ ID NO: 27963 - DNA, 22 bp, Artificial Sequence
  chemically synthesized
atttctttttattgtttatctg

SEQ ID NO: 27964 - DNA, 22 bp, Artificial Sequence
  chemically synthesized
ctttttattgtttatctgagtt

SEQ ID NO: 27965 - DNA, 22 bp, Artificial Sequence
  chemically synthesized
tttttattgtttatctgagttc

SEQ ID NO: 27966 - DNA, 22 bp, Artificial Sequence
  chemically synthesized
tttattgtttatctgagttctc

SEQ ID NO: 27967 - DNA, 22 bp, Artificial Sequence
  chemically synthesized
ttattgtttatctgagttctct

SEQ ID NO: 27968 - DNA, 22 bp, Artificial Sequence
  chemically synthesized
tattgtttatctgagttctctt

SEQ ID NO: 27969 - DNA, 22 bp, Artificial Sequence
  chemically synthesized
attgtttatctgagttctcttg

SEQ ID NO: 27970 - DNA, 22 bp, Artificial Sequence
  chemically synthesized
ttgtttatctgagttctcttgt

SEQ ID NO: 27971 - DNA, 22 bp, Artificial Sequence
  chemically synthesized
tttatctgagttctcttgtgtc

SEQ ID NO: 27972 - DNA, 22 bp, Artificial Sequence
  chemically synthesized
atctgagttctcttgtgtctca

SEQ ID NO: 27973 - DNA, 22 bp, Artificial Sequence
  chemically synthesized
tctgagttctcttgtgtctcac

SEQ ID NO: 27974 - DNA, 22 bp, Artificial Sequence
  chemically synthesized
agttctcttgtgtctcactgag

SEQ ID NO: 27975 - DNA, 22 bp, Artificial Sequence
  chemically synthesized
tcttgtgtctcactgagcttcc

SEQ ID NO: 27976 - DNA, 22 bp, Artificial Sequence
  chemically synthesized
ttgtgtctcactgagcttcctt

SEQ ID NO: 27977 - DNA, 22 bp, Artificial Sequence
  chemically synthesized
gtgtctcactgagcttccttaa

SEQ ID NO: 27978 - DNA, 22 bp, Artificial Sequence
  chemically synthesized
tgtctcactgagcttccttaat

SEQ ID NO: 27979 - DNA, 22 bp, Artificial Sequence
  chemically synthesized
actgagcttccttaatatcaac

SEQ ID NO: 27980 - DNA, 22 bp, Artificial Sequence
  chemically synthesized
agcttccttaatatcaacattt

SEQ ID NO: 27981 - DNA, 22 bp, Artificial Sequence
  chemically synthesized
ccttaatatcaacattttggat

SEQ ID NO: 27982 - DNA, 22 bp, Artificial Sequence
  chemically synthesized
cttaatatcaacattttggatt

SEQ ID NO: 27983 - DNA, 22 bp, Artificial Sequence
  chemically synthesized
aatatcaacattttggattctt

SEQ ID NO: 27984 - DNA, 22 bp, Artificial Sequence
  chemically synthesized
atatcaacattttggattcttt

SEQ ID NO: 27985 - DNA, 22 bp, Artificial Sequence
  chemically synthesized
tggattcttttttccagaattt

SEQ ID NO: 27986 - DNA, 22 bp, Artificial Sequence
  chemically synthesized
ggattcttttttccagaatttt

SEQ ID NO: 27987 - DNA, 22 bp, Artificial Sequence
  chemically synthesized
gattcttttttccagaatttta

SEQ ID NO: 27988 - DNA, 22 bp, Artificial Sequence
  chemically synthesized
ttttttccagaattttataaat

SEQ ID NO: 27989 - DNA, 22 bp, Artificial Sequence
  chemically synthesized
ttttccagaattttataaatgt

SEQ ID NO: 27990 - DNA, 22 bp, Artificial Sequence
  chemically synthesized
tttccagaattttataaatgtc

SEQ ID NO: 27991 - DNA, 22 bp, Artificial Sequence
  chemically synthesized
ttccagaattttataaatgtct

SEQ ID NO: 27992 - DNA, 22 bp, Artificial Sequence
  chemically synthesized
tccagaattttataaatgtctt

SEQ ID NO: 27993 - DNA, 22 bp, Artificial Sequence
  chemically synthesized
ccagaattttataaatgtcttt

SEQ ID NO: 27994 - DNA, 22 bp, Artificial Sequence
  chemically synthesized
cagaattttataaatgtctttt

SEQ ID NO: 27995 - DNA, 22 bp, Artificial Sequence
  chemically synthesized
tataaatgtcttttttttccac

SEQ ID NO: 27996 - DNA, 22 bp, Artificial Sequence
  chemically synthesized
ataaatgtcttttttttccact

SEQ ID NO: 27997 - DNA, 22 bp, Artificial Sequence
  chemically synthesized
taaatgtcttttttttccactg

SEQ ID NO: 27998 - DNA, 22 bp, Artificial Sequence
  chemically synthesized
ttttttccactggcttatgttg

SEQ ID NO: 27999 - DNA, 22 bp, Artificial Sequence
  chemically synthesized
tttttccactggcttatgttgc

SEQ ID NO: 28000 - DNA, 22 bp, Artificial Sequence
  chemically synthesized
ttttccactggcttatgttgct

SEQ ID NO: 28001 - DNA, 22 bp, Artificial Sequence
  chemically synthesized
tttccactggcttatgttgctg

SEQ ID NO: 28002 - DNA, 22 bp, Artificial Sequence
  chemically synthesized
ttccactggcttatgttgctga

SEQ ID NO: 28003 - DNA, 22 bp, Artificial Sequence
  chemically synthesized
tccactggcttatgttgctgaa

SEQ ID NO: 28004 - DNA, 22 bp, Artificial Sequence
  chemically synthesized
ccactggcttatgttgctgaag

SEQ ID NO: 28005 - DNA, 22 bp, Artificial Sequence
  chemically synthesized
cactggcttatgttgctgaaga

SEQ ID NO: 28006 - DNA, 22 bp, Artificial Sequence
  chemically synthesized
gcttatgttgctgaagaattat

SEQ ID NO: 28007 - DNA, 22 bp, Artificial Sequence
  chemically synthesized
atgttgctgaagaattattaaa

SEQ ID NO: 28008 - DNA, 22 bp, Artificial Sequence
  chemically synthesized
tgttgctgaagaattattaaat

SEQ ID NO: 28009 - DNA, 22 bp, Artificial Sequence
  chemically synthesized
ctgaagaattattaaattcctt

SEQ ID NO: 28010 - DNA, 22 bp, Artificial Sequence
  chemically synthesized
aagaattattaaattcctttgg

SEQ ID NO: 28011 - DNA, 22 bp, Artificial Sequence
  chemically synthesized
ttaaattcctttggaagtgtca

SEQ ID NO: 28012 - DNA, 22 bp, Artificial Sequence
  chemically synthesized
aattcctttggaagtgtcatat

SEQ ID NO: 28013 - DNA, 22 bp, Artificial Sequence
  chemically synthesized
ctttggaagtgtcatatttctt

SEQ ID NO: 28014 - DNA, 22 bp, Artificial Sequence
  chemically synthesized
tggaagtgtcatatttcttcac

SEQ ID NO: 28015 - DNA, 22 bp, Artificial Sequence
  chemically synthesized
ggaagtgtcatatttcttcacc

SEQ ID NO: 28016 - DNA, 22 bp, Artificial Sequence
  chemically synthesized
gaagtgtcatatttcttcacct

SEQ ID NO: 28017 - DNA, 22 bp, Artificial Sequence
  chemically synthesized
cttcacctttttatgtttattt

SEQ ID NO: 28018 - DNA, 22 bp, Artificial Sequence
  chemically synthesized
ttcacctttttatgtttatttt

SEQ ID NO: 28019 - DNA, 22 bp, Artificial Sequence
  chemically synthesized
cacctttttatgtttattttgt

SEQ ID NO: 28020 - DNA, 22 bp, Artificial Sequence
  chemically synthesized
acctttttatgtttattttgtt

SEQ ID NO: 28021 - DNA, 22 bp, Artificial Sequence
  chemically synthesized
tttatgtttattttgttcttgc

SEQ ID NO: 28022 - DNA, 22 bp, Artificial Sequence
  chemically synthesized
ttatgtttattttgttcttgca

SEQ ID NO: 28023 - DNA, 22 bp, Artificial Sequence
  chemically synthesized
tatgtttattttgttcttgcat

SEQ ID NO: 28024 - DNA, 22 bp, Artificial Sequence
  chemically synthesized
atgtttattttgttcttgcatt

SEQ ID NO: 28025 - DNA, 22 bp, Artificial Sequence
  chemically synthesized
tgtttattttgttcttgcattg

SEQ ID NO: 28026 - DNA, 22 bp, Artificial Sequence
  chemically synthesized
attttgttcttgcattgatatc

SEQ ID NO: 28027 - DNA, 22 bp, Artificial Sequence
  chemically synthesized
ttttgttcttgcattgatatct

SEQ ID NO: 28028 - DNA, 22 bp, Artificial Sequence
  chemically synthesized
tgttcttgcattgatatctctg

SEQ ID NO: 28029 - DNA, 22 bp, Artificial Sequence
  chemically synthesized
gttcttgcattgatatctctgc

SEQ ID NO: 28030 - DNA, 22 bp, Artificial Sequence
  chemically synthesized
ttcttgcattgatatctctgca

SEQ ID NO: 28031 - DNA, 22 bp, Artificial Sequence
  chemically synthesized
ttgcattgatatctctgcatct

SEQ ID NO: 28032 - DNA, 22 bp, Artificial Sequence
  chemically synthesized
gcattgatatctctgcatctgg

SEQ ID NO: 28033 - DNA, 22 bp, Artificial Sequence
  chemically synthesized
cattgatatctctgcatctggt

SEQ ID NO: 28034 - DNA, 22 bp, Artificial Sequence
  chemically synthesized
atatctctgcatctggtgtaat

SEQ ID NO: 28035 - DNA, 22 bp, Artificial Sequence
  chemically synthesized
tgcatctggtgtaatgattgct

SEQ ID NO: 28036 - DNA, 22 bp, Artificial Sequence
  chemically synthesized
catctggtgtaatgattgctgc

SEQ ID NO: 28037 - DNA, 22 bp, Artificial Sequence
  chemically synthesized
gtgtaatgattgctgcttccag

SEQ ID NO: 28038 - DNA, 22 bp, Artificial Sequence
  chemically synthesized
ctgcttccagttttgtaaattt

SEQ ID NO: 28039 - DNA, 22 bp, Artificial Sequence
  chemically synthesized
cttccagttttgtaaatttgtt

SEQ ID NO: 28040 - DNA, 22 bp, Artificial Sequence
  chemically synthesized
ccagttttgtaaatttgttttt

SEQ ID NO: 28041 - DNA, 22 bp, Artificial Sequence
  chemically synthesized
cagttttgtaaatttgtttttg

SEQ ID NO: 28042 - DNA, 22 bp, Artificial Sequence
  chemically synthesized
tgtaaatttgtttttgtagggg

SEQ ID NO: 28043 - DNA, 22 bp, Artificial Sequence
  chemically synthesized
gtaaatttgtttttgtagggga

SEQ ID NO: 28044 - DNA, 22 bp, Artificial Sequence
  chemically synthesized
taaatttgtttttgtaggggaa

SEQ ID NO: 28045 - DNA, 22 bp, Artificial Sequence
  chemically synthesized
gtttttgtaggggaagactttt

SEQ ID NO: 28046 - DNA, 22 bp, Artificial Sequence
  chemically synthesized
tttttgtaggggaagacttttt

SEQ ID NO: 28047 - DNA, 22 bp, Artificial Sequence
  chemically synthesized
ttgtaggggaagacttttttct

SEQ ID NO: 28048 - DNA, 22 bp, Artificial Sequence
  chemically synthesized
tgtaggggaagacttttttctg

SEQ ID NO: 28049 - DNA, 22 bp, Artificial Sequence
  chemically synthesized
gtaggggaagacttttttctga

SEQ ID NO: 28050 - DNA, 22 bp, Artificial Sequence
  chemically synthesized
taggggaagacttttttctgaa

SEQ ID NO: 28051 - DNA, 22 bp, Artificial Sequence
  chemically synthesized
ttttctgaagatgtatcttggt

SEQ ID NO: 28052 - DNA, 22 bp, Artificial Sequence
  chemically synthesized
tttctgaagatgtatcttggtg

SEQ ID NO: 28053 - DNA, 22 bp, Artificial Sequence
  chemically synthesized
ttctgaagatgtatcttggtgt

SEQ ID NO: 28054 - DNA, 22 bp, Artificial Sequence
  chemically synthesized
tctgaagatgtatcttggtgtt

SEQ ID NO: 28055 - DNA, 22 bp, Artificial Sequence
  chemically synthesized
ctgaagatgtatcttggtgttg

SEQ ID NO: 28056 - DNA, 22 bp, Artificial Sequence
  chemically synthesized
tgaagatgtatcttggtgttga

SEQ ID NO: 28057 - DNA, 22 bp, Artificial Sequence
  chemically synthesized
aagatgtatcttggtgttgatt

SEQ ID NO: 28058 - DNA, 22 bp, Artificial Sequence
  chemically synthesized
ggtgttgattgagtagggcact

SEQ ID NO: 28059 - DNA, 22 bp, Artificial Sequence
  chemically synthesized
gtgttgattgagtagggcactt

SEQ ID NO: 28060 - DNA, 22 bp, Artificial Sequence
  chemically synthesized
attgagtagggcactttgattt

SEQ ID NO: 28061 - DNA, 22 bp, Artificial Sequence
  chemically synthesized
agtagggcactttgattttgat

SEQ ID NO: 28062 - DNA, 22 bp, Artificial Sequence
  chemically synthesized
tgattttgatttctaggtgcat

SEQ ID NO: 28063 - DNA, 22 bp, Artificial Sequence
  chemically synthesized
gattttgatttctaggtgcata

SEQ ID NO: 28064 - DNA, 22 bp, Artificial Sequence
  chemically synthesized
attttgatttctaggtgcatac

SEQ ID NO: 28065 - DNA, 22 bp, Artificial Sequence
  chemically synthesized
tgatttctaggtgcatacagca

SEQ ID NO: 28066 - DNA, 22 bp, Artificial Sequence
  chemically synthesized
gatttctaggtgcatacagcag

SEQ ID NO: 28067 - DNA, 22 bp, Artificial Sequence
  chemically synthesized
atttctaggtgcatacagcagc

SEQ ID NO: 28068 - DNA, 22 bp, Artificial Sequence
  chemically synthesized
ctaggtgcatacagcagcatag

SEQ ID NO: 28069 - DNA, 22 bp, Artificial Sequence
  chemically synthesized
taggtgcatacagcagcatagt

SEQ ID NO: 28070 - DNA, 22 bp, Artificial Sequence
  chemically synthesized
ggtgcatacagcagcatagtct

SEQ ID NO: 28071 - DNA, 22 bp, Artificial Sequence
  chemically synthesized
catattattttttttcagctgc

SEQ ID NO: 28072 - DNA, 22 bp, Artificial Sequence
  chemically synthesized
atattattttttttcagctgcc

SEQ ID NO: 28073 - DNA, 22 bp, Artificial Sequence
  chemically synthesized
ttttttttcagctgccaacagt

SEQ ID NO: 28074 - DNA, 22 bp, Artificial Sequence
  chemically synthesized
tttttcagctgccaacagtatc

SEQ ID NO: 28075 - DNA, 22 bp, Artificial Sequence
  chemically synthesized
ttttcagctgccaacagtatca

SEQ ID NO: 28076 - DNA, 22 bp, Artificial Sequence
  chemically synthesized
tttcagctgccaacagtatcat

SEQ ID NO: 28077 - DNA, 22 bp, Artificial Sequence
  chemically synthesized
ttcagctgccaacagtatcatc

SEQ ID NO: 28078 - DNA, 22 bp, Artificial Sequence
  chemically synthesized
tcagctgccaacagtatcatca

SEQ ID NO: 28079 - DNA, 22 bp, Artificial Sequence
  chemically synthesized
cagctgccaacagtatcatcag

SEQ ID NO: 28080 - DNA, 22 bp, Artificial Sequence
  chemically synthesized
agctgccaacagtatcatcagt

SEQ ID NO: 28081 - DNA, 22 bp, Artificial Sequence
  chemically synthesized
ccaacagtatcatcagtgtctg

SEQ ID NO: 28082 - DNA, 22 bp, Artificial Sequence
  chemically synthesized
tgattttttcagtggcttaggg

SEQ ID NO: 28083 - DNA, 22 bp, Artificial Sequence
  chemically synthesized
tttcagtggcttagggtgcatt

SEQ ID NO: 28084 - DNA, 22 bp, Artificial Sequence
  chemically synthesized
ttcagtggcttagggtgcattt

SEQ ID NO: 28085 - DNA, 22 bp, Artificial Sequence
  chemically synthesized
tcagtggcttagggtgcatttg

SEQ ID NO: 28086 - DNA, 22 bp, Artificial Sequence
  chemically synthesized
cagtggcttagggtgcatttgt

SEQ ID NO: 28087 - DNA, 22 bp, Artificial Sequence
  chemically synthesized
agtggcttagggtgcatttgtt

SEQ ID NO: 28088 - DNA, 22 bp, Artificial Sequence
  chemically synthesized
agggtgcatttgttagtgaagg

SEQ ID NO: 28089 - DNA, 22 bp, Artificial Sequence
  chemically synthesized
gggtgcatttgttagtgaaggt

SEQ ID NO: 28090 - DNA, 22 bp, Artificial Sequence
  chemically synthesized
gttagtgaaggtggtgatgagg

SEQ ID NO: 28091 - DNA, 22 bp, Artificial Sequence
  chemically synthesized
ttagtgaaggtggtgatgaggt

SEQ ID NO: 28092 - DNA, 22 bp, Artificial Sequence
  chemically synthesized
gtgaaggtggtgatgaggttgt

SEQ ID NO: 28093 - DNA, 22 bp, Artificial Sequence
  chemically synthesized
tgctggagacaagaatatcaag

SEQ ID NO: 28094 - DNA, 22 bp, Artificial Sequence
  chemically synthesized
gagacaagaatatcaagtgggc

SEQ ID NO: 28095 - DNA, 22 bp, Artificial Sequence
  chemically synthesized
ggccccagtggtggtggtgggc

SEQ ID NO: 28096 - DNA, 22 bp, Artificial Sequence
  chemically synthesized
gccccagtggtggtggtgggcc

SEQ ID NO: 28097 - DNA, 22 bp, Artificial Sequence
  chemically synthesized
gcattcctgtccttgggcccca

SEQ ID NO: 28098 - DNA, 22 bp, Artificial Sequence
  chemically synthesized
ctgtccttgggccccatggctg

SEQ ID NO: 28099 - DNA, 22 bp, Artificial Sequence
  chemically synthesized
tccttgggccccatggctgtgt

SEQ ID NO: 28100 - DNA, 22 bp, Artificial Sequence
  chemically synthesized
gggccccatggctgtgtacatt

SEQ ID NO: 28101 - DNA, 22 bp, Artificial Sequence
  chemically synthesized
ggccccatggctgtgtacattg

SEQ ID NO: 28102 - DNA, 22 bp, Artificial Sequence
  chemically synthesized
tgtacattggcactgatggtaa

SEQ ID NO: 28103 - DNA, 22 bp, Artificial Sequence
  chemically synthesized
gcactgatggtaatgagtctag

SEQ ID NO: 28104 - DNA, 22 bp, Artificial Sequence
  chemically synthesized
atggtaatgagtctagttgggt

SEQ ID NO: 28105 - DNA, 22 bp, Artificial Sequence
  chemically synthesized
gttgggttgattctttggcctt

SEQ ID NO: 28106 - DNA, 22 bp, Artificial Sequence
  chemically synthesized
ggttgattctttggccttcagg

SEQ ID NO: 28107 - DNA, 22 bp, Artificial Sequence
  chemically synthesized
attctttggccttcaggcagtt

SEQ ID NO: 28108 - DNA, 22 bp, Artificial Sequence
  chemically synthesized
tttggccttcaggcagtttgct

SEQ ID NO: 28109 - DNA, 22 bp, Artificial Sequence
  chemically synthesized
tggccttcaggcagtttgcttg

SEQ ID NO: 28110 - DNA, 22 bp, Artificial Sequence
  chemically synthesized
ggccttcaggcagtttgcttgg

SEQ ID NO: 28111 - DNA, 22 bp, Artificial Sequence
  chemically synthesized
gccttcaggcagtttgcttggg

SEQ ID NO: 28112 - DNA, 22 bp, Artificial Sequence
  chemically synthesized
caggcagtttgcttgggtgtca

SEQ ID NO: 28113 - DNA, 22 bp, Artificial Sequence
  chemically synthesized
aggcagtttgcttgggtgtcag

SEQ ID NO: 28114 - DNA, 22 bp, Artificial Sequence
  chemically synthesized
gcttgggtgtcagtagtggcca

SEQ ID NO: 28115 - DNA, 22 bp, Artificial Sequence
  chemically synthesized
cttgggtgtcagtagtggccat

SEQ ID NO: 28116 - DNA, 22 bp, Artificial Sequence
  chemically synthesized
gggtgtcagtagtggccatagt

SEQ ID NO: 28117 - DNA, 22 bp, Artificial Sequence
  chemically synthesized
ggtgtcagtagtggccatagta

SEQ ID NO: 28118 - DNA, 22 bp, Artificial Sequence
  chemically synthesized
ggctggtgtgtgggtcctcagg

SEQ ID NO: 28119 - DNA, 22 bp, Artificial Sequence
  chemically synthesized
gtgtgtgggtcctcaggcttct

SEQ ID NO: 28120 - DNA, 22 bp, Artificial Sequence
  chemically synthesized
aggcttctggacagtgggtgtg

SEQ ID NO: 28121 - DNA, 22 bp, Artificial Sequence
  chemically synthesized
ctggacagtgggtgtggtgtgg

SEQ ID NO: 28122 - DNA, 22 bp, Artificial Sequence
  chemically synthesized
tggacagtgggtgtggtgtggg

SEQ ID NO: 28123 - DNA, 22 bp, Artificial Sequence
  chemically synthesized
gacagtgggtgtggtgtgggtg

SEQ ID NO: 28124 - DNA, 22 bp, Artificial Sequence
  chemically synthesized
tagcaactgcaggacaaccctc

SEQ ID NO: 28125 - DNA, 22 bp, Artificial Sequence
  chemically synthesized
caggacaaccctctggctccca

SEQ ID NO: 28126 - DNA, 22 bp, Artificial Sequence
  chemically synthesized
tggctcccaagcagtctgcact

SEQ ID NO: 28127 - DNA, 22 bp, Artificial Sequence
  chemically synthesized
gctcccaagcagtctgcactgg

SEQ ID NO: 28128 - DNA, 22 bp, Artificial Sequence
  chemically synthesized
ccaagcagtctgcactggtgtt

SEQ ID NO: 28129 - DNA, 22 bp, Artificial Sequence
  chemically synthesized
cactggtgttggtggtggctgc

SEQ ID NO: 28130 - DNA, 22 bp, Artificial Sequence
  chemically synthesized
gtgttggtggtggctgcaaggg

SEQ ID NO: 28131 - DNA, 22 bp, Artificial Sequence
  chemically synthesized
gtggtggctgcaagggctgaat

SEQ ID NO: 28132 - DNA, 22 bp, Artificial Sequence
  chemically synthesized
caagggctgaatgagccagtct

SEQ ID NO: 28133 - DNA, 22 bp, Artificial Sequence
  chemically synthesized
aatgagccagtcttcagaccca

SEQ ID NO: 28134 - DNA, 22 bp, Artificial Sequence
  chemically synthesized
cagacccacaggtggcacatgc

SEQ ID NO: 28135 - DNA, 22 bp, Artificial Sequence
  chemically synthesized
agacccacaggtggcacatgca

SEQ ID NO: 28136 - DNA, 22 bp, Artificial Sequence
  chemically synthesized
tgatggcagtggcagattgggt

SEQ ID NO: 28137 - DNA, 22 bp, Artificial Sequence
  chemically synthesized
ggtaggcccatcatcaggcttc

SEQ ID NO: 28138 - DNA, 22 bp, Artificial Sequence
  chemically synthesized
ctgggagggttgcttaggtacc

SEQ ID NO: 28139 - DNA, 22 bp, Artificial Sequence
  chemically synthesized
tgggagggttgcttaggtacca

SEQ ID NO: 28140 - DNA, 22 bp, Artificial Sequence
  chemically synthesized
ggagggttgcttaggtaccagt

SEQ ID NO: 28141 - DNA, 22 bp, Artificial Sequence
  chemically synthesized
cttaggtaccagtcatggtgga

SEQ ID NO: 28142 - DNA, 22 bp, Artificial Sequence
  chemically synthesized
aggtaccagtcatggtggatgg

SEQ ID NO: 28143 - DNA, 22 bp, Artificial Sequence
  chemically synthesized
ggtaccagtcatggtggatggc

SEQ ID NO: 28144 - DNA, 22 bp, Artificial Sequence
  chemically synthesized
tctctgggttcccagacaactt

SEQ ID NO: 28145 - DNA, 22 bp, Artificial Sequence
  chemically synthesized
tgggttcccagacaacttgctt

SEQ ID NO: 28146 - DNA, 22 bp, Artificial Sequence
  chemically synthesized
ggttcccagacaacttgcttag

SEQ ID NO: 28147 - DNA, 22 bp, Artificial Sequence
  chemically synthesized
ccagacaacttgcttaggcatt

SEQ ID NO: 28148 - DNA, 22 bp, Artificial Sequence
  chemically synthesized
gcttaggcattgaggaaggcaa

SEQ ID NO: 28149 - DNA, 22 bp, Artificial Sequence
  chemically synthesized
cttaggcattgaggaaggcaaa

SEQ ID NO: 28150 - DNA, 22 bp, Artificial Sequence
  chemically synthesized
aggcattgaggaaggcaaagcc

SEQ ID NO: 28151 - DNA, 22 bp, Artificial Sequence
  chemically synthesized
ggcattgaggaaggcaaagcca

SEQ ID NO: 28152 - DNA, 22 bp, Artificial Sequence
  chemically synthesized
aggaaggcaaagccaggctggg

SEQ ID NO: 28153 - DNA, 22 bp, Artificial Sequence
  chemically synthesized
ggtgttcctgacctcaggccac

SEQ ID NO: 28154 - DNA, 22 bp, Artificial Sequence
  chemically synthesized
ctgacctcaggccactcagtgg

SEQ ID NO: 28155 - DNA, 22 bp, Artificial Sequence
  chemically synthesized
acctcaggccactcagtggtgt

SEQ ID NO: 28156 - DNA, 22 bp, Artificial Sequence
  chemically synthesized
aggccactcagtggtgtgtgtg

SEQ ID NO: 28157 - DNA, 22 bp, Artificial Sequence
  chemically synthesized
agtggtgtgtgtggacaccggc

SEQ ID NO: 28158 - DNA, 22 bp, Artificial Sequence
  chemically synthesized
tcataggctggagtggagtgat

SEQ ID NO: 28159 - DNA, 22 bp, Artificial Sequence
  chemically synthesized
gagtggagtgatcctcaggccc

SEQ ID NO: 28160 - DNA, 22 bp, Artificial Sequence
  chemically synthesized
aggcccccagcagaatgcctga

SEQ ID NO: 28161 - DNA, 22 bp, Artificial Sequence
  chemically synthesized
agtgaattagcagctactgcat

SEQ ID NO: 28162 - DNA, 22 bp, Artificial Sequence
  chemically synthesized
gcagctactgcattgttgccct

SEQ ID NO: 28163 - DNA, 22 bp, Artificial Sequence
  chemically synthesized
ctgcattgttgccctgctcttg

SEQ ID NO: 28164 - DNA, 22 bp, Artificial Sequence
  chemically synthesized
cattgttgccctgctcttgaag

SEQ ID NO: 28165 - DNA, 22 bp, Artificial Sequence
  chemically synthesized
ttgccctgctcttgaaggggtg

SEQ ID NO: 28166 - DNA, 22 bp, Artificial Sequence
  chemically synthesized
ccctgctcttgaaggggtgcgg

SEQ ID NO: 28167 - DNA, 22 bp, Artificial Sequence
  chemically synthesized
ctcttgaaggggtgcggggtgt

SEQ ID NO: 28168 - DNA, 22 bp, Artificial Sequence
  chemically synthesized
ttgaaggggtgcggggtgtgtt

SEQ ID NO: 28169 - DNA, 22 bp, Artificial Sequence
  chemically synthesized
gaaggggtgcggggtgtgttgc

SEQ ID NO: 28170 - DNA, 22 bp, Artificial Sequence
  chemically synthesized
aaggggtgcggggtgtgttgct

SEQ ID NO: 28171 - DNA, 22 bp, Artificial Sequence
  chemically synthesized
ctttcagtggcagcagctataa

SEQ ID NO: 28172 - DNA, 22 bp, Artificial Sequence
  chemically synthesized
tcagtggcagcagctataaatg

SEQ ID NO: 28173 - DNA, 22 bp, Artificial Sequence
  chemically synthesized
cagtggcagcagctataaatgg

SEQ ID NO: 28174 - DNA, 22 bp, Artificial Sequence
  chemically synthesized
agtggcagcagctataaatggg

SEQ ID NO: 28175 - DNA, 22 bp, Artificial Sequence
  chemically synthesized
taaatgggttgctggtgggcat

SEQ ID NO: 28176 - DNA, 22 bp, Artificial Sequence
  chemically synthesized
ctggtgggcatgtgtttcagcc

SEQ ID NO: 28177 - DNA, 22 bp, Artificial Sequence
  chemically synthesized
gtgggcatgtgtttcagcccca

SEQ ID NO: 28178 - DNA, 22 bp, Artificial Sequence
  chemically synthesized
cagccccagatggtggctgcaa

SEQ ID NO: 28179 - DNA, 22 bp, Artificial Sequence
  chemically synthesized
agccccagatggtggctgcaag

SEQ ID NO: 28180 - DNA, 22 bp, Artificial Sequence
  chemically synthesized
caagtggggtagcattttctta

SEQ ID NO: 28181 - DNA, 22 bp, Artificial Sequence
  chemically synthesized
tcttagggagcttataaatgtg

SEQ ID NO: 28182 - DNA, 22 bp, Artificial Sequence
  chemically synthesized
cttagggagcttataaatgtgt

SEQ ID NO: 28183 - DNA, 22 bp, Artificial Sequence
  chemically synthesized
ttagggagcttataaatgtgta

SEQ ID NO: 28184 - DNA, 22 bp, Artificial Sequence
  chemically synthesized
agggagcttataaatgtgtagc

SEQ ID NO: 28185 - DNA, 22 bp, Artificial Sequence
  chemically synthesized
gggagcttataaatgtgtagca

SEQ ID NO: 28186 - DNA, 22 bp, Artificial Sequence
  chemically synthesized
ataaatgtgtagcagccctgct

SEQ ID NO: 28187 - DNA, 22 bp, Artificial Sequence
  chemically synthesized
taaatgtgtagcagccctgcta

SEQ ID NO: 28188 - DNA, 22 bp, Artificial Sequence
  chemically synthesized
ctactgggggtgggggagtcca

SEQ ID NO: 28189 - DNA, 22 bp, Artificial Sequence
  chemically synthesized
ctgggggtgggggagtccactt

SEQ ID NO: 28190 - DNA, 22 bp, Artificial Sequence
  chemically synthesized
ggggtgggggagtccacttcta

SEQ ID NO: 28191 - DNA, 22 bp, Artificial Sequence
  chemically synthesized
ctaatgacacactttatccctg

SEQ ID NO: 28192 - DNA, 22 bp, Artificial Sequence
  chemically synthesized
taatgacacactttatccctgg

SEQ ID NO: 28193 - DNA, 22 bp, Artificial Sequence
  chemically synthesized
atgacacactttatccctggtg

SEQ ID NO: 28194 - DNA, 22 bp, Artificial Sequence
  chemically synthesized
tatccctggtgacagcagccag

SEQ ID NO: 28195 - DNA, 22 bp, Artificial Sequence
  chemically synthesized
atccctggtgacagcagccagc

SEQ ID NO: 28196 - DNA, 22 bp, Artificial Sequence
  chemically synthesized
tccctggtgacagcagccagca

SEQ ID NO: 28197 - DNA, 22 bp, Artificial Sequence
  chemically synthesized
gtgacagcagccagcagtagca

SEQ ID NO: 28198 - DNA, 22 bp, Artificial Sequence
  chemically synthesized
agctgtgggtgggggatgtcag

SEQ ID NO: 28199 - DNA, 22 bp, Artificial Sequence
  chemically synthesized
tgggtgggggatgtcagcagag

SEQ ID NO: 28200 - DNA, 22 bp, Artificial Sequence
  chemically synthesized
cagggatgtagagatgcagatg

SEQ ID NO: 28201 - DNA, 22 bp, Artificial Sequence
  chemically synthesized
agggatgtagagatgcagatga

SEQ ID NO: 28202 - DNA, 22 bp, Artificial Sequence
  chemically synthesized
gggtctgaggaacgatgtcatc

SEQ ID NO: 28203 - DNA, 22 bp, Artificial Sequence
  chemically synthesized
aggaacgatgtcatctggtggg

SEQ ID NO: 28204 - DNA, 22 bp, Artificial Sequence
  chemically synthesized
gtgggtgttgggctctcaaaat

SEQ ID NO: 28205 - DNA, 22 bp, Artificial Sequence
  chemically synthesized
ggctctcaaaatggcaccttgc

SEQ ID NO: 28206 - DNA, 22 bp, Artificial Sequence
  chemically synthesized
tcaaaatggcaccttgctgctc

SEQ ID NO: 28207 - DNA, 22 bp, Artificial Sequence
  chemically synthesized
aaaatggcaccttgctgctcag

SEQ ID NO: 28208 - DNA, 22 bp, Artificial Sequence
  chemically synthesized
gctgctcagtaatggggatggc

SEQ ID NO: 28209 - DNA, 22 bp, Artificial Sequence
  chemically synthesized
ctgctcagtaatggggatggca

SEQ ID NO: 28210 - DNA, 22 bp, Artificial Sequence
  chemically synthesized
ctcagtaatggggatggcaggg

SEQ ID NO: 28211 - DNA, 22 bp, Artificial Sequence
  chemically synthesized
agtaatggggatggcaggggtg

SEQ ID NO: 28212 - DNA, 22 bp, Artificial Sequence
  chemically synthesized
cttctctggagcaatgcctttg

SEQ ID NO: 28213 - DNA, 22 bp, Artificial Sequence
  chemically synthesized
ctctggagcaatgcctttgtgc

SEQ ID NO: 28214 - DNA, 22 bp, Artificial Sequence
  chemically synthesized
tctggagcaatgcctttgtgcg

SEQ ID NO: 28215 - DNA, 22 bp, Artificial Sequence
  chemically synthesized
tggagcaatgcctttgtgcgat

SEQ ID NO: 28216 - DNA, 22 bp, Artificial Sequence
  chemically synthesized
gagcaatgcctttgtgcgattg

SEQ ID NO: 28217 - DNA, 22 bp, Artificial Sequence
  chemically synthesized
tgtgcgattgctgggcagttcc

SEQ ID NO: 28218 - DNA, 22 bp, Artificial Sequence
  chemically synthesized
gtgcgattgctgggcagttcct

SEQ ID NO: 28219 - DNA, 22 bp, Artificial Sequence
  chemically synthesized
tgcgattgctgggcagttcctt

SEQ ID NO: 28220 - DNA, 22 bp, Artificial Sequence
  chemically synthesized
ctgggcagttccttatgatagt

SEQ ID NO: 28221 - DNA, 22 bp, Artificial Sequence
  chemically synthesized
ggcagttccttatgatagtctc

SEQ ID NO: 28222 - DNA, 22 bp, Artificial Sequence
  chemically synthesized
cttatgatagtctcaaggcctg

SEQ ID NO: 28223 - DNA, 22 bp, Artificial Sequence
  chemically synthesized
atgatagtctcaaggcctgcat

SEQ ID NO: 28224 - DNA, 22 bp, Artificial Sequence
  chemically synthesized
tgatagtctcaaggcctgcatg

SEQ ID NO: 28225 - DNA, 22 bp, Artificial Sequence
  chemically synthesized
aaggcctgcatggtcaagggac

SEQ ID NO: 28226 - DNA, 22 bp, Artificial Sequence
  chemically synthesized
catggtcaagggactctcctgt

SEQ ID NO: 28227 - DNA, 22 bp, Artificial Sequence
  chemically synthesized
tcctgtggctaggattcctgga

SEQ ID NO: 28228 - DNA, 22 bp, Artificial Sequence
  chemically synthesized
ctgtggctaggattcctggagt

SEQ ID NO: 28229 - DNA, 22 bp, Artificial Sequence
  chemically synthesized
tggctaggattcctggagtcca

SEQ ID NO: 28230 - DNA, 22 bp, Artificial Sequence
  chemically synthesized
ggattcctggagtccataatgc

SEQ ID NO: 28231 - DNA, 22 bp, Artificial Sequence
  chemically synthesized
ctggagtccataatgcagatgt

SEQ ID NO: 28232 - DNA, 22 bp, Artificial Sequence
  chemically synthesized
gagtccataatgcagatgtgga

SEQ ID NO: 28233 - DNA, 22 bp, Artificial Sequence
  chemically synthesized
ggagtcagtcacttaactttcg

SEQ ID NO: 28234 - DNA, 22 bp, Artificial Sequence
  chemically synthesized
aactttcgatgcactggggagc

SEQ ID NO: 28235 - DNA, 22 bp, Artificial Sequence
  chemically synthesized
actttcgatgcactggggagcc

SEQ ID NO: 28236 - DNA, 22 bp, Artificial Sequence
  chemically synthesized
tcgatgcactggggagcctctc

SEQ ID NO: 28237 - DNA, 22 bp, Artificial Sequence
  chemically synthesized
cgatgcactggggagcctctct

SEQ ID NO: 28238 - DNA, 22 bp, Artificial Sequence
  chemically synthesized
gatgcactggggagcctctctg

SEQ ID NO: 28239 - DNA, 22 bp, Artificial Sequence
  chemically synthesized
gggagcctctctggcctcacag

SEQ ID NO: 28240 - DNA, 22 bp, Artificial Sequence
  chemically synthesized
tctggcctcacagaggatccct

SEQ ID NO: 28241 - DNA, 22 bp, Artificial Sequence
  chemically synthesized
tggcctcacagaggatccctac

SEQ ID NO: 28242 - DNA, 22 bp, Artificial Sequence
  chemically synthesized
gcctcacagaggatccctactg

SEQ ID NO: 28243 - DNA, 22 bp, Artificial Sequence
  chemically synthesized
acagaggatccctactgggtag

SEQ ID NO: 28244 - DNA, 22 bp, Artificial Sequence
  chemically synthesized
ctgggtaggcttccttgcttcc

SEQ ID NO: 28245 - DNA, 22 bp, Artificial Sequence
  chemically synthesized
ggtaggcttccttgcttccctc

SEQ ID NO: 28246 - DNA, 22 bp, Artificial Sequence
  chemically synthesized
ccttgcttccctccccttcatt

SEQ ID NO: 28247 - DNA, 22 bp, Artificial Sequence
  chemically synthesized
cttgcttccctccccttcattg

SEQ ID NO: 28248 - DNA, 22 bp, Artificial Sequence
  chemically synthesized
gcttccctccccttcattgcct

SEQ ID NO: 28249 - DNA, 22 bp, Artificial Sequence
  chemically synthesized
cttccctccccttcattgcctt

SEQ ID NO: 28250 - DNA, 22 bp, Artificial Sequence
  chemically synthesized
ccctccccttcattgccttaga

SEQ ID NO: 28251 - DNA, 22 bp, Artificial Sequence
  chemically synthesized
cctccccttcattgccttagat

SEQ ID NO: 28252 - DNA, 22 bp, Artificial Sequence
  chemically synthesized
cccttcattgccttagatgctt

SEQ ID NO: 28253 - DNA, 22 bp, Artificial Sequence
  chemically synthesized
cattgccttagatgcttcctgt

SEQ ID NO: 28254 - DNA, 22 bp, Artificial Sequence
  chemically synthesized
attgccttagatgcttcctgtc

SEQ ID NO: 28255 - DNA, 22 bp, Artificial Sequence
  chemically synthesized
ccttagatgcttcctgtcactt

SEQ ID NO: 28256 - DNA, 22 bp, Artificial Sequence
  chemically synthesized
agatgcttcctgtcacttctct

SEQ ID NO: 28257 - DNA, 22 bp, Artificial Sequence
  chemically synthesized
gatgcttcctgtcacttctctg

SEQ ID NO: 28258 - DNA, 22 bp, Artificial Sequence
  chemically synthesized
cctgtcacttctctgttgaatt

SEQ ID NO: 28259 - DNA, 22 bp, Artificial Sequence
  chemically synthesized
ctgtcacttctctgttgaattc

SEQ ID NO: 28260 - DNA, 22 bp, Artificial Sequence
  chemically synthesized
tcacttctctgttgaattccag

SEQ ID NO: 28261 - DNA, 22 bp, Artificial Sequence
  chemically synthesized
ctctgttgaattccagaattct

SEQ ID NO: 28262 - DNA, 22 bp, Artificial Sequence
  chemically synthesized
tctgttgaattccagaattctc

SEQ ID NO: 28263 - DNA, 22 bp, Artificial Sequence
  chemically synthesized
tgttgaattccagaattctctc

SEQ ID NO: 28264 - DNA, 22 bp, Artificial Sequence
  chemically synthesized
ttgaattccagaattctctctt

SEQ ID NO: 28265 - DNA, 22 bp, Artificial Sequence
  chemically synthesized
aattccagaattctctcttatg

SEQ ID NO: 28266 - DNA, 22 bp, Artificial Sequence
  chemically synthesized
cagaattctctcttatgtggga

SEQ ID NO: 28267 - DNA, 22 bp, Artificial Sequence
  chemically synthesized
tctcttatgtgggattttctac

SEQ ID NO: 28268 - DNA, 22 bp, Artificial Sequence
  chemically synthesized
tcttatgtgggattttctactt

SEQ ID NO: 28269 - DNA, 22 bp, Artificial Sequence
  chemically synthesized
ttatgtgggattttctacttac

SEQ ID NO: 28270 - DNA, 22 bp, Artificial Sequence
  chemically synthesized
atgtgggattttctacttacta

SEQ ID NO: 28271 - DNA, 22 bp, Artificial Sequence
  chemically synthesized
tgtgggattttctacttactat

SEQ ID NO: 28272 - DNA, 22 bp, Artificial Sequence
  chemically synthesized
tctacttactattttggttctt

SEQ ID NO: 28273 - DNA, 22 bp, Artificial Sequence
  chemically synthesized
ctacttactattttggttcttt

SEQ ID NO: 28274 - DNA, 22 bp, Artificial Sequence
  chemically synthesized
tacttactattttggttctttg

SEQ ID NO: 28275 - DNA, 22 bp, Artificial Sequence
  chemically synthesized
cttactattttggttctttgtg

SEQ ID NO: 28276 - DNA, 22 bp, Artificial Sequence
  chemically synthesized
actattttggttctttgtggag

SEQ ID NO: 28277 - DNA, 22 bp, Artificial Sequence
  chemically synthesized
ctattttggttctttgtggagg

SEQ ID NO: 28278 - DNA, 22 bp, Artificial Sequence
  chemically synthesized
ttttggttctttgtggaggagg

SEQ ID NO: 28279 - DNA, 22 bp, Artificial Sequence
  chemically synthesized
tggttctttgtggaggaggtga

SEQ ID NO: 28280 - DNA, 22 bp, Artificial Sequence
  chemically synthesized
ggttctttgtggaggaggtgag

SEQ ID NO: 28281 - DNA, 22 bp, Artificial Sequence
  chemically synthesized
gttctttgtggaggaggtgagt

SEQ ID NO: 28282 - DNA, 22 bp, Artificial Sequence
  chemically synthesized
tttgtggaggaggtgagtgtca

SEQ ID NO: 28283 - DNA, 22 bp, Artificial Sequence
  chemically synthesized
tgtggaggaggtgagtgtcagc

SEQ ID NO: 28284 - DNA, 22 bp, Artificial Sequence
  chemically synthesized
gtggaggaggtgagtgtcagct

SEQ ID NO: 28285 - DNA, 22 bp, Artificial Sequence
  chemically synthesized
tggaggaggtgagtgtcagctg

SEQ ID NO: 28286 - DNA, 22 bp, Artificial Sequence
  chemically synthesized
cccttagtcagtaatcttcaag

SEQ ID NO: 28287 - DNA, 22 bp, Artificial Sequence
  chemically synthesized
agtcagtaatcttcaagcccct

SEQ ID NO: 28288 - DNA, 22 bp, Artificial Sequence
  chemically synthesized
gtcagtaatcttcaagcccctt

SEQ ID NO: 28289 - DNA, 22 bp, Artificial Sequence
  chemically synthesized
caagccccttcccttgaaattt

SEQ ID NO: 28290 - DNA, 22 bp, Artificial Sequence
  chemically synthesized
aagccccttcccttgaaatttt

SEQ ID NO: 28291 - DNA, 22 bp, Artificial Sequence
  chemically synthesized
cccttgaaattttttaagcttt

SEQ ID NO: 28292 - DNA, 22 bp, Artificial Sequence
  chemically synthesized
ccttgaaattttttaagcttta

SEQ ID NO: 28293 - DNA, 22 bp, Artificial Sequence
  chemically synthesized
gaaattttttaagctttatgtt

SEQ ID NO: 28294 - DNA, 22 bp, Artificial Sequence
  chemically synthesized
aaattttttaagctttatgttt

SEQ ID NO: 28295 - DNA, 22 bp, Artificial Sequence
  chemically synthesized
tttaagctttatgtttttattt

SEQ ID NO: 28296 - DNA, 22 bp, Artificial Sequence
  chemically synthesized
ttaagctttatgtttttatttc

SEQ ID NO: 28297 - DNA, 22 bp, Artificial Sequence
  chemically synthesized
taagctttatgtttttatttct

SEQ ID NO: 28298 - DNA, 22 bp, Artificial Sequence
  chemically synthesized
aagctttatgtttttatttcta

SEQ ID NO: 28299 - DNA, 22 bp, Artificial Sequence
  chemically synthesized
agctttatgtttttatttctaa

SEQ ID NO: 28300 - DNA, 22 bp, Artificial Sequence
  chemically synthesized
tatgtttttatttctaatagac

SEQ ID NO: 28301 - DNA, 22 bp, Artificial Sequence
  chemically synthesized
atgtttttatttctaatagact

SEQ ID NO: 28302 - DNA, 22 bp, Artificial Sequence
  chemically synthesized
tgtttttatttctaatagactg

SEQ ID NO: 28303 - DNA, 22 bp, Artificial Sequence
  chemically synthesized
ttatttctaatagactgaaaga

SEQ ID NO: 28304 - DNA, 22 bp, Artificial Sequence
  chemically synthesized
tatttctaatagactgaaagag

SEQ ID NO: 28305 - DNA, 22 bp, Artificial Sequence
  chemically synthesized
atttctaatagactgaaagagc

SEQ ID NO: 28306 - DNA, 22 bp, Artificial Sequence
  chemically synthesized
tttctaatagactgaaagagca

SEQ ID NO: 28307 - DNA, 22 bp, Artificial Sequence
  chemically synthesized
ctaatagactgaaagagcataa

SEQ ID NO: 28308 - DNA, 22 bp, Artificial Sequence
  chemically synthesized
taatagactgaaagagcataat

SEQ ID NO: 28309 - DNA, 22 bp, Artificial Sequence
  chemically synthesized
atagactgaaagagcataatca

SEQ ID NO: 28310 - DNA, 22 bp, Artificial Sequence
  chemically synthesized
aaagagcataatcatattttaa

SEQ ID NO: 28311 - DNA, 22 bp, Artificial Sequence
  chemically synthesized
taaacactctaaggctatatgg

SEQ ID NO: 28312 - DNA, 22 bp, Artificial Sequence
  chemically synthesized
aaacactctaaggctatatggg

SEQ ID NO: 28313 - DNA, 22 bp, Artificial Sequence
  chemically synthesized
aacactctaaggctatatgggg

SEQ ID NO: 28314 - DNA, 22 bp, Artificial Sequence
  chemically synthesized
taaggctatatgggggactatc

SEQ ID NO: 28315 - DNA, 22 bp, Artificial Sequence
  chemically synthesized
aggctatatgggggactatctg

SEQ ID NO: 28316 - DNA, 22 bp, Artificial Sequence
  chemically synthesized
tatgggggactatctgaaggcc

SEQ ID NO: 28317 - DNA, 22 bp, Artificial Sequence
  chemically synthesized
tctgaaggcctcagatgagtaa

SEQ ID NO: 28318 - DNA, 22 bp, Artificial Sequence
  chemically synthesized
aaggcctcagatgagtaaaaga

SEQ ID NO: 28319 - DNA, 22 bp, Artificial Sequence
  chemically synthesized
agatgagtaaaagaagtagcga

SEQ ID NO: 28320 - DNA, 22 bp, Artificial Sequence
  chemically synthesized
gttaactatgtttttcttttca

SEQ ID NO: 28321 - DNA, 22 bp, Artificial Sequence
  chemically synthesized
actatgtttttcttttcatttc

SEQ ID NO: 28322 - DNA, 22 bp, Artificial Sequence
  chemically synthesized
tgtttttcttttcatttcattt

SEQ ID NO: 28323 - DNA, 22 bp, Artificial Sequence
  chemically synthesized
ttcttttcatttcatttcccaa

SEQ ID NO: 28324 - DNA, 22 bp, Artificial Sequence
  chemically synthesized
tcttttcatttcatttcccaaa

SEQ ID NO: 28325 - DNA, 22 bp, Artificial Sequence
  chemically synthesized
cttttcatttcatttcccaaat

SEQ ID NO: 28326 - DNA, 22 bp, Artificial Sequence
  chemically synthesized
ttttcatttcatttcccaaatc

SEQ ID NO: 28327 - DNA, 22 bp, Artificial Sequence
  chemically synthesized
ttcatttcatttcccaaatcaa

SEQ ID NO: 28328 - DNA, 22 bp, Artificial Sequence
  chemically synthesized
tcatttcatttcccaaatcaaa

SEQ ID NO: 28329 - DNA, 22 bp, Artificial Sequence
  chemically synthesized
catttcatttcccaaatcaaat

SEQ ID NO: 28330 - DNA, 22 bp, Artificial Sequence
  chemically synthesized
atttcatttcccaaatcaaatc

SEQ ID NO: 28331 - DNA, 22 bp, Artificial Sequence
  chemically synthesized
catttcccaaatcaaatcattt

SEQ ID NO: 28332 - DNA, 22 bp, Artificial Sequence
  chemically synthesized
atttcccaaatcaaatcatttg

SEQ ID NO: 28333 - DNA, 22 bp, Artificial Sequence
  chemically synthesized
cccaaatcaaatcatttgtttc

SEQ ID NO: 28334 - DNA, 22 bp, Artificial Sequence
  chemically synthesized
ccaaatcaaatcatttgtttct

SEQ ID NO: 28335 - DNA, 22 bp, Artificial Sequence
  chemically synthesized
gtttcttcaaataaagaatctc

SEQ ID NO: 28336 - DNA, 22 bp, Artificial Sequence
  chemically synthesized
tttcttcaaataaagaatctct

SEQ ID NO: 28337 - DNA, 22 bp, Artificial Sequence
  chemically synthesized
cttcaaataaagaatctctatt

SEQ ID NO: 28338 - DNA, 22 bp, Artificial Sequence
  chemically synthesized
ttcaaataaagaatctctattt

SEQ ID NO: 28339 - DNA, 22 bp, Artificial Sequence
  chemically synthesized
caaataaagaatctctatttcc

SEQ ID NO: 28340 - DNA, 22 bp, Artificial Sequence
  chemically synthesized
aaataaagaatctctatttccc

SEQ ID NO: 28341 - DNA, 22 bp, Artificial Sequence
  chemically synthesized
tatttcccccttatgttcttca

SEQ ID NO: 28342 - DNA, 22 bp, Artificial Sequence
  chemically synthesized
tttcccccttatgttcttcagc

SEQ ID NO: 28343 - DNA, 22 bp, Artificial Sequence
  chemically synthesized
cccccttatgttcttcagcaaa

SEQ ID NO: 28344 - DNA, 22 bp, Artificial Sequence
  chemically synthesized
ccccttatgttcttcagcaaat

SEQ ID NO: 28345 - DNA, 22 bp, Artificial Sequence
  chemically synthesized
atgttcttcagcaaataaaaat

SEQ ID NO: 28346 - DNA, 22 bp, Artificial Sequence
  chemically synthesized
tgttcttcagcaaataaaaatg

SEQ ID NO: 28347 - DNA, 22 bp, Artificial Sequence
  chemically synthesized
ttcagcaaataaaaatgtttgc

SEQ ID NO: 28348 - DNA, 22 bp, Artificial Sequence
  chemically synthesized
cagcaaataaaaatgtttgcat

SEQ ID NO: 28349 - DNA, 22 bp, Artificial Sequence
  chemically synthesized
agcaaataaaaatgtttgcatc

SEQ ID NO: 28350 - DNA, 22 bp, Artificial Sequence
  chemically synthesized
gcatctaccaaagtgtatatga

SEQ ID NO: 28351 - DNA, 22 bp, Artificial Sequence
  chemically synthesized
catctaccaaagtgtatatgaa

SEQ ID NO: 28352 - DNA, 22 bp, Artificial Sequence
  chemically synthesized
ccaaagtgtatatgaatttgaa

SEQ ID NO: 28353 - DNA, 22 bp, Artificial Sequence
  chemically synthesized
gaaatacgtaatctaacaaaca

SEQ ID NO: 28354 - DNA, 22 bp, Artificial Sequence
  chemically synthesized
aaatacgtaatctaacaaacaa

SEQ ID NO: 28355 - DNA, 22 bp, Artificial Sequence
  chemically synthesized
acaaacaaggatgttttaagat

SEQ ID NO: 28356 - DNA, 22 bp, Artificial Sequence
  chemically synthesized
taagatctctgagtaagatgca

SEQ ID NO: 28357 - DNA, 22 bp, Artificial Sequence
  chemically synthesized
aagatctctgagtaagatgcat

SEQ ID NO: 28358 - DNA, 22 bp, Artificial Sequence
  chemically synthesized
agatctctgagtaagatgcata

SEQ ID NO: 28359 - DNA, 22 bp, Artificial Sequence
  chemically synthesized
tgagtaagatgcatagttgcaa

SEQ ID NO: 28360 - DNA, 22 bp, Artificial Sequence
  chemically synthesized
agtaagatgcatagttgcaaat

SEQ ID NO: 28361 - DNA, 22 bp, Artificial Sequence
  chemically synthesized
caaataaaaggagttttcaagg

SEQ ID NO: 28362 - DNA, 22 bp, Artificial Sequence
  chemically synthesized
tcaaggataaaaaatgtaaata

SEQ ID NO: 28363 - DNA, 22 bp, Artificial Sequence
  chemically synthesized
caaggataaaaaatgtaaataa

SEQ ID NO: 28364 - DNA, 22 bp, Artificial Sequence
  chemically synthesized
aaggataaaaaatgtaaataaa

SEQ ID NO: 28365 - DNA, 22 bp, Artificial Sequence
  chemically synthesized
ataaatgtgtaccatcagaaac

SEQ ID NO: 28366 - DNA, 22 bp, Artificial Sequence
  chemically synthesized
atggtatattctcctggaaaag

SEQ ID NO: 28367 - DNA, 22 bp, Artificial Sequence
  chemically synthesized
tggtatattctcctggaaaaga

SEQ ID NO: 28368 - DNA, 22 bp, Artificial Sequence
  chemically synthesized
tcctggaaaagatgaagatgaa

SEQ ID NO: 28369 - DNA, 22 bp, Artificial Sequence
  chemically synthesized
ctggaaaagatgaagatgaaga

SEQ ID NO: 28370 - DNA, 22 bp, Artificial Sequence
  chemically synthesized
gaaaagatgaagatgaagaaaa

SEQ ID NO: 28371 - DNA, 22 bp, Artificial Sequence
  chemically synthesized
cagaagaggagaaattctttgg

SEQ ID NO: 28372 - DNA, 22 bp, Artificial Sequence
  chemically synthesized
tttggaaattttgcatttttgt

SEQ ID NO: 28373 - DNA, 22 bp, Artificial Sequence
  chemically synthesized
tggaaattttgcatttttgtgg

SEQ ID NO: 28374 - DNA, 22 bp, Artificial Sequence
  chemically synthesized
ggaaattttgcatttttgtgga

SEQ ID NO: 28375 - DNA, 22 bp, Artificial Sequence
  chemically synthesized
gaaattttgcatttttgtggat

SEQ ID NO: 28376 - DNA, 22 bp, Artificial Sequence
  chemically synthesized
tgcatttttgtggatagtggtt

SEQ ID NO: 28377 - DNA, 22 bp, Artificial Sequence
  chemically synthesized
gcatttttgtggatagtggttt

SEQ ID NO: 28378 - DNA, 22 bp, Artificial Sequence
  chemically synthesized
catttttgtggatagtggtttt

SEQ ID NO: 28379 - DNA, 22 bp, Artificial Sequence
  chemically synthesized
ttgtggatagtggttttgaaga

SEQ ID NO: 28380 - DNA, 22 bp, Artificial Sequence
  chemically synthesized
tgtggatagtggttttgaagaa

SEQ ID NO: 28381 - DNA, 22 bp, Artificial Sequence
  chemically synthesized
gtggatagtggttttgaagaaa

SEQ ID NO: 28382 - DNA, 22 bp, Artificial Sequence
  chemically synthesized
tggatagtggttttgaagaaag

SEQ ID NO: 28383 - DNA, 22 bp, Artificial Sequence
  chemically synthesized
tgaagaaagcttagatatattt

SEQ ID NO: 28384 - DNA, 22 bp, Artificial Sequence
  chemically synthesized
gaagaaagcttagatatattta

SEQ ID NO: 28385 - DNA, 22 bp, Artificial Sequence
  chemically synthesized
aagaaagcttagatatatttaa

SEQ ID NO: 28386 - DNA, 22 bp, Artificial Sequence
  chemically synthesized
agatatatttaaatatgttgct

SEQ ID NO: 28387 - DNA, 22 bp, Artificial Sequence
  chemically synthesized
gatatatttaaatatgttgcta

SEQ ID NO: 28388 - DNA, 22 bp, Artificial Sequence
  chemically synthesized
aaatatgttgctaagatgtgac

SEQ ID NO: 28389 - DNA, 22 bp, Artificial Sequence
  chemically synthesized
aatatgttgctaagatgtgact

SEQ ID NO: 28390 - DNA, 22 bp, Artificial Sequence
  chemically synthesized
ctaagatgtgactcccacactt

SEQ ID NO: 28391 - DNA, 22 bp, Artificial Sequence
  chemically synthesized
agatgtgactcccacactttaa

SEQ ID NO: 28392 - DNA, 22 bp, Artificial Sequence
  chemically synthesized
ccacactttaaagaaaagttct

SEQ ID NO: 28393 - DNA, 22 bp, Artificial Sequence
  chemically synthesized
taaagaaaagttcttcatttta

SEQ ID NO: 28394 - DNA, 22 bp, Artificial Sequence
  chemically synthesized
aaagaaaagttcttcattttag

SEQ ID NO: 28395 - DNA, 22 bp, Artificial Sequence
  chemically synthesized
aagaaaagttcttcattttagt

SEQ ID NO: 28396 - DNA, 22 bp, Artificial Sequence
  chemically synthesized
ttcattttagttgcccttgcaa

SEQ ID NO: 28397 - DNA, 22 bp, Artificial Sequence
  chemically synthesized
cattttagttgcccttgcaaat

SEQ ID NO: 28398 - DNA, 22 bp, Artificial Sequence
  chemically synthesized
attttagttgcccttgcaaatt

SEQ ID NO: 28399 - DNA, 22 bp, Artificial Sequence
  chemically synthesized
tagttgcccttgcaaattggct

SEQ ID NO: 28400 - DNA, 22 bp, Artificial Sequence
  chemically synthesized
agttgcccttgcaaattggcta

SEQ ID NO: 28401 - DNA, 22 bp, Artificial Sequence
  chemically synthesized
gttgcccttgcaaattggctaa

SEQ ID NO: 28402 - DNA, 22 bp, Artificial Sequence
  chemically synthesized
cccttgcaaattggctaagttt

SEQ ID NO: 28403 - DNA, 22 bp, Artificial Sequence
  chemically synthesized
gcaaattggctaagtttatttt

SEQ ID NO: 28404 - DNA, 22 bp, Artificial Sequence
  chemically synthesized
caaattggctaagtttattttt

SEQ ID NO: 28405 - DNA, 22 bp, Artificial Sequence
  chemically synthesized
gctaagtttatttttcctcaac

SEQ ID NO: 28406 - DNA, 22 bp, Artificial Sequence
  chemically synthesized
agtttatttttcctcaacaaat

SEQ ID NO: 28407 - DNA, 22 bp, Artificial Sequence
  chemically synthesized
atttttcctcaacaaataattt

SEQ ID NO: 28408 - DNA, 22 bp, Artificial Sequence
  chemically synthesized
tttttcctcaacaaataatttt

SEQ ID NO: 28409 - DNA, 22 bp, Artificial Sequence
  chemically synthesized
ttcctcaacaaataattttgat

SEQ ID NO: 28410 - DNA, 22 bp, Artificial Sequence
  chemically synthesized
tcctcaacaaataattttgatg

SEQ ID NO: 28411 - DNA, 22 bp, Artificial Sequence
  chemically synthesized
cctcaacaaataattttgatgg

SEQ ID NO: 28412 - DNA, 22 bp, Artificial Sequence
  chemically synthesized
ctcaacaaataattttgatggt

SEQ ID NO: 28413 - DNA, 22 bp, Artificial Sequence
  chemically synthesized
aacaaataattttgatggtttc

SEQ ID NO: 28414 - DNA, 22 bp, Artificial Sequence
  chemically synthesized
tgatggtttctaaaattgtcca

SEQ ID NO: 28415 - DNA, 22 bp, Artificial Sequence
  chemically synthesized
gatggtttctaaaattgtccag

SEQ ID NO: 28416 - DNA, 22 bp, Artificial Sequence
  chemically synthesized
atggtttctaaaattgtccaga

SEQ ID NO: 28417 - DNA, 22 bp, Artificial Sequence
  chemically synthesized
ctaaaattgtccagaatttgag

SEQ ID NO: 28418 - DNA, 22 bp, Artificial Sequence
  chemically synthesized
taaaattgtccagaatttgagg

SEQ ID NO: 28419 - DNA, 22 bp, Artificial Sequence
  chemically synthesized
aaattgtccagaatttgaggaa

SEQ ID NO: 28420 - DNA, 22 bp, Artificial Sequence
  chemically synthesized
tccagaatttgaggaaatactt

SEQ ID NO: 28421 - DNA, 22 bp, Artificial Sequence
  chemically synthesized
gaggaaatacttagatgtagta

SEQ ID NO: 28422 - DNA, 22 bp, Artificial Sequence
  chemically synthesized
aggaaatacttagatgtagtag

SEQ ID NO: 28423 - DNA, 22 bp, Artificial Sequence
  chemically synthesized
agatgtagtagatgacatcaat

SEQ ID NO: 28424 - DNA, 22 bp, Artificial Sequence
  chemically synthesized
gatgtagtagatgacatcaatt

SEQ ID NO: 28425 - DNA, 22 bp, Artificial Sequence
  chemically synthesized
atgttaacttagatttattgtt

SEQ ID NO: 28426 - DNA, 22 bp, Artificial Sequence
  chemically synthesized
tgttaacttagatttattgttg

SEQ ID NO: 28427 - DNA, 22 bp, Artificial Sequence
  chemically synthesized
acttagatttattgttggatgg

SEQ ID NO: 28428 - DNA, 22 bp, Artificial Sequence
  chemically synthesized
agatttattgttggatggttaa

SEQ ID NO: 28429 - DNA, 22 bp, Artificial Sequence
  chemically synthesized
gatttattgttggatggttaag

SEQ ID NO: 28430 - DNA, 22 bp, Artificial Sequence
  chemically synthesized
attgttggatggttaagttaat

SEQ ID NO: 28431 - DNA, 22 bp, Artificial Sequence
  chemically synthesized
ttgttggatggttaagttaatc

SEQ ID NO: 28432 - DNA, 22 bp, Artificial Sequence
  chemically synthesized
ttggatggttaagttaatcatg

SEQ ID NO: 28433 - DNA, 22 bp, Artificial Sequence
  chemically synthesized
gatggttaagttaatcatgtct

SEQ ID NO: 28434 - DNA, 22 bp, Artificial Sequence
  chemically synthesized
agttaatcatgtctgttcttgt

SEQ ID NO: 28435 - DNA, 22 bp, Artificial Sequence
  chemically synthesized
atcatgtctgttcttgtccagt

SEQ ID NO: 28436 - DNA, 22 bp, Artificial Sequence
  chemically synthesized
ttcttgtccagtctagaagttt

SEQ ID NO: 28437 - DNA, 22 bp, Artificial Sequence
  chemically synthesized
ttgtccagtctagaagtttctg

SEQ ID NO: 28438 - DNA, 22 bp, Artificial Sequence
  chemically synthesized
gtccagtctagaagtttctgct

SEQ ID NO: 28439 - DNA, 22 bp, Artificial Sequence
  chemically synthesized
tccagtctagaagtttctgctt

SEQ ID NO: 28440 - DNA, 22 bp, Artificial Sequence
  chemically synthesized
gaagtttctgcttcctcctcat

SEQ ID NO: 28441 - DNA, 22 bp, Artificial Sequence
  chemically synthesized
ctgcttcctcctcatgtgttct

SEQ ID NO: 28442 - DNA, 22 bp, Artificial Sequence
  chemically synthesized
tgcttcctcctcatgtgttcta

SEQ ID NO: 28443 - DNA, 22 bp, Artificial Sequence
  chemically synthesized
cttcctcctcatgtgttctatt

SEQ ID NO: 28444 - DNA, 22 bp, Artificial Sequence
  chemically synthesized
cctcctcatgtgttctattctg

SEQ ID NO: 28445 - DNA, 22 bp, Artificial Sequence
  chemically synthesized
ctcctcatgtgttctattctgt

SEQ ID NO: 28446 - DNA, 22 bp, Artificial Sequence
  chemically synthesized
ctcatgtgttctattctgtcct

SEQ ID NO: 28447 - DNA, 22 bp, Artificial Sequence
  chemically synthesized
atgtgttctattctgtcctcat

SEQ ID NO: 28448 - DNA, 22 bp, Artificial Sequence
  chemically synthesized
tattctgtcctcatcacataac

SEQ ID NO: 28449 - DNA, 22 bp, Artificial Sequence
  chemically synthesized
ttctgtcctcatcacataacat

SEQ ID NO: 28450 - DNA, 22 bp, Artificial Sequence
  chemically synthesized
tgtcctcatcacataacatctg

SEQ ID NO: 28451 - DNA, 22 bp, Artificial Sequence
  chemically synthesized
tcctcatcacataacatctgaa

SEQ ID NO: 28452 - DNA, 22 bp, Artificial Sequence
  chemically synthesized
atcacataacatctgaactgtg

SEQ ID NO: 28453 - DNA, 22 bp, Artificial Sequence
  chemically synthesized
aactgtgatttgacagtgtcct

SEQ ID NO: 28454 - DNA, 22 bp, Artificial Sequence
  chemically synthesized
tgatttgacagtgtccttatta

SEQ ID NO: 28455 - DNA, 22 bp, Artificial Sequence
  chemically synthesized
gacagtgtccttattatcagac

SEQ ID NO: 28456 - DNA, 22 bp, Artificial Sequence
  chemically synthesized
acagtgtccttattatcagact

SEQ ID NO: 28457 - DNA, 22 bp, Artificial Sequence
  chemically synthesized
attatcagactctgctcaatga

SEQ ID NO: 28458 - DNA, 22 bp, Artificial Sequence
  chemically synthesized
ttatcagactctgctcaatgac

SEQ ID NO: 28459 - DNA, 22 bp, Artificial Sequence
  chemically synthesized
tcagactctgctcaatgacagt

SEQ ID NO: 28460 - DNA, 22 bp, Artificial Sequence
  chemically synthesized
tgctcaatgacagtttaaactt

SEQ ID NO: 28461 - DNA, 22 bp, Artificial Sequence
  chemically synthesized
ctcaatgacagtttaaacttct

SEQ ID NO: 28462 - DNA, 22 bp, Artificial Sequence
  chemically synthesized
aatgacagtttaaacttctttt

SEQ ID NO: 28463 - DNA, 22 bp, Artificial Sequence
  chemically synthesized
aaacttctttttgatacagtaa

SEQ ID NO: 28464 - DNA, 22 bp, Artificial Sequence
  chemically synthesized
aacttctttttgatacagtaaa

SEQ ID NO: 28465 - DNA, 22 bp, Artificial Sequence
  chemically synthesized
ctttttgatacagtaaaaaact

SEQ ID NO: 28466 - DNA, 22 bp, Artificial Sequence
  chemically synthesized
tttttgatacagtaaaaaactt

SEQ ID NO: 28467 - DNA, 22 bp, Artificial Sequence
  chemically synthesized
tttgatacagtaaaaaactttt

SEQ ID NO: 28468 - DNA, 22 bp, Artificial Sequence
  chemically synthesized
ttgatacagtaaaaaacttttc

SEQ ID NO: 28469 - DNA, 22 bp, Artificial Sequence
  chemically synthesized
tgatacagtaaaaaacttttcc

SEQ ID NO: 28470 - DNA, 22 bp, Artificial Sequence
  chemically synthesized
gatacagtaaaaaacttttcct

SEQ ID NO: 28471 - DNA, 22 bp, Artificial Sequence
  chemically synthesized
atacagtaaaaaacttttcctt

SEQ ID NO: 28472 - DNA, 22 bp, Artificial Sequence
  chemically synthesized
ttccttaaagatgaaattctta

SEQ ID NO: 28473 - DNA, 22 bp, Artificial Sequence
  chemically synthesized
tccttaaagatgaaattcttaa

SEQ ID NO: 28474 - DNA, 22 bp, Artificial Sequence
  chemically synthesized
ccttaaagatgaaattcttaag

SEQ ID NO: 28475 - DNA, 22 bp, Artificial Sequence
  chemically synthesized
cttaaagatgaaattcttaagg

SEQ ID NO: 28476 - DNA, 22 bp, Artificial Sequence
  chemically synthesized
aaagatgaaattcttaaggaca

SEQ ID NO: 28477 - DNA, 22 bp, Artificial Sequence
  chemically synthesized
aagatgaaattcttaaggacaa

SEQ ID NO: 28478 - DNA, 22 bp, Artificial Sequence
  chemically synthesized
ttaaggacaattagcttgtgta

SEQ ID NO: 28479 - DNA, 22 bp, Artificial Sequence
  chemically synthesized
aaggacaattagcttgtgtaga

SEQ ID NO: 28480 - DNA, 22 bp, Artificial Sequence
  chemically synthesized
aggacaattagcttgtgtagac

SEQ ID NO: 28481 - DNA, 22 bp, Artificial Sequence
  chemically synthesized
gcttgtgtagactcatatgaaa

SEQ ID NO: 28482 - DNA, 22 bp, Artificial Sequence
  chemically synthesized
gtgtagactcatatgaaaattg

SEQ ID NO: 28483 - DNA, 22 bp, Artificial Sequence
  chemically synthesized
tgtagactcatatgaaaattgc

SEQ ID NO: 28484 - DNA, 22 bp, Artificial Sequence
  chemically synthesized
atatgaaaattgcttgcatttt

SEQ ID NO: 28485 - DNA, 22 bp, Artificial Sequence
  chemically synthesized
cttgcattttggagttacatta

SEQ ID NO: 28486 - DNA, 22 bp, Artificial Sequence
  chemically synthesized
gcattttggagttacattagct

SEQ ID NO: 28487 - DNA, 22 bp, Artificial Sequence
  chemically synthesized
cattttggagttacattagctc

SEQ ID NO: 28488 - DNA, 22 bp, Artificial Sequence
  chemically synthesized
tggagttacattagctcttctc

SEQ ID NO: 28489 - DNA, 22 bp, Artificial Sequence
  chemically synthesized
ggagttacattagctcttctcc

SEQ ID NO: 28490 - DNA, 22 bp, Artificial Sequence
  chemically synthesized
gagttacattagctcttctcct

SEQ ID NO: 28491 - DNA, 22 bp, Artificial Sequence
  chemically synthesized
cattagctcttctcctttataa

SEQ ID NO: 28492 - DNA, 22 bp, Artificial Sequence
  chemically synthesized
gctcttctcctttataaattaa

SEQ ID NO: 28493 - DNA, 22 bp, Artificial Sequence
  chemically synthesized
ttctcctttataaattaatgaa

SEQ ID NO: 28494 - DNA, 22 bp, Artificial Sequence
  chemically synthesized
ctcctttataaattaatgaatc

SEQ ID NO: 28495 - DNA, 22 bp, Artificial Sequence
  chemically synthesized
tcctttataaattaatgaatcc

SEQ ID NO: 28496 - DNA, 22 bp, Artificial Sequence
  chemically synthesized
ctttataaattaatgaatccta

SEQ ID NO: 28497 - DNA, 22 bp, Artificial Sequence
  chemically synthesized
tataaattaatgaatcctattg

SEQ ID NO: 28498 - DNA, 22 bp, Artificial Sequence
  chemically synthesized
ataaattaatgaatcctattgg

SEQ ID NO: 28499 - DNA, 22 bp, Artificial Sequence
  chemically synthesized
taaattaatgaatcctattggt

SEQ ID NO: 28500 - DNA, 22 bp, Artificial Sequence
  chemically synthesized
atgaatcctattggtaccatat

SEQ ID NO: 28501 - DNA, 22 bp, Artificial Sequence
  chemically synthesized
ttggtaccatataatagcatca

SEQ ID NO: 28502 - DNA, 22 bp, Artificial Sequence
  chemically synthesized
gtaccatataatagcatcaaca

SEQ ID NO: 28503 - DNA, 22 bp, Artificial Sequence
  chemically synthesized
gccttttgtgtctcgcctttca

SEQ ID NO: 28504 - DNA, 22 bp, Artificial Sequence
  chemically synthesized
ccttttgtgtctcgcctttcaa

SEQ ID NO: 28505 - DNA, 22 bp, Artificial Sequence
  chemically synthesized
ttgtgtctcgcctttcaaaggg

SEQ ID NO: 28506 - DNA, 22 bp, Artificial Sequence
  chemically synthesized
tgtgtctcgcctttcaaagggc

SEQ ID NO: 28507 - DNA, 22 bp, Artificial Sequence
  chemically synthesized
gtgtctcgcctttcaaagggca

SEQ ID NO: 28508 - DNA, 22 bp, Artificial Sequence
  chemically synthesized
tgtctcgcctttcaaagggcaa

SEQ ID NO: 28509 - DNA, 22 bp, Artificial Sequence
  chemically synthesized
gcctttcaaagggcaattttcc

SEQ ID NO: 28510 - DNA, 22 bp, Artificial Sequence
  chemically synthesized
tcaaagggcaattttccaaaaa

SEQ ID NO: 28511 - DNA, 22 bp, Artificial Sequence
  chemically synthesized
caaagggcaattttccaaaaag

SEQ ID NO: 28512 - DNA, 22 bp, Artificial Sequence
  chemically synthesized
aaagggcaattttccaaaaagt

SEQ ID NO: 28513 - DNA, 22 bp, Artificial Sequence
  chemically synthesized
tccaaaaagtatattttgcatg

SEQ ID NO: 28514 - DNA, 22 bp, Artificial Sequence
  chemically synthesized
ccaaaaagtatattttgcatgg

SEQ ID NO: 28515 - DNA, 22 bp, Artificial Sequence
  chemically synthesized
caaaaagtatattttgcatggc

SEQ ID NO: 28516 - DNA, 22 bp, Artificial Sequence
  chemically synthesized
tgcatggctcaggctaaaagta

SEQ ID NO: 28517 - DNA, 22 bp, Artificial Sequence
  chemically synthesized
gcatggctcaggctaaaagtaa

SEQ ID NO: 28518 - DNA, 22 bp, Artificial Sequence
  chemically synthesized
catggctcaggctaaaagtaat

SEQ ID NO: 28519 - DNA, 22 bp, Artificial Sequence
  chemically synthesized
aggctaaaagtaatgtctccag

SEQ ID NO: 28520 - DNA, 22 bp, Artificial Sequence
  chemically synthesized
aaagtaatgtctccagatgaag

SEQ ID NO: 28521 - DNA, 22 bp, Artificial Sequence
  chemically synthesized
cagatgaagttctactttgtga

SEQ ID NO: 28522 - DNA, 22 bp, Artificial Sequence
  chemically synthesized
tactttgtgaccattgattgtg

SEQ ID NO: 28523 - DNA, 22 bp, Artificial Sequence
  chemically synthesized
ctttgtgaccattgattgtgac

SEQ ID NO: 28524 - DNA, 22 bp, Artificial Sequence
  chemically synthesized
tgtgaccattgattgtgactat

SEQ ID NO: 28525 - DNA, 22 bp, Artificial Sequence
  chemically synthesized
gtgaccattgattgtgactatt

SEQ ID NO: 28526 - DNA, 22 bp, Artificial Sequence
  chemically synthesized
tgaccattgattgtgactattg

SEQ ID NO: 28527 - DNA, 22 bp, Artificial Sequence
  chemically synthesized
attgtgactattgataagattt

SEQ ID NO: 28528 - DNA, 22 bp, Artificial Sequence
  chemically synthesized
tgactattgataagatttacta

SEQ ID NO: 28529 - DNA, 22 bp, Artificial Sequence
  chemically synthesized
ttgataagatttactatgtaaa

SEQ ID NO: 28530 - DNA, 22 bp, Artificial Sequence
  chemically synthesized
ataagatttactatgtaaagta

SEQ ID NO: 28531 - DNA, 22 bp, Artificial Sequence
  chemically synthesized
actatgtaaagtataagttact

SEQ ID NO: 28532 - DNA, 22 bp, Artificial Sequence
  chemically synthesized
ctatgtaaagtataagttactg

SEQ ID NO: 28533 - DNA, 22 bp, Artificial Sequence
  chemically synthesized
tgtaaagtataagttactggaa

SEQ ID NO: 28534 - DNA, 22 bp, Artificial Sequence
  chemically synthesized
ctggaataatacatttaagaaa

SEQ ID NO: 28535 - DNA, 22 bp, Artificial Sequence
  chemically synthesized
gaataatacatttaagaaatat

SEQ ID NO: 28536 - DNA, 22 bp, Artificial Sequence
  chemically synthesized
aagaaatatagtagctattaaa

SEQ ID NO: 28537 - DNA, 22 bp, Artificial Sequence
  chemically synthesized
agaaatatagtagctattaaaa

SEQ ID NO: 28538 - DNA, 22 bp, Artificial Sequence
  chemically synthesized
ttaaaacctgtagtctgatgaa

SEQ ID NO: 28539 - DNA, 22 bp, Artificial Sequence
  chemically synthesized
aaacctgtagtctgatgaaatg

SEQ ID NO: 28540 - DNA, 22 bp, Artificial Sequence
  chemically synthesized
tagtctgatgaaatggaatatg

SEQ ID NO: 28541 - DNA, 22 bp, Artificial Sequence
  chemically synthesized
atgaaatggaatatgttttgaa

SEQ ID NO: 28542 - DNA, 22 bp, Artificial Sequence
  chemically synthesized
tgaaagacagcagtgaaaaatg

SEQ ID NO: 28543 - DNA, 22 bp, Artificial Sequence
  chemically synthesized
gaaagacagcagtgaaaaatga

SEQ ID NO: 28544 - DNA, 22 bp, Artificial Sequence
  chemically synthesized
aaagacagcagtgaaaaatgag

SEQ ID NO: 28545 - DNA, 22 bp, Artificial Sequence
  chemically synthesized
ctttttgcaattgagttgaaga

SEQ ID NO: 28546 - DNA, 22 bp, Artificial Sequence
  chemically synthesized
tttgcaattgagttgaagattg

SEQ ID NO: 28547 - DNA, 22 bp, Artificial Sequence
  chemically synthesized
ttgcaattgagttgaagattga

SEQ ID NO: 28548 - DNA, 22 bp, Artificial Sequence
  chemically synthesized
tgcaattgagttgaagattgat

SEQ ID NO: 28549 - DNA, 22 bp, Artificial Sequence
  chemically synthesized
gcaattgagttgaagattgatg

SEQ ID NO: 28550 - DNA, 22 bp, Artificial Sequence
  chemically synthesized
caattgagttgaagattgatgc

SEQ ID NO: 28551 - DNA, 22 bp, Artificial Sequence
  chemically synthesized
agttgaagattgatgccaggat

SEQ ID NO: 28552 - DNA, 22 bp, Artificial Sequence
  chemically synthesized
aagattgatgccaggatcttat

SEQ ID NO: 28553 - DNA, 22 bp, Artificial Sequence
  chemically synthesized
atgccaggatcttattacctcc

SEQ ID NO: 28554 - DNA, 22 bp, Artificial Sequence
  chemically synthesized
attacctccaggatttcacaaa

SEQ ID NO: 28555 - DNA, 22 bp, Artificial Sequence
  chemically synthesized
ttacctccaggatttcacaaag

SEQ ID NO: 28556 - DNA, 22 bp, Artificial Sequence
  chemically synthesized
cctccaggatttcacaaaggat

SEQ ID NO: 28557 - DNA, 22 bp, Artificial Sequence
  chemically synthesized
caggatttcacaaaggatttct

SEQ ID NO: 28558 - DNA, 22 bp, Artificial Sequence
  chemically synthesized
cacaaaggatttcttgagtcat

SEQ ID NO: 28559 - DNA, 22 bp, Artificial Sequence
  chemically synthesized
acaaaggatttcttgagtcatc

SEQ ID NO: 28560 - DNA, 22 bp, Artificial Sequence
  chemically synthesized
cttgagtcatccccttgctcta

SEQ ID NO: 28561 - DNA, 22 bp, Artificial Sequence
  chemically synthesized
ttgagtcatccccttgctctag

SEQ ID NO: 28562 - DNA, 22 bp, Artificial Sequence
  chemically synthesized
gagtcatccccttgctctagct

SEQ ID NO: 28563 - DNA, 22 bp, Artificial Sequence
  chemically synthesized
agtcatccccttgctctagctc

SEQ ID NO: 28564 - DNA, 22 bp, Artificial Sequence
  chemically synthesized
gctctagctcatgaacaaagta

SEQ ID NO: 28565 - DNA, 22 bp, Artificial Sequence
  chemically synthesized
ctctagctcatgaacaaagtat

SEQ ID NO: 28566 - DNA, 22 bp, Artificial Sequence
  chemically synthesized
tagctcatgaacaaagtattgc

SEQ ID NO: 28567 - DNA, 22 bp, Artificial Sequence
  chemically synthesized
gctcatgaacaaagtattgctc

SEQ ID NO: 28568 - DNA, 22 bp, Artificial Sequence
  chemically synthesized
atgaacaaagtattgctcaagt

SEQ ID NO: 28569 - DNA, 22 bp, Artificial Sequence
  chemically synthesized
ctcaagtaatcgacagattatt

SEQ ID NO: 28570 - DNA, 22 bp, Artificial Sequence
  chemically synthesized
aagtaatcgacagattatttgt

SEQ ID NO: 28571 - DNA, 22 bp, Artificial Sequence
  chemically synthesized
tttgtgtattctcacatgtgat

SEQ ID NO: 28572 - DNA, 22 bp, Artificial Sequence
  chemically synthesized
gtgtattctcacatgtgattat

SEQ ID NO: 28573 - DNA, 22 bp, Artificial Sequence
  chemically synthesized
tgtattctcacatgtgattatt

SEQ ID NO: 28574 - DNA, 22 bp, Artificial Sequence
  chemically synthesized
tcacatgtgattattatttagt

SEQ ID NO: 28575 - DNA, 22 bp, Artificial Sequence
  chemically synthesized
acatgtgattattatttagtgc

SEQ ID NO: 28576 - DNA, 22 bp, Artificial Sequence
  chemically synthesized
ttatttagtgctgtcacgggaa

SEQ ID NO: 28577 - DNA, 22 bp, Artificial Sequence
  chemically synthesized
tttagtgctgtcacgggaaata

SEQ ID NO: 28578 - DNA, 22 bp, Artificial Sequence
  chemically synthesized
agtgctgtcacgggaaatatcc

SEQ ID NO: 28579 - DNA, 22 bp, Artificial Sequence
  chemically synthesized
gtgctgtcacgggaaatatcct

SEQ ID NO: 28580 - DNA, 22 bp, Artificial Sequence
  chemically synthesized
tcacgggaaatatcctgcctaa

SEQ ID NO: 28581 - DNA, 22 bp, Artificial Sequence
  chemically synthesized
cctaagtttactggaggtcttc

SEQ ID NO: 28582 - DNA, 22 bp, Artificial Sequence
  chemically synthesized
agtttactggaggtcttcctcc

SEQ ID NO: 28583 - DNA, 22 bp, Artificial Sequence
  chemically synthesized
actggaggtcttcctcccctta

SEQ ID NO: 28584 - DNA, 22 bp, Artificial Sequence
  chemically synthesized
ctggaggtcttcctccccttac

SEQ ID NO: 28585 - DNA, 22 bp, Artificial Sequence
  chemically synthesized
gaggtcttcctccccttacccc

SEQ ID NO: 28586 - DNA, 22 bp, Artificial Sequence
  chemically synthesized
cctccccttacccctccctatg

SEQ ID NO: 28587 - DNA, 22 bp, Artificial Sequence
  chemically synthesized
ctccccttacccctccctatgt

SEQ ID NO: 28588 - DNA, 22 bp, Artificial Sequence
  chemically synthesized
cccttacccctccctatgtcct

SEQ ID NO: 28589 - DNA, 22 bp, Artificial Sequence
  chemically synthesized
acccctccctatgtcctcctac

SEQ ID NO: 28590 - DNA, 22 bp, Artificial Sequence
  chemically synthesized
cccctccctatgtcctcctacc

SEQ ID NO: 28591 - DNA, 22 bp, Artificial Sequence
  chemically synthesized
cctatgtcctcctacctggtta

SEQ ID NO: 28592 - DNA, 22 bp, Artificial Sequence
  chemically synthesized
tgtcctcctacctggttatcct

SEQ ID NO: 28593 - DNA, 22 bp, Artificial Sequence
  chemically synthesized
ctacctggttatccttttcaat

SEQ ID NO: 28594 - DNA, 22 bp, Artificial Sequence
  chemically synthesized
cctggttatccttttcaatcct

SEQ ID NO: 28595 - DNA, 22 bp, Artificial Sequence
  chemically synthesized
gttatccttttcaatcctatta

SEQ ID NO: 28596 - DNA, 22 bp, Artificial Sequence
  chemically synthesized
tccttttcaatcctattactct

SEQ ID NO: 28597 - DNA, 22 bp, Artificial Sequence
  chemically synthesized
ttcaatcctattactctttcct

SEQ ID NO: 28598 - DNA, 22 bp, Artificial Sequence
  chemically synthesized
tcaatcctattactctttcctt

SEQ ID NO: 28599 - DNA, 22 bp, Artificial Sequence
  chemically synthesized
caatcctattactctttccttg

SEQ ID NO: 28600 - DNA, 22 bp, Artificial Sequence
  chemically synthesized
aatcctattactctttccttgc

SEQ ID NO: 28601 - DNA, 22 bp, Artificial Sequence
  chemically synthesized
ttactctttccttgcacactct

SEQ ID NO: 28602 - DNA, 22 bp, Artificial Sequence
  chemically synthesized
ctctttccttgcacactctact

SEQ ID NO: 28603 - DNA, 22 bp, Artificial Sequence
  chemically synthesized
tttccttgcacactctactcca

SEQ ID NO: 28604 - DNA, 22 bp, Artificial Sequence
  chemically synthesized
tccttgcacactctactccagc

SEQ ID NO: 28605 - DNA, 22 bp, Artificial Sequence
  chemically synthesized
ccttgcacactctactccagct

SEQ ID NO: 28606 - DNA, 22 bp, Artificial Sequence
  chemically synthesized
cttgcacactctactccagctt

SEQ ID NO: 28607 - DNA, 22 bp, Artificial Sequence
  chemically synthesized
gcacactctactccagcttagg

SEQ ID NO: 28608 - DNA, 22 bp, Artificial Sequence
  chemically synthesized
cacactctactccagcttaggg

SEQ ID NO: 28609 - DNA, 22 bp, Artificial Sequence
  chemically synthesized
tactccagcttagggcctgggc

SEQ ID NO: 28610 - DNA, 22 bp, Artificial Sequence
  chemically synthesized
ctccagcttagggcctgggctc

SEQ ID NO: 28611 - DNA, 22 bp, Artificial Sequence
  chemically synthesized
cagcttagggcctgggctctga

SEQ ID NO: 28612 - DNA, 22 bp, Artificial Sequence
  chemically synthesized
agggcctgggctctgaccatta

SEQ ID NO: 28613 - DNA, 22 bp, Artificial Sequence
  chemically synthesized
gggcctgggctctgaccattac

SEQ ID NO: 28614 - DNA, 22 bp, Artificial Sequence
  chemically synthesized
ggctctgaccattacctctgcc

SEQ ID NO: 28615 - DNA, 22 bp, Artificial Sequence
  chemically synthesized
tgaccattacctctgcctaaaa

SEQ ID NO: 28616 - DNA, 22 bp, Artificial Sequence
  chemically synthesized
accattacctctgcctaaaaat

SEQ ID NO: 28617 - DNA, 22 bp, Artificial Sequence
  chemically synthesized
cctctgcctaaaaattcctcct

SEQ ID NO: 28618 - DNA, 22 bp, Artificial Sequence
  chemically synthesized
tgcctaaaaattcctcctcatg

SEQ ID NO: 28619 - DNA, 22 bp, Artificial Sequence
  chemically synthesized
cctaaaaattcctcctcatgac

SEQ ID NO: 28620 - DNA, 22 bp, Artificial Sequence
  chemically synthesized
aaaattcctcctcatgacatcc

SEQ ID NO: 28621 - DNA, 22 bp, Artificial Sequence
  chemically synthesized
ctcctcatgacatccatttgcc

SEQ ID NO: 28622 - DNA, 22 bp, Artificial Sequence
  chemically synthesized
ctcatgacatccatttgcccaa

SEQ ID NO: 28623 - DNA, 22 bp, Artificial Sequence
  chemically synthesized
atgacatccatttgcccaattt

SEQ ID NO: 28624 - DNA, 22 bp, Artificial Sequence
  chemically synthesized
gcccaatttcttcaccctttta

SEQ ID NO: 28625 - DNA, 22 bp, Artificial Sequence
  chemically synthesized
cccaatttcttcacccttttaa

SEQ ID NO: 28626 - DNA, 22 bp, Artificial Sequence
  chemically synthesized
cttcacccttttaattacccca

SEQ ID NO: 28627 - DNA, 22 bp, Artificial Sequence
  chemically synthesized
ttcacccttttaattaccccat

SEQ ID NO: 28628 - DNA, 22 bp, Artificial Sequence
  chemically synthesized
cacccttttaattaccccatta

SEQ ID NO: 28629 - DNA, 22 bp, Artificial Sequence
  chemically synthesized
acccttttaattaccccattaa

SEQ ID NO: 28630 - DNA, 22 bp, Artificial Sequence
  chemically synthesized
ttaattaccccattaagtgata

SEQ ID NO: 28631 - DNA, 22 bp, Artificial Sequence
  chemically synthesized
taattaccccattaagtgatat

SEQ ID NO: 28632 - DNA, 22 bp, Artificial Sequence
  chemically synthesized
aattaccccattaagtgatatt

SEQ ID NO: 28633 - DNA, 22 bp, Artificial Sequence
  chemically synthesized
attaccccattaagtgatattt

SEQ ID NO: 28634 - DNA, 22 bp, Artificial Sequence
  chemically synthesized
ccccattaagtgatattttgct

SEQ ID NO: 28635 - DNA, 22 bp, Artificial Sequence
  chemically synthesized
agtgatattttgcttgctcaat

SEQ ID NO: 28636 - DNA, 22 bp, Artificial Sequence
  chemically synthesized
tgcttgctcaatttttgccttt

SEQ ID NO: 28637 - DNA, 22 bp, Artificial Sequence
  chemically synthesized
gcttgctcaatttttgcctttt

SEQ ID NO: 28638 - DNA, 22 bp, Artificial Sequence
  chemically synthesized
cttgctcaatttttgccttttc

SEQ ID NO: 28639 - DNA, 22 bp, Artificial Sequence
  chemically synthesized
gctcaatttttgccttttcaat

SEQ ID NO: 28640 - DNA, 22 bp, Artificial Sequence
  chemically synthesized
ctcaatttttgccttttcaatc

SEQ ID NO: 28641 - DNA, 22 bp, Artificial Sequence
  chemically synthesized
aatttttgccttttcaatcaga

SEQ ID NO: 28642 - DNA, 22 bp, Artificial Sequence
  chemically synthesized
ttgccttttcaatcagatctaa

SEQ ID NO: 28643 - DNA, 22 bp, Artificial Sequence
  chemically synthesized
tgccttttcaatcagatctaat

SEQ ID NO: 28644 - DNA, 22 bp, Artificial Sequence
  chemically synthesized
gccttttcaatcagatctaatt

SEQ ID NO: 28645 - DNA, 22 bp, Artificial Sequence
  chemically synthesized
ccttttcaatcagatctaattt

SEQ ID NO: 28646 - DNA, 22 bp, Artificial Sequence
  chemically synthesized
ttcaatcagatctaatttattt

SEQ ID NO: 28647 - DNA, 22 bp, Artificial Sequence
  chemically synthesized
tcaatcagatctaatttatttt

SEQ ID NO: 28648 - DNA, 22 bp, Artificial Sequence
  chemically synthesized
caatcagatctaatttatttta

SEQ ID NO: 28649 - DNA, 22 bp, Artificial Sequence
  chemically synthesized
aatcagatctaatttattttat

SEQ ID NO: 28650 - DNA, 22 bp, Artificial Sequence
  chemically synthesized
atttattttatatttttaaaat

SEQ ID NO: 28651 - DNA, 22 bp, Artificial Sequence
  chemically synthesized
attttatatttttaaaatttat

SEQ ID NO: 28652 - DNA, 22 bp, Artificial Sequence
  chemically synthesized
ttttatatttttaaaatttatt

SEQ ID NO: 28653 - DNA, 22 bp, Artificial Sequence
  chemically synthesized
tatatttttaaaatttatttat

SEQ ID NO: 28654 - DNA, 22 bp, Artificial Sequence
  chemically synthesized
atatttttaaaatttatttata

SEQ ID NO: 28655 - DNA, 22 bp, Artificial Sequence
  chemically synthesized
tatttttaaaatttatttatat

SEQ ID NO: 28656 - DNA, 22 bp, Artificial Sequence
  chemically synthesized
ttaaaatttatttatatatatt

SEQ ID NO: 28657 - DNA, 22 bp, Artificial Sequence
  chemically synthesized
taaaatttatttatatatattt

SEQ ID NO: 28658 - DNA, 22 bp, Artificial Sequence
  chemically synthesized
aaaatttatttatatatattta

SEQ ID NO: 28659 - DNA, 22 bp, Artificial Sequence
  chemically synthesized
aaatttatttatatatatttag

SEQ ID NO: 28660 - DNA, 22 bp, Artificial Sequence
  chemically synthesized
atttatatatatttagaaggta

SEQ ID NO: 28661 - DNA, 22 bp, Artificial Sequence
  chemically synthesized
tttatatatatttagaaggtat

SEQ ID NO: 28662 - DNA, 22 bp, Artificial Sequence
  chemically synthesized
atatatatttagaaggtatgta

SEQ ID NO: 28663 - DNA, 22 bp, Artificial Sequence
  chemically synthesized
tatatatttagaaggtatgtac

SEQ ID NO: 28664 - DNA, 22 bp, Artificial Sequence
  chemically synthesized
agaaggtatgtactagttcgtt

SEQ ID NO: 28665 - DNA, 22 bp, Artificial Sequence
  chemically synthesized
gaaggtatgtactagttcgtta

SEQ ID NO: 28666 - DNA, 22 bp, Artificial Sequence
  chemically synthesized
gttcgttatcatgctgcttata

SEQ ID NO: 28667 - DNA, 22 bp, Artificial Sequence
  chemically synthesized
gttatcatgctgcttataaaga

SEQ ID NO: 28668 - DNA, 22 bp, Artificial Sequence
  chemically synthesized
tcatgctgcttataaagacata

SEQ ID NO: 28669 - DNA, 22 bp, Artificial Sequence
  chemically synthesized
cttataaagacatacctgagac

SEQ ID NO: 28670 - DNA, 22 bp, Artificial Sequence
  chemically synthesized
ataaagacatacctgagactgg

SEQ ID NO: 28671 - DNA, 22 bp, Artificial Sequence
  chemically synthesized
taaagacatacctgagactggg

SEQ ID NO: 28672 - DNA, 22 bp, Artificial Sequence
  chemically synthesized
agactgggtaatttataaggaa

SEQ ID NO: 28673 - DNA, 22 bp, Artificial Sequence
  chemically synthesized
ggtaatttataaggaaaaaacg

SEQ ID NO: 28674 - DNA, 22 bp, Artificial Sequence
  chemically synthesized
ataaggaaaaaacgtttaattg

SEQ ID NO: 28675 - DNA, 22 bp, Artificial Sequence
  chemically synthesized
taaggaaaaaacgtttaattgt

SEQ ID NO: 28676 - DNA, 22 bp, Artificial Sequence
  chemically synthesized
aattgtctcacagttccacagg

SEQ ID NO: 28677 - DNA, 22 bp, Artificial Sequence
  chemically synthesized
attgtctcacagttccacaggg

SEQ ID NO: 28678 - DNA, 22 bp, Artificial Sequence
  chemically synthesized
tctcacagttccacagggctgg

SEQ ID NO: 28679 - DNA, 22 bp, Artificial Sequence
  chemically synthesized
acagttccacagggctggggag

SEQ ID NO: 28680 - DNA, 22 bp, Artificial Sequence
  chemically synthesized
cacagggctggggaggcctcgg

SEQ ID NO: 28681 - DNA, 22 bp, Artificial Sequence
  chemically synthesized
gggaggcctcgggaaacttaca

SEQ ID NO: 28682 - DNA, 22 bp, Artificial Sequence
  chemically synthesized
gggaaacttacaatcatggcag

SEQ ID NO: 28683 - DNA, 22 bp, Artificial Sequence
  chemically synthesized
acaatcatggcagaagaagaaa

SEQ ID NO: 28684 - DNA, 22 bp, Artificial Sequence
  chemically synthesized
caatcatggcagaagaagaaac

SEQ ID NO: 28685 - DNA, 22 bp, Artificial Sequence
  chemically synthesized
cttcacatggcagcagcaagta

SEQ ID NO: 28686 - DNA, 22 bp, Artificial Sequence
  chemically synthesized
ttcacatggcagcagcaagtag

SEQ ID NO: 28687 - DNA, 22 bp, Artificial Sequence
  chemically synthesized
cacatggcagcagcaagtagaa

SEQ ID NO: 28688 - DNA, 22 bp, Artificial Sequence
  chemically synthesized
acatggcagcagcaagtagaag

SEQ ID NO: 28689 - DNA, 22 bp, Artificial Sequence
  chemically synthesized
ataaaaccatcagatcttgtaa

SEQ ID NO: 28690 - DNA, 22 bp, Artificial Sequence
  chemically synthesized
taaaaccatcagatcttgtaag

SEQ ID NO: 28691 - DNA, 22 bp, Artificial Sequence
  chemically synthesized
gtaagaactcactatcacgaga

SEQ ID NO: 28692 - DNA, 22 bp, Artificial Sequence
  chemically synthesized
taagaactcactatcacgagaa

SEQ ID NO: 28693 - DNA, 22 bp, Artificial Sequence
  chemically synthesized
actatcacgagaagagcatgag

SEQ ID NO: 28694 - DNA, 22 bp, Artificial Sequence
  chemically synthesized
tcacgagaagagcatgagagta

SEQ ID NO: 28695 - DNA, 22 bp, Artificial Sequence
  chemically synthesized
ctctatgattcaattacctccc

SEQ ID NO: 28696 - DNA, 22 bp, Artificial Sequence
  chemically synthesized
tatgattcaattacctccctcc

SEQ ID NO: 28697 - DNA, 22 bp, Artificial Sequence
  chemically synthesized
tgattcaattacctccctccaa

SEQ ID NO: 28698 - DNA, 22 bp, Artificial Sequence
  chemically synthesized
aattacctccctccaaatccct

SEQ ID NO: 28699 - DNA, 22 bp, Artificial Sequence
  chemically synthesized
cctccctccaaatccctcccac

SEQ ID NO: 28700 - DNA, 22 bp, Artificial Sequence
  chemically synthesized
cctccaaatccctcccacaaca

SEQ ID NO: 28701 - DNA, 22 bp, Artificial Sequence
  chemically synthesized
caaatccctcccacaacacgtg

SEQ ID NO: 28702 - DNA, 22 bp, Artificial Sequence
  chemically synthesized
ccacaacacgtgaggattatgg

SEQ ID NO: 28703 - DNA, 22 bp, Artificial Sequence
  chemically synthesized
tgggaactacaattcaagatga

SEQ ID NO: 28704 - DNA, 22 bp, Artificial Sequence
  chemically synthesized
caattcaagatgagatttgggt

SEQ ID NO: 28705 - DNA, 22 bp, Artificial Sequence
  chemically synthesized
aagatgagatttgggtggggac

SEQ ID NO: 28706 - DNA, 22 bp, Artificial Sequence
  chemically synthesized
gggtggggacacagtcaagctg

SEQ ID NO: 28707 - DNA, 22 bp, Artificial Sequence
  chemically synthesized
ggtggggacacagtcaagctgt

SEQ ID NO: 28708 - DNA, 22 bp, Artificial Sequence
  chemically synthesized
tatcagggtacaagctcgggtt

SEQ ID NO: 28709 - DNA, 22 bp, Artificial Sequence
  chemically synthesized
gggttccttacatatgtatgtt

SEQ ID NO: 28710 - DNA, 22 bp, Artificial Sequence
  chemically synthesized
cttacatatgtatgttgcatag

SEQ ID NO: 28711 - DNA, 22 bp, Artificial Sequence
  chemically synthesized
acatatgtatgttgcatagtgg

SEQ ID NO: 28712 - DNA, 22 bp, Artificial Sequence
  chemically synthesized
catatgtatgttgcatagtggt

SEQ ID NO: 28713 - DNA, 22 bp, Artificial Sequence
  chemically synthesized
catagtggtgaagtctgagctt

SEQ ID NO: 28714 - DNA, 22 bp, Artificial Sequence
  chemically synthesized
agcttttagtggaccatcacct

SEQ ID NO: 28715 - DNA, 22 bp, Artificial Sequence
  chemically synthesized
ttagtggaccatcacctgaaaa

SEQ ID NO: 28716 - DNA, 22 bp, Artificial Sequence
  chemically synthesized
tagtggaccatcacctgaaaag

SEQ ID NO: 28717 - DNA, 22 bp, Artificial Sequence
  chemically synthesized
agtggaccatcacctgaaaagt

SEQ ID NO: 28718 - DNA, 22 bp, Artificial Sequence
  chemically synthesized
gtggaccatcacctgaaaagtg

SEQ ID NO: 28719 - DNA, 22 bp, Artificial Sequence
  chemically synthesized
aaaagtgaatgttgtatccaat

SEQ ID NO: 28720 - DNA, 22 bp, Artificial Sequence
  chemically synthesized
tatccaatccgtagtttttcag

SEQ ID NO: 28721 - DNA, 22 bp, Artificial Sequence
  chemically synthesized
ttcagtcctcaccatactccta

SEQ ID NO: 28722 - DNA, 22 bp, Artificial Sequence
  chemically synthesized
tcagtcctcaccatactcctat

SEQ ID NO: 28723 - DNA, 22 bp, Artificial Sequence
  chemically synthesized
cagtcctcaccatactcctatc

SEQ ID NO: 28724 - DNA, 22 bp, Artificial Sequence
  chemically synthesized
agtcctcaccatactcctatcc

SEQ ID NO: 28725 - DNA, 22 bp, Artificial Sequence
  chemically synthesized
accatactcctatcctcccacc

SEQ ID NO: 28726 - DNA, 22 bp, Artificial Sequence
  chemically synthesized
ctatcctcccacctttctctag

SEQ ID NO: 28727 - DNA, 22 bp, Artificial Sequence
  chemically synthesized
tcctcccacctttctctagtct

SEQ ID NO: 28728 - DNA, 22 bp, Artificial Sequence
  chemically synthesized
ccacctttctctagtctcaagt

SEQ ID NO: 28729 - DNA, 22 bp, Artificial Sequence
  chemically synthesized
tctctagtctcaagtgtctatt

SEQ ID NO: 28730 - DNA, 22 bp, Artificial Sequence
  chemically synthesized
ctctagtctcaagtgtctatta

SEQ ID NO: 28731 - DNA, 22 bp, Artificial Sequence
  chemically synthesized
tctagtctcaagtgtctattat

SEQ ID NO: 28732 - DNA, 22 bp, Artificial Sequence
  chemically synthesized
tagtctcaagtgtctattattt

SEQ ID NO: 28733 - DNA, 22 bp, Artificial Sequence
  chemically synthesized
gtctcaagtgtctattatttca

SEQ ID NO: 28734 - DNA, 22 bp, Artificial Sequence
  chemically synthesized
aagtgtctattatttcattcta

SEQ ID NO: 28735 - DNA, 22 bp, Artificial Sequence
  chemically synthesized
ttatttcattctatatgtctat

SEQ ID NO: 28736 - DNA, 22 bp, Artificial Sequence
  chemically synthesized
tttcattctatatgtctatgct

SEQ ID NO: 28737 - DNA, 22 bp, Artificial Sequence
  chemically synthesized
cattctatatgtctatgcttac

SEQ ID NO: 28738 - DNA, 22 bp, Artificial Sequence
  chemically synthesized
attctatatgtctatgcttact

SEQ ID NO: 28739 - DNA, 22 bp, Artificial Sequence
  chemically synthesized
tatatgtctatgcttactcatc

SEQ ID NO: 28740 - DNA, 22 bp, Artificial Sequence
  chemically synthesized
tatgtctatgcttactcatcgt

SEQ ID NO: 28741 - DNA, 22 bp, Artificial Sequence
  chemically synthesized
tgcttactcatcgtttagctcc

SEQ ID NO: 28742 - DNA, 22 bp, Artificial Sequence
  chemically synthesized
actcatcgtttagctcccactt

SEQ ID NO: 28743 - DNA, 22 bp, Artificial Sequence
  chemically synthesized
ctcatcgtttagctcccacttg

SEQ ID NO: 28744 - DNA, 22 bp, Artificial Sequence
  chemically synthesized
atcgtttagctcccacttggct

SEQ ID NO: 28745 - DNA, 22 bp, Artificial Sequence
  chemically synthesized
agctcccacttggctctcacta

SEQ ID NO: 28746 - DNA, 22 bp, Artificial Sequence
  chemically synthesized
gctcccacttggctctcactaa

SEQ ID NO: 28747 - DNA, 22 bp, Artificial Sequence
  chemically synthesized
ccacttggctctcactaaatga

SEQ ID NO: 28748 - DNA, 22 bp, Artificial Sequence
  chemically synthesized
ggctctcactaaatgagaacat

SEQ ID NO: 28749 - DNA, 22 bp, Artificial Sequence
  chemically synthesized
gctctcactaaatgagaacata

SEQ ID NO: 28750 - DNA, 22 bp, Artificial Sequence
  chemically synthesized
tcactaaatgagaacatactgt

SEQ ID NO: 28751 - DNA, 22 bp, Artificial Sequence
  chemically synthesized
actaaatgagaacatactgtgt

SEQ ID NO: 28752 - DNA, 22 bp, Artificial Sequence
  chemically synthesized
aatgagaacatactgtgtttga

SEQ ID NO: 28753 - DNA, 22 bp, Artificial Sequence
  chemically synthesized
tgtttgactttctgtttctgag

SEQ ID NO: 28754 - DNA, 22 bp, Artificial Sequence
  chemically synthesized
gactttctgtttctgagttatt

SEQ ID NO: 28755 - DNA, 22 bp, Artificial Sequence
  chemically synthesized
actttctgtttctgagttattt

SEQ ID NO: 28756 - DNA, 22 bp, Artificial Sequence
  chemically synthesized
tctgtttctgagttatttcact

SEQ ID NO: 28757 - DNA, 22 bp, Artificial Sequence
  chemically synthesized
ctgtttctgagttatttcactg

SEQ ID NO: 28758 - DNA, 22 bp, Artificial Sequence
  chemically synthesized
tgtttctgagttatttcactga

SEQ ID NO: 28759 - DNA, 22 bp, Artificial Sequence
  chemically synthesized
tttctgagttatttcactgagg

SEQ ID NO: 28760 - DNA, 22 bp, Artificial Sequence
  chemically synthesized
ctgagttatttcactgaggata

SEQ ID NO: 28761 - DNA, 22 bp, Artificial Sequence
  chemically synthesized
tgagttatttcactgaggataa

SEQ ID NO: 28762 - DNA, 22 bp, Artificial Sequence
  chemically synthesized
agttatttcactgaggataatg

SEQ ID NO: 28763 - DNA, 22 bp, Artificial Sequence
  chemically synthesized
tttcactgaggataatgtcctc

SEQ ID NO: 28764 - DNA, 22 bp, Artificial Sequence
  chemically synthesized
cactgaggataatgtcctccag

SEQ ID NO: 28765 - DNA, 22 bp, Artificial Sequence
  chemically synthesized
actgaggataatgtcctccagt

SEQ ID NO: 28766 - DNA, 22 bp, Artificial Sequence
  chemically synthesized
aggataatgtcctccagttcta

SEQ ID NO: 28767 - DNA, 22 bp, Artificial Sequence
  chemically synthesized
cagttctaaccatgtttctaga

SEQ ID NO: 28768 - DNA, 22 bp, Artificial Sequence
  chemically synthesized
taaccatgtttctagagaagac

SEQ ID NO: 28769 - DNA, 22 bp, Artificial Sequence
  chemically synthesized
accatgtttctagagaagacat

SEQ ID NO: 28770 - DNA, 22 bp, Artificial Sequence
  chemically synthesized
ctagagaagacatgatttcatt

SEQ ID NO: 28771 - DNA, 22 bp, Artificial Sequence
  chemically synthesized
tagagaagacatgatttcattc

SEQ ID NO: 28772 - DNA, 22 bp, Artificial Sequence
  chemically synthesized
gagaagacatgatttcattctt

SEQ ID NO: 28773 - DNA, 22 bp, Artificial Sequence
  chemically synthesized
cattcttttttatggctgagta

SEQ ID NO: 28774 - DNA, 22 bp, Artificial Sequence
  chemically synthesized
attcttttttatggctgagtaa

SEQ ID NO: 28775 - DNA, 22 bp, Artificial Sequence
  chemically synthesized
ttttttatggctgagtaatata

SEQ ID NO: 28776 - DNA, 22 bp, Artificial Sequence
  chemically synthesized
ttttatggctgagtaatatata

SEQ ID NO: 28777 - DNA, 22 bp, Artificial Sequence
  chemically synthesized
tttatggctgagtaatatatat

SEQ ID NO: 28778 - DNA, 22 bp, Artificial Sequence
  chemically synthesized
ttatggctgagtaatatatatg

SEQ ID NO: 28779 - DNA, 22 bp, Artificial Sequence
  chemically synthesized
tatggctgagtaatatatatgt

SEQ ID NO: 28780 - DNA, 22 bp, Artificial Sequence
  chemically synthesized
atggctgagtaatatatatgta

SEQ ID NO: 28781 - DNA, 22 bp, Artificial Sequence
  chemically synthesized
tggctgagtaatatatatgtat

SEQ ID NO: 28782 - DNA, 22 bp, Artificial Sequence
  chemically synthesized
agtaatatatatgtatataaat

SEQ ID NO: 28783 - DNA, 22 bp, Artificial Sequence
  chemically synthesized
tctttatccaatcgtccattgg

SEQ ID NO: 28784 - DNA, 22 bp, Artificial Sequence
  chemically synthesized
ctttatccaatcgtccattggt

SEQ ID NO: 28785 - DNA, 22 bp, Artificial Sequence
  chemically synthesized
tttatccaatcgtccattggta

SEQ ID NO: 28786 - DNA, 22 bp, Artificial Sequence
  chemically synthesized
tatccaatcgtccattggtaga

SEQ ID NO: 28787 - DNA, 22 bp, Artificial Sequence
  chemically synthesized
atccaatcgtccattggtagac

SEQ ID NO: 28788 - DNA, 22 bp, Artificial Sequence
  chemically synthesized
tccaatcgtccattggtagaca

SEQ ID NO: 28789 - DNA, 22 bp, Artificial Sequence
  chemically synthesized
gtagacatttaggttgattcca

SEQ ID NO: 28790 - DNA, 22 bp, Artificial Sequence
  chemically synthesized
aggttgattccatatctttgct

SEQ ID NO: 28791 - DNA, 22 bp, Artificial Sequence
  chemically synthesized
ggttgattccatatctttgcta

SEQ ID NO: 28792 - DNA, 22 bp, Artificial Sequence
  chemically synthesized
attccatatctttgctattggg

SEQ ID NO: 28793 - DNA, 22 bp, Artificial Sequence
  chemically synthesized
catatctttgctattgggaaca

SEQ ID NO: 28794 - DNA, 22 bp, Artificial Sequence
  chemically synthesized
tgctattgggaacagtgctact

SEQ ID NO: 28795 - DNA, 22 bp, Artificial Sequence
  chemically synthesized
gctattgggaacagtgctactt

SEQ ID NO: 28796 - DNA, 22 bp, Artificial Sequence
  chemically synthesized
ctattgggaacagtgctacttt

SEQ ID NO: 28797 - DNA, 22 bp, Artificial Sequence
  chemically synthesized
ttgggaacagtgctactttgaa

SEQ ID NO: 28798 - DNA, 22 bp, Artificial Sequence
  chemically synthesized
ggaacagtgctactttgaacat

SEQ ID NO: 28799 - DNA, 22 bp, Artificial Sequence
  chemically synthesized
ctttgaacatactaatgcagat

SEQ ID NO: 28800 - DNA, 22 bp, Artificial Sequence
  chemically synthesized
tgaacatactaatgcagatatc

SEQ ID NO: 28801 - DNA, 22 bp, Artificial Sequence
  chemically synthesized
gaacatactaatgcagatatct

SEQ ID NO: 28802 - DNA, 22 bp, Artificial Sequence
  chemically synthesized
aacatactaatgcagatatctt

SEQ ID NO: 28803 - DNA, 22 bp, Artificial Sequence
  chemically synthesized
atgcagatatcttttttaatat

SEQ ID NO: 28804 - DNA, 22 bp, Artificial Sequence
  chemically synthesized
ttttaatatgatctctttcact

SEQ ID NO: 28805 - DNA, 22 bp, Artificial Sequence
  chemically synthesized
tttaatatgatctctttcactt

SEQ ID NO: 28806 - DNA, 22 bp, Artificial Sequence
  chemically synthesized
ttaatatgatctctttcacttt

SEQ ID NO: 28807 - DNA, 22 bp, Artificial Sequence
  chemically synthesized
taatatgatctctttcactttg

SEQ ID NO: 28808 - DNA, 22 bp, Artificial Sequence
  chemically synthesized
aatatgatctctttcactttgg

SEQ ID NO: 28809 - DNA, 22 bp, Artificial Sequence
  chemically synthesized
atatgatctctttcactttggg

SEQ ID NO: 28810 - DNA, 22 bp, Artificial Sequence
  chemically synthesized
tttcactttgggtccataccca

SEQ ID NO: 28811 - DNA, 22 bp, Artificial Sequence
  chemically synthesized
tcactttgggtccatacccagt

SEQ ID NO: 28812 - DNA, 22 bp, Artificial Sequence
  chemically synthesized
cactttgggtccatacccagta

SEQ ID NO: 28813 - DNA, 22 bp, Artificial Sequence
  chemically synthesized
actttgggtccatacccagtag

SEQ ID NO: 28814 - DNA, 22 bp, Artificial Sequence
  chemically synthesized
tgggtccatacccagtagtggg

SEQ ID NO: 28815 - DNA, 22 bp, Artificial Sequence
  chemically synthesized
gggtccatacccagtagtggga

SEQ ID NO: 28816 - DNA, 22 bp, Artificial Sequence
  chemically synthesized
ggtccatacccagtagtgggat

SEQ ID NO: 28817 - DNA, 22 bp, Artificial Sequence
  chemically synthesized
caggattgaatggtagttctgt

SEQ ID NO: 28818 - DNA, 22 bp, Artificial Sequence
  chemically synthesized
aatggtagttctgtttctagtt

SEQ ID NO: 28819 - DNA, 22 bp, Artificial Sequence
  chemically synthesized
tgtttctagttctttaagaaat

SEQ ID NO: 28820 - DNA, 22 bp, Artificial Sequence
  chemically synthesized
tttctagttctttaagaaatct

SEQ ID NO: 28821 - DNA, 22 bp, Artificial Sequence
  chemically synthesized
ctagttctttaagaaatcttca

SEQ ID NO: 28822 - DNA, 22 bp, Artificial Sequence
  chemically synthesized
tagttctttaagaaatcttcat

SEQ ID NO: 28823 - DNA, 22 bp, Artificial Sequence
  chemically synthesized
gttctttaagaaatcttcatgc

SEQ ID NO: 28824 - DNA, 22 bp, Artificial Sequence
  chemically synthesized
tttaagaaatcttcatgctgtc

SEQ ID NO: 28825 - DNA, 22 bp, Artificial Sequence
  chemically synthesized
taagaaatcttcatgctgtctt

SEQ ID NO: 28826 - DNA, 22 bp, Artificial Sequence
  chemically synthesized
aagaaatcttcatgctgtcttc

SEQ ID NO: 28827 - DNA, 22 bp, Artificial Sequence
  chemically synthesized
agaaatcttcatgctgtcttcc

SEQ ID NO: 28828 - DNA, 22 bp, Artificial Sequence
  chemically synthesized
catgctgtcttccataaagttt

SEQ ID NO: 28829 - DNA, 22 bp, Artificial Sequence
  chemically synthesized
atgctgtcttccataaagtttg

SEQ ID NO: 28830 - DNA, 22 bp, Artificial Sequence
  chemically synthesized
tcttccataaagtttgtactaa

SEQ ID NO: 28831 - DNA, 22 bp, Artificial Sequence
  chemically synthesized
ccataaagtttgtactaattta

SEQ ID NO: 28832 - DNA, 22 bp, Artificial Sequence
  chemically synthesized
cataaagtttgtactaatttac

SEQ ID NO: 28833 - DNA, 22 bp, Artificial Sequence
  chemically synthesized
gtactaatttacattcttacca

SEQ ID NO: 28834 - DNA, 22 bp, Artificial Sequence
  chemically synthesized
tactaatttacattcttaccaa

SEQ ID NO: 28835 - DNA, 22 bp, Artificial Sequence
  chemically synthesized
atttacattcttaccaacagtg

SEQ ID NO: 28836 - DNA, 22 bp, Artificial Sequence
  chemically synthesized
acattcttaccaacagtgtata

SEQ ID NO: 28837 - DNA, 22 bp, Artificial Sequence
  chemically synthesized
cattcttaccaacagtgtataa

SEQ ID NO: 28838 - DNA, 22 bp, Artificial Sequence
  chemically synthesized
ttaccaacagtgtataagcatt

SEQ ID NO: 28839 - DNA, 22 bp, Artificial Sequence
  chemically synthesized
accaacagtgtataagcatttt

SEQ ID NO: 28840 - DNA, 22 bp, Artificial Sequence
  chemically synthesized
ccaacagtgtataagcattttc

SEQ ID NO: 28841 - DNA, 22 bp, Artificial Sequence
  chemically synthesized
tcttgtctccacatcctcacca

SEQ ID NO: 28842 - DNA, 22 bp, Artificial Sequence
  chemically synthesized
cttgtctccacatcctcaccaa

SEQ ID NO: 28843 - DNA, 22 bp, Artificial Sequence
  chemically synthesized
ttgtctccacatcctcaccaac

SEQ ID NO: 28844 - DNA, 22 bp, Artificial Sequence
  chemically synthesized
gtctccacatcctcaccaacat

SEQ ID NO: 28845 - DNA, 22 bp, Artificial Sequence
  chemically synthesized
tctccacatcctcaccaacatc

SEQ ID NO: 28846 - DNA, 22 bp, Artificial Sequence
  chemically synthesized
cacatcctcaccaacatctgct

SEQ ID NO: 28847 - DNA, 22 bp, Artificial Sequence
  chemically synthesized
accaacatctgctgtttttgaa

SEQ ID NO: 28848 - DNA, 22 bp, Artificial Sequence
  chemically synthesized
ctgtttttgaactttataatga

SEQ ID NO: 28849 - DNA, 22 bp, Artificial Sequence
  chemically synthesized
tttttgaactttataatgatag

SEQ ID NO: 28850 - DNA, 22 bp, Artificial Sequence
  chemically synthesized
ttgaactttataatgatagcca

SEQ ID NO: 28851 - DNA, 22 bp, Artificial Sequence
  chemically synthesized
tgaactttataatgatagccat

SEQ ID NO: 28852 - DNA, 22 bp, Artificial Sequence
  chemically synthesized
gaactttataatgatagccatt

SEQ ID NO: 28853 - DNA, 22 bp, Artificial Sequence
  chemically synthesized
aactttataatgatagccattc

SEQ ID NO: 28854 - DNA, 22 bp, Artificial Sequence
  chemically synthesized
tataatgatagccattctgact

SEQ ID NO: 28855 - DNA, 22 bp, Artificial Sequence
  chemically synthesized
ataatgatagccattctgactg

SEQ ID NO: 28856 - DNA, 22 bp, Artificial Sequence
  chemically synthesized
taatgatagccattctgactgg

SEQ ID NO: 28857 - DNA, 22 bp, Artificial Sequence
  chemically synthesized
tgactggcataaggaggtatca

SEQ ID NO: 28858 - DNA, 22 bp, Artificial Sequence
  chemically synthesized
actggcataaggaggtatcata

SEQ ID NO: 28859 - DNA, 22 bp, Artificial Sequence
  chemically synthesized
gcataaggaggtatcatatggt

SEQ ID NO: 28860 - DNA, 22 bp, Artificial Sequence
  chemically synthesized
taatttgcattctctgattatt

SEQ ID NO: 28861 - DNA, 22 bp, Artificial Sequence
  chemically synthesized
aatttgcattctctgattatta

SEQ ID NO: 28862 - DNA, 22 bp, Artificial Sequence
  chemically synthesized
atttgcattctctgattattag

SEQ ID NO: 28863 - DNA, 22 bp, Artificial Sequence
  chemically synthesized
gcattctctgattattagtgat

SEQ ID NO: 28864 - DNA, 22 bp, Artificial Sequence
  chemically synthesized
cattctctgattattagtgatg

SEQ ID NO: 28865 - DNA, 22 bp, Artificial Sequence
  chemically synthesized
tctgattattagtgatgttgaa

SEQ ID NO: 28866 - DNA, 22 bp, Artificial Sequence
  chemically synthesized
tgattattagtgatgttgaact

SEQ ID NO: 28867 - DNA, 22 bp, Artificial Sequence
  chemically synthesized
attattagtgatgttgaacttt

SEQ ID NO: 28868 - DNA, 22 bp, Artificial Sequence
  chemically synthesized
ttagtgatgttgaacttttttt

SEQ ID NO: 28869 - DNA, 22 bp, Artificial Sequence
  chemically synthesized
gtgatgttgaacttttttttga

SEQ ID NO: 28870 - DNA, 22 bp, Artificial Sequence
  chemically synthesized
aacttttttttgacgtttattg

SEQ ID NO: 28871 - DNA, 22 bp, Artificial Sequence
  chemically synthesized
ttttttgacgtttattggccac

SEQ ID NO: 28872 - DNA, 22 bp, Artificial Sequence
  chemically synthesized
tttttgacgtttattggccact

SEQ ID NO: 28873 - DNA, 22 bp, Artificial Sequence
  chemically synthesized
ttttgacgtttattggccactt

SEQ ID NO: 28874 - DNA, 22 bp, Artificial Sequence
  chemically synthesized
tttgacgtttattggccacttg

SEQ ID NO: 28875 - DNA, 22 bp, Artificial Sequence
  chemically synthesized
ttgacgtttattggccacttgt

SEQ ID NO: 28876 - DNA, 22 bp, Artificial Sequence
  chemically synthesized
tgacgtttattggccacttgta

SEQ ID NO: 28877 - DNA, 22 bp, Artificial Sequence
  chemically synthesized
gacgtttattggccacttgtat

SEQ ID NO: 28878 - DNA, 22 bp, Artificial Sequence
  chemically synthesized
acgtttattggccacttgtatg

SEQ ID NO: 28879 - DNA, 22 bp, Artificial Sequence
  chemically synthesized
attggccacttgtatgtcttct

SEQ ID NO: 28880 - DNA, 22 bp, Artificial Sequence
  chemically synthesized
ttggccacttgtatgtcttctt

SEQ ID NO: 28881 - DNA, 22 bp, Artificial Sequence
  chemically synthesized
gccacttgtatgtcttcttttg

SEQ ID NO: 28882 - DNA, 22 bp, Artificial Sequence
  chemically synthesized
gtatgtcttcttttggaaaatg

SEQ ID NO: 28883 - DNA, 22 bp, Artificial Sequence
  chemically synthesized
tatgtcttcttttggaaaatgt

SEQ ID NO: 28884 - DNA, 22 bp, Artificial Sequence
  chemically synthesized
cttttggaaaatgtctgctcag

SEQ ID NO: 28885 - DNA, 22 bp, Artificial Sequence
  chemically synthesized
ttttggaaaatgtctgctcagg

SEQ ID NO: 28886 - DNA, 22 bp, Artificial Sequence
  chemically synthesized
ttggaaaatgtctgctcaggac

SEQ ID NO: 28887 - DNA, 22 bp, Artificial Sequence
  chemically synthesized
tggaaaatgtctgctcaggacc

SEQ ID NO: 28888 - DNA, 22 bp, Artificial Sequence
  chemically synthesized
ggaaaatgtctgctcaggacct

SEQ ID NO: 28889 - DNA, 22 bp, Artificial Sequence
  chemically synthesized
gaaaatgtctgctcaggacctg

SEQ ID NO: 28890 - DNA, 22 bp, Artificial Sequence
  chemically synthesized
ctcaggacctgagctcactgta

SEQ ID NO: 28891 - DNA, 22 bp, Artificial Sequence
  chemically synthesized
aggacctgagctcactgtattt

SEQ ID NO: 28892 - DNA, 22 bp, Artificial Sequence
  chemically synthesized
agctcactgtatttgtcagggt

SEQ ID NO: 28893 - DNA, 22 bp, Artificial Sequence
  chemically synthesized
actgtatttgtcagggttccct

SEQ ID NO: 28894 - DNA, 22 bp, Artificial Sequence
  chemically synthesized
tatttgtcagggttccctagag

SEQ ID NO: 28895 - DNA, 22 bp, Artificial Sequence
  chemically synthesized
gtcagggttccctagagagaca

SEQ ID NO: 28896 - DNA, 22 bp, Artificial Sequence
  chemically synthesized
tcagggttccctagagagacag

SEQ ID NO: 28897 - DNA, 22 bp, Artificial Sequence
  chemically synthesized
cctagagagacagaactaatag

SEQ ID NO: 28898 - DNA, 22 bp, Artificial Sequence
  chemically synthesized
gagagacagaactaataggaga

SEQ ID NO: 28899 - DNA, 22 bp, Artificial Sequence
  chemically synthesized
ataggagatagatagatagata

SEQ ID NO: 28900 - DNA, 22 bp, Artificial Sequence
  chemically synthesized
agatataaaagggagtttatta

SEQ ID NO: 28901 - DNA, 22 bp, Artificial Sequence
  chemically synthesized
gatataaaagggagtttattaa

SEQ ID NO: 28902 - DNA, 22 bp, Artificial Sequence
  chemically synthesized
attaagtagtgttaacttacac

SEQ ID NO: 28903 - DNA, 22 bp, Artificial Sequence
  chemically synthesized
ttaagtagtgttaacttacaca

SEQ ID NO: 28904 - DNA, 22 bp, Artificial Sequence
  chemically synthesized
agtagtgttaacttacacaatc

SEQ ID NO: 28905 - DNA, 22 bp, Artificial Sequence
  chemically synthesized
acttacacaatcacaaggtccc

SEQ ID NO: 28906 - DNA, 22 bp, Artificial Sequence
  chemically synthesized
acacaatcacaaggtcccacaa

SEQ ID NO: 28907 - DNA, 22 bp, Artificial Sequence
  chemically synthesized
cacaatcacaaggtcccacaat

SEQ ID NO: 28908 - DNA, 22 bp, Artificial Sequence
  chemically synthesized
caagcagaggagcaaggaagcc

SEQ ID NO: 28909 - DNA, 22 bp, Artificial Sequence
  chemically synthesized
aaggacttggagtccaatgttt

SEQ ID NO: 28910 - DNA, 22 bp, Artificial Sequence
  chemically synthesized
ggagtccaatgtttgagggcag

SEQ ID NO: 28911 - DNA, 22 bp, Artificial Sequence
  chemically synthesized
gagtccaatgtttgagggcagg

SEQ ID NO: 28912 - DNA, 22 bp, Artificial Sequence
  chemically synthesized
gagggcaggaagcatccagcat

SEQ ID NO: 28913 - DNA, 22 bp, Artificial Sequence
  chemically synthesized
agggcaggaagcatccagcatg

SEQ ID NO: 28914 - DNA, 22 bp, Artificial Sequence
  chemically synthesized
ggaggctaagccagtccaggat

SEQ ID NO: 28915 - DNA, 22 bp, Artificial Sequence
  chemically synthesized
gaggctaagccagtccaggatt

SEQ ID NO: 28916 - DNA, 22 bp, Artificial Sequence
  chemically synthesized
agccagtccaggattttcacat

SEQ ID NO: 28917 - DNA, 22 bp, Artificial Sequence
  chemically synthesized
tcacatgttttttttctgcctg

SEQ ID NO: 28918 - DNA, 22 bp, Artificial Sequence
  chemically synthesized
cacatgttttttttctgcctgc

SEQ ID NO: 28919 - DNA, 22 bp, Artificial Sequence
  chemically synthesized
acatgttttttttctgcctgct

SEQ ID NO: 28920 - DNA, 22 bp, Artificial Sequence
  chemically synthesized
tttttctgcctgctttatatcc

SEQ ID NO: 28921 - DNA, 22 bp, Artificial Sequence
  chemically synthesized
ttttctgcctgctttatatcct

SEQ ID NO: 28922 - DNA, 22 bp, Artificial Sequence
  chemically synthesized
tttctgcctgctttatatcctg

SEQ ID NO: 28923 - DNA, 22 bp, Artificial Sequence
  chemically synthesized
ttctgcctgctttatatcctgg

SEQ ID NO: 28924 - DNA, 22 bp, Artificial Sequence
  chemically synthesized
tctgcctgctttatatcctggc

SEQ ID NO: 28925 - DNA, 22 bp, Artificial Sequence
  chemically synthesized
ctgcctgctttatatcctggcc

SEQ ID NO: 28926 - DNA, 22 bp, Artificial Sequence
  chemically synthesized
tgcctgctttatatcctggcca

SEQ ID NO: 28927 - DNA, 22 bp, Artificial Sequence
  chemically synthesized
cctgctttatatcctggccaca

SEQ ID NO: 28928 - DNA, 22 bp, Artificial Sequence
  chemically synthesized
ctttatatcctggccacactgg

SEQ ID NO: 28929 - DNA, 22 bp, Artificial Sequence
  chemically synthesized
tatatcctggccacactggcaa

SEQ ID NO: 28930 - DNA, 22 bp, Artificial Sequence
  chemically synthesized
atatcctggccacactggcaac

SEQ ID NO: 28931 - DNA, 22 bp, Artificial Sequence
  chemically synthesized
tatcctggccacactggcaact

SEQ ID NO: 28932 - DNA, 22 bp, Artificial Sequence
  chemically synthesized
gccacactggcaactgattaga

SEQ ID NO: 28933 - DNA, 22 bp, Artificial Sequence
  chemically synthesized
gcaactgattagatggtgccca

SEQ ID NO: 28934 - DNA, 22 bp, Artificial Sequence
  chemically synthesized
attagatggtgcccacccagat

SEQ ID NO: 28935 - DNA, 22 bp, Artificial Sequence
  chemically synthesized
gatggtgcccacccagattaag

SEQ ID NO: 28936 - DNA, 22 bp, Artificial Sequence
  chemically synthesized
agggtgggtctgcctttcccag

SEQ ID NO: 28937 - DNA, 22 bp, Artificial Sequence
  chemically synthesized
cctttcccagcccactgactaa

SEQ ID NO: 28938 - DNA, 22 bp, Artificial Sequence
  chemically synthesized
tcccagcccactgactaaaatg

SEQ ID NO: 28939 - DNA, 22 bp, Artificial Sequence
  chemically synthesized
cccagcccactgactaaaatgt

SEQ ID NO: 28940 - DNA, 22 bp, Artificial Sequence
  chemically synthesized
ccagcccactgactaaaatgtt

SEQ ID NO: 28941 - DNA, 22 bp, Artificial Sequence
  chemically synthesized
actaaaatgttaatctcctttg

SEQ ID NO: 28942 - DNA, 22 bp, Artificial Sequence
  chemically synthesized
aaatgttaatctcctttggcaa

SEQ ID NO: 28943 - DNA, 22 bp, Artificial Sequence
  chemically synthesized
atctcctttggcaataccctca

SEQ ID NO: 28944 - DNA, 22 bp, Artificial Sequence
  chemically synthesized
ctttggcaataccctcacagac

SEQ ID NO: 28945 - DNA, 22 bp, Artificial Sequence
  chemically synthesized
tggcaataccctcacagacaca

SEQ ID NO: 28946 - DNA, 22 bp, Artificial Sequence
  chemically synthesized
ggcaataccctcacagacacac

SEQ ID NO: 28947 - DNA, 22 bp, Artificial Sequence
  chemically synthesized
gcaataccctcacagacacact

SEQ ID NO: 28948 - DNA, 22 bp, Artificial Sequence
  chemically synthesized
acagacacactcaggatcaata

SEQ ID NO: 28949 - DNA, 22 bp, Artificial Sequence
  chemically synthesized
aggatcaatactttgcacactt

SEQ ID NO: 28950 - DNA, 22 bp, Artificial Sequence
  chemically synthesized
tgcacacttcaatccaatcaag

SEQ ID NO: 28951 - DNA, 22 bp, Artificial Sequence
  chemically synthesized
gcacacttcaatccaatcaagt

SEQ ID NO: 28952 - DNA, 22 bp, Artificial Sequence
  chemically synthesized
cacacttcaatccaatcaagtt

SEQ ID NO: 28953 - DNA, 22 bp, Artificial Sequence
  chemically synthesized
caatccaatcaagttgacactc

SEQ ID NO: 28954 - DNA, 22 bp, Artificial Sequence
  chemically synthesized
aatccaatcaagttgacactca

SEQ ID NO: 28955 - DNA, 22 bp, Artificial Sequence
  chemically synthesized
acactcagtattaaccatcaca

SEQ ID NO: 28956 - DNA, 22 bp, Artificial Sequence
  chemically synthesized
agtattaaccatcacaagtcca

SEQ ID NO: 28957 - DNA, 22 bp, Artificial Sequence
  chemically synthesized
accatcacaagtccatcgcttg

SEQ ID NO: 28958 - DNA, 22 bp, Artificial Sequence
  chemically synthesized
gtcaacttgagcctatacacat

SEQ ID NO: 28959 - DNA, 22 bp, Artificial Sequence
  chemically synthesized
tcaacttgagcctatacacatc

SEQ ID NO: 28960 - DNA, 22 bp, Artificial Sequence
  chemically synthesized
gagcctatacacatcccctgag

SEQ ID NO: 28961 - DNA, 22 bp, Artificial Sequence
  chemically synthesized
agcctatacacatcccctgagg

SEQ ID NO: 28962 - DNA, 22 bp, Artificial Sequence
  chemically synthesized
tacacatcccctgaggtcatac

SEQ ID NO: 28963 - DNA, 22 bp, Artificial Sequence
  chemically synthesized
aggtcatacattatcttcaaat

SEQ ID NO: 28964 - DNA, 22 bp, Artificial Sequence
  chemically synthesized
tcttcaaataaagacaacaata

SEQ ID NO: 28965 - DNA, 22 bp, Artificial Sequence
  chemically synthesized
caaataaagacaacaataagtc

SEQ ID NO: 28966 - DNA, 22 bp, Artificial Sequence
  chemically synthesized
aaataaagacaacaataagtca

SEQ ID NO: 28967 - DNA, 22 bp, Artificial Sequence
  chemically synthesized
tgcctaacatactaaaactatc

SEQ ID NO: 28968 - DNA, 22 bp, Artificial Sequence
  chemically synthesized
acatactaaaactatccttcgt

SEQ ID NO: 28969 - DNA, 22 bp, Artificial Sequence
  chemically synthesized
aaactatccttcgtgcaattga

SEQ ID NO: 28970 - DNA, 22 bp, Artificial Sequence
  chemically synthesized
tccttcgtgcaattgaaaatgc

SEQ ID NO: 28971 - DNA, 22 bp, Artificial Sequence
  chemically synthesized
cgtgcaattgaaaatgcaccaa

SEQ ID NO: 28972 - DNA, 22 bp, Artificial Sequence
  chemically synthesized
gtgcaattgaaaatgcaccaat

SEQ ID NO: 28973 - DNA, 22 bp, Artificial Sequence
  chemically synthesized
aaaatgcaccaatccccattgc

SEQ ID NO: 28974 - DNA, 22 bp, Artificial Sequence
  chemically synthesized
caaatgctattacataaactta

SEQ ID NO: 28975 - DNA, 22 bp, Artificial Sequence
  chemically synthesized
ttacataaacttaacaatactt

SEQ ID NO: 28976 - DNA, 22 bp, Artificial Sequence
  chemically synthesized
cataaacttaacaatacttaaa

SEQ ID NO: 28977 - DNA, 22 bp, Artificial Sequence
  chemically synthesized
aacaatacttaaatgctgatat

SEQ ID NO: 28978 - DNA, 22 bp, Artificial Sequence
  chemically synthesized
acaatacttaaatgctgatatg

SEQ ID NO: 28979 - DNA, 22 bp, Artificial Sequence
  chemically synthesized
aaatgctgatatgaagtcaata

SEQ ID NO: 28980 - DNA, 22 bp, Artificial Sequence
  chemically synthesized
aatgctgatatgaagtcaataa

SEQ ID NO: 28981 - DNA, 22 bp, Artificial Sequence
  chemically synthesized
atatgaagtcaataaatcttat

SEQ ID NO: 28982 - DNA, 22 bp, Artificial Sequence
  chemically synthesized
atgtcacatgataaaggaaaaa

SEQ ID NO: 28983 - DNA, 22 bp, Artificial Sequence
  chemically synthesized
tgtcacatgataaaggaaaaag

SEQ ID NO: 28984 - DNA, 22 bp, Artificial Sequence
  chemically synthesized
tcttagtacaagtgtatacaga

SEQ ID NO: 28985 - DNA, 22 bp, Artificial Sequence
  chemically synthesized
cttagtacaagtgtatacagac

SEQ ID NO: 28986 - DNA, 22 bp, Artificial Sequence
  chemically synthesized
ttagtacaagtgtatacagaca

SEQ ID NO: 28987 - DNA, 22 bp, Artificial Sequence
  chemically synthesized
agtacaagtgtatacagacacg

SEQ ID NO: 28988 - DNA, 22 bp, Artificial Sequence
  chemically synthesized
gtacaagtgtatacagacacga

SEQ ID NO: 28989 - DNA, 22 bp, Artificial Sequence
  chemically synthesized
ttaacaaaagaaggaggaaata

SEQ ID NO: 28990 - DNA, 22 bp, Artificial Sequence
  chemically synthesized
taacaaaagaaggaggaaatac

SEQ ID NO: 28991 - DNA, 22 bp, Artificial Sequence
  chemically synthesized
aacaaaagaaggaggaaatact

SEQ ID NO: 28992 - DNA, 22 bp, Artificial Sequence
  chemically synthesized
acaaaagaaggaggaaatactc

SEQ ID NO: 28993 - DNA, 22 bp, Artificial Sequence
  chemically synthesized
atgacaattacagtccttgtat

SEQ ID NO: 28994 - DNA, 22 bp, Artificial Sequence
  chemically synthesized
cagtccttgtatctgcaattgg

SEQ ID NO: 28995 - DNA, 22 bp, Artificial Sequence
  chemically synthesized
gtatctgcaattggtcacgtga

SEQ ID NO: 28996 - DNA, 22 bp, Artificial Sequence
  chemically synthesized
tatctgcaattggtcacgtgat

SEQ ID NO: 28997 - DNA, 22 bp, Artificial Sequence
  chemically synthesized
caattggtcacgtgatcgtagc

SEQ ID NO: 28998 - DNA, 22 bp, Artificial Sequence
  chemically synthesized
gtcacgtgatcgtagctggtat

SEQ ID NO: 28999 - DNA, 22 bp, Artificial Sequence
  chemically synthesized
gtattgatgactaccttcttct

SEQ ID NO: 29000 - DNA, 22 bp, Artificial Sequence
  chemically synthesized
atgactaccttcttctgctaca

SEQ ID NO: 29001 - DNA, 22 bp, Artificial Sequence
  chemically synthesized
ccttcttctgctacatattctg

SEQ ID NO: 29002 - DNA, 22 bp, Artificial Sequence
  chemically synthesized
cttctgctacatattctgtatt

SEQ ID NO: 29003 - DNA, 22 bp, Artificial Sequence
  chemically synthesized
ttctgctacatattctgtattc

SEQ ID NO: 29004 - DNA, 22 bp, Artificial Sequence
  chemically synthesized
ctgctacatattctgtattccc

SEQ ID NO: 29005 - DNA, 22 bp, Artificial Sequence
  chemically synthesized
tgctacatattctgtattccct

SEQ ID NO: 29006 - DNA, 22 bp, Artificial Sequence
  chemically synthesized
ctacatattctgtattcccttt

SEQ ID NO: 29007 - DNA, 22 bp, Artificial Sequence
  chemically synthesized
catattctgtattccctttgcc

SEQ ID NO: 29008 - DNA, 22 bp, Artificial Sequence
  chemically synthesized
tgtattccctttgccctcagca

SEQ ID NO: 29009 - DNA, 22 bp, Artificial Sequence
  chemically synthesized
tattccctttgccctcagcaag

SEQ ID NO: 29010 - DNA, 22 bp, Artificial Sequence
  chemically synthesized
cctttgccctcagcaagcacct

SEQ ID NO: 29011 - DNA, 22 bp, Artificial Sequence
  chemically synthesized
tgccctcagcaagcacctcagc

SEQ ID NO: 29012 - DNA, 22 bp, Artificial Sequence
  chemically synthesized
gccctcagcaagcacctcagca

SEQ ID NO: 29013 - DNA, 22 bp, Artificial Sequence
  chemically synthesized
ccctcagcaagcacctcagcag

SEQ ID NO: 29014 - DNA, 22 bp, Artificial Sequence
  chemically synthesized
agcaagcacctcagcaggtctt

SEQ ID NO: 29015 - DNA, 22 bp, Artificial Sequence
  chemically synthesized
agcaggtcttgtcttttttttt

SEQ ID NO: 29016 - DNA, 22 bp, Artificial Sequence
  chemically synthesized
gtcttttttttttttttttttc

SEQ ID NO: 29017 - DNA, 22 bp, Artificial Sequence
  chemically synthesized
tcttttttttttttttttttcc

SEQ ID NO: 29018 - DNA, 22 bp, Artificial Sequence
  chemically synthesized
ttttttttttttttttcctggt

SEQ ID NO: 29019 - DNA, 22 bp, Artificial Sequence
  chemically synthesized
tttttttttttttttcctggtg

SEQ ID NO: 29020 - DNA, 22 bp, Artificial Sequence
  chemically synthesized
ttttttttttttttcctggtgg

SEQ ID NO: 29021 - DNA, 22 bp, Artificial Sequence
  chemically synthesized
tttttttttttttcctggtgga

SEQ ID NO: 29022 - DNA, 22 bp, Artificial Sequence
  chemically synthesized
ttttttttttttcctggtggag

SEQ ID NO: 29023 - DNA, 22 bp, Artificial Sequence
  chemically synthesized
tttttttttttcctggtggagt

SEQ ID NO: 29024 - DNA, 22 bp, Artificial Sequence
  chemically synthesized
ttttttttttcctggtggagtg

SEQ ID NO: 29025 - DNA, 22 bp, Artificial Sequence
  chemically synthesized
tttttttttcctggtggagtga

SEQ ID NO: 29026 - DNA, 22 bp, Artificial Sequence
  chemically synthesized
ttttttttcctggtggagtgac

SEQ ID NO: 29027 - DNA, 22 bp, Artificial Sequence
  chemically synthesized
tttttttcctggtggagtgacc

SEQ ID NO: 29028 - DNA, 22 bp, Artificial Sequence
  chemically synthesized
ttttttcctggtggagtgaccc

SEQ ID NO: 29029 - DNA, 22 bp, Artificial Sequence
  chemically synthesized
tttttcctggtggagtgaccca

SEQ ID NO: 29030 - DNA, 22 bp, Artificial Sequence
  chemically synthesized
ttttcctggtggagtgacccaa

SEQ ID NO: 29031 - DNA, 22 bp, Artificial Sequence
  chemically synthesized
tttcctggtggagtgacccaaa

SEQ ID NO: 29032 - DNA, 22 bp, Artificial Sequence
  chemically synthesized
ttcctggtggagtgacccaaac

SEQ ID NO: 29033 - DNA, 22 bp, Artificial Sequence
  chemically synthesized
tcctggtggagtgacccaaacc

SEQ ID NO: 29034 - DNA, 22 bp, Artificial Sequence
  chemically synthesized
cctggtggagtgacccaaacct

SEQ ID NO: 29035 - DNA, 22 bp, Artificial Sequence
  chemically synthesized
ctggtggagtgacccaaacctt

SEQ ID NO: 29036 - DNA, 22 bp, Artificial Sequence
  chemically synthesized
gtggagtgacccaaacctttat

SEQ ID NO: 29037 - DNA, 22 bp, Artificial Sequence
  chemically synthesized
tatttgtagtcctgcctggaat

SEQ ID NO: 29038 - DNA, 22 bp, Artificial Sequence
  chemically synthesized
atttgtagtcctgcctggaatg

SEQ ID NO: 29039 - DNA, 22 bp, Artificial Sequence
  chemically synthesized
tttgtagtcctgcctggaatgg

SEQ ID NO: 29040 - DNA, 22 bp, Artificial Sequence
  chemically synthesized
gtagtcctgcctggaatggcct

SEQ ID NO: 29041 - DNA, 22 bp, Artificial Sequence
  chemically synthesized
tagtcctgcctggaatggcctg

SEQ ID NO: 29042 - DNA, 22 bp, Artificial Sequence
  chemically synthesized
cctggaatggcctgtagtagtt

SEQ ID NO: 29043 - DNA, 22 bp, Artificial Sequence
  chemically synthesized
gaatggcctgtagtagtttccc

SEQ ID NO: 29044 - DNA, 22 bp, Artificial Sequence
  chemically synthesized
tagtagtttcccactgacctta

SEQ ID NO: 29045 - DNA, 22 bp, Artificial Sequence
  chemically synthesized
cccactgaccttaattccagga

SEQ ID NO: 29046 - DNA, 22 bp, Artificial Sequence
  chemically synthesized
ccactgaccttaattccaggac

SEQ ID NO: 29047 - DNA, 22 bp, Artificial Sequence
  chemically synthesized
accttaattccaggacatggta

SEQ ID NO: 29048 - DNA, 22 bp, Artificial Sequence
  chemically synthesized
aattccaggacatggtaaaact

SEQ ID NO: 29049 - DNA, 22 bp, Artificial Sequence
  chemically synthesized
attccaggacatggtaaaacta

SEQ ID NO: 29050 - DNA, 22 bp, Artificial Sequence
  chemically synthesized
caggacatggtaaaactaagag

SEQ ID NO: 29051 - DNA, 22 bp, Artificial Sequence
  chemically synthesized
agagacaccctaatggatctcc

SEQ ID NO: 29052 - DNA, 22 bp, Artificial Sequence
  chemically synthesized
atggatctcctatattccatgc

SEQ ID NO: 29053 - DNA, 22 bp, Artificial Sequence
  chemically synthesized
ctatattccatgcatacgcttc

SEQ ID NO: 29054 - DNA, 22 bp, Artificial Sequence
  chemically synthesized
tattccatgcatacgcttcctt

SEQ ID NO: 29055 - DNA, 22 bp, Artificial Sequence
  chemically synthesized
catgcatacgcttccttacctc

SEQ ID NO: 29056 - DNA, 22 bp, Artificial Sequence
  chemically synthesized
ccttacctccattgtggagttg

SEQ ID NO: 29057 - DNA, 22 bp, Artificial Sequence
  chemically synthesized
cttacctccattgtggagttgt

SEQ ID NO: 29058 - DNA, 22 bp, Artificial Sequence
  chemically synthesized
acctccattgtggagttgtaga

SEQ ID NO: 29059 - DNA, 22 bp, Artificial Sequence
  chemically synthesized
cctccattgtggagttgtagac

SEQ ID NO: 29060 - DNA, 22 bp, Artificial Sequence
  chemically synthesized
cattgtggagttgtagactgat

SEQ ID NO: 29061 - DNA, 22 bp, Artificial Sequence
  chemically synthesized
tggagttgtagactgatttcat

SEQ ID NO: 29062 - DNA, 22 bp, Artificial Sequence
  chemically synthesized
tagactgatttcatcttgatag

SEQ ID NO: 29063 - DNA, 22 bp, Artificial Sequence
  chemically synthesized
atttcatcttgatagtctgggt

SEQ ID NO: 29064 - DNA, 22 bp, Artificial Sequence
  chemically synthesized
catcttgatagtctgggttaat

SEQ ID NO: 29065 - DNA, 22 bp, Artificial Sequence
  chemically synthesized
atcttgatagtctgggttaatc

SEQ ID NO: 29066 - DNA, 22 bp, Artificial Sequence
  chemically synthesized
gatagtctgggttaatcaccgc

SEQ ID NO: 29067 - DNA, 22 bp, Artificial Sequence
  chemically synthesized
atagtctgggttaatcaccgca

SEQ ID NO: 29068 - DNA, 22 bp, Artificial Sequence
  chemically synthesized
ggttaatcaccgcagccaacac

SEQ ID NO: 29069 - DNA, 22 bp, Artificial Sequence
  chemically synthesized
atcaccgcagccaacactgtaa

SEQ ID NO: 29070 - DNA, 22 bp, Artificial Sequence
  chemically synthesized
taactctcttcttagcctgttg

SEQ ID NO: 29071 - DNA, 22 bp, Artificial Sequence
  chemically synthesized
tcttcttagcctgttgacttaa

SEQ ID NO: 29072 - DNA, 22 bp, Artificial Sequence
  chemically synthesized
ttcttagcctgttgacttaaag

SEQ ID NO: 29073 - DNA, 22 bp, Artificial Sequence
  chemically synthesized
cttagcctgttgacttaaaggt

SEQ ID NO: 29074 - DNA, 22 bp, Artificial Sequence
  chemically synthesized
ttagcctgttgacttaaaggtg

SEQ ID NO: 29075 - DNA, 22 bp, Artificial Sequence
  chemically synthesized
agcctgttgacttaaaggtggg

SEQ ID NO: 29076 - DNA, 22 bp, Artificial Sequence
  chemically synthesized
gcctgttgacttaaaggtggga

SEQ ID NO: 29077 - DNA, 22 bp, Artificial Sequence
  chemically synthesized
ttgacttaaaggtgggaggagc

SEQ ID NO: 29078 - DNA, 22 bp, Artificial Sequence
  chemically synthesized
acttaaaggtgggaggagccca

SEQ ID NO: 29079 - DNA, 22 bp, Artificial Sequence
  chemically synthesized
aaaggtgggaggagcccaaagt

SEQ ID NO: 29080 - DNA, 22 bp, Artificial Sequence
  chemically synthesized
aaggtgggaggagcccaaagtg

SEQ ID NO: 29081 - DNA, 22 bp, Artificial Sequence
  chemically synthesized
aatttgcagtttaatggaatca

SEQ ID NO: 29082 - DNA, 22 bp, Artificial Sequence
  chemically synthesized
atttgcagtttaatggaatcat

SEQ ID NO: 29083 - DNA, 22 bp, Artificial Sequence
  chemically synthesized
gcagtttaatggaatcattatt

SEQ ID NO: 29084 - DNA, 22 bp, Artificial Sequence
  chemically synthesized
cagtttaatggaatcattattg

SEQ ID NO: 29085 - DNA, 22 bp, Artificial Sequence
  chemically synthesized
aatggaatcattattgtgtcac

SEQ ID NO: 29086 - DNA, 22 bp, Artificial Sequence
  chemically synthesized
atggaatcattattgtgtcacc

SEQ ID NO: 29087 - DNA, 22 bp, Artificial Sequence
  chemically synthesized
ttgtgtcacctggcggcagtgt

SEQ ID NO: 29088 - DNA, 22 bp, Artificial Sequence
  chemically synthesized
tgtcacctggcggcagtgttcc

SEQ ID NO: 29089 - DNA, 22 bp, Artificial Sequence
  chemically synthesized
gcggcagtgttcctccctctgg

SEQ ID NO: 29090 - DNA, 22 bp, Artificial Sequence
  chemically synthesized
ctccctctggaactaagacctc

SEQ ID NO: 29091 - DNA, 22 bp, Artificial Sequence
  chemically synthesized
cctctggaactaagacctctaa

SEQ ID NO: 29092 - DNA, 22 bp, Artificial Sequence
  chemically synthesized
tggaactaagacctctaagcca

SEQ ID NO: 29093 - DNA, 22 bp, Artificial Sequence
  chemically synthesized
gaactaagacctctaagccagc

SEQ ID NO: 29094 - DNA, 22 bp, Artificial Sequence
  chemically synthesized
agacctctaagccagcagaaca

SEQ ID NO: 29095 - DNA, 22 bp, Artificial Sequence
  chemically synthesized
taagccagcagaacataatgcc

SEQ ID NO: 29096 - DNA, 22 bp, Artificial Sequence
  chemically synthesized
agccagcagaacataatgccat

SEQ ID NO: 29097 - DNA, 22 bp, Artificial Sequence
  chemically synthesized
tgctagtggaacactaggggtg

SEQ ID NO: 29098 - DNA, 22 bp, Artificial Sequence
  chemically synthesized
gctagtggaacactaggggtga

SEQ ID NO: 29099 - DNA, 22 bp, Artificial Sequence
  chemically synthesized
ctagtggaacactaggggtgat

SEQ ID NO: 29100 - DNA, 22 bp, Artificial Sequence
  chemically synthesized
gtggaacactaggggtgatggt

SEQ ID NO: 29101 - DNA, 22 bp, Artificial Sequence
  chemically synthesized
ggggtgatggtgagtggtgcca

SEQ ID NO: 29102 - DNA, 22 bp, Artificial Sequence
  chemically synthesized
ccacttccacttccaccctttg

SEQ ID NO: 29103 - DNA, 22 bp, Artificial Sequence
  chemically synthesized
cacttccacttccaccctttga

SEQ ID NO: 29104 - DNA, 22 bp, Artificial Sequence
  chemically synthesized
ccacttccaccctttgattcct

SEQ ID NO: 29105 - DNA, 22 bp, Artificial Sequence
  chemically synthesized
cacttccaccctttgattcctg

SEQ ID NO: 29106 - DNA, 22 bp, Artificial Sequence
  chemically synthesized
ccaccctttgattcctggaccc

SEQ ID NO: 29107 - DNA, 22 bp, Artificial Sequence
  chemically synthesized
caccctttgattcctggacccg

SEQ ID NO: 29108 - DNA, 22 bp, Artificial Sequence
  chemically synthesized
tgattcctggacccgtgaatcc

SEQ ID NO: 29109 - DNA, 22 bp, Artificial Sequence
  chemically synthesized
gattcctggacccgtgaatcct

SEQ ID NO: 29110 - DNA, 22 bp, Artificial Sequence
  chemically synthesized
attcctggacccgtgaatcctg

SEQ ID NO: 29111 - DNA, 22 bp, Artificial Sequence
  chemically synthesized
ctggacccgtgaatcctgtcta

SEQ ID NO: 29112 - DNA, 22 bp, Artificial Sequence
  chemically synthesized
gacccgtgaatcctgtctatgg

SEQ ID NO: 29113 - DNA, 22 bp, Artificial Sequence
  chemically synthesized
tctatgggagaaacagtaccat

SEQ ID NO: 29114 - DNA, 22 bp, Artificial Sequence
  chemically synthesized
tgggagaaacagtaccatatat

SEQ ID NO: 29115 - DNA, 22 bp, Artificial Sequence
  chemically synthesized
gacactgattcagagcatacac

SEQ ID NO: 29116 - DNA, 22 bp, Artificial Sequence
  chemically synthesized
attcagagcatacacagccttc

SEQ ID NO: 29117 - DNA, 22 bp, Artificial Sequence
  chemically synthesized
agagcatacacagccttctgga

SEQ ID NO: 29118 - DNA, 22 bp, Artificial Sequence
  chemically synthesized
ctggagaactttgccccaggcc

SEQ ID NO: 29119 - DNA, 22 bp, Artificial Sequence
  chemically synthesized
tggagaactttgccccaggcct

SEQ ID NO: 29120 - DNA, 22 bp, Artificial Sequence
  chemically synthesized
gagaactttgccccaggcctgc

SEQ ID NO: 29121 - DNA, 22 bp, Artificial Sequence
  chemically synthesized
tgccccaggcctgcaaagtatt

SEQ ID NO: 29122 - DNA, 22 bp, Artificial Sequence
  chemically synthesized
gccccaggcctgcaaagtattg

SEQ ID NO: 29123 - DNA, 22 bp, Artificial Sequence
  chemically synthesized
ccccaggcctgcaaagtattgt

SEQ ID NO: 29124 - DNA, 22 bp, Artificial Sequence
  chemically synthesized
caaagtattgtcacctagttgg

SEQ ID NO: 29125 - DNA, 22 bp, Artificial Sequence
  chemically synthesized
tcacctagttggcattgtaatc

SEQ ID NO: 29126 - DNA, 22 bp, Artificial Sequence
  chemically synthesized
gttggcattgtaatcgtgactt

SEQ ID NO: 29127 - DNA, 22 bp, Artificial Sequence
  chemically synthesized
gcattgtaatcgtgacttcaaa

SEQ ID NO: 29128 - DNA, 22 bp, Artificial Sequence
  chemically synthesized
taatcgtgacttcaaaaggcca

SEQ ID NO: 29129 - DNA, 22 bp, Artificial Sequence
  chemically synthesized
caaaaggccattcaaaagctgc

SEQ ID NO: 29130 - DNA, 22 bp, Artificial Sequence
  chemically synthesized
aaaaggccattcaaaagctgct

SEQ ID NO: 29131 - DNA, 22 bp, Artificial Sequence
  chemically synthesized
aaaagctgcttcaggatgatag

SEQ ID NO: 29132 - DNA, 22 bp, Artificial Sequence
  chemically synthesized
cttcaggatgatagggatcatg

SEQ ID NO: 29133 - DNA, 22 bp, Artificial Sequence
  chemically synthesized
caggatgatagggatcatggta

SEQ ID NO: 29134 - DNA, 22 bp, Artificial Sequence
  chemically synthesized
aggatgatagggatcatggtaa

SEQ ID NO: 29135 - DNA, 22 bp, Artificial Sequence
  chemically synthesized
catgagcatgagcccactgtca

SEQ ID NO: 29136 - DNA, 22 bp, Artificial Sequence
  chemically synthesized
tcacacttctttagccataaag

SEQ ID NO: 29137 - DNA, 22 bp, Artificial Sequence
  chemically synthesized
ctttagccataaagtgagtggc

SEQ ID NO: 29138 - DNA, 22 bp, Artificial Sequence
  chemically synthesized
tttagccataaagtgagtggct

SEQ ID NO: 29139 - DNA, 22 bp, Artificial Sequence
  chemically synthesized
tagccataaagtgagtggcttg

SEQ ID NO: 29140 - DNA, 22 bp, Artificial Sequence
  chemically synthesized
agccataaagtgagtggcttgg

SEQ ID NO: 29141 - DNA, 22 bp, Artificial Sequence
  chemically synthesized
gccataaagtgagtggcttggt

SEQ ID NO: 29142 - DNA, 22 bp, Artificial Sequence
  chemically synthesized
ggtcagaagcaatgctgtgtgg

SEQ ID NO: 29143 - DNA, 22 bp, Artificial Sequence
  chemically synthesized
gtcagaagcaatgctgtgtgga

SEQ ID NO: 29144 - DNA, 22 bp, Artificial Sequence
  chemically synthesized
tgtggaataccatgacagtgga

SEQ ID NO: 29145 - DNA, 22 bp, Artificial Sequence
  chemically synthesized
tgtgattccatggatggtagtc

SEQ ID NO: 29146 - DNA, 22 bp, Artificial Sequence
  chemically synthesized
tgattccatggatggtagtctt

SEQ ID NO: 29147 - DNA, 22 bp, Artificial Sequence
  chemically synthesized
catggatggtagtcttggcata

SEQ ID NO: 29148 - DNA, 22 bp, Artificial Sequence
  chemically synthesized
ggcataagcattgagttcagga

SEQ ID NO: 29149 - DNA, 22 bp, Artificial Sequence
  chemically synthesized
gcataagcattgagttcaggat

SEQ ID NO: 29150 - DNA, 22 bp, Artificial Sequence
  chemically synthesized
agttcaggattgggaaacccat

SEQ ID NO: 29151 - DNA, 22 bp, Artificial Sequence
  chemically synthesized
aggattgggaaacccatatcca

SEQ ID NO: 29152 - DNA, 22 bp, Artificial Sequence
  chemically synthesized
ggaaacccatatccagagtaag

SEQ ID NO: 29153 - DNA, 22 bp, Artificial Sequence
  chemically synthesized
ttccagtgaggacaagcctctg

SEQ ID NO: 29154 - DNA, 22 bp, Artificial Sequence
  chemically synthesized
cagtgaggacaagcctctgccc

SEQ ID NO: 29155 - DNA, 22 bp, Artificial Sequence
  chemically synthesized
tgccctttccatgatggaagag

SEQ ID NO: 29156 - DNA, 22 bp, Artificial Sequence
  chemically synthesized
ccctttccatgatggaagaggt

SEQ ID NO: 29157 - DNA, 22 bp, Artificial Sequence
  chemically synthesized
tccatgatggaagaggtccaat

SEQ ID NO: 29158 - DNA, 22 bp, Artificial Sequence
  chemically synthesized
ccatgatggaagaggtccaata

SEQ ID NO: 29159 - DNA, 22 bp, Artificial Sequence
  chemically synthesized
catgatggaagaggtccaatat

SEQ ID NO: 29160 - DNA, 22 bp, Artificial Sequence
  chemically synthesized
ccaccaggtagctggctgatca

SEQ ID NO: 29161 - DNA, 22 bp, Artificial Sequence
  chemically synthesized
gctgatcaccccgaggaatggt

SEQ ID NO: 29162 - DNA, 22 bp, Artificial Sequence
  chemically synthesized
atcaccccgaggaatggtgcca

SEQ ID NO: 29163 - DNA, 22 bp, Artificial Sequence
  chemically synthesized
agtgttggtctctgatgctggc

SEQ ID NO: 29164 - DNA, 22 bp, Artificial Sequence
  chemically synthesized
gtgttggtctctgatgctggca

SEQ ID NO: 29165 - DNA, 22 bp, Artificial Sequence
  chemically synthesized
gtctctgatgctggcaagcagt

SEQ ID NO: 29166 - DNA, 22 bp, Artificial Sequence
  chemically synthesized
tgatgctggcaagcagtggctg

SEQ ID NO: 29167 - DNA, 22 bp, Artificial Sequence
  chemically synthesized
atgctggcaagcagtggctgtg

SEQ ID NO: 29168 - DNA, 22 bp, Artificial Sequence
  chemically synthesized
gcaagcagtggctgtggccagg

SEQ ID NO: 29169 - DNA, 22 bp, Artificial Sequence
  chemically synthesized
tggccaggtcagctttggtgag

SEQ ID NO: 29170 - DNA, 22 bp, Artificial Sequence
  chemically synthesized
tggtgagtggaagtccatgttg

SEQ ID NO: 29171 - DNA, 22 bp, Artificial Sequence
  chemically synthesized
ggtgagtggaagtccatgttgc

SEQ ID NO: 29172 - DNA, 22 bp, Artificial Sequence
  chemically synthesized
gtgagtggaagtccatgttgct

SEQ ID NO: 29173 - DNA, 22 bp, Artificial Sequence
  chemically synthesized
ctgagcccaagcataacttcca

SEQ ID NO: 29174 - DNA, 22 bp, Artificial Sequence
  chemically synthesized
agcccaagcataacttccatcc

SEQ ID NO: 29175 - DNA, 22 bp, Artificial Sequence
  chemically synthesized
ccatccctgcaactgtggccac

SEQ ID NO: 29176 - DNA, 22 bp, Artificial Sequence
  chemically synthesized
catccctgcaactgtggccact

SEQ ID NO: 29177 - DNA, 22 bp, Artificial Sequence
  chemically synthesized
caactgtggccactttgttcat

SEQ ID NO: 29178 - DNA, 22 bp, Artificial Sequence
  chemically synthesized
tggccactttgttcatgggtcc

SEQ ID NO: 29179 - DNA, 22 bp, Artificial Sequence
  chemically synthesized
tgttcatgggtccattggacga

SEQ ID NO: 29180 - DNA, 22 bp, Artificial Sequence
  chemically synthesized
gttcatgggtccattggacgat

SEQ ID NO: 29181 - DNA, 22 bp, Artificial Sequence
  chemically synthesized
ttcatgggtccattggacgatg

SEQ ID NO: 29182 - DNA, 22 bp, Artificial Sequence
  chemically synthesized
atgggtccattggacgatgaca

SEQ ID NO: 29183 - DNA, 22 bp, Artificial Sequence
  chemically synthesized
gacgatgacatgagtggcctgg

SEQ ID NO: 29184 - DNA, 22 bp, Artificial Sequence
  chemically synthesized
ggaaaaggctgagtggtgtcca

SEQ ID NO: 29185 - DNA, 22 bp, Artificial Sequence
  chemically synthesized
agtggtgtccacagaattgatc

SEQ ID NO: 29186 - DNA, 22 bp, Artificial Sequence
  chemically synthesized
atcatcctatccacttgattat

SEQ ID NO: 29187 - DNA, 22 bp, Artificial Sequence
  chemically synthesized
tccacttgattattaaaatcct

SEQ ID NO: 29188 - DNA, 22 bp, Artificial Sequence
  chemically synthesized
gattattaaaatcctcttctgc

SEQ ID NO: 29189 - DNA, 22 bp, Artificial Sequence
  chemically synthesized
attattaaaatcctcttctgct

SEQ ID NO: 29190 - DNA, 22 bp, Artificial Sequence
  chemically synthesized
ttaaaatcctcttctgctgagg

SEQ ID NO: 29191 - DNA, 22 bp, Artificial Sequence
  chemically synthesized
aaatcctcttctgctgaggtca

SEQ ID NO: 29192 - DNA, 22 bp, Artificial Sequence
  chemically synthesized
ttctgctgaggtcacccattgg

SEQ ID NO: 29193 - DNA, 22 bp, Artificial Sequence
  chemically synthesized
ctgctgaggtcacccattggtg

SEQ ID NO: 29194 - DNA, 22 bp, Artificial Sequence
  chemically synthesized
tgctgaggtcacccattggtga

SEQ ID NO: 29195 - DNA, 22 bp, Artificial Sequence
  chemically synthesized
ctgaggtcacccattggtgagc

SEQ ID NO: 29196 - DNA, 22 bp, Artificial Sequence
  chemically synthesized
aggtcacccattggtgagcact

SEQ ID NO: 29197 - DNA, 22 bp, Artificial Sequence
  chemically synthesized
gtgagcactcacatgggatgaa

SEQ ID NO: 29198 - DNA, 22 bp, Artificial Sequence
  chemically synthesized
acatgggatgaaaatatctttg

SEQ ID NO: 29199 - DNA, 22 bp, Artificial Sequence
  chemically synthesized
tgtagtttttgactaatcatag

SEQ ID NO: 29200 - DNA, 22 bp, Artificial Sequence
  chemically synthesized
gtagtttttgactaatcataga

SEQ ID NO: 29201 - DNA, 22 bp, Artificial Sequence
  chemically synthesized
tagtttttgactaatcatagag

SEQ ID NO: 29202 - DNA, 22 bp, Artificial Sequence
  chemically synthesized
ttgactaatcatagaggtccat

SEQ ID NO: 29203 - DNA, 22 bp, Artificial Sequence
  chemically synthesized
tgactaatcatagaggtccatc

SEQ ID NO: 29204 - DNA, 22 bp, Artificial Sequence
  chemically synthesized
gactaatcatagaggtccatcc

SEQ ID NO: 29205 - DNA, 22 bp, Artificial Sequence
  chemically synthesized
actaatcatagaggtccatcca

SEQ ID NO: 29206 - DNA, 22 bp, Artificial Sequence
  chemically synthesized
atcatagaggtccatccacata

SEQ ID NO: 29207 - DNA, 22 bp, Artificial Sequence
  chemically synthesized
ttccccaaatttctttgtcatc

SEQ ID NO: 29208 - DNA, 22 bp, Artificial Sequence
  chemically synthesized
ccccaaatttctttgtcatcaa

SEQ ID NO: 29209 - DNA, 22 bp, Artificial Sequence
  chemically synthesized
cccaaatttctttgtcatcaat

SEQ ID NO: 29210 - DNA, 22 bp, Artificial Sequence
  chemically synthesized
ctttgtcatcaattttccagtc

SEQ ID NO: 29211 - DNA, 22 bp, Artificial Sequence
  chemically synthesized
tttgtcatcaattttccagtca

SEQ ID NO: 29212 - DNA, 22 bp, Artificial Sequence
  chemically synthesized
tgtcatcaattttccagtcatg

SEQ ID NO: 29213 - DNA, 22 bp, Artificial Sequence
  chemically synthesized
gtcatcaattttccagtcatgc

SEQ ID NO: 29214 - DNA, 22 bp, Artificial Sequence
  chemically synthesized
tcatcaattttccagtcatgct

SEQ ID NO: 29215 - DNA, 22 bp, Artificial Sequence
  chemically synthesized
tccagtcatgctttttccaagt

SEQ ID NO: 29216 - DNA, 22 bp, Artificial Sequence
  chemically synthesized
ccagtcatgctttttccaagtc

SEQ ID NO: 29217 - DNA, 22 bp, Artificial Sequence
  chemically synthesized
cagtcatgctttttccaagtcc

SEQ ID NO: 29218 - DNA, 22 bp, Artificial Sequence
  chemically synthesized
tttccaagtccctgaccatcta

SEQ ID NO: 29219 - DNA, 22 bp, Artificial Sequence
  chemically synthesized
ttccaagtccctgaccatctag

SEQ ID NO: 29220 - DNA, 22 bp, Artificial Sequence
  chemically synthesized
tccaagtccctgaccatctagc

SEQ ID NO: 29221 - DNA, 22 bp, Artificial Sequence
  chemically synthesized
ccaagtccctgaccatctagcc

SEQ ID NO: 29222 - DNA, 22 bp, Artificial Sequence
  chemically synthesized
caagtccctgaccatctagcca

SEQ ID NO: 29223 - DNA, 22 bp, Artificial Sequence
  chemically synthesized
accatctagccaaacctttggc

SEQ ID NO: 29224 - DNA, 22 bp, Artificial Sequence
  chemically synthesized
gccaaacctttggctacagccc

SEQ ID NO: 29225 - DNA, 22 bp, Artificial Sequence
  chemically synthesized
tggctacagcccatgaataagt

SEQ ID NO: 29226 - DNA, 22 bp, Artificial Sequence
  chemically synthesized
ggctacagcccatgaataagta

SEQ ID NO: 29227 - DNA, 22 bp, Artificial Sequence
  chemically synthesized
gctacagcccatgaataagtat

SEQ ID NO: 29228 - DNA, 22 bp, Artificial Sequence
  chemically synthesized
cagcccatgaataagtatataa

SEQ ID NO: 29229 - DNA, 22 bp, Artificial Sequence
  chemically synthesized
gccatttctccttctgtgcaaa

SEQ ID NO: 29230 - DNA, 22 bp, Artificial Sequence
  chemically synthesized
ctccttctgtgcaaagtgcaca

SEQ ID NO: 29231 - DNA, 22 bp, Artificial Sequence
  chemically synthesized
tccttctgtgcaaagtgcacaa

SEQ ID NO: 29232 - DNA, 22 bp, Artificial Sequence
  chemically synthesized
cttctgtgcaaagtgcacaacc

SEQ ID NO: 29233 - DNA, 22 bp, Artificial Sequence
  chemically synthesized
ctgtgcaaagtgcacaaccagg

SEQ ID NO: 29234 - DNA, 22 bp, Artificial Sequence
  chemically synthesized
tgtgcaaagtgcacaaccaggc

SEQ ID NO: 29235 - DNA, 22 bp, Artificial Sequence
  chemically synthesized
tgcaaagtgcacaaccaggcac

SEQ ID NO: 29236 - DNA, 22 bp, Artificial Sequence
  chemically synthesized
ctcaaagttctgccaactagga

SEQ ID NO: 29237 - DNA, 22 bp, Artificial Sequence
  chemically synthesized
aaagttctgccaactaggaaga

SEQ ID NO: 29238 - DNA, 22 bp, Artificial Sequence
  chemically synthesized
tgccaactaggaagatttccct

SEQ ID NO: 29239 - DNA, 22 bp, Artificial Sequence
  chemically synthesized
ccaactaggaagatttcccttc

SEQ ID NO: 29240 - DNA, 22 bp, Artificial Sequence
  chemically synthesized
ggaagatttcccttcaccgttg

SEQ ID NO: 29241 - DNA, 22 bp, Artificial Sequence
  chemically synthesized
cccttcaccgttgtccttcagg

SEQ ID NO: 29242 - DNA, 22 bp, Artificial Sequence
  chemically synthesized
ccttcaccgttgtccttcaggg

SEQ ID NO: 29243 - DNA, 22 bp, Artificial Sequence
  chemically synthesized
caccgttgtccttcagggatgt

SEQ ID NO: 29244 - DNA, 22 bp, Artificial Sequence
  chemically synthesized
accgttgtccttcagggatgtc

SEQ ID NO: 29245 - DNA, 22 bp, Artificial Sequence
  chemically synthesized
tccttcagggatgtcctagaaa

SEQ ID NO: 29246 - DNA, 22 bp, Artificial Sequence
  chemically synthesized
cagggatgtcctagaaaggggc

SEQ ID NO: 29247 - DNA, 22 bp, Artificial Sequence
  chemically synthesized
agggatgtcctagaaaggggct

SEQ ID NO: 29248 - DNA, 22 bp, Artificial Sequence
  chemically synthesized
gaaaggggctgtagtgctgcgg

SEQ ID NO: 29249 - DNA, 22 bp, Artificial Sequence
  chemically synthesized
tagtgctgcggctgtccacttt

SEQ ID NO: 29250 - DNA, 22 bp, Artificial Sequence
  chemically synthesized
cggctgtccacttttgggtggt

SEQ ID NO: 29251 - DNA, 22 bp, Artificial Sequence
  chemically synthesized
tccacttttgggtggtgcctgc

SEQ ID NO: 29252 - DNA, 22 bp, Artificial Sequence
  chemically synthesized
ttgggtggtgcctgcatatcgt

SEQ ID NO: 29253 - DNA, 22 bp, Artificial Sequence
  chemically synthesized
tgggtggtgcctgcatatcgtg

SEQ ID NO: 29254 - DNA, 22 bp, Artificial Sequence
  chemically synthesized
gggtggtgcctgcatatcgtgc

SEQ ID NO: 29255 - DNA, 22 bp, Artificial Sequence
  chemically synthesized
ggtggtgcctgcatatcgtgca

SEQ ID NO: 29256 - DNA, 22 bp, Artificial Sequence
  chemically synthesized
catatcgtgcagaactatctgt

SEQ ID NO: 29257 - DNA, 22 bp, Artificial Sequence
  chemically synthesized
tctgtgaaccaggacctagtct

SEQ ID NO: 29258 - DNA, 22 bp, Artificial Sequence
  chemically synthesized
tgaaccaggacctagtcttctc

SEQ ID NO: 29259 - DNA, 22 bp, Artificial Sequence
  chemically synthesized
gtcttctcttcctctgtcagct

SEQ ID NO: 29260 - DNA, 22 bp, Artificial Sequence
  chemically synthesized
ctcttcctctgtcagctgatca

SEQ ID NO: 29261 - DNA, 22 bp, Artificial Sequence
  chemically synthesized
tcttcctctgtcagctgatcat

SEQ ID NO: 29262 - DNA, 22 bp, Artificial Sequence
  chemically synthesized
ttcctctgtcagctgatcatag

SEQ ID NO: 29263 - DNA, 22 bp, Artificial Sequence
  chemically synthesized
cctctgtcagctgatcataggg

SEQ ID NO: 29264 - DNA, 22 bp, Artificial Sequence
  chemically synthesized
ctctgtcagctgatcataggga

SEQ ID NO: 29265 - DNA, 22 bp, Artificial Sequence
  chemically synthesized
tgtcagctgatcatagggaact

SEQ ID NO: 29266 - DNA, 22 bp, Artificial Sequence
  chemically synthesized
tcagctgatcatagggaactcc

SEQ ID NO: 29267 - DNA, 22 bp, Artificial Sequence
  chemically synthesized
atcatagggaactccccatgag

SEQ ID NO: 29268 - DNA, 22 bp, Artificial Sequence
  chemically synthesized
cccatgagaccatcggtgcagt

SEQ ID NO: 29269 - DNA, 22 bp, Artificial Sequence
  chemically synthesized
agggagagaaagcagtgtgtca

SEQ ID NO: 29270 - DNA, 22 bp, Artificial Sequence
  chemically synthesized
gagcccctttctcatgtaactt

SEQ ID NO: 29271 - DNA, 22 bp, Artificial Sequence
  chemically synthesized
agcccctttctcatgtaactta

SEQ ID NO: 29272 - DNA, 22 bp, Artificial Sequence
  chemically synthesized
tctcatgtaacttactagtgcc

SEQ ID NO: 29273 - DNA, 22 bp, Artificial Sequence
  chemically synthesized
ctcatgtaacttactagtgcct

SEQ ID NO: 29274 - DNA, 22 bp, Artificial Sequence
  chemically synthesized
tcatgtaacttactagtgcctt

SEQ ID NO: 29275 - DNA, 22 bp, Artificial Sequence
  chemically synthesized
atgtaacttactagtgccttca

SEQ ID NO: 29276 - DNA, 22 bp, Artificial Sequence
  chemically synthesized
actagtgccttcaggatctgct

SEQ ID NO: 29277 - DNA, 22 bp, Artificial Sequence
  chemically synthesized
ctagtgccttcaggatctgctc

SEQ ID NO: 29278 - DNA, 22 bp, Artificial Sequence
  chemically synthesized
gtgccttcaggatctgctcaag

SEQ ID NO: 29279 - DNA, 22 bp, Artificial Sequence
  chemically synthesized
caggatctgctcaagcccaatc

SEQ ID NO: 29280 - DNA, 22 bp, Artificial Sequence
  chemically synthesized
aggatctgctcaagcccaatcg

SEQ ID NO: 29281 - DNA, 22 bp, Artificial Sequence
  chemically synthesized
ctcaagcccaatcgcatatata

SEQ ID NO: 29282 - DNA, 22 bp, Artificial Sequence
  chemically synthesized
aagcccaatcgcatatatacca

SEQ ID NO: 29283 - DNA, 22 bp, Artificial Sequence
  chemically synthesized
ccatttgctgatgcaatgctgc

SEQ ID NO: 29284 - DNA, 22 bp, Artificial Sequence
  chemically synthesized
catttgctgatgcaatgctgct

SEQ ID NO: 29285 - DNA, 22 bp, Artificial Sequence
  chemically synthesized
gctgatgcaatgctgctgtgca

SEQ ID NO: 29286 - DNA, 22 bp, Artificial Sequence
  chemically synthesized
ctgatgcaatgctgctgtgcac

SEQ ID NO: 29287 - DNA, 22 bp, Artificial Sequence
  chemically synthesized
atgcaatgctgctgtgcacagc

SEQ ID NO: 29288 - DNA, 22 bp, Artificial Sequence
  chemically synthesized
ctgtgcacagcccactttatgg

SEQ ID NO: 29289 - DNA, 22 bp, Artificial Sequence
  chemically synthesized
tgcacagcccactttatggcta

SEQ ID NO: 29290 - DNA, 22 bp, Artificial Sequence
  chemically synthesized
tatggctagatggatcagaaag

SEQ ID NO: 29291 - DNA, 22 bp, Artificial Sequence
  chemically synthesized
atggctagatggatcagaaagc

SEQ ID NO: 29292 - DNA, 22 bp, Artificial Sequence
  chemically synthesized
tggctagatggatcagaaagca

SEQ ID NO: 29293 - DNA, 22 bp, Artificial Sequence
  chemically synthesized
gatggatcagaaagcacccagt

SEQ ID NO: 29294 - DNA, 22 bp, Artificial Sequence
  chemically synthesized
atgataggcagttcaggtcaca

SEQ ID NO: 29295 - DNA, 22 bp, Artificial Sequence
  chemically synthesized
aggtcacatggtgacttgatga

SEQ ID NO: 29296 - DNA, 22 bp, Artificial Sequence
  chemically synthesized
gatgactcatagtcaaatattt

SEQ ID NO: 29297 - DNA, 22 bp, Artificial Sequence
  chemically synthesized
atgactcatagtcaaatatttc

SEQ ID NO: 29298 - DNA, 22 bp, Artificial Sequence
  chemically synthesized
atagtcaaatatttcgtttcca

SEQ ID NO: 29299 - DNA, 22 bp, Artificial Sequence
  chemically synthesized
cgtttccaccaaagcccagtaa

SEQ ID NO: 29300 - DNA, 22 bp, Artificial Sequence
  chemically synthesized
gtttccaccaaagcccagtaac

SEQ ID NO: 29301 - DNA, 22 bp, Artificial Sequence
  chemically synthesized
ccaccaaagcccagtaacaggc

SEQ ID NO: 29302 - DNA, 22 bp, Artificial Sequence
  chemically synthesized
caccaaagcccagtaacaggcc

SEQ ID NO: 29303 - DNA, 22 bp, Artificial Sequence
  chemically synthesized
tctccctaaaagagagtagtta

SEQ ID NO: 29304 - DNA, 22 bp, Artificial Sequence
  chemically synthesized
ctccctaaaagagagtagttat

SEQ ID NO: 29305 - DNA, 22 bp, Artificial Sequence
  chemically synthesized
tccctaaaagagagtagttatc

SEQ ID NO: 29306 - DNA, 22 bp, Artificial Sequence
  chemically synthesized
cctaaaagagagtagttatctg

SEQ ID NO: 29307 - DNA, 22 bp, Artificial Sequence
  chemically synthesized
aaagagagtagttatctgcaga

SEQ ID NO: 29308 - DNA, 22 bp, Artificial Sequence
  chemically synthesized
tctgcagaagatggcagggcct

SEQ ID NO: 29309 - DNA, 22 bp, Artificial Sequence
  chemically synthesized
cagaagatggcagggccttgct

SEQ ID NO: 29310 - DNA, 22 bp, Artificial Sequence
  chemically synthesized
gctccaaaatcctagaggcctc

SEQ ID NO: 29311 - DNA, 22 bp, Artificial Sequence
  chemically synthesized
ctccaaaatcctagaggcctcc

SEQ ID NO: 29312 - DNA, 22 bp, Artificial Sequence
  chemically synthesized
caaaatcctagaggcctccgct

SEQ ID NO: 29313 - DNA, 22 bp, Artificial Sequence
  chemically synthesized
gaggcctccgctgtgattcagc

SEQ ID NO: 29314 - DNA, 22 bp, Artificial Sequence
  chemically synthesized
cgctgtgattcagcctgccaaa

SEQ ID NO: 29315 - DNA, 22 bp, Artificial Sequence
  chemically synthesized
tgattcagcctgccaaatgctc

SEQ ID NO: 29316 - DNA, 22 bp, Artificial Sequence
  chemically synthesized
agcctgccaaatgctccaaaca

SEQ ID NO: 29317 - DNA, 22 bp, Artificial Sequence
  chemically synthesized
ccaaatgctccaaacagcatcc

SEQ ID NO: 29318 - DNA, 22 bp, Artificial Sequence
  chemically synthesized
caaacagcatccctatctggca

SEQ ID NO: 29319 - DNA, 22 bp, Artificial Sequence
  chemically synthesized
tctggcactgacacctcaagca

SEQ ID NO: 29320 - DNA, 22 bp, Artificial Sequence
  chemically synthesized
gcactgacacctcaagcatcat

SEQ ID NO: 29321 - DNA, 22 bp, Artificial Sequence
  chemically synthesized
acacctcaagcatcattggatc

SEQ ID NO: 29322 - DNA, 22 bp, Artificial Sequence
  chemically synthesized
aagcatcattggatctgctagg

SEQ ID NO: 29323 - DNA, 22 bp, Artificial Sequence
  chemically synthesized
gatctgctaggtcatatggccc

SEQ ID NO: 29324 - DNA, 22 bp, Artificial Sequence
  chemically synthesized
ctaggtcatatggcccaagtgg

SEQ ID NO: 29325 - DNA, 22 bp, Artificial Sequence
  chemically synthesized
ggtcatatggcccaagtggcat

SEQ ID NO: 29326 - DNA, 22 bp, Artificial Sequence
  chemically synthesized
gcacagcagcctggacctgtgg

SEQ ID NO: 29327 - DNA, 22 bp, Artificial Sequence
  chemically synthesized
cacagcagcctggacctgtggc

SEQ ID NO: 29328 - DNA, 22 bp, Artificial Sequence
  chemically synthesized
gacctgtggcagagccttctgt

SEQ ID NO: 29329 - DNA, 22 bp, Artificial Sequence
  chemically synthesized
tggcagagccttctgttctgga

SEQ ID NO: 29330 - DNA, 22 bp, Artificial Sequence
  chemically synthesized
ctgttctggactccactcaaaa

SEQ ID NO: 29331 - DNA, 22 bp, Artificial Sequence
  chemically synthesized
tgttctggactccactcaaaac

SEQ ID NO: 29332 - DNA, 22 bp, Artificial Sequence
  chemically synthesized
ttctggactccactcaaaactg

SEQ ID NO: 29333 - DNA, 22 bp, Artificial Sequence
  chemically synthesized
tggactccactcaaaactggca

SEQ ID NO: 29334 - DNA, 22 bp, Artificial Sequence
  chemically synthesized
gactccactcaaaactggcagc

SEQ ID NO: 29335 - DNA, 22 bp, Artificial Sequence
  chemically synthesized
cactcaaaactggcagcctttt

SEQ ID NO: 29336 - DNA, 22 bp, Artificial Sequence
  chemically synthesized
aaaactggcagccttttggatc

SEQ ID NO: 29337 - DNA, 22 bp, Artificial Sequence
  chemically synthesized
gcagccttttggatcactcgat

SEQ ID NO: 29338 - DNA, 22 bp, Artificial Sequence
  chemically synthesized
ttggatcactcgataaatgggc

SEQ ID NO: 29339 - DNA, 22 bp, Artificial Sequence
  chemically synthesized
tggatcactcgataaatgggcc

SEQ ID NO: 29340 - DNA, 22 bp, Artificial Sequence
  chemically synthesized
ggatcactcgataaatgggcca

SEQ ID NO: 29341 - DNA, 22 bp, Artificial Sequence
  chemically synthesized
gatcactcgataaatgggccag

SEQ ID NO: 29342 - DNA, 22 bp, Artificial Sequence
  chemically synthesized
gataaatgggccagagtaacac

SEQ ID NO: 29343 - DNA, 22 bp, Artificial Sequence
  chemically synthesized
cctccaaaatccaaataggccc

SEQ ID NO: 29344 - DNA, 22 bp, Artificial Sequence
  chemically synthesized
caaaatccaaataggcccacta

SEQ ID NO: 29345 - DNA, 22 bp, Artificial Sequence
  chemically synthesized
ggcgttgtgcctatttcttggt

SEQ ID NO: 29346 - DNA, 22 bp, Artificial Sequence
  chemically synthesized
tgcctatttcttggttgtaaga

SEQ ID NO: 29347 - DNA, 22 bp, Artificial Sequence
  chemically synthesized
tttcttggttgtaagagtggcc

SEQ ID NO: 29348 - DNA, 22 bp, Artificial Sequence
  chemically synthesized
cttggttgtaagagtggccaaa

SEQ ID NO: 29349 - DNA, 22 bp, Artificial Sequence
  chemically synthesized
ttggttgtaagagtggccaaat

SEQ ID NO: 29350 - DNA, 22 bp, Artificial Sequence
  chemically synthesized
ggttgtaagagtggccaaatgc

SEQ ID NO: 29351 - DNA, 22 bp, Artificial Sequence
  chemically synthesized
gttgtaagagtggccaaatgca

SEQ ID NO: 29352 - DNA, 22 bp, Artificial Sequence
  chemically synthesized
taagagtggccaaatgcagcaa

SEQ ID NO: 29353 - DNA, 22 bp, Artificial Sequence
  chemically synthesized
tccttcactttagaaggaatat

SEQ ID NO: 29354 - DNA, 22 bp, Artificial Sequence
  chemically synthesized
cactttagaaggaatatctcaa

SEQ ID NO: 29355 - DNA, 22 bp, Artificial Sequence
  chemically synthesized
actttagaaggaatatctcaaa

SEQ ID NO: 29356 - DNA, 22 bp, Artificial Sequence
  chemically synthesized
tagaaggaatatctcaaagagc

SEQ ID NO: 29357 - DNA, 22 bp, Artificial Sequence
  chemically synthesized
agaaggaatatctcaaagagcc

SEQ ID NO: 29358 - DNA, 22 bp, Artificial Sequence
  chemically synthesized
gaaggaatatctcaaagagccc

SEQ ID NO: 29359 - DNA, 22 bp, Artificial Sequence
  chemically synthesized
aaagagccccaaaccattggac

SEQ ID NO: 29360 - DNA, 22 bp, Artificial Sequence
  chemically synthesized
gacccctataaattttactgag

SEQ ID NO: 29361 - DNA, 22 bp, Artificial Sequence
  chemically synthesized
taaattttactgaggtagaagg

SEQ ID NO: 29362 - DNA, 22 bp, Artificial Sequence
  chemically synthesized
tactgaggtagaaggtccctga

SEQ ID NO: 29363 - DNA, 22 bp, Artificial Sequence
  chemically synthesized
actgaggtagaaggtccctgaa

SEQ ID NO: 29364 - DNA, 22 bp, Artificial Sequence
  chemically synthesized
ctgaggtagaaggtccctgaat

SEQ ID NO: 29365 - DNA, 22 bp, Artificial Sequence
  chemically synthesized
aggtagaaggtccctgaattta

SEQ ID NO: 29366 - DNA, 22 bp, Artificial Sequence
  chemically synthesized
aatttaatcagatttatttccc

SEQ ID NO: 29367 - DNA, 22 bp, Artificial Sequence
  chemically synthesized
aatcagatttatttcccatcct

SEQ ID NO: 29368 - DNA, 22 bp, Artificial Sequence
  chemically synthesized
atcagatttatttcccatcctc

SEQ ID NO: 29369 - DNA, 22 bp, Artificial Sequence
  chemically synthesized
atttcccatcctctgtcccaca

SEQ ID NO: 29370 - DNA, 22 bp, Artificial Sequence
  chemically synthesized
tttcccatcctctgtcccacaa

SEQ ID NO: 29371 - DNA, 22 bp, Artificial Sequence
  chemically synthesized
cccatcctctgtcccacaaatg

SEQ ID NO: 29372 - DNA, 22 bp, Artificial Sequence
  chemically synthesized
ccatcctctgtcccacaaatgt

SEQ ID NO: 29373 - DNA, 22 bp, Artificial Sequence
  chemically synthesized
tgtcccacaaatgtctcatcaa

SEQ ID NO: 29374 - DNA, 22 bp, Artificial Sequence
  chemically synthesized
tcccacaaatgtctcatcaata

SEQ ID NO: 29375 - DNA, 22 bp, Artificial Sequence
  chemically synthesized
atcaataaatccagtgtgtttg

SEQ ID NO: 29376 - DNA, 22 bp, Artificial Sequence
  chemically synthesized
gctacttcttgctcactagttc

SEQ ID NO: 29377 - DNA, 22 bp, Artificial Sequence
  chemically synthesized
ctacttcttgctcactagttcc

SEQ ID NO: 29378 - DNA, 22 bp, Artificial Sequence
  chemically synthesized
cttcttgctcactagttccagt

SEQ ID NO: 29379 - DNA, 22 bp, Artificial Sequence
  chemically synthesized
cttgctcactagttccagtcag

SEQ ID NO: 29380 - DNA, 22 bp, Artificial Sequence
  chemically synthesized
ttgctcactagttccagtcagc

SEQ ID NO: 29381 - DNA, 22 bp, Artificial Sequence
  chemically synthesized
gctcactagttccagtcagcat

SEQ ID NO: 29382 - DNA, 22 bp, Artificial Sequence
  chemically synthesized
ctcactagttccagtcagcatg

SEQ ID NO: 29383 - DNA, 22 bp, Artificial Sequence
  chemically synthesized
actagttccagtcagcatgtca

SEQ ID NO: 29384 - DNA, 22 bp, Artificial Sequence
  chemically synthesized
gttccagtcagcatgtcatcaa

SEQ ID NO: 29385 - DNA, 22 bp, Artificial Sequence
  chemically synthesized
cagtcagcatgtcatcaatgta

SEQ ID NO: 29386 - DNA, 22 bp, Artificial Sequence
  chemically synthesized
tgatatcttgtggaagtgaaag

SEQ ID NO: 29387 - DNA, 22 bp, Artificial Sequence
  chemically synthesized
gtggaagtgaaaggtgagcaag

SEQ ID NO: 29388 - DNA, 22 bp, Artificial Sequence
  chemically synthesized
tggaagtgaaaggtgagcaagt

SEQ ID NO: 29389 - DNA, 22 bp, Artificial Sequence
  chemically synthesized
tctccaaataagattatggcac

SEQ ID NO: 29390 - DNA, 22 bp, Artificial Sequence
  chemically synthesized
tccaaataagattatggcacaa

SEQ ID NO: 29391 - DNA, 22 bp, Artificial Sequence
  chemically synthesized
caaataagattatggcacaaag

SEQ ID NO: 29392 - DNA, 22 bp, Artificial Sequence
  chemically synthesized
tggcacaaagctggagagttga

SEQ ID NO: 29393 - DNA, 22 bp, Artificial Sequence
  chemically synthesized
gagagttgatatactcctgagt

SEQ ID NO: 29394 - DNA, 22 bp, Artificial Sequence
  chemically synthesized
atatactcctgagttcatcatt

SEQ ID NO: 29395 - DNA, 22 bp, Artificial Sequence
  chemically synthesized
ctgagttcatcattttctttca

SEQ ID NO: 29396 - DNA, 22 bp, Artificial Sequence
  chemically synthesized
agttcatcattttctttcatca

SEQ ID NO: 29397 - DNA, 22 bp, Artificial Sequence
  chemically synthesized
atcattttctttcatcactttg

SEQ ID NO: 29398 - DNA, 22 bp, Artificial Sequence
  chemically synthesized
tctttcatcactttgtccagcg

SEQ ID NO: 29399 - DNA, 22 bp, Artificial Sequence
  chemically synthesized
ctttcatcactttgtccagcga

SEQ ID NO: 29400 - DNA, 22 bp, Artificial Sequence
  chemically synthesized
tttcatcactttgtccagcgaa

SEQ ID NO: 29401 - DNA, 22 bp, Artificial Sequence
  chemically synthesized
tcatcactttgtccagcgaact

SEQ ID NO: 29402 - DNA, 22 bp, Artificial Sequence
  chemically synthesized
catcactttgtccagcgaactt

SEQ ID NO: 29403 - DNA, 22 bp, Artificial Sequence
  chemically synthesized
atcactttgtccagcgaactta

SEQ ID NO: 29404 - DNA, 22 bp, Artificial Sequence
  chemically synthesized
tgtccagcgaacttacaagcaa

SEQ ID NO: 29405 - DNA, 22 bp, Artificial Sequence
  chemically synthesized
gtccagcgaacttacaagcaac

SEQ ID NO: 29406 - DNA, 22 bp, Artificial Sequence
  chemically synthesized
tccagcgaacttacaagcaacc

SEQ ID NO: 29407 - DNA, 22 bp, Artificial Sequence
  chemically synthesized
acaagcaaccaaccaacttcac

SEQ ID NO: 29408 - DNA, 22 bp, Artificial Sequence
  chemically synthesized
caagcaaccaaccaacttcact

SEQ ID NO: 29409 - DNA, 22 bp, Artificial Sequence
  chemically synthesized
cactatgttccttgattctcca

SEQ ID NO: 29410 - DNA, 22 bp, Artificial Sequence
  chemically synthesized
actatgttccttgattctccac

SEQ ID NO: 29411 - DNA, 22 bp, Artificial Sequence
  chemically synthesized
tgttccttgattctccacatat

SEQ ID NO: 29412 - DNA, 22 bp, Artificial Sequence
  chemically synthesized
cttgattctccacatatagtca

SEQ ID NO: 29413 - DNA, 22 bp, Artificial Sequence
  chemically synthesized
gattctccacatatagtcaaaa

SEQ ID NO: 29414 - DNA, 22 bp, Artificial Sequence
  chemically synthesized
attctccacatatagtcaaaag

SEQ ID NO: 29415 - DNA, 22 bp, Artificial Sequence
  chemically synthesized
tccacatatagtcaaaagtatt

SEQ ID NO: 29416 - DNA, 22 bp, Artificial Sequence
  chemically synthesized
cacatatagtcaaaagtattat

SEQ ID NO: 29417 - DNA, 22 bp, Artificial Sequence
  chemically synthesized
tgtatacagtagctaaattcct

SEQ ID NO: 29418 - DNA, 22 bp, Artificial Sequence
  chemically synthesized
aattccttgcctctcacaagcg

SEQ ID NO: 29419 - DNA, 22 bp, Artificial Sequence
  chemically synthesized
cttgcctctcacaagcgttgaa

SEQ ID NO: 29420 - DNA, 22 bp, Artificial Sequence
  chemically synthesized
gcctctcacaagcgttgaatca

SEQ ID NO: 29421 - DNA, 22 bp, Artificial Sequence
  chemically synthesized
cctctcacaagcgttgaatcaa

SEQ ID NO: 29422 - DNA, 22 bp, Artificial Sequence
  chemically synthesized
tcacaagcgttgaatcaagagt

SEQ ID NO: 29423 - DNA, 22 bp, Artificial Sequence
  chemically synthesized
acaagcgttgaatcaagagtgt

SEQ ID NO: 29424 - DNA, 22 bp, Artificial Sequence
  chemically synthesized
aatcaagagtgtcaaatgcatt

SEQ ID NO: 29425 - DNA, 22 bp, Artificial Sequence
  chemically synthesized
attttgcataactctctaaaca

SEQ ID NO: 29426 - DNA, 22 bp, Artificial Sequence
  chemically synthesized
ttttgcataactctctaaacaa

SEQ ID NO: 29427 - DNA, 22 bp, Artificial Sequence
  chemically synthesized
tgcataactctctaaacaattg

SEQ ID NO: 29428 - DNA, 22 bp, Artificial Sequence
  chemically synthesized
gcataactctctaaacaattga

SEQ ID NO: 29429 - DNA, 22 bp, Artificial Sequence
  chemically synthesized
cataactctctaaacaattgat

SEQ ID NO: 29430 - DNA, 22 bp, Artificial Sequence
  chemically synthesized
tctaaacaattgatgccaagga

SEQ ID NO: 29431 - DNA, 22 bp, Artificial Sequence
  chemically synthesized
taaacaattgatgccaaggatt

SEQ ID NO: 29432 - DNA, 22 bp, Artificial Sequence
  chemically synthesized
aacaattgatgccaaggattat

SEQ ID NO: 29433 - DNA, 22 bp, Artificial Sequence
  chemically synthesized
atgccaaggattatcagtgttc

SEQ ID NO: 29434 - DNA, 22 bp, Artificial Sequence
  chemically synthesized
tcagtgttctccataccattag

SEQ ID NO: 29435 - DNA, 22 bp, Artificial Sequence
  chemically synthesized
tccataccattagaagaagagt

SEQ ID NO: 29436 - DNA, 22 bp, Artificial Sequence
  chemically synthesized
cataccattagaagaagagtcc

SEQ ID NO: 29437 - DNA, 22 bp, Artificial Sequence
  chemically synthesized
gaagaagagtccttagcatatt

SEQ ID NO: 29438 - DNA, 22 bp, Artificial Sequence
  chemically synthesized
agcatatttgggtctaatcata

SEQ ID NO: 29439 - DNA, 22 bp, Artificial Sequence
  chemically synthesized
gcatatttgggtctaatcatat

SEQ ID NO: 29440 - DNA, 22 bp, Artificial Sequence
  chemically synthesized
gggtctaatcatattaagcagc

SEQ ID NO: 29441 - DNA, 22 bp, Artificial Sequence
  chemically synthesized
ggtctaatcatattaagcagcc

SEQ ID NO: 29442 - DNA, 22 bp, Artificial Sequence
  chemically synthesized
atcatattaagcagccaactcc

SEQ ID NO: 29443 - DNA, 22 bp, Artificial Sequence
  chemically synthesized
agcagccaactccagaaacccc

SEQ ID NO: 29444 - DNA, 22 bp, Artificial Sequence
  chemically synthesized
cagaaaccccaaaaccaatgaa

SEQ ID NO: 29445 - DNA, 22 bp, Artificial Sequence
  chemically synthesized
catccttaatattctgttcctc

SEQ ID NO: 29446 - DNA, 22 bp, Artificial Sequence
  chemically synthesized
aatattctgttcctctagaacc

SEQ ID NO: 29447 - DNA, 22 bp, Artificial Sequence
  chemically synthesized
atattctgttcctctagaacca

SEQ ID NO: 29448 - DNA, 22 bp, Artificial Sequence
  chemically synthesized
tgttcctctagaaccactcctg

SEQ ID NO: 29449 - DNA, 22 bp, Artificial Sequence
  chemically synthesized
ttcctctagaaccactcctggt

SEQ ID NO: 29450 - DNA, 22 bp, Artificial Sequence
  chemically synthesized
ctctagaaccactcctggtacc

SEQ ID NO: 29451 - DNA, 22 bp, Artificial Sequence
  chemically synthesized
tagaaccactcctggtaccaaa

SEQ ID NO: 29452 - DNA, 22 bp, Artificial Sequence
  chemically synthesized
gaaccactcctggtaccaaaat

SEQ ID NO: 29453 - DNA, 22 bp, Artificial Sequence
  chemically synthesized
ctggtaccaaaatctgtattag

SEQ ID NO: 29454 - DNA, 22 bp, Artificial Sequence
  chemically synthesized
gtaccaaaatctgtattagggt

SEQ ID NO: 29455 - DNA, 22 bp, Artificial Sequence
  chemically synthesized
tattagggttctacagagaaac

SEQ ID NO: 29456 - DNA, 22 bp, Artificial Sequence
  chemically synthesized
gggttctacagagaaacagaat

SEQ ID NO: 29457 - DNA, 22 bp, Artificial Sequence
  chemically synthesized
tacagagaaacagaattaatag

SEQ ID NO: 29458 - DNA, 22 bp, Artificial Sequence
  chemically synthesized
cagagaaacagaattaatagga

SEQ ID NO: 29459 - DNA, 22 bp, Artificial Sequence
  chemically synthesized
ataggagatatatatctatatc

SEQ ID NO: 29460 - DNA, 22 bp, Artificial Sequence
  chemically synthesized
tatctatatctatatctatatc

SEQ ID NO: 29461 - DNA, 22 bp, Artificial Sequence
  chemically synthesized
tatctatatctatatctatatc

SEQ ID NO: 29462 - DNA, 22 bp, Artificial Sequence
  chemically synthesized
tatctatatctatatctatatc

SEQ ID NO: 29463 - DNA, 22 bp, Artificial Sequence
  chemically synthesized
tatctatatctatatctatctc

SEQ ID NO: 29464 - DNA, 22 bp, Artificial Sequence
  chemically synthesized
tatctatatctatctctatatc

SEQ ID NO: 29465 - DNA, 22 bp, Artificial Sequence
  chemically synthesized
tatctatctctatatctatctc

SEQ ID NO: 29466 - DNA, 22 bp, Artificial Sequence
  chemically synthesized
tctctatatctatctctatatc

SEQ ID NO: 29467 - DNA, 22 bp, Artificial Sequence
  chemically synthesized
tatatctatctctatatctata

SEQ ID NO: 29468 - DNA, 22 bp, Artificial Sequence
  chemically synthesized
tatctatctctatatctatatc

SEQ ID NO: 29469 - DNA, 22 bp, Artificial Sequence
  chemically synthesized
tctctatatctatatctatatg

SEQ ID NO: 29470 - DNA, 22 bp, Artificial Sequence
  chemically synthesized
tatatctatatctatatgagag

SEQ ID NO: 29471 - DNA, 22 bp, Artificial Sequence
  chemically synthesized
tatctatatctatatgagagtt

SEQ ID NO: 29472 - DNA, 22 bp, Artificial Sequence
  chemically synthesized
tatctatatgagagtttattat

SEQ ID NO: 29473 - DNA, 22 bp, Artificial Sequence
  chemically synthesized
tatgagagtttattatgtagta

SEQ ID NO: 29474 - DNA, 22 bp, Artificial Sequence
  chemically synthesized
attatgtagtattgactcacat

SEQ ID NO: 29475 - DNA, 22 bp, Artificial Sequence
  chemically synthesized
ttatgtagtattgactcacatg

SEQ ID NO: 29476 - DNA, 22 bp, Artificial Sequence
  chemically synthesized
tgtagtattgactcacatgttc

SEQ ID NO: 29477 - DNA, 22 bp, Artificial Sequence
  chemically synthesized
actcacatgttcacaaggtccc

SEQ ID NO: 29478 - DNA, 22 bp, Artificial Sequence
  chemically synthesized
acatgttcacaaggtcccaaaa

SEQ ID NO: 29479 - DNA, 22 bp, Artificial Sequence
  chemically synthesized
acaaggtcccaaaacaggccat

SEQ ID NO: 29480 - DNA, 22 bp, Artificial Sequence
  chemically synthesized
ccagctgaggaacaaggaagct

SEQ ID NO: 29481 - DNA, 22 bp, Artificial Sequence
  chemically synthesized
aggaacaaggaagctagtcgga

SEQ ID NO: 29482 - DNA, 22 bp, Artificial Sequence
  chemically synthesized
gtcggagtcccaaagctgaaga

SEQ ID NO: 29483 - DNA, 22 bp, Artificial Sequence
  chemically synthesized
aagaacctggagttcaatgttc

SEQ ID NO: 29484 - DNA, 22 bp, Artificial Sequence
  chemically synthesized
gagttcaatgttccagggcagg

SEQ ID NO: 29485 - DNA, 22 bp, Artificial Sequence
  chemically synthesized
aatgttccagggcaggaagaat

SEQ ID NO: 29486 - DNA, 22 bp, Artificial Sequence
  chemically synthesized
cagggcaggaagaatccagcat

SEQ ID NO: 29487 - DNA, 22 bp, Artificial Sequence
  chemically synthesized
ggatgccaagccaatctagcct

SEQ ID NO: 29488 - DNA, 22 bp, Artificial Sequence
  chemically synthesized
gccttttcacatttttctgcct

SEQ ID NO: 29489 - DNA, 22 bp, Artificial Sequence
  chemically synthesized
ttcacatttttctgcctgcttt

SEQ ID NO: 29490 - DNA, 22 bp, Artificial Sequence
  chemically synthesized
tcacatttttctgcctgcttta

SEQ ID NO: 29491 - DNA, 22 bp, Artificial Sequence
  chemically synthesized
cacatttttctgcctgctttat

SEQ ID NO: 29492 - DNA, 22 bp, Artificial Sequence
  chemically synthesized
acatttttctgcctgctttata

SEQ ID NO: 29493 - DNA, 22 bp, Artificial Sequence
  chemically synthesized
ttctgcctgctttatatcctgg

SEQ ID NO: 29494 - DNA, 22 bp, Artificial Sequence
  chemically synthesized
tctgcctgctttatatcctggc

SEQ ID NO: 29495 - DNA, 22 bp, Artificial Sequence
  chemically synthesized
ctgcctgctttatatcctggct

SEQ ID NO: 29496 - DNA, 22 bp, Artificial Sequence
  chemically synthesized
tgcctgctttatatcctggctg

SEQ ID NO: 29497 - DNA, 22 bp, Artificial Sequence
  chemically synthesized
cctgctttatatcctggctgtg

SEQ ID NO: 29498 - DNA, 22 bp, Artificial Sequence
  chemically synthesized
ctttatatcctggctgtgctgg

SEQ ID NO: 29499 - DNA, 22 bp, Artificial Sequence
  chemically synthesized
tatatcctggctgtgctggcaa

SEQ ID NO: 29500 - DNA, 22 bp, Artificial Sequence
  chemically synthesized
atatcctggctgtgctggcaac

SEQ ID NO: 29501 - DNA, 22 bp, Artificial Sequence
  chemically synthesized
tatcctggctgtgctggcaact

SEQ ID NO: 29502 - DNA, 22 bp, Artificial Sequence
  chemically synthesized
gctgtgctggcaactgattaga

SEQ ID NO: 29503 - DNA, 22 bp, Artificial Sequence
  chemically synthesized
tgctggcaactgattagatggt

SEQ ID NO: 29504 - DNA, 22 bp, Artificial Sequence
  chemically synthesized
gcaactgattagatggtgccca

SEQ ID NO: 29505 - DNA, 22 bp, Artificial Sequence
  chemically synthesized
attagatggtgcccacccagat

SEQ ID NO: 29506 - DNA, 22 bp, Artificial Sequence
  chemically synthesized
gatggtgcccacccagattaag

SEQ ID NO: 29507 - DNA, 22 bp, Artificial Sequence
  chemically synthesized
agggtgggtctgccttccccag

SEQ ID NO: 29508 - DNA, 22 bp, Artificial Sequence
  chemically synthesized
ccttccccagcccactgactga

SEQ ID NO: 29509 - DNA, 22 bp, Artificial Sequence
  chemically synthesized
ccccagcccactgactgaaata

SEQ ID NO: 29510 - DNA, 22 bp, Artificial Sequence
  chemically synthesized
cccagcccactgactgaaatat

SEQ ID NO: 29511 - DNA, 22 bp, Artificial Sequence
  chemically synthesized
actgaaatattaatctcctttg

SEQ ID NO: 29512 - DNA, 22 bp, Artificial Sequence
  chemically synthesized
aaatattaatctcctttggtaa

SEQ ID NO: 29513 - DNA, 22 bp, Artificial Sequence
  chemically synthesized
atctcctttggtaacaccctca

SEQ ID NO: 29514 - DNA, 22 bp, Artificial Sequence
  chemically synthesized
ctttggtaacaccctcacagac

SEQ ID NO: 29515 - DNA, 22 bp, Artificial Sequence
  chemically synthesized
tggtaacaccctcacagacaca

SEQ ID NO: 29516 - DNA, 22 bp, Artificial Sequence
  chemically synthesized
ggtaacaccctcacagacacac

SEQ ID NO: 29517 - DNA, 22 bp, Artificial Sequence
  chemically synthesized
gtaacaccctcacagacacacc

SEQ ID NO: 29518 - DNA, 22 bp, Artificial Sequence
  chemically synthesized
acagacacacccaagatcatta

SEQ ID NO: 29519 - DNA, 22 bp, Artificial Sequence
  chemically synthesized
ctttgcatccttcagtccaatc

SEQ ID NO: 29520 - DNA, 22 bp, Artificial Sequence
  chemically synthesized
tgcatccttcagtccaatcaag

SEQ ID NO: 29521 - DNA, 22 bp, Artificial Sequence
  chemically synthesized
gcatccttcagtccaatcaagt

SEQ ID NO: 29522 - DNA, 22 bp, Artificial Sequence
  chemically synthesized
catccttcagtccaatcaagtt

SEQ ID NO: 29523 - DNA, 22 bp, Artificial Sequence
  chemically synthesized
cagtccaatcaagttgacactc

SEQ ID NO: 29524 - DNA, 22 bp, Artificial Sequence
  chemically synthesized
agtccaatcaagttgacactca

SEQ ID NO: 29525 - DNA, 22 bp, Artificial Sequence
  chemically synthesized
acactcagtattaaccatcaca

SEQ ID NO: 29526 - DNA, 22 bp, Artificial Sequence
  chemically synthesized
agtattaaccatcacagtcact

SEQ ID NO: 29527 - DNA, 22 bp, Artificial Sequence
  chemically synthesized
accatcacagtcactttctaat

SEQ ID NO: 29528 - DNA, 22 bp, Artificial Sequence
  chemically synthesized
tctaatgaggttggtttttttg

SEQ ID NO: 29529 - DNA, 22 bp, Artificial Sequence
  chemically synthesized
ctaatgaggttggtttttttgt

SEQ ID NO: 29530 - DNA, 22 bp, Artificial Sequence
  chemically synthesized
taatgaggttggtttttttgtt

SEQ ID NO: 29531 - DNA, 22 bp, Artificial Sequence
  chemically synthesized
atgaggttggtttttttgttgt

SEQ ID NO: 29532 - DNA, 22 bp, Artificial Sequence
  chemically synthesized
gtttttttgttgttgagttcct

SEQ ID NO: 29533 - DNA, 22 bp, Artificial Sequence
  chemically synthesized
ttttgttgttgagttccttgta

SEQ ID NO: 29534 - DNA, 22 bp, Artificial Sequence
  chemically synthesized
tttgttgttgagttccttgtag

SEQ ID NO: 29535 - DNA, 22 bp, Artificial Sequence
  chemically synthesized
ttgttgttgagttccttgtaga

SEQ ID NO: 29536 - DNA, 22 bp, Artificial Sequence
  chemically synthesized
tgttgttgagttccttgtagat

SEQ ID NO: 29537 - DNA, 22 bp, Artificial Sequence
  chemically synthesized
gttgttgagttccttgtagatt

SEQ ID NO: 29538 - DNA, 22 bp, Artificial Sequence
  chemically synthesized
ttgttgagttccttgtagattc

SEQ ID NO: 29539 - DNA, 22 bp, Artificial Sequence
  chemically synthesized
ttgagttccttgtagattctgt

SEQ ID NO: 29540 - DNA, 22 bp, Artificial Sequence
  chemically synthesized
agttccttgtagattctgtata

SEQ ID NO: 29541 - DNA, 22 bp, Artificial Sequence
  chemically synthesized
cttgtagattctgtatattagc

SEQ ID NO: 29542 - DNA, 22 bp, Artificial Sequence
  chemically synthesized
gtagattctgtatattagcctt

SEQ ID NO: 29543 - DNA, 22 bp, Artificial Sequence
  chemically synthesized
tagattctgtatattagccttt

SEQ ID NO: 29544 - DNA, 22 bp, Artificial Sequence
  chemically synthesized
tgtatattagccttttgttgca

SEQ ID NO: 29545 - DNA, 22 bp, Artificial Sequence
  chemically synthesized
tatattagccttttgttgcatt

SEQ ID NO: 29546 - DNA, 22 bp, Artificial Sequence
  chemically synthesized
gccttttgttgcattcatagtt

SEQ ID NO: 29547 - DNA, 22 bp, Artificial Sequence
  chemically synthesized
ttgttgcattcatagtttgcaa

SEQ ID NO: 29548 - DNA, 22 bp, Artificial Sequence
  chemically synthesized
tgttgcattcatagtttgcaat

SEQ ID NO: 29549 - DNA, 22 bp, Artificial Sequence
  chemically synthesized
gttgcattcatagtttgcaatt

SEQ ID NO: 29550 - DNA, 22 bp, Artificial Sequence
  chemically synthesized
ttgcattcatagtttgcaattt

SEQ ID NO: 29551 - DNA, 22 bp, Artificial Sequence
  chemically synthesized
cattcatagtttgcaatttttt

SEQ ID NO: 29552 - DNA, 22 bp, Artificial Sequence
  chemically synthesized
atagtttgcaatttttttttct

SEQ ID NO: 29553 - DNA, 22 bp, Artificial Sequence
  chemically synthesized
gcaatttttttttctcattctg

SEQ ID NO: 29554 - DNA, 22 bp, Artificial Sequence
  chemically synthesized
caatttttttttctcattctgt

SEQ ID NO: 29555 - DNA, 22 bp, Artificial Sequence
  chemically synthesized
ttttttctcattctgtaggtta

SEQ ID NO: 29556 - DNA, 22 bp, Artificial Sequence
  chemically synthesized
tttttctcattctgtaggttat

SEQ ID NO: 29557 - DNA, 22 bp, Artificial Sequence
  chemically synthesized
ttttctcattctgtaggttatc

SEQ ID NO: 29558 - DNA, 22 bp, Artificial Sequence
  chemically synthesized
tttctcattctgtaggttatcc

SEQ ID NO: 29559 - DNA, 22 bp, Artificial Sequence
  chemically synthesized
ttctcattctgtaggttatccg

SEQ ID NO: 29560 - DNA, 22 bp, Artificial Sequence
  chemically synthesized
tctcattctgtaggttatccgt

SEQ ID NO: 29561 - DNA, 22 bp, Artificial Sequence
  chemically synthesized
ctcattctgtaggttatccgtt

SEQ ID NO: 29562 - DNA, 22 bp, Artificial Sequence
  chemically synthesized
tcattctgtaggttatccgttt

SEQ ID NO: 29563 - DNA, 22 bp, Artificial Sequence
  chemically synthesized
attctgtaggttatccgtttac

SEQ ID NO: 29564 - DNA, 22 bp, Artificial Sequence
  chemically synthesized
tgtaggttatccgtttactctg

SEQ ID NO: 29565 - DNA, 22 bp, Artificial Sequence
  chemically synthesized
taggttatccgtttactctgtt

SEQ ID NO: 29566 - DNA, 22 bp, Artificial Sequence
  chemically synthesized
tccgtttactctgttgattcgg

SEQ ID NO: 29567 - DNA, 22 bp, Artificial Sequence
  chemically synthesized
actctgttgattcggtcttttg

SEQ ID NO: 29568 - DNA, 22 bp, Artificial Sequence
  chemically synthesized
ctctgttgattcggtcttttgc

SEQ ID NO: 29569 - DNA, 22 bp, Artificial Sequence
  chemically synthesized
tgttgattcggtcttttgcggt

SEQ ID NO: 29570 - DNA, 22 bp, Artificial Sequence
  chemically synthesized
ttgattcggtcttttgcggtgc

SEQ ID NO: 29571 - DNA, 22 bp, Artificial Sequence
  chemically synthesized
attcggtcttttgcggtgcaga

SEQ ID NO: 29572 - DNA, 22 bp, Artificial Sequence
  chemically synthesized
ggtcttttgcggtgcagaagca

SEQ ID NO: 29573 - DNA, 22 bp, Artificial Sequence
  chemically synthesized
ttgcggtgcagaagcattttag

SEQ ID NO: 29574 - DNA, 22 bp, Artificial Sequence
  chemically synthesized
tgcggtgcagaagcattttagt

SEQ ID NO: 29575 - DNA, 22 bp, Artificial Sequence
  chemically synthesized
gcggtgcagaagcattttagtt

SEQ ID NO: 29576 - DNA, 22 bp, Artificial Sequence
  chemically synthesized
cggtgcagaagcattttagttt

SEQ ID NO: 29577 - DNA, 22 bp, Artificial Sequence
  chemically synthesized
tagtttaattaagtcccatttg

SEQ ID NO: 29578 - DNA, 22 bp, Artificial Sequence
  chemically synthesized
agtttaattaagtcccatttgt

SEQ ID NO: 29579 - DNA, 22 bp, Artificial Sequence
  chemically synthesized
gtttaattaagtcccatttgtc

SEQ ID NO: 29580 - DNA, 22 bp, Artificial Sequence
  chemically synthesized
aattaagtcccatttgtctgtt

SEQ ID NO: 29581 - DNA, 22 bp, Artificial Sequence
  chemically synthesized
attaagtcccatttgtctgttt

SEQ ID NO: 29582 - DNA, 22 bp, Artificial Sequence
  chemically synthesized
agtcccatttgtctgtttttgt

SEQ ID NO: 29583 - DNA, 22 bp, Artificial Sequence
  chemically synthesized
gtctgtttttgtttttgttgtg

SEQ ID NO: 29584 - DNA, 22 bp, Artificial Sequence
  chemically synthesized
tctgtttttgtttttgttgtgt

SEQ ID NO: 29585 - DNA, 22 bp, Artificial Sequence
  chemically synthesized
tttttgtttttgttgtgtttag

SEQ ID NO: 29586 - DNA, 22 bp, Artificial Sequence
  chemically synthesized
ttgtttttgttgtgtttagttt

SEQ ID NO: 29587 - DNA, 22 bp, Artificial Sequence
  chemically synthesized
tgtttttgttgtgtttagtttt

SEQ ID NO: 29588 - DNA, 22 bp, Artificial Sequence
  chemically synthesized
gtttttgttgtgtttagttttg

SEQ ID NO: 29589 - DNA, 22 bp, Artificial Sequence
  chemically synthesized
tttttgttgtgtttagttttga

SEQ ID NO: 29590 - DNA, 22 bp, Artificial Sequence
  chemically synthesized
ttgttgtgtttagttttgagga

SEQ ID NO: 29591 - DNA, 22 bp, Artificial Sequence
  chemically synthesized
tgttgtgtttagttttgaggac

SEQ ID NO: 29592 - DNA, 22 bp, Artificial Sequence
  chemically synthesized
gttgtgtttagttttgaggact

SEQ ID NO: 29593 - DNA, 22 bp, Artificial Sequence
  chemically synthesized
ttgtgtttagttttgaggactt

SEQ ID NO: 29594 - DNA, 22 bp, Artificial Sequence
  chemically synthesized
tgtttagttttgaggacttggt

SEQ ID NO: 29595 - DNA, 22 bp, Artificial Sequence
  chemically synthesized
agttttgaggacttggtcataa

SEQ ID NO: 29596 - DNA, 22 bp, Artificial Sequence
  chemically synthesized
gttttgaggacttggtcataaa

SEQ ID NO: 29597 - DNA, 22 bp, Artificial Sequence
  chemically synthesized
tgaggacttggtcataaattct

SEQ ID NO: 29598 - DNA, 22 bp, Artificial Sequence
  chemically synthesized
gaggacttggtcataaattctt

SEQ ID NO: 29599 - DNA, 22 bp, Artificial Sequence
  chemically synthesized
aggacttggtcataaattcttt

SEQ ID NO: 29600 - DNA, 22 bp, Artificial Sequence
  chemically synthesized
ggtcataaattctttgcctagg

SEQ ID NO: 29601 - DNA, 22 bp, Artificial Sequence
  chemically synthesized
gtcataaattctttgcctaggc

SEQ ID NO: 29602 - DNA, 22 bp, Artificial Sequence
  chemically synthesized
tttgcctaggccacatctaatt

SEQ ID NO: 29603 - DNA, 22 bp, Artificial Sequence
  chemically synthesized
tgcctaggccacatctaatttt

SEQ ID NO: 29604 - DNA, 22 bp, Artificial Sequence
  chemically synthesized
gcctaggccacatctaattttt

SEQ ID NO: 29605 - DNA, 22 bp, Artificial Sequence
  chemically synthesized
cctaggccacatctaattttta

SEQ ID NO: 29606 - DNA, 22 bp, Artificial Sequence
  chemically synthesized
ggccacatctaatttttaatcc

SEQ ID NO: 29607 - DNA, 22 bp, Artificial Sequence
  chemically synthesized
atttttaatcctcttttagagc

SEQ ID NO: 29608 - DNA, 22 bp, Artificial Sequence
  chemically synthesized
ttaatcctcttttagagcctgt

SEQ ID NO: 29609 - DNA, 22 bp, Artificial Sequence
  chemically synthesized
taatcctcttttagagcctgtc

SEQ ID NO: 29610 - DNA, 22 bp, Artificial Sequence
  chemically synthesized
aatcctcttttagagcctgtct

SEQ ID NO: 29611 - DNA, 22 bp, Artificial Sequence
  chemically synthesized
atcctcttttagagcctgtctt

SEQ ID NO: 29612 - DNA, 22 bp, Artificial Sequence
  chemically synthesized
ttttagagcctgtctttccctc

SEQ ID NO: 29613 - DNA, 22 bp, Artificial Sequence
  chemically synthesized
ttagagcctgtctttccctcca

SEQ ID NO: 29614 - DNA, 22 bp, Artificial Sequence
  chemically synthesized
tagagcctgtctttccctccaa

SEQ ID NO: 29615 - DNA, 22 bp, Artificial Sequence
  chemically synthesized
agagcctgtctttccctccaaa

SEQ ID NO: 29616 - DNA, 22 bp, Artificial Sequence
  chemically synthesized
gagcctgtctttccctccaaac

SEQ ID NO: 29617 - DNA, 22 bp, Artificial Sequence
  chemically synthesized
tctttccctccaaactaaatat

SEQ ID NO: 29618 - DNA, 22 bp, Artificial Sequence
  chemically synthesized
tccctccaaactaaatattatt

SEQ ID NO: 29619 - DNA, 22 bp, Artificial Sequence
  chemically synthesized
ccctccaaactaaatattattt

SEQ ID NO: 29620 - DNA, 22 bp, Artificial Sequence
  chemically synthesized
cctccaaactaaatattatttt

SEQ ID NO: 29621 - DNA, 22 bp, Artificial Sequence
  chemically synthesized
caaactaaatattattttaccc

SEQ ID NO: 29622 - DNA, 22 bp, Artificial Sequence
  chemically synthesized
aatattattttacccccatttg

SEQ ID NO: 29623 - DNA, 22 bp, Artificial Sequence
  chemically synthesized
ttttacccccatttgacacatg

SEQ ID NO: 29624 - DNA, 22 bp, Artificial Sequence
  chemically synthesized
tacccccatttgacacatgagc

SEQ ID NO: 29625 - DNA, 22 bp, Artificial Sequence
  chemically synthesized
acccccatttgacacatgagct

SEQ ID NO: 29626 - DNA, 22 bp, Artificial Sequence
  chemically synthesized
cccccatttgacacatgagcta

SEQ ID NO: 29627 - DNA, 22 bp, Artificial Sequence
  chemically synthesized
gacacatgagctaattgagcct

SEQ ID NO: 29628 - DNA, 22 bp, Artificial Sequence
  chemically synthesized
acacatgagctaattgagcctt

SEQ ID NO: 29629 - DNA, 22 bp, Artificial Sequence
  chemically synthesized
attgagccttctgtctgttaag

SEQ ID NO: 29630 - DNA, 22 bp, Artificial Sequence
  chemically synthesized
agccttctgtctgttaagtaag

SEQ ID NO: 29631 - DNA, 22 bp, Artificial Sequence
  chemically synthesized
ctgtctgttaagtaagttgact

SEQ ID NO: 29632 - DNA, 22 bp, Artificial Sequence
  chemically synthesized
tgtctgttaagtaagttgacta

SEQ ID NO: 29633 - DNA, 22 bp, Artificial Sequence
  chemically synthesized
tctgttaagtaagttgactagt

SEQ ID NO: 29634 - DNA, 22 bp, Artificial Sequence
  chemically synthesized
ttaagtaagttgactagttcag

SEQ ID NO: 29635 - DNA, 22 bp, Artificial Sequence
  chemically synthesized
agtaagttgactagttcagtgt

SEQ ID NO: 29636 - DNA, 22 bp, Artificial Sequence
  chemically synthesized
actagttcagtgtaagttgttt

SEQ ID NO: 29637 - DNA, 22 bp, Artificial Sequence
  chemically synthesized
gttcagtgtaagttgtttctaa

SEQ ID NO: 29638 - DNA, 22 bp, Artificial Sequence
  chemically synthesized
agtgtaagttgtttctaatttt

SEQ ID NO: 29639 - DNA, 22 bp, Artificial Sequence
  chemically synthesized
tttctaattttttgccatcata

SEQ ID NO: 29640 - DNA, 22 bp, Artificial Sequence
  chemically synthesized
ctaattttttgccatcataatg

SEQ ID NO: 29641 - DNA, 22 bp, Artificial Sequence
  chemically synthesized
taattttttgccatcataatgc

SEQ ID NO: 29642 - DNA, 22 bp, Artificial Sequence
  chemically synthesized
attttttgccatcataatgctt

SEQ ID NO: 29643 - DNA, 22 bp, Artificial Sequence
  chemically synthesized
tttgccatcataatgctttagt

SEQ ID NO: 29644 - DNA, 22 bp, Artificial Sequence
  chemically synthesized
ttgccatcataatgctttagta

SEQ ID NO: 29645 - DNA, 22 bp, Artificial Sequence
  chemically synthesized
tgccatcataatgctttagtaa

SEQ ID NO: 29646 - DNA, 22 bp, Artificial Sequence
  chemically synthesized
gccatcataatgctttagtaaa

SEQ ID NO: 29647 - DNA, 22 bp, Artificial Sequence
  chemically synthesized
ccatcataatgctttagtaaac

SEQ ID NO: 29648 - DNA, 22 bp, Artificial Sequence
  chemically synthesized
tagtaaacatccttttcatact

SEQ ID NO: 29649 - DNA, 22 bp, Artificial Sequence
  chemically synthesized
agtaaacatccttttcatactc

SEQ ID NO: 29650 - DNA, 22 bp, Artificial Sequence
  chemically synthesized
gtaaacatccttttcatactct

SEQ ID NO: 29651 - DNA, 22 bp, Artificial Sequence
  chemically synthesized
ttcatactctccttaattttcc

SEQ ID NO: 29652 - DNA, 22 bp, Artificial Sequence
  chemically synthesized
tcatactctccttaattttccc

SEQ ID NO: 29653 - DNA, 22 bp, Artificial Sequence
  chemically synthesized
catactctccttaattttcccc

SEQ ID NO: 29654 - DNA, 22 bp, Artificial Sequence
  chemically synthesized
atactctccttaattttccccc

SEQ ID NO: 29655 - DNA, 22 bp, Artificial Sequence
  chemically synthesized
tccttaattttcccccaggatg

SEQ ID NO: 29656 - DNA, 22 bp, Artificial Sequence
  chemically synthesized
cttaattttcccccaggatggt

SEQ ID NO: 29657 - DNA, 22 bp, Artificial Sequence
  chemically synthesized
aattttcccccaggatggtttt

SEQ ID NO: 29658 - DNA, 22 bp, Artificial Sequence
  chemically synthesized
attttcccccaggatggttttc

SEQ ID NO: 29659 - DNA, 22 bp, Artificial Sequence
  chemically synthesized
tcccccaggatggttttctaga

SEQ ID NO: 29660 - DNA, 22 bp, Artificial Sequence
  chemically synthesized
cccccaggatggttttctagat

SEQ ID NO: 29661 - DNA, 22 bp, Artificial Sequence
  chemically synthesized
ccccaggatggttttctagatg

SEQ ID NO: 29662 - DNA, 22 bp, Artificial Sequence
  chemically synthesized
tctagatgtggacttgctggat

SEQ ID NO: 29663 - DNA, 22 bp, Artificial Sequence
  chemically synthesized
ctagatgtggacttgctggatc

SEQ ID NO: 29664 - DNA, 22 bp, Artificial Sequence
  chemically synthesized
tagatgtggacttgctggatcc

SEQ ID NO: 29665 - DNA, 22 bp, Artificial Sequence
  chemically synthesized
gatgtggacttgctggatccaa

SEQ ID NO: 29666 - DNA, 22 bp, Artificial Sequence
  chemically synthesized
gctggatccaaagtgtgcatat

SEQ ID NO: 29667 - DNA, 22 bp, Artificial Sequence
  chemically synthesized
ctggatccaaagtgtgcatatt

SEQ ID NO: 29668 - DNA, 22 bp, Artificial Sequence
  chemically synthesized
gatccaaagtgtgcatattttc

SEQ ID NO: 29669 - DNA, 22 bp, Artificial Sequence
  chemically synthesized
tccaaatgtatccatatattgt

SEQ ID NO: 29670 - DNA, 22 bp, Artificial Sequence
  chemically synthesized
ccaaatgtatccatatattgtg

SEQ ID NO: 29671 - DNA, 22 bp, Artificial Sequence
  chemically synthesized
caaatgtatccatatattgtgg

SEQ ID NO: 29672 - DNA, 22 bp, Artificial Sequence
  chemically synthesized
tggctttgtgttttaatagagg

SEQ ID NO: 29673 - DNA, 22 bp, Artificial Sequence
  chemically synthesized
tgtgttttaatagaggtagcag

SEQ ID NO: 29674 - DNA, 22 bp, Artificial Sequence
  chemically synthesized
gtgttttaatagaggtagcagc

SEQ ID NO: 29675 - DNA, 22 bp, Artificial Sequence
  chemically synthesized
tgttttaatagaggtagcagca

SEQ ID NO: 29676 - DNA, 22 bp, Artificial Sequence
  chemically synthesized
taatagaggtagcagcaatatt

SEQ ID NO: 29677 - DNA, 22 bp, Artificial Sequence
  chemically synthesized
aatagaggtagcagcaatatta

SEQ ID NO: 29678 - DNA, 22 bp, Artificial Sequence
  chemically synthesized
atagaggtagcagcaatattag

SEQ ID NO: 29679 - DNA, 22 bp, Artificial Sequence
  chemically synthesized
gaggagagaattaaggaacgat

SEQ ID NO: 29680 - DNA, 22 bp, Artificial Sequence
  chemically synthesized
aggaacgattctagtgtagcag

SEQ ID NO: 29681 - DNA, 22 bp, Artificial Sequence
  chemically synthesized
tagtgtagcaggacaagctgca

SEQ ID NO: 29682 - DNA, 22 bp, Artificial Sequence
  chemically synthesized
gtgtagcaggacaagctgcata

SEQ ID NO: 29683 - DNA, 22 bp, Artificial Sequence
  chemically synthesized
catacaaaacccctcagacacc

SEQ ID NO: 29684 - DNA, 22 bp, Artificial Sequence
  chemically synthesized
agacaccgagttaaagaaggaa

SEQ ID NO: 29685 - DNA, 22 bp, Artificial Sequence
  chemically synthesized
aagaaggaagggctttattcgg

SEQ ID NO: 29686 - DNA, 22 bp, Artificial Sequence
  chemically synthesized
tattcggctgggagcttgggca

SEQ ID NO: 29687 - DNA, 22 bp, Artificial Sequence
  chemically synthesized
attcggctgggagcttgggcaa

SEQ ID NO: 29688 - DNA, 22 bp, Artificial Sequence
  chemically synthesized
ttcggctgggagcttgggcaag

SEQ ID NO: 29689 - DNA, 22 bp, Artificial Sequence
  chemically synthesized
ggctgggagcttgggcaagact

SEQ ID NO: 29690 - DNA, 22 bp, Artificial Sequence
  chemically synthesized
ggagcttgggcaagactcacat

SEQ ID NO: 29691 - DNA, 22 bp, Artificial Sequence
  chemically synthesized
gggcaagactcacatctccaac

SEQ ID NO: 29692 - DNA, 22 bp, Artificial Sequence
  chemically synthesized
ggcaagactcacatctccaaca

SEQ ID NO: 29693 - DNA, 22 bp, Artificial Sequence
  chemically synthesized
acatctccaacaaccaagctct

SEQ ID NO: 29694 - DNA, 22 bp, Artificial Sequence
  chemically synthesized
caacaaccaagctctcagagtg

SEQ ID NO: 29695 - DNA, 22 bp, Artificial Sequence
  chemically synthesized
tcagagtgagcaattcctgtcc

SEQ ID NO: 29696 - DNA, 22 bp, Artificial Sequence
  chemically synthesized
agagtgagcaattcctgtccct

SEQ ID NO: 29697 - DNA, 22 bp, Artificial Sequence
  chemically synthesized
ctgtcccttttaagggcttaca

SEQ ID NO: 29698 - DNA, 22 bp, Artificial Sequence
  chemically synthesized
tcccttttaagggcttacaact

SEQ ID NO: 29699 - DNA, 22 bp, Artificial Sequence
  chemically synthesized
ttaagggcttacaactctaagg

SEQ ID NO: 29700 - DNA, 22 bp, Artificial Sequence
  chemically synthesized
taagggcttacaactctaaggg

SEQ ID NO: 29701 - DNA, 22 bp, Artificial Sequence
  chemically synthesized
aagggcttacaactctaagggg

SEQ ID NO: 29702 - DNA, 22 bp, Artificial Sequence
  chemically synthesized
agggcttacaactctaaggggg

SEQ ID NO: 29703 - DNA, 22 bp, Artificial Sequence
  chemically synthesized
acaactctaagggggtacatga

SEQ ID NO: 29704 - DNA, 22 bp, Artificial Sequence
  chemically synthesized
caactctaagggggtacatgac

SEQ ID NO: 29705 - DNA, 22 bp, Artificial Sequence
  chemically synthesized
taagggggtacatgactggggg

SEQ ID NO: 29706 - DNA, 22 bp, Artificial Sequence
  chemically synthesized
agggggtacatgactgggggct

SEQ ID NO: 29707 - DNA, 22 bp, Artificial Sequence
  chemically synthesized
ggggctgcatgcactggtcatc

SEQ ID NO: 29708 - DNA, 22 bp, Artificial Sequence
  chemically synthesized
catgcactggtcatcagaatgg

SEQ ID NO: 29709 - DNA, 22 bp, Artificial Sequence
  chemically synthesized
gtcatcagaatggaacagaaca

SEQ ID NO: 29710 - DNA, 22 bp, Artificial Sequence
  chemically synthesized
tcacactgcttttccatacagt

SEQ ID NO: 29711 - DNA, 22 bp, Artificial Sequence
  chemically synthesized
cacactgcttttccatacagtg

SEQ ID NO: 29712 - DNA, 22 bp, Artificial Sequence
  chemically synthesized
acactgcttttccatacagtgt

SEQ ID NO: 29713 - DNA, 22 bp, Artificial Sequence
  chemically synthesized
cttttccatacagtgtctggaa

SEQ ID NO: 29714 - DNA, 22 bp, Artificial Sequence
  chemically synthesized
ttccatacagtgtctggaatct

SEQ ID NO: 29715 - DNA, 22 bp, Artificial Sequence
  chemically synthesized
tccatacagtgtctggaatcta

SEQ ID NO: 29716 - DNA, 22 bp, Artificial Sequence
  chemically synthesized
ccatacagtgtctggaatctat

SEQ ID NO: 29717 - DNA, 22 bp, Artificial Sequence
  chemically synthesized
catacagtgtctggaatctata

SEQ ID NO: 29718 - DNA, 22 bp, Artificial Sequence
  chemically synthesized
gaatctatagataacataactg

SEQ ID NO: 29719 - DNA, 22 bp, Artificial Sequence
  chemically synthesized
tagataacataactggccaggt

SEQ ID NO: 29720 - DNA, 22 bp, Artificial Sequence
  chemically synthesized
gccaggtcaggggtctatcttt

SEQ ID NO: 29721 - DNA, 22 bp, Artificial Sequence
  chemically synthesized
tctttaaccaggcccaggatgt

SEQ ID NO: 29722 - DNA, 22 bp, Artificial Sequence
  chemically synthesized
taaccaggcccaggatgtggtc

SEQ ID NO: 29723 - DNA, 22 bp, Artificial Sequence
  chemically synthesized
aaccaggcccaggatgtggtct

SEQ ID NO: 29724 - DNA, 22 bp, Artificial Sequence
  chemically synthesized
accaggcccaggatgtggtctc

SEQ ID NO: 29725 - DNA, 22 bp, Artificial Sequence
  chemically synthesized
aggctgtttgcctgtggatttc

SEQ ID NO: 29726 - DNA, 22 bp, Artificial Sequence
  chemically synthesized
tttgcctgtggatttcatttct

SEQ ID NO: 29727 - DNA, 22 bp, Artificial Sequence
  chemically synthesized
gcctgtggatttcatttctgcc

SEQ ID NO: 29728 - DNA, 22 bp, Artificial Sequence
  chemically synthesized
cctgtggatttcatttctgcct

SEQ ID NO: 29729 - DNA, 22 bp, Artificial Sequence
  chemically synthesized
tggatttcatttctgcctttta

SEQ ID NO: 29730 - DNA, 22 bp, Artificial Sequence
  chemically synthesized
catttctgccttttagttttta

SEQ ID NO: 29731 - DNA, 22 bp, Artificial Sequence
  chemically synthesized
atttctgccttttagtttttac

SEQ ID NO: 29732 - DNA, 22 bp, Artificial Sequence
  chemically synthesized
ctgccttttagtttttacttct

SEQ ID NO: 29733 - DNA, 22 bp, Artificial Sequence
  chemically synthesized
tgccttttagtttttacttctt

SEQ ID NO: 29734 - DNA, 22 bp, Artificial Sequence
  chemically synthesized
ccttttagtttttacttcttct

SEQ ID NO: 29735 - DNA, 22 bp, Artificial Sequence
  chemically synthesized
ttagtttttacttcttctttct

SEQ ID NO: 29736 - DNA, 22 bp, Artificial Sequence
  chemically synthesized
tagtttttacttcttctttctt

SEQ ID NO: 29737 - DNA, 22 bp, Artificial Sequence
  chemically synthesized
agtttttacttcttctttcttt

SEQ ID NO: 29738 - DNA, 22 bp, Artificial Sequence
  chemically synthesized
gtttttacttcttctttctttg

SEQ ID NO: 29739 - DNA, 22 bp, Artificial Sequence
  chemically synthesized
ttacttcttctttctttggagg

SEQ ID NO: 29740 - DNA, 22 bp, Artificial Sequence
  chemically synthesized
tacttcttctttctttggaggc

SEQ ID NO: 29741 - DNA, 22 bp, Artificial Sequence
  chemically synthesized
acttcttctttctttggaggca

SEQ ID NO: 29742 - DNA, 22 bp, Artificial Sequence
  chemically synthesized
cttcttctttctttggaggcag

SEQ ID NO: 29743 - DNA, 22 bp, Artificial Sequence
  chemically synthesized
cttctttctttggaggcagaaa

SEQ ID NO: 29744 - DNA, 22 bp, Artificial Sequence
  chemically synthesized
ttctttctttggaggcagaaat

SEQ ID NO: 29745 - DNA, 22 bp, Artificial Sequence
  chemically synthesized
ctttctttggaggcagaaattg

SEQ ID NO: 29746 - DNA, 22 bp, Artificial Sequence
  chemically synthesized
tttctttggaggcagaaattgg

SEQ ID NO: 29747 - DNA, 22 bp, Artificial Sequence
  chemically synthesized
tctttggaggcagaaattgggc

SEQ ID NO: 29748 - DNA, 22 bp, Artificial Sequence
  chemically synthesized
ctttggaggcagaaattgggca

SEQ ID NO: 29749 - DNA, 22 bp, Artificial Sequence
  chemically synthesized
tttggaggcagaaattgggcat

SEQ ID NO: 29750 - DNA, 22 bp, Artificial Sequence
  chemically synthesized
tggaggcagaaattgggcataa

SEQ ID NO: 29751 - DNA, 22 bp, Artificial Sequence
  chemically synthesized
ggaggcagaaattgggcataaa

SEQ ID NO: 29752 - DNA, 22 bp, Artificial Sequence
  chemically synthesized
gaggcagaaattgggcataaaa

SEQ ID NO: 29753 - DNA, 22 bp, Artificial Sequence
  chemically synthesized
ggcataaaacaatatgaagggt

SEQ ID NO: 29754 - DNA, 22 bp, Artificial Sequence
  chemically synthesized
ctcccttactaggaagagagaa

SEQ ID NO: 29755 - DNA, 22 bp, Artificial Sequence
  chemically synthesized
ccttactaggaagagagaaata

SEQ ID NO: 29756 - DNA, 22 bp, Artificial Sequence
  chemically synthesized
actaggaagagagaaataccat

SEQ ID NO: 29757 - DNA, 22 bp, Artificial Sequence
  chemically synthesized
ctaggaagagagaaataccatg

SEQ ID NO: 29758 - DNA, 22 bp, Artificial Sequence
  chemically synthesized
ggaagagagaaataccatgtga

SEQ ID NO: 29759 - DNA, 22 bp, Artificial Sequence
  chemically synthesized
gtgttattggatttgacatcgg

SEQ ID NO: 29760 - DNA, 22 bp, Artificial Sequence
  chemically synthesized
tgttattggatttgacatcggg

SEQ ID NO: 29761 - DNA, 22 bp, Artificial Sequence
  chemically synthesized
ttggatttgacatcggggttgg

SEQ ID NO: 29762 - DNA, 22 bp, Artificial Sequence
  chemically synthesized
gatttgacatcggggttggacc

SEQ ID NO: 29763 - DNA, 22 bp, Artificial Sequence
  chemically synthesized
gacatcggggttggaccaagca

SEQ ID NO: 29764 - DNA, 22 bp, Artificial Sequence
  chemically synthesized
acatcggggttggaccaagcat

SEQ ID NO: 29765 - DNA, 22 bp, Artificial Sequence
  chemically synthesized
gaccaagcatcttctatgaaca

SEQ ID NO: 29766 - DNA, 22 bp, Artificial Sequence
  chemically synthesized
ctatgaacatctataagcacgt

SEQ ID NO: 29767 - DNA, 22 bp, Artificial Sequence
  chemically synthesized
tatgaacatctataagcacgtt

SEQ ID NO: 29768 - DNA, 22 bp, Artificial Sequence
  chemically synthesized
tgaacatctataagcacgttct

SEQ ID NO: 29769 - DNA, 22 bp, Artificial Sequence
  chemically synthesized
taagcacgttctccttatcaaa

SEQ ID NO: 29770 - DNA, 22 bp, Artificial Sequence
  chemically synthesized
tccttatcaaaaggtactttgc

SEQ ID NO: 29771 - DNA, 22 bp, Artificial Sequence
  chemically synthesized
cttatcaaaaggtactttgctt

SEQ ID NO: 29772 - DNA, 22 bp, Artificial Sequence
  chemically synthesized
atcaaaaggtactttgcttggt

SEQ ID NO: 29773 - DNA, 22 bp, Artificial Sequence
  chemically synthesized
tcaaaaggtactttgcttggtg

SEQ ID NO: 29774 - DNA, 22 bp, Artificial Sequence
  chemically synthesized
tgcttggtgctttaaaagataa

SEQ ID NO: 29775 - DNA, 22 bp, Artificial Sequence
  chemically synthesized
gcttggtgctttaaaagataaa

SEQ ID NO: 29776 - DNA, 22 bp, Artificial Sequence
  chemically synthesized
cttggtgctttaaaagataaat

SEQ ID NO: 29777 - DNA, 22 bp, Artificial Sequence
  chemically synthesized
ggtgctttaaaagataaatgac

SEQ ID NO: 29778 - DNA, 22 bp, Artificial Sequence
  chemically synthesized
gtgctttaaaagataaatgact

SEQ ID NO: 29779 - DNA, 22 bp, Artificial Sequence
  chemically synthesized
taaaagataaatgactatgtag

SEQ ID NO: 29780 - DNA, 22 bp, Artificial Sequence
  chemically synthesized
aaaagataaatgactatgtagc

SEQ ID NO: 29781 - DNA, 22 bp, Artificial Sequence
  chemically synthesized
aaagataaatgactatgtagct

SEQ ID NO: 29782 - DNA, 22 bp, Artificial Sequence
  chemically synthesized
tgtagcttaggagatttcttca

SEQ ID NO: 29783 - DNA, 22 bp, Artificial Sequence
  chemically synthesized
aggagatttcttcataattgaa

SEQ ID NO: 29784 - DNA, 22 bp, Artificial Sequence
  chemically synthesized
ggagatttcttcataattgaaa

SEQ ID NO: 29785 - DNA, 22 bp, Artificial Sequence
  chemically synthesized
cttcataattgaaaaccacagc

SEQ ID NO: 29786 - DNA, 22 bp, Artificial Sequence
  chemically synthesized
ttcataattgaaaaccacagca

SEQ ID NO: 29787 - DNA, 22 bp, Artificial Sequence
  chemically synthesized
cataattgaaaaccacagcagc

SEQ ID NO: 29788 - DNA, 22 bp, Artificial Sequence
  chemically synthesized
ataattgaaaaccacagcagct

SEQ ID NO: 29789 - DNA, 22 bp, Artificial Sequence
  chemically synthesized
aaaaccacagcagctgttattt

SEQ ID NO: 29790 - DNA, 22 bp, Artificial Sequence
  chemically synthesized
ttatttgaacatacctgagccc

SEQ ID NO: 29791 - DNA, 22 bp, Artificial Sequence
  chemically synthesized
tttgaacatacctgagcccctt

SEQ ID NO: 29792 - DNA, 22 bp, Artificial Sequence
  chemically synthesized
gaacatacctgagccccttctg

SEQ ID NO: 29793 - DNA, 22 bp, Artificial Sequence
  chemically synthesized
aacatacctgagccccttctgg

SEQ ID NO: 29794 - DNA, 22 bp, Artificial Sequence
  chemically synthesized
agccccttctggaccactgtag

SEQ ID NO: 29795 - DNA, 22 bp, Artificial Sequence
  chemically synthesized
ctggaccactgtaggagaagga

SEQ ID NO: 29796 - DNA, 22 bp, Artificial Sequence
  chemically synthesized
tggaccactgtaggagaaggag

SEQ ID NO: 29797 - DNA, 22 bp, Artificial Sequence
  chemically synthesized
gaccactgtaggagaaggagga

SEQ ID NO: 29798 - DNA, 22 bp, Artificial Sequence
  chemically synthesized
taggagaaggaggaagagaggt

SEQ ID NO: 29799 - DNA, 22 bp, Artificial Sequence
  chemically synthesized
ctgctgctgagggcatgtatga

SEQ ID NO: 29800 - DNA, 22 bp, Artificial Sequence
  chemically synthesized
tgctgctgagggcatgtatgat

SEQ ID NO: 29801 - DNA, 22 bp, Artificial Sequence
  chemically synthesized
ctgctgagggcatgtatgatga

SEQ ID NO: 29802 - DNA, 22 bp, Artificial Sequence
  chemically synthesized
ctgagggcatgtatgatgacaa

SEQ ID NO: 29803 - DNA, 22 bp, Artificial Sequence
  chemically synthesized
agggcatgtatgatgacaatgg

SEQ ID NO: 29804 - DNA, 22 bp, Artificial Sequence
  chemically synthesized
gtcctaactttgacactacaaa

SEQ ID NO: 29805 - DNA, 22 bp, Artificial Sequence
  chemically synthesized
tcctaactttgacactacaaag

SEQ ID NO: 29806 - DNA, 22 bp, Artificial Sequence
  chemically synthesized
actttgacactacaaagtgact

SEQ ID NO: 29807 - DNA, 22 bp, Artificial Sequence
  chemically synthesized
tgacactacaaagtgactggag

SEQ ID NO: 29808 - DNA, 22 bp, Artificial Sequence
  chemically synthesized
gacactacaaagtgactggagc

SEQ ID NO: 29809 - DNA, 22 bp, Artificial Sequence
  chemically synthesized
acactacaaagtgactggagct

SEQ ID NO: 29810 - DNA, 22 bp, Artificial Sequence
  chemically synthesized
caaagtgactggagctttaggc

SEQ ID NO: 29811 - DNA, 22 bp, Artificial Sequence
  chemically synthesized
gagctttaggcaagtagttact

SEQ ID NO: 29812 - DNA, 22 bp, Artificial Sequence
  chemically synthesized
taggcaagtagttactccaatt

SEQ ID NO: 29813 - DNA, 22 bp, Artificial Sequence
  chemically synthesized
aggcaagtagttactccaattg

SEQ ID NO: 29814 - DNA, 22 bp, Artificial Sequence
  chemically synthesized
ggcaagtagttactccaattgt

SEQ ID NO: 29815 - DNA, 22 bp, Artificial Sequence
  chemically synthesized
ctccaattgtcttttcagactc

SEQ ID NO: 29816 - DNA, 22 bp, Artificial Sequence
  chemically synthesized
caattgtcttttcagactcttt

SEQ ID NO: 29817 - DNA, 22 bp, Artificial Sequence
  chemically synthesized
tcttttcagactctttcttttt

SEQ ID NO: 29818 - DNA, 22 bp, Artificial Sequence
  chemically synthesized
ttcagactctttctttttgagg

SEQ ID NO: 29819 - DNA, 22 bp, Artificial Sequence
  chemically synthesized
tcagactctttctttttgaggt

SEQ ID NO: 29820 - DNA, 22 bp, Artificial Sequence
  chemically synthesized
cagactctttctttttgaggta

SEQ ID NO: 29821 - DNA, 22 bp, Artificial Sequence
  chemically synthesized
agactctttctttttgaggtat

SEQ ID NO: 29822 - DNA, 22 bp, Artificial Sequence
  chemically synthesized
tttctttttgaggtatttgacc

SEQ ID NO: 29823 - DNA, 22 bp, Artificial Sequence
  chemically synthesized
tctttttgaggtatttgacctc

SEQ ID NO: 29824 - DNA, 22 bp, Artificial Sequence
  chemically synthesized
ctttttgaggtatttgacctct

SEQ ID NO: 29825 - DNA, 22 bp, Artificial Sequence
  chemically synthesized
tttttgaggtatttgacctctt

SEQ ID NO: 29826 - DNA, 22 bp, Artificial Sequence
  chemically synthesized
tttgaggtatttgacctctttg

SEQ ID NO: 29827 - DNA, 22 bp, Artificial Sequence
  chemically synthesized
ttgaggtatttgacctctttgc

SEQ ID NO: 29828 - DNA, 22 bp, Artificial Sequence
  chemically synthesized
tgaggtatttgacctctttgcg

SEQ ID NO: 29829 - DNA, 22 bp, Artificial Sequence
  chemically synthesized
gaggtatttgacctctttgcgg

SEQ ID NO: 29830 - DNA, 22 bp, Artificial Sequence
  chemically synthesized
aggtatttgacctctttgcggc

SEQ ID NO: 29831 - DNA, 22 bp, Artificial Sequence
  chemically synthesized
gacctctttgcggcatcagcct

SEQ ID NO: 29832 - DNA, 22 bp, Artificial Sequence
  chemically synthesized
acctctttgcggcatcagcctg

SEQ ID NO: 29833 - DNA, 22 bp, Artificial Sequence
  chemically synthesized
tttgcggcatcagcctgctgct

SEQ ID NO: 29834 - DNA, 22 bp, Artificial Sequence
  chemically synthesized
tgcggcatcagcctgctgctat

SEQ ID NO: 29835 - DNA, 22 bp, Artificial Sequence
  chemically synthesized
gcggcatcagcctgctgctatt

SEQ ID NO: 29836 - DNA, 22 bp, Artificial Sequence
  chemically synthesized
cggcatcagcctgctgctattt

SEQ ID NO: 29837 - DNA, 22 bp, Artificial Sequence
  chemically synthesized
ctgctatttcacatgcacctag

SEQ ID NO: 29838 - DNA, 22 bp, Artificial Sequence
  chemically synthesized
ctatttcacatgcacctagaag

SEQ ID NO: 29839 - DNA, 22 bp, Artificial Sequence
  chemically synthesized
tttcacatgcacctagaaggga

SEQ ID NO: 29840 - DNA, 22 bp, Artificial Sequence
  chemically synthesized
cacatgcacctagaagggactt

SEQ ID NO: 29841 - DNA, 22 bp, Artificial Sequence
  chemically synthesized
acatgcacctagaagggacttt

SEQ ID NO: 29842 - DNA, 22 bp, Artificial Sequence
  chemically synthesized
gaagggactttaaaacatgcac

SEQ ID NO: 29843 - DNA, 22 bp, Artificial Sequence
  chemically synthesized
taaaacatgcacagaattgaac

SEQ ID NO: 29844 - DNA, 22 bp, Artificial Sequence
  chemically synthesized
aaaacatgcacagaattgaaca

SEQ ID NO: 29845 - DNA, 22 bp, Artificial Sequence
  chemically synthesized
aaacatgcacagaattgaacaa

SEQ ID NO: 29846 - DNA, 22 bp, Artificial Sequence
  chemically synthesized
aacaaagcagtaaccattcgtt

SEQ ID NO: 29847 - DNA, 22 bp, Artificial Sequence
  chemically synthesized
gttggtgtcccttaacaatatg

SEQ ID NO: 29848 - DNA, 22 bp, Artificial Sequence
  chemically synthesized
gtgtcccttaacaatatgtcaa

SEQ ID NO: 29849 - DNA, 22 bp, Artificial Sequence
  chemically synthesized
aacaatatgtcaaatactatta

SEQ ID NO: 29850 - DNA, 22 bp, Artificial Sequence
  chemically synthesized
acaatatgtcaaatactattat

SEQ ID NO: 29851 - DNA, 22 bp, Artificial Sequence
  chemically synthesized
ttatttttgaaaggtaaataaa

SEQ ID NO: 29852 - DNA, 22 bp, Artificial Sequence
  chemically synthesized
tttttgaaaggtaaataaatcc

SEQ ID NO: 29853 - DNA, 22 bp, Artificial Sequence
  chemically synthesized
ttgaaaggtaaataaatccttg

SEQ ID NO: 29854 - DNA, 22 bp, Artificial Sequence
  chemically synthesized
tgaaaggtaaataaatccttgg

SEQ ID NO: 29855 - DNA, 22 bp, Artificial Sequence
  chemically synthesized
gaaaggtaaataaatccttggg

SEQ ID NO: 29856 - DNA, 22 bp, Artificial Sequence
  chemically synthesized
aaaggtaaataaatccttgggc

SEQ ID NO: 29857 - DNA, 22 bp, Artificial Sequence
  chemically synthesized
gggcttagtggatcctaaatgc

SEQ ID NO: 29858 - DNA, 22 bp, Artificial Sequence
  chemically synthesized
ggcttagtggatcctaaatgct

SEQ ID NO: 29859 - DNA, 22 bp, Artificial Sequence
  chemically synthesized
agtggatcctaaatgctaattt

SEQ ID NO: 29860 - DNA, 22 bp, Artificial Sequence
  chemically synthesized
gtggatcctaaatgctaattta

SEQ ID NO: 29861 - DNA, 22 bp, Artificial Sequence
  chemically synthesized
aatgctaatttaaaaatctgaa

SEQ ID NO: 29862 - DNA, 22 bp, Artificial Sequence
  chemically synthesized
atttaaaaatctgaactcattt

SEQ ID NO: 29863 - DNA, 22 bp, Artificial Sequence
  chemically synthesized
aaaaatctgaactcatttccat

SEQ ID NO: 29864 - DNA, 22 bp, Artificial Sequence
  chemically synthesized
aaaatctgaactcatttccatc

SEQ ID NO: 29865 - DNA, 22 bp, Artificial Sequence
  chemically synthesized
aactcatttccatcccttatta

SEQ ID NO: 29866 - DNA, 22 bp, Artificial Sequence
  chemically synthesized
atttccatcccttattacttta

SEQ ID NO: 29867 - DNA, 22 bp, Artificial Sequence
  chemically synthesized
ccatcccttattactttaaaca

SEQ ID NO: 29868 - DNA, 22 bp, Artificial Sequence
  chemically synthesized
catcccttattactttaaacaa

SEQ ID NO: 29869 - DNA, 22 bp, Artificial Sequence
  chemically synthesized
attactttaaacaaattgctaa

SEQ ID NO: 29870 - DNA, 22 bp, Artificial Sequence
  chemically synthesized
ttactttaaacaaattgctaac

SEQ ID NO: 29871 - DNA, 22 bp, Artificial Sequence
  chemically synthesized
ctttaaacaaattgctaacctg

SEQ ID NO: 29872 - DNA, 22 bp, Artificial Sequence
  chemically synthesized
taaacaaattgctaacctgaat

SEQ ID NO: 29873 - DNA, 22 bp, Artificial Sequence
  chemically synthesized
aaacaaattgctaacctgaatg

SEQ ID NO: 29874 - DNA, 22 bp, Artificial Sequence
  chemically synthesized
aacaaattgctaacctgaatga

SEQ ID NO: 29875 - DNA, 22 bp, Artificial Sequence
  chemically synthesized
ctaacctgaatgataatagaaa

SEQ ID NO: 29876 - DNA, 22 bp, Artificial Sequence
  chemically synthesized
acctgaatgataatagaaactt

SEQ ID NO: 29877 - DNA, 22 bp, Artificial Sequence
  chemically synthesized
aatgataatagaaacttttttc

SEQ ID NO: 29878 - DNA, 22 bp, Artificial Sequence
  chemically synthesized
ttttccttttaacagttggagg

SEQ ID NO: 29879 - DNA, 22 bp, Artificial Sequence
  chemically synthesized
tttccttttaacagttggaggc

SEQ ID NO: 29880 - DNA, 22 bp, Artificial Sequence
  chemically synthesized
ttccttttaacagttggaggca

SEQ ID NO: 29881 - DNA, 22 bp, Artificial Sequence
  chemically synthesized
tccttttaacagttggaggcat

SEQ ID NO: 29882 - DNA, 22 bp, Artificial Sequence
  chemically synthesized
ccttttaacagttggaggcatc

SEQ ID NO: 29883 - DNA, 22 bp, Artificial Sequence
  chemically synthesized
cttttaacagttggaggcatct

SEQ ID NO: 29884 - DNA, 22 bp, Artificial Sequence
  chemically synthesized
ttaacagttggaggcatctata

SEQ ID NO: 29885 - DNA, 22 bp, Artificial Sequence
  chemically synthesized
taacagttggaggcatctatac

SEQ ID NO: 29886 - DNA, 22 bp, Artificial Sequence
  chemically synthesized
aacagttggaggcatctatact

SEQ ID NO: 29887 - DNA, 22 bp, Artificial Sequence
  chemically synthesized
acagttggaggcatctatactg

SEQ ID NO: 29888 - DNA, 22 bp, Artificial Sequence
  chemically synthesized
gaggcatctatactgtgattca

SEQ ID NO: 29889 - DNA, 22 bp, Artificial Sequence
  chemically synthesized
tactgtgattcagacaaaggcc

SEQ ID NO: 29890 - DNA, 22 bp, Artificial Sequence
  chemically synthesized
tgattcagacaaaggccaaaac

SEQ ID NO: 29891 - DNA, 22 bp, Artificial Sequence
  chemically synthesized
agacaaaggccaaaacaacagc

SEQ ID NO: 29892 - DNA, 22 bp, Artificial Sequence
  chemically synthesized
ttttctgataggtccatatttt

SEQ ID NO: 29893 - DNA, 22 bp, Artificial Sequence
  chemically synthesized
tctgataggtccatattttgag

SEQ ID NO: 29894 - DNA, 22 bp, Artificial Sequence
  chemically synthesized
ctgataggtccatattttgagc

SEQ ID NO: 29895 - DNA, 22 bp, Artificial Sequence
  chemically synthesized
tgataggtccatattttgagca

SEQ ID NO: 29896 - DNA, 22 bp, Artificial Sequence
  chemically synthesized
ataggtccatattttgagcata

SEQ ID NO: 29897 - DNA, 22 bp, Artificial Sequence
  chemically synthesized
tgagcataatatgaagactcag

SEQ ID NO: 29898 - DNA, 22 bp, Artificial Sequence
  chemically synthesized
gagcataatatgaagactcagg

SEQ ID NO: 29899 - DNA, 22 bp, Artificial Sequence
  chemically synthesized
agcataatatgaagactcaggt

SEQ ID NO: 29900 - DNA, 22 bp, Artificial Sequence
  chemically synthesized
aggtggaacagtgtgaacctgt

SEQ ID NO: 29901 - DNA, 22 bp, Artificial Sequence
  chemically synthesized
taaatgatgctgtcagaagagc

SEQ ID NO: 29902 - DNA, 22 bp, Artificial Sequence
  chemically synthesized
tcagaagagcagtggacgcaat

SEQ ID NO: 29903 - DNA, 20 bp, Artificial Sequence
  chemically synthesized
tgtccttctggcagggaacc

SEQ ID NO: 29904 - DNA, 20 bp, Artificial Sequence
  chemically synthesized
gtccttctggcagggaacct

SEQ ID NO: 29905 - DNA, 20 bp, Artificial Sequence
  chemically synthesized
cttctggcagggaacctggg

SEQ ID NO: 29906 - DNA, 20 bp, Artificial Sequence
  chemically synthesized
tggcagggaacctgggcagc

SEQ ID NO: 29907 - DNA, 20 bp, Artificial Sequence
  chemically synthesized
ggcagggaacctgggcagcg

SEQ ID NO: 29908 - DNA, 20 bp, Artificial Sequence
  chemically synthesized
tgggcagcgaggatcctctg

SEQ ID NO: 29909 - DNA, 20 bp, Artificial Sequence
  chemically synthesized
agaacactcattcccaaatc

SEQ ID NO: 29910 - DNA, 20 bp, Artificial Sequence
  chemically synthesized
ccaaatccagaaatgtactg

SEQ ID NO: 29911 - DNA, 20 bp, Artificial Sequence
  chemically synthesized
caaatccagaaatgtactgt

SEQ ID NO: 29912 - DNA, 20 bp, Artificial Sequence
  chemically synthesized
gaaatgtactgtaggtgaca

SEQ ID NO: 29913 - DNA, 20 bp, Artificial Sequence
  chemically synthesized
aaagacacaaatgccaccat

SEQ ID NO: 29914 - DNA, 20 bp, Artificial Sequence
  chemically synthesized
gacacaaatgccaccattag

SEQ ID NO: 29915 - DNA, 20 bp, Artificial Sequence
  chemically synthesized
acacaaatgccaccattagc

SEQ ID NO: 29916 - DNA, 20 bp, Artificial Sequence
  chemically synthesized
gccaccattagcaggattta

SEQ ID NO: 29917 - DNA, 20 bp, Artificial Sequence
  chemically synthesized
caccattagcaggatttaaa

SEQ ID NO: 29918 - DNA, 20 bp, Artificial Sequence
  chemically synthesized
gcaggatttaaagagcattt

SEQ ID NO: 29919 - DNA, 20 bp, Artificial Sequence
  chemically synthesized
taaagagcatttcagaaaat

SEQ ID NO: 29920 - DNA, 20 bp, Artificial Sequence
  chemically synthesized
agagcatttcagaaaattgg

SEQ ID NO: 29921 - DNA, 20 bp, Artificial Sequence
  chemically synthesized
cagaaaattggcagtttact

SEQ ID NO: 29922 - DNA, 20 bp, Artificial Sequence
  chemically synthesized
agaaaattggcagtttacta

SEQ ID NO: 29923 - DNA, 20 bp, Artificial Sequence
  chemically synthesized
aattggcagtttactaaggt

SEQ ID NO: 29924 - DNA, 20 bp, Artificial Sequence
  chemically synthesized
ctaaggtaagaatttctata

SEQ ID NO: 29925 - DNA, 20 bp, Artificial Sequence
  chemically synthesized
gtcttgacatatgaatcatt

SEQ ID NO: 29926 - DNA, 20 bp, Artificial Sequence
  chemically synthesized
tcttgacatatgaatcattt

SEQ ID NO: 29927 - DNA, 20 bp, Artificial Sequence
  chemically synthesized
cttgacatatgaatcattta

SEQ ID NO: 29928 - DNA, 20 bp, Artificial Sequence
  chemically synthesized
gacatatgaatcatttaggg

SEQ ID NO: 29929 - DNA, 20 bp, Artificial Sequence
  chemically synthesized
atcatttagggaagacaata

SEQ ID NO: 29930 - DNA, 20 bp, Artificial Sequence
  chemically synthesized
tatggtttctgtgaatttta

SEQ ID NO: 29931 - DNA, 20 bp, Artificial Sequence
  chemically synthesized
tttaaagacttctaattaat

SEQ ID NO: 29932 - DNA, 20 bp, Artificial Sequence
  chemically synthesized
aaagacttctaattaatcag

SEQ ID NO: 29933 - DNA, 20 bp, Artificial Sequence
  chemically synthesized
agacttctaattaatcagaa

SEQ ID NO: 29934 - DNA, 20 bp, Artificial Sequence
  chemically synthesized
ctaattaatcagaagagtgc

SEQ ID NO: 29935 - DNA, 20 bp, Artificial Sequence
  chemically synthesized
gaagagtgctggatattgca

SEQ ID NO: 29936 - DNA, 20 bp, Artificial Sequence
  chemically synthesized
tgcatagacttctccaccct

SEQ ID NO: 29937 - DNA, 20 bp, Artificial Sequence
  chemically synthesized
tctccacccttagctgtact

SEQ ID NO: 29938 - DNA, 20 bp, Artificial Sequence
  chemically synthesized
agctgtacttagctgatttg

SEQ ID NO: 29939 - DNA, 20 bp, Artificial Sequence
  chemically synthesized
gctgtacttagctgatttgt

SEQ ID NO: 29940 - DNA, 20 bp, Artificial Sequence
  chemically synthesized
actgtaacctccctgaactt

SEQ ID NO: 29941 - DNA, 20 bp, Artificial Sequence
  chemically synthesized
tccatttccctttcaaactc

SEQ ID NO: 29942 - DNA, 20 bp, Artificial Sequence
  chemically synthesized
ccatttccctttcaaactct

SEQ ID NO: 29943 - DNA, 20 bp, Artificial Sequence
  chemically synthesized
tttcaaactctgggaaaaaa

SEQ ID NO: 29944 - DNA, 20 bp, Artificial Sequence
  chemically synthesized
actctgggaaaaaaaagaaa

SEQ ID NO: 29945 - DNA, 20 bp, Artificial Sequence
  chemically synthesized
aaaaagaaaaagcatctatg

SEQ ID NO: 29946 - DNA, 20 bp, Artificial Sequence
  chemically synthesized
aaagaaaaagcatctatgaa

SEQ ID NO: 29947 - DNA, 20 bp, Artificial Sequence
  chemically synthesized
aagaaaaagcatctatgaag

SEQ ID NO: 29948 - DNA, 20 bp, Artificial Sequence
  chemically synthesized
agcatctatgaagaggtgtg

SEQ ID NO: 29949 - DNA, 20 bp, Artificial Sequence
  chemically synthesized
gcatctatgaagaggtgtgt

SEQ ID NO: 29950 - DNA, 20 bp, Artificial Sequence
  chemically synthesized
gtgtgtgggtccaaccctga

SEQ ID NO: 29951 - DNA, 20 bp, Artificial Sequence
  chemically synthesized
cagcaaaaccctctccaaac

SEQ ID NO: 29952 - DNA, 20 bp, Artificial Sequence
  chemically synthesized
tctccaaactagccttgctg

SEQ ID NO: 29953 - DNA, 20 bp, Artificial Sequence
  chemically synthesized
ctccaaactagccttgctgt

SEQ ID NO: 29954 - DNA, 20 bp, Artificial Sequence
  chemically synthesized
caaactagccttgctgtagg

SEQ ID NO: 29955 - DNA, 20 bp, Artificial Sequence
  chemically synthesized
actagccttgctgtaggcag

SEQ ID NO: 29956 - DNA, 20 bp, Artificial Sequence
  chemically synthesized
tctgctatctgcctcatcta

SEQ ID NO: 29957 - DNA, 20 bp, Artificial Sequence
  chemically synthesized
tgtgcgaatgcatgaaaata

SEQ ID NO: 29958 - DNA, 20 bp, Artificial Sequence
  chemically synthesized
atgcatgaaaataaagttta

SEQ ID NO: 29959 - DNA, 20 bp, Artificial Sequence
  chemically synthesized
gaaaataaagtttaaagata

SEQ ID NO: 29960 - DNA, 20 bp, Artificial Sequence
  chemically synthesized
aaaataaagtttaaagatat

SEQ ID NO: 29961 - DNA, 20 bp, Artificial Sequence
  chemically synthesized
ataaagtttaaagatatggg

SEQ ID NO: 29962 - DNA, 20 bp, Artificial Sequence
  chemically synthesized
ttaaagatatgggtggcctt

SEQ ID NO: 29963 - DNA, 20 bp, Artificial Sequence
  chemically synthesized
taaagatatgggtggccttc

SEQ ID NO: 29964 - DNA, 20 bp, Artificial Sequence
  chemically synthesized
aagatatgggtggccttcag

SEQ ID NO: 29965 - DNA, 20 bp, Artificial Sequence
  chemically synthesized
gtggccttcaggagacacgc

SEQ ID NO: 29966 - DNA, 20 bp, Artificial Sequence
  chemically synthesized
cttcaggagacacgccagcc

SEQ ID NO: 29967 - DNA, 20 bp, Artificial Sequence
  chemically synthesized
atcttttcacaatgacacaa

SEQ ID NO: 29968 - DNA, 20 bp, Artificial Sequence
  chemically synthesized
ccatctcttcactttacacc

SEQ ID NO: 29969 - DNA, 20 bp, Artificial Sequence
  chemically synthesized
atctcttcactttacaccca

SEQ ID NO: 29970 - DNA, 20 bp, Artificial Sequence
  chemically synthesized
tctcttcactttacacccag

SEQ ID NO: 29971 - DNA, 20 bp, Artificial Sequence
  chemically synthesized
ttacacccagaggaaaaaaa

SEQ ID NO: 29972 - DNA, 20 bp, Artificial Sequence
  chemically synthesized
ccagaggaaaaaaaaagtta

SEQ ID NO: 29973 - DNA, 20 bp, Artificial Sequence
  chemically synthesized
cagaggaaaaaaaaagttaa

SEQ ID NO: 29974 - DNA, 20 bp, Artificial Sequence
  chemically synthesized
agaggaaaaaaaaagttaaa

SEQ ID NO: 29975 - DNA, 20 bp, Artificial Sequence
  chemically synthesized
aagttaaagggtttctcaac

SEQ ID NO: 29976 - DNA, 20 bp, Artificial Sequence
  chemically synthesized
agttaaagggtttctcaacc

SEQ ID NO: 29977 - DNA, 20 bp, Artificial Sequence
  chemically synthesized
aaagggtttctcaaccaggt

SEQ ID NO: 29978 - DNA, 20 bp, Artificial Sequence
  chemically synthesized
tttctcaaccaggtaagtca

SEQ ID NO: 29979 - DNA, 20 bp, Artificial Sequence
  chemically synthesized
tctcaaccaggtaagtcatg

SEQ ID NO: 29980 - DNA, 20 bp, Artificial Sequence
  chemically synthesized
tcaaccaggtaagtcatgga

SEQ ID NO: 29981 - DNA, 20 bp, Artificial Sequence
  chemically synthesized
gcaacactcaacacacttgt

SEQ ID NO: 29982 - DNA, 20 bp, Artificial Sequence
  chemically synthesized
gtgagttcttgtgcactgtc

SEQ ID NO: 29983 - DNA, 20 bp, Artificial Sequence
  chemically synthesized
gcactgtctggcttttttgc

SEQ ID NO: 29984 - DNA, 20 bp, Artificial Sequence
  chemically synthesized
tggcttttttgctagcctat

SEQ ID NO: 29985 - DNA, 20 bp, Artificial Sequence
  chemically synthesized
gctagcctataagctgcatg

SEQ ID NO: 29986 - DNA, 20 bp, Artificial Sequence
  chemically synthesized
ctagcctataagctgcatga

SEQ ID NO: 29987 - DNA, 20 bp, Artificial Sequence
  chemically synthesized
ctataagctgcatgaaggct

SEQ ID NO: 29988 - DNA, 20 bp, Artificial Sequence
  chemically synthesized
ctgcatgaaggctgagacta

SEQ ID NO: 29989 - DNA, 20 bp, Artificial Sequence
  chemically synthesized
catgaaggctgagactatgg

SEQ ID NO: 29990 - DNA, 20 bp, Artificial Sequence
  chemically synthesized
ggctgagactatggcagtct

SEQ ID NO: 29991 - DNA, 20 bp, Artificial Sequence
  chemically synthesized
actatggcagtcttggctca

SEQ ID NO: 29992 - DNA, 20 bp, Artificial Sequence
  chemically synthesized
atggcagtcttggctcatag

SEQ ID NO: 29993 - DNA, 20 bp, Artificial Sequence
  chemically synthesized
tggcagtcttggctcataga

SEQ ID NO: 29994 - DNA, 20 bp, Artificial Sequence
  chemically synthesized
cttggctcatagaaggtaat

SEQ ID NO: 29995 - DNA, 20 bp, Artificial Sequence
  chemically synthesized
ggctcatagaaggtaatcag

SEQ ID NO: 29996 - DNA, 20 bp, Artificial Sequence
  chemically synthesized
ttgattgaatttttccctta

SEQ ID NO: 29997 - DNA, 20 bp, Artificial Sequence
  chemically synthesized
cttaaagccaattctaatgt

SEQ ID NO: 29998 - DNA, 20 bp, Artificial Sequence
  chemically synthesized
tgtatgtgtgctgctgtaaa

SEQ ID NO: 29999 - DNA, 20 bp, Artificial Sequence
  chemically synthesized
gtatgtgtgctgctgtaaat

SEQ ID NO: 30000 - DNA, 20 bp, Artificial Sequence
  chemically synthesized
tatgtgtgctgctgtaaata

SEQ ID NO: 30001 - DNA, 20 bp, Artificial Sequence
  chemically synthesized
tgtgctgctgtaaatagggt

SEQ ID NO: 30002 - DNA, 20 bp, Artificial Sequence
  chemically synthesized
acttaaataccaattgattt

SEQ ID NO: 30003 - DNA, 20 bp, Artificial Sequence
  chemically synthesized
aataccaattgattttagcc

SEQ ID NO: 30004 - DNA, 20 bp, Artificial Sequence
  chemically synthesized
ataccaattgattttagccc

SEQ ID NO: 30005 - DNA, 20 bp, Artificial Sequence
  chemically synthesized
agcccaggataatgaaaatg

SEQ ID NO: 30006 - DNA, 20 bp, Artificial Sequence
  chemically synthesized
aatgaaaatgcagtcttgct

SEQ ID NO: 30007 - DNA, 20 bp, Artificial Sequence
  chemically synthesized
aaaatgcagtcttgctcagc

SEQ ID NO: 30008 - DNA, 20 bp, Artificial Sequence
  chemically synthesized
gaaatgtaaccatctgaaca

SEQ ID NO: 30009 - DNA, 20 bp, Artificial Sequence
  chemically synthesized
ccatctgaacacagctcctt

SEQ ID NO: 30010 - DNA, 20 bp, Artificial Sequence
  chemically synthesized
atctgaacacagctccttaa

SEQ ID NO: 30011 - DNA, 20 bp, Artificial Sequence
  chemically synthesized
cacagctccttaagagatat

SEQ ID NO: 30012 - DNA, 20 bp, Artificial Sequence
  chemically synthesized
agctccttaagagatataag

SEQ ID NO: 30013 - DNA, 20 bp, Artificial Sequence
  chemically synthesized
gctccttaagagatataaga

SEQ ID NO: 30014 - DNA, 20 bp, Artificial Sequence
  chemically synthesized
ctccttaagagatataagaa

SEQ ID NO: 30015 - DNA, 20 bp, Artificial Sequence
  chemically synthesized
cttaagagatataagaaggg

SEQ ID NO: 30016 - DNA, 20 bp, Artificial Sequence
  chemically synthesized
aagagatataagaagggtgg

SEQ ID NO: 30017 - DNA, 20 bp, Artificial Sequence
  chemically synthesized
agatataagaagggtggaag

SEQ ID NO: 30018 - DNA, 20 bp, Artificial Sequence
  chemically synthesized
gatataagaagggtggaagt

SEQ ID NO: 30019 - DNA, 20 bp, Artificial Sequence
  chemically synthesized
aagaagggtggaagtgggtg

SEQ ID NO: 30020 - DNA, 20 bp, Artificial Sequence
  chemically synthesized
agaagggtggaagtgggtga

SEQ ID NO: 30021 - DNA, 20 bp, Artificial Sequence
  chemically synthesized
gaagggtggaagtgggtgaa

SEQ ID NO: 30022 - DNA, 20 bp, Artificial Sequence
  chemically synthesized
gggtggaagtgggtgaaggg

SEQ ID NO: 30023 - DNA, 20 bp, Artificial Sequence
  chemically synthesized
ggtggaagtgggtgaagggt

SEQ ID NO: 30024 - DNA, 20 bp, Artificial Sequence
  chemically synthesized
tgggtgaagggtaggccctc

SEQ ID NO: 30025 - DNA, 20 bp, Artificial Sequence
  chemically synthesized
ggtgaagggtaggccctcca

SEQ ID NO: 30026 - DNA, 20 bp, Artificial Sequence
  chemically synthesized
ggtaggccctccagagttct

SEQ ID NO: 30027 - DNA, 20 bp, Artificial Sequence
  chemically synthesized
tccagagttctcagttgttg

SEQ ID NO: 30028 - DNA, 20 bp, Artificial Sequence
  chemically synthesized
ccagagttctcagttgttgc

SEQ ID NO: 30029 - DNA, 20 bp, Artificial Sequence
  chemically synthesized
gagttctcagttgttgcggg

SEQ ID NO: 30030 - DNA, 20 bp, Artificial Sequence
  chemically synthesized
ctcagttgttgcgggaagtc

SEQ ID NO: 30031 - DNA, 20 bp, Artificial Sequence
  chemically synthesized
tcagttgttgcgggaagtct

SEQ ID NO: 30032 - DNA, 20 bp, Artificial Sequence
  chemically synthesized
gggaagtctgggactccaaa

SEQ ID NO: 30033 - DNA, 20 bp, Artificial Sequence
  chemically synthesized
gaagtctgggactccaaacg

SEQ ID NO: 30034 - DNA, 20 bp, Artificial Sequence
  chemically synthesized
aagtctgggactccaaacgg

SEQ ID NO: 30035 - DNA, 20 bp, Artificial Sequence
  chemically synthesized
agtctgggactccaaacgga

SEQ ID NO: 30036 - DNA, 20 bp, Artificial Sequence
  chemically synthesized
gggactccaaacggagggat

SEQ ID NO: 30037 - DNA, 20 bp, Artificial Sequence
  chemically synthesized
ccaaacggagggatcagctg

SEQ ID NO: 30038 - DNA, 20 bp, Artificial Sequence
  chemically synthesized
ggagggatcagctgaagcca

SEQ ID NO: 30039 - DNA, 20 bp, Artificial Sequence
  chemically synthesized
gggatcagctgaagccatgg

SEQ ID NO: 30040 - DNA, 20 bp, Artificial Sequence
  chemically synthesized
atcagctgaagccatggcag

SEQ ID NO: 30041 - DNA, 20 bp, Artificial Sequence
  chemically synthesized
gaagccatggcagaagttcg

SEQ ID NO: 30042 - DNA, 20 bp, Artificial Sequence
  chemically synthesized
gcagaagttcgtggattgtg

SEQ ID NO: 30043 - DNA, 20 bp, Artificial Sequence
  chemically synthesized
cgtggattgtgaagatttca

SEQ ID NO: 30044 - DNA, 20 bp, Artificial Sequence
  chemically synthesized
aagatttcatggacatttat

SEQ ID NO: 30045 - DNA, 20 bp, Artificial Sequence
  chemically synthesized
atctctaaacataaattgta

SEQ ID NO: 30046 - DNA, 20 bp, Artificial Sequence
  chemically synthesized
cataaattgtaaagatttca

SEQ ID NO: 30047 - DNA, 20 bp, Artificial Sequence
  chemically synthesized
atggacacttatcacttccc

SEQ ID NO: 30048 - DNA, 20 bp, Artificial Sequence
  chemically synthesized
ctttaatctcttaatcctgt

SEQ ID NO: 30049 - DNA, 20 bp, Artificial Sequence
  chemically synthesized
atctcttaatcctgtcagct

SEQ ID NO: 30050 - DNA, 20 bp, Artificial Sequence
  chemically synthesized
tctcttaatcctgtcagctg

SEQ ID NO: 30051 - DNA, 20 bp, Artificial Sequence
  chemically synthesized
tcttaatcctgtcagctgag

SEQ ID NO: 30052 - DNA, 20 bp, Artificial Sequence
  chemically synthesized
cttaatcctgtcagctgagg

SEQ ID NO: 30053 - DNA, 20 bp, Artificial Sequence
  chemically synthesized
gaggaggatgtatattgcct

SEQ ID NO: 30054 - DNA, 20 bp, Artificial Sequence
  chemically synthesized
aggaggatgtatattgcctc

SEQ ID NO: 30055 - DNA, 20 bp, Artificial Sequence
  chemically synthesized
cattaactgcacaaattgta

SEQ ID NO: 30056 - DNA, 20 bp, Artificial Sequence
  chemically synthesized
attgtacagcatgtgtgttt

SEQ ID NO: 30057 - DNA, 20 bp, Artificial Sequence
  chemically synthesized
tgtttgagcaacatgaaatg

SEQ ID NO: 30058 - DNA, 20 bp, Artificial Sequence
  chemically synthesized
aaatgtggacaccttgaaaa

SEQ ID NO: 30059 - DNA, 20 bp, Artificial Sequence
  chemically synthesized
tggacaccttgaaaaaagaa

SEQ ID NO: 30060 - DNA, 20 bp, Artificial Sequence
  chemically synthesized
ggacaccttgaaaaaagaac

SEQ ID NO: 30061 - DNA, 20 bp, Artificial Sequence
  chemically synthesized
ttgaaaaaagaacaggataa

SEQ ID NO: 30062 - DNA, 20 bp, Artificial Sequence
  chemically synthesized
acaggataacagcaattgtt

SEQ ID NO: 30063 - DNA, 20 bp, Artificial Sequence
  chemically synthesized
caggataacagcaattgttc

SEQ ID NO: 30064 - DNA, 20 bp, Artificial Sequence
  chemically synthesized
aggataacagcaattgttca

SEQ ID NO: 30065 - DNA, 20 bp, Artificial Sequence
  chemically synthesized
acagcaattgttcagggaat

SEQ ID NO: 30066 - DNA, 20 bp, Artificial Sequence
  chemically synthesized
agcaattgttcagggaataa

SEQ ID NO: 30067 - DNA, 20 bp, Artificial Sequence
  chemically synthesized
caattgttcagggaataaga

SEQ ID NO: 30068 - DNA, 20 bp, Artificial Sequence
  chemically synthesized
taaccttaaactctgactgc

SEQ ID NO: 30069 - DNA, 20 bp, Artificial Sequence
  chemically synthesized
cttaaactctgactgctggt

SEQ ID NO: 30070 - DNA, 20 bp, Artificial Sequence
  chemically synthesized
aactctgactgctggtgagc

SEQ ID NO: 30071 - DNA, 20 bp, Artificial Sequence
  chemically synthesized
actctgactgctggtgagcc

SEQ ID NO: 30072 - DNA, 20 bp, Artificial Sequence
  chemically synthesized
ctgactgctggtgagccagg

SEQ ID NO: 30073 - DNA, 20 bp, Artificial Sequence
  chemically synthesized
tgctggtgagccaggcagaa

SEQ ID NO: 30074 - DNA, 20 bp, Artificial Sequence
  chemically synthesized
ctggtgagccaggcagaaca

SEQ ID NO: 30075 - DNA, 20 bp, Artificial Sequence
  chemically synthesized
ccatatttctcttctttcaa

SEQ ID NO: 30076 - DNA, 20 bp, Artificial Sequence
  chemically synthesized
tctcttctttcaaaagcaaa

SEQ ID NO: 30077 - DNA, 20 bp, Artificial Sequence
  chemically synthesized
ctcttctttcaaaagcaaat

SEQ ID NO: 30078 - DNA, 20 bp, Artificial Sequence
  chemically synthesized
cttctttcaaaagcaaatgg

SEQ ID NO: 30079 - DNA, 20 bp, Artificial Sequence
  chemically synthesized
tatcgctgaattctttttct

SEQ ID NO: 30080 - DNA, 20 bp, Artificial Sequence
  chemically synthesized
ctgaattctttttctcagca

SEQ ID NO: 30081 - DNA, 20 bp, Artificial Sequence
  chemically synthesized
tctcagcatggaacatccct

SEQ ID NO: 30082 - DNA, 20 bp, Artificial Sequence
  chemically synthesized
agcatggaacatccctgaga

SEQ ID NO: 30083 - DNA, 20 bp, Artificial Sequence
  chemically synthesized
catggaacatccctgagaaa

SEQ ID NO: 30084 - DNA, 20 bp, Artificial Sequence
  chemically synthesized
atccctgagaaagagaatac

SEQ ID NO: 30085 - DNA, 20 bp, Artificial Sequence
  chemically synthesized
ctgagaaagagaatacgagc

SEQ ID NO: 30086 - DNA, 20 bp, Artificial Sequence
  chemically synthesized
tgagaaagagaatacgagcc

SEQ ID NO: 30087 - DNA, 20 bp, Artificial Sequence
  chemically synthesized
agaaagagaatacgagccag

SEQ ID NO: 30088 - DNA, 20 bp, Artificial Sequence
  chemically synthesized
gaaagagaatacgagccagg

SEQ ID NO: 30089 - DNA, 20 bp, Artificial Sequence
  chemically synthesized
agaatacgagccaggaggta

SEQ ID NO: 30090 - DNA, 20 bp, Artificial Sequence
  chemically synthesized
gaatacgagccaggaggtat

SEQ ID NO: 30091 - DNA, 20 bp, Artificial Sequence
  chemically synthesized
aggaggtataggcttataaa

SEQ ID NO: 30092 - DNA, 20 bp, Artificial Sequence
  chemically synthesized
gcttataaacagcccccctc

SEQ ID NO: 30093 - DNA, 20 bp, Artificial Sequence
  chemically synthesized
cttataaacagcccccctcc

SEQ ID NO: 30094 - DNA, 20 bp, Artificial Sequence
  chemically synthesized
ccaggtgcgcctgtctctta

SEQ ID NO: 30095 - DNA, 20 bp, Artificial Sequence
  chemically synthesized
tgcgcctgtctcttatggtc

SEQ ID NO: 30096 - DNA, 20 bp, Artificial Sequence
  chemically synthesized
gtctcttatggtcgagactg

SEQ ID NO: 30097 - DNA, 20 bp, Artificial Sequence
  chemically synthesized
tctcttatggtcgagactgc

SEQ ID NO: 30098 - DNA, 20 bp, Artificial Sequence
  chemically synthesized
ctcttatggtcgagactgca

SEQ ID NO: 30099 - DNA, 20 bp, Artificial Sequence
  chemically synthesized
tcttatggtcgagactgcag

SEQ ID NO: 30100 - DNA, 20 bp, Artificial Sequence
  chemically synthesized
tcgagactgcaggggtgaaa

SEQ ID NO: 30101 - DNA, 20 bp, Artificial Sequence
  chemically synthesized
tgcaggggtgaaatagaccc

SEQ ID NO: 30102 - DNA, 20 bp, Artificial Sequence
  chemically synthesized
aaatagaccccagtctccca

SEQ ID NO: 30103 - DNA, 20 bp, Artificial Sequence
  chemically synthesized
ccagtctcccacagcgctcc

SEQ ID NO: 30104 - DNA, 20 bp, Artificial Sequence
  chemically synthesized
cagtctcccacagcgctccc

SEQ ID NO: 30105 - DNA, 20 bp, Artificial Sequence
  chemically synthesized
cacagcgctcccaggcttat

SEQ ID NO: 30106 - DNA, 20 bp, Artificial Sequence
  chemically synthesized
acagcgctcccaggcttatt

SEQ ID NO: 30107 - DNA, 20 bp, Artificial Sequence
  chemically synthesized
gcgctcccaggcttattagg

SEQ ID NO: 30108 - DNA, 20 bp, Artificial Sequence
  chemically synthesized
gctcccaggcttattaggaa

SEQ ID NO: 30109 - DNA, 20 bp, Artificial Sequence
  chemically synthesized
ctcccaggcttattaggaag

SEQ ID NO: 30110 - DNA, 20 bp, Artificial Sequence
  chemically synthesized
aattcccgcctaataaattt

SEQ ID NO: 30111 - DNA, 20 bp, Artificial Sequence
  chemically synthesized
cccgcctaataaattttggt

SEQ ID NO: 30112 - DNA, 20 bp, Artificial Sequence
  chemically synthesized
ctaataaattttggtcagac

SEQ ID NO: 30113 - DNA, 20 bp, Artificial Sequence
  chemically synthesized
taaaaaccctgtctcctgat

SEQ ID NO: 30114 - DNA, 20 bp, Artificial Sequence
  chemically synthesized
taagatgttatcaatgacaa

SEQ ID NO: 30115 - DNA, 20 bp, Artificial Sequence
  chemically synthesized
aatggtgcccgaaacttcat

SEQ ID NO: 30116 - DNA, 20 bp, Artificial Sequence
  chemically synthesized
tagcaattttaatttcgcct

SEQ ID NO: 30117 - DNA, 20 bp, Artificial Sequence
  chemically synthesized
ttaatttcgcctcggtcctg

SEQ ID NO: 30118 - DNA, 20 bp, Artificial Sequence
  chemically synthesized
tgatattctattaccttgta

SEQ ID NO: 30119 - DNA, 20 bp, Artificial Sequence
  chemically synthesized
aatccctaatacaaacttgc

SEQ ID NO: 30120 - DNA, 20 bp, Artificial Sequence
  chemically synthesized
tacaaacttgctggtttttg

SEQ ID NO: 30121 - DNA, 20 bp, Artificial Sequence
  chemically synthesized
ttgctggtttttgtggcttg

SEQ ID NO: 30122 - DNA, 20 bp, Artificial Sequence
  chemically synthesized
tgctggtttttgtggcttgt

SEQ ID NO: 30123 - DNA, 20 bp, Artificial Sequence
  chemically synthesized
gctggtttttgtggcttgtg

SEQ ID NO: 30124 - DNA, 20 bp, Artificial Sequence
  chemically synthesized
ttgtggcttgtggggcatca

SEQ ID NO: 30125 - DNA, 20 bp, Artificial Sequence
  chemically synthesized
ccgaaatgtgatgcctcccc

SEQ ID NO: 30126 - DNA, 20 bp, Artificial Sequence
  chemically synthesized
tgatgcctcccccggatgcc

SEQ ID NO: 30127 - DNA, 20 bp, Artificial Sequence
  chemically synthesized
actctgtccctttatttcta

SEQ ID NO: 30128 - DNA, 20 bp, Artificial Sequence
  chemically synthesized
tgtccctttatttctaaagt

SEQ ID NO: 30129 - DNA, 20 bp, Artificial Sequence
  chemically synthesized
ttctaaagttggccgacgct

SEQ ID NO: 30130 - DNA, 20 bp, Artificial Sequence
  chemically synthesized
tctaaagttggccgacgctt

SEQ ID NO: 30131 - DNA, 20 bp, Artificial Sequence
  chemically synthesized
ctaaagttggccgacgctta

SEQ ID NO: 30132 - DNA, 20 bp, Artificial Sequence
  chemically synthesized
tggccgacgcttagggaaaa

SEQ ID NO: 30133 - DNA, 20 bp, Artificial Sequence
  chemically synthesized
gacgcttagggaaaatagaa

SEQ ID NO: 30134 - DNA, 20 bp, Artificial Sequence
  chemically synthesized
aaaagaacctacgtgaatat

SEQ ID NO: 30135 - DNA, 20 bp, Artificial Sequence
  chemically synthesized
aaagaacctacgtgaatatt

SEQ ID NO: 30136 - DNA, 20 bp, Artificial Sequence
  chemically synthesized
aagaacctacgtgaatattg

SEQ ID NO: 30137 - DNA, 20 bp, Artificial Sequence
  chemically synthesized
aacctacgtgaatattgggg

SEQ ID NO: 30138 - DNA, 20 bp, Artificial Sequence
  chemically synthesized
acctacgtgaatattggggc

SEQ ID NO: 30139 - DNA, 20 bp, Artificial Sequence
  chemically synthesized
ggggcaggttccctgatact

SEQ ID NO: 30140 - DNA, 20 bp, Artificial Sequence
  chemically synthesized
gcaggttccctgatactcag

SEQ ID NO: 30141 - DNA, 20 bp, Artificial Sequence
  chemically synthesized
ttccctgatactcagtggcg

SEQ ID NO: 30142 - DNA, 20 bp, Artificial Sequence
  chemically synthesized
ccctgatactcagtggcgtg

SEQ ID NO: 30143 - DNA, 20 bp, Artificial Sequence
  chemically synthesized
cagtggcgtggagatgtaac

SEQ ID NO: 30144 - DNA, 20 bp, Artificial Sequence
  chemically synthesized
gcgtggagatgtaacaagcc

SEQ ID NO: 30145 - DNA, 20 bp, Artificial Sequence
  chemically synthesized
tgtaacaagcctggatgtgt

SEQ ID NO: 30146 - DNA, 20 bp, Artificial Sequence
  chemically synthesized
ctggatgtgtgagtgatgat

SEQ ID NO: 30147 - DNA, 20 bp, Artificial Sequence
  chemically synthesized
tggatgtgtgagtgatgatc

SEQ ID NO: 30148 - DNA, 20 bp, Artificial Sequence
  chemically synthesized
agtgatgatcaggccaacaa

SEQ ID NO: 30149 - DNA, 20 bp, Artificial Sequence
  chemically synthesized
ggccaacaacagtctgtatt

SEQ ID NO: 30150 - DNA, 20 bp, Artificial Sequence
  chemically synthesized
caacaacagtctgtatttgg

SEQ ID NO: 30151 - DNA, 20 bp, Artificial Sequence
  chemically synthesized
tctgtatttggaagaaatat

SEQ ID NO: 30152 - DNA, 20 bp, Artificial Sequence
  chemically synthesized
cagatgtgaatgttatgacc

SEQ ID NO: 30153 - DNA, 20 bp, Artificial Sequence
  chemically synthesized
agatgtgaatgttatgacct

SEQ ID NO: 30154 - DNA, 20 bp, Artificial Sequence
  chemically synthesized
tgtgaatgttatgacctagg

SEQ ID NO: 30155 - DNA, 20 bp, Artificial Sequence
  chemically synthesized
tgttatgacctaggaagcaa

SEQ ID NO: 30156 - DNA, 20 bp, Artificial Sequence
  chemically synthesized
tatgacctaggaagcaatgg

SEQ ID NO: 30157 - DNA, 20 bp, Artificial Sequence
  chemically synthesized
aaaattattctttttgcctt

SEQ ID NO: 30158 - DNA, 20 bp, Artificial Sequence
  chemically synthesized
ttgtcaacacaaaaaatact

SEQ ID NO: 30159 - DNA, 20 bp, Artificial Sequence
  chemically synthesized
gttgtatactgatttgttaa

SEQ ID NO: 30160 - DNA, 20 bp, Artificial Sequence
  chemically synthesized
gtatactgatttgttaaaag

SEQ ID NO: 30161 - DNA, 20 bp, Artificial Sequence
  chemically synthesized
tactgatttgttaaaagcag

SEQ ID NO: 30162 - DNA, 20 bp, Artificial Sequence
  chemically synthesized
ttgttaaaagcagcagcatg

SEQ ID NO: 30163 - DNA, 20 bp, Artificial Sequence
  chemically synthesized
taaaagcagcagcatgcagt

SEQ ID NO: 30164 - DNA, 20 bp, Artificial Sequence
  chemically synthesized
aaaagcagcagcatgcagtt

SEQ ID NO: 30165 - DNA, 20 bp, Artificial Sequence
  chemically synthesized
tgcagttaggatgatatctt

SEQ ID NO: 30166 - DNA, 20 bp, Artificial Sequence
  chemically synthesized
gcagttaggatgatatcttt

SEQ ID NO: 30167 - DNA, 20 bp, Artificial Sequence
  chemically synthesized
cagttaggatgatatctttg

SEQ ID NO: 30168 - DNA, 20 bp, Artificial Sequence
  chemically synthesized
ggatgatatctttggggaaa

SEQ ID NO: 30169 - DNA, 20 bp, Artificial Sequence
  chemically synthesized
tgatatctttggggaaatgg

SEQ ID NO: 30170 - DNA, 20 bp, Artificial Sequence
  chemically synthesized
atatctttggggaaatggca

SEQ ID NO: 30171 - DNA, 20 bp, Artificial Sequence
  chemically synthesized
aaccccatgctcaccatcaa

SEQ ID NO: 30172 - DNA, 20 bp, Artificial Sequence
  chemically synthesized
accccatgctcaccatcaac

SEQ ID NO: 30173 - DNA, 20 bp, Artificial Sequence
  chemically synthesized
ccatcaacgggattgaattt

SEQ ID NO: 30174 - DNA, 20 bp, Artificial Sequence
  chemically synthesized
gggattgaatttgagctgct

SEQ ID NO: 30175 - DNA, 20 bp, Artificial Sequence
  chemically synthesized
gaatttgagctgctgagaat

SEQ ID NO: 30176 - DNA, 20 bp, Artificial Sequence
  chemically synthesized
ttatcttcaattctgtgaaa

SEQ ID NO: 30177 - DNA, 20 bp, Artificial Sequence
  chemically synthesized
aattctgtgaaatggaattt

SEQ ID NO: 30178 - DNA, 20 bp, Artificial Sequence
  chemically synthesized
tgtgaaatggaattttagac

SEQ ID NO: 30179 - DNA, 20 bp, Artificial Sequence
  chemically synthesized
tttagaccagcctgtgactg

SEQ ID NO: 30180 - DNA, 20 bp, Artificial Sequence
  chemically synthesized
cagcctgtgactgaagccac

SEQ ID NO: 30181 - DNA, 20 bp, Artificial Sequence
  chemically synthesized
agcctgtgactgaagccact

SEQ ID NO: 30182 - DNA, 20 bp, Artificial Sequence
  chemically synthesized
actgaagccactgggcatta

SEQ ID NO: 30183 - DNA, 20 bp, Artificial Sequence
  chemically synthesized
gccgcattgtttctctctgc

SEQ ID NO: 30184 - DNA, 20 bp, Artificial Sequence
  chemically synthesized
cgcattgtttctctctgcaa

SEQ ID NO: 30185 - DNA, 20 bp, Artificial Sequence
  chemically synthesized
cattgtttctctctgcaaga

SEQ ID NO: 30186 - DNA, 20 bp, Artificial Sequence
  chemically synthesized
attgtttctctctgcaagag

SEQ ID NO: 30187 - DNA, 20 bp, Artificial Sequence
  chemically synthesized
gtttctctctgcaagagagg

SEQ ID NO: 30188 - DNA, 20 bp, Artificial Sequence
  chemically synthesized
tttctctctgcaagagagga

SEQ ID NO: 30189 - DNA, 20 bp, Artificial Sequence
  chemically synthesized
ctctctgcaagagaggaagg

SEQ ID NO: 30190 - DNA, 20 bp, Artificial Sequence
  chemically synthesized
tctctgcaagagaggaagga

SEQ ID NO: 30191 - DNA, 20 bp, Artificial Sequence
  chemically synthesized
tgcaagagaggaaggaaggc

SEQ ID NO: 30192 - DNA, 20 bp, Artificial Sequence
  chemically synthesized
caagagaggaaggaaggctg

SEQ ID NO: 30193 - DNA, 20 bp, Artificial Sequence
  chemically synthesized
gaggaaggaaggctggagta

SEQ ID NO: 30194 - DNA, 20 bp, Artificial Sequence
  chemically synthesized
aggaaggctggagtacagct

SEQ ID NO: 30195 - DNA, 20 bp, Artificial Sequence
  chemically synthesized
tggagtacagctgagctttc

SEQ ID NO: 30196 - DNA, 20 bp, Artificial Sequence
  chemically synthesized
agtacagctgagctttctgg

SEQ ID NO: 30197 - DNA, 20 bp, Artificial Sequence
  chemically synthesized
gtacagctgagctttctggc

SEQ ID NO: 30198 - DNA, 20 bp, Artificial Sequence
  chemically synthesized
ctgagctttctggcaggcac

SEQ ID NO: 30199 - DNA, 20 bp, Artificial Sequence
  chemically synthesized
agctttctggcaggcactgg

SEQ ID NO: 30200 - DNA, 20 bp, Artificial Sequence
  chemically synthesized
ctttctggcaggcactggtg

SEQ ID NO: 30201 - DNA, 20 bp, Artificial Sequence
  chemically synthesized
ccttccccattctttgtaac

SEQ ID NO: 30202 - DNA, 20 bp, Artificial Sequence
  chemically synthesized
tccccattctttgtaactgg

SEQ ID NO: 30203 - DNA, 20 bp, Artificial Sequence
  chemically synthesized
ttctttgtaactggtggcct

SEQ ID NO: 30204 - DNA, 20 bp, Artificial Sequence
  chemically synthesized
tttgtaactggtggccttag

SEQ ID NO: 30205 - DNA, 20 bp, Artificial Sequence
  chemically synthesized
tgtaactggtggccttagaa

SEQ ID NO: 30206 - DNA, 20 bp, Artificial Sequence
  chemically synthesized
gtaactggtggccttagaag

SEQ ID NO: 30207 - DNA, 20 bp, Artificial Sequence
  chemically synthesized
taactggtggccttagaaga

SEQ ID NO: 30208 - DNA, 20 bp, Artificial Sequence
  chemically synthesized
ggtggccttagaagagggtt

SEQ ID NO: 30209 - DNA, 20 bp, Artificial Sequence
  chemically synthesized
gtggccttagaagagggttc

SEQ ID NO: 30210 - DNA, 20 bp, Artificial Sequence
  chemically synthesized
tggccttagaagagggttca

SEQ ID NO: 30211 - DNA, 20 bp, Artificial Sequence
  chemically synthesized
agggttcagggttatgtgtt

SEQ ID NO: 30212 - DNA, 20 bp, Artificial Sequence
  chemically synthesized
gggttatgtgtttggaacac

SEQ ID NO: 30213 - DNA, 20 bp, Artificial Sequence
  chemically synthesized
tatgtgtttggaacacgagt

SEQ ID NO: 30214 - DNA, 20 bp, Artificial Sequence
  chemically synthesized
ggaacacgagttagtataaa

SEQ ID NO: 30215 - DNA, 20 bp, Artificial Sequence
  chemically synthesized
agttagtataaatggttctg

SEQ ID NO: 30216 - DNA, 20 bp, Artificial Sequence
  chemically synthesized
tggttctgaagcacttgatt

SEQ ID NO: 30217 - DNA, 20 bp, Artificial Sequence
  chemically synthesized
tcagactgtgctttaaaaaa

SEQ ID NO: 30218 - DNA, 20 bp, Artificial Sequence
  chemically synthesized
cagactgtgctttaaaaaat

SEQ ID NO: 30219 - DNA, 20 bp, Artificial Sequence
  chemically synthesized
ctgtgctttaaaaaatagga

SEQ ID NO: 30220 - DNA, 20 bp, Artificial Sequence
  chemically synthesized
gctttaaaaaataggaaaga

SEQ ID NO: 30221 - DNA, 20 bp, Artificial Sequence
  chemically synthesized
ttaaaaaataggaaagaaag

SEQ ID NO: 30222 - DNA, 20 bp, Artificial Sequence
  chemically synthesized
aaaataggaaagaaagtaga

SEQ ID NO: 30223 - DNA, 20 bp, Artificial Sequence
  chemically synthesized
aggaaagaaagtagaaagaa

SEQ ID NO: 30224 - DNA, 20 bp, Artificial Sequence
  chemically synthesized
aaagtagaaagaacagctga

SEQ ID NO: 30225 - DNA, 20 bp, Artificial Sequence
  chemically synthesized
agaaagaacagctgatggtt

SEQ ID NO: 30226 - DNA, 20 bp, Artificial Sequence
  chemically synthesized
aagaacagctgatggtttgg

SEQ ID NO: 30227 - DNA, 20 bp, Artificial Sequence
  chemically synthesized
agaacagctgatggtttgga

SEQ ID NO: 30228 - DNA, 20 bp, Artificial Sequence
  chemically synthesized
gaacagctgatggtttggaa

SEQ ID NO: 30229 - DNA, 20 bp, Artificial Sequence
  chemically synthesized
acagctgatggtttggaagg

SEQ ID NO: 30230 - DNA, 20 bp, Artificial Sequence
  chemically synthesized
tggtttggaagggagccacc

SEQ ID NO: 30231 - DNA, 20 bp, Artificial Sequence
  chemically synthesized
gaagggagccaccaagcacc

SEQ ID NO: 30232 - DNA, 20 bp, Artificial Sequence
  chemically synthesized
agggagccaccaagcaccaa

SEQ ID NO: 30233 - DNA, 20 bp, Artificial Sequence
  chemically synthesized
gggagccaccaagcaccaag

SEQ ID NO: 30234 - DNA, 20 bp, Artificial Sequence
  chemically synthesized
caccaagcaccaagaggtgt

SEQ ID NO: 30235 - DNA, 20 bp, Artificial Sequence
  chemically synthesized
ctgaatccgtttctcaatct

SEQ ID NO: 30236 - DNA, 20 bp, Artificial Sequence
  chemically synthesized
ccgtttctcaatcttagctg

SEQ ID NO: 30237 - DNA, 20 bp, Artificial Sequence
  chemically synthesized
cgtttctcaatcttagctgc

SEQ ID NO: 30238 - DNA, 20 bp, Artificial Sequence
  chemically synthesized
gtttctcaatcttagctgca

SEQ ID NO: 30239 - DNA, 20 bp, Artificial Sequence
  chemically synthesized
caatcttagctgcagggcat

SEQ ID NO: 30240 - DNA, 20 bp, Artificial Sequence
  chemically synthesized
tagctgcagggcattggcta

SEQ ID NO: 30241 - DNA, 20 bp, Artificial Sequence
  chemically synthesized
gctgcagggcattggctaaa

SEQ ID NO: 30242 - DNA, 20 bp, Artificial Sequence
  chemically synthesized
ctgcagggcattggctaaag

SEQ ID NO: 30243 - DNA, 20 bp, Artificial Sequence
  chemically synthesized
cagggcattggctaaagagg

SEQ ID NO: 30244 - DNA, 20 bp, Artificial Sequence
  chemically synthesized
agggcattggctaaagagga

SEQ ID NO: 30245 - DNA, 20 bp, Artificial Sequence
  chemically synthesized
agaggaaggtgaaaactgct

SEQ ID NO: 30246 - DNA, 20 bp, Artificial Sequence
  chemically synthesized
tgagtcactatcaaatcaat

SEQ ID NO: 30247 - DNA, 20 bp, Artificial Sequence
  chemically synthesized
attggtttttctaatcccct

SEQ ID NO: 30248 - DNA, 20 bp, Artificial Sequence
  chemically synthesized
tggtttttctaatcccctga

SEQ ID NO: 30249 - DNA, 20 bp, Artificial Sequence
  chemically synthesized
ttctaatcccctgagagaaa

SEQ ID NO: 30250 - DNA, 20 bp, Artificial Sequence
  chemically synthesized
atcccctgagagaaaaagta

SEQ ID NO: 30251 - DNA, 20 bp, Artificial Sequence
  chemically synthesized
cccctgagagaaaaagtaca

SEQ ID NO: 30252 - DNA, 20 bp, Artificial Sequence
  chemically synthesized
aaaaagtacagagtttattg

SEQ ID NO: 30253 - DNA, 20 bp, Artificial Sequence
  chemically synthesized
ttaaaatgccatgcccctca

SEQ ID NO: 30254 - DNA, 20 bp, Artificial Sequence
  chemically synthesized
tgccatgcccctcacggcca

SEQ ID NO: 30255 - DNA, 20 bp, Artificial Sequence
  chemically synthesized
gccatgcccctcacggccaa

SEQ ID NO: 30256 - DNA, 20 bp, Artificial Sequence
  chemically synthesized
cggccaaaggcatctgaatt

SEQ ID NO: 30257 - DNA, 20 bp, Artificial Sequence
  chemically synthesized
ggccaaaggcatctgaatta

SEQ ID NO: 30258 - DNA, 20 bp, Artificial Sequence
  chemically synthesized
caaaggcatctgaattaagg

SEQ ID NO: 30259 - DNA, 20 bp, Artificial Sequence
  chemically synthesized
aggcatctgaattaaggaag

SEQ ID NO: 30260 - DNA, 20 bp, Artificial Sequence
  chemically synthesized
aattaaggaagcagtattca

SEQ ID NO: 30261 - DNA, 20 bp, Artificial Sequence
  chemically synthesized
gtattcacagctgctttctc

SEQ ID NO: 30262 - DNA, 20 bp, Artificial Sequence
  chemically synthesized
agctgctttctccagacatt

SEQ ID NO: 30263 - DNA, 20 bp, Artificial Sequence
  chemically synthesized
tttctccagacattgagctc

SEQ ID NO: 30264 - DNA, 20 bp, Artificial Sequence
  chemically synthesized
ttctccagacattgagctca

SEQ ID NO: 30265 - DNA, 20 bp, Artificial Sequence
  chemically synthesized
ccagacattgagctcaagga

SEQ ID NO: 30266 - DNA, 20 bp, Artificial Sequence
  chemically synthesized
aatctgaactctgcttttat

SEQ ID NO: 30267 - DNA, 20 bp, Artificial Sequence
  chemically synthesized
tttatcagctgcgaaaatcc

SEQ ID NO: 30268 - DNA, 20 bp, Artificial Sequence
  chemically synthesized
aaaatccaagcattcatttc

SEQ ID NO: 30269 - DNA, 20 bp, Artificial Sequence
  chemically synthesized
tccaagcattcatttccagc

SEQ ID NO: 30270 - DNA, 20 bp, Artificial Sequence
  chemically synthesized
gcattcatttccagctggtt

SEQ ID NO: 30271 - DNA, 20 bp, Artificial Sequence
  chemically synthesized
ctggttcagtgcctatgtaa

SEQ ID NO: 30272 - DNA, 20 bp, Artificial Sequence
  chemically synthesized
agtatactgtgtacaaaaat

SEQ ID NO: 30273 - DNA, 20 bp, Artificial Sequence
  chemically synthesized
tgtacaaaaataagattaaa

SEQ ID NO: 30274 - DNA, 20 bp, Artificial Sequence
  chemically synthesized
aagattaaaaagctaacatt

SEQ ID NO: 30275 - DNA, 20 bp, Artificial Sequence
  chemically synthesized
ttaaaaagctaacattaagc

SEQ ID NO: 30276 - DNA, 20 bp, Artificial Sequence
  chemically synthesized
gtgtgtttgtatgttttcta

SEQ ID NO: 30277 - DNA, 20 bp, Artificial Sequence
  chemically synthesized
tttgtatgttttctacagtt

SEQ ID NO: 30278 - DNA, 20 bp, Artificial Sequence
  chemically synthesized
ttctgaataatttgatccga

SEQ ID NO: 30279 - DNA, 20 bp, Artificial Sequence
  chemically synthesized
atatgatttcatttcttttc

SEQ ID NO: 30280 - DNA, 20 bp, Artificial Sequence
  chemically synthesized
atgatttcatttcttttcga

SEQ ID NO: 30281 - DNA, 20 bp, Artificial Sequence
  chemically synthesized
tatgcatactttctaaatgc

SEQ ID NO: 30282 - DNA, 20 bp, Artificial Sequence
  chemically synthesized
aaatgcaagaataaattcct

SEQ ID NO: 30283 - DNA, 20 bp, Artificial Sequence
  chemically synthesized
tcctgagctccatgtgactt

SEQ ID NO: 30284 - DNA, 20 bp, Artificial Sequence
  chemically synthesized
ccatgtgacttcagtaccat

SEQ ID NO: 30285 - DNA, 20 bp, Artificial Sequence
  chemically synthesized
cttcagtaccatcagctctt

SEQ ID NO: 30286 - DNA, 20 bp, Artificial Sequence
  chemically synthesized
cagtaccatcagctctttgg

SEQ ID NO: 30287 - DNA, 20 bp, Artificial Sequence
  chemically synthesized
tcagctctttggcagcttat

SEQ ID NO: 30288 - DNA, 20 bp, Artificial Sequence
  chemically synthesized
tttggcagcttatgagtata

SEQ ID NO: 30289 - DNA, 20 bp, Artificial Sequence
  chemically synthesized
acagctttttaattctcacc

SEQ ID NO: 30290 - DNA, 20 bp, Artificial Sequence
  chemically synthesized
tttaattctcacctggtccc

SEQ ID NO: 30291 - DNA, 20 bp, Artificial Sequence
  chemically synthesized
ttaattctcacctggtcccc

SEQ ID NO: 30292 - DNA, 20 bp, Artificial Sequence
  chemically synthesized
ctcacctggtccccaggata

SEQ ID NO: 30293 - DNA, 20 bp, Artificial Sequence
  chemically synthesized
ccaggatatggtttacttgt

SEQ ID NO: 30294 - DNA, 20 bp, Artificial Sequence
  chemically synthesized
aggatatggtttacttgtca

SEQ ID NO: 30295 - DNA, 20 bp, Artificial Sequence
  chemically synthesized
atatggtttacttgtcagag

SEQ ID NO: 30296 - DNA, 20 bp, Artificial Sequence
  chemically synthesized
acttgtcagagtagttttat

SEQ ID NO: 30297 - DNA, 20 bp, Artificial Sequence
  chemically synthesized
cttgtcagagtagttttatg

SEQ ID NO: 30298 - DNA, 20 bp, Artificial Sequence
  chemically synthesized
ctttctcctgactctgattc

SEQ ID NO: 30299 - DNA, 20 bp, Artificial Sequence
  chemically synthesized
tttctcctgactctgattct

SEQ ID NO: 30300 - DNA, 20 bp, Artificial Sequence
  chemically synthesized
gattctaggtaacacctgat

SEQ ID NO: 30301 - DNA, 20 bp, Artificial Sequence
  chemically synthesized
gtaacacctgatgagatgaa

SEQ ID NO: 30302 - DNA, 20 bp, Artificial Sequence
  chemically synthesized
cacctgatgagatgaacaga

SEQ ID NO: 30303 - DNA, 20 bp, Artificial Sequence
  chemically synthesized
tgcacctcacttcctcttac

SEQ ID NO: 30304 - DNA, 20 bp, Artificial Sequence
  chemically synthesized
gcacctcacttcctcttact

SEQ ID NO: 30305 - DNA, 20 bp, Artificial Sequence
  chemically synthesized
acttcctcttactgggcatg

SEQ ID NO: 30306 - DNA, 20 bp, Artificial Sequence
  chemically synthesized
cttcctcttactgggcatga

SEQ ID NO: 30307 - DNA, 20 bp, Artificial Sequence
  chemically synthesized
ctcttactgggcatgaagga

SEQ ID NO: 30308 - DNA, 20 bp, Artificial Sequence
  chemically synthesized
cttactgggcatgaaggaaa

SEQ ID NO: 30309 - DNA, 20 bp, Artificial Sequence
  chemically synthesized
tactgggcatgaaggaaaga

SEQ ID NO: 30310 - DNA, 20 bp, Artificial Sequence
  chemically synthesized
ctgggcatgaaggaaagaga

SEQ ID NO: 30311 - DNA, 20 bp, Artificial Sequence
  chemically synthesized
ggcatgaaggaaagagagag

SEQ ID NO: 30312 - DNA, 20 bp, Artificial Sequence
  chemically synthesized
tgaaggaaagagagagaagt

SEQ ID NO: 30313 - DNA, 20 bp, Artificial Sequence
  chemically synthesized
gaaggaaagagagagaagtc

SEQ ID NO: 30314 - DNA, 20 bp, Artificial Sequence
  chemically synthesized
aaggaaagagagagaagtca

SEQ ID NO: 30315 - DNA, 20 bp, Artificial Sequence
  chemically synthesized
gaaagagagagaagtcaggg

SEQ ID NO: 30316 - DNA, 20 bp, Artificial Sequence
  chemically synthesized
aagagagagaagtcagggta

SEQ ID NO: 30317 - DNA, 20 bp, Artificial Sequence
  chemically synthesized
tgctacattttttttttctg

SEQ ID NO: 30318 - DNA, 20 bp, Artificial Sequence
  chemically synthesized
attttttttttctgtggaaa

SEQ ID NO: 30319 - DNA, 20 bp, Artificial Sequence
  chemically synthesized
tttttttttctgtggaaaaa

SEQ ID NO: 30320 - DNA, 20 bp, Artificial Sequence
  chemically synthesized
atatttctaattaaccttga

SEQ ID NO: 30321 - DNA, 20 bp, Artificial Sequence
  chemically synthesized
tatttctaattaaccttgat

SEQ ID NO: 30322 - DNA, 20 bp, Artificial Sequence
  chemically synthesized
aattaaccttgatgggaaca

SEQ ID NO: 30323 - DNA, 20 bp, Artificial Sequence
  chemically synthesized
cttgatgggaacatagaaca

SEQ ID NO: 30324 - DNA, 20 bp, Artificial Sequence
  chemically synthesized
aacatagaacatagattgta

SEQ ID NO: 30325 - DNA, 20 bp, Artificial Sequence
  chemically synthesized
acatagaacatagattgtaa

SEQ ID NO: 30326 - DNA, 20 bp, Artificial Sequence
  chemically synthesized
catagaacatagattgtaaa

SEQ ID NO: 30327 - DNA, 20 bp, Artificial Sequence
  chemically synthesized
agggaacttgcacattatcg

SEQ ID NO: 30328 - DNA, 20 bp, Artificial Sequence
  chemically synthesized
gaacttgcacattatcgcag

SEQ ID NO: 30329 - DNA, 20 bp, Artificial Sequence
  chemically synthesized
aacttgcacattatcgcagt

SEQ ID NO: 30330 - DNA, 20 bp, Artificial Sequence
  chemically synthesized
tatcgcagtaggctgaataa

SEQ ID NO: 30331 - DNA, 20 bp, Artificial Sequence
  chemically synthesized
gtaggctgaataatggctaa

SEQ ID NO: 30332 - DNA, 20 bp, Artificial Sequence
  chemically synthesized
tggctaatggctcactctga

SEQ ID NO: 30333 - DNA, 20 bp, Artificial Sequence
  chemically synthesized
ctcactctgaaagatatgta

SEQ ID NO: 30334 - DNA, 20 bp, Artificial Sequence
  chemically synthesized
gcttaacccctgaaacctgt

SEQ ID NO: 30335 - DNA, 20 bp, Artificial Sequence
  chemically synthesized
cctgtgagtattatcttttc

SEQ ID NO: 30336 - DNA, 20 bp, Artificial Sequence
  chemically synthesized
tattatcttttctagccaaa

SEQ ID NO: 30337 - DNA, 20 bp, Artificial Sequence
  chemically synthesized
agacttttgcatatataatt

SEQ ID NO: 30338 - DNA, 20 bp, Artificial Sequence
  chemically synthesized
gacttttgcatatataatta

SEQ ID NO: 30339 - DNA, 20 bp, Artificial Sequence
  chemically synthesized
gcatatataattaaggatct

SEQ ID NO: 30340 - DNA, 20 bp, Artificial Sequence
  chemically synthesized
catatataattaaggatctt

SEQ ID NO: 30341 - DNA, 20 bp, Artificial Sequence
  chemically synthesized
tataattaaggatcttggga

SEQ ID NO: 30342 - DNA, 20 bp, Artificial Sequence
  chemically synthesized
ataattaaggatcttgggat

SEQ ID NO: 30343 - DNA, 20 bp, Artificial Sequence
  chemically synthesized
taattaaggatcttgggatg

SEQ ID NO: 30344 - DNA, 20 bp, Artificial Sequence
  chemically synthesized
attaaggatcttgggatggg

SEQ ID NO: 30345 - DNA, 20 bp, Artificial Sequence
  chemically synthesized
ggggagatatcctaattatt

SEQ ID NO: 30346 - DNA, 20 bp, Artificial Sequence
  chemically synthesized
gggagatatcctaattattt

SEQ ID NO: 30347 - DNA, 20 bp, Artificial Sequence
  chemically synthesized
tgtatcctaaatgtaatcac

SEQ ID NO: 30348 - DNA, 20 bp, Artificial Sequence
  chemically synthesized
gtaatcacaagtgtcattat

SEQ ID NO: 30349 - DNA, 20 bp, Artificial Sequence
  chemically synthesized
aatcacaagtgtcattataa

SEQ ID NO: 30350 - DNA, 20 bp, Artificial Sequence
  chemically synthesized
atcacaagtgtcattataag

SEQ ID NO: 30351 - DNA, 20 bp, Artificial Sequence
  chemically synthesized
tcacaagtgtcattataaga

SEQ ID NO: 30352 - DNA, 20 bp, Artificial Sequence
  chemically synthesized
acaagtgtcattataagagg

SEQ ID NO: 30353 - DNA, 20 bp, Artificial Sequence
  chemically synthesized
caagtgtcattataagaggg

SEQ ID NO: 30354 - DNA, 20 bp, Artificial Sequence
  chemically synthesized
gtcattataagagggaggca

SEQ ID NO: 30355 - DNA, 20 bp, Artificial Sequence
  chemically synthesized
tcattataagagggaggcaa

SEQ ID NO: 30356 - DNA, 20 bp, Artificial Sequence
  chemically synthesized
cattataagagggaggcaaa

SEQ ID NO: 30357 - DNA, 20 bp, Artificial Sequence
  chemically synthesized
ttataagagggaggcaaagg

SEQ ID NO: 30358 - DNA, 20 bp, Artificial Sequence
  chemically synthesized
caaagggagatttgacttat

SEQ ID NO: 30359 - DNA, 20 bp, Artificial Sequence
  chemically synthesized
aagggagatttgacttataa

SEQ ID NO: 30360 - DNA, 20 bp, Artificial Sequence
  chemically synthesized
agggagatttgacttataag

SEQ ID NO: 30361 - DNA, 20 bp, Artificial Sequence
  chemically synthesized
ggagatttgacttataagag

SEQ ID NO: 30362 - DNA, 20 bp, Artificial Sequence
  chemically synthesized
aaaatgtgacgtgattacaa

SEQ ID NO: 30363 - DNA, 20 bp, Artificial Sequence
  chemically synthesized
atgtgacgtgattacaaaag

SEQ ID NO: 30364 - DNA, 20 bp, Artificial Sequence
  chemically synthesized
gtgacgtgattacaaaagca

SEQ ID NO: 30365 - DNA, 20 bp, Artificial Sequence
  chemically synthesized
agcagagatacatttttttg

SEQ ID NO: 30366 - DNA, 20 bp, Artificial Sequence
  chemically synthesized
gatacatttttttgaagatc

SEQ ID NO: 30367 - DNA, 20 bp, Artificial Sequence
  chemically synthesized
atacatttttttgaagatcg

SEQ ID NO: 30368 - DNA, 20 bp, Artificial Sequence
  chemically synthesized
catttttttgaagatcgagg

SEQ ID NO: 30369 - DNA, 20 bp, Artificial Sequence
  chemically synthesized
tttttttgaagatcgaggaa

SEQ ID NO: 30370 - DNA, 20 bp, Artificial Sequence
  chemically synthesized
ttttttgaagatcgaggaag

SEQ ID NO: 30371 - DNA, 20 bp, Artificial Sequence
  chemically synthesized
cgaggaagaggctacaaacc

SEQ ID NO: 30372 - DNA, 20 bp, Artificial Sequence
  chemically synthesized
gaggaagaggctacaaacca

SEQ ID NO: 30373 - DNA, 20 bp, Artificial Sequence
  chemically synthesized
aggctacaaaccaaggaatg

SEQ ID NO: 30374 - DNA, 20 bp, Artificial Sequence
  chemically synthesized
ggctacaaaccaaggaatgt

SEQ ID NO: 30375 - DNA, 20 bp, Artificial Sequence
  chemically synthesized
tacaaaccaaggaatgtggg

SEQ ID NO: 30376 - DNA, 20 bp, Artificial Sequence
  chemically synthesized
caaggaatgtgggtagcctc

SEQ ID NO: 30377 - DNA, 20 bp, Artificial Sequence
  chemically synthesized
ggaatgtgggtagcctctag

SEQ ID NO: 30378 - DNA, 20 bp, Artificial Sequence
  chemically synthesized
aatgtgggtagcctctagaa

SEQ ID NO: 30379 - DNA, 20 bp, Artificial Sequence
  chemically synthesized
atgtgggtagcctctagaag

SEQ ID NO: 30380 - DNA, 20 bp, Artificial Sequence
  chemically synthesized
gtagcctctagaagaggaaa

SEQ ID NO: 30381 - DNA, 20 bp, Artificial Sequence
  chemically synthesized
agaagaggaaacagaatcca

SEQ ID NO: 30382 - DNA, 20 bp, Artificial Sequence
  chemically synthesized
aggaaacagaatccatggaa

SEQ ID NO: 30383 - DNA, 20 bp, Artificial Sequence
  chemically synthesized
ggaaacagaatccatggaaa

SEQ ID NO: 30384 - DNA, 20 bp, Artificial Sequence
  chemically synthesized
aacagaatccatggaaaagg

SEQ ID NO: 30385 - DNA, 20 bp, Artificial Sequence
  chemically synthesized
acagaatccatggaaaaggc

SEQ ID NO: 30386 - DNA, 20 bp, Artificial Sequence
  chemically synthesized
caggaaaacacaatctctca

SEQ ID NO: 30387 - DNA, 20 bp, Artificial Sequence
  chemically synthesized
ggaaaacacaatctctcata

SEQ ID NO: 30388 - DNA, 20 bp, Artificial Sequence
  chemically synthesized
acaatctctcatagagtctc

SEQ ID NO: 30389 - DNA, 20 bp, Artificial Sequence
  chemically synthesized
atctctcatagagtctccag

SEQ ID NO: 30390 - DNA, 20 bp, Artificial Sequence
  chemically synthesized
catagagtctccagaagaaa

SEQ ID NO: 30391 - DNA, 20 bp, Artificial Sequence
  chemically synthesized
ccacactgacacctcgactt

SEQ ID NO: 30392 - DNA, 20 bp, Artificial Sequence
  chemically synthesized
ctgacacctcgactttagcc

SEQ ID NO: 30393 - DNA, 20 bp, Artificial Sequence
  chemically synthesized
tagcccagtgaaaccgattt

SEQ ID NO: 30394 - DNA, 20 bp, Artificial Sequence
  chemically synthesized
cttctgacctccacaacttc

SEQ ID NO: 30395 - DNA, 20 bp, Artificial Sequence
  chemically synthesized
taatacatttgtgttgtttt

SEQ ID NO: 30396 - DNA, 20 bp, Artificial Sequence
  chemically synthesized
gttttaagccaataaatttg

SEQ ID NO: 30397 - DNA, 20 bp, Artificial Sequence
  chemically synthesized
aaatttgtggtaatttttta

SEQ ID NO: 30398 - DNA, 20 bp, Artificial Sequence
  chemically synthesized
tttgtggtaattttttacag

SEQ ID NO: 30399 - DNA, 20 bp, Artificial Sequence
  chemically synthesized
tggtaattttttacagcagc

SEQ ID NO: 30400 - DNA, 20 bp, Artificial Sequence
  chemically synthesized
gtaattttttacagcagcaa

SEQ ID NO: 30401 - DNA, 20 bp, Artificial Sequence
  chemically synthesized
taattttttacagcagcaag

SEQ ID NO: 30402 - DNA, 20 bp, Artificial Sequence
  chemically synthesized
ttacagcagcaagaggaaat

SEQ ID NO: 30403 - DNA, 20 bp, Artificial Sequence
  chemically synthesized
gcaagaggaaatcagttacg

SEQ ID NO: 30404 - DNA, 20 bp, Artificial Sequence
  chemically synthesized
aggaaatcagttacgtagaa

SEQ ID NO: 30405 - DNA, 20 bp, Artificial Sequence
  chemically synthesized
aaatcagttacgtagaatag

SEQ ID NO: 30406 - DNA, 20 bp, Artificial Sequence
  chemically synthesized
aatcagttacgtagaatagt

SEQ ID NO: 30407 - DNA, 20 bp, Artificial Sequence
  chemically synthesized
agaatagtaggtcctgtctc

SEQ ID NO: 30408 - DNA, 20 bp, Artificial Sequence
  chemically synthesized
tcctgtctctggctaatcat

SEQ ID NO: 30409 - DNA, 20 bp, Artificial Sequence
  chemically synthesized
gctaatcattagaatcactc

SEQ ID NO: 30410 - DNA, 20 bp, Artificial Sequence
  chemically synthesized
aatcattagaatcactccag

SEQ ID NO: 30411 - DNA, 20 bp, Artificial Sequence
  chemically synthesized
ctccagaagcttgttacata

SEQ ID NO: 30412 - DNA, 20 bp, Artificial Sequence
  chemically synthesized
aagcttgttacatacagacc

SEQ ID NO: 30413 - DNA, 20 bp, Artificial Sequence
  chemically synthesized
gcttgttacatacagaccca

SEQ ID NO: 30414 - DNA, 20 bp, Artificial Sequence
  chemically synthesized
gttacatacagacccagagc

SEQ ID NO: 30415 - DNA, 20 bp, Artificial Sequence
  chemically synthesized
agacccagagccagtgaatc

SEQ ID NO: 30416 - DNA, 20 bp, Artificial Sequence
  chemically synthesized
gacccagagccagtgaatca

SEQ ID NO: 30417 - DNA, 20 bp, Artificial Sequence
  chemically synthesized
gagccagtgaatcaaggatt

SEQ ID NO: 30418 - DNA, 20 bp, Artificial Sequence
  chemically synthesized
ccagtgaatcaaggatttgg

SEQ ID NO: 30419 - DNA, 20 bp, Artificial Sequence
  chemically synthesized
gtgaatcaaggatttggtgg

SEQ ID NO: 30420 - DNA, 20 bp, Artificial Sequence
  chemically synthesized
tgaatcaaggatttggtggt

SEQ ID NO: 30421 - DNA, 20 bp, Artificial Sequence
  chemically synthesized
gaatcaaggatttggtggtg

SEQ ID NO: 30422 - DNA, 20 bp, Artificial Sequence
  chemically synthesized
aaggatttggtggtggggcc

SEQ ID NO: 30423 - DNA, 20 bp, Artificial Sequence
  chemically synthesized
ggatttggtggtggggccca

SEQ ID NO: 30424 - DNA, 20 bp, Artificial Sequence
  chemically synthesized
gggcccagagcctgaatatt

SEQ ID NO: 30425 - DNA, 20 bp, Artificial Sequence
  chemically synthesized
ccagagcctgaatattaagc

SEQ ID NO: 30426 - DNA, 20 bp, Artificial Sequence
  chemically synthesized
attaagcaagttcttcgttt

SEQ ID NO: 30427 - DNA, 20 bp, Artificial Sequence
  chemically synthesized
aagttcttcgttttagaaat

SEQ ID NO: 30428 - DNA, 20 bp, Artificial Sequence
  chemically synthesized
agttcttcgttttagaaatg

SEQ ID NO: 30429 - DNA, 20 bp, Artificial Sequence
  chemically synthesized
gttttagaaatgaggaaacc

SEQ ID NO: 30430 - DNA, 20 bp, Artificial Sequence
  chemically synthesized
ttttagaaatgaggaaacca

SEQ ID NO: 30431 - DNA, 20 bp, Artificial Sequence
  chemically synthesized
agaaatgaggaaaccaaggt

SEQ ID NO: 30432 - DNA, 20 bp, Artificial Sequence
  chemically synthesized
gaaatgaggaaaccaaggtt

SEQ ID NO: 30433 - DNA, 20 bp, Artificial Sequence
  chemically synthesized
aatgaggaaaccaaggttgg

SEQ ID NO: 30434 - DNA, 20 bp, Artificial Sequence
  chemically synthesized
gaggaaaccaaggttgggag

SEQ ID NO: 30435 - DNA, 20 bp, Artificial Sequence
  chemically synthesized
aaccaaggttgggagaagct

SEQ ID NO: 30436 - DNA, 20 bp, Artificial Sequence
  chemically synthesized
aagcaacttactcaaataca

SEQ ID NO: 30437 - DNA, 20 bp, Artificial Sequence
  chemically synthesized
agcaacttactcaaatacat

SEQ ID NO: 30438 - DNA, 20 bp, Artificial Sequence
  chemically synthesized
gcaacttactcaaatacata

SEQ ID NO: 30439 - DNA, 20 bp, Artificial Sequence
  chemically synthesized
tcttttgaattttcttaccc

SEQ ID NO: 30440 - DNA, 20 bp, Artificial Sequence
  chemically synthesized
tgtaaatgtgatttcattta

SEQ ID NO: 30441 - DNA, 20 bp, Artificial Sequence
  chemically synthesized
ttgacatattcattaaaatg

SEQ ID NO: 30442 - DNA, 20 bp, Artificial Sequence
  chemically synthesized
tcattaaaatgaagaaataa

SEQ ID NO: 30443 - DNA, 20 bp, Artificial Sequence
  chemically synthesized
aaaatgaagaaataaaagat

SEQ ID NO: 30444 - DNA, 20 bp, Artificial Sequence
  chemically synthesized
aagaaataaaagatgagaaa

SEQ ID NO: 30445 - DNA, 20 bp, Artificial Sequence
  chemically synthesized
attatataatgtttattgat

SEQ ID NO: 30446 - DNA, 20 bp, Artificial Sequence
  chemically synthesized
agaatgaatatgatgcaatc

SEQ ID NO: 30447 - DNA, 20 bp, Artificial Sequence
  chemically synthesized
gcaatctggttttctgtgtt

SEQ ID NO: 30448 - DNA, 20 bp, Artificial Sequence
  chemically synthesized
gtgttcagattcctgacctc

SEQ ID NO: 30449 - DNA, 20 bp, Artificial Sequence
  chemically synthesized
gttcagattcctgacctctg

SEQ ID NO: 30450 - DNA, 20 bp, Artificial Sequence
  chemically synthesized
ggagttaacctttctttgta

SEQ ID NO: 30451 - DNA, 20 bp, Artificial Sequence
  chemically synthesized
taacctttctttgtaaagat

SEQ ID NO: 30452 - DNA, 20 bp, Artificial Sequence
  chemically synthesized
ctttctttgtaaagattaga

SEQ ID NO: 30453 - DNA, 20 bp, Artificial Sequence
  chemically synthesized
tctttgtaaagattagacag

SEQ ID NO: 30454 - DNA, 20 bp, Artificial Sequence
  chemically synthesized
ctttgtaaagattagacagc

SEQ ID NO: 30455 - DNA, 20 bp, Artificial Sequence
  chemically synthesized
tgtaaagattagacagcagg

SEQ ID NO: 30456 - DNA, 20 bp, Artificial Sequence
  chemically synthesized
gtaaagattagacagcaggc

SEQ ID NO: 30457 - DNA, 20 bp, Artificial Sequence
  chemically synthesized
taaagattagacagcaggca

SEQ ID NO: 30458 - DNA, 20 bp, Artificial Sequence
  chemically synthesized
agattagacagcaggcaggg

SEQ ID NO: 30459 - DNA, 20 bp, Artificial Sequence
  chemically synthesized
ggaagaatgcctttgaaact

SEQ ID NO: 30460 - DNA, 20 bp, Artificial Sequence
  chemically synthesized
aagaatgcctttgaaactga

SEQ ID NO: 30461 - DNA, 20 bp, Artificial Sequence
  chemically synthesized
tgcctttgaaactgagagca

SEQ ID NO: 30462 - DNA, 20 bp, Artificial Sequence
  chemically synthesized
ttgaaactgagagcaaagac

SEQ ID NO: 30463 - DNA, 20 bp, Artificial Sequence
  chemically synthesized
tgcaatttacattgatgtcc

SEQ ID NO: 30464 - DNA, 20 bp, Artificial Sequence
  chemically synthesized
gtcctggtgctgtgcataat

SEQ ID NO: 30465 - DNA, 20 bp, Artificial Sequence
  chemically synthesized
aataagttgcttaaacatga

SEQ ID NO: 30466 - DNA, 20 bp, Artificial Sequence
  chemically synthesized
aagttgcttaaacatgacag

SEQ ID NO: 30467 - DNA, 20 bp, Artificial Sequence
  chemically synthesized
agttgcttaaacatgacagc

SEQ ID NO: 30468 - DNA, 20 bp, Artificial Sequence
  chemically synthesized
gcttaaacatgacagcagga

SEQ ID NO: 30469 - DNA, 20 bp, Artificial Sequence
  chemically synthesized
cttaaacatgacagcaggat

SEQ ID NO: 30470 - DNA, 20 bp, Artificial Sequence
  chemically synthesized
acataaaatttatttataaa

SEQ ID NO: 30471 - DNA, 20 bp, Artificial Sequence
  chemically synthesized
aaatttatttataaatggta

SEQ ID NO: 30472 - DNA, 20 bp, Artificial Sequence
  chemically synthesized
acctctgctgaacttcctca

SEQ ID NO: 30473 - DNA, 20 bp, Artificial Sequence
  chemically synthesized
cttcctcatagaatgttcat

SEQ ID NO: 30474 - DNA, 20 bp, Artificial Sequence
  chemically synthesized
agaatgttcatcagaaaaca

SEQ ID NO: 30475 - DNA, 20 bp, Artificial Sequence
  chemically synthesized
ttctatctactctttcttcc

SEQ ID NO: 30476 - DNA, 20 bp, Artificial Sequence
  chemically synthesized
accactgacatcatgaccct

SEQ ID NO: 30477 - DNA, 20 bp, Artificial Sequence
  chemically synthesized
gaccctcagttctattcccc

SEQ ID NO: 30478 - DNA, 20 bp, Artificial Sequence
  chemically synthesized
ctgcccactcccctgaaatc

SEQ ID NO: 30479 - DNA, 20 bp, Artificial Sequence
  chemically synthesized
ccataaatccaaccaccgcc

SEQ ID NO: 30480 - DNA, 20 bp, Artificial Sequence
  chemically synthesized
cataaatccaaccaccgcct

SEQ ID NO: 30481 - DNA, 20 bp, Artificial Sequence
  chemically synthesized
caaccaccgcctgggtatct

SEQ ID NO: 30482 - DNA, 20 bp, Artificial Sequence
  chemically synthesized
accgcctgggtatctcagtt

SEQ ID NO: 30483 - DNA, 20 bp, Artificial Sequence
  chemically synthesized
tccctccatcaactcaaatt

SEQ ID NO: 30484 - DNA, 20 bp, Artificial Sequence
  chemically synthesized
caactcaaatttggctgaca

SEQ ID NO: 30485 - DNA, 20 bp, Artificial Sequence
  chemically synthesized
aaatttggctgacacagttt

SEQ ID NO: 30486 - DNA, 20 bp, Artificial Sequence
  chemically synthesized
gctgacacagttttggattc

SEQ ID NO: 30487 - DNA, 20 bp, Artificial Sequence
  chemically synthesized
tgacacagttttggattcta

SEQ ID NO: 30488 - DNA, 20 bp, Artificial Sequence
  chemically synthesized
gttttggattctagagcatg

SEQ ID NO: 30489 - DNA, 20 bp, Artificial Sequence
  chemically synthesized
ttttggattctagagcatgc

SEQ ID NO: 30490 - DNA, 20 bp, Artificial Sequence
  chemically synthesized
tttgcactcactcttccctc

SEQ ID NO: 30491 - DNA, 20 bp, Artificial Sequence
  chemically synthesized
cccgtccttcctcactttgc

SEQ ID NO: 30492 - DNA, 20 bp, Artificial Sequence
  chemically synthesized
ccagttccaacttctctctg

SEQ ID NO: 30493 - DNA, 20 bp, Artificial Sequence
  chemically synthesized
ccaacttctctctgaagact

SEQ ID NO: 30494 - DNA, 20 bp, Artificial Sequence
  chemically synthesized
ttctctctgaagactcagtt

SEQ ID NO: 30495 - DNA, 20 bp, Artificial Sequence
  chemically synthesized
tctctctgaagactcagttt

SEQ ID NO: 30496 - DNA, 20 bp, Artificial Sequence
  chemically synthesized
ctgaagactcagtttaggta

SEQ ID NO: 30497 - DNA, 20 bp, Artificial Sequence
  chemically synthesized
tgaagactcagtttaggtac

SEQ ID NO: 30498 - DNA, 20 bp, Artificial Sequence
  chemically synthesized
agtttaggtacaggctcctt

SEQ ID NO: 30499 - DNA, 20 bp, Artificial Sequence
  chemically synthesized
gtttaggtacaggctccttt

SEQ ID NO: 30500 - DNA, 20 bp, Artificial Sequence
  chemically synthesized
aatttttttttgactctacc

SEQ ID NO: 30501 - DNA, 20 bp, Artificial Sequence
  chemically synthesized
ttttttgactctacctagcc

SEQ ID NO: 30502 - DNA, 20 bp, Artificial Sequence
  chemically synthesized
gactctacctagcccagact

SEQ ID NO: 30503 - DNA, 20 bp, Artificial Sequence
  chemically synthesized
tcatctacgatattaatctg

SEQ ID NO: 30504 - DNA, 20 bp, Artificial Sequence
  chemically synthesized
taatctgcagtgtcatgcac

SEQ ID NO: 30505 - DNA, 20 bp, Artificial Sequence
  chemically synthesized
acaaaatatttgctgaatga

SEQ ID NO: 30506 - DNA, 20 bp, Artificial Sequence
  chemically synthesized
tatttgctgaatgaaagaat

SEQ ID NO: 30507 - DNA, 20 bp, Artificial Sequence
  chemically synthesized
tttgctgaatgaaagaatga

SEQ ID NO: 30508 - DNA, 20 bp, Artificial Sequence
  chemically synthesized
aaagaatgagagttaacttt

SEQ ID NO: 30509 - DNA, 20 bp, Artificial Sequence
  chemically synthesized
aatgagagttaacttttagt

SEQ ID NO: 30510 - DNA, 20 bp, Artificial Sequence
  chemically synthesized
atgagagttaacttttagtc

SEQ ID NO: 30511 - DNA, 20 bp, Artificial Sequence
  chemically synthesized
ttaacttttagtcaggcata

SEQ ID NO: 30512 - DNA, 20 bp, Artificial Sequence
  chemically synthesized
ggcataaagataaaaaacca

SEQ ID NO: 30513 - DNA, 20 bp, Artificial Sequence
  chemically synthesized
aaaaccaaagtcttttactc

SEQ ID NO: 30514 - DNA, 20 bp, Artificial Sequence
  chemically synthesized
caaagtcttttactccggtg

SEQ ID NO: 30515 - DNA, 20 bp, Artificial Sequence
  chemically synthesized
aagtcttttactccggtgtg

SEQ ID NO: 30516 - DNA, 20 bp, Artificial Sequence
  chemically synthesized
actccggtgtggagtgtttt

SEQ ID NO: 30517 - DNA, 20 bp, Artificial Sequence
  chemically synthesized
ctccggtgtggagtgttttc

SEQ ID NO: 30518 - DNA, 20 bp, Artificial Sequence
  chemically synthesized
ttttcaggattcctaccaat

SEQ ID NO: 30519 - DNA, 20 bp, Artificial Sequence
  chemically synthesized
tttcaggattcctaccaatt

SEQ ID NO: 30520 - DNA, 20 bp, Artificial Sequence
  chemically synthesized
caggattcctaccaattagg

SEQ ID NO: 30521 - DNA, 20 bp, Artificial Sequence
  chemically synthesized
aggattcctaccaattagga

SEQ ID NO: 30522 - DNA, 20 bp, Artificial Sequence
  chemically synthesized
ggtgtttgattcttcaaact

SEQ ID NO: 30523 - DNA, 20 bp, Artificial Sequence
  chemically synthesized
aaacacctccccttaactga

SEQ ID NO: 30524 - DNA, 20 bp, Artificial Sequence
  chemically synthesized
actgatggattcttcaaact

SEQ ID NO: 30525 - DNA, 20 bp, Artificial Sequence
  chemically synthesized
ggattcttcaaactcagcat

SEQ ID NO: 30526 - DNA, 20 bp, Artificial Sequence
  chemically synthesized
tcttcaaactcagcatcagt

SEQ ID NO: 30527 - DNA, 20 bp, Artificial Sequence
  chemically synthesized
ttcaaactcagcatcagtta

SEQ ID NO: 30528 - DNA, 20 bp, Artificial Sequence
  chemically synthesized
tcaaactcagcatcagttag

SEQ ID NO: 30529 - DNA, 20 bp, Artificial Sequence
  chemically synthesized
caaactcagcatcagttaga

SEQ ID NO: 30530 - DNA, 20 bp, Artificial Sequence
  chemically synthesized
cagcatcagttagagggcat

SEQ ID NO: 30531 - DNA, 20 bp, Artificial Sequence
  chemically synthesized
agcatcagttagagggcatt

SEQ ID NO: 30532 - DNA, 20 bp, Artificial Sequence
  chemically synthesized
gcatcagttagagggcatta

SEQ ID NO: 30533 - DNA, 20 bp, Artificial Sequence
  chemically synthesized
cacttctcaaaccctgcatt

SEQ ID NO: 30534 - DNA, 20 bp, Artificial Sequence
  chemically synthesized
acttctcaaaccctgcattc

SEQ ID NO: 30535 - DNA, 20 bp, Artificial Sequence
  chemically synthesized
cttctcaaaccctgcattca

SEQ ID NO: 30536 - DNA, 20 bp, Artificial Sequence
  chemically synthesized
ctcaaaccctgcattcaggg

SEQ ID NO: 30537 - DNA, 20 bp, Artificial Sequence
  chemically synthesized
ttcagggaagatgtctgttg

SEQ ID NO: 30538 - DNA, 20 bp, Artificial Sequence
  chemically synthesized
tcagggaagatgtctgttgt

SEQ ID NO: 30539 - DNA, 20 bp, Artificial Sequence
  chemically synthesized
cagggaagatgtctgttgtg

SEQ ID NO: 30540 - DNA, 20 bp, Artificial Sequence
  chemically synthesized
ggaagatgtctgttgtgggg

SEQ ID NO: 30541 - DNA, 20 bp, Artificial Sequence
  chemically synthesized
atgtctgttgtggggtggtc

SEQ ID NO: 30542 - DNA, 20 bp, Artificial Sequence
  chemically synthesized
gtggggtggtctggcctact

SEQ ID NO: 30543 - DNA, 20 bp, Artificial Sequence
  chemically synthesized
tggtctggcctacttggcct

SEQ ID NO: 30544 - DNA, 20 bp, Artificial Sequence
  chemically synthesized
tggcctacttggcctgagcc

SEQ ID NO: 30545 - DNA, 20 bp, Artificial Sequence
  chemically synthesized
ggcctacttggcctgagcca

SEQ ID NO: 30546 - DNA, 20 bp, Artificial Sequence
  chemically synthesized
cttggcctgagccaaggttc

SEQ ID NO: 30547 - DNA, 20 bp, Artificial Sequence
  chemically synthesized
ttggcctgagccaaggttct

SEQ ID NO: 30548 - DNA, 20 bp, Artificial Sequence
  chemically synthesized
gcctgagccaaggttctggg

SEQ ID NO: 30549 - DNA, 20 bp, Artificial Sequence
  chemically synthesized
aggttctgggcagttctgtt

SEQ ID NO: 30550 - DNA, 20 bp, Artificial Sequence
  chemically synthesized
cagttacacatgcatgcgtt

SEQ ID NO: 30551 - DNA, 20 bp, Artificial Sequence
  chemically synthesized
catgcgttgagcattgattc

SEQ ID NO: 30552 - DNA, 20 bp, Artificial Sequence
  chemically synthesized
gttgagcattgattcaagcc

SEQ ID NO: 30553 - DNA, 20 bp, Artificial Sequence
  chemically synthesized
gcattgattcaagcctggcc

SEQ ID NO: 30554 - DNA, 20 bp, Artificial Sequence
  chemically synthesized
cattgattcaagcctggcct

SEQ ID NO: 30555 - DNA, 20 bp, Artificial Sequence
  chemically synthesized
ttcaagcctggcctgggcac

SEQ ID NO: 30556 - DNA, 20 bp, Artificial Sequence
  chemically synthesized
tcaagcctggcctgggcact

SEQ ID NO: 30557 - DNA, 20 bp, Artificial Sequence
  chemically synthesized
cctggcctgggcactaggca

SEQ ID NO: 30558 - DNA, 20 bp, Artificial Sequence
  chemically synthesized
ctgggcactaggcatggttt

SEQ ID NO: 30559 - DNA, 20 bp, Artificial Sequence
  chemically synthesized
ctaggcatggttttagatat

SEQ ID NO: 30560 - DNA, 20 bp, Artificial Sequence
  chemically synthesized
taggcatggttttagatatt

SEQ ID NO: 30561 - DNA, 20 bp, Artificial Sequence
  chemically synthesized
aggcatggttttagatatta

SEQ ID NO: 30562 - DNA, 20 bp, Artificial Sequence
  chemically synthesized
tattctgttttccttgcctt

SEQ ID NO: 30563 - DNA, 20 bp, Artificial Sequence
  chemically synthesized
ttttccttgccttaagatac

SEQ ID NO: 30564 - DNA, 20 bp, Artificial Sequence
  chemically synthesized
cttgccttaagataccagtc

SEQ ID NO: 30565 - DNA, 20 bp, Artificial Sequence
  chemically synthesized
gccttaagataccagtctag

SEQ ID NO: 30566 - DNA, 20 bp, Artificial Sequence
  chemically synthesized
ccttaagataccagtctagt

SEQ ID NO: 30567 - DNA, 20 bp, Artificial Sequence
  chemically synthesized
ttaagataccagtctagtag

SEQ ID NO: 30568 - DNA, 20 bp, Artificial Sequence
  chemically synthesized
ccagtctagtaggagccact

SEQ ID NO: 30569 - DNA, 20 bp, Artificial Sequence
  chemically synthesized
cagtctagtaggagccacta

SEQ ID NO: 30570 - DNA, 20 bp, Artificial Sequence
  chemically synthesized
agccactaaggccccttttt

SEQ ID NO: 30571 - DNA, 20 bp, Artificial Sequence
  chemically synthesized
ctaaggcccctttttgagcc

SEQ ID NO: 30572 - DNA, 20 bp, Artificial Sequence
  chemically synthesized
aacataccctgcttctaatc

SEQ ID NO: 30573 - DNA, 20 bp, Artificial Sequence
  chemically synthesized
cttctaatcaagtcatctat

SEQ ID NO: 30574 - DNA, 20 bp, Artificial Sequence
  chemically synthesized
ctaatcaagtcatctattgg

SEQ ID NO: 30575 - DNA, 20 bp, Artificial Sequence
  chemically synthesized
tcatctattggcagtgacct

SEQ ID NO: 30576 - DNA, 20 bp, Artificial Sequence
  chemically synthesized
catctattggcagtgacctt

SEQ ID NO: 30577 - DNA, 20 bp, Artificial Sequence
  chemically synthesized
cagtgaccttgggcaaatca

SEQ ID NO: 30578 - DNA, 20 bp, Artificial Sequence
  chemically synthesized
gggcaaatcatagtctctcc

SEQ ID NO: 30579 - DNA, 20 bp, Artificial Sequence
  chemically synthesized
attacttttctaattgaaac

SEQ ID NO: 30580 - DNA, 20 bp, Artificial Sequence
  chemically synthesized
aagaacctctctctataccc

SEQ ID NO: 30581 - DNA, 20 bp, Artificial Sequence
  chemically synthesized
ctataccccagatttatttt

SEQ ID NO: 30582 - DNA, 20 bp, Artificial Sequence
  chemically synthesized
tataccccagatttattttg

SEQ ID NO: 30583 - DNA, 20 bp, Artificial Sequence
  chemically synthesized
agatttattttgaggattat

SEQ ID NO: 30584 - DNA, 20 bp, Artificial Sequence
  chemically synthesized
gaggattatgagttaattca

SEQ ID NO: 30585 - DNA, 20 bp, Artificial Sequence
  chemically synthesized
taattcatagctaaaatgct

SEQ ID NO: 30586 - DNA, 20 bp, Artificial Sequence
  chemically synthesized
ctaaaatgcttagcacctaa

SEQ ID NO: 30587 - DNA, 20 bp, Artificial Sequence
  chemically synthesized
ttcaattgcgtattactaaa

SEQ ID NO: 30588 - DNA, 20 bp, Artificial Sequence
  chemically synthesized
aattgcgtattactaaaaag

SEQ ID NO: 30589 - DNA, 20 bp, Artificial Sequence
  chemically synthesized
attgcgtattactaaaaaga

SEQ ID NO: 30590 - DNA, 20 bp, Artificial Sequence
  chemically synthesized
aaaaagaaggaatgatttcc

SEQ ID NO: 30591 - DNA, 20 bp, Artificial Sequence
  chemically synthesized
aaagaaggaatgatttccta

SEQ ID NO: 30592 - DNA, 20 bp, Artificial Sequence
  chemically synthesized
aagaaggaatgatttcctag

SEQ ID NO: 30593 - DNA, 20 bp, Artificial Sequence
  chemically synthesized
gaaggaatgatttcctagag

SEQ ID NO: 30594 - DNA, 20 bp, Artificial Sequence
  chemically synthesized
aaggaatgatttcctagagg

SEQ ID NO: 30595 - DNA, 20 bp, Artificial Sequence
  chemically synthesized
cctagaggaggtgcttcttc

SEQ ID NO: 30596 - DNA, 20 bp, Artificial Sequence
  chemically synthesized
aggaggtgcttcttctggcc

SEQ ID NO: 30597 - DNA, 20 bp, Artificial Sequence
  chemically synthesized
ggaggtgcttcttctggcca

SEQ ID NO: 30598 - DNA, 20 bp, Artificial Sequence
  chemically synthesized
gaggtgcttcttctggccaa

SEQ ID NO: 30599 - DNA, 20 bp, Artificial Sequence
  chemically synthesized
cttctggccaagggctgatt

SEQ ID NO: 30600 - DNA, 20 bp, Artificial Sequence
  chemically synthesized
tctggccaagggctgattca

SEQ ID NO: 30601 - DNA, 20 bp, Artificial Sequence
  chemically synthesized
cagagccttaattaactaaa

SEQ ID NO: 30602 - DNA, 20 bp, Artificial Sequence
  chemically synthesized
cttaattaactaaatagatc

SEQ ID NO: 30603 - DNA, 20 bp, Artificial Sequence
  chemically synthesized
atagatcaagcatatctaac

SEQ ID NO: 30604 - DNA, 20 bp, Artificial Sequence
  chemically synthesized
aagcatatctaactggtcac

SEQ ID NO: 30605 - DNA, 20 bp, Artificial Sequence
  chemically synthesized
catatctaactggtcaccgg

SEQ ID NO: 30606 - DNA, 20 bp, Artificial Sequence
  chemically synthesized
atctaactggtcaccggaag

SEQ ID NO: 30607 - DNA, 20 bp, Artificial Sequence
  chemically synthesized
ggtcaccggaagtggtccat

SEQ ID NO: 30608 - DNA, 20 bp, Artificial Sequence
  chemically synthesized
gtcaccggaagtggtccatg

SEQ ID NO: 30609 - DNA, 20 bp, Artificial Sequence
  chemically synthesized
ggaagtggtccatgaggctg

SEQ ID NO: 30610 - DNA, 20 bp, Artificial Sequence
  chemically synthesized
ggtccatgaggctgcagcaa

SEQ ID NO: 30611 - DNA, 20 bp, Artificial Sequence
  chemically synthesized
gtccatgaggctgcagcaat

SEQ ID NO: 30612 - DNA, 20 bp, Artificial Sequence
  chemically synthesized
catgaggctgcagcaatggg

SEQ ID NO: 30613 - DNA, 20 bp, Artificial Sequence
  chemically synthesized
atgaggctgcagcaatggga

SEQ ID NO: 30614 - DNA, 20 bp, Artificial Sequence
  chemically synthesized
ctgcagcaatgggaaggtgt

SEQ ID NO: 30615 - DNA, 20 bp, Artificial Sequence
  chemically synthesized
gcagcaatgggaaggtgtca

SEQ ID NO: 30616 - DNA, 20 bp, Artificial Sequence
  chemically synthesized
gcaatgggaaggtgtcagag

SEQ ID NO: 30617 - DNA, 20 bp, Artificial Sequence
  chemically synthesized
caatgggaaggtgtcagagc

SEQ ID NO: 30618 - DNA, 20 bp, Artificial Sequence
  chemically synthesized
aatgggaaggtgtcagagca

SEQ ID NO: 30619 - DNA, 20 bp, Artificial Sequence
  chemically synthesized
atgggaaggtgtcagagcag

SEQ ID NO: 30620 - DNA, 20 bp, Artificial Sequence
  chemically synthesized
gaaggtgtcagagcaggggt

SEQ ID NO: 30621 - DNA, 20 bp, Artificial Sequence
  chemically synthesized
aaggtgtcagagcaggggtt

SEQ ID NO: 30622 - DNA, 20 bp, Artificial Sequence
  chemically synthesized
tcagagcaggggttgggaaa

SEQ ID NO: 30623 - DNA, 20 bp, Artificial Sequence
  chemically synthesized
caggggttgggaaaaagaca

SEQ ID NO: 30624 - DNA, 20 bp, Artificial Sequence
  chemically synthesized
ggggttgggaaaaagacata

SEQ ID NO: 30625 - DNA, 20 bp, Artificial Sequence
  chemically synthesized
ggttgggaaaaagacataga

SEQ ID NO: 30626 - DNA, 20 bp, Artificial Sequence
  chemically synthesized
gagagaaacgtgcatgtccg

SEQ ID NO: 30627 - DNA, 20 bp, Artificial Sequence
  chemically synthesized
agaaacgtgcatgtccgtag

SEQ ID NO: 30628 - DNA, 20 bp, Artificial Sequence
  chemically synthesized
aaacgtgcatgtccgtagtg

SEQ ID NO: 30629 - DNA, 20 bp, Artificial Sequence
  chemically synthesized
aacgtgcatgtccgtagtgg

SEQ ID NO: 30630 - DNA, 20 bp, Artificial Sequence
  chemically synthesized
acgtgcatgtccgtagtgga

SEQ ID NO: 30631 - DNA, 20 bp, Artificial Sequence
  chemically synthesized
cgtgcatgtccgtagtggag

SEQ ID NO: 30632 - DNA, 20 bp, Artificial Sequence
  chemically synthesized
tgcatgtccgtagtggaggg

SEQ ID NO: 30633 - DNA, 20 bp, Artificial Sequence
  chemically synthesized
ccgtagtggaggggagctct

SEQ ID NO: 30634 - DNA, 20 bp, Artificial Sequence
  chemically synthesized
cgtagtggaggggagctctt

SEQ ID NO: 30635 - DNA, 20 bp, Artificial Sequence
  chemically synthesized
gggagctcttaggatgtcta

SEQ ID NO: 30636 - DNA, 20 bp, Artificial Sequence
  chemically synthesized
taggatgtctacagatttcc

SEQ ID NO: 30637 - DNA, 20 bp, Artificial Sequence
  chemically synthesized
gacaataattgaaatgaaca

SEQ ID NO: 30638 - DNA, 20 bp, Artificial Sequence
  chemically synthesized
acaataattgaaatgaacaa

SEQ ID NO: 30639 - DNA, 20 bp, Artificial Sequence
  chemically synthesized
taattgaaatgaacaaaggc

SEQ ID NO: 30640 - DNA, 20 bp, Artificial Sequence
  chemically synthesized
aattgaaatgaacaaaggca

SEQ ID NO: 30641 - DNA, 20 bp, Artificial Sequence
  chemically synthesized
attgaaatgaacaaaggcaa

SEQ ID NO: 30642 - DNA, 20 bp, Artificial Sequence
  chemically synthesized
aaaggcaagggatgaccaat

SEQ ID NO: 30643 - DNA, 20 bp, Artificial Sequence
  chemically synthesized
aggcaagggatgaccaataa

SEQ ID NO: 30644 - DNA, 20 bp, Artificial Sequence
  chemically synthesized
atcacctttcccttgttctt

SEQ ID NO: 30645 - DNA, 20 bp, Artificial Sequence
  chemically synthesized
tttcccttgttcttcagctc

SEQ ID NO: 30646 - DNA, 20 bp, Artificial Sequence
  chemically synthesized
ttcagctccagctgtgccca

SEQ ID NO: 30647 - DNA, 20 bp, Artificial Sequence
  chemically synthesized
agctgtgcccacagacacca

SEQ ID NO: 30648 - DNA, 20 bp, Artificial Sequence
  chemically synthesized
gctgtgcccacagacaccac

SEQ ID NO: 30649 - DNA, 20 bp, Artificial Sequence
  chemically synthesized
ctgtgcccacagacaccaca

SEQ ID NO: 30650 - DNA, 20 bp, Artificial Sequence
  chemically synthesized
tgcccacagacaccacaggg

SEQ ID NO: 30651 - DNA, 20 bp, Artificial Sequence
  chemically synthesized
cacagggaagcctctgaaca

SEQ ID NO: 30652 - DNA, 20 bp, Artificial Sequence
  chemically synthesized
acagggaagcctctgaacac

SEQ ID NO: 30653 - DNA, 20 bp, Artificial Sequence
  chemically synthesized
cagggaagcctctgaacaca

SEQ ID NO: 30654 - DNA, 20 bp, Artificial Sequence
  chemically synthesized
agggaagcctctgaacacag

SEQ ID NO: 30655 - DNA, 20 bp, Artificial Sequence
  chemically synthesized
ctgaacacaggggtttgaac

SEQ ID NO: 30656 - DNA, 20 bp, Artificial Sequence
  chemically synthesized
tgaacacaggggtttgaacc

SEQ ID NO: 30657 - DNA, 20 bp, Artificial Sequence
  chemically synthesized
gaacacaggggtttgaacca

SEQ ID NO: 30658 - DNA, 20 bp, Artificial Sequence
  chemically synthesized
gtttgaaccagggcctctct

SEQ ID NO: 30659 - DNA, 20 bp, Artificial Sequence
  chemically synthesized
tttccaactctgataccctg

SEQ ID NO: 30660 - DNA, 20 bp, Artificial Sequence
  chemically synthesized
ctctgataccctgaagttct

SEQ ID NO: 30661 - DNA, 20 bp, Artificial Sequence
  chemically synthesized
tcagaaacttccataaattt

SEQ ID NO: 30662 - DNA, 20 bp, Artificial Sequence
  chemically synthesized
acttccataaattttggctg

SEQ ID NO: 30663 - DNA, 20 bp, Artificial Sequence
  chemically synthesized
tccataaattttggctgaag

SEQ ID NO: 30664 - DNA, 20 bp, Artificial Sequence
  chemically synthesized
aattttggctgaagaagcca

SEQ ID NO: 30665 - DNA, 20 bp, Artificial Sequence
  chemically synthesized
agaagccatagcaaacttgt

SEQ ID NO: 30666 - DNA, 20 bp, Artificial Sequence
  chemically synthesized
gccatagcaaacttgtcaga

SEQ ID NO: 30667 - DNA, 20 bp, Artificial Sequence
  chemically synthesized
atggtttcttacctttaact

SEQ ID NO: 30668 - DNA, 20 bp, Artificial Sequence
  chemically synthesized
ttttctctctcctctatgtg

SEQ ID NO: 30669 - DNA, 20 bp, Artificial Sequence
  chemically synthesized
tcctctatgtgtggtgactt

SEQ ID NO: 30670 - DNA, 20 bp, Artificial Sequence
  chemically synthesized
cctctatgtgtggtgacttc

SEQ ID NO: 30671 - DNA, 20 bp, Artificial Sequence
  chemically synthesized
tgtggtgacttcaggaaacc

SEQ ID NO: 30672 - DNA, 20 bp, Artificial Sequence
  chemically synthesized
gtggtgacttcaggaaaccc

SEQ ID NO: 30673 - DNA, 20 bp, Artificial Sequence
  chemically synthesized
gacttcaggaaacccaggcc

SEQ ID NO: 30674 - DNA, 20 bp, Artificial Sequence
  chemically synthesized
cttcaggaaacccaggccca

SEQ ID NO: 30675 - DNA, 20 bp, Artificial Sequence
  chemically synthesized
ttcaggaaacccaggcccag

SEQ ID NO: 30676 - DNA, 20 bp, Artificial Sequence
  chemically synthesized
acccaggcccagaggatata

SEQ ID NO: 30677 - DNA, 20 bp, Artificial Sequence
  chemically synthesized
ttctccttcaaaccactctt

SEQ ID NO: 30678 - DNA, 20 bp, Artificial Sequence
  chemically synthesized
aaaccactctttggatattc

SEQ ID NO: 30679 - DNA, 20 bp, Artificial Sequence
  chemically synthesized
actgcttcactgcgcttcac

SEQ ID NO: 30680 - DNA, 20 bp, Artificial Sequence
  chemically synthesized
cttcactgcgcttcactggt

SEQ ID NO: 30681 - DNA, 20 bp, Artificial Sequence
  chemically synthesized
ggtcagtgcgtcactcaaac

SEQ ID NO: 30682 - DNA, 20 bp, Artificial Sequence
  chemically synthesized
gcgtcactcaaactagctga

SEQ ID NO: 30683 - DNA, 20 bp, Artificial Sequence
  chemically synthesized
agaattgtctaactcataca

SEQ ID NO: 30684 - DNA, 20 bp, Artificial Sequence
  chemically synthesized
gaattgtctaactcatacac

SEQ ID NO: 30685 - DNA, 20 bp, Artificial Sequence
  chemically synthesized
aattgtctaactcatacaca

SEQ ID NO: 30686 - DNA, 20 bp, Artificial Sequence
  chemically synthesized
ctaactcatacacagggaca

SEQ ID NO: 30687 - DNA, 20 bp, Artificial Sequence
  chemically synthesized
tcatacacagggacaaagtc

SEQ ID NO: 30688 - DNA, 20 bp, Artificial Sequence
  chemically synthesized
acacagggacaaagtccagc

SEQ ID NO: 30689 - DNA, 20 bp, Artificial Sequence
  chemically synthesized
gtccagcaagcttatttaac

SEQ ID NO: 30690 - DNA, 20 bp, Artificial Sequence
  chemically synthesized
accggttacacaattgcctt

SEQ ID NO: 30691 - DNA, 20 bp, Artificial Sequence
  chemically synthesized
acaattgcctttggttttta

SEQ ID NO: 30692 - DNA, 20 bp, Artificial Sequence
  chemically synthesized
ggtttttacagtttgttcct

SEQ ID NO: 30693 - DNA, 20 bp, Artificial Sequence
  chemically synthesized
agtttgttcctaagtgtttc

SEQ ID NO: 30694 - DNA, 20 bp, Artificial Sequence
  chemically synthesized
tttgttcctaagtgtttcca

SEQ ID NO: 30695 - DNA, 20 bp, Artificial Sequence
  chemically synthesized
ttgttcctaagtgtttccag

SEQ ID NO: 30696 - DNA, 20 bp, Artificial Sequence
  chemically synthesized
cctaagtgtttccagaggct

SEQ ID NO: 30697 - DNA, 20 bp, Artificial Sequence
  chemically synthesized
ggcttggttcctcttcacct

SEQ ID NO: 30698 - DNA, 20 bp, Artificial Sequence
  chemically synthesized
gcttggttcctcttcacctg

SEQ ID NO: 30699 - DNA, 20 bp, Artificial Sequence
  chemically synthesized
tggttcctcttcacctgagg

SEQ ID NO: 30700 - DNA, 20 bp, Artificial Sequence
  chemically synthesized
gttcctcttcacctgaggta

SEQ ID NO: 30701 - DNA, 20 bp, Artificial Sequence
  chemically synthesized
gattgaccaattatttattc

SEQ ID NO: 30702 - DNA, 20 bp, Artificial Sequence
  chemically synthesized
caattatttattccagttaa

SEQ ID NO: 30703 - DNA, 20 bp, Artificial Sequence
  chemically synthesized
ttatttattccagttaaaag

SEQ ID NO: 30704 - DNA, 20 bp, Artificial Sequence
  chemically synthesized
tatttattccagttaaaagt

SEQ ID NO: 30705 - DNA, 20 bp, Artificial Sequence
  chemically synthesized
taaaagtaggcttatttcaa

SEQ ID NO: 30706 - DNA, 20 bp, Artificial Sequence
  chemically synthesized
aaaagtaggcttatttcaaa

SEQ ID NO: 30707 - DNA, 20 bp, Artificial Sequence
  chemically synthesized
agtaggcttatttcaaaagg

SEQ ID NO: 30708 - DNA, 20 bp, Artificial Sequence
  chemically synthesized
taggcttatttcaaaaggca

SEQ ID NO: 30709 - DNA, 20 bp, Artificial Sequence
  chemically synthesized
ttcaaaaggcagagaatttg

SEQ ID NO: 30710 - DNA, 20 bp, Artificial Sequence
  chemically synthesized
ggcagagaatttgaagctat

SEQ ID NO: 30711 - DNA, 20 bp, Artificial Sequence
  chemically synthesized
gcagagaatttgaagctatc

SEQ ID NO: 30712 - DNA, 20 bp, Artificial Sequence
  chemically synthesized
cagagaatttgaagctatcg

SEQ ID NO: 30713 - DNA, 20 bp, Artificial Sequence
  chemically synthesized
gaatttgaagctatcgggga

SEQ ID NO: 30714 - DNA, 20 bp, Artificial Sequence
  chemically synthesized
aatttgaagctatcggggaa

SEQ ID NO: 30715 - DNA, 20 bp, Artificial Sequence
  chemically synthesized
gctatcggggaaaggaactg

SEQ ID NO: 30716 - DNA, 20 bp, Artificial Sequence
  chemically synthesized
atcggggaaaggaactgtgg

SEQ ID NO: 30717 - DNA, 20 bp, Artificial Sequence
  chemically synthesized
gggaaaggaactgtggcaga

SEQ ID NO: 30718 - DNA, 20 bp, Artificial Sequence
  chemically synthesized
cagatagtgcctgctgtgtg

SEQ ID NO: 30719 - DNA, 20 bp, Artificial Sequence
  chemically synthesized
atagtgcctgctgtgtgtgg

SEQ ID NO: 30720 - DNA, 20 bp, Artificial Sequence
  chemically synthesized
agtgcctgctgtgtgtggtg

SEQ ID NO: 30721 - DNA, 20 bp, Artificial Sequence
  chemically synthesized
gtgcctgctgtgtgtggtgg

SEQ ID NO: 30722 - DNA, 20 bp, Artificial Sequence
  chemically synthesized
gtggtggaggattctctgct

SEQ ID NO: 30723 - DNA, 20 bp, Artificial Sequence
  chemically synthesized
ttctctgctcagtcctgact

SEQ ID NO: 30724 - DNA, 20 bp, Artificial Sequence
  chemically synthesized
tctctgctcagtcctgactc

SEQ ID NO: 30725 - DNA, 20 bp, Artificial Sequence
  chemically synthesized
tgctcagtcctgactcaggc

SEQ ID NO: 30726 - DNA, 20 bp, Artificial Sequence
  chemically synthesized
gctcagtcctgactcaggct

SEQ ID NO: 30727 - DNA, 20 bp, Artificial Sequence
  chemically synthesized
cagtcctgactcaggctagg

SEQ ID NO: 30728 - DNA, 20 bp, Artificial Sequence
  chemically synthesized
agtcctgactcaggctagga

SEQ ID NO: 30729 - DNA, 20 bp, Artificial Sequence
  chemically synthesized
tgactcaggctaggaaggaa

SEQ ID NO: 30730 - DNA, 20 bp, Artificial Sequence
  chemically synthesized
gactcaggctaggaaggaac

SEQ ID NO: 30731 - DNA, 20 bp, Artificial Sequence
  chemically synthesized
actcaggctaggaaggaaca

SEQ ID NO: 30732 - DNA, 20 bp, Artificial Sequence
  chemically synthesized
caggctaggaaggaacaggg

SEQ ID NO: 30733 - DNA, 20 bp, Artificial Sequence
  chemically synthesized
ggaaggaacagggcagtgct

SEQ ID NO: 30734 - DNA, 20 bp, Artificial Sequence
  chemically synthesized
cagggcagtgctgagtctcc

SEQ ID NO: 30735 - DNA, 20 bp, Artificial Sequence
  chemically synthesized
gggcagtgctgagtctcctg

SEQ ID NO: 30736 - DNA, 20 bp, Artificial Sequence
  chemically synthesized
agcactgccctgttccttcc

SEQ ID NO: 30737 - DNA, 20 bp, Artificial Sequence
  chemically synthesized
gccctgttccttcctagcct

SEQ ID NO: 30738 - DNA, 20 bp, Artificial Sequence
  chemically synthesized
tgttccttcctagcctgagt

SEQ ID NO: 30739 - DNA, 20 bp, Artificial Sequence
  chemically synthesized
gttccttcctagcctgagtc

SEQ ID NO: 30740 - DNA, 20 bp, Artificial Sequence
  chemically synthesized
tcctagcctgagtcaggact

SEQ ID NO: 30741 - DNA, 20 bp, Artificial Sequence
  chemically synthesized
tagcctgagtcaggactgag

SEQ ID NO: 30742 - DNA, 20 bp, Artificial Sequence
  chemically synthesized
gcctgagtcaggactgagca

SEQ ID NO: 30743 - DNA, 20 bp, Artificial Sequence
  chemically synthesized
agagaatcctccaccacaca

SEQ ID NO: 30744 - DNA, 20 bp, Artificial Sequence
  chemically synthesized
gaatcctccaccacacacag

SEQ ID NO: 30745 - DNA, 20 bp, Artificial Sequence
  chemically synthesized
aatcctccaccacacacagc

SEQ ID NO: 30746 - DNA, 20 bp, Artificial Sequence
  chemically synthesized
acagcaggcactatctgcca

SEQ ID NO: 30747 - DNA, 20 bp, Artificial Sequence
  chemically synthesized
gccacagttcctttccccga

SEQ ID NO: 30748 - DNA, 20 bp, Artificial Sequence
  chemically synthesized
aattctctgccttttgaaat

SEQ ID NO: 30749 - DNA, 20 bp, Artificial Sequence
  chemically synthesized
gaaataagcctacttttaac

SEQ ID NO: 30750 - DNA, 20 bp, Artificial Sequence
  chemically synthesized
ttttaactggaataaataat

SEQ ID NO: 30751 - DNA, 20 bp, Artificial Sequence
  chemically synthesized
taattggtcaatctctacct

SEQ ID NO: 30752 - DNA, 20 bp, Artificial Sequence
  chemically synthesized
aattggtcaatctctacctc

SEQ ID NO: 30753 - DNA, 20 bp, Artificial Sequence
  chemically synthesized
gtcaatctctacctcaggtg

SEQ ID NO: 30754 - DNA, 20 bp, Artificial Sequence
  chemically synthesized
caatctctacctcaggtgaa

SEQ ID NO: 30755 - DNA, 20 bp, Artificial Sequence
  chemically synthesized
aatctctacctcaggtgaag

SEQ ID NO: 30756 - DNA, 20 bp, Artificial Sequence
  chemically synthesized
acctcaggtgaagaggaacc

SEQ ID NO: 30757 - DNA, 20 bp, Artificial Sequence
  chemically synthesized
gtgaagaggaaccaagcctc

SEQ ID NO: 30758 - DNA, 20 bp, Artificial Sequence
  chemically synthesized
accaagcctctggaaacact

SEQ ID NO: 30759 - DNA, 20 bp, Artificial Sequence
  chemically synthesized
ccaagcctctggaaacactt

SEQ ID NO: 30760 - DNA, 20 bp, Artificial Sequence
  chemically synthesized
ggaacaaactgtaaaaacca

SEQ ID NO: 30761 - DNA, 20 bp, Artificial Sequence
  chemically synthesized
gaacaaactgtaaaaaccaa

SEQ ID NO: 30762 - DNA, 20 bp, Artificial Sequence
  chemically synthesized
accaaaggcaattgtgtaac

SEQ ID NO: 30763 - DNA, 20 bp, Artificial Sequence
  chemically synthesized
aattgtgtaaccggttaaat

SEQ ID NO: 30764 - DNA, 20 bp, Artificial Sequence
  chemically synthesized
aaccggttaaataagcttgc

SEQ ID NO: 30765 - DNA, 20 bp, Artificial Sequence
  chemically synthesized
tggactttgtccctgtgtat

SEQ ID NO: 30766 - DNA, 20 bp, Artificial Sequence
  chemically synthesized
ctttgtccctgtgtatgagt

SEQ ID NO: 30767 - DNA, 20 bp, Artificial Sequence
  chemically synthesized
tatgagttagacaattcttt

SEQ ID NO: 30768 - DNA, 20 bp, Artificial Sequence
  chemically synthesized
agttagacaattctttcagc

SEQ ID NO: 30769 - DNA, 20 bp, Artificial Sequence
  chemically synthesized
acaattctttcagctagttt

SEQ ID NO: 30770 - DNA, 20 bp, Artificial Sequence
  chemically synthesized
agtttgagtgacgcactgac

SEQ ID NO: 30771 - DNA, 20 bp, Artificial Sequence
  chemically synthesized
gagtgacgcactgaccagtg

SEQ ID NO: 30772 - DNA, 20 bp, Artificial Sequence
  chemically synthesized
acgcactgaccagtgaagcg

SEQ ID NO: 30773 - DNA, 20 bp, Artificial Sequence
  chemically synthesized
ctgaccagtgaagcgcagtg

SEQ ID NO: 30774 - DNA, 20 bp, Artificial Sequence
  chemically synthesized
accagtgaagcgcagtgaag

SEQ ID NO: 30775 - DNA, 20 bp, Artificial Sequence
  chemically synthesized
agtgaagcgcagtgaagcag

SEQ ID NO: 30776 - DNA, 20 bp, Artificial Sequence
  chemically synthesized
gtgaagcgcagtgaagcagt

SEQ ID NO: 30777 - DNA, 20 bp, Artificial Sequence
  chemically synthesized
cgcagtgaagcagtgggaac

SEQ ID NO: 30778 - DNA, 20 bp, Artificial Sequence
  chemically synthesized
agtgggaaccggaatatcca

SEQ ID NO: 30779 - DNA, 20 bp, Artificial Sequence
  chemically synthesized
tgggaaccggaatatccaaa

SEQ ID NO: 30780 - DNA, 20 bp, Artificial Sequence
  chemically synthesized
gaaccggaatatccaaagag

SEQ ID NO: 30781 - DNA, 20 bp, Artificial Sequence
  chemically synthesized
aatatccaaagagtggtttg

SEQ ID NO: 30782 - DNA, 20 bp, Artificial Sequence
  chemically synthesized
atatccaaagagtggtttga

SEQ ID NO: 30783 - DNA, 20 bp, Artificial Sequence
  chemically synthesized
atccaaagagtggtttgaag

SEQ ID NO: 30784 - DNA, 20 bp, Artificial Sequence
  chemically synthesized
aaagagtggtttgaaggaga

SEQ ID NO: 30785 - DNA, 20 bp, Artificial Sequence
  chemically synthesized
gagtggtttgaaggagaaag

SEQ ID NO: 30786 - DNA, 20 bp, Artificial Sequence
  chemically synthesized
tgaaggagaaagaagcattg

SEQ ID NO: 30787 - DNA, 20 bp, Artificial Sequence
  chemically synthesized
cattgtggctttatatcctc

SEQ ID NO: 30788 - DNA, 20 bp, Artificial Sequence
  chemically synthesized
attgtggctttatatcctct

SEQ ID NO: 30789 - DNA, 20 bp, Artificial Sequence
  chemically synthesized
ggctttatatcctctgggcc

SEQ ID NO: 30790 - DNA, 20 bp, Artificial Sequence
  chemically synthesized
gctttatatcctctgggcct

SEQ ID NO: 30791 - DNA, 20 bp, Artificial Sequence
  chemically synthesized
ctctgggcctgggtttcctg

SEQ ID NO: 30792 - DNA, 20 bp, Artificial Sequence
  chemically synthesized
tttcctgaagtcaccacaca

SEQ ID NO: 30793 - DNA, 20 bp, Artificial Sequence
  chemically synthesized
tcctgaagtcaccacacata

SEQ ID NO: 30794 - DNA, 20 bp, Artificial Sequence
  chemically synthesized
cctgaagtcaccacacatag

SEQ ID NO: 30795 - DNA, 20 bp, Artificial Sequence
  chemically synthesized
tgaagtcaccacacatagag

SEQ ID NO: 30796 - DNA, 20 bp, Artificial Sequence
  chemically synthesized
aagtcaccacacatagagga

SEQ ID NO: 30797 - DNA, 20 bp, Artificial Sequence
  chemically synthesized
gtcaccacacatagaggaga

SEQ ID NO: 30798 - DNA, 20 bp, Artificial Sequence
  chemically synthesized
cacatagaggagagagaaaa

SEQ ID NO: 30799 - DNA, 20 bp, Artificial Sequence
  chemically synthesized
agaggagagagaaaatggct

SEQ ID NO: 30800 - DNA, 20 bp, Artificial Sequence
  chemically synthesized
gagagaaaatggctgagtta

SEQ ID NO: 30801 - DNA, 20 bp, Artificial Sequence
  chemically synthesized
agagaaaatggctgagttaa

SEQ ID NO: 30802 - DNA, 20 bp, Artificial Sequence
  chemically synthesized
aaaatggctgagttaaaggt

SEQ ID NO: 30803 - DNA, 20 bp, Artificial Sequence
  chemically synthesized
aaggtaagaaaccatctgac

SEQ ID NO: 30804 - DNA, 20 bp, Artificial Sequence
  chemically synthesized
accatctgacaagtttgcta

SEQ ID NO: 30805 - DNA, 20 bp, Artificial Sequence
  chemically synthesized
caagtttgctatggcttctt

SEQ ID NO: 30806 - DNA, 20 bp, Artificial Sequence
  chemically synthesized
gcttcttcagccaaaattta

SEQ ID NO: 30807 - DNA, 20 bp, Artificial Sequence
  chemically synthesized
tcttcagccaaaatttatgg

SEQ ID NO: 30808 - DNA, 20 bp, Artificial Sequence
  chemically synthesized
caaaatttatggaagtttct

SEQ ID NO: 30809 - DNA, 20 bp, Artificial Sequence
  chemically synthesized
atggaagtttctgagaactt

SEQ ID NO: 30810 - DNA, 20 bp, Artificial Sequence
  chemically synthesized
tggaagtttctgagaacttc

SEQ ID NO: 30811 - DNA, 20 bp, Artificial Sequence
  chemically synthesized
ggaagtttctgagaacttca

SEQ ID NO: 30812 - DNA, 20 bp, Artificial Sequence
  chemically synthesized
ttctgagaacttcagggtat

SEQ ID NO: 30813 - DNA, 20 bp, Artificial Sequence
  chemically synthesized
ctgagaacttcagggtatca

SEQ ID NO: 30814 - DNA, 20 bp, Artificial Sequence
  chemically synthesized
gaacttcagggtatcagagt

SEQ ID NO: 30815 - DNA, 20 bp, Artificial Sequence
  chemically synthesized
tcagggtatcagagttggaa

SEQ ID NO: 30816 - DNA, 20 bp, Artificial Sequence
  chemically synthesized
tatcagagttggaaaagact

SEQ ID NO: 30817 - DNA, 20 bp, Artificial Sequence
  chemically synthesized
tcagagttggaaaagactta

SEQ ID NO: 30818 - DNA, 20 bp, Artificial Sequence
  chemically synthesized
agagttggaaaagacttaga

SEQ ID NO: 30819 - DNA, 20 bp, Artificial Sequence
  chemically synthesized
gagttggaaaagacttagag

SEQ ID NO: 30820 - DNA, 20 bp, Artificial Sequence
  chemically synthesized
gaaaagacttagagaggccc

SEQ ID NO: 30821 - DNA, 20 bp, Artificial Sequence
  chemically synthesized
ctggttcaaacccctgtgtt

SEQ ID NO: 30822 - DNA, 20 bp, Artificial Sequence
  chemically synthesized
ggttcaaacccctgtgttca

SEQ ID NO: 30823 - DNA, 20 bp, Artificial Sequence
  chemically synthesized
gttcaaacccctgtgttcag

SEQ ID NO: 30824 - DNA, 20 bp, Artificial Sequence
  chemically synthesized
tgtgttcagaggcttccctg

SEQ ID NO: 30825 - DNA, 20 bp, Artificial Sequence
  chemically synthesized
aggcttccctgtggtgtctg

SEQ ID NO: 30826 - DNA, 20 bp, Artificial Sequence
  chemically synthesized
ggcttccctgtggtgtctgt

SEQ ID NO: 30827 - DNA, 20 bp, Artificial Sequence
  chemically synthesized
ccctgtggtgtctgtgggca

SEQ ID NO: 30828 - DNA, 20 bp, Artificial Sequence
  chemically synthesized
gtggtgtctgtgggcacagc

SEQ ID NO: 30829 - DNA, 20 bp, Artificial Sequence
  chemically synthesized
ggtgtctgtgggcacagctg

SEQ ID NO: 30830 - DNA, 20 bp, Artificial Sequence
  chemically synthesized
tgtgggcacagctggagctg

SEQ ID NO: 30831 - DNA, 20 bp, Artificial Sequence
  chemically synthesized
cacagctggagctgaagaac

SEQ ID NO: 30832 - DNA, 20 bp, Artificial Sequence
  chemically synthesized
acagctggagctgaagaaca

SEQ ID NO: 30833 - DNA, 20 bp, Artificial Sequence
  chemically synthesized
cagctggagctgaagaacaa

SEQ ID NO: 30834 - DNA, 20 bp, Artificial Sequence
  chemically synthesized
tggagctgaagaacaaggga

SEQ ID NO: 30835 - DNA, 20 bp, Artificial Sequence
  chemically synthesized
ggagctgaagaacaagggaa

SEQ ID NO: 30836 - DNA, 20 bp, Artificial Sequence
  chemically synthesized
agaacaagggaaaggtgata

SEQ ID NO: 30837 - DNA, 20 bp, Artificial Sequence
  chemically synthesized
gaacaagggaaaggtgataa

SEQ ID NO: 30838 - DNA, 20 bp, Artificial Sequence
  chemically synthesized
aagggaaaggtgataaagga

SEQ ID NO: 30839 - DNA, 20 bp, Artificial Sequence
  chemically synthesized
ggtgataaaggaaagaaatg

SEQ ID NO: 30840 - DNA, 20 bp, Artificial Sequence
  chemically synthesized
gaaagaaatgaagctcttat

SEQ ID NO: 30841 - DNA, 20 bp, Artificial Sequence
  chemically synthesized
gttcatttcaattattgtct

SEQ ID NO: 30842 - DNA, 20 bp, Artificial Sequence
  chemically synthesized
attattgtcttggaaatctg

SEQ ID NO: 30843 - DNA, 20 bp, Artificial Sequence
  chemically synthesized
tggaaatctgtagacatcct

SEQ ID NO: 30844 - DNA, 20 bp, Artificial Sequence
  chemically synthesized
gaaatctgtagacatcctaa

SEQ ID NO: 30845 - DNA, 20 bp, Artificial Sequence
  chemically synthesized
ctaagagctcccctccacta

SEQ ID NO: 30846 - DNA, 20 bp, Artificial Sequence
  chemically synthesized
ctgacaccttcccattgctg

SEQ ID NO: 30847 - DNA, 20 bp, Artificial Sequence
  chemically synthesized
ttcccattgctgcagcctca

SEQ ID NO: 30848 - DNA, 20 bp, Artificial Sequence
  chemically synthesized
gcagcctcatggaccacttc

SEQ ID NO: 30849 - DNA, 20 bp, Artificial Sequence
  chemically synthesized
catggaccacttccggtgac

SEQ ID NO: 30850 - DNA, 20 bp, Artificial Sequence
  chemically synthesized
gaccacttccggtgaccagt

SEQ ID NO: 30851 - DNA, 20 bp, Artificial Sequence
  chemically synthesized
ttagatatgcttgatctatt

SEQ ID NO: 30852 - DNA, 20 bp, Artificial Sequence
  chemically synthesized
cttgatctatttagttaatt

SEQ ID NO: 30853 - DNA, 20 bp, Artificial Sequence
  chemically synthesized
ttgatctatttagttaatta

SEQ ID NO: 30854 - DNA, 20 bp, Artificial Sequence
  chemically synthesized
agttaattaaggctctgaat

SEQ ID NO: 30855 - DNA, 20 bp, Artificial Sequence
  chemically synthesized
taaggctctgaatcagccct

SEQ ID NO: 30856 - DNA, 20 bp, Artificial Sequence
  chemically synthesized
gctctgaatcagcccttggc

SEQ ID NO: 30857 - DNA, 20 bp, Artificial Sequence
  chemically synthesized
ctgaatcagcccttggccag

SEQ ID NO: 30858 - DNA, 20 bp, Artificial Sequence
  chemically synthesized
aatcagcccttggccagaag

SEQ ID NO: 30859 - DNA, 20 bp, Artificial Sequence
  chemically synthesized
gccagaagaagcacctcctc

SEQ ID NO: 30860 - DNA, 20 bp, Artificial Sequence
  chemically synthesized
ccagaagaagcacctcctct

SEQ ID NO: 30861 - DNA, 20 bp, Artificial Sequence
  chemically synthesized
aggaaatcattccttctttt

SEQ ID NO: 30862 - DNA, 20 bp, Artificial Sequence
  chemically synthesized
tttagtaatacgcaattgaa

SEQ ID NO: 30863 - DNA, 20 bp, Artificial Sequence
  chemically synthesized
acgcaattgaaaagtatgtg

SEQ ID NO: 30864 - DNA, 20 bp, Artificial Sequence
  chemically synthesized
cgcaattgaaaagtatgtgt

SEQ ID NO: 30865 - DNA, 20 bp, Artificial Sequence
  chemically synthesized
atgtgtgggttatgtgctgt

SEQ ID NO: 30866 - DNA, 20 bp, Artificial Sequence
  chemically synthesized
tgtgtgggttatgtgctgtt

SEQ ID NO: 30867 - DNA, 20 bp, Artificial Sequence
  chemically synthesized
gttatgtgctgttaggtgct

SEQ ID NO: 30868 - DNA, 20 bp, Artificial Sequence
  chemically synthesized
ctgttaggtgctaagcattt

SEQ ID NO: 30869 - DNA, 20 bp, Artificial Sequence
  chemically synthesized
cataatcctcaaaataaatc

SEQ ID NO: 30870 - DNA, 20 bp, Artificial Sequence
  chemically synthesized
ataatcctcaaaataaatct

SEQ ID NO: 30871 - DNA, 20 bp, Artificial Sequence
  chemically synthesized
taatcctcaaaataaatctg

SEQ ID NO: 30872 - DNA, 20 bp, Artificial Sequence
  chemically synthesized
ctcaaaataaatctggggta

SEQ ID NO: 30873 - DNA, 20 bp, Artificial Sequence
  chemically synthesized
caaaataaatctggggtata

SEQ ID NO: 30874 - DNA, 20 bp, Artificial Sequence
  chemically synthesized
aaataaatctggggtataga

SEQ ID NO: 30875 - DNA, 20 bp, Artificial Sequence
  chemically synthesized
ataaatctggggtatagaga

SEQ ID NO: 30876 - DNA, 20 bp, Artificial Sequence
  chemically synthesized
taaatctggggtatagagag

SEQ ID NO: 30877 - DNA, 20 bp, Artificial Sequence
  chemically synthesized
agagaggttcttgtttcaat

SEQ ID NO: 30878 - DNA, 20 bp, Artificial Sequence
  chemically synthesized
ggttcttgtttcaattagaa

SEQ ID NO: 30879 - DNA, 20 bp, Artificial Sequence
  chemically synthesized
tcaattagaaaagtaatgct

SEQ ID NO: 30880 - DNA, 20 bp, Artificial Sequence
  chemically synthesized
aattagaaaagtaatgcttg

SEQ ID NO: 30881 - DNA, 20 bp, Artificial Sequence
  chemically synthesized
ttagaaaagtaatgcttgga

SEQ ID NO: 30882 - DNA, 20 bp, Artificial Sequence
  chemically synthesized
ggagagactatgatttgccc

SEQ ID NO: 30883 - DNA, 20 bp, Artificial Sequence
  chemically synthesized
gagagactatgatttgccca

SEQ ID NO: 30884 - DNA, 20 bp, Artificial Sequence
  chemically synthesized
ttgcccaaggtcactgccaa

SEQ ID NO: 30885 - DNA, 20 bp, Artificial Sequence
  chemically synthesized
ctgccaatagatgacttgat

SEQ ID NO: 30886 - DNA, 20 bp, Artificial Sequence
  chemically synthesized
ccaatagatgacttgattag

SEQ ID NO: 30887 - DNA, 20 bp, Artificial Sequence
  chemically synthesized
atagatgacttgattagaag

SEQ ID NO: 30888 - DNA, 20 bp, Artificial Sequence
  chemically synthesized
tagatgacttgattagaagc

SEQ ID NO: 30889 - DNA, 20 bp, Artificial Sequence
  chemically synthesized
agatgacttgattagaagca

SEQ ID NO: 30890 - DNA, 20 bp, Artificial Sequence
  chemically synthesized
gcagggtatgtttgaatgcg

SEQ ID NO: 30891 - DNA, 20 bp, Artificial Sequence
  chemically synthesized
gtatgtttgaatgcgaagtc

SEQ ID NO: 30892 - DNA, 20 bp, Artificial Sequence
  chemically synthesized
tatgtttgaatgcgaagtcc

SEQ ID NO: 30893 - DNA, 20 bp, Artificial Sequence
  chemically synthesized
atgcgaagtccaggctcaaa

SEQ ID NO: 30894 - DNA, 20 bp, Artificial Sequence
  chemically synthesized
tgcgaagtccaggctcaaaa

SEQ ID NO: 30895 - DNA, 20 bp, Artificial Sequence
  chemically synthesized
gcgaagtccaggctcaaaaa

SEQ ID NO: 30896 - DNA, 20 bp, Artificial Sequence
  chemically synthesized
cgaagtccaggctcaaaaag

SEQ ID NO: 30897 - DNA, 20 bp, Artificial Sequence
  chemically synthesized
ccaggctcaaaaaggggcct

SEQ ID NO: 30898 - DNA, 20 bp, Artificial Sequence
  chemically synthesized
ggctcaaaaaggggccttag

SEQ ID NO: 30899 - DNA, 20 bp, Artificial Sequence
  chemically synthesized
ggggccttagtggctcctac

SEQ ID NO: 30900 - DNA, 20 bp, Artificial Sequence
  chemically synthesized
cttagtggctcctactagac

SEQ ID NO: 30901 - DNA, 20 bp, Artificial Sequence
  chemically synthesized
tcctactagactggtatctt

SEQ ID NO: 30902 - DNA, 20 bp, Artificial Sequence
  chemically synthesized
cctactagactggtatctta

SEQ ID NO: 30903 - DNA, 20 bp, Artificial Sequence
  chemically synthesized
ctagactggtatcttaaggc

SEQ ID NO: 30904 - DNA, 20 bp, Artificial Sequence
  chemically synthesized
tagactggtatcttaaggca

SEQ ID NO: 30905 - DNA, 20 bp, Artificial Sequence
  chemically synthesized
gtatcttaaggcaaggaaaa

SEQ ID NO: 30906 - DNA, 20 bp, Artificial Sequence
  chemically synthesized
ctaatatctaaaaccatgcc

SEQ ID NO: 30907 - DNA, 20 bp, Artificial Sequence
  chemically synthesized
ctaaaaccatgcctagtgcc

SEQ ID NO: 30908 - DNA, 20 bp, Artificial Sequence
  chemically synthesized
taaaaccatgcctagtgccc

SEQ ID NO: 30909 - DNA, 20 bp, Artificial Sequence
  chemically synthesized
accatgcctagtgcccaggc

SEQ ID NO: 30910 - DNA, 20 bp, Artificial Sequence
  chemically synthesized
ccatgcctagtgcccaggcc

SEQ ID NO: 30911 - DNA, 20 bp, Artificial Sequence
  chemically synthesized
cgcatgcatgtgtaactgaa

SEQ ID NO: 30912 - DNA, 20 bp, Artificial Sequence
  chemically synthesized
tgtaactgaacagaactgcc

SEQ ID NO: 30913 - DNA, 20 bp, Artificial Sequence
  chemically synthesized
aacagaactgcccagaacct

SEQ ID NO: 30914 - DNA, 20 bp, Artificial Sequence
  chemically synthesized
aactgcccagaaccttggct

SEQ ID NO: 30915 - DNA, 20 bp, Artificial Sequence
  chemically synthesized
actgcccagaaccttggctc

SEQ ID NO: 30916 - DNA, 20 bp, Artificial Sequence
  chemically synthesized
ccagaaccttggctcaggcc

SEQ ID NO: 30917 - DNA, 20 bp, Artificial Sequence
  chemically synthesized
gaaccttggctcaggccaag

SEQ ID NO: 30918 - DNA, 20 bp, Artificial Sequence
  chemically synthesized
aaccttggctcaggccaagt

SEQ ID NO: 30919 - DNA, 20 bp, Artificial Sequence
  chemically synthesized
ttggctcaggccaagtaggc

SEQ ID NO: 30920 - DNA, 20 bp, Artificial Sequence
  chemically synthesized
taggccagaccaccccacaa

SEQ ID NO: 30921 - DNA, 20 bp, Artificial Sequence
  chemically synthesized
acagacatcttccctgaatg

SEQ ID NO: 30922 - DNA, 20 bp, Artificial Sequence
  chemically synthesized
cagacatcttccctgaatgc

SEQ ID NO: 30923 - DNA, 20 bp, Artificial Sequence
  chemically synthesized
agacatcttccctgaatgca

SEQ ID NO: 30924 - DNA, 20 bp, Artificial Sequence
  chemically synthesized
cttccctgaatgcagggttt

SEQ ID NO: 30925 - DNA, 20 bp, Artificial Sequence
  chemically synthesized
ccctgaatgcagggtttgag

SEQ ID NO: 30926 - DNA, 20 bp, Artificial Sequence
  chemically synthesized
aatgccctctaactgatgct

SEQ ID NO: 30927 - DNA, 20 bp, Artificial Sequence
  chemically synthesized
tctaactgatgctgagtttg

SEQ ID NO: 30928 - DNA, 20 bp, Artificial Sequence
  chemically synthesized
gctgagtttgaagaatccat

SEQ ID NO: 30929 - DNA, 20 bp, Artificial Sequence
  chemically synthesized
gtttgaagaatccatcagtt

SEQ ID NO: 30930 - DNA, 20 bp, Artificial Sequence
  chemically synthesized
tttgaagaatccatcagtta

SEQ ID NO: 30931 - DNA, 20 bp, Artificial Sequence
  chemically synthesized
ttgaagaatccatcagttaa

SEQ ID NO: 30932 - DNA, 20 bp, Artificial Sequence
  chemically synthesized
tgaagaatccatcagttaag

SEQ ID NO: 30933 - DNA, 20 bp, Artificial Sequence
  chemically synthesized
aagaatccatcagttaaggg

SEQ ID NO: 30934 - DNA, 20 bp, Artificial Sequence
  chemically synthesized
agaatccatcagttaagggg

SEQ ID NO: 30935 - DNA, 20 bp, Artificial Sequence
  chemically synthesized
agttaaggggaggtgtttct

SEQ ID NO: 30936 - DNA, 20 bp, Artificial Sequence
  chemically synthesized
gggaggtgtttctgagtttg

SEQ ID NO: 30937 - DNA, 20 bp, Artificial Sequence
  chemically synthesized
gaatcaaacaccttcctaat

SEQ ID NO: 30938 - DNA, 20 bp, Artificial Sequence
  chemically synthesized
tcaaacaccttcctaattgg

SEQ ID NO: 30939 - DNA, 20 bp, Artificial Sequence
  chemically synthesized
caaacaccttcctaattggt

SEQ ID NO: 30940 - DNA, 20 bp, Artificial Sequence
  chemically synthesized
atcctgaaaacactccacac

SEQ ID NO: 30941 - DNA, 20 bp, Artificial Sequence
  chemically synthesized
cctgaaaacactccacaccg

SEQ ID NO: 30942 - DNA, 20 bp, Artificial Sequence
  chemically synthesized
aacactccacaccggagtaa

SEQ ID NO: 30943 - DNA, 20 bp, Artificial Sequence
  chemically synthesized
cacaccggagtaaaagactt

SEQ ID NO: 30944 - DNA, 20 bp, Artificial Sequence
  chemically synthesized
ttatctttatgcctgactaa

SEQ ID NO: 30945 - DNA, 20 bp, Artificial Sequence
  chemically synthesized
ttaactctcattctttcatt

SEQ ID NO: 30946 - DNA, 20 bp, Artificial Sequence
  chemically synthesized
attcagcaaatattttgtgc

SEQ ID NO: 30947 - DNA, 20 bp, Artificial Sequence
  chemically synthesized
tgtgctagtgcatgacactg

SEQ ID NO: 30948 - DNA, 20 bp, Artificial Sequence
  chemically synthesized
gacactgcagattaatatcg

SEQ ID NO: 30949 - DNA, 20 bp, Artificial Sequence
  chemically synthesized
attaatatcgtagatgaact

SEQ ID NO: 30950 - DNA, 20 bp, Artificial Sequence
  chemically synthesized
tatcgtagatgaactgagtc

SEQ ID NO: 30951 - DNA, 20 bp, Artificial Sequence
  chemically synthesized
atcgtagatgaactgagtct

SEQ ID NO: 30952 - DNA, 20 bp, Artificial Sequence
  chemically synthesized
tagatgaactgagtctgggc

SEQ ID NO: 30953 - DNA, 20 bp, Artificial Sequence
  chemically synthesized
agatgaactgagtctgggct

SEQ ID NO: 30954 - DNA, 20 bp, Artificial Sequence
  chemically synthesized
tgaactgagtctgggctagg

SEQ ID NO: 30955 - DNA, 20 bp, Artificial Sequence
  chemically synthesized
aactgagtctgggctaggta

SEQ ID NO: 30956 - DNA, 20 bp, Artificial Sequence
  chemically synthesized
agtcaaaaaaaaatttccta

SEQ ID NO: 30957 - DNA, 20 bp, Artificial Sequence
  chemically synthesized
gtcaaaaaaaaatttcctaa

SEQ ID NO: 30958 - DNA, 20 bp, Artificial Sequence
  chemically synthesized
caaaaaaaaatttcctaaag

SEQ ID NO: 30959 - DNA, 20 bp, Artificial Sequence
  chemically synthesized
aaggagcctgtacctaaact

SEQ ID NO: 30960 - DNA, 20 bp, Artificial Sequence
  chemically synthesized
ctgtacctaaactgagtctt

SEQ ID NO: 30961 - DNA, 20 bp, Artificial Sequence
  chemically synthesized
gtacctaaactgagtcttca

SEQ ID NO: 30962 - DNA, 20 bp, Artificial Sequence
  chemically synthesized
acctaaactgagtcttcaga

SEQ ID NO: 30963 - DNA, 20 bp, Artificial Sequence
  chemically synthesized
taaactgagtcttcagagag

SEQ ID NO: 30964 - DNA, 20 bp, Artificial Sequence
  chemically synthesized
ctgagtcttcagagagaagt

SEQ ID NO: 30965 - DNA, 20 bp, Artificial Sequence
  chemically synthesized
cttcagagagaagttggaac

SEQ ID NO: 30966 - DNA, 20 bp, Artificial Sequence
  chemically synthesized
gagagaagttggaactggca

SEQ ID NO: 30967 - DNA, 20 bp, Artificial Sequence
  chemically synthesized
gaagttggaactggcaaagt

SEQ ID NO: 30968 - DNA, 20 bp, Artificial Sequence
  chemically synthesized
aagttggaactggcaaagtg

SEQ ID NO: 30969 - DNA, 20 bp, Artificial Sequence
  chemically synthesized
ttggaactggcaaagtgagg

SEQ ID NO: 30970 - DNA, 20 bp, Artificial Sequence
  chemically synthesized
tggaactggcaaagtgagga

SEQ ID NO: 30971 - DNA, 20 bp, Artificial Sequence
  chemically synthesized
actggcaaagtgaggaagga

SEQ ID NO: 30972 - DNA, 20 bp, Artificial Sequence
  chemically synthesized
ctggcaaagtgaggaaggac

SEQ ID NO: 30973 - DNA, 20 bp, Artificial Sequence
  chemically synthesized
tggcaaagtgaggaaggacg

SEQ ID NO: 30974 - DNA, 20 bp, Artificial Sequence
  chemically synthesized
aagtgaggaaggacggggtc

SEQ ID NO: 30975 - DNA, 20 bp, Artificial Sequence
  chemically synthesized
gtgaggaaggacggggtctg

SEQ ID NO: 30976 - DNA, 20 bp, Artificial Sequence
  chemically synthesized
tgaggaaggacggggtctgg

SEQ ID NO: 30977 - DNA, 20 bp, Artificial Sequence
  chemically synthesized
gaggaaggacggggtctgga

SEQ ID NO: 30978 - DNA, 20 bp, Artificial Sequence
  chemically synthesized
gaaggacggggtctggaggg

SEQ ID NO: 30979 - DNA, 20 bp, Artificial Sequence
  chemically synthesized
aggacggggtctggagggaa

SEQ ID NO: 30980 - DNA, 20 bp, Artificial Sequence
  chemically synthesized
cggggtctggagggaagagt

SEQ ID NO: 30981 - DNA, 20 bp, Artificial Sequence
  chemically synthesized
tggagggaagagtgagtgca

SEQ ID NO: 30982 - DNA, 20 bp, Artificial Sequence
  chemically synthesized
ggagggaagagtgagtgcaa

SEQ ID NO: 30983 - DNA, 20 bp, Artificial Sequence
  chemically synthesized
gaagagtgagtgcaaaggca

SEQ ID NO: 30984 - DNA, 20 bp, Artificial Sequence
  chemically synthesized
gtgcaaaggcacagcacata

SEQ ID NO: 30985 - DNA, 20 bp, Artificial Sequence
  chemically synthesized
tacagaatgcctgcatgctc

SEQ ID NO: 30986 - DNA, 20 bp, Artificial Sequence
  chemically synthesized
tctagaatccaaaactgtgt

SEQ ID NO: 30987 - DNA, 20 bp, Artificial Sequence
  chemically synthesized
aaactgtgtcagccaaattt

SEQ ID NO: 30988 - DNA, 20 bp, Artificial Sequence
  chemically synthesized
gtcagccaaatttgagttga

SEQ ID NO: 30989 - DNA, 20 bp, Artificial Sequence
  chemically synthesized
cagccaaatttgagttgatg

SEQ ID NO: 30990 - DNA, 20 bp, Artificial Sequence
  chemically synthesized
agccaaatttgagttgatgg

SEQ ID NO: 30991 - DNA, 20 bp, Artificial Sequence
  chemically synthesized
gccaaatttgagttgatgga

SEQ ID NO: 30992 - DNA, 20 bp, Artificial Sequence
  chemically synthesized
aatttgagttgatggaggga

SEQ ID NO: 30993 - DNA, 20 bp, Artificial Sequence
  chemically synthesized
gatggagggacagccaaact

SEQ ID NO: 30994 - DNA, 20 bp, Artificial Sequence
  chemically synthesized
gacagccaaactgagatacc

SEQ ID NO: 30995 - DNA, 20 bp, Artificial Sequence
  chemically synthesized
acagccaaactgagataccc

SEQ ID NO: 30996 - DNA, 20 bp, Artificial Sequence
  chemically synthesized
gccaaactgagatacccagg

SEQ ID NO: 30997 - DNA, 20 bp, Artificial Sequence
  chemically synthesized
aaactgagatacccaggcgg

SEQ ID NO: 30998 - DNA, 20 bp, Artificial Sequence
  chemically synthesized
tgagatacccaggcggtggt

SEQ ID NO: 30999 - DNA, 20 bp, Artificial Sequence
  chemically synthesized
ccaggcggtggttggattta

SEQ ID NO: 31000 - DNA, 20 bp, Artificial Sequence
  chemically synthesized
ggtggttggatttatggatc

SEQ ID NO: 31001 - DNA, 20 bp, Artificial Sequence
  chemically synthesized
ggatttatggatctggattt

SEQ ID NO: 31002 - DNA, 20 bp, Artificial Sequence
  chemically synthesized
gatttatggatctggatttc

SEQ ID NO: 31003 - DNA, 20 bp, Artificial Sequence
  chemically synthesized
atttatggatctggatttca

SEQ ID NO: 31004 - DNA, 20 bp, Artificial Sequence
  chemically synthesized
tttatggatctggatttcag

SEQ ID NO: 31005 - DNA, 20 bp, Artificial Sequence
  chemically synthesized
tatggatctggatttcaggg

SEQ ID NO: 31006 - DNA, 20 bp, Artificial Sequence
  chemically synthesized
ggatctggatttcaggggag

SEQ ID NO: 31007 - DNA, 20 bp, Artificial Sequence
  chemically synthesized
gatctggatttcaggggagt

SEQ ID NO: 31008 - DNA, 20 bp, Artificial Sequence
  chemically synthesized
ctggatttcaggggagtggg

SEQ ID NO: 31009 - DNA, 20 bp, Artificial Sequence
  chemically synthesized
tggatttcaggggagtgggc

SEQ ID NO: 31010 - DNA, 20 bp, Artificial Sequence
  chemically synthesized
ggatttcaggggagtgggca

SEQ ID NO: 31011 - DNA, 20 bp, Artificial Sequence
  chemically synthesized
ttcaggggagtgggcagggc

SEQ ID NO: 31012 - DNA, 20 bp, Artificial Sequence
  chemically synthesized
tcaggggagtgggcagggct

SEQ ID NO: 31013 - DNA, 20 bp, Artificial Sequence
  chemically synthesized
caggggagtgggcagggcta

SEQ ID NO: 31014 - DNA, 20 bp, Artificial Sequence
  chemically synthesized
aggggagtgggcagggctag

SEQ ID NO: 31015 - DNA, 20 bp, Artificial Sequence
  chemically synthesized
agtgggcagggctaggggaa

SEQ ID NO: 31016 - DNA, 20 bp, Artificial Sequence
  chemically synthesized
agggctaggggaatagaact

SEQ ID NO: 31017 - DNA, 20 bp, Artificial Sequence
  chemically synthesized
gggctaggggaatagaactg

SEQ ID NO: 31018 - DNA, 20 bp, Artificial Sequence
  chemically synthesized
ggctaggggaatagaactga

SEQ ID NO: 31019 - DNA, 20 bp, Artificial Sequence
  chemically synthesized
agaactgagggtcatgatgt

SEQ ID NO: 31020 - DNA, 20 bp, Artificial Sequence
  chemically synthesized
actgagggtcatgatgtcag

SEQ ID NO: 31021 - DNA, 20 bp, Artificial Sequence
  chemically synthesized
gagggtcatgatgtcagtgg

SEQ ID NO: 31022 - DNA, 20 bp, Artificial Sequence
  chemically synthesized
agggtcatgatgtcagtggt

SEQ ID NO: 31023 - DNA, 20 bp, Artificial Sequence
  chemically synthesized
ggtcatgatgtcagtggtag

SEQ ID NO: 31024 - DNA, 20 bp, Artificial Sequence
  chemically synthesized
gatgtcagtggtaggagttg

SEQ ID NO: 31025 - DNA, 20 bp, Artificial Sequence
  chemically synthesized
agtggtaggagttgaagtct

SEQ ID NO: 31026 - DNA, 20 bp, Artificial Sequence
  chemically synthesized
ggtaggagttgaagtcttgg

SEQ ID NO: 31027 - DNA, 20 bp, Artificial Sequence
  chemically synthesized
ggagttgaagtcttggaaga

SEQ ID NO: 31028 - DNA, 20 bp, Artificial Sequence
  chemically synthesized
agttgaagtcttggaagaaa

SEQ ID NO: 31029 - DNA, 20 bp, Artificial Sequence
  chemically synthesized
tgaagtcttggaagaaagag

SEQ ID NO: 31030 - DNA, 20 bp, Artificial Sequence
  chemically synthesized
gtcttggaagaaagagtaga

SEQ ID NO: 31031 - DNA, 20 bp, Artificial Sequence
  chemically synthesized
ttttctgatgaacattctat

SEQ ID NO: 31032 - DNA, 20 bp, Artificial Sequence
  chemically synthesized
tttctgatgaacattctatg

SEQ ID NO: 31033 - DNA, 20 bp, Artificial Sequence
  chemically synthesized
ctgatgaacattctatgagg

SEQ ID NO: 31034 - DNA, 20 bp, Artificial Sequence
  chemically synthesized
gaacattctatgaggaagtt

SEQ ID NO: 31035 - DNA, 20 bp, Artificial Sequence
  chemically synthesized
cattctatgaggaagttcag

SEQ ID NO: 31036 - DNA, 20 bp, Artificial Sequence
  chemically synthesized
ttctatgaggaagttcagca

SEQ ID NO: 31037 - DNA, 20 bp, Artificial Sequence
  chemically synthesized
tctatgaggaagttcagcag

SEQ ID NO: 31038 - DNA, 20 bp, Artificial Sequence
  chemically synthesized
tgaggaagttcagcagaggt

SEQ ID NO: 31039 - DNA, 20 bp, Artificial Sequence
  chemically synthesized
cctatcctgctgtcatgttt

SEQ ID NO: 31040 - DNA, 20 bp, Artificial Sequence
  chemically synthesized
tttaagcaacttattatgca

SEQ ID NO: 31041 - DNA, 20 bp, Artificial Sequence
  chemically synthesized
caacttattatgcacagcac

SEQ ID NO: 31042 - DNA, 20 bp, Artificial Sequence
  chemically synthesized
aacttattatgcacagcacc

SEQ ID NO: 31043 - DNA, 20 bp, Artificial Sequence
  chemically synthesized
catcaatgtaaattgcatgc

SEQ ID NO: 31044 - DNA, 20 bp, Artificial Sequence
  chemically synthesized
tgcatgccagtctttgctct

SEQ ID NO: 31045 - DNA, 20 bp, Artificial Sequence
  chemically synthesized
agtctttgctctcagtttca

SEQ ID NO: 31046 - DNA, 20 bp, Artificial Sequence
  chemically synthesized
gtctttgctctcagtttcaa

SEQ ID NO: 31047 - DNA, 20 bp, Artificial Sequence
  chemically synthesized
cctgctgtctaatctttaca

SEQ ID NO: 31048 - DNA, 20 bp, Artificial Sequence
  chemically synthesized
ctgtctaatctttacaaaga

SEQ ID NO: 31049 - DNA, 20 bp, Artificial Sequence
  chemically synthesized
tgtctaatctttacaaagaa

SEQ ID NO: 31050 - DNA, 20 bp, Artificial Sequence
  chemically synthesized
ttacaaagaaaggttaactc

SEQ ID NO: 31051 - DNA, 20 bp, Artificial Sequence
  chemically synthesized
acaaagaaaggttaactcca

SEQ ID NO: 31052 - DNA, 20 bp, Artificial Sequence
  chemically synthesized
caaagaaaggttaactccag

SEQ ID NO: 31053 - DNA, 20 bp, Artificial Sequence
  chemically synthesized
gaaaggttaactccagaggt

SEQ ID NO: 31054 - DNA, 20 bp, Artificial Sequence
  chemically synthesized
aaaggttaactccagaggtc

SEQ ID NO: 31055 - DNA, 20 bp, Artificial Sequence
  chemically synthesized
agaggtcaggaatctgaaca

SEQ ID NO: 31056 - DNA, 20 bp, Artificial Sequence
  chemically synthesized
ggaatctgaacacagaaaac

SEQ ID NO: 31057 - DNA, 20 bp, Artificial Sequence
  chemically synthesized
ttaatgaatatgtcaacaca

SEQ ID NO: 31058 - DNA, 20 bp, Artificial Sequence
  chemically synthesized
atgaaatcacatttacacaa

SEQ ID NO: 31059 - DNA, 20 bp, Artificial Sequence
  chemically synthesized
catttacacaaaagtacaac

SEQ ID NO: 31060 - DNA, 20 bp, Artificial Sequence
  chemically synthesized
atttacacaaaagtacaact

SEQ ID NO: 31061 - DNA, 20 bp, Artificial Sequence
  chemically synthesized
tttacacaaaagtacaactg

SEQ ID NO: 31062 - DNA, 20 bp, Artificial Sequence
  chemically synthesized
cacaaaagtacaactggggt

SEQ ID NO: 31063 - DNA, 20 bp, Artificial Sequence
  chemically synthesized
actggggtaagaaaattcaa

SEQ ID NO: 31064 - DNA, 20 bp, Artificial Sequence
  chemically synthesized
gtaagaaaattcaaaagata

SEQ ID NO: 31065 - DNA, 20 bp, Artificial Sequence
  chemically synthesized
atgaaataccctatgtattt

SEQ ID NO: 31066 - DNA, 20 bp, Artificial Sequence
  chemically synthesized
aataccctatgtatttgagt

SEQ ID NO: 31067 - DNA, 20 bp, Artificial Sequence
  chemically synthesized
atgtatttgagtaagttgct

SEQ ID NO: 31068 - DNA, 20 bp, Artificial Sequence
  chemically synthesized
tgcttagcttctcccaacct

SEQ ID NO: 31069 - DNA, 20 bp, Artificial Sequence
  chemically synthesized
gtttcctcatttctaaaacg

SEQ ID NO: 31070 - DNA, 20 bp, Artificial Sequence
  chemically synthesized
cgaagaacttgcttaatatt

SEQ ID NO: 31071 - DNA, 20 bp, Artificial Sequence
  chemically synthesized
gaagaacttgcttaatattc

SEQ ID NO: 31072 - DNA, 20 bp, Artificial Sequence
  chemically synthesized
cttgcttaatattcaggctc

SEQ ID NO: 31073 - DNA, 20 bp, Artificial Sequence
  chemically synthesized
ttgcttaatattcaggctct

SEQ ID NO: 31074 - DNA, 20 bp, Artificial Sequence
  chemically synthesized
ccaccaaatccttgattcac

SEQ ID NO: 31075 - DNA, 20 bp, Artificial Sequence
  chemically synthesized
aatccttgattcactggctc

SEQ ID NO: 31076 - DNA, 20 bp, Artificial Sequence
  chemically synthesized
atccttgattcactggctct

SEQ ID NO: 31077 - DNA, 20 bp, Artificial Sequence
  chemically synthesized
gctctgggtctgtatgtaac

SEQ ID NO: 31078 - DNA, 20 bp, Artificial Sequence
  chemically synthesized
gtctgtatgtaacaagcttc

SEQ ID NO: 31079 - DNA, 20 bp, Artificial Sequence
  chemically synthesized
ctgtatgtaacaagcttctg

SEQ ID NO: 31080 - DNA, 20 bp, Artificial Sequence
  chemically synthesized
tctggagtgattctaatgat

SEQ ID NO: 31081 - DNA, 20 bp, Artificial Sequence
  chemically synthesized
gagtgattctaatgattagc

SEQ ID NO: 31082 - DNA, 20 bp, Artificial Sequence
  chemically synthesized
gtgattctaatgattagcca

SEQ ID NO: 31083 - DNA, 20 bp, Artificial Sequence
  chemically synthesized
ttctaatgattagccagaga

SEQ ID NO: 31084 - DNA, 20 bp, Artificial Sequence
  chemically synthesized
tctaatgattagccagagac

SEQ ID NO: 31085 - DNA, 20 bp, Artificial Sequence
  chemically synthesized
aaaaattaccacaaatttat

SEQ ID NO: 31086 - DNA, 20 bp, Artificial Sequence
  chemically synthesized
aacacaaatgtattatcttg

SEQ ID NO: 31087 - DNA, 20 bp, Artificial Sequence
  chemically synthesized
aatgtattatcttgaagttg

SEQ ID NO: 31088 - DNA, 20 bp, Artificial Sequence
  chemically synthesized
tgtattatcttgaagttgtg

SEQ ID NO: 31089 - DNA, 20 bp, Artificial Sequence
  chemically synthesized
gtattatcttgaagttgtgg

SEQ ID NO: 31090 - DNA, 20 bp, Artificial Sequence
  chemically synthesized
tatcttgaagttgtggaggt

SEQ ID NO: 31091 - DNA, 20 bp, Artificial Sequence
  chemically synthesized
cttgaagttgtggaggtcag

SEQ ID NO: 31092 - DNA, 20 bp, Artificial Sequence
  chemically synthesized
ggaggtcagaagtctgaaat

SEQ ID NO: 31093 - DNA, 20 bp, Artificial Sequence
  chemically synthesized
aagtctgaaatcggtttcac

SEQ ID NO: 31094 - DNA, 20 bp, Artificial Sequence
  chemically synthesized
agtctgaaatcggtttcact

SEQ ID NO: 31095 - DNA, 20 bp, Artificial Sequence
  chemically synthesized
aaatcggtttcactgggcta

SEQ ID NO: 31096 - DNA, 20 bp, Artificial Sequence
  chemically synthesized
ggtttcactgggctaaagtc

SEQ ID NO: 31097 - DNA, 20 bp, Artificial Sequence
  chemically synthesized
gtttcactgggctaaagtcg

SEQ ID NO: 31098 - DNA, 20 bp, Artificial Sequence
  chemically synthesized
ctgggctaaagtcgaggtgt

SEQ ID NO: 31099 - DNA, 20 bp, Artificial Sequence
  chemically synthesized
ctaaagtcgaggtgtcagtg

SEQ ID NO: 31100 - DNA, 20 bp, Artificial Sequence
  chemically synthesized
gtcagtgtggctgtttcttc

SEQ ID NO: 31101 - DNA, 20 bp, Artificial Sequence
  chemically synthesized
cagtgtggctgtttcttctg

SEQ ID NO: 31102 - DNA, 20 bp, Artificial Sequence
  chemically synthesized
gtttcttctggagactctat

SEQ ID NO: 31103 - DNA, 20 bp, Artificial Sequence
  chemically synthesized
ttcttctggagactctatga

SEQ ID NO: 31104 - DNA, 20 bp, Artificial Sequence
  chemically synthesized
gtgttttcctgccttttcca

SEQ ID NO: 31105 - DNA, 20 bp, Artificial Sequence
  chemically synthesized
atggattctgtttcctcttc

SEQ ID NO: 31106 - DNA, 20 bp, Artificial Sequence
  chemically synthesized
ggattctgtttcctcttcta

SEQ ID NO: 31107 - DNA, 20 bp, Artificial Sequence
  chemically synthesized
gattctgtttcctcttctag

SEQ ID NO: 31108 - DNA, 20 bp, Artificial Sequence
  chemically synthesized
tagaggctacccacattcct

SEQ ID NO: 31109 - DNA, 20 bp, Artificial Sequence
  chemically synthesized
tacccacattccttggtttg

SEQ ID NO: 31110 - DNA, 20 bp, Artificial Sequence
  chemically synthesized
gtcacattttctcctcttat

SEQ ID NO: 31111 - DNA, 20 bp, Artificial Sequence
  chemically synthesized
atgacacttgtgattacatt

SEQ ID NO: 31112 - DNA, 20 bp, Artificial Sequence
  chemically synthesized
tgacacttgtgattacattt

SEQ ID NO: 31113 - DNA, 20 bp, Artificial Sequence
  chemically synthesized
ttaggatacacccaaataat

SEQ ID NO: 31114 - DNA, 20 bp, Artificial Sequence
  chemically synthesized
taggatacacccaaataatt

SEQ ID NO: 31115 - DNA, 20 bp, Artificial Sequence
  chemically synthesized
ttaggatatctccccatccc

SEQ ID NO: 31116 - DNA, 20 bp, Artificial Sequence
  chemically synthesized
atccttaattatatatgcaa

SEQ ID NO: 31117 - DNA, 20 bp, Artificial Sequence
  chemically synthesized
tatatatgcaaaagtctgtt

SEQ ID NO: 31118 - DNA, 20 bp, Artificial Sequence
  chemically synthesized
tatgcaaaagtctgtttggc

SEQ ID NO: 31119 - DNA, 20 bp, Artificial Sequence
  chemically synthesized
aaaagtctgtttggctagaa

SEQ ID NO: 31120 - DNA, 20 bp, Artificial Sequence
  chemically synthesized
gctagaaaagataatactca

SEQ ID NO: 31121 - DNA, 20 bp, Artificial Sequence
  chemically synthesized
ctagaaaagataatactcac

SEQ ID NO: 31122 - DNA, 20 bp, Artificial Sequence
  chemically synthesized
aagataatactcacaggttt

SEQ ID NO: 31123 - DNA, 20 bp, Artificial Sequence
  chemically synthesized
agataatactcacaggtttc

SEQ ID NO: 31124 - DNA, 20 bp, Artificial Sequence
  chemically synthesized
gataatactcacaggtttca

SEQ ID NO: 31125 - DNA, 20 bp, Artificial Sequence
  chemically synthesized
ataatactcacaggtttcag

SEQ ID NO: 31126 - DNA, 20 bp, Artificial Sequence
  chemically synthesized
actcacaggtttcaggggtt

SEQ ID NO: 31127 - DNA, 20 bp, Artificial Sequence
  chemically synthesized
gttaagccatacatatcttt

SEQ ID NO: 31128 - DNA, 20 bp, Artificial Sequence
  chemically synthesized
taagccatacatatctttca

SEQ ID NO: 31129 - DNA, 20 bp, Artificial Sequence
  chemically synthesized
ccatacatatctttcagagt

SEQ ID NO: 31130 - DNA, 20 bp, Artificial Sequence
  chemically synthesized
tatctttcagagtgagccat

SEQ ID NO: 31131 - DNA, 20 bp, Artificial Sequence
  chemically synthesized
gtgagccattagccattatt

SEQ ID NO: 31132 - DNA, 20 bp, Artificial Sequence
  chemically synthesized
agcctactgcgataatgtgc

SEQ ID NO: 31133 - DNA, 20 bp, Artificial Sequence
  chemically synthesized
ctatgttctatgttcccatc

SEQ ID NO: 31134 - DNA, 20 bp, Artificial Sequence
  chemically synthesized
tatgttctatgttcccatca

SEQ ID NO: 31135 - DNA, 20 bp, Artificial Sequence
  chemically synthesized
atgttcccatcaaggttaat

SEQ ID NO: 31136 - DNA, 20 bp, Artificial Sequence
  chemically synthesized
tcaaggttaattagaaatat

SEQ ID NO: 31137 - DNA, 20 bp, Artificial Sequence
  chemically synthesized
aatattagactctttttcca

SEQ ID NO: 31138 - DNA, 20 bp, Artificial Sequence
  chemically synthesized
ttccacagaaaaaaaaaatg

SEQ ID NO: 31139 - DNA, 20 bp, Artificial Sequence
  chemically synthesized
cacagaaaaaaaaaatgtag

SEQ ID NO: 31140 - DNA, 20 bp, Artificial Sequence
  chemically synthesized
agaaaaaaaaaatgtagcag

SEQ ID NO: 31141 - DNA, 20 bp, Artificial Sequence
  chemically synthesized
ctctctctttccttcatgcc

SEQ ID NO: 31142 - DNA, 20 bp, Artificial Sequence
  chemically synthesized
ctctttccttcatgcccagt

SEQ ID NO: 31143 - DNA, 20 bp, Artificial Sequence
  chemically synthesized
ctttccttcatgcccagtaa

SEQ ID NO: 31144 - DNA, 20 bp, Artificial Sequence
  chemically synthesized
tttccttcatgcccagtaag

SEQ ID NO: 31145 - DNA, 20 bp, Artificial Sequence
  chemically synthesized
ccttcatgcccagtaagagg

SEQ ID NO: 31146 - DNA, 20 bp, Artificial Sequence
  chemically synthesized
catgcccagtaagaggaagt

SEQ ID NO: 31147 - DNA, 20 bp, Artificial Sequence
  chemically synthesized
atgcccagtaagaggaagtg

SEQ ID NO: 31148 - DNA, 20 bp, Artificial Sequence
  chemically synthesized
gcaccatctgttcatctcat

SEQ ID NO: 31149 - DNA, 20 bp, Artificial Sequence
  chemically synthesized
caccatctgttcatctcatc

SEQ ID NO: 31150 - DNA, 20 bp, Artificial Sequence
  chemically synthesized
tcatctcatcaggtgttacc

SEQ ID NO: 31151 - DNA, 20 bp, Artificial Sequence
  chemically synthesized
catcaggtgttacctagaat

SEQ ID NO: 31152 - DNA, 20 bp, Artificial Sequence
  chemically synthesized
tcaggtgttacctagaatca

SEQ ID NO: 31153 - DNA, 20 bp, Artificial Sequence
  chemically synthesized
gtgttacctagaatcagagt

SEQ ID NO: 31154 - DNA, 20 bp, Artificial Sequence
  chemically synthesized
tgttacctagaatcagagtc

SEQ ID NO: 31155 - DNA, 20 bp, Artificial Sequence
  chemically synthesized
ttacctagaatcagagtcag

SEQ ID NO: 31156 - DNA, 20 bp, Artificial Sequence
  chemically synthesized
ctagaatcagagtcaggaga

SEQ ID NO: 31157 - DNA, 20 bp, Artificial Sequence
  chemically synthesized
cctcataaaactactctgac

SEQ ID NO: 31158 - DNA, 20 bp, Artificial Sequence
  chemically synthesized
ctgacaagtaaaccatatcc

SEQ ID NO: 31159 - DNA, 20 bp, Artificial Sequence
  chemically synthesized
tgacaagtaaaccatatcct

SEQ ID NO: 31160 - DNA, 20 bp, Artificial Sequence
  chemically synthesized
gacaagtaaaccatatcctg

SEQ ID NO: 31161 - DNA, 20 bp, Artificial Sequence
  chemically synthesized
gtaaaccatatcctggggac

SEQ ID NO: 31162 - DNA, 20 bp, Artificial Sequence
  chemically synthesized
taaaccatatcctggggacc

SEQ ID NO: 31163 - DNA, 20 bp, Artificial Sequence
  chemically synthesized
ccatatcctggggaccaggt

SEQ ID NO: 31164 - DNA, 20 bp, Artificial Sequence
  chemically synthesized
gggaccaggtgagaattaaa

SEQ ID NO: 31165 - DNA, 20 bp, Artificial Sequence
  chemically synthesized
ttaaaaagctgtatactcat

SEQ ID NO: 31166 - DNA, 20 bp, Artificial Sequence
  chemically synthesized
tgtatactcataagctgcca

SEQ ID NO: 31167 - DNA, 20 bp, Artificial Sequence
  chemically synthesized
tatactcataagctgccaaa

SEQ ID NO: 31168 - DNA, 20 bp, Artificial Sequence
  chemically synthesized
ataagctgccaaagagctga

SEQ ID NO: 31169 - DNA, 20 bp, Artificial Sequence
  chemically synthesized
ccaaagagctgatggtactg

SEQ ID NO: 31170 - DNA, 20 bp, Artificial Sequence
  chemically synthesized
ctgatggtactgaagtcaca

SEQ ID NO: 31171 - DNA, 20 bp, Artificial Sequence
  chemically synthesized
gatggtactgaagtcacatg

SEQ ID NO: 31172 - DNA, 20 bp, Artificial Sequence
  chemically synthesized
tactgaagtcacatggagct

SEQ ID NO: 31173 - DNA, 20 bp, Artificial Sequence
  chemically synthesized
actgaagtcacatggagctc

SEQ ID NO: 31174 - DNA, 20 bp, Artificial Sequence
  chemically synthesized
caggaatttattcttgcatt

SEQ ID NO: 31175 - DNA, 20 bp, Artificial Sequence
  chemically synthesized
aatttattcttgcatttaga

SEQ ID NO: 31176 - DNA, 20 bp, Artificial Sequence
  chemically synthesized
atgcatataattctctcgaa

SEQ ID NO: 31177 - DNA, 20 bp, Artificial Sequence
  chemically synthesized
atgaaatcatatttttctgt

SEQ ID NO: 31178 - DNA, 20 bp, Artificial Sequence
  chemically synthesized
ttctgtcggatcaaattatt

SEQ ID NO: 31179 - DNA, 20 bp, Artificial Sequence
  chemically synthesized
ttattcagaaatccgaactg

SEQ ID NO: 31180 - DNA, 20 bp, Artificial Sequence
  chemically synthesized
caaacacacttgcttaatgt

SEQ ID NO: 31181 - DNA, 20 bp, Artificial Sequence
  chemically synthesized
tttaatcttatttttgtaca

SEQ ID NO: 31182 - DNA, 20 bp, Artificial Sequence
  chemically synthesized
gtacacagtatacttttaca

SEQ ID NO: 31183 - DNA, 20 bp, Artificial Sequence
  chemically synthesized
tacacagtatacttttacat

SEQ ID NO: 31184 - DNA, 20 bp, Artificial Sequence
  chemically synthesized
cttttacataggcactgaac

SEQ ID NO: 31185 - DNA, 20 bp, Artificial Sequence
  chemically synthesized
tacataggcactgaaccagc

SEQ ID NO: 31186 - DNA, 20 bp, Artificial Sequence
  chemically synthesized
accagctggaaatgaatgct

SEQ ID NO: 31187 - DNA, 20 bp, Artificial Sequence
  chemically synthesized
aatgaatgcttggattttcg

SEQ ID NO: 31188 - DNA, 20 bp, Artificial Sequence
  chemically synthesized
tggattttcgcagctgataa

SEQ ID NO: 31189 - DNA, 20 bp, Artificial Sequence
  chemically synthesized
attttcgcagctgataaaag

SEQ ID NO: 31190 - DNA, 20 bp, Artificial Sequence
  chemically synthesized
tttcgcagctgataaaagca

SEQ ID NO: 31191 - DNA, 20 bp, Artificial Sequence
  chemically synthesized
cagctgataaaagcagagtt

SEQ ID NO: 31192 - DNA, 20 bp, Artificial Sequence
  chemically synthesized
agagttcagattctgtcctt

SEQ ID NO: 31193 - DNA, 20 bp, Artificial Sequence
  chemically synthesized
ctgtccttgagctcaatgtc

SEQ ID NO: 31194 - DNA, 20 bp, Artificial Sequence
  chemically synthesized
gtccttgagctcaatgtctg

SEQ ID NO: 31195 - DNA, 20 bp, Artificial Sequence
  chemically synthesized
ttgagctcaatgtctggaga

SEQ ID NO: 31196 - DNA, 20 bp, Artificial Sequence
  chemically synthesized
agctcaatgtctggagaaag

SEQ ID NO: 31197 - DNA, 20 bp, Artificial Sequence
  chemically synthesized
tgaatactgcttccttaatt

SEQ ID NO: 31198 - DNA, 20 bp, Artificial Sequence
  chemically synthesized
ttccttaattcagatgcctt

SEQ ID NO: 31199 - DNA, 20 bp, Artificial Sequence
  chemically synthesized
attcagatgcctttggccgt

SEQ ID NO: 31200 - DNA, 20 bp, Artificial Sequence
  chemically synthesized
ttcagatgcctttggccgtg

SEQ ID NO: 31201 - DNA, 20 bp, Artificial Sequence
  chemically synthesized
tcagatgcctttggccgtga

SEQ ID NO: 31202 - DNA, 20 bp, Artificial Sequence
  chemically synthesized
cagatgcctttggccgtgag

SEQ ID NO: 31203 - DNA, 20 bp, Artificial Sequence
  chemically synthesized
gcctttggccgtgaggggca

SEQ ID NO: 31204 - DNA, 20 bp, Artificial Sequence
  chemically synthesized
gtgaggggcatggcatttta

SEQ ID NO: 31205 - DNA, 20 bp, Artificial Sequence
  chemically synthesized
aaactctgtactttttctct

SEQ ID NO: 31206 - DNA, 20 bp, Artificial Sequence
  chemically synthesized
aactctgtactttttctctc

SEQ ID NO: 31207 - DNA, 20 bp, Artificial Sequence
  chemically synthesized
actctgtactttttctctca

SEQ ID NO: 31208 - DNA, 20 bp, Artificial Sequence
  chemically synthesized
ctctgtactttttctctcag

SEQ ID NO: 31209 - DNA, 20 bp, Artificial Sequence
  chemically synthesized
tactttttctctcaggggat

SEQ ID NO: 31210 - DNA, 20 bp, Artificial Sequence
  chemically synthesized
agaaaaaccaattgatttga

SEQ ID NO: 31211 - DNA, 20 bp, Artificial Sequence
  chemically synthesized
caattgatttgatagtgact

SEQ ID NO: 31212 - DNA, 20 bp, Artificial Sequence
  chemically synthesized
ttgatttgatagtgactcag

SEQ ID NO: 31213 - DNA, 20 bp, Artificial Sequence
  chemically synthesized
gcagttttcaccttcctctt

SEQ ID NO: 31214 - DNA, 20 bp, Artificial Sequence
  chemically synthesized
cctctttagccaatgccctg

SEQ ID NO: 31215 - DNA, 20 bp, Artificial Sequence
  chemically synthesized
ttagccaatgccctgcagct

SEQ ID NO: 31216 - DNA, 20 bp, Artificial Sequence
  chemically synthesized
aatgccctgcagctaagatt

SEQ ID NO: 31217 - DNA, 20 bp, Artificial Sequence
  chemically synthesized
ctgcagctaagattgagaaa

SEQ ID NO: 31218 - DNA, 20 bp, Artificial Sequence
  chemically synthesized
ctaagattgagaaacggatt

SEQ ID NO: 31219 - DNA, 20 bp, Artificial Sequence
  chemically synthesized
gattcagaactcacacctct

SEQ ID NO: 31220 - DNA, 20 bp, Artificial Sequence
  chemically synthesized
aactcacacctcttggtgct

SEQ ID NO: 31221 - DNA, 20 bp, Artificial Sequence
  chemically synthesized
tcacacctcttggtgcttgg

SEQ ID NO: 31222 - DNA, 20 bp, Artificial Sequence
  chemically synthesized
gtggctcccttccaaaccat

SEQ ID NO: 31223 - DNA, 20 bp, Artificial Sequence
  chemically synthesized
actttctttcctatttttta

SEQ ID NO: 31224 - DNA, 20 bp, Artificial Sequence
  chemically synthesized
ctttcctattttttaaagca

SEQ ID NO: 31225 - DNA, 20 bp, Artificial Sequence
  chemically synthesized
tttaaagcacagtctgaatc

SEQ ID NO: 31226 - DNA, 20 bp, Artificial Sequence
  chemically synthesized
acagtctgaatcaagtgctt

SEQ ID NO: 31227 - DNA, 20 bp, Artificial Sequence
  chemically synthesized
ataaccctgaaccctcttct

SEQ ID NO: 31228 - DNA, 20 bp, Artificial Sequence
  chemically synthesized
taaccctgaaccctcttcta

SEQ ID NO: 31229 - DNA, 20 bp, Artificial Sequence
  chemically synthesized
gaaccctcttctaaggccac

SEQ ID NO: 31230 - DNA, 20 bp, Artificial Sequence
  chemically synthesized
ttctaaggccaccagttaca

SEQ ID NO: 31231 - DNA, 20 bp, Artificial Sequence
  chemically synthesized
aggccaccagttacaaagaa

SEQ ID NO: 31232 - DNA, 20 bp, Artificial Sequence
  chemically synthesized
ggccaccagttacaaagaat

SEQ ID NO: 31233 - DNA, 20 bp, Artificial Sequence
  chemically synthesized
gccaccagttacaaagaatg

SEQ ID NO: 31234 - DNA, 20 bp, Artificial Sequence
  chemically synthesized
accagttacaaagaatgggg

SEQ ID NO: 31235 - DNA, 20 bp, Artificial Sequence
  chemically synthesized
ccagttacaaagaatgggga

SEQ ID NO: 31236 - DNA, 20 bp, Artificial Sequence
  chemically synthesized
aaagaatggggaaggttaat

SEQ ID NO: 31237 - DNA, 20 bp, Artificial Sequence
  chemically synthesized
aggttaatgagtaactccac

SEQ ID NO: 31238 - DNA, 20 bp, Artificial Sequence
  chemically synthesized
gtaactccaccagtgcctgc

SEQ ID NO: 31239 - DNA, 20 bp, Artificial Sequence
  chemically synthesized
ctccaccagtgcctgccaga

SEQ ID NO: 31240 - DNA, 20 bp, Artificial Sequence
  chemically synthesized
ccagtgcctgccagaaagct

SEQ ID NO: 31241 - DNA, 20 bp, Artificial Sequence
  chemically synthesized
cagaaagctcagctgtactc

SEQ ID NO: 31242 - DNA, 20 bp, Artificial Sequence
  chemically synthesized
cagccttccttcctctcttg

SEQ ID NO: 31243 - DNA, 20 bp, Artificial Sequence
  chemically synthesized
gccttccttcctctcttgca

SEQ ID NO: 31244 - DNA, 20 bp, Artificial Sequence
  chemically synthesized
cttccttcctctcttgcaga

SEQ ID NO: 31245 - DNA, 20 bp, Artificial Sequence
  chemically synthesized
tcttgcagagagaaacaatg

SEQ ID NO: 31246 - DNA, 20 bp, Artificial Sequence
  chemically synthesized
tgcagagagaaacaatgcgg

SEQ ID NO: 31247 - DNA, 20 bp, Artificial Sequence
  chemically synthesized
aacaatgcggcagttgaaca

SEQ ID NO: 31248 - DNA, 20 bp, Artificial Sequence
  chemically synthesized
tgcggcagttgaacaaagcg

SEQ ID NO: 31249 - DNA, 20 bp, Artificial Sequence
  chemically synthesized
gcggcagttgaacaaagcga

SEQ ID NO: 31250 - DNA, 20 bp, Artificial Sequence
  chemically synthesized
agcgaaggcactgtaatgcc

SEQ ID NO: 31251 - DNA, 20 bp, Artificial Sequence
  chemically synthesized
gaaggcactgtaatgcccag

SEQ ID NO: 31252 - DNA, 20 bp, Artificial Sequence
  chemically synthesized
actgtaatgcccagtggctt

SEQ ID NO: 31253 - DNA, 20 bp, Artificial Sequence
  chemically synthesized
atgcccagtggcttcagtca

SEQ ID NO: 31254 - DNA, 20 bp, Artificial Sequence
  chemically synthesized
tgcccagtggcttcagtcac

SEQ ID NO: 31255 - DNA, 20 bp, Artificial Sequence
  chemically synthesized
cagtggcttcagtcacaggc

SEQ ID NO: 31256 - DNA, 20 bp, Artificial Sequence
  chemically synthesized
tggtctaaaattccatttca

SEQ ID NO: 31257 - DNA, 20 bp, Artificial Sequence
  chemically synthesized
aattccatttcacagaattg

SEQ ID NO: 31258 - DNA, 20 bp, Artificial Sequence
  chemically synthesized
tcacagaattgaagataatt

SEQ ID NO: 31259 - DNA, 20 bp, Artificial Sequence
  chemically synthesized
cacagaattgaagataattt

SEQ ID NO: 31260 - DNA, 20 bp, Artificial Sequence
  chemically synthesized
acagaattgaagataatttg

SEQ ID NO: 31261 - DNA, 20 bp, Artificial Sequence
  chemically synthesized
ttggggttattaccaattct

SEQ ID NO: 31262 - DNA, 20 bp, Artificial Sequence
  chemically synthesized
gggttattaccaattctcag

SEQ ID NO: 31263 - DNA, 20 bp, Artificial Sequence
  chemically synthesized
ctcaaattcaatcccgttga

SEQ ID NO: 31264 - DNA, 20 bp, Artificial Sequence
  chemically synthesized
aattcaatcccgttgatggt

SEQ ID NO: 31265 - DNA, 20 bp, Artificial Sequence
  chemically synthesized
aatcccgttgatggtgagca

SEQ ID NO: 31266 - DNA, 20 bp, Artificial Sequence
  chemically synthesized
atcccgttgatggtgagcat

SEQ ID NO: 31267 - DNA, 20 bp, Artificial Sequence
  chemically synthesized
tcccgttgatggtgagcatg

SEQ ID NO: 31268 - DNA, 20 bp, Artificial Sequence
  chemically synthesized
gtgagcatggggttcatttt

SEQ ID NO: 31269 - DNA, 20 bp, Artificial Sequence
  chemically synthesized
gagcatggggttcattttga

SEQ ID NO: 31270 - DNA, 20 bp, Artificial Sequence
  chemically synthesized
catggggttcattttgagag

SEQ ID NO: 31271 - DNA, 20 bp, Artificial Sequence
  chemically synthesized
tcattttgagagtagaaaat

SEQ ID NO: 31272 - DNA, 20 bp, Artificial Sequence
  chemically synthesized
tgagagtagaaaattggatg

SEQ ID NO: 31273 - DNA, 20 bp, Artificial Sequence
  chemically synthesized
gagtagaaaattggatgcag

SEQ ID NO: 31274 - DNA, 20 bp, Artificial Sequence
  chemically synthesized
gtagaaaattggatgcagtg

SEQ ID NO: 31275 - DNA, 20 bp, Artificial Sequence
  chemically synthesized
aattggatgcagtggagaat

SEQ ID NO: 31276 - DNA, 20 bp, Artificial Sequence
  chemically synthesized
gcagtggagaatcagaatgt

SEQ ID NO: 31277 - DNA, 20 bp, Artificial Sequence
  chemically synthesized
tggagaatcagaatgttgga

SEQ ID NO: 31278 - DNA, 20 bp, Artificial Sequence
  chemically synthesized
tggtctctgccatttcccca

SEQ ID NO: 31279 - DNA, 20 bp, Artificial Sequence
  chemically synthesized
tgctgctgcttttaacaaat

SEQ ID NO: 31280 - DNA, 20 bp, Artificial Sequence
  chemically synthesized
taacaaatcagtatacaact

SEQ ID NO: 31281 - DNA, 20 bp, Artificial Sequence
  chemically synthesized
tttcaaatatacaaaatatt

SEQ ID NO: 31282 - DNA, 20 bp, Artificial Sequence
  chemically synthesized
tatacaaaatattgagtctg

SEQ ID NO: 31283 - DNA, 20 bp, Artificial Sequence
  chemically synthesized
atacaaaatattgagtctga

SEQ ID NO: 31284 - DNA, 20 bp, Artificial Sequence
  chemically synthesized
atattgagtctgaaggcaaa

SEQ ID NO: 31285 - DNA, 20 bp, Artificial Sequence
  chemically synthesized
ttttcacttccattgcttcc

SEQ ID NO: 31286 - DNA, 20 bp, Artificial Sequence
  chemically synthesized
tttcacttccattgcttcct

SEQ ID NO: 31287 - DNA, 20 bp, Artificial Sequence
  chemically synthesized
tctgatatttcttccaaata

SEQ ID NO: 31288 - DNA, 20 bp, Artificial Sequence
  chemically synthesized
ttccaaatacagactgttgt

SEQ ID NO: 31289 - DNA, 20 bp, Artificial Sequence
  chemically synthesized
ctgatcatcactcacacatc

SEQ ID NO: 31290 - DNA, 20 bp, Artificial Sequence
  chemically synthesized
tgatcatcactcacacatcc

SEQ ID NO: 31291 - DNA, 20 bp, Artificial Sequence
  chemically synthesized
tgttacatctccacgccact

SEQ ID NO: 31292 - DNA, 20 bp, Artificial Sequence
  chemically synthesized
atctccacgccactgagtat

SEQ ID NO: 31293 - DNA, 20 bp, Artificial Sequence
  chemically synthesized
tctccacgccactgagtatc

SEQ ID NO: 31294 - DNA, 20 bp, Artificial Sequence
  chemically synthesized
ctccacgccactgagtatca

SEQ ID NO: 31295 - DNA, 20 bp, Artificial Sequence
  chemically synthesized
aacctgccccaatattcacg

SEQ ID NO: 31296 - DNA, 20 bp, Artificial Sequence
  chemically synthesized
acctgccccaatattcacgt

SEQ ID NO: 31297 - DNA, 20 bp, Artificial Sequence
  chemically synthesized
ggttcttttctattttccct

SEQ ID NO: 31298 - DNA, 20 bp, Artificial Sequence
  chemically synthesized
tttctattttccctaagcgt

SEQ ID NO: 31299 - DNA, 20 bp, Artificial Sequence
  chemically synthesized
ccctaagcgtcggccaactt

SEQ ID NO: 31300 - DNA, 20 bp, Artificial Sequence
  chemically synthesized
gtcggccaactttagaaata

SEQ ID NO: 31301 - DNA, 20 bp, Artificial Sequence
  chemically synthesized
tcggccaactttagaaataa

SEQ ID NO: 31302 - DNA, 20 bp, Artificial Sequence
  chemically synthesized
cggccaactttagaaataaa

SEQ ID NO: 31303 - DNA, 20 bp, Artificial Sequence
  chemically synthesized
caactttagaaataaaggga

SEQ ID NO: 31304 - DNA, 20 bp, Artificial Sequence
  chemically synthesized
actttagaaataaagggaca

SEQ ID NO: 31305 - DNA, 20 bp, Artificial Sequence
  chemically synthesized
aataaagggacagagtacaa

SEQ ID NO: 31306 - DNA, 20 bp, Artificial Sequence
  chemically synthesized
taaagggacagagtacaaaa

SEQ ID NO: 31307 - DNA, 20 bp, Artificial Sequence
  chemically synthesized
aagggacagagtacaaaaga

SEQ ID NO: 31308 - DNA, 20 bp, Artificial Sequence
  chemically synthesized
tacaaaagagagaaatttta

SEQ ID NO: 31309 - DNA, 20 bp, Artificial Sequence
  chemically synthesized
aaagagagaaattttaaagc

SEQ ID NO: 31310 - DNA, 20 bp, Artificial Sequence
  chemically synthesized
aagagagaaattttaaagcc

SEQ ID NO: 31311 - DNA, 20 bp, Artificial Sequence
  chemically synthesized
aaattttaaagccgggcatc

SEQ ID NO: 31312 - DNA, 20 bp, Artificial Sequence
  chemically synthesized
aattttaaagccgggcatcc

SEQ ID NO: 31313 - DNA, 20 bp, Artificial Sequence
  chemically synthesized
attttaaagccgggcatccg

SEQ ID NO: 31314 - DNA, 20 bp, Artificial Sequence
  chemically synthesized
ttttaaagccgggcatccgg

SEQ ID NO: 31315 - DNA, 20 bp, Artificial Sequence
  chemically synthesized
ttaaagccgggcatccgggg

SEQ ID NO: 31316 - DNA, 20 bp, Artificial Sequence
  chemically synthesized
taaagccgggcatccggggg

SEQ ID NO: 31317 - DNA, 20 bp, Artificial Sequence
  chemically synthesized
ccgggggaggcatcacattt

SEQ ID NO: 31318 - DNA, 20 bp, Artificial Sequence
  chemically synthesized
ggggaggcatcacatttcgg

SEQ ID NO: 31319 - DNA, 20 bp, Artificial Sequence
  chemically synthesized
gggaggcatcacatttcggt

SEQ ID NO: 31320 - DNA, 20 bp, Artificial Sequence
  chemically synthesized
taggttccgtgatgccccac

SEQ ID NO: 31321 - DNA, 20 bp, Artificial Sequence
  chemically synthesized
gccccacaagccacaaaaac

SEQ ID NO: 31322 - DNA, 20 bp, Artificial Sequence
  chemically synthesized
cacaagccacaaaaaccagc

SEQ ID NO: 31323 - DNA, 20 bp, Artificial Sequence
  chemically synthesized
aaaaaccagcaagtttgtat

SEQ ID NO: 31324 - DNA, 20 bp, Artificial Sequence
  chemically synthesized
aaaaccagcaagtttgtatt

SEQ ID NO: 31325 - DNA, 20 bp, Artificial Sequence
  chemically synthesized
aaaccagcaagtttgtatta

SEQ ID NO: 31326 - DNA, 20 bp, Artificial Sequence
  chemically synthesized
ttgtattagggattttcaaa

SEQ ID NO: 31327 - DNA, 20 bp, Artificial Sequence
  chemically synthesized
tgtattagggattttcaaat

SEQ ID NO: 31328 - DNA, 20 bp, Artificial Sequence
  chemically synthesized
gtattagggattttcaaatg

SEQ ID NO: 31329 - DNA, 20 bp, Artificial Sequence
  chemically synthesized
attagggattttcaaatggg

SEQ ID NO: 31330 - DNA, 20 bp, Artificial Sequence
  chemically synthesized
ttagggattttcaaatgggg

SEQ ID NO: 31331 - DNA, 20 bp, Artificial Sequence
  chemically synthesized
gggattttcaaatggggagg

SEQ ID NO: 31332 - DNA, 20 bp, Artificial Sequence
  chemically synthesized
atggggaggcagtgtgcaaa

SEQ ID NO: 31333 - DNA, 20 bp, Artificial Sequence
  chemically synthesized
tggggaggcagtgtgcaaat

SEQ ID NO: 31334 - DNA, 20 bp, Artificial Sequence
  chemically synthesized
aggcagtgtgcaaataggtg

SEQ ID NO: 31335 - DNA, 20 bp, Artificial Sequence
  chemically synthesized
ggcagtgtgcaaataggtgt

SEQ ID NO: 31336 - DNA, 20 bp, Artificial Sequence
  chemically synthesized
gtgcaaataggtgtgggtca

SEQ ID NO: 31337 - DNA, 20 bp, Artificial Sequence
  chemically synthesized
aggtgtgggtcacagacatc

SEQ ID NO: 31338 - DNA, 20 bp, Artificial Sequence
  chemically synthesized
acagacatcaagtactttac

SEQ ID NO: 31339 - DNA, 20 bp, Artificial Sequence
  chemically synthesized
cagacatcaagtactttaca

SEQ ID NO: 31340 - DNA, 20 bp, Artificial Sequence
  chemically synthesized
tcaagtactttacaaggtaa

SEQ ID NO: 31341 - DNA, 20 bp, Artificial Sequence
  chemically synthesized
acaaggtaatagaatatcac

SEQ ID NO: 31342 - DNA, 20 bp, Artificial Sequence
  chemically synthesized
caaggtaatagaatatcaca

SEQ ID NO: 31343 - DNA, 20 bp, Artificial Sequence
  chemically synthesized
gtaatagaatatcacaaggc

SEQ ID NO: 31344 - DNA, 20 bp, Artificial Sequence
  chemically synthesized
atagaatatcacaaggcaag

SEQ ID NO: 31345 - DNA, 20 bp, Artificial Sequence
  chemically synthesized
agaatatcacaaggcaagtg

SEQ ID NO: 31346 - DNA, 20 bp, Artificial Sequence
  chemically synthesized
gaatatcacaaggcaagtgg

SEQ ID NO: 31347 - DNA, 20 bp, Artificial Sequence
  chemically synthesized
tatcacaaggcaagtggagg

SEQ ID NO: 31348 - DNA, 20 bp, Artificial Sequence
  chemically synthesized
atcacaaggcaagtggaggc

SEQ ID NO: 31349 - DNA, 20 bp, Artificial Sequence
  chemically synthesized
tcacaaggcaagtggaggca

SEQ ID NO: 31350 - DNA, 20 bp, Artificial Sequence
  chemically synthesized
aaggcaagtggaggcagggt

SEQ ID NO: 31351 - DNA, 20 bp, Artificial Sequence
  chemically synthesized
gtggaggcagggtgagatca

SEQ ID NO: 31352 - DNA, 20 bp, Artificial Sequence
  chemically synthesized
tggaggcagggtgagatcac

SEQ ID NO: 31353 - DNA, 20 bp, Artificial Sequence
  chemically synthesized
agggtgagatcacaggacca

SEQ ID NO: 31354 - DNA, 20 bp, Artificial Sequence
  chemically synthesized
gggtgagatcacaggaccac

SEQ ID NO: 31355 - DNA, 20 bp, Artificial Sequence
  chemically synthesized
gatcacaggaccacaggacc

SEQ ID NO: 31356 - DNA, 20 bp, Artificial Sequence
  chemically synthesized
atcacaggaccacaggaccg

SEQ ID NO: 31357 - DNA, 20 bp, Artificial Sequence
  chemically synthesized
cgaaattaaaattgctaatg

SEQ ID NO: 31358 - DNA, 20 bp, Artificial Sequence
  chemically synthesized
taaaattgctaatgaagttt

SEQ ID NO: 31359 - DNA, 20 bp, Artificial Sequence
  chemically synthesized
aaaattgctaatgaagtttc

SEQ ID NO: 31360 - DNA, 20 bp, Artificial Sequence
  chemically synthesized
tgtcattgataacatcttat

SEQ ID NO: 31361 - DNA, 20 bp, Artificial Sequence
  chemically synthesized
gtcattgataacatcttatc

SEQ ID NO: 31362 - DNA, 20 bp, Artificial Sequence
  chemically synthesized
cattgataacatcttatcag

SEQ ID NO: 31363 - DNA, 20 bp, Artificial Sequence
  chemically synthesized
gataacatcttatcaggaga

SEQ ID NO: 31364 - DNA, 20 bp, Artificial Sequence
  chemically synthesized
ataacatcttatcaggagac

SEQ ID NO: 31365 - DNA, 20 bp, Artificial Sequence
  chemically synthesized
taacatcttatcaggagaca

SEQ ID NO: 31366 - DNA, 20 bp, Artificial Sequence
  chemically synthesized
ttatcaggagacagggtttt

SEQ ID NO: 31367 - DNA, 20 bp, Artificial Sequence
  chemically synthesized
tatcaggagacagggttttt

SEQ ID NO: 31368 - DNA, 20 bp, Artificial Sequence
  chemically synthesized
acagggtttttaggatcaac

SEQ ID NO: 31369 - DNA, 20 bp, Artificial Sequence
  chemically synthesized
ctggtctgaccaaaatttat

SEQ ID NO: 31370 - DNA, 20 bp, Artificial Sequence
  chemically synthesized
tggtctgaccaaaatttatt

SEQ ID NO: 31371 - DNA, 20 bp, Artificial Sequence
  chemically synthesized
tctgaccaaaatttattagg

SEQ ID NO: 31372 - DNA, 20 bp, Artificial Sequence
  chemically synthesized
ctgaccaaaatttattaggc

SEQ ID NO: 31373 - DNA, 20 bp, Artificial Sequence
  chemically synthesized
gggaatttcctcttcctaat

SEQ ID NO: 31374 - DNA, 20 bp, Artificial Sequence
  chemically synthesized
tttcctcttcctaataagcc

SEQ ID NO: 31375 - DNA, 20 bp, Artificial Sequence
  chemically synthesized
ttcctcttcctaataagcct

SEQ ID NO: 31376 - DNA, 20 bp, Artificial Sequence
  chemically synthesized
cctcttcctaataagcctgg

SEQ ID NO: 31377 - DNA, 20 bp, Artificial Sequence
  chemically synthesized
taataagcctgggagcgctg

SEQ ID NO: 31378 - DNA, 20 bp, Artificial Sequence
  chemically synthesized
aataagcctgggagcgctgt

SEQ ID NO: 31379 - DNA, 20 bp, Artificial Sequence
  chemically synthesized
taagcctgggagcgctgtgg

SEQ ID NO: 31380 - DNA, 20 bp, Artificial Sequence
  chemically synthesized
ctgggagcgctgtgggagac

SEQ ID NO: 31381 - DNA, 20 bp, Artificial Sequence
  chemically synthesized
tgggagcgctgtgggagact

SEQ ID NO: 31382 - DNA, 20 bp, Artificial Sequence
  chemically synthesized
gggagcgctgtgggagactg

SEQ ID NO: 31383 - DNA, 20 bp, Artificial Sequence
  chemically synthesized
tggggtctatttcacccctg

SEQ ID NO: 31384 - DNA, 20 bp, Artificial Sequence
  chemically synthesized
acccctgcagtctcgaccat

SEQ ID NO: 31385 - DNA, 20 bp, Artificial Sequence
  chemically synthesized
ccctgcagtctcgaccataa

SEQ ID NO: 31386 - DNA, 20 bp, Artificial Sequence
  chemically synthesized
gcagtctcgaccataagaga

SEQ ID NO: 31387 - DNA, 20 bp, Artificial Sequence
  chemically synthesized
cagtctcgaccataagagac

SEQ ID NO: 31388 - DNA, 20 bp, Artificial Sequence
  chemically synthesized
ccataagagacaggcgcacc

SEQ ID NO: 31389 - DNA, 20 bp, Artificial Sequence
  chemically synthesized
ataagagacaggcgcacctg

SEQ ID NO: 31390 - DNA, 20 bp, Artificial Sequence
  chemically synthesized
taagagacaggcgcacctgg

SEQ ID NO: 31391 - DNA, 20 bp, Artificial Sequence
  chemically synthesized
aagagacaggcgcacctgga

SEQ ID NO: 31392 - DNA, 20 bp, Artificial Sequence
  chemically synthesized
agagacaggcgcacctggag

SEQ ID NO: 31393 - DNA, 20 bp, Artificial Sequence
  chemically synthesized
gagacaggcgcacctggagg

SEQ ID NO: 31394 - DNA, 20 bp, Artificial Sequence
  chemically synthesized
agacaggcgcacctggaggg

SEQ ID NO: 31395 - DNA, 20 bp, Artificial Sequence
  chemically synthesized
cctggaggggggctgtttat

SEQ ID NO: 31396 - DNA, 20 bp, Artificial Sequence
  chemically synthesized
gtttataagcctatacctcc

SEQ ID NO: 31397 - DNA, 20 bp, Artificial Sequence
  chemically synthesized
ctggctcgtattctctttct

SEQ ID NO: 31398 - DNA, 20 bp, Artificial Sequence
  chemically synthesized
tggctcgtattctctttctc

SEQ ID NO: 31399 - DNA, 20 bp, Artificial Sequence
  chemically synthesized
ggctcgtattctctttctca

SEQ ID NO: 31400 - DNA, 20 bp, Artificial Sequence
  chemically synthesized
tctcagggatgttccatgct

SEQ ID NO: 31401 - DNA, 20 bp, Artificial Sequence
  chemically synthesized
ggatgttccatgctgagaaa

SEQ ID NO: 31402 - DNA, 20 bp, Artificial Sequence
  chemically synthesized
ccatgctgagaaaaagaatt

SEQ ID NO: 31403 - DNA, 20 bp, Artificial Sequence
  chemically synthesized
tttctcccatttgcttttga

SEQ ID NO: 31404 - DNA, 20 bp, Artificial Sequence
  chemically synthesized
ctcccatttgcttttgaaag

SEQ ID NO: 31405 - DNA, 20 bp, Artificial Sequence
  chemically synthesized
cccatttgcttttgaaagaa

SEQ ID NO: 31406 - DNA, 20 bp, Artificial Sequence
  chemically synthesized
cttttgaaagaagagaaata

SEQ ID NO: 31407 - DNA, 20 bp, Artificial Sequence
  chemically synthesized
aaatatggctctgttctgcc

SEQ ID NO: 31408 - DNA, 20 bp, Artificial Sequence
  chemically synthesized
ctctgttctgcctggctcac

SEQ ID NO: 31409 - DNA, 20 bp, Artificial Sequence
  chemically synthesized
tgttctgcctggctcaccag

SEQ ID NO: 31410 - DNA, 20 bp, Artificial Sequence
  chemically synthesized
ctgcctggctcaccagcagt

SEQ ID NO: 31411 - DNA, 20 bp, Artificial Sequence
  chemically synthesized
gcctggctcaccagcagtca

SEQ ID NO: 31412 - DNA, 20 bp, Artificial Sequence
  chemically synthesized
ctcaccagcagtcagagttt

SEQ ID NO: 31413 - DNA, 20 bp, Artificial Sequence
  chemically synthesized
tcaccagcagtcagagttta

SEQ ID NO: 31414 - DNA, 20 bp, Artificial Sequence
  chemically synthesized
tgttatcctgttcttttttc

SEQ ID NO: 31415 - DNA, 20 bp, Artificial Sequence
  chemically synthesized
gttatcctgttcttttttca

SEQ ID NO: 31416 - DNA, 20 bp, Artificial Sequence
  chemically synthesized
cacatgctgtacaatttgtg

SEQ ID NO: 31417 - DNA, 20 bp, Artificial Sequence
  chemically synthesized
tgcagttaatgcaattatta

SEQ ID NO: 31418 - DNA, 20 bp, Artificial Sequence
  chemically synthesized
gcagttaatgcaattattac

SEQ ID NO: 31419 - DNA, 20 bp, Artificial Sequence
  chemically synthesized
cagttaatgcaattattaca

SEQ ID NO: 31420 - DNA, 20 bp, Artificial Sequence
  chemically synthesized
tgcaattattacagggtcct

SEQ ID NO: 31421 - DNA, 20 bp, Artificial Sequence
  chemically synthesized
gcaattattacagggtcctg

SEQ ID NO: 31422 - DNA, 20 bp, Artificial Sequence
  chemically synthesized
gaggcaatatacatcctcct

SEQ ID NO: 31423 - DNA, 20 bp, Artificial Sequence
  chemically synthesized
tatacatcctcctcagctga

SEQ ID NO: 31424 - DNA, 20 bp, Artificial Sequence
  chemically synthesized
atacatcctcctcagctgac

SEQ ID NO: 31425 - DNA, 20 bp, Artificial Sequence
  chemically synthesized
cctcctcagctgacaggatt

SEQ ID NO: 31426 - DNA, 20 bp, Artificial Sequence
  chemically synthesized
tcctcagctgacaggattaa

SEQ ID NO: 31427 - DNA, 20 bp, Artificial Sequence
  chemically synthesized
ctgacaggattaagagatta

SEQ ID NO: 31428 - DNA, 20 bp, Artificial Sequence
  chemically synthesized
aggattaagagattaaagta

SEQ ID NO: 31429 - DNA, 20 bp, Artificial Sequence
  chemically synthesized
ttaagagattaaagtaaaga

SEQ ID NO: 31430 - DNA, 20 bp, Artificial Sequence
  chemically synthesized
taagagattaaagtaaagac

SEQ ID NO: 31431 - DNA, 20 bp, Artificial Sequence
  chemically synthesized
taaagacaggcataaatcac

SEQ ID NO: 31432 - DNA, 20 bp, Artificial Sequence
  chemically synthesized
aaagacaggcataaatcaca

SEQ ID NO: 31433 - DNA, 20 bp, Artificial Sequence
  chemically synthesized
taaatcacaaggatattgac

SEQ ID NO: 31434 - DNA, 20 bp, Artificial Sequence
  chemically synthesized
aaatcacaaggatattgact

SEQ ID NO: 31435 - DNA, 20 bp, Artificial Sequence
  chemically synthesized
aatcacaaggatattgactg

SEQ ID NO: 31436 - DNA, 20 bp, Artificial Sequence
  chemically synthesized
cacaaggatattgactgggg

SEQ ID NO: 31437 - DNA, 20 bp, Artificial Sequence
  chemically synthesized
atattgactggggaagtgat

SEQ ID NO: 31438 - DNA, 20 bp, Artificial Sequence
  chemically synthesized
aaatctttacaatttatgtt

SEQ ID NO: 31439 - DNA, 20 bp, Artificial Sequence
  chemically synthesized
atctttacaatttatgttta

SEQ ID NO: 31440 - DNA, 20 bp, Artificial Sequence
  chemically synthesized
caatttatgtttagagattg

SEQ ID NO: 31441 - DNA, 20 bp, Artificial Sequence
  chemically synthesized
tatgtttagagattgcagta

SEQ ID NO: 31442 - DNA, 20 bp, Artificial Sequence
  chemically synthesized
tttagagattgcagtaaaga

SEQ ID NO: 31443 - DNA, 20 bp, Artificial Sequence
  chemically synthesized
ttagagattgcagtaaagac

SEQ ID NO: 31444 - DNA, 20 bp, Artificial Sequence
  chemically synthesized
attgcagtaaagacaggcat

SEQ ID NO: 31445 - DNA, 20 bp, Artificial Sequence
  chemically synthesized
acaggcataagaaattacaa

SEQ ID NO: 31446 - DNA, 20 bp, Artificial Sequence
  chemically synthesized
aaattacaaaagtattaatt

SEQ ID NO: 31447 - DNA, 20 bp, Artificial Sequence
  chemically synthesized
aattacaaaagtattaattt

SEQ ID NO: 31448 - DNA, 20 bp, Artificial Sequence
  chemically synthesized
attacaaaagtattaatttg

SEQ ID NO: 31449 - DNA, 20 bp, Artificial Sequence
  chemically synthesized
caatccacgaacttctgcca

SEQ ID NO: 31450 - DNA, 20 bp, Artificial Sequence
  chemically synthesized
acgaacttctgccatggctt

SEQ ID NO: 31451 - DNA, 20 bp, Artificial Sequence
  chemically synthesized
cttcagctgatccctccgtt

SEQ ID NO: 31452 - DNA, 20 bp, Artificial Sequence
  chemically synthesized
tcagctgatccctccgtttg

SEQ ID NO: 31453 - DNA, 20 bp, Artificial Sequence
  chemically synthesized
gatccctccgtttggagtcc

SEQ ID NO: 31454 - DNA, 20 bp, Artificial Sequence
  chemically synthesized
ccagacttcccgcaacaact

SEQ ID NO: 31455 - DNA, 20 bp, Artificial Sequence
  chemically synthesized
cccgcaacaactgagaactc

SEQ ID NO: 31456 - DNA, 20 bp, Artificial Sequence
  chemically synthesized
cgcaacaactgagaactctg

SEQ ID NO: 31457 - DNA, 20 bp, Artificial Sequence
  chemically synthesized
gcaacaactgagaactctgg

SEQ ID NO: 31458 - DNA, 20 bp, Artificial Sequence
  chemically synthesized
caacaactgagaactctgga

SEQ ID NO: 31459 - DNA, 20 bp, Artificial Sequence
  chemically synthesized
ccacccttcttatatctctt

SEQ ID NO: 31460 - DNA, 20 bp, Artificial Sequence
  chemically synthesized
cacccttcttatatctctta

SEQ ID NO: 31461 - DNA, 20 bp, Artificial Sequence
  chemically synthesized
cccttcttatatctcttaag

SEQ ID NO: 31462 - DNA, 20 bp, Artificial Sequence
  chemically synthesized
atctcttaaggagctgtgtt

SEQ ID NO: 31463 - DNA, 20 bp, Artificial Sequence
  chemically synthesized
cttaaggagctgtgttcaga

SEQ ID NO: 31464 - DNA, 20 bp, Artificial Sequence
  chemically synthesized
atggttacatttcgcttgct

SEQ ID NO: 31465 - DNA, 20 bp, Artificial Sequence
  chemically synthesized
ttacatttcgcttgctgagc

SEQ ID NO: 31466 - DNA, 20 bp, Artificial Sequence
  chemically synthesized
agactgcattttcattatcc

SEQ ID NO: 31467 - DNA, 20 bp, Artificial Sequence
  chemically synthesized
gactgcattttcattatcct

SEQ ID NO: 31468 - DNA, 20 bp, Artificial Sequence
  chemically synthesized
tatcctgggctaaaatcaat

SEQ ID NO: 31469 - DNA, 20 bp, Artificial Sequence
  chemically synthesized
gctaaaatcaattggtattt

SEQ ID NO: 31470 - DNA, 20 bp, Artificial Sequence
  chemically synthesized
aaatcaattggtatttaagt

SEQ ID NO: 31471 - DNA, 20 bp, Artificial Sequence
  chemically synthesized
atcaattggtatttaagtta

SEQ ID NO: 31472 - DNA, 20 bp, Artificial Sequence
  chemically synthesized
ggtatttaagttagagcaaa

SEQ ID NO: 31473 - DNA, 20 bp, Artificial Sequence
  chemically synthesized
gtatttaagttagagcaaaa

SEQ ID NO: 31474 - DNA, 20 bp, Artificial Sequence
  chemically synthesized
tatttaagttagagcaaaaa

SEQ ID NO: 31475 - DNA, 20 bp, Artificial Sequence
  chemically synthesized
aagggttctaaccctattta

SEQ ID NO: 31476 - DNA, 20 bp, Artificial Sequence
  chemically synthesized
ggttctaaccctatttacag

SEQ ID NO: 31477 - DNA, 20 bp, Artificial Sequence
  chemically synthesized
cagcacacatacacttacat

SEQ ID NO: 31478 - DNA, 20 bp, Artificial Sequence
  chemically synthesized
acatacacttacattagaat

SEQ ID NO: 31479 - DNA, 20 bp, Artificial Sequence
  chemically synthesized
cttacattagaattggcttt

SEQ ID NO: 31480 - DNA, 20 bp, Artificial Sequence
  chemically synthesized
ttacattagaattggcttta

SEQ ID NO: 31481 - DNA, 20 bp, Artificial Sequence
  chemically synthesized
tacattagaattggctttaa

SEQ ID NO: 31482 - DNA, 20 bp, Artificial Sequence
  chemically synthesized
ttccactgattaccttctat

SEQ ID NO: 31483 - DNA, 20 bp, Artificial Sequence
  chemically synthesized
ctgattaccttctatgagcc

SEQ ID NO: 31484 - DNA, 20 bp, Artificial Sequence
  chemically synthesized
tctatgagccaagactgcca

SEQ ID NO: 31485 - DNA, 20 bp, Artificial Sequence
  chemically synthesized
agccaagactgccatagtct

SEQ ID NO: 31486 - DNA, 20 bp, Artificial Sequence
  chemically synthesized
ccatagtctcagccttcatg

SEQ ID NO: 31487 - DNA, 20 bp, Artificial Sequence
  chemically synthesized
ctcagccttcatgcagctta

SEQ ID NO: 31488 - DNA, 20 bp, Artificial Sequence
  chemically synthesized
tcagccttcatgcagcttat

SEQ ID NO: 31489 - DNA, 20 bp, Artificial Sequence
  chemically synthesized
ccttcatgcagcttataggc

SEQ ID NO: 31490 - DNA, 20 bp, Artificial Sequence
  chemically synthesized
cagcttataggctagcaaaa

SEQ ID NO: 31491 - DNA, 20 bp, Artificial Sequence
  chemically synthesized
ttataggctagcaaaaaagc

SEQ ID NO: 31492 - DNA, 20 bp, Artificial Sequence
  chemically synthesized
aggctagcaaaaaagccaga

SEQ ID NO: 31493 - DNA, 20 bp, Artificial Sequence
  chemically synthesized
aaaaaagccagacagtgcac

SEQ ID NO: 31494 - DNA, 20 bp, Artificial Sequence
  chemically synthesized
gacagtgcacaagaactcac

SEQ ID NO: 31495 - DNA, 20 bp, Artificial Sequence
  chemically synthesized
caagaactcacaagtgtgtt

SEQ ID NO: 31496 - DNA, 20 bp, Artificial Sequence
  chemically synthesized
acaagtgtgttgagtgttgc

SEQ ID NO: 31497 - DNA, 20 bp, Artificial Sequence
  chemically synthesized
aagtgtgttgagtgttgcaa

SEQ ID NO: 31498 - DNA, 20 bp, Artificial Sequence
  chemically synthesized
gtgttgagtgttgcaagagt

SEQ ID NO: 31499 - DNA, 20 bp, Artificial Sequence
  chemically synthesized
agtgttgcaagagtaagttt

SEQ ID NO: 31500 - DNA, 20 bp, Artificial Sequence
  chemically synthesized
gtgttgcaagagtaagtttc

SEQ ID NO: 31501 - DNA, 20 bp, Artificial Sequence
  chemically synthesized
tgttgcaagagtaagtttca

SEQ ID NO: 31502 - DNA, 20 bp, Artificial Sequence
  chemically synthesized
gttgcaagagtaagtttcag

SEQ ID NO: 31503 - DNA, 20 bp, Artificial Sequence
  chemically synthesized
ggggctctccatgacttacc

SEQ ID NO: 31504 - DNA, 20 bp, Artificial Sequence
  chemically synthesized
tctccatgacttacctggtt

SEQ ID NO: 31505 - DNA, 20 bp, Artificial Sequence
  chemically synthesized
ctttaactttttttttcctc

SEQ ID NO: 31506 - DNA, 20 bp, Artificial Sequence
  chemically synthesized
tttaactttttttttcctct

SEQ ID NO: 31507 - DNA, 20 bp, Artificial Sequence
  chemically synthesized
ttttttttcctctgggtgta

SEQ ID NO: 31508 - DNA, 20 bp, Artificial Sequence
  chemically synthesized
tttcctctgggtgtaaagtg

SEQ ID NO: 31509 - DNA, 20 bp, Artificial Sequence
  chemically synthesized
tcctctgggtgtaaagtgaa

SEQ ID NO: 31510 - DNA, 20 bp, Artificial Sequence
  chemically synthesized
ctgggtgtaaagtgaagaga

SEQ ID NO: 31511 - DNA, 20 bp, Artificial Sequence
  chemically synthesized
taaagtgaagagatggcaat

SEQ ID NO: 31512 - DNA, 20 bp, Artificial Sequence
  chemically synthesized
aagtgaagagatggcaatca

SEQ ID NO: 31513 - DNA, 20 bp, Artificial Sequence
  chemically synthesized
tgaagagatggcaatcagag

SEQ ID NO: 31514 - DNA, 20 bp, Artificial Sequence
  chemically synthesized
gaagagatggcaatcagagt

SEQ ID NO: 31515 - DNA, 20 bp, Artificial Sequence
  chemically synthesized
ttccattgtgtcattgtgaa

SEQ ID NO: 31516 - DNA, 20 bp, Artificial Sequence
  chemically synthesized
gtgtcattgtgaaaagatgc

SEQ ID NO: 31517 - DNA, 20 bp, Artificial Sequence
  chemically synthesized
tgtcattgtgaaaagatgct

SEQ ID NO: 31518 - DNA, 20 bp, Artificial Sequence
  chemically synthesized
attgtgaaaagatgctgggc

SEQ ID NO: 31519 - DNA, 20 bp, Artificial Sequence
  chemically synthesized
ctgggctggcgtgtctcctg

SEQ ID NO: 31520 - DNA, 20 bp, Artificial Sequence
  chemically synthesized
tgggctggcgtgtctcctga

SEQ ID NO: 31521 - DNA, 20 bp, Artificial Sequence
  chemically synthesized
ttcatgcattcgcacaaata

SEQ ID NO: 31522 - DNA, 20 bp, Artificial Sequence
  chemically synthesized
acaaatatagatgtgttcca

SEQ ID NO: 31523 - DNA, 20 bp, Artificial Sequence
  chemically synthesized
tatagatgtgttccatagat

SEQ ID NO: 31524 - DNA, 20 bp, Artificial Sequence
  chemically synthesized
atagatgtgttccatagatg

SEQ ID NO: 31525 - DNA, 20 bp, Artificial Sequence
  chemically synthesized
gatgtgttccatagatgagg

SEQ ID NO: 31526 - DNA, 20 bp, Artificial Sequence
  chemically synthesized
tgttccatagatgaggcaga

SEQ ID NO: 31527 - DNA, 20 bp, Artificial Sequence
  chemically synthesized
tccatagatgaggcagatag

SEQ ID NO: 31528 - DNA, 20 bp, Artificial Sequence
  chemically synthesized
catagatgaggcagatagca

SEQ ID NO: 31529 - DNA, 20 bp, Artificial Sequence
  chemically synthesized
atagatgaggcagatagcag

SEQ ID NO: 31530 - DNA, 20 bp, Artificial Sequence
  chemically synthesized
atagcagaggcttctgccta

SEQ ID NO: 31531 - DNA, 20 bp, Artificial Sequence
  chemically synthesized
cagaggcttctgcctacagc

SEQ ID NO: 31532 - DNA, 20 bp, Artificial Sequence
  chemically synthesized
agaggcttctgcctacagca

SEQ ID NO: 31533 - DNA, 20 bp, Artificial Sequence
  chemically synthesized
gcttctgcctacagcaaggc

SEQ ID NO: 31534 - DNA, 20 bp, Artificial Sequence
  chemically synthesized
tgcctacagcaaggctagtt

SEQ ID NO: 31535 - DNA, 20 bp, Artificial Sequence
  chemically synthesized
cctacagcaaggctagtttg

SEQ ID NO: 31536 - DNA, 20 bp, Artificial Sequence
  chemically synthesized
tacagcaaggctagtttgga

SEQ ID NO: 31537 - DNA, 20 bp, Artificial Sequence
  chemically synthesized
acagcaaggctagtttggag

SEQ ID NO: 31538 - DNA, 20 bp, Artificial Sequence
  chemically synthesized
cagcaaggctagtttggaga

SEQ ID NO: 31539 - DNA, 20 bp, Artificial Sequence
  chemically synthesized
tttggagagggttttgctgt

SEQ ID NO: 31540 - DNA, 20 bp, Artificial Sequence
  chemically synthesized
ttggagagggttttgctgtc

SEQ ID NO: 31541 - DNA, 20 bp, Artificial Sequence
  chemically synthesized
tggagagggttttgctgtca

SEQ ID NO: 31542 - DNA, 20 bp, Artificial Sequence
  chemically synthesized
gagggttttgctgtcagggt

SEQ ID NO: 31543 - DNA, 20 bp, Artificial Sequence
  chemically synthesized
tggacccacacacctcttca

SEQ ID NO: 31544 - DNA, 20 bp, Artificial Sequence
  chemically synthesized
atgctttttcttttttttcc

SEQ ID NO: 31545 - DNA, 20 bp, Artificial Sequence
  chemically synthesized
gctttttcttttttttccca

SEQ ID NO: 31546 - DNA, 20 bp, Artificial Sequence
  chemically synthesized
ttttttttcccagagtttga

SEQ ID NO: 31547 - DNA, 20 bp, Artificial Sequence
  chemically synthesized
tttttttcccagagtttgaa

SEQ ID NO: 31548 - DNA, 20 bp, Artificial Sequence
  chemically synthesized
ttttttcccagagtttgaaa

SEQ ID NO: 31549 - DNA, 20 bp, Artificial Sequence
  chemically synthesized
cccagagtttgaaagggaaa

SEQ ID NO: 31550 - DNA, 20 bp, Artificial Sequence
  chemically synthesized
cagagtttgaaagggaaatg

SEQ ID NO: 31551 - DNA, 20 bp, Artificial Sequence
  chemically synthesized
tgaaagggaaatggagtctc

SEQ ID NO: 31552 - DNA, 20 bp, Artificial Sequence
  chemically synthesized
gggaaatggagtctcaagtt

SEQ ID NO: 31553 - DNA, 20 bp, Artificial Sequence
  chemically synthesized
ggaaatggagtctcaagttc

SEQ ID NO: 31554 - DNA, 20 bp, Artificial Sequence
  chemically synthesized
gaaatggagtctcaagttca

SEQ ID NO: 31555 - DNA, 20 bp, Artificial Sequence
  chemically synthesized
aatggagtctcaagttcagg

SEQ ID NO: 31556 - DNA, 20 bp, Artificial Sequence
  chemically synthesized
atggagtctcaagttcaggg

SEQ ID NO: 31557 - DNA, 20 bp, Artificial Sequence
  chemically synthesized
tctcaagttcagggaggtta

SEQ ID NO: 31558 - DNA, 20 bp, Artificial Sequence
  chemically synthesized
agttcagggaggttacagtg

SEQ ID NO: 31559 - DNA, 20 bp, Artificial Sequence
  chemically synthesized
tacagtgtagacccacaaat

SEQ ID NO: 31560 - DNA, 20 bp, Artificial Sequence
  chemically synthesized
tgtagacccacaaatcagct

SEQ ID NO: 31561 - DNA, 20 bp, Artificial Sequence
  chemically synthesized
acccacaaatcagctaagta

SEQ ID NO: 31562 - DNA, 20 bp, Artificial Sequence
  chemically synthesized
caaatcagctaagtacagct

SEQ ID NO: 31563 - DNA, 20 bp, Artificial Sequence
  chemically synthesized
aaatcagctaagtacagcta

SEQ ID NO: 31564 - DNA, 20 bp, Artificial Sequence
  chemically synthesized
aatcagctaagtacagctaa

SEQ ID NO: 31565 - DNA, 20 bp, Artificial Sequence
  chemically synthesized
cagctaagtacagctaaggg

SEQ ID NO: 31566 - DNA, 20 bp, Artificial Sequence
  chemically synthesized
gctaagtacagctaagggtg

SEQ ID NO: 31567 - DNA, 20 bp, Artificial Sequence
  chemically synthesized
aagtacagctaagggtggag

SEQ ID NO: 31568 - DNA, 20 bp, Artificial Sequence
  chemically synthesized
ggagaagtctatgcaatatc

SEQ ID NO: 31569 - DNA, 20 bp, Artificial Sequence
  chemically synthesized
ccagcactcttctgattaat

SEQ ID NO: 31570 - DNA, 20 bp, Artificial Sequence
  chemically synthesized
gcactcttctgattaattag

SEQ ID NO: 31571 - DNA, 20 bp, Artificial Sequence
  chemically synthesized
ttagaagtctttaaaattca

SEQ ID NO: 31572 - DNA, 20 bp, Artificial Sequence
  chemically synthesized
ccctaaatgattcatatgtc

SEQ ID NO: 31573 - DNA, 20 bp, Artificial Sequence
  chemically synthesized
atgattcatatgtcaagaca

SEQ ID NO: 31574 - DNA, 20 bp, Artificial Sequence
  chemically synthesized
tcatatgtcaagacacagta

SEQ ID NO: 31575 - DNA, 20 bp, Artificial Sequence
  chemically synthesized
cacagtaaagatattatatg

SEQ ID NO: 31576 - DNA, 20 bp, Artificial Sequence
  chemically synthesized
tggaacatcatacacaaaca

SEQ ID NO: 31577 - DNA, 20 bp, Artificial Sequence
  chemically synthesized
ggaacatcatacacaaacat

SEQ ID NO: 31578 - DNA, 20 bp, Artificial Sequence
  chemically synthesized
tacacaaacataggtccata

SEQ ID NO: 31579 - DNA, 20 bp, Artificial Sequence
  chemically synthesized
ccatatagaaattcttacct

SEQ ID NO: 31580 - DNA, 20 bp, Artificial Sequence
  chemically synthesized
tgctctttaaatcctgctaa

SEQ ID NO: 31581 - DNA, 20 bp, Artificial Sequence
  chemically synthesized
tctttaaatcctgctaatgg

SEQ ID NO: 31582 - DNA, 20 bp, Artificial Sequence
  chemically synthesized
atttgtgtctttgtcaccta

SEQ ID NO: 31583 - DNA, 20 bp, Artificial Sequence
  chemically synthesized
tgtcacctacagtacatttc

SEQ ID NO: 31584 - DNA, 20 bp, Artificial Sequence
  chemically synthesized
ctacagtacatttctggatt

SEQ ID NO: 31585 - DNA, 20 bp, Artificial Sequence
  chemically synthesized
tacagtacatttctggattt

SEQ ID NO: 31586 - DNA, 20 bp, Artificial Sequence
  chemically synthesized
acatttctggatttgggaat

SEQ ID NO: 31587 - DNA, 20 bp, Artificial Sequence
  chemically synthesized
atttgggaatgagtgttctt

SEQ ID NO: 31588 - DNA, 20 bp, Artificial Sequence
  chemically synthesized
ttgggaatgagtgttcttca

SEQ ID NO: 31589 - DNA, 20 bp, Artificial Sequence
  chemically synthesized
tgggaatgagtgttcttcag

SEQ ID NO: 31590 - DNA, 20 bp, Artificial Sequence
  chemically synthesized
ttcagaggatcctcgctgcc

SEQ ID NO: 31591 - DNA, 20 bp, Artificial Sequence
  chemically synthesized
tcagaggatcctcgctgccc

SEQ ID NO: 31592 - DNA, 20 bp, Artificial Sequence
  chemically synthesized
tcgctgcccaggttccctgc

SEQ ID NO: 31593 - DNA, 20 bp, Artificial Sequence
  chemically synthesized
ctgcccaggttccctgccag

SEQ ID NO: 31594 - DNA, 20 bp, Artificial Sequence
  chemically synthesized
tgcccaggttccctgccaga

SEQ ID NO: 31595 - DNA, 20 bp, Artificial Sequence
  chemically synthesized
caggttccctgccagaagga

SEQ ID NO: 31596 - DNA, 20 bp, Artificial Sequence
  chemically synthesized
tggcagggaacctgggcagc

SEQ ID NO: 31597 - DNA, 20 bp, Artificial Sequence
  chemically synthesized
gacacaaatgccaccattag

SEQ ID NO: 31598 - DNA, 20 bp, Artificial Sequence
  chemically synthesized
aattggcagtttactaaggt

SEQ ID NO: 31599 - DNA, 20 bp, Artificial Sequence
  chemically synthesized
tctttactgtgtcttgacat

SEQ ID NO: 31600 - DNA, 20 bp, Artificial Sequence
  chemically synthesized
gggaagacaatatggtttct

SEQ ID NO: 31601 - DNA, 20 bp, Artificial Sequence
  chemically synthesized
aaagacttctaattaatcag

SEQ ID NO: 31602 - DNA, 20 bp, Artificial Sequence
  chemically synthesized
tctaattaatcagaagagtg

SEQ ID NO: 31603 - DNA, 20 bp, Artificial Sequence
  chemically synthesized
tagctgtacttagctgattt

SEQ ID NO: 31604 - DNA, 20 bp, Artificial Sequence
  chemically synthesized
aagcatctatgaagaggtgt

SEQ ID NO: 31605 - DNA, 20 bp, Artificial Sequence
  chemically synthesized
tggaacacatctatatttgt

SEQ ID NO: 31606 - DNA, 20 bp, Artificial Sequence
  chemically synthesized
tgaaaataaagtttaaagat

SEQ ID NO: 31607 - DNA, 20 bp, Artificial Sequence
  chemically synthesized
ccagaggaaaaaaaaagtta

SEQ ID NO: 31608 - DNA, 20 bp, Artificial Sequence
  chemically synthesized
ttgcaacactcaacacactt

SEQ ID NO: 31609 - DNA, 20 bp, Artificial Sequence
  chemically synthesized
agtggaaatttgtcgattga

SEQ ID NO: 31610 - DNA, 20 bp, Artificial Sequence
  chemically synthesized
tgtatgtgtgctgctgtaaa

SEQ ID NO: 31611 - DNA, 20 bp, Artificial Sequence
  chemically synthesized
aataccaattgattttagcc

SEQ ID NO: 31612 - DNA, 20 bp, Artificial Sequence
  chemically synthesized
agctccttaagagatataag

SEQ ID NO: 31613 - DNA, 20 bp, Artificial Sequence
  chemically synthesized
gagatataagaagggtggaa

SEQ ID NO: 31614 - DNA, 20 bp, Artificial Sequence
  chemically synthesized
aagaagggtggaagtgggtg

SEQ ID NO: 31615 - DNA, 20 bp, Artificial Sequence
  chemically synthesized
tgggtgaagggtaggccctc

SEQ ID NO: 31616 - DNA, 20 bp, Artificial Sequence
  chemically synthesized
aagtctgggactccaaacgg

SEQ ID NO: 31617 - DNA, 20 bp, Artificial Sequence
  chemically synthesized
tgaagccatggcagaagttc

SEQ ID NO: 31618 - DNA, 20 bp, Artificial Sequence
  chemically synthesized
tcttaatcctgtcagctgag

SEQ ID NO: 31619 - DNA, 20 bp, Artificial Sequence
  chemically synthesized
tggacaccttgaaaaaagaa

SEQ ID NO: 31620 - DNA, 20 bp, Artificial Sequence
  chemically synthesized
aggataacagcaattgttca

SEQ ID NO: 31621 - DNA, 20 bp, Artificial Sequence
  chemically synthesized
agcaaatgggagaaatatcg

SEQ ID NO: 31622 - DNA, 20 bp, Artificial Sequence
  chemically synthesized
catggaacatccctgagaaa

SEQ ID NO: 31623 - DNA, 20 bp, Artificial Sequence
  chemically synthesized
tctcttatggtcgagactgc

SEQ ID NO: 31624 - DNA, 20 bp, Artificial Sequence
  chemically synthesized
accgaaatgtgatgcctccc

SEQ ID NO: 31625 - DNA, 20 bp, Artificial Sequence
  chemically synthesized
gaaaatagaaaagaacctac

SEQ ID NO: 31626 - DNA, 20 bp, Artificial Sequence
  chemically synthesized
ggcgtggagatgtaacaagc

SEQ ID NO: 31627 - DNA, 20 bp, Artificial Sequence
  chemically synthesized
gatgtaacaagcctggatgt

SEQ ID NO: 31628 - DNA, 20 bp, Artificial Sequence
  chemically synthesized
atttggaagaaatatcagat

SEQ ID NO: 31629 - DNA, 20 bp, Artificial Sequence
  chemically synthesized
taaaagcagcagcatgcagt

SEQ ID NO: 31630 - DNA, 20 bp, Artificial Sequence
  chemically synthesized
aaccccatgctcaccatcaa

SEQ ID NO: 31631 - DNA, 20 bp, Artificial Sequence
  chemically synthesized
catgctcaccatcaacggga

SEQ ID NO: 31632 - DNA, 20 bp, Artificial Sequence
  chemically synthesized
gggattgaatttgagctgct

SEQ ID NO: 31633 - DNA, 20 bp, Artificial Sequence
  chemically synthesized
ttatcttcaattctgtgaaa

SEQ ID NO: 31634 - DNA, 20 bp, Artificial Sequence
  chemically synthesized
tgcaagagaggaaggaaggc

SEQ ID NO: 31635 - DNA, 20 bp, Artificial Sequence
  chemically synthesized
agctttctggcaggcactgg

SEQ ID NO: 31636 - DNA, 20 bp, Artificial Sequence
  chemically synthesized
tgtaactggtggccttagaa

SEQ ID NO: 31637 - DNA, 20 bp, Artificial Sequence
  chemically synthesized
ggtggccttagaagagggtt

SEQ ID NO: 31638 - DNA, 20 bp, Artificial Sequence
  chemically synthesized
cagggttatgtgtttggaac

SEQ ID NO: 31639 - DNA, 20 bp, Artificial Sequence
  chemically synthesized
gccaccaagcaccaagaggt

SEQ ID NO: 31640 - DNA, 20 bp, Artificial Sequence
  chemically synthesized
agcaccaagaggtgtgagtt

SEQ ID NO: 31641 - DNA, 20 bp, Artificial Sequence
  chemically synthesized
aaagaggaaggtgaaaactg

SEQ ID NO: 31642 - DNA, 20 bp, Artificial Sequence
  chemically synthesized
atcccctgagagaaaaagta

SEQ ID NO: 31643 - DNA, 20 bp, Artificial Sequence
  chemically synthesized
cccctcacggccaaaggcat

SEQ ID NO: 31644 - DNA, 20 bp, Artificial Sequence
  chemically synthesized
ccagacattgagctcaagga

SEQ ID NO: 31645 - DNA, 20 bp, Artificial Sequence
  chemically synthesized
gtttgtatgttttctacagt

SEQ ID NO: 31646 - DNA, 20 bp, Artificial Sequence
  chemically synthesized
gttttctacagttcggattt

SEQ ID NO: 31647 - DNA, 20 bp, Artificial Sequence
  chemically synthesized
atgatttcatttcttttcga

SEQ ID NO: 31648 - DNA, 20 bp, Artificial Sequence
  chemically synthesized
tatgcatactttctaaatgc

SEQ ID NO: 31649 - DNA, 20 bp, Artificial Sequence
  chemically synthesized
catcagctctttggcagctt

SEQ ID NO: 31650 - DNA, 20 bp, Artificial Sequence
  chemically synthesized
tttaattctcacctggtccc

SEQ ID NO: 31651 - DNA, 20 bp, Artificial Sequence
  chemically synthesized
ccaggatatggtttacttgt

SEQ ID NO: 31652 - DNA, 20 bp, Artificial Sequence
  chemically synthesized
tgaaggaaagagagagaagt

SEQ ID NO: 31653 - DNA, 20 bp, Artificial Sequence
  chemically synthesized
attttttttttctgtggaaa

SEQ ID NO: 31654 - DNA, 20 bp, Artificial Sequence
  chemically synthesized
ttgcacattatcgcagtagg

SEQ ID NO: 31655 - DNA, 20 bp, Artificial Sequence
  chemically synthesized
tggcttaacccctgaaacct

SEQ ID NO: 31656 - DNA, 20 bp, Artificial Sequence
  chemically synthesized
agacttttgcatatataatt

SEQ ID NO: 31657 - DNA, 20 bp, Artificial Sequence
  chemically synthesized
gcatatataattaaggatct

SEQ ID NO: 31658 - DNA, 20 bp, Artificial Sequence
  chemically synthesized
tggggagatatcctaattat

SEQ ID NO: 31659 - DNA, 20 bp, Artificial Sequence
  chemically synthesized
gaggaagaggctacaaacca

SEQ ID NO: 31660 - DNA, 20 bp, Artificial Sequence
  chemically synthesized
gaggctacaaaccaaggaat

SEQ ID NO: 31661 - DNA, 20 bp, Artificial Sequence
  chemically synthesized
gtagcctctagaagaggaaa

SEQ ID NO: 31662 - DNA, 20 bp, Artificial Sequence
  chemically synthesized
caggaaaacacaatctctca

SEQ ID NO: 31663 - DNA, 20 bp, Artificial Sequence
  chemically synthesized
gcaagaggaaatcagttacg

SEQ ID NO: 31664 - DNA, 20 bp, Artificial Sequence
  chemically synthesized
tcctgtctctggctaatcat

SEQ ID NO: 31665 - DNA, 20 bp, Artificial Sequence
  chemically synthesized
tacatacagacccagagcca

SEQ ID NO: 31666 - DNA, 20 bp, Artificial Sequence
  chemically synthesized
agacccagagccagtgaatc

SEQ ID NO: 31667 - DNA, 20 bp, Artificial Sequence
  chemically synthesized
ttggtggtggggcccagagc

SEQ ID NO: 31668 - DNA, 20 bp, Artificial Sequence
  chemically synthesized
aagcaacttactcaaataca

SEQ ID NO: 31669 - DNA, 20 bp, Artificial Sequence
  chemically synthesized
taattttattactttatctt

SEQ ID NO: 31670 - DNA, 20 bp, Artificial Sequence
  chemically synthesized
attatataatgtttattgat

SEQ ID NO: 31671 - DNA, 20 bp, Artificial Sequence
  chemically synthesized
tataatgtttattgattaga

SEQ ID NO: 31672 - DNA, 20 bp, Artificial Sequence
  chemically synthesized
gtgttcagattcctgacctc

SEQ ID NO: 31673 - DNA, 20 bp, Artificial Sequence
  chemically synthesized
agattagacagcaggcaggg

SEQ ID NO: 31674 - DNA, 20 bp, Artificial Sequence
  chemically synthesized
aagttgcttaaacatgacag

SEQ ID NO: 31675 - DNA, 20 bp, Artificial Sequence
  chemically synthesized
gcttaaacatgacagcagga

SEQ ID NO: 31676 - DNA, 20 bp, Artificial Sequence
  chemically synthesized
acctctgctgaacttcctca

SEQ ID NO: 31677 - DNA, 20 bp, Artificial Sequence
  chemically synthesized
tccataaatccaaccaccgc

SEQ ID NO: 31678 - DNA, 20 bp, Artificial Sequence
  chemically synthesized
caaatttggctgacacagtt

SEQ ID NO: 31679 - DNA, 20 bp, Artificial Sequence
  chemically synthesized
gcactagcacaaaatatttg

SEQ ID NO: 31680 - DNA, 20 bp, Artificial Sequence
  chemically synthesized
acaaaatatttgctgaatga

SEQ ID NO: 31681 - DNA, 20 bp, Artificial Sequence
  chemically synthesized
tatttgctgaatgaaagaat

SEQ ID NO: 31682 - DNA, 20 bp, Artificial Sequence
  chemically synthesized
caaagtcttttactccggtg

SEQ ID NO: 31683 - DNA, 20 bp, Artificial Sequence
  chemically synthesized
actccggtgtggagtgtttt

SEQ ID NO: 31684 - DNA, 20 bp, Artificial Sequence
  chemically synthesized
gaaacacctccccttaactg

SEQ ID NO: 31685 - DNA, 20 bp, Artificial Sequence
  chemically synthesized
ttcagggaagatgtctgttg

SEQ ID NO: 31686 - DNA, 20 bp, Artificial Sequence
  chemically synthesized
ctataccccagatttatttt

SEQ ID NO: 31687 - DNA, 20 bp, Artificial Sequence
  chemically synthesized
ccagatttattttgaggatt

SEQ ID NO: 31688 - DNA, 20 bp, Artificial Sequence
  chemically synthesized
attgcgtattactaaaaaga

SEQ ID NO: 31689 - DNA, 20 bp, Artificial Sequence
  chemically synthesized
caatgggaaggtgtcagagc

SEQ ID NO: 31690 - DNA, 20 bp, Artificial Sequence
  chemically synthesized
ccgtagtggaggggagctct

SEQ ID NO: 31691 - DNA, 20 bp, Artificial Sequence
  chemically synthesized
aattgaaatgaacaaaggca

SEQ ID NO: 31692 - DNA, 20 bp, Artificial Sequence
  chemically synthesized
acagggaagcctctgaacac

SEQ ID NO: 31693 - DNA, 20 bp, Artificial Sequence
  chemically synthesized
cttcaggaaacccaggccca

SEQ ID NO: 31694 - DNA, 20 bp, Artificial Sequence
  chemically synthesized
tttctccttcaaaccactct

SEQ ID NO: 31695 - DNA, 20 bp, Artificial Sequence
  chemically synthesized
gcgtcactcaaactagctga

SEQ ID NO: 31696 - DNA, 20 bp, Artificial Sequence
  chemically synthesized
taggcttatttcaaaaggca

SEQ ID NO: 31697 - DNA, 20 bp, Artificial Sequence
  chemically synthesized
agtgcctgctgtgtgtggtg

SEQ ID NO: 31698 - DNA, 20 bp, Artificial Sequence
  chemically synthesized
taggaaggaacagggcagtg

SEQ ID NO: 31699 - DNA, 20 bp, Artificial Sequence
  chemically synthesized
ctgccctgttccttcctagc

SEQ ID NO: 31700 - DNA, 20 bp, Artificial Sequence
  chemically synthesized
gcctgagtcaggactgagca

SEQ ID NO: 31701 - DNA, 20 bp, Artificial Sequence
  chemically synthesized
gaaataagcctacttttaac

SEQ ID NO: 31702 - DNA, 20 bp, Artificial Sequence
  chemically synthesized
gctggactttgtccctgtgt

SEQ ID NO: 31703 - DNA, 20 bp, Artificial Sequence
  chemically synthesized
agacaattctttcagctagt

SEQ ID NO: 31704 - DNA, 20 bp, Artificial Sequence
  chemically synthesized
cgcagtgaagcagtgggaac

SEQ ID NO: 31705 - DNA, 20 bp, Artificial Sequence
  chemically synthesized
agtgggaaccggaatatcca

SEQ ID NO: 31706 - DNA, 20 bp, Artificial Sequence
  chemically synthesized
tggctttatatcctctgggc

SEQ ID NO: 31707 - DNA, 20 bp, Artificial Sequence
  chemically synthesized
atagaggagagagaaaatgg

SEQ ID NO: 31708 - DNA, 20 bp, Artificial Sequence
  chemically synthesized
atggaagtttctgagaactt

SEQ ID NO: 31709 - DNA, 20 bp, Artificial Sequence
  chemically synthesized
ttctgagaacttcagggtat

SEQ ID NO: 31710 - DNA, 20 bp, Artificial Sequence
  chemically synthesized
ctatttagttaattaaggct

SEQ ID NO: 31711 - DNA, 20 bp, Artificial Sequence
  chemically synthesized
tacgcaattgaaaagtatgt

SEQ ID NO: 31712 - DNA, 20 bp, Artificial Sequence
  chemically synthesized
aggtgctaagcattttagct

SEQ ID NO: 31713 - DNA, 20 bp, Artificial Sequence
  chemically synthesized
cataatcctcaaaataaatc

SEQ ID NO: 31714 - DNA, 20 bp, Artificial Sequence
  chemically synthesized
atagatgacttgattagaag

SEQ ID NO: 31715 - DNA, 20 bp, Artificial Sequence
  chemically synthesized
tgattagaagcagggtatgt

SEQ ID NO: 31716 - DNA, 20 bp, Artificial Sequence
  chemically synthesized
gtatcttaaggcaaggaaaa

SEQ ID NO: 31717 - DNA, 20 bp, Artificial Sequence
  chemically synthesized
gcctagtgcccaggccaggc

SEQ ID NO: 31718 - DNA, 20 bp, Artificial Sequence
  chemically synthesized
ccccacaacagacatcttcc

SEQ ID NO: 31719 - DNA, 20 bp, Artificial Sequence
  chemically synthesized
acagacatcttccctgaatg

SEQ ID NO: 31720 - DNA, 20 bp, Artificial Sequence
  chemically synthesized
ctaatgccctctaactgatg

SEQ ID NO: 31721 - DNA, 20 bp, Artificial Sequence
  chemically synthesized
tctaactgatgctgagtttg

SEQ ID NO: 31722 - DNA, 20 bp, Artificial Sequence
  chemically synthesized
tcagttaaggggaggtgttt

SEQ ID NO: 31723 - DNA, 20 bp, Artificial Sequence
  chemically synthesized
gggaggtgtttctgagtttg

SEQ ID NO: 31724 - DNA, 20 bp, Artificial Sequence
  chemically synthesized
caaacaccttcctaattggt

SEQ ID NO: 31725 - DNA, 20 bp, Artificial Sequence
  chemically synthesized
atcctgaaaacactccacac

SEQ ID NO: 31726 - DNA, 20 bp, Artificial Sequence
  chemically synthesized
agattaatatcgtagatgaa

SEQ ID NO: 31727 - DNA, 20 bp, Artificial Sequence
  chemically synthesized
tgaactgagtctgggctagg

SEQ ID NO: 31728 - DNA, 20 bp, Artificial Sequence
  chemically synthesized
taaaggagcctgtacctaaa

SEQ ID NO: 31729 - DNA, 20 bp, Artificial Sequence
  chemically synthesized
actggcaaagtgaggaagga

SEQ ID NO: 31730 - DNA, 20 bp, Artificial Sequence
  chemically synthesized
gaaggacggggtctggaggg

SEQ ID NO: 31731 - DNA, 20 bp, Artificial Sequence
  chemically synthesized
gacggggtctggagggaaga

SEQ ID NO: 31732 - DNA, 20 bp, Artificial Sequence
  chemically synthesized
gtgcaaaggcacagcacata

SEQ ID NO: 31733 - DNA, 20 bp, Artificial Sequence
  chemically synthesized
tacagaatgcctgcatgctc

SEQ ID NO: 31734 - DNA, 20 bp, Artificial Sequence
  chemically synthesized
caaaactgtgtcagccaaat

SEQ ID NO: 31735 - DNA, 20 bp, Artificial Sequence
  chemically synthesized
ctgagatacccaggcggtgg

SEQ ID NO: 31736 - DNA, 20 bp, Artificial Sequence
  chemically synthesized
cccaggcggtggttggattt

SEQ ID NO: 31737 - DNA, 20 bp, Artificial Sequence
  chemically synthesized
cggtggttggatttatggat

SEQ ID NO: 31738 - DNA, 20 bp, Artificial Sequence
  chemically synthesized
tttatggatctggatttcag

SEQ ID NO: 31739 - DNA, 20 bp, Artificial Sequence
  chemically synthesized
aggggagtgggcagggctag

SEQ ID NO: 31740 - DNA, 20 bp, Artificial Sequence
  chemically synthesized
agggctaggggaatagaact

SEQ ID NO: 31741 - DNA, 20 bp, Artificial Sequence
  chemically synthesized
agggtcatgatgtcagtggt

SEQ ID NO: 31742 - DNA, 20 bp, Artificial Sequence
  chemically synthesized
ggagttgaagtcttggaaga

SEQ ID NO: 31743 - DNA, 20 bp, Artificial Sequence
  chemically synthesized
aaaggttaactccagaggtc

SEQ ID NO: 31744 - DNA, 20 bp, Artificial Sequence
  chemically synthesized
tcttttatttcttcatttta

SEQ ID NO: 31745 - DNA, 20 bp, Artificial Sequence
  chemically synthesized
catttacacaaaagtacaac

SEQ ID NO: 31746 - DNA, 20 bp, Artificial Sequence
  chemically synthesized
aaatgaaataccctatgtat

SEQ ID NO: 31747 - DNA, 20 bp, Artificial Sequence
  chemically synthesized
aaatccttgattcactggct

SEQ ID NO: 31748 - DNA, 20 bp, Artificial Sequence
  chemically synthesized
gtctgtatgtaacaagcttc

SEQ ID NO: 31749 - DNA, 20 bp, Artificial Sequence
  chemically synthesized
tgtgttttcctgccttttcc

SEQ ID NO: 31750 - DNA, 20 bp, Artificial Sequence
  chemically synthesized
atgacacttgtgattacatt

SEQ ID NO: 31751 - DNA, 20 bp, Artificial Sequence
  chemically synthesized
ttaggatacacccaaataat

SEQ ID NO: 31752 - DNA, 20 bp, Artificial Sequence
  chemically synthesized
agataatactcacaggtttc

SEQ ID NO: 31753 - DNA, 20 bp, Artificial Sequence
  chemically synthesized
gttaagccatacatatcttt

SEQ ID NO: 31754 - DNA, 20 bp, Artificial Sequence
  chemically synthesized
tcatctcatcaggtgttacc

SEQ ID NO: 31755 - DNA, 20 bp, Artificial Sequence
  chemically synthesized
catcaggtgttacctagaat

SEQ ID NO: 31756 - DNA, 20 bp, Artificial Sequence
  chemically synthesized
ccatatcctggggaccaggt

SEQ ID NO: 31757 - DNA, 20 bp, Artificial Sequence
  chemically synthesized
actgaagtcacatggagctc

SEQ ID NO: 31758 - DNA, 20 bp, Artificial Sequence
  chemically synthesized
aatgaaatcatatttttctg

SEQ ID NO: 31759 - DNA, 20 bp, Artificial Sequence
  chemically synthesized
aggcactgaaccagctggaa

SEQ ID NO: 31760 - DNA, 20 bp, Artificial Sequence
  chemically synthesized
aaccagctggaaatgaatgc

SEQ ID NO: 31761 - DNA, 20 bp, Artificial Sequence
  chemically synthesized
attttcgcagctgataaaag

SEQ ID NO: 31762 - DNA, 20 bp, Artificial Sequence
  chemically synthesized
aatgtctggagaaagcagct

SEQ ID NO: 31763 - DNA, 20 bp, Artificial Sequence
  chemically synthesized
actctgtactttttctctca

SEQ ID NO: 31764 - DNA, 20 bp, Artificial Sequence
  chemically synthesized
cctgcagctaagattgagaa

SEQ ID NO: 31765 - DNA, 20 bp, Artificial Sequence
  chemically synthesized
cctattttttaaagcacagt

SEQ ID NO: 31766 - DNA, 20 bp, Artificial Sequence
  chemically synthesized
ttctaaggccaccagttaca

SEQ ID NO: 31767 - DNA, 20 bp, Artificial Sequence
  chemically synthesized
acaaagaatggggaaggtta

SEQ ID NO: 31768 - DNA, 20 bp, Artificial Sequence
  chemically synthesized
tggtctaaaattccatttca

SEQ ID NO: 31769 - DNA, 20 bp, Artificial Sequence
  chemically synthesized
tcacagaattgaagataatt

SEQ ID NO: 31770 - DNA, 20 bp, Artificial Sequence
  chemically synthesized
aatcccgttgatggtgagca

SEQ ID NO: 31771 - DNA, 20 bp, Artificial Sequence
  chemically synthesized
gtgagcatggggttcatttt

SEQ ID NO: 31772 - DNA, 20 bp, Artificial Sequence
  chemically synthesized
ttcattttgagagtagaaaa

SEQ ID NO: 31773 - DNA, 20 bp, Artificial Sequence
  chemically synthesized
gtagaaaattggatgcagtg

SEQ ID NO: 31774 - DNA, 20 bp, Artificial Sequence
  chemically synthesized
aattggatgcagtggagaat

SEQ ID NO: 31775 - DNA, 20 bp, Artificial Sequence
  chemically synthesized
tgcagtggagaatcagaatg

SEQ ID NO: 31776 - DNA, 20 bp, Artificial Sequence
  chemically synthesized
attttcaaatatacaaaata

SEQ ID NO: 31777 - DNA, 20 bp, Artificial Sequence
  chemically synthesized
atattgagtctgaaggcaaa

SEQ ID NO: 31778 - DNA, 20 bp, Artificial Sequence
  chemically synthesized
cttgttacatctccacgcca

SEQ ID NO: 31779 - DNA, 20 bp, Artificial Sequence
  chemically synthesized
caactttagaaataaaggga

SEQ ID NO: 31780 - DNA, 20 bp, Artificial Sequence
  chemically synthesized
aaaaccagcaagtttgtatt

SEQ ID NO: 31781 - DNA, 20 bp, Artificial Sequence
  chemically synthesized
gaggcagtgtgcaaataggt

SEQ ID NO: 31782 - DNA, 20 bp, Artificial Sequence
  chemically synthesized
tcaagtactttacaaggtaa

SEQ ID NO: 31783 - DNA, 20 bp, Artificial Sequence
  chemically synthesized
tatcacaaggcaagtggagg

SEQ ID NO: 31784 - DNA, 20 bp, Artificial Sequence
  chemically synthesized
gataacatcttatcaggaga

SEQ ID NO: 31785 - DNA, 20 bp, Artificial Sequence
  chemically synthesized
ttatcaggagacagggtttt

SEQ ID NO: 31786 - DNA, 20 bp, Artificial Sequence
  chemically synthesized
ctgaccaaaatttattaggc

SEQ ID NO: 31787 - DNA, 20 bp, Artificial Sequence
  chemically synthesized
ctgggagcgctgtgggagac

SEQ ID NO: 31788 - DNA, 20 bp, Artificial Sequence
  chemically synthesized
tggctcgtattctctttctc

SEQ ID NO: 31789 - DNA, 20 bp, Artificial Sequence
  chemically synthesized
ggatgttccatgctgagaaa

SEQ ID NO: 31790 - DNA, 20 bp, Artificial Sequence
  chemically synthesized
ctgcctggctcaccagcagt

SEQ ID NO: 31791 - DNA, 20 bp, Artificial Sequence
  chemically synthesized
tgcagttaatgcaattatta

SEQ ID NO: 31792 - DNA, 20 bp, Artificial Sequence
  chemically synthesized
tatacatcctcctcagctga

SEQ ID NO: 31793 - DNA, 20 bp, Artificial Sequence
  chemically synthesized
taaagacaggcataaatcac

SEQ ID NO: 31794 - DNA, 20 bp, Artificial Sequence
  chemically synthesized
cttcagctgatccctccgtt

SEQ ID NO: 31795 - DNA, 20 bp, Artificial Sequence
  chemically synthesized
ggtatttaagttagagcaaa

SEQ ID NO: 31796 - DNA, 20 bp, Artificial Sequence
  chemically synthesized
cagcacacatacacttacat

SEQ ID NO: 31797 - DNA, 20 bp, Artificial Sequence
  chemically synthesized
cacaagaactcacaagtgtg

SEQ ID NO: 31798 - DNA, 20 bp, Artificial Sequence
  chemically synthesized
acaagtgtgttgagtgttgc

SEQ ID NO: 31799 - DNA, 20 bp, Artificial Sequence
  chemically synthesized
cctttaactttttttttcct

SEQ ID NO: 31800 - DNA, 20 bp, Artificial Sequence
  chemically synthesized
taaagtgaagagatggcaat

SEQ ID NO: 31801 - DNA, 20 bp, Artificial Sequence
  chemically synthesized
tacagcaaggctagtttgga

SEQ ID NO: 31802 - DNA, 20 bp, Artificial Sequence
  chemically synthesized
tttggagagggttttgctgt

SEQ ID NO: 31803 - DNA, 20 bp, Artificial Sequence
  chemically synthesized
atgctttttcttttttttcc

SEQ ID NO: 31804 - DNA, 20 bp, Artificial Sequence
  chemically synthesized
cccagagtttgaaagggaaa

SEQ ID NO: 31805 - DNA, 20 bp, Artificial Sequence
  chemically synthesized
caaatcagctaagtacagct

SEQ ID NO: 31806 - DNA, 20 bp, Artificial Sequence
  chemically synthesized
ttgtcacctacagtacattt

SEQ ID NO: 31807 - DNA, 20 bp, Artificial Sequence
  chemically synthesized
tacagtacatttctggattt

SEQ ID NO: 31808 - DNA, 20 bp, Artificial Sequence
  chemically synthesized
gtacatttctggatttggga

SEQ ID NO: 31809 - DNA, 20 bp, Artificial Sequence
  chemically synthesized
ttgggaatgagtgttcttca

SEQ ID NO: 31810 - DNA, 20 bp, Artificial Sequence
  chemically synthesized
aagaacactcattcccaaat

SEQ ID NO: 31811 - DNA, 20 bp, Artificial Sequence
  chemically synthesized
agcaggatttaaagagcatt

SEQ ID NO: 31812 - DNA, 20 bp, Artificial Sequence
  chemically synthesized
aaattggcagtttactaagg

SEQ ID NO: 31813 - DNA, 20 bp, Artificial Sequence
  chemically synthesized
ctttcaaactctgggaaaaa

SEQ ID NO: 31814 - DNA, 20 bp, Artificial Sequence
  chemically synthesized
tcttctttcaaaagcaaatg

SEQ ID NO: 31815 - DNA, 20 bp, Artificial Sequence
  chemically synthesized
ttctcagcatggaacatccc

SEQ ID NO: 31816 - DNA, 20 bp, Artificial Sequence
  chemically synthesized
gcatggaacatccctgagaa

SEQ ID NO: 31817 - DNA, 20 bp, Artificial Sequence
  chemically synthesized
ttggccgacgcttagggaaa

SEQ ID NO: 31818 - DNA, 20 bp, Artificial Sequence
  chemically synthesized
ccaacaacagtctgtatttg

SEQ ID NO: 31819 - DNA, 20 bp, Artificial Sequence
  chemically synthesized
cgggattgaatttgagctgc

SEQ ID NO: 31820 - DNA, 20 bp, Artificial Sequence
  chemically synthesized
actgtgctttaaaaaatagg

SEQ ID NO: 31821 - DNA, 20 bp, Artificial Sequence
  chemically synthesized
tttaaaaaataggaaagaaa

SEQ ID NO: 31822 - DNA, 20 bp, Artificial Sequence
  chemically synthesized
ttggtttttctaatcccctg

SEQ ID NO: 31823 - DNA, 20 bp, Artificial Sequence
  chemically synthesized
tccagacattgagctcaagg

SEQ ID NO: 31824 - DNA, 20 bp, Artificial Sequence
  chemically synthesized
tttctgaataatttgatccg

SEQ ID NO: 31825 - DNA, 20 bp, Artificial Sequence
  chemically synthesized
tatgatttcatttcttttcg

SEQ ID NO: 31826 - DNA, 20 bp, Artificial Sequence
  chemically synthesized
atatgcatactttctaaatg

SEQ ID NO: 31827 - DNA, 20 bp, Artificial Sequence
  chemically synthesized
gggagatttgacttataaga

SEQ ID NO: 31828 - DNA, 20 bp, Artificial Sequence
  chemically synthesized
ggtagcctctagaagaggaa

SEQ ID NO: 31829 - DNA, 20 bp, Artificial Sequence
  chemically synthesized
aatctctcatagagtctcca

SEQ ID NO: 31830 - DNA, 20 bp, Artificial Sequence
  chemically synthesized
agcaagaggaaatcagttac

SEQ ID NO: 31831 - DNA, 20 bp, Artificial Sequence
  chemically synthesized
gtcctgtctctggctaatca

SEQ ID NO: 31832 - DNA, 20 bp, Artificial Sequence
  chemically synthesized
tattaagcaagttcttcgtt

SEQ ID NO: 31833 - DNA, 20 bp, Artificial Sequence
  chemically synthesized
gttgacatattcattaaaat

SEQ ID NO: 31834 - DNA, 20 bp, Artificial Sequence
  chemically synthesized
taaaatgaagaaataaaaga

SEQ ID NO: 31835 - DNA, 20 bp, Artificial Sequence
  chemically synthesized
aattatataatgtttattga

SEQ ID NO: 31836 - DNA, 20 bp, Artificial Sequence
  chemically synthesized
aagattagacagcaggcagg

SEQ ID NO: 31837 - DNA, 20 bp, Artificial Sequence
  chemically synthesized
aacctctgctgaacttcctc

SEQ ID NO: 31838 - DNA, 20 bp, Artificial Sequence
  chemically synthesized
acttcctcatagaatgttca

SEQ ID NO: 31839 - DNA, 20 bp, Artificial Sequence
  chemically synthesized
cacaaaatatttgctgaatg

SEQ ID NO: 31840 - DNA, 20 bp, Artificial Sequence
  chemically synthesized
aggtgtttgattcttcaaac

SEQ ID NO: 31841 - DNA, 20 bp, Artificial Sequence
  chemically synthesized
gggttgggaaaaagacatag

SEQ ID NO: 31842 - DNA, 20 bp, Artificial Sequence
  chemically synthesized
actctgataccctgaagttc

SEQ ID NO: 31843 - DNA, 20 bp, Artificial Sequence
  chemically synthesized
tgcgtcactcaaactagctg

SEQ ID NO: 31844 - DNA, 20 bp, Artificial Sequence
  chemically synthesized
gtaggcttatttcaaaaggc

SEQ ID NO: 31845 - DNA, 20 bp, Artificial Sequence
  chemically synthesized
agcctgagtcaggactgagc

SEQ ID NO: 31846 - DNA, 20 bp, Artificial Sequence
  chemically synthesized
tatccaaagagtggtttgaa

SEQ ID NO: 31847 - DNA, 20 bp, Artificial Sequence
  chemically synthesized
agtcaccacacatagaggag

SEQ ID NO: 31848 - DNA, 20 bp, Artificial Sequence
  chemically synthesized
gaaaatggctgagttaaagg

SEQ ID NO: 31849 - DNA, 20 bp, Artificial Sequence
  chemically synthesized
caagggaaaggtgataaagg

SEQ ID NO: 31850 - DNA, 20 bp, Artificial Sequence
  chemically synthesized
gagagaggttcttgtttcaa

SEQ ID NO: 31851 - DNA, 20 bp, Artificial Sequence
  chemically synthesized
ggtatcttaaggcaaggaaa

SEQ ID NO: 31852 - DNA, 20 bp, Artificial Sequence
  chemically synthesized
ctctaactgatgctgagttt

SEQ ID NO: 31853 - DNA, 20 bp, Artificial Sequence
  chemically synthesized
ggggaggtgtttctgagttt

SEQ ID NO: 31854 - DNA, 20 bp, Artificial Sequence
  chemically synthesized
agtgcaaaggcacagcacat

SEQ ID NO: 31855 - DNA, 20 bp, Artificial Sequence
  chemically synthesized
atacagaatgcctgcatgct

SEQ ID NO: 31856 - DNA, 20 bp, Artificial Sequence
  chemically synthesized
tggtaggagttgaagtcttg

SEQ ID NO: 31857 - DNA, 20 bp, Artificial Sequence
  chemically synthesized
agtcttggaagaaagagtag

SEQ ID NO: 31858 - DNA, 20 bp, Artificial Sequence
  chemically synthesized
gcctgctgtctaatctttac

SEQ ID NO: 31859 - DNA, 20 bp, Artificial Sequence
  chemically synthesized
cagaggtcaggaatctgaac

SEQ ID NO: 31860 - DNA, 20 bp, Artificial Sequence
  chemically synthesized
acacaaaagtacaactgggg

SEQ ID NO: 31861 - DNA, 20 bp, Artificial Sequence
  chemically synthesized
atatgcaaaagtctgtttgg

SEQ ID NO: 31862 - DNA, 20 bp, Artificial Sequence
  chemically synthesized
tatgttcccatcaaggttaa

SEQ ID NO: 31863 - DNA, 20 bp, Artificial Sequence
  chemically synthesized
aaatattagactctttttcc

SEQ ID NO: 31864 - DNA, 20 bp, Artificial Sequence
  chemically synthesized
ttcatctcatcaggtgttac

SEQ ID NO: 31865 - DNA, 20 bp, Artificial Sequence
  chemically synthesized
gttacctagaatcagagtca

SEQ ID NO: 31866 - DNA, 20 bp, Artificial Sequence
  chemically synthesized
accatatcctggggaccagg

SEQ ID NO: 31867 - DNA, 20 bp, Artificial Sequence
  chemically synthesized
tcaggaatttattcttgcat

SEQ ID NO: 31868 - DNA, 20 bp, Artificial Sequence
  chemically synthesized
tatgcatataattctctcga

SEQ ID NO: 31869 - DNA, 20 bp, Artificial Sequence
  chemically synthesized
tttctgtcggatcaaattat

SEQ ID NO: 31870 - DNA, 20 bp, Artificial Sequence
  chemically synthesized
attattcagaaatccgaact

SEQ ID NO: 31871 - DNA, 20 bp, Artificial Sequence
  chemically synthesized
tgtccttgagctcaatgtct

SEQ ID NO: 31872 - DNA, 20 bp, Artificial Sequence
  chemically synthesized
gtactttttctctcagggga

SEQ ID NO: 31873 - DNA, 20 bp, Artificial Sequence
  chemically synthesized
caatgccctgcagctaagat

SEQ ID NO: 31874 - DNA, 20 bp, Artificial Sequence
  chemically synthesized
cttctaaggccaccagttac

SEQ ID NO: 31875 - DNA, 20 bp, Artificial Sequence
  chemically synthesized
agtaactccaccagtgcctg

SEQ ID NO: 31876 - DNA, 20 bp, Artificial Sequence
  chemically synthesized
ccttccttcctctcttgcag

SEQ ID NO: 31877 - DNA, 20 bp, Artificial Sequence
  chemically synthesized
ctggtctaaaattccatttc

SEQ ID NO: 31878 - DNA, 20 bp, Artificial Sequence
  chemically synthesized
gcatggggttcattttgaga

SEQ ID NO: 31879 - DNA, 20 bp, Artificial Sequence
  chemically synthesized
agtagaaaattggatgcagt

SEQ ID NO: 31880 - DNA, 20 bp, Artificial Sequence
  chemically synthesized
aaattggatgcagtggagaa

SEQ ID NO: 31881 - DNA, 20 bp, Artificial Sequence
  chemically synthesized
aatattgagtctgaaggcaa

SEQ ID NO: 31882 - DNA, 20 bp, Artificial Sequence
  chemically synthesized
tccctaagcgtcggccaact

SEQ ID NO: 31883 - DNA, 20 bp, Artificial Sequence
  chemically synthesized
aaagggacagagtacaaaag

SEQ ID NO: 31884 - DNA, 20 bp, Artificial Sequence
  chemically synthesized
atcaagtactttacaaggta

SEQ ID NO: 31885 - DNA, 20 bp, Artificial Sequence
  chemically synthesized
ttctcagggatgttccatgc

SEQ ID NO: 31886 - DNA, 20 bp, Artificial Sequence
  chemically synthesized
gggatgttccatgctgagaa

SEQ ID NO: 31887 - DNA, 20 bp, Artificial Sequence
  chemically synthesized
tcccatttgcttttgaaaga

SEQ ID NO: 31888 - DNA, 20 bp, Artificial Sequence
  chemically synthesized
gattgcagtaaagacaggca

SEQ ID NO: 31889 - DNA, 20 bp, Artificial Sequence
  chemically synthesized
gcagcacacatacacttaca

SEQ ID NO: 31890 - DNA, 20 bp, Artificial Sequence
  chemically synthesized
ctctccatgacttacctggt

SEQ ID NO: 31891 - DNA, 20 bp, Artificial Sequence
  chemically synthesized
attagaagtctttaaaattc

SEQ ID NO: 31892 - DNA, 20 bp, Artificial Sequence
  chemically synthesized
atacacaaacataggtccat

SEQ ID NO: 31893 - DNA, 20 bp, Artificial Sequence
  chemically synthesized
tgtgggtccaaccctgacag

SEQ ID NO: 31894 - DNA, 20 bp, Artificial Sequence
  chemically synthesized
tggtcagaccagttgatcct

SEQ ID NO: 31895 - DNA, 20 bp, Artificial Sequence
  chemically synthesized
cattggctaaagaggaaggt

SEQ ID NO: 31896 - DNA, 20 bp, Artificial Sequence
  chemically synthesized
agaatccatggaaaaggcag

SEQ ID NO: 31897 - DNA, 20 bp, Artificial Sequence
  chemically synthesized
tcctcatagaatgttcatca

SEQ ID NO: 31898 - DNA, 20 bp, Artificial Sequence
  chemically synthesized
tttagtcaggcataaagata

SEQ ID NO: 31899 - DNA, 20 bp, Artificial Sequence
  chemically synthesized
aacacttaggaacaaactgt

SEQ ID NO: 31900 - DNA, 20 bp, Artificial Sequence
  chemically synthesized
gactggtatcttaaggcaag

SEQ ID NO: 31901 - DNA, 20 bp, Artificial Sequence
  chemically synthesized
cagaatatgtccctaatatc

SEQ ID NO: 31902 - DNA, 20 bp, Artificial Sequence
  chemically synthesized
tcctaattggtaggaatcct

SEQ ID NO: 31903 - DNA, 20 bp, Artificial Sequence
  chemically synthesized
tgcctgcatgctctagaatc

SEQ ID NO: 31904 - DNA, 20 bp, Artificial Sequence
  chemically synthesized
aggtcaggaatctgaacaca

SEQ ID NO: 31905 - DNA, 20 bp, Artificial Sequence
  chemically synthesized
aataaacattatataatttt

SEQ ID NO: 31906 - DNA, 20 bp, Artificial Sequence
  chemically synthesized
aaccttggtttcctcatttc

SEQ ID NO: 31907 - DNA, 20 bp, Artificial Sequence
  chemically synthesized
ttaccacaaatttattggct

SEQ ID NO: 31908 - DNA, 20 bp, Artificial Sequence
  chemically synthesized
agtcaggagaaagcacctca

SEQ ID NO: 31909 - DNA, 20 bp, Artificial Sequence
  chemically synthesized
attcagaaatccgaactgta

SEQ ID NO: 31910 - DNA, 20 bp, Artificial Sequence
  chemically synthesized
tttttctctcaggggattag

SEQ ID NO: 31911 - DNA, 20 bp, Artificial Sequence
  chemically synthesized
cgtgatgccccacaagccac

SEQ ID NO: 31912 - DNA, 20 bp, Artificial Sequence
  chemically synthesized
agacacaaatgccaccatta

SEQ ID NO: 31913 - DNA, 20 bp, Artificial Sequence
  chemically synthesized
aaagagcatttcagaaaatt

SEQ ID NO: 31914 - DNA, 20 bp, Artificial Sequence
  chemically synthesized
gtaagaatttctatatggac

SEQ ID NO: 31915 - DNA, 20 bp, Artificial Sequence
  chemically synthesized
gaatcatttagggaagacaa

SEQ ID NO: 31916 - DNA, 20 bp, Artificial Sequence
  chemically synthesized
ctccacccttagctgtactt

SEQ ID NO: 31917 - DNA, 20 bp, Artificial Sequence
  chemically synthesized
tttgtgcgaatgcatgaaaa

SEQ ID NO: 31918 - DNA, 20 bp, Artificial Sequence
  chemically synthesized
caatgacacaatggaaccta

SEQ ID NO: 31919 - DNA, 20 bp, Artificial Sequence
  chemically synthesized
ccagaggaaaaaaaaagtta

SEQ ID NO: 31920 - DNA, 20 bp, Artificial Sequence
  chemically synthesized
ttgtgagttcttgtgcactg

SEQ ID NO: 31921 - DNA, 20 bp, Artificial Sequence
  chemically synthesized
gaaggtaatcagtggaaatt

SEQ ID NO: 31922 - DNA, 20 bp, Artificial Sequence
  chemically synthesized
gtaatcagtggaaatttgtc

SEQ ID NO: 31923 - DNA, 20 bp, Artificial Sequence
  chemically synthesized
tttgctctaacttaaatacc

SEQ ID NO: 31924 - DNA, 20 bp, Artificial Sequence
  chemically synthesized
ctgaagccatggcagaagtt

SEQ ID NO: 31925 - DNA, 20 bp, Artificial Sequence
  chemically synthesized
tggcagaagttcgtggattg

SEQ ID NO: 31926 - DNA, 20 bp, Artificial Sequence
  chemically synthesized
caatctctaaacataaattg

SEQ ID NO: 31927 - DNA, 20 bp, Artificial Sequence
  chemically synthesized
cacttccccagtcaatatcc

SEQ ID NO: 31928 - DNA, 20 bp, Artificial Sequence
  chemically synthesized
ctgcacaaattgtacagcat

SEQ ID NO: 31929 - DNA, 20 bp, Artificial Sequence
  chemically synthesized
gagaatacgagccaggaggt

SEQ ID NO: 31930 - DNA, 20 bp, Artificial Sequence
  chemically synthesized
cccagtctcccacagcgctc

SEQ ID NO: 31931 - DNA, 20 bp, Artificial Sequence
  chemically synthesized
aaaatccctaatacaaactt

SEQ ID NO: 31932 - DNA, 20 bp, Artificial Sequence
  chemically synthesized
aatacaaacttgctggtttt

SEQ ID NO: 31933 - DNA, 20 bp, Artificial Sequence
  chemically synthesized
tgtgatgcctcccccggatg

SEQ ID NO: 31934 - DNA, 20 bp, Artificial Sequence
  chemically synthesized
cctttatttctaaagttggc

SEQ ID NO: 31935 - DNA, 20 bp, Artificial Sequence
  chemically synthesized
acaaaaaatactaagttgta

SEQ ID NO: 31936 - DNA, 20 bp, Artificial Sequence
  chemically synthesized
atggcagagaccatccaaca

SEQ ID NO: 31937 - DNA, 20 bp, Artificial Sequence
  chemically synthesized
gaaccccatgctcaccatca

SEQ ID NO: 31938 - DNA, 20 bp, Artificial Sequence
  chemically synthesized
gccactgggcattacagtgc

SEQ ID NO: 31939 - DNA, 20 bp, Artificial Sequence
  chemically synthesized
ttcgctttgttcaactgccg

SEQ ID NO: 31940 - DNA, 20 bp, Artificial Sequence
  chemically synthesized
gaaggaaggctggagtacag

SEQ ID NO: 31941 - DNA, 20 bp, Artificial Sequence
  chemically synthesized
ttagaagagggttcagggtt

SEQ ID NO: 31942 - DNA, 20 bp, Artificial Sequence
  chemically synthesized
agtataaatggttctgaagc

SEQ ID NO: 31943 - DNA, 20 bp, Artificial Sequence
  chemically synthesized
tctgaagcacttgattcaga

SEQ ID NO: 31944 - DNA, 20 bp, Artificial Sequence
  chemically synthesized
agaaagtagaaagaacagct

SEQ ID NO: 31945 - DNA, 20 bp, Artificial Sequence
  chemically synthesized
ccaagaggtgtgagttctga

SEQ ID NO: 31946 - DNA, 20 bp, Artificial Sequence
  chemically synthesized
gctgagtcactatcaaatca

SEQ ID NO: 31947 - DNA, 20 bp, Artificial Sequence
  chemically synthesized
atcccctgagagaaaaagta

SEQ ID NO: 31948 - DNA, 20 bp, Artificial Sequence
  chemically synthesized
agaaaaagtacagagtttat

SEQ ID NO: 31949 - DNA, 20 bp, Artificial Sequence
  chemically synthesized
attaaggaagcagtattcac

SEQ ID NO: 31950 - DNA, 20 bp, Artificial Sequence
  chemically synthesized
gctcaaggacagaatctgaa

SEQ ID NO: 31951 - DNA, 20 bp, Artificial Sequence
  chemically synthesized
aaagtatactgtgtacaaaa

SEQ ID NO: 31952 - DNA, 20 bp, Artificial Sequence
  chemically synthesized
aaaaagctaacattaagcaa

SEQ ID NO: 31953 - DNA, 20 bp, Artificial Sequence
  chemically synthesized
aacattaagcaagtgtgttt

SEQ ID NO: 31954 - DNA, 20 bp, Artificial Sequence
  chemically synthesized
tgtttgtatgttttctacag

SEQ ID NO: 31955 - DNA, 20 bp, Artificial Sequence
  chemically synthesized
taatttgatccgacagaaaa

SEQ ID NO: 31956 - DNA, 20 bp, Artificial Sequence
  chemically synthesized
ttcagtaccatcagctcttt

SEQ ID NO: 31957 - DNA, 20 bp, Artificial Sequence
  chemically synthesized
tctttggcagcttatgagta

SEQ ID NO: 31958 - DNA, 20 bp, Artificial Sequence
  chemically synthesized
ttctcacctggtccccagga

SEQ ID NO: 31959 - DNA, 20 bp, Artificial Sequence
  chemically synthesized
ggatatggtttacttgtcag

SEQ ID NO: 31960 - DNA, 20 bp, Artificial Sequence
  chemically synthesized
cttgtcagagtagttttatg

SEQ ID NO: 31961 - DNA, 20 bp, Artificial Sequence
  chemically synthesized
tatgaggtgctttctcctga

SEQ ID NO: 31962 - DNA, 20 bp, Artificial Sequence
  chemically synthesized
accttgatgggaacatagaa

SEQ ID NO: 31963 - DNA, 20 bp, Artificial Sequence
  chemically synthesized
ggctcactctgaaagatatg

SEQ ID NO: 31964 - DNA, 20 bp, Artificial Sequence
  chemically synthesized
cattataagagggaggcaaa

SEQ ID NO: 31965 - DNA, 20 bp, Artificial Sequence
  chemically synthesized
ttataagaggagaaaatgtg

SEQ ID NO: 31966 - DNA, 20 bp, Artificial Sequence
  chemically synthesized
cctcgactttagcccagtga

SEQ ID NO: 31967 - DNA, 20 bp, Artificial Sequence
  chemically synthesized
acttcaagataatacatttg

SEQ ID NO: 31968 - DNA, 20 bp, Artificial Sequence
  chemically synthesized
ctaatcattagaatcactcc

SEQ ID NO: 31969 - DNA, 20 bp, Artificial Sequence
  chemically synthesized
cagacccagagccagtgaat

SEQ ID NO: 31970 - DNA, 20 bp, Artificial Sequence
  chemically synthesized
gcctgaatattaagcaagtt

SEQ ID NO: 31971 - DNA, 20 bp, Artificial Sequence
  chemically synthesized
ccagttgtacttttgtgtaa

SEQ ID NO: 31972 - DNA, 20 bp, Artificial Sequence
  chemically synthesized
tgtgtaaatgtgatttcatt

SEQ ID NO: 31973 - DNA, 20 bp, Artificial Sequence
  chemically synthesized
tgaagaaataaaagatgaga

SEQ ID NO: 31974 - DNA, 20 bp, Artificial Sequence
  chemically synthesized
aaacagttttaaaaattata

SEQ ID NO: 31975 - DNA, 20 bp, Artificial Sequence
  chemically synthesized
tttaaaaattatataatgtt

SEQ ID NO: 31976 - DNA, 20 bp, Artificial Sequence
  chemically synthesized
ttagaatgaatatgatgcaa

SEQ ID NO: 31977 - DNA, 20 bp, Artificial Sequence
  chemically synthesized
atgcaatctggttttctgtg

SEQ ID NO: 31978 - DNA, 20 bp, Artificial Sequence
  chemically synthesized
ctggagttaacctttctttg

SEQ ID NO: 31979 - DNA, 20 bp, Artificial Sequence
  chemically synthesized
tcctggtgctgtgcataata

SEQ ID NO: 31980 - DNA, 20 bp, Artificial Sequence
  chemically synthesized
tgcttaaacatgacagcagg

SEQ ID NO: 31981 - DNA, 20 bp, Artificial Sequence
  chemically synthesized
aatttatttataaatggtaa

SEQ ID NO: 31982 - DNA, 20 bp, Artificial Sequence
  chemically synthesized
atagaatgttcatcagaaaa

SEQ ID NO: 31983 - DNA, 20 bp, Artificial Sequence
  chemically synthesized
tccaaccaccgcctgggtat

SEQ ID NO: 31984 - DNA, 20 bp, Artificial Sequence
  chemically synthesized
atcaactcaaatttggctga

SEQ ID NO: 31985 - DNA, 20 bp, Artificial Sequence
  chemically synthesized
tcaaatttggctgacacagt

SEQ ID NO: 31986 - DNA, 20 bp, Artificial Sequence
  chemically synthesized
ttccaacttctctctgaaga

SEQ ID NO: 31987 - DNA, 20 bp, Artificial Sequence
  chemically synthesized
aagtcttttactccggtgtg

SEQ ID NO: 31988 - DNA, 20 bp, Artificial Sequence
  chemically synthesized
tactccggtgtggagtgttt

SEQ ID NO: 31989 - DNA, 20 bp, Artificial Sequence
  chemically synthesized
aggattcctaccaattagga

SEQ ID NO: 31990 - DNA, 20 bp, Artificial Sequence
  chemically synthesized
ttcctaccaattaggaaggt

SEQ ID NO: 31991 - DNA, 20 bp, Artificial Sequence
  chemically synthesized
agaaacacctccccttaact

SEQ ID NO: 31992 - DNA, 20 bp, Artificial Sequence
  chemically synthesized
ttacacatgcatgcgttgag

SEQ ID NO: 31993 - DNA, 20 bp, Artificial Sequence
  chemically synthesized
agcctggcctgggcactagg

SEQ ID NO: 31994 - DNA, 20 bp, Artificial Sequence
  chemically synthesized
ttttagatattagggacata

SEQ ID NO: 31995 - DNA, 20 bp, Artificial Sequence
  chemically synthesized
ggacttcgcattcaaacata

SEQ ID NO: 31996 - DNA, 20 bp, Artificial Sequence
  chemically synthesized
acaagaacctctctctatac

SEQ ID NO: 31997 - DNA, 20 bp, Artificial Sequence
  chemically synthesized
tctataccccagatttattt

SEQ ID NO: 31998 - DNA, 20 bp, Artificial Sequence
  chemically synthesized
tatgagttaattcatagcta

SEQ ID NO: 31999 - DNA, 20 bp, Artificial Sequence
  chemically synthesized
tgcgtattactaaaaagaag

SEQ ID NO: 32000 - DNA, 20 bp, Artificial Sequence
  chemically synthesized
aaggaatgatttcctagagg

SEQ ID NO: 32001 - DNA, 20 bp, Artificial Sequence
  chemically synthesized
aggtgcttcttctggccaag

SEQ ID NO: 32002 - DNA, 20 bp, Artificial Sequence
  chemically synthesized
aggggagctcttaggatgtc

SEQ ID NO: 32003 - DNA, 20 bp, Artificial Sequence
  chemically synthesized
aaaggcaagggatgaccaat

SEQ ID NO: 32004 - DNA, 20 bp, Artificial Sequence
  chemically synthesized
acagggaagcctctgaacac

SEQ ID NO: 32005 - DNA, 20 bp, Artificial Sequence
  chemically synthesized
aagccatagcaaacttgtca

SEQ ID NO: 32006 - DNA, 20 bp, Artificial Sequence
  chemically synthesized
gcccagaggatataaagcca

SEQ ID NO: 32007 - DNA, 20 bp, Artificial Sequence
  chemically synthesized
tctttggatattccggttcc

SEQ ID NO: 32008 - DNA, 20 bp, Artificial Sequence
  chemically synthesized
ttccggttcccactgcttca

SEQ ID NO: 32009 - DNA, 20 bp, Artificial Sequence
  chemically synthesized
atacacagggacaaagtcca

SEQ ID NO: 32010 - DNA, 20 bp, Artificial Sequence
  chemically synthesized
taaccggttacacaattgcc

SEQ ID NO: 32011 - DNA, 20 bp, Artificial Sequence
  chemically synthesized
acacaattgcctttggtttt

SEQ ID NO: 32012 - DNA, 20 bp, Artificial Sequence
  chemically synthesized
ggtttttacagtttgttcct

SEQ ID NO: 32013 - DNA, 20 bp, Artificial Sequence
  chemically synthesized
gtttgttcctaagtgtttcc

SEQ ID NO: 32014 - DNA, 20 bp, Artificial Sequence
  chemically synthesized
tggttcctcttcacctgagg

SEQ ID NO: 32015 - DNA, 20 bp, Artificial Sequence
  chemically synthesized
attatttattccagttaaaa

SEQ ID NO: 32016 - DNA, 20 bp, Artificial Sequence
  chemically synthesized
tagtgcctgctgtgtgtggt

SEQ ID NO: 32017 - DNA, 20 bp, Artificial Sequence
  chemically synthesized
ctgccacagttcctttcccc

SEQ ID NO: 32018 - DNA, 20 bp, Artificial Sequence
  chemically synthesized
gcaattgtgtaaccggttaa

SEQ ID NO: 32019 - DNA, 20 bp, Artificial Sequence
  chemically synthesized
tgagttagacaattctttca

SEQ ID NO: 32020 - DNA, 20 bp, Artificial Sequence
  chemically synthesized
gggaaccggaatatccaaag

SEQ ID NO: 32021 - DNA, 20 bp, Artificial Sequence
  chemically synthesized
tttgaaggagaaagaagcat

SEQ ID NO: 32022 - DNA, 20 bp, Artificial Sequence
  chemically synthesized
tggctttatatcctctgggc

SEQ ID NO: 32023 - DNA, 20 bp, Artificial Sequence
  chemically synthesized
taaaggtaagaaaccatctg

SEQ ID NO: 32024 - DNA, 20 bp, Artificial Sequence
  chemically synthesized
aaaccatctgacaagtttgc

SEQ ID NO: 32025 - DNA, 20 bp, Artificial Sequence
  chemically synthesized
cttcttcagccaaaatttat

SEQ ID NO: 32026 - DNA, 20 bp, Artificial Sequence
  chemically synthesized
tggttcaaacccctgtgttc

SEQ ID NO: 32027 - DNA, 20 bp, Artificial Sequence
  chemically synthesized
ctcccctccactacggacat

SEQ ID NO: 32028 - DNA, 20 bp, Artificial Sequence
  chemically synthesized
cacttccggtgaccagttag

SEQ ID NO: 32029 - DNA, 20 bp, Artificial Sequence
  chemically synthesized
tctggggtatagagagaggt

SEQ ID NO: 32030 - DNA, 20 bp, Artificial Sequence
  chemically synthesized
tcttgtttcaattagaaaag

SEQ ID NO: 32031 - DNA, 20 bp, Artificial Sequence
  chemically synthesized
aaaagtaatgcttggagaga

SEQ ID NO: 32032 - DNA, 20 bp, Artificial Sequence
  chemically synthesized
aaggtcactgccaatagatg

SEQ ID NO: 32033 - DNA, 20 bp, Artificial Sequence
  chemically synthesized
atgacttgattagaagcagg

SEQ ID NO: 32034 - DNA, 20 bp, Artificial Sequence
  chemically synthesized
aaccatgcctagtgcccagg

SEQ ID NO: 32035 - DNA, 20 bp, Artificial Sequence
  chemically synthesized
acagacatcttccctgaatg

SEQ ID NO: 32036 - DNA, 20 bp, Artificial Sequence
  chemically synthesized
ctaatgccctctaactgatg

SEQ ID NO: 32037 - DNA, 20 bp, Artificial Sequence
  chemically synthesized
agaatccatcagttaagggg

SEQ ID NO: 32038 - DNA, 20 bp, Artificial Sequence
  chemically synthesized
tcagttaaggggaggtgttt

SEQ ID NO: 32039 - DNA, 20 bp, Artificial Sequence
  chemically synthesized
tccacaccggagtaaaagac

SEQ ID NO: 32040 - DNA, 20 bp, Artificial Sequence
  chemically synthesized
tttgtgctagtgcatgacac

SEQ ID NO: 32041 - DNA, 20 bp, Artificial Sequence
  chemically synthesized
actgagatacccaggcggtg

SEQ ID NO: 32042 - DNA, 20 bp, Artificial Sequence
  chemically synthesized
gcggtggttggatttatgga

SEQ ID NO: 32043 - DNA, 20 bp, Artificial Sequence
  chemically synthesized
gaagaaagagtagatagaaa

SEQ ID NO: 32044 - DNA, 20 bp, Artificial Sequence
  chemically synthesized
tgtaaaatcctatcctgctg

SEQ ID NO: 32045 - DNA, 20 bp, Artificial Sequence
  chemically synthesized
attgcatgccagtctttgct

SEQ ID NO: 32046 - DNA, 20 bp, Artificial Sequence
  chemically synthesized
caggaatctgaacacagaaa

SEQ ID NO: 32047 - DNA, 20 bp, Artificial Sequence
  chemically synthesized
aaacattatataatttttaa

SEQ ID NO: 32048 - DNA, 20 bp, Artificial Sequence
  chemically synthesized
ataccctatgtatttgagta

SEQ ID NO: 32049 - DNA, 20 bp, Artificial Sequence
  chemically synthesized
ctatgtatttgagtaagttg

SEQ ID NO: 32050 - DNA, 20 bp, Artificial Sequence
  chemically synthesized
gttgcttagcttctcccaac

SEQ ID NO: 32051 - DNA, 20 bp, Artificial Sequence
  chemically synthesized
cctcatttctaaaacgaaga

SEQ ID NO: 32052 - DNA, 20 bp, Artificial Sequence
  chemically synthesized
tctgggccccaccaccaaat

SEQ ID NO: 32053 - DNA, 20 bp, Artificial Sequence
  chemically synthesized
tggctctgggtctgtatgta

SEQ ID NO: 32054 - DNA, 20 bp, Artificial Sequence
  chemically synthesized
ctgtatgtaacaagcttctg

SEQ ID NO: 32055 - DNA, 20 bp, Artificial Sequence
  chemically synthesized
acaagcttctggagtgattc

SEQ ID NO: 32056 - DNA, 20 bp, Artificial Sequence
  chemically synthesized
caggacctactattctacgt

SEQ ID NO: 32057 - DNA, 20 bp, Artificial Sequence
  chemically synthesized
taaaaaattaccacaaattt

SEQ ID NO: 32058 - DNA, 20 bp, Artificial Sequence
  chemically synthesized
gtggaggtcagaagtctgaa

SEQ ID NO: 32059 - DNA, 20 bp, Artificial Sequence
  chemically synthesized
taaagtcgaggtgtcagtgt

SEQ ID NO: 32060 - DNA, 20 bp, Artificial Sequence
  chemically synthesized
gtttcttctggagactctat

SEQ ID NO: 32061 - DNA, 20 bp, Artificial Sequence
  chemically synthesized
tctggagactctatgagaga

SEQ ID NO: 32062 - DNA, 20 bp, Artificial Sequence
  chemically synthesized
ttgtgttttcctgccttttc

SEQ ID NO: 32063 - DNA, 20 bp, Artificial Sequence
  chemically synthesized
tttcctgccttttccatgga

SEQ ID NO: 32064 - DNA, 20 bp, Artificial Sequence
  chemically synthesized
tctagaggctacccacattc

SEQ ID NO: 32065 - DNA, 20 bp, Artificial Sequence
  chemically synthesized
cgatcttcaaaaaaatgtat

SEQ ID NO: 32066 - DNA, 20 bp, Artificial Sequence
  chemically synthesized
cctccctcttataatgacac

SEQ ID NO: 32067 - DNA, 20 bp, Artificial Sequence
  chemically synthesized
ccttaattatatatgcaaaa

SEQ ID NO: 32068 - DNA, 20 bp, Artificial Sequence
  chemically synthesized
ggctagaaaagataatactc

SEQ ID NO: 32069 - DNA, 20 bp, Artificial Sequence
  chemically synthesized
acagaaaaaaaaaatgtagc

SEQ ID NO: 32070 - DNA, 20 bp, Artificial Sequence
  chemically synthesized
tgtagaaaacatacaaacac

SEQ ID NO: 32071 - DNA, 20 bp, Artificial Sequence
  chemically synthesized
tacaaacacacttgcttaat

SEQ ID NO: 32072 - DNA, 20 bp, Artificial Sequence
  chemically synthesized
gcactgaaccagctggaaat

SEQ ID NO: 32073 - DNA, 20 bp, Artificial Sequence
  chemically synthesized
gaaccagctggaaatgaatg

SEQ ID NO: 32074 - DNA, 20 bp, Artificial Sequence
  chemically synthesized
cgcagctgataaaagcagag

SEQ ID NO: 32075 - DNA, 20 bp, Artificial Sequence
  chemically synthesized
ctggagaaagcagctgtgaa

SEQ ID NO: 32076 - DNA, 20 bp, Artificial Sequence
  chemically synthesized
aactctgtactttttctctc

SEQ ID NO: 32077 - DNA, 20 bp, Artificial Sequence
  chemically synthesized
ctcaggggattagaaaaacc

SEQ ID NO: 32078 - DNA, 20 bp, Artificial Sequence
  chemically synthesized
aattgatttgatagtgactc

SEQ ID NO: 32079 - DNA, 20 bp, Artificial Sequence
  chemically synthesized
ctttagccaatgccctgcag

SEQ ID NO: 32080 - DNA, 20 bp, Artificial Sequence
  chemically synthesized
ccctgcagctaagattgaga

SEQ ID NO: 32081 - DNA, 20 bp, Artificial Sequence
  chemically synthesized
gattcagaactcacacctct

SEQ ID NO: 32082 - DNA, 20 bp, Artificial Sequence
  chemically synthesized
tttaaagcacagtctgaatc

SEQ ID NO: 32083 - DNA, 20 bp, Artificial Sequence
  chemically synthesized
gcgaaggcactgtaatgccc

SEQ ID NO: 32084 - DNA, 20 bp, Artificial Sequence
  chemically synthesized
atatcatcctaactgcatgc

SEQ ID NO: 32085 - DNA, 20 bp, Artificial Sequence
  chemically synthesized
aaagaataatttttcacttc

SEQ ID NO: 32086 - DNA, 20 bp, Artificial Sequence
  chemically synthesized
cctgatcatcactcacacat

SEQ ID NO: 32087 - DNA, 20 bp, Artificial Sequence
  chemically synthesized
cccacaagccacaaaaacca

SEQ ID NO: 32088 - DNA, 20 bp, Artificial Sequence
  chemically synthesized
aaaaaccagcaagtttgtat

SEQ ID NO: 32089 - DNA, 20 bp, Artificial Sequence
  chemically synthesized
ggcgaaattaaaattgctaa

SEQ ID NO: 32090 - DNA, 20 bp, Artificial Sequence
  chemically synthesized
gataacatcttatcaggaga

SEQ ID NO: 32091 - DNA, 20 bp, Artificial Sequence
  chemically synthesized
gacaggcgcacctggagggg

SEQ ID NO: 32092 - DNA, 20 bp, Artificial Sequence
  chemically synthesized
aattcagcgatatttctccc

SEQ ID NO: 32093 - DNA, 20 bp, Artificial Sequence
  chemically synthesized
ctgcctggctcaccagcagt

SEQ ID NO: 32094 - DNA, 20 bp, Artificial Sequence
  chemically synthesized
atatacatcctcctcagctg

SEQ ID NO: 32095 - DNA, 20 bp, Artificial Sequence
  chemically synthesized
cctcctcagctgacaggatt

SEQ ID NO: 32096 - DNA, 20 bp, Artificial Sequence
  chemically synthesized
gtccatgaaatctttacaat

SEQ ID NO: 32097 - DNA, 20 bp, Artificial Sequence
  chemically synthesized
aaatctttacaatttatgtt

SEQ ID NO: 32098 - DNA, 20 bp, Artificial Sequence
  chemically synthesized
cacaatccacgaacttctgc

SEQ ID NO: 32099 - DNA, 20 bp, Artificial Sequence
  chemically synthesized
gccatggcttcagctgatcc

SEQ ID NO: 32100 - DNA, 20 bp, Artificial Sequence
  chemically synthesized
gctgtgttcagatggttaca

SEQ ID NO: 32101 - DNA, 20 bp, Artificial Sequence
  chemically synthesized
acacatacacttacattaga

SEQ ID NO: 32102 - DNA, 20 bp, Artificial Sequence
  chemically synthesized
tcaatcaatcgacaaatttc

SEQ ID NO: 32103 - DNA, 20 bp, Artificial Sequence
  chemically synthesized
tgccatagtctcagccttca

SEQ ID NO: 32104 - DNA, 20 bp, Artificial Sequence
  chemically synthesized
gtgtgttgagtgttgcaaga

SEQ ID NO: 32105 - DNA, 20 bp, Artificial Sequence
  chemically synthesized
ccatagatgaggcagatagc

SEQ ID NO: 32106 - DNA, 20 bp, Artificial Sequence
  chemically synthesized
aggcttctgcctacagcaag

SEQ ID NO: 32107 - DNA, 20 bp, Artificial Sequence
  chemically synthesized
tacagcaaggctagtttgga

SEQ ID NO: 32108 - DNA, 20 bp, Artificial Sequence
  chemically synthesized
ggacccacacacctcttcat

SEQ ID NO: 32109 - DNA, 20 bp, Artificial Sequence
  chemically synthesized
atgctttttcttttttttcc

SEQ ID NO: 32110 - DNA, 20 bp, Artificial Sequence
  chemically synthesized
ctatgcaatatccagcactc

SEQ ID NO: 32111 - DNA, 20 bp, Artificial Sequence
  chemically synthesized
gaaaccatattgtcttccct

SEQ ID NO: 32112 - DNA, 20 bp, Artificial Sequence
  chemically synthesized
tttgtcacctacagtacatt

SEQ ID NO: 32113 - DNA, 22 bp, Artificial Sequence
  chemically synthesized
tccttctggcagggaacctggg

SEQ ID NO: 32114 - DNA, 22 bp, Artificial Sequence
  chemically synthesized
ctggcagggaacctgggcagcg

SEQ ID NO: 32115 - DNA, 22 bp, Artificial Sequence
  chemically synthesized
tggcagggaacctgggcagcga

SEQ ID NO: 32116 - DNA, 22 bp, Artificial Sequence
  chemically synthesized
gcagggaacctgggcagcgagg

SEQ ID NO: 32117 - DNA, 22 bp, Artificial Sequence
  chemically synthesized
ggcagcgaggatcctctgaaga

SEQ ID NO: 32118 - DNA, 22 bp, Artificial Sequence
  chemically synthesized
tgaagaacactcattcccaaat

SEQ ID NO: 32119 - DNA, 22 bp, Artificial Sequence
  chemically synthesized
aagaacactcattcccaaatcc

SEQ ID NO: 32120 - DNA, 22 bp, Artificial Sequence
  chemically synthesized
attcccaaatccagaaatgtac

SEQ ID NO: 32121 - DNA, 22 bp, Artificial Sequence
  chemically synthesized
ccaaatccagaaatgtactgta

SEQ ID NO: 32122 - DNA, 22 bp, Artificial Sequence
  chemically synthesized
taggtgacaaagacacaaatgc

SEQ ID NO: 32123 - DNA, 22 bp, Artificial Sequence
  chemically synthesized
gcaggatttaaagagcatttca

SEQ ID NO: 32124 - DNA, 22 bp, Artificial Sequence
  chemically synthesized
aaagagcatttcagaaaattgg

SEQ ID NO: 32125 - DNA, 22 bp, Artificial Sequence
  chemically synthesized
aagagcatttcagaaaattggc

SEQ ID NO: 32126 - DNA, 22 bp, Artificial Sequence
  chemically synthesized
cagaaaattggcagtttactaa

SEQ ID NO: 32127 - DNA, 22 bp, Artificial Sequence
  chemically synthesized
agaaaattggcagtttactaag

SEQ ID NO: 32128 - DNA, 22 bp, Artificial Sequence
  chemically synthesized
gcagtttactaaggtaagaatt

SEQ ID NO: 32129 - DNA, 22 bp, Artificial Sequence
  chemically synthesized
actaaggtaagaatttctatat

SEQ ID NO: 32130 - DNA, 22 bp, Artificial Sequence
  chemically synthesized
ctaaggtaagaatttctatatg

SEQ ID NO: 32131 - DNA, 22 bp, Artificial Sequence
  chemically synthesized
aggtaagaatttctatatggac

SEQ ID NO: 32132 - DNA, 22 bp, Artificial Sequence
  chemically synthesized
ctatatggacctatgtttgtgt

SEQ ID NO: 32133 - DNA, 22 bp, Artificial Sequence
  chemically synthesized
tatatggacctatgtttgtgta

SEQ ID NO: 32134 - DNA, 22 bp, Artificial Sequence
  chemically synthesized
tatggacctatgtttgtgtatg

SEQ ID NO: 32135 - DNA, 22 bp, Artificial Sequence
  chemically synthesized
tgtttgtgtatgatgttccaca

SEQ ID NO: 32136 - DNA, 22 bp, Artificial Sequence
  chemically synthesized
gtgtatgatgttccacatataa

SEQ ID NO: 32137 - DNA, 22 bp, Artificial Sequence
  chemically synthesized
tgtatgatgttccacatataat

SEQ ID NO: 32138 - DNA, 22 bp, Artificial Sequence
  chemically synthesized
cacatataatatctttactgtg

SEQ ID NO: 32139 - DNA, 22 bp, Artificial Sequence
  chemically synthesized
tactgtgtcttgacatatgaat

SEQ ID NO: 32140 - DNA, 22 bp, Artificial Sequence
  chemically synthesized
actgtgtcttgacatatgaatc

SEQ ID NO: 32141 - DNA, 22 bp, Artificial Sequence
  chemically synthesized
ctgtgtcttgacatatgaatca

SEQ ID NO: 32142 - DNA, 22 bp, Artificial Sequence
  chemically synthesized
tgtcttgacatatgaatcattt

SEQ ID NO: 32143 - DNA, 22 bp, Artificial Sequence
  chemically synthesized
gacatatgaatcatttagggaa

SEQ ID NO: 32144 - DNA, 22 bp, Artificial Sequence
  chemically synthesized
acatatgaatcatttagggaag

SEQ ID NO: 32145 - DNA, 22 bp, Artificial Sequence
  chemically synthesized
agggaagacaatatggtttctg

SEQ ID NO: 32146 - DNA, 22 bp, Artificial Sequence
  chemically synthesized
gggaagacaatatggtttctgt

SEQ ID NO: 32147 - DNA, 22 bp, Artificial Sequence
  chemically synthesized
ctgtgaattttaaagacttcta

SEQ ID NO: 32148 - DNA, 22 bp, Artificial Sequence
  chemically synthesized
tgtgaattttaaagacttctaa

SEQ ID NO: 32149 - DNA, 22 bp, Artificial Sequence
  chemically synthesized
tgaattttaaagacttctaatt

SEQ ID NO: 32150 - DNA, 22 bp, Artificial Sequence
  chemically synthesized
taaagacttctaattaatcaga

SEQ ID NO: 32151 - DNA, 22 bp, Artificial Sequence
  chemically synthesized
aaagacttctaattaatcagaa

SEQ ID NO: 32152 - DNA, 22 bp, Artificial Sequence
  chemically synthesized
aagacttctaattaatcagaag

SEQ ID NO: 32153 - DNA, 22 bp, Artificial Sequence
  chemically synthesized
ctaattaatcagaagagtgctg

SEQ ID NO: 32154 - DNA, 22 bp, Artificial Sequence
  chemically synthesized
taattaatcagaagagtgctgg

SEQ ID NO: 32155 - DNA, 22 bp, Artificial Sequence
  chemically synthesized
attaatcagaagagtgctggat

SEQ ID NO: 32156 - DNA, 22 bp, Artificial Sequence
  chemically synthesized
atcagaagagtgctggatattg

SEQ ID NO: 32157 - DNA, 22 bp, Artificial Sequence
  chemically synthesized
gatattgcatagacttctccac

SEQ ID NO: 32158 - DNA, 22 bp, Artificial Sequence
  chemically synthesized
catagacttctccacccttagc

SEQ ID NO: 32159 - DNA, 22 bp, Artificial Sequence
  chemically synthesized
ctccacccttagctgtacttag

SEQ ID NO: 32160 - DNA, 22 bp, Artificial Sequence
  chemically synthesized
tccacccttagctgtacttagc

SEQ ID NO: 32161 - DNA, 22 bp, Artificial Sequence
  chemically synthesized
cacccttagctgtacttagctg

SEQ ID NO: 32162 - DNA, 22 bp, Artificial Sequence
  chemically synthesized
agctgtacttagctgatttgtg

SEQ ID NO: 32163 - DNA, 22 bp, Artificial Sequence
  chemically synthesized
gctgtacttagctgatttgtgg

SEQ ID NO: 32164 - DNA, 22 bp, Artificial Sequence
  chemically synthesized
tacttagctgatttgtgggtct

SEQ ID NO: 32165 - DNA, 22 bp, Artificial Sequence
  chemically synthesized
agctgatttgtgggtctacact

SEQ ID NO: 32166 - DNA, 22 bp, Artificial Sequence
  chemically synthesized
gctgatttgtgggtctacactg

SEQ ID NO: 32167 - DNA, 22 bp, Artificial Sequence
  chemically synthesized
atttgtgggtctacactgtaac

SEQ ID NO: 32168 - DNA, 22 bp, Artificial Sequence
  chemically synthesized
gtgggtctacactgtaacctcc

SEQ ID NO: 32169 - DNA, 22 bp, Artificial Sequence
  chemically synthesized
tgggtctacactgtaacctccc

SEQ ID NO: 32170 - DNA, 22 bp, Artificial Sequence
  chemically synthesized
cactgtaacctccctgaacttg

SEQ ID NO: 32171 - DNA, 22 bp, Artificial Sequence
  chemically synthesized
taacctccctgaacttgagact

SEQ ID NO: 32172 - DNA, 22 bp, Artificial Sequence
  chemically synthesized
cctgaacttgagactccatttc

SEQ ID NO: 32173 - DNA, 22 bp, Artificial Sequence
  chemically synthesized
aacttgagactccatttccctt

SEQ ID NO: 32174 - DNA, 22 bp, Artificial Sequence
  chemically synthesized
gagactccatttccctttcaaa

SEQ ID NO: 32175 - DNA, 22 bp, Artificial Sequence
  chemically synthesized
agactccatttccctttcaaac

SEQ ID NO: 32176 - DNA, 22 bp, Artificial Sequence
  chemically synthesized
catttccctttcaaactctggg

SEQ ID NO: 32177 - DNA, 22 bp, Artificial Sequence
  chemically synthesized
ccctttcaaactctgggaaaaa

SEQ ID NO: 32178 - DNA, 22 bp, Artificial Sequence
  chemically synthesized
cctttcaaactctgggaaaaaa

SEQ ID NO: 32179 - DNA, 22 bp, Artificial Sequence
  chemically synthesized
tcaaactctgggaaaaaaaaga

SEQ ID NO: 32180 - DNA, 22 bp, Artificial Sequence
  chemically synthesized
caaactctgggaaaaaaaagaa

SEQ ID NO: 32181 - DNA, 22 bp, Artificial Sequence
  chemically synthesized
aaactctgggaaaaaaaagaaa

SEQ ID NO: 32182 - DNA, 22 bp, Artificial Sequence
  chemically synthesized
tgggaaaaaaaagaaaaagcat

SEQ ID NO: 32183 - DNA, 22 bp, Artificial Sequence
  chemically synthesized
ggaaaaaaaagaaaaagcatct

SEQ ID NO: 32184 - DNA, 22 bp, Artificial Sequence
  chemically synthesized
tgaagaggtgtgtgggtccaac

SEQ ID NO: 32185 - DNA, 22 bp, Artificial Sequence
  chemically synthesized
acagcaaaaccctctccaaact

SEQ ID NO: 32186 - DNA, 22 bp, Artificial Sequence
  chemically synthesized
tccaaactagccttgctgtagg

SEQ ID NO: 32187 - DNA, 22 bp, Artificial Sequence
  chemically synthesized
caaactagccttgctgtaggca

SEQ ID NO: 32188 - DNA, 22 bp, Artificial Sequence
  chemically synthesized
gccttgctgtaggcagaagcct

SEQ ID NO: 32189 - DNA, 22 bp, Artificial Sequence
  chemically synthesized
gctgtaggcagaagcctctgct

SEQ ID NO: 32190 - DNA, 22 bp, Artificial Sequence
  chemically synthesized
ctgtaggcagaagcctctgcta

SEQ ID NO: 32191 - DNA, 22 bp, Artificial Sequence
  chemically synthesized
taggcagaagcctctgctatct

SEQ ID NO: 32192 - DNA, 22 bp, Artificial Sequence
  chemically synthesized
tgctatctgcctcatctatgga

SEQ ID NO: 32193 - DNA, 22 bp, Artificial Sequence
  chemically synthesized
ctatctgcctcatctatggaac

SEQ ID NO: 32194 - DNA, 22 bp, Artificial Sequence
  chemically synthesized
tctgcctcatctatggaacaca

SEQ ID NO: 32195 - DNA, 22 bp, Artificial Sequence
  chemically synthesized
cctcatctatggaacacatcta

SEQ ID NO: 32196 - DNA, 22 bp, Artificial Sequence
  chemically synthesized
atctatggaacacatctatatt

SEQ ID NO: 32197 - DNA, 22 bp, Artificial Sequence
  chemically synthesized
tggaacacatctatatttgtgc

SEQ ID NO: 32198 - DNA, 22 bp, Artificial Sequence
  chemically synthesized
tatttgtgcgaatgcatgaaaa

SEQ ID NO: 32199 - DNA, 22 bp, Artificial Sequence
  chemically synthesized
gtgcgaatgcatgaaaataaag

SEQ ID NO: 32200 - DNA, 22 bp, Artificial Sequence
  chemically synthesized
tgcgaatgcatgaaaataaagt

SEQ ID NO: 32201 - DNA, 22 bp, Artificial Sequence
  chemically synthesized
aaagatatgggtggccttcagg

SEQ ID NO: 32202 - DNA, 22 bp, Artificial Sequence
  chemically synthesized
aagatatgggtggccttcagga

SEQ ID NO: 32203 - DNA, 22 bp, Artificial Sequence
  chemically synthesized
caggagacacgccagcccagca

SEQ ID NO: 32204 - DNA, 22 bp, Artificial Sequence
  chemically synthesized
aggagacacgccagcccagcat

SEQ ID NO: 32205 - DNA, 22 bp, Artificial Sequence
  chemically synthesized
ttcacaatgacacaatggaacc

SEQ ID NO: 32206 - DNA, 22 bp, Artificial Sequence
  chemically synthesized
tcacaatgacacaatggaacct

SEQ ID NO: 32207 - DNA, 22 bp, Artificial Sequence
  chemically synthesized
cacaatgacacaatggaaccta

SEQ ID NO: 32208 - DNA, 22 bp, Artificial Sequence
  chemically synthesized
acaatgacacaatggaacctac

SEQ ID NO: 32209 - DNA, 22 bp, Artificial Sequence
  chemically synthesized
ctctgattgccatctcttcact

SEQ ID NO: 32210 - DNA, 22 bp, Artificial Sequence
  chemically synthesized
tgattgccatctcttcacttta

SEQ ID NO: 32211 - DNA, 22 bp, Artificial Sequence
  chemically synthesized
attgccatctcttcactttaca

SEQ ID NO: 32212 - DNA, 22 bp, Artificial Sequence
  chemically synthesized
ccatctcttcactttacaccca

SEQ ID NO: 32213 - DNA, 22 bp, Artificial Sequence
  chemically synthesized
ttcactttacacccagaggaaa

SEQ ID NO: 32214 - DNA, 22 bp, Artificial Sequence
  chemically synthesized
cactttacacccagaggaaaaa

SEQ ID NO: 32215 - DNA, 22 bp, Artificial Sequence
  chemically synthesized
actttacacccagaggaaaaaa

SEQ ID NO: 32216 - DNA, 22 bp, Artificial Sequence
  chemically synthesized
tacacccagaggaaaaaaaaag

SEQ ID NO: 32217 - DNA, 22 bp, Artificial Sequence
  chemically synthesized
acacccagaggaaaaaaaaagt

SEQ ID NO: 32218 - DNA, 22 bp, Artificial Sequence
  chemically synthesized
cacccagaggaaaaaaaaagtt

SEQ ID NO: 32219 - DNA, 22 bp, Artificial Sequence
  chemically synthesized
aagggtttctcaaccaggtaag

SEQ ID NO: 32220 - DNA, 22 bp, Artificial Sequence
  chemically synthesized
ctcaaccaggtaagtcatggag

SEQ ID NO: 32221 - DNA, 22 bp, Artificial Sequence
  chemically synthesized
tcaaccaggtaagtcatggaga

SEQ ID NO: 32222 - DNA, 22 bp, Artificial Sequence
  chemically synthesized
aaccaggtaagtcatggagagc

SEQ ID NO: 32223 - DNA, 22 bp, Artificial Sequence
  chemically synthesized
aaacttactcttgcaacactca

SEQ ID NO: 32224 - DNA, 22 bp, Artificial Sequence
  chemically synthesized
actcttgcaacactcaacacac

SEQ ID NO: 32225 - DNA, 22 bp, Artificial Sequence
  chemically synthesized
ctcttgcaacactcaacacact

SEQ ID NO: 32226 - DNA, 22 bp, Artificial Sequence
  chemically synthesized
ttgcaacactcaacacacttgt

SEQ ID NO: 32227 - DNA, 22 bp, Artificial Sequence
  chemically synthesized
gcaacactcaacacacttgtga

SEQ ID NO: 32228 - DNA, 22 bp, Artificial Sequence
  chemically synthesized
caacactcaacacacttgtgag

SEQ ID NO: 32229 - DNA, 22 bp, Artificial Sequence
  chemically synthesized
aacacacttgtgagttcttgtg

SEQ ID NO: 32230 - DNA, 22 bp, Artificial Sequence
  chemically synthesized
gtgagttcttgtgcactgtctg

SEQ ID NO: 32231 - DNA, 22 bp, Artificial Sequence
  chemically synthesized
tgagttcttgtgcactgtctgg

SEQ ID NO: 32232 - DNA, 22 bp, Artificial Sequence
  chemically synthesized
ttgtgcactgtctggctttttt

SEQ ID NO: 32233 - DNA, 22 bp, Artificial Sequence
  chemically synthesized
gtgcactgtctggcttttttgc

SEQ ID NO: 32234 - DNA, 22 bp, Artificial Sequence
  chemically synthesized
tgcactgtctggcttttttgct

SEQ ID NO: 32235 - DNA, 22 bp, Artificial Sequence
  chemically synthesized
tctggcttttttgctagcctat

SEQ ID NO: 32236 - DNA, 22 bp, Artificial Sequence
  chemically synthesized
gcttttttgctagcctataagc

SEQ ID NO: 32237 - DNA, 22 bp, Artificial Sequence
  chemically synthesized
ttttgctagcctataagctgca

SEQ ID NO: 32238 - DNA, 22 bp, Artificial Sequence
  chemically synthesized
tttgctagcctataagctgcat

SEQ ID NO: 32239 - DNA, 22 bp, Artificial Sequence
  chemically synthesized
ttgctagcctataagctgcatg

SEQ ID NO: 32240 - DNA, 22 bp, Artificial Sequence
  chemically synthesized
tgctagcctataagctgcatga

SEQ ID NO: 32241 - DNA, 22 bp, Artificial Sequence
  chemically synthesized
gctagcctataagctgcatgaa

SEQ ID NO: 32242 - DNA, 22 bp, Artificial Sequence
  chemically synthesized
ctagcctataagctgcatgaag

SEQ ID NO: 32243 - DNA, 22 bp, Artificial Sequence
  chemically synthesized
gcctataagctgcatgaaggct

SEQ ID NO: 32244 - DNA, 22 bp, Artificial Sequence
  chemically synthesized
taagctgcatgaaggctgagac

SEQ ID NO: 32245 - DNA, 22 bp, Artificial Sequence
  chemically synthesized
catgaaggctgagactatggca

SEQ ID NO: 32246 - DNA, 22 bp, Artificial Sequence
  chemically synthesized
agactatggcagtcttggctca

SEQ ID NO: 32247 - DNA, 22 bp, Artificial Sequence
  chemically synthesized
tggcagtcttggctcatagaag

SEQ ID NO: 32248 - DNA, 22 bp, Artificial Sequence
  chemically synthesized
ggctcatagaaggtaatcagtg

SEQ ID NO: 32249 - DNA, 22 bp, Artificial Sequence
  chemically synthesized
gctcatagaaggtaatcagtgg

SEQ ID NO: 32250 - DNA, 22 bp, Artificial Sequence
  chemically synthesized
atagaaggtaatcagtggaaat

SEQ ID NO: 32251 - DNA, 22 bp, Artificial Sequence
  chemically synthesized
gtcgattgattgaatttttccc

SEQ ID NO: 32252 - DNA, 22 bp, Artificial Sequence
  chemically synthesized
tcgattgattgaatttttccct

SEQ ID NO: 32253 - DNA, 22 bp, Artificial Sequence
  chemically synthesized
attgaatttttcccttaaagcc

SEQ ID NO: 32254 - DNA, 22 bp, Artificial Sequence
  chemically synthesized
aatttttcccttaaagccaatt

SEQ ID NO: 32255 - DNA, 22 bp, Artificial Sequence
  chemically synthesized
ttcccttaaagccaattctaat

SEQ ID NO: 32256 - DNA, 22 bp, Artificial Sequence
  chemically synthesized
tcccttaaagccaattctaatg

SEQ ID NO: 32257 - DNA, 22 bp, Artificial Sequence
  chemically synthesized
cccttaaagccaattctaatgt

SEQ ID NO: 32258 - DNA, 22 bp, Artificial Sequence
  chemically synthesized
ccttaaagccaattctaatgta

SEQ ID NO: 32259 - DNA, 22 bp, Artificial Sequence
  chemically synthesized
aaagccaattctaatgtaagtg

SEQ ID NO: 32260 - DNA, 22 bp, Artificial Sequence
  chemically synthesized
aagccaattctaatgtaagtgt

SEQ ID NO: 32261 - DNA, 22 bp, Artificial Sequence
  chemically synthesized
taatgtaagtgtatgtgtgctg

SEQ ID NO: 32262 - DNA, 22 bp, Artificial Sequence
  chemically synthesized
atgtaagtgtatgtgtgctgct

SEQ ID NO: 32263 - DNA, 22 bp, Artificial Sequence
  chemically synthesized
ctgtaaatagggttagaaccct

SEQ ID NO: 32264 - DNA, 22 bp, Artificial Sequence
  chemically synthesized
taaatagggttagaaccctttt

SEQ ID NO: 32265 - DNA, 22 bp, Artificial Sequence
  chemically synthesized
gaaccctttttgctctaactta

SEQ ID NO: 32266 - DNA, 22 bp, Artificial Sequence
  chemically synthesized
tttgctctaacttaaataccaa

SEQ ID NO: 32267 - DNA, 22 bp, Artificial Sequence
  chemically synthesized
ttgctctaacttaaataccaat

SEQ ID NO: 32268 - DNA, 22 bp, Artificial Sequence
  chemically synthesized
tgctctaacttaaataccaatt

SEQ ID NO: 32269 - DNA, 22 bp, Artificial Sequence
  chemically synthesized
gctctaacttaaataccaattg

SEQ ID NO: 32270 - DNA, 22 bp, Artificial Sequence
  chemically synthesized
ctctaacttaaataccaattga

SEQ ID NO: 32271 - DNA, 22 bp, Artificial Sequence
  chemically synthesized
taacttaaataccaattgattt

SEQ ID NO: 32272 - DNA, 22 bp, Artificial Sequence
  chemically synthesized
acttaaataccaattgatttta

SEQ ID NO: 32273 - DNA, 22 bp, Artificial Sequence
  chemically synthesized
aaataccaattgattttagccc

SEQ ID NO: 32274 - DNA, 22 bp, Artificial Sequence
  chemically synthesized
aataccaattgattttagccca

SEQ ID NO: 32275 - DNA, 22 bp, Artificial Sequence
  chemically synthesized
attttagcccaggataatgaaa

SEQ ID NO: 32276 - DNA, 22 bp, Artificial Sequence
  chemically synthesized
tagcccaggataatgaaaatgc

SEQ ID NO: 32277 - DNA, 22 bp, Artificial Sequence
  chemically synthesized
agcccaggataatgaaaatgca

SEQ ID NO: 32278 - DNA, 22 bp, Artificial Sequence
  chemically synthesized
gcccaggataatgaaaatgcag

SEQ ID NO: 32279 - DNA, 22 bp, Artificial Sequence
  chemically synthesized
gctcagcaagcgaaatgtaacc

SEQ ID NO: 32280 - DNA, 22 bp, Artificial Sequence
  chemically synthesized
ctcagcaagcgaaatgtaacca

SEQ ID NO: 32281 - DNA, 22 bp, Artificial Sequence
  chemically synthesized
agcaagcgaaatgtaaccatct

SEQ ID NO: 32282 - DNA, 22 bp, Artificial Sequence
  chemically synthesized
aacacagctccttaagagatat

SEQ ID NO: 32283 - DNA, 22 bp, Artificial Sequence
  chemically synthesized
cttaagagatataagaagggtg

SEQ ID NO: 32284 - DNA, 22 bp, Artificial Sequence
  chemically synthesized
aagagatataagaagggtggaa

SEQ ID NO: 32285 - DNA, 22 bp, Artificial Sequence
  chemically synthesized
agagatataagaagggtggaag

SEQ ID NO: 32286 - DNA, 22 bp, Artificial Sequence
  chemically synthesized
cagagttctcagttgttgcggg

SEQ ID NO: 32287 - DNA, 22 bp, Artificial Sequence
  chemically synthesized
tcagttgttgcgggaagtctgg

SEQ ID NO: 32288 - DNA, 22 bp, Artificial Sequence
  chemically synthesized
agttgttgcgggaagtctggga

SEQ ID NO: 32289 - DNA, 22 bp, Artificial Sequence
  chemically synthesized
ttgcgggaagtctgggactcca

SEQ ID NO: 32290 - DNA, 22 bp, Artificial Sequence
  chemically synthesized
cgggaagtctgggactccaaac

SEQ ID NO: 32291 - DNA, 22 bp, Artificial Sequence
  chemically synthesized
ggactccaaacggagggatcag

SEQ ID NO: 32292 - DNA, 22 bp, Artificial Sequence
  chemically synthesized
caaacggagggatcagctgaag

SEQ ID NO: 32293 - DNA, 22 bp, Artificial Sequence
  chemically synthesized
aagccatggcagaagttcgtgg

SEQ ID NO: 32294 - DNA, 22 bp, Artificial Sequence
  chemically synthesized
gtggattgtgaagatttcatgg

SEQ ID NO: 32295 - DNA, 22 bp, Artificial Sequence
  chemically synthesized
tgaagatttcatggacatttat

SEQ ID NO: 32296 - DNA, 22 bp, Artificial Sequence
  chemically synthesized
catggacatttattagttcccc

SEQ ID NO: 32297 - DNA, 22 bp, Artificial Sequence
  chemically synthesized
atggacatttattagttcccca

SEQ ID NO: 32298 - DNA, 22 bp, Artificial Sequence
  chemically synthesized
attagttccccaaattaatact

SEQ ID NO: 32299 - DNA, 22 bp, Artificial Sequence
  chemically synthesized
ttagttccccaaattaatactt

SEQ ID NO: 32300 - DNA, 22 bp, Artificial Sequence
  chemically synthesized
gttccccaaattaatacttttg

SEQ ID NO: 32301 - DNA, 22 bp, Artificial Sequence
  chemically synthesized
cccaaattaatacttttgtaat

SEQ ID NO: 32302 - DNA, 22 bp, Artificial Sequence
  chemically synthesized
atacttttgtaatttcttatgc

SEQ ID NO: 32303 - DNA, 22 bp, Artificial Sequence
  chemically synthesized
ttgtaatttcttatgcctgtct

SEQ ID NO: 32304 - DNA, 22 bp, Artificial Sequence
  chemically synthesized
tgtaatttcttatgcctgtctt

SEQ ID NO: 32305 - DNA, 22 bp, Artificial Sequence
  chemically synthesized
gtaatttcttatgcctgtcttt

SEQ ID NO: 32306 - DNA, 22 bp, Artificial Sequence
  chemically synthesized
taatttcttatgcctgtcttta

SEQ ID NO: 32307 - DNA, 22 bp, Artificial Sequence
  chemically synthesized
cttatgcctgtctttactgcaa

SEQ ID NO: 32308 - DNA, 22 bp, Artificial Sequence
  chemically synthesized
ttatgcctgtctttactgcaat

SEQ ID NO: 32309 - DNA, 22 bp, Artificial Sequence
  chemically synthesized
atgcctgtctttactgcaatct

SEQ ID NO: 32310 - DNA, 22 bp, Artificial Sequence
  chemically synthesized
tgcctgtctttactgcaatctc

SEQ ID NO: 32311 - DNA, 22 bp, Artificial Sequence
  chemically synthesized
tctttactgcaatctctaaaca

SEQ ID NO: 32312 - DNA, 22 bp, Artificial Sequence
  chemically synthesized
tactgcaatctctaaacataaa

SEQ ID NO: 32313 - DNA, 22 bp, Artificial Sequence
  chemically synthesized
actgcaatctctaaacataaat

SEQ ID NO: 32314 - DNA, 22 bp, Artificial Sequence
  chemically synthesized
ctgcaatctctaaacataaatt

SEQ ID NO: 32315 - DNA, 22 bp, Artificial Sequence
  chemically synthesized
caatctctaaacataaattgta

SEQ ID NO: 32316 - DNA, 22 bp, Artificial Sequence
  chemically synthesized
taaacataaattgtaaagattt

SEQ ID NO: 32317 - DNA, 22 bp, Artificial Sequence
  chemically synthesized
aacataaattgtaaagatttca

SEQ ID NO: 32318 - DNA, 22 bp, Artificial Sequence
  chemically synthesized
taaagatttcatggacacttat

SEQ ID NO: 32319 - DNA, 22 bp, Artificial Sequence
  chemically synthesized
catggacacttatcacttcccc

SEQ ID NO: 32320 - DNA, 22 bp, Artificial Sequence
  chemically synthesized
atggacacttatcacttcccca

SEQ ID NO: 32321 - DNA, 22 bp, Artificial Sequence
  chemically synthesized
atcacttccccagtcaatatcc

SEQ ID NO: 32322 - DNA, 22 bp, Artificial Sequence
  chemically synthesized
tcacttccccagtcaatatcct

SEQ ID NO: 32323 - DNA, 22 bp, Artificial Sequence
  chemically synthesized
ccccagtcaatatccttgtgat

SEQ ID NO: 32324 - DNA, 22 bp, Artificial Sequence
  chemically synthesized
cccagtcaatatccttgtgatt

SEQ ID NO: 32325 - DNA, 22 bp, Artificial Sequence
  chemically synthesized
gtgatttatgcctgtctttact

SEQ ID NO: 32326 - DNA, 22 bp, Artificial Sequence
  chemically synthesized
tgatttatgcctgtctttactt

SEQ ID NO: 32327 - DNA, 22 bp, Artificial Sequence
  chemically synthesized
atgcctgtctttactttaatct

SEQ ID NO: 32328 - DNA, 22 bp, Artificial Sequence
  chemically synthesized
tgcctgtctttactttaatctc

SEQ ID NO: 32329 - DNA, 22 bp, Artificial Sequence
  chemically synthesized
tctttactttaatctcttaatc

SEQ ID NO: 32330 - DNA, 22 bp, Artificial Sequence
  chemically synthesized
tactttaatctcttaatcctgt

SEQ ID NO: 32331 - DNA, 22 bp, Artificial Sequence
  chemically synthesized
actttaatctcttaatcctgtc

SEQ ID NO: 32332 - DNA, 22 bp, Artificial Sequence
  chemically synthesized
ctttaatctcttaatcctgtca

SEQ ID NO: 32333 - DNA, 22 bp, Artificial Sequence
  chemically synthesized
taatctcttaatcctgtcagct

SEQ ID NO: 32334 - DNA, 22 bp, Artificial Sequence
  chemically synthesized
aatctcttaatcctgtcagctg

SEQ ID NO: 32335 - DNA, 22 bp, Artificial Sequence
  chemically synthesized
atctcttaatcctgtcagctga

SEQ ID NO: 32336 - DNA, 22 bp, Artificial Sequence
  chemically synthesized
ttaatcctgtcagctgaggagg

SEQ ID NO: 32337 - DNA, 22 bp, Artificial Sequence
  chemically synthesized
aatcctgtcagctgaggaggat

SEQ ID NO: 32338 - DNA, 22 bp, Artificial Sequence
  chemically synthesized
atcctgtcagctgaggaggatg

SEQ ID NO: 32339 - DNA, 22 bp, Artificial Sequence
  chemically synthesized
tcagctgaggaggatgtatatt

SEQ ID NO: 32340 - DNA, 22 bp, Artificial Sequence
  chemically synthesized
aggaggatgtatattgcctcag

SEQ ID NO: 32341 - DNA, 22 bp, Artificial Sequence
  chemically synthesized
cctcaggaccctgtaataattg

SEQ ID NO: 32342 - DNA, 22 bp, Artificial Sequence
  chemically synthesized
aggaccctgtaataattgcatt

SEQ ID NO: 32343 - DNA, 22 bp, Artificial Sequence
  chemically synthesized
taataattgcattaactgcaca

SEQ ID NO: 32344 - DNA, 22 bp, Artificial Sequence
  chemically synthesized
cattaactgcacaaattgtaca

SEQ ID NO: 32345 - DNA, 22 bp, Artificial Sequence
  chemically synthesized
actgcacaaattgtacagcatg

SEQ ID NO: 32346 - DNA, 22 bp, Artificial Sequence
  chemically synthesized
cacaaattgtacagcatgtgtg

SEQ ID NO: 32347 - DNA, 22 bp, Artificial Sequence
  chemically synthesized
tacagcatgtgtgtttgagcaa

SEQ ID NO: 32348 - DNA, 22 bp, Artificial Sequence
  chemically synthesized
gagcaacatgaaatgtggacac

SEQ ID NO: 32349 - DNA, 22 bp, Artificial Sequence
  chemically synthesized
agcaacatgaaatgtggacacc

SEQ ID NO: 32350 - DNA, 22 bp, Artificial Sequence
  chemically synthesized
gaaaaaagaacaggataacagc

SEQ ID NO: 32351 - DNA, 22 bp, Artificial Sequence
  chemically synthesized
aaaaaagaacaggataacagca

SEQ ID NO: 32352 - DNA, 22 bp, Artificial Sequence
  chemically synthesized
ttcagggaataagagagataac

SEQ ID NO: 32353 - DNA, 22 bp, Artificial Sequence
  chemically synthesized
agggaataagagagataacctt

SEQ ID NO: 32354 - DNA, 22 bp, Artificial Sequence
  chemically synthesized
aaactctgactgctggtgagcc

SEQ ID NO: 32355 - DNA, 22 bp, Artificial Sequence
  chemically synthesized
aactctgactgctggtgagcca

SEQ ID NO: 32356 - DNA, 22 bp, Artificial Sequence
  chemically synthesized
tgactgctggtgagccaggcag

SEQ ID NO: 32357 - DNA, 22 bp, Artificial Sequence
  chemically synthesized
actgctggtgagccaggcagaa

SEQ ID NO: 32358 - DNA, 22 bp, Artificial Sequence
  chemically synthesized
ctggtgagccaggcagaacaga

SEQ ID NO: 32359 - DNA, 22 bp, Artificial Sequence
  chemically synthesized
gtgagccaggcagaacagagcc

SEQ ID NO: 32360 - DNA, 22 bp, Artificial Sequence
  chemically synthesized
ctcttctttcaaaagcaaatgg

SEQ ID NO: 32361 - DNA, 22 bp, Artificial Sequence
  chemically synthesized
tcttctttcaaaagcaaatggg

SEQ ID NO: 32362 - DNA, 22 bp, Artificial Sequence
  chemically synthesized
ttctttcaaaagcaaatgggag

SEQ ID NO: 32363 - DNA, 22 bp, Artificial Sequence
  chemically synthesized
ctttcaaaagcaaatgggagaa

SEQ ID NO: 32364 - DNA, 22 bp, Artificial Sequence
  chemically synthesized
tttcaaaagcaaatgggagaaa

SEQ ID NO: 32365 - DNA, 22 bp, Artificial Sequence
  chemically synthesized
tcaaaagcaaatgggagaaata

SEQ ID NO: 32366 - DNA, 22 bp, Artificial Sequence
  chemically synthesized
caaaagcaaatgggagaaatat

SEQ ID NO: 32367 - DNA, 22 bp, Artificial Sequence
  chemically synthesized
aaaagcaaatgggagaaatatc

SEQ ID NO: 32368 - DNA, 22 bp, Artificial Sequence
  chemically synthesized
aattctttttctcagcatggaa

SEQ ID NO: 32369 - DNA, 22 bp, Artificial Sequence
  chemically synthesized
tttttctcagcatggaacatcc

SEQ ID NO: 32370 - DNA, 22 bp, Artificial Sequence
  chemically synthesized
tttctcagcatggaacatccct

SEQ ID NO: 32371 - DNA, 22 bp, Artificial Sequence
  chemically synthesized
ttctcagcatggaacatccctg

SEQ ID NO: 32372 - DNA, 22 bp, Artificial Sequence
  chemically synthesized
tctcagcatggaacatccctga

SEQ ID NO: 32373 - DNA, 22 bp, Artificial Sequence
  chemically synthesized
ctcagcatggaacatccctgag

SEQ ID NO: 32374 - DNA, 22 bp, Artificial Sequence
  chemically synthesized
tcagcatggaacatccctgaga

SEQ ID NO: 32375 - DNA, 22 bp, Artificial Sequence
  chemically synthesized
agcatggaacatccctgagaaa

SEQ ID NO: 32376 - DNA, 22 bp, Artificial Sequence
  chemically synthesized
agaaagagaatacgagccagga

SEQ ID NO: 32377 - DNA, 22 bp, Artificial Sequence
  chemically synthesized
ataaacagcccccctccaggtg

SEQ ID NO: 32378 - DNA, 22 bp, Artificial Sequence
  chemically synthesized
taaacagcccccctccaggtgc

SEQ ID NO: 32379 - DNA, 22 bp, Artificial Sequence
  chemically synthesized
caggtgcgcctgtctcttatgg

SEQ ID NO: 32380 - DNA, 22 bp, Artificial Sequence
  chemically synthesized
tctcttatggtcgagactgcag

SEQ ID NO: 32381 - DNA, 22 bp, Artificial Sequence
  chemically synthesized
ttatggtcgagactgcaggggt

SEQ ID NO: 32382 - DNA, 22 bp, Artificial Sequence
  chemically synthesized
atggtcgagactgcaggggtga

SEQ ID NO: 32383 - DNA, 22 bp, Artificial Sequence
  chemically synthesized
tggtcgagactgcaggggtgaa

SEQ ID NO: 32384 - DNA, 22 bp, Artificial Sequence
  chemically synthesized
caggggtgaaatagaccccagt

SEQ ID NO: 32385 - DNA, 22 bp, Artificial Sequence
  chemically synthesized
ccacagcgctcccaggcttatt

SEQ ID NO: 32386 - DNA, 22 bp, Artificial Sequence
  chemically synthesized
ccaggcttattaggaagaggaa

SEQ ID NO: 32387 - DNA, 22 bp, Artificial Sequence
  chemically synthesized
attaggaagaggaaattcccgc

SEQ ID NO: 32388 - DNA, 22 bp, Artificial Sequence
  chemically synthesized
ttaggaagaggaaattcccgcc

SEQ ID NO: 32389 - DNA, 22 bp, Artificial Sequence
  chemically synthesized
ggaagaggaaattcccgcctaa

SEQ ID NO: 32390 - DNA, 22 bp, Artificial Sequence
  chemically synthesized
ccgcctaataaattttggtcag

SEQ ID NO: 32391 - DNA, 22 bp, Artificial Sequence
  chemically synthesized
ataaattttggtcagaccagtt

SEQ ID NO: 32392 - DNA, 22 bp, Artificial Sequence
  chemically synthesized
tggtcagaccagttgatcctaa

SEQ ID NO: 32393 - DNA, 22 bp, Artificial Sequence
  chemically synthesized
ggtcagaccagttgatcctaaa

SEQ ID NO: 32394 - DNA, 22 bp, Artificial Sequence
  chemically synthesized
gtcagaccagttgatcctaaaa

SEQ ID NO: 32395 - DNA, 22 bp, Artificial Sequence
  chemically synthesized
atcctaaaaaccctgtctcctg

SEQ ID NO: 32396 - DNA, 22 bp, Artificial Sequence
  chemically synthesized
aaaaccctgtctcctgataaga

SEQ ID NO: 32397 - DNA, 22 bp, Artificial Sequence
  chemically synthesized
tctcctgataagatgttatcaa

SEQ ID NO: 32398 - DNA, 22 bp, Artificial Sequence
  chemically synthesized
ctgataagatgttatcaatgac

SEQ ID NO: 32399 - DNA, 22 bp, Artificial Sequence
  chemically synthesized
ataagatgttatcaatgacaat

SEQ ID NO: 32400 - DNA, 22 bp, Artificial Sequence
  chemically synthesized
tcaatgacaatggtgcccgaaa

SEQ ID NO: 32401 - DNA, 22 bp, Artificial Sequence
  chemically synthesized
cattagcaattttaatttcgcc

SEQ ID NO: 32402 - DNA, 22 bp, Artificial Sequence
  chemically synthesized
attagcaattttaatttcgcct

SEQ ID NO: 32403 - DNA, 22 bp, Artificial Sequence
  chemically synthesized
gcaattttaatttcgcctcggt

SEQ ID NO: 32404 - DNA, 22 bp, Artificial Sequence
  chemically synthesized
taatttcgcctcggtcctgtgg

SEQ ID NO: 32405 - DNA, 22 bp, Artificial Sequence
  chemically synthesized
aatttcgcctcggtcctgtggt

SEQ ID NO: 32406 - DNA, 22 bp, Artificial Sequence
  chemically synthesized
atttcgcctcggtcctgtggtc

SEQ ID NO: 32407 - DNA, 22 bp, Artificial Sequence
  chemically synthesized
cgcctcggtcctgtggtcctgt

SEQ ID NO: 32408 - DNA, 22 bp, Artificial Sequence
  chemically synthesized
gcctcggtcctgtggtcctgtg

SEQ ID NO: 32409 - DNA, 22 bp, Artificial Sequence
  chemically synthesized
ggtcctgtggtcctgtgatctc

SEQ ID NO: 32410 - DNA, 22 bp, Artificial Sequence
  chemically synthesized
tggtcctgtgatctcaccctgc

SEQ ID NO: 32411 - DNA, 22 bp, Artificial Sequence
  chemically synthesized
tgatctcaccctgcctccactt

SEQ ID NO: 32412 - DNA, 22 bp, Artificial Sequence
  chemically synthesized
accctgcctccacttgccttgt

SEQ ID NO: 32413 - DNA, 22 bp, Artificial Sequence
  chemically synthesized
cctccacttgccttgtgatatt

SEQ ID NO: 32414 - DNA, 22 bp, Artificial Sequence
  chemically synthesized
cacttgccttgtgatattctat

SEQ ID NO: 32415 - DNA, 22 bp, Artificial Sequence
  chemically synthesized
gccttgtgatattctattacct

SEQ ID NO: 32416 - DNA, 22 bp, Artificial Sequence
  chemically synthesized
ccttgtgatattctattacctt

SEQ ID NO: 32417 - DNA, 22 bp, Artificial Sequence
  chemically synthesized
gtgatattctattaccttgtaa

SEQ ID NO: 32418 - DNA, 22 bp, Artificial Sequence
  chemically synthesized
tgatattctattaccttgtaaa

SEQ ID NO: 32419 - DNA, 22 bp, Artificial Sequence
  chemically synthesized
tattaccttgtaaagtacttga

SEQ ID NO: 32420 - DNA, 22 bp, Artificial Sequence
  chemically synthesized
ttaccttgtaaagtacttgatg

SEQ ID NO: 32421 - DNA, 22 bp, Artificial Sequence
  chemically synthesized
ccttgtaaagtacttgatgtct

SEQ ID NO: 32422 - DNA, 22 bp, Artificial Sequence
  chemically synthesized
gtaaagtacttgatgtctgtga

SEQ ID NO: 32423 - DNA, 22 bp, Artificial Sequence
  chemically synthesized
taaagtacttgatgtctgtgac

SEQ ID NO: 32424 - DNA, 22 bp, Artificial Sequence
  chemically synthesized
gatgtctgtgacccacacctat

SEQ ID NO: 32425 - DNA, 22 bp, Artificial Sequence
  chemically synthesized
atgtctgtgacccacacctatt

SEQ ID NO: 32426 - DNA, 22 bp, Artificial Sequence
  chemically synthesized
tgacccacacctatttgcacac

SEQ ID NO: 32427 - DNA, 22 bp, Artificial Sequence
  chemically synthesized
tttgcacactgcctccccattt

SEQ ID NO: 32428 - DNA, 22 bp, Artificial Sequence
  chemically synthesized
gcacactgcctccccatttgaa

SEQ ID NO: 32429 - DNA, 22 bp, Artificial Sequence
  chemically synthesized
cacactgcctccccatttgaaa

SEQ ID NO: 32430 - DNA, 22 bp, Artificial Sequence
  chemically synthesized
cctccccatttgaaaatcccta

SEQ ID NO: 32431 - DNA, 22 bp, Artificial Sequence
  chemically synthesized
cccatttgaaaatccctaatac

SEQ ID NO: 32432 - DNA, 22 bp, Artificial Sequence
  chemically synthesized
gaaaatccctaatacaaacttg

SEQ ID NO: 32433 - DNA, 22 bp, Artificial Sequence
  chemically synthesized
aaaatccctaatacaaacttgc

SEQ ID NO: 32434 - DNA, 22 bp, Artificial Sequence
  chemically synthesized
atacaaacttgctggtttttgt

SEQ ID NO: 32435 - DNA, 22 bp, Artificial Sequence
  chemically synthesized
gctggtttttgtggcttgtggg

SEQ ID NO: 32436 - DNA, 22 bp, Artificial Sequence
  chemically synthesized
ctggtttttgtggcttgtgggg

SEQ ID NO: 32437 - DNA, 22 bp, Artificial Sequence
  chemically synthesized
gtttttgtggcttgtggggcat

SEQ ID NO: 32438 - DNA, 22 bp, Artificial Sequence
  chemically synthesized
ttgtggcttgtggggcatcacg

SEQ ID NO: 32439 - DNA, 22 bp, Artificial Sequence
  chemically synthesized
tgtggcttgtggggcatcacgg

SEQ ID NO: 32440 - DNA, 22 bp, Artificial Sequence
  chemically synthesized
gtggcttgtggggcatcacgga

SEQ ID NO: 32441 - DNA, 22 bp, Artificial Sequence
  chemically synthesized
tggcttgtggggcatcacggaa

SEQ ID NO: 32442 - DNA, 22 bp, Artificial Sequence
  chemically synthesized
gtggggcatcacggaacctacc

SEQ ID NO: 32443 - DNA, 22 bp, Artificial Sequence
  chemically synthesized
tggggcatcacggaacctaccg

SEQ ID NO: 32444 - DNA, 22 bp, Artificial Sequence
  chemically synthesized
ccgaaatgtgatgcctcccccg

SEQ ID NO: 32445 - DNA, 22 bp, Artificial Sequence
  chemically synthesized
ccccggatgcccggctttaaaa

SEQ ID NO: 32446 - DNA, 22 bp, Artificial Sequence
  chemically synthesized
taaaatttctctcttttgtact

SEQ ID NO: 32447 - DNA, 22 bp, Artificial Sequence
  chemically synthesized
aaaatttctctcttttgtactc

SEQ ID NO: 32448 - DNA, 22 bp, Artificial Sequence
  chemically synthesized
aaatttctctcttttgtactct

SEQ ID NO: 32449 - DNA, 22 bp, Artificial Sequence
  chemically synthesized
ctctcttttgtactctgtccct

SEQ ID NO: 32450 - DNA, 22 bp, Artificial Sequence
  chemically synthesized
tctcttttgtactctgtccctt

SEQ ID NO: 32451 - DNA, 22 bp, Artificial Sequence
  chemically synthesized
tcttttgtactctgtcccttta

SEQ ID NO: 32452 - DNA, 22 bp, Artificial Sequence
  chemically synthesized
ttttgtactctgtccctttatt

SEQ ID NO: 32453 - DNA, 22 bp, Artificial Sequence
  chemically synthesized
ttgtactctgtccctttatttc

SEQ ID NO: 32454 - DNA, 22 bp, Artificial Sequence
  chemically synthesized
tgtactctgtccctttatttct

SEQ ID NO: 32455 - DNA, 22 bp, Artificial Sequence
  chemically synthesized
gtactctgtccctttatttcta

SEQ ID NO: 32456 - DNA, 22 bp, Artificial Sequence
  chemically synthesized
tactctgtccctttatttctaa

SEQ ID NO: 32457 - DNA, 22 bp, Artificial Sequence
  chemically synthesized
tgtccctttatttctaaagttg

SEQ ID NO: 32458 - DNA, 22 bp, Artificial Sequence
  chemically synthesized
tccctttatttctaaagttggc

SEQ ID NO: 32459 - DNA, 22 bp, Artificial Sequence
  chemically synthesized
tatttctaaagttggccgacgc

SEQ ID NO: 32460 - DNA, 22 bp, Artificial Sequence
  chemically synthesized
atttctaaagttggccgacgct

SEQ ID NO: 32461 - DNA, 22 bp, Artificial Sequence
  chemically synthesized
tttctaaagttggccgacgctt

SEQ ID NO: 32462 - DNA, 22 bp, Artificial Sequence
  chemically synthesized
ctaaagttggccgacgcttagg

SEQ ID NO: 32463 - DNA, 22 bp, Artificial Sequence
  chemically synthesized
taaagttggccgacgcttaggg

SEQ ID NO: 32464 - DNA, 22 bp, Artificial Sequence
  chemically synthesized
aagttggccgacgcttagggaa

SEQ ID NO: 32465 - DNA, 22 bp, Artificial Sequence
  chemically synthesized
gccgacgcttagggaaaataga

SEQ ID NO: 32466 - DNA, 22 bp, Artificial Sequence
  chemically synthesized
agggaaaatagaaaagaaccta

SEQ ID NO: 32467 - DNA, 22 bp, Artificial Sequence
  chemically synthesized
gggaaaatagaaaagaacctac

SEQ ID NO: 32468 - DNA, 22 bp, Artificial Sequence
  chemically synthesized
cgtgaatattggggcaggttcc

SEQ ID NO: 32469 - DNA, 22 bp, Artificial Sequence
  chemically synthesized
gggcaggttccctgatactcag

SEQ ID NO: 32470 - DNA, 22 bp, Artificial Sequence
  chemically synthesized
cctgatactcagtggcgtggag

SEQ ID NO: 32471 - DNA, 22 bp, Artificial Sequence
  chemically synthesized
atactcagtggcgtggagatgt

SEQ ID NO: 32472 - DNA, 22 bp, Artificial Sequence
  chemically synthesized
agtggcgtggagatgtaacaag

SEQ ID NO: 32473 - DNA, 22 bp, Artificial Sequence
  chemically synthesized
gatgtgtgagtgatgatcaggc

SEQ ID NO: 32474 - DNA, 22 bp, Artificial Sequence
  chemically synthesized
tatttggaagaaatatcagatg

SEQ ID NO: 32475 - DNA, 22 bp, Artificial Sequence
  chemically synthesized
ggaagaaatatcagatgtgaat

SEQ ID NO: 32476 - DNA, 22 bp, Artificial Sequence
  chemically synthesized
gaagaaatatcagatgtgaatg

SEQ ID NO: 32477 - DNA, 22 bp, Artificial Sequence
  chemically synthesized
tgacctaggaagcaatggaagt

SEQ ID NO: 32478 - DNA, 22 bp, Artificial Sequence
  chemically synthesized
ggaagcaatggaagtgaaaaat

SEQ ID NO: 32479 - DNA, 22 bp, Artificial Sequence
  chemically synthesized
ttctttttgccttcagactcaa

SEQ ID NO: 32480 - DNA, 22 bp, Artificial Sequence
  chemically synthesized
tttttgccttcagactcaatat

SEQ ID NO: 32481 - DNA, 22 bp, Artificial Sequence
  chemically synthesized
tttgccttcagactcaatattt

SEQ ID NO: 32482 - DNA, 22 bp, Artificial Sequence
  chemically synthesized
ttgccttcagactcaatatttt

SEQ ID NO: 32483 - DNA, 22 bp, Artificial Sequence
  chemically synthesized
tgccttcagactcaatattttg

SEQ ID NO: 32484 - DNA, 22 bp, Artificial Sequence
  chemically synthesized
gccttcagactcaatattttgt

SEQ ID NO: 32485 - DNA, 22 bp, Artificial Sequence
  chemically synthesized
ccttcagactcaatattttgta

SEQ ID NO: 32486 - DNA, 22 bp, Artificial Sequence
  chemically synthesized
cagactcaatattttgtatatt

SEQ ID NO: 32487 - DNA, 22 bp, Artificial Sequence
  chemically synthesized
agactcaatattttgtatattt

SEQ ID NO: 32488 - DNA, 22 bp, Artificial Sequence
  chemically synthesized
aatattttgtatatttgaaaat

SEQ ID NO: 32489 - DNA, 22 bp, Artificial Sequence
  chemically synthesized
tgtatatttgaaaatttgtcaa

SEQ ID NO: 32490 - DNA, 22 bp, Artificial Sequence
  chemically synthesized
gtatatttgaaaatttgtcaac

SEQ ID NO: 32491 - DNA, 22 bp, Artificial Sequence
  chemically synthesized
tatatttgaaaatttgtcaaca

SEQ ID NO: 32492 - DNA, 22 bp, Artificial Sequence
  chemically synthesized
gaaaatttgtcaacacaaaaaa

SEQ ID NO: 32493 - DNA, 22 bp, Artificial Sequence
  chemically synthesized
aaaatttgtcaacacaaaaaat

SEQ ID NO: 32494 - DNA, 22 bp, Artificial Sequence
  chemically synthesized
gtcaacacaaaaaatactaagt

SEQ ID NO: 32495 - DNA, 22 bp, Artificial Sequence
  chemically synthesized
tcaacacaaaaaatactaagtt

SEQ ID NO: 32496 - DNA, 22 bp, Artificial Sequence
  chemically synthesized
agttgtatactgatttgttaaa

SEQ ID NO: 32497 - DNA, 22 bp, Artificial Sequence
  chemically synthesized
tatactgatttgttaaaagcag

SEQ ID NO: 32498 - DNA, 22 bp, Artificial Sequence
  chemically synthesized
atttgttaaaagcagcagcatg

SEQ ID NO: 32499 - DNA, 22 bp, Artificial Sequence
  chemically synthesized
gttaaaagcagcagcatgcagt

SEQ ID NO: 32500 - DNA, 22 bp, Artificial Sequence
  chemically synthesized
ttaaaagcagcagcatgcagtt

SEQ ID NO: 32501 - DNA, 22 bp, Artificial Sequence
  chemically synthesized
aaagcagcagcatgcagttagg

SEQ ID NO: 32502 - DNA, 22 bp, Artificial Sequence
  chemically synthesized
ggatgatatctttggggaaatg

SEQ ID NO: 32503 - DNA, 22 bp, Artificial Sequence
  chemically synthesized
tggggaaatggcagagaccatc

SEQ ID NO: 32504 - DNA, 22 bp, Artificial Sequence
  chemically synthesized
ggggaaatggcagagaccatcc

SEQ ID NO: 32505 - DNA, 22 bp, Artificial Sequence
  chemically synthesized
gggaaatggcagagaccatcca

SEQ ID NO: 32506 - DNA, 22 bp, Artificial Sequence
  chemically synthesized
tgattctccactgcatccaatt

SEQ ID NO: 32507 - DNA, 22 bp, Artificial Sequence
  chemically synthesized
attctccactgcatccaatttt

SEQ ID NO: 32508 - DNA, 22 bp, Artificial Sequence
  chemically synthesized
tccactgcatccaattttctac

SEQ ID NO: 32509 - DNA, 22 bp, Artificial Sequence
  chemically synthesized
cactgcatccaattttctactc

SEQ ID NO: 32510 - DNA, 22 bp, Artificial Sequence
  chemically synthesized
catccaattttctactctcaaa

SEQ ID NO: 32511 - DNA, 22 bp, Artificial Sequence
  chemically synthesized
tctactctcaaaatgaacccca

SEQ ID NO: 32512 - DNA, 22 bp, Artificial Sequence
  chemically synthesized
ctactctcaaaatgaaccccat

SEQ ID NO: 32513 - DNA, 22 bp, Artificial Sequence
  chemically synthesized
tactctcaaaatgaaccccatg

SEQ ID NO: 32514 - DNA, 22 bp, Artificial Sequence
  chemically synthesized
ctctcaaaatgaaccccatgct

SEQ ID NO: 32515 - DNA, 22 bp, Artificial Sequence
  chemically synthesized
tcaaaatgaaccccatgctcac

SEQ ID NO: 32516 - DNA, 22 bp, Artificial Sequence
  chemically synthesized
aaaatgaaccccatgctcacca

SEQ ID NO: 32517 - DNA, 22 bp, Artificial Sequence
  chemically synthesized
accatcaacgggattgaatttg

SEQ ID NO: 32518 - DNA, 22 bp, Artificial Sequence
  chemically synthesized
aatttgagctgctgagaattgg

SEQ ID NO: 32519 - DNA, 22 bp, Artificial Sequence
  chemically synthesized
gagctgctgagaattggtaata

SEQ ID NO: 32520 - DNA, 22 bp, Artificial Sequence
  chemically synthesized
agctgctgagaattggtaataa

SEQ ID NO: 32521 - DNA, 22 bp, Artificial Sequence
  chemically synthesized
ctgagaattggtaataacccca

SEQ ID NO: 32522 - DNA, 22 bp, Artificial Sequence
  chemically synthesized
agaattggtaataaccccaaat

SEQ ID NO: 32523 - DNA, 22 bp, Artificial Sequence
  chemically synthesized
gtaataaccccaaattatcttc

SEQ ID NO: 32524 - DNA, 22 bp, Artificial Sequence
  chemically synthesized
tcttcaattctgtgaaatggaa

SEQ ID NO: 32525 - DNA, 22 bp, Artificial Sequence
  chemically synthesized
caattctgtgaaatggaatttt

SEQ ID NO: 32526 - DNA, 22 bp, Artificial Sequence
  chemically synthesized
aattctgtgaaatggaatttta

SEQ ID NO: 32527 - DNA, 22 bp, Artificial Sequence
  chemically synthesized
tgtgaaatggaattttagacca

SEQ ID NO: 32528 - DNA, 22 bp, Artificial Sequence
  chemically synthesized
tgaaatggaattttagaccagc

SEQ ID NO: 32529 - DNA, 22 bp, Artificial Sequence
  chemically synthesized
tagaccagcctgtgactgaagc

SEQ ID NO: 32530 - DNA, 22 bp, Artificial Sequence
  chemically synthesized
agaccagcctgtgactgaagcc

SEQ ID NO: 32531 - DNA, 22 bp, Artificial Sequence
  chemically synthesized
gaccagcctgtgactgaagcca

SEQ ID NO: 32532 - DNA, 22 bp, Artificial Sequence
  chemically synthesized
tgactgaagccactgggcatta

SEQ ID NO: 32533 - DNA, 22 bp, Artificial Sequence
  chemically synthesized
aagccactgggcattacagtgc

SEQ ID NO: 32534 - DNA, 22 bp, Artificial Sequence
  chemically synthesized
ggcattacagtgccttcgcttt

SEQ ID NO: 32535 - DNA, 22 bp, Artificial Sequence
  chemically synthesized
cagtgccttcgctttgttcaac

SEQ ID NO: 32536 - DNA, 22 bp, Artificial Sequence
  chemically synthesized
cgctttgttcaactgccgcatt

SEQ ID NO: 32537 - DNA, 22 bp, Artificial Sequence
  chemically synthesized
gctttgttcaactgccgcattg

SEQ ID NO: 32538 - DNA, 22 bp, Artificial Sequence
  chemically synthesized
tgttcaactgccgcattgtttc

SEQ ID NO: 32539 - DNA, 22 bp, Artificial Sequence
  chemically synthesized
gttcaactgccgcattgtttct

SEQ ID NO: 32540 - DNA, 22 bp, Artificial Sequence
  chemically synthesized
ttcaactgccgcattgtttctc

SEQ ID NO: 32541 - DNA, 22 bp, Artificial Sequence
  chemically synthesized
aactgccgcattgtttctctct

SEQ ID NO: 32542 - DNA, 22 bp, Artificial Sequence
  chemically synthesized
ccgcattgtttctctctgcaag

SEQ ID NO: 32543 - DNA, 22 bp, Artificial Sequence
  chemically synthesized
tttctctctgcaagagaggaag

SEQ ID NO: 32544 - DNA, 22 bp, Artificial Sequence
  chemically synthesized
ctctctgcaagagaggaaggaa

SEQ ID NO: 32545 - DNA, 22 bp, Artificial Sequence
  chemically synthesized
tctctgcaagagaggaaggaag

SEQ ID NO: 32546 - DNA, 22 bp, Artificial Sequence
  chemically synthesized
tctgcaagagaggaaggaaggc

SEQ ID NO: 32547 - DNA, 22 bp, Artificial Sequence
  chemically synthesized
tgcaagagaggaaggaaggctg

SEQ ID NO: 32548 - DNA, 22 bp, Artificial Sequence
  chemically synthesized
caagagaggaaggaaggctgga

SEQ ID NO: 32549 - DNA, 22 bp, Artificial Sequence
  chemically synthesized
gagtacagctgagctttctggc

SEQ ID NO: 32550 - DNA, 22 bp, Artificial Sequence
  chemically synthesized
agctttctggcaggcactggtg

SEQ ID NO: 32551 - DNA, 22 bp, Artificial Sequence
  chemically synthesized
tctggcaggcactggtggagtt

SEQ ID NO: 32552 - DNA, 22 bp, Artificial Sequence
  chemically synthesized
ctggcaggcactggtggagtta

SEQ ID NO: 32553 - DNA, 22 bp, Artificial Sequence
  chemically synthesized
tggcaggcactggtggagttac

SEQ ID NO: 32554 - DNA, 22 bp, Artificial Sequence
  chemically synthesized
gcaggcactggtggagttactc

SEQ ID NO: 32555 - DNA, 22 bp, Artificial Sequence
  chemically synthesized
gtggagttactcattaaccttc

SEQ ID NO: 32556 - DNA, 22 bp, Artificial Sequence
  chemically synthesized
ctcattaaccttccccattctt

SEQ ID NO: 32557 - DNA, 22 bp, Artificial Sequence
  chemically synthesized
attaaccttccccattctttgt

SEQ ID NO: 32558 - DNA, 22 bp, Artificial Sequence
  chemically synthesized
accttccccattctttgtaact

SEQ ID NO: 32559 - DNA, 22 bp, Artificial Sequence
  chemically synthesized
ccccattctttgtaactggtgg

SEQ ID NO: 32560 - DNA, 22 bp, Artificial Sequence
  chemically synthesized
cccattctttgtaactggtggc

SEQ ID NO: 32561 - DNA, 22 bp, Artificial Sequence
  chemically synthesized
tttgtaactggtggccttagaa

SEQ ID NO: 32562 - DNA, 22 bp, Artificial Sequence
  chemically synthesized
tgtaactggtggccttagaaga

SEQ ID NO: 32563 - DNA, 22 bp, Artificial Sequence
  chemically synthesized
gtaactggtggccttagaagag

SEQ ID NO: 32564 - DNA, 22 bp, Artificial Sequence
  chemically synthesized
taactggtggccttagaagagg

SEQ ID NO: 32565 - DNA, 22 bp, Artificial Sequence
  chemically synthesized
gtggccttagaagagggttcag

SEQ ID NO: 32566 - DNA, 22 bp, Artificial Sequence
  chemically synthesized
agaagagggttcagggttatgt

SEQ ID NO: 32567 - DNA, 22 bp, Artificial Sequence
  chemically synthesized
gaagagggttcagggttatgtg

SEQ ID NO: 32568 - DNA, 22 bp, Artificial Sequence
  chemically synthesized
agggttatgtgtttggaacacg

SEQ ID NO: 32569 - DNA, 22 bp, Artificial Sequence
  chemically synthesized
tgtgtttggaacacgagttagt

SEQ ID NO: 32570 - DNA, 22 bp, Artificial Sequence
  chemically synthesized
ggaacacgagttagtataaatg

SEQ ID NO: 32571 - DNA, 22 bp, Artificial Sequence
  chemically synthesized
gaacacgagttagtataaatgg

SEQ ID NO: 32572 - DNA, 22 bp, Artificial Sequence
  chemically synthesized
gtataaatggttctgaagcact

SEQ ID NO: 32573 - DNA, 22 bp, Artificial Sequence
  chemically synthesized
tgaagcacttgattcagactgt

SEQ ID NO: 32574 - DNA, 22 bp, Artificial Sequence
  chemically synthesized
aagcacttgattcagactgtgc

SEQ ID NO: 32575 - DNA, 22 bp, Artificial Sequence
  chemically synthesized
gattcagactgtgctttaaaaa

SEQ ID NO: 32576 - DNA, 22 bp, Artificial Sequence
  chemically synthesized
attcagactgtgctttaaaaaa

SEQ ID NO: 32577 - DNA, 22 bp, Artificial Sequence
  chemically synthesized
agactgtgctttaaaaaatagg

SEQ ID NO: 32578 - DNA, 22 bp, Artificial Sequence
  chemically synthesized
tgctttaaaaaataggaaagaa

SEQ ID NO: 32579 - DNA, 22 bp, Artificial Sequence
  chemically synthesized
taaaaaataggaaagaaagtag

SEQ ID NO: 32580 - DNA, 22 bp, Artificial Sequence
  chemically synthesized
aaaaaataggaaagaaagtaga

SEQ ID NO: 32581 - DNA, 22 bp, Artificial Sequence
  chemically synthesized
aaaaataggaaagaaagtagaa

SEQ ID NO: 32582 - DNA, 22 bp, Artificial Sequence
  chemically synthesized
atggtttggaagggagccacca

SEQ ID NO: 32583 - DNA, 22 bp, Artificial Sequence
  chemically synthesized
ggaagggagccaccaagcacca

SEQ ID NO: 32584 - DNA, 22 bp, Artificial Sequence
  chemically synthesized
gaagggagccaccaagcaccaa

SEQ ID NO: 32585 - DNA, 22 bp, Artificial Sequence
  chemically synthesized
tgaatccgtttctcaatcttag

SEQ ID NO: 32586 - DNA, 22 bp, Artificial Sequence
  chemically synthesized
aatccgtttctcaatcttagct

SEQ ID NO: 32587 - DNA, 22 bp, Artificial Sequence
  chemically synthesized
ctcaatcttagctgcagggcat

SEQ ID NO: 32588 - DNA, 22 bp, Artificial Sequence
  chemically synthesized
tcaatcttagctgcagggcatt

SEQ ID NO: 32589 - DNA, 22 bp, Artificial Sequence
  chemically synthesized
aatcttagctgcagggcattgg

SEQ ID NO: 32590 - DNA, 22 bp, Artificial Sequence
  chemically synthesized
agctgcagggcattggctaaag

SEQ ID NO: 32591 - DNA, 22 bp, Artificial Sequence
  chemically synthesized
gctgcagggcattggctaaaga

SEQ ID NO: 32592 - DNA, 22 bp, Artificial Sequence
  chemically synthesized
cagggcattggctaaagaggaa

SEQ ID NO: 32593 - DNA, 22 bp, Artificial Sequence
  chemically synthesized
gctaaagaggaaggtgaaaact

SEQ ID NO: 32594 - DNA, 22 bp, Artificial Sequence
  chemically synthesized
aagaggaaggtgaaaactgctg

SEQ ID NO: 32595 - DNA, 22 bp, Artificial Sequence
  chemically synthesized
ctgagtcactatcaaatcaatt

SEQ ID NO: 32596 - DNA, 22 bp, Artificial Sequence
  chemically synthesized
agtcactatcaaatcaattggt

SEQ ID NO: 32597 - DNA, 22 bp, Artificial Sequence
  chemically synthesized
tcaaatcaattggtttttctaa

SEQ ID NO: 32598 - DNA, 22 bp, Artificial Sequence
  chemically synthesized
gtttttctaatcccctgagaga

SEQ ID NO: 32599 - DNA, 22 bp, Artificial Sequence
  chemically synthesized
ttctaatcccctgagagaaaaa

SEQ ID NO: 32600 - DNA, 22 bp, Artificial Sequence
  chemically synthesized
tctaatcccctgagagaaaaag

SEQ ID NO: 32601 - DNA, 22 bp, Artificial Sequence
  chemically synthesized
ctaatcccctgagagaaaaagt

SEQ ID NO: 32602 - DNA, 22 bp, Artificial Sequence
  chemically synthesized
taatcccctgagagaaaaagta

SEQ ID NO: 32603 - DNA, 22 bp, Artificial Sequence
  chemically synthesized
atcccctgagagaaaaagtaca

SEQ ID NO: 32604 - DNA, 22 bp, Artificial Sequence
  chemically synthesized
agagaaaaagtacagagtttat

SEQ ID NO: 32605 - DNA, 22 bp, Artificial Sequence
  chemically synthesized
attgcagctttaaaatgccatg

SEQ ID NO: 32606 - DNA, 22 bp, Artificial Sequence
  chemically synthesized
ttgcagctttaaaatgccatgc

SEQ ID NO: 32607 - DNA, 22 bp, Artificial Sequence
  chemically synthesized
cagctttaaaatgccatgcccc

SEQ ID NO: 32608 - DNA, 22 bp, Artificial Sequence
  chemically synthesized
taaaatgccatgcccctcacgg

SEQ ID NO: 32609 - DNA, 22 bp, Artificial Sequence
  chemically synthesized
aaaatgccatgcccctcacggc

SEQ ID NO: 32610 - DNA, 22 bp, Artificial Sequence
  chemically synthesized
aaatgccatgcccctcacggcc

SEQ ID NO: 32611 - DNA, 22 bp, Artificial Sequence
  chemically synthesized
acggccaaaggcatctgaatta

SEQ ID NO: 32612 - DNA, 22 bp, Artificial Sequence
  chemically synthesized
aattaaggaagcagtattcaca

SEQ ID NO: 32613 - DNA, 22 bp, Artificial Sequence
  chemically synthesized
aggaagcagtattcacagctgc

SEQ ID NO: 32614 - DNA, 22 bp, Artificial Sequence
  chemically synthesized
acagctgctttctccagacatt

SEQ ID NO: 32615 - DNA, 22 bp, Artificial Sequence
  chemically synthesized
ctttctccagacattgagctca

SEQ ID NO: 32616 - DNA, 22 bp, Artificial Sequence
  chemically synthesized
tctccagacattgagctcaagg

SEQ ID NO: 32617 - DNA, 22 bp, Artificial Sequence
  chemically synthesized
ctccagacattgagctcaagga

SEQ ID NO: 32618 - DNA, 22 bp, Artificial Sequence
  chemically synthesized
tccagacattgagctcaaggac

SEQ ID NO: 32619 - DNA, 22 bp, Artificial Sequence
  chemically synthesized
cagacattgagctcaaggacag

SEQ ID NO: 32620 - DNA, 22 bp, Artificial Sequence
  chemically synthesized
agctcaaggacagaatctgaac

SEQ ID NO: 32621 - DNA, 22 bp, Artificial Sequence
  chemically synthesized
aaggacagaatctgaactctgc

SEQ ID NO: 32622 - DNA, 22 bp, Artificial Sequence
  chemically synthesized
aactctgcttttatcagctgcg

SEQ ID NO: 32623 - DNA, 22 bp, Artificial Sequence
  chemically synthesized
tgcttttatcagctgcgaaaat

SEQ ID NO: 32624 - DNA, 22 bp, Artificial Sequence
  chemically synthesized
cttttatcagctgcgaaaatcc

SEQ ID NO: 32625 - DNA, 22 bp, Artificial Sequence
  chemically synthesized
ttatcagctgcgaaaatccaag

SEQ ID NO: 32626 - DNA, 22 bp, Artificial Sequence
  chemically synthesized
tatcagctgcgaaaatccaagc

SEQ ID NO: 32627 - DNA, 22 bp, Artificial Sequence
  chemically synthesized
atcagctgcgaaaatccaagca

SEQ ID NO: 32628 - DNA, 22 bp, Artificial Sequence
  chemically synthesized
tcagctgcgaaaatccaagcat

SEQ ID NO: 32629 - DNA, 22 bp, Artificial Sequence
  chemically synthesized
cgaaaatccaagcattcatttc

SEQ ID NO: 32630 - DNA, 22 bp, Artificial Sequence
  chemically synthesized
atttccagctggttcagtgcct

SEQ ID NO: 32631 - DNA, 22 bp, Artificial Sequence
  chemically synthesized
ccagctggttcagtgcctatgt

SEQ ID NO: 32632 - DNA, 22 bp, Artificial Sequence
  chemically synthesized
cagctggttcagtgcctatgta

SEQ ID NO: 32633 - DNA, 22 bp, Artificial Sequence
  chemically synthesized
gttcagtgcctatgtaaaagta

SEQ ID NO: 32634 - DNA, 22 bp, Artificial Sequence
  chemically synthesized
agtgcctatgtaaaagtatact

SEQ ID NO: 32635 - DNA, 22 bp, Artificial Sequence
  chemically synthesized
tgtaaaagtatactgtgtacaa

SEQ ID NO: 32636 - DNA, 22 bp, Artificial Sequence
  chemically synthesized
tgtacaaaaataagattaaaaa

SEQ ID NO: 32637 - DNA, 22 bp, Artificial Sequence
  chemically synthesized
aaaagctaacattaagcaagtg

SEQ ID NO: 32638 - DNA, 22 bp, Artificial Sequence
  chemically synthesized
acattaagcaagtgtgtttgta

SEQ ID NO: 32639 - DNA, 22 bp, Artificial Sequence
  chemically synthesized
agcaagtgtgtttgtatgtttt

SEQ ID NO: 32640 - DNA, 22 bp, Artificial Sequence
  chemically synthesized
gtatgttttctacagttcggat

SEQ ID NO: 32641 - DNA, 22 bp, Artificial Sequence
  chemically synthesized
tatgttttctacagttcggatt

SEQ ID NO: 32642 - DNA, 22 bp, Artificial Sequence
  chemically synthesized
tctacagttcggatttctgaat

SEQ ID NO: 32643 - DNA, 22 bp, Artificial Sequence
  chemically synthesized
ctacagttcggatttctgaata

SEQ ID NO: 32644 - DNA, 22 bp, Artificial Sequence
  chemically synthesized
tacagttcggatttctgaataa

SEQ ID NO: 32645 - DNA, 22 bp, Artificial Sequence
  chemically synthesized
cagttcggatttctgaataatt

SEQ ID NO: 32646 - DNA, 22 bp, Artificial Sequence
  chemically synthesized
ggatttctgaataatttgatcc

SEQ ID NO: 32647 - DNA, 22 bp, Artificial Sequence
  chemically synthesized
ctgaataatttgatccgacaga

SEQ ID NO: 32648 - DNA, 22 bp, Artificial Sequence
  chemically synthesized
tgaataatttgatccgacagaa

SEQ ID NO: 32649 - DNA, 22 bp, Artificial Sequence
  chemically synthesized
aataatttgatccgacagaaaa

SEQ ID NO: 32650 - DNA, 22 bp, Artificial Sequence
  chemically synthesized
gatccgacagaaaaatatgatt

SEQ ID NO: 32651 - DNA, 22 bp, Artificial Sequence
  chemically synthesized
atccgacagaaaaatatgattt

SEQ ID NO: 32652 - DNA, 22 bp, Artificial Sequence
  chemically synthesized
catttcttttcgagagaattat

SEQ ID NO: 32653 - DNA, 22 bp, Artificial Sequence
  chemically synthesized
atttcttttcgagagaattata

SEQ ID NO: 32654 - DNA, 22 bp, Artificial Sequence
  chemically synthesized
cttttcgagagaattatatgca

SEQ ID NO: 32655 - DNA, 22 bp, Artificial Sequence
  chemically synthesized
ttttcgagagaattatatgcat

SEQ ID NO: 32656 - DNA, 22 bp, Artificial Sequence
  chemically synthesized
ttcgagagaattatatgcatac

SEQ ID NO: 32657 - DNA, 22 bp, Artificial Sequence
  chemically synthesized
tcgagagaattatatgcatact

SEQ ID NO: 32658 - DNA, 22 bp, Artificial Sequence
  chemically synthesized
cgagagaattatatgcatactt

SEQ ID NO: 32659 - DNA, 22 bp, Artificial Sequence
  chemically synthesized
gagagaattatatgcatacttt

SEQ ID NO: 32660 - DNA, 22 bp, Artificial Sequence
  chemically synthesized
tatgcatactttctaaatgcaa

SEQ ID NO: 32661 - DNA, 22 bp, Artificial Sequence
  chemically synthesized
tctaaatgcaagaataaattcc

SEQ ID NO: 32662 - DNA, 22 bp, Artificial Sequence
  chemically synthesized
ctaaatgcaagaataaattcct

SEQ ID NO: 32663 - DNA, 22 bp, Artificial Sequence
  chemically synthesized
taaatgcaagaataaattcctg

SEQ ID NO: 32664 - DNA, 22 bp, Artificial Sequence
  chemically synthesized
aatgcaagaataaattcctgag

SEQ ID NO: 32665 - DNA, 22 bp, Artificial Sequence
  chemically synthesized
ctgagctccatgtgacttcagt

SEQ ID NO: 32666 - DNA, 22 bp, Artificial Sequence
  chemically synthesized
agctccatgtgacttcagtacc

SEQ ID NO: 32667 - DNA, 22 bp, Artificial Sequence
  chemically synthesized
catgtgacttcagtaccatcag

SEQ ID NO: 32668 - DNA, 22 bp, Artificial Sequence
  chemically synthesized
cagtaccatcagctctttggca

SEQ ID NO: 32669 - DNA, 22 bp, Artificial Sequence
  chemically synthesized
agtaccatcagctctttggcag

SEQ ID NO: 32670 - DNA, 22 bp, Artificial Sequence
  chemically synthesized
tttggcagcttatgagtataca

SEQ ID NO: 32671 - DNA, 22 bp, Artificial Sequence
  chemically synthesized
tggcagcttatgagtatacagc

SEQ ID NO: 32672 - DNA, 22 bp, Artificial Sequence
  chemically synthesized
ggcagcttatgagtatacagct

SEQ ID NO: 32673 - DNA, 22 bp, Artificial Sequence
  chemically synthesized
gcagcttatgagtatacagctt

SEQ ID NO: 32674 - DNA, 22 bp, Artificial Sequence
  chemically synthesized
atgagtatacagctttttaatt

SEQ ID NO: 32675 - DNA, 22 bp, Artificial Sequence
  chemically synthesized
tgagtatacagctttttaattc

SEQ ID NO: 32676 - DNA, 22 bp, Artificial Sequence
  chemically synthesized
tttaattctcacctggtcccca

SEQ ID NO: 32677 - DNA, 22 bp, Artificial Sequence
  chemically synthesized
ttaattctcacctggtccccag

SEQ ID NO: 32678 - DNA, 22 bp, Artificial Sequence
  chemically synthesized
taattctcacctggtccccagg

SEQ ID NO: 32679 - DNA, 22 bp, Artificial Sequence
  chemically synthesized
aattctcacctggtccccagga

SEQ ID NO: 32680 - DNA, 22 bp, Artificial Sequence
  chemically synthesized
attctcacctggtccccaggat

SEQ ID NO: 32681 - DNA, 22 bp, Artificial Sequence
  chemically synthesized
tcacctggtccccaggatatgg

SEQ ID NO: 32682 - DNA, 22 bp, Artificial Sequence
  chemically synthesized
acctggtccccaggatatggtt

SEQ ID NO: 32683 - DNA, 22 bp, Artificial Sequence
  chemically synthesized
gtccccaggatatggtttactt

SEQ ID NO: 32684 - DNA, 22 bp, Artificial Sequence
  chemically synthesized
acttgtcagagtagttttatga

SEQ ID NO: 32685 - DNA, 22 bp, Artificial Sequence
  chemically synthesized
cttgtcagagtagttttatgag

SEQ ID NO: 32686 - DNA, 22 bp, Artificial Sequence
  chemically synthesized
gtcagagtagttttatgaggtg

SEQ ID NO: 32687 - DNA, 22 bp, Artificial Sequence
  chemically synthesized
tcagagtagttttatgaggtgc

SEQ ID NO: 32688 - DNA, 22 bp, Artificial Sequence
  chemically synthesized
tatgaggtgctttctcctgact

SEQ ID NO: 32689 - DNA, 22 bp, Artificial Sequence
  chemically synthesized
atgaggtgctttctcctgactc

SEQ ID NO: 32690 - DNA, 22 bp, Artificial Sequence
  chemically synthesized
tgaggtgctttctcctgactct

SEQ ID NO: 32691 - DNA, 22 bp, Artificial Sequence
  chemically synthesized
tctcctgactctgattctaggt

SEQ ID NO: 32692 - DNA, 22 bp, Artificial Sequence
  chemically synthesized
ctcctgactctgattctaggta

SEQ ID NO: 32693 - DNA, 22 bp, Artificial Sequence
  chemically synthesized
tcctgactctgattctaggtaa

SEQ ID NO: 32694 - DNA, 22 bp, Artificial Sequence
  chemically synthesized
ctgactctgattctaggtaaca

SEQ ID NO: 32695 - DNA, 22 bp, Artificial Sequence
  chemically synthesized
actctgattctaggtaacacct

SEQ ID NO: 32696 - DNA, 22 bp, Artificial Sequence
  chemically synthesized
tgattctaggtaacacctgatg

SEQ ID NO: 32697 - DNA, 22 bp, Artificial Sequence
  chemically synthesized
attctaggtaacacctgatgag

SEQ ID NO: 32698 - DNA, 22 bp, Artificial Sequence
  chemically synthesized
taggtaacacctgatgagatga

SEQ ID NO: 32699 - DNA, 22 bp, Artificial Sequence
  chemically synthesized
ggtaacacctgatgagatgaac

SEQ ID NO: 32700 - DNA, 22 bp, Artificial Sequence
  chemically synthesized
atgagatgaacagatggtgcac

SEQ ID NO: 32701 - DNA, 22 bp, Artificial Sequence
  chemically synthesized
acttcctcttactgggcatgaa

SEQ ID NO: 32702 - DNA, 22 bp, Artificial Sequence
  chemically synthesized
cctcttactgggcatgaaggaa

SEQ ID NO: 32703 - DNA, 22 bp, Artificial Sequence
  chemically synthesized
ctcttactgggcatgaaggaaa

SEQ ID NO: 32704 - DNA, 22 bp, Artificial Sequence
  chemically synthesized
ttactgggcatgaaggaaagag

SEQ ID NO: 32705 - DNA, 22 bp, Artificial Sequence
  chemically synthesized
actgggcatgaaggaaagagag

SEQ ID NO: 32706 - DNA, 22 bp, Artificial Sequence
  chemically synthesized
ctgggcatgaaggaaagagaga

SEQ ID NO: 32707 - DNA, 22 bp, Artificial Sequence
  chemically synthesized
ggcatgaaggaaagagagagaa

SEQ ID NO: 32708 - DNA, 22 bp, Artificial Sequence
  chemically synthesized
ctgctacattttttttttctgt

SEQ ID NO: 32709 - DNA, 22 bp, Artificial Sequence
  chemically synthesized
ctacattttttttttctgtgga

SEQ ID NO: 32710 - DNA, 22 bp, Artificial Sequence
  chemically synthesized
cattttttttttctgtggaaaa

SEQ ID NO: 32711 - DNA, 22 bp, Artificial Sequence
  chemically synthesized
tttttttctgtggaaaaagagt

SEQ ID NO: 32712 - DNA, 22 bp, Artificial Sequence
  chemically synthesized
ttttttctgtggaaaaagagtc

SEQ ID NO: 32713 - DNA, 22 bp, Artificial Sequence
  chemically synthesized
tttttctgtggaaaaagagtct

SEQ ID NO: 32714 - DNA, 22 bp, Artificial Sequence
  chemically synthesized
ttttctgtggaaaaagagtcta

SEQ ID NO: 32715 - DNA, 22 bp, Artificial Sequence
  chemically synthesized
tttctgtggaaaaagagtctaa

SEQ ID NO: 32716 - DNA, 22 bp, Artificial Sequence
  chemically synthesized
ttctgtggaaaaagagtctaat

SEQ ID NO: 32717 - DNA, 22 bp, Artificial Sequence
  chemically synthesized
tctgtggaaaaagagtctaata

SEQ ID NO: 32718 - DNA, 22 bp, Artificial Sequence
  chemically synthesized
ctgtggaaaaagagtctaatat

SEQ ID NO: 32719 - DNA, 22 bp, Artificial Sequence
  chemically synthesized
tgtggaaaaagagtctaatatt

SEQ ID NO: 32720 - DNA, 22 bp, Artificial Sequence
  chemically synthesized
tggaaaaagagtctaatatttc

SEQ ID NO: 32721 - DNA, 22 bp, Artificial Sequence
  chemically synthesized
atatttctaattaaccttgatg

SEQ ID NO: 32722 - DNA, 22 bp, Artificial Sequence
  chemically synthesized
ctaattaaccttgatgggaaca

SEQ ID NO: 32723 - DNA, 22 bp, Artificial Sequence
  chemically synthesized
taattaaccttgatgggaacat

SEQ ID NO: 32724 - DNA, 22 bp, Artificial Sequence
  chemically synthesized
attaaccttgatgggaacatag

SEQ ID NO: 32725 - DNA, 22 bp, Artificial Sequence
  chemically synthesized
accttgatgggaacatagaaca

SEQ ID NO: 32726 - DNA, 22 bp, Artificial Sequence
  chemically synthesized
gatgggaacatagaacatagat

SEQ ID NO: 32727 - DNA, 22 bp, Artificial Sequence
  chemically synthesized
atgggaacatagaacatagatt

SEQ ID NO: 32728 - DNA, 22 bp, Artificial Sequence
  chemically synthesized
taaagggaacttgcacattatc

SEQ ID NO: 32729 - DNA, 22 bp, Artificial Sequence
  chemically synthesized
gcacattatcgcagtaggctga

SEQ ID NO: 32730 - DNA, 22 bp, Artificial Sequence
  chemically synthesized
cacattatcgcagtaggctgaa

SEQ ID NO: 32731 - DNA, 22 bp, Artificial Sequence
  chemically synthesized
tcgcagtaggctgaataatggc

SEQ ID NO: 32732 - DNA, 22 bp, Artificial Sequence
  chemically synthesized
aataatggctaatggctcactc

SEQ ID NO: 32733 - DNA, 22 bp, Artificial Sequence
  chemically synthesized
atggctcactctgaaagatatg

SEQ ID NO: 32734 - DNA, 22 bp, Artificial Sequence
  chemically synthesized
actctgaaagatatgtatggct

SEQ ID NO: 32735 - DNA, 22 bp, Artificial Sequence
  chemically synthesized
tgaaagatatgtatggcttaac

SEQ ID NO: 32736 - DNA, 22 bp, Artificial Sequence
  chemically synthesized
aaagatatgtatggcttaaccc

SEQ ID NO: 32737 - DNA, 22 bp, Artificial Sequence
  chemically synthesized
aacccctgaaacctgtgagtat

SEQ ID NO: 32738 - DNA, 22 bp, Artificial Sequence
  chemically synthesized
acccctgaaacctgtgagtatt

SEQ ID NO: 32739 - DNA, 22 bp, Artificial Sequence
  chemically synthesized
aaacctgtgagtattatctttt

SEQ ID NO: 32740 - DNA, 22 bp, Artificial Sequence
  chemically synthesized
tgagtattatcttttctagcca

SEQ ID NO: 32741 - DNA, 22 bp, Artificial Sequence
  chemically synthesized
tcttttctagccaaacagactt

SEQ ID NO: 32742 - DNA, 22 bp, Artificial Sequence
  chemically synthesized
ttctagccaaacagacttttgc

SEQ ID NO: 32743 - DNA, 22 bp, Artificial Sequence
  chemically synthesized
tctagccaaacagacttttgca

SEQ ID NO: 32744 - DNA, 22 bp, Artificial Sequence
  chemically synthesized
ctagccaaacagacttttgcat

SEQ ID NO: 32745 - DNA, 22 bp, Artificial Sequence
  chemically synthesized
tagccaaacagacttttgcata

SEQ ID NO: 32746 - DNA, 22 bp, Artificial Sequence
  chemically synthesized
gccaaacagacttttgcatata

SEQ ID NO: 32747 - DNA, 22 bp, Artificial Sequence
  chemically synthesized
ttgcatatataattaaggatct

SEQ ID NO: 32748 - DNA, 22 bp, Artificial Sequence
  chemically synthesized
tgcatatataattaaggatctt

SEQ ID NO: 32749 - DNA, 22 bp, Artificial Sequence
  chemically synthesized
gcatatataattaaggatcttg

SEQ ID NO: 32750 - DNA, 22 bp, Artificial Sequence
  chemically synthesized
catatataattaaggatcttgg

SEQ ID NO: 32751 - DNA, 22 bp, Artificial Sequence
  chemically synthesized
aggatcttgggatggggagata

SEQ ID NO: 32752 - DNA, 22 bp, Artificial Sequence
  chemically synthesized
gggatggggagatatcctaatt

SEQ ID NO: 32753 - DNA, 22 bp, Artificial Sequence
  chemically synthesized
ggatggggagatatcctaatta

SEQ ID NO: 32754 - DNA, 22 bp, Artificial Sequence
  chemically synthesized
attatttgggtgtatcctaaat

SEQ ID NO: 32755 - DNA, 22 bp, Artificial Sequence
  chemically synthesized
tttgggtgtatcctaaatgtaa

SEQ ID NO: 32756 - DNA, 22 bp, Artificial Sequence
  chemically synthesized
gggtgtatcctaaatgtaatca

SEQ ID NO: 32757 - DNA, 22 bp, Artificial Sequence
  chemically synthesized
ggtgtatcctaaatgtaatcac

SEQ ID NO: 32758 - DNA, 22 bp, Artificial Sequence
  chemically synthesized
aatgtaatcacaagtgtcatta

SEQ ID NO: 32759 - DNA, 22 bp, Artificial Sequence
  chemically synthesized
taagagggaggcaaagggagat

SEQ ID NO: 32760 - DNA, 22 bp, Artificial Sequence
  chemically synthesized
gacttataagaggagaaaatgt

SEQ ID NO: 32761 - DNA, 22 bp, Artificial Sequence
  chemically synthesized
acttataagaggagaaaatgtg

SEQ ID NO: 32762 - DNA, 22 bp, Artificial Sequence
  chemically synthesized
ataagaggagaaaatgtgacgt

SEQ ID NO: 32763 - DNA, 22 bp, Artificial Sequence
  chemically synthesized
taagaggagaaaatgtgacgtg

SEQ ID NO: 32764 - DNA, 22 bp, Artificial Sequence
  chemically synthesized
caaaagcagagatacatttttt

SEQ ID NO: 32765 - DNA, 22 bp, Artificial Sequence
  chemically synthesized
ttttgaagatcgaggaagaggc

SEQ ID NO: 32766 - DNA, 22 bp, Artificial Sequence
  chemically synthesized
tttgaagatcgaggaagaggct

SEQ ID NO: 32767 - DNA, 22 bp, Artificial Sequence
  chemically synthesized
ttgaagatcgaggaagaggcta

SEQ ID NO: 32768 - DNA, 22 bp, Artificial Sequence
  chemically synthesized
tgaagatcgaggaagaggctac

SEQ ID NO: 32769 - DNA, 22 bp, Artificial Sequence
  chemically synthesized
gaagatcgaggaagaggctaca

SEQ ID NO: 32770 - DNA, 22 bp, Artificial Sequence
  chemically synthesized
aagatcgaggaagaggctacaa

SEQ ID NO: 32771 - DNA, 22 bp, Artificial Sequence
  chemically synthesized
caaaccaaggaatgtgggtagc

SEQ ID NO: 32772 - DNA, 22 bp, Artificial Sequence
  chemically synthesized
tagaagaggaaacagaatccat

SEQ ID NO: 32773 - DNA, 22 bp, Artificial Sequence
  chemically synthesized
gaagaggaaacagaatccatgg

SEQ ID NO: 32774 - DNA, 22 bp, Artificial Sequence
  chemically synthesized
tcatagagtctccagaagaaac

SEQ ID NO: 32775 - DNA, 22 bp, Artificial Sequence
  chemically synthesized
atagagtctccagaagaaacag

SEQ ID NO: 32776 - DNA, 22 bp, Artificial Sequence
  chemically synthesized
cagaagaaacagccacactgac

SEQ ID NO: 32777 - DNA, 22 bp, Artificial Sequence
  chemically synthesized
acacctcgactttagcccagtg

SEQ ID NO: 32778 - DNA, 22 bp, Artificial Sequence
  chemically synthesized
gactttagcccagtgaaaccga

SEQ ID NO: 32779 - DNA, 22 bp, Artificial Sequence
  chemically synthesized
tagcccagtgaaaccgatttca

SEQ ID NO: 32780 - DNA, 22 bp, Artificial Sequence
  chemically synthesized
agcccagtgaaaccgatttcag

SEQ ID NO: 32781 - DNA, 22 bp, Artificial Sequence
  chemically synthesized
gcccagtgaaaccgatttcaga

SEQ ID NO: 32782 - DNA, 22 bp, Artificial Sequence
  chemically synthesized
cagacttctgacctccacaact

SEQ ID NO: 32783 - DNA, 22 bp, Artificial Sequence
  chemically synthesized
agacttctgacctccacaactt

SEQ ID NO: 32784 - DNA, 22 bp, Artificial Sequence
  chemically synthesized
ctgacctccacaacttcaagat

SEQ ID NO: 32785 - DNA, 22 bp, Artificial Sequence
  chemically synthesized
tgacctccacaacttcaagata

SEQ ID NO: 32786 - DNA, 22 bp, Artificial Sequence
  chemically synthesized
acctccacaacttcaagataat

SEQ ID NO: 32787 - DNA, 22 bp, Artificial Sequence
  chemically synthesized
cacaacttcaagataatacatt

SEQ ID NO: 32788 - DNA, 22 bp, Artificial Sequence
  chemically synthesized
caagataatacatttgtgttgt

SEQ ID NO: 32789 - DNA, 22 bp, Artificial Sequence
  chemically synthesized
aagataatacatttgtgttgtt

SEQ ID NO: 32790 - DNA, 22 bp, Artificial Sequence
  chemically synthesized
gtgttgttttaagccaataaat

SEQ ID NO: 32791 - DNA, 22 bp, Artificial Sequence
  chemically synthesized
tgttgttttaagccaataaatt

SEQ ID NO: 32792 - DNA, 22 bp, Artificial Sequence
  chemically synthesized
ttttaagccaataaatttgtgg

SEQ ID NO: 32793 - DNA, 22 bp, Artificial Sequence
  chemically synthesized
taagccaataaatttgtggtaa

SEQ ID NO: 32794 - DNA, 22 bp, Artificial Sequence
  chemically synthesized
aagccaataaatttgtggtaat

SEQ ID NO: 32795 - DNA, 22 bp, Artificial Sequence
  chemically synthesized
agccaataaatttgtggtaatt

SEQ ID NO: 32796 - DNA, 22 bp, Artificial Sequence
  chemically synthesized
gtggtaattttttacagcagca

SEQ ID NO: 32797 - DNA, 22 bp, Artificial Sequence
  chemically synthesized
tggtaattttttacagcagcaa

SEQ ID NO: 32798 - DNA, 22 bp, Artificial Sequence
  chemically synthesized
tttacagcagcaagaggaaatc

SEQ ID NO: 32799 - DNA, 22 bp, Artificial Sequence
  chemically synthesized
ttacagcagcaagaggaaatca

SEQ ID NO: 32800 - DNA, 22 bp, Artificial Sequence
  chemically synthesized
tacagcagcaagaggaaatcag

SEQ ID NO: 32801 - DNA, 22 bp, Artificial Sequence
  chemically synthesized
acagcagcaagaggaaatcagt

SEQ ID NO: 32802 - DNA, 22 bp, Artificial Sequence
  chemically synthesized
cagcagcaagaggaaatcagtt

SEQ ID NO: 32803 - DNA, 22 bp, Artificial Sequence
  chemically synthesized
cgtagaatagtaggtcctgtct

SEQ ID NO: 32804 - DNA, 22 bp, Artificial Sequence
  chemically synthesized
tctctggctaatcattagaatc

SEQ ID NO: 32805 - DNA, 22 bp, Artificial Sequence
  chemically synthesized
tggctaatcattagaatcactc

SEQ ID NO: 32806 - DNA, 22 bp, Artificial Sequence
  chemically synthesized
gctaatcattagaatcactcca

SEQ ID NO: 32807 - DNA, 22 bp, Artificial Sequence
  chemically synthesized
atcattagaatcactccagaag

SEQ ID NO: 32808 - DNA, 22 bp, Artificial Sequence
  chemically synthesized
gaatcactccagaagcttgtta

SEQ ID NO: 32809 - DNA, 22 bp, Artificial Sequence
  chemically synthesized
cagaagcttgttacatacagac

SEQ ID NO: 32810 - DNA, 22 bp, Artificial Sequence
  chemically synthesized
gttacatacagacccagagcca

SEQ ID NO: 32811 - DNA, 22 bp, Artificial Sequence
  chemically synthesized
ttacatacagacccagagccag

SEQ ID NO: 32812 - DNA, 22 bp, Artificial Sequence
  chemically synthesized
catacagacccagagccagtga

SEQ ID NO: 32813 - DNA, 22 bp, Artificial Sequence
  chemically synthesized
ggtggtggggcccagagcctga

SEQ ID NO: 32814 - DNA, 22 bp, Artificial Sequence
  chemically synthesized
gtggtggggcccagagcctgaa

SEQ ID NO: 32815 - DNA, 22 bp, Artificial Sequence
  chemically synthesized
aatattaagcaagttcttcgtt

SEQ ID NO: 32816 - DNA, 22 bp, Artificial Sequence
  chemically synthesized
agcaagttcttcgttttagaaa

SEQ ID NO: 32817 - DNA, 22 bp, Artificial Sequence
  chemically synthesized
ttcgttttagaaatgaggaaac

SEQ ID NO: 32818 - DNA, 22 bp, Artificial Sequence
  chemically synthesized
cgttttagaaatgaggaaacca

SEQ ID NO: 32819 - DNA, 22 bp, Artificial Sequence
  chemically synthesized
gttttagaaatgaggaaaccaa

SEQ ID NO: 32820 - DNA, 22 bp, Artificial Sequence
  chemically synthesized
tagaaatgaggaaaccaaggtt

SEQ ID NO: 32821 - DNA, 22 bp, Artificial Sequence
  chemically synthesized
agaaatgaggaaaccaaggttg

SEQ ID NO: 32822 - DNA, 22 bp, Artificial Sequence
  chemically synthesized
gaaatgaggaaaccaaggttgg

SEQ ID NO: 32823 - DNA, 22 bp, Artificial Sequence
  chemically synthesized
ggagaagctaagcaacttactc

SEQ ID NO: 32824 - DNA, 22 bp, Artificial Sequence
  chemically synthesized
agcaacttactcaaatacatag

SEQ ID NO: 32825 - DNA, 22 bp, Artificial Sequence
  chemically synthesized
actcaaatacatagggtatttc

SEQ ID NO: 32826 - DNA, 22 bp, Artificial Sequence
  chemically synthesized
ctcaaatacatagggtatttca

SEQ ID NO: 32827 - DNA, 22 bp, Artificial Sequence
  chemically synthesized
aaatacatagggtatttcattt

SEQ ID NO: 32828 - DNA, 22 bp, Artificial Sequence
  chemically synthesized
cattttaaatttaattttatta

SEQ ID NO: 32829 - DNA, 22 bp, Artificial Sequence
  chemically synthesized
attttaaatttaattttattac

SEQ ID NO: 32830 - DNA, 22 bp, Artificial Sequence
  chemically synthesized
taaatttaattttattacttta

SEQ ID NO: 32831 - DNA, 22 bp, Artificial Sequence
  chemically synthesized
aaatttaattttattactttat

SEQ ID NO: 32832 - DNA, 22 bp, Artificial Sequence
  chemically synthesized
aatttaattttattactttatc

SEQ ID NO: 32833 - DNA, 22 bp, Artificial Sequence
  chemically synthesized
aattttattactttatcttttg

SEQ ID NO: 32834 - DNA, 22 bp, Artificial Sequence
  chemically synthesized
attttattactttatcttttga

SEQ ID NO: 32835 - DNA, 22 bp, Artificial Sequence
  chemically synthesized
tattactttatcttttgaattt

SEQ ID NO: 32836 - DNA, 22 bp, Artificial Sequence
  chemically synthesized
attactttatcttttgaatttt

SEQ ID NO: 32837 - DNA, 22 bp, Artificial Sequence
  chemically synthesized
ttactttatcttttgaattttc

SEQ ID NO: 32838 - DNA, 22 bp, Artificial Sequence
  chemically synthesized
ctttatcttttgaattttctta

SEQ ID NO: 32839 - DNA, 22 bp, Artificial Sequence
  chemically synthesized
tatcttttgaattttcttaccc

SEQ ID NO: 32840 - DNA, 22 bp, Artificial Sequence
  chemically synthesized
atcttttgaattttcttacccc

SEQ ID NO: 32841 - DNA, 22 bp, Artificial Sequence
  chemically synthesized
tcttttgaattttcttacccca

SEQ ID NO: 32842 - DNA, 22 bp, Artificial Sequence
  chemically synthesized
ttgaattttcttaccccagttg

SEQ ID NO: 32843 - DNA, 22 bp, Artificial Sequence
  chemically synthesized
tgaattttcttaccccagttgt

SEQ ID NO: 32844 - DNA, 22 bp, Artificial Sequence
  chemically synthesized
gaattttcttaccccagttgta

SEQ ID NO: 32845 - DNA, 22 bp, Artificial Sequence
  chemically synthesized
aattttcttaccccagttgtac

SEQ ID NO: 32846 - DNA, 22 bp, Artificial Sequence
  chemically synthesized
tcttaccccagttgtacttttg

SEQ ID NO: 32847 - DNA, 22 bp, Artificial Sequence
  chemically synthesized
cttaccccagttgtacttttgt

SEQ ID NO: 32848 - DNA, 22 bp, Artificial Sequence
  chemically synthesized
ttaccccagttgtacttttgtg

SEQ ID NO: 32849 - DNA, 22 bp, Artificial Sequence
  chemically synthesized
accccagttgtacttttgtgta

SEQ ID NO: 32850 - DNA, 22 bp, Artificial Sequence
  chemically synthesized
ccccagttgtacttttgtgtaa

SEQ ID NO: 32851 - DNA, 22 bp, Artificial Sequence
  chemically synthesized
tacttttgtgtaaatgtgattt

SEQ ID NO: 32852 - DNA, 22 bp, Artificial Sequence
  chemically synthesized
ttgtgtaaatgtgatttcattt

SEQ ID NO: 32853 - DNA, 22 bp, Artificial Sequence
  chemically synthesized
tgtgtaaatgtgatttcattta

SEQ ID NO: 32854 - DNA, 22 bp, Artificial Sequence
  chemically synthesized
gtgtaaatgtgatttcatttac

SEQ ID NO: 32855 - DNA, 22 bp, Artificial Sequence
  chemically synthesized
tgtaaatgtgatttcatttacg

SEQ ID NO: 32856 - DNA, 22 bp, Artificial Sequence
  chemically synthesized
catttacggctttgtgttgaca

SEQ ID NO: 32857 - DNA, 22 bp, Artificial Sequence
  chemically synthesized
atttacggctttgtgttgacat

SEQ ID NO: 32858 - DNA, 22 bp, Artificial Sequence
  chemically synthesized
acggctttgtgttgacatattc

SEQ ID NO: 32859 - DNA, 22 bp, Artificial Sequence
  chemically synthesized
cggctttgtgttgacatattca

SEQ ID NO: 32860 - DNA, 22 bp, Artificial Sequence
  chemically synthesized
tgtgttgacatattcattaaaa

SEQ ID NO: 32861 - DNA, 22 bp, Artificial Sequence
  chemically synthesized
gtgttgacatattcattaaaat

SEQ ID NO: 32862 - DNA, 22 bp, Artificial Sequence
  chemically synthesized
tgttgacatattcattaaaatg

SEQ ID NO: 32863 - DNA, 22 bp, Artificial Sequence
  chemically synthesized
acatattcattaaaatgaagaa

SEQ ID NO: 32864 - DNA, 22 bp, Artificial Sequence
  chemically synthesized
attaaaatgaagaaataaaaga

SEQ ID NO: 32865 - DNA, 22 bp, Artificial Sequence
  chemically synthesized
aaatgaagaaataaaagatgag

SEQ ID NO: 32866 - DNA, 22 bp, Artificial Sequence
  chemically synthesized
taaaaattatataatgtttatt

SEQ ID NO: 32867 - DNA, 22 bp, Artificial Sequence
  chemically synthesized
aaaaattatataatgtttattg

SEQ ID NO: 32868 - DNA, 22 bp, Artificial Sequence
  chemically synthesized
aaaattatataatgtttattga

SEQ ID NO: 32869 - DNA, 22 bp, Artificial Sequence
  chemically synthesized
tataatgtttattgattagaat

SEQ ID NO: 32870 - DNA, 22 bp, Artificial Sequence
  chemically synthesized
attgattagaatgaatatgatg

SEQ ID NO: 32871 - DNA, 22 bp, Artificial Sequence
  chemically synthesized
ttgattagaatgaatatgatgc

SEQ ID NO: 32872 - DNA, 22 bp, Artificial Sequence
  chemically synthesized
attagaatgaatatgatgcaat

SEQ ID NO: 32873 - DNA, 22 bp, Artificial Sequence
  chemically synthesized
gaatgaatatgatgcaatctgg

SEQ ID NO: 32874 - DNA, 22 bp, Artificial Sequence
  chemically synthesized
gttttctgtgttcagattcctg

SEQ ID NO: 32875 - DNA, 22 bp, Artificial Sequence
  chemically synthesized
tctgtgttcagattcctgacct

SEQ ID NO: 32876 - DNA, 22 bp, Artificial Sequence
  chemically synthesized
ctgtgttcagattcctgacctc

SEQ ID NO: 32877 - DNA, 22 bp, Artificial Sequence
  chemically synthesized
tgtgttcagattcctgacctct

SEQ ID NO: 32878 - DNA, 22 bp, Artificial Sequence
  chemically synthesized
tgttcagattcctgacctctgg

SEQ ID NO: 32879 - DNA, 22 bp, Artificial Sequence
  chemically synthesized
agattcctgacctctggagtta

SEQ ID NO: 32880 - DNA, 22 bp, Artificial Sequence
  chemically synthesized
ctgacctctggagttaaccttt

SEQ ID NO: 32881 - DNA, 22 bp, Artificial Sequence
  chemically synthesized
acctctggagttaacctttctt

SEQ ID NO: 32882 - DNA, 22 bp, Artificial Sequence
  chemically synthesized
tggagttaacctttctttgtaa

SEQ ID NO: 32883 - DNA, 22 bp, Artificial Sequence
  chemically synthesized
gagttaacctttctttgtaaag

SEQ ID NO: 32884 - DNA, 22 bp, Artificial Sequence
  chemically synthesized
acctttctttgtaaagattaga

SEQ ID NO: 32885 - DNA, 22 bp, Artificial Sequence
  chemically synthesized
tctttgtaaagattagacagca

SEQ ID NO: 32886 - DNA, 22 bp, Artificial Sequence
  chemically synthesized
ctttgtaaagattagacagcag

SEQ ID NO: 32887 - DNA, 22 bp, Artificial Sequence
  chemically synthesized
tttgtaaagattagacagcagg

SEQ ID NO: 32888 - DNA, 22 bp, Artificial Sequence
  chemically synthesized
tgtaaagattagacagcaggca

SEQ ID NO: 32889 - DNA, 22 bp, Artificial Sequence
  chemically synthesized
gtaaagattagacagcaggcag

SEQ ID NO: 32890 - DNA, 22 bp, Artificial Sequence
  chemically synthesized
taaagattagacagcaggcagg

SEQ ID NO: 32891 - DNA, 22 bp, Artificial Sequence
  chemically synthesized
gacagcaggcagggaagaatgc

SEQ ID NO: 32892 - DNA, 22 bp, Artificial Sequence
  chemically synthesized
tgaaactgagagcaaagactgg

SEQ ID NO: 32893 - DNA, 22 bp, Artificial Sequence
  chemically synthesized
gaaactgagagcaaagactggc

SEQ ID NO: 32894 - DNA, 22 bp, Artificial Sequence
  chemically synthesized
aaactgagagcaaagactggca

SEQ ID NO: 32895 - DNA, 22 bp, Artificial Sequence
  chemically synthesized
agagcaaagactggcatgcaat

SEQ ID NO: 32896 - DNA, 22 bp, Artificial Sequence
  chemically synthesized
gcatgcaatttacattgatgtc

SEQ ID NO: 32897 - DNA, 22 bp, Artificial Sequence
  chemically synthesized
acattgatgtcctggtgctgtg

SEQ ID NO: 32898 - DNA, 22 bp, Artificial Sequence
  chemically synthesized
cattgatgtcctggtgctgtgc

SEQ ID NO: 32899 - DNA, 22 bp, Artificial Sequence
  chemically synthesized
atgtcctggtgctgtgcataat

SEQ ID NO: 32900 - DNA, 22 bp, Artificial Sequence
  chemically synthesized
gtgctgtgcataataagttgct

SEQ ID NO: 32901 - DNA, 22 bp, Artificial Sequence
  chemically synthesized
tgcataataagttgcttaaaca

SEQ ID NO: 32902 - DNA, 22 bp, Artificial Sequence
  chemically synthesized
cttaaacatgacagcaggatag

SEQ ID NO: 32903 - DNA, 22 bp, Artificial Sequence
  chemically synthesized
aaacatgacagcaggataggat

SEQ ID NO: 32904 - DNA, 22 bp, Artificial Sequence
  chemically synthesized
aacatgacagcaggataggatt

SEQ ID NO: 32905 - DNA, 22 bp, Artificial Sequence
  chemically synthesized
tacataaaatttatttataaat

SEQ ID NO: 32906 - DNA, 22 bp, Artificial Sequence
  chemically synthesized
acataaaatttatttataaatg

SEQ ID NO: 32907 - DNA, 22 bp, Artificial Sequence
  chemically synthesized
cataaaatttatttataaatgg

SEQ ID NO: 32908 - DNA, 22 bp, Artificial Sequence
  chemically synthesized
atttataaatggtaaagatgtt

SEQ ID NO: 32909 - DNA, 22 bp, Artificial Sequence
  chemically synthesized
tttataaatggtaaagatgttt

SEQ ID NO: 32910 - DNA, 22 bp, Artificial Sequence
  chemically synthesized
ataaatggtaaagatgtttcca

SEQ ID NO: 32911 - DNA, 22 bp, Artificial Sequence
  chemically synthesized
taaatggtaaagatgtttccaa

SEQ ID NO: 32912 - DNA, 22 bp, Artificial Sequence
  chemically synthesized
ccaacctctgctgaacttcctc

SEQ ID NO: 32913 - DNA, 22 bp, Artificial Sequence
  chemically synthesized
caacctctgctgaacttcctca

SEQ ID NO: 32914 - DNA, 22 bp, Artificial Sequence
  chemically synthesized
tgctgaacttcctcatagaatg

SEQ ID NO: 32915 - DNA, 22 bp, Artificial Sequence
  chemically synthesized
ctgaacttcctcatagaatgtt

SEQ ID NO: 32916 - DNA, 22 bp, Artificial Sequence
  chemically synthesized
aacttcctcatagaatgttcat

SEQ ID NO: 32917 - DNA, 22 bp, Artificial Sequence
  chemically synthesized
cctcatagaatgttcatcagaa

SEQ ID NO: 32918 - DNA, 22 bp, Artificial Sequence
  chemically synthesized
ctcatagaatgttcatcagaaa

SEQ ID NO: 32919 - DNA, 22 bp, Artificial Sequence
  chemically synthesized
atagaatgttcatcagaaaaca

SEQ ID NO: 32920 - DNA, 22 bp, Artificial Sequence
  chemically synthesized
atcagaaaacaaagtttctatc

SEQ ID NO: 32921 - DNA, 22 bp, Artificial Sequence
  chemically synthesized
ctatctactctttcttccaaga

SEQ ID NO: 32922 - DNA, 22 bp, Artificial Sequence
  chemically synthesized
tatctactctttcttccaagac

SEQ ID NO: 32923 - DNA, 22 bp, Artificial Sequence
  chemically synthesized
tctactctttcttccaagactt

SEQ ID NO: 32924 - DNA, 22 bp, Artificial Sequence
  chemically synthesized
ctctttcttccaagacttcaac

SEQ ID NO: 32925 - DNA, 22 bp, Artificial Sequence
  chemically synthesized
tttcttccaagacttcaactcc

SEQ ID NO: 32926 - DNA, 22 bp, Artificial Sequence
  chemically synthesized
tcttccaagacttcaactccta

SEQ ID NO: 32927 - DNA, 22 bp, Artificial Sequence
  chemically synthesized
cttccaagacttcaactcctac

SEQ ID NO: 32928 - DNA, 22 bp, Artificial Sequence
  chemically synthesized
ttccaagacttcaactcctacc

SEQ ID NO: 32929 - DNA, 22 bp, Artificial Sequence
  chemically synthesized
ccaagacttcaactcctaccac

SEQ ID NO: 32930 - DNA, 22 bp, Artificial Sequence
  chemically synthesized
caagacttcaactcctaccact

SEQ ID NO: 32931 - DNA, 22 bp, Artificial Sequence
  chemically synthesized
caactcctaccactgacatcat

SEQ ID NO: 32932 - DNA, 22 bp, Artificial Sequence
  chemically synthesized
aactcctaccactgacatcatg

SEQ ID NO: 32933 - DNA, 22 bp, Artificial Sequence
  chemically synthesized
ctaccactgacatcatgaccct

SEQ ID NO: 32934 - DNA, 22 bp, Artificial Sequence
  chemically synthesized
ccactgacatcatgaccctcag

SEQ ID NO: 32935 - DNA, 22 bp, Artificial Sequence
  chemically synthesized
acatcatgaccctcagttctat

SEQ ID NO: 32936 - DNA, 22 bp, Artificial Sequence
  chemically synthesized
agttctattcccctagccctgc

SEQ ID NO: 32937 - DNA, 22 bp, Artificial Sequence
  chemically synthesized
tattcccctagccctgcccact

SEQ ID NO: 32938 - DNA, 22 bp, Artificial Sequence
  chemically synthesized
ttcccctagccctgcccactcc

SEQ ID NO: 32939 - DNA, 22 bp, Artificial Sequence
  chemically synthesized
ccctagccctgcccactcccct

SEQ ID NO: 32940 - DNA, 22 bp, Artificial Sequence
  chemically synthesized
gccctgcccactcccctgaaat

SEQ ID NO: 32941 - DNA, 22 bp, Artificial Sequence
  chemically synthesized
cccactcccctgaaatccagat

SEQ ID NO: 32942 - DNA, 22 bp, Artificial Sequence
  chemically synthesized
ccctgaaatccagatccataaa

SEQ ID NO: 32943 - DNA, 22 bp, Artificial Sequence
  chemically synthesized
aaatccagatccataaatccaa

SEQ ID NO: 32944 - DNA, 22 bp, Artificial Sequence
  chemically synthesized
ggtatctcagtttggctgtccc

SEQ ID NO: 32945 - DNA, 22 bp, Artificial Sequence
  chemically synthesized
agtttggctgtccctccatcaa

SEQ ID NO: 32946 - DNA, 22 bp, Artificial Sequence
  chemically synthesized
ggctgtccctccatcaactcaa

SEQ ID NO: 32947 - DNA, 22 bp, Artificial Sequence
  chemically synthesized
gctgtccctccatcaactcaaa

SEQ ID NO: 32948 - DNA, 22 bp, Artificial Sequence
  chemically synthesized
tccctccatcaactcaaatttg

SEQ ID NO: 32949 - DNA, 22 bp, Artificial Sequence
  chemically synthesized
catcaactcaaatttggctgac

SEQ ID NO: 32950 - DNA, 22 bp, Artificial Sequence
  chemically synthesized
aaatttggctgacacagttttg

SEQ ID NO: 32951 - DNA, 22 bp, Artificial Sequence
  chemically synthesized
ggctgacacagttttggattct

SEQ ID NO: 32952 - DNA, 22 bp, Artificial Sequence
  chemically synthesized
gctgacacagttttggattcta

SEQ ID NO: 32953 - DNA, 22 bp, Artificial Sequence
  chemically synthesized
acacagttttggattctagagc

SEQ ID NO: 32954 - DNA, 22 bp, Artificial Sequence
  chemically synthesized
tggattctagagcatgcaggca

SEQ ID NO: 32955 - DNA, 22 bp, Artificial Sequence
  chemically synthesized
ggattctagagcatgcaggcat

SEQ ID NO: 32956 - DNA, 22 bp, Artificial Sequence
  chemically synthesized
gattctagagcatgcaggcatt

SEQ ID NO: 32957 - DNA, 22 bp, Artificial Sequence
  chemically synthesized
tagagcatgcaggcattctgta

SEQ ID NO: 32958 - DNA, 22 bp, Artificial Sequence
  chemically synthesized
gagcatgcaggcattctgtatg

SEQ ID NO: 32959 - DNA, 22 bp, Artificial Sequence
  chemically synthesized
tgtatgtgctgtgcctttgcac

SEQ ID NO: 32960 - DNA, 22 bp, Artificial Sequence
  chemically synthesized
tatgtgctgtgcctttgcactc

SEQ ID NO: 32961 - DNA, 22 bp, Artificial Sequence
  chemically synthesized
tgcctttgcactcactcttccc

SEQ ID NO: 32962 - DNA, 22 bp, Artificial Sequence
  chemically synthesized
tgcactcactcttccctccaga

SEQ ID NO: 32963 - DNA, 22 bp, Artificial Sequence
  chemically synthesized
gcactcactcttccctccagac

SEQ ID NO: 32964 - DNA, 22 bp, Artificial Sequence
  chemically synthesized
cactcactcttccctccagacc

SEQ ID NO: 32965 - DNA, 22 bp, Artificial Sequence
  chemically synthesized
actcttccctccagaccccgtc

SEQ ID NO: 32966 - DNA, 22 bp, Artificial Sequence
  chemically synthesized
ttccctccagaccccgtccttc

SEQ ID NO: 32967 - DNA, 22 bp, Artificial Sequence
  chemically synthesized
ccctccagaccccgtccttcct

SEQ ID NO: 32968 - DNA, 22 bp, Artificial Sequence
  chemically synthesized
cctccagaccccgtccttcctc

SEQ ID NO: 32969 - DNA, 22 bp, Artificial Sequence
  chemically synthesized
cagaccccgtccttcctcactt

SEQ ID NO: 32970 - DNA, 22 bp, Artificial Sequence
  chemically synthesized
cctcactttgccagttccaact

SEQ ID NO: 32971 - DNA, 22 bp, Artificial Sequence
  chemically synthesized
ctcactttgccagttccaactt

SEQ ID NO: 32972 - DNA, 22 bp, Artificial Sequence
  chemically synthesized
actttgccagttccaacttctc

SEQ ID NO: 32973 - DNA, 22 bp, Artificial Sequence
  chemically synthesized
tgccagttccaacttctctctg

SEQ ID NO: 32974 - DNA, 22 bp, Artificial Sequence
  chemically synthesized
gccagttccaacttctctctga

SEQ ID NO: 32975 - DNA, 22 bp, Artificial Sequence
  chemically synthesized
ccagttccaacttctctctgaa

SEQ ID NO: 32976 - DNA, 22 bp, Artificial Sequence
  chemically synthesized
caacttctctctgaagactcag

SEQ ID NO: 32977 - DNA, 22 bp, Artificial Sequence
  chemically synthesized
ctctctgaagactcagtttagg

SEQ ID NO: 32978 - DNA, 22 bp, Artificial Sequence
  chemically synthesized
tctctgaagactcagtttaggt

SEQ ID NO: 32979 - DNA, 22 bp, Artificial Sequence
  chemically synthesized
tctgaagactcagtttaggtac

SEQ ID NO: 32980 - DNA, 22 bp, Artificial Sequence
  chemically synthesized
tgaagactcagtttaggtacag

SEQ ID NO: 32981 - DNA, 22 bp, Artificial Sequence
  chemically synthesized
aagactcagtttaggtacaggc

SEQ ID NO: 32982 - DNA, 22 bp, Artificial Sequence
  chemically synthesized
agtttaggtacaggctccttta

SEQ ID NO: 32983 - DNA, 22 bp, Artificial Sequence
  chemically synthesized
aggtacaggctcctttaggaaa

SEQ ID NO: 32984 - DNA, 22 bp, Artificial Sequence
  chemically synthesized
ggtacaggctcctttaggaaat

SEQ ID NO: 32985 - DNA, 22 bp, Artificial Sequence
  chemically synthesized
ctttaggaaatttttttttgac

SEQ ID NO: 32986 - DNA, 22 bp, Artificial Sequence
  chemically synthesized
taggaaatttttttttgactct

SEQ ID NO: 32987 - DNA, 22 bp, Artificial Sequence
  chemically synthesized
aggaaatttttttttgactcta

SEQ ID NO: 32988 - DNA, 22 bp, Artificial Sequence
  chemically synthesized
ggaaatttttttttgactctac

SEQ ID NO: 32989 - DNA, 22 bp, Artificial Sequence
  chemically synthesized
ttttttgactctacctagccca

SEQ ID NO: 32990 - DNA, 22 bp, Artificial Sequence
  chemically synthesized
tttttgactctacctagcccag

SEQ ID NO: 32991 - DNA, 22 bp, Artificial Sequence
  chemically synthesized
ttttgactctacctagcccaga

SEQ ID NO: 32992 - DNA, 22 bp, Artificial Sequence
  chemically synthesized
tttgactctacctagcccagac

SEQ ID NO: 32993 - DNA, 22 bp, Artificial Sequence
  chemically synthesized
ttgactctacctagcccagact

SEQ ID NO: 32994 - DNA, 22 bp, Artificial Sequence
  chemically synthesized
tgactctacctagcccagactc

SEQ ID NO: 32995 - DNA, 22 bp, Artificial Sequence
  chemically synthesized
gactctacctagcccagactca

SEQ ID NO: 32996 - DNA, 22 bp, Artificial Sequence
  chemically synthesized
actctacctagcccagactcag

SEQ ID NO: 32997 - DNA, 22 bp, Artificial Sequence
  chemically synthesized
tacctagcccagactcagttca

SEQ ID NO: 32998 - DNA, 22 bp, Artificial Sequence
  chemically synthesized
cctagcccagactcagttcatc

SEQ ID NO: 32999 - DNA, 22 bp, Artificial Sequence
  chemically synthesized
gcccagactcagttcatctacg

SEQ ID NO: 33000 - DNA, 22 bp, Artificial Sequence
  chemically synthesized
agttcatctacgatattaatct

SEQ ID NO: 33001 - DNA, 22 bp, Artificial Sequence
  chemically synthesized
atctacgatattaatctgcagt

SEQ ID NO: 33002 - DNA, 22 bp, Artificial Sequence
  chemically synthesized
cgatattaatctgcagtgtcat

SEQ ID NO: 33003 - DNA, 22 bp, Artificial Sequence
  chemically synthesized
atctgcagtgtcatgcactagc

SEQ ID NO: 33004 - DNA, 22 bp, Artificial Sequence
  chemically synthesized
cagtgtcatgcactagcacaaa

SEQ ID NO: 33005 - DNA, 22 bp, Artificial Sequence
  chemically synthesized
gcacaaaatatttgctgaatga

SEQ ID NO: 33006 - DNA, 22 bp, Artificial Sequence
  chemically synthesized
gctgaatgaaagaatgagagtt

SEQ ID NO: 33007 - DNA, 22 bp, Artificial Sequence
  chemically synthesized
ctgaatgaaagaatgagagtta

SEQ ID NO: 33008 - DNA, 22 bp, Artificial Sequence
  chemically synthesized
aatgaaagaatgagagttaact

SEQ ID NO: 33009 - DNA, 22 bp, Artificial Sequence
  chemically synthesized
acttttagtcaggcataaagat

SEQ ID NO: 33010 - DNA, 22 bp, Artificial Sequence
  chemically synthesized
ttagtcaggcataaagataaaa

SEQ ID NO: 33011 - DNA, 22 bp, Artificial Sequence
  chemically synthesized
tagtcaggcataaagataaaaa

SEQ ID NO: 33012 - DNA, 22 bp, Artificial Sequence
  chemically synthesized
agtcaggcataaagataaaaaa

SEQ ID NO: 33013 - DNA, 22 bp, Artificial Sequence
  chemically synthesized
gtcaggcataaagataaaaaac

SEQ ID NO: 33014 - DNA, 22 bp, Artificial Sequence
  chemically synthesized
ttactccggtgtggagtgtttt

SEQ ID NO: 33015 - DNA, 22 bp, Artificial Sequence
  chemically synthesized
tactccggtgtggagtgttttc

SEQ ID NO: 33016 - DNA, 22 bp, Artificial Sequence
  chemically synthesized
actccggtgtggagtgttttca

SEQ ID NO: 33017 - DNA, 22 bp, Artificial Sequence
  chemically synthesized
ctccggtgtggagtgttttcag

SEQ ID NO: 33018 - DNA, 22 bp, Artificial Sequence
  chemically synthesized
cggtgtggagtgttttcaggat

SEQ ID NO: 33019 - DNA, 22 bp, Artificial Sequence
  chemically synthesized
tcaggattcctaccaattagga

SEQ ID NO: 33020 - DNA, 22 bp, Artificial Sequence
  chemically synthesized
caggattcctaccaattaggaa

SEQ ID NO: 33021 - DNA, 22 bp, Artificial Sequence
  chemically synthesized
aggattcctaccaattaggaag

SEQ ID NO: 33022 - DNA, 22 bp, Artificial Sequence
  chemically synthesized
ctaccaattaggaaggtgtttg

SEQ ID NO: 33023 - DNA, 22 bp, Artificial Sequence
  chemically synthesized
ccaattaggaaggtgtttgatt

SEQ ID NO: 33024 - DNA, 22 bp, Artificial Sequence
  chemically synthesized
ggaaggtgtttgattcttcaaa

SEQ ID NO: 33025 - DNA, 22 bp, Artificial Sequence
  chemically synthesized
gattcttcaaactcagaaacac

SEQ ID NO: 33026 - DNA, 22 bp, Artificial Sequence
  chemically synthesized
attcttcaaactcagaaacacc

SEQ ID NO: 33027 - DNA, 22 bp, Artificial Sequence
  chemically synthesized
ttcaaactcagaaacacctccc

SEQ ID NO: 33028 - DNA, 22 bp, Artificial Sequence
  chemically synthesized
caaactcagaaacacctcccct

SEQ ID NO: 33029 - DNA, 22 bp, Artificial Sequence
  chemically synthesized
aaactcagaaacacctcccctt

SEQ ID NO: 33030 - DNA, 22 bp, Artificial Sequence
  chemically synthesized
agaaacacctccccttaactga

SEQ ID NO: 33031 - DNA, 22 bp, Artificial Sequence
  chemically synthesized
cccttaactgatggattcttca

SEQ ID NO: 33032 - DNA, 22 bp, Artificial Sequence
  chemically synthesized
aactgatggattcttcaaactc

SEQ ID NO: 33033 - DNA, 22 bp, Artificial Sequence
  chemically synthesized
actgatggattcttcaaactca

SEQ ID NO: 33034 - DNA, 22 bp, Artificial Sequence
  chemically synthesized
atggattcttcaaactcagcat

SEQ ID NO: 33035 - DNA, 22 bp, Artificial Sequence
  chemically synthesized
ttcaaactcagcatcagttaga

SEQ ID NO: 33036 - DNA, 22 bp, Artificial Sequence
  chemically synthesized
caaactcagcatcagttagagg

SEQ ID NO: 33037 - DNA, 22 bp, Artificial Sequence
  chemically synthesized
aaactcagcatcagttagaggg

SEQ ID NO: 33038 - DNA, 22 bp, Artificial Sequence
  chemically synthesized
agcatcagttagagggcattag

SEQ ID NO: 33039 - DNA, 22 bp, Artificial Sequence
  chemically synthesized
gagggcattagggcacttctca

SEQ ID NO: 33040 - DNA, 22 bp, Artificial Sequence
  chemically synthesized
gggcacttctcaaaccctgcat

SEQ ID NO: 33041 - DNA, 22 bp, Artificial Sequence
  chemically synthesized
ctcaaaccctgcattcagggaa

SEQ ID NO: 33042 - DNA, 22 bp, Artificial Sequence
  chemically synthesized
tcaaaccctgcattcagggaag

SEQ ID NO: 33043 - DNA, 22 bp, Artificial Sequence
  chemically synthesized
aaaccctgcattcagggaagat

SEQ ID NO: 33044 - DNA, 22 bp, Artificial Sequence
  chemically synthesized
cattcagggaagatgtctgttg

SEQ ID NO: 33045 - DNA, 22 bp, Artificial Sequence
  chemically synthesized
agggaagatgtctgttgtgggg

SEQ ID NO: 33046 - DNA, 22 bp, Artificial Sequence
  chemically synthesized
ttgtggggtggtctggcctact

SEQ ID NO: 33047 - DNA, 22 bp, Artificial Sequence
  chemically synthesized
tggggtggtctggcctacttgg

SEQ ID NO: 33048 - DNA, 22 bp, Artificial Sequence
  chemically synthesized
gcctacttggcctgagccaagg

SEQ ID NO: 33049 - DNA, 22 bp, Artificial Sequence
  chemically synthesized
cttggcctgagccaaggttctg

SEQ ID NO: 33050 - DNA, 22 bp, Artificial Sequence
  chemically synthesized
ggcctgagccaaggttctgggc

SEQ ID NO: 33051 - DNA, 22 bp, Artificial Sequence
  chemically synthesized
gcctgagccaaggttctgggca

SEQ ID NO: 33052 - DNA, 22 bp, Artificial Sequence
  chemically synthesized
agccaaggttctgggcagttct

SEQ ID NO: 33053 - DNA, 22 bp, Artificial Sequence
  chemically synthesized
tgggcagttctgttcagttaca

SEQ ID NO: 33054 - DNA, 22 bp, Artificial Sequence
  chemically synthesized
ggcagttctgttcagttacaca

SEQ ID NO: 33055 - DNA, 22 bp, Artificial Sequence
  chemically synthesized
tgttcagttacacatgcatgcg

SEQ ID NO: 33056 - DNA, 22 bp, Artificial Sequence
  chemically synthesized
ttcagttacacatgcatgcgtt

SEQ ID NO: 33057 - DNA, 22 bp, Artificial Sequence
  chemically synthesized
agttacacatgcatgcgttgag

SEQ ID NO: 33058 - DNA, 22 bp, Artificial Sequence
  chemically synthesized
cacatgcatgcgttgagcattg

SEQ ID NO: 33059 - DNA, 22 bp, Artificial Sequence
  chemically synthesized
agcattgattcaagcctggcct

SEQ ID NO: 33060 - DNA, 22 bp, Artificial Sequence
  chemically synthesized
attcaagcctggcctgggcact

SEQ ID NO: 33061 - DNA, 22 bp, Artificial Sequence
  chemically synthesized
aagcctggcctgggcactaggc

SEQ ID NO: 33062 - DNA, 22 bp, Artificial Sequence
  chemically synthesized
gcctgggcactaggcatggttt

SEQ ID NO: 33063 - DNA, 22 bp, Artificial Sequence
  chemically synthesized
ggcactaggcatggttttagat

SEQ ID NO: 33064 - DNA, 22 bp, Artificial Sequence
  chemically synthesized
ggcatggttttagatattaggg

SEQ ID NO: 33065 - DNA, 22 bp, Artificial Sequence
  chemically synthesized
tagatattagggacatattctg

SEQ ID NO: 33066 - DNA, 22 bp, Artificial Sequence
  chemically synthesized
agatattagggacatattctgt

SEQ ID NO: 33067 - DNA, 22 bp, Artificial Sequence
  chemically synthesized
gatattagggacatattctgtt

SEQ ID NO: 33068 - DNA, 22 bp, Artificial Sequence
  chemically synthesized
gggacatattctgttttccttg

SEQ ID NO: 33069 - DNA, 22 bp, Artificial Sequence
  chemically synthesized
tgttttccttgccttaagatac

SEQ ID NO: 33070 - DNA, 22 bp, Artificial Sequence
  chemically synthesized
ttttccttgccttaagatacca

SEQ ID NO: 33071 - DNA, 22 bp, Artificial Sequence
  chemically synthesized
tccttgccttaagataccagtc

SEQ ID NO: 33072 - DNA, 22 bp, Artificial Sequence
  chemically synthesized
ccttgccttaagataccagtct

SEQ ID NO: 33073 - DNA, 22 bp, Artificial Sequence
  chemically synthesized
cttgccttaagataccagtcta

SEQ ID NO: 33074 - DNA, 22 bp, Artificial Sequence
  chemically synthesized
gccttaagataccagtctagta

SEQ ID NO: 33075 - DNA, 22 bp, Artificial Sequence
  chemically synthesized
ccttaagataccagtctagtag

SEQ ID NO: 33076 - DNA, 22 bp, Artificial Sequence
  chemically synthesized
aagataccagtctagtaggagc

SEQ ID NO: 33077 - DNA, 22 bp, Artificial Sequence
  chemically synthesized
agataccagtctagtaggagcc

SEQ ID NO: 33078 - DNA, 22 bp, Artificial Sequence
  chemically synthesized
gtaggagccactaaggcccctt

SEQ ID NO: 33079 - DNA, 22 bp, Artificial Sequence
  chemically synthesized
aggcccctttttgagcctggac

SEQ ID NO: 33080 - DNA, 22 bp, Artificial Sequence
  chemically synthesized
tttgagcctggacttcgcattc

SEQ ID NO: 33081 - DNA, 22 bp, Artificial Sequence
  chemically synthesized
ttgagcctggacttcgcattca

SEQ ID NO: 33082 - DNA, 22 bp, Artificial Sequence
  chemically synthesized
tgagcctggacttcgcattcaa

SEQ ID NO: 33083 - DNA, 22 bp, Artificial Sequence
  chemically synthesized
gagcctggacttcgcattcaaa

SEQ ID NO: 33084 - DNA, 22 bp, Artificial Sequence
  chemically synthesized
agcctggacttcgcattcaaac

SEQ ID NO: 33085 - DNA, 22 bp, Artificial Sequence
  chemically synthesized
gacttcgcattcaaacataccc

SEQ ID NO: 33086 - DNA, 22 bp, Artificial Sequence
  chemically synthesized
cgcattcaaacataccctgctt

SEQ ID NO: 33087 - DNA, 22 bp, Artificial Sequence
  chemically synthesized
gcattcaaacataccctgcttc

SEQ ID NO: 33088 - DNA, 22 bp, Artificial Sequence
  chemically synthesized
aaacataccctgcttctaatca

SEQ ID NO: 33089 - DNA, 22 bp, Artificial Sequence
  chemically synthesized
cttctaatcaagtcatctattg

SEQ ID NO: 33090 - DNA, 22 bp, Artificial Sequence
  chemically synthesized
ctaatcaagtcatctattggca

SEQ ID NO: 33091 - DNA, 22 bp, Artificial Sequence
  chemically synthesized
taatcaagtcatctattggcag

SEQ ID NO: 33092 - DNA, 22 bp, Artificial Sequence
  chemically synthesized
atcaagtcatctattggcagtg

SEQ ID NO: 33093 - DNA, 22 bp, Artificial Sequence
  chemically synthesized
ttggcagtgaccttgggcaaat

SEQ ID NO: 33094 - DNA, 22 bp, Artificial Sequence
  chemically synthesized
gcagtgaccttgggcaaatcat

SEQ ID NO: 33095 - DNA, 22 bp, Artificial Sequence
  chemically synthesized
gggcaaatcatagtctctccaa

SEQ ID NO: 33096 - DNA, 22 bp, Artificial Sequence
  chemically synthesized
ggcaaatcatagtctctccaag

SEQ ID NO: 33097 - DNA, 22 bp, Artificial Sequence
  chemically synthesized
tccaagcattacttttctaatt

SEQ ID NO: 33098 - DNA, 22 bp, Artificial Sequence
  chemically synthesized
caagcattacttttctaattga

SEQ ID NO: 33099 - DNA, 22 bp, Artificial Sequence
  chemically synthesized
cttttctaattgaaacaagaac

SEQ ID NO: 33100 - DNA, 22 bp, Artificial Sequence
  chemically synthesized
ttctaattgaaacaagaacctc

SEQ ID NO: 33101 - DNA, 22 bp, Artificial Sequence
  chemically synthesized
tctaattgaaacaagaacctct

SEQ ID NO: 33102 - DNA, 22 bp, Artificial Sequence
  chemically synthesized
ctaattgaaacaagaacctctc

SEQ ID NO: 33103 - DNA, 22 bp, Artificial Sequence
  chemically synthesized
taattgaaacaagaacctctct

SEQ ID NO: 33104 - DNA, 22 bp, Artificial Sequence
  chemically synthesized
attgaaacaagaacctctctct

SEQ ID NO: 33105 - DNA, 22 bp, Artificial Sequence
  chemically synthesized
aaacaagaacctctctctatac

SEQ ID NO: 33106 - DNA, 22 bp, Artificial Sequence
  chemically synthesized
tctctataccccagatttattt

SEQ ID NO: 33107 - DNA, 22 bp, Artificial Sequence
  chemically synthesized
tctataccccagatttattttg

SEQ ID NO: 33108 - DNA, 22 bp, Artificial Sequence
  chemically synthesized
tataccccagatttattttgag

SEQ ID NO: 33109 - DNA, 22 bp, Artificial Sequence
  chemically synthesized
taccccagatttattttgagga

SEQ ID NO: 33110 - DNA, 22 bp, Artificial Sequence
  chemically synthesized
attttgaggattatgagttaat

SEQ ID NO: 33111 - DNA, 22 bp, Artificial Sequence
  chemically synthesized
ttttgaggattatgagttaatt

SEQ ID NO: 33112 - DNA, 22 bp, Artificial Sequence
  chemically synthesized
tgaggattatgagttaattcat

SEQ ID NO: 33113 - DNA, 22 bp, Artificial Sequence
  chemically synthesized
gaggattatgagttaattcata

SEQ ID NO: 33114 - DNA, 22 bp, Artificial Sequence
  chemically synthesized
aggattatgagttaattcatag

SEQ ID NO: 33115 - DNA, 22 bp, Artificial Sequence
  chemically synthesized
tgagttaattcatagctaaaat

SEQ ID NO: 33116 - DNA, 22 bp, Artificial Sequence
  chemically synthesized
attcatagctaaaatgcttagc

SEQ ID NO: 33117 - DNA, 22 bp, Artificial Sequence
  chemically synthesized
atagctaaaatgcttagcacct

SEQ ID NO: 33118 - DNA, 22 bp, Artificial Sequence
  chemically synthesized
aaatgcttagcacctaacagca

SEQ ID NO: 33119 - DNA, 22 bp, Artificial Sequence
  chemically synthesized
agcacctaacagcacataaccc

SEQ ID NO: 33120 - DNA, 22 bp, Artificial Sequence
  chemically synthesized
gcacctaacagcacataaccca

SEQ ID NO: 33121 - DNA, 22 bp, Artificial Sequence
  chemically synthesized
acagcacataacccacacatac

SEQ ID NO: 33122 - DNA, 22 bp, Artificial Sequence
  chemically synthesized
ttcaattgcgtattactaaaaa

SEQ ID NO: 33123 - DNA, 22 bp, Artificial Sequence
  chemically synthesized
tcaattgcgtattactaaaaag

SEQ ID NO: 33124 - DNA, 22 bp, Artificial Sequence
  chemically synthesized
caattgcgtattactaaaaaga

SEQ ID NO: 33125 - DNA, 22 bp, Artificial Sequence
  chemically synthesized
aattgcgtattactaaaaagaa

SEQ ID NO: 33126 - DNA, 22 bp, Artificial Sequence
  chemically synthesized
cgtattactaaaaagaaggaat

SEQ ID NO: 33127 - DNA, 22 bp, Artificial Sequence
  chemically synthesized
ctaaaaagaaggaatgatttcc

SEQ ID NO: 33128 - DNA, 22 bp, Artificial Sequence
  chemically synthesized
aaaagaaggaatgatttcctag

SEQ ID NO: 33129 - DNA, 22 bp, Artificial Sequence
  chemically synthesized
cctagaggaggtgcttcttctg

SEQ ID NO: 33130 - DNA, 22 bp, Artificial Sequence
  chemically synthesized
ctagaggaggtgcttcttctgg

SEQ ID NO: 33131 - DNA, 22 bp, Artificial Sequence
  chemically synthesized
gaggaggtgcttcttctggcca

SEQ ID NO: 33132 - DNA, 22 bp, Artificial Sequence
  chemically synthesized
cttctggccaagggctgattca

SEQ ID NO: 33133 - DNA, 22 bp, Artificial Sequence
  chemically synthesized
ttctggccaagggctgattcag

SEQ ID NO: 33134 - DNA, 22 bp, Artificial Sequence
  chemically synthesized
ctggccaagggctgattcagag

SEQ ID NO: 33135 - DNA, 22 bp, Artificial Sequence
  chemically synthesized
tggccaagggctgattcagagc

SEQ ID NO: 33136 - DNA, 22 bp, Artificial Sequence
  chemically synthesized
gccaagggctgattcagagcct

SEQ ID NO: 33137 - DNA, 22 bp, Artificial Sequence
  chemically synthesized
attcagagccttaattaactaa

SEQ ID NO: 33138 - DNA, 22 bp, Artificial Sequence
  chemically synthesized
agagccttaattaactaaatag

SEQ ID NO: 33139 - DNA, 22 bp, Artificial Sequence
  chemically synthesized
aattaactaaatagatcaagca

SEQ ID NO: 33140 - DNA, 22 bp, Artificial Sequence
  chemically synthesized
attaactaaatagatcaagcat

SEQ ID NO: 33141 - DNA, 22 bp, Artificial Sequence
  chemically synthesized
actaaatagatcaagcatatct

SEQ ID NO: 33142 - DNA, 22 bp, Artificial Sequence
  chemically synthesized
aatagatcaagcatatctaact

SEQ ID NO: 33143 - DNA, 22 bp, Artificial Sequence
  chemically synthesized
actggtcaccggaagtggtcca

SEQ ID NO: 33144 - DNA, 22 bp, Artificial Sequence
  chemically synthesized
gtcaccggaagtggtccatgag

SEQ ID NO: 33145 - DNA, 22 bp, Artificial Sequence
  chemically synthesized
cagcaatgggaaggtgtcagag

SEQ ID NO: 33146 - DNA, 22 bp, Artificial Sequence
  chemically synthesized
ggaaaaagacatagagagaaac

SEQ ID NO: 33147 - DNA, 22 bp, Artificial Sequence
  chemically synthesized
ttaggatgtctacagatttcca

SEQ ID NO: 33148 - DNA, 22 bp, Artificial Sequence
  chemically synthesized
aggatgtctacagatttccaag

SEQ ID NO: 33149 - DNA, 22 bp, Artificial Sequence
  chemically synthesized
ggatgtctacagatttccaaga

SEQ ID NO: 33150 - DNA, 22 bp, Artificial Sequence
  chemically synthesized
cagatttccaagacaataattg

SEQ ID NO: 33151 - DNA, 22 bp, Artificial Sequence
  chemically synthesized
ccaagacaataattgaaatgaa

SEQ ID NO: 33152 - DNA, 22 bp, Artificial Sequence
  chemically synthesized
caagacaataattgaaatgaac

SEQ ID NO: 33153 - DNA, 22 bp, Artificial Sequence
  chemically synthesized
aaatgaacaaaggcaagggatg

SEQ ID NO: 33154 - DNA, 22 bp, Artificial Sequence
  chemically synthesized
catttctttcctttatcacctt

SEQ ID NO: 33155 - DNA, 22 bp, Artificial Sequence
  chemically synthesized
atttctttcctttatcaccttt

SEQ ID NO: 33156 - DNA, 22 bp, Artificial Sequence
  chemically synthesized
ctttcctttatcacctttccct

SEQ ID NO: 33157 - DNA, 22 bp, Artificial Sequence
  chemically synthesized
tttcctttatcacctttccctt

SEQ ID NO: 33158 - DNA, 22 bp, Artificial Sequence
  chemically synthesized
tcctttatcacctttcccttgt

SEQ ID NO: 33159 - DNA, 22 bp, Artificial Sequence
  chemically synthesized
cctttatcacctttcccttgtt

SEQ ID NO: 33160 - DNA, 22 bp, Artificial Sequence
  chemically synthesized
ctttatcacctttcccttgttc

SEQ ID NO: 33161 - DNA, 22 bp, Artificial Sequence
  chemically synthesized
tatcacctttcccttgttcttc

SEQ ID NO: 33162 - DNA, 22 bp, Artificial Sequence
  chemically synthesized
atcacctttcccttgttcttca

SEQ ID NO: 33163 - DNA, 22 bp, Artificial Sequence
  chemically synthesized
tcacctttcccttgttcttcag

SEQ ID NO: 33164 - DNA, 22 bp, Artificial Sequence
  chemically synthesized
tcccttgttcttcagctccagc

SEQ ID NO: 33165 - DNA, 22 bp, Artificial Sequence
  chemically synthesized
cccttgttcttcagctccagct

SEQ ID NO: 33166 - DNA, 22 bp, Artificial Sequence
  chemically synthesized
ccttgttcttcagctccagctg

SEQ ID NO: 33167 - DNA, 22 bp, Artificial Sequence
  chemically synthesized
gttcttcagctccagctgtgcc

SEQ ID NO: 33168 - DNA, 22 bp, Artificial Sequence
  chemically synthesized
ttcttcagctccagctgtgccc

SEQ ID NO: 33169 - DNA, 22 bp, Artificial Sequence
  chemically synthesized
ttcagctccagctgtgcccaca

SEQ ID NO: 33170 - DNA, 22 bp, Artificial Sequence
  chemically synthesized
cagctccagctgtgcccacaga

SEQ ID NO: 33171 - DNA, 22 bp, Artificial Sequence
  chemically synthesized
agctccagctgtgcccacagac

SEQ ID NO: 33172 - DNA, 22 bp, Artificial Sequence
  chemically synthesized
cagctgtgcccacagacaccac

SEQ ID NO: 33173 - DNA, 22 bp, Artificial Sequence
  chemically synthesized
tgcccacagacaccacagggaa

SEQ ID NO: 33174 - DNA, 22 bp, Artificial Sequence
  chemically synthesized
tgaacacaggggtttgaaccag

SEQ ID NO: 33175 - DNA, 22 bp, Artificial Sequence
  chemically synthesized
aacacaggggtttgaaccaggg

SEQ ID NO: 33176 - DNA, 22 bp, Artificial Sequence
  chemically synthesized
gaaccagggcctctctaagtct

SEQ ID NO: 33177 - DNA, 22 bp, Artificial Sequence
  chemically synthesized
aaccagggcctctctaagtctt

SEQ ID NO: 33178 - DNA, 22 bp, Artificial Sequence
  chemically synthesized
tctaagtcttttccaactctga

SEQ ID NO: 33179 - DNA, 22 bp, Artificial Sequence
  chemically synthesized
taagtcttttccaactctgata

SEQ ID NO: 33180 - DNA, 22 bp, Artificial Sequence
  chemically synthesized
agtcttttccaactctgatacc

SEQ ID NO: 33181 - DNA, 22 bp, Artificial Sequence
  chemically synthesized
ttccaactctgataccctgaag

SEQ ID NO: 33182 - DNA, 22 bp, Artificial Sequence
  chemically synthesized
tccaactctgataccctgaagt

SEQ ID NO: 33183 - DNA, 22 bp, Artificial Sequence
  chemically synthesized
ccaactctgataccctgaagtt

SEQ ID NO: 33184 - DNA, 22 bp, Artificial Sequence
  chemically synthesized
caactctgataccctgaagttc

SEQ ID NO: 33185 - DNA, 22 bp, Artificial Sequence
  chemically synthesized
tgataccctgaagttctcagaa

SEQ ID NO: 33186 - DNA, 22 bp, Artificial Sequence
  chemically synthesized
ataccctgaagttctcagaaac

SEQ ID NO: 33187 - DNA, 22 bp, Artificial Sequence
  chemically synthesized
aagttctcagaaacttccataa

SEQ ID NO: 33188 - DNA, 22 bp, Artificial Sequence
  chemically synthesized
tcagaaacttccataaattttg

SEQ ID NO: 33189 - DNA, 22 bp, Artificial Sequence
  chemically synthesized
agaaacttccataaattttggc

SEQ ID NO: 33190 - DNA, 22 bp, Artificial Sequence
  chemically synthesized
ccataaattttggctgaagaag

SEQ ID NO: 33191 - DNA, 22 bp, Artificial Sequence
  chemically synthesized
cataaattttggctgaagaagc

SEQ ID NO: 33192 - DNA, 22 bp, Artificial Sequence
  chemically synthesized
tggctgaagaagccatagcaaa

SEQ ID NO: 33193 - DNA, 22 bp, Artificial Sequence
  chemically synthesized
ggctgaagaagccatagcaaac

SEQ ID NO: 33194 - DNA, 22 bp, Artificial Sequence
  chemically synthesized
gctgaagaagccatagcaaact

SEQ ID NO: 33195 - DNA, 22 bp, Artificial Sequence
  chemically synthesized
aagaagccatagcaaacttgtc

SEQ ID NO: 33196 - DNA, 22 bp, Artificial Sequence
  chemically synthesized
gtcagatggtttcttaccttta

SEQ ID NO: 33197 - DNA, 22 bp, Artificial Sequence
  chemically synthesized
tcagatggtttcttacctttaa

SEQ ID NO: 33198 - DNA, 22 bp, Artificial Sequence
  chemically synthesized
cttacctttaactcagccattt

SEQ ID NO: 33199 - DNA, 22 bp, Artificial Sequence
  chemically synthesized
ttacctttaactcagccatttt

SEQ ID NO: 33200 - DNA, 22 bp, Artificial Sequence
  chemically synthesized
acctttaactcagccattttct

SEQ ID NO: 33201 - DNA, 22 bp, Artificial Sequence
  chemically synthesized
cctttaactcagccattttctc

SEQ ID NO: 33202 - DNA, 22 bp, Artificial Sequence
  chemically synthesized
taactcagccattttctctctc

SEQ ID NO: 33203 - DNA, 22 bp, Artificial Sequence
  chemically synthesized
aactcagccattttctctctcc

SEQ ID NO: 33204 - DNA, 22 bp, Artificial Sequence
  chemically synthesized
actcagccattttctctctcct

SEQ ID NO: 33205 - DNA, 22 bp, Artificial Sequence
  chemically synthesized
agccattttctctctcctctat

SEQ ID NO: 33206 - DNA, 22 bp, Artificial Sequence
  chemically synthesized
tctctctcctctatgtgtggtg

SEQ ID NO: 33207 - DNA, 22 bp, Artificial Sequence
  chemically synthesized
ctctctcctctatgtgtggtga

SEQ ID NO: 33208 - DNA, 22 bp, Artificial Sequence
  chemically synthesized
tctctcctctatgtgtggtgac

SEQ ID NO: 33209 - DNA, 22 bp, Artificial Sequence
  chemically synthesized
tctcctctatgtgtggtgactt

SEQ ID NO: 33210 - DNA, 22 bp, Artificial Sequence
  chemically synthesized
tcctctatgtgtggtgacttca

SEQ ID NO: 33211 - DNA, 22 bp, Artificial Sequence
  chemically synthesized
ctctatgtgtggtgacttcagg

SEQ ID NO: 33212 - DNA, 22 bp, Artificial Sequence
  chemically synthesized
tatgtgtggtgacttcaggaaa

SEQ ID NO: 33213 - DNA, 22 bp, Artificial Sequence
  chemically synthesized
tgtgtggtgacttcaggaaacc

SEQ ID NO: 33214 - DNA, 22 bp, Artificial Sequence
  chemically synthesized
caggaaacccaggcccagagga

SEQ ID NO: 33215 - DNA, 22 bp, Artificial Sequence
  chemically synthesized
aggaaacccaggcccagaggat

SEQ ID NO: 33216 - DNA, 22 bp, Artificial Sequence
  chemically synthesized
ctttctccttcaaaccactctt

SEQ ID NO: 33217 - DNA, 22 bp, Artificial Sequence
  chemically synthesized
tttctccttcaaaccactcttt

SEQ ID NO: 33218 - DNA, 22 bp, Artificial Sequence
  chemically synthesized
tctccttcaaaccactctttgg

SEQ ID NO: 33219 - DNA, 22 bp, Artificial Sequence
  chemically synthesized
ctccttcaaaccactctttgga

SEQ ID NO: 33220 - DNA, 22 bp, Artificial Sequence
  chemically synthesized
tccttcaaaccactctttggat

SEQ ID NO: 33221 - DNA, 22 bp, Artificial Sequence
  chemically synthesized
cttcaaaccactctttggatat

SEQ ID NO: 33222 - DNA, 22 bp, Artificial Sequence
  chemically synthesized
caaaccactctttggatattcc

SEQ ID NO: 33223 - DNA, 22 bp, Artificial Sequence
  chemically synthesized
aaaccactctttggatattccg

SEQ ID NO: 33224 - DNA, 22 bp, Artificial Sequence
  chemically synthesized
tttggatattccggttcccact

SEQ ID NO: 33225 - DNA, 22 bp, Artificial Sequence
  chemically synthesized
tggatattccggttcccactgc

SEQ ID NO: 33226 - DNA, 22 bp, Artificial Sequence
  chemically synthesized
ggatattccggttcccactgct

SEQ ID NO: 33227 - DNA, 22 bp, Artificial Sequence
  chemically synthesized
gatattccggttcccactgctt

SEQ ID NO: 33228 - DNA, 22 bp, Artificial Sequence
  chemically synthesized
cggttcccactgcttcactgcg

SEQ ID NO: 33229 - DNA, 22 bp, Artificial Sequence
  chemically synthesized
ccactgcttcactgcgcttcac

SEQ ID NO: 33230 - DNA, 22 bp, Artificial Sequence
  chemically synthesized
cttcactgcgcttcactggtca

SEQ ID NO: 33231 - DNA, 22 bp, Artificial Sequence
  chemically synthesized
cactgcgcttcactggtcagtg

SEQ ID NO: 33232 - DNA, 22 bp, Artificial Sequence
  chemically synthesized
actgcgcttcactggtcagtgc

SEQ ID NO: 33233 - DNA, 22 bp, Artificial Sequence
  chemically synthesized
cgcttcactggtcagtgcgtca

SEQ ID NO: 33234 - DNA, 22 bp, Artificial Sequence
  chemically synthesized
cactggtcagtgcgtcactcaa

SEQ ID NO: 33235 - DNA, 22 bp, Artificial Sequence
  chemically synthesized
actggtcagtgcgtcactcaaa

SEQ ID NO: 33236 - DNA, 22 bp, Artificial Sequence
  chemically synthesized
gtcagtgcgtcactcaaactag

SEQ ID NO: 33237 - DNA, 22 bp, Artificial Sequence
  chemically synthesized
aaactagctgaaagaattgtct

SEQ ID NO: 33238 - DNA, 22 bp, Artificial Sequence
  chemically synthesized
gctgaaagaattgtctaactca

SEQ ID NO: 33239 - DNA, 22 bp, Artificial Sequence
  chemically synthesized
aaagaattgtctaactcataca

SEQ ID NO: 33240 - DNA, 22 bp, Artificial Sequence
  chemically synthesized
tctaactcatacacagggacaa

SEQ ID NO: 33241 - DNA, 22 bp, Artificial Sequence
  chemically synthesized
actcatacacagggacaaagtc

SEQ ID NO: 33242 - DNA, 22 bp, Artificial Sequence
  chemically synthesized
atacacagggacaaagtccagc

SEQ ID NO: 33243 - DNA, 22 bp, Artificial Sequence
  chemically synthesized
atttaaccggttacacaattgc

SEQ ID NO: 33244 - DNA, 22 bp, Artificial Sequence
  chemically synthesized
tttaaccggttacacaattgcc

SEQ ID NO: 33245 - DNA, 22 bp, Artificial Sequence
  chemically synthesized
aaccggttacacaattgccttt

SEQ ID NO: 33246 - DNA, 22 bp, Artificial Sequence
  chemically synthesized
accggttacacaattgcctttg

SEQ ID NO: 33247 - DNA, 22 bp, Artificial Sequence
  chemically synthesized
cacaattgcctttggtttttac

SEQ ID NO: 33248 - DNA, 22 bp, Artificial Sequence
  chemically synthesized
cctttggtttttacagtttgtt

SEQ ID NO: 33249 - DNA, 22 bp, Artificial Sequence
  chemically synthesized
tggtttttacagtttgttccta

SEQ ID NO: 33250 - DNA, 22 bp, Artificial Sequence
  chemically synthesized
ggtttttacagtttgttcctaa

SEQ ID NO: 33251 - DNA, 22 bp, Artificial Sequence
  chemically synthesized
gtttttacagtttgttcctaag

SEQ ID NO: 33252 - DNA, 22 bp, Artificial Sequence
  chemically synthesized
ttacagtttgttcctaagtgtt

SEQ ID NO: 33253 - DNA, 22 bp, Artificial Sequence
  chemically synthesized
tacagtttgttcctaagtgttt

SEQ ID NO: 33254 - DNA, 22 bp, Artificial Sequence
  chemically synthesized
acagtttgttcctaagtgtttc

SEQ ID NO: 33255 - DNA, 22 bp, Artificial Sequence
  chemically synthesized
cagtttgttcctaagtgtttcc

SEQ ID NO: 33256 - DNA, 22 bp, Artificial Sequence
  chemically synthesized
gttcctaagtgtttccagaggc

SEQ ID NO: 33257 - DNA, 22 bp, Artificial Sequence
  chemically synthesized
ttcctaagtgtttccagaggct

SEQ ID NO: 33258 - DNA, 22 bp, Artificial Sequence
  chemically synthesized
ctaagtgtttccagaggcttgg

SEQ ID NO: 33259 - DNA, 22 bp, Artificial Sequence
  chemically synthesized
agtgtttccagaggcttggttc

SEQ ID NO: 33260 - DNA, 22 bp, Artificial Sequence
  chemically synthesized
ccagaggcttggttcctcttca

SEQ ID NO: 33261 - DNA, 22 bp, Artificial Sequence
  chemically synthesized
cagaggcttggttcctcttcac

SEQ ID NO: 33262 - DNA, 22 bp, Artificial Sequence
  chemically synthesized
ggttcctcttcacctgaggtag

SEQ ID NO: 33263 - DNA, 22 bp, Artificial Sequence
  chemically synthesized
gttcctcttcacctgaggtaga

SEQ ID NO: 33264 - DNA, 22 bp, Artificial Sequence
  chemically synthesized
ctcttcacctgaggtagagatt

SEQ ID NO: 33265 - DNA, 22 bp, Artificial Sequence
  chemically synthesized
ttcacctgaggtagagattgac

SEQ ID NO: 33266 - DNA, 22 bp, Artificial Sequence
  chemically synthesized
cacctgaggtagagattgacca

SEQ ID NO: 33267 - DNA, 22 bp, Artificial Sequence
  chemically synthesized
acctgaggtagagattgaccaa

SEQ ID NO: 33268 - DNA, 22 bp, Artificial Sequence
  chemically synthesized
aggtagagattgaccaattatt

SEQ ID NO: 33269 - DNA, 22 bp, Artificial Sequence
  chemically synthesized
accaattatttattccagttaa

SEQ ID NO: 33270 - DNA, 22 bp, Artificial Sequence
  chemically synthesized
tttattccagttaaaagtaggc

SEQ ID NO: 33271 - DNA, 22 bp, Artificial Sequence
  chemically synthesized
attccagttaaaagtaggctta

SEQ ID NO: 33272 - DNA, 22 bp, Artificial Sequence
  chemically synthesized
ttccagttaaaagtaggcttat

SEQ ID NO: 33273 - DNA, 22 bp, Artificial Sequence
  chemically synthesized
cagttaaaagtaggcttatttc

SEQ ID NO: 33274 - DNA, 22 bp, Artificial Sequence
  chemically synthesized
aaagtaggcttatttcaaaagg

SEQ ID NO: 33275 - DNA, 22 bp, Artificial Sequence
  chemically synthesized
atttcaaaaggcagagaatttg

SEQ ID NO: 33276 - DNA, 22 bp, Artificial Sequence
  chemically synthesized
tttcaaaaggcagagaatttga

SEQ ID NO: 33277 - DNA, 22 bp, Artificial Sequence
  chemically synthesized
caaaaggcagagaatttgaagc

SEQ ID NO: 33278 - DNA, 22 bp, Artificial Sequence
  chemically synthesized
aaaaggcagagaatttgaagct

SEQ ID NO: 33279 - DNA, 22 bp, Artificial Sequence
  chemically synthesized
gaagctatcggggaaaggaact

SEQ ID NO: 33280 - DNA, 22 bp, Artificial Sequence
  chemically synthesized
aagctatcggggaaaggaactg

SEQ ID NO: 33281 - DNA, 22 bp, Artificial Sequence
  chemically synthesized
tcggggaaaggaactgtggcag

SEQ ID NO: 33282 - DNA, 22 bp, Artificial Sequence
  chemically synthesized
tggcagatagtgcctgctgtgt

SEQ ID NO: 33283 - DNA, 22 bp, Artificial Sequence
  chemically synthesized
ctgtgtgtggtggaggattctc

SEQ ID NO: 33284 - DNA, 22 bp, Artificial Sequence
  chemically synthesized
tgtgtggtggaggattctctgc

SEQ ID NO: 33285 - DNA, 22 bp, Artificial Sequence
  chemically synthesized
tctgctcagtcctgactcaggc

SEQ ID NO: 33286 - DNA, 22 bp, Artificial Sequence
  chemically synthesized
tgctcagtcctgactcaggcta

SEQ ID NO: 33287 - DNA, 22 bp, Artificial Sequence
  chemically synthesized
ctcagtcctgactcaggctagg

SEQ ID NO: 33288 - DNA, 22 bp, Artificial Sequence
  chemically synthesized
agtcctgactcaggctaggaag

SEQ ID NO: 33289 - DNA, 22 bp, Artificial Sequence
  chemically synthesized
actcaggctaggaaggaacagg

SEQ ID NO: 33290 - DNA, 22 bp, Artificial Sequence
  chemically synthesized
aggctaggaaggaacagggcag

SEQ ID NO: 33291 - DNA, 22 bp, Artificial Sequence
  chemically synthesized
ggaaggaacagggcagtgctga

SEQ ID NO: 33292 - DNA, 22 bp, Artificial Sequence
  chemically synthesized
caggagactcagcactgccctg

SEQ ID NO: 33293 - DNA, 22 bp, Artificial Sequence
  chemically synthesized
agcactgccctgttccttccta

SEQ ID NO: 33294 - DNA, 22 bp, Artificial Sequence
  chemically synthesized
ccctgttccttcctagcctgag

SEQ ID NO: 33295 - DNA, 22 bp, Artificial Sequence
  chemically synthesized
ttccttcctagcctgagtcagg

SEQ ID NO: 33296 - DNA, 22 bp, Artificial Sequence
  chemically synthesized
cttcctagcctgagtcaggact

SEQ ID NO: 33297 - DNA, 22 bp, Artificial Sequence
  chemically synthesized
cctagcctgagtcaggactgag

SEQ ID NO: 33298 - DNA, 22 bp, Artificial Sequence
  chemically synthesized
ctagcctgagtcaggactgagc

SEQ ID NO: 33299 - DNA, 22 bp, Artificial Sequence
  chemically synthesized
gcctgagtcaggactgagcaga

SEQ ID NO: 33300 - DNA, 22 bp, Artificial Sequence
  chemically synthesized
agtcaggactgagcagagaatc

SEQ ID NO: 33301 - DNA, 22 bp, Artificial Sequence
  chemically synthesized
agcagagaatcctccaccacac

SEQ ID NO: 33302 - DNA, 22 bp, Artificial Sequence
  chemically synthesized
caccacacacagcaggcactat

SEQ ID NO: 33303 - DNA, 22 bp, Artificial Sequence
  chemically synthesized
tctgccacagttcctttccccg

SEQ ID NO: 33304 - DNA, 22 bp, Artificial Sequence
  chemically synthesized
ccacagttcctttccccgatag

SEQ ID NO: 33305 - DNA, 22 bp, Artificial Sequence
  chemically synthesized
ctttccccgatagcttcaaatt

SEQ ID NO: 33306 - DNA, 22 bp, Artificial Sequence
  chemically synthesized
tccccgatagcttcaaattctc

SEQ ID NO: 33307 - DNA, 22 bp, Artificial Sequence
  chemically synthesized
ccccgatagcttcaaattctct

SEQ ID NO: 33308 - DNA, 22 bp, Artificial Sequence
  chemically synthesized
cccgatagcttcaaattctctg

SEQ ID NO: 33309 - DNA, 22 bp, Artificial Sequence
  chemically synthesized
caaattctctgccttttgaaat

SEQ ID NO: 33310 - DNA, 22 bp, Artificial Sequence
  chemically synthesized
aaattctctgccttttgaaata

SEQ ID NO: 33311 - DNA, 22 bp, Artificial Sequence
  chemically synthesized
tctgccttttgaaataagccta

SEQ ID NO: 33312 - DNA, 22 bp, Artificial Sequence
  chemically synthesized
tgccttttgaaataagcctact

SEQ ID NO: 33313 - DNA, 22 bp, Artificial Sequence
  chemically synthesized
ccttttgaaataagcctacttt

SEQ ID NO: 33314 - DNA, 22 bp, Artificial Sequence
  chemically synthesized
ttgaaataagcctacttttaac

SEQ ID NO: 33315 - DNA, 22 bp, Artificial Sequence
  chemically synthesized
tgaaataagcctacttttaact

SEQ ID NO: 33316 - DNA, 22 bp, Artificial Sequence
  chemically synthesized
gaaataagcctacttttaactg

SEQ ID NO: 33317 - DNA, 22 bp, Artificial Sequence
  chemically synthesized
aaataagcctacttttaactgg

SEQ ID NO: 33318 - DNA, 22 bp, Artificial Sequence
  chemically synthesized
cttttaactggaataaataatt

SEQ ID NO: 33319 - DNA, 22 bp, Artificial Sequence
  chemically synthesized
ttaactggaataaataattggt

SEQ ID NO: 33320 - DNA, 22 bp, Artificial Sequence
  chemically synthesized
taactggaataaataattggtc

SEQ ID NO: 33321 - DNA, 22 bp, Artificial Sequence
  chemically synthesized
aactggaataaataattggtca

SEQ ID NO: 33322 - DNA, 22 bp, Artificial Sequence
  chemically synthesized
actggaataaataattggtcaa

SEQ ID NO: 33323 - DNA, 22 bp, Artificial Sequence
  chemically synthesized
gaataaataattggtcaatctc

SEQ ID NO: 33324 - DNA, 22 bp, Artificial Sequence
  chemically synthesized
gtcaatctctacctcaggtgaa

SEQ ID NO: 33325 - DNA, 22 bp, Artificial Sequence
  chemically synthesized
tacctcaggtgaagaggaacca

SEQ ID NO: 33326 - DNA, 22 bp, Artificial Sequence
  chemically synthesized
cctcaggtgaagaggaaccaag

SEQ ID NO: 33327 - DNA, 22 bp, Artificial Sequence
  chemically synthesized
aggtgaagaggaaccaagcctc

SEQ ID NO: 33328 - DNA, 22 bp, Artificial Sequence
  chemically synthesized
tggaaacacttaggaacaaact

SEQ ID NO: 33329 - DNA, 22 bp, Artificial Sequence
  chemically synthesized
gaaacacttaggaacaaactgt

SEQ ID NO: 33330 - DNA, 22 bp, Artificial Sequence
  chemically synthesized
aggaacaaactgtaaaaaccaa

SEQ ID NO: 33331 - DNA, 22 bp, Artificial Sequence
  chemically synthesized
ggaacaaactgtaaaaaccaaa

SEQ ID NO: 33332 - DNA, 22 bp, Artificial Sequence
  chemically synthesized
taaaaaccaaaggcaattgtgt

SEQ ID NO: 33333 - DNA, 22 bp, Artificial Sequence
  chemically synthesized
tgtaaccggttaaataagcttg

SEQ ID NO: 33334 - DNA, 22 bp, Artificial Sequence
  chemically synthesized
aataagcttgctggactttgtc

SEQ ID NO: 33335 - DNA, 22 bp, Artificial Sequence
  chemically synthesized
gctggactttgtccctgtgtat

SEQ ID NO: 33336 - DNA, 22 bp, Artificial Sequence
  chemically synthesized
ctggactttgtccctgtgtatg

SEQ ID NO: 33337 - DNA, 22 bp, Artificial Sequence
  chemically synthesized
gactttgtccctgtgtatgagt

SEQ ID NO: 33338 - DNA, 22 bp, Artificial Sequence
  chemically synthesized
tgtccctgtgtatgagttagac

SEQ ID NO: 33339 - DNA, 22 bp, Artificial Sequence
  chemically synthesized
gtccctgtgtatgagttagaca

SEQ ID NO: 33340 - DNA, 22 bp, Artificial Sequence
  chemically synthesized
tccctgtgtatgagttagacaa

SEQ ID NO: 33341 - DNA, 22 bp, Artificial Sequence
  chemically synthesized
tgtatgagttagacaattcttt

SEQ ID NO: 33342 - DNA, 22 bp, Artificial Sequence
  chemically synthesized
gacaattctttcagctagtttg

SEQ ID NO: 33343 - DNA, 22 bp, Artificial Sequence
  chemically synthesized
tttcagctagtttgagtgacgc

SEQ ID NO: 33344 - DNA, 22 bp, Artificial Sequence
  chemically synthesized
tcagctagtttgagtgacgcac

SEQ ID NO: 33345 - DNA, 22 bp, Artificial Sequence
  chemically synthesized
cagctagtttgagtgacgcact

SEQ ID NO: 33346 - DNA, 22 bp, Artificial Sequence
  chemically synthesized
agctagtttgagtgacgcactg

SEQ ID NO: 33347 - DNA, 22 bp, Artificial Sequence
  chemically synthesized
gtttgagtgacgcactgaccag

SEQ ID NO: 33348 - DNA, 22 bp, Artificial Sequence
  chemically synthesized
gagtgacgcactgaccagtgaa

SEQ ID NO: 33349 - DNA, 22 bp, Artificial Sequence
  chemically synthesized
agtgacgcactgaccagtgaag

SEQ ID NO: 33350 - DNA, 22 bp, Artificial Sequence
  chemically synthesized
accagtgaagcgcagtgaagca

SEQ ID NO: 33351 - DNA, 22 bp, Artificial Sequence
  chemically synthesized
gaaggagaaagaagcattgtgg

SEQ ID NO: 33352 - DNA, 22 bp, Artificial Sequence
  chemically synthesized
aaggagaaagaagcattgtggc

SEQ ID NO: 33353 - DNA, 22 bp, Artificial Sequence
  chemically synthesized
tggctttatatcctctgggcct

SEQ ID NO: 33354 - DNA, 22 bp, Artificial Sequence
  chemically synthesized
tatatcctctgggcctgggttt

SEQ ID NO: 33355 - DNA, 22 bp, Artificial Sequence
  chemically synthesized
atatcctctgggcctgggtttc

SEQ ID NO: 33356 - DNA, 22 bp, Artificial Sequence
  chemically synthesized
tatcctctgggcctgggtttcc

SEQ ID NO: 33357 - DNA, 22 bp, Artificial Sequence
  chemically synthesized
tgggcctgggtttcctgaagtc

SEQ ID NO: 33358 - DNA, 22 bp, Artificial Sequence
  chemically synthesized
ggcctgggtttcctgaagtcac

SEQ ID NO: 33359 - DNA, 22 bp, Artificial Sequence
  chemically synthesized
ggtttcctgaagtcaccacaca

SEQ ID NO: 33360 - DNA, 22 bp, Artificial Sequence
  chemically synthesized
cctgaagtcaccacacatagag

SEQ ID NO: 33361 - DNA, 22 bp, Artificial Sequence
  chemically synthesized
ctgaagtcaccacacatagagg

SEQ ID NO: 33362 - DNA, 22 bp, Artificial Sequence
  chemically synthesized
aagtcaccacacatagaggaga

SEQ ID NO: 33363 - DNA, 22 bp, Artificial Sequence
  chemically synthesized
agttaaaggtaagaaaccatct

SEQ ID NO: 33364 - DNA, 22 bp, Artificial Sequence
  chemically synthesized
aaggtaagaaaccatctgacaa

SEQ ID NO: 33365 - DNA, 22 bp, Artificial Sequence
  chemically synthesized
acaagtttgctatggcttcttc

SEQ ID NO: 33366 - DNA, 22 bp, Artificial Sequence
  chemically synthesized
gctatggcttcttcagccaaaa

SEQ ID NO: 33367 - DNA, 22 bp, Artificial Sequence
  chemically synthesized
ctatggcttcttcagccaaaat

SEQ ID NO: 33368 - DNA, 22 bp, Artificial Sequence
  chemically synthesized
tggcttcttcagccaaaattta

SEQ ID NO: 33369 - DNA, 22 bp, Artificial Sequence
  chemically synthesized
cttcagccaaaatttatggaag

SEQ ID NO: 33370 - DNA, 22 bp, Artificial Sequence
  chemically synthesized
ttcagccaaaatttatggaagt

SEQ ID NO: 33371 - DNA, 22 bp, Artificial Sequence
  chemically synthesized
cagccaaaatttatggaagttt

SEQ ID NO: 33372 - DNA, 22 bp, Artificial Sequence
  chemically synthesized
agccaaaatttatggaagtttc

SEQ ID NO: 33373 - DNA, 22 bp, Artificial Sequence
  chemically synthesized
atggaagtttctgagaacttca

SEQ ID NO: 33374 - DNA, 22 bp, Artificial Sequence
  chemically synthesized
tggaagtttctgagaacttcag

SEQ ID NO: 33375 - DNA, 22 bp, Artificial Sequence
  chemically synthesized
ctgagaacttcagggtatcaga

SEQ ID NO: 33376 - DNA, 22 bp, Artificial Sequence
  chemically synthesized
tgagaacttcagggtatcagag

SEQ ID NO: 33377 - DNA, 22 bp, Artificial Sequence
  chemically synthesized
agaacttcagggtatcagagtt

SEQ ID NO: 33378 - DNA, 22 bp, Artificial Sequence
  chemically synthesized
cagggtatcagagttggaaaag

SEQ ID NO: 33379 - DNA, 22 bp, Artificial Sequence
  chemically synthesized
agggtatcagagttggaaaaga

SEQ ID NO: 33380 - DNA, 22 bp, Artificial Sequence
  chemically synthesized
gaaaagacttagagaggccctg

SEQ ID NO: 33381 - DNA, 22 bp, Artificial Sequence
  chemically synthesized
agagaggccctggttcaaaccc

SEQ ID NO: 33382 - DNA, 22 bp, Artificial Sequence
  chemically synthesized
gagaggccctggttcaaacccc

SEQ ID NO: 33383 - DNA, 22 bp, Artificial Sequence
  chemically synthesized
gttcaaacccctgtgttcagag

SEQ ID NO: 33384 - DNA, 22 bp, Artificial Sequence
  chemically synthesized
aaacccctgtgttcagaggctt

SEQ ID NO: 33385 - DNA, 22 bp, Artificial Sequence
  chemically synthesized
tgttcagaggcttccctgtggt

SEQ ID NO: 33386 - DNA, 22 bp, Artificial Sequence
  chemically synthesized
agaggcttccctgtggtgtctg

SEQ ID NO: 33387 - DNA, 22 bp, Artificial Sequence
  chemically synthesized
ccctgtggtgtctgtgggcaca

SEQ ID NO: 33388 - DNA, 22 bp, Artificial Sequence
  chemically synthesized
cctgtggtgtctgtgggcacag

SEQ ID NO: 33389 - DNA, 22 bp, Artificial Sequence
  chemically synthesized
tggtgtctgtgggcacagctgg

SEQ ID NO: 33390 - DNA, 22 bp, Artificial Sequence
  chemically synthesized
tgggcacagctggagctgaaga

SEQ ID NO: 33391 - DNA, 22 bp, Artificial Sequence
  chemically synthesized
gagctgaagaacaagggaaagg

SEQ ID NO: 33392 - DNA, 22 bp, Artificial Sequence
  chemically synthesized
aagaacaagggaaaggtgataa

SEQ ID NO: 33393 - DNA, 22 bp, Artificial Sequence
  chemically synthesized
ttattggtcatcccttgccttt

SEQ ID NO: 33394 - DNA, 22 bp, Artificial Sequence
  chemically synthesized
attggtcatcccttgcctttgt

SEQ ID NO: 33395 - DNA, 22 bp, Artificial Sequence
  chemically synthesized
ttggtcatcccttgcctttgtt

SEQ ID NO: 33396 - DNA, 22 bp, Artificial Sequence
  chemically synthesized
gtcatcccttgcctttgttcat

SEQ ID NO: 33397 - DNA, 22 bp, Artificial Sequence
  chemically synthesized
gcctttgttcatttcaattatt

SEQ ID NO: 33398 - DNA, 22 bp, Artificial Sequence
  chemically synthesized
cctttgttcatttcaattattg

SEQ ID NO: 33399 - DNA, 22 bp, Artificial Sequence
  chemically synthesized
tgttcatttcaattattgtctt

SEQ ID NO: 33400 - DNA, 22 bp, Artificial Sequence
  chemically synthesized
gttcatttcaattattgtcttg

SEQ ID NO: 33401 - DNA, 22 bp, Artificial Sequence
  chemically synthesized
ttcatttcaattattgtcttgg

SEQ ID NO: 33402 - DNA, 22 bp, Artificial Sequence
  chemically synthesized
atttcaattattgtcttggaaa

SEQ ID NO: 33403 - DNA, 22 bp, Artificial Sequence
  chemically synthesized
caattattgtcttggaaatctg

SEQ ID NO: 33404 - DNA, 22 bp, Artificial Sequence
  chemically synthesized
aattattgtcttggaaatctgt

SEQ ID NO: 33405 - DNA, 22 bp, Artificial Sequence
  chemically synthesized
ttgtcttggaaatctgtagaca

SEQ ID NO: 33406 - DNA, 22 bp, Artificial Sequence
  chemically synthesized
tcttggaaatctgtagacatcc

SEQ ID NO: 33407 - DNA, 22 bp, Artificial Sequence
  chemically synthesized
ggaaatctgtagacatcctaag

SEQ ID NO: 33408 - DNA, 22 bp, Artificial Sequence
  chemically synthesized
gaaatctgtagacatcctaaga

SEQ ID NO: 33409 - DNA, 22 bp, Artificial Sequence
  chemically synthesized
tagacatcctaagagctcccct

SEQ ID NO: 33410 - DNA, 22 bp, Artificial Sequence
  chemically synthesized
agagctcccctccactacggac

SEQ ID NO: 33411 - DNA, 22 bp, Artificial Sequence
  chemically synthesized
ccctccactacggacatgcacg

SEQ ID NO: 33412 - DNA, 22 bp, Artificial Sequence
  chemically synthesized
cactacggacatgcacgtttct

SEQ ID NO: 33413 - DNA, 22 bp, Artificial Sequence
  chemically synthesized
cggacatgcacgtttctctcta

SEQ ID NO: 33414 - DNA, 22 bp, Artificial Sequence
  chemically synthesized
ctctctatgtctttttcccaac

SEQ ID NO: 33415 - DNA, 22 bp, Artificial Sequence
  chemically synthesized
tctctatgtctttttcccaacc

SEQ ID NO: 33416 - DNA, 22 bp, Artificial Sequence
  chemically synthesized
tctatgtctttttcccaacccc

SEQ ID NO: 33417 - DNA, 22 bp, Artificial Sequence
  chemically synthesized
tatgtctttttcccaacccctg

SEQ ID NO: 33418 - DNA, 22 bp, Artificial Sequence
  chemically synthesized
tgtctttttcccaacccctgct

SEQ ID NO: 33419 - DNA, 22 bp, Artificial Sequence
  chemically synthesized
tttcccaacccctgctctgaca

SEQ ID NO: 33420 - DNA, 22 bp, Artificial Sequence
  chemically synthesized
ttcccaacccctgctctgacac

SEQ ID NO: 33421 - DNA, 22 bp, Artificial Sequence
  chemically synthesized
tcccaacccctgctctgacacc

SEQ ID NO: 33422 - DNA, 22 bp, Artificial Sequence
  chemically synthesized
cccaacccctgctctgacacct

SEQ ID NO: 33423 - DNA, 22 bp, Artificial Sequence
  chemically synthesized
ccaacccctgctctgacacctt

SEQ ID NO: 33424 - DNA, 22 bp, Artificial Sequence
  chemically synthesized
ctctgacaccttcccattgctg

SEQ ID NO: 33425 - DNA, 22 bp, Artificial Sequence
  chemically synthesized
tgacaccttcccattgctgcag

SEQ ID NO: 33426 - DNA, 22 bp, Artificial Sequence
  chemically synthesized
acaccttcccattgctgcagcc

SEQ ID NO: 33427 - DNA, 22 bp, Artificial Sequence
  chemically synthesized
cccattgctgcagcctcatgga

SEQ ID NO: 33428 - DNA, 22 bp, Artificial Sequence
  chemically synthesized
ccattgctgcagcctcatggac

SEQ ID NO: 33429 - DNA, 22 bp, Artificial Sequence
  chemically synthesized
ctgcagcctcatggaccacttc

SEQ ID NO: 33430 - DNA, 22 bp, Artificial Sequence
  chemically synthesized
cagcctcatggaccacttccgg

SEQ ID NO: 33431 - DNA, 22 bp, Artificial Sequence
  chemically synthesized
atggaccacttccggtgaccag

SEQ ID NO: 33432 - DNA, 22 bp, Artificial Sequence
  chemically synthesized
ccggtgaccagttagatatgct

SEQ ID NO: 33433 - DNA, 22 bp, Artificial Sequence
  chemically synthesized
cggtgaccagttagatatgctt

SEQ ID NO: 33434 - DNA, 22 bp, Artificial Sequence
  chemically synthesized
gatatgcttgatctatttagtt

SEQ ID NO: 33435 - DNA, 22 bp, Artificial Sequence
  chemically synthesized
gatctatttagttaattaaggc

SEQ ID NO: 33436 - DNA, 22 bp, Artificial Sequence
  chemically synthesized
atctatttagttaattaaggct

SEQ ID NO: 33437 - DNA, 22 bp, Artificial Sequence
  chemically synthesized
tttagttaattaaggctctgaa

SEQ ID NO: 33438 - DNA, 22 bp, Artificial Sequence
  chemically synthesized
agttaattaaggctctgaatca

SEQ ID NO: 33439 - DNA, 22 bp, Artificial Sequence
  chemically synthesized
gttaattaaggctctgaatcag

SEQ ID NO: 33440 - DNA, 22 bp, Artificial Sequence
  chemically synthesized
attaaggctctgaatcagccct

SEQ ID NO: 33441 - DNA, 22 bp, Artificial Sequence
  chemically synthesized
aggctctgaatcagcccttggc

SEQ ID NO: 33442 - DNA, 22 bp, Artificial Sequence
  chemically synthesized
tgaatcagcccttggccagaag

SEQ ID NO: 33443 - DNA, 22 bp, Artificial Sequence
  chemically synthesized
aatcagcccttggccagaagaa

SEQ ID NO: 33444 - DNA, 22 bp, Artificial Sequence
  chemically synthesized
ggccagaagaagcacctcctct

SEQ ID NO: 33445 - DNA, 22 bp, Artificial Sequence
  chemically synthesized
gccagaagaagcacctcctcta

SEQ ID NO: 33446 - DNA, 22 bp, Artificial Sequence
  chemically synthesized
ctctaggaaatcattccttctt

SEQ ID NO: 33447 - DNA, 22 bp, Artificial Sequence
  chemically synthesized
taggaaatcattccttcttttt

SEQ ID NO: 33448 - DNA, 22 bp, Artificial Sequence
  chemically synthesized
ggaaatcattccttctttttag

SEQ ID NO: 33449 - DNA, 22 bp, Artificial Sequence
  chemically synthesized
cttctttttagtaatacgcaat

SEQ ID NO: 33450 - DNA, 22 bp, Artificial Sequence
  chemically synthesized
ctttttagtaatacgcaattga

SEQ ID NO: 33451 - DNA, 22 bp, Artificial Sequence
  chemically synthesized
tttttagtaatacgcaattgaa

SEQ ID NO: 33452 - DNA, 22 bp, Artificial Sequence
  chemically synthesized
tttagtaatacgcaattgaaaa

SEQ ID NO: 33453 - DNA, 22 bp, Artificial Sequence
  chemically synthesized
ttagtaatacgcaattgaaaag

SEQ ID NO: 33454 - DNA, 22 bp, Artificial Sequence
  chemically synthesized
tagtaatacgcaattgaaaagt

SEQ ID NO: 33455 - DNA, 22 bp, Artificial Sequence
  chemically synthesized
agtaatacgcaattgaaaagta

SEQ ID NO: 33456 - DNA, 22 bp, Artificial Sequence
  chemically synthesized
gtaatacgcaattgaaaagtat

SEQ ID NO: 33457 - DNA, 22 bp, Artificial Sequence
  chemically synthesized
aaaagtatgtgtgggttatgtg

SEQ ID NO: 33458 - DNA, 22 bp, Artificial Sequence
  chemically synthesized
tgtgctgttaggtgctaagcat

SEQ ID NO: 33459 - DNA, 22 bp, Artificial Sequence
  chemically synthesized
ttaggtgctaagcattttagct

SEQ ID NO: 33460 - DNA, 22 bp, Artificial Sequence
  chemically synthesized
ggtgctaagcattttagctatg

SEQ ID NO: 33461 - DNA, 22 bp, Artificial Sequence
  chemically synthesized
agcattttagctatgaattaac

SEQ ID NO: 33462 - DNA, 22 bp, Artificial Sequence
  chemically synthesized
tagctatgaattaactcataat

SEQ ID NO: 33463 - DNA, 22 bp, Artificial Sequence
  chemically synthesized
agctatgaattaactcataatc

SEQ ID NO: 33464 - DNA, 22 bp, Artificial Sequence
  chemically synthesized
gctatgaattaactcataatcc

SEQ ID NO: 33465 - DNA, 22 bp, Artificial Sequence
  chemically synthesized
tgaattaactcataatcctcaa

SEQ ID NO: 33466 - DNA, 22 bp, Artificial Sequence
  chemically synthesized
actcataatcctcaaaataaat

SEQ ID NO: 33467 - DNA, 22 bp, Artificial Sequence
  chemically synthesized
ataatcctcaaaataaatctgg

SEQ ID NO: 33468 - DNA, 22 bp, Artificial Sequence
  chemically synthesized
aaaataaatctggggtatagag

SEQ ID NO: 33469 - DNA, 22 bp, Artificial Sequence
  chemically synthesized
gggtatagagagaggttcttgt

SEQ ID NO: 33470 - DNA, 22 bp, Artificial Sequence
  chemically synthesized
ttgtttcaattagaaaagtaat

SEQ ID NO: 33471 - DNA, 22 bp, Artificial Sequence
  chemically synthesized
gtttcaattagaaaagtaatgc

SEQ ID NO: 33472 - DNA, 22 bp, Artificial Sequence
  chemically synthesized
tttcaattagaaaagtaatgct

SEQ ID NO: 33473 - DNA, 22 bp, Artificial Sequence
  chemically synthesized
caattagaaaagtaatgcttgg

SEQ ID NO: 33474 - DNA, 22 bp, Artificial Sequence
  chemically synthesized
aattagaaaagtaatgcttgga

SEQ ID NO: 33475 - DNA, 22 bp, Artificial Sequence
  chemically synthesized
gaaaagtaatgcttggagagac

SEQ ID NO: 33476 - DNA, 22 bp, Artificial Sequence
  chemically synthesized
ggagagactatgatttgcccaa

SEQ ID NO: 33477 - DNA, 22 bp, Artificial Sequence
  chemically synthesized
gagagactatgatttgcccaag

SEQ ID NO: 33478 - DNA, 22 bp, Artificial Sequence
  chemically synthesized
tgatttgcccaaggtcactgcc

SEQ ID NO: 33479 - DNA, 22 bp, Artificial Sequence
  chemically synthesized
gcccaaggtcactgccaataga

SEQ ID NO: 33480 - DNA, 22 bp, Artificial Sequence
  chemically synthesized
cccaaggtcactgccaatagat

SEQ ID NO: 33481 - DNA, 22 bp, Artificial Sequence
  chemically synthesized
ccaatagatgacttgattagaa

SEQ ID NO: 33482 - DNA, 22 bp, Artificial Sequence
  chemically synthesized
gattagaagcagggtatgtttg

SEQ ID NO: 33483 - DNA, 22 bp, Artificial Sequence
  chemically synthesized
attagaagcagggtatgtttga

SEQ ID NO: 33484 - DNA, 22 bp, Artificial Sequence
  chemically synthesized
gaagcagggtatgtttgaatgc

SEQ ID NO: 33485 - DNA, 22 bp, Artificial Sequence
  chemically synthesized
gaatgcgaagtccaggctcaaa

SEQ ID NO: 33486 - DNA, 22 bp, Artificial Sequence
  chemically synthesized
aatgcgaagtccaggctcaaaa

SEQ ID NO: 33487 - DNA, 22 bp, Artificial Sequence
  chemically synthesized
aaaaaggggccttagtggctcc

SEQ ID NO: 33488 - DNA, 22 bp, Artificial Sequence
  chemically synthesized
agtggctcctactagactggta

SEQ ID NO: 33489 - DNA, 22 bp, Artificial Sequence
  chemically synthesized
gtggctcctactagactggtat

SEQ ID NO: 33490 - DNA, 22 bp, Artificial Sequence
  chemically synthesized
ctactagactggtatcttaagg

SEQ ID NO: 33491 - DNA, 22 bp, Artificial Sequence
  chemically synthesized
ctagactggtatcttaaggcaa

SEQ ID NO: 33492 - DNA, 22 bp, Artificial Sequence
  chemically synthesized
gactggtatcttaaggcaagga

SEQ ID NO: 33493 - DNA, 22 bp, Artificial Sequence
  chemically synthesized
gtatcttaaggcaaggaaaaca

SEQ ID NO: 33494 - DNA, 22 bp, Artificial Sequence
  chemically synthesized
aaggcaaggaaaacagaatatg

SEQ ID NO: 33495 - DNA, 22 bp, Artificial Sequence
  chemically synthesized
aggcaaggaaaacagaatatgt

SEQ ID NO: 33496 - DNA, 22 bp, Artificial Sequence
  chemically synthesized
atatctaaaaccatgcctagtg

SEQ ID NO: 33497 - DNA, 22 bp, Artificial Sequence
  chemically synthesized
aaaccatgcctagtgcccaggc

SEQ ID NO: 33498 - DNA, 22 bp, Artificial Sequence
  chemically synthesized
gtgcccaggccaggcttgaatc

SEQ ID NO: 33499 - DNA, 22 bp, Artificial Sequence
  chemically synthesized
gaatcaatgctcaacgcatgca

SEQ ID NO: 33500 - DNA, 22 bp, Artificial Sequence
  chemically synthesized
aatcaatgctcaacgcatgcat

SEQ ID NO: 33501 - DNA, 22 bp, Artificial Sequence
  chemically synthesized
aacgcatgcatgtgtaactgaa

SEQ ID NO: 33502 - DNA, 22 bp, Artificial Sequence
  chemically synthesized
aacagaactgcccagaaccttg

SEQ ID NO: 33503 - DNA, 22 bp, Artificial Sequence
  chemically synthesized
cccagaaccttggctcaggcca

SEQ ID NO: 33504 - DNA, 22 bp, Artificial Sequence
  chemically synthesized
ggctcaggccaagtaggccaga

SEQ ID NO: 33505 - DNA, 22 bp, Artificial Sequence
  chemically synthesized
gctcaggccaagtaggccagac

SEQ ID NO: 33506 - DNA, 22 bp, Artificial Sequence
  chemically synthesized
aggccaagtaggccagaccacc

SEQ ID NO: 33507 - DNA, 22 bp, Artificial Sequence
  chemically synthesized
ccctgaatgcagggtttgagaa

SEQ ID NO: 33508 - DNA, 22 bp, Artificial Sequence
  chemically synthesized
cctgaatgcagggtttgagaag

SEQ ID NO: 33509 - DNA, 22 bp, Artificial Sequence
  chemically synthesized
aatgcagggtttgagaagtgcc

SEQ ID NO: 33510 - DNA, 22 bp, Artificial Sequence
  chemically synthesized
gagaagtgccctaatgccctct

SEQ ID NO: 33511 - DNA, 22 bp, Artificial Sequence
  chemically synthesized
agaagtgccctaatgccctcta

SEQ ID NO: 33512 - DNA, 22 bp, Artificial Sequence
  chemically synthesized
atgccctctaactgatgctgag

SEQ ID NO: 33513 - DNA, 22 bp, Artificial Sequence
  chemically synthesized
taactgatgctgagtttgaaga

SEQ ID NO: 33514 - DNA, 22 bp, Artificial Sequence
  chemically synthesized
actgatgctgagtttgaagaat

SEQ ID NO: 33515 - DNA, 22 bp, Artificial Sequence
  chemically synthesized
atgctgagtttgaagaatccat

SEQ ID NO: 33516 - DNA, 22 bp, Artificial Sequence
  chemically synthesized
agtttgaagaatccatcagtta

SEQ ID NO: 33517 - DNA, 22 bp, Artificial Sequence
  chemically synthesized
gaagaatccatcagttaagggg

SEQ ID NO: 33518 - DNA, 22 bp, Artificial Sequence
  chemically synthesized
aagaatccatcagttaagggga

SEQ ID NO: 33519 - DNA, 22 bp, Artificial Sequence
  chemically synthesized
aggggaggtgtttctgagtttg

SEQ ID NO: 33520 - DNA, 22 bp, Artificial Sequence
  chemically synthesized
ctgagtttgaagaatcaaacac

SEQ ID NO: 33521 - DNA, 22 bp, Artificial Sequence
  chemically synthesized
tgagtttgaagaatcaaacacc

SEQ ID NO: 33522 - DNA, 22 bp, Artificial Sequence
  chemically synthesized
agtttgaagaatcaaacacctt

SEQ ID NO: 33523 - DNA, 22 bp, Artificial Sequence
  chemically synthesized
gaagaatcaaacaccttcctaa

SEQ ID NO: 33524 - DNA, 22 bp, Artificial Sequence
  chemically synthesized
aagaatcaaacaccttcctaat

SEQ ID NO: 33525 - DNA, 22 bp, Artificial Sequence
  chemically synthesized
cctaattggtaggaatcctgaa

SEQ ID NO: 33526 - DNA, 22 bp, Artificial Sequence
  chemically synthesized
ctaattggtaggaatcctgaaa

SEQ ID NO: 33527 - DNA, 22 bp, Artificial Sequence
  chemically synthesized
attggtaggaatcctgaaaaca

SEQ ID NO: 33528 - DNA, 22 bp, Artificial Sequence
  chemically synthesized
gtaggaatcctgaaaacactcc

SEQ ID NO: 33529 - DNA, 22 bp, Artificial Sequence
  chemically synthesized
aaaacactccacaccggagtaa

SEQ ID NO: 33530 - DNA, 22 bp, Artificial Sequence
  chemically synthesized
cacaccggagtaaaagactttg

SEQ ID NO: 33531 - DNA, 22 bp, Artificial Sequence
  chemically synthesized
tggttttttatctttatgcctg

SEQ ID NO: 33532 - DNA, 22 bp, Artificial Sequence
  chemically synthesized
ggttttttatctttatgcctga

SEQ ID NO: 33533 - DNA, 22 bp, Artificial Sequence
  chemically synthesized
gttttttatctttatgcctgac

SEQ ID NO: 33534 - DNA, 22 bp, Artificial Sequence
  chemically synthesized
tttatctttatgcctgactaaa

SEQ ID NO: 33535 - DNA, 22 bp, Artificial Sequence
  chemically synthesized
ttatctttatgcctgactaaaa

SEQ ID NO: 33536 - DNA, 22 bp, Artificial Sequence
  chemically synthesized
tatctttatgcctgactaaaag

SEQ ID NO: 33537 - DNA, 22 bp, Artificial Sequence
  chemically synthesized
atctttatgcctgactaaaagt

SEQ ID NO: 33538 - DNA, 22 bp, Artificial Sequence
  chemically synthesized
tctttatgcctgactaaaagtt

SEQ ID NO: 33539 - DNA, 22 bp, Artificial Sequence
  chemically synthesized
tatgcctgactaaaagttaact

SEQ ID NO: 33540 - DNA, 22 bp, Artificial Sequence
  chemically synthesized
atgcctgactaaaagttaactc

SEQ ID NO: 33541 - DNA, 22 bp, Artificial Sequence
  chemically synthesized
tgcctgactaaaagttaactct

SEQ ID NO: 33542 - DNA, 22 bp, Artificial Sequence
  chemically synthesized
actaaaagttaactctcattct

SEQ ID NO: 33543 - DNA, 22 bp, Artificial Sequence
  chemically synthesized
aaagttaactctcattctttca

SEQ ID NO: 33544 - DNA, 22 bp, Artificial Sequence
  chemically synthesized
actctcattctttcattcagca

SEQ ID NO: 33545 - DNA, 22 bp, Artificial Sequence
  chemically synthesized
tcattctttcattcagcaaata

SEQ ID NO: 33546 - DNA, 22 bp, Artificial Sequence
  chemically synthesized
attctttcattcagcaaatatt

SEQ ID NO: 33547 - DNA, 22 bp, Artificial Sequence
  chemically synthesized
tttcattcagcaaatattttgt

SEQ ID NO: 33548 - DNA, 22 bp, Artificial Sequence
  chemically synthesized
tcattcagcaaatattttgtgc

SEQ ID NO: 33549 - DNA, 22 bp, Artificial Sequence
  chemically synthesized
cattcagcaaatattttgtgct

SEQ ID NO: 33550 - DNA, 22 bp, Artificial Sequence
  chemically synthesized
attcagcaaatattttgtgcta

SEQ ID NO: 33551 - DNA, 22 bp, Artificial Sequence
  chemically synthesized
agcaaatattttgtgctagtgc

SEQ ID NO: 33552 - DNA, 22 bp, Artificial Sequence
  chemically synthesized
tgtgctagtgcatgacactgca

SEQ ID NO: 33553 - DNA, 22 bp, Artificial Sequence
  chemically synthesized
gtgctagtgcatgacactgcag

SEQ ID NO: 33554 - DNA, 22 bp, Artificial Sequence
  chemically synthesized
tgctagtgcatgacactgcaga

SEQ ID NO: 33555 - DNA, 22 bp, Artificial Sequence
  chemically synthesized
gtgcatgacactgcagattaat

SEQ ID NO: 33556 - DNA, 22 bp, Artificial Sequence
  chemically synthesized
cagattaatatcgtagatgaac

SEQ ID NO: 33557 - DNA, 22 bp, Artificial Sequence
  chemically synthesized
atatcgtagatgaactgagtct

SEQ ID NO: 33558 - DNA, 22 bp, Artificial Sequence
  chemically synthesized
agtctgggctaggtagagtcaa

SEQ ID NO: 33559 - DNA, 22 bp, Artificial Sequence
  chemically synthesized
ggctaggtagagtcaaaaaaaa

SEQ ID NO: 33560 - DNA, 22 bp, Artificial Sequence
  chemically synthesized
ggtagagtcaaaaaaaaatttc

SEQ ID NO: 33561 - DNA, 22 bp, Artificial Sequence
  chemically synthesized
cctaaaggagcctgtacctaaa

SEQ ID NO: 33562 - DNA, 22 bp, Artificial Sequence
  chemically synthesized
ctaaaggagcctgtacctaaac

SEQ ID NO: 33563 - DNA, 22 bp, Artificial Sequence
  chemically synthesized
aaggagcctgtacctaaactga

SEQ ID NO: 33564 - DNA, 22 bp, Artificial Sequence
  chemically synthesized
tacctaaactgagtcttcagag

SEQ ID NO: 33565 - DNA, 22 bp, Artificial Sequence
  chemically synthesized
aactgagtcttcagagagaagt

SEQ ID NO: 33566 - DNA, 22 bp, Artificial Sequence
  chemically synthesized
agtcttcagagagaagttggaa

SEQ ID NO: 33567 - DNA, 22 bp, Artificial Sequence
  chemically synthesized
cagagagaagttggaactggca

SEQ ID NO: 33568 - DNA, 22 bp, Artificial Sequence
  chemically synthesized
agagagaagttggaactggcaa

SEQ ID NO: 33569 - DNA, 22 bp, Artificial Sequence
  chemically synthesized
gaactggcaaagtgaggaagga

SEQ ID NO: 33570 - DNA, 22 bp, Artificial Sequence
  chemically synthesized
gcaaagtgaggaaggacggggt

SEQ ID NO: 33571 - DNA, 22 bp, Artificial Sequence
  chemically synthesized
gagggaagagtgagtgcaaagg

SEQ ID NO: 33572 - DNA, 22 bp, Artificial Sequence
  chemically synthesized
catgctctagaatccaaaactg

SEQ ID NO: 33573 - DNA, 22 bp, Artificial Sequence
  chemically synthesized
tagaatccaaaactgtgtcagc

SEQ ID NO: 33574 - DNA, 22 bp, Artificial Sequence
  chemically synthesized
gaatccaaaactgtgtcagcca

SEQ ID NO: 33575 - DNA, 22 bp, Artificial Sequence
  chemically synthesized
tgtcagccaaatttgagttgat

SEQ ID NO: 33576 - DNA, 22 bp, Artificial Sequence
  chemically synthesized
gagttgatggagggacagccaa

SEQ ID NO: 33577 - DNA, 22 bp, Artificial Sequence
  chemically synthesized
agttgatggagggacagccaaa

SEQ ID NO: 33578 - DNA, 22 bp, Artificial Sequence
  chemically synthesized
atggagggacagccaaactgag

SEQ ID NO: 33579 - DNA, 22 bp, Artificial Sequence
  chemically synthesized
agatacccaggcggtggttgga

SEQ ID NO: 33580 - DNA, 22 bp, Artificial Sequence
  chemically synthesized
gatttatggatctggatttcag

SEQ ID NO: 33581 - DNA, 22 bp, Artificial Sequence
  chemically synthesized
atggatctggatttcaggggag

SEQ ID NO: 33582 - DNA, 22 bp, Artificial Sequence
  chemically synthesized
tggatctggatttcaggggagt

SEQ ID NO: 33583 - DNA, 22 bp, Artificial Sequence
  chemically synthesized
gatttcaggggagtgggcaggg

SEQ ID NO: 33584 - DNA, 22 bp, Artificial Sequence
  chemically synthesized
caggggagtgggcagggctagg

SEQ ID NO: 33585 - DNA, 22 bp, Artificial Sequence
  chemically synthesized
aggggagtgggcagggctaggg

SEQ ID NO: 33586 - DNA, 22 bp, Artificial Sequence
  chemically synthesized
ggggaatagaactgagggtcat

SEQ ID NO: 33587 - DNA, 22 bp, Artificial Sequence
  chemically synthesized
agggtcatgatgtcagtggtag

SEQ ID NO: 33588 - DNA, 22 bp, Artificial Sequence
  chemically synthesized
aagtcttggaagaaagagtaga

SEQ ID NO: 33589 - DNA, 22 bp, Artificial Sequence
  chemically synthesized
ggaagaaagagtagatagaaac

SEQ ID NO: 33590 - DNA, 22 bp, Artificial Sequence
  chemically synthesized
gaagaaagagtagatagaaact

SEQ ID NO: 33591 - DNA, 22 bp, Artificial Sequence
  chemically synthesized
tgttttctgatgaacattctat

SEQ ID NO: 33592 - DNA, 22 bp, Artificial Sequence
  chemically synthesized
gttttctgatgaacattctatg

SEQ ID NO: 33593 - DNA, 22 bp, Artificial Sequence
  chemically synthesized
ttttctgatgaacattctatga

SEQ ID NO: 33594 - DNA, 22 bp, Artificial Sequence
  chemically synthesized
tctgatgaacattctatgagga

SEQ ID NO: 33595 - DNA, 22 bp, Artificial Sequence
  chemically synthesized
ctgatgaacattctatgaggaa

SEQ ID NO: 33596 - DNA, 22 bp, Artificial Sequence
  chemically synthesized
tgatgaacattctatgaggaag

SEQ ID NO: 33597 - DNA, 22 bp, Artificial Sequence
  chemically synthesized
atgaacattctatgaggaagtt

SEQ ID NO: 33598 - DNA, 22 bp, Artificial Sequence
  chemically synthesized
tatgaggaagttcagcagaggt

SEQ ID NO: 33599 - DNA, 22 bp, Artificial Sequence
  chemically synthesized
tgaggaagttcagcagaggttg

SEQ ID NO: 33600 - DNA, 22 bp, Artificial Sequence
  chemically synthesized
agcagaggttggaaacatcttt

SEQ ID NO: 33601 - DNA, 22 bp, Artificial Sequence
  chemically synthesized
gaaacatctttaccatttataa

SEQ ID NO: 33602 - DNA, 22 bp, Artificial Sequence
  chemically synthesized
taccatttataaataaatttta

SEQ ID NO: 33603 - DNA, 22 bp, Artificial Sequence
  chemically synthesized
accatttataaataaattttat

SEQ ID NO: 33604 - DNA, 22 bp, Artificial Sequence
  chemically synthesized
ccatttataaataaattttatg

SEQ ID NO: 33605 - DNA, 22 bp, Artificial Sequence
  chemically synthesized
ataaataaattttatgtaaaat

SEQ ID NO: 33606 - DNA, 22 bp, Artificial Sequence
  chemically synthesized
taaataaattttatgtaaaatc

SEQ ID NO: 33607 - DNA, 22 bp, Artificial Sequence
  chemically synthesized
tatgtaaaatcctatcctgctg

SEQ ID NO: 33608 - DNA, 22 bp, Artificial Sequence
  chemically synthesized
atgtaaaatcctatcctgctgt

SEQ ID NO: 33609 - DNA, 22 bp, Artificial Sequence
  chemically synthesized
tgtaaaatcctatcctgctgtc

SEQ ID NO: 33610 - DNA, 22 bp, Artificial Sequence
  chemically synthesized
tcctgctgtcatgtttaagcaa

SEQ ID NO: 33611 - DNA, 22 bp, Artificial Sequence
  chemically synthesized
ctgtcatgtttaagcaacttat

SEQ ID NO: 33612 - DNA, 22 bp, Artificial Sequence
  chemically synthesized
tcatgtttaagcaacttattat

SEQ ID NO: 33613 - DNA, 22 bp, Artificial Sequence
  chemically synthesized
aagcaacttattatgcacagca

SEQ ID NO: 33614 - DNA, 22 bp, Artificial Sequence
  chemically synthesized
agcaacttattatgcacagcac

SEQ ID NO: 33615 - DNA, 22 bp, Artificial Sequence
  chemically synthesized
attatgcacagcaccaggacat

SEQ ID NO: 33616 - DNA, 22 bp, Artificial Sequence
  chemically synthesized
ttatgcacagcaccaggacatc

SEQ ID NO: 33617 - DNA, 22 bp, Artificial Sequence
  chemically synthesized
tgcacagcaccaggacatcaat

SEQ ID NO: 33618 - DNA, 22 bp, Artificial Sequence
  chemically synthesized
catgccagtctttgctctcagt

SEQ ID NO: 33619 - DNA, 22 bp, Artificial Sequence
  chemically synthesized
tgctctcagtttcaaaggcatt

SEQ ID NO: 33620 - DNA, 22 bp, Artificial Sequence
  chemically synthesized
gctctcagtttcaaaggcattc

SEQ ID NO: 33621 - DNA, 22 bp, Artificial Sequence
  chemically synthesized
ctctcagtttcaaaggcattct

SEQ ID NO: 33622 - DNA, 22 bp, Artificial Sequence
  chemically synthesized
tcagtttcaaaggcattcttcc

SEQ ID NO: 33623 - DNA, 22 bp, Artificial Sequence
  chemically synthesized
agtttcaaaggcattcttccct

SEQ ID NO: 33624 - DNA, 22 bp, Artificial Sequence
  chemically synthesized
caaaggcattcttccctgcctg

SEQ ID NO: 33625 - DNA, 22 bp, Artificial Sequence
  chemically synthesized
aaaggcattcttccctgcctgc

SEQ ID NO: 33626 - DNA, 22 bp, Artificial Sequence
  chemically synthesized
ttccctgcctgctgtctaatct

SEQ ID NO: 33627 - DNA, 22 bp, Artificial Sequence
  chemically synthesized
ccctgcctgctgtctaatcttt

SEQ ID NO: 33628 - DNA, 22 bp, Artificial Sequence
  chemically synthesized
cctgcctgctgtctaatcttta

SEQ ID NO: 33629 - DNA, 22 bp, Artificial Sequence
  chemically synthesized
cctgctgtctaatctttacaaa

SEQ ID NO: 33630 - DNA, 22 bp, Artificial Sequence
  chemically synthesized
ctgtctaatctttacaaagaaa

SEQ ID NO: 33631 - DNA, 22 bp, Artificial Sequence
  chemically synthesized
tctaatctttacaaagaaaggt

SEQ ID NO: 33632 - DNA, 22 bp, Artificial Sequence
  chemically synthesized
atctttacaaagaaaggttaac

SEQ ID NO: 33633 - DNA, 22 bp, Artificial Sequence
  chemically synthesized
tacaaagaaaggttaactccag

SEQ ID NO: 33634 - DNA, 22 bp, Artificial Sequence
  chemically synthesized
acaaagaaaggttaactccaga

SEQ ID NO: 33635 - DNA, 22 bp, Artificial Sequence
  chemically synthesized
caaagaaaggttaactccagag

SEQ ID NO: 33636 - DNA, 22 bp, Artificial Sequence
  chemically synthesized
actccagaggtcaggaatctga

SEQ ID NO: 33637 - DNA, 22 bp, Artificial Sequence
  chemically synthesized
cagaggtcaggaatctgaacac

SEQ ID NO: 33638 - DNA, 22 bp, Artificial Sequence
  chemically synthesized
aacacagaaaaccagattgcat

SEQ ID NO: 33639 - DNA, 22 bp, Artificial Sequence
  chemically synthesized
catcatattcattctaatcaat

SEQ ID NO: 33640 - DNA, 22 bp, Artificial Sequence
  chemically synthesized
attctaatcaataaacattata

SEQ ID NO: 33641 - DNA, 22 bp, Artificial Sequence
  chemically synthesized
taatcaataaacattatataat

SEQ ID NO: 33642 - DNA, 22 bp, Artificial Sequence
  chemically synthesized
atcaataaacattatataattt

SEQ ID NO: 33643 - DNA, 22 bp, Artificial Sequence
  chemically synthesized
tataatttttaaaactgtttct

SEQ ID NO: 33644 - DNA, 22 bp, Artificial Sequence
  chemically synthesized
ttaaaactgtttctcatctttt

SEQ ID NO: 33645 - DNA, 22 bp, Artificial Sequence
  chemically synthesized
taaaactgtttctcatctttta

SEQ ID NO: 33646 - DNA, 22 bp, Artificial Sequence
  chemically synthesized
aaaactgtttctcatcttttat

SEQ ID NO: 33647 - DNA, 22 bp, Artificial Sequence
  chemically synthesized
aaactgtttctcatcttttatt

SEQ ID NO: 33648 - DNA, 22 bp, Artificial Sequence
  chemically synthesized
tttctcatcttttatttcttca

SEQ ID NO: 33649 - DNA, 22 bp, Artificial Sequence
  chemically synthesized
ctcatcttttatttcttcattt

SEQ ID NO: 33650 - DNA, 22 bp, Artificial Sequence
  chemically synthesized
tcatcttttatttcttcatttt

SEQ ID NO: 33651 - DNA, 22 bp, Artificial Sequence
  chemically synthesized
atcttttatttcttcattttaa

SEQ ID NO: 33652 - DNA, 22 bp, Artificial Sequence
  chemically synthesized
ttatttcttcattttaatgaat

SEQ ID NO: 33653 - DNA, 22 bp, Artificial Sequence
  chemically synthesized
tatttcttcattttaatgaata

SEQ ID NO: 33654 - DNA, 22 bp, Artificial Sequence
  chemically synthesized
atttcttcattttaatgaatat

SEQ ID NO: 33655 - DNA, 22 bp, Artificial Sequence
  chemically synthesized
tttcttcattttaatgaatatg

SEQ ID NO: 33656 - DNA, 22 bp, Artificial Sequence
  chemically synthesized
cttcattttaatgaatatgtca

SEQ ID NO: 33657 - DNA, 22 bp, Artificial Sequence
  chemically synthesized
ttcattttaatgaatatgtcaa

SEQ ID NO: 33658 - DNA, 22 bp, Artificial Sequence
  chemically synthesized
cattttaatgaatatgtcaaca

SEQ ID NO: 33659 - DNA, 22 bp, Artificial Sequence
  chemically synthesized
attttaatgaatatgtcaacac

SEQ ID NO: 33660 - DNA, 22 bp, Artificial Sequence
  chemically synthesized
taatgaatatgtcaacacaaag

SEQ ID NO: 33661 - DNA, 22 bp, Artificial Sequence
  chemically synthesized
aatgaatatgtcaacacaaagc

SEQ ID NO: 33662 - DNA, 22 bp, Artificial Sequence
  chemically synthesized
atgaatatgtcaacacaaagcc

SEQ ID NO: 33663 - DNA, 22 bp, Artificial Sequence
  chemically synthesized
acacaaaagtacaactggggta

SEQ ID NO: 33664 - DNA, 22 bp, Artificial Sequence
  chemically synthesized
cacaaaagtacaactggggtaa

SEQ ID NO: 33665 - DNA, 22 bp, Artificial Sequence
  chemically synthesized
gggtaagaaaattcaaaagata

SEQ ID NO: 33666 - DNA, 22 bp, Artificial Sequence
  chemically synthesized
aaaagataaagtaataaaatta

SEQ ID NO: 33667 - DNA, 22 bp, Artificial Sequence
  chemically synthesized
aatttaaaatgaaataccctat

SEQ ID NO: 33668 - DNA, 22 bp, Artificial Sequence
  chemically synthesized
aaaatgaaataccctatgtatt

SEQ ID NO: 33669 - DNA, 22 bp, Artificial Sequence
  chemically synthesized
aaatgaaataccctatgtattt

SEQ ID NO: 33670 - DNA, 22 bp, Artificial Sequence
  chemically synthesized
tgtatttgagtaagttgcttag

SEQ ID NO: 33671 - DNA, 22 bp, Artificial Sequence
  chemically synthesized
gagtaagttgcttagcttctcc

SEQ ID NO: 33672 - DNA, 22 bp, Artificial Sequence
  chemically synthesized
agtaagttgcttagcttctccc

SEQ ID NO: 33673 - DNA, 22 bp, Artificial Sequence
  chemically synthesized
cttagcttctcccaaccttggt

SEQ ID NO: 33674 - DNA, 22 bp, Artificial Sequence
  chemically synthesized
agcttctcccaaccttggtttc

SEQ ID NO: 33675 - DNA, 22 bp, Artificial Sequence
  chemically synthesized
gcttctcccaaccttggtttcc

SEQ ID NO: 33676 - DNA, 22 bp, Artificial Sequence
  chemically synthesized
ctcccaaccttggtttcctcat

SEQ ID NO: 33677 - DNA, 22 bp, Artificial Sequence
  chemically synthesized
tcccaaccttggtttcctcatt

SEQ ID NO: 33678 - DNA, 22 bp, Artificial Sequence
  chemically synthesized
ccaaccttggtttcctcatttc

SEQ ID NO: 33679 - DNA, 22 bp, Artificial Sequence
  chemically synthesized
ggtttcctcatttctaaaacga

SEQ ID NO: 33680 - DNA, 22 bp, Artificial Sequence
  chemically synthesized
gtttcctcatttctaaaacgaa

SEQ ID NO: 33681 - DNA, 22 bp, Artificial Sequence
  chemically synthesized
cctcatttctaaaacgaagaac

SEQ ID NO: 33682 - DNA, 22 bp, Artificial Sequence
  chemically synthesized
ctcatttctaaaacgaagaact

SEQ ID NO: 33683 - DNA, 22 bp, Artificial Sequence
  chemically synthesized
atttctaaaacgaagaacttgc

SEQ ID NO: 33684 - DNA, 22 bp, Artificial Sequence
  chemically synthesized
ctaaaacgaagaacttgcttaa

SEQ ID NO: 33685 - DNA, 22 bp, Artificial Sequence
  chemically synthesized
taaaacgaagaacttgcttaat

SEQ ID NO: 33686 - DNA, 22 bp, Artificial Sequence
  chemically synthesized
aaacgaagaacttgcttaatat

SEQ ID NO: 33687 - DNA, 22 bp, Artificial Sequence
  chemically synthesized
gcttaatattcaggctctgggc

SEQ ID NO: 33688 - DNA, 22 bp, Artificial Sequence
  chemically synthesized
cttaatattcaggctctgggcc

SEQ ID NO: 33689 - DNA, 22 bp, Artificial Sequence
  chemically synthesized
aatattcaggctctgggcccca

SEQ ID NO: 33690 - DNA, 22 bp, Artificial Sequence
  chemically synthesized
atattcaggctctgggccccac

SEQ ID NO: 33691 - DNA, 22 bp, Artificial Sequence
  chemically synthesized
aggctctgggccccaccaccaa

SEQ ID NO: 33692 - DNA, 22 bp, Artificial Sequence
  chemically synthesized
tgggccccaccaccaaatcctt

SEQ ID NO: 33693 - DNA, 22 bp, Artificial Sequence
  chemically synthesized
ggccccaccaccaaatccttga

SEQ ID NO: 33694 - DNA, 22 bp, Artificial Sequence
  chemically synthesized
gattcactggctctgggtctgt

SEQ ID NO: 33695 - DNA, 22 bp, Artificial Sequence
  chemically synthesized
attcactggctctgggtctgta

SEQ ID NO: 33696 - DNA, 22 bp, Artificial Sequence
  chemically synthesized
actggctctgggtctgtatgta

SEQ ID NO: 33697 - DNA, 22 bp, Artificial Sequence
  chemically synthesized
gctctgggtctgtatgtaacaa

SEQ ID NO: 33698 - DNA, 22 bp, Artificial Sequence
  chemically synthesized
tgggtctgtatgtaacaagctt

SEQ ID NO: 33699 - DNA, 22 bp, Artificial Sequence
  chemically synthesized
ggtctgtatgtaacaagcttct

SEQ ID NO: 33700 - DNA, 22 bp, Artificial Sequence
  chemically synthesized
tatgtaacaagcttctggagtg

SEQ ID NO: 33701 - DNA, 22 bp, Artificial Sequence
  chemically synthesized
ctggagtgattctaatgattag

SEQ ID NO: 33702 - DNA, 22 bp, Artificial Sequence
  chemically synthesized
tggagtgattctaatgattagc

SEQ ID NO: 33703 - DNA, 22 bp, Artificial Sequence
  chemically synthesized
gagtgattctaatgattagcca

SEQ ID NO: 33704 - DNA, 22 bp, Artificial Sequence
  chemically synthesized
taatgattagccagagacagga

SEQ ID NO: 33705 - DNA, 22 bp, Artificial Sequence
  chemically synthesized
atgattagccagagacaggacc

SEQ ID NO: 33706 - DNA, 22 bp, Artificial Sequence
  chemically synthesized
gccagagacaggacctactatt

SEQ ID NO: 33707 - DNA, 22 bp, Artificial Sequence
  chemically synthesized
ctattctacgtaactgatttcc

SEQ ID NO: 33708 - DNA, 22 bp, Artificial Sequence
  chemically synthesized
ttctacgtaactgatttcctct

SEQ ID NO: 33709 - DNA, 22 bp, Artificial Sequence
  chemically synthesized
tacgtaactgatttcctcttgc

SEQ ID NO: 33710 - DNA, 22 bp, Artificial Sequence
  chemically synthesized
cgtaactgatttcctcttgctg

SEQ ID NO: 33711 - DNA, 22 bp, Artificial Sequence
  chemically synthesized
atttcctcttgctgctgtaaaa

SEQ ID NO: 33712 - DNA, 22 bp, Artificial Sequence
  chemically synthesized
cctcttgctgctgtaaaaaatt

SEQ ID NO: 33713 - DNA, 22 bp, Artificial Sequence
  chemically synthesized
ctcttgctgctgtaaaaaatta

SEQ ID NO: 33714 - DNA, 22 bp, Artificial Sequence
  chemically synthesized
ttgctgctgtaaaaaattacca

SEQ ID NO: 33715 - DNA, 22 bp, Artificial Sequence
  chemically synthesized
gctgctgtaaaaaattaccaca

SEQ ID NO: 33716 - DNA, 22 bp, Artificial Sequence
  chemically synthesized
ctgctgtaaaaaattaccacaa

SEQ ID NO: 33717 - DNA, 22 bp, Artificial Sequence
  chemically synthesized
ctgtaaaaaattaccacaaatt

SEQ ID NO: 33718 - DNA, 22 bp, Artificial Sequence
  chemically synthesized
taaaaaattaccacaaatttat

SEQ ID NO: 33719 - DNA, 22 bp, Artificial Sequence
  chemically synthesized
ccacaaatttattggcttaaaa

SEQ ID NO: 33720 - DNA, 22 bp, Artificial Sequence
  chemically synthesized
attggcttaaaacaacacaaat

SEQ ID NO: 33721 - DNA, 22 bp, Artificial Sequence
  chemically synthesized
ttggcttaaaacaacacaaatg

SEQ ID NO: 33722 - DNA, 22 bp, Artificial Sequence
  chemically synthesized
gcttaaaacaacacaaatgtat

SEQ ID NO: 33723 - DNA, 22 bp, Artificial Sequence
  chemically synthesized
aaaacaacacaaatgtattatc

SEQ ID NO: 33724 - DNA, 22 bp, Artificial Sequence
  chemically synthesized
aaacaacacaaatgtattatct

SEQ ID NO: 33725 - DNA, 22 bp, Artificial Sequence
  chemically synthesized
tcttgaagttgtggaggtcaga

SEQ ID NO: 33726 - DNA, 22 bp, Artificial Sequence
  chemically synthesized
gaagttgtggaggtcagaagtc

SEQ ID NO: 33727 - DNA, 22 bp, Artificial Sequence
  chemically synthesized
aagttgtggaggtcagaagtct

SEQ ID NO: 33728 - DNA, 22 bp, Artificial Sequence
  chemically synthesized
tggaggtcagaagtctgaaatc

SEQ ID NO: 33729 - DNA, 22 bp, Artificial Sequence
  chemically synthesized
aaatcggtttcactgggctaaa

SEQ ID NO: 33730 - DNA, 22 bp, Artificial Sequence
  chemically synthesized
cactgggctaaagtcgaggtgt

SEQ ID NO: 33731 - DNA, 22 bp, Artificial Sequence
  chemically synthesized
actgggctaaagtcgaggtgtc

SEQ ID NO: 33732 - DNA, 22 bp, Artificial Sequence
  chemically synthesized
ggctaaagtcgaggtgtcagtg

SEQ ID NO: 33733 - DNA, 22 bp, Artificial Sequence
  chemically synthesized
aagtcgaggtgtcagtgtggct

SEQ ID NO: 33734 - DNA, 22 bp, Artificial Sequence
  chemically synthesized
tttcttctggagactctatgag

SEQ ID NO: 33735 - DNA, 22 bp, Artificial Sequence
  chemically synthesized
cttctggagactctatgagaga

SEQ ID NO: 33736 - DNA, 22 bp, Artificial Sequence
  chemically synthesized
ttctggagactctatgagagat

SEQ ID NO: 33737 - DNA, 22 bp, Artificial Sequence
  chemically synthesized
ctggagactctatgagagattg

SEQ ID NO: 33738 - DNA, 22 bp, Artificial Sequence
  chemically synthesized
tggagactctatgagagattgt

SEQ ID NO: 33739 - DNA, 22 bp, Artificial Sequence
  chemically synthesized
gagactctatgagagattgtgt

SEQ ID NO: 33740 - DNA, 22 bp, Artificial Sequence
  chemically synthesized
tatgagagattgtgttttcctg

SEQ ID NO: 33741 - DNA, 22 bp, Artificial Sequence
  chemically synthesized
tgagagattgtgttttcctgcc

SEQ ID NO: 33742 - DNA, 22 bp, Artificial Sequence
  chemically synthesized
tgttttcctgccttttccatgg

SEQ ID NO: 33743 - DNA, 22 bp, Artificial Sequence
  chemically synthesized
tcctgccttttccatggattct

SEQ ID NO: 33744 - DNA, 22 bp, Artificial Sequence
  chemically synthesized
cctgccttttccatggattctg

SEQ ID NO: 33745 - DNA, 22 bp, Artificial Sequence
  chemically synthesized
ctgccttttccatggattctgt

SEQ ID NO: 33746 - DNA, 22 bp, Artificial Sequence
  chemically synthesized
ccttttccatggattctgtttc

SEQ ID NO: 33747 - DNA, 22 bp, Artificial Sequence
  chemically synthesized
ttccatggattctgtttcctct

SEQ ID NO: 33748 - DNA, 22 bp, Artificial Sequence
  chemically synthesized
tccatggattctgtttcctctt

SEQ ID NO: 33749 - DNA, 22 bp, Artificial Sequence
  chemically synthesized
ccatggattctgtttcctcttc

SEQ ID NO: 33750 - DNA, 22 bp, Artificial Sequence
  chemically synthesized
catggattctgtttcctcttct

SEQ ID NO: 33751 - DNA, 22 bp, Artificial Sequence
  chemically synthesized
tgtttcctcttctagaggctac

SEQ ID NO: 33752 - DNA, 22 bp, Artificial Sequence
  chemically synthesized
tttcctcttctagaggctaccc

SEQ ID NO: 33753 - DNA, 22 bp, Artificial Sequence
  chemically synthesized
cctcttctagaggctacccaca

SEQ ID NO: 33754 - DNA, 22 bp, Artificial Sequence
  chemically synthesized
ctcttctagaggctacccacat

SEQ ID NO: 33755 - DNA, 22 bp, Artificial Sequence
  chemically synthesized
ttctagaggctacccacattcc

SEQ ID NO: 33756 - DNA, 22 bp, Artificial Sequence
  chemically synthesized
ctagaggctacccacattcctt

SEQ ID NO: 33757 - DNA, 22 bp, Artificial Sequence
  chemically synthesized
tagaggctacccacattccttg

SEQ ID NO: 33758 - DNA, 22 bp, Artificial Sequence
  chemically synthesized
gaggctacccacattccttggt

SEQ ID NO: 33759 - DNA, 22 bp, Artificial Sequence
  chemically synthesized
cccacattccttggtttgtagc

SEQ ID NO: 33760 - DNA, 22 bp, Artificial Sequence
  chemically synthesized
cttggtttgtagcctcttcctc

SEQ ID NO: 33761 - DNA, 22 bp, Artificial Sequence
  chemically synthesized
ggtttgtagcctcttcctcgat

SEQ ID NO: 33762 - DNA, 22 bp, Artificial Sequence
  chemically synthesized
gtttgtagcctcttcctcgatc

SEQ ID NO: 33763 - DNA, 22 bp, Artificial Sequence
  chemically synthesized
gtagcctcttcctcgatcttca

SEQ ID NO: 33764 - DNA, 22 bp, Artificial Sequence
  chemically synthesized
tagcctcttcctcgatcttcaa

SEQ ID NO: 33765 - DNA, 22 bp, Artificial Sequence
  chemically synthesized
ttcctcgatcttcaaaaaaatg

SEQ ID NO: 33766 - DNA, 22 bp, Artificial Sequence
  chemically synthesized
cctcgatcttcaaaaaaatgta

SEQ ID NO: 33767 - DNA, 22 bp, Artificial Sequence
  chemically synthesized
ctcgatcttcaaaaaaatgtat

SEQ ID NO: 33768 - DNA, 22 bp, Artificial Sequence
  chemically synthesized
gatcttcaaaaaaatgtatctc

SEQ ID NO: 33769 - DNA, 22 bp, Artificial Sequence
  chemically synthesized
caaaaaaatgtatctctgcttt

SEQ ID NO: 33770 - DNA, 22 bp, Artificial Sequence
  chemically synthesized
aaaaaaatgtatctctgctttt

SEQ ID NO: 33771 - DNA, 22 bp, Artificial Sequence
  chemically synthesized
tgcttttgtaatcacgtcacat

SEQ ID NO: 33772 - DNA, 22 bp, Artificial Sequence
  chemically synthesized
cttttgtaatcacgtcacattt

SEQ ID NO: 33773 - DNA, 22 bp, Artificial Sequence
  chemically synthesized
ttgtaatcacgtcacattttct

SEQ ID NO: 33774 - DNA, 22 bp, Artificial Sequence
  chemically synthesized
tgtaatcacgtcacattttctc

SEQ ID NO: 33775 - DNA, 22 bp, Artificial Sequence
  chemically synthesized
gtaatcacgtcacattttctcc

SEQ ID NO: 33776 - DNA, 22 bp, Artificial Sequence
  chemically synthesized
taatcacgtcacattttctcct

SEQ ID NO: 33777 - DNA, 22 bp, Artificial Sequence
  chemically synthesized
tctcctcttataagtcaaatct

SEQ ID NO: 33778 - DNA, 22 bp, Artificial Sequence
  chemically synthesized
ctcctcttataagtcaaatctc

SEQ ID NO: 33779 - DNA, 22 bp, Artificial Sequence
  chemically synthesized
tcctcttataagtcaaatctcc

SEQ ID NO: 33780 - DNA, 22 bp, Artificial Sequence
  chemically synthesized
ctcttataagtcaaatctccct

SEQ ID NO: 33781 - DNA, 22 bp, Artificial Sequence
  chemically synthesized
ttataagtcaaatctccctttg

SEQ ID NO: 33782 - DNA, 22 bp, Artificial Sequence
  chemically synthesized
ataagtcaaatctccctttgcc

SEQ ID NO: 33783 - DNA, 22 bp, Artificial Sequence
  chemically synthesized
taagtcaaatctccctttgcct

SEQ ID NO: 33784 - DNA, 22 bp, Artificial Sequence
  chemically synthesized
cctttgcctccctcttataatg

SEQ ID NO: 33785 - DNA, 22 bp, Artificial Sequence
  chemically synthesized
tgcctccctcttataatgacac

SEQ ID NO: 33786 - DNA, 22 bp, Artificial Sequence
  chemically synthesized
gcctccctcttataatgacact

SEQ ID NO: 33787 - DNA, 22 bp, Artificial Sequence
  chemically synthesized
cctccctcttataatgacactt

SEQ ID NO: 33788 - DNA, 22 bp, Artificial Sequence
  chemically synthesized
cctcttataatgacacttgtga

SEQ ID NO: 33789 - DNA, 22 bp, Artificial Sequence
  chemically synthesized
ttataatgacacttgtgattac

SEQ ID NO: 33790 - DNA, 22 bp, Artificial Sequence
  chemically synthesized
ataatgacacttgtgattacat

SEQ ID NO: 33791 - DNA, 22 bp, Artificial Sequence
  chemically synthesized
taatgacacttgtgattacatt

SEQ ID NO: 33792 - DNA, 22 bp, Artificial Sequence
  chemically synthesized
gtgattacatttaggatacacc

SEQ ID NO: 33793 - DNA, 22 bp, Artificial Sequence
  chemically synthesized
tgattacatttaggatacaccc

SEQ ID NO: 33794 - DNA, 22 bp, Artificial Sequence
  chemically synthesized
catttaggatacacccaaataa

SEQ ID NO: 33795 - DNA, 22 bp, Artificial Sequence
  chemically synthesized
aggatacacccaaataattagg

SEQ ID NO: 33796 - DNA, 22 bp, Artificial Sequence
  chemically synthesized
ggatacacccaaataattagga

SEQ ID NO: 33797 - DNA, 22 bp, Artificial Sequence
  chemically synthesized
ggatatctccccatcccaagat

SEQ ID NO: 33798 - DNA, 22 bp, Artificial Sequence
  chemically synthesized
cccatcccaagatccttaatta

SEQ ID NO: 33799 - DNA, 22 bp, Artificial Sequence
  chemically synthesized
aattatatatgcaaaagtctgt

SEQ ID NO: 33800 - DNA, 22 bp, Artificial Sequence
  chemically synthesized
attatatatgcaaaagtctgtt

SEQ ID NO: 33801 - DNA, 22 bp, Artificial Sequence
  chemically synthesized
tatatgcaaaagtctgtttggc

SEQ ID NO: 33802 - DNA, 22 bp, Artificial Sequence
  chemically synthesized
tttggctagaaaagataatact

SEQ ID NO: 33803 - DNA, 22 bp, Artificial Sequence
  chemically synthesized
ggctagaaaagataatactcac

SEQ ID NO: 33804 - DNA, 22 bp, Artificial Sequence
  chemically synthesized
gctagaaaagataatactcaca

SEQ ID NO: 33805 - DNA, 22 bp, Artificial Sequence
  chemically synthesized
gaaaagataatactcacaggtt

SEQ ID NO: 33806 - DNA, 22 bp, Artificial Sequence
  chemically synthesized
acaggtttcaggggttaagcca

SEQ ID NO: 33807 - DNA, 22 bp, Artificial Sequence
  chemically synthesized
caggggttaagccatacatatc

SEQ ID NO: 33808 - DNA, 22 bp, Artificial Sequence
  chemically synthesized
aggggttaagccatacatatct

SEQ ID NO: 33809 - DNA, 22 bp, Artificial Sequence
  chemically synthesized
agccatacatatctttcagagt

SEQ ID NO: 33810 - DNA, 22 bp, Artificial Sequence
  chemically synthesized
tcagagtgagccattagccatt

SEQ ID NO: 33811 - DNA, 22 bp, Artificial Sequence
  chemically synthesized
cagagtgagccattagccatta

SEQ ID NO: 33812 - DNA, 22 bp, Artificial Sequence
  chemically synthesized
agagtgagccattagccattat

SEQ ID NO: 33813 - DNA, 22 bp, Artificial Sequence
  chemically synthesized
gccattattcagcctactgcga

SEQ ID NO: 33814 - DNA, 22 bp, Artificial Sequence
  chemically synthesized
ttcagcctactgcgataatgtg

SEQ ID NO: 33815 - DNA, 22 bp, Artificial Sequence
  chemically synthesized
agcctactgcgataatgtgcaa

SEQ ID NO: 33816 - DNA, 22 bp, Artificial Sequence
  chemically synthesized
ctgcgataatgtgcaagttccc

SEQ ID NO: 33817 - DNA, 22 bp, Artificial Sequence
  chemically synthesized
cgataatgtgcaagttcccttt

SEQ ID NO: 33818 - DNA, 22 bp, Artificial Sequence
  chemically synthesized
cctttacaatctatgttctatg

SEQ ID NO: 33819 - DNA, 22 bp, Artificial Sequence
  chemically synthesized
tacaatctatgttctatgttcc

SEQ ID NO: 33820 - DNA, 22 bp, Artificial Sequence
  chemically synthesized
acaatctatgttctatgttccc

SEQ ID NO: 33821 - DNA, 22 bp, Artificial Sequence
  chemically synthesized
caatctatgttctatgttccca

SEQ ID NO: 33822 - DNA, 22 bp, Artificial Sequence
  chemically synthesized
tgttctatgttcccatcaaggt

SEQ ID NO: 33823 - DNA, 22 bp, Artificial Sequence
  chemically synthesized
tatgttcccatcaaggttaatt

SEQ ID NO: 33824 - DNA, 22 bp, Artificial Sequence
  chemically synthesized
tgttcccatcaaggttaattag

SEQ ID NO: 33825 - DNA, 22 bp, Artificial Sequence
  chemically synthesized
ccatcaaggttaattagaaata

SEQ ID NO: 33826 - DNA, 22 bp, Artificial Sequence
  chemically synthesized
attagaaatattagactctttt

SEQ ID NO: 33827 - DNA, 22 bp, Artificial Sequence
  chemically synthesized
gaaatattagactctttttcca

SEQ ID NO: 33828 - DNA, 22 bp, Artificial Sequence
  chemically synthesized
gactctttttccacagaaaaaa

SEQ ID NO: 33829 - DNA, 22 bp, Artificial Sequence
  chemically synthesized
tttttccacagaaaaaaaaaat

SEQ ID NO: 33830 - DNA, 22 bp, Artificial Sequence
  chemically synthesized
tttccacagaaaaaaaaaatgt

SEQ ID NO: 33831 - DNA, 22 bp, Artificial Sequence
  chemically synthesized
ttccacagaaaaaaaaaatgta

SEQ ID NO: 33832 - DNA, 22 bp, Artificial Sequence
  chemically synthesized
tccacagaaaaaaaaaatgtag

SEQ ID NO: 33833 - DNA, 22 bp, Artificial Sequence
  chemically synthesized
ccacagaaaaaaaaaatgtagc

SEQ ID NO: 33834 - DNA, 22 bp, Artificial Sequence
  chemically synthesized
cacagaaaaaaaaaatgtagca

SEQ ID NO: 33835 - DNA, 22 bp, Artificial Sequence
  chemically synthesized
catctctaccctgacttctctc

SEQ ID NO: 33836 - DNA, 22 bp, Artificial Sequence
  chemically synthesized
atctctaccctgacttctctct

SEQ ID NO: 33837 - DNA, 22 bp, Artificial Sequence
  chemically synthesized
taccctgacttctctctctttc

SEQ ID NO: 33838 - DNA, 22 bp, Artificial Sequence
  chemically synthesized
ccctgacttctctctctttcct

SEQ ID NO: 33839 - DNA, 22 bp, Artificial Sequence
  chemically synthesized
acttctctctctttccttcatg

SEQ ID NO: 33840 - DNA, 22 bp, Artificial Sequence
  chemically synthesized
ctctctctttccttcatgccca

SEQ ID NO: 33841 - DNA, 22 bp, Artificial Sequence
  chemically synthesized
tctctctttccttcatgcccag

SEQ ID NO: 33842 - DNA, 22 bp, Artificial Sequence
  chemically synthesized
tctctttccttcatgcccagta

SEQ ID NO: 33843 - DNA, 22 bp, Artificial Sequence
  chemically synthesized
tctttccttcatgcccagtaag

SEQ ID NO: 33844 - DNA, 22 bp, Artificial Sequence
  chemically synthesized
tttccttcatgcccagtaagag

SEQ ID NO: 33845 - DNA, 22 bp, Artificial Sequence
  chemically synthesized
tccttcatgcccagtaagagga

SEQ ID NO: 33846 - DNA, 22 bp, Artificial Sequence
  chemically synthesized
ccttcatgcccagtaagaggaa

SEQ ID NO: 33847 - DNA, 22 bp, Artificial Sequence
  chemically synthesized
cttcatgcccagtaagaggaag

SEQ ID NO: 33848 - DNA, 22 bp, Artificial Sequence
  chemically synthesized
catgcccagtaagaggaagtga

SEQ ID NO: 33849 - DNA, 22 bp, Artificial Sequence
  chemically synthesized
atgcccagtaagaggaagtgag

SEQ ID NO: 33850 - DNA, 22 bp, Artificial Sequence
  chemically synthesized
ttcatctcatcaggtgttacct

SEQ ID NO: 33851 - DNA, 22 bp, Artificial Sequence
  chemically synthesized
atctcatcaggtgttacctaga

SEQ ID NO: 33852 - DNA, 22 bp, Artificial Sequence
  chemically synthesized
atcaggtgttacctagaatcag

SEQ ID NO: 33853 - DNA, 22 bp, Artificial Sequence
  chemically synthesized
cctagaatcagagtcaggagaa

SEQ ID NO: 33854 - DNA, 22 bp, Artificial Sequence
  chemically synthesized
gaatcagagtcaggagaaagca

SEQ ID NO: 33855 - DNA, 22 bp, Artificial Sequence
  chemically synthesized
ataaaactactctgacaagtaa

SEQ ID NO: 33856 - DNA, 22 bp, Artificial Sequence
  chemically synthesized
ctctgacaagtaaaccatatcc

SEQ ID NO: 33857 - DNA, 22 bp, Artificial Sequence
  chemically synthesized
tgacaagtaaaccatatcctgg

SEQ ID NO: 33858 - DNA, 22 bp, Artificial Sequence
  chemically synthesized
acaagtaaaccatatcctgggg

SEQ ID NO: 33859 - DNA, 22 bp, Artificial Sequence
  chemically synthesized
gggaccaggtgagaattaaaaa

SEQ ID NO: 33860 - DNA, 22 bp, Artificial Sequence
  chemically synthesized
aaaagctgtatactcataagct

SEQ ID NO: 33861 - DNA, 22 bp, Artificial Sequence
  chemically synthesized
tatactcataagctgccaaaga

SEQ ID NO: 33862 - DNA, 22 bp, Artificial Sequence
  chemically synthesized
ataagctgccaaagagctgatg

SEQ ID NO: 33863 - DNA, 22 bp, Artificial Sequence
  chemically synthesized
ccaaagagctgatggtactgaa

SEQ ID NO: 33864 - DNA, 22 bp, Artificial Sequence
  chemically synthesized
atggtactgaagtcacatggag

SEQ ID NO: 33865 - DNA, 22 bp, Artificial Sequence
  chemically synthesized
aagtcacatggagctcaggaat

SEQ ID NO: 33866 - DNA, 22 bp, Artificial Sequence
  chemically synthesized
aggaatttattcttgcatttag

SEQ ID NO: 33867 - DNA, 22 bp, Artificial Sequence
  chemically synthesized
attcttgcatttagaaagtatg

SEQ ID NO: 33868 - DNA, 22 bp, Artificial Sequence
  chemically synthesized
ttcttgcatttagaaagtatgc

SEQ ID NO: 33869 - DNA, 22 bp, Artificial Sequence
  chemically synthesized
ttgcatttagaaagtatgcata

SEQ ID NO: 33870 - DNA, 22 bp, Artificial Sequence
  chemically synthesized
gcatttagaaagtatgcatata

SEQ ID NO: 33871 - DNA, 22 bp, Artificial Sequence
  chemically synthesized
catttagaaagtatgcatataa

SEQ ID NO: 33872 - DNA, 22 bp, Artificial Sequence
  chemically synthesized
agaaagtatgcatataattctc

SEQ ID NO: 33873 - DNA, 22 bp, Artificial Sequence
  chemically synthesized
gaaagtatgcatataattctct

SEQ ID NO: 33874 - DNA, 22 bp, Artificial Sequence
  chemically synthesized
tctcgaaaagaaatgaaatcat

SEQ ID NO: 33875 - DNA, 22 bp, Artificial Sequence
  chemically synthesized
tcgaaaagaaatgaaatcatat

SEQ ID NO: 33876 - DNA, 22 bp, Artificial Sequence
  chemically synthesized
gaaaagaaatgaaatcatattt

SEQ ID NO: 33877 - DNA, 22 bp, Artificial Sequence
  chemically synthesized
ttctgtcggatcaaattattca

SEQ ID NO: 33878 - DNA, 22 bp, Artificial Sequence
  chemically synthesized
tctgtcggatcaaattattcag

SEQ ID NO: 33879 - DNA, 22 bp, Artificial Sequence
  chemically synthesized
ctgtcggatcaaattattcaga

SEQ ID NO: 33880 - DNA, 22 bp, Artificial Sequence
  chemically synthesized
tgtcggatcaaattattcagaa

SEQ ID NO: 33881 - DNA, 22 bp, Artificial Sequence
  chemically synthesized
tcggatcaaattattcagaaat

SEQ ID NO: 33882 - DNA, 22 bp, Artificial Sequence
  chemically synthesized
ttcagaaatccgaactgtagaa

SEQ ID NO: 33883 - DNA, 22 bp, Artificial Sequence
  chemically synthesized
agaaatccgaactgtagaaaac

SEQ ID NO: 33884 - DNA, 22 bp, Artificial Sequence
  chemically synthesized
tagaaaacatacaaacacactt

SEQ ID NO: 33885 - DNA, 22 bp, Artificial Sequence
  chemically synthesized
gcttaatgttagctttttaatc

SEQ ID NO: 33886 - DNA, 22 bp, Artificial Sequence
  chemically synthesized
cttaatgttagctttttaatct

SEQ ID NO: 33887 - DNA, 22 bp, Artificial Sequence
  chemically synthesized
aatgttagctttttaatcttat

SEQ ID NO: 33888 - DNA, 22 bp, Artificial Sequence
  chemically synthesized
atgttagctttttaatcttatt

SEQ ID NO: 33889 - DNA, 22 bp, Artificial Sequence
  chemically synthesized
gctttttaatcttatttttgta

SEQ ID NO: 33890 - DNA, 22 bp, Artificial Sequence
  chemically synthesized
tttaatcttatttttgtacaca

SEQ ID NO: 33891 - DNA, 22 bp, Artificial Sequence
  chemically synthesized
ttaatcttatttttgtacacag

SEQ ID NO: 33892 - DNA, 22 bp, Artificial Sequence
  chemically synthesized
taatcttatttttgtacacagt

SEQ ID NO: 33893 - DNA, 22 bp, Artificial Sequence
  chemically synthesized
aatcttatttttgtacacagta

SEQ ID NO: 33894 - DNA, 22 bp, Artificial Sequence
  chemically synthesized
atcttatttttgtacacagtat

SEQ ID NO: 33895 - DNA, 22 bp, Artificial Sequence
  chemically synthesized
atttttgtacacagtatacttt

SEQ ID NO: 33896 - DNA, 22 bp, Artificial Sequence
  chemically synthesized
tttttgtacacagtatactttt

SEQ ID NO: 33897 - DNA, 22 bp, Artificial Sequence
  chemically synthesized
ttgtacacagtatacttttaca

SEQ ID NO: 33898 - DNA, 22 bp, Artificial Sequence
  chemically synthesized
tgtacacagtatacttttacat

SEQ ID NO: 33899 - DNA, 22 bp, Artificial Sequence
  chemically synthesized
gtacacagtatacttttacata

SEQ ID NO: 33900 - DNA, 22 bp, Artificial Sequence
  chemically synthesized
tacacagtatacttttacatag

SEQ ID NO: 33901 - DNA, 22 bp, Artificial Sequence
  chemically synthesized
ttacataggcactgaaccagct

SEQ ID NO: 33902 - DNA, 22 bp, Artificial Sequence
  chemically synthesized
tacataggcactgaaccagctg

SEQ ID NO: 33903 - DNA, 22 bp, Artificial Sequence
  chemically synthesized
acataggcactgaaccagctgg

SEQ ID NO: 33904 - DNA, 22 bp, Artificial Sequence
  chemically synthesized
cataggcactgaaccagctgga

SEQ ID NO: 33905 - DNA, 22 bp, Artificial Sequence
  chemically synthesized
aaccagctggaaatgaatgctt

SEQ ID NO: 33906 - DNA, 22 bp, Artificial Sequence
  chemically synthesized
gaaatgaatgcttggattttcg

SEQ ID NO: 33907 - DNA, 22 bp, Artificial Sequence
  chemically synthesized
ggattttcgcagctgataaaag

SEQ ID NO: 33908 - DNA, 22 bp, Artificial Sequence
  chemically synthesized
gattttcgcagctgataaaagc

SEQ ID NO: 33909 - DNA, 22 bp, Artificial Sequence
  chemically synthesized
tcgcagctgataaaagcagagt

SEQ ID NO: 33910 - DNA, 22 bp, Artificial Sequence
  chemically synthesized
cgcagctgataaaagcagagtt

SEQ ID NO: 33911 - DNA, 22 bp, Artificial Sequence
  chemically synthesized
gcagctgataaaagcagagttc

SEQ ID NO: 33912 - DNA, 22 bp, Artificial Sequence
  chemically synthesized
ataaaagcagagttcagattct

SEQ ID NO: 33913 - DNA, 22 bp, Artificial Sequence
  chemically synthesized
agattctgtccttgagctcaat

SEQ ID NO: 33914 - DNA, 22 bp, Artificial Sequence
  chemically synthesized
tgtccttgagctcaatgtctgg

SEQ ID NO: 33915 - DNA, 22 bp, Artificial Sequence
  chemically synthesized
tccttgagctcaatgtctggag

SEQ ID NO: 33916 - DNA, 22 bp, Artificial Sequence
  chemically synthesized
gagctcaatgtctggagaaagc

SEQ ID NO: 33917 - DNA, 22 bp, Artificial Sequence
  chemically synthesized
agctcaatgtctggagaaagca

SEQ ID NO: 33918 - DNA, 22 bp, Artificial Sequence
  chemically synthesized
aatgtctggagaaagcagctgt

SEQ ID NO: 33919 - DNA, 22 bp, Artificial Sequence
  chemically synthesized
gagaaagcagctgtgaatactg

SEQ ID NO: 33920 - DNA, 22 bp, Artificial Sequence
  chemically synthesized
tgaatactgcttccttaattca

SEQ ID NO: 33921 - DNA, 22 bp, Artificial Sequence
  chemically synthesized
cttccttaattcagatgccttt

SEQ ID NO: 33922 - DNA, 22 bp, Artificial Sequence
  chemically synthesized
ccttaattcagatgcctttggc

SEQ ID NO: 33923 - DNA, 22 bp, Artificial Sequence
  chemically synthesized
cttaattcagatgcctttggcc

SEQ ID NO: 33924 - DNA, 22 bp, Artificial Sequence
  chemically synthesized
aattcagatgcctttggccgtg

SEQ ID NO: 33925 - DNA, 22 bp, Artificial Sequence
  chemically synthesized
attcagatgcctttggccgtga

SEQ ID NO: 33926 - DNA, 22 bp, Artificial Sequence
  chemically synthesized
agatgcctttggccgtgagggg

SEQ ID NO: 33927 - DNA, 22 bp, Artificial Sequence
  chemically synthesized
tggccgtgaggggcatggcatt

SEQ ID NO: 33928 - DNA, 22 bp, Artificial Sequence
  chemically synthesized
ggccgtgaggggcatggcattt

SEQ ID NO: 33929 - DNA, 22 bp, Artificial Sequence
  chemically synthesized
gccgtgaggggcatggcatttt

SEQ ID NO: 33930 - DNA, 22 bp, Artificial Sequence
  chemically synthesized
taaagctgcaataaactctgta

SEQ ID NO: 33931 - DNA, 22 bp, Artificial Sequence
  chemically synthesized
aaagctgcaataaactctgtac

SEQ ID NO: 33932 - DNA, 22 bp, Artificial Sequence
  chemically synthesized
aagctgcaataaactctgtact

SEQ ID NO: 33933 - DNA, 22 bp, Artificial Sequence
  chemically synthesized
caataaactctgtactttttct

SEQ ID NO: 33934 - DNA, 22 bp, Artificial Sequence
  chemically synthesized
tgtactttttctctcaggggat

SEQ ID NO: 33935 - DNA, 22 bp, Artificial Sequence
  chemically synthesized
tactttttctctcaggggatta

SEQ ID NO: 33936 - DNA, 22 bp, Artificial Sequence
  chemically synthesized
tttctctcaggggattagaaaa

SEQ ID NO: 33937 - DNA, 22 bp, Artificial Sequence
  chemically synthesized
ttctctcaggggattagaaaaa

SEQ ID NO: 33938 - DNA, 22 bp, Artificial Sequence
  chemically synthesized
tctctcaggggattagaaaaac

SEQ ID NO: 33939 - DNA, 22 bp, Artificial Sequence
  chemically synthesized
ctctcaggggattagaaaaacc

SEQ ID NO: 33940 - DNA, 22 bp, Artificial Sequence
  chemically synthesized
tctcaggggattagaaaaacca

SEQ ID NO: 33941 - DNA, 22 bp, Artificial Sequence
  chemically synthesized
tcaggggattagaaaaaccaat

SEQ ID NO: 33942 - DNA, 22 bp, Artificial Sequence
  chemically synthesized
aggggattagaaaaaccaattg

SEQ ID NO: 33943 - DNA, 22 bp, Artificial Sequence
  chemically synthesized
gaaaaaccaattgatttgatag

SEQ ID NO: 33944 - DNA, 22 bp, Artificial Sequence
  chemically synthesized
atttgatagtgactcagcagtt

SEQ ID NO: 33945 - DNA, 22 bp, Artificial Sequence
  chemically synthesized
gatagtgactcagcagttttca

SEQ ID NO: 33946 - DNA, 22 bp, Artificial Sequence
  chemically synthesized
atagtgactcagcagttttcac

SEQ ID NO: 33947 - DNA, 22 bp, Artificial Sequence
  chemically synthesized
agcagttttcaccttcctcttt

SEQ ID NO: 33948 - DNA, 22 bp, Artificial Sequence
  chemically synthesized
tcaccttcctctttagccaatg

SEQ ID NO: 33949 - DNA, 22 bp, Artificial Sequence
  chemically synthesized
caccttcctctttagccaatgc

SEQ ID NO: 33950 - DNA, 22 bp, Artificial Sequence
  chemically synthesized
accttcctctttagccaatgcc

SEQ ID NO: 33951 - DNA, 22 bp, Artificial Sequence
  chemically synthesized
cctctttagccaatgccctgca

SEQ ID NO: 33952 - DNA, 22 bp, Artificial Sequence
  chemically synthesized
ctctttagccaatgccctgcag

SEQ ID NO: 33953 - DNA, 22 bp, Artificial Sequence
  chemically synthesized
tttagccaatgccctgcagcta

SEQ ID NO: 33954 - DNA, 22 bp, Artificial Sequence
  chemically synthesized
tagccaatgccctgcagctaag

SEQ ID NO: 33955 - DNA, 22 bp, Artificial Sequence
  chemically synthesized
agccaatgccctgcagctaaga

SEQ ID NO: 33956 - DNA, 22 bp, Artificial Sequence
  chemically synthesized
gccaatgccctgcagctaagat

SEQ ID NO: 33957 - DNA, 22 bp, Artificial Sequence
  chemically synthesized
cagctaagattgagaaacggat

SEQ ID NO: 33958 - DNA, 22 bp, Artificial Sequence
  chemically synthesized
agattgagaaacggattcagaa

SEQ ID NO: 33959 - DNA, 22 bp, Artificial Sequence
  chemically synthesized
agaaacggattcagaactcaca

SEQ ID NO: 33960 - DNA, 22 bp, Artificial Sequence
  chemically synthesized
agaactcacacctcttggtgct

SEQ ID NO: 33961 - DNA, 22 bp, Artificial Sequence
  chemically synthesized
acacctcttggtgcttggtggc

SEQ ID NO: 33962 - DNA, 22 bp, Artificial Sequence
  chemically synthesized
ttggtgcttggtggctcccttc

SEQ ID NO: 33963 - DNA, 22 bp, Artificial Sequence
  chemically synthesized
ggtgcttggtggctcccttcca

SEQ ID NO: 33964 - DNA, 22 bp, Artificial Sequence
  chemically synthesized
gtgcttggtggctcccttccaa

SEQ ID NO: 33965 - DNA, 22 bp, Artificial Sequence
  chemically synthesized
ggtggctcccttccaaaccatc

SEQ ID NO: 33966 - DNA, 22 bp, Artificial Sequence
  chemically synthesized
gtggctcccttccaaaccatca

SEQ ID NO: 33967 - DNA, 22 bp, Artificial Sequence
  chemically synthesized
ccttccaaaccatcagctgttc

SEQ ID NO: 33968 - DNA, 22 bp, Artificial Sequence
  chemically synthesized
ccaaaccatcagctgttctttc

SEQ ID NO: 33969 - DNA, 22 bp, Artificial Sequence
  chemically synthesized
caaaccatcagctgttctttct

SEQ ID NO: 33970 - DNA, 22 bp, Artificial Sequence
  chemically synthesized
ttctttctactttctttcctat

SEQ ID NO: 33971 - DNA, 22 bp, Artificial Sequence
  chemically synthesized
tttctactttctttcctatttt

SEQ ID NO: 33972 - DNA, 22 bp, Artificial Sequence
  chemically synthesized
tctactttctttcctatttttt

SEQ ID NO: 33973 - DNA, 22 bp, Artificial Sequence
  chemically synthesized
ctactttctttcctatttttta

SEQ ID NO: 33974 - DNA, 22 bp, Artificial Sequence
  chemically synthesized
tactttctttcctattttttaa

SEQ ID NO: 33975 - DNA, 22 bp, Artificial Sequence
  chemically synthesized
ctttctttcctattttttaaag

SEQ ID NO: 33976 - DNA, 22 bp, Artificial Sequence
  chemically synthesized
tctttcctattttttaaagcac

SEQ ID NO: 33977 - DNA, 22 bp, Artificial Sequence
  chemically synthesized
ctttcctattttttaaagcaca

SEQ ID NO: 33978 - DNA, 22 bp, Artificial Sequence
  chemically synthesized
tttcctattttttaaagcacag

SEQ ID NO: 33979 - DNA, 22 bp, Artificial Sequence
  chemically synthesized
tcctattttttaaagcacagtc

SEQ ID NO: 33980 - DNA, 22 bp, Artificial Sequence
  chemically synthesized
cctattttttaaagcacagtct

SEQ ID NO: 33981 - DNA, 22 bp, Artificial Sequence
  chemically synthesized
ctattttttaaagcacagtctg

SEQ ID NO: 33982 - DNA, 22 bp, Artificial Sequence
  chemically synthesized
ttttttaaagcacagtctgaat

SEQ ID NO: 33983 - DNA, 22 bp, Artificial Sequence
  chemically synthesized
tttaaagcacagtctgaatcaa

SEQ ID NO: 33984 - DNA, 22 bp, Artificial Sequence
  chemically synthesized
ttaaagcacagtctgaatcaag

SEQ ID NO: 33985 - DNA, 22 bp, Artificial Sequence
  chemically synthesized
taaagcacagtctgaatcaagt

SEQ ID NO: 33986 - DNA, 22 bp, Artificial Sequence
  chemically synthesized
aaagcacagtctgaatcaagtg

SEQ ID NO: 33987 - DNA, 22 bp, Artificial Sequence
  chemically synthesized
aagcacagtctgaatcaagtgc

SEQ ID NO: 33988 - DNA, 22 bp, Artificial Sequence
  chemically synthesized
aatcaagtgcttcagaaccatt

SEQ ID NO: 33989 - DNA, 22 bp, Artificial Sequence
  chemically synthesized
cagaaccatttatactaactcg

SEQ ID NO: 33990 - DNA, 22 bp, Artificial Sequence
  chemically synthesized
agaaccatttatactaactcgt

SEQ ID NO: 33991 - DNA, 22 bp, Artificial Sequence
  chemically synthesized
atactaactcgtgttccaaaca

SEQ ID NO: 33992 - DNA, 22 bp, Artificial Sequence
  chemically synthesized
tactaactcgtgttccaaacac

SEQ ID NO: 33993 - DNA, 22 bp, Artificial Sequence
  chemically synthesized
actcgtgttccaaacacataac

SEQ ID NO: 33994 - DNA, 22 bp, Artificial Sequence
  chemically synthesized
gtgttccaaacacataaccctg

SEQ ID NO: 33995 - DNA, 22 bp, Artificial Sequence
  chemically synthesized
caaacacataaccctgaaccct

SEQ ID NO: 33996 - DNA, 22 bp, Artificial Sequence
  chemically synthesized
aaccctcttctaaggccaccag

SEQ ID NO: 33997 - DNA, 22 bp, Artificial Sequence
  chemically synthesized
ttctaaggccaccagttacaaa

SEQ ID NO: 33998 - DNA, 22 bp, Artificial Sequence
  chemically synthesized
ctaaggccaccagttacaaaga

SEQ ID NO: 33999 - DNA, 22 bp, Artificial Sequence
  chemically synthesized
taaggccaccagttacaaagaa

SEQ ID NO: 34000 - DNA, 22 bp, Artificial Sequence
  chemically synthesized
aggccaccagttacaaagaatg

SEQ ID NO: 34001 - DNA, 22 bp, Artificial Sequence
  chemically synthesized
caaagaatggggaaggttaatg

SEQ ID NO: 34002 - DNA, 22 bp, Artificial Sequence
  chemically synthesized
atgagtaactccaccagtgcct

SEQ ID NO: 34003 - DNA, 22 bp, Artificial Sequence
  chemically synthesized
caccagtgcctgccagaaagct

SEQ ID NO: 34004 - DNA, 22 bp, Artificial Sequence
  chemically synthesized
ccagaaagctcagctgtactcc

SEQ ID NO: 34005 - DNA, 22 bp, Artificial Sequence
  chemically synthesized
agctgtactccagccttccttc

SEQ ID NO: 34006 - DNA, 22 bp, Artificial Sequence
  chemically synthesized
tactccagccttccttcctctc

SEQ ID NO: 34007 - DNA, 22 bp, Artificial Sequence
  chemically synthesized
cagccttccttcctctcttgca

SEQ ID NO: 34008 - DNA, 22 bp, Artificial Sequence
  chemically synthesized
ccttcctctcttgcagagagaa

SEQ ID NO: 34009 - DNA, 22 bp, Artificial Sequence
  chemically synthesized
cttcctctcttgcagagagaaa

SEQ ID NO: 34010 - DNA, 22 bp, Artificial Sequence
  chemically synthesized
cctctcttgcagagagaaacaa

SEQ ID NO: 34011 - DNA, 22 bp, Artificial Sequence
  chemically synthesized
ctctcttgcagagagaaacaat

SEQ ID NO: 34012 - DNA, 22 bp, Artificial Sequence
  chemically synthesized
tcttgcagagagaaacaatgcg

SEQ ID NO: 34013 - DNA, 22 bp, Artificial Sequence
  chemically synthesized
ttgcagagagaaacaatgcggc

SEQ ID NO: 34014 - DNA, 22 bp, Artificial Sequence
  chemically synthesized
gcagagagaaacaatgcggcag

SEQ ID NO: 34015 - DNA, 22 bp, Artificial Sequence
  chemically synthesized
cagagagaaacaatgcggcagt

SEQ ID NO: 34016 - DNA, 22 bp, Artificial Sequence
  chemically synthesized
aacaaagcgaaggcactgtaat

SEQ ID NO: 34017 - DNA, 22 bp, Artificial Sequence
  chemically synthesized
taatgcccagtggcttcagtca

SEQ ID NO: 34018 - DNA, 22 bp, Artificial Sequence
  chemically synthesized
cagtcacaggctggtctaaaat

SEQ ID NO: 34019 - DNA, 22 bp, Artificial Sequence
  chemically synthesized
agtcacaggctggtctaaaatt

SEQ ID NO: 34020 - DNA, 22 bp, Artificial Sequence
  chemically synthesized
gtctaaaattccatttcacaga

SEQ ID NO: 34021 - DNA, 22 bp, Artificial Sequence
  chemically synthesized
aaattccatttcacagaattga

SEQ ID NO: 34022 - DNA, 22 bp, Artificial Sequence
  chemically synthesized
catttcacagaattgaagataa

SEQ ID NO: 34023 - DNA, 22 bp, Artificial Sequence
  chemically synthesized
cacagaattgaagataatttgg

SEQ ID NO: 34024 - DNA, 22 bp, Artificial Sequence
  chemically synthesized
acagaattgaagataatttggg

SEQ ID NO: 34025 - DNA, 22 bp, Artificial Sequence
  chemically synthesized
aagataatttggggttattacc

SEQ ID NO: 34026 - DNA, 22 bp, Artificial Sequence
  chemically synthesized
ggggttattaccaattctcagc

SEQ ID NO: 34027 - DNA, 22 bp, Artificial Sequence
  chemically synthesized
gggttattaccaattctcagca

SEQ ID NO: 34028 - DNA, 22 bp, Artificial Sequence
  chemically synthesized
ttaccaattctcagcagctcaa

SEQ ID NO: 34029 - DNA, 22 bp, Artificial Sequence
  chemically synthesized
ccaattctcagcagctcaaatt

SEQ ID NO: 34030 - DNA, 22 bp, Artificial Sequence
  chemically synthesized
tcagcagctcaaattcaatccc

SEQ ID NO: 34031 - DNA, 22 bp, Artificial Sequence
  chemically synthesized
agcagctcaaattcaatcccgt

SEQ ID NO: 34032 - DNA, 22 bp, Artificial Sequence
  chemically synthesized
aaattcaatcccgttgatggtg

SEQ ID NO: 34033 - DNA, 22 bp, Artificial Sequence
  chemically synthesized
aatcccgttgatggtgagcatg

SEQ ID NO: 34034 - DNA, 22 bp, Artificial Sequence
  chemically synthesized
atggtgagcatggggttcattt

SEQ ID NO: 34035 - DNA, 22 bp, Artificial Sequence
  chemically synthesized
attttgagagtagaaaattgga

SEQ ID NO: 34036 - DNA, 22 bp, Artificial Sequence
  chemically synthesized
tgagagtagaaaattggatgca

SEQ ID NO: 34037 - DNA, 22 bp, Artificial Sequence
  chemically synthesized
gagagtagaaaattggatgcag

SEQ ID NO: 34038 - DNA, 22 bp, Artificial Sequence
  chemically synthesized
agagtagaaaattggatgcagt

SEQ ID NO: 34039 - DNA, 22 bp, Artificial Sequence
  chemically synthesized
gatgcagtggagaatcagaatg

SEQ ID NO: 34040 - DNA, 22 bp, Artificial Sequence
  chemically synthesized
gatggtctctgccatttcccca

SEQ ID NO: 34041 - DNA, 22 bp, Artificial Sequence
  chemically synthesized
tgccatttccccaaagatatca

SEQ ID NO: 34042 - DNA, 22 bp, Artificial Sequence
  chemically synthesized
ccatttccccaaagatatcatc

SEQ ID NO: 34043 - DNA, 22 bp, Artificial Sequence
  chemically synthesized
ccccaaagatatcatcctaact

SEQ ID NO: 34044 - DNA, 22 bp, Artificial Sequence
  chemically synthesized
cccaaagatatcatcctaactg

SEQ ID NO: 34045 - DNA, 22 bp, Artificial Sequence
  chemically synthesized
actgcatgctgctgcttttaac

SEQ ID NO: 34046 - DNA, 22 bp, Artificial Sequence
  chemically synthesized
catgctgctgcttttaacaaat

SEQ ID NO: 34047 - DNA, 22 bp, Artificial Sequence
  chemically synthesized
ctgcttttaacaaatcagtata

SEQ ID NO: 34048 - DNA, 22 bp, Artificial Sequence
  chemically synthesized
cttttaacaaatcagtatacaa

SEQ ID NO: 34049 - DNA, 22 bp, Artificial Sequence
  chemically synthesized
ttaacaaatcagtatacaactt

SEQ ID NO: 34050 - DNA, 22 bp, Artificial Sequence
  chemically synthesized
taacaaatcagtatacaactta

SEQ ID NO: 34051 - DNA, 22 bp, Artificial Sequence
  chemically synthesized
aacaaatcagtatacaacttag

SEQ ID NO: 34052 - DNA, 22 bp, Artificial Sequence
  chemically synthesized
acaaatcagtatacaacttagt

SEQ ID NO: 34053 - DNA, 22 bp, Artificial Sequence
  chemically synthesized
agtattttttgtgttgacaaat

SEQ ID NO: 34054 - DNA, 22 bp, Artificial Sequence
  chemically synthesized
gtattttttgtgttgacaaatt

SEQ ID NO: 34055 - DNA, 22 bp, Artificial Sequence
  chemically synthesized
tttgtgttgacaaattttcaaa

SEQ ID NO: 34056 - DNA, 22 bp, Artificial Sequence
  chemically synthesized
ttgtgttgacaaattttcaaat

SEQ ID NO: 34057 - DNA, 22 bp, Artificial Sequence
  chemically synthesized
tgtgttgacaaattttcaaata

SEQ ID NO: 34058 - DNA, 22 bp, Artificial Sequence
  chemically synthesized
gtgttgacaaattttcaaatat

SEQ ID NO: 34059 - DNA, 22 bp, Artificial Sequence
  chemically synthesized
tgttgacaaattttcaaatata

SEQ ID NO: 34060 - DNA, 22 bp, Artificial Sequence
  chemically synthesized
acaaattttcaaatatacaaaa

SEQ ID NO: 34061 - DNA, 22 bp, Artificial Sequence
  chemically synthesized
tcaaatatacaaaatattgagt

SEQ ID NO: 34062 - DNA, 22 bp, Artificial Sequence
  chemically synthesized
caaatatacaaaatattgagtc

SEQ ID NO: 34063 - DNA, 22 bp, Artificial Sequence
  chemically synthesized
aaatatacaaaatattgagtct

SEQ ID NO: 34064 - DNA, 22 bp, Artificial Sequence
  chemically synthesized
agtctgaaggcaaaaagaataa

SEQ ID NO: 34065 - DNA, 22 bp, Artificial Sequence
  chemically synthesized
aaggcaaaaagaataatttttc

SEQ ID NO: 34066 - DNA, 22 bp, Artificial Sequence
  chemically synthesized
ttcacttccattgcttcctagg

SEQ ID NO: 34067 - DNA, 22 bp, Artificial Sequence
  chemically synthesized
tcacttccattgcttcctaggt

SEQ ID NO: 34068 - DNA, 22 bp, Artificial Sequence
  chemically synthesized
cacttccattgcttcctaggtc

SEQ ID NO: 34069 - DNA, 22 bp, Artificial Sequence
  chemically synthesized
acttccattgcttcctaggtca

SEQ ID NO: 34070 - DNA, 22 bp, Artificial Sequence
  chemically synthesized
ccattgcttcctaggtcataac

SEQ ID NO: 34071 - DNA, 22 bp, Artificial Sequence
  chemically synthesized
cattgcttcctaggtcataaca

SEQ ID NO: 34072 - DNA, 22 bp, Artificial Sequence
  chemically synthesized
cttcctaggtcataacattcac

SEQ ID NO: 34073 - DNA, 22 bp, Artificial Sequence
  chemically synthesized
cctaggtcataacattcacatc

SEQ ID NO: 34074 - DNA, 22 bp, Artificial Sequence
  chemically synthesized
ctaggtcataacattcacatct

SEQ ID NO: 34075 - DNA, 22 bp, Artificial Sequence
  chemically synthesized
ggtcataacattcacatctgat

SEQ ID NO: 34076 - DNA, 22 bp, Artificial Sequence
  chemically synthesized
acatctgatatttcttccaaat

SEQ ID NO: 34077 - DNA, 22 bp, Artificial Sequence
  chemically synthesized
atatttcttccaaatacagact

SEQ ID NO: 34078 - DNA, 22 bp, Artificial Sequence
  chemically synthesized
cttccaaatacagactgttgtt

SEQ ID NO: 34079 - DNA, 22 bp, Artificial Sequence
  chemically synthesized
ttccaaatacagactgttgttg

SEQ ID NO: 34080 - DNA, 22 bp, Artificial Sequence
  chemically synthesized
ccaaatacagactgttgttggc

SEQ ID NO: 34081 - DNA, 22 bp, Artificial Sequence
  chemically synthesized
caaatacagactgttgttggcc

SEQ ID NO: 34082 - DNA, 22 bp, Artificial Sequence
  chemically synthesized
ttgttggcctgatcatcactca

SEQ ID NO: 34083 - DNA, 22 bp, Artificial Sequence
  chemically synthesized
ttggcctgatcatcactcacac

SEQ ID NO: 34084 - DNA, 22 bp, Artificial Sequence
  chemically synthesized
gcctgatcatcactcacacatc

SEQ ID NO: 34085 - DNA, 22 bp, Artificial Sequence
  chemically synthesized
atcatcactcacacatccaggc

SEQ ID NO: 34086 - DNA, 22 bp, Artificial Sequence
  chemically synthesized
acacatccaggcttgttacatc

SEQ ID NO: 34087 - DNA, 22 bp, Artificial Sequence
  chemically synthesized
gttacatctccacgccactgag

SEQ ID NO: 34088 - DNA, 22 bp, Artificial Sequence
  chemically synthesized
ttacatctccacgccactgagt

SEQ ID NO: 34089 - DNA, 22 bp, Artificial Sequence
  chemically synthesized
catctccacgccactgagtatc

SEQ ID NO: 34090 - DNA, 22 bp, Artificial Sequence
  chemically synthesized
cacgccactgagtatcagggaa

SEQ ID NO: 34091 - DNA, 22 bp, Artificial Sequence
  chemically synthesized
agtatcagggaacctgccccaa

SEQ ID NO: 34092 - DNA, 22 bp, Artificial Sequence
  chemically synthesized
ccccaatattcacgtaggttct

SEQ ID NO: 34093 - DNA, 22 bp, Artificial Sequence
  chemically synthesized
acgtaggttcttttctattttc

SEQ ID NO: 34094 - DNA, 22 bp, Artificial Sequence
  chemically synthesized
ttttctattttccctaagcgtc

SEQ ID NO: 34095 - DNA, 22 bp, Artificial Sequence
  chemically synthesized
ttctattttccctaagcgtcgg

SEQ ID NO: 34096 - DNA, 22 bp, Artificial Sequence
  chemically synthesized
tctattttccctaagcgtcggc

SEQ ID NO: 34097 - DNA, 22 bp, Artificial Sequence
  chemically synthesized
ctattttccctaagcgtcggcc

SEQ ID NO: 34098 - DNA, 22 bp, Artificial Sequence
  chemically synthesized
tattttccctaagcgtcggcca

SEQ ID NO: 34099 - DNA, 22 bp, Artificial Sequence
  chemically synthesized
ttttccctaagcgtcggccaac

SEQ ID NO: 34100 - DNA, 22 bp, Artificial Sequence
  chemically synthesized
tccctaagcgtcggccaacttt

SEQ ID NO: 34101 - DNA, 22 bp, Artificial Sequence
  chemically synthesized
ccctaagcgtcggccaacttta

SEQ ID NO: 34102 - DNA, 22 bp, Artificial Sequence
  chemically synthesized
cctaagcgtcggccaactttag

SEQ ID NO: 34103 - DNA, 22 bp, Artificial Sequence
  chemically synthesized
agcgtcggccaactttagaaat

SEQ ID NO: 34104 - DNA, 22 bp, Artificial Sequence
  chemically synthesized
tagaaataaagggacagagtac

SEQ ID NO: 34105 - DNA, 22 bp, Artificial Sequence
  chemically synthesized
agaaataaagggacagagtaca

SEQ ID NO: 34106 - DNA, 22 bp, Artificial Sequence
  chemically synthesized
gaaataaagggacagagtacaa

SEQ ID NO: 34107 - DNA, 22 bp, Artificial Sequence
  chemically synthesized
taaagccgggcatccgggggag

SEQ ID NO: 34108 - DNA, 22 bp, Artificial Sequence
  chemically synthesized
aaagccgggcatccgggggagg

SEQ ID NO: 34109 - DNA, 22 bp, Artificial Sequence
  chemically synthesized
aagccgggcatccgggggaggc

SEQ ID NO: 34110 - DNA, 22 bp, Artificial Sequence
  chemically synthesized
cggtaggttccgtgatgcccca

SEQ ID NO: 34111 - DNA, 22 bp, Artificial Sequence
  chemically synthesized
ggtaggttccgtgatgccccac

SEQ ID NO: 34112 - DNA, 22 bp, Artificial Sequence
  chemically synthesized
cgtgatgccccacaagccacaa

SEQ ID NO: 34113 - DNA, 22 bp, Artificial Sequence
  chemically synthesized
gtattagggattttcaaatggg

SEQ ID NO: 34114 - DNA, 22 bp, Artificial Sequence
  chemically synthesized
tattagggattttcaaatgggg

SEQ ID NO: 34115 - DNA, 22 bp, Artificial Sequence
  chemically synthesized
gggattttcaaatggggaggca

SEQ ID NO: 34116 - DNA, 22 bp, Artificial Sequence
  chemically synthesized
tcaaatggggaggcagtgtgca

SEQ ID NO: 34117 - DNA, 22 bp, Artificial Sequence
  chemically synthesized
caaatggggaggcagtgtgcaa

SEQ ID NO: 34118 - DNA, 22 bp, Artificial Sequence
  chemically synthesized
aaatggggaggcagtgtgcaaa

SEQ ID NO: 34119 - DNA, 22 bp, Artificial Sequence
  chemically synthesized
tacaaggtaatagaatatcaca

SEQ ID NO: 34120 - DNA, 22 bp, Artificial Sequence
  chemically synthesized
acaaggtaatagaatatcacaa

SEQ ID NO: 34121 - DNA, 22 bp, Artificial Sequence
  chemically synthesized
caaggtaatagaatatcacaag

SEQ ID NO: 34122 - DNA, 22 bp, Artificial Sequence
  chemically synthesized
aaattgctaatgaagtttcggg

SEQ ID NO: 34123 - DNA, 22 bp, Artificial Sequence
  chemically synthesized
ctaatgaagtttcgggcaccat

SEQ ID NO: 34124 - DNA, 22 bp, Artificial Sequence
  chemically synthesized
atgaagtttcgggcaccattgt

SEQ ID NO: 34125 - DNA, 22 bp, Artificial Sequence
  chemically synthesized
cgggcaccattgtcattgataa

SEQ ID NO: 34126 - DNA, 22 bp, Artificial Sequence
  chemically synthesized
gggcaccattgtcattgataac

SEQ ID NO: 34127 - DNA, 22 bp, Artificial Sequence
  chemically synthesized
tcattgataacatcttatcagg

SEQ ID NO: 34128 - DNA, 22 bp, Artificial Sequence
  chemically synthesized
ataacatcttatcaggagacag

SEQ ID NO: 34129 - DNA, 22 bp, Artificial Sequence
  chemically synthesized
atcaggagacagggtttttagg

SEQ ID NO: 34130 - DNA, 22 bp, Artificial Sequence
  chemically synthesized
tcaggagacagggtttttagga

SEQ ID NO: 34131 - DNA, 22 bp, Artificial Sequence
  chemically synthesized
ttaggatcaactggtctgacca

SEQ ID NO: 34132 - DNA, 22 bp, Artificial Sequence
  chemically synthesized
taggatcaactggtctgaccaa

SEQ ID NO: 34133 - DNA, 22 bp, Artificial Sequence
  chemically synthesized
aggatcaactggtctgaccaaa

SEQ ID NO: 34134 - DNA, 22 bp, Artificial Sequence
  chemically synthesized
ggatcaactggtctgaccaaaa

SEQ ID NO: 34135 - DNA, 22 bp, Artificial Sequence
  chemically synthesized
gtctgaccaaaatttattaggc

SEQ ID NO: 34136 - DNA, 22 bp, Artificial Sequence
  chemically synthesized
accaaaatttattaggcgggaa

SEQ ID NO: 34137 - DNA, 22 bp, Artificial Sequence
  chemically synthesized
attaggcgggaatttcctcttc

SEQ ID NO: 34138 - DNA, 22 bp, Artificial Sequence
  chemically synthesized
ttaggcgggaatttcctcttcc

SEQ ID NO: 34139 - DNA, 22 bp, Artificial Sequence
  chemically synthesized
ggcgggaatttcctcttcctaa

SEQ ID NO: 34140 - DNA, 22 bp, Artificial Sequence
  chemically synthesized
cctcttcctaataagcctggga

SEQ ID NO: 34141 - DNA, 22 bp, Artificial Sequence
  chemically synthesized
ctcttcctaataagcctgggag

SEQ ID NO: 34142 - DNA, 22 bp, Artificial Sequence
  chemically synthesized
ttcctaataagcctgggagcgc

SEQ ID NO: 34143 - DNA, 22 bp, Artificial Sequence
  chemically synthesized
cctaataagcctgggagcgctg

SEQ ID NO: 34144 - DNA, 22 bp, Artificial Sequence
  chemically synthesized
ctaataagcctgggagcgctgt

SEQ ID NO: 34145 - DNA, 22 bp, Artificial Sequence
  chemically synthesized
ataagcctgggagcgctgtggg

SEQ ID NO: 34146 - DNA, 22 bp, Artificial Sequence
  chemically synthesized
ggagcgctgtgggagactgggg

SEQ ID NO: 34147 - DNA, 22 bp, Artificial Sequence
  chemically synthesized
tgggagactggggtctatttca

SEQ ID NO: 34148 - DNA, 22 bp, Artificial Sequence
  chemically synthesized
gggtctatttcacccctgcagt

SEQ ID NO: 34149 - DNA, 22 bp, Artificial Sequence
  chemically synthesized
tttcacccctgcagtctcgacc

SEQ ID NO: 34150 - DNA, 22 bp, Artificial Sequence
  chemically synthesized
cacccctgcagtctcgaccata

SEQ ID NO: 34151 - DNA, 22 bp, Artificial Sequence
  chemically synthesized
acccctgcagtctcgaccataa

SEQ ID NO: 34152 - DNA, 22 bp, Artificial Sequence
  chemically synthesized
cagtctcgaccataagagacag

SEQ ID NO: 34153 - DNA, 22 bp, Artificial Sequence
  chemically synthesized
gaccataagagacaggcgcacc

SEQ ID NO: 34154 - DNA, 22 bp, Artificial Sequence
  chemically synthesized
gaggggggctgtttataagcct

SEQ ID NO: 34155 - DNA, 22 bp, Artificial Sequence
  chemically synthesized
tttataagcctatacctcctgg

SEQ ID NO: 34156 - DNA, 22 bp, Artificial Sequence
  chemically synthesized
ataagcctatacctcctggctc

SEQ ID NO: 34157 - DNA, 22 bp, Artificial Sequence
  chemically synthesized
taagcctatacctcctggctcg

SEQ ID NO: 34158 - DNA, 22 bp, Artificial Sequence
  chemically synthesized
tacctcctggctcgtattctct

SEQ ID NO: 34159 - DNA, 22 bp, Artificial Sequence
  chemically synthesized
ctggctcgtattctctttctca

SEQ ID NO: 34160 - DNA, 22 bp, Artificial Sequence
  chemically synthesized
gctcgtattctctttctcaggg

SEQ ID NO: 34161 - DNA, 22 bp, Artificial Sequence
  chemically synthesized
gtattctctttctcagggatgt

SEQ ID NO: 34162 - DNA, 22 bp, Artificial Sequence
  chemically synthesized
tctttctcagggatgttccatg

SEQ ID NO: 34163 - DNA, 22 bp, Artificial Sequence
  chemically synthesized
tttctcagggatgttccatgct

SEQ ID NO: 34164 - DNA, 22 bp, Artificial Sequence
  chemically synthesized
tctcagggatgttccatgctga

SEQ ID NO: 34165 - DNA, 22 bp, Artificial Sequence
  chemically synthesized
ctcagggatgttccatgctgag

SEQ ID NO: 34166 - DNA, 22 bp, Artificial Sequence
  chemically synthesized
tcagggatgttccatgctgaga

SEQ ID NO: 34167 - DNA, 22 bp, Artificial Sequence
  chemically synthesized
agggatgttccatgctgagaaa

SEQ ID NO: 34168 - DNA, 22 bp, Artificial Sequence
  chemically synthesized
catgctgagaaaaagaattcag

SEQ ID NO: 34169 - DNA, 22 bp, Artificial Sequence
  chemically synthesized
agaaaaagaattcagcgatatt

SEQ ID NO: 34170 - DNA, 22 bp, Artificial Sequence
  chemically synthesized
agcgatatttctcccatttgct

SEQ ID NO: 34171 - DNA, 22 bp, Artificial Sequence
  chemically synthesized
ctcccatttgcttttgaaagaa

SEQ ID NO: 34172 - DNA, 22 bp, Artificial Sequence
  chemically synthesized
tcccatttgcttttgaaagaag

SEQ ID NO: 34173 - DNA, 22 bp, Artificial Sequence
  chemically synthesized
ccatttgcttttgaaagaagag

SEQ ID NO: 34174 - DNA, 22 bp, Artificial Sequence
  chemically synthesized
gcttttgaaagaagagaaatat

SEQ ID NO: 34175 - DNA, 22 bp, Artificial Sequence
  chemically synthesized
cttttgaaagaagagaaatatg

SEQ ID NO: 34176 - DNA, 22 bp, Artificial Sequence
  chemically synthesized
ttgaaagaagagaaatatggct

SEQ ID NO: 34177 - DNA, 22 bp, Artificial Sequence
  chemically synthesized
tgaaagaagagaaatatggctc

SEQ ID NO: 34178 - DNA, 22 bp, Artificial Sequence
  chemically synthesized
gaaagaagagaaatatggctct

SEQ ID NO: 34179 - DNA, 22 bp, Artificial Sequence
  chemically synthesized
aaagaagagaaatatggctctg

SEQ ID NO: 34180 - DNA, 22 bp, Artificial Sequence
  chemically synthesized
tgttctgcctggctcaccagca

SEQ ID NO: 34181 - DNA, 22 bp, Artificial Sequence
  chemically synthesized
ttctgcctggctcaccagcagt

SEQ ID NO: 34182 - DNA, 22 bp, Artificial Sequence
  chemically synthesized
tgcctggctcaccagcagtcag

SEQ ID NO: 34183 - DNA, 22 bp, Artificial Sequence
  chemically synthesized
cctggctcaccagcagtcagag

SEQ ID NO: 34184 - DNA, 22 bp, Artificial Sequence
  chemically synthesized
gctcaccagcagtcagagttta

SEQ ID NO: 34185 - DNA, 22 bp, Artificial Sequence
  chemically synthesized
accagcagtcagagtttaaggt

SEQ ID NO: 34186 - DNA, 22 bp, Artificial Sequence
  chemically synthesized
aaggttatctctcttattccct

SEQ ID NO: 34187 - DNA, 22 bp, Artificial Sequence
  chemically synthesized
aggttatctctcttattccctg

SEQ ID NO: 34188 - DNA, 22 bp, Artificial Sequence
  chemically synthesized
tctctcttattccctgaacaat

SEQ ID NO: 34189 - DNA, 22 bp, Artificial Sequence
  chemically synthesized
tcttattccctgaacaattgct

SEQ ID NO: 34190 - DNA, 22 bp, Artificial Sequence
  chemically synthesized
ttattccctgaacaattgctgt

SEQ ID NO: 34191 - DNA, 22 bp, Artificial Sequence
  chemically synthesized
attccctgaacaattgctgtta

SEQ ID NO: 34192 - DNA, 22 bp, Artificial Sequence
  chemically synthesized
ttccctgaacaattgctgttat

SEQ ID NO: 34193 - DNA, 22 bp, Artificial Sequence
  chemically synthesized
cctgaacaattgctgttatcct

SEQ ID NO: 34194 - DNA, 22 bp, Artificial Sequence
  chemically synthesized
aacaattgctgttatcctgttc

SEQ ID NO: 34195 - DNA, 22 bp, Artificial Sequence
  chemically synthesized
ctgttatcctgttcttttttca

SEQ ID NO: 34196 - DNA, 22 bp, Artificial Sequence
  chemically synthesized
ttatcctgttcttttttcaagg

SEQ ID NO: 34197 - DNA, 22 bp, Artificial Sequence
  chemically synthesized
tcctgttcttttttcaaggtgt

SEQ ID NO: 34198 - DNA, 22 bp, Artificial Sequence
  chemically synthesized
ttcttttttcaaggtgtccaca

SEQ ID NO: 34199 - DNA, 22 bp, Artificial Sequence
  chemically synthesized
ttttttcaaggtgtccacattt

SEQ ID NO: 34200 - DNA, 22 bp, Artificial Sequence
  chemically synthesized
ttttcaaggtgtccacatttca

SEQ ID NO: 34201 - DNA, 22 bp, Artificial Sequence
  chemically synthesized
tttcaaggtgtccacatttcat

SEQ ID NO: 34202 - DNA, 22 bp, Artificial Sequence
  chemically synthesized
ttcaaggtgtccacatttcatg

SEQ ID NO: 34203 - DNA, 22 bp, Artificial Sequence
  chemically synthesized
tcaaggtgtccacatttcatgt

SEQ ID NO: 34204 - DNA, 22 bp, Artificial Sequence
  chemically synthesized
caaggtgtccacatttcatgtt

SEQ ID NO: 34205 - DNA, 22 bp, Artificial Sequence
  chemically synthesized
aaggtgtccacatttcatgttg

SEQ ID NO: 34206 - DNA, 22 bp, Artificial Sequence
  chemically synthesized
catgttgctcaaacacacatgc

SEQ ID NO: 34207 - DNA, 22 bp, Artificial Sequence
  chemically synthesized
atgttgctcaaacacacatgct

SEQ ID NO: 34208 - DNA, 22 bp, Artificial Sequence
  chemically synthesized
ctcaaacacacatgctgtacaa

SEQ ID NO: 34209 - DNA, 22 bp, Artificial Sequence
  chemically synthesized
aaacacacatgctgtacaattt

SEQ ID NO: 34210 - DNA, 22 bp, Artificial Sequence
  chemically synthesized
tacaatttgtgcagttaatgca

SEQ ID NO: 34211 - DNA, 22 bp, Artificial Sequence
  chemically synthesized
gtgcagttaatgcaattattac

SEQ ID NO: 34212 - DNA, 22 bp, Artificial Sequence
  chemically synthesized
tgcagttaatgcaattattaca

SEQ ID NO: 34213 - DNA, 22 bp, Artificial Sequence
  chemically synthesized
atgcaattattacagggtcctg

SEQ ID NO: 34214 - DNA, 22 bp, Artificial Sequence
  chemically synthesized
ttacagggtcctgaggcaatat

SEQ ID NO: 34215 - DNA, 22 bp, Artificial Sequence
  chemically synthesized
cagggtcctgaggcaatataca

SEQ ID NO: 34216 - DNA, 22 bp, Artificial Sequence
  chemically synthesized
aggcaatatacatcctcctcag

SEQ ID NO: 34217 - DNA, 22 bp, Artificial Sequence
  chemically synthesized
ctcagctgacaggattaagaga

SEQ ID NO: 34218 - DNA, 22 bp, Artificial Sequence
  chemically synthesized
agctgacaggattaagagatta

SEQ ID NO: 34219 - DNA, 22 bp, Artificial Sequence
  chemically synthesized
acaggattaagagattaaagta

SEQ ID NO: 34220 - DNA, 22 bp, Artificial Sequence
  chemically synthesized
agagattaaagtaaagacaggc

SEQ ID NO: 34221 - DNA, 22 bp, Artificial Sequence
  chemically synthesized
aagtaaagacaggcataaatca

SEQ ID NO: 34222 - DNA, 22 bp, Artificial Sequence
  chemically synthesized
actggggaagtgataagtgtcc

SEQ ID NO: 34223 - DNA, 22 bp, Artificial Sequence
  chemically synthesized
gggaagtgataagtgtccatga

SEQ ID NO: 34224 - DNA, 22 bp, Artificial Sequence
  chemically synthesized
tacaatttatgtttagagattg

SEQ ID NO: 34225 - DNA, 22 bp, Artificial Sequence
  chemically synthesized
acaatttatgtttagagattgc

SEQ ID NO: 34226 - DNA, 22 bp, Artificial Sequence
  chemically synthesized
caatttatgtttagagattgca

SEQ ID NO: 34227 - DNA, 22 bp, Artificial Sequence
  chemically synthesized
atgtttagagattgcagtaaag

SEQ ID NO: 34228 - DNA, 22 bp, Artificial Sequence
  chemically synthesized
tgtttagagattgcagtaaaga

SEQ ID NO: 34229 - DNA, 22 bp, Artificial Sequence
  chemically synthesized
agagattgcagtaaagacaggc

SEQ ID NO: 34230 - DNA, 22 bp, Artificial Sequence
  chemically synthesized
gagattgcagtaaagacaggca

SEQ ID NO: 34231 - DNA, 22 bp, Artificial Sequence
  chemically synthesized
cagtaaagacaggcataagaaa

SEQ ID NO: 34232 - DNA, 22 bp, Artificial Sequence
  chemically synthesized
caaaagtattaatttggggaac

SEQ ID NO: 34233 - DNA, 22 bp, Artificial Sequence
  chemically synthesized
atttggggaactaataaatgtc

SEQ ID NO: 34234 - DNA, 22 bp, Artificial Sequence
  chemically synthesized
ggggaactaataaatgtccatg

SEQ ID NO: 34235 - DNA, 22 bp, Artificial Sequence
  chemically synthesized
gggaactaataaatgtccatga

SEQ ID NO: 34236 - DNA, 22 bp, Artificial Sequence
  chemically synthesized
ataaatgtccatgaaatcttca

SEQ ID NO: 34237 - DNA, 22 bp, Artificial Sequence
  chemically synthesized
cacaatccacgaacttctgcca

SEQ ID NO: 34238 - DNA, 22 bp, Artificial Sequence
  chemically synthesized
acaatccacgaacttctgccat

SEQ ID NO: 34239 - DNA, 22 bp, Artificial Sequence
  chemically synthesized
ctgccatggcttcagctgatcc

SEQ ID NO: 34240 - DNA, 22 bp, Artificial Sequence
  chemically synthesized
tgccatggcttcagctgatccc

SEQ ID NO: 34241 - DNA, 22 bp, Artificial Sequence
  chemically synthesized
ccatggcttcagctgatccctc

SEQ ID NO: 34242 - DNA, 22 bp, Artificial Sequence
  chemically synthesized
cagctgatccctccgtttggag

SEQ ID NO: 34243 - DNA, 22 bp, Artificial Sequence
  chemically synthesized
agctgatccctccgtttggagt

SEQ ID NO: 34244 - DNA, 22 bp, Artificial Sequence
  chemically synthesized
atccctccgtttggagtcccag

SEQ ID NO: 34245 - DNA, 22 bp, Artificial Sequence
  chemically synthesized
cgtttggagtcccagacttccc

SEQ ID NO: 34246 - DNA, 22 bp, Artificial Sequence
  chemically synthesized
ggagtcccagacttcccgcaac

SEQ ID NO: 34247 - DNA, 22 bp, Artificial Sequence
  chemically synthesized
gagtcccagacttcccgcaaca

SEQ ID NO: 34248 - DNA, 22 bp, Artificial Sequence
  chemically synthesized
cccgcaacaactgagaactctg

SEQ ID NO: 34249 - DNA, 22 bp, Artificial Sequence
  chemically synthesized
ccgcaacaactgagaactctgg

SEQ ID NO: 34250 - DNA, 22 bp, Artificial Sequence
  chemically synthesized
agaactctggagggcctaccct

SEQ ID NO: 34251 - DNA, 22 bp, Artificial Sequence
  chemically synthesized
tggagggcctacccttcaccca

SEQ ID NO: 34252 - DNA, 22 bp, Artificial Sequence
  chemically synthesized
gagggcctacccttcacccact

SEQ ID NO: 34253 - DNA, 22 bp, Artificial Sequence
  chemically synthesized
cccttcacccacttccaccctt

SEQ ID NO: 34254 - DNA, 22 bp, Artificial Sequence
  chemically synthesized
cacccacttccacccttcttat

SEQ ID NO: 34255 - DNA, 22 bp, Artificial Sequence
  chemically synthesized
acccacttccacccttcttata

SEQ ID NO: 34256 - DNA, 22 bp, Artificial Sequence
  chemically synthesized
ccacccttcttatatctcttaa

SEQ ID NO: 34257 - DNA, 22 bp, Artificial Sequence
  chemically synthesized
cacccttcttatatctcttaag

SEQ ID NO: 34258 - DNA, 22 bp, Artificial Sequence
  chemically synthesized
cttatatctcttaaggagctgt

SEQ ID NO: 34259 - DNA, 22 bp, Artificial Sequence
  chemically synthesized
ttatatctcttaaggagctgtg

SEQ ID NO: 34260 - DNA, 22 bp, Artificial Sequence
  chemically synthesized
atatctcttaaggagctgtgtt

SEQ ID NO: 34261 - DNA, 22 bp, Artificial Sequence
  chemically synthesized
tatctcttaaggagctgtgttc

SEQ ID NO: 34262 - DNA, 22 bp, Artificial Sequence
  chemically synthesized
ttaaggagctgtgttcagatgg

SEQ ID NO: 34263 - DNA, 22 bp, Artificial Sequence
  chemically synthesized
aaggagctgtgttcagatggtt

SEQ ID NO: 34264 - DNA, 22 bp, Artificial Sequence
  chemically synthesized
aggagctgtgttcagatggtta

SEQ ID NO: 34265 - DNA, 22 bp, Artificial Sequence
  chemically synthesized
tgttcagatggttacatttcgc

SEQ ID NO: 34266 - DNA, 22 bp, Artificial Sequence
  chemically synthesized
agatggttacatttcgcttgct

SEQ ID NO: 34267 - DNA, 22 bp, Artificial Sequence
  chemically synthesized
catttcgcttgctgagcaagac

SEQ ID NO: 34268 - DNA, 22 bp, Artificial Sequence
  chemically synthesized
cgcttgctgagcaagactgcat

SEQ ID NO: 34269 - DNA, 22 bp, Artificial Sequence
  chemically synthesized
gcttgctgagcaagactgcatt

SEQ ID NO: 34270 - DNA, 22 bp, Artificial Sequence
  chemically synthesized
gctgagcaagactgcattttca

SEQ ID NO: 34271 - DNA, 22 bp, Artificial Sequence
  chemically synthesized
ctgagcaagactgcattttcat

SEQ ID NO: 34272 - DNA, 22 bp, Artificial Sequence
  chemically synthesized
agcaagactgcattttcattat

SEQ ID NO: 34273 - DNA, 22 bp, Artificial Sequence
  chemically synthesized
cattttcattatcctgggctaa

SEQ ID NO: 34274 - DNA, 22 bp, Artificial Sequence
  chemically synthesized
tcattatcctgggctaaaatca

SEQ ID NO: 34275 - DNA, 22 bp, Artificial Sequence
  chemically synthesized
cattatcctgggctaaaatcaa

SEQ ID NO: 34276 - DNA, 22 bp, Artificial Sequence
  chemically synthesized
attatcctgggctaaaatcaat

SEQ ID NO: 34277 - DNA, 22 bp, Artificial Sequence
  chemically synthesized
tcctgggctaaaatcaattggt

SEQ ID NO: 34278 - DNA, 22 bp, Artificial Sequence
  chemically synthesized
ggctaaaatcaattggtattta

SEQ ID NO: 34279 - DNA, 22 bp, Artificial Sequence
  chemically synthesized
aaatcaattggtatttaagtta

SEQ ID NO: 34280 - DNA, 22 bp, Artificial Sequence
  chemically synthesized
gtatttaagttagagcaaaaag

SEQ ID NO: 34281 - DNA, 22 bp, Artificial Sequence
  chemically synthesized
aagttagagcaaaaagggttct

SEQ ID NO: 34282 - DNA, 22 bp, Artificial Sequence
  chemically synthesized
agttagagcaaaaagggttcta

SEQ ID NO: 34283 - DNA, 22 bp, Artificial Sequence
  chemically synthesized
gagcaaaaagggttctaaccct

SEQ ID NO: 34284 - DNA, 22 bp, Artificial Sequence
  chemically synthesized
taaccctatttacagcagcaca

SEQ ID NO: 34285 - DNA, 22 bp, Artificial Sequence
  chemically synthesized
accctatttacagcagcacaca

SEQ ID NO: 34286 - DNA, 22 bp, Artificial Sequence
  chemically synthesized
tttacagcagcacacatacact

SEQ ID NO: 34287 - DNA, 22 bp, Artificial Sequence
  chemically synthesized
acagcagcacacatacacttac

SEQ ID NO: 34288 - DNA, 22 bp, Artificial Sequence
  chemically synthesized
cagcagcacacatacacttaca

SEQ ID NO: 34289 - DNA, 22 bp, Artificial Sequence
  chemically synthesized
acattagaattggctttaaggg

SEQ ID NO: 34290 - DNA, 22 bp, Artificial Sequence
  chemically synthesized
cattagaattggctttaaggga

SEQ ID NO: 34291 - DNA, 22 bp, Artificial Sequence
  chemically synthesized
gaattggctttaagggaaaaat

SEQ ID NO: 34292 - DNA, 22 bp, Artificial Sequence
  chemically synthesized
gctttaagggaaaaattcaatc

SEQ ID NO: 34293 - DNA, 22 bp, Artificial Sequence
  chemically synthesized
taagggaaaaattcaatcaatc

SEQ ID NO: 34294 - DNA, 22 bp, Artificial Sequence
  chemically synthesized
aagggaaaaattcaatcaatcg

SEQ ID NO: 34295 - DNA, 22 bp, Artificial Sequence
  chemically synthesized
agggaaaaattcaatcaatcga

SEQ ID NO: 34296 - DNA, 22 bp, Artificial Sequence
  chemically synthesized
aatcaatcgacaaatttccact

SEQ ID NO: 34297 - DNA, 22 bp, Artificial Sequence
  chemically synthesized
ccactgattaccttctatgagc

SEQ ID NO: 34298 - DNA, 22 bp, Artificial Sequence
  chemically synthesized
cactgattaccttctatgagcc

SEQ ID NO: 34299 - DNA, 22 bp, Artificial Sequence
  chemically synthesized
attaccttctatgagccaagac

SEQ ID NO: 34300 - DNA, 22 bp, Artificial Sequence
  chemically synthesized
ccttctatgagccaagactgcc

SEQ ID NO: 34301 - DNA, 22 bp, Artificial Sequence
  chemically synthesized
ctatgagccaagactgccatag

SEQ ID NO: 34302 - DNA, 22 bp, Artificial Sequence
  chemically synthesized
tatgagccaagactgccatagt

SEQ ID NO: 34303 - DNA, 22 bp, Artificial Sequence
  chemically synthesized
tgagccaagactgccatagtct

SEQ ID NO: 34304 - DNA, 22 bp, Artificial Sequence
  chemically synthesized
ccatagtctcagccttcatgca

SEQ ID NO: 34305 - DNA, 22 bp, Artificial Sequence
  chemically synthesized
agccttcatgcagcttataggc

SEQ ID NO: 34306 - DNA, 22 bp, Artificial Sequence
  chemically synthesized
catgcagcttataggctagcaa

SEQ ID NO: 34307 - DNA, 22 bp, Artificial Sequence
  chemically synthesized
atgcagcttataggctagcaaa

SEQ ID NO: 34308 - DNA, 22 bp, Artificial Sequence
  chemically synthesized
ataggctagcaaaaaagccaga

SEQ ID NO: 34309 - DNA, 22 bp, Artificial Sequence
  chemically synthesized
taggctagcaaaaaagccagac

SEQ ID NO: 34310 - DNA, 22 bp, Artificial Sequence
  chemically synthesized
gcaaaaaagccagacagtgcac

SEQ ID NO: 34311 - DNA, 22 bp, Artificial Sequence
  chemically synthesized
acaagtgtgttgagtgttgcaa

SEQ ID NO: 34312 - DNA, 22 bp, Artificial Sequence
  chemically synthesized
agtgttgcaagagtaagtttca

SEQ ID NO: 34313 - DNA, 22 bp, Artificial Sequence
  chemically synthesized
caagagtaagtttcaggggctc

SEQ ID NO: 34314 - DNA, 22 bp, Artificial Sequence
  chemically synthesized
caggggctctccatgacttacc

SEQ ID NO: 34315 - DNA, 22 bp, Artificial Sequence
  chemically synthesized
aggggctctccatgacttacct

SEQ ID NO: 34316 - DNA, 22 bp, Artificial Sequence
  chemically synthesized
tccatgacttacctggttgaga

SEQ ID NO: 34317 - DNA, 22 bp, Artificial Sequence
  chemically synthesized
catgacttacctggttgagaaa

SEQ ID NO: 34318 - DNA, 22 bp, Artificial Sequence
  chemically synthesized
acctggttgagaaaccctttaa

SEQ ID NO: 34319 - DNA, 22 bp, Artificial Sequence
  chemically synthesized
cctggttgagaaaccctttaac

SEQ ID NO: 34320 - DNA, 22 bp, Artificial Sequence
  chemically synthesized
gttgagaaaccctttaactttt

SEQ ID NO: 34321 - DNA, 22 bp, Artificial Sequence
  chemically synthesized
agaaaccctttaactttttttt

SEQ ID NO: 34322 - DNA, 22 bp, Artificial Sequence
  chemically synthesized
taactttttttttcctctgggt

SEQ ID NO: 34323 - DNA, 22 bp, Artificial Sequence
  chemically synthesized
aactttttttttcctctgggtg

SEQ ID NO: 34324 - DNA, 22 bp, Artificial Sequence
  chemically synthesized
actttttttttcctctgggtgt

SEQ ID NO: 34325 - DNA, 22 bp, Artificial Sequence
  chemically synthesized
tttttttcctctgggtgtaaag

SEQ ID NO: 34326 - DNA, 22 bp, Artificial Sequence
  chemically synthesized
ttttttcctctgggtgtaaagt

SEQ ID NO: 34327 - DNA, 22 bp, Artificial Sequence
  chemically synthesized
tttttcctctgggtgtaaagtg

SEQ ID NO: 34328 - DNA, 22 bp, Artificial Sequence
  chemically synthesized
ttttcctctgggtgtaaagtga

SEQ ID NO: 34329 - DNA, 22 bp, Artificial Sequence
  chemically synthesized
tttcctctgggtgtaaagtgaa

SEQ ID NO: 34330 - DNA, 22 bp, Artificial Sequence
  chemically synthesized
ttcctctgggtgtaaagtgaag

SEQ ID NO: 34331 - DNA, 22 bp, Artificial Sequence
  chemically synthesized
tcctctgggtgtaaagtgaaga

SEQ ID NO: 34332 - DNA, 22 bp, Artificial Sequence
  chemically synthesized
cctctgggtgtaaagtgaagag

SEQ ID NO: 34333 - DNA, 22 bp, Artificial Sequence
  chemically synthesized
ctctgggtgtaaagtgaagaga

SEQ ID NO: 34334 - DNA, 22 bp, Artificial Sequence
  chemically synthesized
tgggtgtaaagtgaagagatgg

SEQ ID NO: 34335 - DNA, 22 bp, Artificial Sequence
  chemically synthesized
ggtgtaaagtgaagagatggca

SEQ ID NO: 34336 - DNA, 22 bp, Artificial Sequence
  chemically synthesized
cattgtgtcattgtgaaaagat

SEQ ID NO: 34337 - DNA, 22 bp, Artificial Sequence
  chemically synthesized
tgtcattgtgaaaagatgctgg

SEQ ID NO: 34338 - DNA, 22 bp, Artificial Sequence
  chemically synthesized
tgaaaagatgctgggctggcgt

SEQ ID NO: 34339 - DNA, 22 bp, Artificial Sequence
  chemically synthesized
ggctggcgtgtctcctgaaggc

SEQ ID NO: 34340 - DNA, 22 bp, Artificial Sequence
  chemically synthesized
gcgtgtctcctgaaggccaccc

SEQ ID NO: 34341 - DNA, 22 bp, Artificial Sequence
  chemically synthesized
ctgaaggccacccatatcttta

SEQ ID NO: 34342 - DNA, 22 bp, Artificial Sequence
  chemically synthesized
aaggccacccatatctttaaac

SEQ ID NO: 34343 - DNA, 22 bp, Artificial Sequence
  chemically synthesized
taaactttattttcatgcattc

SEQ ID NO: 34344 - DNA, 22 bp, Artificial Sequence
  chemically synthesized
aaactttattttcatgcattcg

SEQ ID NO: 34345 - DNA, 22 bp, Artificial Sequence
  chemically synthesized
aactttattttcatgcattcgc

SEQ ID NO: 34346 - DNA, 22 bp, Artificial Sequence
  chemically synthesized
tattttcatgcattcgcacaaa

SEQ ID NO: 34347 - DNA, 22 bp, Artificial Sequence
  chemically synthesized
attttcatgcattcgcacaaat

SEQ ID NO: 34348 - DNA, 22 bp, Artificial Sequence
  chemically synthesized
ttttcatgcattcgcacaaata

SEQ ID NO: 34349 - DNA, 22 bp, Artificial Sequence
  chemically synthesized
tcatgcattcgcacaaatatag

SEQ ID NO: 34350 - DNA, 22 bp, Artificial Sequence
  chemically synthesized
catgcattcgcacaaatataga

SEQ ID NO: 34351 - DNA, 22 bp, Artificial Sequence
  chemically synthesized
atgcattcgcacaaatatagat

SEQ ID NO: 34352 - DNA, 22 bp, Artificial Sequence
  chemically synthesized
gcacaaatatagatgtgttcca

SEQ ID NO: 34353 - DNA, 22 bp, Artificial Sequence
  chemically synthesized
catagatgaggcagatagcaga

SEQ ID NO: 34354 - DNA, 22 bp, Artificial Sequence
  chemically synthesized
ctgcctacagcaaggctagttt

SEQ ID NO: 34355 - DNA, 22 bp, Artificial Sequence
  chemically synthesized
tgcctacagcaaggctagtttg

SEQ ID NO: 34356 - DNA, 22 bp, Artificial Sequence
  chemically synthesized
cctacagcaaggctagtttgga

SEQ ID NO: 34357 - DNA, 22 bp, Artificial Sequence
  chemically synthesized
cagcaaggctagtttggagagg

SEQ ID NO: 34358 - DNA, 22 bp, Artificial Sequence
  chemically synthesized
gtttggagagggttttgctgtc

SEQ ID NO: 34359 - DNA, 22 bp, Artificial Sequence
  chemically synthesized
ggagagggttttgctgtcaggg

SEQ ID NO: 34360 - DNA, 22 bp, Artificial Sequence
  chemically synthesized
gagagggttttgctgtcagggt

SEQ ID NO: 34361 - DNA, 22 bp, Artificial Sequence
  chemically synthesized
tgctgtcagggttggacccaca

SEQ ID NO: 34362 - DNA, 22 bp, Artificial Sequence
  chemically synthesized
gctgtcagggttggacccacac

SEQ ID NO: 34363 - DNA, 22 bp, Artificial Sequence
  chemically synthesized
ctgtcagggttggacccacaca

SEQ ID NO: 34364 - DNA, 22 bp, Artificial Sequence
  chemically synthesized
tcagggttggacccacacacct

SEQ ID NO: 34365 - DNA, 22 bp, Artificial Sequence
  chemically synthesized
gacccacacacctcttcataga

SEQ ID NO: 34366 - DNA, 22 bp, Artificial Sequence
  chemically synthesized
ttcatagatgctttttcttttt

SEQ ID NO: 34367 - DNA, 22 bp, Artificial Sequence
  chemically synthesized
catagatgctttttcttttttt

SEQ ID NO: 34368 - DNA, 22 bp, Artificial Sequence
  chemically synthesized
atagatgctttttctttttttt

SEQ ID NO: 34369 - DNA, 22 bp, Artificial Sequence
  chemically synthesized
tttcttttttttcccagagttt

SEQ ID NO: 34370 - DNA, 22 bp, Artificial Sequence
  chemically synthesized
ttcttttttttcccagagtttg

SEQ ID NO: 34371 - DNA, 22 bp, Artificial Sequence
  chemically synthesized
tcttttttttcccagagtttga

SEQ ID NO: 34372 - DNA, 22 bp, Artificial Sequence
  chemically synthesized
cttttttttcccagagtttgaa

SEQ ID NO: 34373 - DNA, 22 bp, Artificial Sequence
  chemically synthesized
ttttttttcccagagtttgaaa

SEQ ID NO: 34374 - DNA, 22 bp, Artificial Sequence
  chemically synthesized
ttttttcccagagtttgaaagg

SEQ ID NO: 34375 - DNA, 22 bp, Artificial Sequence
  chemically synthesized
tttttcccagagtttgaaaggg

SEQ ID NO: 34376 - DNA, 22 bp, Artificial Sequence
  chemically synthesized
ttttcccagagtttgaaaggga

SEQ ID NO: 34377 - DNA, 22 bp, Artificial Sequence
  chemically synthesized
tttcccagagtttgaaagggaa

SEQ ID NO: 34378 - DNA, 22 bp, Artificial Sequence
  chemically synthesized
ttcccagagtttgaaagggaaa

SEQ ID NO: 34379 - DNA, 22 bp, Artificial Sequence
  chemically synthesized
tcccagagtttgaaagggaaat

SEQ ID NO: 34380 - DNA, 22 bp, Artificial Sequence
  chemically synthesized
cccagagtttgaaagggaaatg

SEQ ID NO: 34381 - DNA, 22 bp, Artificial Sequence
  chemically synthesized
ccagagtttgaaagggaaatgg

SEQ ID NO: 34382 - DNA, 22 bp, Artificial Sequence
  chemically synthesized
gaaagggaaatggagtctcaag

SEQ ID NO: 34383 - DNA, 22 bp, Artificial Sequence
  chemically synthesized
aaagggaaatggagtctcaagt

SEQ ID NO: 34384 - DNA, 22 bp, Artificial Sequence
  chemically synthesized
aagttcagggaggttacagtgt

SEQ ID NO: 34385 - DNA, 22 bp, Artificial Sequence
  chemically synthesized
agggaggttacagtgtagaccc

SEQ ID NO: 34386 - DNA, 22 bp, Artificial Sequence
  chemically synthesized
cagtgtagacccacaaatcagc

SEQ ID NO: 34387 - DNA, 22 bp, Artificial Sequence
  chemically synthesized
agtacagctaagggtggagaag

SEQ ID NO: 34388 - DNA, 22 bp, Artificial Sequence
  chemically synthesized
agggtggagaagtctatgcaat

SEQ ID NO: 34389 - DNA, 22 bp, Artificial Sequence
  chemically synthesized
tgcaatatccagcactcttctg

SEQ ID NO: 34390 - DNA, 22 bp, Artificial Sequence
  chemically synthesized
ttctgattaattagaagtcttt

SEQ ID NO: 34391 - DNA, 22 bp, Artificial Sequence
  chemically synthesized
ctgattaattagaagtctttaa

SEQ ID NO: 34392 - DNA, 22 bp, Artificial Sequence
  chemically synthesized
tgattaattagaagtctttaaa

SEQ ID NO: 34393 - DNA, 22 bp, Artificial Sequence
  chemically synthesized
attaattagaagtctttaaaat

SEQ ID NO: 34394 - DNA, 22 bp, Artificial Sequence
  chemically synthesized
attagaagtctttaaaattcac

SEQ ID NO: 34395 - DNA, 22 bp, Artificial Sequence
  chemically synthesized
gaagtctttaaaattcacagaa

SEQ ID NO: 34396 - DNA, 22 bp, Artificial Sequence
  chemically synthesized
taaaattcacagaaaccatatt

SEQ ID NO: 34397 - DNA, 22 bp, Artificial Sequence
  chemically synthesized
aaaattcacagaaaccatattg

SEQ ID NO: 34398 - DNA, 22 bp, Artificial Sequence
  chemically synthesized
aaattcacagaaaccatattgt

SEQ ID NO: 34399 - DNA, 22 bp, Artificial Sequence
  chemically synthesized
acagaaaccatattgtcttccc

SEQ ID NO: 34400 - DNA, 22 bp, Artificial Sequence
  chemically synthesized
tcttccctaaatgattcatatg

SEQ ID NO: 34401 - DNA, 22 bp, Artificial Sequence
  chemically synthesized
ccctaaatgattcatatgtcaa

SEQ ID NO: 34402 - DNA, 22 bp, Artificial Sequence
  chemically synthesized
cctaaatgattcatatgtcaag

SEQ ID NO: 34403 - DNA, 22 bp, Artificial Sequence
  chemically synthesized
aatgattcatatgtcaagacac

SEQ ID NO: 34404 - DNA, 22 bp, Artificial Sequence
  chemically synthesized
atatgtcaagacacagtaaaga

SEQ ID NO: 34405 - DNA, 22 bp, Artificial Sequence
  chemically synthesized
tatgtggaacatcatacacaaa

SEQ ID NO: 34406 - DNA, 22 bp, Artificial Sequence
  chemically synthesized
ttaccttagtaaactgccaatt

SEQ ID NO: 34407 - DNA, 22 bp, Artificial Sequence
  chemically synthesized
accttagtaaactgccaatttt

SEQ ID NO: 34408 - DNA, 22 bp, Artificial Sequence
  chemically synthesized
ccttagtaaactgccaattttc

SEQ ID NO: 34409 - DNA, 22 bp, Artificial Sequence
  chemically synthesized
agtaaactgccaattttctgaa

SEQ ID NO: 34410 - DNA, 22 bp, Artificial Sequence
  chemically synthesized
gtaaactgccaattttctgaaa

SEQ ID NO: 34411 - DNA, 22 bp, Artificial Sequence
  chemically synthesized
ccaattttctgaaatgctcttt

SEQ ID NO: 34412 - DNA, 22 bp, Artificial Sequence
  chemically synthesized
tctgaaatgctctttaaatcct

SEQ ID NO: 34413 - DNA, 22 bp, Artificial Sequence
  chemically synthesized
ctgaaatgctctttaaatcctg

SEQ ID NO: 34414 - DNA, 22 bp, Artificial Sequence
  chemically synthesized
tgaaatgctctttaaatcctgc

SEQ ID NO: 34415 - DNA, 22 bp, Artificial Sequence
  chemically synthesized
aaatgctctttaaatcctgcta

SEQ ID NO: 34416 - DNA, 22 bp, Artificial Sequence
  chemically synthesized
tttaaatcctgctaatggtggc

SEQ ID NO: 34417 - DNA, 22 bp, Artificial Sequence
  chemically synthesized
taaatcctgctaatggtggcat

SEQ ID NO: 34418 - DNA, 22 bp, Artificial Sequence
  chemically synthesized
aaatcctgctaatggtggcatt

SEQ ID NO: 34419 - DNA, 22 bp, Artificial Sequence
  chemically synthesized
aatcctgctaatggtggcattt

SEQ ID NO: 34420 - DNA, 22 bp, Artificial Sequence
  chemically synthesized
ctaatggtggcatttgtgtctt

SEQ ID NO: 34421 - DNA, 22 bp, Artificial Sequence
  chemically synthesized
atggtggcatttgtgtctttgt

SEQ ID NO: 34422 - DNA, 22 bp, Artificial Sequence
  chemically synthesized
gtgtctttgtcacctacagtac

SEQ ID NO: 34423 - DNA, 22 bp, Artificial Sequence
  chemically synthesized
tgtctttgtcacctacagtaca

SEQ ID NO: 34424 - DNA, 22 bp, Artificial Sequence
  chemically synthesized
tgtcacctacagtacatttctg

SEQ ID NO: 34425 - DNA, 22 bp, Artificial Sequence
  chemically synthesized
gtcacctacagtacatttctgg

SEQ ID NO: 34426 - DNA, 22 bp, Artificial Sequence
  chemically synthesized
tcacctacagtacatttctgga

SEQ ID NO: 34427 - DNA, 22 bp, Artificial Sequence
  chemically synthesized
cagtacatttctggatttggga

SEQ ID NO: 34428 - DNA, 22 bp, Artificial Sequence
  chemically synthesized
ctggatttgggaatgagtgttc

SEQ ID NO: 34429 - DNA, 22 bp, Artificial Sequence
  chemically synthesized
tggatttgggaatgagtgttct

SEQ ID NO: 34430 - DNA, 22 bp, Artificial Sequence
  chemically synthesized
gatttgggaatgagtgttcttc

SEQ ID NO: 34431 - DNA, 22 bp, Artificial Sequence
  chemically synthesized
gggaatgagtgttcttcagagg

SEQ ID NO: 34432 - DNA, 22 bp, Artificial Sequence
  chemically synthesized
ggaatgagtgttcttcagagga

SEQ ID NO: 34433 - DNA, 22 bp, Artificial Sequence
  chemically synthesized
ttcagaggatcctcgctgccca

SEQ ID NO: 34434 - DNA, 22 bp, Artificial Sequence
  chemically synthesized
cagaggatcctcgctgcccagg

SEQ ID NO: 34435 - DNA, 22 bp, Artificial Sequence
  chemically synthesized
agaggatcctcgctgcccaggt

SEQ ID NO: 34436 - DNA, 22 bp, Artificial Sequence
  chemically synthesized
gctgcccaggttccctgccaga

SEQ ID NO: 34437 - DNA, 22 bp, Artificial Sequence
  chemically synthesized
cccaggttccctgccagaagga

SEQ ID NO: 34438 - DNA, 20 bp, Artificial Sequence
  chemically synthesized
ctccttttgccacaccctca

SEQ ID NO: 34439 - DNA, 20 bp, Artificial Sequence
  chemically synthesized
acaccctcacagacataacc

SEQ ID NO: 34440 - DNA, 20 bp, Artificial Sequence
  chemically synthesized
ttgcatctttcaatccaatc

SEQ ID NO: 34441 - DNA, 20 bp, Artificial Sequence
  chemically synthesized
tttcaatccaatcaagttga

SEQ ID NO: 34442 - DNA, 20 bp, Artificial Sequence
  chemically synthesized
ttgacagtattaaccatcac

SEQ ID NO: 34443 - DNA, 20 bp, Artificial Sequence
  chemically synthesized
tcatacataatcttcaaata

SEQ ID NO: 34444 - DNA, 20 bp, Artificial Sequence
  chemically synthesized
cttcaaataaagacaataat

SEQ ID NO: 34445 - DNA, 20 bp, Artificial Sequence
  chemically synthesized
ttcaaataaagacaataata

SEQ ID NO: 34446 - DNA, 20 bp, Artificial Sequence
  chemically synthesized
tacaactatcctcatacaac

SEQ ID NO: 34447 - DNA, 20 bp, Artificial Sequence
  chemically synthesized
cgcaccaatccccaaaccaa

SEQ ID NO: 34448 - DNA, 20 bp, Artificial Sequence
  chemically synthesized
caaaccaaaagttattacat

SEQ ID NO: 34449 - DNA, 20 bp, Artificial Sequence
  chemically synthesized
aaaccaaaagttattacata

SEQ ID NO: 34450 - DNA, 20 bp, Artificial Sequence
  chemically synthesized
aatgcttaaatgctgatgtg

SEQ ID NO: 34451 - DNA, 20 bp, Artificial Sequence
  chemically synthesized
gatgtgaagtccataaatct

SEQ ID NO: 34452 - DNA, 20 bp, Artificial Sequence
  chemically synthesized
atgtgaagtccataaatcta

SEQ ID NO: 34453 - DNA, 20 bp, Artificial Sequence
  chemically synthesized
aaatctaaggtcacatgata

SEQ ID NO: 34454 - DNA, 20 bp, Artificial Sequence
  chemically synthesized
aatctaaggtcacatgataa

SEQ ID NO: 34455 - DNA, 20 bp, Artificial Sequence
  chemically synthesized
cacatgataaaggaaaaata

SEQ ID NO: 34456 - DNA, 20 bp, Artificial Sequence
  chemically synthesized
acatgataaaggaaaaataa

SEQ ID NO: 34457 - DNA, 20 bp, Artificial Sequence
  chemically synthesized
aaaataaaggaaataaaata

SEQ ID NO: 34458 - DNA, 20 bp, Artificial Sequence
  chemically synthesized
ataaaataaagatattttct

SEQ ID NO: 34459 - DNA, 20 bp, Artificial Sequence
  chemically synthesized
taaagatattttcttagcac

SEQ ID NO: 34460 - DNA, 20 bp, Artificial Sequence
  chemically synthesized
cacaagtgtacacatgcatt

SEQ ID NO: 34461 - DNA, 20 bp, Artificial Sequence
  chemically synthesized
agtgtacacatgcatttaga

SEQ ID NO: 34462 - DNA, 20 bp, Artificial Sequence
  chemically synthesized
gtacacatgcatttagaaag

SEQ ID NO: 34463 - DNA, 20 bp, Artificial Sequence
  chemically synthesized
atgcatttagaaagtggata

SEQ ID NO: 34464 - DNA, 20 bp, Artificial Sequence
  chemically synthesized
agaaagtggatatagtgctg

SEQ ID NO: 34465 - DNA, 20 bp, Artificial Sequence
  chemically synthesized
gtgctgcagctgtccacttt

SEQ ID NO: 34466 - DNA, 20 bp, Artificial Sequence
  chemically synthesized
tgctgcagctgtccactttc

SEQ ID NO: 34467 - DNA, 20 bp, Artificial Sequence
  chemically synthesized
tgcagctgtccactttcggg

SEQ ID NO: 34468 - DNA, 20 bp, Artificial Sequence
  chemically synthesized
ggtggtgcctgcatatcgtg

SEQ ID NO: 34469 - DNA, 20 bp, Artificial Sequence
  chemically synthesized
gtgcagaaccatctatgaac

SEQ ID NO: 34470 - DNA, 20 bp, Artificial Sequence
  chemically synthesized
accatctatgaaccagtcct

SEQ ID NO: 34471 - DNA, 20 bp, Artificial Sequence
  chemically synthesized
cttcctctgtcaactgatca

SEQ ID NO: 34472 - DNA, 20 bp, Artificial Sequence
  chemically synthesized
ttcctctgtcaactgatcat

SEQ ID NO: 34473 - DNA, 20 bp, Artificial Sequence
  chemically synthesized
tcctctgtcaactgatcata

SEQ ID NO: 34474 - DNA, 20 bp, Artificial Sequence
  chemically synthesized
gatcatagggaactccccat

SEQ ID NO: 34475 - DNA, 20 bp, Artificial Sequence
  chemically synthesized
atcatagggaactccccatg

SEQ ID NO: 34476 - DNA, 20 bp, Artificial Sequence
  chemically synthesized
ggaactccccatgaggccat

SEQ ID NO: 34477 - DNA, 20 bp, Artificial Sequence
  chemically synthesized
tccccatgaggccattggtg

SEQ ID NO: 34478 - DNA, 20 bp, Artificial Sequence
  chemically synthesized
ccccatgaggccattggtgc

SEQ ID NO: 34479 - DNA, 20 bp, Artificial Sequence
  chemically synthesized
atgaggccattggtgcaggc

SEQ ID NO: 34480 - DNA, 20 bp, Artificial Sequence
  chemically synthesized
tgaggccattggtgcaggct

SEQ ID NO: 34481 - DNA, 20 bp, Artificial Sequence
  chemically synthesized
gaggccattggtgcaggctg

SEQ ID NO: 34482 - DNA, 20 bp, Artificial Sequence
  chemically synthesized
aggccattggtgcaggctgg

SEQ ID NO: 34483 - DNA, 20 bp, Artificial Sequence
  chemically synthesized
gccattggtgcaggctgggg

SEQ ID NO: 34484 - DNA, 20 bp, Artificial Sequence
  chemically synthesized
ccattggtgcaggctggggg

SEQ ID NO: 34485 - DNA, 20 bp, Artificial Sequence
  chemically synthesized
cattggtgcaggctggggga

SEQ ID NO: 34486 - DNA, 20 bp, Artificial Sequence
  chemically synthesized
tggtgcaggctgggggaggg

SEQ ID NO: 34487 - DNA, 20 bp, Artificial Sequence
  chemically synthesized
ggtgcaggctgggggaggga

SEQ ID NO: 34488 - DNA, 20 bp, Artificial Sequence
  chemically synthesized
gcaggctgggggagggaagg

SEQ ID NO: 34489 - DNA, 20 bp, Artificial Sequence
  chemically synthesized
caggctgggggagggaaggc

SEQ ID NO: 34490 - DNA, 20 bp, Artificial Sequence
  chemically synthesized
aggctgggggagggaaggca

SEQ ID NO: 34491 - DNA, 20 bp, Artificial Sequence
  chemically synthesized
ctgggggagggaaggcaggg

SEQ ID NO: 34492 - DNA, 20 bp, Artificial Sequence
  chemically synthesized
gagggaaggcagggtggcat

SEQ ID NO: 34493 - DNA, 20 bp, Artificial Sequence
  chemically synthesized
ggaaggcagggtggcatgag

SEQ ID NO: 34494 - DNA, 20 bp, Artificial Sequence
  chemically synthesized
aaggcagggtggcatgagtg

SEQ ID NO: 34495 - DNA, 20 bp, Artificial Sequence
  chemically synthesized
ggtggcatgagtggagaaca

SEQ ID NO: 34496 - DNA, 20 bp, Artificial Sequence
  chemically synthesized
gtggcatgagtggagaacat

SEQ ID NO: 34497 - DNA, 20 bp, Artificial Sequence
  chemically synthesized
agtggagaacatgggcattt

SEQ ID NO: 34498 - DNA, 20 bp, Artificial Sequence
  chemically synthesized
atgtaacttacttgtgcctt

SEQ ID NO: 34499 - DNA, 20 bp, Artificial Sequence
  chemically synthesized
tgtaacttacttgtgccttc

SEQ ID NO: 34500 - DNA, 20 bp, Artificial Sequence
  chemically synthesized
tgtgccttcaggacctgctc

SEQ ID NO: 34501 - DNA, 20 bp, Artificial Sequence
  chemically synthesized
cgctgtgctgacccacttca

SEQ ID NO: 34502 - DNA, 20 bp, Artificial Sequence
  chemically synthesized
gtgctgacccacttcatggc

SEQ ID NO: 34503 - DNA, 20 bp, Artificial Sequence
  chemically synthesized
tgacccacttcatggctaga

SEQ ID NO: 34504 - DNA, 20 bp, Artificial Sequence
  chemically synthesized
gacccacttcatggctagat

SEQ ID NO: 34505 - DNA, 20 bp, Artificial Sequence
  chemically synthesized
cacttcatggctagatgggt

SEQ ID NO: 34506 - DNA, 20 bp, Artificial Sequence
  chemically synthesized
tcatggctagatgggtcaga

SEQ ID NO: 34507 - DNA, 20 bp, Artificial Sequence
  chemically synthesized
tagatgggtcagaaagcaac

SEQ ID NO: 34508 - DNA, 20 bp, Artificial Sequence
  chemically synthesized
agaaagcaaccagttcatga

SEQ ID NO: 34509 - DNA, 20 bp, Artificial Sequence
  chemically synthesized
gaaagcaaccagttcatgat

SEQ ID NO: 34510 - DNA, 20 bp, Artificial Sequence
  chemically synthesized
agcaaccagttcatgatagg

SEQ ID NO: 34511 - DNA, 20 bp, Artificial Sequence
  chemically synthesized
gcaaccagttcatgataggc

SEQ ID NO: 34512 - DNA, 20 bp, Artificial Sequence
  chemically synthesized
cagttcatgataggcaggtt

SEQ ID NO: 34513 - DNA, 20 bp, Artificial Sequence
  chemically synthesized
agttcatgataggcaggttc

SEQ ID NO: 34514 - DNA, 20 bp, Artificial Sequence
  chemically synthesized
tcatgataggcaggttcagg

SEQ ID NO: 34515 - DNA, 20 bp, Artificial Sequence
  chemically synthesized
ataggcaggttcaggtagca

SEQ ID NO: 34516 - DNA, 20 bp, Artificial Sequence
  chemically synthesized
catggtgactttatgaccca

SEQ ID NO: 34517 - DNA, 20 bp, Artificial Sequence
  chemically synthesized
atgacccacagtcaaacgtt

SEQ ID NO: 34518 - DNA, 20 bp, Artificial Sequence
  chemically synthesized
caaacgttcagttaccacca

SEQ ID NO: 34519 - DNA, 20 bp, Artificial Sequence
  chemically synthesized
ttaccaccaaagcccaataa

SEQ ID NO: 34520 - DNA, 20 bp, Artificial Sequence
  chemically synthesized
aaagcccaataacagaccaa

SEQ ID NO: 34521 - DNA, 20 bp, Artificial Sequence
  chemically synthesized
gaccaatagctgtctctcaa

SEQ ID NO: 34522 - DNA, 20 bp, Artificial Sequence
  chemically synthesized
accaatagctgtctctcaaa

SEQ ID NO: 34523 - DNA, 20 bp, Artificial Sequence
  chemically synthesized
caatagctgtctctcaaaag

SEQ ID NO: 34524 - DNA, 20 bp, Artificial Sequence
  chemically synthesized
atagctgtctctcaaaagga

SEQ ID NO: 34525 - DNA, 20 bp, Artificial Sequence
  chemically synthesized
gctgtctctcaaaaggagag

SEQ ID NO: 34526 - DNA, 20 bp, Artificial Sequence
  chemically synthesized
aaaaggagagtagttatctg

SEQ ID NO: 34527 - DNA, 20 bp, Artificial Sequence
  chemically synthesized
aggagagtagttatctgcag

SEQ ID NO: 34528 - DNA, 20 bp, Artificial Sequence
  chemically synthesized
agagtagttatctgcagaag

SEQ ID NO: 34529 - DNA, 20 bp, Artificial Sequence
  chemically synthesized
gtagttatctgcagaagtgg

SEQ ID NO: 34530 - DNA, 20 bp, Artificial Sequence
  chemically synthesized
tagttatctgcagaagtggc

SEQ ID NO: 34531 - DNA, 20 bp, Artificial Sequence
  chemically synthesized
agttatctgcagaagtggca

SEQ ID NO: 34532 - DNA, 20 bp, Artificial Sequence
  chemically synthesized
agggccttgctccaaaatcc

SEQ ID NO: 34533 - DNA, 20 bp, Artificial Sequence
  chemically synthesized
ggccttgctccaaaatccta

SEQ ID NO: 34534 - DNA, 20 bp, Artificial Sequence
  chemically synthesized
gccttgctccaaaatcctag

SEQ ID NO: 34535 - DNA, 20 bp, Artificial Sequence
  chemically synthesized
tctccactgtgattcaccta

SEQ ID NO: 34536 - DNA, 20 bp, Artificial Sequence
  chemically synthesized
ctccactgtgattcacctat

SEQ ID NO: 34537 - DNA, 20 bp, Artificial Sequence
  chemically synthesized
tccactgtgattcacctatg

SEQ ID NO: 34538 - DNA, 20 bp, Artificial Sequence
  chemically synthesized
ccactgtgattcacctatgg

SEQ ID NO: 34539 - DNA, 20 bp, Artificial Sequence
  chemically synthesized
tcacctatgggggcctgcca

SEQ ID NO: 34540 - DNA, 20 bp, Artificial Sequence
  chemically synthesized
cacctatgggggcctgccaa

SEQ ID NO: 34541 - DNA, 20 bp, Artificial Sequence
  chemically synthesized
ggcctgccaaaggctccaaa

SEQ ID NO: 34542 - DNA, 20 bp, Artificial Sequence
  chemically synthesized
ctatctgccactgacacctc

SEQ ID NO: 34543 - DNA, 20 bp, Artificial Sequence
  chemically synthesized
actgacacctcaagcaccat

SEQ ID NO: 34544 - DNA, 20 bp, Artificial Sequence
  chemically synthesized
ctcaagcaccattggatctg

SEQ ID NO: 34545 - DNA, 20 bp, Artificial Sequence
  chemically synthesized
tcaagcaccattggatctgc

SEQ ID NO: 34546 - DNA, 20 bp, Artificial Sequence
  chemically synthesized
caagcaccattggatctgcg

SEQ ID NO: 34547 - DNA, 20 bp, Artificial Sequence
  chemically synthesized
attggatctgcggggtcatg

SEQ ID NO: 34548 - DNA, 20 bp, Artificial Sequence
  chemically synthesized
gcggggtcatgtggcccaaa

SEQ ID NO: 34549 - DNA, 20 bp, Artificial Sequence
  chemically synthesized
gggtcatgtggcccaaatgg

SEQ ID NO: 34550 - DNA, 20 bp, Artificial Sequence
  chemically synthesized
gtcatgtggcccaaatggca

SEQ ID NO: 34551 - DNA, 20 bp, Artificial Sequence
  chemically synthesized
atgtggcccaaatggcagag

SEQ ID NO: 34552 - DNA, 20 bp, Artificial Sequence
  chemically synthesized
aaatggcagagcagctttca

SEQ ID NO: 34553 - DNA, 20 bp, Artificial Sequence
  chemically synthesized
tggcagagcagctttcacag

SEQ ID NO: 34554 - DNA, 20 bp, Artificial Sequence
  chemically synthesized
gagcagctttcacagcagcc

SEQ ID NO: 34555 - DNA, 20 bp, Artificial Sequence
  chemically synthesized
acagcagcctggacctgttt

SEQ ID NO: 34556 - DNA, 20 bp, Artificial Sequence
  chemically synthesized
agcagcctggacctgtttca

SEQ ID NO: 34557 - DNA, 20 bp, Artificial Sequence
  chemically synthesized
ttcagagccttcttttgttc

SEQ ID NO: 34558 - DNA, 20 bp, Artificial Sequence
  chemically synthesized
ttctagactgcacttaaatc

SEQ ID NO: 34559 - DNA, 20 bp, Artificial Sequence
  chemically synthesized
tagactgcacttaaatctgg

SEQ ID NO: 34560 - DNA, 20 bp, Artificial Sequence
  chemically synthesized
acttaaatctggcagccttt

SEQ ID NO: 34561 - DNA, 20 bp, Artificial Sequence
  chemically synthesized
cttaaatctggcagcctttc

SEQ ID NO: 34562 - DNA, 20 bp, Artificial Sequence
  chemically synthesized
ctttcaggtcactcgataaa

SEQ ID NO: 34563 - DNA, 20 bp, Artificial Sequence
  chemically synthesized
tttcaggtcactcgataaat

SEQ ID NO: 34564 - DNA, 20 bp, Artificial Sequence
  chemically synthesized
aggtcactcgataaatgggc

SEQ ID NO: 34565 - DNA, 20 bp, Artificial Sequence
  chemically synthesized
gtcactcgataaatgggcca

SEQ ID NO: 34566 - DNA, 20 bp, Artificial Sequence
  chemically synthesized
ccagagtaacacacccaaac

SEQ ID NO: 34567 - DNA, 20 bp, Artificial Sequence
  chemically synthesized
cagagtaacacacccaaacg

SEQ ID NO: 34568 - DNA, 20 bp, Artificial Sequence
  chemically synthesized
tgttgcctccaaaatccaaa

SEQ ID NO: 34569 - DNA, 20 bp, Artificial Sequence
  chemically synthesized
gttgcctccaaaatccaaat

SEQ ID NO: 34570 - DNA, 20 bp, Artificial Sequence
  chemically synthesized
caaaatccaaataggcccac

SEQ ID NO: 34571 - DNA, 20 bp, Artificial Sequence
  chemically synthesized
aaaatccaaataggcccacc

SEQ ID NO: 34572 - DNA, 20 bp, Artificial Sequence
  chemically synthesized
caggcattgtgcctctttct

SEQ ID NO: 34573 - DNA, 20 bp, Artificial Sequence
  chemically synthesized
tgtgcctctttcttggttgt

SEQ ID NO: 34574 - DNA, 20 bp, Artificial Sequence
  chemically synthesized
tgcctctttcttggttgtaa

SEQ ID NO: 34575 - DNA, 20 bp, Artificial Sequence
  chemically synthesized
gcctctttcttggttgtaag

SEQ ID NO: 34576 - DNA, 20 bp, Artificial Sequence
  chemically synthesized
cctctttcttggttgtaaga

SEQ ID NO: 34577 - DNA, 20 bp, Artificial Sequence
  chemically synthesized
ctctttcttggttgtaagag

SEQ ID NO: 34578 - DNA, 20 bp, Artificial Sequence
  chemically synthesized
gttgtaagaggggccaaacg

SEQ ID NO: 34579 - DNA, 20 bp, Artificial Sequence
  chemically synthesized
taagaggggccaaacgcagc

SEQ ID NO: 34580 - DNA, 20 bp, Artificial Sequence
  chemically synthesized
cagcaagttatgcttcacct

SEQ ID NO: 34581 - DNA, 20 bp, Artificial Sequence
  chemically synthesized
caagttatgcttcaccttag

SEQ ID NO: 34582 - DNA, 20 bp, Artificial Sequence
  chemically synthesized
aagttatgcttcaccttaga

SEQ ID NO: 34583 - DNA, 20 bp, Artificial Sequence
  chemically synthesized
ccttagaaggaatatctcca

SEQ ID NO: 34584 - DNA, 20 bp, Artificial Sequence
  chemically synthesized
cttagaaggaatatctccat

SEQ ID NO: 34585 - DNA, 20 bp, Artificial Sequence
  chemically synthesized
ctccataggtctcatgccac

SEQ ID NO: 34586 - DNA, 20 bp, Artificial Sequence
  chemically synthesized
gtctcatgccactggaaccc

SEQ ID NO: 34587 - DNA, 20 bp, Artificial Sequence
  chemically synthesized
ggaaccctagaaattttacc

SEQ ID NO: 34588 - DNA, 20 bp, Artificial Sequence
  chemically synthesized
gaaccctagaaattttaccg

SEQ ID NO: 34589 - DNA, 20 bp, Artificial Sequence
  chemically synthesized
ccctagaaattttaccgagg

SEQ ID NO: 34590 - DNA, 20 bp, Artificial Sequence
  chemically synthesized
agaaattttaccgaggtaga

SEQ ID NO: 34591 - DNA, 20 bp, Artificial Sequence
  chemically synthesized
ggtagaaagtccctaaattt

SEQ ID NO: 34592 - DNA, 20 bp, Artificial Sequence
  chemically synthesized
gaaagtccctaaattttagc

SEQ ID NO: 34593 - DNA, 20 bp, Artificial Sequence
  chemically synthesized
tggatttatttcccatcctc

SEQ ID NO: 34594 - DNA, 20 bp, Artificial Sequence
  chemically synthesized
catacaaatgtctcaccaat

SEQ ID NO: 34595 - DNA, 20 bp, Artificial Sequence
  chemically synthesized
aaatgtctcaccaataagtt

SEQ ID NO: 34596 - DNA, 20 bp, Artificial Sequence
  chemically synthesized
tcataatgtcatgaatgtaa

SEQ ID NO: 34597 - DNA, 20 bp, Artificial Sequence
  chemically synthesized
atgtcatgaatgtaatggac

SEQ ID NO: 34598 - DNA, 20 bp, Artificial Sequence
  chemically synthesized
tggaccagtgttatatctcg

SEQ ID NO: 34599 - DNA, 20 bp, Artificial Sequence
  chemically synthesized
accagtgttatatctcgtgg

SEQ ID NO: 34600 - DNA, 20 bp, Artificial Sequence
  chemically synthesized
ttatatctcgtggaagtgaa

SEQ ID NO: 34601 - DNA, 20 bp, Artificial Sequence
  chemically synthesized
atctcgtggaagtgaaaagc

SEQ ID NO: 34602 - DNA, 20 bp, Artificial Sequence
  chemically synthesized
cgtggaagtgaaaagcgagc

SEQ ID NO: 34603 - DNA, 20 bp, Artificial Sequence
  chemically synthesized
gtggaagtgaaaagcgagca

SEQ ID NO: 34604 - DNA, 20 bp, Artificial Sequence
  chemically synthesized
cgagcaaggtctctccaaat

SEQ ID NO: 34605 - DNA, 20 bp, Artificial Sequence
  chemically synthesized
ccaaataagattatgacaca

SEQ ID NO: 34606 - DNA, 20 bp, Artificial Sequence
  chemically synthesized
ataagattatgacacaaagc

SEQ ID NO: 34607 - DNA, 20 bp, Artificial Sequence
  chemically synthesized
aagattatgacacaaagctg

SEQ ID NO: 34608 - DNA, 20 bp, Artificial Sequence
  chemically synthesized
gattatgacacaaagctgga

SEQ ID NO: 34609 - DNA, 20 bp, Artificial Sequence
  chemically synthesized
tggagagttgatacacccct

SEQ ID NO: 34610 - DNA, 20 bp, Artificial Sequence
  chemically synthesized
ggagagttgatacacccctg

SEQ ID NO: 34611 - DNA, 20 bp, Artificial Sequence
  chemically synthesized
gagttgatacacccctgagg

SEQ ID NO: 34612 - DNA, 20 bp, Artificial Sequence
  chemically synthesized
agttgatacacccctgaggt

SEQ ID NO: 34613 - DNA, 20 bp, Artificial Sequence
  chemically synthesized
gttgatacacccctgaggta

SEQ ID NO: 34614 - DNA, 20 bp, Artificial Sequence
  chemically synthesized
gatacacccctgaggtaggg

SEQ ID NO: 34615 - DNA, 20 bp, Artificial Sequence
  chemically synthesized
acccctgaggtagggtggta

SEQ ID NO: 34616 - DNA, 20 bp, Artificial Sequence
  chemically synthesized
cccctgaggtagggtggtaa

SEQ ID NO: 34617 - DNA, 20 bp, Artificial Sequence
  chemically synthesized
gggtggtaaaggtataatgc

SEQ ID NO: 34618 - DNA, 20 bp, Artificial Sequence
  chemically synthesized
aggtataatgctggccttgt

SEQ ID NO: 34619 - DNA, 20 bp, Artificial Sequence
  chemically synthesized
aatgctggccttgtcagctg

SEQ ID NO: 34620 - DNA, 20 bp, Artificial Sequence
  chemically synthesized
atgctggccttgtcagctga

SEQ ID NO: 34621 - DNA, 20 bp, Artificial Sequence
  chemically synthesized
agctgaaggcaaattgcttc

SEQ ID NO: 34622 - DNA, 20 bp, Artificial Sequence
  chemically synthesized
tgaaggcaaattgcttctgg

SEQ ID NO: 34623 - DNA, 20 bp, Artificial Sequence
  chemically synthesized
gaaggcaaattgcttctggt

SEQ ID NO: 34624 - DNA, 20 bp, Artificial Sequence
  chemically synthesized
attgcttctggtgggtctta

SEQ ID NO: 34625 - DNA, 20 bp, Artificial Sequence
  chemically synthesized
cttctggtgggtcttatgga

SEQ ID NO: 34626 - DNA, 20 bp, Artificial Sequence
  chemically synthesized
ttctggtgggtcttatggac

SEQ ID NO: 34627 - DNA, 20 bp, Artificial Sequence
  chemically synthesized
gtgggtcttatggacaggaa

SEQ ID NO: 34628 - DNA, 20 bp, Artificial Sequence
  chemically synthesized
gggtcttatggacaggaatg

SEQ ID NO: 34629 - DNA, 20 bp, Artificial Sequence
  chemically synthesized
tatggacaggaatggagaaa

SEQ ID NO: 34630 - DNA, 20 bp, Artificial Sequence
  chemically synthesized
tggagaaaaagccacttgcc

SEQ ID NO: 34631 - DNA, 20 bp, Artificial Sequence
  chemically synthesized
aaagccacttgccaagccaa

SEQ ID NO: 34632 - DNA, 20 bp, Artificial Sequence
  chemically synthesized
ccaagccaatggctgcatac

SEQ ID NO: 34633 - DNA, 20 bp, Artificial Sequence
  chemically synthesized
caagccaatggctgcatacc

SEQ ID NO: 34634 - DNA, 20 bp, Artificial Sequence
  chemically synthesized
aatggctgcataccaggcac

SEQ ID NO: 34635 - DNA, 20 bp, Artificial Sequence
  chemically synthesized
atggctgcataccaggcacc

SEQ ID NO: 34636 - DNA, 20 bp, Artificial Sequence
  chemically synthesized
ggctgcataccaggcaccag

SEQ ID NO: 34637 - DNA, 20 bp, Artificial Sequence
  chemically synthesized
ggagatgtgttaatttgctc

SEQ ID NO: 34638 - DNA, 20 bp, Artificial Sequence
  chemically synthesized
tcaagcaacaaaaccacaac

SEQ ID NO: 34639 - DNA, 20 bp, Artificial Sequence
  chemically synthesized
agcaacaaaaccacaactgg

SEQ ID NO: 34640 - DNA, 20 bp, Artificial Sequence
  chemically synthesized
caacaaaaccacaactggta

SEQ ID NO: 34641 - DNA, 20 bp, Artificial Sequence
  chemically synthesized
caaaaccacaactggtagag

SEQ ID NO: 34642 - DNA, 20 bp, Artificial Sequence
  chemically synthesized
actggtagagcagctgcaat

SEQ ID NO: 34643 - DNA, 20 bp, Artificial Sequence
  chemically synthesized
tggtagagcagctgcaattg

SEQ ID NO: 34644 - DNA, 20 bp, Artificial Sequence
  chemically synthesized
ctgcaattggagtcaccact

SEQ ID NO: 34645 - DNA, 20 bp, Artificial Sequence
  chemically synthesized
attggagtcaccacttggtt

SEQ ID NO: 34646 - DNA, 20 bp, Artificial Sequence
  chemically synthesized
ataatccaccatcattttcc

SEQ ID NO: 34647 - DNA, 20 bp, Artificial Sequence
  chemically synthesized
agatccatctgtcctctgca

SEQ ID NO: 34648 - DNA, 20 bp, Artificial Sequence
  chemically synthesized
gatccatctgtcctctgcac

SEQ ID NO: 34649 - DNA, 20 bp, Artificial Sequence
  chemically synthesized
tgtcctctgcacaggtcaaa

SEQ ID NO: 34650 - DNA, 20 bp, Artificial Sequence
  chemically synthesized
gtcctctgcacaggtcaaat

SEQ ID NO: 34651 - DNA, 20 bp, Artificial Sequence
  chemically synthesized
cctctgcacaggtcaaatgg

SEQ ID NO: 34652 - DNA, 20 bp, Artificial Sequence
  chemically synthesized
tctgcacaggtcaaatggga

SEQ ID NO: 34653 - DNA, 20 bp, Artificial Sequence
  chemically synthesized
ggtcaaatgggagagttgaa

SEQ ID NO: 34654 - DNA, 20 bp, Artificial Sequence
  chemically synthesized
gtcaaatgggagagttgaac

SEQ ID NO: 34655 - DNA, 20 bp, Artificial Sequence
  chemically synthesized
tcaaatgggagagttgaaca

SEQ ID NO: 34656 - DNA, 20 bp, Artificial Sequence
  chemically synthesized
gggagagttgaacagggatg

SEQ ID NO: 34657 - DNA, 20 bp, Artificial Sequence
  chemically synthesized
agagttgaacagggatgtgg

SEQ ID NO: 34658 - DNA, 20 bp, Artificial Sequence
  chemically synthesized
gagttgaacagggatgtggt

SEQ ID NO: 34659 - DNA, 20 bp, Artificial Sequence
  chemically synthesized
tcaccacccctgcgtctttc

SEQ ID NO: 34660 - DNA, 20 bp, Artificial Sequence
  chemically synthesized
tgcgtctttcaagtccttga

SEQ ID NO: 34661 - DNA, 20 bp, Artificial Sequence
  chemically synthesized
gatggtgacactaatcactt

SEQ ID NO: 34662 - DNA, 20 bp, Artificial Sequence
  chemically synthesized
actaatcacttcagtccctc

SEQ ID NO: 34663 - DNA, 20 bp, Artificial Sequence
  chemically synthesized
ctaatcacttcagtccctcc

SEQ ID NO: 34664 - DNA, 20 bp, Artificial Sequence
  chemically synthesized
taatcacttcagtccctcca

SEQ ID NO: 34665 - DNA, 20 bp, Artificial Sequence
  chemically synthesized
cacttcagtccctccaggga

SEQ ID NO: 34666 - DNA, 20 bp, Artificial Sequence
  chemically synthesized
acttcagtccctccagggat

SEQ ID NO: 34667 - DNA, 20 bp, Artificial Sequence
  chemically synthesized
ttttgatttttttatttttc

SEQ ID NO: 34668 - DNA, 20 bp, Artificial Sequence
  chemically synthesized
tttgatttttttatttttct

SEQ ID NO: 34669 - DNA, 20 bp, Artificial Sequence
  chemically synthesized
gatttttttatttttctagg

SEQ ID NO: 34670 - DNA, 20 bp, Artificial Sequence
  chemically synthesized
tttttttatttttctaggta

SEQ ID NO: 34671 - DNA, 20 bp, Artificial Sequence
  chemically synthesized
tttatttttctaggtagaga

SEQ ID NO: 34672 - DNA, 20 bp, Artificial Sequence
  chemically synthesized
ctaggtagagacagctctaa

SEQ ID NO: 34673 - DNA, 20 bp, Artificial Sequence
  chemically synthesized
cagctctaatggcttctgtt

SEQ ID NO: 34674 - DNA, 20 bp, Artificial Sequence
  chemically synthesized
tttggcctttcccaccataa

SEQ ID NO: 34675 - DNA, 20 bp, Artificial Sequence
  chemically synthesized
cataatagccctcatcctac

SEQ ID NO: 34676 - DNA, 20 bp, Artificial Sequence
  chemically synthesized
atagccctcatcctaccagt

SEQ ID NO: 34677 - DNA, 20 bp, Artificial Sequence
  chemically synthesized
tagccctcatcctaccagtc

SEQ ID NO: 34678 - DNA, 20 bp, Artificial Sequence
  chemically synthesized
agccctcatcctaccagtca

SEQ ID NO: 34679 - DNA, 20 bp, Artificial Sequence
  chemically synthesized
ccctcatcctaccagtcagg

SEQ ID NO: 34680 - DNA, 20 bp, Artificial Sequence
  chemically synthesized
taccagtcagggagccaatg

SEQ ID NO: 34681 - DNA, 20 bp, Artificial Sequence
  chemically synthesized
agccaatgtggcatttctgc

SEQ ID NO: 34682 - DNA, 20 bp, Artificial Sequence
  chemically synthesized
tggcatttctgccagctaat

SEQ ID NO: 34683 - DNA, 20 bp, Artificial Sequence
  chemically synthesized
tctatacaaattatgcattt

SEQ ID NO: 34684 - DNA, 20 bp, Artificial Sequence
  chemically synthesized
caaattatgcattttggcac

SEQ ID NO: 34685 - DNA, 20 bp, Artificial Sequence
  chemically synthesized
aaattatgcattttggcact

SEQ ID NO: 34686 - DNA, 20 bp, Artificial Sequence
  chemically synthesized
tttggcactgggaaaatgac

SEQ ID NO: 34687 - DNA, 20 bp, Artificial Sequence
  chemically synthesized
tggcactgggaaaatgacca

SEQ ID NO: 34688 - DNA, 20 bp, Artificial Sequence
  chemically synthesized
ggcactgggaaaatgaccag

SEQ ID NO: 34689 - DNA, 20 bp, Artificial Sequence
  chemically synthesized
tgggaaaatgaccagaggat

SEQ ID NO: 34690 - DNA, 20 bp, Artificial Sequence
  chemically synthesized
aaatgaccagaggataagtc

SEQ ID NO: 34691 - DNA, 20 bp, Artificial Sequence
  chemically synthesized
aatgaccagaggataagtcc

SEQ ID NO: 34692 - DNA, 20 bp, Artificial Sequence
  chemically synthesized
atgaccagaggataagtcca

SEQ ID NO: 34693 - DNA, 20 bp, Artificial Sequence
  chemically synthesized
ggataagtccagggacccac

SEQ ID NO: 34694 - DNA, 20 bp, Artificial Sequence
  chemically synthesized
ggacccactggaaccactgt

SEQ ID NO: 34695 - DNA, 20 bp, Artificial Sequence
  chemically synthesized
ccactggaaccactgtaagt

SEQ ID NO: 34696 - DNA, 20 bp, Artificial Sequence
  chemically synthesized
aaccactgtaagtcagaaat

SEQ ID NO: 34697 - DNA, 20 bp, Artificial Sequence
  chemically synthesized
attaattacctaacctccat

SEQ ID NO: 34698 - DNA, 20 bp, Artificial Sequence
  chemically synthesized
ccataagcccctactttaac

SEQ ID NO: 34699 - DNA, 20 bp, Artificial Sequence
  chemically synthesized
cataagcccctactttaact

SEQ ID NO: 34700 - DNA, 20 bp, Artificial Sequence
  chemically synthesized
ataagcccctactttaactg

SEQ ID NO: 34701 - DNA, 20 bp, Artificial Sequence
  chemically synthesized
ggggaaccacaataacgttt

SEQ ID NO: 34702 - DNA, 20 bp, Artificial Sequence
  chemically synthesized
gggaaccacaataacgtttt

SEQ ID NO: 34703 - DNA, 20 bp, Artificial Sequence
  chemically synthesized
caataacgttttgggtaccc

SEQ ID NO: 34704 - DNA, 20 bp, Artificial Sequence
  chemically synthesized
gggtaccctggaatcaacgt

SEQ ID NO: 34705 - DNA, 20 bp, Artificial Sequence
  chemically synthesized
ccctggaatcaacgtcagct

SEQ ID NO: 34706 - DNA, 20 bp, Artificial Sequence
  chemically synthesized
ctggaatcaacgtcagctca

SEQ ID NO: 34707 - DNA, 20 bp, Artificial Sequence
  chemically synthesized
aatcaacgtcagctcagagc

SEQ ID NO: 34708 - DNA, 20 bp, Artificial Sequence
  chemically synthesized
gtcagctcagagccagtgtc

SEQ ID NO: 34709 - DNA, 20 bp, Artificial Sequence
  chemically synthesized
tctcattacttccctttctc

SEQ ID NO: 34710 - DNA, 20 bp, Artificial Sequence
  chemically synthesized
ttccctttctccagtacaca

SEQ ID NO: 34711 - DNA, 20 bp, Artificial Sequence
  chemically synthesized
tccagtacacacagttaccc

SEQ ID NO: 34712 - DNA, 20 bp, Artificial Sequence
  chemically synthesized
acacacagttaccctggtaa

SEQ ID NO: 34713 - DNA, 20 bp, Artificial Sequence
  chemically synthesized
cacacagttaccctggtaaa

SEQ ID NO: 34714 - DNA, 20 bp, Artificial Sequence
  chemically synthesized
cagttaccctggtaaaaggc

SEQ ID NO: 34715 - DNA, 20 bp, Artificial Sequence
  chemically synthesized
gttaccctggtaaaaggcca

SEQ ID NO: 34716 - DNA, 20 bp, Artificial Sequence
  chemically synthesized
ttaccctggtaaaaggccag

SEQ ID NO: 34717 - DNA, 20 bp, Artificial Sequence
  chemically synthesized
taaaaggccagaggtctcct

SEQ ID NO: 34718 - DNA, 20 bp, Artificial Sequence
  chemically synthesized
aaaaggccagaggtctcctt

SEQ ID NO: 34719 - DNA, 20 bp, Artificial Sequence
  chemically synthesized
aaaggccagaggtctcctta

SEQ ID NO: 34720 - DNA, 20 bp, Artificial Sequence
  chemically synthesized
ggccagaggtctccttaggg

SEQ ID NO: 34721 - DNA, 20 bp, Artificial Sequence
  chemically synthesized
gccagaggtctccttaggga

SEQ ID NO: 34722 - DNA, 20 bp, Artificial Sequence
  chemically synthesized
gaggtctccttagggaagga

SEQ ID NO: 34723 - DNA, 20 bp, Artificial Sequence
  chemically synthesized
aggtctccttagggaaggat

SEQ ID NO: 34724 - DNA, 20 bp, Artificial Sequence
  chemically synthesized
gtctccttagggaaggatgg

SEQ ID NO: 34725 - DNA, 20 bp, Artificial Sequence
  chemically synthesized
ccttagggaaggatgggaga

SEQ ID NO: 34726 - DNA, 20 bp, Artificial Sequence
  chemically synthesized
ttagggaaggatgggagaaa

SEQ ID NO: 34727 - DNA, 20 bp, Artificial Sequence
  chemically synthesized
aaggatgggagaaagagtaa

SEQ ID NO: 34728 - DNA, 20 bp, Artificial Sequence
  chemically synthesized
gggagaaagagtaacagcat

SEQ ID NO: 34729 - DNA, 20 bp, Artificial Sequence
  chemically synthesized
agagtaacagcataagttgt

SEQ ID NO: 34730 - DNA, 20 bp, Artificial Sequence
  chemically synthesized
gtaacagcataagttgtcag

SEQ ID NO: 34731 - DNA, 20 bp, Artificial Sequence
  chemically synthesized
agcataagttgtcagtagcc

SEQ ID NO: 34732 - DNA, 20 bp, Artificial Sequence
  chemically synthesized
ataagttgtcagtagcctag

SEQ ID NO: 34733 - DNA, 20 bp, Artificial Sequence
  chemically synthesized
gcctagtggtgtccttcctc

SEQ ID NO: 34734 - DNA, 20 bp, Artificial Sequence
  chemically synthesized
cctagtggtgtccttcctca

SEQ ID NO: 34735 - DNA, 20 bp, Artificial Sequence
  chemically synthesized
ctagtggtgtccttcctcaa

SEQ ID NO: 34736 - DNA, 20 bp, Artificial Sequence
  chemically synthesized
tagtggtgtccttcctcaag

SEQ ID NO: 34737 - DNA, 20 bp, Artificial Sequence
  chemically synthesized
tgtccttcctcaaggggatc

SEQ ID NO: 34738 - DNA, 20 bp, Artificial Sequence
  chemically synthesized
gatccagcctccccttcatt

SEQ ID NO: 34739 - DNA, 20 bp, Artificial Sequence
  chemically synthesized
ccagcctccccttcattcag

SEQ ID NO: 34740 - DNA, 20 bp, Artificial Sequence
  chemically synthesized
cagcctccccttcattcagt

SEQ ID NO: 34741 - DNA, 20 bp, Artificial Sequence
  chemically synthesized
ccccttcattcagtgggttc

SEQ ID NO: 34742 - DNA, 20 bp, Artificial Sequence
  chemically synthesized
agtgggttctggaactgtaa

SEQ ID NO: 34743 - DNA, 20 bp, Artificial Sequence
  chemically synthesized
gtgggttctggaactgtaac

SEQ ID NO: 34744 - DNA, 20 bp, Artificial Sequence
  chemically synthesized
tctggaactgtaacaggttc

SEQ ID NO: 34745 - DNA, 20 bp, Artificial Sequence
  chemically synthesized
aactgtaacaggttcgagtc

SEQ ID NO: 34746 - DNA, 20 bp, Artificial Sequence
  chemically synthesized
ttcgagtctggaaattgatt

SEQ ID NO: 34747 - DNA, 20 bp, Artificial Sequence
  chemically synthesized
tcgagtctggaaattgattg

SEQ ID NO: 34748 - DNA, 20 bp, Artificial Sequence
  chemically synthesized
cgagtctggaaattgattga

SEQ ID NO: 34749 - DNA, 20 bp, Artificial Sequence
  chemically synthesized
gattctctgtttttataatt

SEQ ID NO: 34750 - DNA, 20 bp, Artificial Sequence
  chemically synthesized
tctgtttttataattcagat

SEQ ID NO: 34751 - DNA, 20 bp, Artificial Sequence
  chemically synthesized
ttataattcagattagtctt

SEQ ID NO: 34752 - DNA, 20 bp, Artificial Sequence
  chemically synthesized
agtctttagtccattctacc

SEQ ID NO: 34753 - DNA, 20 bp, Artificial Sequence
  chemically synthesized
ctttagtccattctacctgg

SEQ ID NO: 34754 - DNA, 20 bp, Artificial Sequence
  chemically synthesized
gttttttgtttatataaatc

SEQ ID NO: 34755 - DNA, 20 bp, Artificial Sequence
  chemically synthesized
ttttgtttatataaatcaag

SEQ ID NO: 34756 - DNA, 20 bp, Artificial Sequence
  chemically synthesized
tttgtttatataaatcaagt

SEQ ID NO: 34757 - DNA, 20 bp, Artificial Sequence
  chemically synthesized
atataaatcaagtaggaata

SEQ ID NO: 34758 - DNA, 20 bp, Artificial Sequence
  chemically synthesized
taaatcaagtaggaatacag

SEQ ID NO: 34759 - DNA, 20 bp, Artificial Sequence
  chemically synthesized
aaatcaagtaggaatacagt

SEQ ID NO: 34760 - DNA, 20 bp, Artificial Sequence
  chemically synthesized
tttcccatcaatttcacttc

SEQ ID NO: 34761 - DNA, 20 bp, Artificial Sequence
  chemically synthesized
ttcccatcaatttcacttct

SEQ ID NO: 34762 - DNA, 20 bp, Artificial Sequence
  chemically synthesized
ctaggaacaccatgattaat

SEQ ID NO: 34763 - DNA, 20 bp, Artificial Sequence
  chemically synthesized
catgattaattagccaatgc

SEQ ID NO: 34764 - DNA, 20 bp, Artificial Sequence
  chemically synthesized
tgattaattagccaatgcca

SEQ ID NO: 34765 - DNA, 20 bp, Artificial Sequence
  chemically synthesized
ccaatgccagagctctacat

SEQ ID NO: 34766 - DNA, 20 bp, Artificial Sequence
  chemically synthesized
tgccagagctctacatgagt

SEQ ID NO: 34767 - DNA, 20 bp, Artificial Sequence
  chemically synthesized
catgagtcagactattctga

SEQ ID NO: 34768 - DNA, 20 bp, Artificial Sequence
  chemically synthesized
tttgcctctgctgtctatta

SEQ ID NO: 34769 - DNA, 20 bp, Artificial Sequence
  chemically synthesized
gcctctgctgtctattatgg

SEQ ID NO: 34770 - DNA, 20 bp, Artificial Sequence
  chemically synthesized
tatgcccaccttgcctttga

SEQ ID NO: 34771 - DNA, 20 bp, Artificial Sequence
  chemically synthesized
ccaccttgcctttgatggtt

SEQ ID NO: 34772 - DNA, 20 bp, Artificial Sequence
  chemically synthesized
gatggttcagtgccaacact

SEQ ID NO: 34773 - DNA, 20 bp, Artificial Sequence
  chemically synthesized
acacttggcccctgccacct

SEQ ID NO: 34774 - DNA, 20 bp, Artificial Sequence
  chemically synthesized
cacttggcccctgccacctc

SEQ ID NO: 34775 - DNA, 20 bp, Artificial Sequence
  chemically synthesized
cccattgtatttaaattttg

SEQ ID NO: 34776 - DNA, 20 bp, Artificial Sequence
  chemically synthesized
tgtatttaaattttgtagtt

SEQ ID NO: 34777 - DNA, 20 bp, Artificial Sequence
  chemically synthesized
attttgtagttgagtgactg

SEQ ID NO: 34778 - DNA, 20 bp, Artificial Sequence
  chemically synthesized
gtgactgtggttcctactgt

SEQ ID NO: 34779 - DNA, 20 bp, Artificial Sequence
  chemically synthesized
ctactgttagatctgacata

SEQ ID NO: 34780 - DNA, 20 bp, Artificial Sequence
  chemically synthesized
actgttagatctgacataca

SEQ ID NO: 34781 - DNA, 20 bp, Artificial Sequence
  chemically synthesized
gttagatctgacatacagag

SEQ ID NO: 34782 - DNA, 20 bp, Artificial Sequence
  chemically synthesized
tagatctgacatacagagaa

SEQ ID NO: 34783 - DNA, 20 bp, Artificial Sequence
  chemically synthesized
catacagagaagagcaatta

SEQ ID NO: 34784 - DNA, 20 bp, Artificial Sequence
  chemically synthesized
atacagagaagagcaattac

SEQ ID NO: 34785 - DNA, 20 bp, Artificial Sequence
  chemically synthesized
ttacgggctcttcaaaaata

SEQ ID NO: 34786 - DNA, 20 bp, Artificial Sequence
  chemically synthesized
tacgggctcttcaaaaatac

SEQ ID NO: 34787 - DNA, 20 bp, Artificial Sequence
  chemically synthesized
tctcacaaatctatttcaca

SEQ ID NO: 34788 - DNA, 20 bp, Artificial Sequence
  chemically synthesized
aaatctatttcacaaagctt

SEQ ID NO: 34789 - DNA, 20 bp, Artificial Sequence
  chemically synthesized
tatttcacaaagcttcggcc

SEQ ID NO: 34790 - DNA, 20 bp, Artificial Sequence
  chemically synthesized
atttcacaaagcttcggcca

SEQ ID NO: 34791 - DNA, 20 bp, Artificial Sequence
  chemically synthesized
tttcacaaagcttcggccaa

SEQ ID NO: 34792 - DNA, 20 bp, Artificial Sequence
  chemically synthesized
tcggccaagggtgtatcttc

SEQ ID NO: 34793 - DNA, 20 bp, Artificial Sequence
  chemically synthesized
gtgtatcttctggaccctcc

SEQ ID NO: 34794 - DNA, 20 bp, Artificial Sequence
  chemically synthesized
atcttctggaccctcccagc

SEQ ID NO: 34795 - DNA, 20 bp, Artificial Sequence
  chemically synthesized
tcttctggaccctcccagct

SEQ ID NO: 34796 - DNA, 20 bp, Artificial Sequence
  chemically synthesized
tggaccctcccagctgggat

SEQ ID NO: 34797 - DNA, 20 bp, Artificial Sequence
  chemically synthesized
accctcccagctgggatgag

SEQ ID NO: 34798 - DNA, 20 bp, Artificial Sequence
  chemically synthesized
ccctcccagctgggatgagt

SEQ ID NO: 34799 - DNA, 20 bp, Artificial Sequence
  chemically synthesized
agctgggatgagtaggtcta

SEQ ID NO: 34800 - DNA, 20 bp, Artificial Sequence
  chemically synthesized
tccaccatcctaatctccct

SEQ ID NO: 34801 - DNA, 20 bp, Artificial Sequence
  chemically synthesized
tcctaatctccctaagcctt

SEQ ID NO: 34802 - DNA, 20 bp, Artificial Sequence
  chemically synthesized
cacttcctctacattaaacc

SEQ ID NO: 34803 - DNA, 20 bp, Artificial Sequence
  chemically synthesized
acttcctctacattaaacca

SEQ ID NO: 34804 - DNA, 20 bp, Artificial Sequence
  chemically synthesized
acattaaaccaaggcatttc

SEQ ID NO: 34805 - DNA, 20 bp, Artificial Sequence
  chemically synthesized
catttccagctcactaacat

SEQ ID NO: 34806 - DNA, 20 bp, Artificial Sequence
  chemically synthesized
ccatcttttaatccatattt

SEQ ID NO: 34807 - DNA, 20 bp, Artificial Sequence
  chemically synthesized
aatccatatttcagctaacc

SEQ ID NO: 34808 - DNA, 20 bp, Artificial Sequence
  chemically synthesized
aacttttttttttttttttt

SEQ ID NO: 34809 - DNA, 20 bp, Artificial Sequence
  chemically synthesized
tttttttttttttttggaaa

SEQ ID NO: 34810 - DNA, 20 bp, Artificial Sequence
  chemically synthesized
tttttttttttttggaaatg

SEQ ID NO: 34811 - DNA, 20 bp, Artificial Sequence
  chemically synthesized
atggagtcttgctctgttac

SEQ ID NO: 34812 - DNA, 20 bp, Artificial Sequence
  chemically synthesized
tggagtcttgctctgttacc

SEQ ID NO: 34813 - DNA, 20 bp, Artificial Sequence
  chemically synthesized
gtcttgctctgttaccaggc

SEQ ID NO: 34814 - DNA, 20 bp, Artificial Sequence
  chemically synthesized
tctgttaccaggctggaatg

SEQ ID NO: 34815 - DNA, 20 bp, Artificial Sequence
  chemically synthesized
gttaccaggctggaatgcag

SEQ ID NO: 34816 - DNA, 20 bp, Artificial Sequence
  chemically synthesized
ttaccaggctggaatgcagt

SEQ ID NO: 34817 - DNA, 20 bp, Artificial Sequence
  chemically synthesized
taccaggctggaatgcagtg

SEQ ID NO: 34818 - DNA, 20 bp, Artificial Sequence
  chemically synthesized
ggaatgcagtggggcgatct

SEQ ID NO: 34819 - DNA, 20 bp, Artificial Sequence
  chemically synthesized
tcactgcaatctctgcctca

SEQ ID NO: 34820 - DNA, 20 bp, Artificial Sequence
  chemically synthesized
cactgcaatctctgcctcac

SEQ ID NO: 34821 - DNA, 20 bp, Artificial Sequence
  chemically synthesized
aatctctgcctcacaggttc

SEQ ID NO: 34822 - DNA, 20 bp, Artificial Sequence
  chemically synthesized
ctctgcctcacaggttcaag

SEQ ID NO: 34823 - DNA, 20 bp, Artificial Sequence
  chemically synthesized
ttcaagcagttctcttgcct

SEQ ID NO: 34824 - DNA, 20 bp, Artificial Sequence
  chemically synthesized
ttctcttgcctcagcctccc

SEQ ID NO: 34825 - DNA, 20 bp, Artificial Sequence
  chemically synthesized
tcttgcctcagcctcccaag

SEQ ID NO: 34826 - DNA, 20 bp, Artificial Sequence
  chemically synthesized
cctcagcctcccaagtagat

SEQ ID NO: 34827 - DNA, 20 bp, Artificial Sequence
  chemically synthesized
ctcccaagtagatgagatta

SEQ ID NO: 34828 - DNA, 20 bp, Artificial Sequence
  chemically synthesized
cagttacgcatcaccatgcc

SEQ ID NO: 34829 - DNA, 20 bp, Artificial Sequence
  chemically synthesized
ccagctaatttttgtatttt

SEQ ID NO: 34830 - DNA, 20 bp, Artificial Sequence
  chemically synthesized
gctaatttttgtatttttag

SEQ ID NO: 34831 - DNA, 20 bp, Artificial Sequence
  chemically synthesized
taatttttgtatttttagca

SEQ ID NO: 34832 - DNA, 20 bp, Artificial Sequence
  chemically synthesized
ttttgtatttttagcagaga

SEQ ID NO: 34833 - DNA, 20 bp, Artificial Sequence
  chemically synthesized
tttgtatttttagcagagat

SEQ ID NO: 34834 - DNA, 20 bp, Artificial Sequence
  chemically synthesized
ttgtatttttagcagagatg

SEQ ID NO: 34835 - DNA, 20 bp, Artificial Sequence
  chemically synthesized
gagatggggtttcaccattt

SEQ ID NO: 34836 - DNA, 20 bp, Artificial Sequence
  chemically synthesized
tggggtttcaccattttagc

SEQ ID NO: 34837 - DNA, 20 bp, Artificial Sequence
  chemically synthesized
tctgcccgcccccgcctccc

SEQ ID NO: 34838 - DNA, 20 bp, Artificial Sequence
  chemically synthesized
ctgcccgcccccgcctccca

SEQ ID NO: 34839 - DNA, 20 bp, Artificial Sequence
  chemically synthesized
gcccccgcctcccaaggtgc

SEQ ID NO: 34840 - DNA, 20 bp, Artificial Sequence
  chemically synthesized
cccccgcctcccaaggtgct

SEQ ID NO: 34841 - DNA, 20 bp, Artificial Sequence
  chemically synthesized
ctcccaaggtgctgggatta

SEQ ID NO: 34842 - DNA, 20 bp, Artificial Sequence
  chemically synthesized
tcccaaggtgctgggattac

SEQ ID NO: 34843 - DNA, 20 bp, Artificial Sequence
  chemically synthesized
ggtgctgggattacaggcgt

SEQ ID NO: 34844 - DNA, 20 bp, Artificial Sequence
  chemically synthesized
caggcgtgagccactgctcc

SEQ ID NO: 34845 - DNA, 20 bp, Artificial Sequence
  chemically synthesized
gccactgctcccggccctat

SEQ ID NO: 34846 - DNA, 20 bp, Artificial Sequence
  chemically synthesized
gccctatcagaaccttttct

SEQ ID NO: 34847 - DNA, 20 bp, Artificial Sequence
  chemically synthesized
agaaccttttctaagtcccc

SEQ ID NO: 34848 - DNA, 20 bp, Artificial Sequence
  chemically synthesized
ccgagctgcaacattaaatg

SEQ ID NO: 34849 - DNA, 20 bp, Artificial Sequence
  chemically synthesized
ttaaatgcagaatccctact

SEQ ID NO: 34850 - DNA, 20 bp, Artificial Sequence
  chemically synthesized
aatgcagaatccctacttag

SEQ ID NO: 34851 - DNA, 20 bp, Artificial Sequence
  chemically synthesized
atgcagaatccctacttagt

SEQ ID NO: 34852 - DNA, 20 bp, Artificial Sequence
  chemically synthesized
tgcagaatccctacttagta

SEQ ID NO: 34853 - DNA, 20 bp, Artificial Sequence
  chemically synthesized
tagggccaaaccaataaatt

SEQ ID NO: 34854 - DNA, 20 bp, Artificial Sequence
  chemically synthesized
ccattcccatgcctgttctc

SEQ ID NO: 34855 - DNA, 20 bp, Artificial Sequence
  chemically synthesized
agatttctgccaatataaat

SEQ ID NO: 34856 - DNA, 20 bp, Artificial Sequence
  chemically synthesized
ttctgccaatataaattaga

SEQ ID NO: 34857 - DNA, 20 bp, Artificial Sequence
  chemically synthesized
caatataaattagaaagctt

SEQ ID NO: 34858 - DNA, 20 bp, Artificial Sequence
  chemically synthesized
tataaattagaaagcttaag

SEQ ID NO: 34859 - DNA, 20 bp, Artificial Sequence
  chemically synthesized
gaaagcttaagcagttcttt

SEQ ID NO: 34860 - DNA, 20 bp, Artificial Sequence
  chemically synthesized
aagcttaagcagttctttta

SEQ ID NO: 34861 - DNA, 20 bp, Artificial Sequence
  chemically synthesized
gagtataatgcacctcctca

SEQ ID NO: 34862 - DNA, 20 bp, Artificial Sequence
  chemically synthesized
agtataatgcacctcctcat

SEQ ID NO: 34863 - DNA, 20 bp, Artificial Sequence
  chemically synthesized
cacactctgaacctcacctc

SEQ ID NO: 34864 - DNA, 20 bp, Artificial Sequence
  chemically synthesized
acactctgaacctcacctct

SEQ ID NO: 34865 - DNA, 20 bp, Artificial Sequence
  chemically synthesized
cactctgaacctcacctctg

SEQ ID NO: 34866 - DNA, 20 bp, Artificial Sequence
  chemically synthesized
acctcacctctggggcccgc

SEQ ID NO: 34867 - DNA, 20 bp, Artificial Sequence
  chemically synthesized
cctcacctctggggcccgca

SEQ ID NO: 34868 - DNA, 20 bp, Artificial Sequence
  chemically synthesized
tctggggcccgcaaggaatt

SEQ ID NO: 34869 - DNA, 20 bp, Artificial Sequence
  chemically synthesized
ggcccgcaaggaatttagcc

SEQ ID NO: 34870 - DNA, 20 bp, Artificial Sequence
  chemically synthesized
caaggaatttagcctagtta

SEQ ID NO: 34871 - DNA, 20 bp, Artificial Sequence
  chemically synthesized
aaggaatttagcctagttat

SEQ ID NO: 34872 - DNA, 20 bp, Artificial Sequence
  chemically synthesized
atttagcctagttataggtc

SEQ ID NO: 34873 - DNA, 20 bp, Artificial Sequence
  chemically synthesized
tagcctagttataggtctag

SEQ ID NO: 34874 - DNA, 20 bp, Artificial Sequence
  chemically synthesized
gttataggtctagaagcatt

SEQ ID NO: 34875 - DNA, 20 bp, Artificial Sequence
  chemically synthesized
ttataggtctagaagcattc

SEQ ID NO: 34876 - DNA, 20 bp, Artificial Sequence
  chemically synthesized
tataggtctagaagcattca

SEQ ID NO: 34877 - DNA, 20 bp, Artificial Sequence
  chemically synthesized
ataggtctagaagcattcag

SEQ ID NO: 34878 - DNA, 20 bp, Artificial Sequence
  chemically synthesized
ctagaagcattcaggggcat

SEQ ID NO: 34879 - DNA, 20 bp, Artificial Sequence
  chemically synthesized
tagaagcattcaggggcatt

SEQ ID NO: 34880 - DNA, 20 bp, Artificial Sequence
  chemically synthesized
agaagcattcaggggcatta

SEQ ID NO: 34881 - DNA, 20 bp, Artificial Sequence
  chemically synthesized
gaagcattcaggggcattag

SEQ ID NO: 34882 - DNA, 20 bp, Artificial Sequence
  chemically synthesized
gggcattaggggtgcctctt

SEQ ID NO: 34883 - DNA, 20 bp, Artificial Sequence
  chemically synthesized
ggcattaggggtgcctcttg

SEQ ID NO: 34884 - DNA, 20 bp, Artificial Sequence
  chemically synthesized
cattaggggtgcctcttgag

SEQ ID NO: 34885 - DNA, 20 bp, Artificial Sequence
  chemically synthesized
agaatcaacattatcttgcc

SEQ ID NO: 34886 - DNA, 20 bp, Artificial Sequence
  chemically synthesized
atcaacattatcttgcctgg

SEQ ID NO: 34887 - DNA, 20 bp, Artificial Sequence
  chemically synthesized
atcttgcctggcagctgcct

SEQ ID NO: 34888 - DNA, 20 bp, Artificial Sequence
  chemically synthesized
tcttgcctggcagctgcctc

SEQ ID NO: 34889 - DNA, 20 bp, Artificial Sequence
  chemically synthesized
cttgcctggcagctgcctca

SEQ ID NO: 34890 - DNA, 20 bp, Artificial Sequence
  chemically synthesized
gcctggcagctgcctcaggg

SEQ ID NO: 34891 - DNA, 20 bp, Artificial Sequence
  chemically synthesized
cctggcagctgcctcaggga

SEQ ID NO: 34892 - DNA, 20 bp, Artificial Sequence
  chemically synthesized
aaggccatcactgttgcctc

SEQ ID NO: 34893 - DNA, 20 bp, Artificial Sequence
  chemically synthesized
gccatcactgttgcctcaag

SEQ ID NO: 34894 - DNA, 20 bp, Artificial Sequence
  chemically synthesized
cactgttgcctcaagcagtg

SEQ ID NO: 34895 - DNA, 20 bp, Artificial Sequence
  chemically synthesized
actgttgcctcaagcagtgc

SEQ ID NO: 34896 - DNA, 20 bp, Artificial Sequence
  chemically synthesized
ctgttgcctcaagcagtgca

SEQ ID NO: 34897 - DNA, 20 bp, Artificial Sequence
  chemically synthesized
cagtgcagggtttacatcct

SEQ ID NO: 34898 - DNA, 20 bp, Artificial Sequence
  chemically synthesized
agggtttacatcctcagaca

SEQ ID NO: 34899 - DNA, 20 bp, Artificial Sequence
  chemically synthesized
gggtttacatcctcagacaa

SEQ ID NO: 34900 - DNA, 20 bp, Artificial Sequence
  chemically synthesized
tttacatcctcagacaaagg

SEQ ID NO: 34901 - DNA, 20 bp, Artificial Sequence
  chemically synthesized
catcctcagacaaaggtgga

SEQ ID NO: 34902 - DNA, 20 bp, Artificial Sequence
  chemically synthesized
atcctcagacaaaggtggaa

SEQ ID NO: 34903 - DNA, 20 bp, Artificial Sequence
  chemically synthesized
gacaaaggtggaaaggctaa

SEQ ID NO: 34904 - DNA, 20 bp, Artificial Sequence
  chemically synthesized
aaaggtggaaaggctaatgg

SEQ ID NO: 34905 - DNA, 20 bp, Artificial Sequence
  chemically synthesized
tggaaaggctaatggcagca

SEQ ID NO: 34906 - DNA, 20 bp, Artificial Sequence
  chemically synthesized
ggaaaggctaatggcagcac

SEQ ID NO: 34907 - DNA, 20 bp, Artificial Sequence
  chemically synthesized
aggctaatggcagcacgggt

SEQ ID NO: 34908 - DNA, 20 bp, Artificial Sequence
  chemically synthesized
ggctaatggcagcacgggtc

SEQ ID NO: 34909 - DNA, 20 bp, Artificial Sequence
  chemically synthesized
gctaatggcagcacgggtca

SEQ ID NO: 34910 - DNA, 20 bp, Artificial Sequence
  chemically synthesized
taatggcagcacgggtcagg

SEQ ID NO: 34911 - DNA, 20 bp, Artificial Sequence
  chemically synthesized
aatggcagcacgggtcaggg

SEQ ID NO: 34912 - DNA, 20 bp, Artificial Sequence
  chemically synthesized
atggcagcacgggtcaggga

SEQ ID NO: 34913 - DNA, 20 bp, Artificial Sequence
  chemically synthesized
tggcagcacgggtcagggag

SEQ ID NO: 34914 - DNA, 20 bp, Artificial Sequence
  chemically synthesized
ggaggggatgttaccactac

SEQ ID NO: 34915 - DNA, 20 bp, Artificial Sequence
  chemically synthesized
gaggggatgttaccactact

SEQ ID NO: 34916 - DNA, 20 bp, Artificial Sequence
  chemically synthesized
aggggatgttaccactactg

SEQ ID NO: 34917 - DNA, 20 bp, Artificial Sequence
  chemically synthesized
gatgttaccactactgggga

SEQ ID NO: 34918 - DNA, 20 bp, Artificial Sequence
  chemically synthesized
atgttaccactactggggat

SEQ ID NO: 34919 - DNA, 20 bp, Artificial Sequence
  chemically synthesized
tgttaccactactggggatg

SEQ ID NO: 34920 - DNA, 20 bp, Artificial Sequence
  chemically synthesized
gatggggaaactgtttcttc

SEQ ID NO: 34921 - DNA, 20 bp, Artificial Sequence
  chemically synthesized
aactgtttcttctggcaaaa

SEQ ID NO: 34922 - DNA, 20 bp, Artificial Sequence
  chemically synthesized
ttctggcaaaaaagtttcat

SEQ ID NO: 34923 - DNA, 20 bp, Artificial Sequence
  chemically synthesized
ctggcaaaaaagtttcatca

SEQ ID NO: 34924 - DNA, 20 bp, Artificial Sequence
  chemically synthesized
ttcatcagagttcacaaact

SEQ ID NO: 34925 - DNA, 20 bp, Artificial Sequence
  chemically synthesized
gttcacaaactcagtgtcct

SEQ ID NO: 34926 - DNA, 20 bp, Artificial Sequence
  chemically synthesized
ctcagtgtcctcagcttcat

SEQ ID NO: 34927 - DNA, 20 bp, Artificial Sequence
  chemically synthesized
tcagtgtcctcagcttcatc

SEQ ID NO: 34928 - DNA, 20 bp, Artificial Sequence
  chemically synthesized
cagtgtcctcagcttcatca

SEQ ID NO: 34929 - DNA, 20 bp, Artificial Sequence
  chemically synthesized
ctcccacacatccccactcc

SEQ ID NO: 34930 - DNA, 20 bp, Artificial Sequence
  chemically synthesized
cacatccccactccaagttc

SEQ ID NO: 34931 - DNA, 20 bp, Artificial Sequence
  chemically synthesized
acatccccactccaagttcc

SEQ ID NO: 34932 - DNA, 20 bp, Artificial Sequence
  chemically synthesized
catccccactccaagttcca

SEQ ID NO: 34933 - DNA, 20 bp, Artificial Sequence
  chemically synthesized
tccagggtcccatttttttc

SEQ ID NO: 34934 - DNA, 20 bp, Artificial Sequence
  chemically synthesized
agtcaatgccctcactttaa

SEQ ID NO: 34935 - DNA, 20 bp, Artificial Sequence
  chemically synthesized
tcactttaacagtaaacacc

SEQ ID NO: 34936 - DNA, 20 bp, Artificial Sequence
  chemically synthesized
tttaacagtaaacacctggc

SEQ ID NO: 34937 - DNA, 20 bp, Artificial Sequence
  chemically synthesized
ttaacagtaaacacctggca

SEQ ID NO: 34938 - DNA, 20 bp, Artificial Sequence
  chemically synthesized
tgtgcatgcacctcttgttg

SEQ ID NO: 34939 - DNA, 20 bp, Artificial Sequence
  chemically synthesized
atgcacctcttgttgcagat

SEQ ID NO: 34940 - DNA, 20 bp, Artificial Sequence
  chemically synthesized
atcagctactcgcatgataa

SEQ ID NO: 34941 - DNA, 20 bp, Artificial Sequence
  chemically synthesized
caatttcaactctttctcta

SEQ ID NO: 34942 - DNA, 20 bp, Artificial Sequence
  chemically synthesized
aatttcaactctttctctac

SEQ ID NO: 34943 - DNA, 20 bp, Artificial Sequence
  chemically synthesized
tttcaactctttctctacag

SEQ ID NO: 34944 - DNA, 20 bp, Artificial Sequence
  chemically synthesized
caggagttaaaactctcatt

SEQ ID NO: 34945 - DNA, 20 bp, Artificial Sequence
  chemically synthesized
aggagttaaaactctcattc

SEQ ID NO: 34946 - DNA, 20 bp, Artificial Sequence
  chemically synthesized
ggagttaaaactctcattca

SEQ ID NO: 34947 - DNA, 20 bp, Artificial Sequence
  chemically synthesized
actctcattcagggcaatct

SEQ ID NO: 34948 - DNA, 20 bp, Artificial Sequence
  chemically synthesized
ctcattcagggcaatcttag

SEQ ID NO: 34949 - DNA, 20 bp, Artificial Sequence
  chemically synthesized
gggcaatcttagcagatttg

SEQ ID NO: 34950 - DNA, 20 bp, Artificial Sequence
  chemically synthesized
atcttagcagatttgtggct

SEQ ID NO: 34951 - DNA, 20 bp, Artificial Sequence
  chemically synthesized
tggctcagtatctgcttctg

SEQ ID NO: 34952 - DNA, 20 bp, Artificial Sequence
  chemically synthesized
ggctcagtatctgcttctga

SEQ ID NO: 34953 - DNA, 20 bp, Artificial Sequence
  chemically synthesized
tcagtatctgcttctgaagg

SEQ ID NO: 34954 - DNA, 20 bp, Artificial Sequence
  chemically synthesized
cagtatctgcttctgaaggt

SEQ ID NO: 34955 - DNA, 20 bp, Artificial Sequence
  chemically synthesized
gtatctgcttctgaaggtgg

SEQ ID NO: 34956 - DNA, 20 bp, Artificial Sequence
  chemically synthesized
ctgcttctgaaggtgggaga

SEQ ID NO: 34957 - DNA, 20 bp, Artificial Sequence
  chemically synthesized
aggtgggagacagatcccct

SEQ ID NO: 34958 - DNA, 20 bp, Artificial Sequence
  chemically synthesized
ttttctttcatctctttctc

SEQ ID NO: 34959 - DNA, 20 bp, Artificial Sequence
  chemically synthesized
ttctttcatctctttctcca

SEQ ID NO: 34960 - DNA, 20 bp, Artificial Sequence
  chemically synthesized
atctctttctccagagaact

SEQ ID NO: 34961 - DNA, 20 bp, Artificial Sequence
  chemically synthesized
tctctttctccagagaactt

SEQ ID NO: 34962 - DNA, 20 bp, Artificial Sequence
  chemically synthesized
tctttctccagagaacttag

SEQ ID NO: 34963 - DNA, 20 bp, Artificial Sequence
  chemically synthesized
accaacttcattatgttcct

SEQ ID NO: 34964 - DNA, 20 bp, Artificial Sequence
  chemically synthesized
gttccttggttctccacata

SEQ ID NO: 34965 - DNA, 20 bp, Artificial Sequence
  chemically synthesized
tggttctccacatatagtca

SEQ ID NO: 34966 - DNA, 20 bp, Artificial Sequence
  chemically synthesized
ggttctccacatatagtcaa

SEQ ID NO: 34967 - DNA, 20 bp, Artificial Sequence
  chemically synthesized
atagtcaaaggtattatgta

SEQ ID NO: 34968 - DNA, 20 bp, Artificial Sequence
  chemically synthesized
agtcaaaggtattatgtata

SEQ ID NO: 34969 - DNA, 20 bp, Artificial Sequence
  chemically synthesized
ctaaactccttgcctctcat

SEQ ID NO: 34970 - DNA, 20 bp, Artificial Sequence
  chemically synthesized
gcctctcataagtgatgaat

SEQ ID NO: 34971 - DNA, 20 bp, Artificial Sequence
  chemically synthesized
tctcataagtgatgaatcag

SEQ ID NO: 34972 - DNA, 20 bp, Artificial Sequence
  chemically synthesized
gcataactctctaaacaatt

SEQ ID NO: 34973 - DNA, 20 bp, Artificial Sequence
  chemically synthesized
cataactctctaaacaattc

SEQ ID NO: 34974 - DNA, 20 bp, Artificial Sequence
  chemically synthesized
ctctctaaacaattcaggcc

SEQ ID NO: 34975 - DNA, 20 bp, Artificial Sequence
  chemically synthesized
caattcaggccaagtactat

SEQ ID NO: 34976 - DNA, 20 bp, Artificial Sequence
  chemically synthesized
atcagtgttctccatactat

SEQ ID NO: 34977 - DNA, 20 bp, Artificial Sequence
  chemically synthesized
agtgttctccatactattag

SEQ ID NO: 34978 - DNA, 20 bp, Artificial Sequence
  chemically synthesized
gttctccatactattagaag

SEQ ID NO: 34979 - DNA, 20 bp, Artificial Sequence
  chemically synthesized
tctccatactattagaagta

SEQ ID NO: 34980 - DNA, 20 bp, Artificial Sequence
  chemically synthesized
actattagaagtagagtcct

SEQ ID NO: 34981 - DNA, 20 bp, Artificial Sequence
  chemically synthesized
gtagagtccttagcattttt

SEQ ID NO: 34982 - DNA, 20 bp, Artificial Sequence
  chemically synthesized
tttggtctaatcatattaat

SEQ ID NO: 34983 - DNA, 20 bp, Artificial Sequence
  chemically synthesized
tcatattaatcagccaacac

SEQ ID NO: 34984 - DNA, 20 bp, Artificial Sequence
  chemically synthesized
tattaatcagccaacaccag

SEQ ID NO: 34985 - DNA, 20 bp, Artificial Sequence
  chemically synthesized
agaagtcccaaaaccaatga

SEQ ID NO: 34986 - DNA, 20 bp, Artificial Sequence
  chemically synthesized
tccttaatattctgttcctc

SEQ ID NO: 34987 - DNA, 20 bp, Artificial Sequence
  chemically synthesized
tgttcctcaagaaccacttc

SEQ ID NO: 34988 - DNA, 20 bp, Artificial Sequence
  chemically synthesized
tctggtatgaaaatctgtat

SEQ ID NO: 34989 - DNA, 20 bp, Artificial Sequence
  chemically synthesized
gtatgaaaatctgtattagt

SEQ ID NO: 34990 - DNA, 20 bp, Artificial Sequence
  chemically synthesized
tatgaaaatctgtattagtc

SEQ ID NO: 34991 - DNA, 20 bp, Artificial Sequence
  chemically synthesized
atgaaaatctgtattagtcg

SEQ ID NO: 34992 - DNA, 20 bp, Artificial Sequence
  chemically synthesized
ctgtattagtcggggttctc

SEQ ID NO: 34993 - DNA, 20 bp, Artificial Sequence
  chemically synthesized
gtattagtcggggttctcta

SEQ ID NO: 34994 - DNA, 20 bp, Artificial Sequence
  chemically synthesized
tattagtcggggttctctag

SEQ ID NO: 34995 - DNA, 20 bp, Artificial Sequence
  chemically synthesized
attagtcggggttctctaga

SEQ ID NO: 34996 - DNA, 20 bp, Artificial Sequence
  chemically synthesized
gtcggggttctctagaggga

SEQ ID NO: 34997 - DNA, 20 bp, Artificial Sequence
  chemically synthesized
ctctagagggacagaactaa

SEQ ID NO: 34998 - DNA, 20 bp, Artificial Sequence
  chemically synthesized
tctagagggacagaactaat

SEQ ID NO: 34999 - DNA, 20 bp, Artificial Sequence
  chemically synthesized
tagagggacagaactaatag

SEQ ID NO: 35000 - DNA, 20 bp, Artificial Sequence
  chemically synthesized
gattatatatatatatatat

SEQ ID NO: 35001 - DNA, 20 bp, Artificial Sequence
  chemically synthesized
ttatatatatatatatatga

SEQ ID NO: 35002 - DNA, 20 bp, Artificial Sequence
  chemically synthesized
atatatatatatatatgaga

SEQ ID NO: 35003 - DNA, 20 bp, Artificial Sequence
  chemically synthesized
atatatatatatatgagaga

SEQ ID NO: 35004 - DNA, 20 bp, Artificial Sequence
  chemically synthesized
atatatatatatgagagaga

SEQ ID NO: 35005 - DNA, 20 bp, Artificial Sequence
  chemically synthesized
atatatatatgagagagaga

SEQ ID NO: 35006 - DNA, 20 bp, Artificial Sequence
  chemically synthesized
atatatatgagagagagaga

SEQ ID NO: 35007 - DNA, 20 bp, Artificial Sequence
  chemically synthesized
atatatgagagagagagaga

SEQ ID NO: 35008 - DNA, 20 bp, Artificial Sequence
  chemically synthesized
atatgagagagagagagaga

SEQ ID NO: 35009 - DNA, 20 bp, Artificial Sequence
  chemically synthesized
tatgtatatatgtgtatata

SEQ ID NO: 35010 - DNA, 20 bp, Artificial Sequence
  chemically synthesized
tatatatgtgtatatatagt

SEQ ID NO: 35011 - DNA, 20 bp, Artificial Sequence
  chemically synthesized
agtatacctatatctatcta

SEQ ID NO: 35012 - DNA, 20 bp, Artificial Sequence
  chemically synthesized
cctatatctatctatagata

SEQ ID NO: 35013 - DNA, 20 bp, Artificial Sequence
  chemically synthesized
gatatagatatactcacaca

SEQ ID NO: 35014 - DNA, 20 bp, Artificial Sequence
  chemically synthesized
atatagatatactcacacaa

SEQ ID NO: 35015 - DNA, 20 bp, Artificial Sequence
  chemically synthesized
tatagatatactcacacaaa

SEQ ID NO: 35016 - DNA, 20 bp, Artificial Sequence
  chemically synthesized
atagatatactcacacaaag

SEQ ID NO: 35017 - DNA, 20 bp, Artificial Sequence
  chemically synthesized
agatatactcacacaaaggg

SEQ ID NO: 35018 - DNA, 20 bp, Artificial Sequence
  chemically synthesized
cacacaaaggggagcttatt

SEQ ID NO: 35019 - DNA, 20 bp, Artificial Sequence
  chemically synthesized
acaaaggggagcttattaag

SEQ ID NO: 35020 - DNA, 20 bp, Artificial Sequence
  chemically synthesized
attaagtggtattaactcac

SEQ ID NO: 35021 - DNA, 20 bp, Artificial Sequence
  chemically synthesized
gtattaactcacaagattac

SEQ ID NO: 35022 - DNA, 20 bp, Artificial Sequence
  chemically synthesized
tattaactcacaagattaca

SEQ ID NO: 35023 - DNA, 20 bp, Artificial Sequence
  chemically synthesized
aagattacaaggtcccataa

SEQ ID NO: 35024 - DNA, 20 bp, Artificial Sequence
  chemically synthesized
agattacaaggtcccataat

SEQ ID NO: 35025 - DNA, 20 bp, Artificial Sequence
  chemically synthesized
taataggccacctgcaatct

SEQ ID NO: 35026 - DNA, 20 bp, Artificial Sequence
  chemically synthesized
aataggccacctgcaatctg

SEQ ID NO: 35027 - DNA, 20 bp, Artificial Sequence
  chemically synthesized
taggccacctgcaatctgag

SEQ ID NO: 35028 - DNA, 20 bp, Artificial Sequence
  chemically synthesized
ccacctgcaatctgaggagc

SEQ ID NO: 35029 - DNA, 20 bp, Artificial Sequence
  chemically synthesized
cacctgcaatctgaggagca

SEQ ID NO: 35030 - DNA, 20 bp, Artificial Sequence
  chemically synthesized
ctgcaatctgaggagcaagg

SEQ ID NO: 35031 - DNA, 20 bp, Artificial Sequence
  chemically synthesized
aatctgaggagcaaggaaga

SEQ ID NO: 35032 - DNA, 20 bp, Artificial Sequence
  chemically synthesized
aggagcaaggaagacagtcc

SEQ ID NO: 35033 - DNA, 20 bp, Artificial Sequence
  chemically synthesized
ggaagacagtccaagtccca

SEQ ID NO: 35034 - DNA, 20 bp, Artificial Sequence
  chemically synthesized
cagtccaagtcccacagctg

SEQ ID NO: 35035 - DNA, 20 bp, Artificial Sequence
  chemically synthesized
agtcccacagctgaagaact

SEQ ID NO: 35036 - DNA, 20 bp, Artificial Sequence
  chemically synthesized
tcccacagctgaagaacttg

SEQ ID NO: 35037 - DNA, 20 bp, Artificial Sequence
  chemically synthesized
gaacttggagtccgatgttc

SEQ ID NO: 35038 - DNA, 20 bp, Artificial Sequence
  chemically synthesized
acttggagtccgatgttcaa

SEQ ID NO: 35039 - DNA, 20 bp, Artificial Sequence
  chemically synthesized
tggagtccgatgttcaagag

SEQ ID NO: 35040 - DNA, 20 bp, Artificial Sequence
  chemically synthesized
ggagtccgatgttcaagagc

SEQ ID NO: 35041 - DNA, 20 bp, Artificial Sequence
  chemically synthesized
gtccgatgttcaagagcagg

SEQ ID NO: 35042 - DNA, 20 bp, Artificial Sequence
  chemically synthesized
tccgatgttcaagagcagga

SEQ ID NO: 35043 - DNA, 20 bp, Artificial Sequence
  chemically synthesized
gttcaagagcaggaaggatc

SEQ ID NO: 35044 - DNA, 20 bp, Artificial Sequence
  chemically synthesized
agagcaggaaggatccagca

SEQ ID NO: 35045 - DNA, 20 bp, Artificial Sequence
  chemically synthesized
gagcaggaaggatccagcac

SEQ ID NO: 35046 - DNA, 20 bp, Artificial Sequence
  chemically synthesized
gcaggaaggatccagcacag

SEQ ID NO: 35047 - DNA, 20 bp, Artificial Sequence
  chemically synthesized
gaaggatccagcacaggaga

SEQ ID NO: 35048 - DNA, 20 bp, Artificial Sequence
  chemically synthesized
tccagcacaggagaaagatg

SEQ ID NO: 35049 - DNA, 20 bp, Artificial Sequence
  chemically synthesized
ccagcacaggagaaagatgt

SEQ ID NO: 35050 - DNA, 20 bp, Artificial Sequence
  chemically synthesized
cacaggagaaagatgtaggc

SEQ ID NO: 35051 - DNA, 20 bp, Artificial Sequence
  chemically synthesized
acaggagaaagatgtaggct

SEQ ID NO: 35052 - DNA, 20 bp, Artificial Sequence
  chemically synthesized
aggagaaagatgtaggctgg

SEQ ID NO: 35053 - DNA, 20 bp, Artificial Sequence
  chemically synthesized
ggagaaagatgtaggctggg

SEQ ID NO: 35054 - DNA, 20 bp, Artificial Sequence
  chemically synthesized
aagatgtaggctgggaggct

SEQ ID NO: 35055 - DNA, 20 bp, Artificial Sequence
  chemically synthesized
tgtaggctgggaggctaagc

SEQ ID NO: 35056 - DNA, 20 bp, Artificial Sequence
  chemically synthesized
gctgggaggctaagccagtc

SEQ ID NO: 35057 - DNA, 20 bp, Artificial Sequence
  chemically synthesized
gcctttttacatttttctgc

SEQ ID NO: 35058 - DNA, 20 bp, Artificial Sequence
  chemically synthesized
tttctgccagctttatattc

SEQ ID NO: 35059 - DNA, 20 bp, Artificial Sequence
  chemically synthesized
agctttatattctggctcta

SEQ ID NO: 35060 - DNA, 20 bp, Artificial Sequence
  chemically synthesized
tatattctggctctacagct

SEQ ID NO: 35061 - DNA, 20 bp, Artificial Sequence
  chemically synthesized
atattctggctctacagctt

SEQ ID NO: 35062 - DNA, 20 bp, Artificial Sequence
  chemically synthesized
tattctggctctacagcttg

SEQ ID NO: 35063 - DNA, 20 bp, Artificial Sequence
  chemically synthesized
attctggctctacagcttgg

SEQ ID NO: 35064 - DNA, 20 bp, Artificial Sequence
  chemically synthesized
ctggctctacagcttggggg

SEQ ID NO: 35065 - DNA, 20 bp, Artificial Sequence
  chemically synthesized
gctctacagcttgggggcag

SEQ ID NO: 35066 - DNA, 20 bp, Artificial Sequence
  chemically synthesized
ctctacagcttgggggcagc

SEQ ID NO: 35067 - DNA, 20 bp, Artificial Sequence
  chemically synthesized
tctacagcttgggggcagca

SEQ ID NO: 35068 - DNA, 20 bp, Artificial Sequence
  chemically synthesized
ctacagcttgggggcagcag

SEQ ID NO: 35069 - DNA, 20 bp, Artificial Sequence
  chemically synthesized
cagcttgggggcagcagggg

SEQ ID NO: 35070 - DNA, 20 bp, Artificial Sequence
  chemically synthesized
agcttgggggcagcaggggc

SEQ ID NO: 35071 - DNA, 20 bp, Artificial Sequence
  chemically synthesized
gcttgggggcagcaggggca

SEQ ID NO: 35072 - DNA, 20 bp, Artificial Sequence
  chemically synthesized
cttgggggcagcaggggcag

SEQ ID NO: 35073 - DNA, 20 bp, Artificial Sequence
  chemically synthesized
ggcagcaggggcaggggcct

SEQ ID NO: 35074 - DNA, 20 bp, Artificial Sequence
  chemically synthesized
gcagcaggggcaggggcctc

SEQ ID NO: 35075 - DNA, 20 bp, Artificial Sequence
  chemically synthesized
cagcaggggcaggggcctca

SEQ ID NO: 35076 - DNA, 20 bp, Artificial Sequence
  chemically synthesized
caggggcctcagggtgcttg

SEQ ID NO: 35077 - DNA, 20 bp, Artificial Sequence
  chemically synthesized
aggggcctcagggtgcttgc

SEQ ID NO: 35078 - DNA, 20 bp, Artificial Sequence
  chemically synthesized
ggggcctcagggtgcttgca

SEQ ID NO: 35079 - DNA, 20 bp, Artificial Sequence
  chemically synthesized
tgcttgcagggatgacacac

SEQ ID NO: 35080 - DNA, 20 bp, Artificial Sequence
  chemically synthesized
acacactggcctcttttcca

SEQ ID NO: 35081 - DNA, 20 bp, Artificial Sequence
  chemically synthesized
cacactggcctcttttccat

SEQ ID NO: 35082 - DNA, 20 bp, Artificial Sequence
  chemically synthesized
acactggcctcttttccata

SEQ ID NO: 35083 - DNA, 20 bp, Artificial Sequence
  chemically synthesized
ctggcctcttttccataggg

SEQ ID NO: 35084 - DNA, 20 bp, Artificial Sequence
  chemically synthesized
cctcttttccatagggtggc

SEQ ID NO: 35085 - DNA, 20 bp, Artificial Sequence
  chemically synthesized
ctcttttccatagggtggct

SEQ ID NO: 35086 - DNA, 20 bp, Artificial Sequence
  chemically synthesized
tcttttccatagggtggctg

SEQ ID NO: 35087 - DNA, 20 bp, Artificial Sequence
  chemically synthesized
atagggtggctggggcacac

SEQ ID NO: 35088 - DNA, 20 bp, Artificial Sequence
  chemically synthesized
tagggtggctggggcacact

SEQ ID NO: 35089 - DNA, 20 bp, Artificial Sequence
  chemically synthesized
agggtggctggggcacactg

SEQ ID NO: 35090 - DNA, 20 bp, Artificial Sequence
  chemically synthesized
gctggggcacactggggtgt

SEQ ID NO: 35091 - DNA, 20 bp, Artificial Sequence
  chemically synthesized
ggcacactggggtgtgagta

SEQ ID NO: 35092 - DNA, 20 bp, Artificial Sequence
  chemically synthesized
tggggtgtgagtaaagcact

SEQ ID NO: 35093 - DNA, 20 bp, Artificial Sequence
  chemically synthesized
ggggtgtgagtaaagcactc

SEQ ID NO: 35094 - DNA, 20 bp, Artificial Sequence
  chemically synthesized
caggatcttttttccttccc

SEQ ID NO: 35095 - DNA, 20 bp, Artificial Sequence
  chemically synthesized
cttttttccttccctagtcc

SEQ ID NO: 35096 - DNA, 20 bp, Artificial Sequence
  chemically synthesized
ttccttccctagtccaagta

SEQ ID NO: 35097 - DNA, 20 bp, Artificial Sequence
  chemically synthesized
ttccctagtccaagtacagc

SEQ ID NO: 35098 - DNA, 20 bp, Artificial Sequence
  chemically synthesized
tccctagtccaagtacagca

SEQ ID NO: 35099 - DNA, 20 bp, Artificial Sequence
  chemically synthesized
ccctagtccaagtacagcaa

SEQ ID NO: 35100 - DNA, 20 bp, Artificial Sequence
  chemically synthesized
tagtccaagtacagcaaggg

SEQ ID NO: 35101 - DNA, 20 bp, Artificial Sequence
  chemically synthesized
cagcaagggcagtatgactg

SEQ ID NO: 35102 - DNA, 20 bp, Artificial Sequence
  chemically synthesized
gggcagtatgactgcagtgt

SEQ ID NO: 35103 - DNA, 20 bp, Artificial Sequence
  chemically synthesized
cagtatgactgcagtgttag

SEQ ID NO: 35104 - DNA, 20 bp, Artificial Sequence
  chemically synthesized
tatgactgcagtgttagtgg

SEQ ID NO: 35105 - DNA, 20 bp, Artificial Sequence
  chemically synthesized
gactgcagtgttagtggcag

SEQ ID NO: 35106 - DNA, 20 bp, Artificial Sequence
  chemically synthesized
actgcagtgttagtggcaga

SEQ ID NO: 35107 - DNA, 20 bp, Artificial Sequence
  chemically synthesized
gttagtggcagaaggacttt

SEQ ID NO: 35108 - DNA, 20 bp, Artificial Sequence
  chemically synthesized
gaaggactttcagtcacctc

SEQ ID NO: 35109 - DNA, 20 bp, Artificial Sequence
  chemically synthesized
aaggactttcagtcacctct

SEQ ID NO: 35110 - DNA, 20 bp, Artificial Sequence
  chemically synthesized
ggactttcagtcacctctgg

SEQ ID NO: 35111 - DNA, 20 bp, Artificial Sequence
  chemically synthesized
agcttcaccccacaaaaaca

SEQ ID NO: 35112 - DNA, 20 bp, Artificial Sequence
  chemically synthesized
cttcaccccacaaaaacaca

SEQ ID NO: 35113 - DNA, 20 bp, Artificial Sequence
  chemically synthesized
ccccacaaaaacacagagtg

SEQ ID NO: 35114 - DNA, 20 bp, Artificial Sequence
  chemically synthesized
acaaaaacacagagtgcagc

SEQ ID NO: 35115 - DNA, 20 bp, Artificial Sequence
  chemically synthesized
aaaacacagagtgcagccag

SEQ ID NO: 35116 - DNA, 20 bp, Artificial Sequence
  chemically synthesized
gccagtggaaatgttcaact

SEQ ID NO: 35117 - DNA, 20 bp, Artificial Sequence
  chemically synthesized
ggaaatgttcaactgagttc

SEQ ID NO: 35118 - DNA, 20 bp, Artificial Sequence
  chemically synthesized
gaaatgttcaactgagttcg

SEQ ID NO: 35119 - DNA, 20 bp, Artificial Sequence
  chemically synthesized
agttcgaggtgcctgcactg

SEQ ID NO: 35120 - DNA, 20 bp, Artificial Sequence
  chemically synthesized
gttcgaggtgcctgcactgt

SEQ ID NO: 35121 - DNA, 20 bp, Artificial Sequence
  chemically synthesized
ggtgcctgcactgtgggccc

SEQ ID NO: 35122 - DNA, 20 bp, Artificial Sequence
  chemically synthesized
cctgcactgtgggcccaagc

SEQ ID NO: 35123 - DNA, 20 bp, Artificial Sequence
  chemically synthesized
ctgcactgtgggcccaagcc

SEQ ID NO: 35124 - DNA, 20 bp, Artificial Sequence
  chemically synthesized
gcactgtgggcccaagccag

SEQ ID NO: 35125 - DNA, 20 bp, Artificial Sequence
  chemically synthesized
cccaagccaggagccttgcc

SEQ ID NO: 35126 - DNA, 20 bp, Artificial Sequence
  chemically synthesized
gccaggagccttgcctggtg

SEQ ID NO: 35127 - DNA, 20 bp, Artificial Sequence
  chemically synthesized
caggagccttgcctggtgaa

SEQ ID NO: 35128 - DNA, 20 bp, Artificial Sequence
  chemically synthesized
gagccttgcctggtgaagag

SEQ ID NO: 35129 - DNA, 20 bp, Artificial Sequence
  chemically synthesized
ccttgcctggtgaagagtag

SEQ ID NO: 35130 - DNA, 20 bp, Artificial Sequence
  chemically synthesized
cttgcctggtgaagagtagc

SEQ ID NO: 35131 - DNA, 20 bp, Artificial Sequence
  chemically synthesized
tggtgaagagtagcaggtga

SEQ ID NO: 35132 - DNA, 20 bp, Artificial Sequence
  chemically synthesized
agtagcaggtgaaagctcac

SEQ ID NO: 35133 - DNA, 20 bp, Artificial Sequence
  chemically synthesized
gcaggtgaaagctcacaaga

SEQ ID NO: 35134 - DNA, 20 bp, Artificial Sequence
  chemically synthesized
aggtgaaagctcacaagaaa

SEQ ID NO: 35135 - DNA, 20 bp, Artificial Sequence
  chemically synthesized
agctcacaagaaagagaaac

SEQ ID NO: 35136 - DNA, 20 bp, Artificial Sequence
  chemically synthesized
attctttccctgctgtgtgc

SEQ ID NO: 35137 - DNA, 20 bp, Artificial Sequence
  chemically synthesized
tctttccctgctgtgtgctg

SEQ ID NO: 35138 - DNA, 20 bp, Artificial Sequence
  chemically synthesized
ctttccctgctgtgtgctgg

SEQ ID NO: 35139 - DNA, 20 bp, Artificial Sequence
  chemically synthesized
ctgctgtgtgctggaggtgt

SEQ ID NO: 35140 - DNA, 20 bp, Artificial Sequence
  chemically synthesized
tgctgtgtgctggaggtgtc

SEQ ID NO: 35141 - DNA, 20 bp, Artificial Sequence
  chemically synthesized
gctgtgtgctggaggtgtca

SEQ ID NO: 35142 - DNA, 20 bp, Artificial Sequence
  chemically synthesized
gtgtgctggaggtgtcaggg

SEQ ID NO: 35143 - DNA, 20 bp, Artificial Sequence
  chemically synthesized
tgctggaggtgtcagggaag

SEQ ID NO: 35144 - DNA, 20 bp, Artificial Sequence
  chemically synthesized
ggaggtgtcagggaagtggc

SEQ ID NO: 35145 - DNA, 20 bp, Artificial Sequence
  chemically synthesized
gaggtgtcagggaagtggcc

SEQ ID NO: 35146 - DNA, 20 bp, Artificial Sequence
  chemically synthesized
ggccaggtcccttctttctc

SEQ ID NO: 35147 - DNA, 20 bp, Artificial Sequence
  chemically synthesized
gtcccttctttctcaagccc

SEQ ID NO: 35148 - DNA, 20 bp, Artificial Sequence
  chemically synthesized
tcccttctttctcaagccca

SEQ ID NO: 35149 - DNA, 20 bp, Artificial Sequence
  chemically synthesized
cccttctttctcaagcccaa

SEQ ID NO: 35150 - DNA, 20 bp, Artificial Sequence
  chemically synthesized
ctcaagcccaagggcattaa

SEQ ID NO: 35151 - DNA, 20 bp, Artificial Sequence
  chemically synthesized
aagcccaagggcattaacgg

SEQ ID NO: 35152 - DNA, 20 bp, Artificial Sequence
  chemically synthesized
cattaacggtggtactgctg

SEQ ID NO: 35153 - DNA, 20 bp, Artificial Sequence
  chemically synthesized
tggtactgctgcagctgaaa

SEQ ID NO: 35154 - DNA, 20 bp, Artificial Sequence
  chemically synthesized
tactgctgcagctgaaatgg

SEQ ID NO: 35155 - DNA, 20 bp, Artificial Sequence
  chemically synthesized
ctgctgcagctgaaatggca

SEQ ID NO: 35156 - DNA, 20 bp, Artificial Sequence
  chemically synthesized
tgctgcagctgaaatggcag

SEQ ID NO: 35157 - DNA, 20 bp, Artificial Sequence
  chemically synthesized
gctgcagctgaaatggcaga

SEQ ID NO: 35158 - DNA, 20 bp, Artificial Sequence
  chemically synthesized
ctgcagctgaaatggcagag

SEQ ID NO: 35159 - DNA, 20 bp, Artificial Sequence
  chemically synthesized
ctgaaatggcagaggggctg

SEQ ID NO: 35160 - DNA, 20 bp, Artificial Sequence
  chemically synthesized
tgaaatggcagaggggctgt

SEQ ID NO: 35161 - DNA, 20 bp, Artificial Sequence
  chemically synthesized
aggggctgtgggttgtctct

SEQ ID NO: 35162 - DNA, 20 bp, Artificial Sequence
  chemically synthesized
tgtctcttggatttcctccc

SEQ ID NO: 35163 - DNA, 20 bp, Artificial Sequence
  chemically synthesized
tctcttggatttcctcccca

SEQ ID NO: 35164 - DNA, 20 bp, Artificial Sequence
  chemically synthesized
cttggatttcctccccagag

SEQ ID NO: 35165 - DNA, 20 bp, Artificial Sequence
  chemically synthesized
atttcctccccagagaagca

SEQ ID NO: 35166 - DNA, 20 bp, Artificial Sequence
  chemically synthesized
ttcctccccagagaagcaca

SEQ ID NO: 35167 - DNA, 20 bp, Artificial Sequence
  chemically synthesized
ccaacactgactaaaatgtt

SEQ ID NO: 35168 - DNA, 20 bp, Artificial Sequence
  chemically synthesized
caacactgactaaaatgttc

SEQ ID NO: 35169 - DNA, 20 bp, Artificial Sequence
  chemically synthesized
cactgactaaaatgttcagg

SEQ ID NO: 35170 - DNA, 20 bp, Artificial Sequence
  chemically synthesized
actgactaaaatgttcaggc

SEQ ID NO: 35171 - DNA, 20 bp, Artificial Sequence
  chemically synthesized
ctgactaaaatgttcaggca

SEQ ID NO: 35172 - DNA, 20 bp, Artificial Sequence
  chemically synthesized
ctaaaatgttcaggcagggc

SEQ ID NO: 35173 - DNA, 20 bp, Artificial Sequence
  chemically synthesized
taaaatgttcaggcagggcc

SEQ ID NO: 35174 - DNA, 20 bp, Artificial Sequence
  chemically synthesized
aaaatgttcaggcagggcca

SEQ ID NO: 35175 - DNA, 20 bp, Artificial Sequence
  chemically synthesized
atgttcaggcagggccaggg

SEQ ID NO: 35176 - DNA, 20 bp, Artificial Sequence
  chemically synthesized
cagggtggctgtgctctgcc

SEQ ID NO: 35177 - DNA, 20 bp, Artificial Sequence
  chemically synthesized
gtggctgtgctctgcccagt

SEQ ID NO: 35178 - DNA, 20 bp, Artificial Sequence
  chemically synthesized
tggctgtgctctgcccagtg

SEQ ID NO: 35179 - DNA, 20 bp, Artificial Sequence
  chemically synthesized
gtgctctgcccagtgaggaa

SEQ ID NO: 35180 - DNA, 20 bp, Artificial Sequence
  chemically synthesized
ctctgcccagtgaggaatag

SEQ ID NO: 35181 - DNA, 20 bp, Artificial Sequence
  chemically synthesized
tctgcccagtgaggaatagt

SEQ ID NO: 35182 - DNA, 20 bp, Artificial Sequence
  chemically synthesized
ctgcccagtgaggaatagta

SEQ ID NO: 35183 - DNA, 20 bp, Artificial Sequence
  chemically synthesized
tgcccagtgaggaatagtag

SEQ ID NO: 35184 - DNA, 20 bp, Artificial Sequence
  chemically synthesized
ccagtgaggaatagtagggg

SEQ ID NO: 35185 - DNA, 20 bp, Artificial Sequence
  chemically synthesized
cagtgaggaatagtaggggc

SEQ ID NO: 35186 - DNA, 20 bp, Artificial Sequence
  chemically synthesized
agtgaggaatagtaggggca

SEQ ID NO: 35187 - DNA, 20 bp, Artificial Sequence
  chemically synthesized
ggaatagtaggggcagggac

SEQ ID NO: 35188 - DNA, 20 bp, Artificial Sequence
  chemically synthesized
agtaggggcagggaccagtg

SEQ ID NO: 35189 - DNA, 20 bp, Artificial Sequence
  chemically synthesized
gcagggaccagtgcagaaaa

SEQ ID NO: 35190 - DNA, 20 bp, Artificial Sequence
  chemically synthesized
gaccagtgcagaaaacagtg

SEQ ID NO: 35191 - DNA, 20 bp, Artificial Sequence
  chemically synthesized
cagtgtggccacttttccat

SEQ ID NO: 35192 - DNA, 20 bp, Artificial Sequence
  chemically synthesized
agtgtggccacttttccata

SEQ ID NO: 35193 - DNA, 20 bp, Artificial Sequence
  chemically synthesized
gtggccacttttccataagg

SEQ ID NO: 35194 - DNA, 20 bp, Artificial Sequence
  chemically synthesized
ataaggcagctacactgtgc

SEQ ID NO: 35195 - DNA, 20 bp, Artificial Sequence
  chemically synthesized
aaggcagctacactgtgctg

SEQ ID NO: 35196 - DNA, 20 bp, Artificial Sequence
  chemically synthesized
aggcagctacactgtgctgg

SEQ ID NO: 35197 - DNA, 20 bp, Artificial Sequence
  chemically synthesized
acactgtgctggaggtccgt

SEQ ID NO: 35198 - DNA, 20 bp, Artificial Sequence
  chemically synthesized
actgtgctggaggtccgtga

SEQ ID NO: 35199 - DNA, 20 bp, Artificial Sequence
  chemically synthesized
ggaggtccgtgagagtcctg

SEQ ID NO: 35200 - DNA, 20 bp, Artificial Sequence
  chemically synthesized
gaagctcctcgctccctcct

SEQ ID NO: 35201 - DNA, 20 bp, Artificial Sequence
  chemically synthesized
tgagcccatactttaatctc

SEQ ID NO: 35202 - DNA, 20 bp, Artificial Sequence
  chemically synthesized
agcccatactttaatctcaa

SEQ ID NO: 35203 - DNA, 20 bp, Artificial Sequence
  chemically synthesized
tactttaatctcaagagttt

SEQ ID NO: 35204 - DNA, 20 bp, Artificial Sequence
  chemically synthesized
tctcaagagtttgagataaa

SEQ ID NO: 35205 - DNA, 20 bp, Artificial Sequence
  chemically synthesized
caagagtttgagataaacag

SEQ ID NO: 35206 - DNA, 20 bp, Artificial Sequence
  chemically synthesized
agtttgagataaacagtggt

SEQ ID NO: 35207 - DNA, 20 bp, Artificial Sequence
  chemically synthesized
gtttgagataaacagtggta

SEQ ID NO: 35208 - DNA, 20 bp, Artificial Sequence
  chemically synthesized
tgagataaacagtggtaagg

SEQ ID NO: 35209 - DNA, 20 bp, Artificial Sequence
  chemically synthesized
ataaacagtggtaaggaaga

SEQ ID NO: 35210 - DNA, 20 bp, Artificial Sequence
  chemically synthesized
tggtaaggaagaaagtacaa

SEQ ID NO: 35211 - DNA, 20 bp, Artificial Sequence
  chemically synthesized
ggtaaggaagaaagtacaac

SEQ ID NO: 35212 - DNA, 20 bp, Artificial Sequence
  chemically synthesized
ggaagaaagtacaacgggta

SEQ ID NO: 35213 - DNA, 20 bp, Artificial Sequence
  chemically synthesized
cgggtacggctaatgaaacc

SEQ ID NO: 35214 - DNA, 20 bp, Artificial Sequence
  chemically synthesized
gggtacggctaatgaaaccc

SEQ ID NO: 35215 - DNA, 20 bp, Artificial Sequence
  chemically synthesized
tacggctaatgaaacccagg

SEQ ID NO: 35216 - DNA, 20 bp, Artificial Sequence
  chemically synthesized
ctaatgaaacccaggaagat

SEQ ID NO: 35217 - DNA, 20 bp, Artificial Sequence
  chemically synthesized
caggaagataagtcaatgcg

SEQ ID NO: 35218 - DNA, 20 bp, Artificial Sequence
  chemically synthesized
gaagataagtcaatgcgtag

SEQ ID NO: 35219 - DNA, 20 bp, Artificial Sequence
  chemically synthesized
gtagaagtaattccaaccta

SEQ ID NO: 35220 - DNA, 20 bp, Artificial Sequence
  chemically synthesized
ctttttaaaaatcatattta

SEQ ID NO: 35221 - DNA, 20 bp, Artificial Sequence
  chemically synthesized
ttttaaaaatcatatttata

SEQ ID NO: 35222 - DNA, 20 bp, Artificial Sequence
  chemically synthesized
tttaaaaatcatatttatag

SEQ ID NO: 35223 - DNA, 20 bp, Artificial Sequence
  chemically synthesized
atcatatttatagaggtttg

SEQ ID NO: 35224 - DNA, 20 bp, Artificial Sequence
  chemically synthesized
agaggtttgcagtgatacta

SEQ ID NO: 35225 - DNA, 20 bp, Artificial Sequence
  chemically synthesized
caatattgcaaatcattatt

SEQ ID NO: 35226 - DNA, 20 bp, Artificial Sequence
  chemically synthesized
caaatcattattaagaatac

SEQ ID NO: 35227 - DNA, 20 bp, Artificial Sequence
  chemically synthesized
atcattattaagaatacaag

SEQ ID NO: 35228 - DNA, 20 bp, Artificial Sequence
  chemically synthesized
tttctttaacacctgtgata

SEQ ID NO: 35229 - DNA, 20 bp, Artificial Sequence
  chemically synthesized
ttctttaacacctgtgatac

SEQ ID NO: 35230 - DNA, 20 bp, Artificial Sequence
  chemically synthesized
ttgatatgaattctacgtaa

SEQ ID NO: 35231 - DNA, 20 bp, Artificial Sequence
  chemically synthesized
ttgcttcttgccaccaccca

SEQ ID NO: 35232 - DNA, 20 bp, Artificial Sequence
  chemically synthesized
cttcttgccaccacccaaag

SEQ ID NO: 35233 - DNA, 20 bp, Artificial Sequence
  chemically synthesized
ttcttgccaccacccaaaga

SEQ ID NO: 35234 - DNA, 20 bp, Artificial Sequence
  chemically synthesized
accacccaaagaaggttgta

SEQ ID NO: 35235 - DNA, 20 bp, Artificial Sequence
  chemically synthesized
aaagaaggttgtatagcact

SEQ ID NO: 35236 - DNA, 20 bp, Artificial Sequence
  chemically synthesized
aactgcaaccgtgtatctct

SEQ ID NO: 35237 - DNA, 20 bp, Artificial Sequence
  chemically synthesized
actgcaaccgtgtatctctt

SEQ ID NO: 35238 - DNA, 20 bp, Artificial Sequence
  chemically synthesized
ttgccctcttccctccctat

SEQ ID NO: 35239 - DNA, 20 bp, Artificial Sequence
  chemically synthesized
cctccctatcagcatgtatc

SEQ ID NO: 35240 - DNA, 20 bp, Artificial Sequence
  chemically synthesized
ccctatcagcatgtatctag

SEQ ID NO: 35241 - DNA, 20 bp, Artificial Sequence
  chemically synthesized
gtatctagcagcattctgaa

SEQ ID NO: 35242 - DNA, 20 bp, Artificial Sequence
  chemically synthesized
attctgaaaagttaactgca

SEQ ID NO: 35243 - DNA, 20 bp, Artificial Sequence
  chemically synthesized
tgaaaagttaactgcacagt

SEQ ID NO: 35244 - DNA, 20 bp, Artificial Sequence
  chemically synthesized
actgcacagtgagcgactgc

SEQ ID NO: 35245 - DNA, 20 bp, Artificial Sequence
  chemically synthesized
ctgcacagtgagcgactgct

SEQ ID NO: 35246 - DNA, 20 bp, Artificial Sequence
  chemically synthesized
gagcgactgctgggcatctt

SEQ ID NO: 35247 - DNA, 20 bp, Artificial Sequence
  chemically synthesized
agcgactgctgggcatctta

SEQ ID NO: 35248 - DNA, 20 bp, Artificial Sequence
  chemically synthesized
gcgactgctgggcatcttaa

SEQ ID NO: 35249 - DNA, 20 bp, Artificial Sequence
  chemically synthesized
cgactgctgggcatcttaag

SEQ ID NO: 35250 - DNA, 20 bp, Artificial Sequence
  chemically synthesized
aaggggcattcttttctacc

SEQ ID NO: 35251 - DNA, 20 bp, Artificial Sequence
  chemically synthesized
aggggcattcttttctacct

SEQ ID NO: 35252 - DNA, 20 bp, Artificial Sequence
  chemically synthesized
ccccctcctccactcatgtc

SEQ ID NO: 35253 - DNA, 20 bp, Artificial Sequence
  chemically synthesized
ctccactcatgtctagcatg

SEQ ID NO: 35254 - DNA, 20 bp, Artificial Sequence
  chemically synthesized
tccactcatgtctagcatgc

SEQ ID NO: 35255 - DNA, 20 bp, Artificial Sequence
  chemically synthesized
catgtctagcatgcaggact

SEQ ID NO: 35256 - DNA, 20 bp, Artificial Sequence
  chemically synthesized
atgtctagcatgcaggactt

SEQ ID NO: 35257 - DNA, 20 bp, Artificial Sequence
  chemically synthesized
tgcaggacttgggtaatctc

SEQ ID NO: 35258 - DNA, 20 bp, Artificial Sequence
  chemically synthesized
gcaggacttgggtaatctct

SEQ ID NO: 35259 - DNA, 20 bp, Artificial Sequence
  chemically synthesized
caggacttgggtaatctctg

SEQ ID NO: 35260 - DNA, 20 bp, Artificial Sequence
  chemically synthesized
ttgggtaatctctggggttt

SEQ ID NO: 35261 - DNA, 20 bp, Artificial Sequence
  chemically synthesized
ctctggggtttcagattctc

SEQ ID NO: 35262 - DNA, 20 bp, Artificial Sequence
  chemically synthesized
tctccagacctccattctct

SEQ ID NO: 35263 - DNA, 20 bp, Artificial Sequence
  chemically synthesized
ctccagacctccattctctc

SEQ ID NO: 35264 - DNA, 20 bp, Artificial Sequence
  chemically synthesized
tccagacctccattctctca

SEQ ID NO: 35265 - DNA, 20 bp, Artificial Sequence
  chemically synthesized
ccagacctccattctctcag

SEQ ID NO: 35266 - DNA, 20 bp, Artificial Sequence
  chemically synthesized
ttccacctcctgctcatatc

SEQ ID NO: 35267 - DNA, 20 bp, Artificial Sequence
  chemically synthesized
ctcatatctagctatctgcc

SEQ ID NO: 35268 - DNA, 20 bp, Artificial Sequence
  chemically synthesized
ctaaccataaaatcttaaat

SEQ ID NO: 35269 - DNA, 20 bp, Artificial Sequence
  chemically synthesized
catgtcatgataaaaaaaat

SEQ ID NO: 35270 - DNA, 20 bp, Artificial Sequence
  chemically synthesized
taaaaaaaataagacaccat

SEQ ID NO: 35271 - DNA, 20 bp, Artificial Sequence
  chemically synthesized
aaaaaataagacaccatcag

SEQ ID NO: 35272 - DNA, 20 bp, Artificial Sequence
  chemically synthesized
tcagtggcaactgtgttgcc

SEQ ID NO: 35273 - DNA, 20 bp, Artificial Sequence
  chemically synthesized
ttgatctgctaatccctgtg

SEQ ID NO: 35274 - DNA, 20 bp, Artificial Sequence
  chemically synthesized
ccctgtgtagaaatgaacct

SEQ ID NO: 35275 - DNA, 20 bp, Artificial Sequence
  chemically synthesized
ctgtgtagaaatgaaccttg

SEQ ID NO: 35276 - DNA, 20 bp, Artificial Sequence
  chemically synthesized
tgtgtagaaatgaaccttgg

SEQ ID NO: 35277 - DNA, 20 bp, Artificial Sequence
  chemically synthesized
atttcttacaatatgtgcat

SEQ ID NO: 35278 - DNA, 20 bp, Artificial Sequence
  chemically synthesized
ttgtaacactgtcactttga

SEQ ID NO: 35279 - DNA, 20 bp, Artificial Sequence
  chemically synthesized
ctgtcactttgacagttgat

SEQ ID NO: 35280 - DNA, 20 bp, Artificial Sequence
  chemically synthesized
gttgataagcatcttctgaa

SEQ ID NO: 35281 - DNA, 20 bp, Artificial Sequence
  chemically synthesized
cttctgaatggtccctcctt

SEQ ID NO: 35282 - DNA, 20 bp, Artificial Sequence
  chemically synthesized
tcctttagttacaaaaatgt

SEQ ID NO: 35283 - DNA, 20 bp, Artificial Sequence
  chemically synthesized
gttacaaaaatgttggtgca

SEQ ID NO: 35284 - DNA, 20 bp, Artificial Sequence
  chemically synthesized
tgttggtgcatggatgatgt

SEQ ID NO: 35285 - DNA, 20 bp, Artificial Sequence
  chemically synthesized
gttggtgcatggatgatgtt

SEQ ID NO: 35286 - DNA, 20 bp, Artificial Sequence
  chemically synthesized
tgatgttgggaataaataaa

SEQ ID NO: 35287 - DNA, 20 bp, Artificial Sequence
  chemically synthesized
actaaattatgttctcatct

SEQ ID NO: 35288 - DNA, 20 bp, Artificial Sequence
  chemically synthesized
ctaaattatgttctcatctt

SEQ ID NO: 35289 - DNA, 20 bp, Artificial Sequence
  chemically synthesized
tctcatcttgggcaaaaatt

SEQ ID NO: 35290 - DNA, 20 bp, Artificial Sequence
  chemically synthesized
aaaattaagcaaaaaaaaaa

SEQ ID NO: 35291 - DNA, 20 bp, Artificial Sequence
  chemically synthesized
aattaagcaaaaaaaaaatg

SEQ ID NO: 35292 - DNA, 20 bp, Artificial Sequence
  chemically synthesized
attaagcaaaaaaaaaatgg

SEQ ID NO: 35293 - DNA, 20 bp, Artificial Sequence
  chemically synthesized
aaaaaaaaatggaggatatg

SEQ ID NO: 35294 - DNA, 20 bp, Artificial Sequence
  chemically synthesized
ggatatgaagctcctccaca

SEQ ID NO: 35295 - DNA, 20 bp, Artificial Sequence
  chemically synthesized
tatgaagctcctccacaaag

SEQ ID NO: 35296 - DNA, 20 bp, Artificial Sequence
  chemically synthesized
atgaagctcctccacaaaga

SEQ ID NO: 35297 - DNA, 20 bp, Artificial Sequence
  chemically synthesized
aaagaaggccatttttgtac

SEQ ID NO: 35298 - DNA, 20 bp, Artificial Sequence
  chemically synthesized
aagaaggccatttttgtact

SEQ ID NO: 35299 - DNA, 20 bp, Artificial Sequence
  chemically synthesized
tttttgtactaggcttacta

SEQ ID NO: 35300 - DNA, 20 bp, Artificial Sequence
  chemically synthesized
ctacagtgacacaccactat

SEQ ID NO: 35301 - DNA, 20 bp, Artificial Sequence
  chemically synthesized
agtgacacaccactattagt

SEQ ID NO: 35302 - DNA, 20 bp, Artificial Sequence
  chemically synthesized
gtgacacaccactattagtt

SEQ ID NO: 35303 - DNA, 20 bp, Artificial Sequence
  chemically synthesized
tgacacaccactattagttg

SEQ ID NO: 35304 - DNA, 20 bp, Artificial Sequence
  chemically synthesized
acacaccactattagttggg

SEQ ID NO: 35305 - DNA, 20 bp, Artificial Sequence
  chemically synthesized
actattagttggggagaatt

SEQ ID NO: 35306 - DNA, 20 bp, Artificial Sequence
  chemically synthesized
ggggagaattcagtttttcc

SEQ ID NO: 35307 - DNA, 20 bp, Artificial Sequence
  chemically synthesized
gggagaattcagtttttcca

SEQ ID NO: 35308 - DNA, 20 bp, Artificial Sequence
  chemically synthesized
cagtttttccaaggtgttga

SEQ ID NO: 35309 - DNA, 20 bp, Artificial Sequence
  chemically synthesized
agtttttccaaggtgttgat

SEQ ID NO: 35310 - DNA, 20 bp, Artificial Sequence
  chemically synthesized
ccaaggtgttgataggcatc

SEQ ID NO: 35311 - DNA, 20 bp, Artificial Sequence
  chemically synthesized
gttgataggcatccagattt

SEQ ID NO: 35312 - DNA, 20 bp, Artificial Sequence
  chemically synthesized
tgataggcatccagatttca

SEQ ID NO: 35313 - DNA, 20 bp, Artificial Sequence
  chemically synthesized
gataggcatccagatttcag

SEQ ID NO: 35314 - DNA, 20 bp, Artificial Sequence
  chemically synthesized
tttcagaggaaattgtaaaa

SEQ ID NO: 35315 - DNA, 20 bp, Artificial Sequence
  chemically synthesized
cagaggaaattgtaaaaaag

SEQ ID NO: 35316 - DNA, 20 bp, Artificial Sequence
  chemically synthesized
aattgtaaaaaagcagaacc

SEQ ID NO: 35317 - DNA, 20 bp, Artificial Sequence
  chemically synthesized
attgtaaaaaagcagaacct

SEQ ID NO: 35318 - DNA, 20 bp, Artificial Sequence
  chemically synthesized
actgcccacgatttttcttt

SEQ ID NO: 35319 - DNA, 20 bp, Artificial Sequence
  chemically synthesized
ttttctttgagatcaaatct

SEQ ID NO: 35320 - DNA, 20 bp, Artificial Sequence
  chemically synthesized
tttctttgagatcaaatctg

SEQ ID NO: 35321 - DNA, 20 bp, Artificial Sequence
  chemically synthesized
gaggcaacaaatctgttcaa

SEQ ID NO: 35322 - DNA, 20 bp, Artificial Sequence
  chemically synthesized
ttcaaaagctgctttctgcc

SEQ ID NO: 35323 - DNA, 20 bp, Artificial Sequence
  chemically synthesized
agctgctttctgcctggttg

SEQ ID NO: 35324 - DNA, 20 bp, Artificial Sequence
  chemically synthesized
ctttctgcctggttgtggca

SEQ ID NO: 35325 - DNA, 20 bp, Artificial Sequence
  chemically synthesized
tttctgcctggttgtggcaa

SEQ ID NO: 35326 - DNA, 20 bp, Artificial Sequence
  chemically synthesized
ttctgcctggttgtggcaaa

SEQ ID NO: 35327 - DNA, 20 bp, Artificial Sequence
  chemically synthesized
tgcctggttgtggcaaaggg

SEQ ID NO: 35328 - DNA, 20 bp, Artificial Sequence
  chemically synthesized
ggttgtggcaaagggtggcc

SEQ ID NO: 35329 - DNA, 20 bp, Artificial Sequence
  chemically synthesized
tgtggcaaagggtggccaag

SEQ ID NO: 35330 - DNA, 20 bp, Artificial Sequence
  chemically synthesized
gtggcaaagggtggccaagt

SEQ ID NO: 35331 - DNA, 20 bp, Artificial Sequence
  chemically synthesized
tggcaaagggtggccaagtg

SEQ ID NO: 35332 - DNA, 20 bp, Artificial Sequence
  chemically synthesized
aagggtggccaagtggggct

SEQ ID NO: 35333 - DNA, 20 bp, Artificial Sequence
  chemically synthesized
ctcagctgtgttcccattgc

SEQ ID NO: 35334 - DNA, 20 bp, Artificial Sequence
  chemically synthesized
tcagctgtgttcccattgca

SEQ ID NO: 35335 - DNA, 20 bp, Artificial Sequence
  chemically synthesized
gttcccattgcaaggctact

SEQ ID NO: 35336 - DNA, 20 bp, Artificial Sequence
  chemically synthesized
tactgagcatcccctgtcct

SEQ ID NO: 35337 - DNA, 20 bp, Artificial Sequence
  chemically synthesized
actgagcatcccctgtcctg

SEQ ID NO: 35338 - DNA, 20 bp, Artificial Sequence
  chemically synthesized
tcccctgtcctgaggctcct

SEQ ID NO: 35339 - DNA, 20 bp, Artificial Sequence
  chemically synthesized
cccctgtcctgaggctcctt

SEQ ID NO: 35340 - DNA, 20 bp, Artificial Sequence
  chemically synthesized
ctgaggctccttaggacacc

SEQ ID NO: 35341 - DNA, 20 bp, Artificial Sequence
  chemically synthesized
gctccttaggacacctggct

SEQ ID NO: 35342 - DNA, 20 bp, Artificial Sequence
  chemically synthesized
taggacacctggctgagctt

SEQ ID NO: 35343 - DNA, 20 bp, Artificial Sequence
  chemically synthesized
gacacctggctgagcttcag

SEQ ID NO: 35344 - DNA, 20 bp, Artificial Sequence
  chemically synthesized
agcttcagcagccctcttcc

SEQ ID NO: 35345 - DNA, 20 bp, Artificial Sequence
  chemically synthesized
cagcagccctcttccaagcc

SEQ ID NO: 35346 - DNA, 20 bp, Artificial Sequence
  chemically synthesized
gcagccctcttccaagcctg

SEQ ID NO: 35347 - DNA, 20 bp, Artificial Sequence
  chemically synthesized
tcttccaagcctggagatgc

SEQ ID NO: 35348 - DNA, 20 bp, Artificial Sequence
  chemically synthesized
ggagatgccagctccatctc

SEQ ID NO: 35349 - DNA, 20 bp, Artificial Sequence
  chemically synthesized
tccatctctggcacaaaatg

SEQ ID NO: 35350 - DNA, 20 bp, Artificial Sequence
  chemically synthesized
acaaaatgtagtgattttca

SEQ ID NO: 35351 - DNA, 20 bp, Artificial Sequence
  chemically synthesized
caaaatgtagtgattttcac

SEQ ID NO: 35352 - DNA, 20 bp, Artificial Sequence
  chemically synthesized
aaaatgtagtgattttcaca

SEQ ID NO: 35353 - DNA, 20 bp, Artificial Sequence
  chemically synthesized
tgtagtgattttcacagggt

SEQ ID NO: 35354 - DNA, 20 bp, Artificial Sequence
  chemically synthesized
tagtgattttcacagggtga

SEQ ID NO: 35355 - DNA, 20 bp, Artificial Sequence
  chemically synthesized
agtgattttcacagggtgag

SEQ ID NO: 35356 - DNA, 20 bp, Artificial Sequence
  chemically synthesized
ttcacagggtgagaggccaa

SEQ ID NO: 35357 - DNA, 20 bp, Artificial Sequence
  chemically synthesized
cacagggtgagaggccaaaa

SEQ ID NO: 35358 - DNA, 20 bp, Artificial Sequence
  chemically synthesized
acagggtgagaggccaaaag

SEQ ID NO: 35359 - DNA, 20 bp, Artificial Sequence
  chemically synthesized
caaaagaggctaataaaatg

SEQ ID NO: 35360 - DNA, 20 bp, Artificial Sequence
  chemically synthesized
agaggctaataaaatgaaga

SEQ ID NO: 35361 - DNA, 20 bp, Artificial Sequence
  chemically synthesized
ctaataaaatgaagatagcc

SEQ ID NO: 35362 - DNA, 20 bp, Artificial Sequence
  chemically synthesized
tgaagatagccaagcttcca

SEQ ID NO: 35363 - DNA, 20 bp, Artificial Sequence
  chemically synthesized
agccaagcttccatggaatt

SEQ ID NO: 35364 - DNA, 20 bp, Artificial Sequence
  chemically synthesized
gcttccatggaattaagcaa

SEQ ID NO: 35365 - DNA, 20 bp, Artificial Sequence
  chemically synthesized
cttccatggaattaagcaac

SEQ ID NO: 35366 - DNA, 20 bp, Artificial Sequence
  chemically synthesized
aggacaaccttgaccacttt

SEQ ID NO: 35367 - DNA, 20 bp, Artificial Sequence
  chemically synthesized
ggacaaccttgaccactttg

SEQ ID NO: 35368 - DNA, 20 bp, Artificial Sequence
  chemically synthesized
gacaaccttgaccactttga

SEQ ID NO: 35369 - DNA, 20 bp, Artificial Sequence
  chemically synthesized
acaaccttgaccactttgag

SEQ ID NO: 35370 - DNA, 20 bp, Artificial Sequence
  chemically synthesized
cttgaccactttgaggggtg

SEQ ID NO: 35371 - DNA, 20 bp, Artificial Sequence
  chemically synthesized
gaccactttgaggggtgtgg

SEQ ID NO: 35372 - DNA, 20 bp, Artificial Sequence
  chemically synthesized
accactttgaggggtgtggt

SEQ ID NO: 35373 - DNA, 20 bp, Artificial Sequence
  chemically synthesized
ccactttgaggggtgtggtg

SEQ ID NO: 35374 - DNA, 20 bp, Artificial Sequence
  chemically synthesized
cactttgaggggtgtggtgg

SEQ ID NO: 35375 - DNA, 20 bp, Artificial Sequence
  chemically synthesized
ggtgtggtgggggccacatg

SEQ ID NO: 35376 - DNA, 20 bp, Artificial Sequence
  chemically synthesized
tggtgggggccacatgcaga

SEQ ID NO: 35377 - DNA, 20 bp, Artificial Sequence
  chemically synthesized
gtgggggccacatgcagatg

SEQ ID NO: 35378 - DNA, 20 bp, Artificial Sequence
  chemically synthesized
ggggccacatgcagatggag

SEQ ID NO: 35379 - DNA, 20 bp, Artificial Sequence
  chemically synthesized
gggccacatgcagatggagt

SEQ ID NO: 35380 - DNA, 20 bp, Artificial Sequence
  chemically synthesized
catgcagatggagtgggtta

SEQ ID NO: 35381 - DNA, 20 bp, Artificial Sequence
  chemically synthesized
tgcagatggagtgggttaaa

SEQ ID NO: 35382 - DNA, 20 bp, Artificial Sequence
  chemically synthesized
ggagtgggttaaagagtgac

SEQ ID NO: 35383 - DNA, 20 bp, Artificial Sequence
  chemically synthesized
gtgggttaaagagtgactag

SEQ ID NO: 35384 - DNA, 20 bp, Artificial Sequence
  chemically synthesized
gggttaaagagtgactagaa

SEQ ID NO: 35385 - DNA, 20 bp, Artificial Sequence
  chemically synthesized
ttaaagagtgactagaagag

SEQ ID NO: 35386 - DNA, 20 bp, Artificial Sequence
  chemically synthesized
aagagtgactagaagagcag

SEQ ID NO: 35387 - DNA, 20 bp, Artificial Sequence
  chemically synthesized
agagtgactagaagagcagt

SEQ ID NO: 35388 - DNA, 20 bp, Artificial Sequence
  chemically synthesized
gagtgactagaagagcagtg

SEQ ID NO: 35389 - DNA, 20 bp, Artificial Sequence
  chemically synthesized
agtgactagaagagcagtgg

SEQ ID NO: 35390 - DNA, 20 bp, Artificial Sequence
  chemically synthesized
gactagaagagcagtggggg

SEQ ID NO: 35391 - DNA, 20 bp, Artificial Sequence
  chemically synthesized
tagaagagcagtgggggtgg

SEQ ID NO: 35392 - DNA, 20 bp, Artificial Sequence
  chemically synthesized
aagagcagtgggggtggcag

SEQ ID NO: 35393 - DNA, 20 bp, Artificial Sequence
  chemically synthesized
agagcagtgggggtggcagc

SEQ ID NO: 35394 - DNA, 20 bp, Artificial Sequence
  chemically synthesized
agcagtgggggtggcagcag

SEQ ID NO: 35395 - DNA, 20 bp, Artificial Sequence
  chemically synthesized
cagtgggggtggcagcagga

SEQ ID NO: 35396 - DNA, 20 bp, Artificial Sequence
  chemically synthesized
tgggggtggcagcaggagag

SEQ ID NO: 35397 - DNA, 20 bp, Artificial Sequence
  chemically synthesized
gtggcagcaggagagaagcc

SEQ ID NO: 35398 - DNA, 20 bp, Artificial Sequence
  chemically synthesized
ggagagaagcctggctctga

SEQ ID NO: 35399 - DNA, 20 bp, Artificial Sequence
  chemically synthesized
gagaagcctggctctgaaag

SEQ ID NO: 35400 - DNA, 20 bp, Artificial Sequence
  chemically synthesized
agcctggctctgaaagcagc

SEQ ID NO: 35401 - DNA, 20 bp, Artificial Sequence
  chemically synthesized
tctgaaagcagcgagacttc

SEQ ID NO: 35402 - DNA, 20 bp, Artificial Sequence
  chemically synthesized
ctgaaagcagcgagacttct

SEQ ID NO: 35403 - DNA, 20 bp, Artificial Sequence
  chemically synthesized
tgaaagcagcgagacttcta

SEQ ID NO: 35404 - DNA, 20 bp, Artificial Sequence
  chemically synthesized
agcgagacttctagggaata

SEQ ID NO: 35405 - DNA, 20 bp, Artificial Sequence
  chemically synthesized
gcgagacttctagggaatac

SEQ ID NO: 35406 - DNA, 20 bp, Artificial Sequence
  chemically synthesized
cgagacttctagggaataca

SEQ ID NO: 35407 - DNA, 20 bp, Artificial Sequence
  chemically synthesized
acttctagggaatacagggt

SEQ ID NO: 35408 - DNA, 20 bp, Artificial Sequence
  chemically synthesized
cttctagggaatacagggtc

SEQ ID NO: 35409 - DNA, 20 bp, Artificial Sequence
  chemically synthesized
ttctagggaatacagggtca

SEQ ID NO: 35410 - DNA, 20 bp, Artificial Sequence
  chemically synthesized
tctagggaatacagggtcag

SEQ ID NO: 35411 - DNA, 20 bp, Artificial Sequence
  chemically synthesized
tagggaatacagggtcaggg

SEQ ID NO: 35412 - DNA, 20 bp, Artificial Sequence
  chemically synthesized
agggaatacagggtcagggg

SEQ ID NO: 35413 - DNA, 20 bp, Artificial Sequence
  chemically synthesized
agggtcaggggaggttctga

SEQ ID NO: 35414 - DNA, 20 bp, Artificial Sequence
  chemically synthesized
ttctgaaagatgacacactg

SEQ ID NO: 35415 - DNA, 20 bp, Artificial Sequence
  chemically synthesized
ctgaaagatgacacactgca

SEQ ID NO: 35416 - DNA, 20 bp, Artificial Sequence
  chemically synthesized
tgtgtttgtatgccgatgac

SEQ ID NO: 35417 - DNA, 20 bp, Artificial Sequence
  chemically synthesized
gtatgccgatgacaagtatc

SEQ ID NO: 35418 - DNA, 20 bp, Artificial Sequence
  chemically synthesized
tgccgatgacaagtatccag

SEQ ID NO: 35419 - DNA, 20 bp, Artificial Sequence
  chemically synthesized
gatgacaagtatccagtaga

SEQ ID NO: 35420 - DNA, 20 bp, Artificial Sequence
  chemically synthesized
atgacaagtatccagtagaa

SEQ ID NO: 35421 - DNA, 20 bp, Artificial Sequence
  chemically synthesized
acaagtatccagtagaaagg

SEQ ID NO: 35422 - DNA, 20 bp, Artificial Sequence
  chemically synthesized
ccagtagaaaggcagatgaa

SEQ ID NO: 35423 - DNA, 20 bp, Artificial Sequence
  chemically synthesized
gatgaacagattctcattct

SEQ ID NO: 35424 - DNA, 20 bp, Artificial Sequence
  chemically synthesized
aacagattctcattctcaga

SEQ ID NO: 35425 - DNA, 20 bp, Artificial Sequence
  chemically synthesized
acagattctcattctcagaa

SEQ ID NO: 35426 - DNA, 20 bp, Artificial Sequence
  chemically synthesized
aaggcctgtcctgacctcct

SEQ ID NO: 35427 - DNA, 20 bp, Artificial Sequence
  chemically synthesized
ggcctgtcctgacctcctga

SEQ ID NO: 35428 - DNA, 20 bp, Artificial Sequence
  chemically synthesized
cctgacctcctgagagtaca

SEQ ID NO: 35429 - DNA, 20 bp, Artificial Sequence
  chemically synthesized
cctgagagtacacagaccat

SEQ ID NO: 35430 - DNA, 20 bp, Artificial Sequence
  chemically synthesized
ctgagagtacacagaccatg

SEQ ID NO: 35431 - DNA, 20 bp, Artificial Sequence
  chemically synthesized
tgagagtacacagaccatga

SEQ ID NO: 35432 - DNA, 20 bp, Artificial Sequence
  chemically synthesized
gagtacacagaccatgaggg

SEQ ID NO: 35433 - DNA, 20 bp, Artificial Sequence
  chemically synthesized
agtacacagaccatgagggc

SEQ ID NO: 35434 - DNA, 20 bp, Artificial Sequence
  chemically synthesized
gtacacagaccatgagggca

SEQ ID NO: 35435 - DNA, 20 bp, Artificial Sequence
  chemically synthesized
acagaccatgagggcagggc

SEQ ID NO: 35436 - DNA, 20 bp, Artificial Sequence
  chemically synthesized
cagaccatgagggcagggca

SEQ ID NO: 35437 - DNA, 20 bp, Artificial Sequence
  chemically synthesized
gaccatgagggcagggcaag

SEQ ID NO: 35438 - DNA, 20 bp, Artificial Sequence
  chemically synthesized
accatgagggcagggcaagg

SEQ ID NO: 35439 - DNA, 20 bp, Artificial Sequence
  chemically synthesized
catgagggcagggcaaggag

SEQ ID NO: 35440 - DNA, 20 bp, Artificial Sequence
  chemically synthesized
atgagggcagggcaaggagg

SEQ ID NO: 35441 - DNA, 20 bp, Artificial Sequence
  chemically synthesized
cacgctcactgtttcatgca

SEQ ID NO: 35442 - DNA, 20 bp, Artificial Sequence
  chemically synthesized
actgtttcatgcaaagtcct

SEQ ID NO: 35443 - DNA, 20 bp, Artificial Sequence
  chemically synthesized
tcatgcaaagtccttggcca

SEQ ID NO: 35444 - DNA, 20 bp, Artificial Sequence
  chemically synthesized
caatttaatatgctctatgc

SEQ ID NO: 35445 - DNA, 20 bp, Artificial Sequence
  chemically synthesized
tatgctctatgctggaaaac

SEQ ID NO: 35446 - DNA, 20 bp, Artificial Sequence
  chemically synthesized
tggaaaactggattattgaa

SEQ ID NO: 35447 - DNA, 20 bp, Artificial Sequence
  chemically synthesized
ggaaaactggattattgaac

SEQ ID NO: 35448 - DNA, 20 bp, Artificial Sequence
  chemically synthesized
ctggattattgaacaggcat

SEQ ID NO: 35449 - DNA, 20 bp, Artificial Sequence
  chemically synthesized
tctgaacctaatccactaaa

SEQ ID NO: 35450 - DNA, 20 bp, Artificial Sequence
  chemically synthesized
atccactaaaaagcacttga

SEQ ID NO: 35451 - DNA, 20 bp, Artificial Sequence
  chemically synthesized
agatatatcaaaatatcatt

SEQ ID NO: 35452 - DNA, 20 bp, Artificial Sequence
  chemically synthesized
atcaaaatatcattgagaaa

SEQ ID NO: 35453 - DNA, 20 bp, Artificial Sequence
  chemically synthesized
tcattgagaaatagatattt

SEQ ID NO: 35454 - DNA, 20 bp, Artificial Sequence
  chemically synthesized
cattgagaaatagatatttt

SEQ ID NO: 35455 - DNA, 20 bp, Artificial Sequence
  chemically synthesized
ctcatttgaactctcttttc

SEQ ID NO: 35456 - DNA, 20 bp, Artificial Sequence
  chemically synthesized
tcatttgaactctcttttcc

SEQ ID NO: 35457 - DNA, 20 bp, Artificial Sequence
  chemically synthesized
tttgaactctcttttccagg

SEQ ID NO: 35458 - DNA, 20 bp, Artificial Sequence
  chemically synthesized
tgaactctcttttccaggaa

SEQ ID NO: 35459 - DNA, 20 bp, Artificial Sequence
  chemically synthesized
tttccaggaagagttgtgct

SEQ ID NO: 35460 - DNA, 20 bp, Artificial Sequence
  chemically synthesized
ttccaggaagagttgtgctt

SEQ ID NO: 35461 - DNA, 20 bp, Artificial Sequence
  chemically synthesized
ttgtgcttgggtaaattcta

SEQ ID NO: 35462 - DNA, 20 bp, Artificial Sequence
  chemically synthesized
tgggtaaattctatagctca

SEQ ID NO: 35463 - DNA, 20 bp, Artificial Sequence
  chemically synthesized
aaaacacacaataaattaat

SEQ ID NO: 35464 - DNA, 20 bp, Artificial Sequence
  chemically synthesized
aaacacacaataaattaata

SEQ ID NO: 35465 - DNA, 20 bp, Artificial Sequence
  chemically synthesized
aattaataaggtgcttccta

SEQ ID NO: 35466 - DNA, 20 bp, Artificial Sequence
  chemically synthesized
aataaggtgcttcctacagt

SEQ ID NO: 35467 - DNA, 20 bp, Artificial Sequence
  chemically synthesized
ggtgcttcctacagtgagtt

SEQ ID NO: 35468 - DNA, 20 bp, Artificial Sequence
  chemically synthesized
gagttcagttaaacattttg

SEQ ID NO: 35469 - DNA, 20 bp, Artificial Sequence
  chemically synthesized
gttcagttaaacattttgaa

SEQ ID NO: 35470 - DNA, 20 bp, Artificial Sequence
  chemically synthesized
tgaagagtgtttttgaaatg

SEQ ID NO: 35471 - DNA, 20 bp, Artificial Sequence
  chemically synthesized
agagtgtttttgaaatgtag

SEQ ID NO: 35472 - DNA, 20 bp, Artificial Sequence
  chemically synthesized
agtgtttttgaaatgtagca

SEQ ID NO: 35473 - DNA, 20 bp, Artificial Sequence
  chemically synthesized
gtttttgaaatgtagcagag

SEQ ID NO: 35474 - DNA, 20 bp, Artificial Sequence
  chemically synthesized
tttttgaaatgtagcagagc

SEQ ID NO: 35475 - DNA, 20 bp, Artificial Sequence
  chemically synthesized
ggctacaattgatattcaaa

SEQ ID NO: 35476 - DNA, 20 bp, Artificial Sequence
  chemically synthesized
ctacaattgatattcaaaaa

SEQ ID NO: 35477 - DNA, 20 bp, Artificial Sequence
  chemically synthesized
tacaattgatattcaaaaag

SEQ ID NO: 35478 - DNA, 20 bp, Artificial Sequence
  chemically synthesized
atttatttccccctttaact

SEQ ID NO: 35479 - DNA, 20 bp, Artificial Sequence
  chemically synthesized
tgtcattttattatgcttca

SEQ ID NO: 35480 - DNA, 20 bp, Artificial Sequence
  chemically synthesized
tcattttattatgcttcata

SEQ ID NO: 35481 - DNA, 20 bp, Artificial Sequence
  chemically synthesized
cttcatagagcatcactgct

SEQ ID NO: 35482 - DNA, 20 bp, Artificial Sequence
  chemically synthesized
cactgctgagatcccctccc

SEQ ID NO: 35483 - DNA, 20 bp, Artificial Sequence
  chemically synthesized
ccctccccagctcatgttgc

SEQ ID NO: 35484 - DNA, 20 bp, Artificial Sequence
  chemically synthesized
cctccccagctcatgttgct

SEQ ID NO: 35485 - DNA, 20 bp, Artificial Sequence
  chemically synthesized
tgctaggaaatatcccaaaa

SEQ ID NO: 35486 - DNA, 20 bp, Artificial Sequence
  chemically synthesized
ttgtttctctgattcacctc

SEQ ID NO: 35487 - DNA, 20 bp, Artificial Sequence
  chemically synthesized
tgtttctctgattcacctcc

SEQ ID NO: 35488 - DNA, 20 bp, Artificial Sequence
  chemically synthesized
gtttctctgattcacctcca

SEQ ID NO: 35489 - DNA, 20 bp, Artificial Sequence
  chemically synthesized
attcacctccagggctcata

SEQ ID NO: 35490 - DNA, 20 bp, Artificial Sequence
  chemically synthesized
ctccagggctcatatggcaa

SEQ ID NO: 35491 - DNA, 20 bp, Artificial Sequence
  chemically synthesized
tccagggctcatatggcaat

SEQ ID NO: 35492 - DNA, 20 bp, Artificial Sequence
  chemically synthesized
ccagggctcatatggcaatg

SEQ ID NO: 35493 - DNA, 20 bp, Artificial Sequence
  chemically synthesized
atatggcaatggggatttaa

SEQ ID NO: 35494 - DNA, 20 bp, Artificial Sequence
  chemically synthesized
tatggcaatggggatttaat

SEQ ID NO: 35495 - DNA, 20 bp, Artificial Sequence
  chemically synthesized
atggcaatggggatttaata

SEQ ID NO: 35496 - DNA, 20 bp, Artificial Sequence
  chemically synthesized
atttaatagggtttatttgt

SEQ ID NO: 35497 - DNA, 20 bp, Artificial Sequence
  chemically synthesized
atagggtttatttgttggtg

SEQ ID NO: 35498 - DNA, 20 bp, Artificial Sequence
  chemically synthesized
acattaaacaaatcttttaa

SEQ ID NO: 35499 - DNA, 20 bp, Artificial Sequence
  chemically synthesized
cattaaacaaatcttttaat

SEQ ID NO: 35500 - DNA, 20 bp, Artificial Sequence
  chemically synthesized
ggaaaaatacttttatatta

SEQ ID NO: 35501 - DNA, 20 bp, Artificial Sequence
  chemically synthesized
gaaaaatacttttatattat

SEQ ID NO: 35502 - DNA, 20 bp, Artificial Sequence
  chemically synthesized
tttatattataggcaaaatg

SEQ ID NO: 35503 - DNA, 20 bp, Artificial Sequence
  chemically synthesized
gtagatgtatattgctactg

SEQ ID NO: 35504 - DNA, 20 bp, Artificial Sequence
  chemically synthesized
aagtaaatgtattttattaa

SEQ ID NO: 35505 - DNA, 20 bp, Artificial Sequence
  chemically synthesized
atgtattttattaatggtgt

SEQ ID NO: 35506 - DNA, 20 bp, Artificial Sequence
  chemically synthesized
tgagaatttcttcctcactg

SEQ ID NO: 35507 - DNA, 20 bp, Artificial Sequence
  chemically synthesized
atgcatatttgcatgtgtaa

SEQ ID NO: 35508 - DNA, 20 bp, Artificial Sequence
  chemically synthesized
atttgcatgtgtaaaagact

SEQ ID NO: 35509 - DNA, 20 bp, Artificial Sequence
  chemically synthesized
aagacttagcaatttgtgaa

SEQ ID NO: 35510 - DNA, 20 bp, Artificial Sequence
  chemically synthesized
acttagcaatttgtgaatag

SEQ ID NO: 35511 - DNA, 20 bp, Artificial Sequence
  chemically synthesized
atgtttctccgcttctcact

SEQ ID NO: 35512 - DNA, 20 bp, Artificial Sequence
  chemically synthesized
tctccgcttctcactgagca

SEQ ID NO: 35513 - DNA, 20 bp, Artificial Sequence
  chemically synthesized
ctcactgagcatggctgtaa

SEQ ID NO: 35514 - DNA, 20 bp, Artificial Sequence
  chemically synthesized
aagaaactttttcctctccc

SEQ ID NO: 35515 - DNA, 20 bp, Artificial Sequence
  chemically synthesized
agaaactttttcctctcccc

SEQ ID NO: 35516 - DNA, 20 bp, Artificial Sequence
  chemically synthesized
tttcctctccccgggcattc

SEQ ID NO: 35517 - DNA, 20 bp, Artificial Sequence
  chemically synthesized
ccgggcattccagcacacat

SEQ ID NO: 35518 - DNA, 20 bp, Artificial Sequence
  chemically synthesized
gcattccagcacacattgga

SEQ ID NO: 35519 - DNA, 20 bp, Artificial Sequence
  chemically synthesized
ttggaaagataacacgtcca

SEQ ID NO: 35520 - DNA, 20 bp, Artificial Sequence
  chemically synthesized
aaagataacacgtccacaga

SEQ ID NO: 35521 - DNA, 20 bp, Artificial Sequence
  chemically synthesized
taacacgtccacagaaagcc

SEQ ID NO: 35522 - DNA, 20 bp, Artificial Sequence
  chemically synthesized
cagaaagcctggctttccaa

SEQ ID NO: 35523 - DNA, 20 bp, Artificial Sequence
  chemically synthesized
gaaagcctggctttccaaaa

SEQ ID NO: 35524 - DNA, 20 bp, Artificial Sequence
  chemically synthesized
ggctttccaaaagagcttat

SEQ ID NO: 35525 - DNA, 20 bp, Artificial Sequence
  chemically synthesized
ctttccaaaagagcttatca

SEQ ID NO: 35526 - DNA, 20 bp, Artificial Sequence
  chemically synthesized
ttatcagagaatgtgccccc

SEQ ID NO: 35527 - DNA, 20 bp, Artificial Sequence
  chemically synthesized
tatcagagaatgtgcccccc

SEQ ID NO: 35528 - DNA, 20 bp, Artificial Sequence
  chemically synthesized
taaaacatatgttaatcctg

SEQ ID NO: 35529 - DNA, 20 bp, Artificial Sequence
  chemically synthesized
aacatatgttaatcctgtgg

SEQ ID NO: 35530 - DNA, 20 bp, Artificial Sequence
  chemically synthesized
catatgttaatcctgtggca

SEQ ID NO: 35531 - DNA, 20 bp, Artificial Sequence
  chemically synthesized
atgttaatcctgtggcagag

SEQ ID NO: 35532 - DNA, 20 bp, Artificial Sequence
  chemically synthesized
tgtggcagagaagtttgttc

SEQ ID NO: 35533 - DNA, 20 bp, Artificial Sequence
  chemically synthesized
gagaagtttgttctagcctt

SEQ ID NO: 35534 - DNA, 20 bp, Artificial Sequence
  chemically synthesized
agaagtttgttctagccttt

SEQ ID NO: 35535 - DNA, 20 bp, Artificial Sequence
  chemically synthesized
tttgttctagcctttgggtg

SEQ ID NO: 35536 - DNA, 20 bp, Artificial Sequence
  chemically synthesized
ttgggtgtagcctgctgaat

SEQ ID NO: 35537 - DNA, 20 bp, Artificial Sequence
  chemically synthesized
tagcctgctgaataagttca

SEQ ID NO: 35538 - DNA, 20 bp, Artificial Sequence
  chemically synthesized
gttcacagtgatctacatcc

SEQ ID NO: 35539 - DNA, 20 bp, Artificial Sequence
  chemically synthesized
gatctacatcctagtttcca

SEQ ID NO: 35540 - DNA, 20 bp, Artificial Sequence
  chemically synthesized
atctacatcctagtttccat

SEQ ID NO: 35541 - DNA, 20 bp, Artificial Sequence
  chemically synthesized
ctagtttccatgggctgaaa

SEQ ID NO: 35542 - DNA, 20 bp, Artificial Sequence
  chemically synthesized
ccctgcactccctacacaca

SEQ ID NO: 35543 - DNA, 20 bp, Artificial Sequence
  chemically synthesized
actccctacacacacagaca

SEQ ID NO: 35544 - DNA, 20 bp, Artificial Sequence
  chemically synthesized
ttctttgatattttcttgaa

SEQ ID NO: 35545 - DNA, 20 bp, Artificial Sequence
  chemically synthesized
ttcaaatgtgtttgacttta

SEQ ID NO: 35546 - DNA, 20 bp, Artificial Sequence
  chemically synthesized
tcaacttgtaaaattttatc

SEQ ID NO: 35547 - DNA, 20 bp, Artificial Sequence
  chemically synthesized
aaattttatctggtaattta

SEQ ID NO: 35548 - DNA, 20 bp, Artificial Sequence
  chemically synthesized
taatttatagattaaattgc

SEQ ID NO: 35549 - DNA, 20 bp, Artificial Sequence
  chemically synthesized
agcatctacctccctttcat

SEQ ID NO: 35550 - DNA, 20 bp, Artificial Sequence
  chemically synthesized
ctttcatcagactctccctg

SEQ ID NO: 35551 - DNA, 20 bp, Artificial Sequence
  chemically synthesized
tttcatcagactctccctgc

SEQ ID NO: 35552 - DNA, 20 bp, Artificial Sequence
  chemically synthesized
ttcatcagactctccctgca

SEQ ID NO: 35553 - DNA, 20 bp, Artificial Sequence
  chemically synthesized
tcagactctccctgcagggc

SEQ ID NO: 35554 - DNA, 20 bp, Artificial Sequence
  chemically synthesized
tctaactatgtatgtgcttc

SEQ ID NO: 35555 - DNA, 20 bp, Artificial Sequence
  chemically synthesized
actatgtatgtgcttcaaga

SEQ ID NO: 35556 - DNA, 20 bp, Artificial Sequence
  chemically synthesized
tgcttcaagatggaactcct

SEQ ID NO: 35557 - DNA, 20 bp, Artificial Sequence
  chemically synthesized
agatggaactcctgagttca

SEQ ID NO: 35558 - DNA, 20 bp, Artificial Sequence
  chemically synthesized
gatggaactcctgagttcac

SEQ ID NO: 35559 - DNA, 20 bp, Artificial Sequence
  chemically synthesized
cacaggtgatttataaacca

SEQ ID NO: 35560 - DNA, 20 bp, Artificial Sequence
  chemically synthesized
actacaaaactctcaccctc

SEQ ID NO: 35561 - DNA, 20 bp, Artificial Sequence
  chemically synthesized
tacaaaactctcaccctcca

SEQ ID NO: 35562 - DNA, 20 bp, Artificial Sequence
  chemically synthesized
accctccagagatttgcctc

SEQ ID NO: 35563 - DNA, 20 bp, Artificial Sequence
  chemically synthesized
ccctccagagatttgcctca

SEQ ID NO: 35564 - DNA, 20 bp, Artificial Sequence
  chemically synthesized
cctccagagatttgcctcaa

SEQ ID NO: 35565 - DNA, 20 bp, Artificial Sequence
  chemically synthesized
gggacaacaccctgctcaca

SEQ ID NO: 35566 - DNA, 20 bp, Artificial Sequence
  chemically synthesized
ggacaacaccctgctcacaa

SEQ ID NO: 35567 - DNA, 20 bp, Artificial Sequence
  chemically synthesized
caccctgctcacaaaggcac

SEQ ID NO: 35568 - DNA, 20 bp, Artificial Sequence
  chemically synthesized
cctgctcacaaaggcaccag

SEQ ID NO: 35569 - DNA, 20 bp, Artificial Sequence
  chemically synthesized
ctgctcacaaaggcaccagc

SEQ ID NO: 35570 - DNA, 20 bp, Artificial Sequence
  chemically synthesized
caggcaactgctcaactacc

SEQ ID NO: 35571 - DNA, 20 bp, Artificial Sequence
  chemically synthesized
gcaactgctcaactacctgg

SEQ ID NO: 35572 - DNA, 20 bp, Artificial Sequence
  chemically synthesized
tgctcaactacctggtggat

SEQ ID NO: 35573 - DNA, 20 bp, Artificial Sequence
  chemically synthesized
gctcaactacctggtggata

SEQ ID NO: 35574 - DNA, 20 bp, Artificial Sequence
  chemically synthesized
acctggtggataaggtgccc

SEQ ID NO: 35575 - DNA, 20 bp, Artificial Sequence
  chemically synthesized
ggtggataaggtgcccaagc

SEQ ID NO: 35576 - DNA, 20 bp, Artificial Sequence
  chemically synthesized
ataaggtgcccaagctagca

SEQ ID NO: 35577 - DNA, 20 bp, Artificial Sequence
  chemically synthesized
cctcctctgttgccttttaa

SEQ ID NO: 35578 - DNA, 20 bp, Artificial Sequence
  chemically synthesized
agtgccactttctgctccta

SEQ ID NO: 35579 - DNA, 20 bp, Artificial Sequence
  chemically synthesized
cactttctgctcctaaagtg

SEQ ID NO: 35580 - DNA, 20 bp, Artificial Sequence
  chemically synthesized
tttctgctcctaaagtgaag

SEQ ID NO: 35581 - DNA, 20 bp, Artificial Sequence
  chemically synthesized
gctcctaaagtgaagtagta

SEQ ID NO: 35582 - DNA, 20 bp, Artificial Sequence
  chemically synthesized
cctaaagtgaagtagtacgg

SEQ ID NO: 35583 - DNA, 20 bp, Artificial Sequence
  chemically synthesized
ctaaagtgaagtagtacggc

SEQ ID NO: 35584 - DNA, 20 bp, Artificial Sequence
  chemically synthesized
actgctgcatttcttcccct

SEQ ID NO: 35585 - DNA, 20 bp, Artificial Sequence
  chemically synthesized
ctgcatttcttcccctaagc

SEQ ID NO: 35586 - DNA, 20 bp, Artificial Sequence
  chemically synthesized
ttcttcccctaagctagctt

SEQ ID NO: 35587 - DNA, 20 bp, Artificial Sequence
  chemically synthesized
ttcccctaagctagctttgg

SEQ ID NO: 35588 - DNA, 20 bp, Artificial Sequence
  chemically synthesized
gcaaatcactttctttatac

SEQ ID NO: 35589 - DNA, 20 bp, Artificial Sequence
  chemically synthesized
cagacttctctcttcttaat

SEQ ID NO: 35590 - DNA, 20 bp, Artificial Sequence
  chemically synthesized
tcttcttaattggattctgc

SEQ ID NO: 35591 - DNA, 20 bp, Artificial Sequence
  chemically synthesized
tcttaattggattctgcaag

SEQ ID NO: 35592 - DNA, 20 bp, Artificial Sequence
  chemically synthesized
caaacaattaacctgctctt

SEQ ID NO: 35593 - DNA, 20 bp, Artificial Sequence
  chemically synthesized
aacctgctcttcagttacat

SEQ ID NO: 35594 - DNA, 20 bp, Artificial Sequence
  chemically synthesized
cagttacattggaatgtgtt

SEQ ID NO: 35595 - DNA, 20 bp, Artificial Sequence
  chemically synthesized
agatttattttttcaaatgt

SEQ ID NO: 35596 - DNA, 20 bp, Artificial Sequence
  chemically synthesized
ttttttcaaatgttggaaca

SEQ ID NO: 35597 - DNA, 20 bp, Artificial Sequence
  chemically synthesized
atgttggaacaaagatgaaa

SEQ ID NO: 35598 - DNA, 20 bp, Artificial Sequence
  chemically synthesized
tggaacaaagatgaaaaagt

SEQ ID NO: 35599 - DNA, 20 bp, Artificial Sequence
  chemically synthesized
aacaaagatgaaaaagtgag

SEQ ID NO: 35600 - DNA, 20 bp, Artificial Sequence
  chemically synthesized
caaagatgaaaaagtgagaa

SEQ ID NO: 35601 - DNA, 20 bp, Artificial Sequence
  chemically synthesized
tgaaaaagtgagaagagccc

SEQ ID NO: 35602 - DNA, 20 bp, Artificial Sequence
  chemically synthesized
aagagccctagattttttct

SEQ ID NO: 35603 - DNA, 20 bp, Artificial Sequence
  chemically synthesized
tagattttttcttggaaatc

SEQ ID NO: 35604 - DNA, 20 bp, Artificial Sequence
  chemically synthesized
ttggaaatctggcttaaatc

SEQ ID NO: 35605 - DNA, 20 bp, Artificial Sequence
  chemically synthesized
tggaaatctggcttaaatcc

SEQ ID NO: 35606 - DNA, 20 bp, Artificial Sequence
  chemically synthesized
gtttctttatttccttgatt

SEQ ID NO: 35607 - DNA, 20 bp, Artificial Sequence
  chemically synthesized
tttctttatttccttgattt

SEQ ID NO: 35608 - DNA, 20 bp, Artificial Sequence
  chemically synthesized
atttccttgatttgggaatt

SEQ ID NO: 35609 - DNA, 20 bp, Artificial Sequence
  chemically synthesized
tgatttgggaatttggtcac

SEQ ID NO: 35610 - DNA, 20 bp, Artificial Sequence
  chemically synthesized
acaaataacatgattttcct

SEQ ID NO: 35611 - DNA, 20 bp, Artificial Sequence
  chemically synthesized
taacatgattttcctaagtc

SEQ ID NO: 35612 - DNA, 20 bp, Artificial Sequence
  chemically synthesized
agatttctttgtttataaaa

SEQ ID NO: 35613 - DNA, 20 bp, Artificial Sequence
  chemically synthesized
gatttctttgtttataaaat

SEQ ID NO: 35614 - DNA, 20 bp, Artificial Sequence
  chemically synthesized
atttctttgtttataaaatg

SEQ ID NO: 35615 - DNA, 20 bp, Artificial Sequence
  chemically synthesized
tgctaccctacctataccat

SEQ ID NO: 35616 - DNA, 20 bp, Artificial Sequence
  chemically synthesized
acctataccatgagctaaat

SEQ ID NO: 35617 - DNA, 20 bp, Artificial Sequence
  chemically synthesized
ataccatgagctaaataagc

SEQ ID NO: 35618 - DNA, 20 bp, Artificial Sequence
  chemically synthesized
taaataagctagtatttgta

SEQ ID NO: 35619 - DNA, 20 bp, Artificial Sequence
  chemically synthesized
aaataagctagtatttgtaa

SEQ ID NO: 35620 - DNA, 20 bp, Artificial Sequence
  chemically synthesized
cttacattcacaatcacaca

SEQ ID NO: 35621 - DNA, 20 bp, Artificial Sequence
  chemically synthesized
tgtatgtatgtataaaaatg

SEQ ID NO: 35622 - DNA, 20 bp, Artificial Sequence
  chemically synthesized
gtatgtatgtataaaaatgt

SEQ ID NO: 35623 - DNA, 20 bp, Artificial Sequence
  chemically synthesized
tatgtatgtataaaaatgtg

SEQ ID NO: 35624 - DNA, 20 bp, Artificial Sequence
  chemically synthesized
acccactcaacaaataccct

SEQ ID NO: 35625 - DNA, 20 bp, Artificial Sequence
  chemically synthesized
cattatatgcgtatatcatc

SEQ ID NO: 35626 - DNA, 20 bp, Artificial Sequence
  chemically synthesized
tgcgtatatcatctggcaaa

SEQ ID NO: 35627 - DNA, 20 bp, Artificial Sequence
  chemically synthesized
atggatgtgtataatttctc

SEQ ID NO: 35628 - DNA, 20 bp, Artificial Sequence
  chemically synthesized
tggatgtgtataatttctcc

SEQ ID NO: 35629 - DNA, 20 bp, Artificial Sequence
  chemically synthesized
ggatgtgtataatttctcca

SEQ ID NO: 35630 - DNA, 20 bp, Artificial Sequence
  chemically synthesized
tgtataatttctccagggat

SEQ ID NO: 35631 - DNA, 20 bp, Artificial Sequence
  chemically synthesized
ataatttctccagggataag

SEQ ID NO: 35632 - DNA, 20 bp, Artificial Sequence
  chemically synthesized
aagaagcaaatgtataccga

SEQ ID NO: 35633 - DNA, 20 bp, Artificial Sequence
  chemically synthesized
agcaaatgtataccgatgga

SEQ ID NO: 35634 - DNA, 20 bp, Artificial Sequence
  chemically synthesized
taccgatggaaagccttact

SEQ ID NO: 35635 - DNA, 20 bp, Artificial Sequence
  chemically synthesized
accgatggaaagccttactc

SEQ ID NO: 35636 - DNA, 20 bp, Artificial Sequence
  chemically synthesized
gccttactcaggccataaca

SEQ ID NO: 35637 - DNA, 20 bp, Artificial Sequence
  chemically synthesized
cttactcaggccataacaaa

SEQ ID NO: 35638 - DNA, 20 bp, Artificial Sequence
  chemically synthesized
tactcaggccataacaaaga

SEQ ID NO: 35639 - DNA, 20 bp, Artificial Sequence
  chemically synthesized
ataacaaagagagaaatgct

SEQ ID NO: 35640 - DNA, 20 bp, Artificial Sequence
  chemically synthesized
gctgagtcccactccatgaa

SEQ ID NO: 35641 - DNA, 20 bp, Artificial Sequence
  chemically synthesized
ctgagtcccactccatgaac

SEQ ID NO: 35642 - DNA, 20 bp, Artificial Sequence
  chemically synthesized
tcccactccatgaacaggtc

SEQ ID NO: 35643 - DNA, 20 bp, Artificial Sequence
  chemically synthesized
cccactccatgaacaggtca

SEQ ID NO: 35644 - DNA, 20 bp, Artificial Sequence
  chemically synthesized
caaggaaccaaacatattca

SEQ ID NO: 35645 - DNA, 20 bp, Artificial Sequence
  chemically synthesized
aggaaccaaacatattcaaa

SEQ ID NO: 35646 - DNA, 20 bp, Artificial Sequence
  chemically synthesized
atttcattgtttcaacttgc

SEQ ID NO: 35647 - DNA, 20 bp, Artificial Sequence
  chemically synthesized
cattgtttcaacttgctagt

SEQ ID NO: 35648 - DNA, 20 bp, Artificial Sequence
  chemically synthesized
attgtttcaacttgctagtg

SEQ ID NO: 35649 - DNA, 20 bp, Artificial Sequence
  chemically synthesized
ttgtttcaacttgctagtga

SEQ ID NO: 35650 - DNA, 20 bp, Artificial Sequence
  chemically synthesized
tgtttcaacttgctagtgag

SEQ ID NO: 35651 - DNA, 20 bp, Artificial Sequence
  chemically synthesized
tttcaacttgctagtgaggg

SEQ ID NO: 35652 - DNA, 20 bp, Artificial Sequence
  chemically synthesized
acttgctagtgaggggagca

SEQ ID NO: 35653 - DNA, 20 bp, Artificial Sequence
  chemically synthesized
aggggagcatggcacctgaa

SEQ ID NO: 35654 - DNA, 20 bp, Artificial Sequence
  chemically synthesized
gggagcatggcacctgaaca

SEQ ID NO: 35655 - DNA, 20 bp, Artificial Sequence
  chemically synthesized
tgatataaattaatgaaact

SEQ ID NO: 35656 - DNA, 20 bp, Artificial Sequence
  chemically synthesized
aattaatgaaactgagaacc

SEQ ID NO: 35657 - DNA, 20 bp, Artificial Sequence
  chemically synthesized
atgaaactgagaaccaagcg

SEQ ID NO: 35658 - DNA, 20 bp, Artificial Sequence
  chemically synthesized
gaaactgagaaccaagcgaa

SEQ ID NO: 35659 - DNA, 20 bp, Artificial Sequence
  chemically synthesized
tgagaaccaagcgaagagct

SEQ ID NO: 35660 - DNA, 20 bp, Artificial Sequence
  chemically synthesized
gagcttagccatcctttgca

SEQ ID NO: 35661 - DNA, 20 bp, Artificial Sequence
  chemically synthesized
ttagccatcctttgcatagt

SEQ ID NO: 35662 - DNA, 20 bp, Artificial Sequence
  chemically synthesized
ctttgcatagttagctacaa

SEQ ID NO: 35663 - DNA, 20 bp, Artificial Sequence
  chemically synthesized
tacaatggctatttattttt

SEQ ID NO: 35664 - DNA, 20 bp, Artificial Sequence
  chemically synthesized
atggctatttatttttcagc

SEQ ID NO: 35665 - DNA, 20 bp, Artificial Sequence
  chemically synthesized
tatttatttttcagccagac

SEQ ID NO: 35666 - DNA, 20 bp, Artificial Sequence
  chemically synthesized
cagccagactggccatcatg

SEQ ID NO: 35667 - DNA, 20 bp, Artificial Sequence
  chemically synthesized
agccagactggccatcatgt

SEQ ID NO: 35668 - DNA, 20 bp, Artificial Sequence
  chemically synthesized
atcatgtaggcacactcttt

SEQ ID NO: 35669 - DNA, 20 bp, Artificial Sequence
  chemically synthesized
gtaggcacactcttttagat

SEQ ID NO: 35670 - DNA, 20 bp, Artificial Sequence
  chemically synthesized
ttttttctgcccattcattc

SEQ ID NO: 35671 - DNA, 20 bp, Artificial Sequence
  chemically synthesized
cattcattccagcaccgtga

SEQ ID NO: 35672 - DNA, 20 bp, Artificial Sequence
  chemically synthesized
cagcaccgtgacagtcttca

SEQ ID NO: 35673 - DNA, 20 bp, Artificial Sequence
  chemically synthesized
agcaccgtgacagtcttcac

SEQ ID NO: 35674 - DNA, 20 bp, Artificial Sequence
  chemically synthesized
gcaccgtgacagtcttcacg

SEQ ID NO: 35675 - DNA, 20 bp, Artificial Sequence
  chemically synthesized
gaaattaaacttattttttt

SEQ ID NO: 35676 - DNA, 20 bp, Artificial Sequence
  chemically synthesized
agaatttttcaatcatatac

SEQ ID NO: 35677 - DNA, 20 bp, Artificial Sequence
  chemically synthesized
tcatatacaagattttgaac

SEQ ID NO: 35678 - DNA, 20 bp, Artificial Sequence
  chemically synthesized
catatacaagattttgaact

SEQ ID NO: 35679 - DNA, 20 bp, Artificial Sequence
  chemically synthesized
aattaaatgaattgcacata

SEQ ID NO: 35680 - DNA, 20 bp, Artificial Sequence
  chemically synthesized
atgaattgcacataaagcca

SEQ ID NO: 35681 - DNA, 20 bp, Artificial Sequence
  chemically synthesized
tatgtatttttactacattg

SEQ ID NO: 35682 - DNA, 20 bp, Artificial Sequence
  chemically synthesized
atgtatttttactacattgt

SEQ ID NO: 35683 - DNA, 20 bp, Artificial Sequence
  chemically synthesized
gtatttttactacattgtgg

SEQ ID NO: 35684 - DNA, 20 bp, Artificial Sequence
  chemically synthesized
aactatgtcttacctgattt

SEQ ID NO: 35685 - DNA, 20 bp, Artificial Sequence
  chemically synthesized
ttacctgatttcagaaataa

SEQ ID NO: 35686 - DNA, 20 bp, Artificial Sequence
  chemically synthesized
cctgatttcagaaataaaag

SEQ ID NO: 35687 - DNA, 20 bp, Artificial Sequence
  chemically synthesized
gatttcagaaataaaagaag

SEQ ID NO: 35688 - DNA, 20 bp, Artificial Sequence
  chemically synthesized
ttcagaaataaaagaagtag

SEQ ID NO: 35689 - DNA, 20 bp, Artificial Sequence
  chemically synthesized
cacttccttatgttccattt

SEQ ID NO: 35690 - DNA, 20 bp, Artificial Sequence
  chemically synthesized
acttccttatgttccatttt

SEQ ID NO: 35691 - DNA, 20 bp, Artificial Sequence
  chemically synthesized
cttatgttccattttgggac

SEQ ID NO: 35692 - DNA, 20 bp, Artificial Sequence
  chemically synthesized
tgttccattttgggactggc

SEQ ID NO: 35693 - DNA, 20 bp, Artificial Sequence
  chemically synthesized
tccattttgggactggccag

SEQ ID NO: 35694 - DNA, 20 bp, Artificial Sequence
  chemically synthesized
tgggactggccagcagtgcc

SEQ ID NO: 35695 - DNA, 20 bp, Artificial Sequence
  chemically synthesized
actggccagcagtgcccaga

SEQ ID NO: 35696 - DNA, 20 bp, Artificial Sequence
  chemically synthesized
cagaaagtgtgtcccaatcc

SEQ ID NO: 35697 - DNA, 20 bp, Artificial Sequence
  chemically synthesized
agaaagtgtgtcccaatccc

SEQ ID NO: 35698 - DNA, 20 bp, Artificial Sequence
  chemically synthesized
aggacattgttgacttacat

SEQ ID NO: 35699 - DNA, 20 bp, Artificial Sequence
  chemically synthesized
gacattgttgacttacatga

SEQ ID NO: 35700 - DNA, 20 bp, Artificial Sequence
  chemically synthesized
gagtaaacgcacccacaaac

SEQ ID NO: 35701 - DNA, 20 bp, Artificial Sequence
  chemically synthesized
aaacgcacccacaaaccaga

SEQ ID NO: 35702 - DNA, 20 bp, Artificial Sequence
  chemically synthesized
acaaaccagatagtcaaatt

SEQ ID NO: 35703 - DNA, 20 bp, Artificial Sequence
  chemically synthesized
aattaagttaatgattctct

SEQ ID NO: 35704 - DNA, 20 bp, Artificial Sequence
  chemically synthesized
ttaagttaatgattctctca

SEQ ID NO: 35705 - DNA, 20 bp, Artificial Sequence
  chemically synthesized
ctctcagagacccatgccac

SEQ ID NO: 35706 - DNA, 20 bp, Artificial Sequence
  chemically synthesized
agagacccatgccactggct

SEQ ID NO: 35707 - DNA, 20 bp, Artificial Sequence
  chemically synthesized
gacccatgccactggctcag

SEQ ID NO: 35708 - DNA, 20 bp, Artificial Sequence
  chemically synthesized
acccatgccactggctcagc

SEQ ID NO: 35709 - DNA, 20 bp, Artificial Sequence
  chemically synthesized
cccatgccactggctcagca

SEQ ID NO: 35710 - DNA, 20 bp, Artificial Sequence
  chemically synthesized
ttcaaacattaccttgaata

SEQ ID NO: 35711 - DNA, 20 bp, Artificial Sequence
  chemically synthesized
caaacattaccttgaatata

SEQ ID NO: 35712 - DNA, 20 bp, Artificial Sequence
  chemically synthesized
tagagtcttataaaatattt

SEQ ID NO: 35713 - DNA, 20 bp, Artificial Sequence
  chemically synthesized
gagtcttataaaatatttga

SEQ ID NO: 35714 - DNA, 20 bp, Artificial Sequence
  chemically synthesized
atttgagagtgcaatgtcaa

SEQ ID NO: 35715 - DNA, 20 bp, Artificial Sequence
  chemically synthesized
agtgcaatgtcaatagatgc

SEQ ID NO: 35716 - DNA, 20 bp, Artificial Sequence
  chemically synthesized
gtgcaatgtcaatagatgct

SEQ ID NO: 35717 - DNA, 20 bp, Artificial Sequence
  chemically synthesized
caatgtcaatagatgctggg

SEQ ID NO: 35718 - DNA, 20 bp, Artificial Sequence
  chemically synthesized
tgtcaatagatgctgggaag

SEQ ID NO: 35719 - DNA, 20 bp, Artificial Sequence
  chemically synthesized
tagatgctgggaagtggtga

SEQ ID NO: 35720 - DNA, 20 bp, Artificial Sequence
  chemically synthesized
gtgaaagccatttcccccct

SEQ ID NO: 35721 - DNA, 20 bp, Artificial Sequence
  chemically synthesized
cttactccttccctcacccc

SEQ ID NO: 35722 - DNA, 20 bp, Artificial Sequence
  chemically synthesized
agaccttcatctttcctgat

SEQ ID NO: 35723 - DNA, 20 bp, Artificial Sequence
  chemically synthesized
ttctttcattctctttcttt

SEQ ID NO: 35724 - DNA, 20 bp, Artificial Sequence
  chemically synthesized
tggataaaataaaatcataa

SEQ ID NO: 35725 - DNA, 20 bp, Artificial Sequence
  chemically synthesized
ataaaataaaatcataaaag

SEQ ID NO: 35726 - DNA, 20 bp, Artificial Sequence
  chemically synthesized
taaaagtagctcatatttgc

SEQ ID NO: 35727 - DNA, 20 bp, Artificial Sequence
  chemically synthesized
ttgctggtaacttccatgac

SEQ ID NO: 35728 - DNA, 20 bp, Artificial Sequence
  chemically synthesized
ccatgaccagaccctctgcc

SEQ ID NO: 35729 - DNA, 20 bp, Artificial Sequence
  chemically synthesized
tgccaagtgctgcacatcca

SEQ ID NO: 35730 - DNA, 20 bp, Artificial Sequence
  chemically synthesized
gcacatccatagcctccctc

SEQ ID NO: 35731 - DNA, 20 bp, Artificial Sequence
  chemically synthesized
gcctccctcaagctttccaa

SEQ ID NO: 35732 - DNA, 20 bp, Artificial Sequence
  chemically synthesized
cctccctcaagctttccaac

SEQ ID NO: 35733 - DNA, 20 bp, Artificial Sequence
  chemically synthesized
ccctcaagctttccaacagg

SEQ ID NO: 35734 - DNA, 20 bp, Artificial Sequence
  chemically synthesized
tccaacaggcagtgctgtac

SEQ ID NO: 35735 - DNA, 20 bp, Artificial Sequence
  chemically synthesized
ccaacaggcagtgctgtacg

SEQ ID NO: 35736 - DNA, 20 bp, Artificial Sequence
  chemically synthesized
aacaggcagtgctgtacgag

SEQ ID NO: 35737 - DNA, 20 bp, Artificial Sequence
  chemically synthesized
acaggcagtgctgtacgagg

SEQ ID NO: 35738 - DNA, 20 bp, Artificial Sequence
  chemically synthesized
caggcagtgctgtacgagga

SEQ ID NO: 35739 - DNA, 20 bp, Artificial Sequence
  chemically synthesized
aggcagtgctgtacgaggag

SEQ ID NO: 35740 - DNA, 20 bp, Artificial Sequence
  chemically synthesized
ggcagtgctgtacgaggagg

SEQ ID NO: 35741 - DNA, 20 bp, Artificial Sequence
  chemically synthesized
tgctgtacgaggagggggct

SEQ ID NO: 35742 - DNA, 20 bp, Artificial Sequence
  chemically synthesized
gctgtacgaggagggggctg

SEQ ID NO: 35743 - DNA, 20 bp, Artificial Sequence
  chemically synthesized
gagggggctgaggccttccc

SEQ ID NO: 35744 - DNA, 20 bp, Artificial Sequence
  chemically synthesized
agggggctgaggccttcccg

SEQ ID NO: 35745 - DNA, 20 bp, Artificial Sequence
  chemically synthesized
cccgaggttgtgtcgctacc

SEQ ID NO: 35746 - DNA, 20 bp, Artificial Sequence
  chemically synthesized
ccgaggttgtgtcgctaccc

SEQ ID NO: 35747 - DNA, 20 bp, Artificial Sequence
  chemically synthesized
cgaggttgtgtcgctaccca

SEQ ID NO: 35748 - DNA, 20 bp, Artificial Sequence
  chemically synthesized
gaggttgtgtcgctacccag

SEQ ID NO: 35749 - DNA, 20 bp, Artificial Sequence
  chemically synthesized
tgtgtcgctacccaggggtg

SEQ ID NO: 35750 - DNA, 20 bp, Artificial Sequence
  chemically synthesized
ctacccaggggtgcagctga

SEQ ID NO: 35751 - DNA, 20 bp, Artificial Sequence
  chemically synthesized
gctgatagacacaacccttt

SEQ ID NO: 35752 - DNA, 20 bp, Artificial Sequence
  chemically synthesized
ctgatagacacaaccctttc

SEQ ID NO: 35753 - DNA, 20 bp, Artificial Sequence
  chemically synthesized
gacacaaccctttcaggtct

SEQ ID NO: 35754 - DNA, 20 bp, Artificial Sequence
  chemically synthesized
cctttcaggtcttagtttac

SEQ ID NO: 35755 - DNA, 20 bp, Artificial Sequence
  chemically synthesized
tcaggtcttagtttacgagc

SEQ ID NO: 35756 - DNA, 20 bp, Artificial Sequence
  chemically synthesized
gtcttagtttacgagcaagc

SEQ ID NO: 35757 - DNA, 20 bp, Artificial Sequence
  chemically synthesized
tcttagtttacgagcaagct

SEQ ID NO: 35758 - DNA, 20 bp, Artificial Sequence
  chemically synthesized
ctgtgccgaaatgacaacat

SEQ ID NO: 35759 - DNA, 20 bp, Artificial Sequence
  chemically synthesized
cttcaaaatttatttattcc

SEQ ID NO: 35760 - DNA, 20 bp, Artificial Sequence
  chemically synthesized
gtaattataaattatgttat

SEQ ID NO: 35761 - DNA, 20 bp, Artificial Sequence
  chemically synthesized
ttataagatatcaatccttc

SEQ ID NO: 35762 - DNA, 20 bp, Artificial Sequence
  chemically synthesized
tataagatatcaatccttcc

SEQ ID NO: 35763 - DNA, 20 bp, Artificial Sequence
  chemically synthesized
taagatatcaatccttccag

SEQ ID NO: 35764 - DNA, 20 bp, Artificial Sequence
  chemically synthesized
aagatatcaatccttccagg

SEQ ID NO: 35765 - DNA, 20 bp, Artificial Sequence
  chemically synthesized
agatatcaatccttccagga

SEQ ID NO: 35766 - DNA, 20 bp, Artificial Sequence
  chemically synthesized
gatatcaatccttccaggag

SEQ ID NO: 35767 - DNA, 20 bp, Artificial Sequence
  chemically synthesized
atatcaatccttccaggagg

SEQ ID NO: 35768 - DNA, 20 bp, Artificial Sequence
  chemically synthesized
tcaatccttccaggaggggg

SEQ ID NO: 35769 - DNA, 20 bp, Artificial Sequence
  chemically synthesized
atccttccaggagggggtgg

SEQ ID NO: 35770 - DNA, 20 bp, Artificial Sequence
  chemically synthesized
gtggctcatgcctataatcc

SEQ ID NO: 35771 - DNA, 20 bp, Artificial Sequence
  chemically synthesized
tgcctataatcccagcattt

SEQ ID NO: 35772 - DNA, 20 bp, Artificial Sequence
  chemically synthesized
gcctataatcccagcatttt

SEQ ID NO: 35773 - DNA, 20 bp, Artificial Sequence
  chemically synthesized
ctataatcccagcattttgg

SEQ ID NO: 35774 - DNA, 20 bp, Artificial Sequence
  chemically synthesized
tataatcccagcattttggg

SEQ ID NO: 35775 - DNA, 20 bp, Artificial Sequence
  chemically synthesized
cccagcattttgggaggcca

SEQ ID NO: 35776 - DNA, 20 bp, Artificial Sequence
  chemically synthesized
agcattttgggaggccacgg

SEQ ID NO: 35777 - DNA, 20 bp, Artificial Sequence
  chemically synthesized
ttttgggaggccacggcaga

SEQ ID NO: 35778 - DNA, 20 bp, Artificial Sequence
  chemically synthesized
ccacggcagatggatcacct

SEQ ID NO: 35779 - DNA, 20 bp, Artificial Sequence
  chemically synthesized
cacggcagatggatcacctg

SEQ ID NO: 35780 - DNA, 20 bp, Artificial Sequence
  chemically synthesized
gcagatggatcacctgaggc

SEQ ID NO: 35781 - DNA, 20 bp, Artificial Sequence
  chemically synthesized
cagatggatcacctgaggcc

SEQ ID NO: 35782 - DNA, 20 bp, Artificial Sequence
  chemically synthesized
gatggatcacctgaggccag

SEQ ID NO: 35783 - DNA, 20 bp, Artificial Sequence
  chemically synthesized
tcacctgaggccaggagttt

SEQ ID NO: 35784 - DNA, 20 bp, Artificial Sequence
  chemically synthesized
tgaggccaggagtttgagac

SEQ ID NO: 35785 - DNA, 20 bp, Artificial Sequence
  chemically synthesized
ccaggagtttgagacaagcc

SEQ ID NO: 35786 - DNA, 20 bp, Artificial Sequence
  chemically synthesized
caggagtttgagacaagcct

SEQ ID NO: 35787 - DNA, 20 bp, Artificial Sequence
  chemically synthesized
tctacaaaaaatacaaaaat

SEQ ID NO: 35788 - DNA, 20 bp, Artificial Sequence
  chemically synthesized
caaaaaatacaaaaattagc

SEQ ID NO: 35789 - DNA, 20 bp, Artificial Sequence
  chemically synthesized
aaaaaatacaaaaattagct

SEQ ID NO: 35790 - DNA, 20 bp, Artificial Sequence
  chemically synthesized
atacaaaaattagctgggtg

SEQ ID NO: 35791 - DNA, 20 bp, Artificial Sequence
  chemically synthesized
acaaaaattagctgggtgtg

SEQ ID NO: 35792 - DNA, 20 bp, Artificial Sequence
  chemically synthesized
caaaaattagctgggtgtgg

SEQ ID NO: 35793 - DNA, 20 bp, Artificial Sequence
  chemically synthesized
ctgggtgtggaggcacatgc

SEQ ID NO: 35794 - DNA, 20 bp, Artificial Sequence
  chemically synthesized
gaggcacatgccagtcatcc

SEQ ID NO: 35795 - DNA, 20 bp, Artificial Sequence
  chemically synthesized
tgccagtcatcccagctact

SEQ ID NO: 35796 - DNA, 20 bp, Artificial Sequence
  chemically synthesized
cagtcatcccagctactaag

SEQ ID NO: 35797 - DNA, 20 bp, Artificial Sequence
  chemically synthesized
agtcatcccagctactaagt

SEQ ID NO: 35798 - DNA, 20 bp, Artificial Sequence
  chemically synthesized
tcccagctactaagtaggct

SEQ ID NO: 35799 - DNA, 20 bp, Artificial Sequence
  chemically synthesized
cccagctactaagtaggctg

SEQ ID NO: 35800 - DNA, 20 bp, Artificial Sequence
  chemically synthesized
tactaagtaggctgaggcac

SEQ ID NO: 35801 - DNA, 20 bp, Artificial Sequence
  chemically synthesized
gcactagaattgcttgaaca

SEQ ID NO: 35802 - DNA, 20 bp, Artificial Sequence
  chemically synthesized
cactagaattgcttgaacac

SEQ ID NO: 35803 - DNA, 20 bp, Artificial Sequence
  chemically synthesized
ctagaattgcttgaacacag

SEQ ID NO: 35804 - DNA, 20 bp, Artificial Sequence
  chemically synthesized
aattgcttgaacacaggaga

SEQ ID NO: 35805 - DNA, 20 bp, Artificial Sequence
  chemically synthesized
ttgcttgaacacaggagatg

SEQ ID NO: 35806 - DNA, 20 bp, Artificial Sequence
  chemically synthesized
tgcttgaacacaggagatgg

SEQ ID NO: 35807 - DNA, 20 bp, Artificial Sequence
  chemically synthesized
aacacaggagatggaggttg

SEQ ID NO: 35808 - DNA, 20 bp, Artificial Sequence
  chemically synthesized
caggagatggaggttgcagt

SEQ ID NO: 35809 - DNA, 20 bp, Artificial Sequence
  chemically synthesized
gatggaggttgcagtgagcc

SEQ ID NO: 35810 - DNA, 20 bp, Artificial Sequence
  chemically synthesized
aagaatgtgccactgcactc

SEQ ID NO: 35811 - DNA, 20 bp, Artificial Sequence
  chemically synthesized
tgtgccactgcactccagcc

SEQ ID NO: 35812 - DNA, 20 bp, Artificial Sequence
  chemically synthesized
gtgccactgcactccagcct

SEQ ID NO: 35813 - DNA, 20 bp, Artificial Sequence
  chemically synthesized
ctgcactccagcctgggtga

SEQ ID NO: 35814 - DNA, 20 bp, Artificial Sequence
  chemically synthesized
gcactccagcctgggtgaca

SEQ ID NO: 35815 - DNA, 20 bp, Artificial Sequence
  chemically synthesized
tccagcctgggtgacagagc

SEQ ID NO: 35816 - DNA, 20 bp, Artificial Sequence
  chemically synthesized
gtgacagagcaagaatgtct

SEQ ID NO: 35817 - DNA, 20 bp, Artificial Sequence
  chemically synthesized
tgacagagcaagaatgtctc

SEQ ID NO: 35818 - DNA, 20 bp, Artificial Sequence
  chemically synthesized
agagcaagaatgtctcagga

SEQ ID NO: 35819 - DNA, 20 bp, Artificial Sequence
  chemically synthesized
aatatcaatccttcctattc

SEQ ID NO: 35820 - DNA, 20 bp, Artificial Sequence
  chemically synthesized
atcaatccttcctattctag

SEQ ID NO: 35821 - DNA, 20 bp, Artificial Sequence
  chemically synthesized
ccttcctattctagtagttg

SEQ ID NO: 35822 - DNA, 20 bp, Artificial Sequence
  chemically synthesized
atatttttaaaaataaaaca

SEQ ID NO: 35823 - DNA, 20 bp, Artificial Sequence
  chemically synthesized
tatttttaaaaataaaacat

SEQ ID NO: 35824 - DNA, 20 bp, Artificial Sequence
  chemically synthesized
atttttaaaaataaaacata

SEQ ID NO: 35825 - DNA, 20 bp, Artificial Sequence
  chemically synthesized
taaaaataaaacatagggtc

SEQ ID NO: 35826 - DNA, 20 bp, Artificial Sequence
  chemically synthesized
ataaaacatagggtcgagtg

SEQ ID NO: 35827 - DNA, 20 bp, Artificial Sequence
  chemically synthesized
aaacatagggtcgagtgcgg

SEQ ID NO: 35828 - DNA, 20 bp, Artificial Sequence
  chemically synthesized
gtggctcaactctgtaatcc

SEQ ID NO: 35829 - DNA, 20 bp, Artificial Sequence
  chemically synthesized
actctgtaatcccagcactt

SEQ ID NO: 35830 - DNA, 20 bp, Artificial Sequence
  chemically synthesized
ctctgtaatcccagcacttt

SEQ ID NO: 35831 - DNA, 20 bp, Artificial Sequence
  chemically synthesized
ctgtaatcccagcactttgg

SEQ ID NO: 35832 - DNA, 20 bp, Artificial Sequence
  chemically synthesized
tgtaatcccagcactttggg

SEQ ID NO: 35833 - DNA, 20 bp, Artificial Sequence
  chemically synthesized
tcccagcactttgggaggcc

SEQ ID NO: 35834 - DNA, 20 bp, Artificial Sequence
  chemically synthesized
agcactttgggaggccaaga

SEQ ID NO: 35835 - DNA, 20 bp, Artificial Sequence
  chemically synthesized
gcactttgggaggccaagac

SEQ ID NO: 35836 - DNA, 20 bp, Artificial Sequence
  chemically synthesized
ctttgggaggccaagacagg

SEQ ID NO: 35837 - DNA, 20 bp, Artificial Sequence
  chemically synthesized
ggccaagacaggtggatcac

SEQ ID NO: 35838 - DNA, 20 bp, Artificial Sequence
  chemically synthesized
gccaagacaggtggatcaca

SEQ ID NO: 35839 - DNA, 20 bp, Artificial Sequence
  chemically synthesized
agacaggtggatcacaaggt

SEQ ID NO: 35840 - DNA, 20 bp, Artificial Sequence
  chemically synthesized
gacaggtggatcacaaggtc

SEQ ID NO: 35841 - DNA, 20 bp, Artificial Sequence
  chemically synthesized
caggtggatcacaaggtcag

SEQ ID NO: 35842 - DNA, 20 bp, Artificial Sequence
  chemically synthesized
gatcacaaggtcaggagttt

SEQ ID NO: 35843 - DNA, 20 bp, Artificial Sequence
  chemically synthesized
caaggtcaggagtttgagac

SEQ ID NO: 35844 - DNA, 20 bp, Artificial Sequence
  chemically synthesized
gtcaggagtttgagaccagc

SEQ ID NO: 35845 - DNA, 20 bp, Artificial Sequence
  chemically synthesized
tcaggagtttgagaccagcc

SEQ ID NO: 35846 - DNA, 20 bp, Artificial Sequence
  chemically synthesized
tgagaccagccaggccaatg

SEQ ID NO: 35847 - DNA, 20 bp, Artificial Sequence
  chemically synthesized
tctactaaaaatacaaaaat

SEQ ID NO: 35848 - DNA, 20 bp, Artificial Sequence
  chemically synthesized
ctaaaaatacaaaaattagc

SEQ ID NO: 35849 - DNA, 20 bp, Artificial Sequence
  chemically synthesized
taaaaatacaaaaattagcc

SEQ ID NO: 35850 - DNA, 20 bp, Artificial Sequence
  chemically synthesized
atacaaaaattagccaggcg

SEQ ID NO: 35851 - DNA, 20 bp, Artificial Sequence
  chemically synthesized
caaaaattagccaggcgtgg

SEQ ID NO: 35852 - DNA, 20 bp, Artificial Sequence
  chemically synthesized
aaattagccaggcgtggtgg

SEQ ID NO: 35853 - DNA, 20 bp, Artificial Sequence
  chemically synthesized
aattagccaggcgtggtggt

SEQ ID NO: 35854 - DNA, 20 bp, Artificial Sequence
  chemically synthesized
gtggtgggcacctgtaatcc

SEQ ID NO: 35855 - DNA, 20 bp, Artificial Sequence
  chemically synthesized
gcacctgtaatcccagctac

SEQ ID NO: 35856 - DNA, 20 bp, Artificial Sequence
  chemically synthesized
cacctgtaatcccagctact

SEQ ID NO: 35857 - DNA, 20 bp, Artificial Sequence
  chemically synthesized
acctgtaatcccagctacta

SEQ ID NO: 35858 - DNA, 20 bp, Artificial Sequence
  chemically synthesized
ctgtaatcccagctactagg

SEQ ID NO: 35859 - DNA, 20 bp, Artificial Sequence
  chemically synthesized
tgtaatcccagctactaggg

SEQ ID NO: 35860 - DNA, 20 bp, Artificial Sequence
  chemically synthesized
atcccagctactagggaggc

SEQ ID NO: 35861 - DNA, 20 bp, Artificial Sequence
  chemically synthesized
cccagctactagggaggctg

SEQ ID NO: 35862 - DNA, 20 bp, Artificial Sequence
  chemically synthesized
ctggagtattcacttgaacc

SEQ ID NO: 35863 - DNA, 20 bp, Artificial Sequence
  chemically synthesized
tggagtattcacttgaaccc

SEQ ID NO: 35864 - DNA, 20 bp, Artificial Sequence
  chemically synthesized
gagtattcacttgaacccag

SEQ ID NO: 35865 - DNA, 20 bp, Artificial Sequence
  chemically synthesized
agtattcacttgaacccagg

SEQ ID NO: 35866 - DNA, 20 bp, Artificial Sequence
  chemically synthesized
attcacttgaacccaggagg

SEQ ID NO: 35867 - DNA, 20 bp, Artificial Sequence
  chemically synthesized
cacttgaacccaggaggtgg

SEQ ID NO: 35868 - DNA, 20 bp, Artificial Sequence
  chemically synthesized
aacccaggaggtggaagttg

SEQ ID NO: 35869 - DNA, 20 bp, Artificial Sequence
  chemically synthesized
caggaggtggaagttgcagt

SEQ ID NO: 35870 - DNA, 20 bp, Artificial Sequence
  chemically synthesized
gcagtgagccaaaatcacgt

SEQ ID NO: 35871 - DNA, 20 bp, Artificial Sequence
  chemically synthesized
tcacgtcagtgcacttcaac

SEQ ID NO: 35872 - DNA, 20 bp, Artificial Sequence
  chemically synthesized
cacgtcagtgcacttcaacc

SEQ ID NO: 35873 - DNA, 20 bp, Artificial Sequence
  chemically synthesized
acgtcagtgcacttcaaccg

SEQ ID NO: 35874 - DNA, 20 bp, Artificial Sequence
  chemically synthesized
cagtgcacttcaaccggggt

SEQ ID NO: 35875 - DNA, 20 bp, Artificial Sequence
  chemically synthesized
gtgcacttcaaccggggtga

SEQ ID NO: 35876 - DNA, 20 bp, Artificial Sequence
  chemically synthesized
aataaaataaaataaaataa

SEQ ID NO: 35877 - DNA, 20 bp, Artificial Sequence
  chemically synthesized
aataaaataaaataaaagca

SEQ ID NO: 35878 - DNA, 20 bp, Artificial Sequence
  chemically synthesized
tctttccgcaaatgaattca

SEQ ID NO: 35879 - DNA, 20 bp, Artificial Sequence
  chemically synthesized
cttacattttcgttctcatg

SEQ ID NO: 35880 - DNA, 20 bp, Artificial Sequence
  chemically synthesized
attttcgttctcatgaagta

SEQ ID NO: 35881 - DNA, 20 bp, Artificial Sequence
  chemically synthesized
tcgttctcatgaagtaaagc

SEQ ID NO: 35882 - DNA, 20 bp, Artificial Sequence
  chemically synthesized
gttctcatgaagtaaagcaa

SEQ ID NO: 35883 - DNA, 20 bp, Artificial Sequence
  chemically synthesized
ctcatgaagtaaagcaagag

SEQ ID NO: 35884 - DNA, 20 bp, Artificial Sequence
  chemically synthesized
atgaagtaaagcaagagtgg

SEQ ID NO: 35885 - DNA, 20 bp, Artificial Sequence
  chemically synthesized
aaagcaagagtggtagaatt

SEQ ID NO: 35886 - DNA, 20 bp, Artificial Sequence
  chemically synthesized
gcaagagtggtagaattaag

SEQ ID NO: 35887 - DNA, 20 bp, Artificial Sequence
  chemically synthesized
gagtggtagaattaagtgga

SEQ ID NO: 35888 - DNA, 20 bp, Artificial Sequence
  chemically synthesized
gtggtagaattaagtggaaa

SEQ ID NO: 35889 - DNA, 20 bp, Artificial Sequence
  chemically synthesized
aagtggaaagagtctatctc

SEQ ID NO: 35890 - DNA, 20 bp, Artificial Sequence
  chemically synthesized
gaaagagtctatctctagtg

SEQ ID NO: 35891 - DNA, 20 bp, Artificial Sequence
  chemically synthesized
tatctctagtgtagtcacgt

SEQ ID NO: 35892 - DNA, 20 bp, Artificial Sequence
  chemically synthesized
ctctagtgtagtcacgtcag

SEQ ID NO: 35893 - DNA, 20 bp, Artificial Sequence
  chemically synthesized
gtcacgtcagtggttgtgtc

SEQ ID NO: 35894 - DNA, 20 bp, Artificial Sequence
  chemically synthesized
cgtcagtggttgtgtcaaga

SEQ ID NO: 35895 - DNA, 20 bp, Artificial Sequence
  chemically synthesized
agtggttgtgtcaagatggt

SEQ ID NO: 35896 - DNA, 20 bp, Artificial Sequence
  chemically synthesized
gtggttgtgtcaagatggtt

SEQ ID NO: 35897 - DNA, 20 bp, Artificial Sequence
  chemically synthesized
ggttgtgtcaagatggttag

SEQ ID NO: 35898 - DNA, 20 bp, Artificial Sequence
  chemically synthesized
gttgtgtcaagatggttagg

SEQ ID NO: 35899 - DNA, 20 bp, Artificial Sequence
  chemically synthesized
gaggctcctcccgtttaaaa

SEQ ID NO: 35900 - DNA, 20 bp, Artificial Sequence
  chemically synthesized
tcccgtttaaaacagtatcc

SEQ ID NO: 35901 - DNA, 20 bp, Artificial Sequence
  chemically synthesized
ttaaaacagtatccaagccc

SEQ ID NO: 35902 - DNA, 20 bp, Artificial Sequence
  chemically synthesized
agccccagttgtaaatcaat

SEQ ID NO: 35903 - DNA, 20 bp, Artificial Sequence
  chemically synthesized
gccccagttgtaaatcaatt

SEQ ID NO: 35904 - DNA, 20 bp, Artificial Sequence
  chemically synthesized
ccccagttgtaaatcaattg

SEQ ID NO: 35905 - DNA, 20 bp, Artificial Sequence
  chemically synthesized
ccagttgtaaatcaattggg

SEQ ID NO: 35906 - DNA, 20 bp, Artificial Sequence
  chemically synthesized
gacacgccaactctgatcat

SEQ ID NO: 35907 - DNA, 20 bp, Artificial Sequence
  chemically synthesized
tctgatcatcagcaatatct

SEQ ID NO: 35908 - DNA, 20 bp, Artificial Sequence
  chemically synthesized
catcagcaatatctgagctc

SEQ ID NO: 35909 - DNA, 20 bp, Artificial Sequence
  chemically synthesized
caatatctgagctccagtct

SEQ ID NO: 35910 - DNA, 20 bp, Artificial Sequence
  chemically synthesized
ccagtctcagatattgtgtg

SEQ ID NO: 35911 - DNA, 20 bp, Artificial Sequence
  chemically synthesized
tctcagatattgtgtgcagt

SEQ ID NO: 35912 - DNA, 20 bp, Artificial Sequence
  chemically synthesized
ccctctacctccttccctac

SEQ ID NO: 35913 - DNA, 20 bp, Artificial Sequence
  chemically synthesized
taccagaaaaatcaccactt

SEQ ID NO: 35914 - DNA, 20 bp, Artificial Sequence
  chemically synthesized
aaaatcaccactttagtccc

SEQ ID NO: 35915 - DNA, 20 bp, Artificial Sequence
  chemically synthesized
ccactttagtccctggccac

SEQ ID NO: 35916 - DNA, 20 bp, Artificial Sequence
  chemically synthesized
cactttagtccctggccacc

SEQ ID NO: 35917 - DNA, 20 bp, Artificial Sequence
  chemically synthesized
ccctggccaccgggacaccc

SEQ ID NO: 35918 - DNA, 20 bp, Artificial Sequence
  chemically synthesized
cctggccaccgggacacccc

SEQ ID NO: 35919 - DNA, 20 bp, Artificial Sequence
  chemically synthesized
tggccaccgggacaccccag

SEQ ID NO: 35920 - DNA, 20 bp, Artificial Sequence
  chemically synthesized
ggccaccgggacaccccagg

SEQ ID NO: 35921 - DNA, 20 bp, Artificial Sequence
  chemically synthesized
gccaccgggacaccccagga

SEQ ID NO: 35922 - DNA, 20 bp, Artificial Sequence
  chemically synthesized
ccgggacaccccaggagggt

SEQ ID NO: 35923 - DNA, 20 bp, Artificial Sequence
  chemically synthesized
ggacaccccaggagggtgag

SEQ ID NO: 35924 - DNA, 20 bp, Artificial Sequence
  chemically synthesized
cccaggagggtgagtggtct

SEQ ID NO: 35925 - DNA, 20 bp, Artificial Sequence
  chemically synthesized
ccaggagggtgagtggtctg

SEQ ID NO: 35926 - DNA, 20 bp, Artificial Sequence
  chemically synthesized
ggagggtgagtggtctgagg

SEQ ID NO: 35927 - DNA, 20 bp, Artificial Sequence
  chemically synthesized
tgagtggtctgaggtagtta

SEQ ID NO: 35928 - DNA, 20 bp, Artificial Sequence
  chemically synthesized
tgaggtagttatggcactta

SEQ ID NO: 35929 - DNA, 20 bp, Artificial Sequence
  chemically synthesized
tggctcccttgctgctgatc

SEQ ID NO: 35930 - DNA, 20 bp, Artificial Sequence
  chemically synthesized
ttgctgctgatctggaactc

SEQ ID NO: 35931 - DNA, 20 bp, Artificial Sequence
  chemically synthesized
tgatctggaactcaagcccc

SEQ ID NO: 35932 - DNA, 20 bp, Artificial Sequence
  chemically synthesized
tctggaactcaagccccaag

SEQ ID NO: 35933 - DNA, 20 bp, Artificial Sequence
  chemically synthesized
caagccccaagaagtcccct

SEQ ID NO: 35934 - DNA, 20 bp, Artificial Sequence
  chemically synthesized
ggatgatctgaatatacatt

SEQ ID NO: 35935 - DNA, 20 bp, Artificial Sequence
  chemically synthesized
gatgatctgaatatacattt

SEQ ID NO: 35936 - DNA, 20 bp, Artificial Sequence
  chemically synthesized
atctgaatatacatttggga

SEQ ID NO: 35937 - DNA, 20 bp, Artificial Sequence
  chemically synthesized
atatacatttgggacagatc

SEQ ID NO: 35938 - DNA, 20 bp, Artificial Sequence
  chemically synthesized
tatacatttgggacagatct

SEQ ID NO: 35939 - DNA, 20 bp, Artificial Sequence
  chemically synthesized
atacatttgggacagatcta

SEQ ID NO: 35940 - DNA, 20 bp, Artificial Sequence
  chemically synthesized
acatttgggacagatctagg

SEQ ID NO: 35941 - DNA, 20 bp, Artificial Sequence
  chemically synthesized
gacagatctagggagtttct

SEQ ID NO: 35942 - DNA, 20 bp, Artificial Sequence
  chemically synthesized
gggagtttctgagcaacact

SEQ ID NO: 35943 - DNA, 20 bp, Artificial Sequence
  chemically synthesized
tttctgagcaacacttagac

SEQ ID NO: 35944 - DNA, 20 bp, Artificial Sequence
  chemically synthesized
ttctgagcaacacttagact

SEQ ID NO: 35945 - DNA, 20 bp, Artificial Sequence
  chemically synthesized
tctgagcaacacttagactg

SEQ ID NO: 35946 - DNA, 20 bp, Artificial Sequence
  chemically synthesized
cctacttgaattcgctactt

SEQ ID NO: 35947 - DNA, 20 bp, Artificial Sequence
  chemically synthesized
ctacttgaattcgctacttt

SEQ ID NO: 35948 - DNA, 20 bp, Artificial Sequence
  chemically synthesized
aattcgctactttgggactc

SEQ ID NO: 35949 - DNA, 20 bp, Artificial Sequence
  chemically synthesized
ctactttgggactcaagtct

SEQ ID NO: 35950 - DNA, 20 bp, Artificial Sequence
  chemically synthesized
tactttgggactcaagtcta

SEQ ID NO: 35951 - DNA, 20 bp, Artificial Sequence
  chemically synthesized
actttgggactcaagtctaa

SEQ ID NO: 35952 - DNA, 20 bp, Artificial Sequence
  chemically synthesized
ggactcaagtctaagggact

SEQ ID NO: 35953 - DNA, 20 bp, Artificial Sequence
  chemically synthesized
aagtctaagggactgagact

SEQ ID NO: 35954 - DNA, 20 bp, Artificial Sequence
  chemically synthesized
ctaagggactgagactgaga

SEQ ID NO: 35955 - DNA, 20 bp, Artificial Sequence
  chemically synthesized
taagggactgagactgagac

SEQ ID NO: 35956 - DNA, 20 bp, Artificial Sequence
  chemically synthesized
agggactgagactgagacag

SEQ ID NO: 35957 - DNA, 20 bp, Artificial Sequence
  chemically synthesized
ggactgagactgagacagga

SEQ ID NO: 35958 - DNA, 20 bp, Artificial Sequence
  chemically synthesized
agactgagacaggagagcac

SEQ ID NO: 35959 - DNA, 20 bp, Artificial Sequence
  chemically synthesized
ggagagcacaagactaactt

SEQ ID NO: 35960 - DNA, 20 bp, Artificial Sequence
  chemically synthesized
cttgcaactgtcaatgcctc

SEQ ID NO: 35961 - DNA, 20 bp, Artificial Sequence
  chemically synthesized
aatgcctccagccaaatgcc

SEQ ID NO: 35962 - DNA, 20 bp, Artificial Sequence
  chemically synthesized
ctccagccaaatgcccagca

SEQ ID NO: 35963 - DNA, 20 bp, Artificial Sequence
  chemically synthesized
ccagccaaatgcccagcaca

SEQ ID NO: 35964 - DNA, 20 bp, Artificial Sequence
  chemically synthesized
caaatgcccagcacagagct

SEQ ID NO: 35965 - DNA, 20 bp, Artificial Sequence
  chemically synthesized
atgcccagcacagagctcag

SEQ ID NO: 35966 - DNA, 20 bp, Artificial Sequence
  chemically synthesized
gtggatttgactcttccatt

SEQ ID NO: 35967 - DNA, 20 bp, Artificial Sequence
  chemically synthesized
ctcttccattcagaaactca

SEQ ID NO: 35968 - DNA, 20 bp, Artificial Sequence
  chemically synthesized
gcacacttcattctcaatca

SEQ ID NO: 35969 - DNA, 20 bp, Artificial Sequence
  chemically synthesized
cacacttcattctcaatcac

SEQ ID NO: 35970 - DNA, 20 bp, Artificial Sequence
  chemically synthesized
acacttcattctcaatcaca

SEQ ID NO: 35971 - DNA, 20 bp, Artificial Sequence
  chemically synthesized
acttcattctcaatcacagg

SEQ ID NO: 35972 - DNA, 20 bp, Artificial Sequence
  chemically synthesized
cattctcaatcacagggagc

SEQ ID NO: 35973 - DNA, 20 bp, Artificial Sequence
  chemically synthesized
attctcaatcacagggagct

SEQ ID NO: 35974 - DNA, 20 bp, Artificial Sequence
  chemically synthesized
acagggagctgggcttcctt

SEQ ID NO: 35975 - DNA, 20 bp, Artificial Sequence
  chemically synthesized
ggagctgggcttccttgaga

SEQ ID NO: 35976 - DNA, 20 bp, Artificial Sequence
  chemically synthesized
ctgggcttccttgagaaagc

SEQ ID NO: 35977 - DNA, 20 bp, Artificial Sequence
  chemically synthesized
ccttgagaaagccagcccca

SEQ ID NO: 35978 - DNA, 20 bp, Artificial Sequence
  chemically synthesized
cttgagaaagccagccccaa

SEQ ID NO: 35979 - DNA, 20 bp, Artificial Sequence
  chemically synthesized
caaaggtacctgtgtttaaa

SEQ ID NO: 35980 - DNA, 20 bp, Artificial Sequence
  chemically synthesized
acctgtgtttaaaaagatga

SEQ ID NO: 35981 - DNA, 20 bp, Artificial Sequence
  chemically synthesized
gtttaaaaagatgaaagaaa

SEQ ID NO: 35982 - DNA, 20 bp, Artificial Sequence
  chemically synthesized
tacgtccacaacatgttcac

SEQ ID NO: 35983 - DNA, 20 bp, Artificial Sequence
  chemically synthesized
acgtccacaacatgttcaca

SEQ ID NO: 35984 - DNA, 20 bp, Artificial Sequence
  chemically synthesized
acatgttcacaaggaaactc

SEQ ID NO: 35985 - DNA, 20 bp, Artificial Sequence
  chemically synthesized
tgttcacaaggaaactccag

SEQ ID NO: 35986 - DNA, 20 bp, Artificial Sequence
  chemically synthesized
acaaggaaactccagaagaa

SEQ ID NO: 35987 - DNA, 20 bp, Artificial Sequence
  chemically synthesized
aaggaaactccagaagaaca

SEQ ID NO: 35988 - DNA, 20 bp, Artificial Sequence
  chemically synthesized
gaaactccagaagaacagag

SEQ ID NO: 35989 - DNA, 20 bp, Artificial Sequence
  chemically synthesized
actccagaagaacagagcag

SEQ ID NO: 35990 - DNA, 20 bp, Artificial Sequence
  chemically synthesized
gaagaacagagcagtggtga

SEQ ID NO: 35991 - DNA, 20 bp, Artificial Sequence
  chemically synthesized
tggacctcctgtctgtccgt

SEQ ID NO: 35992 - DNA, 20 bp, Artificial Sequence
  chemically synthesized
ggacctcctgtctgtccgtg

SEQ ID NO: 35993 - DNA, 20 bp, Artificial Sequence
  chemically synthesized
cctgtctgtccgtgaggctg

SEQ ID NO: 35994 - DNA, 20 bp, Artificial Sequence
  chemically synthesized
tccgtgaggctgtagaacac

SEQ ID NO: 35995 - DNA, 20 bp, Artificial Sequence
  chemically synthesized
ccgtgaggctgtagaacaca

SEQ ID NO: 35996 - DNA, 20 bp, Artificial Sequence
  chemically synthesized
tgaggctgtagaacacaagg

SEQ ID NO: 35997 - DNA, 20 bp, Artificial Sequence
  chemically synthesized
aaggcagctcccaatgctgc

SEQ ID NO: 35998 - DNA, 20 bp, Artificial Sequence
  chemically synthesized
ctgccagactctctgaaccc

SEQ ID NO: 35999 - DNA, 20 bp, Artificial Sequence
  chemically synthesized
gccagactctctgaaccctg

SEQ ID NO: 36000 - DNA, 20 bp, Artificial Sequence
  chemically synthesized
cagactctctgaaccctgga

SEQ ID NO: 36001 - DNA, 20 bp, Artificial Sequence
  chemically synthesized
ggagagtgtaaacgtcatat

SEQ ID NO: 36002 - DNA, 20 bp, Artificial Sequence
  chemically synthesized
agagtgtaaacgtcatataa

SEQ ID NO: 36003 - DNA, 20 bp, Artificial Sequence
  chemically synthesized
gagtctatgttccaaaaacc

SEQ ID NO: 36004 - DNA, 20 bp, Artificial Sequence
  chemically synthesized
aaacctggatttaacaatct

SEQ ID NO: 36005 - DNA, 20 bp, Artificial Sequence
  chemically synthesized
taacaatctgagctttgtca

SEQ ID NO: 36006 - DNA, 20 bp, Artificial Sequence
  chemically synthesized
agctttgtcatggtgctttg

SEQ ID NO: 36007 - DNA, 20 bp, Artificial Sequence
  chemically synthesized
ttgtcatggtgctttgcggt

SEQ ID NO: 36008 - DNA, 20 bp, Artificial Sequence
  chemically synthesized
tctttgcttttaaaaccata

SEQ ID NO: 36009 - DNA, 20 bp, Artificial Sequence
  chemically synthesized
taaagaataatgtttaaatg

SEQ ID NO: 36010 - DNA, 20 bp, Artificial Sequence
  chemically synthesized
aagaataatgtttaaatgta

SEQ ID NO: 36011 - DNA, 20 bp, Artificial Sequence
  chemically synthesized
aatgtttaaatgtagagtct

SEQ ID NO: 36012 - DNA, 20 bp, Artificial Sequence
  chemically synthesized
tgctattgtttttatatttt

SEQ ID NO: 36013 - DNA, 20 bp, Artificial Sequence
  chemically synthesized
ttcactcaacattacataat

SEQ ID NO: 36014 - DNA, 20 bp, Artificial Sequence
  chemically synthesized
attacataatgagttttgta

SEQ ID NO: 36015 - DNA, 20 bp, Artificial Sequence
  chemically synthesized
tcttcataactaatatttta

SEQ ID NO: 36016 - DNA, 20 bp, Artificial Sequence
  chemically synthesized
cttcataactaatattttaa

SEQ ID NO: 36017 - DNA, 20 bp, Artificial Sequence
  chemically synthesized
tcataactaatattttaaag

SEQ ID NO: 36018 - DNA, 20 bp, Artificial Sequence
  chemically synthesized
ataactaatattttaaagga

SEQ ID NO: 36019 - DNA, 20 bp, Artificial Sequence
  chemically synthesized
aaggagagctactgattaat

SEQ ID NO: 36020 - DNA, 20 bp, Artificial Sequence
  chemically synthesized
agctactgattaatgagcat

SEQ ID NO: 36021 - DNA, 20 bp, Artificial Sequence
  chemically synthesized
gctactgattaatgagcatg

SEQ ID NO: 36022 - DNA, 20 bp, Artificial Sequence
  chemically synthesized
aatgagcatgaggtttcctt

SEQ ID NO: 36023 - DNA, 20 bp, Artificial Sequence
  chemically synthesized
atgagcatgaggtttccttt

SEQ ID NO: 36024 - DNA, 20 bp, Artificial Sequence
  chemically synthesized
tgagcatgaggtttcctttg

SEQ ID NO: 36025 - DNA, 20 bp, Artificial Sequence
  chemically synthesized
atgaggtttcctttggggat

SEQ ID NO: 36026 - DNA, 20 bp, Artificial Sequence
  chemically synthesized
tgaggtttcctttggggatg

SEQ ID NO: 36027 - DNA, 20 bp, Artificial Sequence
  chemically synthesized
tggggatgaggaaaatattc

SEQ ID NO: 36028 - DNA, 20 bp, Artificial Sequence
  chemically synthesized
atattctggaaatatgatga

SEQ ID NO: 36029 - DNA, 20 bp, Artificial Sequence
  chemically synthesized
tgaatgtactaaatgccact

SEQ ID NO: 36030 - DNA, 20 bp, Artificial Sequence
  chemically synthesized
atgtactaaatgccacttgg

SEQ ID NO: 36031 - DNA, 20 bp, Artificial Sequence
  chemically synthesized
ttggtggtaccctgcaaaaa

SEQ ID NO: 36032 - DNA, 20 bp, Artificial Sequence
  chemically synthesized
ccctgcaaaaatggttaaaa

SEQ ID NO: 36033 - DNA, 20 bp, Artificial Sequence
  chemically synthesized
tacattttattgcaataaaa

SEQ ID NO: 36034 - DNA, 20 bp, Artificial Sequence
  chemically synthesized
tttattgcaataaaaaagaa

SEQ ID NO: 36035 - DNA, 20 bp, Artificial Sequence
  chemically synthesized
aagaatagtcatcatttact

SEQ ID NO: 36036 - DNA, 20 bp, Artificial Sequence
  chemically synthesized
ttactaagcattatcctttc

SEQ ID NO: 36037 - DNA, 20 bp, Artificial Sequence
  chemically synthesized
tactaagcattatcctttcc

SEQ ID NO: 36038 - DNA, 20 bp, Artificial Sequence
  chemically synthesized
gcattatcctttccaggcac

SEQ ID NO: 36039 - DNA, 20 bp, Artificial Sequence
  chemically synthesized
ccaggcacaagcttataatg

SEQ ID NO: 36040 - DNA, 20 bp, Artificial Sequence
  chemically synthesized
atctcacttcatcctcacaa

SEQ ID NO: 36041 - DNA, 20 bp, Artificial Sequence
  chemically synthesized
ctcacaacagtcctatgaaa

SEQ ID NO: 36042 - DNA, 20 bp, Artificial Sequence
  chemically synthesized
tcacaacagtcctatgaaac

SEQ ID NO: 36043 - DNA, 20 bp, Artificial Sequence
  chemically synthesized
caacagtcctatgaaacagg

SEQ ID NO: 36044 - DNA, 20 bp, Artificial Sequence
  chemically synthesized
gttccatcactcctgctcta

SEQ ID NO: 36045 - DNA, 20 bp, Artificial Sequence
  chemically synthesized
atcactcctgctctacagtt

SEQ ID NO: 36046 - DNA, 20 bp, Artificial Sequence
  chemically synthesized
tcactcctgctctacagtta

SEQ ID NO: 36047 - DNA, 20 bp, Artificial Sequence
  chemically synthesized
gctctacagttaaggaaact

SEQ ID NO: 36048 - DNA, 20 bp, Artificial Sequence
  chemically synthesized
ctctacagttaaggaaactg

SEQ ID NO: 36049 - DNA, 20 bp, Artificial Sequence
  chemically synthesized
agttaaggaaactgaggtgt

SEQ ID NO: 36050 - DNA, 20 bp, Artificial Sequence
  chemically synthesized
gttaaggaaactgaggtgta

SEQ ID NO: 36051 - DNA, 20 bp, Artificial Sequence
  chemically synthesized
taaggaaactgaggtgtaag

SEQ ID NO: 36052 - DNA, 20 bp, Artificial Sequence
  chemically synthesized
aaggaaactgaggtgtaagg

SEQ ID NO: 36053 - DNA, 20 bp, Artificial Sequence
  chemically synthesized
tgaggtgtaaggaggttgtc

SEQ ID NO: 36054 - DNA, 20 bp, Artificial Sequence
  chemically synthesized
gaggttgtctagttcaacct

SEQ ID NO: 36055 - DNA, 20 bp, Artificial Sequence
  chemically synthesized
tgtctagttcaacctgagcc

SEQ ID NO: 36056 - DNA, 20 bp, Artificial Sequence
  chemically synthesized
gtctagttcaacctgagcct

SEQ ID NO: 36057 - DNA, 20 bp, Artificial Sequence
  chemically synthesized
tcaacctgagcctgggtctg

SEQ ID NO: 36058 - DNA, 20 bp, Artificial Sequence
  chemically synthesized
aacctgagcctgggtctgcg

SEQ ID NO: 36059 - DNA, 20 bp, Artificial Sequence
  chemically synthesized
tgcttcctccccgtgcgcgt

SEQ ID NO: 36060 - DNA, 20 bp, Artificial Sequence
  chemically synthesized
cctccacatctttgttcata

SEQ ID NO: 36061 - DNA, 20 bp, Artificial Sequence
  chemically synthesized
cttattccttaatattttct

SEQ ID NO: 36062 - DNA, 20 bp, Artificial Sequence
  chemically synthesized
ccttaatattttctgagcct

SEQ ID NO: 36063 - DNA, 20 bp, Artificial Sequence
  chemically synthesized
ctaagttcccataaattata

SEQ ID NO: 36064 - DNA, 20 bp, Artificial Sequence
  chemically synthesized
aacactgccaatttattttc

SEQ ID NO: 36065 - DNA, 20 bp, Artificial Sequence
  chemically synthesized
actgccaatttattttctag

SEQ ID NO: 36066 - DNA, 20 bp, Artificial Sequence
  chemically synthesized
ctgccaatttattttctaga

SEQ ID NO: 36067 - DNA, 20 bp, Artificial Sequence
  chemically synthesized
tattttctagaaggttatga

SEQ ID NO: 36068 - DNA, 20 bp, Artificial Sequence
  chemically synthesized
atgacagtgtaaaatgtcac

SEQ ID NO: 36069 - DNA, 20 bp, Artificial Sequence
  chemically synthesized
tcacttcaccacacttgtat

SEQ ID NO: 36070 - DNA, 20 bp, Artificial Sequence
  chemically synthesized
agtgttcaatttttaaatat

SEQ ID NO: 36071 - DNA, 20 bp, Artificial Sequence
  chemically synthesized
ttaaatattagctaatctaa

SEQ ID NO: 36072 - DNA, 20 bp, Artificial Sequence
  chemically synthesized
taaatattagctaatctaac

SEQ ID NO: 36073 - DNA, 20 bp, Artificial Sequence
  chemically synthesized
tttatacttctttgacaatt

SEQ ID NO: 36074 - DNA, 20 bp, Artificial Sequence
  chemically synthesized
ttatacttctttgacaattt

SEQ ID NO: 36075 - DNA, 20 bp, Artificial Sequence
  chemically synthesized
atacttctttgacaatttgg

SEQ ID NO: 36076 - DNA, 20 bp, Artificial Sequence
  chemically synthesized
acttctttgacaatttggga

SEQ ID NO: 36077 - DNA, 20 bp, Artificial Sequence
  chemically synthesized
tttgacaatttgggagagtg

SEQ ID NO: 36078 - DNA, 20 bp, Artificial Sequence
  chemically synthesized
tgggagagtgaagattctcc

SEQ ID NO: 36079 - DNA, 20 bp, Artificial Sequence
  chemically synthesized
ttttctttgccaaattcaaa

SEQ ID NO: 36080 - DNA, 20 bp, Artificial Sequence
  chemically synthesized
tttgccaaattcaaatagaa

SEQ ID NO: 36081 - DNA, 20 bp, Artificial Sequence
  chemically synthesized
tagaacggttgcaaaattgc

SEQ ID NO: 36082 - DNA, 20 bp, Artificial Sequence
  chemically synthesized
gaacggttgcaaaattgcca

SEQ ID NO: 36083 - DNA, 20 bp, Artificial Sequence
  chemically synthesized
aacggttgcaaaattgccag

SEQ ID NO: 36084 - DNA, 20 bp, Artificial Sequence
  chemically synthesized
cagaggaaatgctgtttttc

SEQ ID NO: 36085 - DNA, 20 bp, Artificial Sequence
  chemically synthesized
ggaaatgctgtttttccaga

SEQ ID NO: 36086 - DNA, 20 bp, Artificial Sequence
  chemically synthesized
tttttccagatggacacacc

SEQ ID NO: 36087 - DNA, 20 bp, Artificial Sequence
  chemically synthesized
ttttccagatggacacaccc

SEQ ID NO: 36088 - DNA, 20 bp, Artificial Sequence
  chemically synthesized
tttccagatggacacaccca

SEQ ID NO: 36089 - DNA, 20 bp, Artificial Sequence
  chemically synthesized
ggacacacccagggatgttt

SEQ ID NO: 36090 - DNA, 20 bp, Artificial Sequence
  chemically synthesized
cagtgttctcacaaataatc

SEQ ID NO: 36091 - DNA, 20 bp, Artificial Sequence
  chemically synthesized
atccagttttctaattttgc

SEQ ID NO: 36092 - DNA, 20 bp, Artificial Sequence
  chemically synthesized
gttttctaattttgcaagcc

SEQ ID NO: 36093 - DNA, 20 bp, Artificial Sequence
  chemically synthesized
tttgcaagcccagctttcat

SEQ ID NO: 36094 - DNA, 20 bp, Artificial Sequence
  chemically synthesized
tgcaaaaatccttgctttgc

SEQ ID NO: 36095 - DNA, 20 bp, Artificial Sequence
  chemically synthesized
aaatccttgctttgcgagca

SEQ ID NO: 36096 - DNA, 20 bp, Artificial Sequence
  chemically synthesized
cttgctttgcgagcatggca

SEQ ID NO: 36097 - DNA, 20 bp, Artificial Sequence
  chemically synthesized
ttgctttgcgagcatggcac

SEQ ID NO: 36098 - DNA, 20 bp, Artificial Sequence
  chemically synthesized
tttgcgagcatggcacaggc

SEQ ID NO: 36099 - DNA, 20 bp, Artificial Sequence
  chemically synthesized
tgcgagcatggcacaggcaa

SEQ ID NO: 36100 - DNA, 20 bp, Artificial Sequence
  chemically synthesized
gcatggcacaggcaagagat

SEQ ID NO: 36101 - DNA, 20 bp, Artificial Sequence
  chemically synthesized
catggcacaggcaagagatg

SEQ ID NO: 36102 - DNA, 20 bp, Artificial Sequence
  chemically synthesized
gcactctctctttcttcccc

SEQ ID NO: 36103 - DNA, 20 bp, Artificial Sequence
  chemically synthesized
actctctctttcttccccca

SEQ ID NO: 36104 - DNA, 20 bp, Artificial Sequence
  chemically synthesized
ccagagcctttgactgcact

SEQ ID NO: 36105 - DNA, 20 bp, Artificial Sequence
  chemically synthesized
tgcacttagatcattgactt

SEQ ID NO: 36106 - DNA, 20 bp, Artificial Sequence
  chemically synthesized
ttagatcattgactttggtt

SEQ ID NO: 36107 - DNA, 20 bp, Artificial Sequence
  chemically synthesized
ttcagaaacctgactgcatc

SEQ ID NO: 36108 - DNA, 20 bp, Artificial Sequence
  chemically synthesized
cagaaacctgactgcatctg

SEQ ID NO: 36109 - DNA, 20 bp, Artificial Sequence
  chemically synthesized
actgcatctggagttgacat

SEQ ID NO: 36110 - DNA, 20 bp, Artificial Sequence
  chemically synthesized
gcatctggagttgacatgag

SEQ ID NO: 36111 - DNA, 20 bp, Artificial Sequence
  chemically synthesized
tggagttgacatgagcagca

SEQ ID NO: 36112 - DNA, 20 bp, Artificial Sequence
  chemically synthesized
agttgacatgagcagcatgg

SEQ ID NO: 36113 - DNA, 20 bp, Artificial Sequence
  chemically synthesized
agcatggaagatgtttgtcc

SEQ ID NO: 36114 - DNA, 20 bp, Artificial Sequence
  chemically synthesized
tttgtcccagcacctcactc

SEQ ID NO: 36115 - DNA, 20 bp, Artificial Sequence
  chemically synthesized
tgtcccagcacctcactcca

SEQ ID NO: 36116 - DNA, 20 bp, Artificial Sequence
  chemically synthesized
gtcccagcacctcactccag

SEQ ID NO: 36117 - DNA, 20 bp, Artificial Sequence
  chemically synthesized
cagcacctcactccagaggc

SEQ ID NO: 36118 - DNA, 20 bp, Artificial Sequence
  chemically synthesized
cctcactccagaggccagct

SEQ ID NO: 36119 - DNA, 20 bp, Artificial Sequence
  chemically synthesized
gaggccagctcagctcaatc

SEQ ID NO: 36120 - DNA, 20 bp, Artificial Sequence
  chemically synthesized
aggccagctcagctcaatct

SEQ ID NO: 36121 - DNA, 20 bp, Artificial Sequence
  chemically synthesized
ccagctcagctcaatctggg

SEQ ID NO: 36122 - DNA, 20 bp, Artificial Sequence
  chemically synthesized
agctcagctcaatctgggca

SEQ ID NO: 36123 - DNA, 20 bp, Artificial Sequence
  chemically synthesized
atctgggcagagctgcatga

SEQ ID NO: 36124 - DNA, 20 bp, Artificial Sequence
  chemically synthesized
tgggcagagctgcatgatgg

SEQ ID NO: 36125 - DNA, 20 bp, Artificial Sequence
  chemically synthesized
gatggaagtttctgactacc

SEQ ID NO: 36126 - DNA, 20 bp, Artificial Sequence
  chemically synthesized
agtttctgactaccaagcat

SEQ ID NO: 36127 - DNA, 20 bp, Artificial Sequence
  chemically synthesized
gtttctgactaccaagcatc

SEQ ID NO: 36128 - DNA, 20 bp, Artificial Sequence
  chemically synthesized
tctgactaccaagcatcggg

SEQ ID NO: 36129 - DNA, 20 bp, Artificial Sequence
  chemically synthesized
tgactaccaagcatcgggca

SEQ ID NO: 36130 - DNA, 20 bp, Artificial Sequence
  chemically synthesized
gactaccaagcatcgggcag

SEQ ID NO: 36131 - DNA, 20 bp, Artificial Sequence
  chemically synthesized
actaccaagcatcgggcaga

SEQ ID NO: 36132 - DNA, 20 bp, Artificial Sequence
  chemically synthesized
cgggcagagggtgcatcacc

SEQ ID NO: 36133 - DNA, 20 bp, Artificial Sequence
  chemically synthesized
ggtgcatcacctggactaca

SEQ ID NO: 36134 - DNA, 20 bp, Artificial Sequence
  chemically synthesized
cctggactacatagttgtgt

SEQ ID NO: 36135 - DNA, 20 bp, Artificial Sequence
  chemically synthesized
ctggactacatagttgtgtg

SEQ ID NO: 36136 - DNA, 20 bp, Artificial Sequence
  chemically synthesized
tggactacatagttgtgtga

SEQ ID NO: 36137 - DNA, 20 bp, Artificial Sequence
  chemically synthesized
gactacatagttgtgtgagg

SEQ ID NO: 36138 - DNA, 20 bp, Artificial Sequence
  chemically synthesized
tgtgagggagcaccgttctc

SEQ ID NO: 36139 - DNA, 20 bp, Artificial Sequence
  chemically synthesized
ttctctagaatctgctattt

SEQ ID NO: 36140 - DNA, 20 bp, Artificial Sequence
  chemically synthesized
ctagaatctgctatttgagc

SEQ ID NO: 36141 - DNA, 20 bp, Artificial Sequence
  chemically synthesized
tagaatctgctatttgagca

SEQ ID NO: 36142 - DNA, 20 bp, Artificial Sequence
  chemically synthesized
caaggcaaacatcctgataa

SEQ ID NO: 36143 - DNA, 20 bp, Artificial Sequence
  chemically synthesized
taatggtgaaaacctaccgc

SEQ ID NO: 36144 - DNA, 20 bp, Artificial Sequence
  chemically synthesized
gaaaacctaccgcaagttgc

SEQ ID NO: 36145 - DNA, 20 bp, Artificial Sequence
  chemically synthesized
aaaacctaccgcaagttgcc

SEQ ID NO: 36146 - DNA, 20 bp, Artificial Sequence
  chemically synthesized
cctaccgcaagttgccagga

SEQ ID NO: 36147 - DNA, 20 bp, Artificial Sequence
  chemically synthesized
agttgccaggaaagttgatg

SEQ ID NO: 36148 - DNA, 20 bp, Artificial Sequence
  chemically synthesized
ggaaagttgatgtggtctgc

SEQ ID NO: 36149 - DNA, 20 bp, Artificial Sequence
  chemically synthesized
aagttgatgtggtctgcgag

SEQ ID NO: 36150 - DNA, 20 bp, Artificial Sequence
  chemically synthesized
agttgatgtggtctgcgagt

SEQ ID NO: 36151 - DNA, 20 bp, Artificial Sequence
  chemically synthesized
tgcgagtaggtgctgccatc

SEQ ID NO: 36152 - DNA, 20 bp, Artificial Sequence
  chemically synthesized
gagtaggtgctgccatccag

SEQ ID NO: 36153 - DNA, 20 bp, Artificial Sequence
  chemically synthesized
ctgccatccagtggccgaca

SEQ ID NO: 36154 - DNA, 20 bp, Artificial Sequence
  chemically synthesized
gccatccagtggccgacata

SEQ ID NO: 36155 - DNA, 20 bp, Artificial Sequence
  chemically synthesized
gacatagagatgtcatctct

SEQ ID NO: 36156 - DNA, 20 bp, Artificial Sequence
  chemically synthesized
acatagagatgtcatctctg

SEQ ID NO: 36157 - DNA, 20 bp, Artificial Sequence
  chemically synthesized
catagagatgtcatctctga

SEQ ID NO: 36158 - DNA, 20 bp, Artificial Sequence
  chemically synthesized
agagatgtcatctctgaggg

SEQ ID NO: 36159 - DNA, 20 bp, Artificial Sequence
  chemically synthesized
gagatgtcatctctgagggc

SEQ ID NO: 36160 - DNA, 20 bp, Artificial Sequence
  chemically synthesized
atgtcatctctgagggcagg

SEQ ID NO: 36161 - DNA, 20 bp, Artificial Sequence
  chemically synthesized
tgtcatctctgagggcaggt

SEQ ID NO: 36162 - DNA, 20 bp, Artificial Sequence
  chemically synthesized
ctctgagggcaggtaggcca

SEQ ID NO: 36163 - DNA, 20 bp, Artificial Sequence
  chemically synthesized
tctgagggcaggtaggccac

SEQ ID NO: 36164 - DNA, 20 bp, Artificial Sequence
  chemically synthesized
gcaggtaggccacaggtgac

SEQ ID NO: 36165 - DNA, 20 bp, Artificial Sequence
  chemically synthesized
aggtaggccacaggtgacaa

SEQ ID NO: 36166 - DNA, 20 bp, Artificial Sequence
  chemically synthesized
ggtaggccacaggtgacaag

SEQ ID NO: 36167 - DNA, 20 bp, Artificial Sequence
  chemically synthesized
cacaggtgacaagaggattg

SEQ ID NO: 36168 - DNA, 20 bp, Artificial Sequence
  chemically synthesized
aggattgaagccctccctga

SEQ ID NO: 36169 - DNA, 20 bp, Artificial Sequence
  chemically synthesized
ggattgaagccctccctgat

SEQ ID NO: 36170 - DNA, 20 bp, Artificial Sequence
  chemically synthesized
gattgaagccctccctgatg

SEQ ID NO: 36171 - DNA, 20 bp, Artificial Sequence
  chemically synthesized
agccctccctgatggggcct

SEQ ID NO: 36172 - DNA, 20 bp, Artificial Sequence
  chemically synthesized
gccctccctgatggggcctt

SEQ ID NO: 36173 - DNA, 20 bp, Artificial Sequence
  chemically synthesized
ccctccctgatggggccttg

SEQ ID NO: 36174 - DNA, 20 bp, Artificial Sequence
  chemically synthesized
ctccctgatggggccttggg

SEQ ID NO: 36175 - DNA, 20 bp, Artificial Sequence
  chemically synthesized
ccctgatggggccttgggga

SEQ ID NO: 36176 - DNA, 20 bp, Artificial Sequence
  chemically synthesized
cctgatggggccttggggag

SEQ ID NO: 36177 - DNA, 20 bp, Artificial Sequence
  chemically synthesized
ctgatggggccttggggaga

SEQ ID NO: 36178 - DNA, 20 bp, Artificial Sequence
  chemically synthesized
atggggccttggggagaggg

SEQ ID NO: 36179 - DNA, 20 bp, Artificial Sequence
  chemically synthesized
gggccttggggagagggcag

SEQ ID NO: 36180 - DNA, 20 bp, Artificial Sequence
  chemically synthesized
ggccttggggagagggcagc

SEQ ID NO: 36181 - DNA, 20 bp, Artificial Sequence
  chemically synthesized
gccttggggagagggcagca

SEQ ID NO: 36182 - DNA, 20 bp, Artificial Sequence
  chemically synthesized
tggggagagggcagcagggt

SEQ ID NO: 36183 - DNA, 20 bp, Artificial Sequence
  chemically synthesized
agagggcagcagggtaagtc

SEQ ID NO: 36184 - DNA, 20 bp, Artificial Sequence
  chemically synthesized
gggcagcagggtaagtccag

SEQ ID NO: 36185 - DNA, 20 bp, Artificial Sequence
  chemically synthesized
cagcagggtaagtccagcgg

SEQ ID NO: 36186 - DNA, 20 bp, Artificial Sequence
  chemically synthesized
agcagggtaagtccagcggc

SEQ ID NO: 36187 - DNA, 20 bp, Artificial Sequence
  chemically synthesized
ggtaagtccagcggcaggat

SEQ ID NO: 36188 - DNA, 20 bp, Artificial Sequence
  chemically synthesized
caggatcagtccattgattg

SEQ ID NO: 36189 - DNA, 20 bp, Artificial Sequence
  chemically synthesized
attgtggatgacgactgacc

SEQ ID NO: 36190 - DNA, 20 bp, Artificial Sequence
  chemically synthesized
actgacctggaaaatcccct

SEQ ID NO: 36191 - DNA, 20 bp, Artificial Sequence
  chemically synthesized
ccaaactctgcatttgatcc

SEQ ID NO: 36192 - DNA, 20 bp, Artificial Sequence
  chemically synthesized
actctgcatttgatccaagt

SEQ ID NO: 36193 - DNA, 20 bp, Artificial Sequence
  chemically synthesized
ctctgcatttgatccaagtc

SEQ ID NO: 36194 - DNA, 20 bp, Artificial Sequence
  chemically synthesized
tctgcatttgatccaagtca

SEQ ID NO: 36195 - DNA, 20 bp, Artificial Sequence
  chemically synthesized
gatccaagtcagggaacacc

SEQ ID NO: 36196 - DNA, 20 bp, Artificial Sequence
  chemically synthesized
agggaacacctggaaacatg

SEQ ID NO: 36197 - DNA, 20 bp, Artificial Sequence
  chemically synthesized
gggaacacctggaaacatga

SEQ ID NO: 36198 - DNA, 20 bp, Artificial Sequence
  chemically synthesized
ggaacacctggaaacatgaa

SEQ ID NO: 36199 - DNA, 20 bp, Artificial Sequence
  chemically synthesized
gaacacctggaaacatgaag

SEQ ID NO: 36200 - DNA, 20 bp, Artificial Sequence
  chemically synthesized
acacctggaaacatgaaggg

SEQ ID NO: 36201 - DNA, 20 bp, Artificial Sequence
  chemically synthesized
acctggaaacatgaagggga

SEQ ID NO: 36202 - DNA, 20 bp, Artificial Sequence
  chemically synthesized
tggaaacatgaaggggagag

SEQ ID NO: 36203 - DNA, 20 bp, Artificial Sequence
  chemically synthesized
ggaaacatgaaggggagagc

SEQ ID NO: 36204 - DNA, 20 bp, Artificial Sequence
  chemically synthesized
gaaaactttgacctccctct

SEQ ID NO: 36205 - DNA, 20 bp, Artificial Sequence
  chemically synthesized
aaactttgacctccctctca

SEQ ID NO: 36206 - DNA, 20 bp, Artificial Sequence
  chemically synthesized
aactttgacctccctctcag

SEQ ID NO: 36207 - DNA, 20 bp, Artificial Sequence
  chemically synthesized
tgacctccctctcagaggct

SEQ ID NO: 36208 - DNA, 20 bp, Artificial Sequence
  chemically synthesized
ctgatgtcattattgacatg

SEQ ID NO: 36209 - DNA, 20 bp, Artificial Sequence
  chemically synthesized
acatgtagaaaattgatgaa

SEQ ID NO: 36210 - DNA, 20 bp, Artificial Sequence
  chemically synthesized
catgtagaaaattgatgaac

SEQ ID NO: 36211 - DNA, 20 bp, Artificial Sequence
  chemically synthesized
gaaaattgatgaacaggcct

SEQ ID NO: 36212 - DNA, 20 bp, Artificial Sequence
  chemically synthesized
caggcctgagttatgttttg

SEQ ID NO: 36213 - DNA, 20 bp, Artificial Sequence
  chemically synthesized
ttatgttttgtggcacctca

SEQ ID NO: 36214 - DNA, 20 bp, Artificial Sequence
  chemically synthesized
ttttgtggcacctcatggtc

SEQ ID NO: 36215 - DNA, 20 bp, Artificial Sequence
  chemically synthesized
gtggcacctcatggtctagt

SEQ ID NO: 36216 - DNA, 20 bp, Artificial Sequence
  chemically synthesized
catggtctagttagtgttct

SEQ ID NO: 36217 - DNA, 20 bp, Artificial Sequence
  chemically synthesized
tgttctgagaatcattttct

SEQ ID NO: 36218 - DNA, 20 bp, Artificial Sequence
  chemically synthesized
tctgagaatcattttctcag

SEQ ID NO: 36219 - DNA, 20 bp, Artificial Sequence
  chemically synthesized
tcattttctcagtggacctg

SEQ ID NO: 36220 - DNA, 20 bp, Artificial Sequence
  chemically synthesized
cattttctcagtggacctgc

SEQ ID NO: 36221 - DNA, 20 bp, Artificial Sequence
  chemically synthesized
ttctcagtggacctgcaggt

SEQ ID NO: 36222 - DNA, 20 bp, Artificial Sequence
  chemically synthesized
agtggacctgcaggtgagac

SEQ ID NO: 36223 - DNA, 20 bp, Artificial Sequence
  chemically synthesized
gtggacctgcaggtgagacc

SEQ ID NO: 36224 - DNA, 20 bp, Artificial Sequence
  chemically synthesized
acctgcaggtgagaccaggc

SEQ ID NO: 36225 - DNA, 20 bp, Artificial Sequence
  chemically synthesized
cctgcaggtgagaccaggcg

SEQ ID NO: 36226 - DNA, 20 bp, Artificial Sequence
  chemically synthesized
gcaggtgagaccaggcgagg

SEQ ID NO: 36227 - DNA, 20 bp, Artificial Sequence
  chemically synthesized
ggtgagaccaggcgaggcag

SEQ ID NO: 36228 - DNA, 20 bp, Artificial Sequence
  chemically synthesized
gaccaggcgaggcagaagcc

SEQ ID NO: 36229 - DNA, 20 bp, Artificial Sequence
  chemically synthesized
caggcgaggcagaagcctag

SEQ ID NO: 36230 - DNA, 20 bp, Artificial Sequence
  chemically synthesized
aggcgaggcagaagcctagt

SEQ ID NO: 36231 - DNA, 20 bp, Artificial Sequence
  chemically synthesized
ggcgaggcagaagcctagtg

SEQ ID NO: 36232 - DNA, 20 bp, Artificial Sequence
  chemically synthesized
gcgaggcagaagcctagtgg

SEQ ID NO: 36233 - DNA, 20 bp, Artificial Sequence
  chemically synthesized
ggcagaagcctagtggggga

SEQ ID NO: 36234 - DNA, 20 bp, Artificial Sequence
  chemically synthesized
agaagcctagtgggggatgg

SEQ ID NO: 36235 - DNA, 20 bp, Artificial Sequence
  chemically synthesized
gcctagtgggggatggtggt

SEQ ID NO: 36236 - DNA, 20 bp, Artificial Sequence
  chemically synthesized
ggatggtggttagaaatgtg

SEQ ID NO: 36237 - DNA, 20 bp, Artificial Sequence
  chemically synthesized
ggtggttagaaatgtgtgga

SEQ ID NO: 36238 - DNA, 20 bp, Artificial Sequence
  chemically synthesized
tagaaatgtgtggatggttg

SEQ ID NO: 36239 - DNA, 20 bp, Artificial Sequence
  chemically synthesized
agaaatgtgtggatggttgt

SEQ ID NO: 36240 - DNA, 20 bp, Artificial Sequence
  chemically synthesized
gaaatgtgtggatggttgtg

SEQ ID NO: 36241 - DNA, 20 bp, Artificial Sequence
  chemically synthesized
atgtgtggatggttgtgggg

SEQ ID NO: 36242 - DNA, 20 bp, Artificial Sequence
  chemically synthesized
tgtggatggttgtggggcag

SEQ ID NO: 36243 - DNA, 20 bp, Artificial Sequence
  chemically synthesized
tggttgtggggcagaagaaa

SEQ ID NO: 36244 - DNA, 20 bp, Artificial Sequence
  chemically synthesized
tgtggggcagaagaaacagc

SEQ ID NO: 36245 - DNA, 20 bp, Artificial Sequence
  chemically synthesized
ggggcagaagaaacagcaag

SEQ ID NO: 36246 - DNA, 20 bp, Artificial Sequence
  chemically synthesized
gggcagaagaaacagcaagt

SEQ ID NO: 36247 - DNA, 20 bp, Artificial Sequence
  chemically synthesized
aagaaacagcaagtaggctc

SEQ ID NO: 36248 - DNA, 20 bp, Artificial Sequence
  chemically synthesized
agaaacagcaagtaggctct

SEQ ID NO: 36249 - DNA, 20 bp, Artificial Sequence
  chemically synthesized
acagcaagtaggctctgggc

SEQ ID NO: 36250 - DNA, 20 bp, Artificial Sequence
  chemically synthesized
gctctgggccagctacaaac

SEQ ID NO: 36251 - DNA, 20 bp, Artificial Sequence
  chemically synthesized
atgatgtctactgatgatga

SEQ ID NO: 36252 - DNA, 20 bp, Artificial Sequence
  chemically synthesized
tctactgatgatgatagtga

SEQ ID NO: 36253 - DNA, 20 bp, Artificial Sequence
  chemically synthesized
actgatgatgatagtgatgg

SEQ ID NO: 36254 - DNA, 20 bp, Artificial Sequence
  chemically synthesized
gatgatgatagtgatggtgg

SEQ ID NO: 36255 - DNA, 20 bp, Artificial Sequence
  chemically synthesized
gatgatagtgatggtggtgg

SEQ ID NO: 36256 - DNA, 20 bp, Artificial Sequence
  chemically synthesized
gatagtgatggtggtggtgg

SEQ ID NO: 36257 - DNA, 20 bp, Artificial Sequence
  chemically synthesized
gatggtggtggtggtggtga

SEQ ID NO: 36258 - DNA, 20 bp, Artificial Sequence
  chemically synthesized
ggtggtggtggtggtgatgg

SEQ ID NO: 36259 - DNA, 20 bp, Artificial Sequence
  chemically synthesized
ggtggtggtggtgatggtgg

SEQ ID NO: 36260 - DNA, 20 bp, Artificial Sequence
  chemically synthesized
ggtggtggtgatggtggtgg

SEQ ID NO: 36261 - DNA, 20 bp, Artificial Sequence
  chemically synthesized
ggtggtggtaataattgtga

SEQ ID NO: 36262 - DNA, 20 bp, Artificial Sequence
  chemically synthesized
ggtggtaataattgtgatgg

SEQ ID NO: 36263 - DNA, 20 bp, Artificial Sequence
  chemically synthesized
ggtaataattgtgatggtgg

SEQ ID NO: 36264 - DNA, 20 bp, Artificial Sequence
  chemically synthesized
tggtggtggaatgatgatga

SEQ ID NO: 36265 - DNA, 20 bp, Artificial Sequence
  chemically synthesized
tggtggaatgatgatgatgg

SEQ ID NO: 36266 - DNA, 20 bp, Artificial Sequence
  chemically synthesized
tggaatgatgatgatggtgg

SEQ ID NO: 36267 - DNA, 20 bp, Artificial Sequence
  chemically synthesized
aatgatgatgatggtggtgg

SEQ ID NO: 36268 - DNA, 20 bp, Artificial Sequence
  chemically synthesized
atgatgatgatggtggtggt

SEQ ID NO: 36269 - DNA, 20 bp, Artificial Sequence
  chemically synthesized
atgatgatggtggtggtggg

SEQ ID NO: 36270 - DNA, 20 bp, Artificial Sequence
  chemically synthesized
gtggtggtgggtagtaatga

SEQ ID NO: 36271 - DNA, 20 bp, Artificial Sequence
  chemically synthesized
gtgggtagtaatgatggtgt

SEQ ID NO: 36272 - DNA, 20 bp, Artificial Sequence
  chemically synthesized
agtaatgatggtgttggtga

SEQ ID NO: 36273 - DNA, 20 bp, Artificial Sequence
  chemically synthesized
aatgatggtgttggtgatgg

SEQ ID NO: 36274 - DNA, 20 bp, Artificial Sequence
  chemically synthesized
gatggtgttggtgatggtgg

SEQ ID NO: 36275 - DNA, 20 bp, Artificial Sequence
  chemically synthesized
ggtgttggtgatggtggtag

SEQ ID NO: 36276 - DNA, 20 bp, Artificial Sequence
  chemically synthesized
ggtgatggtggtagtggtcg

SEQ ID NO: 36277 - DNA, 20 bp, Artificial Sequence
  chemically synthesized
ggtggtagtggtcgtggtga

SEQ ID NO: 36278 - DNA, 20 bp, Artificial Sequence
  chemically synthesized
agtggtcgtggtgatggtga

SEQ ID NO: 36279 - DNA, 20 bp, Artificial Sequence
  chemically synthesized
cgtggtgatggtgatagtga

SEQ ID NO: 36280 - DNA, 20 bp, Artificial Sequence
  chemically synthesized
gatggtgatagtgatagtga

SEQ ID NO: 36281 - DNA, 20 bp, Artificial Sequence
  chemically synthesized
ggtgatagtgatagtgatgg

SEQ ID NO: 36282 - DNA, 20 bp, Artificial Sequence
  chemically synthesized
gatagtgatagtgatggtgg

SEQ ID NO: 36283 - DNA, 20 bp, Artificial Sequence
  chemically synthesized
ggtggtaatgataatgctaa

SEQ ID NO: 36284 - DNA, 20 bp, Artificial Sequence
  chemically synthesized
ggtaatgataatgctaatgg

SEQ ID NO: 36285 - DNA, 20 bp, Artificial Sequence
  chemically synthesized
aatgataatgctaatggtgg

SEQ ID NO: 36286 - DNA, 20 bp, Artificial Sequence
  chemically synthesized
gataatgattatcatgatga

SEQ ID NO: 36287 - DNA, 20 bp, Artificial Sequence
  chemically synthesized
aatgattatcatgatgatag

SEQ ID NO: 36288 - DNA, 20 bp, Artificial Sequence
  chemically synthesized
gattatcatgatgatagcgg

SEQ ID NO: 36289 - DNA, 20 bp, Artificial Sequence
  chemically synthesized
catgatgatagcggtggtga

SEQ ID NO: 36290 - DNA, 20 bp, Artificial Sequence
  chemically synthesized
gatagcggtggtgatggtga

SEQ ID NO: 36291 - DNA, 20 bp, Artificial Sequence
  chemically synthesized
gatggtgatggtgatgataa

SEQ ID NO: 36292 - DNA, 20 bp, Artificial Sequence
  chemically synthesized
gatggtgatgataatggtga

SEQ ID NO: 36293 - DNA, 20 bp, Artificial Sequence
  chemically synthesized
ggtgatgataatggtgatgg

SEQ ID NO: 36294 - DNA, 20 bp, Artificial Sequence
  chemically synthesized
gatgataatggtgatggtgg

SEQ ID NO: 36295 - DNA, 20 bp, Artificial Sequence
  chemically synthesized
tggtggtagaatgatgatga

SEQ ID NO: 36296 - DNA, 20 bp, Artificial Sequence
  chemically synthesized
tagaatgatgatgatggtga

SEQ ID NO: 36297 - DNA, 20 bp, Artificial Sequence
  chemically synthesized
aatgatgatgatggtgatgg

SEQ ID NO: 36298 - DNA, 20 bp, Artificial Sequence
  chemically synthesized
gatgatgatggtgatggtgg

SEQ ID NO: 36299 - DNA, 20 bp, Artificial Sequence
  chemically synthesized
gatgatggtgatggtggtgg

SEQ ID NO: 36300 - DNA, 20 bp, Artificial Sequence
  chemically synthesized
gatggtgatggtggtggtgg

SEQ ID NO: 36301 - DNA, 20 bp, Artificial Sequence
  chemically synthesized
ggtgatggtggtggtggtgg

SEQ ID NO: 36302 - DNA, 20 bp, Artificial Sequence
  chemically synthesized
ggtggtggtagtaatgatga

SEQ ID NO: 36303 - DNA, 20 bp, Artificial Sequence
  chemically synthesized
ggtggtagtaatgatgatgg

SEQ ID NO: 36304 - DNA, 20 bp, Artificial Sequence
  chemically synthesized
ggtagtaatgatgatggtgg

SEQ ID NO: 36305 - DNA, 20 bp, Artificial Sequence
  chemically synthesized
atggtggtggtgatgatgtt

SEQ ID NO: 36306 - DNA, 20 bp, Artificial Sequence
  chemically synthesized
tggtggtggtgatgatgttg

SEQ ID NO: 36307 - DNA, 20 bp, Artificial Sequence
  chemically synthesized
ggtggtggtgatgatgttga

SEQ ID NO: 36308 - DNA, 20 bp, Artificial Sequence
  chemically synthesized
gatgttgagggtgatgataa

SEQ ID NO: 36309 - DNA, 20 bp, Artificial Sequence
  chemically synthesized
gagggtgatgataatagtga

SEQ ID NO: 36310 - DNA, 20 bp, Artificial Sequence
  chemically synthesized
ggtgatgataatagtgacag

SEQ ID NO: 36311 - DNA, 20 bp, Artificial Sequence
  chemically synthesized
gatgataatagtgacagtgg

SEQ ID NO: 36312 - DNA, 20 bp, Artificial Sequence
  chemically synthesized
gataatagtgacagtggtgg

SEQ ID NO: 36313 - DNA, 20 bp, Artificial Sequence
  chemically synthesized
agtggtggtggtaatgataa

SEQ ID NO: 36314 - DNA, 20 bp, Artificial Sequence
  chemically synthesized
ggtggtaatgataatggtga

SEQ ID NO: 36315 - DNA, 20 bp, Artificial Sequence
  chemically synthesized
ggtaatgataatggtgatgg

SEQ ID NO: 36316 - DNA, 20 bp, Artificial Sequence
  chemically synthesized
taatggtgatggtggaatga

SEQ ID NO: 36317 - DNA, 20 bp, Artificial Sequence
  chemically synthesized
tgatggtggaatgatggtga

SEQ ID NO: 36318 - DNA, 20 bp, Artificial Sequence
  chemically synthesized
tggtggaatgatggtgatgg

SEQ ID NO: 36319 - DNA, 20 bp, Artificial Sequence
  chemically synthesized
tggaatgatggtgatggtgg

SEQ ID NO: 36320 - DNA, 20 bp, Artificial Sequence
  chemically synthesized
tgatggtggtggaatgatga

SEQ ID NO: 36321 - DNA, 20 bp, Artificial Sequence
  chemically synthesized
tggtggtggaatgatgatgg

SEQ ID NO: 36322 - DNA, 20 bp, Artificial Sequence
  chemically synthesized
ggaatgatgatggtggtgct

SEQ ID NO: 36323 - DNA, 20 bp, Artificial Sequence
  chemically synthesized
atgatgatggtggtgctgag

SEQ ID NO: 36324 - DNA, 20 bp, Artificial Sequence
  chemically synthesized
gtggtgctgagtagtaatga

SEQ ID NO: 36325 - DNA, 20 bp, Artificial Sequence
  chemically synthesized
ctgagtagtaatgatggtga

SEQ ID NO: 36326 - DNA, 20 bp, Artificial Sequence
  chemically synthesized
agtagtaatgatggtgatgg

SEQ ID NO: 36327 - DNA, 20 bp, Artificial Sequence
  chemically synthesized
agtaatgatggtgatggtgg

SEQ ID NO: 36328 - DNA, 20 bp, Artificial Sequence
  chemically synthesized
aatgatggtgatggtggtgg

SEQ ID NO: 36329 - DNA, 20 bp, Artificial Sequence
  chemically synthesized
ggtgatggtggtggtggctg

SEQ ID NO: 36330 - DNA, 20 bp, Artificial Sequence
  chemically synthesized
ggtggtggctgtggtgatga

SEQ ID NO: 36331 - DNA, 20 bp, Artificial Sequence
  chemically synthesized
ggtggctgtggtgatgatgg

SEQ ID NO: 36332 - DNA, 20 bp, Artificial Sequence
  chemically synthesized
ggctgtggtgatgatggtgg

SEQ ID NO: 36333 - DNA, 20 bp, Artificial Sequence
  chemically synthesized
tgtggtgatgatggtggtgg

SEQ ID NO: 36334 - DNA, 20 bp, Artificial Sequence
  chemically synthesized
ggtgatgatggtggtggtag

SEQ ID NO: 36335 - DNA, 20 bp, Artificial Sequence
  chemically synthesized
gatgatggtggtggtagtgg

SEQ ID NO: 36336 - DNA, 20 bp, Artificial Sequence
  chemically synthesized
ggtagtggtagtaacgatga

SEQ ID NO: 36337 - DNA, 20 bp, Artificial Sequence
  chemically synthesized
agtggtagtaacgatgatgg

SEQ ID NO: 36338 - DNA, 20 bp, Artificial Sequence
  chemically synthesized
ggtagtaacgatgatggtgg

SEQ ID NO: 36339 - DNA, 20 bp, Artificial Sequence
  chemically synthesized
gatgatggtggtggtgatga

SEQ ID NO: 36340 - DNA, 20 bp, Artificial Sequence
  chemically synthesized
ggtggtgatgatagtgatga

SEQ ID NO: 36341 - DNA, 20 bp, Artificial Sequence
  chemically synthesized
gtgatgatggtgatgatgtt

SEQ ID NO: 36342 - DNA, 20 bp, Artificial Sequence
  chemically synthesized
tgatgatggtgatgatgttg

SEQ ID NO: 36343 - DNA, 20 bp, Artificial Sequence
  chemically synthesized
gatgatggtgatgatgttga

SEQ ID NO: 36344 - DNA, 20 bp, Artificial Sequence
  chemically synthesized
gatgttgagggtgatgataa

SEQ ID NO: 36345 - DNA, 20 bp, Artificial Sequence
  chemically synthesized
gagggtgatgataatagtga

SEQ ID NO: 36346 - DNA, 20 bp, Artificial Sequence
  chemically synthesized
ggtgatgataatagtgatag

SEQ ID NO: 36347 - DNA, 20 bp, Artificial Sequence
  chemically synthesized
gatgataatagtgatagcgg

SEQ ID NO: 36348 - DNA, 20 bp, Artificial Sequence
  chemically synthesized
taccaccaccatcatcacca

SEQ ID NO: 36349 - DNA, 20 bp, Artificial Sequence
  chemically synthesized
ccatcaccatcattactact

SEQ ID NO: 36350 - DNA, 20 bp, Artificial Sequence
  chemically synthesized
attatcattaccaccaccat

SEQ ID NO: 36351 - DNA, 20 bp, Artificial Sequence
  chemically synthesized
accaccatcactatcatcat

SEQ ID NO: 36352 - DNA, 20 bp, Artificial Sequence
  chemically synthesized
accatcactatcatcatcag

SEQ ID NO: 36353 - DNA, 20 bp, Artificial Sequence
  chemically synthesized
atcagtagacatcatataac

SEQ ID NO: 36354 - DNA, 20 bp, Artificial Sequence
  chemically synthesized
gacatcatataaccagtttg

SEQ ID NO: 36355 - DNA, 20 bp, Artificial Sequence
  chemically synthesized
tcatataaccagtttgtagc

SEQ ID NO: 36356 - DNA, 20 bp, Artificial Sequence
  chemically synthesized
taaccagtttgtagctggcc

SEQ ID NO: 36357 - DNA, 20 bp, Artificial Sequence
  chemically synthesized
accagtttgtagctggccca

SEQ ID NO: 36358 - DNA, 20 bp, Artificial Sequence
  chemically synthesized
ttctaaccaccatcccccac

SEQ ID NO: 36359 - DNA, 20 bp, Artificial Sequence
  chemically synthesized
tctaaccaccatcccccact

SEQ ID NO: 36360 - DNA, 20 bp, Artificial Sequence
  chemically synthesized
cactaggcttctgcctcgcc

SEQ ID NO: 36361 - DNA, 20 bp, Artificial Sequence
  chemically synthesized
gcctcgcctggtctcacctg

SEQ ID NO: 36362 - DNA, 20 bp, Artificial Sequence
  chemically synthesized
cctcgcctggtctcacctgc

SEQ ID NO: 36363 - DNA, 20 bp, Artificial Sequence
  chemically synthesized
gtctcacctgcaggtccact

SEQ ID NO: 36364 - DNA, 20 bp, Artificial Sequence
  chemically synthesized
tccactgagaaaatgattct

SEQ ID NO: 36365 - DNA, 20 bp, Artificial Sequence
  chemically synthesized
atgattctcagaacactaac

SEQ ID NO: 36366 - DNA, 20 bp, Artificial Sequence
  chemically synthesized
cagaacactaactagaccat

SEQ ID NO: 36367 - DNA, 20 bp, Artificial Sequence
  chemically synthesized
agaacactaactagaccatg

SEQ ID NO: 36368 - DNA, 20 bp, Artificial Sequence
  chemically synthesized
aggtgccacaaaacataact

SEQ ID NO: 36369 - DNA, 20 bp, Artificial Sequence
  chemically synthesized
ggtgccacaaaacataactc

SEQ ID NO: 36370 - DNA, 20 bp, Artificial Sequence
  chemically synthesized
ctacatgtcaataatgacat

SEQ ID NO: 36371 - DNA, 20 bp, Artificial Sequence
  chemically synthesized
tacatgtcaataatgacatc

SEQ ID NO: 36372 - DNA, 20 bp, Artificial Sequence
  chemically synthesized
aataatgacatcaggtcaat

SEQ ID NO: 36373 - DNA, 20 bp, Artificial Sequence
  chemically synthesized
atcaggtcaattggcgttct

SEQ ID NO: 36374 - DNA, 20 bp, Artificial Sequence
  chemically synthesized
aattggcgttctcagcctct

SEQ ID NO: 36375 - DNA, 20 bp, Artificial Sequence
  chemically synthesized
ttggcgttctcagcctctga

SEQ ID NO: 36376 - DNA, 20 bp, Artificial Sequence
  chemically synthesized
tggcgttctcagcctctgag

SEQ ID NO: 36377 - DNA, 20 bp, Artificial Sequence
  chemically synthesized
ggcgttctcagcctctgaga

SEQ ID NO: 36378 - DNA, 20 bp, Artificial Sequence
  chemically synthesized
cgttctcagcctctgagagg

SEQ ID NO: 36379 - DNA, 20 bp, Artificial Sequence
  chemically synthesized
gttctcagcctctgagaggg

SEQ ID NO: 36380 - DNA, 20 bp, Artificial Sequence
  chemically synthesized
agcctctgagagggaggtca

SEQ ID NO: 36381 - DNA, 20 bp, Artificial Sequence
  chemically synthesized
tgctctccccttcatgtttc

SEQ ID NO: 36382 - DNA, 20 bp, Artificial Sequence
  chemically synthesized
gctctccccttcatgtttcc

SEQ ID NO: 36383 - DNA, 20 bp, Artificial Sequence
  chemically synthesized
tttccaggtgttccctgact

SEQ ID NO: 36384 - DNA, 20 bp, Artificial Sequence
  chemically synthesized
tccctgacttggatcaaatg

SEQ ID NO: 36385 - DNA, 20 bp, Artificial Sequence
  chemically synthesized
cctgacttggatcaaatgca

SEQ ID NO: 36386 - DNA, 20 bp, Artificial Sequence
  chemically synthesized
cttggatcaaatgcagagtt

SEQ ID NO: 36387 - DNA, 20 bp, Artificial Sequence
  chemically synthesized
tggatcaaatgcagagtttg

SEQ ID NO: 36388 - DNA, 20 bp, Artificial Sequence
  chemically synthesized
ggatcaaatgcagagtttgg

SEQ ID NO: 36389 - DNA, 20 bp, Artificial Sequence
  chemically synthesized
atgcagagtttggaggtgtt

SEQ ID NO: 36390 - DNA, 20 bp, Artificial Sequence
  chemically synthesized
tgcagagtttggaggtgttg

SEQ ID NO: 36391 - DNA, 20 bp, Artificial Sequence
  chemically synthesized
agtttggaggtgttgaggcc

SEQ ID NO: 36392 - DNA, 20 bp, Artificial Sequence
  chemically synthesized
gtttggaggtgttgaggcca

SEQ ID NO: 36393 - DNA, 20 bp, Artificial Sequence
  chemically synthesized
tttggaggtgttgaggccaa

SEQ ID NO: 36394 - DNA, 20 bp, Artificial Sequence
  chemically synthesized
ttggaggtgttgaggccaag

SEQ ID NO: 36395 - DNA, 20 bp, Artificial Sequence
  chemically synthesized
ttgaggccaaggggattttc

SEQ ID NO: 36396 - DNA, 20 bp, Artificial Sequence
  chemically synthesized
tgaggccaaggggattttcc

SEQ ID NO: 36397 - DNA, 20 bp, Artificial Sequence
  chemically synthesized
gccaaggggattttccaggt

SEQ ID NO: 36398 - DNA, 20 bp, Artificial Sequence
  chemically synthesized
cagtcgtcatccacaatcaa

SEQ ID NO: 36399 - DNA, 20 bp, Artificial Sequence
  chemically synthesized
caatggactgatcctgccgc

SEQ ID NO: 36400 - DNA, 20 bp, Artificial Sequence
  chemically synthesized
taccctgctgccctctcccc

SEQ ID NO: 36401 - DNA, 20 bp, Artificial Sequence
  chemically synthesized
accctgctgccctctcccca

SEQ ID NO: 36402 - DNA, 20 bp, Artificial Sequence
  chemically synthesized
ccctctccccaaggccccat

SEQ ID NO: 36403 - DNA, 20 bp, Artificial Sequence
  chemically synthesized
cctctccccaaggccccatc

SEQ ID NO: 36404 - DNA, 20 bp, Artificial Sequence
  chemically synthesized
ctctccccaaggccccatca

SEQ ID NO: 36405 - DNA, 20 bp, Artificial Sequence
  chemically synthesized
ctccccaaggccccatcagg

SEQ ID NO: 36406 - DNA, 20 bp, Artificial Sequence
  chemically synthesized
tccccaaggccccatcaggg

SEQ ID NO: 36407 - DNA, 20 bp, Artificial Sequence
  chemically synthesized
ccccaaggccccatcaggga

SEQ ID NO: 36408 - DNA, 20 bp, Artificial Sequence
  chemically synthesized
ttcaatcctcttgtcacctg

SEQ ID NO: 36409 - DNA, 20 bp, Artificial Sequence
  chemically synthesized
acctgtggcctacctgccct

SEQ ID NO: 36410 - DNA, 20 bp, Artificial Sequence
  chemically synthesized
ctgtggcctacctgccctca

SEQ ID NO: 36411 - DNA, 20 bp, Artificial Sequence
  chemically synthesized
cagagatgacatctctatgt

SEQ ID NO: 36412 - DNA, 20 bp, Artificial Sequence
  chemically synthesized
gacatctctatgtcggccac

SEQ ID NO: 36413 - DNA, 20 bp, Artificial Sequence
  chemically synthesized
tctctatgtcggccactgga

SEQ ID NO: 36414 - DNA, 20 bp, Artificial Sequence
  chemically synthesized
ctatgtcggccactggatgg

SEQ ID NO: 36415 - DNA, 20 bp, Artificial Sequence
  chemically synthesized
tggatggcagcacctactcg

SEQ ID NO: 36416 - DNA, 20 bp, Artificial Sequence
  chemically synthesized
gcagaccacatcaactttcc

SEQ ID NO: 36417 - DNA, 20 bp, Artificial Sequence
  chemically synthesized
tcaactttcctggcaacttg

SEQ ID NO: 36418 - DNA, 20 bp, Artificial Sequence
  chemically synthesized
actttcctggcaacttgcgg

SEQ ID NO: 36419 - DNA, 20 bp, Artificial Sequence
  chemically synthesized
ctttcctggcaacttgcggt

SEQ ID NO: 36420 - DNA, 20 bp, Artificial Sequence
  chemically synthesized
cggtaggttttcaccattat

SEQ ID NO: 36421 - DNA, 20 bp, Artificial Sequence
  chemically synthesized
ggtaggttttcaccattatc

SEQ ID NO: 36422 - DNA, 20 bp, Artificial Sequence
  chemically synthesized
ggatgtttgccttgctcaaa

SEQ ID NO: 36423 - DNA, 20 bp, Artificial Sequence
  chemically synthesized
tgtttgccttgctcaaatag

SEQ ID NO: 36424 - DNA, 20 bp, Artificial Sequence
  chemically synthesized
cttgctcaaatagcagattc

SEQ ID NO: 36425 - DNA, 20 bp, Artificial Sequence
  chemically synthesized
tgctcaaatagcagattcta

SEQ ID NO: 36426 - DNA, 20 bp, Artificial Sequence
  chemically synthesized
aaatagcagattctagagaa

SEQ ID NO: 36427 - DNA, 20 bp, Artificial Sequence
  chemically synthesized
tgctccctcacacaactatg

SEQ ID NO: 36428 - DNA, 20 bp, Artificial Sequence
  chemically synthesized
cctcacacaactatgtagtc

SEQ ID NO: 36429 - DNA, 20 bp, Artificial Sequence
  chemically synthesized
ctcacacaactatgtagtcc

SEQ ID NO: 36430 - DNA, 20 bp, Artificial Sequence
  chemically synthesized
tgcaccctctgcccgatgct

SEQ ID NO: 36431 - DNA, 20 bp, Artificial Sequence
  chemically synthesized
accctctgcccgatgcttgg

SEQ ID NO: 36432 - DNA, 20 bp, Artificial Sequence
  chemically synthesized
tctgcccgatgcttggtagt

SEQ ID NO: 36433 - DNA, 20 bp, Artificial Sequence
  chemically synthesized
agtcagaaacttccatcatg

SEQ ID NO: 36434 - DNA, 20 bp, Artificial Sequence
  chemically synthesized
ttccatcatgcagctctgcc

SEQ ID NO: 36435 - DNA, 20 bp, Artificial Sequence
  chemically synthesized
catgcagctctgcccagatt

SEQ ID NO: 36436 - DNA, 20 bp, Artificial Sequence
  chemically synthesized
agctctgcccagattgagct

SEQ ID NO: 36437 - DNA, 20 bp, Artificial Sequence
  chemically synthesized
ctgcccagattgagctgagc

SEQ ID NO: 36438 - DNA, 20 bp, Artificial Sequence
  chemically synthesized
gattgagctgagctggcctc

SEQ ID NO: 36439 - DNA, 20 bp, Artificial Sequence
  chemically synthesized
ttgagctgagctggcctctg

SEQ ID NO: 36440 - DNA, 20 bp, Artificial Sequence
  chemically synthesized
gctgagctggcctctggagt

SEQ ID NO: 36441 - DNA, 20 bp, Artificial Sequence
  chemically synthesized
ctgagctggcctctggagtg

SEQ ID NO: 36442 - DNA, 20 bp, Artificial Sequence
  chemically synthesized
tggcctctggagtgaggtgc

SEQ ID NO: 36443 - DNA, 20 bp, Artificial Sequence
  chemically synthesized
ggcctctggagtgaggtgct

SEQ ID NO: 36444 - DNA, 20 bp, Artificial Sequence
  chemically synthesized
catgctgctcatgtcaactc

SEQ ID NO: 36445 - DNA, 20 bp, Artificial Sequence
  chemically synthesized
gctcatgtcaactccagatg

SEQ ID NO: 36446 - DNA, 20 bp, Artificial Sequence
  chemically synthesized
atgtcaactccagatgcagt

SEQ ID NO: 36447 - DNA, 20 bp, Artificial Sequence
  chemically synthesized
tgtcaactccagatgcagtc

SEQ ID NO: 36448 - DNA, 20 bp, Artificial Sequence
  chemically synthesized
gcagtcaggtttctgaacca

SEQ ID NO: 36449 - DNA, 20 bp, Artificial Sequence
  chemically synthesized
tgaaccaaagtcaatgatct

SEQ ID NO: 36450 - DNA, 20 bp, Artificial Sequence
  chemically synthesized
caaagtcaatgatctaagtg

SEQ ID NO: 36451 - DNA, 20 bp, Artificial Sequence
  chemically synthesized
caatgatctaagtgcagtca

SEQ ID NO: 36452 - DNA, 20 bp, Artificial Sequence
  chemically synthesized
aatgatctaagtgcagtcaa

SEQ ID NO: 36453 - DNA, 20 bp, Artificial Sequence
  chemically synthesized
ctaagtgcagtcaaaggctc

SEQ ID NO: 36454 - DNA, 20 bp, Artificial Sequence
  chemically synthesized
taagtgcagtcaaaggctct

SEQ ID NO: 36455 - DNA, 20 bp, Artificial Sequence
  chemically synthesized
aagtgcagtcaaaggctctg

SEQ ID NO: 36456 - DNA, 20 bp, Artificial Sequence
  chemically synthesized
agtgcagtcaaaggctctgg

SEQ ID NO: 36457 - DNA, 20 bp, Artificial Sequence
  chemically synthesized
gcagtcaaaggctctggggg

SEQ ID NO: 36458 - DNA, 20 bp, Artificial Sequence
  chemically synthesized
tcaaaggctctgggggaaga

SEQ ID NO: 36459 - DNA, 20 bp, Artificial Sequence
  chemically synthesized
aaaggctctgggggaagaaa

SEQ ID NO: 36460 - DNA, 20 bp, Artificial Sequence
  chemically synthesized
aggctctgggggaagaaaga

SEQ ID NO: 36461 - DNA, 20 bp, Artificial Sequence
  chemically synthesized
gctctgggggaagaaagaga

SEQ ID NO: 36462 - DNA, 20 bp, Artificial Sequence
  chemically synthesized
ttgcctgtgccatgctcgca

SEQ ID NO: 36463 - DNA, 20 bp, Artificial Sequence
  chemically synthesized
ctgtgccatgctcgcaaagc

SEQ ID NO: 36464 - DNA, 20 bp, Artificial Sequence
  chemically synthesized
tgtgccatgctcgcaaagca

SEQ ID NO: 36465 - DNA, 20 bp, Artificial Sequence
  chemically synthesized
tttttgcaaaattctaatga

SEQ ID NO: 36466 - DNA, 20 bp, Artificial Sequence
  chemically synthesized
tgcaaaattctaatgaaagc

SEQ ID NO: 36467 - DNA, 20 bp, Artificial Sequence
  chemically synthesized
gcaaaattctaatgaaagct

SEQ ID NO: 36468 - DNA, 20 bp, Artificial Sequence
  chemically synthesized
gaaagctgggcttgcaaaat

SEQ ID NO: 36469 - DNA, 20 bp, Artificial Sequence
  chemically synthesized
ggcttgcaaaattagaaaac

SEQ ID NO: 36470 - DNA, 20 bp, Artificial Sequence
  chemically synthesized
tagaaaactggattatttgt

SEQ ID NO: 36471 - DNA, 20 bp, Artificial Sequence
  chemically synthesized
tgagaacactgaaacatccc

SEQ ID NO: 36472 - DNA, 20 bp, Artificial Sequence
  chemically synthesized
gagaacactgaaacatccct

SEQ ID NO: 36473 - DNA, 20 bp, Artificial Sequence
  chemically synthesized
catccctgggtgtgtccatc

SEQ ID NO: 36474 - DNA, 20 bp, Artificial Sequence
  chemically synthesized
ggtgtgtccatctggaaaaa

SEQ ID NO: 36475 - DNA, 20 bp, Artificial Sequence
  chemically synthesized
tggaaaaacagcatttcctc

SEQ ID NO: 36476 - DNA, 20 bp, Artificial Sequence
  chemically synthesized
gcaaccgttctatttgaatt

SEQ ID NO: 36477 - DNA, 20 bp, Artificial Sequence
  chemically synthesized
cgttctatttgaatttggca

SEQ ID NO: 36478 - DNA, 20 bp, Artificial Sequence
  chemically synthesized
tgaatttggcaaagaaaata

SEQ ID NO: 36479 - DNA, 20 bp, Artificial Sequence
  chemically synthesized
atttggcaaagaaaataaag

SEQ ID NO: 36480 - DNA, 20 bp, Artificial Sequence
  chemically synthesized
aataaagcagtttttcacaa

SEQ ID NO: 36481 - DNA, 20 bp, Artificial Sequence
  chemically synthesized
cacaaaagaataaacacaac

SEQ ID NO: 36482 - DNA, 20 bp, Artificial Sequence
  chemically synthesized
acaaaagaataaacacaacc

SEQ ID NO: 36483 - DNA, 20 bp, Artificial Sequence
  chemically synthesized
aaaagaataaacacaaccag

SEQ ID NO: 36484 - DNA, 20 bp, Artificial Sequence
  chemically synthesized
ttcactctcccaaattgtca

SEQ ID NO: 36485 - DNA, 20 bp, Artificial Sequence
  chemically synthesized
actctcccaaattgtcaaag

SEQ ID NO: 36486 - DNA, 20 bp, Artificial Sequence
  chemically synthesized
attgtcaaagaagtataaat

SEQ ID NO: 36487 - DNA, 20 bp, Artificial Sequence
  chemically synthesized
gtataaattagaaaatgaat

SEQ ID NO: 36488 - DNA, 20 bp, Artificial Sequence
  chemically synthesized
tataaattagaaaatgaatc

SEQ ID NO: 36489 - DNA, 20 bp, Artificial Sequence
  chemically synthesized
tcaggacaatttcaacctgt

SEQ ID NO: 36490 - DNA, 20 bp, Artificial Sequence
  chemically synthesized
acaatttcaacctgttagat

SEQ ID NO: 36491 - DNA, 20 bp, Artificial Sequence
  chemically synthesized
taaaaattgaacactcatac

SEQ ID NO: 36492 - DNA, 20 bp, Artificial Sequence
  chemically synthesized
attgaacactcatacaagtg

SEQ ID NO: 36493 - DNA, 20 bp, Artificial Sequence
  chemically synthesized
acactcatacaagtgtggtg

SEQ ID NO: 36494 - DNA, 20 bp, Artificial Sequence
  chemically synthesized
gtggtgaagtgattgttttc

SEQ ID NO: 36495 - DNA, 20 bp, Artificial Sequence
  chemically synthesized
tttacactgtcataaccttc

SEQ ID NO: 36496 - DNA, 20 bp, Artificial Sequence
  chemically synthesized
taaccttctagaaaataaat

SEQ ID NO: 36497 - DNA, 20 bp, Artificial Sequence
  chemically synthesized
ccttctagaaaataaattgg

SEQ ID NO: 36498 - DNA, 20 bp, Artificial Sequence
  chemically synthesized
aaataaattggcagtgttat

SEQ ID NO: 36499 - DNA, 20 bp, Artificial Sequence
  chemically synthesized
aataaattggcagtgttatt

SEQ ID NO: 36500 - DNA, 20 bp, Artificial Sequence
  chemically synthesized
taaattggcagtgttattgg

SEQ ID NO: 36501 - DNA, 20 bp, Artificial Sequence
  chemically synthesized
ttggcagtgttattgggaga

SEQ ID NO: 36502 - DNA, 20 bp, Artificial Sequence
  chemically synthesized
aaatatgtctatataattta

SEQ ID NO: 36503 - DNA, 20 bp, Artificial Sequence
  chemically synthesized
aatatgtctatataatttat

SEQ ID NO: 36504 - DNA, 20 bp, Artificial Sequence
  chemically synthesized
ctatataatttatgggaact

SEQ ID NO: 36505 - DNA, 20 bp, Artificial Sequence
  chemically synthesized
tatataatttatgggaactt

SEQ ID NO: 36506 - DNA, 20 bp, Artificial Sequence
  chemically synthesized
aatttatgggaacttaggct

SEQ ID NO: 36507 - DNA, 20 bp, Artificial Sequence
  chemically synthesized
acttaggctcagaaaatatt

SEQ ID NO: 36508 - DNA, 20 bp, Artificial Sequence
  chemically synthesized
cttaggctcagaaaatatta

SEQ ID NO: 36509 - DNA, 20 bp, Artificial Sequence
  chemically synthesized
ctcagaaaatattaaggaat

SEQ ID NO: 36510 - DNA, 20 bp, Artificial Sequence
  chemically synthesized
aagaatgaactttatgaaca

SEQ ID NO: 36511 - DNA, 20 bp, Artificial Sequence
  chemically synthesized
gaactttatgaacaaagatg

SEQ ID NO: 36512 - DNA, 20 bp, Artificial Sequence
  chemically synthesized
actttatgaacaaagatgtg

SEQ ID NO: 36513 - DNA, 20 bp, Artificial Sequence
  chemically synthesized
ctttatgaacaaagatgtgg

SEQ ID NO: 36514 - DNA, 20 bp, Artificial Sequence
  chemically synthesized
tttatgaacaaagatgtgga

SEQ ID NO: 36515 - DNA, 20 bp, Artificial Sequence
  chemically synthesized
tgaacaaagatgtggagggt

SEQ ID NO: 36516 - DNA, 20 bp, Artificial Sequence
  chemically synthesized
acaaagatgtggagggttgg

SEQ ID NO: 36517 - DNA, 20 bp, Artificial Sequence
  chemically synthesized
agatgtggagggttggaagc

SEQ ID NO: 36518 - DNA, 20 bp, Artificial Sequence
  chemically synthesized
atgtggagggttggaagcaa

SEQ ID NO: 36519 - DNA, 20 bp, Artificial Sequence
  chemically synthesized
tgtggagggttggaagcaag

SEQ ID NO: 36520 - DNA, 20 bp, Artificial Sequence
  chemically synthesized
gtggagggttggaagcaaga

SEQ ID NO: 36521 - DNA, 20 bp, Artificial Sequence
  chemically synthesized
tggagggttggaagcaagag

SEQ ID NO: 36522 - DNA, 20 bp, Artificial Sequence
  chemically synthesized
ggagggttggaagcaagagg

SEQ ID NO: 36523 - DNA, 20 bp, Artificial Sequence
  chemically synthesized
gagggttggaagcaagaggg

SEQ ID NO: 36524 - DNA, 20 bp, Artificial Sequence
  chemically synthesized
aagaggggggccaacgcgca

SEQ ID NO: 36525 - DNA, 20 bp, Artificial Sequence
  chemically synthesized
agaggggggccaacgcgcac

SEQ ID NO: 36526 - DNA, 20 bp, Artificial Sequence
  chemically synthesized
gaggggggccaacgcgcacg

SEQ ID NO: 36527 - DNA, 20 bp, Artificial Sequence
  chemically synthesized
ggggggccaacgcgcacggg

SEQ ID NO: 36528 - DNA, 20 bp, Artificial Sequence
  chemically synthesized
gggggccaacgcgcacgggg

SEQ ID NO: 36529 - DNA, 20 bp, Artificial Sequence
  chemically synthesized
ggccaacgcgcacggggagg

SEQ ID NO: 36530 - DNA, 20 bp, Artificial Sequence
  chemically synthesized
gcgcacggggaggaagcatt

SEQ ID NO: 36531 - DNA, 20 bp, Artificial Sequence
  chemically synthesized
cgcacggggaggaagcattt

SEQ ID NO: 36532 - DNA, 20 bp, Artificial Sequence
  chemically synthesized
acggggaggaagcatttggg

SEQ ID NO: 36533 - DNA, 20 bp, Artificial Sequence
  chemically synthesized
gcatttgggcagtgactccg

SEQ ID NO: 36534 - DNA, 20 bp, Artificial Sequence
  chemically synthesized
gggcagtgactccgcagacc

SEQ ID NO: 36535 - DNA, 20 bp, Artificial Sequence
  chemically synthesized
ggcagtgactccgcagaccc

SEQ ID NO: 36536 - DNA, 20 bp, Artificial Sequence
  chemically synthesized
tgactccgcagacccaggct

SEQ ID NO: 36537 - DNA, 20 bp, Artificial Sequence
  chemically synthesized
gactccgcagacccaggctc

SEQ ID NO: 36538 - DNA, 20 bp, Artificial Sequence
  chemically synthesized
gacccaggctcaggttgaac

SEQ ID NO: 36539 - DNA, 20 bp, Artificial Sequence
  chemically synthesized
tagacaacctccttacacct

SEQ ID NO: 36540 - DNA, 20 bp, Artificial Sequence
  chemically synthesized
cacctcagtttccttaactg

SEQ ID NO: 36541 - DNA, 20 bp, Artificial Sequence
  chemically synthesized
cctcagtttccttaactgta

SEQ ID NO: 36542 - DNA, 20 bp, Artificial Sequence
  chemically synthesized
cagtttccttaactgtagag

SEQ ID NO: 36543 - DNA, 20 bp, Artificial Sequence
  chemically synthesized
agtttccttaactgtagagc

SEQ ID NO: 36544 - DNA, 20 bp, Artificial Sequence
  chemically synthesized
tttccttaactgtagagcag

SEQ ID NO: 36545 - DNA, 20 bp, Artificial Sequence
  chemically synthesized
taactgtagagcaggagtga

SEQ ID NO: 36546 - DNA, 20 bp, Artificial Sequence
  chemically synthesized
tgatggaactgcctgtttca

SEQ ID NO: 36547 - DNA, 20 bp, Artificial Sequence
  chemically synthesized
gatggaactgcctgtttcat

SEQ ID NO: 36548 - DNA, 20 bp, Artificial Sequence
  chemically synthesized
ctgtttcataggactgttgt

SEQ ID NO: 36549 - DNA, 20 bp, Artificial Sequence
  chemically synthesized
tgtttcataggactgttgtg

SEQ ID NO: 36550 - DNA, 20 bp, Artificial Sequence
  chemically synthesized
ataggactgttgtgaggatg

SEQ ID NO: 36551 - DNA, 20 bp, Artificial Sequence
  chemically synthesized
gactgttgtgaggatgaagt

SEQ ID NO: 36552 - DNA, 20 bp, Artificial Sequence
  chemically synthesized
agtgagatacaccacattat

SEQ ID NO: 36553 - DNA, 20 bp, Artificial Sequence
  chemically synthesized
ccacattataagcttgtgcc

SEQ ID NO: 36554 - DNA, 20 bp, Artificial Sequence
  chemically synthesized
attataagcttgtgcctgga

SEQ ID NO: 36555 - DNA, 20 bp, Artificial Sequence
  chemically synthesized
ttataagcttgtgcctggaa

SEQ ID NO: 36556 - DNA, 20 bp, Artificial Sequence
  chemically synthesized
tgcctggaaaggataatgct

SEQ ID NO: 36557 - DNA, 20 bp, Artificial Sequence
  chemically synthesized
ttattgcaataaaatgtaca

SEQ ID NO: 36558 - DNA, 20 bp, Artificial Sequence
  chemically synthesized
caataaaatgtacacagcgt

SEQ ID NO: 36559 - DNA, 20 bp, Artificial Sequence
  chemically synthesized
ataaaatgtacacagcgtaa

SEQ ID NO: 36560 - DNA, 20 bp, Artificial Sequence
  chemically synthesized
tactattttaaccatttttg

SEQ ID NO: 36561 - DNA, 20 bp, Artificial Sequence
  chemically synthesized
actattttaaccatttttgc

SEQ ID NO: 36562 - DNA, 20 bp, Artificial Sequence
  chemically synthesized
ctattttaaccatttttgca

SEQ ID NO: 36563 - DNA, 20 bp, Artificial Sequence
  chemically synthesized
catttttgcagggtaccacc

SEQ ID NO: 36564 - DNA, 20 bp, Artificial Sequence
  chemically synthesized
ttttgcagggtaccaccaag

SEQ ID NO: 36565 - DNA, 20 bp, Artificial Sequence
  chemically synthesized
gggtaccaccaagtggcatt

SEQ ID NO: 36566 - DNA, 20 bp, Artificial Sequence
  chemically synthesized
agtggcatttagtacattca

SEQ ID NO: 36567 - DNA, 20 bp, Artificial Sequence
  chemically synthesized
ggcatttagtacattcacag

SEQ ID NO: 36568 - DNA, 20 bp, Artificial Sequence
  chemically synthesized
tgcaaccatcatcatatttc

SEQ ID NO: 36569 - DNA, 20 bp, Artificial Sequence
  chemically synthesized
gaatattttcctcatcccca

SEQ ID NO: 36570 - DNA, 20 bp, Artificial Sequence
  chemically synthesized
aatattttcctcatccccaa

SEQ ID NO: 36571 - DNA, 20 bp, Artificial Sequence
  chemically synthesized
gaaacctcatgctcattaat

SEQ ID NO: 36572 - DNA, 20 bp, Artificial Sequence
  chemically synthesized
acctcatgctcattaatcag

SEQ ID NO: 36573 - DNA, 20 bp, Artificial Sequence
  chemically synthesized
gtagctctcctttaaaatat

SEQ ID NO: 36574 - DNA, 20 bp, Artificial Sequence
  chemically synthesized
cctttaaaatattagttatg

SEQ ID NO: 36575 - DNA, 20 bp, Artificial Sequence
  chemically synthesized
aatattagttatgaagatca

SEQ ID NO: 36576 - DNA, 20 bp, Artificial Sequence
  chemically synthesized
aaaactcattatgtaatgtt

SEQ ID NO: 36577 - DNA, 20 bp, Artificial Sequence
  chemically synthesized
gtaatgttgagtgaaaaaat

SEQ ID NO: 36578 - DNA, 20 bp, Artificial Sequence
  chemically synthesized
taatgttgagtgaaaaaatc

SEQ ID NO: 36579 - DNA, 20 bp, Artificial Sequence
  chemically synthesized
aatgttgagtgaaaaaatca

SEQ ID NO: 36580 - DNA, 20 bp, Artificial Sequence
  chemically synthesized
attttgtgatatgatgtaat

SEQ ID NO: 36581 - DNA, 20 bp, Artificial Sequence
  chemically synthesized
tgatatgatgtaattagtga

SEQ ID NO: 36582 - DNA, 20 bp, Artificial Sequence
  chemically synthesized
tatgatgtaattagtgaaag

SEQ ID NO: 36583 - DNA, 20 bp, Artificial Sequence
  chemically synthesized
tagtgaaagaagcatacaaa

SEQ ID NO: 36584 - DNA, 20 bp, Artificial Sequence
  chemically synthesized
gtctgaaaatataaaaacaa

SEQ ID NO: 36585 - DNA, 20 bp, Artificial Sequence
  chemically synthesized
acaatagcaattgcatttct

SEQ ID NO: 36586 - DNA, 20 bp, Artificial Sequence
  chemically synthesized
catttaaacattattcttta

SEQ ID NO: 36587 - DNA, 20 bp, Artificial Sequence
  chemically synthesized
attattctttatggttttaa

SEQ ID NO: 36588 - DNA, 20 bp, Artificial Sequence
  chemically synthesized
tctttatggttttaaaagca

SEQ ID NO: 36589 - DNA, 20 bp, Artificial Sequence
  chemically synthesized
tggttttaaaagcaaagaaa

SEQ ID NO: 36590 - DNA, 20 bp, Artificial Sequence
  chemically synthesized
ggttttaaaagcaaagaaaa

SEQ ID NO: 36591 - DNA, 20 bp, Artificial Sequence
  chemically synthesized
taaaagcaaagaaaaaggta

SEQ ID NO: 36592 - DNA, 20 bp, Artificial Sequence
  chemically synthesized
agaaacaacaaccaaccgca

SEQ ID NO: 36593 - DNA, 20 bp, Artificial Sequence
  chemically synthesized
aaccgcaaagcaccatgaca

SEQ ID NO: 36594 - DNA, 20 bp, Artificial Sequence
  chemically synthesized
caaagcaccatgacaaagct

SEQ ID NO: 36595 - DNA, 20 bp, Artificial Sequence
  chemically synthesized
aaagctcagattgttaaatc

SEQ ID NO: 36596 - DNA, 20 bp, Artificial Sequence
  chemically synthesized
aagctcagattgttaaatcc

SEQ ID NO: 36597 - DNA, 20 bp, Artificial Sequence
  chemically synthesized
gattgttaaatccaggtttt

SEQ ID NO: 36598 - DNA, 20 bp, Artificial Sequence
  chemically synthesized
aaatccaggtttttggaaca

SEQ ID NO: 36599 - DNA, 20 bp, Artificial Sequence
  chemically synthesized
tatatgacgtttacactctc

SEQ ID NO: 36600 - DNA, 20 bp, Artificial Sequence
  chemically synthesized
atatgacgtttacactctcc

SEQ ID NO: 36601 - DNA, 20 bp, Artificial Sequence
  chemically synthesized
tatgacgtttacactctcca

SEQ ID NO: 36602 - DNA, 20 bp, Artificial Sequence
  chemically synthesized
cgtttacactctccagggtt

SEQ ID NO: 36603 - DNA, 20 bp, Artificial Sequence
  chemically synthesized
tttacactctccagggttca

SEQ ID NO: 36604 - DNA, 20 bp, Artificial Sequence
  chemically synthesized
tacactctccagggttcaga

SEQ ID NO: 36605 - DNA, 20 bp, Artificial Sequence
  chemically synthesized
tctccagggttcagagagtc

SEQ ID NO: 36606 - DNA, 20 bp, Artificial Sequence
  chemically synthesized
ccagggttcagagagtctgg

SEQ ID NO: 36607 - DNA, 20 bp, Artificial Sequence
  chemically synthesized
ttcagagagtctggcagcat

SEQ ID NO: 36608 - DNA, 20 bp, Artificial Sequence
  chemically synthesized
tcagagagtctggcagcatt

SEQ ID NO: 36609 - DNA, 20 bp, Artificial Sequence
  chemically synthesized
agagagtctggcagcattgg

SEQ ID NO: 36610 - DNA, 20 bp, Artificial Sequence
  chemically synthesized
gggagctgccttgtgttcta

SEQ ID NO: 36611 - DNA, 20 bp, Artificial Sequence
  chemically synthesized
ccttgtgttctacagcctca

SEQ ID NO: 36612 - DNA, 20 bp, Artificial Sequence
  chemically synthesized
gtgttctacagcctcacgga

SEQ ID NO: 36613 - DNA, 20 bp, Artificial Sequence
  chemically synthesized
tctacagcctcacggacaga

SEQ ID NO: 36614 - DNA, 20 bp, Artificial Sequence
  chemically synthesized
ctacagcctcacggacagac

SEQ ID NO: 36615 - DNA, 20 bp, Artificial Sequence
  chemically synthesized
acagcctcacggacagacag

SEQ ID NO: 36616 - DNA, 20 bp, Artificial Sequence
  chemically synthesized
cagcctcacggacagacagg

SEQ ID NO: 36617 - DNA, 20 bp, Artificial Sequence
  chemically synthesized
tcaccactgctctgttcttc

SEQ ID NO: 36618 - DNA, 20 bp, Artificial Sequence
  chemically synthesized
accactgctctgttcttctg

SEQ ID NO: 36619 - DNA, 20 bp, Artificial Sequence
  chemically synthesized
gtttccttgtgaacatgttg

SEQ ID NO: 36620 - DNA, 20 bp, Artificial Sequence
  chemically synthesized
ttgtgaacatgttgtggacg

SEQ ID NO: 36621 - DNA, 20 bp, Artificial Sequence
  chemically synthesized
ttctttcatctttttaaaca

SEQ ID NO: 36622 - DNA, 20 bp, Artificial Sequence
  chemically synthesized
tctttcatctttttaaacac

SEQ ID NO: 36623 - DNA, 20 bp, Artificial Sequence
  chemically synthesized
tttttaaacacaggtacctt

SEQ ID NO: 36624 - DNA, 20 bp, Artificial Sequence
  chemically synthesized
ttttaaacacaggtaccttt

SEQ ID NO: 36625 - DNA, 20 bp, Artificial Sequence
  chemically synthesized
tttaaacacaggtacctttg

SEQ ID NO: 36626 - DNA, 20 bp, Artificial Sequence
  chemically synthesized
aacacaggtacctttggggc

SEQ ID NO: 36627 - DNA, 20 bp, Artificial Sequence
  chemically synthesized
cctttggggctggctttctc

SEQ ID NO: 36628 - DNA, 20 bp, Artificial Sequence
  chemically synthesized
ctttggggctggctttctca

SEQ ID NO: 36629 - DNA, 20 bp, Artificial Sequence
  chemically synthesized
tggggctggctttctcaagg

SEQ ID NO: 36630 - DNA, 20 bp, Artificial Sequence
  chemically synthesized
ctggctttctcaaggaagcc

SEQ ID NO: 36631 - DNA, 20 bp, Artificial Sequence
  chemically synthesized
aagcccagctccctgtgatt

SEQ ID NO: 36632 - DNA, 20 bp, Artificial Sequence
  chemically synthesized
gctccctgtgattgagaatg

SEQ ID NO: 36633 - DNA, 20 bp, Artificial Sequence
  chemically synthesized
atgaagtgtgcaatcgctat

SEQ ID NO: 36634 - DNA, 20 bp, Artificial Sequence
  chemically synthesized
aatcgctatgagtttctgaa

SEQ ID NO: 36635 - DNA, 20 bp, Artificial Sequence
  chemically synthesized
cgctatgagtttctgaatgg

SEQ ID NO: 36636 - DNA, 20 bp, Artificial Sequence
  chemically synthesized
ctatgagtttctgaatggaa

SEQ ID NO: 36637 - DNA, 20 bp, Artificial Sequence
  chemically synthesized
atggaagagtcaaatccact

SEQ ID NO: 36638 - DNA, 20 bp, Artificial Sequence
  chemically synthesized
aaatccactgagctctgtgc

SEQ ID NO: 36639 - DNA, 20 bp, Artificial Sequence
  chemically synthesized
aatccactgagctctgtgct

SEQ ID NO: 36640 - DNA, 20 bp, Artificial Sequence
  chemically synthesized
tgagctctgtgctgggcatt

SEQ ID NO: 36641 - DNA, 20 bp, Artificial Sequence
  chemically synthesized
ctctgtgctgggcatttggc

SEQ ID NO: 36642 - DNA, 20 bp, Artificial Sequence
  chemically synthesized
ctgtgctgggcatttggctg

SEQ ID NO: 36643 - DNA, 20 bp, Artificial Sequence
  chemically synthesized
tgtgctgggcatttggctgg

SEQ ID NO: 36644 - DNA, 20 bp, Artificial Sequence
  chemically synthesized
catttggctggaggcattga

SEQ ID NO: 36645 - DNA, 20 bp, Artificial Sequence
  chemically synthesized
ctggaggcattgacagttgc

SEQ ID NO: 36646 - DNA, 20 bp, Artificial Sequence
  chemically synthesized
tggaggcattgacagttgca

SEQ ID NO: 36647 - DNA, 20 bp, Artificial Sequence
  chemically synthesized
ggcattgacagttgcaaggt

SEQ ID NO: 36648 - DNA, 20 bp, Artificial Sequence
  chemically synthesized
tgacagttgcaaggtaagaa

SEQ ID NO: 36649 - DNA, 20 bp, Artificial Sequence
  chemically synthesized
ttgcaaggtaagaaaagatc

SEQ ID NO: 36650 - DNA, 20 bp, Artificial Sequence
  chemically synthesized
gcaaggtaagaaaagatcaa

SEQ ID NO: 36651 - DNA, 20 bp, Artificial Sequence
  chemically synthesized
aagaaaagatcaagagacca

SEQ ID NO: 36652 - DNA, 20 bp, Artificial Sequence
  chemically synthesized
aaagatcaagagaccaaagt

SEQ ID NO: 36653 - DNA, 20 bp, Artificial Sequence
  chemically synthesized
agtcttgtgctctcctgtct

SEQ ID NO: 36654 - DNA, 20 bp, Artificial Sequence
  chemically synthesized
gtgctctcctgtctcagtct

SEQ ID NO: 36655 - DNA, 20 bp, Artificial Sequence
  chemically synthesized
ctgtctcagtctcagtccct

SEQ ID NO: 36656 - DNA, 20 bp, Artificial Sequence
  chemically synthesized
agtctcagtcccttagactt

SEQ ID NO: 36657 - DNA, 20 bp, Artificial Sequence
  chemically synthesized
tcccttagacttgagtccca

SEQ ID NO: 36658 - DNA, 20 bp, Artificial Sequence
  chemically synthesized
cttagacttgagtcccaaag

SEQ ID NO: 36659 - DNA, 20 bp, Artificial Sequence
  chemically synthesized
agtcccaaagtagcgaattc

SEQ ID NO: 36660 - DNA, 20 bp, Artificial Sequence
  chemically synthesized
cccaaagtagcgaattcaag

SEQ ID NO: 36661 - DNA, 20 bp, Artificial Sequence
  chemically synthesized
ccaaagtagcgaattcaagt

SEQ ID NO: 36662 - DNA, 20 bp, Artificial Sequence
  chemically synthesized
ttcaagtaggatttaatcaa

SEQ ID NO: 36663 - DNA, 20 bp, Artificial Sequence
  chemically synthesized
aagtaggatttaatcaatgg

SEQ ID NO: 36664 - DNA, 20 bp, Artificial Sequence
  chemically synthesized
atttaatcaatggaagaccc

SEQ ID NO: 36665 - DNA, 20 bp, Artificial Sequence
  chemically synthesized
tcaatggaagaccccagtct

SEQ ID NO: 36666 - DNA, 20 bp, Artificial Sequence
  chemically synthesized
accccagtctaagtgttgct

SEQ ID NO: 36667 - DNA, 20 bp, Artificial Sequence
  chemically synthesized
agtgttgctcagaaactccc

SEQ ID NO: 36668 - DNA, 20 bp, Artificial Sequence
  chemically synthesized
atctgtcccaaatgtatatt

SEQ ID NO: 36669 - DNA, 20 bp, Artificial Sequence
  chemically synthesized
aatgtatattcagatcatcc

SEQ ID NO: 36670 - DNA, 20 bp, Artificial Sequence
  chemically synthesized
atgtatattcagatcatcca

SEQ ID NO: 36671 - DNA, 20 bp, Artificial Sequence
  chemically synthesized
tgtatattcagatcatccaa

SEQ ID NO: 36672 - DNA, 20 bp, Artificial Sequence
  chemically synthesized
gtatattcagatcatccaag

SEQ ID NO: 36673 - DNA, 20 bp, Artificial Sequence
  chemically synthesized
gatcatccaaggggacttct

SEQ ID NO: 36674 - DNA, 20 bp, Artificial Sequence
  chemically synthesized
atcatccaaggggacttctt

SEQ ID NO: 36675 - DNA, 20 bp, Artificial Sequence
  chemically synthesized
tcatccaaggggacttcttg

SEQ ID NO: 36676 - DNA, 20 bp, Artificial Sequence
  chemically synthesized
aaggggacttcttggggctt

SEQ ID NO: 36677 - DNA, 20 bp, Artificial Sequence
  chemically synthesized
acttcttggggcttgagttc

SEQ ID NO: 36678 - DNA, 20 bp, Artificial Sequence
  chemically synthesized
ttggggcttgagttccagat

SEQ ID NO: 36679 - DNA, 20 bp, Artificial Sequence
  chemically synthesized
gggcttgagttccagatcag

SEQ ID NO: 36680 - DNA, 20 bp, Artificial Sequence
  chemically synthesized
ttgagttccagatcagcagc

SEQ ID NO: 36681 - DNA, 20 bp, Artificial Sequence
  chemically synthesized
tgagttccagatcagcagca

SEQ ID NO: 36682 - DNA, 20 bp, Artificial Sequence
  chemically synthesized
gagttccagatcagcagcaa

SEQ ID NO: 36683 - DNA, 20 bp, Artificial Sequence
  chemically synthesized
gttccagatcagcagcaagg

SEQ ID NO: 36684 - DNA, 20 bp, Artificial Sequence
  chemically synthesized
atcagcagcaagggagccat

SEQ ID NO: 36685 - DNA, 20 bp, Artificial Sequence
  chemically synthesized
cataagtgccataactacct

SEQ ID NO: 36686 - DNA, 20 bp, Artificial Sequence
  chemically synthesized
cctcagaccactcaccctcc

SEQ ID NO: 36687 - DNA, 20 bp, Artificial Sequence
  chemically synthesized
ctcagaccactcaccctcct

SEQ ID NO: 36688 - DNA, 20 bp, Artificial Sequence
  chemically synthesized
tcagaccactcaccctcctg

SEQ ID NO: 36689 - DNA, 20 bp, Artificial Sequence
  chemically synthesized
ctcaccctcctggggtgtcc

SEQ ID NO: 36690 - DNA, 20 bp, Artificial Sequence
  chemically synthesized
accctcctggggtgtcccgg

SEQ ID NO: 36691 - DNA, 20 bp, Artificial Sequence
  chemically synthesized
tcctggggtgtcccggtggc

SEQ ID NO: 36692 - DNA, 20 bp, Artificial Sequence
  chemically synthesized
cctggggtgtcccggtggcc

SEQ ID NO: 36693 - DNA, 20 bp, Artificial Sequence
  chemically synthesized
ctggggtgtcccggtggcca

SEQ ID NO: 36694 - DNA, 20 bp, Artificial Sequence
  chemically synthesized
gtcccggtggccagggacta

SEQ ID NO: 36695 - DNA, 20 bp, Artificial Sequence
  chemically synthesized
ccggtggccagggactaaag

SEQ ID NO: 36696 - DNA, 20 bp, Artificial Sequence
  chemically synthesized
gactaaagtggtgatttttc

SEQ ID NO: 36697 - DNA, 20 bp, Artificial Sequence
  chemically synthesized
taaagtggtgatttttctgg

SEQ ID NO: 36698 - DNA, 20 bp, Artificial Sequence
  chemically synthesized
aaagtggtgatttttctggt

SEQ ID NO: 36699 - DNA, 20 bp, Artificial Sequence
  chemically synthesized
aagtggtgatttttctggta

SEQ ID NO: 36700 - DNA, 20 bp, Artificial Sequence
  chemically synthesized
tggtgatttttctggtaggg

SEQ ID NO: 36701 - DNA, 20 bp, Artificial Sequence
  chemically synthesized
ggtgatttttctggtaggga

SEQ ID NO: 36702 - DNA, 20 bp, Artificial Sequence
  chemically synthesized
tgatttttctggtagggaag

SEQ ID NO: 36703 - DNA, 20 bp, Artificial Sequence
  chemically synthesized
gatttttctggtagggaagg

SEQ ID NO: 36704 - DNA, 20 bp, Artificial Sequence
  chemically synthesized
ttttctggtagggaaggagg

SEQ ID NO: 36705 - DNA, 20 bp, Artificial Sequence
  chemically synthesized
ttctggtagggaaggaggta

SEQ ID NO: 36706 - DNA, 20 bp, Artificial Sequence
  chemically synthesized
tctggtagggaaggaggtag

SEQ ID NO: 36707 - DNA, 20 bp, Artificial Sequence
  chemically synthesized
ctggtagggaaggaggtaga

SEQ ID NO: 36708 - DNA, 20 bp, Artificial Sequence
  chemically synthesized
agggaaggaggtagagggta

SEQ ID NO: 36709 - DNA, 20 bp, Artificial Sequence
  chemically synthesized
gggaaggaggtagagggtac

SEQ ID NO: 36710 - DNA, 20 bp, Artificial Sequence
  chemically synthesized
aggaggtagagggtacagga

SEQ ID NO: 36711 - DNA, 20 bp, Artificial Sequence
  chemically synthesized
gaggtagagggtacaggaca

SEQ ID NO: 36712 - DNA, 20 bp, Artificial Sequence
  chemically synthesized
actaactgcacacaatatct

SEQ ID NO: 36713 - DNA, 20 bp, Artificial Sequence
  chemically synthesized
ctgcacacaatatctgagac

SEQ ID NO: 36714 - DNA, 20 bp, Artificial Sequence
  chemically synthesized
gcacacaatatctgagactg

SEQ ID NO: 36715 - DNA, 20 bp, Artificial Sequence
  chemically synthesized
caatatctgagactggagct

SEQ ID NO: 36716 - DNA, 20 bp, Artificial Sequence
  chemically synthesized
gctcagatattgctgatgat

SEQ ID NO: 36717 - DNA, 20 bp, Artificial Sequence
  chemically synthesized
tcagatattgctgatgatca

SEQ ID NO: 36718 - DNA, 20 bp, Artificial Sequence
  chemically synthesized
atattgctgatgatcagagt

SEQ ID NO: 36719 - DNA, 20 bp, Artificial Sequence
  chemically synthesized
ctccccaattgatttacaac

SEQ ID NO: 36720 - DNA, 20 bp, Artificial Sequence
  chemically synthesized
tccccaattgatttacaact

SEQ ID NO: 36721 - DNA, 20 bp, Artificial Sequence
  chemically synthesized
ccccaattgatttacaactg

SEQ ID NO: 36722 - DNA, 20 bp, Artificial Sequence
  chemically synthesized
attgatttacaactggggct

SEQ ID NO: 36723 - DNA, 20 bp, Artificial Sequence
  chemically synthesized
ggcttggatactgttttaaa

SEQ ID NO: 36724 - DNA, 20 bp, Artificial Sequence
  chemically synthesized
gcttggatactgttttaaac

SEQ ID NO: 36725 - DNA, 20 bp, Artificial Sequence
  chemically synthesized
ttggatactgttttaaacgg

SEQ ID NO: 36726 - DNA, 20 bp, Artificial Sequence
  chemically synthesized
tggatactgttttaaacggg

SEQ ID NO: 36727 - DNA, 20 bp, Artificial Sequence
  chemically synthesized
gatactgttttaaacgggag

SEQ ID NO: 36728 - DNA, 20 bp, Artificial Sequence
  chemically synthesized
aaccactgacgtgactacac

SEQ ID NO: 36729 - DNA, 20 bp, Artificial Sequence
  chemically synthesized
ccactgacgtgactacacta

SEQ ID NO: 36730 - DNA, 20 bp, Artificial Sequence
  chemically synthesized
tgacgtgactacactagaga

SEQ ID NO: 36731 - DNA, 20 bp, Artificial Sequence
  chemically synthesized
ccactcttgctttacttcat

SEQ ID NO: 36732 - DNA, 20 bp, Artificial Sequence
  chemically synthesized
cttcatgagaacgaaaatgt

SEQ ID NO: 36733 - DNA, 20 bp, Artificial Sequence
  chemically synthesized
ttgcaccatgaattcatttg

SEQ ID NO: 36734 - DNA, 20 bp, Artificial Sequence
  chemically synthesized
accatgaattcatttgcgga

SEQ ID NO: 36735 - DNA, 20 bp, Artificial Sequence
  chemically synthesized
ttattttattttattttatt

SEQ ID NO: 36736 - DNA, 20 bp, Artificial Sequence
  chemically synthesized
ttttattgagactctcaccc

SEQ ID NO: 36737 - DNA, 20 bp, Artificial Sequence
  chemically synthesized
tgagactctcaccccggttg

SEQ ID NO: 36738 - DNA, 20 bp, Artificial Sequence
  chemically synthesized
gaagtgcactgacgtgattt

SEQ ID NO: 36739 - DNA, 20 bp, Artificial Sequence
  chemically synthesized
tcactgcaacttccacctcc

SEQ ID NO: 36740 - DNA, 20 bp, Artificial Sequence
  chemically synthesized
cactgcaacttccacctcct

SEQ ID NO: 36741 - DNA, 20 bp, Artificial Sequence
  chemically synthesized
aacttccacctcctgggttc

SEQ ID NO: 36742 - DNA, 20 bp, Artificial Sequence
  chemically synthesized
ctgggttcaagtgaatactc

SEQ ID NO: 36743 - DNA, 20 bp, Artificial Sequence
  chemically synthesized
agtgaatactccagcctccc

SEQ ID NO: 36744 - DNA, 20 bp, Artificial Sequence
  chemically synthesized
gaatactccagcctccctag

SEQ ID NO: 36745 - DNA, 20 bp, Artificial Sequence
  chemically synthesized
actccagcctccctagtagc

SEQ ID NO: 36746 - DNA, 20 bp, Artificial Sequence
  chemically synthesized
ctccagcctccctagtagct

SEQ ID NO: 36747 - DNA, 20 bp, Artificial Sequence
  chemically synthesized
ctccctagtagctgggatta

SEQ ID NO: 36748 - DNA, 20 bp, Artificial Sequence
  chemically synthesized
tccctagtagctgggattac

SEQ ID NO: 36749 - DNA, 20 bp, Artificial Sequence
  chemically synthesized
caggtgcccaccaccacgcc

SEQ ID NO: 36750 - DNA, 20 bp, Artificial Sequence
  chemically synthesized
ctggctaatttttgtatttt

SEQ ID NO: 36751 - DNA, 20 bp, Artificial Sequence
  chemically synthesized
gctaatttttgtatttttag

SEQ ID NO: 36752 - DNA, 20 bp, Artificial Sequence
  chemically synthesized
taatttttgtatttttagta

SEQ ID NO: 36753 - DNA, 20 bp, Artificial Sequence
  chemically synthesized
ttttgtatttttagtagaga

SEQ ID NO: 36754 - DNA, 20 bp, Artificial Sequence
  chemically synthesized
tttgtatttttagtagagat

SEQ ID NO: 36755 - DNA, 20 bp, Artificial Sequence
  chemically synthesized
ttgtatttttagtagagatg

SEQ ID NO: 36756 - DNA, 20 bp, Artificial Sequence
  chemically synthesized
gagatggggtttcaccacat

SEQ ID NO: 36757 - DNA, 20 bp, Artificial Sequence
  chemically synthesized
ggggtttcaccacattggcc

SEQ ID NO: 36758 - DNA, 20 bp, Artificial Sequence
  chemically synthesized
tttcaccacattggcctggc

SEQ ID NO: 36759 - DNA, 20 bp, Artificial Sequence
  chemically synthesized
accttgtgatccacctgtct

SEQ ID NO: 36760 - DNA, 20 bp, Artificial Sequence
  chemically synthesized
ccacctgtcttggcctccca

SEQ ID NO: 36761 - DNA, 20 bp, Artificial Sequence
  chemically synthesized
gtcttggcctcccaaagtgc

SEQ ID NO: 36762 - DNA, 20 bp, Artificial Sequence
  chemically synthesized
tcttggcctcccaaagtgct

SEQ ID NO: 36763 - DNA, 20 bp, Artificial Sequence
  chemically synthesized
ctcccaaagtgctgggatta

SEQ ID NO: 36764 - DNA, 20 bp, Artificial Sequence
  chemically synthesized
cccaaagtgctgggattaca

SEQ ID NO: 36765 - DNA, 20 bp, Artificial Sequence
  chemically synthesized
agtgctgggattacagagtt

SEQ ID NO: 36766 - DNA, 20 bp, Artificial Sequence
  chemically synthesized
aaatatttatttatttattt

SEQ ID NO: 36767 - DNA, 20 bp, Artificial Sequence
  chemically synthesized
tttatttaagccacaactac

SEQ ID NO: 36768 - DNA, 20 bp, Artificial Sequence
  chemically synthesized
ttaagccacaactactagaa

SEQ ID NO: 36769 - DNA, 20 bp, Artificial Sequence
  chemically synthesized
taagccacaactactagaat

SEQ ID NO: 36770 - DNA, 20 bp, Artificial Sequence
  chemically synthesized
gccacaactactagaatagg

SEQ ID NO: 36771 - DNA, 20 bp, Artificial Sequence
  chemically synthesized
ccacaactactagaatagga

SEQ ID NO: 36772 - DNA, 20 bp, Artificial Sequence
  chemically synthesized
gatattttattaattttatt

SEQ ID NO: 36773 - DNA, 20 bp, Artificial Sequence
  chemically synthesized
attatttttttttctttcct

SEQ ID NO: 36774 - DNA, 20 bp, Artificial Sequence
  chemically synthesized
gacattcttgctctgtcacc

SEQ ID NO: 36775 - DNA, 20 bp, Artificial Sequence
  chemically synthesized
acattcttgctctgtcaccc

SEQ ID NO: 36776 - DNA, 20 bp, Artificial Sequence
  chemically synthesized
tcttgctctgtcacccaggc

SEQ ID NO: 36777 - DNA, 20 bp, Artificial Sequence
  chemically synthesized
ttgctctgtcacccaggctg

SEQ ID NO: 36778 - DNA, 20 bp, Artificial Sequence
  chemically synthesized
ctgtcacccaggctggagtg

SEQ ID NO: 36779 - DNA, 20 bp, Artificial Sequence
  chemically synthesized
tcacccaggctggagtgcag

SEQ ID NO: 36780 - DNA, 20 bp, Artificial Sequence
  chemically synthesized
ggagtgcagtggcacattct

SEQ ID NO: 36781 - DNA, 20 bp, Artificial Sequence
  chemically synthesized
aacctccatctcctgtgttc

SEQ ID NO: 36782 - DNA, 20 bp, Artificial Sequence
  chemically synthesized
ctcctgtgttcaagcaattc

SEQ ID NO: 36783 - DNA, 20 bp, Artificial Sequence
  chemically synthesized
ttcaagcaattctagtgcct

SEQ ID NO: 36784 - DNA, 20 bp, Artificial Sequence
  chemically synthesized
ttctagtgcctcagcctact

SEQ ID NO: 36785 - DNA, 20 bp, Artificial Sequence
  chemically synthesized
tagtgcctcagcctacttag

SEQ ID NO: 36786 - DNA, 20 bp, Artificial Sequence
  chemically synthesized
gcctcagcctacttagtagc

SEQ ID NO: 36787 - DNA, 20 bp, Artificial Sequence
  chemically synthesized
cctcagcctacttagtagct

SEQ ID NO: 36788 - DNA, 20 bp, Artificial Sequence
  chemically synthesized
tacttagtagctgggatgac

SEQ ID NO: 36789 - DNA, 20 bp, Artificial Sequence
  chemically synthesized
ctggcatgtgcctccacacc

SEQ ID NO: 36790 - DNA, 20 bp, Artificial Sequence
  chemically synthesized
gctaatttttgtattttttg

SEQ ID NO: 36791 - DNA, 20 bp, Artificial Sequence
  chemically synthesized
taatttttgtattttttgta

SEQ ID NO: 36792 - DNA, 20 bp, Artificial Sequence
  chemically synthesized
ttttgtattttttgtagaga

SEQ ID NO: 36793 - DNA, 20 bp, Artificial Sequence
  chemically synthesized
tttgtattttttgtagagac

SEQ ID NO: 36794 - DNA, 20 bp, Artificial Sequence
  chemically synthesized
ttgtattttttgtagagaca

SEQ ID NO: 36795 - DNA, 20 bp, Artificial Sequence
  chemically synthesized
tttttgtagagacagggttt

SEQ ID NO: 36796 - DNA, 20 bp, Artificial Sequence
  chemically synthesized
cagggttttggcatgttgcc

SEQ ID NO: 36797 - DNA, 20 bp, Artificial Sequence
  chemically synthesized
agggttttggcatgttgccc

SEQ ID NO: 36798 - DNA, 20 bp, Artificial Sequence
  chemically synthesized
ccaggcttgtctcaaactcc

SEQ ID NO: 36799 - DNA, 20 bp, Artificial Sequence
  chemically synthesized
ttgtctcaaactcctggcct

SEQ ID NO: 36800 - DNA, 20 bp, Artificial Sequence
  chemically synthesized
tgtctcaaactcctggcctc

SEQ ID NO: 36801 - DNA, 20 bp, Artificial Sequence
  chemically synthesized
ctcaggtgatccatctgccg

SEQ ID NO: 36802 - DNA, 20 bp, Artificial Sequence
  chemically synthesized
gccgtggcctcccaaaatgc

SEQ ID NO: 36803 - DNA, 20 bp, Artificial Sequence
  chemically synthesized
ccgtggcctcccaaaatgct

SEQ ID NO: 36804 - DNA, 20 bp, Artificial Sequence
  chemically synthesized
ctcccaaaatgctgggatta

SEQ ID NO: 36805 - DNA, 20 bp, Artificial Sequence
  chemically synthesized
tcccaaaatgctgggattat

SEQ ID NO: 36806 - DNA, 20 bp, Artificial Sequence
  chemically synthesized
aatgctgggattataggcat

SEQ ID NO: 36807 - DNA, 20 bp, Artificial Sequence
  chemically synthesized
catgagccaccaccccctcc

SEQ ID NO: 36808 - DNA, 20 bp, Artificial Sequence
  chemically synthesized
gagccaccaccccctcctgg

SEQ ID NO: 36809 - DNA, 20 bp, Artificial Sequence
  chemically synthesized
agccaccaccccctcctgga

SEQ ID NO: 36810 - DNA, 20 bp, Artificial Sequence
  chemically synthesized
tataacataatttataatta

SEQ ID NO: 36811 - DNA, 20 bp, Artificial Sequence
  chemically synthesized
tataattacagaaaacatgt

SEQ ID NO: 36812 - DNA, 20 bp, Artificial Sequence
  chemically synthesized
cagaaaacatgtgagttcac

SEQ ID NO: 36813 - DNA, 20 bp, Artificial Sequence
  chemically synthesized
agaaaacatgtgagttcact

SEQ ID NO: 36814 - DNA, 20 bp, Artificial Sequence
  chemically synthesized
ctaggaataaataaattttg

SEQ ID NO: 36815 - DNA, 20 bp, Artificial Sequence
  chemically synthesized
ataaattttgaagataataa

SEQ ID NO: 36816 - DNA, 20 bp, Artificial Sequence
  chemically synthesized
tttcacttatgttgtcattt

SEQ ID NO: 36817 - DNA, 20 bp, Artificial Sequence
  chemically synthesized
cttatgttgtcatttcggca

SEQ ID NO: 36818 - DNA, 20 bp, Artificial Sequence
  chemically synthesized
gttgtcatttcggcacagtt

SEQ ID NO: 36819 - DNA, 20 bp, Artificial Sequence
  chemically synthesized
catttcggcacagtttggta

SEQ ID NO: 36820 - DNA, 20 bp, Artificial Sequence
  chemically synthesized
atttcggcacagtttggtat

SEQ ID NO: 36821 - DNA, 20 bp, Artificial Sequence
  chemically synthesized
gcacagtttggtataggatg

SEQ ID NO: 36822 - DNA, 20 bp, Artificial Sequence
  chemically synthesized
acagtttggtataggatgtg

SEQ ID NO: 36823 - DNA, 20 bp, Artificial Sequence
  chemically synthesized
gagatgttaacatttatacc

SEQ ID NO: 36824 - DNA, 20 bp, Artificial Sequence
  chemically synthesized
acctagcttgctcgtaaact

SEQ ID NO: 36825 - DNA, 20 bp, Artificial Sequence
  chemically synthesized
gctcgtaaactaagacctga

SEQ ID NO: 36826 - DNA, 20 bp, Artificial Sequence
  chemically synthesized
ctcgtaaactaagacctgaa

SEQ ID NO: 36827 - DNA, 20 bp, Artificial Sequence
  chemically synthesized
tcgtaaactaagacctgaaa

SEQ ID NO: 36828 - DNA, 20 bp, Artificial Sequence
  chemically synthesized
cctgaaagggttgtgtctat

SEQ ID NO: 36829 - DNA, 20 bp, Artificial Sequence
  chemically synthesized
gtgtctatcagctgcacccc

SEQ ID NO: 36830 - DNA, 20 bp, Artificial Sequence
  chemically synthesized
tgtctatcagctgcacccct

SEQ ID NO: 36831 - DNA, 20 bp, Artificial Sequence
  chemically synthesized
ctatcagctgcacccctggg

SEQ ID NO: 36832 - DNA, 20 bp, Artificial Sequence
  chemically synthesized
cctgggtagcgacacaacct

SEQ ID NO: 36833 - DNA, 20 bp, Artificial Sequence
  chemically synthesized
ctgggtagcgacacaacctc

SEQ ID NO: 36834 - DNA, 20 bp, Artificial Sequence
  chemically synthesized
ggtagcgacacaacctcggg

SEQ ID NO: 36835 - DNA, 20 bp, Artificial Sequence
  chemically synthesized
gtagcgacacaacctcggga

SEQ ID NO: 36836 - DNA, 20 bp, Artificial Sequence
  chemically synthesized
acacaacctcgggaaggcct

SEQ ID NO: 36837 - DNA, 20 bp, Artificial Sequence
  chemically synthesized
gcctcagccccctcctcgta

SEQ ID NO: 36838 - DNA, 20 bp, Artificial Sequence
  chemically synthesized
cctcgtacagcactgcctgt

SEQ ID NO: 36839 - DNA, 20 bp, Artificial Sequence
  chemically synthesized
gtacagcactgcctgttgga

SEQ ID NO: 36840 - DNA, 20 bp, Artificial Sequence
  chemically synthesized
cactgcctgttggaaagctt

SEQ ID NO: 36841 - DNA, 20 bp, Artificial Sequence
  chemically synthesized
actgcctgttggaaagcttg

SEQ ID NO: 36842 - DNA, 20 bp, Artificial Sequence
  chemically synthesized
ctgcctgttggaaagcttga

SEQ ID NO: 36843 - DNA, 20 bp, Artificial Sequence
  chemically synthesized
gcctgttggaaagcttgagg

SEQ ID NO: 36844 - DNA, 20 bp, Artificial Sequence
  chemically synthesized
cctgttggaaagcttgaggg

SEQ ID NO: 36845 - DNA, 20 bp, Artificial Sequence
  chemically synthesized
ggaaagcttgagggaggcta

SEQ ID NO: 36846 - DNA, 20 bp, Artificial Sequence
  chemically synthesized
tgagggaggctatggatgtg

SEQ ID NO: 36847 - DNA, 20 bp, Artificial Sequence
  chemically synthesized
ggctatggatgtgcagcact

SEQ ID NO: 36848 - DNA, 20 bp, Artificial Sequence
  chemically synthesized
tatggatgtgcagcacttgg

SEQ ID NO: 36849 - DNA, 20 bp, Artificial Sequence
  chemically synthesized
tggatgtgcagcacttggca

SEQ ID NO: 36850 - DNA, 20 bp, Artificial Sequence
  chemically synthesized
ggatgtgcagcacttggcag

SEQ ID NO: 36851 - DNA, 20 bp, Artificial Sequence
  chemically synthesized
gatgtgcagcacttggcaga

SEQ ID NO: 36852 - DNA, 20 bp, Artificial Sequence
  chemically synthesized
gcagcacttggcagagggtc

SEQ ID NO: 36853 - DNA, 20 bp, Artificial Sequence
  chemically synthesized
cttggcagagggtctggtca

SEQ ID NO: 36854 - DNA, 20 bp, Artificial Sequence
  chemically synthesized
ggcagagggtctggtcatgg

SEQ ID NO: 36855 - DNA, 20 bp, Artificial Sequence
  chemically synthesized
ggtctggtcatggaagttac

SEQ ID NO: 36856 - DNA, 20 bp, Artificial Sequence
  chemically synthesized
tggaagttaccagcaaatat

SEQ ID NO: 36857 - DNA, 20 bp, Artificial Sequence
  chemically synthesized
tatgattttattttatccaa

SEQ ID NO: 36858 - DNA, 20 bp, Artificial Sequence
  chemically synthesized
attttattttatccaaaaga

SEQ ID NO: 36859 - DNA, 20 bp, Artificial Sequence
  chemically synthesized
tttattttatccaaaagaaa

SEQ ID NO: 36860 - DNA, 20 bp, Artificial Sequence
  chemically synthesized
atccaaaagaaagagaatga

SEQ ID NO: 36861 - DNA, 20 bp, Artificial Sequence
  chemically synthesized
caaaagaaagagaatgaaag

SEQ ID NO: 36862 - DNA, 20 bp, Artificial Sequence
  chemically synthesized
aaagaaagagaatgaaagaa

SEQ ID NO: 36863 - DNA, 20 bp, Artificial Sequence
  chemically synthesized
aagaaagagaatgaaagaag

SEQ ID NO: 36864 - DNA, 20 bp, Artificial Sequence
  chemically synthesized
agaaagagaatgaaagaaga

SEQ ID NO: 36865 - DNA, 20 bp, Artificial Sequence
  chemically synthesized
gaaagagaatgaaagaagag

SEQ ID NO: 36866 - DNA, 20 bp, Artificial Sequence
  chemically synthesized
aagagaatgaaagaagaggg

SEQ ID NO: 36867 - DNA, 20 bp, Artificial Sequence
  chemically synthesized
agagaatgaaagaagagggg

SEQ ID NO: 36868 - DNA, 20 bp, Artificial Sequence
  chemically synthesized
gaaagaagaggggaggaaac

SEQ ID NO: 36869 - DNA, 20 bp, Artificial Sequence
  chemically synthesized
ggggaggaaacaagactaat

SEQ ID NO: 36870 - DNA, 20 bp, Artificial Sequence
  chemically synthesized
gggaggaaacaagactaatc

SEQ ID NO: 36871 - DNA, 20 bp, Artificial Sequence
  chemically synthesized
ggaaacaagactaatcagga

SEQ ID NO: 36872 - DNA, 20 bp, Artificial Sequence
  chemically synthesized
aagactaatcaggaaagatg

SEQ ID NO: 36873 - DNA, 20 bp, Artificial Sequence
  chemically synthesized
agactaatcaggaaagatga

SEQ ID NO: 36874 - DNA, 20 bp, Artificial Sequence
  chemically synthesized
aatcaggaaagatgaaggtc

SEQ ID NO: 36875 - DNA, 20 bp, Artificial Sequence
  chemically synthesized
atcaggaaagatgaaggtct

SEQ ID NO: 36876 - DNA, 20 bp, Artificial Sequence
  chemically synthesized
tcaggaaagatgaaggtcta

SEQ ID NO: 36877 - DNA, 20 bp, Artificial Sequence
  chemically synthesized
caggaaagatgaaggtctag

SEQ ID NO: 36878 - DNA, 20 bp, Artificial Sequence
  chemically synthesized
aaagatgaaggtctaggggt

SEQ ID NO: 36879 - DNA, 20 bp, Artificial Sequence
  chemically synthesized
aagatgaaggtctaggggtg

SEQ ID NO: 36880 - DNA, 20 bp, Artificial Sequence
  chemically synthesized
agatgaaggtctaggggtga

SEQ ID NO: 36881 - DNA, 20 bp, Artificial Sequence
  chemically synthesized
tgaaggtctaggggtgaggg

SEQ ID NO: 36882 - DNA, 20 bp, Artificial Sequence
  chemically synthesized
gaaggtctaggggtgaggga

SEQ ID NO: 36883 - DNA, 20 bp, Artificial Sequence
  chemically synthesized
aggtctaggggtgagggaag

SEQ ID NO: 36884 - DNA, 20 bp, Artificial Sequence
  chemically synthesized
ctaggggtgagggaaggagt

SEQ ID NO: 36885 - DNA, 20 bp, Artificial Sequence
  chemically synthesized
taggggtgagggaaggagta

SEQ ID NO: 36886 - DNA, 20 bp, Artificial Sequence
  chemically synthesized
ggggtgagggaaggagtaag

SEQ ID NO: 36887 - DNA, 20 bp, Artificial Sequence
  chemically synthesized
ggaaggagtaaggagacata

SEQ ID NO: 36888 - DNA, 20 bp, Artificial Sequence
  chemically synthesized
gaaggagtaaggagacataa

SEQ ID NO: 36889 - DNA, 20 bp, Artificial Sequence
  chemically synthesized
aaggagacataaaggcaatg

SEQ ID NO: 36890 - DNA, 20 bp, Artificial Sequence
  chemically synthesized
ggagacataaaggcaatgtg

SEQ ID NO: 36891 - DNA, 20 bp, Artificial Sequence
  chemically synthesized
gacataaaggcaatgtggag

SEQ ID NO: 36892 - DNA, 20 bp, Artificial Sequence
  chemically synthesized
aaaggcaatgtggagcagct

SEQ ID NO: 36893 - DNA, 20 bp, Artificial Sequence
  chemically synthesized
aaggcaatgtggagcagctg

SEQ ID NO: 36894 - DNA, 20 bp, Artificial Sequence
  chemically synthesized
aggcaatgtggagcagctga

SEQ ID NO: 36895 - DNA, 20 bp, Artificial Sequence
  chemically synthesized
ggcaatgtggagcagctgag

SEQ ID NO: 36896 - DNA, 20 bp, Artificial Sequence
  chemically synthesized
gcaatgtggagcagctgagg

SEQ ID NO: 36897 - DNA, 20 bp, Artificial Sequence
  chemically synthesized
caatgtggagcagctgaggg

SEQ ID NO: 36898 - DNA, 20 bp, Artificial Sequence
  chemically synthesized
ggagcagctgaggggggaaa

SEQ ID NO: 36899 - DNA, 20 bp, Artificial Sequence
  chemically synthesized
aaatggctttcaccacttcc

SEQ ID NO: 36900 - DNA, 20 bp, Artificial Sequence
  chemically synthesized
tgcactctcaaatattttat

SEQ ID NO: 36901 - DNA, 20 bp, Artificial Sequence
  chemically synthesized
ttttataagactctatattc

SEQ ID NO: 36902 - DNA, 20 bp, Artificial Sequence
  chemically synthesized
tttataagactctatattca

SEQ ID NO: 36903 - DNA, 20 bp, Artificial Sequence
  chemically synthesized
ggtaatgtttgaaccctgct

SEQ ID NO: 36904 - DNA, 20 bp, Artificial Sequence
  chemically synthesized
atgtttgaaccctgctgagc

SEQ ID NO: 36905 - DNA, 20 bp, Artificial Sequence
  chemically synthesized
tttgaaccctgctgagccag

SEQ ID NO: 36906 - DNA, 20 bp, Artificial Sequence
  chemically synthesized
accctgctgagccagtggca

SEQ ID NO: 36907 - DNA, 20 bp, Artificial Sequence
  chemically synthesized
ccctgctgagccagtggcat

SEQ ID NO: 36908 - DNA, 20 bp, Artificial Sequence
  chemically synthesized
agccagtggcatgggtctct

SEQ ID NO: 36909 - DNA, 20 bp, Artificial Sequence
  chemically synthesized
ccagtggcatgggtctctga

SEQ ID NO: 36910 - DNA, 20 bp, Artificial Sequence
  chemically synthesized
attaacttaatttgactatc

SEQ ID NO: 36911 - DNA, 20 bp, Artificial Sequence
  chemically synthesized
taatttgactatctggtttg

SEQ ID NO: 36912 - DNA, 20 bp, Artificial Sequence
  chemically synthesized
aatttgactatctggtttgt

SEQ ID NO: 36913 - DNA, 20 bp, Artificial Sequence
  chemically synthesized
gggtgcgtttactctcatgt

SEQ ID NO: 36914 - DNA, 20 bp, Artificial Sequence
  chemically synthesized
catgtaagtcaacaatgtcc

SEQ ID NO: 36915 - DNA, 20 bp, Artificial Sequence
  chemically synthesized
atgtaagtcaacaatgtcct

SEQ ID NO: 36916 - DNA, 20 bp, Artificial Sequence
  chemically synthesized
agtcaacaatgtcctgggat

SEQ ID NO: 36917 - DNA, 20 bp, Artificial Sequence
  chemically synthesized
gtcaacaatgtcctgggatt

SEQ ID NO: 36918 - DNA, 20 bp, Artificial Sequence
  chemically synthesized
tgggattgggacacactttc

SEQ ID NO: 36919 - DNA, 20 bp, Artificial Sequence
  chemically synthesized
gggattgggacacactttct

SEQ ID NO: 36920 - DNA, 20 bp, Artificial Sequence
  chemically synthesized
acacactttctgggcactgc

SEQ ID NO: 36921 - DNA, 20 bp, Artificial Sequence
  chemically synthesized
actttctgggcactgctggc

SEQ ID NO: 36922 - DNA, 20 bp, Artificial Sequence
  chemically synthesized
actgctggccagtcccaaaa

SEQ ID NO: 36923 - DNA, 20 bp, Artificial Sequence
  chemically synthesized
ccagtcccaaaatggaacat

SEQ ID NO: 36924 - DNA, 20 bp, Artificial Sequence
  chemically synthesized
cagtcccaaaatggaacata

SEQ ID NO: 36925 - DNA, 20 bp, Artificial Sequence
  chemically synthesized
tcccaaaatggaacataagg

SEQ ID NO: 36926 - DNA, 20 bp, Artificial Sequence
  chemically synthesized
caaaatggaacataaggaag

SEQ ID NO: 36927 - DNA, 20 bp, Artificial Sequence
  chemically synthesized
acttcttttatttctgaaat

SEQ ID NO: 36928 - DNA, 20 bp, Artificial Sequence
  chemically synthesized
cttcttttatttctgaaatc

SEQ ID NO: 36929 - DNA, 20 bp, Artificial Sequence
  chemically synthesized
ttttatttctgaaatcaggt

SEQ ID NO: 36930 - DNA, 20 bp, Artificial Sequence
  chemically synthesized
ttctgaaatcaggtaagaca

SEQ ID NO: 36931 - DNA, 20 bp, Artificial Sequence
  chemically synthesized
acatagtttttttaaattat

SEQ ID NO: 36932 - DNA, 20 bp, Artificial Sequence
  chemically synthesized
ttattttttctcccacaatg

SEQ ID NO: 36933 - DNA, 20 bp, Artificial Sequence
  chemically synthesized
tagtaaaaatacatatgcca

SEQ ID NO: 36934 - DNA, 20 bp, Artificial Sequence
  chemically synthesized
tttttgattcatgaaattcc

SEQ ID NO: 36935 - DNA, 20 bp, Artificial Sequence
  chemically synthesized
tgaaaaattcttaaaaaaat

SEQ ID NO: 36936 - DNA, 20 bp, Artificial Sequence
  chemically synthesized
ataagtttaatttccccgtg

SEQ ID NO: 36937 - DNA, 20 bp, Artificial Sequence
  chemically synthesized
tttccccgtgaagactgtca

SEQ ID NO: 36938 - DNA, 20 bp, Artificial Sequence
  chemically synthesized
cgtgaagactgtcacggtgc

SEQ ID NO: 36939 - DNA, 20 bp, Artificial Sequence
  chemically synthesized
tgtcacggtgctggaatgaa

SEQ ID NO: 36940 - DNA, 20 bp, Artificial Sequence
  chemically synthesized
gtcacggtgctggaatgaat

SEQ ID NO: 36941 - DNA, 20 bp, Artificial Sequence
  chemically synthesized
acggtgctggaatgaatggg

SEQ ID NO: 36942 - DNA, 20 bp, Artificial Sequence
  chemically synthesized
tgaatgggcagaaaaaataa

SEQ ID NO: 36943 - DNA, 20 bp, Artificial Sequence
  chemically synthesized
ggttgatttttctaatctaa

SEQ ID NO: 36944 - DNA, 20 bp, Artificial Sequence
  chemically synthesized
ttgatttttctaatctaaaa

SEQ ID NO: 36945 - DNA, 20 bp, Artificial Sequence
  chemically synthesized
aaaagagtgtgcctacatga

SEQ ID NO: 36946 - DNA, 20 bp, Artificial Sequence
  chemically synthesized
gagtgtgcctacatgatggc

SEQ ID NO: 36947 - DNA, 20 bp, Artificial Sequence
  chemically synthesized
tgcctacatgatggccagtc

SEQ ID NO: 36948 - DNA, 20 bp, Artificial Sequence
  chemically synthesized
cagtctggctgaaaaataaa

SEQ ID NO: 36949 - DNA, 20 bp, Artificial Sequence
  chemically synthesized
tgaaaaataaatagccattg

SEQ ID NO: 36950 - DNA, 20 bp, Artificial Sequence
  chemically synthesized
ccattgtagctaactatgca

SEQ ID NO: 36951 - DNA, 20 bp, Artificial Sequence
  chemically synthesized
cattgtagctaactatgcaa

SEQ ID NO: 36952 - DNA, 20 bp, Artificial Sequence
  chemically synthesized
gtagctaactatgcaaagga

SEQ ID NO: 36953 - DNA, 20 bp, Artificial Sequence
  chemically synthesized
taactatgcaaaggatggct

SEQ ID NO: 36954 - DNA, 20 bp, Artificial Sequence
  chemically synthesized
ggatggctaagctcttcgct

SEQ ID NO: 36955 - DNA, 20 bp, Artificial Sequence
  chemically synthesized
taagctcttcgcttggttct

SEQ ID NO: 36956 - DNA, 20 bp, Artificial Sequence
  chemically synthesized
taatttatatcatctctgtt

SEQ ID NO: 36957 - DNA, 20 bp, Artificial Sequence
  chemically synthesized
aatttatatcatctctgttc

SEQ ID NO: 36958 - DNA, 20 bp, Artificial Sequence
  chemically synthesized
aggtgccatgctcccctcac

SEQ ID NO: 36959 - DNA, 20 bp, Artificial Sequence
  chemically synthesized
gccatgctcccctcactagc

SEQ ID NO: 36960 - DNA, 20 bp, Artificial Sequence
  chemically synthesized
aataactctttgaatatgtt

SEQ ID NO: 36961 - DNA, 20 bp, Artificial Sequence
  chemically synthesized
ttggttccttgacctgttca

SEQ ID NO: 36962 - DNA, 20 bp, Artificial Sequence
  chemically synthesized
ggttccttgacctgttcatg

SEQ ID NO: 36963 - DNA, 20 bp, Artificial Sequence
  chemically synthesized
tccttgacctgttcatggag

SEQ ID NO: 36964 - DNA, 20 bp, Artificial Sequence
  chemically synthesized
ccttgacctgttcatggagt

SEQ ID NO: 36965 - DNA, 20 bp, Artificial Sequence
  chemically synthesized
cctgttcatggagtgggact

SEQ ID NO: 36966 - DNA, 20 bp, Artificial Sequence
  chemically synthesized
cagcatttctctctttgtta

SEQ ID NO: 36967 - DNA, 20 bp, Artificial Sequence
  chemically synthesized
ttctctctttgttatggcct

SEQ ID NO: 36968 - DNA, 20 bp, Artificial Sequence
  chemically synthesized
ctctttgttatggcctgagt

SEQ ID NO: 36969 - DNA, 20 bp, Artificial Sequence
  chemically synthesized
tctttgttatggcctgagta

SEQ ID NO: 36970 - DNA, 20 bp, Artificial Sequence
  chemically synthesized
gcctgagtaaggctttccat

SEQ ID NO: 36971 - DNA, 20 bp, Artificial Sequence
  chemically synthesized
atacatttgcttcttatccc

SEQ ID NO: 36972 - DNA, 20 bp, Artificial Sequence
  chemically synthesized
acatttgcttcttatccctg

SEQ ID NO: 36973 - DNA, 20 bp, Artificial Sequence
  chemically synthesized
aattatacacatccatttgc

SEQ ID NO: 36974 - DNA, 20 bp, Artificial Sequence
  chemically synthesized
ataatgattcaacaaatact

SEQ ID NO: 36975 - DNA, 20 bp, Artificial Sequence
  chemically synthesized
taatgattcaacaaatactc

SEQ ID NO: 36976 - DNA, 20 bp, Artificial Sequence
  chemically synthesized
aatgattcaacaaatactca

SEQ ID NO: 36977 - DNA, 20 bp, Artificial Sequence
  chemically synthesized
aaatactcagggtatttgtt

SEQ ID NO: 36978 - DNA, 20 bp, Artificial Sequence
  chemically synthesized
tactcagggtatttgttgag

SEQ ID NO: 36979 - DNA, 20 bp, Artificial Sequence
  chemically synthesized
actcagggtatttgttgagt

SEQ ID NO: 36980 - DNA, 20 bp, Artificial Sequence
  chemically synthesized
agggtatttgttgagtgggt

SEQ ID NO: 36981 - DNA, 20 bp, Artificial Sequence
  chemically synthesized
gggtatttgttgagtgggtt

SEQ ID NO: 36982 - DNA, 20 bp, Artificial Sequence
  chemically synthesized
ccgtgtgtgattgtgaatgt

SEQ ID NO: 36983 - DNA, 20 bp, Artificial Sequence
  chemically synthesized
tgtgtgtcctttacaaatac

SEQ ID NO: 36984 - DNA, 20 bp, Artificial Sequence
  chemically synthesized
tttacaaatactagcttatt

SEQ ID NO: 36985 - DNA, 20 bp, Artificial Sequence
  chemically synthesized
atactagcttatttagctca

SEQ ID NO: 36986 - DNA, 20 bp, Artificial Sequence
  chemically synthesized
agcttatttagctcatggta

SEQ ID NO: 36987 - DNA, 20 bp, Artificial Sequence
  chemically synthesized
gcttatttagctcatggtat

SEQ ID NO: 36988 - DNA, 20 bp, Artificial Sequence
  chemically synthesized
tatttagctcatggtatagg

SEQ ID NO: 36989 - DNA, 20 bp, Artificial Sequence
  chemically synthesized
atttagctcatggtataggt

SEQ ID NO: 36990 - DNA, 20 bp, Artificial Sequence
  chemically synthesized
tttagctcatggtataggta

SEQ ID NO: 36991 - DNA, 20 bp, Artificial Sequence
  chemically synthesized
agctcatggtataggtaggg

SEQ ID NO: 36992 - DNA, 20 bp, Artificial Sequence
  chemically synthesized
atggtataggtagggtagca

SEQ ID NO: 36993 - DNA, 20 bp, Artificial Sequence
  chemically synthesized
tcatccccattttataaaca

SEQ ID NO: 36994 - DNA, 20 bp, Artificial Sequence
  chemically synthesized
attttataaacaaagaaatc

SEQ ID NO: 36995 - DNA, 20 bp, Artificial Sequence
  chemically synthesized
taaacaaagaaatctagact

SEQ ID NO: 36996 - DNA, 20 bp, Artificial Sequence
  chemically synthesized
aaacaaagaaatctagactt

SEQ ID NO: 36997 - DNA, 20 bp, Artificial Sequence
  chemically synthesized
cgtgaccaaattcccaaatc

SEQ ID NO: 36998 - DNA, 20 bp, Artificial Sequence
  chemically synthesized
gtgaccaaattcccaaatca

SEQ ID NO: 36999 - DNA, 20 bp, Artificial Sequence
  chemically synthesized
attcccaaatcaaggaaata

SEQ ID NO: 37000 - DNA, 20 bp, Artificial Sequence
  chemically synthesized
atcaaggaaataaagaaacc

SEQ ID NO: 37001 - DNA, 20 bp, Artificial Sequence
  chemically synthesized
aaataaagaaacctggattt

SEQ ID NO: 37002 - DNA, 20 bp, Artificial Sequence
  chemically synthesized
aaagaaacctggatttaagc

SEQ ID NO: 37003 - DNA, 20 bp, Artificial Sequence
  chemically synthesized
tggatttaagccagatttcc

SEQ ID NO: 37004 - DNA, 20 bp, Artificial Sequence
  chemically synthesized
cagatttccaagaaaaaatc

SEQ ID NO: 37005 - DNA, 20 bp, Artificial Sequence
  chemically synthesized
agatttccaagaaaaaatct

SEQ ID NO: 37006 - DNA, 20 bp, Artificial Sequence
  chemically synthesized
gatttccaagaaaaaatcta

SEQ ID NO: 37007 - DNA, 20 bp, Artificial Sequence
  chemically synthesized
aacacattccaatgtaactg

SEQ ID NO: 37008 - DNA, 20 bp, Artificial Sequence
  chemically synthesized
cacattccaatgtaactgaa

SEQ ID NO: 37009 - DNA, 20 bp, Artificial Sequence
  chemically synthesized
attccaatgtaactgaagag

SEQ ID NO: 37010 - DNA, 20 bp, Artificial Sequence
  chemically synthesized
ttccaatgtaactgaagagc

SEQ ID NO: 37011 - DNA, 20 bp, Artificial Sequence
  chemically synthesized
ggttaattgtttgccacttg

SEQ ID NO: 37012 - DNA, 20 bp, Artificial Sequence
  chemically synthesized
gccacttgcagaatccaatt

SEQ ID NO: 37013 - DNA, 20 bp, Artificial Sequence
  chemically synthesized
acttgcagaatccaattaag

SEQ ID NO: 37014 - DNA, 20 bp, Artificial Sequence
  chemically synthesized
ttgcagaatccaattaagaa

SEQ ID NO: 37015 - DNA, 20 bp, Artificial Sequence
  chemically synthesized
gcagaatccaattaagaaga

SEQ ID NO: 37016 - DNA, 20 bp, Artificial Sequence
  chemically synthesized
gaatccaattaagaagagag

SEQ ID NO: 37017 - DNA, 20 bp, Artificial Sequence
  chemically synthesized
caattaagaagagagaagtc

SEQ ID NO: 37018 - DNA, 20 bp, Artificial Sequence
  chemically synthesized
gaagagagaagtctggtata

SEQ ID NO: 37019 - DNA, 20 bp, Artificial Sequence
  chemically synthesized
agagaagtctggtataaaga

SEQ ID NO: 37020 - DNA, 20 bp, Artificial Sequence
  chemically synthesized
aagaaagtgatttgcttcca

SEQ ID NO: 37021 - DNA, 20 bp, Artificial Sequence
  chemically synthesized
aagtgatttgcttccaaagc

SEQ ID NO: 37022 - DNA, 20 bp, Artificial Sequence
  chemically synthesized
atttgcttccaaagctagct

SEQ ID NO: 37023 - DNA, 20 bp, Artificial Sequence
  chemically synthesized
tttgcttccaaagctagctt

SEQ ID NO: 37024 - DNA, 20 bp, Artificial Sequence
  chemically synthesized
ttgcttccaaagctagctta

SEQ ID NO: 37025 - DNA, 20 bp, Artificial Sequence
  chemically synthesized
tgcttccaaagctagcttag

SEQ ID NO: 37026 - DNA, 20 bp, Artificial Sequence
  chemically synthesized
ttccaaagctagcttagggg

SEQ ID NO: 37027 - DNA, 20 bp, Artificial Sequence
  chemically synthesized
ctagcttaggggaagaaatg

SEQ ID NO: 37028 - DNA, 20 bp, Artificial Sequence
  chemically synthesized
gcttaggggaagaaatgcag

SEQ ID NO: 37029 - DNA, 20 bp, Artificial Sequence
  chemically synthesized
cctgccgtactacttcactt

SEQ ID NO: 37030 - DNA, 20 bp, Artificial Sequence
  chemically synthesized
ctgccgtactacttcacttt

SEQ ID NO: 37031 - DNA, 20 bp, Artificial Sequence
  chemically synthesized
gccgtactacttcactttag

SEQ ID NO: 37032 - DNA, 20 bp, Artificial Sequence
  chemically synthesized
gtactacttcactttaggag

SEQ ID NO: 37033 - DNA, 20 bp, Artificial Sequence
  chemically synthesized
tacttcactttaggagcaga

SEQ ID NO: 37034 - DNA, 20 bp, Artificial Sequence
  chemically synthesized
ttcactttaggagcagaaag

SEQ ID NO: 37035 - DNA, 20 bp, Artificial Sequence
  chemically synthesized
gcagaaagtggcacttttaa

SEQ ID NO: 37036 - DNA, 20 bp, Artificial Sequence
  chemically synthesized
cagaaagtggcacttttaaa

SEQ ID NO: 37037 - DNA, 20 bp, Artificial Sequence
  chemically synthesized
gtggcacttttaaaaggcaa

SEQ ID NO: 37038 - DNA, 20 bp, Artificial Sequence
  chemically synthesized
ggcacttttaaaaggcaaca

SEQ ID NO: 37039 - DNA, 20 bp, Artificial Sequence
  chemically synthesized
gcacttttaaaaggcaacag

SEQ ID NO: 37040 - DNA, 20 bp, Artificial Sequence
  chemically synthesized
acttttaaaaggcaacagag

SEQ ID NO: 37041 - DNA, 20 bp, Artificial Sequence
  chemically synthesized
cttttaaaaggcaacagagg

SEQ ID NO: 37042 - DNA, 20 bp, Artificial Sequence
  chemically synthesized
taaaaggcaacagaggaggc

SEQ ID NO: 37043 - DNA, 20 bp, Artificial Sequence
  chemically synthesized
aggcaacagaggaggcgagc

SEQ ID NO: 37044 - DNA, 20 bp, Artificial Sequence
  chemically synthesized
ggcaacagaggaggcgagca

SEQ ID NO: 37045 - DNA, 20 bp, Artificial Sequence
  chemically synthesized
agaggaggcgagcaaggatt

SEQ ID NO: 37046 - DNA, 20 bp, Artificial Sequence
  chemically synthesized
gaggaggcgagcaaggattc

SEQ ID NO: 37047 - DNA, 20 bp, Artificial Sequence
  chemically synthesized
aggaggcgagcaaggattca

SEQ ID NO: 37048 - DNA, 20 bp, Artificial Sequence
  chemically synthesized
ggaggcgagcaaggattcag

SEQ ID NO: 37049 - DNA, 20 bp, Artificial Sequence
  chemically synthesized
aaggattcaggggtccatgc

SEQ ID NO: 37050 - DNA, 20 bp, Artificial Sequence
  chemically synthesized
ttcaggggtccatgctagct

SEQ ID NO: 37051 - DNA, 20 bp, Artificial Sequence
  chemically synthesized
tcaggggtccatgctagctt

SEQ ID NO: 37052 - DNA, 20 bp, Artificial Sequence
  chemically synthesized
agcttgggcaccttatccac

SEQ ID NO: 37053 - DNA, 20 bp, Artificial Sequence
  chemically synthesized
gcttgggcaccttatccacc

SEQ ID NO: 37054 - DNA, 20 bp, Artificial Sequence
  chemically synthesized
tgggcaccttatccaccagg

SEQ ID NO: 37055 - DNA, 20 bp, Artificial Sequence
  chemically synthesized
accttatccaccaggtagtt

SEQ ID NO: 37056 - DNA, 20 bp, Artificial Sequence
  chemically synthesized
ttatccaccaggtagttgag

SEQ ID NO: 37057 - DNA, 20 bp, Artificial Sequence
  chemically synthesized
gtagttgagcagttgcctgc

SEQ ID NO: 37058 - DNA, 20 bp, Artificial Sequence
  chemically synthesized
ttgcctgctggtgcctttgt

SEQ ID NO: 37059 - DNA, 20 bp, Artificial Sequence
  chemically synthesized
cctgctggtgcctttgtgag

SEQ ID NO: 37060 - DNA, 20 bp, Artificial Sequence
  chemically synthesized
ctgctggtgcctttgtgagc

SEQ ID NO: 37061 - DNA, 20 bp, Artificial Sequence
  chemically synthesized
tgctggtgcctttgtgagca

SEQ ID NO: 37062 - DNA, 20 bp, Artificial Sequence
  chemically synthesized
tgagcagggtgttgtccctt

SEQ ID NO: 37063 - DNA, 20 bp, Artificial Sequence
  chemically synthesized
gagcagggtgttgtcccttg

SEQ ID NO: 37064 - DNA, 20 bp, Artificial Sequence
  chemically synthesized
tgtcccttgaggcaaatctc

SEQ ID NO: 37065 - DNA, 20 bp, Artificial Sequence
  chemically synthesized
tcccttgaggcaaatctctg

SEQ ID NO: 37066 - DNA, 20 bp, Artificial Sequence
  chemically synthesized
cccttgaggcaaatctctgg

SEQ ID NO: 37067 - DNA, 20 bp, Artificial Sequence
  chemically synthesized
ccttgaggcaaatctctgga

SEQ ID NO: 37068 - DNA, 20 bp, Artificial Sequence
  chemically synthesized
gaggcaaatctctggagggt

SEQ ID NO: 37069 - DNA, 20 bp, Artificial Sequence
  chemically synthesized
ggcaaatctctggagggtga

SEQ ID NO: 37070 - DNA, 20 bp, Artificial Sequence
  chemically synthesized
tctggagggtgagagttttg

SEQ ID NO: 37071 - DNA, 20 bp, Artificial Sequence
  chemically synthesized
ggagggtgagagttttgtag

SEQ ID NO: 37072 - DNA, 20 bp, Artificial Sequence
  chemically synthesized
gagggtgagagttttgtagt

SEQ ID NO: 37073 - DNA, 20 bp, Artificial Sequence
  chemically synthesized
gttttgtagtgggcatgctt

SEQ ID NO: 37074 - DNA, 20 bp, Artificial Sequence
  chemically synthesized
ttataaatcacctgtgaact

SEQ ID NO: 37075 - DNA, 20 bp, Artificial Sequence
  chemically synthesized
tataaatcacctgtgaactc

SEQ ID NO: 37076 - DNA, 20 bp, Artificial Sequence
  chemically synthesized
taaatcacctgtgaactcag

SEQ ID NO: 37077 - DNA, 20 bp, Artificial Sequence
  chemically synthesized
aactcaggagttccatcttg

SEQ ID NO: 37078 - DNA, 20 bp, Artificial Sequence
  chemically synthesized
tccatcttgaagcacataca

SEQ ID NO: 37079 - DNA, 20 bp, Artificial Sequence
  chemically synthesized
tcttgaagcacatacatagt

SEQ ID NO: 37080 - DNA, 20 bp, Artificial Sequence
  chemically synthesized
agttagatgaacttgccctg

SEQ ID NO: 37081 - DNA, 20 bp, Artificial Sequence
  chemically synthesized
gttagatgaacttgccctgc

SEQ ID NO: 37082 - DNA, 20 bp, Artificial Sequence
  chemically synthesized
ttagatgaacttgccctgca

SEQ ID NO: 37083 - DNA, 20 bp, Artificial Sequence
  chemically synthesized
agatgaacttgccctgcagg

SEQ ID NO: 37084 - DNA, 20 bp, Artificial Sequence
  chemically synthesized
atgaacttgccctgcaggga

SEQ ID NO: 37085 - DNA, 20 bp, Artificial Sequence
  chemically synthesized
ctgcagggagagtctgatga

SEQ ID NO: 37086 - DNA, 20 bp, Artificial Sequence
  chemically synthesized
tgcagggagagtctgatgaa

SEQ ID NO: 37087 - DNA, 20 bp, Artificial Sequence
  chemically synthesized
gcagggagagtctgatgaaa

SEQ ID NO: 37088 - DNA, 20 bp, Artificial Sequence
  chemically synthesized
agggagagtctgatgaaagg

SEQ ID NO: 37089 - DNA, 20 bp, Artificial Sequence
  chemically synthesized
gggagagtctgatgaaaggg

SEQ ID NO: 37090 - DNA, 20 bp, Artificial Sequence
  chemically synthesized
agagtctgatgaaagggagg

SEQ ID NO: 37091 - DNA, 20 bp, Artificial Sequence
  chemically synthesized
caatttaatctataaattac

SEQ ID NO: 37092 - DNA, 20 bp, Artificial Sequence
  chemically synthesized
attaccagataaaattttac

SEQ ID NO: 37093 - DNA, 20 bp, Artificial Sequence
  chemically synthesized
aattttacaagttgacttta

SEQ ID NO: 37094 - DNA, 20 bp, Artificial Sequence
  chemically synthesized
aagtcaaacacatttgaatt

SEQ ID NO: 37095 - DNA, 20 bp, Artificial Sequence
  chemically synthesized
tcaaacacatttgaatttag

SEQ ID NO: 37096 - DNA, 20 bp, Artificial Sequence
  chemically synthesized
aacacatttgaatttagtgg

SEQ ID NO: 37097 - DNA, 20 bp, Artificial Sequence
  chemically synthesized
gaatttagtggaagccattc

SEQ ID NO: 37098 - DNA, 20 bp, Artificial Sequence
  chemically synthesized
agccattcaagaaaatatca

SEQ ID NO: 37099 - DNA, 20 bp, Artificial Sequence
  chemically synthesized
agaaaatatcaaagaaaata

SEQ ID NO: 37100 - DNA, 20 bp, Artificial Sequence
  chemically synthesized
aaaatatcaaagaaaataca

SEQ ID NO: 37101 - DNA, 20 bp, Artificial Sequence
  chemically synthesized
atatcaaagaaaatacagag

SEQ ID NO: 37102 - DNA, 20 bp, Artificial Sequence
  chemically synthesized
tatcaaagaaaatacagagc

SEQ ID NO: 37103 - DNA, 20 bp, Artificial Sequence
  chemically synthesized
tcaaagaaaatacagagcag

SEQ ID NO: 37104 - DNA, 20 bp, Artificial Sequence
  chemically synthesized
aagaaaatacagagcaggag

SEQ ID NO: 37105 - DNA, 20 bp, Artificial Sequence
  chemically synthesized
atacagagcaggagaagatt

SEQ ID NO: 37106 - DNA, 20 bp, Artificial Sequence
  chemically synthesized
gagcaggagaagattaagca

SEQ ID NO: 37107 - DNA, 20 bp, Artificial Sequence
  chemically synthesized
gcaggagaagattaagcaaa

SEQ ID NO: 37108 - DNA, 20 bp, Artificial Sequence
  chemically synthesized
agattaagcaaagagttttt

SEQ ID NO: 37109 - DNA, 20 bp, Artificial Sequence
  chemically synthesized
gattaagcaaagagtttttt

SEQ ID NO: 37110 - DNA, 20 bp, Artificial Sequence
  chemically synthesized
attaagcaaagagttttttg

SEQ ID NO: 37111 - DNA, 20 bp, Artificial Sequence
  chemically synthesized
aaagagttttttggggaaat

SEQ ID NO: 37112 - DNA, 20 bp, Artificial Sequence
  chemically synthesized
ggtgtctatgtctgtgtgtg

SEQ ID NO: 37113 - DNA, 20 bp, Artificial Sequence
  chemically synthesized
gtgtctatgtctgtgtgtgt

SEQ ID NO: 37114 - DNA, 20 bp, Artificial Sequence
  chemically synthesized
tgtctatgtctgtgtgtgta

SEQ ID NO: 37115 - DNA, 20 bp, Artificial Sequence
  chemically synthesized
tctatgtctgtgtgtgtagg

SEQ ID NO: 37116 - DNA, 20 bp, Artificial Sequence
  chemically synthesized
gtctgtgtgtgtagggagtg

SEQ ID NO: 37117 - DNA, 20 bp, Artificial Sequence
  chemically synthesized
tctgtgtgtgtagggagtgc

SEQ ID NO: 37118 - DNA, 20 bp, Artificial Sequence
  chemically synthesized
ctgtgtgtgtagggagtgca

SEQ ID NO: 37119 - DNA, 20 bp, Artificial Sequence
  chemically synthesized
tgtgtgtgtagggagtgcag

SEQ ID NO: 37120 - DNA, 20 bp, Artificial Sequence
  chemically synthesized
gggatatgaatattctattt

SEQ ID NO: 37121 - DNA, 20 bp, Artificial Sequence
  chemically synthesized
gaatattctatttcagccca

SEQ ID NO: 37122 - DNA, 20 bp, Artificial Sequence
  chemically synthesized
ctatttcagcccatggaaac

SEQ ID NO: 37123 - DNA, 20 bp, Artificial Sequence
  chemically synthesized
tatttcagcccatggaaact

SEQ ID NO: 37124 - DNA, 20 bp, Artificial Sequence
  chemically synthesized
agcccatggaaactaggatg

SEQ ID NO: 37125 - DNA, 20 bp, Artificial Sequence
  chemically synthesized
tagatcactgtgaacttatt

SEQ ID NO: 37126 - DNA, 20 bp, Artificial Sequence
  chemically synthesized
atcactgtgaacttattcag

SEQ ID NO: 37127 - DNA, 20 bp, Artificial Sequence
  chemically synthesized
tcactgtgaacttattcagc

SEQ ID NO: 37128 - DNA, 20 bp, Artificial Sequence
  chemically synthesized
tattcagcaggctacaccca

SEQ ID NO: 37129 - DNA, 20 bp, Artificial Sequence
  chemically synthesized
attcagcaggctacacccaa

SEQ ID NO: 37130 - DNA, 20 bp, Artificial Sequence
  chemically synthesized
agcaggctacacccaaaggc

SEQ ID NO: 37131 - DNA, 20 bp, Artificial Sequence
  chemically synthesized
tagaacaaacttctctgcca

SEQ ID NO: 37132 - DNA, 20 bp, Artificial Sequence
  chemically synthesized
agaacaaacttctctgccac

SEQ ID NO: 37133 - DNA, 20 bp, Artificial Sequence
  chemically synthesized
aacatatgttttaatcgacc

SEQ ID NO: 37134 - DNA, 20 bp, Artificial Sequence
  chemically synthesized
acatatgttttaatcgacct

SEQ ID NO: 37135 - DNA, 20 bp, Artificial Sequence
  chemically synthesized
catatgttttaatcgacctg

SEQ ID NO: 37136 - DNA, 20 bp, Artificial Sequence
  chemically synthesized
atatgttttaatcgacctgg

SEQ ID NO: 37137 - DNA, 20 bp, Artificial Sequence
  chemically synthesized
tatgttttaatcgacctggg

SEQ ID NO: 37138 - DNA, 20 bp, Artificial Sequence
  chemically synthesized
tggggggcacattctctgat

SEQ ID NO: 37139 - DNA, 20 bp, Artificial Sequence
  chemically synthesized
cattctctgataagctcttt

SEQ ID NO: 37140 - DNA, 20 bp, Artificial Sequence
  chemically synthesized
ctctgataagctcttttgga

SEQ ID NO: 37141 - DNA, 20 bp, Artificial Sequence
  chemically synthesized
gataagctcttttggaaagc

SEQ ID NO: 37142 - DNA, 20 bp, Artificial Sequence
  chemically synthesized
ataagctcttttggaaagcc

SEQ ID NO: 37143 - DNA, 20 bp, Artificial Sequence
  chemically synthesized
ttggaaagccaggctttctg

SEQ ID NO: 37144 - DNA, 20 bp, Artificial Sequence
  chemically synthesized
gttatctttccaatgtgtgc

SEQ ID NO: 37145 - DNA, 20 bp, Artificial Sequence
  chemically synthesized
ccaatgtgtgctggaatgcc

SEQ ID NO: 37146 - DNA, 20 bp, Artificial Sequence
  chemically synthesized
caatgtgtgctggaatgccc

SEQ ID NO: 37147 - DNA, 20 bp, Artificial Sequence
  chemically synthesized
aatgtgtgctggaatgcccg

SEQ ID NO: 37148 - DNA, 20 bp, Artificial Sequence
  chemically synthesized
tgtgtgctggaatgcccggg

SEQ ID NO: 37149 - DNA, 20 bp, Artificial Sequence
  chemically synthesized
tgtgctggaatgcccgggga

SEQ ID NO: 37150 - DNA, 20 bp, Artificial Sequence
  chemically synthesized
gtgctggaatgcccggggag

SEQ ID NO: 37151 - DNA, 20 bp, Artificial Sequence
  chemically synthesized
gaatgcccggggagaggaaa

SEQ ID NO: 37152 - DNA, 20 bp, Artificial Sequence
  chemically synthesized
agaggaaaaagtttctttta

SEQ ID NO: 37153 - DNA, 20 bp, Artificial Sequence
  chemically synthesized
gtttcttttacagccatgct

SEQ ID NO: 37154 - DNA, 20 bp, Artificial Sequence
  chemically synthesized
cttttacagccatgctcagt

SEQ ID NO: 37155 - DNA, 20 bp, Artificial Sequence
  chemically synthesized
ttacagccatgctcagtgag

SEQ ID NO: 37156 - DNA, 20 bp, Artificial Sequence
  chemically synthesized
cagccatgctcagtgagaag

SEQ ID NO: 37157 - DNA, 20 bp, Artificial Sequence
  chemically synthesized
gccatgctcagtgagaagcg

SEQ ID NO: 37158 - DNA, 20 bp, Artificial Sequence
  chemically synthesized
tcttctattcacaaattgct

SEQ ID NO: 37159 - DNA, 20 bp, Artificial Sequence
  chemically synthesized
gcatacacattcacacacca

SEQ ID NO: 37160 - DNA, 20 bp, Artificial Sequence
  chemically synthesized
acacattcacacaccacagt

SEQ ID NO: 37161 - DNA, 20 bp, Artificial Sequence
  chemically synthesized
cacattcacacaccacagtg

SEQ ID NO: 37162 - DNA, 20 bp, Artificial Sequence
  chemically synthesized
attcacacaccacagtgagg

SEQ ID NO: 37163 - DNA, 20 bp, Artificial Sequence
  chemically synthesized
ttaataaaatacatttactt

SEQ ID NO: 37164 - DNA, 20 bp, Artificial Sequence
  chemically synthesized
ataaaatacatttacttcag

SEQ ID NO: 37165 - DNA, 20 bp, Artificial Sequence
  chemically synthesized
acattttgcctataatataa

SEQ ID NO: 37166 - DNA, 20 bp, Artificial Sequence
  chemically synthesized
aaaagtatttttcctattaa

SEQ ID NO: 37167 - DNA, 20 bp, Artificial Sequence
  chemically synthesized
ttaaatccccattgccatat

SEQ ID NO: 37168 - DNA, 20 bp, Artificial Sequence
  chemically synthesized
ccccattgccatatgagccc

SEQ ID NO: 37169 - DNA, 20 bp, Artificial Sequence
  chemically synthesized
ccattgccatatgagccctg

SEQ ID NO: 37170 - DNA, 20 bp, Artificial Sequence
  chemically synthesized
cattgccatatgagccctgg

SEQ ID NO: 37171 - DNA, 20 bp, Artificial Sequence
  chemically synthesized
tatgagccctggaggtgaat

SEQ ID NO: 37172 - DNA, 20 bp, Artificial Sequence
  chemically synthesized
tgagccctggaggtgaatca

SEQ ID NO: 37173 - DNA, 20 bp, Artificial Sequence
  chemically synthesized
gaggtgaatcagagaaacaa

SEQ ID NO: 37174 - DNA, 20 bp, Artificial Sequence
  chemically synthesized
aggtgaatcagagaaacaaa

SEQ ID NO: 37175 - DNA, 20 bp, Artificial Sequence
  chemically synthesized
tcagagaaacaaaaggattg

SEQ ID NO: 37176 - DNA, 20 bp, Artificial Sequence
  chemically synthesized
aaggattgtggaaaaatcat

SEQ ID NO: 37177 - DNA, 20 bp, Artificial Sequence
  chemically synthesized
aggattgtggaaaaatcatc

SEQ ID NO: 37178 - DNA, 20 bp, Artificial Sequence
  chemically synthesized
aaaaatcatcaggttaaaaa

SEQ ID NO: 37179 - DNA, 20 bp, Artificial Sequence
  chemically synthesized
aagaaaaattgattctgttt

SEQ ID NO: 37180 - DNA, 20 bp, Artificial Sequence
  chemically synthesized
agaaaaattgattctgtttt

SEQ ID NO: 37181 - DNA, 20 bp, Artificial Sequence
  chemically synthesized
ttctgttttgggatatttcc

SEQ ID NO: 37182 - DNA, 20 bp, Artificial Sequence
  chemically synthesized
gggatatttcctagcaacat

SEQ ID NO: 37183 - DNA, 20 bp, Artificial Sequence
  chemically synthesized
tatttcctagcaacatgagc

SEQ ID NO: 37184 - DNA, 20 bp, Artificial Sequence
  chemically synthesized
atttcctagcaacatgagct

SEQ ID NO: 37185 - DNA, 20 bp, Artificial Sequence
  chemically synthesized
tttcctagcaacatgagctg

SEQ ID NO: 37186 - DNA, 20 bp, Artificial Sequence
  chemically synthesized
tcctagcaacatgagctggg

SEQ ID NO: 37187 - DNA, 20 bp, Artificial Sequence
  chemically synthesized
cctagcaacatgagctgggg

SEQ ID NO: 37188 - DNA, 20 bp, Artificial Sequence
  chemically synthesized
ctagcaacatgagctgggga

SEQ ID NO: 37189 - DNA, 20 bp, Artificial Sequence
  chemically synthesized
tagcaacatgagctggggag

SEQ ID NO: 37190 - DNA, 20 bp, Artificial Sequence
  chemically synthesized
atgagctggggaggggatct

SEQ ID NO: 37191 - DNA, 20 bp, Artificial Sequence
  chemically synthesized
agctggggaggggatctcag

SEQ ID NO: 37192 - DNA, 20 bp, Artificial Sequence
  chemically synthesized
ctcagcagtgatgctctatg

SEQ ID NO: 37193 - DNA, 20 bp, Artificial Sequence
  chemically synthesized
tgaagcataataaaatgaca

SEQ ID NO: 37194 - DNA, 20 bp, Artificial Sequence
  chemically synthesized
ataataaaatgacacagtta

SEQ ID NO: 37195 - DNA, 20 bp, Artificial Sequence
  chemically synthesized
taataaaatgacacagttac

SEQ ID NO: 37196 - DNA, 20 bp, Artificial Sequence
  chemically synthesized
tgacacagttacaggtaact

SEQ ID NO: 37197 - DNA, 20 bp, Artificial Sequence
  chemically synthesized
agttacaggtaacttagtta

SEQ ID NO: 37198 - DNA, 20 bp, Artificial Sequence
  chemically synthesized
gttacaggtaacttagttaa

SEQ ID NO: 37199 - DNA, 20 bp, Artificial Sequence
  chemically synthesized
ttacaggtaacttagttaaa

SEQ ID NO: 37200 - DNA, 20 bp, Artificial Sequence
  chemically synthesized
tacaggtaacttagttaaag

SEQ ID NO: 37201 - DNA, 20 bp, Artificial Sequence
  chemically synthesized
acaggtaacttagttaaagg

SEQ ID NO: 37202 - DNA, 20 bp, Artificial Sequence
  chemically synthesized
tagttaaagggggaaataaa

SEQ ID NO: 37203 - DNA, 20 bp, Artificial Sequence
  chemically synthesized
ttaaagggggaaataaatgg

SEQ ID NO: 37204 - DNA, 20 bp, Artificial Sequence
  chemically synthesized
ctctttttgaatatcaattg

SEQ ID NO: 37205 - DNA, 20 bp, Artificial Sequence
  chemically synthesized
atgtttaactgaactcactg

SEQ ID NO: 37206 - DNA, 20 bp, Artificial Sequence
  chemically synthesized
tgtttaactgaactcactgt

SEQ ID NO: 37207 - DNA, 20 bp, Artificial Sequence
  chemically synthesized
ttaactgaactcactgtagg

SEQ ID NO: 37208 - DNA, 20 bp, Artificial Sequence
  chemically synthesized
ttaatttattgtgtgttttg

SEQ ID NO: 37209 - DNA, 20 bp, Artificial Sequence
  chemically synthesized
gtgttttgaagtcacactgt

SEQ ID NO: 37210 - DNA, 20 bp, Artificial Sequence
  chemically synthesized
tgaagtcacactgtgagcta

SEQ ID NO: 37211 - DNA, 20 bp, Artificial Sequence
  chemically synthesized
gtgagctatagaatttaccc

SEQ ID NO: 37212 - DNA, 20 bp, Artificial Sequence
  chemically synthesized
tacccaagcacaactcttcc

SEQ ID NO: 37213 - DNA, 20 bp, Artificial Sequence
  chemically synthesized
aagcacaactcttcctggaa

SEQ ID NO: 37214 - DNA, 20 bp, Artificial Sequence
  chemically synthesized
gcacaactcttcctggaaaa

SEQ ID NO: 37215 - DNA, 20 bp, Artificial Sequence
  chemically synthesized
acaactcttcctggaaaaga

SEQ ID NO: 37216 - DNA, 20 bp, Artificial Sequence
  chemically synthesized
ctggaaaagagagttcaaat

SEQ ID NO: 37217 - DNA, 20 bp, Artificial Sequence
  chemically synthesized
aagagagttcaaatgagaaa

SEQ ID NO: 37218 - DNA, 20 bp, Artificial Sequence
  chemically synthesized
agttcaaatgagaaacagtg

SEQ ID NO: 37219 - DNA, 20 bp, Artificial Sequence
  chemically synthesized
gttcaaatgagaaacagtgc

SEQ ID NO: 37220 - DNA, 20 bp, Artificial Sequence
  chemically synthesized
ttcaaatgagaaacagtgcg

SEQ ID NO: 37221 - DNA, 20 bp, Artificial Sequence
  chemically synthesized
atgagaaacagtgcggggtg

SEQ ID NO: 37222 - DNA, 20 bp, Artificial Sequence
  chemically synthesized
aacagtgcggggtgaagaca

SEQ ID NO: 37223 - DNA, 20 bp, Artificial Sequence
  chemically synthesized
gcggggtgaagacatggata

SEQ ID NO: 37224 - DNA, 20 bp, Artificial Sequence
  chemically synthesized
cggggtgaagacatggatat

SEQ ID NO: 37225 - DNA, 20 bp, Artificial Sequence
  chemically synthesized
gatattttgatatatctatc

SEQ ID NO: 37226 - DNA, 20 bp, Artificial Sequence
  chemically synthesized
tatatctatcaagtgctttt

SEQ ID NO: 37227 - DNA, 20 bp, Artificial Sequence
  chemically synthesized
atctatcaagtgctttttag

SEQ ID NO: 37228 - DNA, 20 bp, Artificial Sequence
  chemically synthesized
tcaagtgctttttagtggat

SEQ ID NO: 37229 - DNA, 20 bp, Artificial Sequence
  chemically synthesized
caagtgctttttagtggatt

SEQ ID NO: 37230 - DNA, 20 bp, Artificial Sequence
  chemically synthesized
gctttttagtggattaggtt

SEQ ID NO: 37231 - DNA, 20 bp, Artificial Sequence
  chemically synthesized
ggattaggttcagaatgcat

SEQ ID NO: 37232 - DNA, 20 bp, Artificial Sequence
  chemically synthesized
ccaatgcctgttcaataatc

SEQ ID NO: 37233 - DNA, 20 bp, Artificial Sequence
  chemically synthesized
tgttcaataatccagttttc

SEQ ID NO: 37234 - DNA, 20 bp, Artificial Sequence
  chemically synthesized
aataatccagttttccagca

SEQ ID NO: 37235 - DNA, 20 bp, Artificial Sequence
  chemically synthesized
taatccagttttccagcata

SEQ ID NO: 37236 - DNA, 20 bp, Artificial Sequence
  chemically synthesized
agcatagagcatattaaatt

SEQ ID NO: 37237 - DNA, 20 bp, Artificial Sequence
  chemically synthesized
gcatagagcatattaaattg

SEQ ID NO: 37238 - DNA, 20 bp, Artificial Sequence
  chemically synthesized
tagagcatattaaattgagg

SEQ ID NO: 37239 - DNA, 20 bp, Artificial Sequence
  chemically synthesized
agagcatattaaattgagga

SEQ ID NO: 37240 - DNA, 20 bp, Artificial Sequence
  chemically synthesized
tattaaattgaggaaggaca

SEQ ID NO: 37241 - DNA, 20 bp, Artificial Sequence
  chemically synthesized
attgaggaaggacaaagtca

SEQ ID NO: 37242 - DNA, 20 bp, Artificial Sequence
  chemically synthesized
tgaggaaggacaaagtcaca

SEQ ID NO: 37243 - DNA, 20 bp, Artificial Sequence
  chemically synthesized
gaggaaggacaaagtcacag

SEQ ID NO: 37244 - DNA, 20 bp, Artificial Sequence
  chemically synthesized
gaaggacaaagtcacagagg

SEQ ID NO: 37245 - DNA, 20 bp, Artificial Sequence
  chemically synthesized
aaggacaaagtcacagaggt

SEQ ID NO: 37246 - DNA, 20 bp, Artificial Sequence
  chemically synthesized
aggacaaagtcacagaggtg

SEQ ID NO: 37247 - DNA, 20 bp, Artificial Sequence
  chemically synthesized
gacaaagtcacagaggtggg

SEQ ID NO: 37248 - DNA, 20 bp, Artificial Sequence
  chemically synthesized
aaagtcacagaggtggggag

SEQ ID NO: 37249 - DNA, 20 bp, Artificial Sequence
  chemically synthesized
aagtcacagaggtggggagc

SEQ ID NO: 37250 - DNA, 20 bp, Artificial Sequence
  chemically synthesized
tcacagaggtggggagcagg

SEQ ID NO: 37251 - DNA, 20 bp, Artificial Sequence
  chemically synthesized
ggtggggagcaggtggactg

SEQ ID NO: 37252 - DNA, 20 bp, Artificial Sequence
  chemically synthesized
ggagcaggtggactgtggcc

SEQ ID NO: 37253 - DNA, 20 bp, Artificial Sequence
  chemically synthesized
gagcaggtggactgtggcca

SEQ ID NO: 37254 - DNA, 20 bp, Artificial Sequence
  chemically synthesized
gccaaggactttgcatgaaa

SEQ ID NO: 37255 - DNA, 20 bp, Artificial Sequence
  chemically synthesized
aggactttgcatgaaacagt

SEQ ID NO: 37256 - DNA, 20 bp, Artificial Sequence
  chemically synthesized
tcctccttgccctgccctca

SEQ ID NO: 37257 - DNA, 20 bp, Artificial Sequence
  chemically synthesized
cctcatggtctgtgtactct

SEQ ID NO: 37258 - DNA, 20 bp, Artificial Sequence
  chemically synthesized
ctcatggtctgtgtactctc

SEQ ID NO: 37259 - DNA, 20 bp, Artificial Sequence
  chemically synthesized
catggtctgtgtactctcag

SEQ ID NO: 37260 - DNA, 20 bp, Artificial Sequence
  chemically synthesized
atggtctgtgtactctcagg

SEQ ID NO: 37261 - DNA, 20 bp, Artificial Sequence
  chemically synthesized
tctgtgtactctcaggaggt

SEQ ID NO: 37262 - DNA, 20 bp, Artificial Sequence
  chemically synthesized
ctgtgtactctcaggaggtc

SEQ ID NO: 37263 - DNA, 20 bp, Artificial Sequence
  chemically synthesized
gtactctcaggaggtcagga

SEQ ID NO: 37264 - DNA, 20 bp, Artificial Sequence
  chemically synthesized
tactctcaggaggtcaggac

SEQ ID NO: 37265 - DNA, 20 bp, Artificial Sequence
  chemically synthesized
aggtcaggacaggcctttct

SEQ ID NO: 37266 - DNA, 20 bp, Artificial Sequence
  chemically synthesized
ggacaggcctttctgagaat

SEQ ID NO: 37267 - DNA, 20 bp, Artificial Sequence
  chemically synthesized
ctgttcatctgcctttctac

SEQ ID NO: 37268 - DNA, 20 bp, Artificial Sequence
  chemically synthesized
ttctactggatacttgtcat

SEQ ID NO: 37269 - DNA, 20 bp, Artificial Sequence
  chemically synthesized
atacaaacacatgttctctg

SEQ ID NO: 37270 - DNA, 20 bp, Artificial Sequence
  chemically synthesized
ctctgcagtgtgtcatcttt

SEQ ID NO: 37271 - DNA, 20 bp, Artificial Sequence
  chemically synthesized
tcccctgaccctgtattccc

SEQ ID NO: 37272 - DNA, 20 bp, Artificial Sequence
  chemically synthesized
cctgaccctgtattccctag

SEQ ID NO: 37273 - DNA, 20 bp, Artificial Sequence
  chemically synthesized
cctagaagtctcgctgcttt

SEQ ID NO: 37274 - DNA, 20 bp, Artificial Sequence
  chemically synthesized
tagaagtctcgctgctttca

SEQ ID NO: 37275 - DNA, 20 bp, Artificial Sequence
  chemically synthesized
agtctcgctgctttcagagc

SEQ ID NO: 37276 - DNA, 20 bp, Artificial Sequence
  chemically synthesized
gtctcgctgctttcagagcc

SEQ ID NO: 37277 - DNA, 20 bp, Artificial Sequence
  chemically synthesized
tgccacccccactgctcttc

SEQ ID NO: 37278 - DNA, 20 bp, Artificial Sequence
  chemically synthesized
taacccactccatctgcatg

SEQ ID NO: 37279 - DNA, 20 bp, Artificial Sequence
  chemically synthesized
ggcccccaccacacccctca

SEQ ID NO: 37280 - DNA, 20 bp, Artificial Sequence
  chemically synthesized
ccccaccacacccctcaaag

SEQ ID NO: 37281 - DNA, 20 bp, Artificial Sequence
  chemically synthesized
ccacacccctcaaagtggtc

SEQ ID NO: 37282 - DNA, 20 bp, Artificial Sequence
  chemically synthesized
cacacccctcaaagtggtca

SEQ ID NO: 37283 - DNA, 20 bp, Artificial Sequence
  chemically synthesized
tgtcctgttgcttaattcca

SEQ ID NO: 37284 - DNA, 20 bp, Artificial Sequence
  chemically synthesized
cctgttgcttaattccatgg

SEQ ID NO: 37285 - DNA, 20 bp, Artificial Sequence
  chemically synthesized
tgcttaattccatggaagct

SEQ ID NO: 37286 - DNA, 20 bp, Artificial Sequence
  chemically synthesized
cttggctatcttcattttat

SEQ ID NO: 37287 - DNA, 20 bp, Artificial Sequence
  chemically synthesized
ttcattttattagcctcttt

SEQ ID NO: 37288 - DNA, 20 bp, Artificial Sequence
  chemically synthesized
aaaatcactacattttgtgc

SEQ ID NO: 37289 - DNA, 20 bp, Artificial Sequence
  chemically synthesized
aatcactacattttgtgcca

SEQ ID NO: 37290 - DNA, 20 bp, Artificial Sequence
  chemically synthesized
actacattttgtgccagaga

SEQ ID NO: 37291 - DNA, 20 bp, Artificial Sequence
  chemically synthesized
tacattttgtgccagagatg

SEQ ID NO: 37292 - DNA, 20 bp, Artificial Sequence
  chemically synthesized
ttttgtgccagagatggagc

SEQ ID NO: 37293 - DNA, 20 bp, Artificial Sequence
  chemically synthesized
agagatggagctggcatctc

SEQ ID NO: 37294 - DNA, 20 bp, Artificial Sequence
  chemically synthesized
gagatggagctggcatctcc

SEQ ID NO: 37295 - DNA, 20 bp, Artificial Sequence
  chemically synthesized
ggagctggcatctccaggct

SEQ ID NO: 37296 - DNA, 20 bp, Artificial Sequence
  chemically synthesized
gctggcatctccaggcttgg

SEQ ID NO: 37297 - DNA, 20 bp, Artificial Sequence
  chemically synthesized
tggcatctccaggcttggaa

SEQ ID NO: 37298 - DNA, 20 bp, Artificial Sequence
  chemically synthesized
ggcatctccaggcttggaag

SEQ ID NO: 37299 - DNA, 20 bp, Artificial Sequence
  chemically synthesized
gcatctccaggcttggaaga

SEQ ID NO: 37300 - DNA, 20 bp, Artificial Sequence
  chemically synthesized
ggcttggaagagggctgctg

SEQ ID NO: 37301 - DNA, 20 bp, Artificial Sequence
  chemically synthesized
ggaagagggctgctgaagct

SEQ ID NO: 37302 - DNA, 20 bp, Artificial Sequence
  chemically synthesized
gagggctgctgaagctcagc

SEQ ID NO: 37303 - DNA, 20 bp, Artificial Sequence
  chemically synthesized
agggctgctgaagctcagcc

SEQ ID NO: 37304 - DNA, 20 bp, Artificial Sequence
  chemically synthesized
gaagctcagccaggtgtcct

SEQ ID NO: 37305 - DNA, 20 bp, Artificial Sequence
  chemically synthesized
aagctcagccaggtgtccta

SEQ ID NO: 37306 - DNA, 20 bp, Artificial Sequence
  chemically synthesized
gctcagccaggtgtcctaag

SEQ ID NO: 37307 - DNA, 20 bp, Artificial Sequence
  chemically synthesized
ccaggtgtcctaaggagcct

SEQ ID NO: 37308 - DNA, 20 bp, Artificial Sequence
  chemically synthesized
caggtgtcctaaggagcctc

SEQ ID NO: 37309 - DNA, 20 bp, Artificial Sequence
  chemically synthesized
tgtcctaaggagcctcagga

SEQ ID NO: 37310 - DNA, 20 bp, Artificial Sequence
  chemically synthesized
gtcctaaggagcctcaggac

SEQ ID NO: 37311 - DNA, 20 bp, Artificial Sequence
  chemically synthesized
tcctaaggagcctcaggaca

SEQ ID NO: 37312 - DNA, 20 bp, Artificial Sequence
  chemically synthesized
cctaaggagcctcaggacag

SEQ ID NO: 37313 - DNA, 20 bp, Artificial Sequence
  chemically synthesized
gcctcaggacaggggatgct

SEQ ID NO: 37314 - DNA, 20 bp, Artificial Sequence
  chemically synthesized
tcaggacaggggatgctcag

SEQ ID NO: 37315 - DNA, 20 bp, Artificial Sequence
  chemically synthesized
gatgctcagtagccttgcaa

SEQ ID NO: 37316 - DNA, 20 bp, Artificial Sequence
  chemically synthesized
atgctcagtagccttgcaat

SEQ ID NO: 37317 - DNA, 20 bp, Artificial Sequence
  chemically synthesized
gtagccttgcaatgggaaca

SEQ ID NO: 37318 - DNA, 20 bp, Artificial Sequence
  chemically synthesized
cttgcaatgggaacacagct

SEQ ID NO: 37319 - DNA, 20 bp, Artificial Sequence
  chemically synthesized
gaacacagctgagccccact

SEQ ID NO: 37320 - DNA, 20 bp, Artificial Sequence
  chemically synthesized
tggccaccctttgccacaac

SEQ ID NO: 37321 - DNA, 20 bp, Artificial Sequence
  chemically synthesized
ggccaccctttgccacaacc

SEQ ID NO: 37322 - DNA, 20 bp, Artificial Sequence
  chemically synthesized
caccctttgccacaaccagg

SEQ ID NO: 37323 - DNA, 20 bp, Artificial Sequence
  chemically synthesized
ctttgccacaaccaggcaga

SEQ ID NO: 37324 - DNA, 20 bp, Artificial Sequence
  chemically synthesized
tgccacaaccaggcagaaag

SEQ ID NO: 37325 - DNA, 20 bp, Artificial Sequence
  chemically synthesized
ggcagaaagcagcttttgaa

SEQ ID NO: 37326 - DNA, 20 bp, Artificial Sequence
  chemically synthesized
tttgaacagatttgttgcct

SEQ ID NO: 37327 - DNA, 20 bp, Artificial Sequence
  chemically synthesized
ttgcctcagatttgatctca

SEQ ID NO: 37328 - DNA, 20 bp, Artificial Sequence
  chemically synthesized
ttgatctcaaagaaaaatcg

SEQ ID NO: 37329 - DNA, 20 bp, Artificial Sequence
  chemically synthesized
tgatctcaaagaaaaatcgt

SEQ ID NO: 37330 - DNA, 20 bp, Artificial Sequence
  chemically synthesized
tctcaaagaaaaatcgtggg

SEQ ID NO: 37331 - DNA, 20 bp, Artificial Sequence
  chemically synthesized
agaaaaatcgtgggcagtat

SEQ ID NO: 37332 - DNA, 20 bp, Artificial Sequence
  chemically synthesized
atcgtgggcagtattggtcc

SEQ ID NO: 37333 - DNA, 20 bp, Artificial Sequence
  chemically synthesized
tcgtgggcagtattggtccc

SEQ ID NO: 37334 - DNA, 20 bp, Artificial Sequence
  chemically synthesized
ttacaatttcctctgaaatc

SEQ ID NO: 37335 - DNA, 20 bp, Artificial Sequence
  chemically synthesized
ctggatgcctatcaacacct

SEQ ID NO: 37336 - DNA, 20 bp, Artificial Sequence
  chemically synthesized
actgaattctccccaactaa

SEQ ID NO: 37337 - DNA, 20 bp, Artificial Sequence
  chemically synthesized
gaattctccccaactaatag

SEQ ID NO: 37338 - DNA, 20 bp, Artificial Sequence
  chemically synthesized
ctaatagtggtgtgtcactg

SEQ ID NO: 37339 - DNA, 20 bp, Artificial Sequence
  chemically synthesized
tagtggtgtgtcactgtagt

SEQ ID NO: 37340 - DNA, 20 bp, Artificial Sequence
  chemically synthesized
gtgtgtcactgtagtaagcc

SEQ ID NO: 37341 - DNA, 20 bp, Artificial Sequence
  chemically synthesized
tagtaagcctagtacaaaaa

SEQ ID NO: 37342 - DNA, 20 bp, Artificial Sequence
  chemically synthesized
tacaaaaatggccttctttg

SEQ ID NO: 37343 - DNA, 20 bp, Artificial Sequence
  chemically synthesized
caaaaatggccttctttgtg

SEQ ID NO: 37344 - DNA, 20 bp, Artificial Sequence
  chemically synthesized
aaaaatggccttctttgtgg

SEQ ID NO: 37345 - DNA, 20 bp, Artificial Sequence
  chemically synthesized
aaatggccttctttgtggag

SEQ ID NO: 37346 - DNA, 20 bp, Artificial Sequence
  chemically synthesized
tttttgcttaatttttgccc

SEQ ID NO: 37347 - DNA, 20 bp, Artificial Sequence
  chemically synthesized
gcttaatttttgcccaagat

SEQ ID NO: 37348 - DNA, 20 bp, Artificial Sequence
  chemically synthesized
cccaagatgagaacataatt

SEQ ID NO: 37349 - DNA, 20 bp, Artificial Sequence
  chemically synthesized
caccaacatttttgtaacta

SEQ ID NO: 37350 - DNA, 20 bp, Artificial Sequence
  chemically synthesized
accaacatttttgtaactaa

SEQ ID NO: 37351 - DNA, 20 bp, Artificial Sequence
  chemically synthesized
caacatttttgtaactaaag

SEQ ID NO: 37352 - DNA, 20 bp, Artificial Sequence
  chemically synthesized
aacatttttgtaactaaagg

SEQ ID NO: 37353 - DNA, 20 bp, Artificial Sequence
  chemically synthesized
acatttttgtaactaaagga

SEQ ID NO: 37354 - DNA, 20 bp, Artificial Sequence
  chemically synthesized
taactaaaggagggaccatt

SEQ ID NO: 37355 - DNA, 20 bp, Artificial Sequence
  chemically synthesized
ctaaaggagggaccattcag

SEQ ID NO: 37356 - DNA, 20 bp, Artificial Sequence
  chemically synthesized
aagatgcttatcaactgtca

SEQ ID NO: 37357 - DNA, 20 bp, Artificial Sequence
  chemically synthesized
cttatcaactgtcaaagtga

SEQ ID NO: 37358 - DNA, 20 bp, Artificial Sequence
  chemically synthesized
acaaccaatgcacatattgt

SEQ ID NO: 37359 - DNA, 20 bp, Artificial Sequence
  chemically synthesized
tattgtaagaaatcaaacaa

SEQ ID NO: 37360 - DNA, 20 bp, Artificial Sequence
  chemically synthesized
gaaatcaaacaatggcctcc

SEQ ID NO: 37361 - DNA, 20 bp, Artificial Sequence
  chemically synthesized
aaatcaaacaatggcctcca

SEQ ID NO: 37362 - DNA, 20 bp, Artificial Sequence
  chemically synthesized
ctccaaggttcatttctaca

SEQ ID NO: 37363 - DNA, 20 bp, Artificial Sequence
  chemically synthesized
tccaaggttcatttctacac

SEQ ID NO: 37364 - DNA, 20 bp, Artificial Sequence
  chemically synthesized
ccaaggttcatttctacaca

SEQ ID NO: 37365 - DNA, 20 bp, Artificial Sequence
  chemically synthesized
gttcatttctacacagggat

SEQ ID NO: 37366 - DNA, 20 bp, Artificial Sequence
  chemically synthesized
catttctacacagggattag

SEQ ID NO: 37367 - DNA, 20 bp, Artificial Sequence
  chemically synthesized
tagcagatcaacatcaatct

SEQ ID NO: 37368 - DNA, 20 bp, Artificial Sequence
  chemically synthesized
caacatcaatcttggcaaca

SEQ ID NO: 37369 - DNA, 20 bp, Artificial Sequence
  chemically synthesized
ggcaacacagttgccactga

SEQ ID NO: 37370 - DNA, 20 bp, Artificial Sequence
  chemically synthesized
ttattttttttatcatgaca

SEQ ID NO: 37371 - DNA, 20 bp, Artificial Sequence
  chemically synthesized
tttatcatgacatggcaatc

SEQ ID NO: 37372 - DNA, 20 bp, Artificial Sequence
  chemically synthesized
tatcatgacatggcaatcaa

SEQ ID NO: 37373 - DNA, 20 bp, Artificial Sequence
  chemically synthesized
aacatgatttattcttattt

SEQ ID NO: 37374 - DNA, 20 bp, Artificial Sequence
  chemically synthesized
tattcttatttaagatttta

SEQ ID NO: 37375 - DNA, 20 bp, Artificial Sequence
  chemically synthesized
cttatttaagattttatggt

SEQ ID NO: 37376 - DNA, 20 bp, Artificial Sequence
  chemically synthesized
ttaagattttatggttagac

SEQ ID NO: 37377 - DNA, 20 bp, Artificial Sequence
  chemically synthesized
taagattttatggttagact

SEQ ID NO: 37378 - DNA, 20 bp, Artificial Sequence
  chemically synthesized
gattttatggttagactagg

SEQ ID NO: 37379 - DNA, 20 bp, Artificial Sequence
  chemically synthesized
ttatggttagactaggcaga

SEQ ID NO: 37380 - DNA, 20 bp, Artificial Sequence
  chemically synthesized
ggttagactaggcagatagc

SEQ ID NO: 37381 - DNA, 20 bp, Artificial Sequence
  chemically synthesized
ctaggcagatagctagatat

SEQ ID NO: 37382 - DNA, 20 bp, Artificial Sequence
  chemically synthesized
ggcagatagctagatatgag

SEQ ID NO: 37383 - DNA, 20 bp, Artificial Sequence
  chemically synthesized
gcagatagctagatatgagc

SEQ ID NO: 37384 - DNA, 20 bp, Artificial Sequence
  chemically synthesized
agatagctagatatgagcag

SEQ ID NO: 37385 - DNA, 20 bp, Artificial Sequence
  chemically synthesized
gatagctagatatgagcagg

SEQ ID NO: 37386 - DNA, 20 bp, Artificial Sequence
  chemically synthesized
agctagatatgagcaggagg

SEQ ID NO: 37387 - DNA, 20 bp, Artificial Sequence
  chemically synthesized
tagatatgagcaggaggtgg

SEQ ID NO: 37388 - DNA, 20 bp, Artificial Sequence
  chemically synthesized
agcaggaggtggaagcccct

SEQ ID NO: 37389 - DNA, 20 bp, Artificial Sequence
  chemically synthesized
caggaggtggaagcccctga

SEQ ID NO: 37390 - DNA, 20 bp, Artificial Sequence
  chemically synthesized
ggtggaagcccctgagagaa

SEQ ID NO: 37391 - DNA, 20 bp, Artificial Sequence
  chemically synthesized
tggaagcccctgagagaatg

SEQ ID NO: 37392 - DNA, 20 bp, Artificial Sequence
  chemically synthesized
ggaagcccctgagagaatgg

SEQ ID NO: 37393 - DNA, 20 bp, Artificial Sequence
  chemically synthesized
cccctgagagaatggaggtc

SEQ ID NO: 37394 - DNA, 20 bp, Artificial Sequence
  chemically synthesized
cctgagagaatggaggtctg

SEQ ID NO: 37395 - DNA, 20 bp, Artificial Sequence
  chemically synthesized
gtctggagaatctgaaaccc

SEQ ID NO: 37396 - DNA, 20 bp, Artificial Sequence
  chemically synthesized
ctggagaatctgaaacccca

SEQ ID NO: 37397 - DNA, 20 bp, Artificial Sequence
  chemically synthesized
tgaaaccccagagattaccc

SEQ ID NO: 37398 - DNA, 20 bp, Artificial Sequence
  chemically synthesized
attacccaagtcctgcatgc

SEQ ID NO: 37399 - DNA, 20 bp, Artificial Sequence
  chemically synthesized
aagtcctgcatgctagacat

SEQ ID NO: 37400 - DNA, 20 bp, Artificial Sequence
  chemically synthesized
tcctgcatgctagacatgag

SEQ ID NO: 37401 - DNA, 20 bp, Artificial Sequence
  chemically synthesized
ctgcatgctagacatgagtg

SEQ ID NO: 37402 - DNA, 20 bp, Artificial Sequence
  chemically synthesized
tgcatgctagacatgagtgg

SEQ ID NO: 37403 - DNA, 20 bp, Artificial Sequence
  chemically synthesized
catgctagacatgagtggag

SEQ ID NO: 37404 - DNA, 20 bp, Artificial Sequence
  chemically synthesized
atgctagacatgagtggagg

SEQ ID NO: 37405 - DNA, 20 bp, Artificial Sequence
  chemically synthesized
tgctagacatgagtggagga

SEQ ID NO: 37406 - DNA, 20 bp, Artificial Sequence
  chemically synthesized
gctagacatgagtggaggag

SEQ ID NO: 37407 - DNA, 20 bp, Artificial Sequence
  chemically synthesized
ctagacatgagtggaggagg

SEQ ID NO: 37408 - DNA, 20 bp, Artificial Sequence
  chemically synthesized
agtggaggagggggaatacc

SEQ ID NO: 37409 - DNA, 20 bp, Artificial Sequence
  chemically synthesized
gtggaggagggggaatacct

SEQ ID NO: 37410 - DNA, 20 bp, Artificial Sequence
  chemically synthesized
gaggagggggaatacctagg

SEQ ID NO: 37411 - DNA, 20 bp, Artificial Sequence
  chemically synthesized
gggggaatacctaggtagaa

SEQ ID NO: 37412 - DNA, 20 bp, Artificial Sequence
  chemically synthesized
ggtagaaaagaatgcccctt

SEQ ID NO: 37413 - DNA, 20 bp, Artificial Sequence
  chemically synthesized
agaatgccccttaagatgcc

SEQ ID NO: 37414 - DNA, 20 bp, Artificial Sequence
  chemically synthesized
atgccccttaagatgcccag

SEQ ID NO: 37415 - DNA, 20 bp, Artificial Sequence
  chemically synthesized
cccagcagtcgctcactgtg

SEQ ID NO: 37416 - DNA, 20 bp, Artificial Sequence
  chemically synthesized
tcactgtgcagttaactttt

SEQ ID NO: 37417 - DNA, 20 bp, Artificial Sequence
  chemically synthesized
ttaacttttcagaatgctgc

SEQ ID NO: 37418 - DNA, 20 bp, Artificial Sequence
  chemically synthesized
tgctgctagatacatgctga

SEQ ID NO: 37419 - DNA, 20 bp, Artificial Sequence
  chemically synthesized
gctgctagatacatgctgat

SEQ ID NO: 37420 - DNA, 20 bp, Artificial Sequence
  chemically synthesized
ctgctagatacatgctgata

SEQ ID NO: 37421 - DNA, 20 bp, Artificial Sequence
  chemically synthesized
gctagatacatgctgatagg

SEQ ID NO: 37422 - DNA, 20 bp, Artificial Sequence
  chemically synthesized
ctagatacatgctgataggg

SEQ ID NO: 37423 - DNA, 20 bp, Artificial Sequence
  chemically synthesized
tagatacatgctgataggga

SEQ ID NO: 37424 - DNA, 20 bp, Artificial Sequence
  chemically synthesized
atacatgctgatagggaggg

SEQ ID NO: 37425 - DNA, 20 bp, Artificial Sequence
  chemically synthesized
acatgctgatagggagggaa

SEQ ID NO: 37426 - DNA, 20 bp, Artificial Sequence
  chemically synthesized
catgctgatagggagggaag

SEQ ID NO: 37427 - DNA, 20 bp, Artificial Sequence
  chemically synthesized
atgctgatagggagggaaga

SEQ ID NO: 37428 - DNA, 20 bp, Artificial Sequence
  chemically synthesized
gatagggagggaagagggca

SEQ ID NO: 37429 - DNA, 20 bp, Artificial Sequence
  chemically synthesized
atagggagggaagagggcaa

SEQ ID NO: 37430 - DNA, 20 bp, Artificial Sequence
  chemically synthesized
agggagggaagagggcaaag

SEQ ID NO: 37431 - DNA, 20 bp, Artificial Sequence
  chemically synthesized
agggcaaaggagaaattcct

SEQ ID NO: 37432 - DNA, 20 bp, Artificial Sequence
  chemically synthesized
ggcaaaggagaaattcctaa

SEQ ID NO: 37433 - DNA, 20 bp, Artificial Sequence
  chemically synthesized
agaaattcctaagagataca

SEQ ID NO: 37434 - DNA, 20 bp, Artificial Sequence
  chemically synthesized
tcctaagagatacacggttg

SEQ ID NO: 37435 - DNA, 20 bp, Artificial Sequence
  chemically synthesized
aagagatacacggttgcagt

SEQ ID NO: 37436 - DNA, 20 bp, Artificial Sequence
  chemically synthesized
gttgcagttagtatacatct

SEQ ID NO: 37437 - DNA, 20 bp, Artificial Sequence
  chemically synthesized
gagtgctatacaaccttctt

SEQ ID NO: 37438 - DNA, 20 bp, Artificial Sequence
  chemically synthesized
agtgctatacaaccttcttt

SEQ ID NO: 37439 - DNA, 20 bp, Artificial Sequence
  chemically synthesized
gctatacaaccttctttggg

SEQ ID NO: 37440 - DNA, 20 bp, Artificial Sequence
  chemically synthesized
atacaaccttctttgggtgg

SEQ ID NO: 37441 - DNA, 20 bp, Artificial Sequence
  chemically synthesized
aaccttctttgggtggtggc

SEQ ID NO: 37442 - DNA, 20 bp, Artificial Sequence
  chemically synthesized
cttctttgggtggtggcaag

SEQ ID NO: 37443 - DNA, 20 bp, Artificial Sequence
  chemically synthesized
ggtggtggcaagaagcaatg

SEQ ID NO: 37444 - DNA, 20 bp, Artificial Sequence
  chemically synthesized
gaagcaatgcagccattacg

SEQ ID NO: 37445 - DNA, 20 bp, Artificial Sequence
  chemically synthesized
catatcaaacacctgtatca

SEQ ID NO: 37446 - DNA, 20 bp, Artificial Sequence
  chemically synthesized
atatcaaacacctgtatcac

SEQ ID NO: 37447 - DNA, 20 bp, Artificial Sequence
  chemically synthesized
cacctgtatcacaggtgtta

SEQ ID NO: 37448 - DNA, 20 bp, Artificial Sequence
  chemically synthesized
atcacaggtgttaaagaaac

SEQ ID NO: 37449 - DNA, 20 bp, Artificial Sequence
  chemically synthesized
atgatttgcaatattgtctt

SEQ ID NO: 37450 - DNA, 20 bp, Artificial Sequence
  chemically synthesized
ctataaatatgatttttaaa

SEQ ID NO: 37451 - DNA, 20 bp, Artificial Sequence
  chemically synthesized
atttttaaaaagtatttctt

SEQ ID NO: 37452 - DNA, 20 bp, Artificial Sequence
  chemically synthesized
tttttaaaaagtatttcttt

SEQ ID NO: 37453 - DNA, 20 bp, Artificial Sequence
  chemically synthesized
taaaaagtatttctttaggt

SEQ ID NO: 37454 - DNA, 20 bp, Artificial Sequence
  chemically synthesized
tacgcattgacttatcttcc

SEQ ID NO: 37455 - DNA, 20 bp, Artificial Sequence
  chemically synthesized
acgcattgacttatcttcct

SEQ ID NO: 37456 - DNA, 20 bp, Artificial Sequence
  chemically synthesized
cttatcttcctgggtttcat

SEQ ID NO: 37457 - DNA, 20 bp, Artificial Sequence
  chemically synthesized
actgtttatctcaaactctt

SEQ ID NO: 37458 - DNA, 20 bp, Artificial Sequence
  chemically synthesized
atctcaaactcttgagatta

SEQ ID NO: 37459 - DNA, 20 bp, Artificial Sequence
  chemically synthesized
aaactcttgagattaaagta

SEQ ID NO: 37460 - DNA, 20 bp, Artificial Sequence
  chemically synthesized
aactcttgagattaaagtat

SEQ ID NO: 37461 - DNA, 20 bp, Artificial Sequence
  chemically synthesized
ttgagattaaagtatgggct

SEQ ID NO: 37462 - DNA, 20 bp, Artificial Sequence
  chemically synthesized
tgagattaaagtatgggctc

SEQ ID NO: 37463 - DNA, 20 bp, Artificial Sequence
  chemically synthesized
agattaaagtatgggctcag

SEQ ID NO: 37464 - DNA, 20 bp, Artificial Sequence
  chemically synthesized
gattaaagtatgggctcagg

SEQ ID NO: 37465 - DNA, 20 bp, Artificial Sequence
  chemically synthesized
attaaagtatgggctcagga

SEQ ID NO: 37466 - DNA, 20 bp, Artificial Sequence
  chemically synthesized
taaagtatgggctcaggagg

SEQ ID NO: 37467 - DNA, 20 bp, Artificial Sequence
  chemically synthesized
gtatgggctcaggagggagc

SEQ ID NO: 37468 - DNA, 20 bp, Artificial Sequence
  chemically synthesized
tatgggctcaggagggagcg

SEQ ID NO: 37469 - DNA, 20 bp, Artificial Sequence
  chemically synthesized
tgggctcaggagggagcgag

SEQ ID NO: 37470 - DNA, 20 bp, Artificial Sequence
  chemically synthesized
caggagggagcgaggagctt

SEQ ID NO: 37471 - DNA, 20 bp, Artificial Sequence
  chemically synthesized
aggagggagcgaggagcttc

SEQ ID NO: 37472 - DNA, 20 bp, Artificial Sequence
  chemically synthesized
gaggagcttcaggactctca

SEQ ID NO: 37473 - DNA, 20 bp, Artificial Sequence
  chemically synthesized
tcaggactctcacggacctc

SEQ ID NO: 37474 - DNA, 20 bp, Artificial Sequence
  chemically synthesized
actctcacggacctccagca

SEQ ID NO: 37475 - DNA, 20 bp, Artificial Sequence
  chemically synthesized
cacggacctccagcacagtg

SEQ ID NO: 37476 - DNA, 20 bp, Artificial Sequence
  chemically synthesized
agcacagtgtagctgcctta

SEQ ID NO: 37477 - DNA, 20 bp, Artificial Sequence
  chemically synthesized
agtgtagctgccttatggaa

SEQ ID NO: 37478 - DNA, 20 bp, Artificial Sequence
  chemically synthesized
gtagctgccttatggaaaag

SEQ ID NO: 37479 - DNA, 20 bp, Artificial Sequence
  chemically synthesized
ggccacactgttttctgcac

SEQ ID NO: 37480 - DNA, 20 bp, Artificial Sequence
  chemically synthesized
ctgcccctactattcctcac

SEQ ID NO: 37481 - DNA, 20 bp, Artificial Sequence
  chemically synthesized
tgcccctactattcctcact

SEQ ID NO: 37482 - DNA, 20 bp, Artificial Sequence
  chemically synthesized
ccctactattcctcactggg

SEQ ID NO: 37483 - DNA, 20 bp, Artificial Sequence
  chemically synthesized
ctactattcctcactgggca

SEQ ID NO: 37484 - DNA, 20 bp, Artificial Sequence
  chemically synthesized
attcctcactgggcagagca

SEQ ID NO: 37485 - DNA, 20 bp, Artificial Sequence
  chemically synthesized
tgggcagagcacagccaccc

SEQ ID NO: 37486 - DNA, 20 bp, Artificial Sequence
  chemically synthesized
ctggccctgcctgaacattt

SEQ ID NO: 37487 - DNA, 20 bp, Artificial Sequence
  chemically synthesized
ccctgcctgaacattttagt

SEQ ID NO: 37488 - DNA, 20 bp, Artificial Sequence
  chemically synthesized
ctgaacattttagtcagtgt

SEQ ID NO: 37489 - DNA, 20 bp, Artificial Sequence
  chemically synthesized
gtgttggctctgtgcttctc

SEQ ID NO: 37490 - DNA, 20 bp, Artificial Sequence
  chemically synthesized
tgttggctctgtgcttctct

SEQ ID NO: 37491 - DNA, 20 bp, Artificial Sequence
  chemically synthesized
gttggctctgtgcttctctg

SEQ ID NO: 37492 - DNA, 20 bp, Artificial Sequence
  chemically synthesized
tggctctgtgcttctctggg

SEQ ID NO: 37493 - DNA, 20 bp, Artificial Sequence
  chemically synthesized
ggctctgtgcttctctgggg

SEQ ID NO: 37494 - DNA, 20 bp, Artificial Sequence
  chemically synthesized
cttctctggggaggaaatcc

SEQ ID NO: 37495 - DNA, 20 bp, Artificial Sequence
  chemically synthesized
tctctggggaggaaatccaa

SEQ ID NO: 37496 - DNA, 20 bp, Artificial Sequence
  chemically synthesized
gaaatccaagagacaaccca

SEQ ID NO: 37497 - DNA, 20 bp, Artificial Sequence
  chemically synthesized
ccacagcccctctgccattt

SEQ ID NO: 37498 - DNA, 20 bp, Artificial Sequence
  chemically synthesized
cccctctgccatttcagctg

SEQ ID NO: 37499 - DNA, 20 bp, Artificial Sequence
  chemically synthesized
ctctgccatttcagctgcag

SEQ ID NO: 37500 - DNA, 20 bp, Artificial Sequence
  chemically synthesized
agtaccaccgttaatgccct

SEQ ID NO: 37501 - DNA, 20 bp, Artificial Sequence
  chemically synthesized
gtaccaccgttaatgccctt

SEQ ID NO: 37502 - DNA, 20 bp, Artificial Sequence
  chemically synthesized
ccgttaatgcccttgggctt

SEQ ID NO: 37503 - DNA, 20 bp, Artificial Sequence
  chemically synthesized
taatgcccttgggcttgaga

SEQ ID NO: 37504 - DNA, 20 bp, Artificial Sequence
  chemically synthesized
tgcccttgggcttgagaaag

SEQ ID NO: 37505 - DNA, 20 bp, Artificial Sequence
  chemically synthesized
gcccttgggcttgagaaaga

SEQ ID NO: 37506 - DNA, 20 bp, Artificial Sequence
  chemically synthesized
cccttgggcttgagaaagaa

SEQ ID NO: 37507 - DNA, 20 bp, Artificial Sequence
  chemically synthesized
ggcttgagaaagaagggacc

SEQ ID NO: 37508 - DNA, 20 bp, Artificial Sequence
  chemically synthesized
ggccacttccctgacacctc

SEQ ID NO: 37509 - DNA, 20 bp, Artificial Sequence
  chemically synthesized
tccctgacacctccagcaca

SEQ ID NO: 37510 - DNA, 20 bp, Artificial Sequence
  chemically synthesized
ctgacacctccagcacacag

SEQ ID NO: 37511 - DNA, 20 bp, Artificial Sequence
  chemically synthesized
tgacacctccagcacacagc

SEQ ID NO: 37512 - DNA, 20 bp, Artificial Sequence
  chemically synthesized
gacacctccagcacacagca

SEQ ID NO: 37513 - DNA, 20 bp, Artificial Sequence
  chemically synthesized
cctccagcacacagcaggga

SEQ ID NO: 37514 - DNA, 20 bp, Artificial Sequence
  chemically synthesized
acacagcagggaaagaattc

SEQ ID NO: 37515 - DNA, 20 bp, Artificial Sequence
  chemically synthesized
ttccagtttctctttcttgt

SEQ ID NO: 37516 - DNA, 20 bp, Artificial Sequence
  chemically synthesized
tttcacctgctactcttcac

SEQ ID NO: 37517 - DNA, 20 bp, Artificial Sequence
  chemically synthesized
ttcacctgctactcttcacc

SEQ ID NO: 37518 - DNA, 20 bp, Artificial Sequence
  chemically synthesized
cctgctactcttcaccaggc

SEQ ID NO: 37519 - DNA, 20 bp, Artificial Sequence
  chemically synthesized
ctgctactcttcaccaggca

SEQ ID NO: 37520 - DNA, 20 bp, Artificial Sequence
  chemically synthesized
tcttcaccaggcaaggctcc

SEQ ID NO: 37521 - DNA, 20 bp, Artificial Sequence
  chemically synthesized
accaggcaaggctcctggct

SEQ ID NO: 37522 - DNA, 20 bp, Artificial Sequence
  chemically synthesized
ccaggcaaggctcctggctt

SEQ ID NO: 37523 - DNA, 20 bp, Artificial Sequence
  chemically synthesized
aggctcctggcttgggccca

SEQ ID NO: 37524 - DNA, 20 bp, Artificial Sequence
  chemically synthesized
cctggcttgggcccacagtg

SEQ ID NO: 37525 - DNA, 20 bp, Artificial Sequence
  chemically synthesized
ctggcttgggcccacagtgc

SEQ ID NO: 37526 - DNA, 20 bp, Artificial Sequence
  chemically synthesized
cagtgcaggcacctcgaact

SEQ ID NO: 37527 - DNA, 20 bp, Artificial Sequence
  chemically synthesized
actcagttgaacatttccac

SEQ ID NO: 37528 - DNA, 20 bp, Artificial Sequence
  chemically synthesized
ggctgcactctgtgtttttg

SEQ ID NO: 37529 - DNA, 20 bp, Artificial Sequence
  chemically synthesized
gctgcactctgtgtttttgt

SEQ ID NO: 37530 - DNA, 20 bp, Artificial Sequence
  chemically synthesized
ctgcactctgtgtttttgtg

SEQ ID NO: 37531 - DNA, 20 bp, Artificial Sequence
  chemically synthesized
ctctgtgtttttgtggggtg

SEQ ID NO: 37532 - DNA, 20 bp, Artificial Sequence
  chemically synthesized
tttttgtggggtgaagctcc

SEQ ID NO: 37533 - DNA, 20 bp, Artificial Sequence
  chemically synthesized
tttgtggggtgaagctccca

SEQ ID NO: 37534 - DNA, 20 bp, Artificial Sequence
  chemically synthesized
ttgtggggtgaagctcccag

SEQ ID NO: 37535 - DNA, 20 bp, Artificial Sequence
  chemically synthesized
aagctcccagaggtgactga

SEQ ID NO: 37536 - DNA, 20 bp, Artificial Sequence
  chemically synthesized
tccttctgccactaacactg

SEQ ID NO: 37537 - DNA, 20 bp, Artificial Sequence
  chemically synthesized
catactgcccttgctgtact

SEQ ID NO: 37538 - DNA, 20 bp, Artificial Sequence
  chemically synthesized
tgcccttgctgtacttggac

SEQ ID NO: 37539 - DNA, 20 bp, Artificial Sequence
  chemically synthesized
gcccttgctgtacttggact

SEQ ID NO: 37540 - DNA, 20 bp, Artificial Sequence
  chemically synthesized
cccttgctgtacttggacta

SEQ ID NO: 37541 - DNA, 20 bp, Artificial Sequence
  chemically synthesized
ttgctgtacttggactaggg

SEQ ID NO: 37542 - DNA, 20 bp, Artificial Sequence
  chemically synthesized
tgctgtacttggactaggga

SEQ ID NO: 37543 - DNA, 20 bp, Artificial Sequence
  chemically synthesized
cttggactagggaaggaaaa

SEQ ID NO: 37544 - DNA, 20 bp, Artificial Sequence
  chemically synthesized
agggaaggaaaaaagatcct

SEQ ID NO: 37545 - DNA, 20 bp, Artificial Sequence
  chemically synthesized
tgagtgctttactcacaccc

SEQ ID NO: 37546 - DNA, 20 bp, Artificial Sequence
  chemically synthesized
actcacaccccagtgtgccc

SEQ ID NO: 37547 - DNA, 20 bp, Artificial Sequence
  chemically synthesized
agtgtgccccagccacccta

SEQ ID NO: 37548 - DNA, 20 bp, Artificial Sequence
  chemically synthesized
gccccagccaccctatggaa

SEQ ID NO: 37549 - DNA, 20 bp, Artificial Sequence
  chemically synthesized
cccagccaccctatggaaaa

SEQ ID NO: 37550 - DNA, 20 bp, Artificial Sequence
  chemically synthesized
ccagccaccctatggaaaag

SEQ ID NO: 37551 - DNA, 20 bp, Artificial Sequence
  chemically synthesized
ccaccctatggaaaagaggc

SEQ ID NO: 37552 - DNA, 20 bp, Artificial Sequence
  chemically synthesized
ggccagtgtgtcatccctgc

SEQ ID NO: 37553 - DNA, 20 bp, Artificial Sequence
  chemically synthesized
gtcatccctgcaagcaccct

SEQ ID NO: 37554 - DNA, 20 bp, Artificial Sequence
  chemically synthesized
tcatccctgcaagcaccctg

SEQ ID NO: 37555 - DNA, 20 bp, Artificial Sequence
  chemically synthesized
cccctgcccctgctgccccc

SEQ ID NO: 37556 - DNA, 20 bp, Artificial Sequence
  chemically synthesized
cccctgctgcccccaagctg

SEQ ID NO: 37557 - DNA, 20 bp, Artificial Sequence
  chemically synthesized
cctgctgcccccaagctgta

SEQ ID NO: 37558 - DNA, 20 bp, Artificial Sequence
  chemically synthesized
ctgcccccaagctgtagagc

SEQ ID NO: 37559 - DNA, 20 bp, Artificial Sequence
  chemically synthesized
agctgtagagccagaatata

SEQ ID NO: 37560 - DNA, 20 bp, Artificial Sequence
  chemically synthesized
gtagagccagaatataaagc

SEQ ID NO: 37561 - DNA, 20 bp, Artificial Sequence
  chemically synthesized
gagccagaatataaagctgg

SEQ ID NO: 37562 - DNA, 20 bp, Artificial Sequence
  chemically synthesized
agctggcagaaaaatgtaaa

SEQ ID NO: 37563 - DNA, 20 bp, Artificial Sequence
  chemically synthesized
gctggcagaaaaatgtaaaa

SEQ ID NO: 37564 - DNA, 20 bp, Artificial Sequence
  chemically synthesized
gcagaaaaatgtaaaaaggc

SEQ ID NO: 37565 - DNA, 20 bp, Artificial Sequence
  chemically synthesized
aaaatgtaaaaaggctagac

SEQ ID NO: 37566 - DNA, 20 bp, Artificial Sequence
  chemically synthesized
gtaaaaaggctagactggct

SEQ ID NO: 37567 - DNA, 20 bp, Artificial Sequence
  chemically synthesized
gctagactggcttagcctcc

SEQ ID NO: 37568 - DNA, 20 bp, Artificial Sequence
  chemically synthesized
cctacatctttctcctgtgc

SEQ ID NO: 37569 - DNA, 20 bp, Artificial Sequence
  chemically synthesized
tccttcctgctcttgaacat

SEQ ID NO: 37570 - DNA, 20 bp, Artificial Sequence
  chemically synthesized
gctcttgaacatcggactcc

SEQ ID NO: 37571 - DNA, 20 bp, Artificial Sequence
  chemically synthesized
acatcggactccaagttctt

SEQ ID NO: 37572 - DNA, 20 bp, Artificial Sequence
  chemically synthesized
gactccaagttcttcagctg

SEQ ID NO: 37573 - DNA, 20 bp, Artificial Sequence
  chemically synthesized
actccaagttcttcagctgt

SEQ ID NO: 37574 - DNA, 20 bp, Artificial Sequence
  chemically synthesized
agttcttcagctgtgggact

SEQ ID NO: 37575 - DNA, 20 bp, Artificial Sequence
  chemically synthesized
ggactgtcttccttgctcct

SEQ ID NO: 37576 - DNA, 20 bp, Artificial Sequence
  chemically synthesized
cttccttgctcctcagattg

SEQ ID NO: 37577 - DNA, 20 bp, Artificial Sequence
  chemically synthesized
ttccttgctcctcagattgc

SEQ ID NO: 37578 - DNA, 20 bp, Artificial Sequence
  chemically synthesized
cttgctcctcagattgcagg

SEQ ID NO: 37579 - DNA, 20 bp, Artificial Sequence
  chemically synthesized
agattgcaggtggcctatta

SEQ ID NO: 37580 - DNA, 20 bp, Artificial Sequence
  chemically synthesized
gattgcaggtggcctattat

SEQ ID NO: 37581 - DNA, 20 bp, Artificial Sequence
  chemically synthesized
atgggaccttgtaatcttgt

SEQ ID NO: 37582 - DNA, 20 bp, Artificial Sequence
  chemically synthesized
gtgagttaataccacttaat

SEQ ID NO: 37583 - DNA, 20 bp, Artificial Sequence
  chemically synthesized
taataagctcccctttgtgt

SEQ ID NO: 37584 - DNA, 20 bp, Artificial Sequence
  chemically synthesized
tgtgagtatatctatatcta

SEQ ID NO: 37585 - DNA, 20 bp, Artificial Sequence
  chemically synthesized
agtatatctatatctataga

SEQ ID NO: 37586 - DNA, 20 bp, Artificial Sequence
  chemically synthesized
tctatatctatagatagata

SEQ ID NO: 37587 - DNA, 20 bp, Artificial Sequence
  chemically synthesized
ctatatctatagatagatat

SEQ ID NO: 37588 - DNA, 20 bp, Artificial Sequence
  chemically synthesized
atatatatataatctcctat

SEQ ID NO: 37589 - DNA, 20 bp, Artificial Sequence
  chemically synthesized
tcctattagttctgtccctc

SEQ ID NO: 37590 - DNA, 20 bp, Artificial Sequence
  chemically synthesized
ctattagttctgtccctcta

SEQ ID NO: 37591 - DNA, 20 bp, Artificial Sequence
  chemically synthesized
ctagagaaccccgactaata

SEQ ID NO: 37592 - DNA, 20 bp, Artificial Sequence
  chemically synthesized
actaatacagattttcatac

SEQ ID NO: 37593 - DNA, 20 bp, Artificial Sequence
  chemically synthesized
aatacagattttcataccag

SEQ ID NO: 37594 - DNA, 20 bp, Artificial Sequence
  chemically synthesized
acagattttcataccagaag

SEQ ID NO: 37595 - DNA, 20 bp, Artificial Sequence
  chemically synthesized
tcataccagaagtggttctt

SEQ ID NO: 37596 - DNA, 20 bp, Artificial Sequence
  chemically synthesized
cataccagaagtggttcttg

SEQ ID NO: 37597 - DNA, 20 bp, Artificial Sequence
  chemically synthesized
cagaagtggttcttgaggaa

SEQ ID NO: 37598 - DNA, 20 bp, Artificial Sequence
  chemically synthesized
ttcttgaggaacagaatatt

SEQ ID NO: 37599 - DNA, 20 bp, Artificial Sequence
  chemically synthesized
tcttgaggaacagaatatta

SEQ ID NO: 37600 - DNA, 20 bp, Artificial Sequence
  chemically synthesized
gaggaacagaatattaagga

SEQ ID NO: 37601 - DNA, 20 bp, Artificial Sequence
  chemically synthesized
taaggatggaattctttcat

SEQ ID NO: 37602 - DNA, 20 bp, Artificial Sequence
  chemically synthesized
tggaattctttcattggttt

SEQ ID NO: 37603 - DNA, 20 bp, Artificial Sequence
  chemically synthesized
ggaattctttcattggtttt

SEQ ID NO: 37604 - DNA, 20 bp, Artificial Sequence
  chemically synthesized
ttcattggttttgggacttc

SEQ ID NO: 37605 - DNA, 20 bp, Artificial Sequence
  chemically synthesized
ggttttgggacttctggtgt

SEQ ID NO: 37606 - DNA, 20 bp, Artificial Sequence
  chemically synthesized
tgttggctgattaatatgat

SEQ ID NO: 37607 - DNA, 20 bp, Artificial Sequence
  chemically synthesized
tgattagaccaaaaaatgct

SEQ ID NO: 37608 - DNA, 20 bp, Artificial Sequence
  chemically synthesized
gattagaccaaaaaatgcta

SEQ ID NO: 37609 - DNA, 20 bp, Artificial Sequence
  chemically synthesized
gctaaggactctacttctaa

SEQ ID NO: 37610 - DNA, 20 bp, Artificial Sequence
  chemically synthesized
ggactctacttctaatagta

SEQ ID NO: 37611 - DNA, 20 bp, Artificial Sequence
  chemically synthesized
actctacttctaatagtatg

SEQ ID NO: 37612 - DNA, 20 bp, Artificial Sequence
  chemically synthesized
aatagtatggagaacactga

SEQ ID NO: 37613 - DNA, 20 bp, Artificial Sequence
  chemically synthesized
tggagaacactgatagtact

SEQ ID NO: 37614 - DNA, 20 bp, Artificial Sequence
  chemically synthesized
agtacttggcctgaattgtt

SEQ ID NO: 37615 - DNA, 20 bp, Artificial Sequence
  chemically synthesized
tacttggcctgaattgttta

SEQ ID NO: 37616 - DNA, 20 bp, Artificial Sequence
  chemically synthesized
cttggcctgaattgtttaga

SEQ ID NO: 37617 - DNA, 20 bp, Artificial Sequence
  chemically synthesized
actactgattcatcacttat

SEQ ID NO: 37618 - DNA, 20 bp, Artificial Sequence
  chemically synthesized
tactgattcatcacttatga

SEQ ID NO: 37619 - DNA, 20 bp, Artificial Sequence
  chemically synthesized
actgattcatcacttatgag

SEQ ID NO: 37620 - DNA, 20 bp, Artificial Sequence
  chemically synthesized
attcatcacttatgagaggc

SEQ ID NO: 37621 - DNA, 20 bp, Artificial Sequence
  chemically synthesized
ttcatcacttatgagaggca

SEQ ID NO: 37622 - DNA, 20 bp, Artificial Sequence
  chemically synthesized
catcacttatgagaggcaag

SEQ ID NO: 37623 - DNA, 20 bp, Artificial Sequence
  chemically synthesized
cttatgagaggcaaggagtt

SEQ ID NO: 37624 - DNA, 20 bp, Artificial Sequence
  chemically synthesized
ataatacctttgactatatg

SEQ ID NO: 37625 - DNA, 20 bp, Artificial Sequence
  chemically synthesized
aatacctttgactatatgtg

SEQ ID NO: 37626 - DNA, 20 bp, Artificial Sequence
  chemically synthesized
ttgactatatgtggagaacc

SEQ ID NO: 37627 - DNA, 20 bp, Artificial Sequence
  chemically synthesized
tgactatatgtggagaacca

SEQ ID NO: 37628 - DNA, 20 bp, Artificial Sequence
  chemically synthesized
gagaaccaaggaacataatg

SEQ ID NO: 37629 - DNA, 20 bp, Artificial Sequence
  chemically synthesized
accaaggaacataatgaagt

SEQ ID NO: 37630 - DNA, 20 bp, Artificial Sequence
  chemically synthesized
gaagttggttgattgctcct

SEQ ID NO: 37631 - DNA, 20 bp, Artificial Sequence
  chemically synthesized
ttgattgctcctaagttctc

SEQ ID NO: 37632 - DNA, 20 bp, Artificial Sequence
  chemically synthesized
gattgctcctaagttctctg

SEQ ID NO: 37633 - DNA, 20 bp, Artificial Sequence
  chemically synthesized
gctcctaagttctctggaga

SEQ ID NO: 37634 - DNA, 20 bp, Artificial Sequence
  chemically synthesized
tcctaagttctctggagaaa

SEQ ID NO: 37635 - DNA, 20 bp, Artificial Sequence
  chemically synthesized
ttctctggagaaagagatga

SEQ ID NO: 37636 - DNA, 20 bp, Artificial Sequence
  chemically synthesized
atgaaagaaaatgatgatct

SEQ ID NO: 37637 - DNA, 20 bp, Artificial Sequence
  chemically synthesized
tgaaagaaaatgatgatctc

SEQ ID NO: 37638 - DNA, 20 bp, Artificial Sequence
  chemically synthesized
gaaagaaaatgatgatctca

SEQ ID NO: 37639 - DNA, 20 bp, Artificial Sequence
  chemically synthesized
aaagaaaatgatgatctcag

SEQ ID NO: 37640 - DNA, 20 bp, Artificial Sequence
  chemically synthesized
ggggatctgtctcccacctt

SEQ ID NO: 37641 - DNA, 20 bp, Artificial Sequence
  chemically synthesized
gatctgtctcccaccttcag

SEQ ID NO: 37642 - DNA, 20 bp, Artificial Sequence
  chemically synthesized
ctgtctcccaccttcagaag

SEQ ID NO: 37643 - DNA, 20 bp, Artificial Sequence
  chemically synthesized
caccttcagaagcagatact

SEQ ID NO: 37644 - DNA, 20 bp, Artificial Sequence
  chemically synthesized
tactgagccacaaatctgct

SEQ ID NO: 37645 - DNA, 20 bp, Artificial Sequence
  chemically synthesized
ctgctaagattgccctgaat

SEQ ID NO: 37646 - DNA, 20 bp, Artificial Sequence
  chemically synthesized
gctaagattgccctgaatga

SEQ ID NO: 37647 - DNA, 20 bp, Artificial Sequence
  chemically synthesized
aatgagagttttaactcctg

SEQ ID NO: 37648 - DNA, 20 bp, Artificial Sequence
  chemically synthesized
tgagagttttaactcctgta

SEQ ID NO: 37649 - DNA, 20 bp, Artificial Sequence
  chemically synthesized
agttttaactcctgtagaga

SEQ ID NO: 37650 - DNA, 20 bp, Artificial Sequence
  chemically synthesized
ttttaactcctgtagagaaa

SEQ ID NO: 37651 - DNA, 20 bp, Artificial Sequence
  chemically synthesized
gagttgaaattgtgaaaaaa

SEQ ID NO: 37652 - DNA, 20 bp, Artificial Sequence
  chemically synthesized
gttgaaattgtgaaaaaaca

SEQ ID NO: 37653 - DNA, 20 bp, Artificial Sequence
  chemically synthesized
aattgtgaaaaaacagagac

SEQ ID NO: 37654 - DNA, 20 bp, Artificial Sequence
  chemically synthesized
gagacaagctgttatcatgc

SEQ ID NO: 37655 - DNA, 20 bp, Artificial Sequence
  chemically synthesized
acaagctgttatcatgcgag

SEQ ID NO: 37656 - DNA, 20 bp, Artificial Sequence
  chemically synthesized
gcgagtagctgatctgcaac

SEQ ID NO: 37657 - DNA, 20 bp, Artificial Sequence
  chemically synthesized
gagtagctgatctgcaacaa

SEQ ID NO: 37658 - DNA, 20 bp, Artificial Sequence
  chemically synthesized
agtagctgatctgcaacaag

SEQ ID NO: 37659 - DNA, 20 bp, Artificial Sequence
  chemically synthesized
tgcaacaagaggtgcatgca

SEQ ID NO: 37660 - DNA, 20 bp, Artificial Sequence
  chemically synthesized
aggtgcatgcacagccttgc

SEQ ID NO: 37661 - DNA, 20 bp, Artificial Sequence
  chemically synthesized
ggtgcatgcacagccttgcc

SEQ ID NO: 37662 - DNA, 20 bp, Artificial Sequence
  chemically synthesized
ttgccaggtgtttactgtta

SEQ ID NO: 37663 - DNA, 20 bp, Artificial Sequence
  chemically synthesized
caggtgtttactgttaaagt

SEQ ID NO: 37664 - DNA, 20 bp, Artificial Sequence
  chemically synthesized
aggtgtttactgttaaagtg

SEQ ID NO: 37665 - DNA, 20 bp, Artificial Sequence
  chemically synthesized
ggtgtttactgttaaagtga

SEQ ID NO: 37666 - DNA, 20 bp, Artificial Sequence
  chemically synthesized
gttaaagtgagggcattgac

SEQ ID NO: 37667 - DNA, 20 bp, Artificial Sequence
  chemically synthesized
gggcattgactggaaaaaaa

SEQ ID NO: 37668 - DNA, 20 bp, Artificial Sequence
  chemically synthesized
ggcattgactggaaaaaaat

SEQ ID NO: 37669 - DNA, 20 bp, Artificial Sequence
  chemically synthesized
actggaaaaaaatgggaccc

SEQ ID NO: 37670 - DNA, 20 bp, Artificial Sequence
  chemically synthesized
aaaaatgggaccctggaact

SEQ ID NO: 37671 - DNA, 20 bp, Artificial Sequence
  chemically synthesized
aaatgggaccctggaacttg

SEQ ID NO: 37672 - DNA, 20 bp, Artificial Sequence
  chemically synthesized
tgggaccctggaacttggag

SEQ ID NO: 37673 - DNA, 20 bp, Artificial Sequence
  chemically synthesized
gggaccctggaacttggagt

SEQ ID NO: 37674 - DNA, 20 bp, Artificial Sequence
  chemically synthesized
ggaccctggaacttggagtg

SEQ ID NO: 37675 - DNA, 20 bp, Artificial Sequence
  chemically synthesized
gaacttggagtggggatgtg

SEQ ID NO: 37676 - DNA, 20 bp, Artificial Sequence
  chemically synthesized
aacttggagtggggatgtgt

SEQ ID NO: 37677 - DNA, 20 bp, Artificial Sequence
  chemically synthesized
cttggagtggggatgtgtgg

SEQ ID NO: 37678 - DNA, 20 bp, Artificial Sequence
  chemically synthesized
tgtgtgggagaaccctgatg

SEQ ID NO: 37679 - DNA, 20 bp, Artificial Sequence
  chemically synthesized
gggagaaccctgatgaagct

SEQ ID NO: 37680 - DNA, 20 bp, Artificial Sequence
  chemically synthesized
ggagaaccctgatgaagctg

SEQ ID NO: 37681 - DNA, 20 bp, Artificial Sequence
  chemically synthesized
ctgatgaagctgaggacact

SEQ ID NO: 37682 - DNA, 20 bp, Artificial Sequence
  chemically synthesized
ctctgatgaaacttttttgc

SEQ ID NO: 37683 - DNA, 20 bp, Artificial Sequence
  chemically synthesized
tgatgaaacttttttgccag

SEQ ID NO: 37684 - DNA, 20 bp, Artificial Sequence
  chemically synthesized
aacttttttgccagaagaaa

SEQ ID NO: 37685 - DNA, 20 bp, Artificial Sequence
  chemically synthesized
agaaacagtttccccatccc

SEQ ID NO: 37686 - DNA, 20 bp, Artificial Sequence
  chemically synthesized
aacagtttccccatccccag

SEQ ID NO: 37687 - DNA, 20 bp, Artificial Sequence
  chemically synthesized
agtttccccatccccagtag

SEQ ID NO: 37688 - DNA, 20 bp, Artificial Sequence
  chemically synthesized
tccctgacccgtgctgccat

SEQ ID NO: 37689 - DNA, 20 bp, Artificial Sequence
  chemically synthesized
tagcctttccacctttgtct

SEQ ID NO: 37690 - DNA, 20 bp, Artificial Sequence
  chemically synthesized
agcctttccacctttgtctg

SEQ ID NO: 37691 - DNA, 20 bp, Artificial Sequence
  chemically synthesized
atgtaaaccctgcactgctt

SEQ ID NO: 37692 - DNA, 20 bp, Artificial Sequence
  chemically synthesized
tgtaaaccctgcactgcttg

SEQ ID NO: 37693 - DNA, 20 bp, Artificial Sequence
  chemically synthesized
ccctgcactgcttgaggcaa

SEQ ID NO: 37694 - DNA, 20 bp, Artificial Sequence
  chemically synthesized
actgcttgaggcaacagtga

SEQ ID NO: 37695 - DNA, 20 bp, Artificial Sequence
  chemically synthesized
caacagtgatggccttccct

SEQ ID NO: 37696 - DNA, 20 bp, Artificial Sequence
  chemically synthesized
aacagtgatggccttccctg

SEQ ID NO: 37697 - DNA, 20 bp, Artificial Sequence
  chemically synthesized
agtgatggccttccctgagg

SEQ ID NO: 37698 - DNA, 20 bp, Artificial Sequence
  chemically synthesized
gccttccctgaggcagctgc

SEQ ID NO: 37699 - DNA, 20 bp, Artificial Sequence
  chemically synthesized
ccttccctgaggcagctgcc

SEQ ID NO: 37700 - DNA, 20 bp, Artificial Sequence
  chemically synthesized
ccctgaggcagctgccaggc

SEQ ID NO: 37701 - DNA, 20 bp, Artificial Sequence
  chemically synthesized
agataatgttgattctcctc

SEQ ID NO: 37702 - DNA, 20 bp, Artificial Sequence
  chemically synthesized
ataatgttgattctcctcaa

SEQ ID NO: 37703 - DNA, 20 bp, Artificial Sequence
  chemically synthesized
taatgttgattctcctcaag

SEQ ID NO: 37704 - DNA, 20 bp, Artificial Sequence
  chemically synthesized
ctaatgcccctgaatgcttc

SEQ ID NO: 37705 - DNA, 20 bp, Artificial Sequence
  chemically synthesized
aatgcttctagacctataac

SEQ ID NO: 37706 - DNA, 20 bp, Artificial Sequence
  chemically synthesized
atgcttctagacctataact

SEQ ID NO: 37707 - DNA, 20 bp, Artificial Sequence
  chemically synthesized
taactaggctaaattccttg

SEQ ID NO: 37708 - DNA, 20 bp, Artificial Sequence
  chemically synthesized
aactaggctaaattccttgc

SEQ ID NO: 37709 - DNA, 20 bp, Artificial Sequence
  chemically synthesized
gctaaattccttgcgggccc

SEQ ID NO: 37710 - DNA, 20 bp, Artificial Sequence
  chemically synthesized
taaattccttgcgggcccca

SEQ ID NO: 37711 - DNA, 20 bp, Artificial Sequence
  chemically synthesized
aaattccttgcgggccccag

SEQ ID NO: 37712 - DNA, 20 bp, Artificial Sequence
  chemically synthesized
tccttgcgggccccagaggt

SEQ ID NO: 37713 - DNA, 20 bp, Artificial Sequence
  chemically synthesized
ccttgcgggccccagaggtg

SEQ ID NO: 37714 - DNA, 20 bp, Artificial Sequence
  chemically synthesized
cgggccccagaggtgaggtt

SEQ ID NO: 37715 - DNA, 20 bp, Artificial Sequence
  chemically synthesized
ggccccagaggtgaggttca

SEQ ID NO: 37716 - DNA, 20 bp, Artificial Sequence
  chemically synthesized
aggttcagagtgtgacccat

SEQ ID NO: 37717 - DNA, 20 bp, Artificial Sequence
  chemically synthesized
ggttcagagtgtgacccatg

SEQ ID NO: 37718 - DNA, 20 bp, Artificial Sequence
  chemically synthesized
ttcagagtgtgacccatgag

SEQ ID NO: 37719 - DNA, 20 bp, Artificial Sequence
  chemically synthesized
tcagagtgtgacccatgagg

SEQ ID NO: 37720 - DNA, 20 bp, Artificial Sequence
  chemically synthesized
ggaggtgcattatactctaa

SEQ ID NO: 37721 - DNA, 20 bp, Artificial Sequence
  chemically synthesized
atactctaaaagaactgctt

SEQ ID NO: 37722 - DNA, 20 bp, Artificial Sequence
  chemically synthesized
ttaagctttctaatttatat

SEQ ID NO: 37723 - DNA, 20 bp, Artificial Sequence
  chemically synthesized
agctttctaatttatattgg

SEQ ID NO: 37724 - DNA, 20 bp, Artificial Sequence
  chemically synthesized
aatttatattggcagaaatc

SEQ ID NO: 37725 - DNA, 20 bp, Artificial Sequence
  chemically synthesized
tttatattggcagaaatctg

SEQ ID NO: 37726 - DNA, 20 bp, Artificial Sequence
  chemically synthesized
attggcagaaatctggagaa

SEQ ID NO: 37727 - DNA, 20 bp, Artificial Sequence
  chemically synthesized
ttggcagaaatctggagaac

SEQ ID NO: 37728 - DNA, 20 bp, Artificial Sequence
  chemically synthesized
agaaatctggagaacaggca

SEQ ID NO: 37729 - DNA, 20 bp, Artificial Sequence
  chemically synthesized
gaaatctggagaacaggcat

SEQ ID NO: 37730 - DNA, 20 bp, Artificial Sequence
  chemically synthesized
ctggagaacaggcatgggaa

SEQ ID NO: 37731 - DNA, 20 bp, Artificial Sequence
  chemically synthesized
caggcatgggaatggatatt

SEQ ID NO: 37732 - DNA, 20 bp, Artificial Sequence
  chemically synthesized
aggcatgggaatggatatta

SEQ ID NO: 37733 - DNA, 20 bp, Artificial Sequence
  chemically synthesized
ggcatgggaatggatattaa

SEQ ID NO: 37734 - DNA, 20 bp, Artificial Sequence
  chemically synthesized
tgggaatggatattaagggt

SEQ ID NO: 37735 - DNA, 20 bp, Artificial Sequence
  chemically synthesized
gggaatggatattaagggta

SEQ ID NO: 37736 - DNA, 20 bp, Artificial Sequence
  chemically synthesized
ggaatggatattaagggtaa

SEQ ID NO: 37737 - DNA, 20 bp, Artificial Sequence
  chemically synthesized
atattaagggtaagggataa

SEQ ID NO: 37738 - DNA, 20 bp, Artificial Sequence
  chemically synthesized
ttaagggtaagggataatgg

SEQ ID NO: 37739 - DNA, 20 bp, Artificial Sequence
  chemically synthesized
agggtaagggataatggtgg

SEQ ID NO: 37740 - DNA, 20 bp, Artificial Sequence
  chemically synthesized
gggtaagggataatggtgga

SEQ ID NO: 37741 - DNA, 20 bp, Artificial Sequence
  chemically synthesized
ggtaagggataatggtggaa

SEQ ID NO: 37742 - DNA, 20 bp, Artificial Sequence
  chemically synthesized
ggataatggtggaagggaca

SEQ ID NO: 37743 - DNA, 20 bp, Artificial Sequence
  chemically synthesized
ataatggtggaagggacata

SEQ ID NO: 37744 - DNA, 20 bp, Artificial Sequence
  chemically synthesized
tggtggaagggacatagagt

SEQ ID NO: 37745 - DNA, 20 bp, Artificial Sequence
  chemically synthesized
aagggacatagagttggatc

SEQ ID NO: 37746 - DNA, 20 bp, Artificial Sequence
  chemically synthesized
ttggatcaagctgaatttat

SEQ ID NO: 37747 - DNA, 20 bp, Artificial Sequence
  chemically synthesized
tcaagctgaatttattggtt

SEQ ID NO: 37748 - DNA, 20 bp, Artificial Sequence
  chemically synthesized
tttattggtttggccctact

SEQ ID NO: 37749 - DNA, 20 bp, Artificial Sequence
  chemically synthesized
attggtttggccctactaag

SEQ ID NO: 37750 - DNA, 20 bp, Artificial Sequence
  chemically synthesized
ttggtttggccctactaagt

SEQ ID NO: 37751 - DNA, 20 bp, Artificial Sequence
  chemically synthesized
tggtttggccctactaagta

SEQ ID NO: 37752 - DNA, 20 bp, Artificial Sequence
  chemically synthesized
ggattctgcatttaatgttg

SEQ ID NO: 37753 - DNA, 20 bp, Artificial Sequence
  chemically synthesized
ctgcatttaatgttgcagct

SEQ ID NO: 37754 - DNA, 20 bp, Artificial Sequence
  chemically synthesized
tgcatttaatgttgcagctc

SEQ ID NO: 37755 - DNA, 20 bp, Artificial Sequence
  chemically synthesized
gcatttaatgttgcagctcg

SEQ ID NO: 37756 - DNA, 20 bp, Artificial Sequence
  chemically synthesized
aatgttgcagctcggggact

SEQ ID NO: 37757 - DNA, 20 bp, Artificial Sequence
  chemically synthesized
tgcagctcggggacttagaa

SEQ ID NO: 37758 - DNA, 20 bp, Artificial Sequence
  chemically synthesized
gcagctcggggacttagaaa

SEQ ID NO: 37759 - DNA, 20 bp, Artificial Sequence
  chemically synthesized
ggacttagaaaaggttctga

SEQ ID NO: 37760 - DNA, 20 bp, Artificial Sequence
  chemically synthesized
gacttagaaaaggttctgat

SEQ ID NO: 37761 - DNA, 20 bp, Artificial Sequence
  chemically synthesized
acttagaaaaggttctgata

SEQ ID NO: 37762 - DNA, 20 bp, Artificial Sequence
  chemically synthesized
agaaaaggttctgatagggc

SEQ ID NO: 37763 - DNA, 20 bp, Artificial Sequence
  chemically synthesized
gaaaaggttctgatagggcc

SEQ ID NO: 37764 - DNA, 20 bp, Artificial Sequence
  chemically synthesized
aaaggttctgatagggccgg

SEQ ID NO: 37765 - DNA, 20 bp, Artificial Sequence
  chemically synthesized
ggttctgatagggccgggag

SEQ ID NO: 37766 - DNA, 20 bp, Artificial Sequence
  chemically synthesized
tctgatagggccgggagcag

SEQ ID NO: 37767 - DNA, 20 bp, Artificial Sequence
  chemically synthesized
gtggctcacgcctgtaatcc

SEQ ID NO: 37768 - DNA, 20 bp, Artificial Sequence
  chemically synthesized
cgcctgtaatcccagcacct

SEQ ID NO: 37769 - DNA, 20 bp, Artificial Sequence
  chemically synthesized
gcctgtaatcccagcacctt

SEQ ID NO: 37770 - DNA, 20 bp, Artificial Sequence
  chemically synthesized
ctgtaatcccagcaccttgg

SEQ ID NO: 37771 - DNA, 20 bp, Artificial Sequence
  chemically synthesized
tgtaatcccagcaccttggg

SEQ ID NO: 37772 - DNA, 20 bp, Artificial Sequence
  chemically synthesized
aatcccagcaccttgggagg

SEQ ID NO: 37773 - DNA, 20 bp, Artificial Sequence
  chemically synthesized
atcccagcaccttgggaggc

SEQ ID NO: 37774 - DNA, 20 bp, Artificial Sequence
  chemically synthesized
tcccagcaccttgggaggcg

SEQ ID NO: 37775 - DNA, 20 bp, Artificial Sequence
  chemically synthesized
cccagcaccttgggaggcgg

SEQ ID NO: 37776 - DNA, 20 bp, Artificial Sequence
  chemically synthesized
agcaccttgggaggcggggg

SEQ ID NO: 37777 - DNA, 20 bp, Artificial Sequence
  chemically synthesized
gcaccttgggaggcgggggc

SEQ ID NO: 37778 - DNA, 20 bp, Artificial Sequence
  chemically synthesized
ccttgggaggcgggggcggg

SEQ ID NO: 37779 - DNA, 20 bp, Artificial Sequence
  chemically synthesized
ggcgggggcgggcagatcac

SEQ ID NO: 37780 - DNA, 20 bp, Artificial Sequence
  chemically synthesized
gggcgggcagatcacgagat

SEQ ID NO: 37781 - DNA, 20 bp, Artificial Sequence
  chemically synthesized
ggcgggcagatcacgagatc

SEQ ID NO: 37782 - DNA, 20 bp, Artificial Sequence
  chemically synthesized
cgggcagatcacgagatcag

SEQ ID NO: 37783 - DNA, 20 bp, Artificial Sequence
  chemically synthesized
gatcacgagatcaggagatt

SEQ ID NO: 37784 - DNA, 20 bp, Artificial Sequence
  chemically synthesized
tcaggagattgagacaattc

SEQ ID NO: 37785 - DNA, 20 bp, Artificial Sequence
  chemically synthesized
tgagacaattctggctaaaa

SEQ ID NO: 37786 - DNA, 20 bp, Artificial Sequence
  chemically synthesized
tctgctaaaaatacaaaaat

SEQ ID NO: 37787 - DNA, 20 bp, Artificial Sequence
  chemically synthesized
ctaaaaatacaaaaattagc

SEQ ID NO: 37788 - DNA, 20 bp, Artificial Sequence
  chemically synthesized
taaaaatacaaaaattagct

SEQ ID NO: 37789 - DNA, 20 bp, Artificial Sequence
  chemically synthesized
atacaaaaattagctgggca

SEQ ID NO: 37790 - DNA, 20 bp, Artificial Sequence
  chemically synthesized
taactgtaatctcatctact

SEQ ID NO: 37791 - DNA, 20 bp, Artificial Sequence
  chemically synthesized
aactgtaatctcatctactt

SEQ ID NO: 37792 - DNA, 20 bp, Artificial Sequence
  chemically synthesized
ctgtaatctcatctacttgg

SEQ ID NO: 37793 - DNA, 20 bp, Artificial Sequence
  chemically synthesized
tgtaatctcatctacttggg

SEQ ID NO: 37794 - DNA, 20 bp, Artificial Sequence
  chemically synthesized
tctcatctacttgggaggct

SEQ ID NO: 37795 - DNA, 20 bp, Artificial Sequence
  chemically synthesized
ctcatctacttgggaggctg

SEQ ID NO: 37796 - DNA, 20 bp, Artificial Sequence
  chemically synthesized
tctacttgggaggctgaggc

SEQ ID NO: 37797 - DNA, 20 bp, Artificial Sequence
  chemically synthesized
tacttgggaggctgaggcaa

SEQ ID NO: 37798 - DNA, 20 bp, Artificial Sequence
  chemically synthesized
agagaactgcttgaacctgt

SEQ ID NO: 37799 - DNA, 20 bp, Artificial Sequence
  chemically synthesized
gagaactgcttgaacctgtg

SEQ ID NO: 37800 - DNA, 20 bp, Artificial Sequence
  chemically synthesized
aactgcttgaacctgtgagg

SEQ ID NO: 37801 - DNA, 20 bp, Artificial Sequence
  chemically synthesized
ctgcttgaacctgtgaggca

SEQ ID NO: 37802 - DNA, 20 bp, Artificial Sequence
  chemically synthesized
aacctgtgaggcagagattg

SEQ ID NO: 37803 - DNA, 20 bp, Artificial Sequence
  chemically synthesized
tgtgaggcagagattgcagt

SEQ ID NO: 37804 - DNA, 20 bp, Artificial Sequence
  chemically synthesized
ggcagagattgcagtgagcc

SEQ ID NO: 37805 - DNA, 20 bp, Artificial Sequence
  chemically synthesized
aagatcgccccactgcattc

SEQ ID NO: 37806 - DNA, 20 bp, Artificial Sequence
  chemically synthesized
cgccccactgcattccagcc

SEQ ID NO: 37807 - DNA, 20 bp, Artificial Sequence
  chemically synthesized
actgcattccagcctggtaa

SEQ ID NO: 37808 - DNA, 20 bp, Artificial Sequence
  chemically synthesized
tgcattccagcctggtaaca

SEQ ID NO: 37809 - DNA, 20 bp, Artificial Sequence
  chemically synthesized
ttccagcctggtaacagagc

SEQ ID NO: 37810 - DNA, 20 bp, Artificial Sequence
  chemically synthesized
ttccaaaaaaaaaaaaaaaa

SEQ ID NO: 37811 - DNA, 20 bp, Artificial Sequence
  chemically synthesized
aaaaaaaaaaaaagttataa

SEQ ID NO: 37812 - DNA, 20 bp, Artificial Sequence
  chemically synthesized
gttataatagtttatttgct

SEQ ID NO: 37813 - DNA, 20 bp, Artificial Sequence
  chemically synthesized
taatagtttatttgcttggt

SEQ ID NO: 37814 - DNA, 20 bp, Artificial Sequence
  chemically synthesized
ttgcttggttagctgaaata

SEQ ID NO: 37815 - DNA, 20 bp, Artificial Sequence
  chemically synthesized
ttagctgaaatatggattaa

SEQ ID NO: 37816 - DNA, 20 bp, Artificial Sequence
  chemically synthesized
ctgaaatatggattaaaaga

SEQ ID NO: 37817 - DNA, 20 bp, Artificial Sequence
  chemically synthesized
attaaaagatggtccaatgt

SEQ ID NO: 37818 - DNA, 20 bp, Artificial Sequence
  chemically synthesized
aaagatggtccaatgttagt

SEQ ID NO: 37819 - DNA, 20 bp, Artificial Sequence
  chemically synthesized
atggtccaatgttagtgagc

SEQ ID NO: 37820 - DNA, 20 bp, Artificial Sequence
  chemically synthesized
ttagtgagctggaaatgcct

SEQ ID NO: 37821 - DNA, 20 bp, Artificial Sequence
  chemically synthesized
ggaaatgccttggtttaatg

SEQ ID NO: 37822 - DNA, 20 bp, Artificial Sequence
  chemically synthesized
aaatgccttggtttaatgta

SEQ ID NO: 37823 - DNA, 20 bp, Artificial Sequence
  chemically synthesized
aatgccttggtttaatgtag

SEQ ID NO: 37824 - DNA, 20 bp, Artificial Sequence
  chemically synthesized
gccttggtttaatgtagagg

SEQ ID NO: 37825 - DNA, 20 bp, Artificial Sequence
  chemically synthesized
aatgtagaggaagtgatcca

SEQ ID NO: 37826 - DNA, 20 bp, Artificial Sequence
  chemically synthesized
atgtagaggaagtgatccaa

SEQ ID NO: 37827 - DNA, 20 bp, Artificial Sequence
  chemically synthesized
gaggaagtgatccaaaggct

SEQ ID NO: 37828 - DNA, 20 bp, Artificial Sequence
  chemically synthesized
aggaagtgatccaaaggctt

SEQ ID NO: 37829 - DNA, 20 bp, Artificial Sequence
  chemically synthesized
ggaagtgatccaaaggctta

SEQ ID NO: 37830 - DNA, 20 bp, Artificial Sequence
  chemically synthesized
aagtgatccaaaggcttagg

SEQ ID NO: 37831 - DNA, 20 bp, Artificial Sequence
  chemically synthesized
atccaaaggcttagggagat

SEQ ID NO: 37832 - DNA, 20 bp, Artificial Sequence
  chemically synthesized
tccaaaggcttagggagatt

SEQ ID NO: 37833 - DNA, 20 bp, Artificial Sequence
  chemically synthesized
aaggcttagggagattagga

SEQ ID NO: 37834 - DNA, 20 bp, Artificial Sequence
  chemically synthesized
gcttagggagattaggatgg

SEQ ID NO: 37835 - DNA, 20 bp, Artificial Sequence
  chemically synthesized
ttagggagattaggatggtg

SEQ ID NO: 37836 - DNA, 20 bp, Artificial Sequence
  chemically synthesized
gggagattaggatggtggag

SEQ ID NO: 37837 - DNA, 20 bp, Artificial Sequence
  chemically synthesized
attaggatggtggagtggat

SEQ ID NO: 37838 - DNA, 20 bp, Artificial Sequence
  chemically synthesized
gtggagtggattagtcactt

SEQ ID NO: 37839 - DNA, 20 bp, Artificial Sequence
  chemically synthesized
cactttagacctactcatcc

SEQ ID NO: 37840 - DNA, 20 bp, Artificial Sequence
  chemically synthesized
ttagacctactcatcccagc

SEQ ID NO: 37841 - DNA, 20 bp, Artificial Sequence
  chemically synthesized
tagacctactcatcccagct

SEQ ID NO: 37842 - DNA, 20 bp, Artificial Sequence
  chemically synthesized
gacctactcatcccagctgg

SEQ ID NO: 37843 - DNA, 20 bp, Artificial Sequence
  chemically synthesized
acctactcatcccagctggg

SEQ ID NO: 37844 - DNA, 20 bp, Artificial Sequence
  chemically synthesized
cctactcatcccagctggga

SEQ ID NO: 37845 - DNA, 20 bp, Artificial Sequence
  chemically synthesized
tcatcccagctgggagggtc

SEQ ID NO: 37846 - DNA, 20 bp, Artificial Sequence
  chemically synthesized
tcccagctgggagggtccag

SEQ ID NO: 37847 - DNA, 20 bp, Artificial Sequence
  chemically synthesized
gggtccagaagatacaccct

SEQ ID NO: 37848 - DNA, 20 bp, Artificial Sequence
  chemically synthesized
agaagatacacccttggccg

SEQ ID NO: 37849 - DNA, 20 bp, Artificial Sequence
  chemically synthesized
ttggccgaagctttgtgaaa

SEQ ID NO: 37850 - DNA, 20 bp, Artificial Sequence
  chemically synthesized
gctttgtgaaatagatttgt

SEQ ID NO: 37851 - DNA, 20 bp, Artificial Sequence
  chemically synthesized
tttgtgaaatagatttgtga

SEQ ID NO: 37852 - DNA, 20 bp, Artificial Sequence
  chemically synthesized
gtgaaatagatttgtgagag

SEQ ID NO: 37853 - DNA, 20 bp, Artificial Sequence
  chemically synthesized
gagcagcacctgtatttttg

SEQ ID NO: 37854 - DNA, 20 bp, Artificial Sequence
  chemically synthesized
gcagcacctgtatttttgaa

SEQ ID NO: 37855 - DNA, 20 bp, Artificial Sequence
  chemically synthesized
aattgctcttctctgtatgt

SEQ ID NO: 37856 - DNA, 20 bp, Artificial Sequence
  chemically synthesized
tctctgtatgtcagatctaa

SEQ ID NO: 37857 - DNA, 20 bp, Artificial Sequence
  chemically synthesized
ctgtatgtcagatctaacag

SEQ ID NO: 37858 - DNA, 20 bp, Artificial Sequence
  chemically synthesized
tgtatgtcagatctaacagt

SEQ ID NO: 37859 - DNA, 20 bp, Artificial Sequence
  chemically synthesized
agatctaacagtaggaacca

SEQ ID NO: 37860 - DNA, 20 bp, Artificial Sequence
  chemically synthesized
actacaaaatttaaatacaa

SEQ ID NO: 37861 - DNA, 20 bp, Artificial Sequence
  chemically synthesized
ctacaaaatttaaatacaat

SEQ ID NO: 37862 - DNA, 20 bp, Artificial Sequence
  chemically synthesized
ttaaatacaatgggaataat

SEQ ID NO: 37863 - DNA, 20 bp, Artificial Sequence
  chemically synthesized
aatgggaataattggatcct

SEQ ID NO: 37864 - DNA, 20 bp, Artificial Sequence
  chemically synthesized
atgggaataattggatcctg

SEQ ID NO: 37865 - DNA, 20 bp, Artificial Sequence
  chemically synthesized
ggaataattggatcctgagg

SEQ ID NO: 37866 - DNA, 20 bp, Artificial Sequence
  chemically synthesized
ataattggatcctgaggtgg

SEQ ID NO: 37867 - DNA, 20 bp, Artificial Sequence
  chemically synthesized
taattggatcctgaggtggc

SEQ ID NO: 37868 - DNA, 20 bp, Artificial Sequence
  chemically synthesized
aattggatcctgaggtggca

SEQ ID NO: 37869 - DNA, 20 bp, Artificial Sequence
  chemically synthesized
attggatcctgaggtggcag

SEQ ID NO: 37870 - DNA, 20 bp, Artificial Sequence
  chemically synthesized
atcctgaggtggcaggggcc

SEQ ID NO: 37871 - DNA, 20 bp, Artificial Sequence
  chemically synthesized
aggtggcaggggccaagtgt

SEQ ID NO: 37872 - DNA, 20 bp, Artificial Sequence
  chemically synthesized
gtgttggcactgaaccatca

SEQ ID NO: 37873 - DNA, 20 bp, Artificial Sequence
  chemically synthesized
tgttggcactgaaccatcaa

SEQ ID NO: 37874 - DNA, 20 bp, Artificial Sequence
  chemically synthesized
ggcactgaaccatcaaaggc

SEQ ID NO: 37875 - DNA, 20 bp, Artificial Sequence
  chemically synthesized
gcactgaaccatcaaaggca

SEQ ID NO: 37876 - DNA, 20 bp, Artificial Sequence
  chemically synthesized
ctgaaccatcaaaggcaagg

SEQ ID NO: 37877 - DNA, 20 bp, Artificial Sequence
  chemically synthesized
tgaaccatcaaaggcaaggt

SEQ ID NO: 37878 - DNA, 20 bp, Artificial Sequence
  chemically synthesized
ggtgggcataactaccataa

SEQ ID NO: 37879 - DNA, 20 bp, Artificial Sequence
  chemically synthesized
ggcataactaccataataga

SEQ ID NO: 37880 - DNA, 20 bp, Artificial Sequence
  chemically synthesized
ataactaccataatagacag

SEQ ID NO: 37881 - DNA, 20 bp, Artificial Sequence
  chemically synthesized
aactaccataatagacagca

SEQ ID NO: 37882 - DNA, 20 bp, Artificial Sequence
  chemically synthesized
actaccataatagacagcag

SEQ ID NO: 37883 - DNA, 20 bp, Artificial Sequence
  chemically synthesized
cataatagacagcagaggca

SEQ ID NO: 37884 - DNA, 20 bp, Artificial Sequence
  chemically synthesized
aatagacagcagaggcaaag

SEQ ID NO: 37885 - DNA, 20 bp, Artificial Sequence
  chemically synthesized
agcagaggcaaagcagccat

SEQ ID NO: 37886 - DNA, 20 bp, Artificial Sequence
  chemically synthesized
aggcaaagcagccatcagaa

SEQ ID NO: 37887 - DNA, 20 bp, Artificial Sequence
  chemically synthesized
tcagaatagtctgactcatg

SEQ ID NO: 37888 - DNA, 20 bp, Artificial Sequence
  chemically synthesized
agaatagtctgactcatgta

SEQ ID NO: 37889 - DNA, 20 bp, Artificial Sequence
  chemically synthesized
gtctgactcatgtagagctc

SEQ ID NO: 37890 - DNA, 20 bp, Artificial Sequence
  chemically synthesized
ctcatgtagagctctggcat

SEQ ID NO: 37891 - DNA, 20 bp, Artificial Sequence
  chemically synthesized
tggcattggctaattaatca

SEQ ID NO: 37892 - DNA, 20 bp, Artificial Sequence
  chemically synthesized
ctaattaatcatggtgttcc

SEQ ID NO: 37893 - DNA, 20 bp, Artificial Sequence
  chemically synthesized
attaatcatggtgttcctag

SEQ ID NO: 37894 - DNA, 20 bp, Artificial Sequence
  chemically synthesized
gttcctagaagtgaaattga

SEQ ID NO: 37895 - DNA, 20 bp, Artificial Sequence
  chemically synthesized
ttcctagaagtgaaattgat

SEQ ID NO: 37896 - DNA, 20 bp, Artificial Sequence
  chemically synthesized
ttatataaacaaaaaactgc

SEQ ID NO: 37897 - DNA, 20 bp, Artificial Sequence
  chemically synthesized
tatataaacaaaaaactgcc

SEQ ID NO: 37898 - DNA, 20 bp, Artificial Sequence
  chemically synthesized
ataaacaaaaaactgccagg

SEQ ID NO: 37899 - DNA, 20 bp, Artificial Sequence
  chemically synthesized
caaaaaactgccaggtagaa

SEQ ID NO: 37900 - DNA, 20 bp, Artificial Sequence
  chemically synthesized
ctgccaggtagaatggacta

SEQ ID NO: 37901 - DNA, 20 bp, Artificial Sequence
  chemically synthesized
actaatctgaattataaaaa

SEQ ID NO: 37902 - DNA, 20 bp, Artificial Sequence
  chemically synthesized
taatctgaattataaaaaca

SEQ ID NO: 37903 - DNA, 20 bp, Artificial Sequence
  chemically synthesized
attataaaaacagagaatca

SEQ ID NO: 37904 - DNA, 20 bp, Artificial Sequence
  chemically synthesized
ttataaaaacagagaatcat

SEQ ID NO: 37905 - DNA, 20 bp, Artificial Sequence
  chemically synthesized
atgggccctcaatcaatttc

SEQ ID NO: 37906 - DNA, 20 bp, Artificial Sequence
  chemically synthesized
ttccagactcgaacctgtta

SEQ ID NO: 37907 - DNA, 20 bp, Artificial Sequence
  chemically synthesized
actcgaacctgttacagttc

SEQ ID NO: 37908 - DNA, 20 bp, Artificial Sequence
  chemically synthesized
gttccagaacccactgaatg

SEQ ID NO: 37909 - DNA, 20 bp, Artificial Sequence
  chemically synthesized
ttccagaacccactgaatga

SEQ ID NO: 37910 - DNA, 20 bp, Artificial Sequence
  chemically synthesized
tccagaacccactgaatgaa

SEQ ID NO: 37911 - DNA, 20 bp, Artificial Sequence
  chemically synthesized
ccagaacccactgaatgaag

SEQ ID NO: 37912 - DNA, 20 bp, Artificial Sequence
  chemically synthesized
agaacccactgaatgaaggg

SEQ ID NO: 37913 - DNA, 20 bp, Artificial Sequence
  chemically synthesized
gaacccactgaatgaagggg

SEQ ID NO: 37914 - DNA, 20 bp, Artificial Sequence
  chemically synthesized
ccactgaatgaaggggaggc

SEQ ID NO: 37915 - DNA, 20 bp, Artificial Sequence
  chemically synthesized
aggggaggctggatcccctt

SEQ ID NO: 37916 - DNA, 20 bp, Artificial Sequence
  chemically synthesized
ggggaggctggatccccttg

SEQ ID NO: 37917 - DNA, 20 bp, Artificial Sequence
  chemically synthesized
gaggctggatccccttgagg

SEQ ID NO: 37918 - DNA, 20 bp, Artificial Sequence
  chemically synthesized
aggctggatccccttgagga

SEQ ID NO: 37919 - DNA, 20 bp, Artificial Sequence
  chemically synthesized
cccttgaggaaggacaccac

SEQ ID NO: 37920 - DNA, 20 bp, Artificial Sequence
  chemically synthesized
ccttgaggaaggacaccact

SEQ ID NO: 37921 - DNA, 20 bp, Artificial Sequence
  chemically synthesized
tctttctcccatccttccct

SEQ ID NO: 37922 - DNA, 20 bp, Artificial Sequence
  chemically synthesized
ctttctcccatccttcccta

SEQ ID NO: 37923 - DNA, 20 bp, Artificial Sequence
  chemically synthesized
ttctcccatccttccctaag

SEQ ID NO: 37924 - DNA, 20 bp, Artificial Sequence
  chemically synthesized
tccttccctaaggagacctc

SEQ ID NO: 37925 - DNA, 20 bp, Artificial Sequence
  chemically synthesized
ggagacctctggccttttac

SEQ ID NO: 37926 - DNA, 20 bp, Artificial Sequence
  chemically synthesized
gagacctctggccttttacc

SEQ ID NO: 37927 - DNA, 20 bp, Artificial Sequence
  chemically synthesized
agacctctggccttttacca

SEQ ID NO: 37928 - DNA, 20 bp, Artificial Sequence
  chemically synthesized
accagggtaactgtgtgtac

SEQ ID NO: 37929 - DNA, 20 bp, Artificial Sequence
  chemically synthesized
cagggtaactgtgtgtactg

SEQ ID NO: 37930 - DNA, 20 bp, Artificial Sequence
  chemically synthesized
gtaactgtgtgtactggaga

SEQ ID NO: 37931 - DNA, 20 bp, Artificial Sequence
  chemically synthesized
taactgtgtgtactggagaa

SEQ ID NO: 37932 - DNA, 20 bp, Artificial Sequence
  chemically synthesized
aactgtgtgtactggagaaa

SEQ ID NO: 37933 - DNA, 20 bp, Artificial Sequence
  chemically synthesized
tgtgtgtactggagaaaggg

SEQ ID NO: 37934 - DNA, 20 bp, Artificial Sequence
  chemically synthesized
actggagaaagggaagtaat

SEQ ID NO: 37935 - DNA, 20 bp, Artificial Sequence
  chemically synthesized
agggaagtaatgagacattt

SEQ ID NO: 37936 - DNA, 20 bp, Artificial Sequence
  chemically synthesized
aagtaatgagacatttcaga

SEQ ID NO: 37937 - DNA, 20 bp, Artificial Sequence
  chemically synthesized
tgagacatttcagaaagtac

SEQ ID NO: 37938 - DNA, 20 bp, Artificial Sequence
  chemically synthesized
tttcagaaagtactggacac

SEQ ID NO: 37939 - DNA, 20 bp, Artificial Sequence
  chemically synthesized
aagtactggacactggctct

SEQ ID NO: 37940 - DNA, 20 bp, Artificial Sequence
  chemically synthesized
ctctgagctgacgttgattc

SEQ ID NO: 37941 - DNA, 20 bp, Artificial Sequence
  chemically synthesized
tctgagctgacgttgattcc

SEQ ID NO: 37942 - DNA, 20 bp, Artificial Sequence
  chemically synthesized
ctgagctgacgttgattcca

SEQ ID NO: 37943 - DNA, 20 bp, Artificial Sequence
  chemically synthesized
gggtacccaaaacgttattg

SEQ ID NO: 37944 - DNA, 20 bp, Artificial Sequence
  chemically synthesized
aaaacgttattgtggttccc

SEQ ID NO: 37945 - DNA, 20 bp, Artificial Sequence
  chemically synthesized
ttattgtggttccccagtta

SEQ ID NO: 37946 - DNA, 20 bp, Artificial Sequence
  chemically synthesized
ttgtggttccccagttaaag

SEQ ID NO: 37947 - DNA, 20 bp, Artificial Sequence
  chemically synthesized
tgtggttccccagttaaagt

SEQ ID NO: 37948 - DNA, 20 bp, Artificial Sequence
  chemically synthesized
gtggttccccagttaaagta

SEQ ID NO: 37949 - DNA, 20 bp, Artificial Sequence
  chemically synthesized
tggttccccagttaaagtag

SEQ ID NO: 37950 - DNA, 20 bp, Artificial Sequence
  chemically synthesized
ccagttaaagtaggggctta

SEQ ID NO: 37951 - DNA, 20 bp, Artificial Sequence
  chemically synthesized
agttaaagtaggggcttatg

SEQ ID NO: 37952 - DNA, 20 bp, Artificial Sequence
  chemically synthesized
gttaaagtaggggcttatgg

SEQ ID NO: 37953 - DNA, 20 bp, Artificial Sequence
  chemically synthesized
aagtaggggcttatggaggt

SEQ ID NO: 37954 - DNA, 20 bp, Artificial Sequence
  chemically synthesized
agtaggggcttatggaggtt

SEQ ID NO: 37955 - DNA, 20 bp, Artificial Sequence
  chemically synthesized
tatggaggttaggtaattaa

SEQ ID NO: 37956 - DNA, 20 bp, Artificial Sequence
  chemically synthesized
tggaggttaggtaattaatg

SEQ ID NO: 37957 - DNA, 20 bp, Artificial Sequence
  chemically synthesized
ttaggtaattaatggagttt

SEQ ID NO: 37958 - DNA, 20 bp, Artificial Sequence
  chemically synthesized
tttagctcatttctgactta

SEQ ID NO: 37959 - DNA, 20 bp, Artificial Sequence
  chemically synthesized
agctcatttctgacttacag

SEQ ID NO: 37960 - DNA, 20 bp, Artificial Sequence
  chemically synthesized
tttctgacttacagtggttc

SEQ ID NO: 37961 - DNA, 20 bp, Artificial Sequence
  chemically synthesized
ctgacttacagtggttccag

SEQ ID NO: 37962 - DNA, 20 bp, Artificial Sequence
  chemically synthesized
tgacttacagtggttccagt

SEQ ID NO: 37963 - DNA, 20 bp, Artificial Sequence
  chemically synthesized
cagtggttccagtgggtccc

SEQ ID NO: 37964 - DNA, 20 bp, Artificial Sequence
  chemically synthesized
gggtccctggacttatcctc

SEQ ID NO: 37965 - DNA, 20 bp, Artificial Sequence
  chemically synthesized
ttatcctctggtcattttcc

SEQ ID NO: 37966 - DNA, 20 bp, Artificial Sequence
  chemically synthesized
gccaaaatgcataatttgta

SEQ ID NO: 37967 - DNA, 20 bp, Artificial Sequence
  chemically synthesized
atttgtatagacatacttat

SEQ ID NO: 37968 - DNA, 20 bp, Artificial Sequence
  chemically synthesized
gtatagacatacttattagc

SEQ ID NO: 37969 - DNA, 20 bp, Artificial Sequence
  chemically synthesized
tagacatacttattagctgg

SEQ ID NO: 37970 - DNA, 20 bp, Artificial Sequence
  chemically synthesized
agctggcagaaatgccacat

SEQ ID NO: 37971 - DNA, 20 bp, Artificial Sequence
  chemically synthesized
tgccacattggctccctgac

SEQ ID NO: 37972 - DNA, 20 bp, Artificial Sequence
  chemically synthesized
cacattggctccctgactgg

SEQ ID NO: 37973 - DNA, 20 bp, Artificial Sequence
  chemically synthesized
acattggctccctgactggt

SEQ ID NO: 37974 - DNA, 20 bp, Artificial Sequence
  chemically synthesized
ggctccctgactggtaggat

SEQ ID NO: 37975 - DNA, 20 bp, Artificial Sequence
  chemically synthesized
gctccctgactggtaggatg

SEQ ID NO: 37976 - DNA, 20 bp, Artificial Sequence
  chemically synthesized
ctccctgactggtaggatga

SEQ ID NO: 37977 - DNA, 20 bp, Artificial Sequence
  chemically synthesized
tggtaggatgagggctatta

SEQ ID NO: 37978 - DNA, 20 bp, Artificial Sequence
  chemically synthesized
taggatgagggctattatgg

SEQ ID NO: 37979 - DNA, 20 bp, Artificial Sequence
  chemically synthesized
aggatgagggctattatggt

SEQ ID NO: 37980 - DNA, 20 bp, Artificial Sequence
  chemically synthesized
tgagggctattatggtggga

SEQ ID NO: 37981 - DNA, 20 bp, Artificial Sequence
  chemically synthesized
gagggctattatggtgggaa

SEQ ID NO: 37982 - DNA, 20 bp, Artificial Sequence
  chemically synthesized
ttatggtgggaaaggccaaa

SEQ ID NO: 37983 - DNA, 20 bp, Artificial Sequence
  chemically synthesized
tggtgggaaaggccaaacag

SEQ ID NO: 37984 - DNA, 20 bp, Artificial Sequence
  chemically synthesized
aaaggccaaacagaagccat

SEQ ID NO: 37985 - DNA, 20 bp, Artificial Sequence
  chemically synthesized
aggccaaacagaagccatta

SEQ ID NO: 37986 - DNA, 20 bp, Artificial Sequence
  chemically synthesized
ccattagagctgtctctacc

SEQ ID NO: 37987 - DNA, 20 bp, Artificial Sequence
  chemically synthesized
caaaaacaatatcccatccc

SEQ ID NO: 37988 - DNA, 20 bp, Artificial Sequence
  chemically synthesized
aaaacaatatcccatccctg

SEQ ID NO: 37989 - DNA, 20 bp, Artificial Sequence
  chemically synthesized
aaacaatatcccatccctgg

SEQ ID NO: 37990 - DNA, 20 bp, Artificial Sequence
  chemically synthesized
aacaatatcccatccctgga

SEQ ID NO: 37991 - DNA, 20 bp, Artificial Sequence
  chemically synthesized
tcccatccctggagggactg

SEQ ID NO: 37992 - DNA, 20 bp, Artificial Sequence
  chemically synthesized
cctggagggactgaagtgat

SEQ ID NO: 37993 - DNA, 20 bp, Artificial Sequence
  chemically synthesized
aagtgattagtgtcaccatc

SEQ ID NO: 37994 - DNA, 20 bp, Artificial Sequence
  chemically synthesized
agtgattagtgtcaccatca

SEQ ID NO: 37995 - DNA, 20 bp, Artificial Sequence
  chemically synthesized
tgtcaccatcaaggacttga

SEQ ID NO: 37996 - DNA, 20 bp, Artificial Sequence
  chemically synthesized
catcaaggacttgaaagacg

SEQ ID NO: 37997 - DNA, 20 bp, Artificial Sequence
  chemically synthesized
atcaaggacttgaaagacgc

SEQ ID NO: 37998 - DNA, 20 bp, Artificial Sequence
  chemically synthesized
tcaaggacttgaaagacgca

SEQ ID NO: 37999 - DNA, 20 bp, Artificial Sequence
  chemically synthesized
caaggacttgaaagacgcag

SEQ ID NO: 38000 - DNA, 20 bp, Artificial Sequence
  chemically synthesized
ggacttgaaagacgcagggg

SEQ ID NO: 38001 - DNA, 20 bp, Artificial Sequence
  chemically synthesized
actctcccatttgacctgtg

SEQ ID NO: 38002 - DNA, 20 bp, Artificial Sequence
  chemically synthesized
tctcccatttgacctgtgca

SEQ ID NO: 38003 - DNA, 20 bp, Artificial Sequence
  chemically synthesized
ctcccatttgacctgtgcag

SEQ ID NO: 38004 - DNA, 20 bp, Artificial Sequence
  chemically synthesized
catttgacctgtgcagagga

SEQ ID NO: 38005 - DNA, 20 bp, Artificial Sequence
  chemically synthesized
tgacctgtgcagaggacaga

SEQ ID NO: 38006 - DNA, 20 bp, Artificial Sequence
  chemically synthesized
tgcagaggacagatggatct

SEQ ID NO: 38007 - DNA, 20 bp, Artificial Sequence
  chemically synthesized
agatggatcttggaaaatga

SEQ ID NO: 38008 - DNA, 20 bp, Artificial Sequence
  chemically synthesized
tggatcttggaaaatgatgg

SEQ ID NO: 38009 - DNA, 20 bp, Artificial Sequence
  chemically synthesized
aaatgatggtggattatttt

SEQ ID NO: 38010 - DNA, 20 bp, Artificial Sequence
  chemically synthesized
ggattattttaagcttaacc

SEQ ID NO: 38011 - DNA, 20 bp, Artificial Sequence
  chemically synthesized
ttattttaagcttaaccaag

SEQ ID NO: 38012 - DNA, 20 bp, Artificial Sequence
  chemically synthesized
ccaagtggtgactccaattg

SEQ ID NO: 38013 - DNA, 20 bp, Artificial Sequence
  chemically synthesized
tccaattgcagctgctctac

SEQ ID NO: 38014 - DNA, 20 bp, Artificial Sequence
  chemically synthesized
tgcagctgctctaccagttg

SEQ ID NO: 38015 - DNA, 20 bp, Artificial Sequence
  chemically synthesized
cagttgtggttttgttgctt

SEQ ID NO: 38016 - DNA, 20 bp, Artificial Sequence
  chemically synthesized
gagcaaattaacacatctcc

SEQ ID NO: 38017 - DNA, 20 bp, Artificial Sequence
  chemically synthesized
ttaacacatctcctggtgcc

SEQ ID NO: 38018 - DNA, 20 bp, Artificial Sequence
  chemically synthesized
atctcctggtgcctggtatg

SEQ ID NO: 38019 - DNA, 20 bp, Artificial Sequence
  chemically synthesized
ggtgcctggtatgcagccat

SEQ ID NO: 38020 - DNA, 20 bp, Artificial Sequence
  chemically synthesized
ctggtatgcagccattggct

SEQ ID NO: 38021 - DNA, 20 bp, Artificial Sequence
  chemically synthesized
tatgcagccattggcttggc

SEQ ID NO: 38022 - DNA, 20 bp, Artificial Sequence
  chemically synthesized
gcagccattggcttggcaag

SEQ ID NO: 38023 - DNA, 20 bp, Artificial Sequence
  chemically synthesized
ttttctccattcctgtccat

SEQ ID NO: 38024 - DNA, 20 bp, Artificial Sequence
  chemically synthesized
ttcctgtccataagacccac

SEQ ID NO: 38025 - DNA, 20 bp, Artificial Sequence
  chemically synthesized
ctgtccataagacccaccag

SEQ ID NO: 38026 - DNA, 20 bp, Artificial Sequence
  chemically synthesized
caccagaagcaatttgcctt

SEQ ID NO: 38027 - DNA, 20 bp, Artificial Sequence
  chemically synthesized
gcaatttgccttcagctgac

SEQ ID NO: 38028 - DNA, 20 bp, Artificial Sequence
  chemically synthesized
caatttgccttcagctgaca

SEQ ID NO: 38029 - DNA, 20 bp, Artificial Sequence
  chemically synthesized
ttgccttcagctgacaaggc

SEQ ID NO: 38030 - DNA, 20 bp, Artificial Sequence
  chemically synthesized
atacctttaccaccctacct

SEQ ID NO: 38031 - DNA, 20 bp, Artificial Sequence
  chemically synthesized
tacctttaccaccctacctc

SEQ ID NO: 38032 - DNA, 20 bp, Artificial Sequence
  chemically synthesized
acctttaccaccctacctca

SEQ ID NO: 38033 - DNA, 20 bp, Artificial Sequence
  chemically synthesized
cctttaccaccctacctcag

SEQ ID NO: 38034 - DNA, 20 bp, Artificial Sequence
  chemically synthesized
tcaggggtgtatcaactctc

SEQ ID NO: 38035 - DNA, 20 bp, Artificial Sequence
  chemically synthesized
ctttgtgtcataatcttatt

SEQ ID NO: 38036 - DNA, 20 bp, Artificial Sequence
  chemically synthesized
ttgtgtcataatcttatttg

SEQ ID NO: 38037 - DNA, 20 bp, Artificial Sequence
  chemically synthesized
gtgtcataatcttatttgga

SEQ ID NO: 38038 - DNA, 20 bp, Artificial Sequence
  chemically synthesized
tgctcgcttttcacttccac

SEQ ID NO: 38039 - DNA, 20 bp, Artificial Sequence
  chemically synthesized
acttccacgagatataacac

SEQ ID NO: 38040 - DNA, 20 bp, Artificial Sequence
  chemically synthesized
attcatgacattatgatgat

SEQ ID NO: 38041 - DNA, 20 bp, Artificial Sequence
  chemically synthesized
gacattatgatgattggata

SEQ ID NO: 38042 - DNA, 20 bp, Artificial Sequence
  chemically synthesized
ttatgatgattggatacagt

SEQ ID NO: 38043 - DNA, 20 bp, Artificial Sequence
  chemically synthesized
gatgattggatacagtgagc

SEQ ID NO: 38044 - DNA, 20 bp, Artificial Sequence
  chemically synthesized
gattggatacagtgagcaag

SEQ ID NO: 38045 - DNA, 20 bp, Artificial Sequence
  chemically synthesized
tggatacagtgagcaagaag

SEQ ID NO: 38046 - DNA, 20 bp, Artificial Sequence
  chemically synthesized
agcaaacacactgaacttat

SEQ ID NO: 38047 - DNA, 20 bp, Artificial Sequence
  chemically synthesized
aacacactgaacttattggt

SEQ ID NO: 38048 - DNA, 20 bp, Artificial Sequence
  chemically synthesized
ttggtgagacatttgtatgc

SEQ ID NO: 38049 - DNA, 20 bp, Artificial Sequence
  chemically synthesized
ggtgagacatttgtatgcca

SEQ ID NO: 38050 - DNA, 20 bp, Artificial Sequence
  chemically synthesized
gtgagacatttgtatgccag

SEQ ID NO: 38051 - DNA, 20 bp, Artificial Sequence
  chemically synthesized
gacatttgtatgccagagga

SEQ ID NO: 38052 - DNA, 20 bp, Artificial Sequence
  chemically synthesized
acatttgtatgccagaggat

SEQ ID NO: 38053 - DNA, 20 bp, Artificial Sequence
  chemically synthesized
cagaggatgggaaataaatc

SEQ ID NO: 38054 - DNA, 20 bp, Artificial Sequence
  chemically synthesized
aaataaatccagctaaaatt

SEQ ID NO: 38055 - DNA, 20 bp, Artificial Sequence
  chemically synthesized
aataaatccagctaaaattt

SEQ ID NO: 38056 - DNA, 20 bp, Artificial Sequence
  chemically synthesized
ataaatccagctaaaattta

SEQ ID NO: 38057 - DNA, 20 bp, Artificial Sequence
  chemically synthesized
aatttagggactttctacct

SEQ ID NO: 38058 - DNA, 20 bp, Artificial Sequence
  chemically synthesized
ttctacctcggtaaaatttc

SEQ ID NO: 38059 - DNA, 20 bp, Artificial Sequence
  chemically synthesized
tctacctcggtaaaatttct

SEQ ID NO: 38060 - DNA, 20 bp, Artificial Sequence
  chemically synthesized
ctacctcggtaaaatttcta

SEQ ID NO: 38061 - DNA, 20 bp, Artificial Sequence
  chemically synthesized
cggtaaaatttctagggttc

SEQ ID NO: 38062 - DNA, 20 bp, Artificial Sequence
  chemically synthesized
taaaatttctagggttccag

SEQ ID NO: 38063 - DNA, 20 bp, Artificial Sequence
  chemically synthesized
ttctagggttccagtggcat

SEQ ID NO: 38064 - DNA, 20 bp, Artificial Sequence
  chemically synthesized
ttccagtggcatgagaccta

SEQ ID NO: 38065 - DNA, 20 bp, Artificial Sequence
  chemically synthesized
ccagtggcatgagacctatg

SEQ ID NO: 38066 - DNA, 20 bp, Artificial Sequence
  chemically synthesized
cctatggagatattccttct

SEQ ID NO: 38067 - DNA, 20 bp, Artificial Sequence
  chemically synthesized
ctatggagatattccttcta

SEQ ID NO: 38068 - DNA, 20 bp, Artificial Sequence
  chemically synthesized
gagatattccttctaaggtg

SEQ ID NO: 38069 - DNA, 20 bp, Artificial Sequence
  chemically synthesized
gaagcataacttgctgcgtt

SEQ ID NO: 38070 - DNA, 20 bp, Artificial Sequence
  chemically synthesized
gtttggcccctcttacaacc

SEQ ID NO: 38071 - DNA, 20 bp, Artificial Sequence
  chemically synthesized
ggcccctcttacaaccaaga

SEQ ID NO: 38072 - DNA, 20 bp, Artificial Sequence
  chemically synthesized
cccctcttacaaccaagaaa

SEQ ID NO: 38073 - DNA, 20 bp, Artificial Sequence
  chemically synthesized
ccctcttacaaccaagaaag

SEQ ID NO: 38074 - DNA, 20 bp, Artificial Sequence
  chemically synthesized
caagaaagaggcacaatgcc

SEQ ID NO: 38075 - DNA, 20 bp, Artificial Sequence
  chemically synthesized
gaaagaggcacaatgcctgg

SEQ ID NO: 38076 - DNA, 20 bp, Artificial Sequence
  chemically synthesized
aaagaggcacaatgcctggt

SEQ ID NO: 38077 - DNA, 20 bp, Artificial Sequence
  chemically synthesized
caatgcctggtgggcctatt

SEQ ID NO: 38078 - DNA, 20 bp, Artificial Sequence
  chemically synthesized
tggtgggcctatttggattt

SEQ ID NO: 38079 - DNA, 20 bp, Artificial Sequence
  chemically synthesized
gtgggcctatttggattttg

SEQ ID NO: 38080 - DNA, 20 bp, Artificial Sequence
  chemically synthesized
tgggcctatttggattttgg

SEQ ID NO: 38081 - DNA, 20 bp, Artificial Sequence
  chemically synthesized
gaggcaacacattcctcgtt

SEQ ID NO: 38082 - DNA, 20 bp, Artificial Sequence
  chemically synthesized
aggcaacacattcctcgttt

SEQ ID NO: 38083 - DNA, 20 bp, Artificial Sequence
  chemically synthesized
ctcgtttgggtgtgttactc

SEQ ID NO: 38084 - DNA, 20 bp, Artificial Sequence
  chemically synthesized
gttactctggcccatttatc

SEQ ID NO: 38085 - DNA, 20 bp, Artificial Sequence
  chemically synthesized
ccatttatcgagtgacctga

SEQ ID NO: 38086 - DNA, 20 bp, Artificial Sequence
  chemically synthesized
catttatcgagtgacctgaa

SEQ ID NO: 38087 - DNA, 20 bp, Artificial Sequence
  chemically synthesized
cgagtgacctgaaaggctgc

SEQ ID NO: 38088 - DNA, 20 bp, Artificial Sequence
  chemically synthesized
cctgaaaggctgccagattt

SEQ ID NO: 38089 - DNA, 20 bp, Artificial Sequence
  chemically synthesized
aaggctgccagatttaagtg

SEQ ID NO: 38090 - DNA, 20 bp, Artificial Sequence
  chemically synthesized
tgccagatttaagtgcagtc

SEQ ID NO: 38091 - DNA, 20 bp, Artificial Sequence
  chemically synthesized
ttaagtgcagtctagaacaa

SEQ ID NO: 38092 - DNA, 20 bp, Artificial Sequence
  chemically synthesized
agtgcagtctagaacaaaag

SEQ ID NO: 38093 - DNA, 20 bp, Artificial Sequence
  chemically synthesized
gtgcagtctagaacaaaaga

SEQ ID NO: 38094 - DNA, 20 bp, Artificial Sequence
  chemically synthesized
aacaaaagaaggctctgaaa

SEQ ID NO: 38095 - DNA, 20 bp, Artificial Sequence
  chemically synthesized
acaaaagaaggctctgaaac

SEQ ID NO: 38096 - DNA, 20 bp, Artificial Sequence
  chemically synthesized
agaaggctctgaaacaggtc

SEQ ID NO: 38097 - DNA, 20 bp, Artificial Sequence
  chemically synthesized
gaaggctctgaaacaggtcc

SEQ ID NO: 38098 - DNA, 20 bp, Artificial Sequence
  chemically synthesized
acaggtccaggctgctgtga

SEQ ID NO: 38099 - DNA, 20 bp, Artificial Sequence
  chemically synthesized
gtgaaagctgctctgccatt

SEQ ID NO: 38100 - DNA, 20 bp, Artificial Sequence
  chemically synthesized
tgaaagctgctctgccattt

SEQ ID NO: 38101 - DNA, 20 bp, Artificial Sequence
  chemically synthesized
atttgggccacatgaccccg

SEQ ID NO: 38102 - DNA, 20 bp, Artificial Sequence
  chemically synthesized
acatgaccccgcagatccaa

SEQ ID NO: 38103 - DNA, 20 bp, Artificial Sequence
  chemically synthesized
ccgcagatccaatggtgctt

SEQ ID NO: 38104 - DNA, 20 bp, Artificial Sequence
  chemically synthesized
cgcagatccaatggtgcttg

SEQ ID NO: 38105 - DNA, 20 bp, Artificial Sequence
  chemically synthesized
tccaatggtgcttgaggtgt

SEQ ID NO: 38106 - DNA, 20 bp, Artificial Sequence
  chemically synthesized
aatggtgcttgaggtgtcag

SEQ ID NO: 38107 - DNA, 20 bp, Artificial Sequence
  chemically synthesized
ggtgcttgaggtgtcagtgg

SEQ ID NO: 38108 - DNA, 20 bp, Artificial Sequence
  chemically synthesized
cttgaggtgtcagtggcaga

SEQ ID NO: 38109 - DNA, 20 bp, Artificial Sequence
  chemically synthesized
ttgaggtgtcagtggcagat

SEQ ID NO: 38110 - DNA, 20 bp, Artificial Sequence
  chemically synthesized
tgaggtgtcagtggcagata

SEQ ID NO: 38111 - DNA, 20 bp, Artificial Sequence
  chemically synthesized
tggcagatagggatgctgtt

SEQ ID NO: 38112 - DNA, 20 bp, Artificial Sequence
  chemically synthesized
gcagatagggatgctgtttg

SEQ ID NO: 38113 - DNA, 20 bp, Artificial Sequence
  chemically synthesized
gggatgctgtttggagcctt

SEQ ID NO: 38114 - DNA, 20 bp, Artificial Sequence
  chemically synthesized
atgctgtttggagcctttgg

SEQ ID NO: 38115 - DNA, 20 bp, Artificial Sequence
  chemically synthesized
tgctgtttggagcctttggc

SEQ ID NO: 38116 - DNA, 20 bp, Artificial Sequence
  chemically synthesized
gagcctttggcaggccccca

SEQ ID NO: 38117 - DNA, 20 bp, Artificial Sequence
  chemically synthesized
agcctttggcaggcccccat

SEQ ID NO: 38118 - DNA, 20 bp, Artificial Sequence
  chemically synthesized
aggcccccataggtgaatca

SEQ ID NO: 38119 - DNA, 20 bp, Artificial Sequence
  chemically synthesized
cccccataggtgaatcacag

SEQ ID NO: 38120 - DNA, 20 bp, Artificial Sequence
  chemically synthesized
cccataggtgaatcacagtg

SEQ ID NO: 38121 - DNA, 20 bp, Artificial Sequence
  chemically synthesized
tgaatcacagtggagacctc

SEQ ID NO: 38122 - DNA, 20 bp, Artificial Sequence
  chemically synthesized
gaatcacagtggagacctct

SEQ ID NO: 38123 - DNA, 20 bp, Artificial Sequence
  chemically synthesized
agtggagacctctaggattt

SEQ ID NO: 38124 - DNA, 20 bp, Artificial Sequence
  chemically synthesized
tggagacctctaggattttg

SEQ ID NO: 38125 - DNA, 20 bp, Artificial Sequence
  chemically synthesized
gacctctaggattttggagc

SEQ ID NO: 38126 - DNA, 20 bp, Artificial Sequence
  chemically synthesized
acctctaggattttggagca

SEQ ID NO: 38127 - DNA, 20 bp, Artificial Sequence
  chemically synthesized
gcaaggccctgccacttctg

SEQ ID NO: 38128 - DNA, 20 bp, Artificial Sequence
  chemically synthesized
cagataactactctcctttt

SEQ ID NO: 38129 - DNA, 20 bp, Artificial Sequence
  chemically synthesized
gataactactctccttttga

SEQ ID NO: 38130 - DNA, 20 bp, Artificial Sequence
  chemically synthesized
actactctccttttgagaga

SEQ ID NO: 38131 - DNA, 20 bp, Artificial Sequence
  chemically synthesized
tccttttgagagacagctat

SEQ ID NO: 38132 - DNA, 20 bp, Artificial Sequence
  chemically synthesized
gacagctattggtctgttat

SEQ ID NO: 38133 - DNA, 20 bp, Artificial Sequence
  chemically synthesized
acagctattggtctgttatt

SEQ ID NO: 38134 - DNA, 20 bp, Artificial Sequence
  chemically synthesized
attggtctgttattgggctt

SEQ ID NO: 38135 - DNA, 20 bp, Artificial Sequence
  chemically synthesized
ggtctgttattgggctttgg

SEQ ID NO: 38136 - DNA, 20 bp, Artificial Sequence
  chemically synthesized
ggtaactgaacgtttgactg

SEQ ID NO: 38137 - DNA, 20 bp, Artificial Sequence
  chemically synthesized
gtaactgaacgtttgactgt

SEQ ID NO: 38138 - DNA, 20 bp, Artificial Sequence
  chemically synthesized
acgtttgactgtgggtcata

SEQ ID NO: 38139 - DNA, 20 bp, Artificial Sequence
  chemically synthesized
tgaacctgcctatcatgaac

SEQ ID NO: 38140 - DNA, 20 bp, Artificial Sequence
  chemically synthesized
tggttgctttctgacccatc

SEQ ID NO: 38141 - DNA, 20 bp, Artificial Sequence
  chemically synthesized
ttctgacccatctagccatg

SEQ ID NO: 38142 - DNA, 20 bp, Artificial Sequence
  chemically synthesized
tgacccatctagccatgaag

SEQ ID NO: 38143 - DNA, 20 bp, Artificial Sequence
  chemically synthesized
gacccatctagccatgaagt

SEQ ID NO: 38144 - DNA, 20 bp, Artificial Sequence
  chemically synthesized
catctagccatgaagtgggt

SEQ ID NO: 38145 - DNA, 20 bp, Artificial Sequence
  chemically synthesized
agccatgaagtgggtcagca

SEQ ID NO: 38146 - DNA, 20 bp, Artificial Sequence
  chemically synthesized
catgaagtgggtcagcacag

SEQ ID NO: 38147 - DNA, 20 bp, Artificial Sequence
  chemically synthesized
ggcatttcatcatcaaattg

SEQ ID NO: 38148 - DNA, 20 bp, Artificial Sequence
  chemically synthesized
atttcatcatcaaattgaag

SEQ ID NO: 38149 - DNA, 20 bp, Artificial Sequence
  chemically synthesized
tgaagtggtgtgtatgtgat

SEQ ID NO: 38150 - DNA, 20 bp, Artificial Sequence
  chemically synthesized
gaagtggtgtgtatgtgatc

SEQ ID NO: 38151 - DNA, 20 bp, Artificial Sequence
  chemically synthesized
gtgtgtatgtgatcgggctt

SEQ ID NO: 38152 - DNA, 20 bp, Artificial Sequence
  chemically synthesized
tgtatgtgatcgggcttgag

SEQ ID NO: 38153 - DNA, 20 bp, Artificial Sequence
  chemically synthesized
gtatgtgatcgggcttgagc

SEQ ID NO: 38154 - DNA, 20 bp, Artificial Sequence
  chemically synthesized
tcgggcttgagcaggtcctg

SEQ ID NO: 38155 - DNA, 20 bp, Artificial Sequence
  chemically synthesized
cgggcttgagcaggtcctga

SEQ ID NO: 38156 - DNA, 20 bp, Artificial Sequence
  chemically synthesized
tgagcaggtcctgaaggcac

SEQ ID NO: 38157 - DNA, 20 bp, Artificial Sequence
  chemically synthesized
caggtcctgaaggcacaagt

SEQ ID NO: 38158 - DNA, 20 bp, Artificial Sequence
  chemically synthesized
aaggcacaagtaagttacat

SEQ ID NO: 38159 - DNA, 20 bp, Artificial Sequence
  chemically synthesized
aggcacaagtaagttacata

SEQ ID NO: 38160 - DNA, 20 bp, Artificial Sequence
  chemically synthesized
cacaagtaagttacataagg

SEQ ID NO: 38161 - DNA, 20 bp, Artificial Sequence
  chemically synthesized
aagtaagttacataaggaag

SEQ ID NO: 38162 - DNA, 20 bp, Artificial Sequence
  chemically synthesized
ccaccctgccttccctcccc

SEQ ID NO: 38163 - DNA, 20 bp, Artificial Sequence
  chemically synthesized
cctcccccagcctgcaccaa

SEQ ID NO: 38164 - DNA, 20 bp, Artificial Sequence
  chemically synthesized
agcctgcaccaatggcctca

SEQ ID NO: 38165 - DNA, 20 bp, Artificial Sequence
  chemically synthesized
gcctgcaccaatggcctcat

SEQ ID NO: 38166 - DNA, 20 bp, Artificial Sequence
  chemically synthesized
cctgcaccaatggcctcatg

SEQ ID NO: 38167 - DNA, 20 bp, Artificial Sequence
  chemically synthesized
tgcaccaatggcctcatggg

SEQ ID NO: 38168 - DNA, 20 bp, Artificial Sequence
  chemically synthesized
catggggagttccctatgat

SEQ ID NO: 38169 - DNA, 20 bp, Artificial Sequence
  chemically synthesized
agttccctatgatcagttga

SEQ ID NO: 38170 - DNA, 20 bp, Artificial Sequence
  chemically synthesized
ttccctatgatcagttgaca

SEQ ID NO: 38171 - DNA, 20 bp, Artificial Sequence
  chemically synthesized
tccctatgatcagttgacag

SEQ ID NO: 38172 - DNA, 20 bp, Artificial Sequence
  chemically synthesized
ctatgatcagttgacagagg

SEQ ID NO: 38173 - DNA, 20 bp, Artificial Sequence
  chemically synthesized
tatgatcagttgacagagga

SEQ ID NO: 38174 - DNA, 20 bp, Artificial Sequence
  chemically synthesized
atgatcagttgacagaggaa

SEQ ID NO: 38175 - DNA, 20 bp, Artificial Sequence
  chemically synthesized
atcagttgacagaggaaggg

SEQ ID NO: 38176 - DNA, 20 bp, Artificial Sequence
  chemically synthesized
tgacagaggaagggaagact

SEQ ID NO: 38177 - DNA, 20 bp, Artificial Sequence
  chemically synthesized
gacagaggaagggaagacta

SEQ ID NO: 38178 - DNA, 20 bp, Artificial Sequence
  chemically synthesized
aggaagggaagactaaggac

SEQ ID NO: 38179 - DNA, 20 bp, Artificial Sequence
  chemically synthesized
gaagactaaggactggttca

SEQ ID NO: 38180 - DNA, 20 bp, Artificial Sequence
  chemically synthesized
actaaggactggttcataga

SEQ ID NO: 38181 - DNA, 20 bp, Artificial Sequence
  chemically synthesized
agatggttctgcacgatatg

SEQ ID NO: 38182 - DNA, 20 bp, Artificial Sequence
  chemically synthesized
gatggttctgcacgatatgc

SEQ ID NO: 38183 - DNA, 20 bp, Artificial Sequence
  chemically synthesized
gatatgcaggcaccacccga

SEQ ID NO: 38184 - DNA, 20 bp, Artificial Sequence
  chemically synthesized
atgcaggcaccacccgaaag

SEQ ID NO: 38185 - DNA, 20 bp, Artificial Sequence
  chemically synthesized
aggcaccacccgaaagtgga

SEQ ID NO: 38186 - DNA, 20 bp, Artificial Sequence
  chemically synthesized
cacccgaaagtggacagctg

SEQ ID NO: 38187 - DNA, 20 bp, Artificial Sequence
  chemically synthesized
tgcatgtgtacacttgtgct

SEQ ID NO: 38188 - DNA, 20 bp, Artificial Sequence
  chemically synthesized
tttcctttatcatgtgacct

SEQ ID NO: 38189 - DNA, 20 bp, Artificial Sequence
  chemically synthesized
atcatgtgaccttagattta

SEQ ID NO: 38190 - DNA, 20 bp, Artificial Sequence
  chemically synthesized
tagatttatggacttcacat

SEQ ID NO: 38191 - DNA, 20 bp, Artificial Sequence
  chemically synthesized
tggacttcacatcagcattt

SEQ ID NO: 38192 - DNA, 20 bp, Artificial Sequence
  chemically synthesized
acatcagcatttaagcattt

SEQ ID NO: 38193 - DNA, 20 bp, Artificial Sequence
  chemically synthesized
catttaagtgttgttcatat

SEQ ID NO: 38194 - DNA, 20 bp, Artificial Sequence
  chemically synthesized
taaccttatgtaataacttt

SEQ ID NO: 38195 - DNA, 20 bp, Artificial Sequence
  chemically synthesized
ttatgtaataacttttggtt

SEQ ID NO: 38196 - DNA, 20 bp, Artificial Sequence
  chemically synthesized
tatgtaataacttttggttt

SEQ ID NO: 38197 - DNA, 20 bp, Artificial Sequence
  chemically synthesized
atgtaataacttttggtttg

SEQ ID NO: 38198 - DNA, 20 bp, Artificial Sequence
  chemically synthesized
ataacttttggtttggggat

SEQ ID NO: 38199 - DNA, 20 bp, Artificial Sequence
  chemically synthesized
tttggggattggtgcgtttc

SEQ ID NO: 38200 - DNA, 20 bp, Artificial Sequence
  chemically synthesized
tggtgcgtttctggttgtat

SEQ ID NO: 38201 - DNA, 20 bp, Artificial Sequence
  chemically synthesized
ggtgcgtttctggttgtatg

SEQ ID NO: 38202 - DNA, 20 bp, Artificial Sequence
  chemically synthesized
cgtttctggttgtatgagga

SEQ ID NO: 38203 - DNA, 20 bp, Artificial Sequence
  chemically synthesized
tgaggatagttgtattatat

SEQ ID NO: 38204 - DNA, 20 bp, Artificial Sequence
  chemically synthesized
gaggatagttgtattatatt

SEQ ID NO: 38205 - DNA, 20 bp, Artificial Sequence
  chemically synthesized
cttattattgtctttatttg

SEQ ID NO: 38206 - DNA, 20 bp, Artificial Sequence
  chemically synthesized
ttgaagattatgtatgattt

SEQ ID NO: 38207 - DNA, 20 bp, Artificial Sequence
  chemically synthesized
tgaagattatgtatgatttc

SEQ ID NO: 38208 - DNA, 20 bp, Artificial Sequence
  chemically synthesized
atgatttcaggatgtgtgta

SEQ ID NO: 38209 - DNA, 20 bp, Artificial Sequence
  chemically synthesized
tgatttcaggatgtgtgtat

SEQ ID NO: 38210 - DNA, 20 bp, Artificial Sequence
  chemically synthesized
caggatgtgtgtatgggttc

SEQ ID NO: 38211 - DNA, 20 bp, Artificial Sequence
  chemically synthesized
gtgtatgggttcaagttgac

SEQ ID NO: 38212 - DNA, 20 bp, Artificial Sequence
  chemically synthesized
tgtatgggttcaagttgaca

SEQ ID NO: 38213 - DNA, 20 bp, Artificial Sequence
  chemically synthesized
tatgggttcaagttgacaag

SEQ ID NO: 38214 - DNA, 20 bp, Artificial Sequence
  chemically synthesized
ggttcaagttgacaaggagt

SEQ ID NO: 38215 - DNA, 20 bp, Artificial Sequence
  chemically synthesized
acaaggagttggacttgtga

SEQ ID NO: 38216 - DNA, 20 bp, Artificial Sequence
  chemically synthesized
gttaatactgtcaacttgat

SEQ ID NO: 38217 - DNA, 20 bp, Artificial Sequence
  chemically synthesized
tgtcaacttgattggattga

SEQ ID NO: 38218 - DNA, 20 bp, Artificial Sequence
  chemically synthesized
tgattggattgaaagatgca

SEQ ID NO: 38219 - DNA, 20 bp, Artificial Sequence
  chemically synthesized
aagatgcaaagtattaatct

SEQ ID NO: 38220 - DNA, 20 bp, Artificial Sequence
  chemically synthesized
ttaatctcggttatgtctgt

SEQ ID NO: 38221 - DNA, 20 bp, Artificial Sequence
  chemically synthesized
taatctcggttatgtctgtg

SEQ ID NO: 38222 - DNA, 20 bp, Artificial Sequence
  chemically synthesized
aatctcggttatgtctgtga

SEQ ID NO: 38223 - DNA, 20 bp, Artificial Sequence
  chemically synthesized
cggttatgtctgtgagggtg

SEQ ID NO: 38224 - DNA, 20 bp, Artificial Sequence
  chemically synthesized
tgtctgtgagggtgtggcaa

SEQ ID NO: 38225 - DNA, 20 bp, Artificial Sequence
  chemically synthesized
gtctgtgagggtgtggcaaa

SEQ ID NO: 38226 - DNA, 20 bp, Artificial Sequence
  chemically synthesized
ctgtgagggtgtggcaaaag

SEQ ID NO: 38227 - DNA, 20 bp, Artificial Sequence
  chemically synthesized
gcaaaaggagattaacattt

SEQ ID NO: 38228 - DNA, 20 bp, Artificial Sequence
  chemically synthesized
aaggagattaacatttgagt

SEQ ID NO: 38229 - DNA, 20 bp, Artificial Sequence
  chemically synthesized
gagattaacatttgagtcag

SEQ ID NO: 38230 - DNA, 20 bp, Artificial Sequence
  chemically synthesized
agattaacatttgagtcagt

SEQ ID NO: 38231 - DNA, 20 bp, Artificial Sequence
  chemically synthesized
taacatttgagtcagtgggc

SEQ ID NO: 38232 - DNA, 20 bp, Artificial Sequence
  chemically synthesized
aacatttgagtcagtgggct

SEQ ID NO: 38233 - DNA, 20 bp, Artificial Sequence
  chemically synthesized
tgtacacatgcatttagaaa

SEQ ID NO: 38234 - DNA, 20 bp, Artificial Sequence
  chemically synthesized
agtgctgcagctgtccactt

SEQ ID NO: 38235 - DNA, 20 bp, Artificial Sequence
  chemically synthesized
gcaggctgggggagggaagg

SEQ ID NO: 38236 - DNA, 20 bp, Artificial Sequence
  chemically synthesized
gggagggaaggcagggtggc

SEQ ID NO: 38237 - DNA, 20 bp, Artificial Sequence
  chemically synthesized
ctgacccacttcatggctag

SEQ ID NO: 38238 - DNA, 20 bp, Artificial Sequence
  chemically synthesized
caatagctgtctctcaaaag

SEQ ID NO: 38239 - DNA, 20 bp, Artificial Sequence
  chemically synthesized
cactgacacctcaagcacca

SEQ ID NO: 38240 - DNA, 20 bp, Artificial Sequence
  chemically synthesized
ctcaagcaccattggatctg

SEQ ID NO: 38241 - DNA, 20 bp, Artificial Sequence
  chemically synthesized
aggtcactcgataaatgggc

SEQ ID NO: 38242 - DNA, 20 bp, Artificial Sequence
  chemically synthesized
cagagtaacacacccaaacg

SEQ ID NO: 38243 - DNA, 20 bp, Artificial Sequence
  chemically synthesized
aagttatgcttcaccttaga

SEQ ID NO: 38244 - DNA, 20 bp, Artificial Sequence
  chemically synthesized
agaaagtccctaaattttag

SEQ ID NO: 38245 - DNA, 20 bp, Artificial Sequence
  chemically synthesized
tatccaatcatcataatgtc

SEQ ID NO: 38246 - DNA, 20 bp, Artificial Sequence
  chemically synthesized
aagattatgacacaaagctg

SEQ ID NO: 38247 - DNA, 20 bp, Artificial Sequence
  chemically synthesized
gagttgatacacccctgagg

SEQ ID NO: 38248 - DNA, 20 bp, Artificial Sequence
  chemically synthesized
ctgaaggcaaattgcttctg

SEQ ID NO: 38249 - DNA, 20 bp, Artificial Sequence
  chemically synthesized
ttctggtgggtcttatggac

SEQ ID NO: 38250 - DNA, 20 bp, Artificial Sequence
  chemically synthesized
actggtagagcagctgcaat

SEQ ID NO: 38251 - DNA, 20 bp, Artificial Sequence
  chemically synthesized
cctctgcacaggtcaaatgg

SEQ ID NO: 38252 - DNA, 20 bp, Artificial Sequence
  chemically synthesized
gtcaaatgggagagttgaac

SEQ ID NO: 38253 - DNA, 20 bp, Artificial Sequence
  chemically synthesized
gagttgaacagggatgtggt

SEQ ID NO: 38254 - DNA, 20 bp, Artificial Sequence
  chemically synthesized
ctaatcacttcagtccctcc

SEQ ID NO: 38255 - DNA, 20 bp, Artificial Sequence
  chemically synthesized
cacttcagtccctccaggga

SEQ ID NO: 38256 - DNA, 20 bp, Artificial Sequence
  chemically synthesized
tggcactgggaaaatgacca

SEQ ID NO: 38257 - DNA, 20 bp, Artificial Sequence
  chemically synthesized
tggggaaccacaataacgtt

SEQ ID NO: 38258 - DNA, 20 bp, Artificial Sequence
  chemically synthesized
caataacgttttgggtaccc

SEQ ID NO: 38259 - DNA, 20 bp, Artificial Sequence
  chemically synthesized
ggccagaggtctccttaggg

SEQ ID NO: 38260 - DNA, 20 bp, Artificial Sequence
  chemically synthesized
ccttagggaaggatgggaga

SEQ ID NO: 38261 - DNA, 20 bp, Artificial Sequence
  chemically synthesized
ctagtggtgtccttcctcaa

SEQ ID NO: 38262 - DNA, 20 bp, Artificial Sequence
  chemically synthesized
tccagcctccccttcattca

SEQ ID NO: 38263 - DNA, 20 bp, Artificial Sequence
  chemically synthesized
gttctggaactgtaacaggt

SEQ ID NO: 38264 - DNA, 20 bp, Artificial Sequence
  chemically synthesized
tttgtttatataaatcaagt

SEQ ID NO: 38265 - DNA, 20 bp, Artificial Sequence
  chemically synthesized
agccaatgccagagctctac

SEQ ID NO: 38266 - DNA, 20 bp, Artificial Sequence
  chemically synthesized
acacttggcccctgccacct

SEQ ID NO: 38267 - DNA, 20 bp, Artificial Sequence
  chemically synthesized
attgtatttaaattttgtag

SEQ ID NO: 38268 - DNA, 20 bp, Artificial Sequence
  chemically synthesized
tatttcacaaagcttcggcc

SEQ ID NO: 38269 - DNA, 20 bp, Artificial Sequence
  chemically synthesized
atcttctggaccctcccagc

SEQ ID NO: 38270 - DNA, 20 bp, Artificial Sequence
  chemically synthesized
tctggaccctcccagctggg

SEQ ID NO: 38271 - DNA, 20 bp, Artificial Sequence
  chemically synthesized
atcctaatctccctaagcct

SEQ ID NO: 38272 - DNA, 20 bp, Artificial Sequence
  chemically synthesized
tttttttttttttttggaaa

SEQ ID NO: 38273 - DNA, 20 bp, Artificial Sequence
  chemically synthesized
gtcttgctctgttaccaggc

SEQ ID NO: 38274 - DNA, 20 bp, Artificial Sequence
  chemically synthesized
ttttgtatttttagcagaga

SEQ ID NO: 38275 - DNA, 20 bp, Artificial Sequence
  chemically synthesized
tggggtttcaccattttagc

SEQ ID NO: 38276 - DNA, 20 bp, Artificial Sequence
  chemically synthesized
gcccccgcctcccaaggtgc

SEQ ID NO: 38277 - DNA, 20 bp, Artificial Sequence
  chemically synthesized
ccgagctgcaacattaaatg

SEQ ID NO: 38278 - DNA, 20 bp, Artificial Sequence
  chemically synthesized
gaaagcttaagcagttcttt

SEQ ID NO: 38279 - DNA, 20 bp, Artificial Sequence
  chemically synthesized
agagtataatgcacctcctc

SEQ ID NO: 38280 - DNA, 20 bp, Artificial Sequence
  chemically synthesized
cctcacctctggggcccgca

SEQ ID NO: 38281 - DNA, 20 bp, Artificial Sequence
  chemically synthesized
tagaagcattcaggggcatt

SEQ ID NO: 38282 - DNA, 20 bp, Artificial Sequence
  chemically synthesized
cattaggggtgcctcttgag

SEQ ID NO: 38283 - DNA, 20 bp, Artificial Sequence
  chemically synthesized
cactgttgcctcaagcagtg

SEQ ID NO: 38284 - DNA, 20 bp, Artificial Sequence
  chemically synthesized
gtggaaaggctaatggcagc

SEQ ID NO: 38285 - DNA, 20 bp, Artificial Sequence
  chemically synthesized
atggcagcacgggtcaggga

SEQ ID NO: 38286 - DNA, 20 bp, Artificial Sequence
  chemically synthesized
gaggggatgttaccactact

SEQ ID NO: 38287 - DNA, 20 bp, Artificial Sequence
  chemically synthesized
ttctggcaaaaaagtttcat

SEQ ID NO: 38288 - DNA, 20 bp, Artificial Sequence
  chemically synthesized
ctcagtgtcctcagcttcat

SEQ ID NO: 38289 - DNA, 20 bp, Artificial Sequence
  chemically synthesized
cacatccccactccaagttc

SEQ ID NO: 38290 - DNA, 20 bp, Artificial Sequence
  chemically synthesized
aatttcaactctttctctac

SEQ ID NO: 38291 - DNA, 20 bp, Artificial Sequence
  chemically synthesized
atagtcaaaggtattatgta

SEQ ID NO: 38292 - DNA, 20 bp, Artificial Sequence
  chemically synthesized
ctccttgcctctcataagtg

SEQ ID NO: 38293 - DNA, 20 bp, Artificial Sequence
  chemically synthesized
gttctccatactattagaag

SEQ ID NO: 38294 - DNA, 20 bp, Artificial Sequence
  chemically synthesized
agaagtcccaaaaccaatga

SEQ ID NO: 38295 - DNA, 20 bp, Artificial Sequence
  chemically synthesized
gtatgaaaatctgtattagt

SEQ ID NO: 38296 - DNA, 20 bp, Artificial Sequence
  chemically synthesized
atatatgagagagagagaga

SEQ ID NO: 38297 - DNA, 20 bp, Artificial Sequence
  chemically synthesized
tgtatatatgtgtatatata

SEQ ID NO: 38298 - DNA, 20 bp, Artificial Sequence
  chemically synthesized
agtcccacagctgaagaact

SEQ ID NO: 38299 - DNA, 20 bp, Artificial Sequence
  chemically synthesized
gtccgatgttcaagagcagg

SEQ ID NO: 38300 - DNA, 20 bp, Artificial Sequence
  chemically synthesized
ggcagcaggggcaggggcct

SEQ ID NO: 38301 - DNA, 20 bp, Artificial Sequence
  chemically synthesized
aggggcctcagggtgcttgc

SEQ ID NO: 38302 - DNA, 20 bp, Artificial Sequence
  chemically synthesized
acacactggcctcttttcca

SEQ ID NO: 38303 - DNA, 20 bp, Artificial Sequence
  chemically synthesized
atagggtggctggggcacac

SEQ ID NO: 38304 - DNA, 20 bp, Artificial Sequence
  chemically synthesized
tggctggggcacactggggt

SEQ ID NO: 38305 - DNA, 20 bp, Artificial Sequence
  chemically synthesized
tggggtgtgagtaaagcact

SEQ ID NO: 38306 - DNA, 20 bp, Artificial Sequence
  chemically synthesized
agcttcaccccacaaaaaca

SEQ ID NO: 38307 - DNA, 20 bp, Artificial Sequence
  chemically synthesized
cagccagtggaaatgttcaa

SEQ ID NO: 38308 - DNA, 20 bp, Artificial Sequence
  chemically synthesized
gccaggagccttgcctggtg

SEQ ID NO: 38309 - DNA, 20 bp, Artificial Sequence
  chemically synthesized
agctcacaagaaagagaaac

SEQ ID NO: 38310 - DNA, 20 bp, Artificial Sequence
  chemically synthesized
gctgaaatggcagaggggct

SEQ ID NO: 38311 - DNA, 20 bp, Artificial Sequence
  chemically synthesized
gaggggctgtgggttgtctc

SEQ ID NO: 38312 - DNA, 20 bp, Artificial Sequence
  chemically synthesized
ctaaaatgttcaggcagggc

SEQ ID NO: 38313 - DNA, 20 bp, Artificial Sequence
  chemically synthesized
tggctgtgctctgcccagtg

SEQ ID NO: 38314 - DNA, 20 bp, Artificial Sequence
  chemically synthesized
acactgtgctggaggtccgt

SEQ ID NO: 38315 - DNA, 20 bp, Artificial Sequence
  chemically synthesized
tgagcccatactttaatctc

SEQ ID NO: 38316 - DNA, 20 bp, Artificial Sequence
  chemically synthesized
gtggtaaggaagaaagtaca

SEQ ID NO: 38317 - DNA, 20 bp, Artificial Sequence
  chemically synthesized
caatattgcaaatcattatt

SEQ ID NO: 38318 - DNA, 20 bp, Artificial Sequence
  chemically synthesized
ctgtgatacaggtgtttgat

SEQ ID NO: 38319 - DNA, 20 bp, Artificial Sequence
  chemically synthesized
actgcaaccgtgtatctctt

SEQ ID NO: 38320 - DNA, 20 bp, Artificial Sequence
  chemically synthesized
tcatgtctagcatgcaggac

SEQ ID NO: 38321 - DNA, 20 bp, Artificial Sequence
  chemically synthesized
tgcaggacttgggtaatctc

SEQ ID NO: 38322 - DNA, 20 bp, Artificial Sequence
  chemically synthesized
ctaaccataaaatcttaaat

SEQ ID NO: 38323 - DNA, 20 bp, Artificial Sequence
  chemically synthesized
tgacagttgataagcatctt

SEQ ID NO: 38324 - DNA, 20 bp, Artificial Sequence
  chemically synthesized
agttacaaaaatgttggtgc

SEQ ID NO: 38325 - DNA, 20 bp, Artificial Sequence
  chemically synthesized
gttggtgcatggatgatgtt

SEQ ID NO: 38326 - DNA, 20 bp, Artificial Sequence
  chemically synthesized
aattaagcaaaaaaaaaatg

SEQ ID NO: 38327 - DNA, 20 bp, Artificial Sequence
  chemically synthesized
acacaccactattagttggg

SEQ ID NO: 38328 - DNA, 20 bp, Artificial Sequence
  chemically synthesized
ctttctgcctggttgtggca

SEQ ID NO: 38329 - DNA, 20 bp, Artificial Sequence
  chemically synthesized
acaaaatgtagtgattttca

SEQ ID NO: 38330 - DNA, 20 bp, Artificial Sequence
  chemically synthesized
tgaagatagccaagcttcca

SEQ ID NO: 38331 - DNA, 20 bp, Artificial Sequence
  chemically synthesized
ggacaaccttgaccactttg

SEQ ID NO: 38332 - DNA, 20 bp, Artificial Sequence
  chemically synthesized
tggtgggggccacatgcaga

SEQ ID NO: 38333 - DNA, 20 bp, Artificial Sequence
  chemically synthesized
gggggccacatgcagatgga

SEQ ID NO: 38334 - DNA, 20 bp, Artificial Sequence
  chemically synthesized
catgcagatggagtgggtta

SEQ ID NO: 38335 - DNA, 20 bp, Artificial Sequence
  chemically synthesized
agagtgactagaagagcagt

SEQ ID NO: 38336 - DNA, 20 bp, Artificial Sequence
  chemically synthesized
tgaaagcagcgagacttcta

SEQ ID NO: 38337 - DNA, 20 bp, Artificial Sequence
  chemically synthesized
agcgagacttctagggaata

SEQ ID NO: 38338 - DNA, 20 bp, Artificial Sequence
  chemically synthesized
aaggcctgtcctgacctcct

SEQ ID NO: 38339 - DNA, 20 bp, Artificial Sequence
  chemically synthesized
catgagggcagggcaaggag

SEQ ID NO: 38340 - DNA, 20 bp, Artificial Sequence
  chemically synthesized
atatgctctatgctggaaaa

SEQ ID NO: 38341 - DNA, 20 bp, Artificial Sequence
  chemically synthesized
tttgaactctcttttccagg

SEQ ID NO: 38342 - DNA, 20 bp, Artificial Sequence
  chemically synthesized
ttttccaggaagagttgtgc

SEQ ID NO: 38343 - DNA, 20 bp, Artificial Sequence
  chemically synthesized
ttaataaggtgcttcctaca

SEQ ID NO: 38344 - DNA, 20 bp, Artificial Sequence
  chemically synthesized
gagttcagttaaacattttg

SEQ ID NO: 38345 - DNA, 20 bp, Artificial Sequence
  chemically synthesized
tgctaggaaatatcccaaaa

SEQ ID NO: 38346 - DNA, 20 bp, Artificial Sequence
  chemically synthesized
tccagggctcatatggcaat

SEQ ID NO: 38347 - DNA, 20 bp, Artificial Sequence
  chemically synthesized
atatggcaatggggatttaa

SEQ ID NO: 38348 - DNA, 20 bp, Artificial Sequence
  chemically synthesized
atgtattttattaatggtgt

SEQ ID NO: 38349 - DNA, 20 bp, Artificial Sequence
  chemically synthesized
tttcttcctcactgtggtgt

SEQ ID NO: 38350 - DNA, 20 bp, Artificial Sequence
  chemically synthesized
tgtaaaagacttagcaattt

SEQ ID NO: 38351 - DNA, 20 bp, Artificial Sequence
  chemically synthesized
ctttccaaaagagcttatca

SEQ ID NO: 38352 - DNA, 20 bp, Artificial Sequence
  chemically synthesized
agagaagtttgttctagcct

SEQ ID NO: 38353 - DNA, 20 bp, Artificial Sequence
  chemically synthesized
tagcctttgggtgtagcctg

SEQ ID NO: 38354 - DNA, 20 bp, Artificial Sequence
  chemically synthesized
ctagtttccatgggctgaaa

SEQ ID NO: 38355 - DNA, 20 bp, Artificial Sequence
  chemically synthesized
gtattttctttgatattttc

SEQ ID NO: 38356 - DNA, 20 bp, Artificial Sequence
  chemically synthesized
tgtgcttcaagatggaactc

SEQ ID NO: 38357 - DNA, 20 bp, Artificial Sequence
  chemically synthesized
ggcaactgctcaactacctg

SEQ ID NO: 38358 - DNA, 20 bp, Artificial Sequence
  chemically synthesized
gcccaagctagcatggaccc

SEQ ID NO: 38359 - DNA, 20 bp, Artificial Sequence
  chemically synthesized
ccagacttctctcttcttaa

SEQ ID NO: 38360 - DNA, 20 bp, Artificial Sequence
  chemically synthesized
aacctgctcttcagttacat

SEQ ID NO: 38361 - DNA, 20 bp, Artificial Sequence
  chemically synthesized
tttctttatttccttgattt

SEQ ID NO: 38362 - DNA, 20 bp, Artificial Sequence
  chemically synthesized
gatttctttgtttataaaat

SEQ ID NO: 38363 - DNA, 20 bp, Artificial Sequence
  chemically synthesized
taacccactcaacaaatacc

SEQ ID NO: 38364 - DNA, 20 bp, Artificial Sequence
  chemically synthesized
acaaataccctgagtatttg

SEQ ID NO: 38365 - DNA, 20 bp, Artificial Sequence
  chemically synthesized
atgcgtatatcatctggcaa

SEQ ID NO: 38366 - DNA, 20 bp, Artificial Sequence
  chemically synthesized
tggatgtgtataatttctcc

SEQ ID NO: 38367 - DNA, 20 bp, Artificial Sequence
  chemically synthesized
ccataacaaagagagaaatg

SEQ ID NO: 38368 - DNA, 20 bp, Artificial Sequence
  chemically synthesized
caaggaaccaaacatattca

SEQ ID NO: 38369 - DNA, 20 bp, Artificial Sequence
  chemically synthesized
gaaattaaacttattttttt

SEQ ID NO: 38370 - DNA, 20 bp, Artificial Sequence
  chemically synthesized
catatacaagattttgaact

SEQ ID NO: 38371 - DNA, 20 bp, Artificial Sequence
  chemically synthesized
gattttgaactgggaatttc

SEQ ID NO: 38372 - DNA, 20 bp, Artificial Sequence
  chemically synthesized
tttcatgaatcaaaaattaa

SEQ ID NO: 38373 - DNA, 20 bp, Artificial Sequence
  chemically synthesized
aggacattgttgacttacat

SEQ ID NO: 38374 - DNA, 20 bp, Artificial Sequence
  chemically synthesized
gacccatgccactggctcag

SEQ ID NO: 38375 - DNA, 20 bp, Artificial Sequence
  chemically synthesized
agcagggttcaaacattacc

SEQ ID NO: 38376 - DNA, 20 bp, Artificial Sequence
  chemically synthesized
ttcaaacattaccttgaata

SEQ ID NO: 38377 - DNA, 20 bp, Artificial Sequence
  chemically synthesized
tagagtcttataaaatattt

SEQ ID NO: 38378 - DNA, 20 bp, Artificial Sequence
  chemically synthesized
cttctttcattctctttctt

SEQ ID NO: 38379 - DNA, 20 bp, Artificial Sequence
  chemically synthesized
ccgaggttgtgtcgctaccc

SEQ ID NO: 38380 - DNA, 20 bp, Artificial Sequence
  chemically synthesized
agatatcaatccttccagga

SEQ ID NO: 38381 - DNA, 20 bp, Artificial Sequence
  chemically synthesized
attttgggaggccacggcag

SEQ ID NO: 38382 - DNA, 20 bp, Artificial Sequence
  chemically synthesized
cagatggatcacctgaggcc

SEQ ID NO: 38383 - DNA, 20 bp, Artificial Sequence
  chemically synthesized
acaaaaaatacaaaaattag

SEQ ID NO: 38384 - DNA, 20 bp, Artificial Sequence
  chemically synthesized
tactaagtaggctgaggcac

SEQ ID NO: 38385 - DNA, 20 bp, Artificial Sequence
  chemically synthesized
gatggaggttgcagtgagcc

SEQ ID NO: 38386 - DNA, 20 bp, Artificial Sequence
  chemically synthesized
atgtgccactgcactccagc

SEQ ID NO: 38387 - DNA, 20 bp, Artificial Sequence
  chemically synthesized
tccagcctgggtgacagagc

SEQ ID NO: 38388 - DNA, 20 bp, Artificial Sequence
  chemically synthesized
atatttttaaaaataaaaca

SEQ ID NO: 38389 - DNA, 20 bp, Artificial Sequence
  chemically synthesized
tttaaaaataaaacataggg

SEQ ID NO: 38390 - DNA, 20 bp, Artificial Sequence
  chemically synthesized
actttgggaggccaagacag

SEQ ID NO: 38391 - DNA, 20 bp, Artificial Sequence
  chemically synthesized
gacaggtggatcacaaggtc

SEQ ID NO: 38392 - DNA, 20 bp, Artificial Sequence
  chemically synthesized
atcccagctactagggaggc

SEQ ID NO: 38393 - DNA, 20 bp, Artificial Sequence
  chemically synthesized
tcacgtcagtgcacttcaac

SEQ ID NO: 38394 - DNA, 20 bp, Artificial Sequence
  chemically synthesized
cagtgcacttcaaccggggt

SEQ ID NO: 38395 - DNA, 20 bp, Artificial Sequence
  chemically synthesized
tagtatcaatctttccgcaa

SEQ ID NO: 38396 - DNA, 20 bp, Artificial Sequence
  chemically synthesized
tcgttctcatgaagtaaagc

SEQ ID NO: 38397 - DNA, 20 bp, Artificial Sequence
  chemically synthesized
atgaagtaaagcaagagtgg

SEQ ID NO: 38398 - DNA, 20 bp, Artificial Sequence
  chemically synthesized
gagtggtagaattaagtgga

SEQ ID NO: 38399 - DNA, 20 bp, Artificial Sequence
  chemically synthesized
tggccaccgggacaccccag

SEQ ID NO: 38400 - DNA, 20 bp, Artificial Sequence
  chemically synthesized
caccgggacaccccaggagg

SEQ ID NO: 38401 - DNA, 20 bp, Artificial Sequence
  chemically synthesized
tcaagccccaagaagtcccc

SEQ ID NO: 38402 - DNA, 20 bp, Artificial Sequence
  chemically synthesized
aagaagtccccttggatgat

SEQ ID NO: 38403 - DNA, 20 bp, Artificial Sequence
  chemically synthesized
atacatttgggacagatcta

SEQ ID NO: 38404 - DNA, 20 bp, Artificial Sequence
  chemically synthesized
tttctgagcaacacttagac

SEQ ID NO: 38405 - DNA, 20 bp, Artificial Sequence
  chemically synthesized
ttccattgattaaatcctac

SEQ ID NO: 38406 - DNA, 20 bp, Artificial Sequence
  chemically synthesized
aatgcccagcacagagctca

SEQ ID NO: 38407 - DNA, 20 bp, Artificial Sequence
  chemically synthesized
gccagactctctgaaccctg

SEQ ID NO: 38408 - DNA, 20 bp, Artificial Sequence
  chemically synthesized
ggagagtgtaaacgtcatat

SEQ ID NO: 38409 - DNA, 20 bp, Artificial Sequence
  chemically synthesized
agagtctatgttccaaaaac

SEQ ID NO: 38410 - DNA, 20 bp, Artificial Sequence
  chemically synthesized
tctttgcttttaaaaccata

SEQ ID NO: 38411 - DNA, 20 bp, Artificial Sequence
  chemically synthesized
taaagaataatgtttaaatg

SEQ ID NO: 38412 - DNA, 20 bp, Artificial Sequence
  chemically synthesized
ttttcactcaacattacata

SEQ ID NO: 38413 - DNA, 20 bp, Artificial Sequence
  chemically synthesized
atgagcatgaggtttccttt

SEQ ID NO: 38414 - DNA, 20 bp, Artificial Sequence
  chemically synthesized
gatgatggttgcacaccact

SEQ ID NO: 38415 - DNA, 20 bp, Artificial Sequence
  chemically synthesized
tacattttattgcaataaaa

SEQ ID NO: 38416 - DNA, 20 bp, Artificial Sequence
  chemically synthesized
ttgtctagttcaacctgagc

SEQ ID NO: 38417 - DNA, 20 bp, Artificial Sequence
  chemically synthesized
tcaacctgagcctgggtctg

SEQ ID NO: 38418 - DNA, 20 bp, Artificial Sequence
  chemically synthesized
aatcacttcaccacacttgt

SEQ ID NO: 38419 - DNA, 20 bp, Artificial Sequence
  chemically synthesized
atacttctttgacaatttgg

SEQ ID NO: 38420 - DNA, 20 bp, Artificial Sequence
  chemically synthesized
ttttccagatggacacaccc

SEQ ID NO: 38421 - DNA, 20 bp, Artificial Sequence
  chemically synthesized
tttgcaagcccagctttcat

SEQ ID NO: 38422 - DNA, 20 bp, Artificial Sequence
  chemically synthesized
ttcagaaacctgactgcatc

SEQ ID NO: 38423 - DNA, 20 bp, Artificial Sequence
  chemically synthesized
tgactaccaagcatcgggca

SEQ ID NO: 38424 - DNA, 20 bp, Artificial Sequence
  chemically synthesized
tgtgagggagcaccgttctc

SEQ ID NO: 38425 - DNA, 20 bp, Artificial Sequence
  chemically synthesized
caggaaagttgatgtggtct

SEQ ID NO: 38426 - DNA, 20 bp, Artificial Sequence
  chemically synthesized
aggtaggccacaggtgacaa

SEQ ID NO: 38427 - DNA, 20 bp, Artificial Sequence
  chemically synthesized
gggccttggggagagggcag

SEQ ID NO: 38428 - DNA, 20 bp, Artificial Sequence
  chemically synthesized
cagcagggtaagtccagcgg

SEQ ID NO: 38429 - DNA, 20 bp, Artificial Sequence
  chemically synthesized
gcaggatcagtccattgatt

SEQ ID NO: 38430 - DNA, 20 bp, Artificial Sequence
  chemically synthesized
tagaaaattgatgaacaggc

SEQ ID NO: 38431 - DNA, 20 bp, Artificial Sequence
  chemically synthesized
catggtctagttagtgttct

SEQ ID NO: 38432 - DNA, 20 bp, Artificial Sequence
  chemically synthesized
ggcgaggcagaagcctagtg

SEQ ID NO: 38433 - DNA, 20 bp, Artificial Sequence
  chemically synthesized
gggatggtggttagaaatgt

SEQ ID NO: 38434 - DNA, 20 bp, Artificial Sequence
  chemically synthesized
ggtaataattgtgatggtgg

SEQ ID NO: 38435 - DNA, 20 bp, Artificial Sequence
  chemically synthesized
gaatgatgatgatggtggtg

SEQ ID NO: 38436 - DNA, 20 bp, Artificial Sequence
  chemically synthesized
gatgataatggtgatggtgg

SEQ ID NO: 38437 - DNA, 20 bp, Artificial Sequence
  chemically synthesized
atggtggtggtgatgatgtt

SEQ ID NO: 38438 - DNA, 20 bp, Artificial Sequence
  chemically synthesized
ggtaatgataatggtgatgg

SEQ ID NO: 38439 - DNA, 20 bp, Artificial Sequence
  chemically synthesized
tggaatgatggtgatggtgg

SEQ ID NO: 38440 - DNA, 20 bp, Artificial Sequence
  chemically synthesized
gtggaatgatgatggtggtg

SEQ ID NO: 38441 - DNA, 20 bp, Artificial Sequence
  chemically synthesized
gtgatgatggtgatgatgtt

SEQ ID NO: 38442 - DNA, 20 bp, Artificial Sequence
  chemically synthesized
gtttccaggtgttccctgac

SEQ ID NO: 38443 - DNA, 20 bp, Artificial Sequence
  chemically synthesized
tccctgacttggatcaaatg

SEQ ID NO: 38444 - DNA, 20 bp, Artificial Sequence
  chemically synthesized
tttggaggtgttgaggccaa

SEQ ID NO: 38445 - DNA, 20 bp, Artificial Sequence
  chemically synthesized
tgacatctctatgtcggcca

SEQ ID NO: 38446 - DNA, 20 bp, Artificial Sequence
  chemically synthesized
cggtaggttttcaccattat

SEQ ID NO: 38447 - DNA, 20 bp, Artificial Sequence
  chemically synthesized
gattgagctgagctggcctc

SEQ ID NO: 38448 - DNA, 20 bp, Artificial Sequence
  chemically synthesized
aggctctgggggaagaaaga

SEQ ID NO: 38449 - DNA, 20 bp, Artificial Sequence
  chemically synthesized
ctgtgccatgctcgcaaagc

SEQ ID NO: 38450 - DNA, 20 bp, Artificial Sequence
  chemically synthesized
gggcttgcaaaattagaaaa

SEQ ID NO: 38451 - DNA, 20 bp, Artificial Sequence
  chemically synthesized
gtgagaacactgaaacatcc

SEQ ID NO: 38452 - DNA, 20 bp, Artificial Sequence
  chemically synthesized
caattttgcaaccgttctat

SEQ ID NO: 38453 - DNA, 20 bp, Artificial Sequence
  chemically synthesized
aataaagcagtttttcacaa

SEQ ID NO: 38454 - DNA, 20 bp, Artificial Sequence
  chemically synthesized
aaaagaataaacacaaccag

SEQ ID NO: 38455 - DNA, 20 bp, Artificial Sequence
  chemically synthesized
aaagaagtataaattagaaa

SEQ ID NO: 38456 - DNA, 20 bp, Artificial Sequence
  chemically synthesized
cttaggctcagaaaatatta

SEQ ID NO: 38457 - DNA, 20 bp, Artificial Sequence
  chemically synthesized
ctcagaaaatattaaggaat

SEQ ID NO: 38458 - DNA, 20 bp, Artificial Sequence
  chemically synthesized
actttatgaacaaagatgtg

SEQ ID NO: 38459 - DNA, 20 bp, Artificial Sequence
  chemically synthesized
agtttccttaactgtagagc

SEQ ID NO: 38460 - DNA, 20 bp, Artificial Sequence
  chemically synthesized
ctgtttcataggactgttgt

SEQ ID NO: 38461 - DNA, 20 bp, Artificial Sequence
  chemically synthesized
attataagcttgtgcctgga

SEQ ID NO: 38462 - DNA, 20 bp, Artificial Sequence
  chemically synthesized
caataaaatgtacacagcgt

SEQ ID NO: 38463 - DNA, 20 bp, Artificial Sequence
  chemically synthesized
tactattttaaccatttttg

SEQ ID NO: 38464 - DNA, 20 bp, Artificial Sequence
  chemically synthesized
tgcaaccatcatcatatttc

SEQ ID NO: 38465 - DNA, 20 bp, Artificial Sequence
  chemically synthesized
acaaaactcattatgtaatg

SEQ ID NO: 38466 - DNA, 20 bp, Artificial Sequence
  chemically synthesized
gtaatgttgagtgaaaaaat

SEQ ID NO: 38467 - DNA, 20 bp, Artificial Sequence
  chemically synthesized
tatatgacgtttacactctc

SEQ ID NO: 38468 - DNA, 20 bp, Artificial Sequence
  chemically synthesized
tttacactctccagggttca

SEQ ID NO: 38469 - DNA, 20 bp, Artificial Sequence
  chemically synthesized
tcaccactgctctgttcttc

SEQ ID NO: 38470 - DNA, 20 bp, Artificial Sequence
  chemically synthesized
aagcccagctccctgtgatt

SEQ ID NO: 38471 - DNA, 20 bp, Artificial Sequence
  chemically synthesized
gaatgaagtgtgcaatcgct

SEQ ID NO: 38472 - DNA, 20 bp, Artificial Sequence
  chemically synthesized
tgtgcaatcgctatgagttt

SEQ ID NO: 38473 - DNA, 20 bp, Artificial Sequence
  chemically synthesized
cgctatgagtttctgaatgg

SEQ ID NO: 38474 - DNA, 20 bp, Artificial Sequence
  chemically synthesized
tcagtctcagtcccttagac

SEQ ID NO: 38475 - DNA, 20 bp, Artificial Sequence
  chemically synthesized
tagacttgagtcccaaagta

SEQ ID NO: 38476 - DNA, 20 bp, Artificial Sequence
  chemically synthesized
cccaaagtagcgaattcaag

SEQ ID NO: 38477 - DNA, 20 bp, Artificial Sequence
  chemically synthesized
ccaaggggacttcttggggc

SEQ ID NO: 38478 - DNA, 20 bp, Artificial Sequence
  chemically synthesized
cctcagaccactcaccctcc

SEQ ID NO: 38479 - DNA, 20 bp, Artificial Sequence
  chemically synthesized
ttctggtagggaaggaggta

SEQ ID NO: 38480 - DNA, 20 bp, Artificial Sequence
  chemically synthesized
gctcagatattgctgatgat

SEQ ID NO: 38481 - DNA, 20 bp, Artificial Sequence
  chemically synthesized
aattgatttacaactggggc

SEQ ID NO: 38482 - DNA, 20 bp, Artificial Sequence
  chemically synthesized
cgaaaatgtaagattgcacc

SEQ ID NO: 38483 - DNA, 20 bp, Artificial Sequence
  chemically synthesized
ctcactgcaacttccacctc

SEQ ID NO: 38484 - DNA, 20 bp, Artificial Sequence
  chemically synthesized
cttccacctcctgggttcaa

SEQ ID NO: 38485 - DNA, 20 bp, Artificial Sequence
  chemically synthesized
actccagcctccctagtagc

SEQ ID NO: 38486 - DNA, 20 bp, Artificial Sequence
  chemically synthesized
ttttgtatttttagtagaga

SEQ ID NO: 38487 - DNA, 20 bp, Artificial Sequence
  chemically synthesized
gtcttggcctcccaaagtgc

SEQ ID NO: 38488 - DNA, 20 bp, Artificial Sequence
  chemically synthesized
ctcccaaagtgctgggatta

SEQ ID NO: 38489 - DNA, 20 bp, Artificial Sequence
  chemically synthesized
tttatttaagccacaactac

SEQ ID NO: 38490 - DNA, 20 bp, Artificial Sequence
  chemically synthesized
gccacaactactagaatagg

SEQ ID NO: 38491 - DNA, 20 bp, Artificial Sequence
  chemically synthesized
tcttgctctgtcacccaggc

SEQ ID NO: 38492 - DNA, 20 bp, Artificial Sequence
  chemically synthesized
gcctcagcctacttagtagc

SEQ ID NO: 38493 - DNA, 20 bp, Artificial Sequence
  chemically synthesized
ttttgtattttttgtagaga

SEQ ID NO: 38494 - DNA, 20 bp, Artificial Sequence
  chemically synthesized
gccgtggcctcccaaaatgc

SEQ ID NO: 38495 - DNA, 20 bp, Artificial Sequence
  chemically synthesized
gagccaccaccccctcctgg

SEQ ID NO: 38496 - DNA, 20 bp, Artificial Sequence
  chemically synthesized
tttataattacagaaaacat

SEQ ID NO: 38497 - DNA, 20 bp, Artificial Sequence
  chemically synthesized
agaaaacatgtgagttcact

SEQ ID NO: 38498 - DNA, 20 bp, Artificial Sequence
  chemically synthesized
catttcggcacagtttggta

SEQ ID NO: 38499 - DNA, 20 bp, Artificial Sequence
  chemically synthesized
gctcgtaaactaagacctga

SEQ ID NO: 38500 - DNA, 20 bp, Artificial Sequence
  chemically synthesized
tgtgtctatcagctgcaccc

SEQ ID NO: 38501 - DNA, 20 bp, Artificial Sequence
  chemically synthesized
tggaaagcttgagggaggct

SEQ ID NO: 38502 - DNA, 20 bp, Artificial Sequence
  chemically synthesized
tggatgtgcagcacttggca

SEQ ID NO: 38503 - DNA, 20 bp, Artificial Sequence
  chemically synthesized
tttattttatccaaaagaaa

SEQ ID NO: 38504 - DNA, 20 bp, Artificial Sequence
  chemically synthesized
atcaggaaagatgaaggtct

SEQ ID NO: 38505 - DNA, 20 bp, Artificial Sequence
  chemically synthesized
gaaggtctaggggtgaggga

SEQ ID NO: 38506 - DNA, 20 bp, Artificial Sequence
  chemically synthesized
aaccctgctgagccagtggc

SEQ ID NO: 38507 - DNA, 20 bp, Artificial Sequence
  chemically synthesized
ccagtggcatgggtctctga

SEQ ID NO: 38508 - DNA, 20 bp, Artificial Sequence
  chemically synthesized
ttaatttgactatctggttt

SEQ ID NO: 38509 - DNA, 20 bp, Artificial Sequence
  chemically synthesized
catgtaagtcaacaatgtcc

SEQ ID NO: 38510 - DNA, 20 bp, Artificial Sequence
  chemically synthesized
acatagtttttttaaattat

SEQ ID NO: 38511 - DNA, 20 bp, Artificial Sequence
  chemically synthesized
cgtgaagactgtcacggtgc

SEQ ID NO: 38512 - DNA, 20 bp, Artificial Sequence
  chemically synthesized
aagactgtcacggtgctgga

SEQ ID NO: 38513 - DNA, 20 bp, Artificial Sequence
  chemically synthesized
ggttgatttttctaatctaa

SEQ ID NO: 38514 - DNA, 20 bp, Artificial Sequence
  chemically synthesized
ccattgtagctaactatgca

SEQ ID NO: 38515 - DNA, 20 bp, Artificial Sequence
  chemically synthesized
tgaaacaatgaaataactct

SEQ ID NO: 38516 - DNA, 20 bp, Artificial Sequence
  chemically synthesized
ttggttccttgacctgttca

SEQ ID NO: 38517 - DNA, 20 bp, Artificial Sequence
  chemically synthesized
atttctctctttgttatggc

SEQ ID NO: 38518 - DNA, 20 bp, Artificial Sequence
  chemically synthesized
ataatgattcaacaaatact

SEQ ID NO: 38519 - DNA, 20 bp, Artificial Sequence
  chemically synthesized
acaaatactcagggtatttg

SEQ ID NO: 38520 - DNA, 20 bp, Artificial Sequence
  chemically synthesized
atactcagggtatttgttga

SEQ ID NO: 38521 - DNA, 20 bp, Artificial Sequence
  chemically synthesized
catacacaccgtgtgtgatt

SEQ ID NO: 38522 - DNA, 20 bp, Artificial Sequence
  chemically synthesized
tatttagctcatggtatagg

SEQ ID NO: 38523 - DNA, 20 bp, Artificial Sequence
  chemically synthesized
aatcaaggaaataaagaaac

SEQ ID NO: 38524 - DNA, 20 bp, Artificial Sequence
  chemically synthesized
ggttaattgtttgccacttg

SEQ ID NO: 38525 - DNA, 20 bp, Artificial Sequence
  chemically synthesized
aggcaacagaggaggcgagc

SEQ ID NO: 38526 - DNA, 20 bp, Artificial Sequence
  chemically synthesized
gaggaggcgagcaaggattc

SEQ ID NO: 38527 - DNA, 20 bp, Artificial Sequence
  chemically synthesized
cctgctggtgcctttgtgag

SEQ ID NO: 38528 - DNA, 20 bp, Artificial Sequence
  chemically synthesized
tcccttgaggcaaatctctg

SEQ ID NO: 38529 - DNA, 20 bp, Artificial Sequence
  chemically synthesized
gaggcaaatctctggagggt

SEQ ID NO: 38530 - DNA, 20 bp, Artificial Sequence
  chemically synthesized
tataaatcacctgtgaactc

SEQ ID NO: 38531 - DNA, 20 bp, Artificial Sequence
  chemically synthesized
agatgaacttgccctgcagg

SEQ ID NO: 38532 - DNA, 20 bp, Artificial Sequence
  chemically synthesized
gactttaaagtcaaacacat

SEQ ID NO: 38533 - DNA, 20 bp, Artificial Sequence
  chemically synthesized
gagcaggagaagattaagca

SEQ ID NO: 38534 - DNA, 20 bp, Artificial Sequence
  chemically synthesized
tgtctatgtctgtgtgtgta

SEQ ID NO: 38535 - DNA, 20 bp, Artificial Sequence
  chemically synthesized
ctgtgtgtgtagggagtgca

SEQ ID NO: 38536 - DNA, 20 bp, Artificial Sequence
  chemically synthesized
gtgtagggagtgcaggggat

SEQ ID NO: 38537 - DNA, 20 bp, Artificial Sequence
  chemically synthesized
ctatttcagcccatggaaac

SEQ ID NO: 38538 - DNA, 20 bp, Artificial Sequence
  chemically synthesized
tagaacaaacttctctgcca

SEQ ID NO: 38539 - DNA, 20 bp, Artificial Sequence
  chemically synthesized
gttatctttccaatgtgtgc

SEQ ID NO: 38540 - DNA, 20 bp, Artificial Sequence
  chemically synthesized
ttgccatatgagccctggag

SEQ ID NO: 38541 - DNA, 20 bp, Artificial Sequence
  chemically synthesized
gaggtgaatcagagaaacaa

SEQ ID NO: 38542 - DNA, 20 bp, Artificial Sequence
  chemically synthesized
aagaaaaattgattctgttt

SEQ ID NO: 38543 - DNA, 20 bp, Artificial Sequence
  chemically synthesized
ctagcaacatgagctgggga

SEQ ID NO: 38544 - DNA, 20 bp, Artificial Sequence
  chemically synthesized
taaatggaagtttcctcttt

SEQ ID NO: 38545 - DNA, 20 bp, Artificial Sequence
  chemically synthesized
tgaagtcacactgtgagcta

SEQ ID NO: 38546 - DNA, 20 bp, Artificial Sequence
  chemically synthesized
gcacaactcttcctggaaaa

SEQ ID NO: 38547 - DNA, 20 bp, Artificial Sequence
  chemically synthesized
agttcaaatgagaaacagtg

SEQ ID NO: 38548 - DNA, 20 bp, Artificial Sequence
  chemically synthesized
aaacagtgcggggtgaagac

SEQ ID NO: 38549 - DNA, 20 bp, Artificial Sequence
  chemically synthesized
tatctatcaagtgcttttta

SEQ ID NO: 38550 - DNA, 20 bp, Artificial Sequence
  chemically synthesized
gctttttagtggattaggtt

SEQ ID NO: 38551 - DNA, 20 bp, Artificial Sequence
  chemically synthesized
aggtcaggacaggcctttct

SEQ ID NO: 38552 - DNA, 20 bp, Artificial Sequence
  chemically synthesized
ggacaggcctttctgagaat

SEQ ID NO: 38553 - DNA, 20 bp, Artificial Sequence
  chemically synthesized
tctgttcatctgcctttcta

SEQ ID NO: 38554 - DNA, 20 bp, Artificial Sequence
  chemically synthesized
tcctaaggagcctcaggaca

SEQ ID NO: 38555 - DNA, 20 bp, Artificial Sequence
  chemically synthesized
tttacaatttcctctgaaat

SEQ ID NO: 38556 - DNA, 20 bp, Artificial Sequence
  chemically synthesized
ctatcaacaccttggaaaaa

SEQ ID NO: 38557 - DNA, 20 bp, Artificial Sequence
  chemically synthesized
tccaaggttcatttctacac

SEQ ID NO: 38558 - DNA, 20 bp, Artificial Sequence
  chemically synthesized
caggaggtggaagcccctga

SEQ ID NO: 38559 - DNA, 20 bp, Artificial Sequence
  chemically synthesized
cctgagagaatggaggtctg

SEQ ID NO: 38560 - DNA, 20 bp, Artificial Sequence
  chemically synthesized
ccaagtcctgcatgctagac

SEQ ID NO: 38561 - DNA, 20 bp, Artificial Sequence
  chemically synthesized
ctagacatgagtggaggagg

SEQ ID NO: 38562 - DNA, 20 bp, Artificial Sequence
  chemically synthesized
gggggaatacctaggtagaa

SEQ ID NO: 38563 - DNA, 20 bp, Artificial Sequence
  chemically synthesized
tcactgtgcagttaactttt

SEQ ID NO: 38564 - DNA, 20 bp, Artificial Sequence
  chemically synthesized
cggttgcagttagtatacat

SEQ ID NO: 38565 - DNA, 20 bp, Artificial Sequence
  chemically synthesized
tgagtgctatacaaccttct

SEQ ID NO: 38566 - DNA, 20 bp, Artificial Sequence
  chemically synthesized
gaagcaatgcagccattacg

SEQ ID NO: 38567 - DNA, 20 bp, Artificial Sequence
  chemically synthesized
taaaaagtatttctttaggt

SEQ ID NO: 38568 - DNA, 20 bp, Artificial Sequence
  chemically synthesized
ctacgcattgacttatcttc

SEQ ID NO: 38569 - DNA, 20 bp, Artificial Sequence
  chemically synthesized
cctccagcacacagcaggga

SEQ ID NO: 38570 - DNA, 20 bp, Artificial Sequence
  chemically synthesized
ggctgcactctgtgtttttg

SEQ ID NO: 38571 - DNA, 20 bp, Artificial Sequence
  chemically synthesized
ctagggaaggaaaaaagatc

SEQ ID NO: 38572 - DNA, 20 bp, Artificial Sequence
  chemically synthesized
ctgcccccaagctgtagagc

SEQ ID NO: 38573 - DNA, 20 bp, Artificial Sequence
  chemically synthesized
gcctacatctttctcctgtg

SEQ ID NO: 38574 - DNA, 20 bp, Artificial Sequence
  chemically synthesized
ttatgggaccttgtaatctt

SEQ ID NO: 38575 - DNA, 20 bp, Artificial Sequence
  chemically synthesized
cttaataagctcccctttgt

SEQ ID NO: 38576 - DNA, 20 bp, Artificial Sequence
  chemically synthesized
cagaagtggttcttgaggaa

SEQ ID NO: 38577 - DNA, 20 bp, Artificial Sequence
  chemically synthesized
ttcttgaggaacagaatatt

SEQ ID NO: 38578 - DNA, 20 bp, Artificial Sequence
  chemically synthesized
gaggaacagaatattaagga

SEQ ID NO: 38579 - DNA, 20 bp, Artificial Sequence
  chemically synthesized
gaacactgatagtacttggc

SEQ ID NO: 38580 - DNA, 20 bp, Artificial Sequence
  chemically synthesized
tacttggcctgaattgttta

SEQ ID NO: 38581 - DNA, 20 bp, Artificial Sequence
  chemically synthesized
ttcatcacttatgagaggca

SEQ ID NO: 38582 - DNA, 20 bp, Artificial Sequence
  chemically synthesized
gaaagaaaatgatgatctca

SEQ ID NO: 38583 - DNA, 20 bp, Artificial Sequence
  chemically synthesized
acaaatctgctaagattgcc

SEQ ID NO: 38584 - DNA, 20 bp, Artificial Sequence
  chemically synthesized
ctgctaagattgccctgaat

SEQ ID NO: 38585 - DNA, 20 bp, Artificial Sequence
  chemically synthesized
agttttaactcctgtagaga

SEQ ID NO: 38586 - DNA, 20 bp, Artificial Sequence
  chemically synthesized
cagagacaagctgttatcat

SEQ ID NO: 38587 - DNA, 20 bp, Artificial Sequence
  chemically synthesized
aaaaatgggaccctggaact

SEQ ID NO: 38588 - DNA, 20 bp, Artificial Sequence
  chemically synthesized
gggaccctggaacttggagt

SEQ ID NO: 38589 - DNA, 20 bp, Artificial Sequence
  chemically synthesized
ccctgatgaagctgaggaca

SEQ ID NO: 38590 - DNA, 20 bp, Artificial Sequence
  chemically synthesized
tagcctttccacctttgtct

SEQ ID NO: 38591 - DNA, 20 bp, Artificial Sequence
  chemically synthesized
aagaggcacccctaatgccc

SEQ ID NO: 38592 - DNA, 20 bp, Artificial Sequence
  chemically synthesized
cgggccccagaggtgaggtt

SEQ ID NO: 38593 - DNA, 20 bp, Artificial Sequence
  chemically synthesized
gaaatctggagaacaggcat

SEQ ID NO: 38594 - DNA, 20 bp, Artificial Sequence
  chemically synthesized
tctggagaacaggcatggga

SEQ ID NO: 38595 - DNA, 20 bp, Artificial Sequence
  chemically synthesized
caggcatgggaatggatatt

SEQ ID NO: 38596 - DNA, 20 bp, Artificial Sequence
  chemically synthesized
gggaatggatattaagggta

SEQ ID NO: 38597 - DNA, 20 bp, Artificial Sequence
  chemically synthesized
ggataatggtggaagggaca

SEQ ID NO: 38598 - DNA, 20 bp, Artificial Sequence
  chemically synthesized
atggtggaagggacatagag

SEQ ID NO: 38599 - DNA, 20 bp, Artificial Sequence
  chemically synthesized
ggacatagagttggatcaag

SEQ ID NO: 38600 - DNA, 20 bp, Artificial Sequence
  chemically synthesized
ttggtttggccctactaagt

SEQ ID NO: 38601 - DNA, 20 bp, Artificial Sequence
  chemically synthesized
tttgcttggttagctgaaat

SEQ ID NO: 38602 - DNA, 20 bp, Artificial Sequence
  chemically synthesized
atccaaaggcttagggagat

SEQ ID NO: 38603 - DNA, 20 bp, Artificial Sequence
  chemically synthesized
gcttagggagattaggatgg

SEQ ID NO: 38604 - DNA, 20 bp, Artificial Sequence
  chemically synthesized
agggagattaggatggtgga

SEQ ID NO: 38605 - DNA, 20 bp, Artificial Sequence
  chemically synthesized
gacctactcatcccagctgg

SEQ ID NO: 38606 - DNA, 20 bp, Artificial Sequence
  chemically synthesized
ctacaaaatttaaatacaat

SEQ ID NO: 38607 - DNA, 20 bp, Artificial Sequence
  chemically synthesized
tttaaatacaatgggaataa

SEQ ID NO: 38608 - DNA, 20 bp, Artificial Sequence
  chemically synthesized
agcagaggcaaagcagccat

SEQ ID NO: 38609 - DNA, 20 bp, Artificial Sequence
  chemically synthesized
ataaacaaaaaactgccagg

SEQ ID NO: 38610 - DNA, 20 bp, Artificial Sequence
  chemically synthesized
agaatggactaaagactaat

SEQ ID NO: 38611 - DNA, 20 bp, Artificial Sequence
  chemically synthesized
taatctgaattataaaaaca

SEQ ID NO: 38612 - DNA, 20 bp, Artificial Sequence
  chemically synthesized
tgttacagttccagaaccca

SEQ ID NO: 38613 - DNA, 20 bp, Artificial Sequence
  chemically synthesized
cccactgaatgaaggggagg

SEQ ID NO: 38614 - DNA, 20 bp, Artificial Sequence
  chemically synthesized
ggagacctctggccttttac

SEQ ID NO: 38615 - DNA, 20 bp, Artificial Sequence
  chemically synthesized
ctctgagctgacgttgattc

SEQ ID NO: 38616 - DNA, 20 bp, Artificial Sequence
  chemically synthesized
tatggaggttaggtaattaa

SEQ ID NO: 38617 - DNA, 20 bp, Artificial Sequence
  chemically synthesized
tctgacttacagtggttcca

SEQ ID NO: 38618 - DNA, 20 bp, Artificial Sequence
  chemically synthesized
cacattggctccctgactgg

SEQ ID NO: 38619 - DNA, 20 bp, Artificial Sequence
  chemically synthesized
atcaaggacttgaaagacgc

SEQ ID NO: 38620 - DNA, 20 bp, Artificial Sequence
  chemically synthesized
ttgacctgtgcagaggacag

SEQ ID NO: 38621 - DNA, 20 bp, Artificial Sequence
  chemically synthesized
atggatcttggaaaatgatg

SEQ ID NO: 38622 - DNA, 20 bp, Artificial Sequence
  chemically synthesized
tacctttaccaccctacctc

SEQ ID NO: 38623 - DNA, 20 bp, Artificial Sequence
  chemically synthesized
cattcatgacattatgatga

SEQ ID NO: 38624 - DNA, 20 bp, Artificial Sequence
  chemically synthesized
ggtgagacatttgtatgcca

SEQ ID NO: 38625 - DNA, 20 bp, Artificial Sequence
  chemically synthesized
ttctacctcggtaaaatttc

SEQ ID NO: 38626 - DNA, 20 bp, Artificial Sequence
  chemically synthesized
acaatgcctggtgggcctat

SEQ ID NO: 38627 - DNA, 20 bp, Artificial Sequence
  chemically synthesized
ggaggcaacacattcctcgt

SEQ ID NO: 38628 - DNA, 20 bp, Artificial Sequence
  chemically synthesized
gtgttactctggcccattta

SEQ ID NO: 38629 - DNA, 20 bp, Artificial Sequence
  chemically synthesized
ttgaggtgtcagtggcagat

SEQ ID NO: 38630 - DNA, 20 bp, Artificial Sequence
  chemically synthesized
cctttggcaggcccccatag

SEQ ID NO: 38631 - DNA, 20 bp, Artificial Sequence
  chemically synthesized
tgaatcacagtggagacctc

SEQ ID NO: 38632 - DNA, 20 bp, Artificial Sequence
  chemically synthesized
tggtaactgaacgtttgact

SEQ ID NO: 38633 - DNA, 20 bp, Artificial Sequence
  chemically synthesized
ctgacccatctagccatgaa

SEQ ID NO: 38634 - DNA, 20 bp, Artificial Sequence
  chemically synthesized
cctgcaccaatggcctcatg

SEQ ID NO: 38635 - DNA, 20 bp, Artificial Sequence
  chemically synthesized
tatgtaataacttttggttt

SEQ ID NO: 38636 - DNA, 20 bp, Artificial Sequence
  chemically synthesized
tggtgcgtttctggttgtat

SEQ ID NO: 38637 - DNA, 20 bp, Artificial Sequence
  chemically synthesized
ttgaagattatgtatgattt

SEQ ID NO: 38638 - DNA, 20 bp, Artificial Sequence
  chemically synthesized
tatgatttcaggatgtgtgt

SEQ ID NO: 38639 - DNA, 20 bp, Artificial Sequence
  chemically synthesized
tgtatgggttcaagttgaca

SEQ ID NO: 38640 - DNA, 20 bp, Artificial Sequence
  chemically synthesized
ggttaatactgtcaacttga

SEQ ID NO: 38641 - DNA, 20 bp, Artificial Sequence
  chemically synthesized
ttaatctcggttatgtctgt

SEQ ID NO: 38642 - DNA, 20 bp, Artificial Sequence
  chemically synthesized
tggcaaaaggagattaacat

SEQ ID NO: 38643 - DNA, 20 bp, Artificial Sequence
  chemically synthesized
atacaactatcctcatacaa

SEQ ID NO: 38644 - DNA, 20 bp, Artificial Sequence
  chemically synthesized
gcacaagtgtacacatgcat

SEQ ID NO: 38645 - DNA, 20 bp, Artificial Sequence
  chemically synthesized
ccacttcatggctagatggg

SEQ ID NO: 38646 - DNA, 20 bp, Artificial Sequence
  chemically synthesized
ggtctcatgccactggaacc

SEQ ID NO: 38647 - DNA, 20 bp, Artificial Sequence
  chemically synthesized
accctagaaattttaccgag

SEQ ID NO: 38648 - DNA, 20 bp, Artificial Sequence
  chemically synthesized
tgggtcttatggacaggaat

SEQ ID NO: 38649 - DNA, 20 bp, Artificial Sequence
  chemically synthesized
cccactggaaccactgtaag

SEQ ID NO: 38650 - DNA, 20 bp, Artificial Sequence
  chemically synthesized
ggtctccttagggaaggatg

SEQ ID NO: 38651 - DNA, 20 bp, Artificial Sequence
  chemically synthesized
atggggtttcaccattttag

SEQ ID NO: 38652 - DNA, 20 bp, Artificial Sequence
  chemically synthesized
cccgagctgcaacattaaat

SEQ ID NO: 38653 - DNA, 20 bp, Artificial Sequence
  chemically synthesized
cagatttctgccaatataaa

SEQ ID NO: 38654 - DNA, 20 bp, Artificial Sequence
  chemically synthesized
gcattaggggtgcctcttga

SEQ ID NO: 38655 - DNA, 20 bp, Artificial Sequence
  chemically synthesized
cagaagtcccaaaaccaatg

SEQ ID NO: 38656 - DNA, 20 bp, Artificial Sequence
  chemically synthesized
agcaggaaggatccagcaca

SEQ ID NO: 38657 - DNA, 20 bp, Artificial Sequence
  chemically synthesized
gagtagcaggtgaaagctca

SEQ ID NO: 38658 - DNA, 20 bp, Artificial Sequence
  chemically synthesized
caggtgaaagctcacaagaa

SEQ ID NO: 38659 - DNA, 20 bp, Artificial Sequence
  chemically synthesized
tagtaggggcagggaccagt

SEQ ID NO: 38660 - DNA, 20 bp, Artificial Sequence
  chemically synthesized
ttgagataaacagtggtaag

SEQ ID NO: 38661 - DNA, 20 bp, Artificial Sequence
  chemically synthesized
cgtagaagtaattccaacct

SEQ ID NO: 38662 - DNA, 20 bp, Artificial Sequence
  chemically synthesized
acaatattgcaaatcattat

SEQ ID NO: 38663 - DNA, 20 bp, Artificial Sequence
  chemically synthesized
tctaaccataaaatcttaaa

SEQ ID NO: 38664 - DNA, 20 bp, Artificial Sequence
  chemically synthesized
gttgatctgctaatccctgt

SEQ ID NO: 38665 - DNA, 20 bp, Artificial Sequence
  chemically synthesized
gacacaccactattagttgg

SEQ ID NO: 38666 - DNA, 20 bp, Artificial Sequence
  chemically synthesized
atgccgatgacaagtatcca

SEQ ID NO: 38667 - DNA, 20 bp, Artificial Sequence
  chemically synthesized
agatgaacagattctcattc

SEQ ID NO: 38668 - DNA, 20 bp, Artificial Sequence
  chemically synthesized
tagatatatcaaaatatcat

SEQ ID NO: 38669 - DNA, 20 bp, Artificial Sequence
  chemically synthesized
ttgctaggaaatatcccaaa

SEQ ID NO: 38670 - DNA, 20 bp, Artificial Sequence
  chemically synthesized
aatagggtttatttgttggt

SEQ ID NO: 38671 - DNA, 20 bp, Artificial Sequence
  chemically synthesized
aatgtattttattaatggtg

SEQ ID NO: 38672 - DNA, 20 bp, Artificial Sequence
  chemically synthesized
tctcactgagcatggctgta

SEQ ID NO: 38673 - DNA, 20 bp, Artificial Sequence
  chemically synthesized
attggaaagataacacgtcc

SEQ ID NO: 38674 - DNA, 20 bp, Artificial Sequence
  chemically synthesized
gctttccaaaagagcttatc

SEQ ID NO: 38675 - DNA, 20 bp, Artificial Sequence
  chemically synthesized
cctagtttccatgggctgaa

SEQ ID NO: 38676 - DNA, 20 bp, Artificial Sequence
  chemically synthesized
ttactcaggccataacaaag

SEQ ID NO: 38677 - DNA, 20 bp, Artificial Sequence
  chemically synthesized
tgtaggcacactcttttaga

SEQ ID NO: 38678 - DNA, 20 bp, Artificial Sequence
  chemically synthesized
ggaaattaaacttatttttt

SEQ ID NO: 38679 - DNA, 20 bp, Artificial Sequence
  chemically synthesized
tgtatttttactacattgtg

SEQ ID NO: 38680 - DNA, 20 bp, Artificial Sequence
  chemically synthesized
aaactatgtcttacctgatt

SEQ ID NO: 38681 - DNA, 20 bp, Artificial Sequence
  chemically synthesized
ttgggactggccagcagtgc

SEQ ID NO: 38682 - DNA, 20 bp, Artificial Sequence
  chemically synthesized
ctactaagtaggctgaggca

SEQ ID NO: 38683 - DNA, 20 bp, Artificial Sequence
  chemically synthesized
agatggaggttgcagtgagc

SEQ ID NO: 38684 - DNA, 20 bp, Artificial Sequence
  chemically synthesized
ctccagcctgggtgacagag

SEQ ID NO: 38685 - DNA, 20 bp, Artificial Sequence
  chemically synthesized
cagagcaagaatgtctcagg

SEQ ID NO: 38686 - DNA, 20 bp, Artificial Sequence
  chemically synthesized
catgaagtaaagcaagagtg

SEQ ID NO: 38687 - DNA, 20 bp, Artificial Sequence
  chemically synthesized
accctctacctccttcccta

SEQ ID NO: 38688 - DNA, 20 bp, Artificial Sequence
  chemically synthesized
agtggatttgactcttccat

SEQ ID NO: 38689 - DNA, 20 bp, Artificial Sequence
  chemically synthesized
cacagggagctgggcttcct

SEQ ID NO: 38690 - DNA, 20 bp, Artificial Sequence
  chemically synthesized
tacctgtgtttaaaaagatg

SEQ ID NO: 38691 - DNA, 20 bp, Artificial Sequence
  chemically synthesized
ttctttgcttttaaaaccat

SEQ ID NO: 38692 - DNA, 20 bp, Artificial Sequence
  chemically synthesized
taatgtttaaatgtagagtc

SEQ ID NO: 38693 - DNA, 20 bp, Artificial Sequence
  chemically synthesized
gtacattttattgcaataaa

SEQ ID NO: 38694 - DNA, 20 bp, Artificial Sequence
  chemically synthesized
tatgacagtgtaaaatgtca

SEQ ID NO: 38695 - DNA, 20 bp, Artificial Sequence
  chemically synthesized
ttttgcaagcccagctttca

SEQ ID NO: 38696 - DNA, 20 bp, Artificial Sequence
  chemically synthesized
cttagatcattgactttggt

SEQ ID NO: 38697 - DNA, 20 bp, Artificial Sequence
  chemically synthesized
gtgtgagggagcaccgttct

SEQ ID NO: 38698 - DNA, 20 bp, Artificial Sequence
  chemically synthesized
cctgatgtcattattgacat

SEQ ID NO: 38699 - DNA, 20 bp, Artificial Sequence
  chemically synthesized
tcatggtctagttagtgttc

SEQ ID NO: 38700 - DNA, 20 bp, Artificial Sequence
  chemically synthesized
agcctagtgggggatggtgg

SEQ ID NO: 38701 - DNA, 20 bp, Artificial Sequence
  chemically synthesized
gtgtggatggttgtggggca

SEQ ID NO: 38702 - DNA, 20 bp, Artificial Sequence
  chemically synthesized
tgatgataatggtgatggtg

SEQ ID NO: 38703 - DNA, 20 bp, Artificial Sequence
  chemically synthesized
ggtctcacctgcaggtccac

SEQ ID NO: 38704 - DNA, 20 bp, Artificial Sequence
  chemically synthesized
ctctgcccgatgcttggtag

SEQ ID NO: 38705 - DNA, 20 bp, Artificial Sequence
  chemically synthesized
tgcagtcaaaggctctgggg

SEQ ID NO: 38706 - DNA, 20 bp, Artificial Sequence
  chemically synthesized
tgaaagctgggcttgcaaaa

SEQ ID NO: 38707 - DNA, 20 bp, Artificial Sequence
  chemically synthesized
ccgttctatttgaatttggc

SEQ ID NO: 38708 - DNA, 20 bp, Artificial Sequence
  chemically synthesized
aaataaagcagtttttcaca

SEQ ID NO: 38709 - DNA, 20 bp, Artificial Sequence
  chemically synthesized
caaaagaataaacacaacca

SEQ ID NO: 38710 - DNA, 20 bp, Artificial Sequence
  chemically synthesized
aattgtcaaagaagtataaa

SEQ ID NO: 38711 - DNA, 20 bp, Artificial Sequence
  chemically synthesized
ttttacactgtcataacctt

SEQ ID NO: 38712 - DNA, 20 bp, Artificial Sequence
  chemically synthesized
attggcagtgttattgggag

SEQ ID NO: 38713 - DNA, 20 bp, Artificial Sequence
  chemically synthesized
taatttatgggaacttaggc

SEQ ID NO: 38714 - DNA, 20 bp, Artificial Sequence
  chemically synthesized
gctcagaaaatattaaggaa

SEQ ID NO: 38715 - DNA, 20 bp, Artificial Sequence
  chemically synthesized
gtgcaaccatcatcatattt

SEQ ID NO: 38716 - DNA, 20 bp, Artificial Sequence
  chemically synthesized
ttctttatggttttaaaagc

SEQ ID NO: 38717 - DNA, 20 bp, Artificial Sequence
  chemically synthesized
ttaaaagcaaagaaaaaggt

SEQ ID NO: 38718 - DNA, 20 bp, Artificial Sequence
  chemically synthesized
gaagcccagctccctgtgat

SEQ ID NO: 38719 - DNA, 20 bp, Artificial Sequence
  chemically synthesized
aggcattgacagttgcaagg

SEQ ID NO: 38720 - DNA, 20 bp, Artificial Sequence
  chemically synthesized
gaccccagtctaagtgttgc

SEQ ID NO: 38721 - DNA, 20 bp, Artificial Sequence
  chemically synthesized
atttatttaagccacaacta

SEQ ID NO: 38722 - DNA, 20 bp, Artificial Sequence
  chemically synthesized
ttataacataatttataatt

SEQ ID NO: 38723 - DNA, 20 bp, Artificial Sequence
  chemically synthesized
ttatgattttattttatcca

SEQ ID NO: 38724 - DNA, 20 bp, Artificial Sequence
  chemically synthesized
ttttattttatccaaaagaa

SEQ ID NO: 38725 - DNA, 20 bp, Artificial Sequence
  chemically synthesized
gccagtggcatgggtctctg

SEQ ID NO: 38726 - DNA, 20 bp, Artificial Sequence
  chemically synthesized
gacatagtttttttaaatta

SEQ ID NO: 38727 - DNA, 20 bp, Artificial Sequence
  chemically synthesized
cacggtgctggaatgaatgg

SEQ ID NO: 38728 - DNA, 20 bp, Artificial Sequence
  chemically synthesized
tacatttgcttcttatccct

SEQ ID NO: 38729 - DNA, 20 bp, Artificial Sequence
  chemically synthesized
gtcatccccattttataaac

SEQ ID NO: 38730 - DNA, 20 bp, Artificial Sequence
  chemically synthesized
aattcccaaatcaaggaaat

SEQ ID NO: 38731 - DNA, 20 bp, Artificial Sequence
  chemically synthesized
ctggatttaagccagatttc

SEQ ID NO: 38732 - DNA, 20 bp, Artificial Sequence
  chemically synthesized
aggttaattgtttgccactt

SEQ ID NO: 38733 - DNA, 20 bp, Artificial Sequence
  chemically synthesized
agaagagagaagtctggtat

SEQ ID NO: 38734 - DNA, 20 bp, Artificial Sequence
  chemically synthesized
cttccaaagctagcttaggg

SEQ ID NO: 38735 - DNA, 20 bp, Artificial Sequence
  chemically synthesized
cgtactacttcactttagga

SEQ ID NO: 38736 - DNA, 20 bp, Artificial Sequence
  chemically synthesized
tgaatttagtggaagccatt

SEQ ID NO: 38737 - DNA, 20 bp, Artificial Sequence
  chemically synthesized
aagccattcaagaaaatatc

SEQ ID NO: 38738 - DNA, 20 bp, Artificial Sequence
  chemically synthesized
agccatgctcagtgagaagc

SEQ ID NO: 38739 - DNA, 20 bp, Artificial Sequence
  chemically synthesized
cattcacacaccacagtgag

SEQ ID NO: 38740 - DNA, 20 bp, Artificial Sequence
  chemically synthesized
atgagccctggaggtgaatc

SEQ ID NO: 38741 - DNA, 20 bp, Artificial Sequence
  chemically synthesized
gaaaaatcatcaggttaaaa

SEQ ID NO: 38742 - DNA, 20 bp, Artificial Sequence
  chemically synthesized
ttgaagtcacactgtgagct

SEQ ID NO: 38743 - DNA, 20 bp, Artificial Sequence
  chemically synthesized
cctggaaaagagagttcaaa

SEQ ID NO: 38744 - DNA, 20 bp, Artificial Sequence
  chemically synthesized
tgctttttagtggattaggt

SEQ ID NO: 38745 - DNA, 20 bp, Artificial Sequence
  chemically synthesized
gaggtcaggacaggcctttc

SEQ ID NO: 38746 - DNA, 20 bp, Artificial Sequence
  chemically synthesized
aggacaggcctttctgagaa

SEQ ID NO: 38747 - DNA, 20 bp, Artificial Sequence
  chemically synthesized
ccaccctttgccacaaccag

SEQ ID NO: 38748 - DNA, 20 bp, Artificial Sequence
  chemically synthesized
gttgcctcagatttgatctc

SEQ ID NO: 38749 - DNA, 20 bp, Artificial Sequence
  chemically synthesized
tacaaccaatgcacatattg

SEQ ID NO: 38750 - DNA, 20 bp, Artificial Sequence
  chemically synthesized
gcaggaggtggaagcccctg

SEQ ID NO: 38751 - DNA, 20 bp, Artificial Sequence
  chemically synthesized
ccctgagagaatggaggtct

SEQ ID NO: 38752 - DNA, 20 bp, Artificial Sequence
  chemically synthesized
ggaggagggggaatacctag

SEQ ID NO: 38753 - DNA, 20 bp, Artificial Sequence
  chemically synthesized
agggggaatacctaggtaga

SEQ ID NO: 38754 - DNA, 20 bp, Artificial Sequence
  chemically synthesized
ctcactgtgcagttaacttt

SEQ ID NO: 38755 - DNA, 20 bp, Artificial Sequence
  chemically synthesized
tagggagggaagagggcaaa

SEQ ID NO: 38756 - DNA, 20 bp, Artificial Sequence
  chemically synthesized
agaagcaatgcagccattac

SEQ ID NO: 38757 - DNA, 20 bp, Artificial Sequence
  chemically synthesized
acacctgtatcacaggtgtt

SEQ ID NO: 38758 - DNA, 20 bp, Artificial Sequence
  chemically synthesized
tatcacaggtgttaaagaaa

SEQ ID NO: 38759 - DNA, 20 bp, Artificial Sequence
  chemically synthesized
accgttaatgcccttgggct

SEQ ID NO: 38760 - DNA, 20 bp, Artificial Sequence
  chemically synthesized
acctccagcacacagcaggg

SEQ ID NO: 38761 - DNA, 20 bp, Artificial Sequence
  chemically synthesized
gctgcccccaagctgtagag

SEQ ID NO: 38762 - DNA, 20 bp, Artificial Sequence
  chemically synthesized
agagccagaatataaagctg

SEQ ID NO: 38763 - DNA, 20 bp, Artificial Sequence
  chemically synthesized
ccagaagtggttcttgagga

SEQ ID NO: 38764 - DNA, 20 bp, Artificial Sequence
  chemically synthesized
tgattgctcctaagttctct

SEQ ID NO: 38765 - DNA, 20 bp, Artificial Sequence
  chemically synthesized
gttctctggagaaagagatg

SEQ ID NO: 38766 - DNA, 20 bp, Artificial Sequence
  chemically synthesized
atgagagttttaactcctgt

SEQ ID NO: 38767 - DNA, 20 bp, Artificial Sequence
  chemically synthesized
ctgatgaaacttttttgcca

SEQ ID NO: 38768 - DNA, 20 bp, Artificial Sequence
  chemically synthesized
aagctttctaatttatattg

SEQ ID NO: 38769 - DNA, 20 bp, Artificial Sequence
  chemically synthesized
taatgttgcagctcggggac

SEQ ID NO: 38770 - DNA, 20 bp, Artificial Sequence
  chemically synthesized
cagcagaggcaaagcagcca

SEQ ID NO: 38771 - DNA, 20 bp, Artificial Sequence
  chemically synthesized
tataaacaaaaaactgccag

SEQ ID NO: 38772 - DNA, 20 bp, Artificial Sequence
  chemically synthesized
ctaatctgaattataaaaac

SEQ ID NO: 38773 - DNA, 20 bp, Artificial Sequence
  chemically synthesized
ccagggtaactgtgtgtact

SEQ ID NO: 38774 - DNA, 20 bp, Artificial Sequence
  chemically synthesized
aagggaagtaatgagacatt

SEQ ID NO: 38775 - DNA, 20 bp, Artificial Sequence
  chemically synthesized
atagacatacttattagctg

SEQ ID NO: 38776 - DNA, 20 bp, Artificial Sequence
  chemically synthesized
gccattagagctgtctctac

SEQ ID NO: 38777 - DNA, 20 bp, Artificial Sequence
  chemically synthesized
cgtttggcccctcttacaac

SEQ ID NO: 38778 - DNA, 20 bp, Artificial Sequence
  chemically synthesized
atgcatgtgtacacttgtgc

SEQ ID NO: 38779 - DNA, 20 bp, Artificial Sequence
  chemically synthesized
gtgttaatttgctcaagcaa

SEQ ID NO: 38780 - DNA, 20 bp, Artificial Sequence
  chemically synthesized
actgtaagtcagaaatgagc

SEQ ID NO: 38781 - DNA, 20 bp, Artificial Sequence
  chemically synthesized
aactctttctctacaggagt

SEQ ID NO: 38782 - DNA, 20 bp, Artificial Sequence
  chemically synthesized
tcagccaacaccagaagtcc

SEQ ID NO: 38783 - DNA, 20 bp, Artificial Sequence
  chemically synthesized
ctctgggagcttcaccccac

SEQ ID NO: 38784 - DNA, 20 bp, Artificial Sequence
  chemically synthesized
taggggcagggaccagtgca

SEQ ID NO: 38785 - DNA, 20 bp, Artificial Sequence
  chemically synthesized
atttaatatgctctatgctg

SEQ ID NO: 38786 - DNA, 20 bp, Artificial Sequence
  chemically synthesized
tatagctcacagtgtgactt

SEQ ID NO: 38787 - DNA, 20 bp, Artificial Sequence
  chemically synthesized
catgttgctaggaaatatcc

SEQ ID NO: 38788 - DNA, 20 bp, Artificial Sequence
  chemically synthesized
aatgtgccccccaggtcgat

SEQ ID NO: 38789 - DNA, 20 bp, Artificial Sequence
  chemically synthesized
catagacaccaatttcccca

SEQ ID NO: 38790 - DNA, 20 bp, Artificial Sequence
  chemically synthesized
aaaccaaagcatgcccacta

SEQ ID NO: 38791 - DNA, 20 bp, Artificial Sequence
  chemically synthesized
aaataattcttataatttaa

SEQ ID NO: 38792 - DNA, 20 bp, Artificial Sequence
  chemically synthesized
gacaagcctgggcaacatgc

SEQ ID NO: 38793 - DNA, 20 bp, Artificial Sequence
  chemically synthesized
taaataaatatttttaaaaa

SEQ ID NO: 38794 - DNA, 20 bp, Artificial Sequence
  chemically synthesized
gttaggaggctcctcccgtt

SEQ ID NO: 38795 - DNA, 20 bp, Artificial Sequence
  chemically synthesized
catataagagtctatgttcc

SEQ ID NO: 38796 - DNA, 20 bp, Artificial Sequence
  chemically synthesized
tttacctttttctttgcttt

SEQ ID NO: 38797 - DNA, 20 bp, Artificial Sequence
  chemically synthesized
gacagtgtaaaatgtcacta

SEQ ID NO: 38798 - DNA, 20 bp, Artificial Sequence
  chemically synthesized
gttgtgtttattcttttgtg

SEQ ID NO: 38799 - DNA, 20 bp, Artificial Sequence
  chemically synthesized
gcaaacatcctgataatggt

SEQ ID NO: 38800 - DNA, 20 bp, Artificial Sequence
  chemically synthesized
aaacatgaaggggagagcag

SEQ ID NO: 38801 - DNA, 20 bp, Artificial Sequence
  chemically synthesized
aactagaccatgaggtgcca

SEQ ID NO: 38802 - DNA, 20 bp, Artificial Sequence
  chemically synthesized
aagctgggcttgcaaaatta

SEQ ID NO: 38803 - DNA, 20 bp, Artificial Sequence
  chemically synthesized
ccctgggtgtgtccatctgg

SEQ ID NO: 38804 - DNA, 20 bp, Artificial Sequence
  chemically synthesized
atgaagatcatagcactata

SEQ ID NO: 38805 - DNA, 20 bp, Artificial Sequence
  chemically synthesized
tacaaaaagtctgaaaatat

SEQ ID NO: 38806 - DNA, 20 bp, Artificial Sequence
  chemically synthesized
taacataatttataattaca

SEQ ID NO: 38807 - DNA, 20 bp, Artificial Sequence
  chemically synthesized
agcctgctctgctacatttc

SEQ ID NO: 38808 - DNA, 20 bp, Artificial Sequence
  chemically synthesized
gatgcctatcaacaccttgg

SEQ ID NO: 38809 - DNA, 20 bp, Artificial Sequence
  chemically synthesized
agaaagagttgaaattgtga

SEQ ID NO: 38810 - DNA, 20 bp, Artificial Sequence
  chemically synthesized
ctacttgatttatataaaca

SEQ ID NO: 38811 - DNA, 20 bp, Artificial Sequence
  chemically synthesized
taaagactaatctgaattat

SEQ ID NO: 38812 - DNA, 20 bp, Artificial Sequence
  chemically synthesized
gacgttgattccagggtacc

SEQ ID NO: 38813 - DNA, 20 bp, Artificial Sequence
  chemically synthesized
cctagaaaaataaaaaaatc

SEQ ID NO: 38814 - DNA, 20 bp, Artificial Sequence
  chemically synthesized
ccacaccctcacagacataa

SEQ ID NO: 38815 - DNA, 20 bp, Artificial Sequence
  chemically synthesized
tgctgatatgaacaacactt

SEQ ID NO: 38816 - DNA, 20 bp, Artificial Sequence
  chemically synthesized
caaaatcctagaggtctcca

SEQ ID NO: 38817 - DNA, 20 bp, Artificial Sequence
  chemically synthesized
tcatgtggcccaaatggcag

SEQ ID NO: 38818 - DNA, 20 bp, Artificial Sequence
  chemically synthesized
cagctttcacagcagcctgg

SEQ ID NO: 38819 - DNA, 20 bp, Artificial Sequence
  chemically synthesized
gaggggccaaacgcagcaag

SEQ ID NO: 38820 - DNA, 20 bp, Artificial Sequence
  chemically synthesized
tagaaagtccctaaatttta

SEQ ID NO: 38821 - DNA, 20 bp, Artificial Sequence
  chemically synthesized
atgtctcaccaataagttca

SEQ ID NO: 38822 - DNA, 20 bp, Artificial Sequence
  chemically synthesized
agcgagcaaggtctctccaa

SEQ ID NO: 38823 - DNA, 20 bp, Artificial Sequence
  chemically synthesized
ggccttgtcagctgaaggca

SEQ ID NO: 38824 - DNA, 20 bp, Artificial Sequence
  chemically synthesized
caattggagtcaccacttgg

SEQ ID NO: 38825 - DNA, 20 bp, Artificial Sequence
  chemically synthesized
cagtccctccagggatggga

SEQ ID NO: 38826 - DNA, 20 bp, Artificial Sequence
  chemically synthesized
ctccagggatgggatattgt

SEQ ID NO: 38827 - DNA, 20 bp, Artificial Sequence
  chemically synthesized
ttctaggtagagacagctct

SEQ ID NO: 38828 - DNA, 20 bp, Artificial Sequence
  chemically synthesized
gtagagacagctctaatggc

SEQ ID NO: 38829 - DNA, 20 bp, Artificial Sequence
  chemically synthesized
ctttaactggggaaccacaa

SEQ ID NO: 38830 - DNA, 20 bp, Artificial Sequence
  chemically synthesized
gtaacaggttcgagtctgga

SEQ ID NO: 38831 - DNA, 20 bp, Artificial Sequence
  chemically synthesized
tctggaaattgattgagggc

SEQ ID NO: 38832 - DNA, 20 bp, Artificial Sequence
  chemically synthesized
ttgattgagggcccatgatt

SEQ ID NO: 38833 - DNA, 20 bp, Artificial Sequence
  chemically synthesized
atgattctctgtttttataa

SEQ ID NO: 38834 - DNA, 20 bp, Artificial Sequence
  chemically synthesized
gtctttagtccattctacct

SEQ ID NO: 38835 - DNA, 20 bp, Artificial Sequence
  chemically synthesized
gtccattctacctggcagtt

SEQ ID NO: 38836 - DNA, 20 bp, Artificial Sequence
  chemically synthesized
ataaatcaagtaggaataca

SEQ ID NO: 38837 - DNA, 20 bp, Artificial Sequence
  chemically synthesized
caatttcacttctaggaaca

SEQ ID NO: 38838 - DNA, 20 bp, Artificial Sequence
  chemically synthesized
atgagtcagactattctgat

SEQ ID NO: 38839 - DNA, 20 bp, Artificial Sequence
  chemically synthesized
gctctcacaaatctatttca

SEQ ID NO: 38840 - DNA, 20 bp, Artificial Sequence
  chemically synthesized
tgcctcagcctcccaagtag

SEQ ID NO: 38841 - DNA, 20 bp, Artificial Sequence
  chemically synthesized
ttttgtatttttagcagaga

SEQ ID NO: 38842 - DNA, 20 bp, Artificial Sequence
  chemically synthesized
cgcccccgcctcccaaggtg

SEQ ID NO: 38843 - DNA, 20 bp, Artificial Sequence
  chemically synthesized
agtagggccaaaccaataaa

SEQ ID NO: 38844 - DNA, 20 bp, Artificial Sequence
  chemically synthesized
atccattcccatgcctgttc

SEQ ID NO: 38845 - DNA, 20 bp, Artificial Sequence
  chemically synthesized
atttctgccaatataaatta

SEQ ID NO: 38846 - DNA, 20 bp, Artificial Sequence
  chemically synthesized
cactgttgcctcaagcagtg

SEQ ID NO: 38847 - DNA, 20 bp, Artificial Sequence
  chemically synthesized
accactactggggatgggga

SEQ ID NO: 38848 - DNA, 20 bp, Artificial Sequence
  chemically synthesized
gaaactgtttcttctggcaa

SEQ ID NO: 38849 - DNA, 20 bp, Artificial Sequence
  chemically synthesized
gagttcacaaactcagtgtc

SEQ ID NO: 38850 - DNA, 20 bp, Artificial Sequence
  chemically synthesized
agatcagctactcgcatgat

SEQ ID NO: 38851 - DNA, 20 bp, Artificial Sequence
  chemically synthesized
ctcgcatgataacagcttgt

SEQ ID NO: 38852 - DNA, 20 bp, Artificial Sequence
  chemically synthesized
ctctcattcagggcaatctt

SEQ ID NO: 38853 - DNA, 20 bp, Artificial Sequence
  chemically synthesized
tagcagatttgtggctcagt

SEQ ID NO: 38854 - DNA, 20 bp, Artificial Sequence
  chemically synthesized
tctagagggacagaactaat

SEQ ID NO: 38855 - DNA, 20 bp, Artificial Sequence
  chemically synthesized
atagatatactcacacaaag

SEQ ID NO: 38856 - DNA, 20 bp, Artificial Sequence
  chemically synthesized
ttattaagtggtattaactc

SEQ ID NO: 38857 - DNA, 20 bp, Artificial Sequence
  chemically synthesized
tagcctttttacatttttct

SEQ ID NO: 38858 - DNA, 20 bp, Artificial Sequence
  chemically synthesized
ccagctttatattctggctc

SEQ ID NO: 38859 - DNA, 20 bp, Artificial Sequence
  chemically synthesized
cagcaggggcaggggcctca

SEQ ID NO: 38860 - DNA, 20 bp, Artificial Sequence
  chemically synthesized
aaggactttcagtcacctct

SEQ ID NO: 38861 - DNA, 20 bp, Artificial Sequence
  chemically synthesized
agaggggctgtgggttgtct

SEQ ID NO: 38862 - DNA, 20 bp, Artificial Sequence
  chemically synthesized
tgagcccatactttaatctc

SEQ ID NO: 38863 - DNA, 20 bp, Artificial Sequence
  chemically synthesized
tttttaaaaatcatatttat

SEQ ID NO: 38864 - DNA, 20 bp, Artificial Sequence
  chemically synthesized
tattaagaatacaagaagta

SEQ ID NO: 38865 - DNA, 20 bp, Artificial Sequence
  chemically synthesized
aatacaagaagtacaatgtt

SEQ ID NO: 38866 - DNA, 20 bp, Artificial Sequence
  chemically synthesized
ttctttaacacctgtgatac

SEQ ID NO: 38867 - DNA, 20 bp, Artificial Sequence
  chemically synthesized
tgaattctacgtaatggctg

SEQ ID NO: 38868 - DNA, 20 bp, Artificial Sequence
  chemically synthesized
tgcaggacttgggtaatctc

SEQ ID NO: 38869 - DNA, 20 bp, Artificial Sequence
  chemically synthesized
acttgggtaatctctggggt

SEQ ID NO: 38870 - DNA, 20 bp, Artificial Sequence
  chemically synthesized
ctccagacctccattctctc

SEQ ID NO: 38871 - DNA, 20 bp, Artificial Sequence
  chemically synthesized
aaatcttaaataagaataaa

SEQ ID NO: 38872 - DNA, 20 bp, Artificial Sequence
  chemically synthesized
taagaataaatcatgtttgc

SEQ ID NO: 38873 - DNA, 20 bp, Artificial Sequence
  chemically synthesized
catcagtggcaactgtgttg

SEQ ID NO: 38874 - DNA, 20 bp, Artificial Sequence
  chemically synthesized
tagaaatgaaccttggaggc

SEQ ID NO: 38875 - DNA, 20 bp, Artificial Sequence
  chemically synthesized
aatgaaccttggaggccatt

SEQ ID NO: 38876 - DNA, 20 bp, Artificial Sequence
  chemically synthesized
caaagaaggccatttttgta

SEQ ID NO: 38877 - DNA, 20 bp, Artificial Sequence
  chemically synthesized
ccactattagttggggagaa

SEQ ID NO: 38878 - DNA, 20 bp, Artificial Sequence
  chemically synthesized
ttccaaggtgttgataggca

SEQ ID NO: 38879 - DNA, 20 bp, Artificial Sequence
  chemically synthesized
gaacctgggaccaatactgc
